United States Patent 11,293,017 (OLIGONUCLEOTIDE PROBES AND USES THEREOF) - sequence listing, part 5

SEQ ID NO: 101768 - DNA, 36 bp, Artificial Sequence
  Synthetic oligonucleotide
ggattcaccgcccacatatgcacacccagctcccaa

SEQ ID NO: 101769 - DNA, 36 bp, Artificial Sequence
  Synthetic oligonucleotide
gatgtcgcactaggtatagtcgagtgcttttggtaa

SEQ ID NO: 101770 - DNA, 37 bp, Artificial Sequence
  Synthetic oligonucleotide
gagccggagctgtaaatgtgtttgggggggttgacga

SEQ ID NO: 101771 - DNA, 37 bp, Artificial Sequence
  Synthetic oligonucleotide
atccacgaatgtgggtctaatatcacctacccatcga

SEQ ID NO: 101772 - DNA, 37 bp, Artificial Sequence
  Synthetic oligonucleotide
gaacgccactcagtcaactttgcatctctcatttgga

SEQ ID NO: 101773 - DNA, 37 bp, Artificial Sequence
  Synthetic oligonucleotide
accgacgaggttgaggtacaagtgaggtagacggtga

SEQ ID NO: 101774 - DNA, 36 bp, Artificial Sequence
  Synthetic oligonucleotide
gtacagtcgtaaacatcaccgataggaccggtagta

SEQ ID NO: 101775 - DNA, 36 bp, Artificial Sequence
  Synthetic oligonucleotide
tgcacctagcagagagaaactagtgattacagtgta

SEQ ID NO: 101776 - DNA, 35 bp, Artificial Sequence
  Synthetic oligonucleotide
gttcgctgttgccaacctgtattgttccttcccaa

SEQ ID NO: 101777 - DNA, 36 bp, Artificial Sequence
  Synthetic oligonucleotide
gcacacccctgtttttgtcacctacaatgagcttaa

SEQ ID NO: 101778 - DNA, 37 bp, Artificial Sequence
  Synthetic oligonucleotide
taggaccgaacgcaatgcgcatcaaggaaggccatga

SEQ ID NO: 101779 - DNA, 38 bp, Artificial Sequence
  Synthetic oligonucleotide
aaggacgagactcgcccacttgtatttccgcctcttga

SEQ ID NO: 101780 - DNA, 36 bp, Artificial Sequence
  Synthetic oligonucleotide
acccggacgactgatctcactcgttcgccagttcta

SEQ ID NO: 101781 - DNA, 35 bp, Artificial Sequence
  Synthetic oligonucleotide
gccacaccgtccctggctttttccgttcagtacac

SEQ ID NO: 101782 - DNA, 35 bp, Artificial Sequence
  Synthetic oligonucleotide
atgccgtcgggcctcgcgcatggccactaccttac

SEQ ID NO: 101783 - DNA, 35 bp, Artificial Sequence
  Synthetic oligonucleotide
gcaatcggaacggaggaggaacaaagggtgggtaa

SEQ ID NO: 101784 - DNA, 35 bp, Artificial Sequence
  Synthetic oligonucleotide
tacatgcgccgaatgggatgtaagagtaatgagta

SEQ ID NO: 101785 - DNA, 35 bp, Artificial Sequence
  Synthetic oligonucleotide
tcatccctaccccttgctccaccagagcggtttta

SEQ ID NO: 101786 - DNA, 35 bp, Artificial Sequence
  Synthetic oligonucleotide
ttaccgctcccatgttgcaactggcctaacctaac

SEQ ID NO: 101787 - DNA, 35 bp, Artificial Sequence
  Synthetic oligonucleotide
tccatacgcgtacatgtttaccagttttttccatg

SEQ ID NO: 101788 - DNA, 36 bp, Artificial Sequence
  Synthetic oligonucleotide
tcagtccgcccctcgcttgtccatcgttggacacaa

SEQ ID NO: 101789 - DNA, 36 bp, Artificial Sequence
  Synthetic oligonucleotide
acccaccccagcacagtttaggtaccatcgtcgaca

SEQ ID NO: 101790 - DNA, 35 bp, Artificial Sequence
  Synthetic oligonucleotide
gtctacgcccgcacgtgctttgctgcccaatctca

SEQ ID NO: 101791 - DNA, 38 bp, Artificial Sequence
  Synthetic oligonucleotide
acgttgttcctgccactctacaatagaccagtcattga

SEQ ID NO: 101792 - DNA, 36 bp, Artificial Sequence
  Synthetic oligonucleotide
tacaacagcacagcgtaggacatgataaagttagta

SEQ ID NO: 101793 - DNA, 34 bp, Artificial Sequence
  Synthetic oligonucleotide
taaaaacagtgtgcccatcgcatctggctctgac

SEQ ID NO: 101794 - DNA, 33 bp, Artificial Sequence
  Synthetic oligonucleotide
gacacctgcgatctcatgaatctctcacacaat

SEQ ID NO: 101795 - DNA, 35 bp, Artificial Sequence
  Synthetic oligonucleotide
atagcgagcccctgttcccggcctgttcacactat

SEQ ID NO: 101796 - DNA, 36 bp, Artificial Sequence
  Synthetic oligonucleotide
gggggggaaggtgagatagagtgggggcggacggga

SEQ ID NO: 101797 - DNA, 38 bp, Artificial Sequence
  Synthetic oligonucleotide
gaccacacagatagcaaagagcggtatgatgcgaatga

SEQ ID NO: 101798 - DNA, 37 bp, Artificial Sequence
  Synthetic oligonucleotide
tgagtgggaggtcacatatgtgttcgtatcgacgtga

SEQ ID NO: 101799 - DNA, 35 bp, Artificial Sequence
  Synthetic oligonucleotide
gatggaggaaaactccaatggagttagtcggacta

SEQ ID NO: 101800 - DNA, 35 bp, Artificial Sequence
  Synthetic oligonucleotide
tccacccacccagcatggcccccgaaagagctccc

SEQ ID NO: 101801 - DNA, 35 bp, Artificial Sequence
  Synthetic oligonucleotide
gacgtgagtcagcatgtcatccctacccctctccc

SEQ ID NO: 101802 - DNA, 35 bp, Artificial Sequence
  Synthetic oligonucleotide
gtcgctgatcctctctgtctcgttgaacactatat

SEQ ID NO: 101803 - DNA, 35 bp, Artificial Sequence
  Synthetic oligonucleotide
accaagctcacagctagcctttccagttctttgct

SEQ ID NO: 101804 - DNA, 36 bp, Artificial Sequence
  Synthetic oligonucleotide
gagagagggaaagggagggtctagttgcctggggca

SEQ ID NO: 101805 - DNA, 36 bp, Artificial Sequence
  Synthetic oligonucleotide
gaacgaagggggatataatagagaggagggcggtca

SEQ ID NO: 101806 - DNA, 36 bp, Artificial Sequence
  Synthetic oligonucleotide
tacacatgttcgatcgtgggtaggaatgcctgtgga

SEQ ID NO: 101807 - DNA, 37 bp, Artificial Sequence
  Synthetic oligonucleotide
taacaaccggcgaggatttataggggaaggaagttga

SEQ ID NO: 101808 - DNA, 35 bp, Artificial Sequence
  Synthetic oligonucleotide
aacacacgctatgaatcaggcattgcacctttata

SEQ ID NO: 101809 - DNA, 35 bp, Artificial Sequence
  Synthetic oligonucleotide
tcgacctctccgtgcctgtatccttgcctcaacag

SEQ ID NO: 101810 - DNA, 35 bp, Artificial Sequence
  Synthetic oligonucleotide
ttcggaaaccgccctgtccgacctctaatgactag

SEQ ID NO: 101811 - DNA, 36 bp, Artificial Sequence
  Synthetic oligonucleotide
gactgcaccatatggtgtctgtccaaatgaacgaaa

SEQ ID NO: 101812 - DNA, 36 bp, Artificial Sequence
  Synthetic oligonucleotide
gacaaaccccggatccgacctttagacgcgcctaaa

SEQ ID NO: 101813 - DNA, 35 bp, Artificial Sequence
  Synthetic oligonucleotide
accctgtgtcgcgcttatgtccgcctctttgtaaa

SEQ ID NO: 101814 - DNA, 35 bp, Artificial Sequence
  Synthetic oligonucleotide
tcgccaccacgttttttgcttaatgttacctccaa

SEQ ID NO: 101815 - DNA, 35 bp, Artificial Sequence
  Synthetic oligonucleotide
acccatccgcctcacagtttgaagcacgatgctaa

SEQ ID NO: 101816 - DNA, 37 bp, Artificial Sequence
  Synthetic oligonucleotide
attgcccgacagaggggggaaatggatattagtatga

SEQ ID NO: 101817 - DNA, 38 bp, Artificial Sequence
  Synthetic oligonucleotide
gcgcccgcaacggactgggtgtaaaggcatgattttga

SEQ ID NO: 101818 - DNA, 35 bp, Artificial Sequence
  Synthetic oligonucleotide
tgaccaccgtgccggctagctcttggtacctttac

SEQ ID NO: 101819 - DNA, 35 bp, Artificial Sequence
  Synthetic oligonucleotide
ggaccacctgccactgtcttccattctcgacattc

SEQ ID NO: 101820 - DNA, 35 bp, Artificial Sequence
  Synthetic oligonucleotide
gacgaatgacccgaccggtcacgatagccccttat

SEQ ID NO: 101821 - DNA, 35 bp, Artificial Sequence
  Synthetic oligonucleotide
gagtgcgcaaaagtgacaagatgctgagcgcttgt

SEQ ID NO: 101822 - DNA, 36 bp, Artificial Sequence
  Synthetic oligonucleotide
tgcacggaccatctgtctggaataccaccccccaaa

SEQ ID NO: 101823 - DNA, 35 bp, Artificial Sequence
  Synthetic oligonucleotide
tactccatcctgtctcctgtgcctccgcgtagaaa

SEQ ID NO: 101824 - DNA, 36 bp, Artificial Sequence
  Synthetic oligonucleotide
ggacagttcgagctacttgtacatatttccctgcaa

SEQ ID NO: 101825 - DNA, 36 bp, Artificial Sequence
  Synthetic oligonucleotide
tatgcccacgcacttcctgaatagcgataccttcaa

SEQ ID NO: 101826 - DNA, 35 bp, Artificial Sequence
  Synthetic oligonucleotide
agccatcgatagcttctcgtacactcacccgttaa

SEQ ID NO: 101827 - DNA, 37 bp, Artificial Sequence
  Synthetic oligonucleotide
atcaagccgcaaggatggtgtgatttgaacagttaga

SEQ ID NO: 101828 - DNA, 38 bp, Artificial Sequence
  Synthetic oligonucleotide
tcaatgcaggaatagggtatgatcggggacagtattga

SEQ ID NO: 101829 - DNA, 36 bp, Artificial Sequence
  Synthetic oligonucleotide
atggtacagccactcaagtgatccccagacatcgta

SEQ ID NO: 101830 - DNA, 35 bp, Artificial Sequence
  Synthetic oligonucleotide
ggtgcgggggggggaagagaaaagttggtggggcc

SEQ ID NO: 101831 - DNA, 35 bp, Artificial Sequence
  Synthetic oligonucleotide
gatccaccgtgcattcccgagggccatgagctcat

SEQ ID NO: 101832 - DNA, 35 bp, Artificial Sequence
  Synthetic oligonucleotide
agcgcacgtacactcgagtagttcacaccatacct

SEQ ID NO: 101833 - DNA, 36 bp, Artificial Sequence
  Synthetic oligonucleotide
ttgcaccaaagccgttaagcgtgcgcactttcaaaa

SEQ ID NO: 101834 - DNA, 36 bp, Artificial Sequence
  Synthetic oligonucleotide
tgcatttgcggaacactggctcaacaacaccatcaa

SEQ ID NO: 101835 - DNA, 36 bp, Artificial Sequence
  Synthetic oligonucleotide
gcacgacatggaaggataagaggacgagcaaccaca

SEQ ID NO: 101836 - DNA, 36 bp, Artificial Sequence
  Synthetic oligonucleotide
gacagtgatacagggagggccgagagcaattccaga

SEQ ID NO: 101837 - DNA, 37 bp, Artificial Sequence
  Synthetic oligonucleotide
acaggggcagggagcaattgcaagggggggggttgga

SEQ ID NO: 101838 - DNA, 38 bp, Artificial Sequence
  Synthetic oligonucleotide
gtgaccggtccgaggggggggatagaggtaaggggtga

SEQ ID NO: 101839 - DNA, 38 bp, Artificial Sequence
  Synthetic oligonucleotide
gagctgtaccgtcgatcacgcattggatcccacattga

SEQ ID NO: 101840 - DNA, 35 bp, Artificial Sequence
  Synthetic oligonucleotide
ttaacgccgccacaactctgctaacgcacagctac

SEQ ID NO: 101841 - DNA, 36 bp, Artificial Sequence
  Synthetic oligonucleotide
tcctgaacgccaattgattgaaccgtcgtaggactc

SEQ ID NO: 101842 - DNA, 35 bp, Artificial Sequence
  Synthetic oligonucleotide
gatgccattggaaagtgtgggagatgggacaaggg

SEQ ID NO: 101843 - DNA, 35 bp, Artificial Sequence
  Synthetic oligonucleotide
tatgctcctgcatgcacctccgttgaccagccaat

SEQ ID NO: 101844 - DNA, 35 bp, Artificial Sequence
  Synthetic oligonucleotide
gtggacctgccgtttccctccctgttgtaatccca

SEQ ID NO: 101845 - DNA, 36 bp, Artificial Sequence
  Synthetic oligonucleotide
aacaaatgccagtcacacgcggaatggtttgcctga

SEQ ID NO: 101846 - DNA, 35 bp, Artificial Sequence
  Synthetic oligonucleotide
ttaccagtgcccttgctcgtaattgcaacaaccac

SEQ ID NO: 101847 - DNA, 35 bp, Artificial Sequence
  Synthetic oligonucleotide
gaagggaggtgtgtgggctggggggagacgttcag

SEQ ID NO: 101848 - DNA, 35 bp, Artificial Sequence
  Synthetic oligonucleotide
gctgcacgcctcccaggcatccctcactgcttcaa

SEQ ID NO: 101849 - DNA, 36 bp, Artificial Sequence
  Synthetic oligonucleotide
tgatgcactcactgaccacctactgctctggctaca

SEQ ID NO: 101850 - DNA, 38 bp, Artificial Sequence
  Synthetic oligonucleotide
gcgatagcacgacgagtttggacacgatataaaagcga

SEQ ID NO: 101851 - DNA, 37 bp, Artificial Sequence
  Synthetic oligonucleotide
tcgaggacgtacccgtgcagaaatcgagcaggagtga

SEQ ID NO: 101852 - DNA, 38 bp, Artificial Sequence
  Synthetic oligonucleotide
aacgtgacgtccatgacgagaaagggtaagtttcttga

SEQ ID NO: 101853 - DNA, 34 bp, Artificial Sequence
  Synthetic oligonucleotide
tctgacgacgccacacgtattaccctcccggtac

SEQ ID NO: 101854 - DNA, 35 bp, Artificial Sequence
  Synthetic oligonucleotide
tcgaccagatcgccctacctgtttagtctgtccat

SEQ ID NO: 101855 - DNA, 35 bp, Artificial Sequence
  Synthetic oligonucleotide
ttgcgtcgcccattggtatttctcccccgtcatat

SEQ ID NO: 101856 - DNA, 35 bp, Artificial Sequence
  Synthetic oligonucleotide
gtcctagaacccctcgtcccttgcttgttacgctt

SEQ ID NO: 101857 - DNA, 35 bp, Artificial Sequence
  Synthetic oligonucleotide
gcatcgccaagtggcagagagaagagggggatttt

SEQ ID NO: 101858 - DNA, 36 bp, Artificial Sequence
  Synthetic oligonucleotide
accgccgtacgaaccggctgtgcgcccctcgttcaa

SEQ ID NO: 101859 - DNA, 37 bp, Artificial Sequence
  Synthetic oligonucleotide
atcgcgggggggaggaaattgagggtgggatatccca

SEQ ID NO: 101860 - DNA, 38 bp, Artificial Sequence
  Synthetic oligonucleotide
gaggggcgaagacagcaggagcgagattaagaaagtga

SEQ ID NO: 101861 - DNA, 35 bp, Artificial Sequence
  Synthetic oligonucleotide
gagccagcactcctttcctctctagcagtttggac

SEQ ID NO: 101862 - DNA, 35 bp, Artificial Sequence
  Synthetic oligonucleotide
gccaagtacctccgcatttatgaaccatcctgagt

SEQ ID NO: 101863 - DNA, 36 bp, Artificial Sequence
  Synthetic oligonucleotide
acgtgaagcctgcgttcgaaatatacgggggccaaa

SEQ ID NO: 101864 - DNA, 36 bp, Artificial Sequence
  Synthetic oligonucleotide
tgctaccccagctgttcctccaccttggtgtgccaa

SEQ ID NO: 101865 - DNA, 36 bp, Artificial Sequence
  Synthetic oligonucleotide
ggaaactccagggagcaacattgatgagttagctaa

SEQ ID NO: 101866 - DNA, 35 bp, Artificial Sequence
  Synthetic oligonucleotide
gatgtgcaggacgggttaactggataggggcgtaa

SEQ ID NO: 101867 - DNA, 37 bp, Artificial Sequence
  Synthetic oligonucleotide
gaatggaacgcggacggagtaacctgaggacggtaga

SEQ ID NO: 101868 - DNA, 37 bp, Artificial Sequence
  Synthetic oligonucleotide
gatgcgggatggacaatagatactgtggccggacgga

SEQ ID NO: 101869 - DNA, 38 bp, Artificial Sequence
  Synthetic oligonucleotide
gatcgtgaggagcagtggcaaacggaacatgaaagtga

SEQ ID NO: 101870 - DNA, 35 bp, Artificial Sequence
  Synthetic oligonucleotide
ggagaccgggggaagatggctagaaagtttcacta

SEQ ID NO: 101871 - DNA, 34 bp, Artificial Sequence
  Synthetic oligonucleotide
gttcgactcccgctctttgttacgttgatcttac

SEQ ID NO: 101872 - DNA, 35 bp, Artificial Sequence
  Synthetic oligonucleotide
accggacgggggcagtacggggtggggggggactg

SEQ ID NO: 101873 - DNA, 35 bp, Artificial Sequence
  Synthetic oligonucleotide
gacacaatcctccgtcgttcctagtgacccggtct

SEQ ID NO: 101874 - DNA, 33 bp, Artificial Sequence
  Synthetic oligonucleotide
tgtaccagctctcccaccgttttgtaactccaa

SEQ ID NO: 101875 - DNA, 36 bp, Artificial Sequence
  Synthetic oligonucleotide
gtcaacgacgatgaggatgaatttggactgcgtaca

SEQ ID NO: 101876 - DNA, 37 bp, Artificial Sequence
  Synthetic oligonucleotide
tacaccacgagacgtctatcatgactggtgtccgtga

SEQ ID NO: 101877 - DNA, 38 bp, Artificial Sequence
  Synthetic oligonucleotide
aaggggaggtgagtggggaaagaacagtcgtctcgtga

SEQ ID NO: 101878 - DNA, 37 bp, Artificial Sequence
  Synthetic oligonucleotide
gacatcgggagtagagctaaagggaagacgtgtgtga

SEQ ID NO: 101879 - DNA, 35 bp, Artificial Sequence
  Synthetic oligonucleotide
tagccttacgccatctagagctaacattccattac

SEQ ID NO: 101880 - DNA, 35 bp, Artificial Sequence
  Synthetic oligonucleotide
attccccaccgttgaggtcaggccctttataacag

SEQ ID NO: 101881 - DNA, 35 bp, Artificial Sequence
  Synthetic oligonucleotide
tgtcgcaccgcgcaccttcgcccaggcattttcag

SEQ ID NO: 101882 - DNA, 35 bp, Artificial Sequence
  Synthetic oligonucleotide
ttgacccgaccgcttgcactgttacttcctaatct

SEQ ID NO: 101883 - DNA, 38 bp, Artificial Sequence
  Synthetic oligonucleotide
acacgggtgaatcaaggaaggataagggtgcctaatga

SEQ ID NO: 101884 - DNA, 36 bp, Artificial Sequence
  Synthetic oligonucleotide
gcccctgccccaactgtcactttcgcaatcgccgta

SEQ ID NO: 101885 - DNA, 35 bp, Artificial Sequence
  Synthetic oligonucleotide
gcagaccgtgaggcctggtactccttccactgcaa

SEQ ID NO: 101886 - DNA, 36 bp, Artificial Sequence
  Synthetic oligonucleotide
agacgcccctctcagtttcttcacatacagctagaa

SEQ ID NO: 101887 - DNA, 36 bp, Artificial Sequence
  Synthetic oligonucleotide
ttcacccttggcgtcttcctgtggcccctctgatca

SEQ ID NO: 101888 - DNA, 36 bp, Artificial Sequence
  Synthetic oligonucleotide
gccaaccgcggcgcgttgatccagcacttaccacga

SEQ ID NO: 101889 - DNA, 35 bp, Artificial Sequence
  Synthetic oligonucleotide
aaactgacggcgtcaactctttgcggacaagcata

SEQ ID NO: 101890 - DNA, 35 bp, Artificial Sequence
  Synthetic oligonucleotide
taggctcgggccacatcataattcagccagccacc

SEQ ID NO: 101891 - DNA, 35 bp, Artificial Sequence
  Synthetic oligonucleotide
tctgaaccggcatccgtttgggcctcacactttcc

SEQ ID NO: 101892 - DNA, 35 bp, Artificial Sequence
  Synthetic oligonucleotide
gaggtgaaaaggtggtggacacgagatagctaaat

SEQ ID NO: 101893 - DNA, 35 bp, Artificial Sequence
  Synthetic oligonucleotide
tacctccgacgtgctcctgttattgttacttaaaa

SEQ ID NO: 101894 - DNA, 36 bp, Artificial Sequence
  Synthetic oligonucleotide
tctcagcctcgccgcctccaattgtcccccgaccaa

SEQ ID NO: 101895 - DNA, 36 bp, Artificial Sequence
  Synthetic oligonucleotide
gagactaggaatcagatggtcgaagttgccgatgca

SEQ ID NO: 101896 - DNA, 36 bp, Artificial Sequence
  Synthetic oligonucleotide
gccctctcccaggttgatcgtcaccacatacgctta

SEQ ID NO: 101897 - DNA, 35 bp, Artificial Sequence
  Synthetic oligonucleotide
gtctgacgccgtcggccgttctacctccttgttac

SEQ ID NO: 101898 - DNA, 34 bp, Artificial Sequence
  Synthetic oligonucleotide
gtcatactggcacatgttacgtaccgccaccaat

SEQ ID NO: 101899 - DNA, 35 bp, Artificial Sequence
  Synthetic oligonucleotide
atatttgcgtacgagctatcatcaccatctcgcct

SEQ ID NO: 101900 - DNA, 35 bp, Artificial Sequence
  Synthetic oligonucleotide
ttcggacaccctgtactctctgataaccgaaacaa

SEQ ID NO: 101901 - DNA, 36 bp, Artificial Sequence
  Synthetic oligonucleotide
tgtccccacgcccaaggagcgattagcggaaacata

SEQ ID NO: 101902 - DNA, 35 bp, Artificial Sequence
  Synthetic oligonucleotide
gccaccggcacggaaattaccaccgcaccttaatc

SEQ ID NO: 101903 - DNA, 35 bp, Artificial Sequence
  Synthetic oligonucleotide
gctgtgcactattcacctgtttggttgtccgactc

SEQ ID NO: 101904 - DNA, 35 bp, Artificial Sequence
  Synthetic oligonucleotide
aagggggagtgctgctcgacgtgaagaataagctc

SEQ ID NO: 101905 - DNA, 36 bp, Artificial Sequence
  Synthetic oligonucleotide
gccacgacctccatgtagtgtcaacattccacccaa

SEQ ID NO: 101906 - DNA, 35 bp, Artificial Sequence
  Synthetic oligonucleotide
gtgtagcgatgatgggggggaagggcaggaggtaa

SEQ ID NO: 101907 - DNA, 37 bp, Artificial Sequence
  Synthetic oligonucleotide
gtgatgcgaagagcgaatatgggtaggtgtgaagcga

SEQ ID NO: 101908 - DNA, 36 bp, Artificial Sequence
  Synthetic oligonucleotide
gaccacaacgagtcaacatgccactgagagattcga

SEQ ID NO: 101909 - DNA, 37 bp, Artificial Sequence
  Synthetic oligonucleotide
gacgcacgctccggttgacttgatatggcgcaaggga

SEQ ID NO: 101910 - DNA, 36 bp, Artificial Sequence
  Synthetic oligonucleotide
gatgcggatggaatcgcctaaatgttacggctaata

SEQ ID NO: 101911 - DNA, 35 bp, Artificial Sequence
  Synthetic oligonucleotide
gactagccccagacccacgttgacgttcgaccgtt

SEQ ID NO: 101912 - DNA, 35 bp, Artificial Sequence
  Synthetic oligonucleotide
aactcgctggtgttccgttcttcactgtacttgaa

SEQ ID NO: 101913 - DNA, 36 bp, Artificial Sequence
  Synthetic oligonucleotide
accactgtccatggccgttatgaccttactcgctaa

SEQ ID NO: 101914 - DNA, 37 bp, Artificial Sequence
  Synthetic oligonucleotide
atgctgcagagcaggaaagcgatgagaaggagtaaga

SEQ ID NO: 101915 - DNA, 38 bp, Artificial Sequence
  Synthetic oligonucleotide
agccactgaaagtagggcagaggtgaaccacaatgtga

SEQ ID NO: 101916 - DNA, 36 bp, Artificial Sequence
  Synthetic oligonucleotide
gcaatgcctcgaattgaccccctctgcacactccta

SEQ ID NO: 101917 - DNA, 35 bp, Artificial Sequence
  Synthetic oligonucleotide
gcattgcctgcaggttagtaacatgacattgggtc

SEQ ID NO: 101918 - DNA, 35 bp, Artificial Sequence
  Synthetic oligonucleotide
ggaccacctgccactgtcttcaatgctcgacattc

SEQ ID NO: 101919 - DNA, 35 bp, Artificial Sequence
  Synthetic oligonucleotide
tgcatcctccaaactgtttccacgaataccgacaa

SEQ ID NO: 101920 - DNA, 35 bp, Artificial Sequence
  Synthetic oligonucleotide
gctcgaccgcatcaccggcactgtacacctaccaa

SEQ ID NO: 101921 - DNA, 35 bp, Artificial Sequence
  Synthetic oligonucleotide
acacacgtagcggttcagtaaccttggtgaccaca

SEQ ID NO: 101922 - DNA, 37 bp, Artificial Sequence
  Synthetic oligonucleotide
accgcgcacagcggtcgtactccctactatttcgcca

SEQ ID NO: 101923 - DNA, 36 bp, Artificial Sequence
  Synthetic oligonucleotide
gatgagcaccgcctctctggtccaacaccgccgcta

SEQ ID NO: 101924 - DNA, 35 bp, Artificial Sequence
  Synthetic oligonucleotide
tgacggaccacctttggattcttgtgctacctgcc

SEQ ID NO: 101925 - DNA, 34 bp, Artificial Sequence
  Synthetic oligonucleotide
gaactgccgcctcactcccgttcgattccaataa

SEQ ID NO: 101926 - DNA, 36 bp, Artificial Sequence
  Synthetic oligonucleotide
gcccgaggcctctcacggtttttttcctggctatga

SEQ ID NO: 101927 - DNA, 38 bp, Artificial Sequence
  Synthetic oligonucleotide
tgatcacagctggtgggaacggagagggggtggattga

SEQ ID NO: 101928 - DNA, 35 bp, Artificial Sequence
  Synthetic oligonucleotide
tacgtgctaactcacaaccatctaccaacagagac

SEQ ID NO: 101929 - DNA, 35 bp, Artificial Sequence
  Synthetic oligonucleotide
gccaacgagtgcgtcacactcatcgcttcttccat

SEQ ID NO: 101930 - DNA, 35 bp, Artificial Sequence
  Synthetic oligonucleotide
tagtggacatgggcggattgggcggggagaaggat

SEQ ID NO: 101931 - DNA, 35 bp, Artificial Sequence
  Synthetic oligonucleotide
acactcgccccgcttggtaccatcccactgggtat

SEQ ID NO: 101932 - DNA, 35 bp, Artificial Sequence
  Synthetic oligonucleotide
aatgtcacgggctgataatggatgggaatacgtgt

SEQ ID NO: 101933 - DNA, 35 bp, Artificial Sequence
  Synthetic oligonucleotide
tgaaagtccattgtcctgccgtgccctgattacac

SEQ ID NO: 101934 - DNA, 35 bp, Artificial Sequence
  Synthetic oligonucleotide
gcaacctcctgccctgtaaccagtagccctacaag

SEQ ID NO: 101935 - DNA, 35 bp, Artificial Sequence
  Synthetic oligonucleotide
tcccggtccgagtcaatccgcgccctgacctcaat

SEQ ID NO: 101936 - DNA, 35 bp, Artificial Sequence
  Synthetic oligonucleotide
aaagtgcggccacatcttttatattgtactgctct

SEQ ID NO: 101937 - DNA, 35 bp, Artificial Sequence
  Synthetic oligonucleotide
taccaggtcgatacagaatatgagggggtaggggt

SEQ ID NO: 101938 - DNA, 35 bp, Artificial Sequence
  Synthetic oligonucleotide
aacgatatccacgcagacttgcaccatgccattaa

SEQ ID NO: 101939 - DNA, 36 bp, Artificial Sequence
  Synthetic oligonucleotide
tcacgccgcaccgtttagggcctcgacccacccaca

SEQ ID NO: 101940 - DNA, 37 bp, Artificial Sequence
  Synthetic oligonucleotide
gtccactctcctgcactgattactcgtatttacagga

SEQ ID NO: 101941 - DNA, 38 bp, Artificial Sequence
  Synthetic oligonucleotide
tgcgggagtcgcaataggatctgggactagaatcctga

SEQ ID NO: 101942 - DNA, 36 bp, Artificial Sequence
  Synthetic oligonucleotide
tcacaacactctactggctaagccaccaggcacaac

SEQ ID NO: 101943 - DNA, 35 bp, Artificial Sequence
  Synthetic oligonucleotide
atgaacccatcgccgctgcaggcactgcttcctat

SEQ ID NO: 101944 - DNA, 35 bp, Artificial Sequence
  Synthetic oligonucleotide
tcaggccccctcccccagcttcctagtgacggtat

SEQ ID NO: 101945 - DNA, 36 bp, Artificial Sequence
  Synthetic oligonucleotide
gtggctcaccgtaatggtgctaccttcccgattgga

SEQ ID NO: 101946 - DNA, 38 bp, Artificial Sequence
  Synthetic oligonucleotide
tatgactgcaccaaacgggcattgacagagtctcttga

SEQ ID NO: 101947 - DNA, 35 bp, Artificial Sequence
  Synthetic oligonucleotide
gaacaacgacggcatgcgcgaccgcccccacgtcc

SEQ ID NO: 101948 - DNA, 36 bp, Artificial Sequence
  Synthetic oligonucleotide
acacaagcccctccgcgcctgcccacacgctttaaa

SEQ ID NO: 101949 - DNA, 35 bp, Artificial Sequence
  Synthetic oligonucleotide
gcaacgacatccgcgaacgatacacggcctaactc

SEQ ID NO: 101950 - DNA, 38 bp, Artificial Sequence
  Synthetic oligonucleotide
taccgtcgggggggtgggacgaacataaatgcctctga

SEQ ID NO: 101951 - DNA, 38 bp, Artificial Sequence
  Synthetic oligonucleotide
taacagcaacagacgctgtacttgtcccacctgagtga

SEQ ID NO: 101952 - DNA, 35 bp, Artificial Sequence
  Synthetic oligonucleotide
gtctcacaccggcgtggacactagcgtgtacccta

SEQ ID NO: 101953 - DNA, 35 bp, Artificial Sequence
  Synthetic oligonucleotide
ttgcgaccccatcgtgctacgtgggactgccttac

SEQ ID NO: 101954 - DNA, 35 bp, Artificial Sequence
  Synthetic oligonucleotide
accgcaacatgtcactcgcgaagccttagttaccc

SEQ ID NO: 101955 - DNA, 33 bp, Artificial Sequence
  Synthetic oligonucleotide
aatggccagtgtagcccgtaccacccacttgaa

SEQ ID NO: 101956 - DNA, 36 bp, Artificial Sequence
  Synthetic oligonucleotide
tgcctagcgccctttgtcttcgtgcctatcttttaa

SEQ ID NO: 101957 - DNA, 36 bp, Artificial Sequence
  Synthetic oligonucleotide
gatgcccgggttggagggattgggggcccgagaaca

SEQ ID NO: 101958 - DNA, 36 bp, Artificial Sequence
  Synthetic oligonucleotide
gcgagacgcaaaagagatattgagggaggtgatcca

SEQ ID NO: 101959 - DNA, 35 bp, Artificial Sequence
  Synthetic oligonucleotide
atgccctccaatcgaagttcggccccatctgtaac

SEQ ID NO: 101960 - DNA, 35 bp, Artificial Sequence
  Synthetic oligonucleotide
gagccccacccgaccctgtctcatgtccgattatt

SEQ ID NO: 101961 - DNA, 36 bp, Artificial Sequence
  Synthetic oligonucleotide
ggtcgccctctctgtctccactgtcctttctagaaa

SEQ ID NO: 101962 - DNA, 36 bp, Artificial Sequence
  Synthetic oligonucleotide
taactcatacggcctgtttcattccccgttcgccaa

SEQ ID NO: 101963 - DNA, 35 bp, Artificial Sequence
  Synthetic oligonucleotide
tatgcgccagtttggggtgaaggaagggtgggtaa

SEQ ID NO: 101964 - DNA, 35 bp, Artificial Sequence
  Synthetic oligonucleotide
gttgaacccgactgctttagcgcttacaaaacgta

SEQ ID NO: 101965 - DNA, 35 bp, Artificial Sequence
  Synthetic oligonucleotide
ttccacgctccaggccggcataccacgttccctat

SEQ ID NO: 101966 - DNA, 36 bp, Artificial Sequence
  Synthetic oligonucleotide
agacgcatccagcctagtcgatagttgtgcaaccaa

SEQ ID NO: 101967 - DNA, 35 bp, Artificial Sequence
  Synthetic oligonucleotide
gtccacgatcgaatcgttccccacatcacagtcaa

SEQ ID NO: 101968 - DNA, 35 bp, Artificial Sequence
  Synthetic oligonucleotide
gaaccgcgccctactttattagcaccaccattgaa

SEQ ID NO: 101969 - DNA, 36 bp, Artificial Sequence
  Synthetic oligonucleotide
tgcgaacatccgatttctattgtgctatgctcctaa

SEQ ID NO: 101970 - DNA, 36 bp, Artificial Sequence
  Synthetic oligonucleotide
tgtgtgctgggccaggtggtagttgatttagtctca

SEQ ID NO: 101971 - DNA, 37 bp, Artificial Sequence
  Synthetic oligonucleotide
ttgacgaacccaaacagcagagacacgattaacatga

SEQ ID NO: 101972 - DNA, 37 bp, Artificial Sequence
  Synthetic oligonucleotide
aacgacggacggtgacgtacatccagaaatacattga

SEQ ID NO: 101973 - DNA, 36 bp, Artificial Sequence
  Synthetic oligonucleotide
gcacaggctgcccaatatgcgcgatcctttatacta

SEQ ID NO: 101974 - DNA, 36 bp, Artificial Sequence
  Synthetic oligonucleotide
tgtgaagtgtgaagggagacagttgagagagtggta

SEQ ID NO: 101975 - DNA, 35 bp, Artificial Sequence
  Synthetic oligonucleotide
tgtacatccgtcccaccgcacgtattcccagttac

SEQ ID NO: 101976 - DNA, 35 bp, Artificial Sequence
  Synthetic oligonucleotide
gccactttcccatgcccttgatacagccacgactc

SEQ ID NO: 101977 - DNA, 36 bp, Artificial Sequence
  Synthetic oligonucleotide
tgcgggtacacacgccatacgattgcctgcctttaa

SEQ ID NO: 101978 - DNA, 36 bp, Artificial Sequence
  Synthetic oligonucleotide
ttgtgtcgtccagcttatttcaaccggtggtagaca

SEQ ID NO: 101979 - DNA, 37 bp, Artificial Sequence
  Synthetic oligonucleotide
gtccgggagtgtttcatctcctcctcacgaacgctga

SEQ ID NO: 101980 - DNA, 35 bp, Artificial Sequence
  Synthetic oligonucleotide
gcgccctccccctgtctgtatcctggtttagcttc

SEQ ID NO: 101981 - DNA, 35 bp, Artificial Sequence
  Synthetic oligonucleotide
aaggtagaggaagggggaagtgcgaagagatgagg

SEQ ID NO: 101982 - DNA, 36 bp, Artificial Sequence
  Synthetic oligonucleotide
tccgcttcccggcaataccaggtactgcttactaaa

SEQ ID NO: 101983 - DNA, 36 bp, Artificial Sequence
  Synthetic oligonucleotide
tacatccaccgaactgaattcccgataggttactca

SEQ ID NO: 101984 - DNA, 37 bp, Artificial Sequence
  Synthetic oligonucleotide
atcaagcccatgcattgtgggatttgaatgtttccga

SEQ ID NO: 101985 - DNA, 37 bp, Artificial Sequence
  Synthetic oligonucleotide
ttgagtgcatagcgaaaaagagtaggtgcaggccgga

SEQ ID NO: 101986 - DNA, 35 bp, Artificial Sequence
  Synthetic oligonucleotide
ttcgacgccacagttagacacgttgctcgccttcc

SEQ ID NO: 101987 - DNA, 35 bp, Artificial Sequence
  Synthetic oligonucleotide
gacgtgcgcaagtgcaacgttatcgtacactggtc

SEQ ID NO: 101988 - DNA, 34 bp, Artificial Sequence
  Synthetic oligonucleotide
gacccgccacccctggtgccttaaatgaattcaa

SEQ ID NO: 101989 - DNA, 37 bp, Artificial Sequence
  Synthetic oligonucleotide
gtcacctccccgactctcacgctggtgggatacgaga

SEQ ID NO: 101990 - DNA, 37 bp, Artificial Sequence
  Synthetic oligonucleotide
gatcaccgctcagaattttgttatgaactgcacgtga

SEQ ID NO: 101991 - DNA, 35 bp, Artificial Sequence
  Synthetic oligonucleotide
tgccaccaatcgactcggagtctgccttctcatac

SEQ ID NO: 101992 - DNA, 35 bp, Artificial Sequence
  Synthetic oligonucleotide
tccacctgacgccaagggcataatgcaatacctac

SEQ ID NO: 101993 - DNA, 35 bp, Artificial Sequence
  Synthetic oligonucleotide
tcaacacgttccggtgttgaacatattgatttctt

SEQ ID NO: 101994 - DNA, 37 bp, Artificial Sequence
  Synthetic oligonucleotide
actgccatctgcccccgccctgatcccttggccatga

SEQ ID NO: 101995 - DNA, 37 bp, Artificial Sequence
  Synthetic oligonucleotide
acactcgcaaccccatgcccaccaccaggcacgatga

SEQ ID NO: 101996 - DNA, 35 bp, Artificial Sequence
  Synthetic oligonucleotide
tgactggccctggcatcgtttcgacccaccataac

SEQ ID NO: 101997 - DNA, 35 bp, Artificial Sequence
  Synthetic oligonucleotide
tcgtccaccttgttctttactttacgacctgccct

SEQ ID NO: 101998 - DNA, 35 bp, Artificial Sequence
  Synthetic oligonucleotide
gtctccctccacatgattgacccccagtggaccaa

SEQ ID NO: 101999 - DNA, 36 bp, Artificial Sequence
  Synthetic oligonucleotide
gccacgcagtgggccgtgccatctttagtactataa

SEQ ID NO: 102000 - DNA, 36 bp, Artificial Sequence
  Synthetic oligonucleotide
gtcaccctccacagcctgtccgtagcaccgctttaa

SEQ ID NO: 102001 - DNA, 36 bp, Artificial Sequence
  Synthetic oligonucleotide
ttacccgcaacacgtattgagtcccccgccatgaca

SEQ ID NO: 102002 - DNA, 37 bp, Artificial Sequence
  Synthetic oligonucleotide
gcgaacgcagccgcccgccttcgtacgttttaactga

SEQ ID NO: 102003 - DNA, 35 bp, Artificial Sequence
  Synthetic oligonucleotide
tccactgaactacgacgcttgctactgggccgaac

SEQ ID NO: 102004 - DNA, 36 bp, Artificial Sequence
  Synthetic oligonucleotide
tgttagcccagggatacaggtggagggagtggggaa

SEQ ID NO: 102005 - DNA, 37 bp, Artificial Sequence
  Synthetic oligonucleotide
accagcccctccgcgcgatccaactccccatgctcga

SEQ ID NO: 102006 - DNA, 36 bp, Artificial Sequence
  Synthetic oligonucleotide
tcaccccgtatctgttcctggtccatgggctactta

SEQ ID NO: 102007 - DNA, 35 bp, Artificial Sequence
  Synthetic oligonucleotide
atgtccgcatcgctgtttccatctaaccgtgccac

SEQ ID NO: 102008 - DNA, 35 bp, Artificial Sequence
  Synthetic oligonucleotide
aacgaagacagcacctctccatctctcatgactcc

SEQ ID NO: 102009 - DNA, 34 bp, Artificial Sequence
  Synthetic oligonucleotide
tctggtcatcgaagcaccctggtcccattacgtc

SEQ ID NO: 102010 - DNA, 35 bp, Artificial Sequence
  Synthetic oligonucleotide
tagacaccctgtctagaactgtccttcaaccctag

SEQ ID NO: 102011 - DNA, 36 bp, Artificial Sequence
  Synthetic oligonucleotide
gaacacgcgggggacacgtacataagagcagaaatt

SEQ ID NO: 102012 - DNA, 35 bp, Artificial Sequence
  Synthetic oligonucleotide
gtagctgacctcaaagttttctctccggtgtcctt

SEQ ID NO: 102013 - DNA, 36 bp, Artificial Sequence
  Synthetic oligonucleotide
tagcacaccacatgataggggctcacgcattccaaa

SEQ ID NO: 102014 - DNA, 36 bp, Artificial Sequence
  Synthetic oligonucleotide
acagcccggacatatctagccctgatccttgtctca

SEQ ID NO: 102015 - DNA, 38 bp, Artificial Sequence
  Synthetic oligonucleotide
acagggaaatccggcatgcgaaacatcgggggagctga

SEQ ID NO: 102016 - DNA, 35 bp, Artificial Sequence
  Synthetic oligonucleotide
acatcccgatccgttagtgcctaactgctggcgcc

SEQ ID NO: 102017 - DNA, 35 bp, Artificial Sequence
  Synthetic oligonucleotide
tacacccggtgcgtgtgccttacttaccctagtcg

SEQ ID NO: 102018 - DNA, 35 bp, Artificial Sequence
  Synthetic oligonucleotide
tacgccacaaggccacggtgatctgtgcacagtct

SEQ ID NO: 102019 - DNA, 35 bp, Artificial Sequence
  Synthetic oligonucleotide
gttgcgagacggtcctgctttggtactccagtaaa

SEQ ID NO: 102020 - DNA, 37 bp, Artificial Sequence
  Synthetic oligonucleotide
tgtgacgcaagtgagaatcggacgcgaaccatttgga

SEQ ID NO: 102021 - DNA, 38 bp, Artificial Sequence
  Synthetic oligonucleotide
acacccccgtgattggctggacgtacgagtctagctga

SEQ ID NO: 102022 - DNA, 38 bp, Artificial Sequence
  Synthetic oligonucleotide
aaacgagggtgaagggttatgaagagggggggatttga

SEQ ID NO: 102023 - DNA, 35 bp, Artificial Sequence
  Synthetic oligonucleotide
ggggggtagaacgggcgttgaggggtacgcagagg

SEQ ID NO: 102024 - DNA, 36 bp, Artificial Sequence
  Synthetic oligonucleotide
aaccaggacggcccattatcgtgaccgctggaaaaa

SEQ ID NO: 102025 - DNA, 36 bp, Artificial Sequence
  Synthetic oligonucleotide
gacgccctcacacactgccttaggtttccgattgaa

SEQ ID NO: 102026 - DNA, 35 bp, Artificial Sequence
  Synthetic oligonucleotide
gtcgccgtacatagcgtgtcccccgttaactctaa

SEQ ID NO: 102027 - DNA, 36 bp, Artificial Sequence
  Synthetic oligonucleotide
gacacttgccccatcttcatacgatttagtatgtaa

SEQ ID NO: 102028 - DNA, 35 bp, Artificial Sequence
  Synthetic oligonucleotide
gtccgacctgtcacatgcccccccctgcagctgac

SEQ ID NO: 102029 - DNA, 36 bp, Artificial Sequence
  Synthetic oligonucleotide
tagcccctcaacttcactgtcctgcgacgttaataa

SEQ ID NO: 102030 - DNA, 37 bp, Artificial Sequence
  Synthetic oligonucleotide
ttagtggagcgcaaggggtaatagatggtagaacgga

SEQ ID NO: 102031 - DNA, 35 bp, Artificial Sequence
  Synthetic oligonucleotide
tgaggggggtgaaatgaaggatggttagaggatga

SEQ ID NO: 102032 - DNA, 38 bp, Artificial Sequence
  Synthetic oligonucleotide
gtacgtaccacgaatttgcgacacctccagcacgctga

SEQ ID NO: 102033 - DNA, 36 bp, Artificial Sequence
  Synthetic oligonucleotide
gatgtcgtcccctctggtttggcctagttaaatata

SEQ ID NO: 102034 - DNA, 35 bp, Artificial Sequence
  Synthetic oligonucleotide
tgacgcctcaacacaagctaaattaggtctacaac

SEQ ID NO: 102035 - DNA, 37 bp, Artificial Sequence
  Synthetic oligonucleotide
ggaggaaaaacgataaagtacgtgggggggacgatga

SEQ ID NO: 102036 - DNA, 37 bp, Artificial Sequence
  Synthetic oligonucleotide
actggcaatccaaccccggaatcacgcttaggcctga

SEQ ID NO: 102037 - DNA, 36 bp, Artificial Sequence
  Synthetic oligonucleotide
gactgcaatacaacaaggggctgtaacggagggtaa

SEQ ID NO: 102038 - DNA, 36 bp, Artificial Sequence
  Synthetic oligonucleotide
attgacgcctcatttacgccacactcattcttccga

SEQ ID NO: 102039 - DNA, 36 bp, Artificial Sequence
  Synthetic oligonucleotide
gataaaggggacatccgggtacagtatgggcacaaa

SEQ ID NO: 102040 - DNA, 36 bp, Artificial Sequence
  Synthetic oligonucleotide
aagggaggtgggtggagtgaggaagcgcagggataa

SEQ ID NO: 102041 - DNA, 36 bp, Artificial Sequence
  Synthetic oligonucleotide
tcgcactgacaacaacttcagggctggatcctttca

SEQ ID NO: 102042 - DNA, 35 bp, Artificial Sequence
  Synthetic oligonucleotide
gcacatccggcgtaggtcgacggagcctccaccac

SEQ ID NO: 102043 - DNA, 35 bp, Artificial Sequence
  Synthetic oligonucleotide
gaagcccttgcttgctttgtggtttgaccctctct

SEQ ID NO: 102044 - DNA, 36 bp, Artificial Sequence
  Synthetic oligonucleotide
agtcaaccgatcataagtgagatggaaaaggtggga

SEQ ID NO: 102045 - DNA, 35 bp, Artificial Sequence
  Synthetic oligonucleotide
actacactgcattggcgctgacacattcacctcta

SEQ ID NO: 102046 - DNA, 35 bp, Artificial Sequence
  Synthetic oligonucleotide
acaccacctcagtacactcaacctggacaacgtta

SEQ ID NO: 102047 - DNA, 35 bp, Artificial Sequence
  Synthetic oligonucleotide
tcgatgcacgctgtgtcgcacctgaccattccgat

SEQ ID NO: 102048 - DNA, 35 bp, Artificial Sequence
  Synthetic oligonucleotide
gcatccccctgttctgtcggacacctcgctcgccc

SEQ ID NO: 102049 - DNA, 35 bp, Artificial Sequence
  Synthetic oligonucleotide
gtggcccccctagatccgactttcactgccaccag

SEQ ID NO: 102050 - DNA, 35 bp, Artificial Sequence
  Synthetic oligonucleotide
aaatcaaccgtcaagacagagatagtggggaacgg

SEQ ID NO: 102051 - DNA, 36 bp, Artificial Sequence
  Synthetic oligonucleotide
atatgacgccattggcggagtgatcatacatactca

SEQ ID NO: 102052 - DNA, 35 bp, Artificial Sequence
  Synthetic oligonucleotide
gtgcgaccccactgactccacttcaagtgactaat

SEQ ID NO: 102053 - DNA, 35 bp, Artificial Sequence
  Synthetic oligonucleotide
atagccgacagtaggagcggtcgtacgatcaggta

SEQ ID NO: 102054 - DNA, 35 bp, Artificial Sequence
  Synthetic oligonucleotide
ttgggacgtaaacggtgggatgacagtaagtgtag

SEQ ID NO: 102055 - DNA, 35 bp, Artificial Sequence
  Synthetic oligonucleotide
gcgtagcagacactgccttatgcatcgaccaccat

SEQ ID NO: 102056 - DNA, 36 bp, Artificial Sequence
  Synthetic oligonucleotide
gtacgcggcacactgctgtccctaactaactctcaa

SEQ ID NO: 102057 - DNA, 35 bp, Artificial Sequence
  Synthetic oligonucleotide
gacccatgcccgcttttccacctgaccttccagaa

SEQ ID NO: 102058 - DNA, 38 bp, Artificial Sequence
  Synthetic oligonucleotide
gtgcccgtgcccggatttacaaggtacgtactacctga

SEQ ID NO: 102059 - DNA, 37 bp, Artificial Sequence
  Synthetic oligonucleotide
actgccatcggcccccgccctgatcccttggccatta

SEQ ID NO: 102060 - DNA, 35 bp, Artificial Sequence
  Synthetic oligonucleotide
tcgcacttcccgccttctcttccgcggtcatcgac

SEQ ID NO: 102061 - DNA, 35 bp, Artificial Sequence
  Synthetic oligonucleotide
gactacctacgcacctggtcatatacagctgctac

SEQ ID NO: 102062 - DNA, 35 bp, Artificial Sequence
  Synthetic oligonucleotide
tcaacgagtccacctacctcctccgggccaatccg

SEQ ID NO: 102063 - DNA, 36 bp, Artificial Sequence
  Synthetic oligonucleotide
aagaccaccgttcattgttccatggcccccgcctca

SEQ ID NO: 102064 - DNA, 35 bp, Artificial Sequence
  Synthetic oligonucleotide
atgggattgaaggcgaatattggagggcgggagta

SEQ ID NO: 102065 - DNA, 35 bp, Artificial Sequence
  Synthetic oligonucleotide
gccaggaccgcaggccattccctcgcccacaaaat

SEQ ID NO: 102066 - DNA, 36 bp, Artificial Sequence
  Synthetic oligonucleotide
tttacgcagacccacatacatcctttcgagcaacca

SEQ ID NO: 102067 - DNA, 36 bp, Artificial Sequence
  Synthetic oligonucleotide
gctgccacggtgcaatccagtaccgttgttccacaa

SEQ ID NO: 102068 - DNA, 36 bp, Artificial Sequence
  Synthetic oligonucleotide
agccaaccccgatcactcttcgctgctagctgaaca

SEQ ID NO: 102069 - DNA, 37 bp, Artificial Sequence
  Synthetic oligonucleotide
tacaccgcatcaattctgagatcgctaagttaaggga

SEQ ID NO: 102070 - DNA, 35 bp, Artificial Sequence
  Synthetic oligonucleotide
gtgaccgcctctaatcgttgattcgcatcatacaa

SEQ ID NO: 102071 - DNA, 35 bp, Artificial Sequence
  Synthetic oligonucleotide
acccactcccgctcgtgctctggcatgattgccaa

SEQ ID NO: 102072 - DNA, 36 bp, Artificial Sequence
  Synthetic oligonucleotide
gagccatgggcttttctaccacagaactctgtttaa

SEQ ID NO: 102073 - DNA, 36 bp, Artificial Sequence
  Synthetic oligonucleotide
tcgaaccccaatcctcccccaacggtacgctagtca

SEQ ID NO: 102074 - DNA, 35 bp, Artificial Sequence
  Synthetic oligonucleotide
ttgcggaggtcggttttagggaggggaggggggga

SEQ ID NO: 102075 - DNA, 38 bp, Artificial Sequence
  Synthetic oligonucleotide
gcaagcaaggcggtaagaatgttccttgtagggaatga

SEQ ID NO: 102076 - DNA, 38 bp, Artificial Sequence
  Synthetic oligonucleotide
gatggggcgatcggggcacctgtaagcaatgggcgtga

SEQ ID NO: 102077 - DNA, 35 bp, Artificial Sequence
  Synthetic oligonucleotide
tgccaccgccggcgctttaacaagcacacacgaac

SEQ ID NO: 102078 - DNA, 35 bp, Artificial Sequence
  Synthetic oligonucleotide
gactggcacaagtgtttgtcgcgtcactacaccac

SEQ ID NO: 102079 - DNA, 36 bp, Artificial Sequence
  Synthetic oligonucleotide
tttgcaaccaccgctgctgcacattatgtccgttaa

SEQ ID NO: 102080 - DNA, 35 bp, Artificial Sequence
  Synthetic oligonucleotide
ttctacgtaccgaacagctactacacgtaccacca

SEQ ID NO: 102081 - DNA, 35 bp, Artificial Sequence
  Synthetic oligonucleotide
tgccccctccgcgtccctatcgcgacacatcccca

SEQ ID NO: 102082 - DNA, 37 bp, Artificial Sequence
  Synthetic oligonucleotide
gattgcacgattgaacaaccctcatgatctacccgga

SEQ ID NO: 102083 - DNA, 35 bp, Artificial Sequence
  Synthetic oligonucleotide
tgctcccaccgcgctatcatcacatccgggcatac

SEQ ID NO: 102084 - DNA, 36 bp, Artificial Sequence
  Synthetic oligonucleotide
atccacatcgggaatgcaaacttgacatcatgccaa

SEQ ID NO: 102085 - DNA, 35 bp, Artificial Sequence
  Synthetic oligonucleotide
atccccgcccctaagtaactgcccctttattagca

SEQ ID NO: 102086 - DNA, 36 bp, Artificial Sequence
  Synthetic oligonucleotide
gttgcctcaccatcgactccgcactgaaaatttcga

SEQ ID NO: 102087 - DNA, 36 bp, Artificial Sequence
  Synthetic oligonucleotide
aaccaccccggaacgccgctgcggaatgggggatta

SEQ ID NO: 102088 - DNA, 35 bp, Artificial Sequence
  Synthetic oligonucleotide
gaatccagcccctgacgatatacttcacctcgaag

SEQ ID NO: 102089 - DNA, 34 bp, Artificial Sequence
  Synthetic oligonucleotide
accgtgccacgccaacgcatttgcaaacatctat

SEQ ID NO: 102090 - DNA, 36 bp, Artificial Sequence
  Synthetic oligonucleotide
gacccagctgtcggtcgccgccaacgtcctctagaa

SEQ ID NO: 102091 - DNA, 36 bp, Artificial Sequence
  Synthetic oligonucleotide
tagtgcgcgcacaccgtctcagcaatccgttccgaa

SEQ ID NO: 102092 - DNA, 35 bp, Artificial Sequence
  Synthetic oligonucleotide
actgcgggtgggggggctatacggatatataataa

SEQ ID NO: 102093 - DNA, 38 bp, Artificial Sequence
  Synthetic oligonucleotide
gggaacggtcgggtttggcaatggacttgtgtgtctga

SEQ ID NO: 102094 - DNA, 35 bp, Artificial Sequence
  Synthetic oligonucleotide
ttatcgcctcatcccttgtgtctatgcattttacc

SEQ ID NO: 102095 - DNA, 35 bp, Artificial Sequence
  Synthetic oligonucleotide
aagccaccgtctccccccccgccaacatctctctg

SEQ ID NO: 102096 - DNA, 35 bp, Artificial Sequence
  Synthetic oligonucleotide
tcaacaagcagatgtgtatacttcagtgcctcctt

SEQ ID NO: 102097 - DNA, 35 bp, Artificial Sequence
  Synthetic oligonucleotide
ttcgccccatccatatgttaccggctgtatatccc

SEQ ID NO: 102098 - DNA, 35 bp, Artificial Sequence
  Synthetic oligonucleotide
tgagacgtgcgctttattctcccacctagcctgcc

SEQ ID NO: 102099 - DNA, 35 bp, Artificial Sequence
  Synthetic oligonucleotide
tgtcgaacgacaaatcagttaacttgccgctctat

SEQ ID NO: 102100 - DNA, 36 bp, Artificial Sequence
  Synthetic oligonucleotide
gaccacgcatccccgtactcacgtcctctgggcaaa

SEQ ID NO: 102101 - DNA, 37 bp, Artificial Sequence
  Synthetic oligonucleotide
ttggtcccccgcaggtttcggaatgagatgtacctga

SEQ ID NO: 102102 - DNA, 35 bp, Artificial Sequence
  Synthetic oligonucleotide
aacacaagagcgacagacattgaatggacgggagt

SEQ ID NO: 102103 - DNA, 37 bp, Artificial Sequence
  Synthetic oligonucleotide
gagccagggcgcagaggggagaaatggattgtctcga

SEQ ID NO: 102104 - DNA, 35 bp, Artificial Sequence
  Synthetic oligonucleotide
gttgcgcaaggacccctatcctagatccctcgcgt

SEQ ID NO: 102105 - DNA, 37 bp, Artificial Sequence
  Synthetic oligonucleotide
tgacccacacgctgcgcaacgagcatcctttatccca

SEQ ID NO: 102106 - DNA, 35 bp, Artificial Sequence
  Synthetic oligonucleotide
aagtccacgacgtacagttaatccgtgcccccctt

SEQ ID NO: 102107 - DNA, 35 bp, Artificial Sequence
  Synthetic oligonucleotide
acactccacggtccatgacgaacaggacaccgtaa

SEQ ID NO: 102108 - DNA, 36 bp, Artificial Sequence
  Synthetic oligonucleotide
gtacccactgatttggccccgctggcttgggcttga

SEQ ID NO: 102109 - DNA, 35 bp, Artificial Sequence
  Synthetic oligonucleotide
tgcccaccgcaaatctactacgaccttcctttccg

SEQ ID NO: 102110 - DNA, 35 bp, Artificial Sequence
  Synthetic oligonucleotide
gttgcaattaagccgataagagcgggggggacgtg

SEQ ID NO: 102111 - DNA, 35 bp, Artificial Sequence
  Synthetic oligonucleotide
tacatgcgcactttcacacatcacaccgtgttcaa

SEQ ID NO: 102112 - DNA, 38 bp, Artificial Sequence
  Synthetic oligonucleotide
gacgtgtgcacggctgtgcattagagatgggggactga

SEQ ID NO: 102113 - DNA, 38 bp, Artificial Sequence
  Synthetic oligonucleotide
ggaaatggaggcaatgatggggaccaaacaaatcgtga

SEQ ID NO: 102114 - DNA, 35 bp, Artificial Sequence
  Synthetic oligonucleotide
actcctgactcatagaacctcacgtttttcactgc

SEQ ID NO: 102115 - DNA, 36 bp, Artificial Sequence
  Synthetic oligonucleotide
aatgcaccctgcctactttctcctcgatcgtgataa

SEQ ID NO: 102116 - DNA, 37 bp, Artificial Sequence
  Synthetic oligonucleotide
gtgaagcgtgaaatggttgatagcatggcgaaaaaga

SEQ ID NO: 102117 - DNA, 37 bp, Artificial Sequence
  Synthetic oligonucleotide
gaacacccactggtctataagtctcgtcccaactcga

SEQ ID NO: 102118 - DNA, 35 bp, Artificial Sequence
  Synthetic oligonucleotide
attgcacggggatactagtcggggaggttgcctta

SEQ ID NO: 102119 - DNA, 35 bp, Artificial Sequence
  Synthetic oligonucleotide
accacgctctgcttgatacttgtggttgcatgtgc

SEQ ID NO: 102120 - DNA, 35 bp, Artificial Sequence
  Synthetic oligonucleotide
tagtgcgccctagagtagtcccgccccattccaag

SEQ ID NO: 102121 - DNA, 35 bp, Artificial Sequence
  Synthetic oligonucleotide
tcagacacgccggtcgtcgtctcttacccgctaat

SEQ ID NO: 102122 - DNA, 35 bp, Artificial Sequence
  Synthetic oligonucleotide
gcccaccccctgtccacggattcagcattttcgat

SEQ ID NO: 102123 - DNA, 36 bp, Artificial Sequence
  Synthetic oligonucleotide
gtagacgatgacaagtataggggggttgggcgggca

SEQ ID NO: 102124 - DNA, 35 bp, Artificial Sequence
  Synthetic oligonucleotide
tgagggcgagaggggtgaatagaggacgggggatg

SEQ ID NO: 102125 - DNA, 36 bp, Artificial Sequence
  Synthetic oligonucleotide
acagcccggctcagcatagtcttctttctctgcaca

SEQ ID NO: 102126 - DNA, 38 bp, Artificial Sequence
  Synthetic oligonucleotide
gacgcgcattccaatcttttcctaagcaattaccatga

SEQ ID NO: 102127 - DNA, 35 bp, Artificial Sequence
  Synthetic oligonucleotide
tcacgcactggctcgctctcaccattgctttatat

SEQ ID NO: 102128 - DNA, 35 bp, Artificial Sequence
  Synthetic oligonucleotide
actgtgccggtcattcgcttggagctcattcaatt

SEQ ID NO: 102129 - DNA, 37 bp, Artificial Sequence
  Synthetic oligonucleotide
gaaccgggcagtctaccttgagttgttattccccaga

SEQ ID NO: 102130 - DNA, 35 bp, Artificial Sequence
  Synthetic oligonucleotide
gaagccgcaaattcgtctgaacctcagcccccccc

SEQ ID NO: 102131 - DNA, 35 bp, Artificial Sequence
  Synthetic oligonucleotide
gagcacatggtggaatgaacagcaatgttcgcact

SEQ ID NO: 102132 - DNA, 36 bp, Artificial Sequence
  Synthetic oligonucleotide
gcactgccacccactccacactcgcgccaagacgaa

SEQ ID NO: 102133 - DNA, 35 bp, Artificial Sequence
  Synthetic oligonucleotide
actaccactgtctgtcctggcctatgcacgcctaa

SEQ ID NO: 102134 - DNA, 35 bp, Artificial Sequence
  Synthetic oligonucleotide
aaccttgaccgacctcaggcattggtgacataaac

SEQ ID NO: 102135 - DNA, 35 bp, Artificial Sequence
  Synthetic oligonucleotide
tacactccgcccctgtgttgctgacctttattaag

SEQ ID NO: 102136 - DNA, 35 bp, Artificial Sequence
  Synthetic oligonucleotide
tcaacgccaaggaaactgccttctatatccatagg

SEQ ID NO: 102137 - DNA, 35 bp, Artificial Sequence
  Synthetic oligonucleotide
tcatgatgcactcctccactgccgttatatgcctt

SEQ ID NO: 102138 - DNA, 36 bp, Artificial Sequence
  Synthetic oligonucleotide
gaagactgtggagggagttgaagggcgctggagaca

SEQ ID NO: 102139 - DNA, 35 bp, Artificial Sequence
  Synthetic oligonucleotide
accaatggaggcctggggtgatagtcataacgtat

SEQ ID NO: 102140 - DNA, 35 bp, Artificial Sequence
  Synthetic oligonucleotide
atgtacgcctgaccgtcatttccctcactgttcct

SEQ ID NO: 102141 - DNA, 37 bp, Artificial Sequence
  Synthetic oligonucleotide
gatacgtacctgccgtatgaactaccaattctcctga

SEQ ID NO: 102142 - DNA, 36 bp, Artificial Sequence
  Synthetic oligonucleotide
gcgataccgacctcatatttgttactctcacgttga

SEQ ID NO: 102143 - DNA, 38 bp, Artificial Sequence
  Synthetic oligonucleotide
tcaacggaagtagtgggcggaggaagtcacatttttga

SEQ ID NO: 102144 - DNA, 35 bp, Artificial Sequence
  Synthetic oligonucleotide
gccactttcacatgcccttgctacagccacgactc

SEQ ID NO: 102145 - DNA, 36 bp, Artificial Sequence
  Synthetic oligonucleotide
tccatcacctgtccttttgtaggttacggtgagaaa

SEQ ID NO: 102146 - DNA, 36 bp, Artificial Sequence
  Synthetic oligonucleotide
acatcgatggtgcaagagagtagtagcactcccgaa

SEQ ID NO: 102147 - DNA, 36 bp, Artificial Sequence
  Synthetic oligonucleotide
agccaaccacgttccttcgtagctcccacacgtaca

SEQ ID NO: 102148 - DNA, 35 bp, Artificial Sequence
  Synthetic oligonucleotide
acacggtccatatctagcctgcggttccactaccc

SEQ ID NO: 102149 - DNA, 36 bp, Artificial Sequence
  Synthetic oligonucleotide
gagggtggggcttcagtgaccgttgggtcgggagaa

SEQ ID NO: 102150 - DNA, 38 bp, Artificial Sequence
  Synthetic oligonucleotide
gacatcaagtctcctgtatcctgttacatccgtactga

SEQ ID NO: 102151 - DNA, 37 bp, Artificial Sequence
  Synthetic oligonucleotide
tgcggtggacgcatgtgaaggttgagggggtgggtga

SEQ ID NO: 102152 - DNA, 35 bp, Artificial Sequence
  Synthetic oligonucleotide
tcctcaagccggctcagtctccttctcacctccgc

SEQ ID NO: 102153 - DNA, 35 bp, Artificial Sequence
  Synthetic oligonucleotide
tactccggcacctcttttggtatccgcttgccctt

SEQ ID NO: 102154 - DNA, 37 bp, Artificial Sequence
  Synthetic oligonucleotide
gaccgacctgaagccgtcgtgccttctgaaactctga

SEQ ID NO: 102155 - DNA, 35 bp, Artificial Sequence
  Synthetic oligonucleotide
gacgccgcaccgcaaggcttatcatcactcgacat

SEQ ID NO: 102156 - DNA, 35 bp, Artificial Sequence
  Synthetic oligonucleotide
tacgactcaacgtcgccggtgatggacctacgtct

SEQ ID NO: 102157 - DNA, 36 bp, Artificial Sequence
  Synthetic oligonucleotide
taggcaccttcgccgccgaaccatcataagtacaca

SEQ ID NO: 102158 - DNA, 35 bp, Artificial Sequence
  Synthetic oligonucleotide
attgtcccctgtgttgtgcccttaaaatcttctca

SEQ ID NO: 102159 - DNA, 35 bp, Artificial Sequence
  Synthetic oligonucleotide
actacgtctcccctgcccatctgaatttatagcat

SEQ ID NO: 102160 - DNA, 36 bp, Artificial Sequence
  Synthetic oligonucleotide
tcagcgacacctcggcttttgactgcctatcctgca

SEQ ID NO: 102161 - DNA, 36 bp, Artificial Sequence
  Synthetic oligonucleotide
aagatccggggataaatggggtaccctgggaaagta

SEQ ID NO: 102162 - DNA, 36 bp, Artificial Sequence
  Synthetic oligonucleotide
agacacgtggccatccacctaccccaaatctagtaa

SEQ ID NO: 102163 - DNA, 36 bp, Artificial Sequence
  Synthetic oligonucleotide
ttcgcaaggggacaaacccgtaaggccgacttcaca

SEQ ID NO: 102164 - DNA, 35 bp, Artificial Sequence
  Synthetic oligonucleotide
tgtgtccgcacaagtgggattgcgttttagataaa

SEQ ID NO: 102165 - DNA, 36 bp, Artificial Sequence
  Synthetic oligonucleotide
tgcatgtccaggccctgcaacgtaggcacttttata

SEQ ID NO: 102166 - DNA, 35 bp, Artificial Sequence
  Synthetic oligonucleotide
tgctacgtggtacgtcatcataattccgccccgcc

SEQ ID NO: 102167 - DNA, 36 bp, Artificial Sequence
  Synthetic oligonucleotide
gccacagcaccacacgcccgcctcgaccattgttca

SEQ ID NO: 102168 - DNA, 36 bp, Artificial Sequence
  Synthetic oligonucleotide
gccatgccacgatctatttacgtctctgctttacta

SEQ ID NO: 102169 - DNA, 33 bp, Artificial Sequence
  Synthetic oligonucleotide
gacctacatgagcccgttacgactgcccacccc

SEQ ID NO: 102170 - DNA, 35 bp, Artificial Sequence
  Synthetic oligonucleotide
ccttggacagttcgctgctctacccccggcccatt

SEQ ID NO: 102171 - DNA, 37 bp, Artificial Sequence
  Synthetic oligonucleotide
gttgtcgacaccttgtagcccctccttcgatctggga

SEQ ID NO: 102172 - DNA, 38 bp, Artificial Sequence
  Synthetic oligonucleotide
agtggtcgcgttggtagaacggaaaacacacattatga

SEQ ID NO: 102173 - DNA, 38 bp, Artificial Sequence
  Synthetic oligonucleotide
aacgcccgtcgtgtaaggttaggagggatcagtggtga

SEQ ID NO: 102174 - DNA, 35 bp, Artificial Sequence
  Synthetic oligonucleotide
attcacaacaaacacctcaggcccctgcttacctg

SEQ ID NO: 102175 - DNA, 34 bp, Artificial Sequence
  Synthetic oligonucleotide
gtccttcccgcccgaataggagagccctggtaac

SEQ ID NO: 102176 - DNA, 36 bp, Artificial Sequence
  Synthetic oligonucleotide
tccactcggggtgactaactccgcccctaatctcca

SEQ ID NO: 102177 - DNA, 37 bp, Artificial Sequence
  Synthetic oligonucleotide
ggtatggagaaagtaaactgtggcagtcggggaatga

SEQ ID NO: 102178 - DNA, 35 bp, Artificial Sequence
  Synthetic oligonucleotide
gtcctggcgcggtttctatcccgaactacacccct

SEQ ID NO: 102179 - DNA, 35 bp, Artificial Sequence
  Synthetic oligonucleotide
ttattcacaaaccccgacctgattgcttcaatgct

SEQ ID NO: 102180 - DNA, 36 bp, Artificial Sequence
  Synthetic oligonucleotide
aagccataccacctgaaatgttgcgttttatcatca

SEQ ID NO: 102181 - DNA, 35 bp, Artificial Sequence
  Synthetic oligonucleotide
ttcaaaccgggtcgatctgctaagctcaatttttc

SEQ ID NO: 102182 - DNA, 35 bp, Artificial Sequence
  Synthetic oligonucleotide
tcacacatgttatcaaatcaagtctcccccccggg

SEQ ID NO: 102183 - DNA, 35 bp, Artificial Sequence
  Synthetic oligonucleotide
tctcgtgcatgtccttatgcagtaccttcttggct

SEQ ID NO: 102184 - DNA, 36 bp, Artificial Sequence
  Synthetic oligonucleotide
acaccaccacgtcgctatcactgagttccgtttgaa

SEQ ID NO: 102185 - DNA, 32 bp, Artificial Sequence
  Synthetic oligonucleotide
gtgaggagctgaaggaaggggggggggtacga

SEQ ID NO: 102186 - DNA, 36 bp, Artificial Sequence
  Synthetic oligonucleotide
aactgagcaagggaggaagatcaccatggggggata

SEQ ID NO: 102187 - DNA, 34 bp, Artificial Sequence
  Synthetic oligonucleotide
ttgctcacgcccagtactcccctttcacacccta

SEQ ID NO: 102188 - DNA, 35 bp, Artificial Sequence
  Synthetic oligonucleotide
tcaactggcaaatccgcccttcatatcagacactt

SEQ ID NO: 102189 - DNA, 35 bp, Artificial Sequence
  Synthetic oligonucleotide
tcccaccgacgatcagacgacccacgttttgcaaa

SEQ ID NO: 102190 - DNA, 35 bp, Artificial Sequence
  Synthetic oligonucleotide
actctcagctggcatcaattatactttgcactcac

SEQ ID NO: 102191 - DNA, 35 bp, Artificial Sequence
  Synthetic oligonucleotide
tgacaccattcagtacctgtccaggcgattcaacc

SEQ ID NO: 102192 - DNA, 35 bp, Artificial Sequence
  Synthetic oligonucleotide
tcccgcctcaaccacgaacgcacggccggagccct

SEQ ID NO: 102193 - DNA, 35 bp, Artificial Sequence
  Synthetic oligonucleotide
gaaggtgtgcgcggggaaacaagaagggtggggct

SEQ ID NO: 102194 - DNA, 35 bp, Artificial Sequence
  Synthetic oligonucleotide
tccggtgggatggaaaggaaagaagggggagcaag

SEQ ID NO: 102195 - DNA, 35 bp, Artificial Sequence
  Synthetic oligonucleotide
gtgatgcggaaatgtgttcctatccactccaataa

SEQ ID NO: 102196 - DNA, 35 bp, Artificial Sequence
  Synthetic oligonucleotide
accgacagtgcgactccctatcacctaggttggta

SEQ ID NO: 102197 - DNA, 35 bp, Artificial Sequence
  Synthetic oligonucleotide
actgggcaggcccccgcttctcactttcattgctc

SEQ ID NO: 102198 - DNA, 38 bp, Artificial Sequence
  Synthetic oligonucleotide
gatcccgactactgaacgctgccacgaaagacacctga

SEQ ID NO: 102199 - DNA, 38 bp, Artificial Sequence
  Synthetic oligonucleotide
tgcgctcgggccctgccgtttattgcctaccatgttga

SEQ ID NO: 102200 - DNA, 35 bp, Artificial Sequence
  Synthetic oligonucleotide
gcagattccacctatgtccctccctggctattttg

SEQ ID NO: 102201 - DNA, 33 bp, Artificial Sequence
  Synthetic oligonucleotide
gacctacatgatcccgttacgactgcccaccac

SEQ ID NO: 102202 - DNA, 35 bp, Artificial Sequence
  Synthetic oligonucleotide
tccccgcccccaccccgcgtttccgtactatctgt

SEQ ID NO: 102203 - DNA, 35 bp, Artificial Sequence
  Synthetic oligonucleotide
gtggggcacgtcgctccaactagctctgggttaaa

SEQ ID NO: 102204 - DNA, 37 bp, Artificial Sequence
  Synthetic oligonucleotide
tttgcctcaacccaaataactacttccggcttgctga

SEQ ID NO: 102205 - DNA, 35 bp, Artificial Sequence
  Synthetic oligonucleotide
gccactttaccatgcccttgctacagccacgactc

SEQ ID NO: 102206 - DNA, 35 bp, Artificial Sequence
  Synthetic oligonucleotide
gaatagggccaaagtgtccgacgatggtcacagat

SEQ ID NO: 102207 - DNA, 35 bp, Artificial Sequence
  Synthetic oligonucleotide
atgaacccatcgccgctgcaggccctgcttactat

SEQ ID NO: 102208 - DNA, 35 bp, Artificial Sequence
  Synthetic oligonucleotide
tcacacatgcctcacctttgaaggattatcgattt

SEQ ID NO: 102209 - DNA, 36 bp, Artificial Sequence
  Synthetic oligonucleotide
tgcacggtaccattgcgccaagtcaccccgttcaaa

SEQ ID NO: 102210 - DNA, 36 bp, Artificial Sequence
  Synthetic oligonucleotide
accccgatgtatacgggtcccatttattatcacata

SEQ ID NO: 102211 - DNA, 36 bp, Artificial Sequence
  Synthetic oligonucleotide
tatgcggcctctgcaccttctagttctgggtcccca

SEQ ID NO: 102212 - DNA, 37 bp, Artificial Sequence
  Synthetic oligonucleotide
atgaggcggactgaggactacaaaaggcgattgggga

SEQ ID NO: 102213 - DNA, 37 bp, Artificial Sequence
  Synthetic oligonucleotide
gagcacaaaggggggggggagacgtcgaattggctga

SEQ ID NO: 102214 - DNA, 35 bp, Artificial Sequence
  Synthetic oligonucleotide
atgaacccatcgccgctgcaggccctgattcctat

SEQ ID NO: 102215 - DNA, 37 bp, Artificial Sequence
  Synthetic oligonucleotide
acctgtccactgcccacctatgtcgtttaacatgtga

SEQ ID NO: 102216 - DNA, 36 bp, Artificial Sequence
  Synthetic oligonucleotide
tacgcaacctcctgcattccttctaccctgtggtga

SEQ ID NO: 102217 - DNA, 35 bp, Artificial Sequence
  Synthetic oligonucleotide
tcctccgcccctctacttatttcacgctagaagta

SEQ ID NO: 102218 - DNA, 37 bp, Artificial Sequence
  Synthetic oligonucleotide
atatgcgcaacgcaccactgcctaattgttcttccga

SEQ ID NO: 102219 - DNA, 35 bp, Artificial Sequence
  Synthetic oligonucleotide
ttcgctactacatctgatgcaagccccctgttaac

SEQ ID NO: 102220 - DNA, 35 bp, Artificial Sequence
  Synthetic oligonucleotide
tgtgccaacatacgcacccctctatttgaggggac

SEQ ID NO: 102221 - DNA, 38 bp, Artificial Sequence
  Synthetic oligonucleotide
gagtacacggtacgaactgagtaacagagtaagtatga

SEQ ID NO: 102222 - DNA, 35 bp, Artificial Sequence
  Synthetic oligonucleotide
ttccgcccccatgccaacatcggtcagtcacttgc

SEQ ID NO: 102223 - DNA, 35 bp, Artificial Sequence
  Synthetic oligonucleotide
tacgacacctgccgccgagaatataacgaaaccag

SEQ ID NO: 102224 - DNA, 35 bp, Artificial Sequence
  Synthetic oligonucleotide
acccacgtcatgggcgttgtggtttcgtcctttct

SEQ ID NO: 102225 - DNA, 37 bp, Artificial Sequence
  Synthetic oligonucleotide
tcctccttgcctcatttgacgttaacgcgcatttcga

SEQ ID NO: 102226 - DNA, 37 bp, Artificial Sequence
  Synthetic oligonucleotide
atggactgcagggtctcatggatttatcaggaacgga

SEQ ID NO: 102227 - DNA, 37 bp, Artificial Sequence
  Synthetic oligonucleotide
gagcacaaggacgggagggttgcaaatacgaatgtga

SEQ ID NO: 102228 - DNA, 35 bp, Artificial Sequence
  Synthetic oligonucleotide
atatgcgcatgccacactgccctgcttttgtcccg

SEQ ID NO: 102229 - DNA, 36 bp, Artificial Sequence
  Synthetic oligonucleotide
ggaatcccccgtccgcctctgtcccgccagcctaaa

SEQ ID NO: 102230 - DNA, 38 bp, Artificial Sequence
  Synthetic oligonucleotide
aagcaggacggggcagatctggactagtcaactgttga

SEQ ID NO: 102231 - DNA, 35 bp, Artificial Sequence
  Synthetic oligonucleotide
atcctcgcaaagtgtcccctctagatgttctacaa

SEQ ID NO: 102232 - DNA, 35 bp, Artificial Sequence
  Synthetic oligonucleotide
gcatgcagtaggagtctcacagtttaaatcgatcc

SEQ ID NO: 102233 - DNA, 35 bp, Artificial Sequence
  Synthetic oligonucleotide
atgacagggaggacggggtaataccggaatagggc

SEQ ID NO: 102234 - DNA, 35 bp, Artificial Sequence
  Synthetic oligonucleotide
ggtgcgatggctacattcccgtactctgcatttat

SEQ ID NO: 102235 - DNA, 36 bp, Artificial Sequence
  Synthetic oligonucleotide
gactcgaccgaaggttgtactatcacctcgctttca

SEQ ID NO: 102236 - DNA, 36 bp, Artificial Sequence
  Synthetic oligonucleotide
aatcacccctggccttgtgcatccgagtcaactgcc

SEQ ID NO: 102237 - DNA, 36 bp, Artificial Sequence
  Synthetic oligonucleotide
tgcacgtagcctcgaccagccggcctaccttcttaa

SEQ ID NO: 102238 - DNA, 35 bp, Artificial Sequence
  Synthetic oligonucleotide
tacgccctttcacttgaagccgtttgaactcccca

SEQ ID NO: 102239 - DNA, 35 bp, Artificial Sequence
  Synthetic oligonucleotide
gtgcgcaaaggggtggagagagaggttaagggtat

SEQ ID NO: 102240 - DNA, 35 bp, Artificial Sequence
  Synthetic oligonucleotide
ttattactgccgggcggactaatgcactgtacctt

SEQ ID NO: 102241 - DNA, 35 bp, Artificial Sequence
  Synthetic oligonucleotide
gacacggaccctatcgcactcagtcctttaccgcc

SEQ ID NO: 102242 - DNA, 37 bp, Artificial Sequence
  Synthetic oligonucleotide
tcacacaccaggcttcgaagagtggagggaatattga

SEQ ID NO: 102243 - DNA, 35 bp, Artificial Sequence
  Synthetic oligonucleotide
gccttcaccgttagcctcttgaaccaatcctgtag

SEQ ID NO: 102244 - DNA, 35 bp, Artificial Sequence
  Synthetic oligonucleotide
gtcctcacccgatgtccacccaagacgccgccctt

SEQ ID NO: 102245 - DNA, 37 bp, Artificial Sequence
  Synthetic oligonucleotide
tcagtaacccagggtggggggaaaacaagggggtaga

SEQ ID NO: 102246 - DNA, 37 bp, Artificial Sequence
  Synthetic oligonucleotide
gatccgccccatagatcgttcgacggtatcccgtcga

SEQ ID NO: 102247 - DNA, 35 bp, Artificial Sequence
  Synthetic oligonucleotide
agccactcgccctaacgtttacacgcaacccatct

SEQ ID NO: 102248 - DNA, 36 bp, Artificial Sequence
  Synthetic oligonucleotide
tcagcaacagccctccgtcactcggctccttacgca

SEQ ID NO: 102249 - DNA, 35 bp, Artificial Sequence
  Synthetic oligonucleotide
tgcctggttcggatcctatcaacgcccacatgctt

SEQ ID NO: 102250 - DNA, 35 bp, Artificial Sequence
  Synthetic oligonucleotide
gaacatgctcccgatttgaccaatacgccttccca

SEQ ID NO: 102251 - DNA, 35 bp, Artificial Sequence
  Synthetic oligonucleotide
gttgatgcagatcttaccacttttttctactcacg

SEQ ID NO: 102252 - DNA, 36 bp, Artificial Sequence
  Synthetic oligonucleotide
atggaccgctcacccccgctctctccgtcgaaaata

SEQ ID NO: 102253 - DNA, 35 bp, Artificial Sequence
  Synthetic oligonucleotide
ggaaaccaagccctttatatgttgtaggcgcctcc

SEQ ID NO: 102254 - DNA, 35 bp, Artificial Sequence
  Synthetic oligonucleotide
gccactttcccatgcacttgctacagccacgactc

SEQ ID NO: 102255 - DNA, 35 bp, Artificial Sequence
  Synthetic oligonucleotide
aacccaggtcgactgcgacacccaacagccttgtc

SEQ ID NO: 102256 - DNA, 35 bp, Artificial Sequence
  Synthetic oligonucleotide
actgaactgcccgcattcggcctgacgggtacatc

SEQ ID NO: 102257 - DNA, 35 bp, Artificial Sequence
  Synthetic oligonucleotide
agtgctgcacaggagggatgagacgctgatgcaaa

SEQ ID NO: 102258 - DNA, 35 bp, Artificial Sequence
  Synthetic oligonucleotide
atgcctctgcgaacctcccttgccggcccctccaa

SEQ ID NO: 102259 - DNA, 37 bp, Artificial Sequence
  Synthetic oligonucleotide
acacgaagagatagtggttaaagacatcgcaacacga

SEQ ID NO: 102260 - DNA, 37 bp, Artificial Sequence
  Synthetic oligonucleotide
acccgctctcccgttcgctattcacgcagtgctttga

SEQ ID NO: 102261 - DNA, 35 bp, Artificial Sequence
  Synthetic oligonucleotide
atcacccatcagtggtccagaactgggcttaaata

SEQ ID NO: 102262 - DNA, 35 bp, Artificial Sequence
  Synthetic oligonucleotide
gatctgcacatgagggccttcccacttacccagac

SEQ ID NO: 102263 - DNA, 35 bp, Artificial Sequence
  Synthetic oligonucleotide
aactgcactccggaaaacgaggtgatacgtgtccc

SEQ ID NO: 102264 - DNA, 35 bp, Artificial Sequence
  Synthetic oligonucleotide
gccactttccaatgcccttgctacagccacgactc

SEQ ID NO: 102265 - DNA, 36 bp, Artificial Sequence
  Synthetic oligonucleotide
gtgcaatcccggctgcctcacctgatcccgattcca

SEQ ID NO: 102266 - DNA, 36 bp, Artificial Sequence
  Synthetic oligonucleotide
tacacgcacgactccacactcataaacgatggtgca

SEQ ID NO: 102267 - DNA, 35 bp, Artificial Sequence
  Synthetic oligonucleotide
gatccggggaggggtttcggtgagcactaaataga

SEQ ID NO: 102268 - DNA, 36 bp, Artificial Sequence
  Synthetic oligonucleotide
gacaggaacggtgatcgaccaacgtccatttaacaa

SEQ ID NO: 102269 - DNA, 36 bp, Artificial Sequence
  Synthetic oligonucleotide
tacactccactcagtaggccctcgcttgatttagca

SEQ ID NO: 102270 - DNA, 35 bp, Artificial Sequence
  Synthetic oligonucleotide
ggagagggagagggaaaggaagctcgaggagcgga

SEQ ID NO: 102271 - DNA, 35 bp, Artificial Sequence
  Synthetic oligonucleotide
gccactttcccatgcccttgctaaagccacgactc

SEQ ID NO: 102272 - DNA, 35 bp, Artificial Sequence
  Synthetic oligonucleotide
tgtgtgcctctttcggttgtctatccacatctctt

SEQ ID NO: 102273 - DNA, 35 bp, Artificial Sequence
  Synthetic oligonucleotide
atgaacccatcgccgctgcaggccctgcttcatat

SEQ ID NO: 102274 - DNA, 36 bp, Artificial Sequence
  Synthetic oligonucleotide
atgatcggccctgactacttgcgcctcgtccactta

SEQ ID NO: 102275 - DNA, 35 bp, Artificial Sequence
  Synthetic oligonucleotide
gccactttcccatgaccttgctacagccacgactc

SEQ ID NO: 102276 - DNA, 35 bp, Artificial Sequence
  Synthetic oligonucleotide
gacattgcccaagctttccgacccctgagccatag

SEQ ID NO: 102277 - DNA, 35 bp, Artificial Sequence
  Synthetic oligonucleotide
gcccaagcgaggattccgaccttccttccatccaa

SEQ ID NO: 102278 - DNA, 35 bp, Artificial Sequence
  Synthetic oligonucleotide
tgggaccgatgctcgattgggctaaacatcactaa

SEQ ID NO: 102279 - DNA, 35 bp, Artificial Sequence
  Synthetic oligonucleotide
ggatcgcttagcgttcctcctgcaccatcgctcca

SEQ ID NO: 102280 - DNA, 38 bp, Artificial Sequence
  Synthetic oligonucleotide
gttaaacgactagggcaaataaggtggagtataggtga

SEQ ID NO: 102281 - DNA, 37 bp, Artificial Sequence
  Synthetic oligonucleotide
gcaccgaaccaagttacccctctcccagagcgttcga

SEQ ID NO: 102282 - DNA, 35 bp, Artificial Sequence
  Synthetic oligonucleotide
agttcggggggaaagtctccggagatgggactgaa

SEQ ID NO: 102283 - DNA, 38 bp, Artificial Sequence
  Synthetic oligonucleotide
agcaaccgacaaacggcaaaacatgagggggtaactga

SEQ ID NO: 102284 - DNA, 38 bp, Artificial Sequence
  Synthetic oligonucleotide
tgccactcactggatgttggcctggtttgggctcctga

SEQ ID NO: 102285 - DNA, 35 bp, Artificial Sequence
  Synthetic oligonucleotide
ataaccaaccatgccttgctcttggcaccctcgac

SEQ ID NO: 102286 - DNA, 35 bp, Artificial Sequence
  Synthetic oligonucleotide
aaccagcacgctgcagtgttaaccgcttgcttctc

SEQ ID NO: 102287 - DNA, 36 bp, Artificial Sequence
  Synthetic oligonucleotide
gatgctatcgtccgcgtgtacctgcccataatctca

SEQ ID NO: 102288 - DNA, 36 bp, Artificial Sequence
  Synthetic oligonucleotide
gagaaagggaatgggactgcgcgggaaaggggggga

SEQ ID NO: 102289 - DNA, 35 bp, Artificial Sequence
  Synthetic oligonucleotide
tgtacccactgtggccactaatcgcaccggttgac

SEQ ID NO: 102290 - DNA, 35 bp, Artificial Sequence
  Synthetic oligonucleotide
acccacgccaaaacctgaaaactcgcacctgcacc

SEQ ID NO: 102291 - DNA, 35 bp, Artificial Sequence
  Synthetic oligonucleotide
tccttcaccgttagcctcttgaaccaatcctgtcg

SEQ ID NO: 102292 - DNA, 36 bp, Artificial Sequence
  Synthetic oligonucleotide
tcagacacaggaagtatggcgttgtggcatggacca

SEQ ID NO: 102293 - DNA, 36 bp, Artificial Sequence
  Synthetic oligonucleotide
tcaaacagggccagagtagtaggtgtctgcaattca

SEQ ID NO: 102294 - DNA, 37 bp, Artificial Sequence
  Synthetic oligonucleotide
tccaccccagcctgcccctcgaagacacgaacctgga

SEQ ID NO: 102295 - DNA, 37 bp, Artificial Sequence
  Synthetic oligonucleotide
ggaactaaggtcgtgccgggaggaatgaggaagctga

SEQ ID NO: 102296 - DNA, 35 bp, Artificial Sequence
  Synthetic oligonucleotide
gtgacggtactgggggctataaggtggtacgcacg

SEQ ID NO: 102297 - DNA, 36 bp, Artificial Sequence
  Synthetic oligonucleotide
gtgacgcgctgtattgcacgggagcacttagtccca

SEQ ID NO: 102298 - DNA, 35 bp, Artificial Sequence
  Synthetic oligonucleotide
gttgacgttgagaatctgtatctttggggttagca

SEQ ID NO: 102299 - DNA, 33 bp, Artificial Sequence
  Synthetic oligonucleotide
tttcaatcacgtacctgtgcaaacccacaattc

SEQ ID NO: 102300 - DNA, 36 bp, Artificial Sequence
  Synthetic oligonucleotide
ggagagcataaggtcgggggggagattggttactaa

SEQ ID NO: 102301 - DNA, 35 bp, Artificial Sequence
  Synthetic oligonucleotide
acgagtcaagggagaagcatgaaggtgtgagttaa

SEQ ID NO: 102302 - DNA, 35 bp, Artificial Sequence
  Synthetic oligonucleotide
tgtgtcccagtgacttacaggcttcttatccccca

SEQ ID NO: 102303 - DNA, 36 bp, Artificial Sequence
  Synthetic oligonucleotide
ttgccaccgactcaccgagtaggccattcatcacta

SEQ ID NO: 102304 - DNA, 35 bp, Artificial Sequence
  Synthetic oligonucleotide
gacctagaacaaaactgcatgagcctcacccgctc

SEQ ID NO: 102305 - DNA, 35 bp, Artificial Sequence
  Synthetic oligonucleotide
tgccacccacaacgagcaggttccgtctttctccg

SEQ ID NO: 102306 - DNA, 35 bp, Artificial Sequence
  Synthetic oligonucleotide
gacgcactgcggttctgcctgcggaaactagatcg

SEQ ID NO: 102307 - DNA, 35 bp, Artificial Sequence
  Synthetic oligonucleotide
tggtcaccacacatcctttgatctagccgcaccct

SEQ ID NO: 102308 - DNA, 35 bp, Artificial Sequence
  Synthetic oligonucleotide
tgtgccgccagcccgtaatagcgattaccactgct

SEQ ID NO: 102309 - DNA, 36 bp, Artificial Sequence
  Synthetic oligonucleotide
acacccatatccccccctatactgaagagacacgaa

SEQ ID NO: 102310 - DNA, 36 bp, Artificial Sequence
  Synthetic oligonucleotide
tcgcactcgactctctgcgcaatacctgctccttca

SEQ ID NO: 102311 - DNA, 35 bp, Artificial Sequence
  Synthetic oligonucleotide
ttatcgcccgggccccaccctgatcgctaccaaag

SEQ ID NO: 102312 - DNA, 36 bp, Artificial Sequence
  Synthetic oligonucleotide
tagcccccgaatagtactgcacgaaaaggtaccaca

SEQ ID NO: 102313 - DNA, 35 bp, Artificial Sequence
  Synthetic oligonucleotide
atgcctccgcccactgaggacaaatgatcctcgca

SEQ ID NO: 102314 - DNA, 37 bp, Artificial Sequence
  Synthetic oligonucleotide
gtcaaggagtgctgctcagatccagtaggatatcaga

SEQ ID NO: 102315 - DNA, 35 bp, Artificial Sequence
  Synthetic oligonucleotide
atccttatacccagtccagtgctgccccatccctg

SEQ ID NO: 102316 - DNA, 35 bp, Artificial Sequence
  Synthetic oligonucleotide
gcgacaacaagaaatggaagcatgaagatagaatt

SEQ ID NO: 102317 - DNA, 36 bp, Artificial Sequence
  Synthetic oligonucleotide
gtcacccggaattccttcggttctcctactacccca

SEQ ID NO: 102318 - DNA, 35 bp, Artificial Sequence
  Synthetic oligonucleotide
tgtagacagcacgcatacgtcacatcccactgcca

SEQ ID NO: 102319 - DNA, 35 bp, Artificial Sequence
  Synthetic oligonucleotide
ataatgaccgtcacatgcaccacacgccatcatca

SEQ ID NO: 102320 - DNA, 37 bp, Artificial Sequence
  Synthetic oligonucleotide
gtgatgagggagaagataattttggggagggcgggga

SEQ ID NO: 102321 - DNA, 36 bp, Artificial Sequence
  Synthetic oligonucleotide
gtcacccctgtctctctgttctgctacatattctga

SEQ ID NO: 102322 - DNA, 35 bp, Artificial Sequence
  Synthetic oligonucleotide
gacacggccactttttaccctagcgcggagcctgc

SEQ ID NO: 102323 - DNA, 36 bp, Artificial Sequence
  Synthetic oligonucleotide
tagcaggcctagtgaaggtaaataaggtgtggtgaa

SEQ ID NO: 102324 - DNA, 37 bp, Artificial Sequence
  Synthetic oligonucleotide
gagaaagcgcacaagggaggaaatggaaggcgacaga

SEQ ID NO: 102325 - DNA, 36 bp, Artificial Sequence
  Synthetic oligonucleotide
gtcgtggggttcggggagatagctggttgagtggga

SEQ ID NO: 102326 - DNA, 38 bp, Artificial Sequence
  Synthetic oligonucleotide
gtcacccgaggattcctccacccgcttttgaagtgtga

SEQ ID NO: 102327 - DNA, 34 bp, Artificial Sequence
  Synthetic oligonucleotide
acgtgtcagtagccacgtctccgcccatccgccc

SEQ ID NO: 102328 - DNA, 38 bp, Artificial Sequence
  Synthetic oligonucleotide
accatgtccccagccaccaccgtcccacccgaccgtga

SEQ ID NO: 102329 - DNA, 36 bp, Artificial Sequence
  Synthetic oligonucleotide
atccgccccatcccaacagcagtagatttactcaga

SEQ ID NO: 102330 - DNA, 37 bp, Artificial Sequence
  Synthetic oligonucleotide
gcacagcctctttatcagggtgcctattttcctctga

SEQ ID NO: 102331 - DNA, 38 bp, Artificial Sequence
  Synthetic oligonucleotide
gcatacggcagatcgatcgccctgacttgaaaccttga

SEQ ID NO: 102332 - DNA, 35 bp, Artificial Sequence
  Synthetic oligonucleotide
atgtcacgacgtcaataggtgctgtctaccctctc

SEQ ID NO: 102333 - DNA, 35 bp, Artificial Sequence
  Synthetic oligonucleotide
tgaccctttgctacatactccacaatctcgttcag

SEQ ID NO: 102334 - DNA, 35 bp, Artificial Sequence
  Synthetic oligonucleotide
ttcggacgtgaaccaccgcaatccgtatttctgtc

SEQ ID NO: 102335 - DNA, 36 bp, Artificial Sequence
  Synthetic oligonucleotide
actgggggaggggaggcattgggtatggcacatctg

SEQ ID NO: 102336 - DNA, 34 bp, Artificial Sequence
  Synthetic oligonucleotide
gtcccatagcgctcttcctctagtggcaacattt

SEQ ID NO: 102337 - DNA, 35 bp, Artificial Sequence
  Synthetic oligonucleotide
ttcggtcggggggtgaagtggagggggtaagggga

SEQ ID NO: 102338 - DNA, 36 bp, Artificial Sequence
  Synthetic oligonucleotide
atgatgagcccgggatctcagcatcgaattgtaata

SEQ ID NO: 102339 - DNA, 35 bp, Artificial Sequence
  Synthetic oligonucleotide
acgacaagccttccgctgttcgtgtggcgcccctc

SEQ ID NO: 102340 - DNA, 35 bp, Artificial Sequence
  Synthetic oligonucleotide
tggacaccgtgcatcactctttatttggttaccca

SEQ ID NO: 102341 - DNA, 36 bp, Artificial Sequence
  Synthetic oligonucleotide
tgatcctcccctgacttagcttaagtactcccggaa

SEQ ID NO: 102342 - DNA, 36 bp, Artificial Sequence
  Synthetic oligonucleotide
atgtgctcgcccagtttttgcctttattttgacgca

SEQ ID NO: 102343 - DNA, 37 bp, Artificial Sequence
  Synthetic oligonucleotide
tgaacgctacctcgatctatctttgccgttctgcgga

SEQ ID NO: 102344 - DNA, 38 bp, Artificial Sequence
  Synthetic oligonucleotide
acagccctcggtaggtttcgggtcctgcaagaccatga

SEQ ID NO: 102345 - DNA, 36 bp, Artificial Sequence
  Synthetic oligonucleotide
gcacctacttccgcttgccctacgataagagcgata

SEQ ID NO: 102346 - DNA, 35 bp, Artificial Sequence
  Synthetic oligonucleotide
taatacgcatccgttgcattgcccacactactcat

SEQ ID NO: 102347 - DNA, 35 bp, Artificial Sequence
  Synthetic oligonucleotide
acacccaggactgcactccacctccgctagttgtt

SEQ ID NO: 102348 - DNA, 35 bp, Artificial Sequence
  Synthetic oligonucleotide
ttcgggggcgggcgaaaatcaggggggggtctcaa

SEQ ID NO: 102349 - DNA, 36 bp, Artificial Sequence
  Synthetic oligonucleotide
acgacttcagccgccgcaaccagaatggctcatgaa

SEQ ID NO: 102350 - DNA, 37 bp, Artificial Sequence
  Synthetic oligonucleotide
acgatgacgaggaggcatagattttgtgtgctataga

SEQ ID NO: 102351 - DNA, 37 bp, Artificial Sequence
  Synthetic oligonucleotide
gcttccacgcacgacctgcatcctctaacgctttaga

SEQ ID NO: 102352 - DNA, 36 bp, Artificial Sequence
  Synthetic oligonucleotide
ttcgacagagggcgagctgccaagtcaagaccttga

SEQ ID NO: 102353 - DNA, 36 bp, Artificial Sequence
  Synthetic oligonucleotide
ttgcccgacctaatcgcctcctgtatcccggttacg

SEQ ID NO: 102354 - DNA, 35 bp, Artificial Sequence
  Synthetic oligonucleotide
gagaagtggaggtcacaagtgggagggccggataa

SEQ ID NO: 102355 - DNA, 35 bp, Artificial Sequence
  Synthetic oligonucleotide
ttgtatgcgcacgttcccacgctttcctcttgtca

SEQ ID NO: 102356 - DNA, 37 bp, Artificial Sequence
  Synthetic oligonucleotide
gctaccacccgcgcctgcctcgtcgcaaagttccgga

SEQ ID NO: 102357 - DNA, 38 bp, Artificial Sequence
  Synthetic oligonucleotide
acagtccggtgcaccgtgatgcgtgcgcagaactctga

SEQ ID NO: 102358 - DNA, 35 bp, Artificial Sequence
  Synthetic oligonucleotide
acacgcacgagaacggtgcgttatggtatgatcct

SEQ ID NO: 102359 - DNA, 37 bp, Artificial Sequence
  Synthetic oligonucleotide
gctccccgccatccttctttgcaccctagacagacga

SEQ ID NO: 102360 - DNA, 35 bp, Artificial Sequence
  Synthetic oligonucleotide
taccatgcctcctaggtgtgctacaatttcccata

SEQ ID NO: 102361 - DNA, 35 bp, Artificial Sequence
  Synthetic oligonucleotide
gtcccatcacgcctgtagaaatctccgagagcacc

SEQ ID NO: 102362 - DNA, 35 bp, Artificial Sequence
  Synthetic oligonucleotide
accttgccccgacatccagatatttggttgcccct

SEQ ID NO: 102363 - DNA, 36 bp, Artificial Sequence
  Synthetic oligonucleotide
acaatgcgtccgctttgtcgcactcgcggatttcca

SEQ ID NO: 102364 - DNA, 35 bp, Artificial Sequence
  Synthetic oligonucleotide
tacggaccctctaatacatcatttattctccttcg

SEQ ID NO: 102365 - DNA, 36 bp, Artificial Sequence
  Synthetic oligonucleotide
aaggtggcctgtcacacctaaagtccacaatctcta

SEQ ID NO: 102366 - DNA, 35 bp, Artificial Sequence
  Synthetic oligonucleotide
aagggaggggcagaatgagggattccgcaaaggac

SEQ ID NO: 102367 - DNA, 35 bp, Artificial Sequence
  Synthetic oligonucleotide
actacttcctatccatgtgagtactatactcttcc

SEQ ID NO: 102368 - DNA, 35 bp, Artificial Sequence
  Synthetic oligonucleotide
acccacaactatcccgtaccgacccgcaaaagccg

SEQ ID NO: 102369 - DNA, 35 bp, Artificial Sequence
  Synthetic oligonucleotide
tgaccccgtacgccccctgtgcctttacatgcttt

SEQ ID NO: 102370 - DNA, 36 bp, Artificial Sequence
  Synthetic oligonucleotide
tactcctccgcacatgctgtccaactgtgcctctaa

SEQ ID NO: 102371 - DNA, 35 bp, Artificial Sequence
  Synthetic oligonucleotide
agtaaggggtagggtgggctagggggtaggagtaa

SEQ ID NO: 102372 - DNA, 38 bp, Artificial Sequence
  Synthetic oligonucleotide
gttgcacgtgattttccgtttgcggaatgcttttttga

SEQ ID NO: 102373 - DNA, 36 bp, Artificial Sequence
  Synthetic oligonucleotide
gcgatcactgctcgcaaaaccccgcggtgacctcca

SEQ ID NO: 102374 - DNA, 36 bp, Artificial Sequence
  Synthetic oligonucleotide
tcccggcccacacctgcgactgttttcgttccatca

SEQ ID NO: 102375 - DNA, 35 bp, Artificial Sequence
  Synthetic oligonucleotide
ttccccaacatgcctgcaatcctactctctgtacg

SEQ ID NO: 102376 - DNA, 36 bp, Artificial Sequence
  Synthetic oligonucleotide
gttctcttccatcccgtgctaatccaatgtcctcga

SEQ ID NO: 102377 - DNA, 37 bp, Artificial Sequence
  Synthetic oligonucleotide
ggacacctcccgacctatccgtcggctataacgccga

SEQ ID NO: 102378 - DNA, 35 bp, Artificial Sequence
  Synthetic oligonucleotide
attgaaaaccgttcccccgtccgtgcctatcaccc

SEQ ID NO: 102379 - DNA, 35 bp, Artificial Sequence
  Synthetic oligonucleotide
tgcgacttgccccgtggtctctaacataatgggtc

SEQ ID NO: 102380 - DNA, 36 bp, Artificial Sequence
  Synthetic oligonucleotide
atcccccacgcccttgcccgctacctgcctcaattg

SEQ ID NO: 102381 - DNA, 36 bp, Artificial Sequence
  Synthetic oligonucleotide
tcgccccctcttccgtactagatagcctcaccgata

SEQ ID NO: 102382 - DNA, 35 bp, Artificial Sequence
  Synthetic oligonucleotide
acaccactccgctcattgtcgaatgttcgttccta

SEQ ID NO: 102383 - DNA, 35 bp, Artificial Sequence
  Synthetic oligonucleotide
tgtcccaccggttctgaatacgccgcaaccttgcc

SEQ ID NO: 102384 - DNA, 35 bp, Artificial Sequence
  Synthetic oligonucleotide
ggggcccactcgacgccgaccgctccttttaatct

SEQ ID NO: 102385 - DNA, 35 bp, Artificial Sequence
  Synthetic oligonucleotide
acgttggcctccccttggcgtgacgtacatccaca

SEQ ID NO: 102386 - DNA, 35 bp, Artificial Sequence
  Synthetic oligonucleotide
tacatggccggttcatccctgttcgtggtttcgac

SEQ ID NO: 102387 - DNA, 35 bp, Artificial Sequence
  Synthetic oligonucleotide
attgaaaccagcggatctctgcctccgagtcccat

SEQ ID NO: 102388 - DNA, 36 bp, Artificial Sequence
  Synthetic oligonucleotide
atgtgccaagtactggaggggagaggttttggctca

SEQ ID NO: 102389 - DNA, 37 bp, Artificial Sequence
  Synthetic oligonucleotide
agccccatcccgccaaattcagactccgagccagtga

SEQ ID NO: 102390 - DNA, 37 bp, Artificial Sequence
  Synthetic oligonucleotide
aagggggtgtggagggaaagtagcgggaaagatcgga

SEQ ID NO: 102391 - DNA, 35 bp, Artificial Sequence
  Synthetic oligonucleotide
ttggccgatccaccgtccggcacctaaccctcaca

SEQ ID NO: 102392 - DNA, 36 bp, Artificial Sequence
  Synthetic oligonucleotide
attagcacatgcctgaccgcacgcacctaggtgcca

SEQ ID NO: 102393 - DNA, 36 bp, Artificial Sequence
  Synthetic oligonucleotide
acccacaggtgtagtcacctaagaccttttttcgta

SEQ ID NO: 102394 - DNA, 37 bp, Artificial Sequence
  Synthetic oligonucleotide
gccagtggtaggggtcgaagggggcgaatggtgggga

SEQ ID NO: 102395 - DNA, 37 bp, Artificial Sequence
  Synthetic oligonucleotide
agcacgatacaggatgggagttgagcgagcagggtga

SEQ ID NO: 102396 - DNA, 38 bp, Artificial Sequence
  Synthetic oligonucleotide
tgaatgccagcatacaattgctattcacctcatgttga

SEQ ID NO: 102397 - DNA, 38 bp, Artificial Sequence
  Synthetic oligonucleotide
ttacgcgccaataccccaccctacccgccatggtgtga

SEQ ID NO: 102398 - DNA, 36 bp, Artificial Sequence
  Synthetic oligonucleotide
acacatcccaatggtggatcgcaccatgccatcgta

SEQ ID NO: 102399 - DNA, 36 bp, Artificial Sequence
  Synthetic oligonucleotide
gagagcgcgaacaggtctgcaggggggcatttgtta

SEQ ID NO: 102400 - DNA, 36 bp, Artificial Sequence
  Synthetic oligonucleotide
tacgggcccaggaatacatgtaggtcgtgtagttta

SEQ ID NO: 102401 - DNA, 35 bp, Artificial Sequence
  Synthetic oligonucleotide
tattgccttcgctcgatccgccgttgtcgggtacg

SEQ ID NO: 102402 - DNA, 35 bp, Artificial Sequence
  Synthetic oligonucleotide
gtgagaggacatctggtcttcatacggtattacct

SEQ ID NO: 102403 - DNA, 35 bp, Artificial Sequence
  Synthetic oligonucleotide
ttgcgtgttgcttgggtcctatctgccgccttcct

SEQ ID NO: 102404 - DNA, 35 bp, Artificial Sequence
  Synthetic oligonucleotide
atcagtccgctcccacctgcacacaccatgatcta

SEQ ID NO: 102405 - DNA, 37 bp, Artificial Sequence
  Synthetic oligonucleotide
gctgaaggtgatagggacgatggaacggcaagagaga

SEQ ID NO: 102406 - DNA, 38 bp, Artificial Sequence
  Synthetic oligonucleotide
gttgtgcctcccatcgttgagtatgccctcccggttga

SEQ ID NO: 102407 - DNA, 36 bp, Artificial Sequence
  Synthetic oligonucleotide
tacaacacgggcaagaggccagggtggtttgctcta

SEQ ID NO: 102408 - DNA, 35 bp, Artificial Sequence
  Synthetic oligonucleotide
acccaggcgggaacagcgctaccttcagccaccct

SEQ ID NO: 102409 - DNA, 37 bp, Artificial Sequence
  Synthetic oligonucleotide
tcagtgcaagggtgggcctggtgctattaatgttgga

SEQ ID NO: 102410 - DNA, 35 bp, Artificial Sequence
  Synthetic oligonucleotide
atgaccccatccttaccgtgaactcgtatccctta

SEQ ID NO: 102411 - DNA, 35 bp, Artificial Sequence
  Synthetic oligonucleotide
tctcacttcccgccttctcttccgcggtcatcgcc

SEQ ID NO: 102412 - DNA, 35 bp, Artificial Sequence
  Synthetic oligonucleotide
tcacgggctgcacctccgctttctgtaattaggcg

SEQ ID NO: 102413 - DNA, 35 bp, Artificial Sequence
  Synthetic oligonucleotide
tagtccggacgaaacttctaatatccggagaccat

SEQ ID NO: 102414 - DNA, 35 bp, Artificial Sequence
  Synthetic oligonucleotide
attgacaccagcggatctctgcctccgagtcccct

SEQ ID NO: 102415 - DNA, 35 bp, Artificial Sequence
  Synthetic oligonucleotide
gctaatcaggcgccttttctatgtctcacccgctt

SEQ ID NO: 102416 - DNA, 36 bp, Artificial Sequence
  Synthetic oligonucleotide
gcctactgaccatctctacagtcgcccgactagcca

SEQ ID NO: 102417 - DNA, 36 bp, Artificial Sequence
  Synthetic oligonucleotide
taccgagtacggatgggggcaagggaaaactaggga

SEQ ID NO: 102418 - DNA, 36 bp, Artificial Sequence
  Synthetic oligonucleotide
tcattacagcccaaacacccgcacatccgactgcta

SEQ ID NO: 102419 - DNA, 36 bp, Artificial Sequence
  Synthetic oligonucleotide
gatgcatggccatggaggggaaaatgtctggtttaa

SEQ ID NO: 102420 - DNA, 35 bp, Artificial Sequence
  Synthetic oligonucleotide
gactcccgtcgcgctcaaaattatctcttactctg

SEQ ID NO: 102421 - DNA, 36 bp, Artificial Sequence
  Synthetic oligonucleotide
gagcgcatatcgctcccttggcacccagtgcaccca

SEQ ID NO: 102422 - DNA, 36 bp, Artificial Sequence
  Synthetic oligonucleotide
tccaacgtacatgaccagaagattgattctcgttgc

SEQ ID NO: 102423 - DNA, 35 bp, Artificial Sequence
  Synthetic oligonucleotide
atgcctctgcgaacctcccttgacggcccctccca

SEQ ID NO: 102424 - DNA, 36 bp, Artificial Sequence
  Synthetic oligonucleotide
gtgaaggagggaacggggaggtgaggtaagggggca

SEQ ID NO: 102425 - DNA, 38 bp, Artificial Sequence
  Synthetic oligonucleotide
gacgccccagcgttcgtttgacttacccctcgtcgtga

SEQ ID NO: 102426 - DNA, 36 bp, Artificial Sequence
  Synthetic oligonucleotide
agcacatcactctgccaccaaaccacggtttttata

SEQ ID NO: 102427 - DNA, 35 bp, Artificial Sequence
  Synthetic oligonucleotide
ttgcacttgcatgccacgtactcacctacgttaga

SEQ ID NO: 102428 - DNA, 35 bp, Artificial Sequence
  Synthetic oligonucleotide
ttacgtcgacaacgtcatcgactccccacgcccct

SEQ ID NO: 102429 - DNA, 36 bp, Artificial Sequence
  Synthetic oligonucleotide
aaccagtgcgattggcgatagaacggggtaagcgca

SEQ ID NO: 102430 - DNA, 37 bp, Artificial Sequence
  Synthetic oligonucleotide
gagatgctgacgggtggttgggttaggtggaggtcga

SEQ ID NO: 102431 - DNA, 35 bp, Artificial Sequence
  Synthetic oligonucleotide
gtgccaggtgacattgttcattgattttgacggat

SEQ ID NO: 102432 - DNA, 38 bp, Artificial Sequence
  Synthetic oligonucleotide
gttcaatcgtgccgcgaatttccgtcccctgccaatga

SEQ ID NO: 102433 - DNA, 37 bp, Artificial Sequence
  Synthetic oligonucleotide
ttcgcgcaacatatgccgttcatctccttctcgaaga

SEQ ID NO: 102434 - DNA, 35 bp, Artificial Sequence
  Synthetic oligonucleotide
tagccccagctcccccgcagtaagttgcgacccca

SEQ ID NO: 102435 - DNA, 36 bp, Artificial Sequence
  Synthetic oligonucleotide
gctgaggtccggcccctgtttttacatgcttacgta

SEQ ID NO: 102436 - DNA, 36 bp, Artificial Sequence
  Synthetic oligonucleotide
gagacataacagctgacttaagacccgccatttcca

SEQ ID NO: 102437 - DNA, 35 bp, Artificial Sequence
  Synthetic oligonucleotide
tatagcctgttgttccgtacgccgtcccgcccgcc

SEQ ID NO: 102438 - DNA, 35 bp, Artificial Sequence
  Synthetic oligonucleotide
ttgcactctgccaggaattcgcatactgttctcct

SEQ ID NO: 102439 - DNA, 35 bp, Artificial Sequence
  Synthetic oligonucleotide
atacctcacatgggccctatctctttagagaagct

SEQ ID NO: 102440 - DNA, 35 bp, Artificial Sequence
  Synthetic oligonucleotide
gtctgatcaagccctgccaactgactaggggtgcc

SEQ ID NO: 102441 - DNA, 35 bp, Artificial Sequence
  Synthetic oligonucleotide
aagacccgggctgattcctctcctactcactattg

SEQ ID NO: 102442 - DNA, 36 bp, Artificial Sequence
  Synthetic oligonucleotide
ttacaccaccatcacatcccgggtgcctttctctca

SEQ ID NO: 102443 - DNA, 38 bp, Artificial Sequence
  Synthetic oligonucleotide
tagacacgagggaggggatcgatctgatcggtgtggga

SEQ ID NO: 102444 - DNA, 36 bp, Artificial Sequence
  Synthetic oligonucleotide
gtgacgcaacagaaggtgggcatacccagaaagata

SEQ ID NO: 102445 - DNA, 35 bp, Artificial Sequence
  Synthetic oligonucleotide
tcacttactcgccttcctctgcacgggtttaaccc

SEQ ID NO: 102446 - DNA, 35 bp, Artificial Sequence
  Synthetic oligonucleotide
acccatcccccctctttgtgctgtgctctcgcgaa

SEQ ID NO: 102447 - DNA, 35 bp, Artificial Sequence
  Synthetic oligonucleotide
accccccggacgggttactggacgtactctgacca

SEQ ID NO: 102448 - DNA, 35 bp, Artificial Sequence
  Synthetic oligonucleotide
gcccaactagcaatatgcatctgtagccttttacc

SEQ ID NO: 102449 - DNA, 35 bp, Artificial Sequence
  Synthetic oligonucleotide
ttgctcgtgctctgcctgggtggccttcctctttc

SEQ ID NO: 102450 - DNA, 35 bp, Artificial Sequence
  Synthetic oligonucleotide
aacggtgctgctatcatatttctgtttcggtctat

SEQ ID NO: 102451 - DNA, 35 bp, Artificial Sequence
  Synthetic oligonucleotide
agccccgcaagccctcggtcctcgctgacccgtcc

SEQ ID NO: 102452 - DNA, 35 bp, Artificial Sequence
  Synthetic oligonucleotide
tgcaaggtctgcacactctgtctcattgttctgat

SEQ ID NO: 102453 - DNA, 38 bp, Artificial Sequence
  Synthetic oligonucleotide
tgatactggtggagagaagggtgagagagatgagatga

SEQ ID NO: 102454 - DNA, 38 bp, Artificial Sequence
  Synthetic oligonucleotide
gagaacagggtgaacttcgccgctcacactccgcttga

SEQ ID NO: 102455 - DNA, 36 bp, Artificial Sequence
  Synthetic oligonucleotide
gatccgcctcagaccccccgttaccagtgcaccata

SEQ ID NO: 102456 - DNA, 35 bp, Artificial Sequence
  Synthetic oligonucleotide
tgccggactcacacacacactcggtccatgaccta

SEQ ID NO: 102457 - DNA, 36 bp, Artificial Sequence
  Synthetic oligonucleotide
aatctgtcacgaagtccccaccaagccgatttacca

SEQ ID NO: 102458 - DNA, 35 bp, Artificial Sequence
  Synthetic oligonucleotide
tgacaccccgtttgccccatccgtgggtttcccta

SEQ ID NO: 102459 - DNA, 35 bp, Artificial Sequence
  Synthetic oligonucleotide
tgtgcacagtggtactggcgccgacttcttttctt

SEQ ID NO: 102460 - DNA, 37 bp, Artificial Sequence
  Synthetic oligonucleotide
tgattggagtgacgagtgtggggataagtggtgcaga

SEQ ID NO: 102461 - DNA, 35 bp, Artificial Sequence
  Synthetic oligonucleotide
gtacaccgacgttccacaacatacctccttgcgct

SEQ ID NO: 102462 - DNA, 36 bp, Artificial Sequence
  Synthetic oligonucleotide
atctcgcgccaacgtcatgcgttcgcctccctacca

SEQ ID NO: 102463 - DNA, 36 bp, Artificial Sequence
  Synthetic oligonucleotide
aacactcatctggtgctgcttcctaaacccgcgcca

SEQ ID NO: 102464 - DNA, 36 bp, Artificial Sequence
  Synthetic oligonucleotide
tgtgaaagctatgtcctaatctgagctccctacata

SEQ ID NO: 102465 - DNA, 35 bp, Artificial Sequence
  Synthetic oligonucleotide
acgcacgtgccacatctgaaccgcacacctacctc

SEQ ID NO: 102466 - DNA, 35 bp, Artificial Sequence
  Synthetic oligonucleotide
tccatcgcctcacaagtgcatctttgctaggctat

SEQ ID NO: 102467 - DNA, 36 bp, Artificial Sequence
  Synthetic oligonucleotide
gtacccacgccacgcatatctcgtttacacccccaa

SEQ ID NO: 102468 - DNA, 35 bp, Artificial Sequence
  Synthetic oligonucleotide
aacgacggttggaacgggtatcaccgtcggaacta

SEQ ID NO: 102469 - DNA, 35 bp, Artificial Sequence
  Synthetic oligonucleotide
tttagagttggtggaggtagtgtggtggtgatatg

SEQ ID NO: 102470 - DNA, 36 bp, Artificial Sequence
  Synthetic oligonucleotide
tcccgataccgaacatccttctccgctttgggacta

SEQ ID NO: 102471 - DNA, 36 bp, Artificial Sequence
  Synthetic oligonucleotide
atccccatccgtccctcagcatcatcttccggggca

SEQ ID NO: 102472 - DNA, 36 bp, Artificial Sequence
  Synthetic oligonucleotide
gcgcgggagcaagaaaggacggattagaagacacta

SEQ ID NO: 102473 - DNA, 35 bp, Artificial Sequence
  Synthetic oligonucleotide
accgtcctctagtacgcctcacacttacctaacag

SEQ ID NO: 102474 - DNA, 35 bp, Artificial Sequence
  Synthetic oligonucleotide
gacgccaacctcccatcatggttctccagtcgact

SEQ ID NO: 102475 - DNA, 37 bp, Artificial Sequence
  Synthetic oligonucleotide
ttggggctaggaagacaaaatggaggggaagatctga

SEQ ID NO: 102476 - DNA, 38 bp, Artificial Sequence
  Synthetic oligonucleotide
tcacacacgtatccatctccaagtctgcacttatttga

SEQ ID NO: 102477 - DNA, 36 bp, Artificial Sequence
  Synthetic oligonucleotide
ataccatggagggtgggtcaagtgtggggtggatta

SEQ ID NO: 102478 - DNA, 34 bp, Artificial Sequence
  Synthetic oligonucleotide
taccgcgacgctacaccgcccacgcacagtattt

SEQ ID NO: 102479 - DNA, 36 bp, Artificial Sequence
  Synthetic oligonucleotide
tccagtttggcagataggggtgagggaggagggcca

SEQ ID NO: 102480 - DNA, 37 bp, Artificial Sequence
  Synthetic oligonucleotide
atcccgtgaacgacggtgctgccctccccaagacgga

SEQ ID NO: 102481 - DNA, 35 bp, Artificial Sequence
  Synthetic oligonucleotide
gttgagctctgcccatattgacctagctgatactc

SEQ ID NO: 102482 - DNA, 35 bp, Artificial Sequence
  Synthetic oligonucleotide
tatacccgcctggccctgcgacccgcaacgcttct

SEQ ID NO: 102483 - DNA, 37 bp, Artificial Sequence
  Synthetic oligonucleotide
tcacgcctcttttcagctgtccctcactggccgagga

SEQ ID NO: 102484 - DNA, 35 bp, Artificial Sequence
  Synthetic oligonucleotide
gttgtccacgttgcccgtcccgaaccgttcgaacc

SEQ ID NO: 102485 - DNA, 35 bp, Artificial Sequence
  Synthetic oligonucleotide
gtgagatctcaatgccttttacgacctgcccctct

SEQ ID NO: 102486 - DNA, 35 bp, Artificial Sequence
  Synthetic oligonucleotide
gagtgggagccgaactttctctcttacccacttct

SEQ ID NO: 102487 - DNA, 36 bp, Artificial Sequence
  Synthetic oligonucleotide
gatgtcgcaaccgtgtttttgttctggggtatgtaa

SEQ ID NO: 102488 - DNA, 35 bp, Artificial Sequence
  Synthetic oligonucleotide
gaaggggcaaaggataagggggggaggacgggaca

SEQ ID NO: 102489 - DNA, 36 bp, Artificial Sequence
  Synthetic oligonucleotide
gacgaacgaagccttacgtagaaagtataccatata

SEQ ID NO: 102490 - DNA, 35 bp, Artificial Sequence
  Synthetic oligonucleotide
gccactttcccatgccattgctacagccacgactc

SEQ ID NO: 102491 - DNA, 38 bp, Artificial Sequence
  Synthetic oligonucleotide
gactgctgccggtattcctgtgccagtccggatattga

SEQ ID NO: 102492 - DNA, 36 bp, Artificial Sequence
  Synthetic oligonucleotide
gcttgcaaagcgctacaagtccttgttaatatttta

SEQ ID NO: 102493 - DNA, 35 bp, Artificial Sequence
  Synthetic oligonucleotide
actgtgacgctaccttatgcccgaccgccccatat

SEQ ID NO: 102494 - DNA, 35 bp, Artificial Sequence
  Synthetic oligonucleotide
tccccctaatctacggacttgcactcgctctacaa

SEQ ID NO: 102495 - DNA, 35 bp, Artificial Sequence
  Synthetic oligonucleotide
gactccttgctccattgggtatttcgctttcatca

SEQ ID NO: 102496 - DNA, 36 bp, Artificial Sequence
  Synthetic oligonucleotide
gcaatgaccggaggggtatggtagaatggataggga

SEQ ID NO: 102497 - DNA, 36 bp, Artificial Sequence
  Synthetic oligonucleotide
tccacaaacgagttattttcattccgcacccactga

SEQ ID NO: 102498 - DNA, 35 bp, Artificial Sequence
  Synthetic oligonucleotide
aacgcacacgtgaggggtttgcctgtgttacccac

SEQ ID NO: 102499 - DNA, 35 bp, Artificial Sequence
  Synthetic oligonucleotide
acctacgtatcagcctgaaccgccggccttgggac

SEQ ID NO: 102500 - DNA, 35 bp, Artificial Sequence
  Synthetic oligonucleotide
attgcacccttccatccaggcccacgatccgactc

SEQ ID NO: 102501 - DNA, 35 bp, Artificial Sequence
  Synthetic oligonucleotide
ggtcccagcccccattgaaatgtccaccttctgcg

SEQ ID NO: 102502 - DNA, 36 bp, Artificial Sequence
  Synthetic oligonucleotide
gagtacgaggcaagtcaattgcaaggttcgaagcta

SEQ ID NO: 102503 - DNA, 35 bp, Artificial Sequence
  Synthetic oligonucleotide
ttgtgggcatagcgtaagacttgtctgacactttc

SEQ ID NO: 102504 - DNA, 35 bp, Artificial Sequence
  Synthetic oligonucleotide
tagggagacagggttttagggcgcgggtgtgcaaa

SEQ ID NO: 102505 - DNA, 36 bp, Artificial Sequence
  Synthetic oligonucleotide
ggaccgatcgctccggcctccgactttaccacctga

SEQ ID NO: 102506 - DNA, 35 bp, Artificial Sequence
  Synthetic oligonucleotide
ttgtacgaccacaacccatgctacacctgcctaag

SEQ ID NO: 102507 - DNA, 35 bp, Artificial Sequence
  Synthetic oligonucleotide
gctgcccctcgcaaattcactgacccagtcaccat

SEQ ID NO: 102508 - DNA, 34 bp, Artificial Sequence
  Synthetic oligonucleotide
tacgctcccttgcactacgcatctccttggtcca

SEQ ID NO: 102509 - DNA, 37 bp, Artificial Sequence
  Synthetic oligonucleotide
tagagcaccgagccgtagcgccatttagtgattctga

SEQ ID NO: 102510 - DNA, 35 bp, Artificial Sequence
  Synthetic oligonucleotide
tcaccaccaagcattgttgccgtacggacatctct

SEQ ID NO: 102511 - DNA, 36 bp, Artificial Sequence
  Synthetic oligonucleotide
gattagcgtaacctgggaaaaaggaagaaaagtgta

SEQ ID NO: 102512 - DNA, 35 bp, Artificial Sequence
  Synthetic oligonucleotide
ttacacctgccccctccctgctccgtttcgggcac

SEQ ID NO: 102513 - DNA, 35 bp, Artificial Sequence
  Synthetic oligonucleotide
gtgttgatgttgtgggtgggaaggcgagaggtggt

SEQ ID NO: 102514 - DNA, 35 bp, Artificial Sequence
  Synthetic oligonucleotide
tcaagtgcgggccggtgacgggataatgcgatgag

SEQ ID NO: 102515 - DNA, 34 bp, Artificial Sequence
  Synthetic oligonucleotide
gctaagcaccattcgccgcctttattttcgaacg

SEQ ID NO: 102516 - DNA, 36 bp, Artificial Sequence
  Synthetic oligonucleotide
gccgagcaacctgtctgtctgcatttactaggaaca

SEQ ID NO: 102517 - DNA, 37 bp, Artificial Sequence
  Synthetic oligonucleotide
gggtaagagggggaggtaggtgcggggggacagaaga

SEQ ID NO: 102518 - DNA, 36 bp, Artificial Sequence
  Synthetic oligonucleotide
agcacacagtaatgaggagtagtacaactggggata

SEQ ID NO: 102519 - DNA, 35 bp, Artificial Sequence
  Synthetic oligonucleotide
gattagcacatcctgtctcattagtcgcacctaat

SEQ ID NO: 102520 - DNA, 36 bp, Artificial Sequence
  Synthetic oligonucleotide
gaccaacctcaacagaaactccccagtcccaggaca

SEQ ID NO: 102521 - DNA, 38 bp, Artificial Sequence
  Synthetic oligonucleotide
gggacgggggccggctttatgggggaggtgaagtgtga

SEQ ID NO: 102522 - DNA, 35 bp, Artificial Sequence
  Synthetic oligonucleotide
tccctggccgcactcctttgccgcactacattttg

SEQ ID NO: 102523 - DNA, 36 bp, Artificial Sequence
  Synthetic oligonucleotide
gctgcaacagagcactctgccgccgctttttacaaa

SEQ ID NO: 102524 - DNA, 37 bp, Artificial Sequence
  Synthetic oligonucleotide
acccatgtcccttgttccgctcctcggacatgtccga

SEQ ID NO: 102525 - DNA, 37 bp, Artificial Sequence
  Synthetic oligonucleotide
ggtcgggaggaagaggcacggggaatggagggccgga

SEQ ID NO: 102526 - DNA, 35 bp, Artificial Sequence
  Synthetic oligonucleotide
aagccagactcgtgaccgtgacaaacctgattcgc

SEQ ID NO: 102527 - DNA, 35 bp, Artificial Sequence
  Synthetic oligonucleotide
ttggacgtacaaacaggaaactgctctaggaccct

SEQ ID NO: 102528 - DNA, 35 bp, Artificial Sequence
  Synthetic oligonucleotide
gatccgaacctgtggtattttcagtcatttaccct

SEQ ID NO: 102529 - DNA, 35 bp, Artificial Sequence
  Synthetic oligonucleotide
tcaatccactgtttcttattgccgttcccgtgctt

SEQ ID NO: 102530 - DNA, 35 bp, Artificial Sequence
  Synthetic oligonucleotide
acagaaaggggggagcgagtaacataaaaaggtaa

SEQ ID NO: 102531 - DNA, 36 bp, Artificial Sequence
  Synthetic oligonucleotide
taagacgagagccaggctgtacacaccatccctaga

SEQ ID NO: 102532 - DNA, 38 bp, Artificial Sequence
  Synthetic oligonucleotide
acaccgtggcccctagattcgtacagcccaggctttga

SEQ ID NO: 102533 - DNA, 35 bp, Artificial Sequence
  Synthetic oligonucleotide
acgcaatcgcacgctccgcgattcccccatctaac

SEQ ID NO: 102534 - DNA, 35 bp, Artificial Sequence
  Synthetic oligonucleotide
gaacccctcagacctccacatatccacctaatggc

SEQ ID NO: 102535 - DNA, 36 bp, Artificial Sequence
  Synthetic oligonucleotide
tgtatcatctggggtttaatatccgtccgcacacaa

SEQ ID NO: 102536 - DNA, 36 bp, Artificial Sequence
  Synthetic oligonucleotide
tgtggaggtggacaacattaggaacgtgcacgggaa

SEQ ID NO: 102537 - DNA, 35 bp, Artificial Sequence
  Synthetic oligonucleotide
tcagacacgaggagcgcggtggctgaggtggatca

SEQ ID NO: 102538 - DNA, 36 bp, Artificial Sequence
  Synthetic oligonucleotide
gacgacagaccccactgttacttccgcctcatatca

SEQ ID NO: 102539 - DNA, 37 bp, Artificial Sequence
  Synthetic oligonucleotide
gtggcgcccaatgtgctagttcccttcccacatccga

SEQ ID NO: 102540 - DNA, 37 bp, Artificial Sequence
  Synthetic oligonucleotide
tgcctaccggaagacttcttttgtttacccccctcga

SEQ ID NO: 102541 - DNA, 35 bp, Artificial Sequence
  Synthetic oligonucleotide
actgagggtccgattttcccgccttctcatctata

SEQ ID NO: 102542 - DNA, 35 bp, Artificial Sequence
  Synthetic oligonucleotide
tcacaacaccgccctgcctaacttccccgaccccg

SEQ ID NO: 102543 - DNA, 35 bp, Artificial Sequence
  Synthetic oligonucleotide
acactgaccttagttttcgtgtactttacccacat

SEQ ID NO: 102544 - DNA, 35 bp, Artificial Sequence
  Synthetic oligonucleotide
aacaacctctcgttgttaaaacatctcctctccgt

SEQ ID NO: 102545 - DNA, 36 bp, Artificial Sequence
  Synthetic oligonucleotide
gcgcaacacttgagtctatgtaatgtctccctctca

SEQ ID NO: 102546 - DNA, 37 bp, Artificial Sequence
  Synthetic oligonucleotide
gatgcctactcagtagcatctcgcttctctgctacga

SEQ ID NO: 102547 - DNA, 38 bp, Artificial Sequence
  Synthetic oligonucleotide
tgacacgggaaagcagtggctgacaagtttcaatatga

SEQ ID NO: 102548 - DNA, 35 bp, Artificial Sequence
  Synthetic oligonucleotide
gccgaacacttgctgaatcctgtaactaaaacgta

SEQ ID NO: 102549 - DNA, 35 bp, Artificial Sequence
  Synthetic oligonucleotide
acccccgcaaacgcaacctcgcggtacctgcctac

SEQ ID NO: 102550 - DNA, 35 bp, Artificial Sequence
  Synthetic oligonucleotide
ggtgactccctcctttgttatacccatgctgcccc

SEQ ID NO: 102551 - DNA, 35 bp, Artificial Sequence
  Synthetic oligonucleotide
gttgggccccgctgctttctgttagctccatcccc

SEQ ID NO: 102552 - DNA, 35 bp, Artificial Sequence
  Synthetic oligonucleotide
gccgcaacgcctcttgttaggccaactcactgcaa

SEQ ID NO: 102553 - DNA, 35 bp, Artificial Sequence
  Synthetic oligonucleotide
atgtaacgcatctacctagtgatccattgtccaca

SEQ ID NO: 102554 - DNA, 36 bp, Artificial Sequence
  Synthetic oligonucleotide
tgagccctggaggtgctcggctatagatttcactca

SEQ ID NO: 102555 - DNA, 36 bp, Artificial Sequence
  Synthetic oligonucleotide
tgacactgactgggcctccacggcgatcttacctca

SEQ ID NO: 102556 - DNA, 38 bp, Artificial Sequence
  Synthetic oligonucleotide
gcacagtcgccactcagcttctgaacccgccacattga

SEQ ID NO: 102557 - DNA, 36 bp, Artificial Sequence
  Synthetic oligonucleotide
tgtgtcagccccgccacgaccggttactatggccta

SEQ ID NO: 102558 - DNA, 34 bp, Artificial Sequence
  Synthetic oligonucleotide
tgcacgggctaaaattaatattgtgaaccaaact

SEQ ID NO: 102559 - DNA, 36 bp, Artificial Sequence
  Synthetic oligonucleotide
tagttccaaacgttacgaccaccatcccggttcgca

SEQ ID NO: 102560 - DNA, 35 bp, Artificial Sequence
  Synthetic oligonucleotide
tatgcgcggaggctctggaattcattgacagggca

SEQ ID NO: 102561 - DNA, 37 bp, Artificial Sequence
  Synthetic oligonucleotide
tccaaggtggttacagcagagggagtaggattgtgga

SEQ ID NO: 102562 - DNA, 37 bp, Artificial Sequence
  Synthetic oligonucleotide
acacacccacaccatctctctcgcagtataagggcga

SEQ ID NO: 102563 - DNA, 37 bp, Artificial Sequence
  Synthetic oligonucleotide
cactccgacatcgcttcctacgcgtcacactaccgga

SEQ ID NO: 102564 - DNA, 35 bp, Artificial Sequence
  Synthetic oligonucleotide
acaaacgggtggcggataaacggagtgcaggtcta

SEQ ID NO: 102565 - DNA, 35 bp, Artificial Sequence
  Synthetic oligonucleotide
acttccttcgccatagcacgacagacctgttagtc

SEQ ID NO: 102566 - DNA, 35 bp, Artificial Sequence
  Synthetic oligonucleotide
ttggggaaggttgagggcttagggtctggacacgt

SEQ ID NO: 102567 - DNA, 35 bp, Artificial Sequence
  Synthetic oligonucleotide
agaacaggggcaggatcgtagaacgtggagggggt

SEQ ID NO: 102568 - DNA, 36 bp, Artificial Sequence
  Synthetic oligonucleotide
tcgctaatgcgcgctctctaacggttactgccagca

SEQ ID NO: 102569 - DNA, 35 bp, Artificial Sequence
  Synthetic oligonucleotide
gaaccaccccattttctaggaaatcccacggggcc

SEQ ID NO: 102570 - DNA, 35 bp, Artificial Sequence
  Synthetic oligonucleotide
gacatgaagggggtgcatccgggggagaggggagc

SEQ ID NO: 102571 - DNA, 35 bp, Artificial Sequence
  Synthetic oligonucleotide
tcacaacaccgcccttcctaacgtccccgaccccg

SEQ ID NO: 102572 - DNA, 35 bp, Artificial Sequence
  Synthetic oligonucleotide
gctattcctacactgggtccaggccataccaatcg

SEQ ID NO: 102573 - DNA, 36 bp, Artificial Sequence
  Synthetic oligonucleotide
gcctcactcccgctcggactcccagactcgacccca

SEQ ID NO: 102574 - DNA, 38 bp, Artificial Sequence
  Synthetic oligonucleotide
tgcaattccatcgcatgcgtcaccccgtctcctcctga

SEQ ID NO: 102575 - DNA, 35 bp, Artificial Sequence
  Synthetic oligonucleotide
gaacgcggccaaactgctctcatcatcgaagaacc

SEQ ID NO: 102576 - DNA, 35 bp, Artificial Sequence
  Synthetic oligonucleotide
tgtaggccgatatgatccgccatcaccccgccctg

SEQ ID NO: 102577 - DNA, 35 bp, Artificial Sequence
  Synthetic oligonucleotide
gtgggcctctctctgggcaactaccgatttaacct

SEQ ID NO: 102578 - DNA, 36 bp, Artificial Sequence
  Synthetic oligonucleotide
gattaaccctccaggcgccaaaagcacaccgtacca

SEQ ID NO: 102579 - DNA, 36 bp, Artificial Sequence
  Synthetic oligonucleotide
tgcacgcctatggagttagcttcctccctttcatca

SEQ ID NO: 102580 - DNA, 35 bp, Artificial Sequence
  Synthetic oligonucleotide
tgacttggtgagcccccacttcgacgtttcccatc

SEQ ID NO: 102581 - DNA, 36 bp, Artificial Sequence
  Synthetic oligonucleotide
tcgcacattcatcatctggtcctgctgcctccacaa

SEQ ID NO: 102582 - DNA, 36 bp, Artificial Sequence
  Synthetic oligonucleotide
acgatcctcacccaccggagacaatagattggacaa

SEQ ID NO: 102583 - DNA, 36 bp, Artificial Sequence
  Synthetic oligonucleotide
acccctgcccgttgctacatcgcttatcgcactata

SEQ ID NO: 102584 - DNA, 35 bp, Artificial Sequence
  Synthetic oligonucleotide
gcccacgacagtgaagtccttcgtccctcaacctc

SEQ ID NO: 102585 - DNA, 35 bp, Artificial Sequence
  Synthetic oligonucleotide
ggaggacattaaagggggtcgtactgcaggaaaca

SEQ ID NO: 102586 - DNA, 35 bp, Artificial Sequence
  Synthetic oligonucleotide
attgacgtatgaatagtccgtagtgagtttagcca

SEQ ID NO: 102587 - DNA, 36 bp, Artificial Sequence
  Synthetic oligonucleotide
gaaccgagaggaataataatgatagatgcggaagta

SEQ ID NO: 102588 - DNA, 36 bp, Artificial Sequence
  Synthetic oligonucleotide
ccaagtagggggggacggaaaaggggaggcggagta

SEQ ID NO: 102589 - DNA, 35 bp, Artificial Sequence
  Synthetic oligonucleotide
gacacagtcgcgctcacagcactcgacaccgtgta

SEQ ID NO: 102590 - DNA, 35 bp, Artificial Sequence
  Synthetic oligonucleotide
aagatgacgagggggcgaagggggcacttgggggg

SEQ ID NO: 102591 - DNA, 37 bp, Artificial Sequence
  Synthetic oligonucleotide
aaagcatgcccctcttcgtgactccgtattttgtcga

SEQ ID NO: 102592 - DNA, 36 bp, Artificial Sequence
  Synthetic oligonucleotide
gccttccttcagagcgctggttggtttcttgttgga

SEQ ID NO: 102593 - DNA, 35 bp, Artificial Sequence
  Synthetic oligonucleotide
gcgacgccaccccaagctaccactagatgaactga

SEQ ID NO: 102594 - DNA, 35 bp, Artificial Sequence
  Synthetic oligonucleotide
actcccgaggtcctagttccgtattctgtcgtacc

SEQ ID NO: 102595 - DNA, 35 bp, Artificial Sequence
  Synthetic oligonucleotide
gatgcgtgctcaaccggagcctttaactcaggagt

SEQ ID NO: 102596 - DNA, 36 bp, Artificial Sequence
  Synthetic oligonucleotide
aatcgccctcatgcacactacaattgactttaagca

SEQ ID NO: 102597 - DNA, 35 bp, Artificial Sequence
  Synthetic oligonucleotide
taaccgccgggcctgaattttgtctggcgttttca

SEQ ID NO: 102598 - DNA, 38 bp, Artificial Sequence
  Synthetic oligonucleotide
attgaacgagagcccgtgcgaccgtggaccaccactga

SEQ ID NO: 102599 - DNA, 37 bp, Artificial Sequence
  Synthetic oligonucleotide
tccctcccgcccgacgttcatcctacactgcaattga

SEQ ID NO: 102600 - DNA, 38 bp, Artificial Sequence
  Synthetic oligonucleotide
aaccccacgccattcgctaagcattgacctattattga

SEQ ID NO: 102601 - DNA, 36 bp, Artificial Sequence
  Synthetic oligonucleotide
gatgcccagctcttcgtgaccctaggttgcaccata

SEQ ID NO: 102602 - DNA, 36 bp, Artificial Sequence
  Synthetic oligonucleotide
aagatccccgtcgccctcatctgcgcaatccatgta

SEQ ID NO: 102603 - DNA, 35 bp, Artificial Sequence
  Synthetic oligonucleotide
atcgcaccacgttccctcggaggtctcatgtctgc

SEQ ID NO: 102604 - DNA, 37 bp, Artificial Sequence
  Synthetic oligonucleotide
gacagtcgggggggaggagaggtggggggaacgcgga

SEQ ID NO: 102605 - DNA, 35 bp, Artificial Sequence
  Synthetic oligonucleotide
gcccacctcgaccgcttgttaggtcccaggttctg

SEQ ID NO: 102606 - DNA, 35 bp, Artificial Sequence
  Synthetic oligonucleotide
ttacgccatgcccacggacactgtaaagattcaat

SEQ ID NO: 102607 - DNA, 35 bp, Artificial Sequence
  Synthetic oligonucleotide
acgaaagccctctccgcatttttaacggaaaccat

SEQ ID NO: 102608 - DNA, 35 bp, Artificial Sequence
  Synthetic oligonucleotide
aacacgcggcagtagattgacaagtggtaccccct

SEQ ID NO: 102609 - DNA, 36 bp, Artificial Sequence
  Synthetic oligonucleotide
agtgcgtgcatcctggctttcctcctctttctgcca

SEQ ID NO: 102610 - DNA, 36 bp, Artificial Sequence
  Synthetic oligonucleotide
tgtggataggcggacgaggaggggtgggtgtacgga

SEQ ID NO: 102611 - DNA, 35 bp, Artificial Sequence
  Synthetic oligonucleotide
gcgcgccttggagcgcccctaccgcttggcccttc

SEQ ID NO: 102612 - DNA, 36 bp, Artificial Sequence
  Synthetic oligonucleotide
gtcccatgcgctcatccaggagaaaaggtgttgcca

SEQ ID NO: 102613 - DNA, 36 bp, Artificial Sequence
  Synthetic oligonucleotide
tacgcgcccctacaacctttatacgccagtgaagca

SEQ ID NO: 102614 - DNA, 35 bp, Artificial Sequence
  Synthetic oligonucleotide
acccccgctgttgacgatagtccagcgcttaatga

SEQ ID NO: 102615 - DNA, 38 bp, Artificial Sequence
  Synthetic oligonucleotide
gcattgcccgatgatcgtgcattctaccactcttttga

SEQ ID NO: 102616 - DNA, 35 bp, Artificial Sequence
  Synthetic oligonucleotide
atgccactcctcctgctcatcattcccgtattgta

SEQ ID NO: 102617 - DNA, 35 bp, Artificial Sequence
  Synthetic oligonucleotide
acaccgagcggcctaattccatcttccgccgttcc

SEQ ID NO: 102618 - DNA, 36 bp, Artificial Sequence
  Synthetic oligonucleotide
gtactgcccaccaatggcgacgttagcagacccaaa

SEQ ID NO: 102619 - DNA, 35 bp, Artificial Sequence
  Synthetic oligonucleotide
acctgtgggtgggtatgaatggaagcggggcacaa

SEQ ID NO: 102620 - DNA, 35 bp, Artificial Sequence
  Synthetic oligonucleotide
gccatgaaacgaatagacataccacaacacaatag

SEQ ID NO: 102621 - DNA, 35 bp, Artificial Sequence
  Synthetic oligonucleotide
gttgaccttcgcaacagccgacacagccaggaccg

SEQ ID NO: 102622 - DNA, 35 bp, Artificial Sequence
  Synthetic oligonucleotide
tcacaacaccgccctgcctaacgtcccctaccccg

SEQ ID NO: 102623 - DNA, 37 bp, Artificial Sequence
  Synthetic oligonucleotide
atgcgtacatttagcaacctctccatcttcctggcga

SEQ ID NO: 102624 - DNA, 38 bp, Artificial Sequence
  Synthetic oligonucleotide
accccggtcctgcattcctctgactcgcctcttcttga

SEQ ID NO: 102625 - DNA, 35 bp, Artificial Sequence
  Synthetic oligonucleotide
gtgacgtacgtgcaaaaatgaacacaatcgggata

SEQ ID NO: 102626 - DNA, 36 bp, Artificial Sequence
  Synthetic oligonucleotide
accaacctgcactacacgtcctggacgctacaccta

SEQ ID NO: 102627 - DNA, 35 bp, Artificial Sequence
  Synthetic oligonucleotide
agagcccctcatccgatcattgcacgagggcatcc

SEQ ID NO: 102628 - DNA, 35 bp, Artificial Sequence
  Synthetic oligonucleotide
aggtcgccctaagaaccattacctcccgcctgaat

SEQ ID NO: 102629 - DNA, 35 bp, Artificial Sequence
  Synthetic oligonucleotide
tgcacatctcactcggtacagcccacaactcatct

SEQ ID NO: 102630 - DNA, 35 bp, Artificial Sequence
  Synthetic oligonucleotide
cggccacatcgcttttcccggctcacaatactgtt

SEQ ID NO: 102631 - DNA, 35 bp, Artificial Sequence
  Synthetic oligonucleotide
tcccgccgccccattcgcacgtcgtacagtcccaa

SEQ ID NO: 102632 - DNA, 37 bp, Artificial Sequence
  Synthetic oligonucleotide
gaaggggagagttggggagaaaagttaacgcggagga

SEQ ID NO: 102633 - DNA, 35 bp, Artificial Sequence
  Synthetic oligonucleotide
gcccaagcgaggattccgaccttccttccatcaca

SEQ ID NO: 102634 - DNA, 38 bp, Artificial Sequence
  Synthetic oligonucleotide
ttccaactccacatcccaagcgcaacatgcccaactga

SEQ ID NO: 102635 - DNA, 38 bp, Artificial Sequence
  Synthetic oligonucleotide
ttgccatgcgcttgcttatcttgttcgtttgtccttga

SEQ ID NO: 102636 - DNA, 35 bp, Artificial Sequence
  Synthetic oligonucleotide
taccttccctgtaattgcaacgtgttggtcgctcc

SEQ ID NO: 102637 - DNA, 37 bp, Artificial Sequence
  Synthetic oligonucleotide
ggtggaagcactcaggggacgggggagctacggagga

SEQ ID NO: 102638 - DNA, 37 bp, Artificial Sequence
  Synthetic oligonucleotide
atggggagaggaccgaggggggtgggtgcgcggagga

SEQ ID NO: 102639 - DNA, 37 bp, Artificial Sequence
  Synthetic oligonucleotide
gtactggcactcagcttgcaccggattttttacctga

SEQ ID NO: 102640 - DNA, 38 bp, Artificial Sequence
  Synthetic oligonucleotide
gataactcacaggccacacctctattgagccccattga

SEQ ID NO: 102641 - DNA, 37 bp, Artificial Sequence
  Synthetic oligonucleotide
ttgaccccagttcttcccggtgatacccagttcttga

SEQ ID NO: 102642 - DNA, 35 bp, Artificial Sequence
  Synthetic oligonucleotide
gtagggacggggactatgaatgaggcaatgccacc

SEQ ID NO: 102643 - DNA, 35 bp, Artificial Sequence
  Synthetic oligonucleotide
gagtgcccacacttgccccctgatccgcgtgactt

SEQ ID NO: 102644 - DNA, 35 bp, Artificial Sequence
  Synthetic oligonucleotide
ttcgatgacccggtctcatctatagggaatccttt

SEQ ID NO: 102645 - DNA, 36 bp, Artificial Sequence
  Synthetic oligonucleotide
taagtgcccactgcctcctgccttctcagtctgcca

SEQ ID NO: 102646 - DNA, 37 bp, Artificial Sequence
  Synthetic oligonucleotide
gtgacgaggaatggagagtgaaggattgcccaggaga

SEQ ID NO: 102647 - DNA, 38 bp, Artificial Sequence
  Synthetic oligonucleotide
gtccgtaggaaaccgtttctggccattctgccttttga

SEQ ID NO: 102648 - DNA, 36 bp, Artificial Sequence
  Synthetic oligonucleotide
tcaccgcacgctgcatgaaggggggagttgaagata

SEQ ID NO: 102649 - DNA, 35 bp, Artificial Sequence
  Synthetic oligonucleotide
gtcaatcccatccgcccgtaaacggttgcaactgc

SEQ ID NO: 102650 - DNA, 35 bp, Artificial Sequence
  Synthetic oligonucleotide
tgcacgccgccctggacttgcgctgtccgcccaac

SEQ ID NO: 102651 - DNA, 35 bp, Artificial Sequence
  Synthetic oligonucleotide
gtactcagtgtcctcgtttatgcgctccccgcccc

SEQ ID NO: 102652 - DNA, 38 bp, Artificial Sequence
  Synthetic oligonucleotide
gatggggtgcacggtgggatgctgcgacttagggttga

SEQ ID NO: 102653 - DNA, 38 bp, Artificial Sequence
  Synthetic oligonucleotide
gcagggccgggtcctgccacacatgtgctattgtttga

SEQ ID NO: 102654 - DNA, 36 bp, Artificial Sequence
  Synthetic oligonucleotide
gagcaccatgtctatcgacttcctaggcctaaccta

SEQ ID NO: 102655 - DNA, 35 bp, Artificial Sequence
  Synthetic oligonucleotide
gcatctagtccgttgccaccaccgtgccccattac

SEQ ID NO: 102656 - DNA, 35 bp, Artificial Sequence
  Synthetic oligonucleotide
tacatgacggtacagttcaagggaatgttctcaat

SEQ ID NO: 102657 - DNA, 36 bp, Artificial Sequence
  Synthetic oligonucleotide
tcgcacccctcctgactatttcaaccaactgccaaa

SEQ ID NO: 102658 - DNA, 35 bp, Artificial Sequence
  Synthetic oligonucleotide
tccacgatagcgcacgaccgtatatcgtactatca

SEQ ID NO: 102659 - DNA, 37 bp, Artificial Sequence
  Synthetic oligonucleotide
tgaacacccccccgtactacacatgccccccgtcatg

SEQ ID NO: 102660 - DNA, 36 bp, Artificial Sequence
  Synthetic oligonucleotide
tccatcctacgtgccaagttctacccgttcactaga

SEQ ID NO: 102661 - DNA, 37 bp, Artificial Sequence
  Synthetic oligonucleotide
tcagtgacctgcagatcgattggaccacccttatata

SEQ ID NO: 102662 - DNA, 35 bp, Artificial Sequence
  Synthetic oligonucleotide
tacgaagacgccctcttgatcatttgtccatgcaa

SEQ ID NO: 102663 - DNA, 36 bp, Artificial Sequence
  Synthetic oligonucleotide
tgggatcactttgagccgcctcctaccaacttgcca

SEQ ID NO: 102664 - DNA, 38 bp, Artificial Sequence
  Synthetic oligonucleotide
gtcactggggaggtgtgaggcagttatgaggttgatga

SEQ ID NO: 102665 - DNA, 36 bp, Artificial Sequence
  Synthetic oligonucleotide
gttgtcgccttcaagatatcccacgcactcgcaata

SEQ ID NO: 102666 - DNA, 35 bp, Artificial Sequence
  Synthetic oligonucleotide
tccgggctgtcacgcttctccccaatttcctctag

SEQ ID NO: 102667 - DNA, 35 bp, Artificial Sequence
  Synthetic oligonucleotide
atcaacgcctgtgccatcaaattcaactaataccg

SEQ ID NO: 102668 - DNA, 38 bp, Artificial Sequence
  Synthetic oligonucleotide
tttgccatctagaactaacacctgcagatttccattga

SEQ ID NO: 102669 - DNA, 36 bp, Artificial Sequence
  Synthetic oligonucleotide
ggtgccccccataggctcccgtagtggaattacata

SEQ ID NO: 102670 - DNA, 35 bp, Artificial Sequence
  Synthetic oligonucleotide
atctcgacactgccgtcggttgtccacccgctcac

SEQ ID NO: 102671 - DNA, 35 bp, Artificial Sequence
  Synthetic oligonucleotide
gagggcgtagccagcgttcatttaaaggtttatgc

SEQ ID NO: 102672 - DNA, 35 bp, Artificial Sequence
  Synthetic oligonucleotide
gttgggcccctctgctttctgttagctccatcctc

SEQ ID NO: 102673 - DNA, 35 bp, Artificial Sequence
  Synthetic oligonucleotide
aacccctgccaaccgctaccattgacttttttgtc

SEQ ID NO: 102674 - DNA, 35 bp, Artificial Sequence
  Synthetic oligonucleotide
tacccatatggccatccaagtcatcgatttactcg

SEQ ID NO: 102675 - DNA, 36 bp, Artificial Sequence
  Synthetic oligonucleotide
gctaccactcaaagtaccgcatcggttttatcctca

SEQ ID NO: 102676 - DNA, 37 bp, Artificial Sequence
  Synthetic oligonucleotide
cctccccctagcaccatcgccgaaatggcatgaccga

SEQ ID NO: 102677 - DNA, 36 bp, Artificial Sequence
  Synthetic oligonucleotide
accgccacttgttcgtccacgctgtccacccacata

SEQ ID NO: 102678 - DNA, 36 bp, Artificial Sequence
  Synthetic oligonucleotide
tccataccactactataactctggggttcccatgta

SEQ ID NO: 102679 - DNA, 35 bp, Artificial Sequence
  Synthetic oligonucleotide
attgtcttagcctcccgttgacggtcactaacctc

SEQ ID NO: 102680 - DNA, 36 bp, Artificial Sequence
  Synthetic oligonucleotide
taccacgcacgactcatcacgaacttaccaaattaa

SEQ ID NO: 102681 - DNA, 35 bp, Artificial Sequence
  Synthetic oligonucleotide
ttccaatcagcgctcccctccgttctatctctaga

SEQ ID NO: 102682 - DNA, 35 bp, Artificial Sequence
  Synthetic oligonucleotide
ttgcacttgcatgccacgtactcacctactttaga

SEQ ID NO: 102683 - DNA, 38 bp, Artificial Sequence
  Synthetic oligonucleotide
tctctatccgctggactatcgtcctcacttgtcactga

SEQ ID NO: 102684 - DNA, 36 bp, Artificial Sequence
  Synthetic oligonucleotide
gagcccacccggttacatgtcgattttcttgctgta

SEQ ID NO: 102685 - DNA, 35 bp, Artificial Sequence
  Synthetic oligonucleotide
tccccaaccctcacatgctcttgcttagtgccttc

SEQ ID NO: 102686 - DNA, 35 bp, Artificial Sequence
  Synthetic oligonucleotide
aacgcaggccgaaaccaaccggacgcgggtatttg

SEQ ID NO: 102687 - DNA, 35 bp, Artificial Sequence
  Synthetic oligonucleotide
gtggccacgtcaaagcctcatttggtctaatttgt

SEQ ID NO: 102688 - DNA, 37 bp, Artificial Sequence
  Synthetic oligonucleotide
tgttcgccgaagtgcggacgcacggggcactccttca

SEQ ID NO: 102689 - DNA, 37 bp, Artificial Sequence
  Synthetic oligonucleotide
tttgcacccggctaccaggacctcccagactcatcga

SEQ ID NO: 102690 - DNA, 37 bp, Artificial Sequence
  Synthetic oligonucleotide
gcgcaatactcacgtacccgcccctgtgccgtgctga

SEQ ID NO: 102691 - DNA, 35 bp, Artificial Sequence
  Synthetic oligonucleotide
gccggtaccgcctatgccgacatcctcaacccctc

SEQ ID NO: 102692 - DNA, 35 bp, Artificial Sequence
  Synthetic oligonucleotide
gttgggccccgctgctttctgttatctccatcctc

SEQ ID NO: 102693 - DNA, 35 bp, Artificial Sequence
  Synthetic oligonucleotide
ataaccccagcgccctctcgagtctcaagccgaat

SEQ ID NO: 102694 - DNA, 35 bp, Artificial Sequence
  Synthetic oligonucleotide
tgagtcggagctgtataccttcttcccatctgtat

SEQ ID NO: 102695 - DNA, 35 bp, Artificial Sequence
  Synthetic oligonucleotide
gaggtggaatcgaacgggtggggagtcttgctagt

SEQ ID NO: 102696 - DNA, 36 bp, Artificial Sequence
  Synthetic oligonucleotide
actcaacgctcctgggtgttattgtccccttataca

SEQ ID NO: 102697 - DNA, 38 bp, Artificial Sequence
  Synthetic oligonucleotide
tgcccaacgagcaccatctgcaagcacacacctattga

SEQ ID NO: 102698 - DNA, 36 bp, Artificial Sequence
  Synthetic oligonucleotide
gtcacaccgccttttcacaacacatgccgtttatta

SEQ ID NO: 102699 - DNA, 35 bp, Artificial Sequence
  Synthetic oligonucleotide
tacgctacctgtaccagtccaacgctatgggccac

SEQ ID NO: 102700 - DNA, 35 bp, Artificial Sequence
  Synthetic oligonucleotide
gaacgtcaacatactcgtctacccgggggtttctc

SEQ ID NO: 102701 - DNA, 35 bp, Artificial Sequence
  Synthetic oligonucleotide
tctgactggatttgctcctccgccttccgcctgtg

SEQ ID NO: 102702 - DNA, 35 bp, Artificial Sequence
  Synthetic oligonucleotide
gcccaatattcgccgttgtaattttcgctgtacct

SEQ ID NO: 102703 - DNA, 35 bp, Artificial Sequence
  Synthetic oligonucleotide
agacttcccctcatagtgtgtgtctcgtattcttt

SEQ ID NO: 102704 - DNA, 35 bp, Artificial Sequence
  Synthetic oligonucleotide
gtgggctggcctattccaccatttacagattacca

SEQ ID NO: 102705 - DNA, 36 bp, Artificial Sequence
  Synthetic oligonucleotide
tctgtgctacccaggtgattttcctcgcgcccttga

SEQ ID NO: 102706 - DNA, 36 bp, Artificial Sequence
  Synthetic oligonucleotide
atcctgtcgcacactgaaatcggttgcctgtgcata

SEQ ID NO: 102707 - DNA, 35 bp, Artificial Sequence
  Synthetic oligonucleotide
tacgctgtgatctgccgcctcttgccgccttctct

SEQ ID NO: 102708 - DNA, 36 bp, Artificial Sequence
  Synthetic oligonucleotide
gttccatcctcattgcgcgactgacgcacttaccaa

SEQ ID NO: 102709 - DNA, 36 bp, Artificial Sequence
  Synthetic oligonucleotide
tcaccccacgcctccctgctaaccatgcctcctgaa

SEQ ID NO: 102710 - DNA, 36 bp, Artificial Sequence
  Synthetic oligonucleotide
tgcacctcaacttcacctttccatccaacgggctga

SEQ ID NO: 102711 - DNA, 35 bp, Artificial Sequence
  Synthetic oligonucleotide
tcaccgtgtgggtatcgtttctcgggggttttctt

SEQ ID NO: 102712 - DNA, 36 bp, Artificial Sequence
  Synthetic oligonucleotide
gactaggcgcacccatcctctctctttaggttccca

SEQ ID NO: 102713 - DNA, 36 bp, Artificial Sequence
  Synthetic oligonucleotide
atttccgcctcagacttgatactttttttaccccga

SEQ ID NO: 102714 - DNA, 37 bp, Artificial Sequence
  Synthetic oligonucleotide
agtgccacgtcgactccctgcactctagcccccccga

SEQ ID NO: 102715 - DNA, 36 bp, Artificial Sequence
  Synthetic oligonucleotide
gcacttggccaattggactttctttctactatgcta

SEQ ID NO: 102716 - DNA, 35 bp, Artificial Sequence
  Synthetic oligonucleotide
gagccaaccatcgatctcgaatcttcccttcgtac

SEQ ID NO: 102717 - DNA, 35 bp, Artificial Sequence
  Synthetic oligonucleotide
tccggacctcccgccgctatcacaggccggtctgc

SEQ ID NO: 102718 - DNA, 35 bp, Artificial Sequence
  Synthetic oligonucleotide
gcccatccgtccgattttcctgtccttccgtcgtc

SEQ ID NO: 102719 - DNA, 35 bp, Artificial Sequence
  Synthetic oligonucleotide
tcatggacctccacctcatgcaagcaactattgtg

SEQ ID NO: 102720 - DNA, 36 bp, Artificial Sequence
  Synthetic oligonucleotide
taccccgccccgccgtgcaaccgacttactacaaat

SEQ ID NO: 102721 - DNA, 35 bp, Artificial Sequence
  Synthetic oligonucleotide
tctaatccggcgccttttctatgtctcacccgctt

SEQ ID NO: 102722 - DNA, 35 bp, Artificial Sequence
  Synthetic oligonucleotide
tgcaccccacttccaccggtccgcaaaacccagga

SEQ ID NO: 102723 - DNA, 37 bp, Artificial Sequence
  Synthetic oligonucleotide
gtggggtgtgaggaaatggaaaatggtatgaggttga

SEQ ID NO: 102724 - DNA, 35 bp, Artificial Sequence
  Synthetic oligonucleotide
aaggacatggaaggagagagaatacgtggtaagat

SEQ ID NO: 102725 - DNA, 35 bp, Artificial Sequence
  Synthetic oligonucleotide
gcctcgcctgcccccaactatctcaatacatcggt

SEQ ID NO: 102726 - DNA, 36 bp, Artificial Sequence
  Synthetic oligonucleotide
aatgagggggtggaaggagagcagatgttctcacca

SEQ ID NO: 102727 - DNA, 35 bp, Artificial Sequence
  Synthetic oligonucleotide
acagttgggatctgtaaaaggaagggagggggcga

SEQ ID NO: 102728 - DNA, 37 bp, Artificial Sequence
  Synthetic oligonucleotide
tccactgacacctccggaacatcattaagtccatcga

SEQ ID NO: 102729 - DNA, 37 bp, Artificial Sequence
  Synthetic oligonucleotide
agaatggtaagggcggtagtacggaaatatacgggga

SEQ ID NO: 102730 - DNA, 36 bp, Artificial Sequence
  Synthetic oligonucleotide
tagtgcctcatggctctcgttgaagctatatccata

SEQ ID NO: 102731 - DNA, 35 bp, Artificial Sequence
  Synthetic oligonucleotide
tcacaacacctccctgcctaacgtccccgaccccg

SEQ ID NO: 102732 - DNA, 35 bp, Artificial Sequence
  Synthetic oligonucleotide
gaaacaagtatggggtggaagcggacaaagacttg

SEQ ID NO: 102733 - DNA, 38 bp, Artificial Sequence
  Synthetic oligonucleotide
aaccgaactggtcgtccagtctaggtccccttccctga

SEQ ID NO: 102734 - DNA, 36 bp, Artificial Sequence
  Synthetic oligonucleotide
ggacgcagaccgtccttaactcgcgacaacactcta

SEQ ID NO: 102735 - DNA, 35 bp, Artificial Sequence
  Synthetic oligonucleotide
gggacaccctaccagtcttgaaccccactgttccc

SEQ ID NO: 102736 - DNA, 35 bp, Artificial Sequence
  Synthetic oligonucleotide
tccaatgaccctgaacgcaaaagaacagtagccat

SEQ ID NO: 102737 - DNA, 35 bp, Artificial Sequence
  Synthetic oligonucleotide
ttagcggaaaagttctgctcaatctcagttcgcct

SEQ ID NO: 102738 - DNA, 35 bp, Artificial Sequence
  Synthetic oligonucleotide
gattcaaccggctcctctacgttgggcgctttttt

SEQ ID NO: 102739 - DNA, 36 bp, Artificial Sequence
  Synthetic oligonucleotide
ttgcgatccaaggcctcgtgcactcctcccgataca

SEQ ID NO: 102740 - DNA, 36 bp, Artificial Sequence
  Synthetic oligonucleotide
gagggacccgagagaaaaataagagggctgatgaga

SEQ ID NO: 102741 - DNA, 37 bp, Artificial Sequence
  Synthetic oligonucleotide
gggacgaacataagagggactgggaagagggggctga

SEQ ID NO: 102742 - DNA, 35 bp, Artificial Sequence
  Synthetic oligonucleotide
gggggacactcagatgggggcgcgggcaaggagac

SEQ ID NO: 102743 - DNA, 35 bp, Artificial Sequence
  Synthetic oligonucleotide
tcgtggcctccgctgaccacccgtacaatatcaag

SEQ ID NO: 102744 - DNA, 35 bp, Artificial Sequence
  Synthetic oligonucleotide
taggagcctacctagcacctggaaatcgattcttg

SEQ ID NO: 102745 - DNA, 35 bp, Artificial Sequence
  Synthetic oligonucleotide
gcacttgcccagtccgggtcctcatcatatggttt

SEQ ID NO: 102746 - DNA, 36 bp, Artificial Sequence
  Synthetic oligonucleotide
atcaccccccggcgatccacctgctagggccataca

SEQ ID NO: 102747 - DNA, 36 bp, Artificial Sequence
  Synthetic oligonucleotide
tcgcacattcatcatcttgtcctgctgcctccacca

SEQ ID NO: 102748 - DNA, 38 bp, Artificial Sequence
  Synthetic oligonucleotide
atccaccatcacacgcgcgcgcatccttccatgaatga

SEQ ID NO: 102749 - DNA, 36 bp, Artificial Sequence
  Synthetic oligonucleotide
tgctggaggaactgaacattaggctggggtcttata

SEQ ID NO: 102750 - DNA, 36 bp, Artificial Sequence
  Synthetic oligonucleotide
caagcagtgcctacctcctctgttacgttgctccta

SEQ ID NO: 102751 - DNA, 35 bp, Artificial Sequence
  Synthetic oligonucleotide
gcaactccgacttggccaatcctccctctgattta

SEQ ID NO: 102752 - DNA, 35 bp, Artificial Sequence
  Synthetic oligonucleotide
accttgccctggcactgtcttctcttctcgtttgc

SEQ ID NO: 102753 - DNA, 35 bp, Artificial Sequence
  Synthetic oligonucleotide
gtgcgataggagaggggtgggagtacgattattgg

SEQ ID NO: 102754 - DNA, 33 bp, Artificial Sequence
  Synthetic oligonucleotide
taaccacatcatgcgcgcccacacattgtccat

SEQ ID NO: 102755 - DNA, 35 bp, Artificial Sequence
  Synthetic oligonucleotide
tacgctggtatctgccgcctcttgccgccttctct

SEQ ID NO: 102756 - DNA, 35 bp, Artificial Sequence
  Synthetic oligonucleotide
gtcacgtgccccgttccttctaattctcctgttct

SEQ ID NO: 102757 - DNA, 37 bp, Artificial Sequence
  Synthetic oligonucleotide
gacatacatcaccgctgttctaggttacacgaattca

SEQ ID NO: 102758 - DNA, 38 bp, Artificial Sequence
  Synthetic oligonucleotide
ggagaccacactgtagttcaacctgccgaggactctga

SEQ ID NO: 102759 - DNA, 35 bp, Artificial Sequence
  Synthetic oligonucleotide
tatgaccttggtcacgcagacgcaaacatgccccc

SEQ ID NO: 102760 - DNA, 35 bp, Artificial Sequence
  Synthetic oligonucleotide
acacgacacccgggttcctttctgcttctacactc

SEQ ID NO: 102761 - DNA, 35 bp, Artificial Sequence
  Synthetic oligonucleotide
agccatgatgctttctcttcagttcgacctctgat

SEQ ID NO: 102762 - DNA, 36 bp, Artificial Sequence
  Synthetic oligonucleotide
atgtccctgccgcagactgtagaagtgaaagtaaca

SEQ ID NO: 102763 - DNA, 35 bp, Artificial Sequence
  Synthetic oligonucleotide
gttacttccccggggttattcctaacgtgctagca

SEQ ID NO: 102764 - DNA, 38 bp, Artificial Sequence
  Synthetic oligonucleotide
gctatgcataaccacgctcctgccttaagatcccttga

SEQ ID NO: 102765 - DNA, 35 bp, Artificial Sequence
  Synthetic oligonucleotide
actcattgcatctctgaacctcccaattgtctctg

SEQ ID NO: 102766 - DNA, 36 bp, Artificial Sequence
  Synthetic oligonucleotide
acgacccaggcgcatgagccgcaaaaacatcaaata

SEQ ID NO: 102767 - DNA, 35 bp, Artificial Sequence
  Synthetic oligonucleotide
atgcccatccctaagagggacacttgtcattccac

SEQ ID NO: 102768 - DNA, 35 bp, Artificial Sequence
  Synthetic oligonucleotide
tgctatctccgggtcttccccaccgtcccataggc

SEQ ID NO: 102769 - DNA, 31 bp, Artificial Sequence
  Synthetic oligonucleotide
gacgactgccgccacttaactgccgaaaatc

SEQ ID NO: 102770 - DNA, 35 bp, Artificial Sequence
  Synthetic oligonucleotide
gtttccagccgtttccctaccgcgtctacaccctc

SEQ ID NO: 102771 - DNA, 35 bp, Artificial Sequence
  Synthetic oligonucleotide
gaccacagcaaccggccattccgcgcccgtaccat

SEQ ID NO: 102772 - DNA, 35 bp, Artificial Sequence
  Synthetic oligonucleotide
taagtgtagtagggtgtgatttgcagggtgagagt

SEQ ID NO: 102773 - DNA, 36 bp, Artificial Sequence
  Synthetic oligonucleotide
atcaccattaccctctcgcgaagtgcgcatactgaa

SEQ ID NO: 102774 - DNA, 38 bp, Artificial Sequence
  Synthetic oligonucleotide
tcagttgggcccgatgtgagtgttcatggtggggttga

SEQ ID NO: 102775 - DNA, 35 bp, Artificial Sequence
  Synthetic oligonucleotide
tgcctatcgccatctagtttgtcccccatgtctcc

SEQ ID NO: 102776 - DNA, 35 bp, Artificial Sequence
  Synthetic oligonucleotide
taaccgaccgcatttacacgcggagcacactgagc

SEQ ID NO: 102777 - DNA, 35 bp, Artificial Sequence
  Synthetic oligonucleotide
tacatcctcaccactgatcgaatttccacccttgc

SEQ ID NO: 102778 - DNA, 35 bp, Artificial Sequence
  Synthetic oligonucleotide
acactaagcgcttcccccatgccgtcactctgctc

SEQ ID NO: 102779 - DNA, 35 bp, Artificial Sequence
  Synthetic oligonucleotide
gttagcaagcccccgagtctctctccggaccccat

SEQ ID NO: 102780 - DNA, 35 bp, Artificial Sequence
  Synthetic oligonucleotide
gagccaacgccgctgctcccctccctatggtttct

SEQ ID NO: 102781 - DNA, 36 bp, Artificial Sequence
  Synthetic oligonucleotide
atacgcctcacttgcataccatcttacagtacgaca

SEQ ID NO: 102782 - DNA, 35 bp, Artificial Sequence
  Synthetic oligonucleotide
gcaccgccaacctaggctaccttgctccatctaca

SEQ ID NO: 102783 - DNA, 37 bp, Artificial Sequence
  Synthetic oligonucleotide
atgggtagggggctggaaatgagtttggtgaactgga

SEQ ID NO: 102784 - DNA, 38 bp, Artificial Sequence
  Synthetic oligonucleotide
gtcttcccaccccattgtatcaagttctacgccgctga

SEQ ID NO: 102785 - DNA, 35 bp, Artificial Sequence
  Synthetic oligonucleotide
tgccccctgggcaaacacccgtacgcttttgtccc

SEQ ID NO: 102786 - DNA, 35 bp, Artificial Sequence
  Synthetic oligonucleotide
gttgggacccgctgctttctgttagctccatcctc

SEQ ID NO: 102787 - DNA, 35 bp, Artificial Sequence
  Synthetic oligonucleotide
ttggcccccttggcgagccaccttcgagttttaat

SEQ ID NO: 102788 - DNA, 36 bp, Artificial Sequence
  Synthetic oligonucleotide
accggggctgtgggaaggtggaggattgggggtcat

SEQ ID NO: 102789 - DNA, 35 bp, Artificial Sequence
  Synthetic oligonucleotide
acccgtgatctaacccagctctgctccctccgctt

SEQ ID NO: 102790 - DNA, 36 bp, Artificial Sequence
  Synthetic oligonucleotide
ggatgaggagagggaaattacaggccttaggtttga

SEQ ID NO: 102791 - DNA, 36 bp, Artificial Sequence
  Synthetic oligonucleotide
gccctcggcccaatgttgccaccaaccgtctcccta

SEQ ID NO: 102792 - DNA, 36 bp, Artificial Sequence
  Synthetic oligonucleotide
gagccttgcccctcttcttggtgttctctgcattta

SEQ ID NO: 102793 - DNA, 35 bp, Artificial Sequence
  Synthetic oligonucleotide
gctgatgtactttgtgtcatcggccgcctgacttc

SEQ ID NO: 102794 - DNA, 35 bp, Artificial Sequence
  Synthetic oligonucleotide
gaccctctgcacttatgtgtgcgaaaatgcacacg

SEQ ID NO: 102795 - DNA, 35 bp, Artificial Sequence
  Synthetic oligonucleotide
cccccgcgcccggatttgctatgcatggcccattt

SEQ ID NO: 102796 - DNA, 36 bp, Artificial Sequence
  Synthetic oligonucleotide
gccgtaacctcaaccccgtcccgtactcgccctgga

SEQ ID NO: 102797 - DNA, 36 bp, Artificial Sequence
  Synthetic oligonucleotide
tagtccagcgtaaccactgcgacaccctacccctga

SEQ ID NO: 102798 - DNA, 37 bp, Artificial Sequence
  Synthetic oligonucleotide
aaagaaggagggggggcacaatattttaatatgctga

SEQ ID NO: 102799 - DNA, 36 bp, Artificial Sequence
  Synthetic oligonucleotide
ttaactaggcccatgcctcacgactatcccttgtga

SEQ ID NO: 102800 - DNA, 36 bp, Artificial Sequence
  Synthetic oligonucleotide
gtgcactctcccattggtgcccctccttctctgtta

SEQ ID NO: 102801 - DNA, 35 bp, Artificial Sequence
  Synthetic oligonucleotide
gtcccgctacacatttggcggatgtctcattcgac

SEQ ID NO: 102802 - DNA, 32 bp, Artificial Sequence
  Synthetic oligonucleotide
tgagtgcttgcccattaccctgccttctacgc

SEQ ID NO: 102803 - DNA, 35 bp, Artificial Sequence
  Synthetic oligonucleotide
aaacacccccggactatatggtagatttatgttag

SEQ ID NO: 102804 - DNA, 35 bp, Artificial Sequence
  Synthetic oligonucleotide
gccggtcctacgttctattcttatcttcccccctg

SEQ ID NO: 102805 - DNA, 35 bp, Artificial Sequence
  Synthetic oligonucleotide
acgcatatgaccgcagaaccgcttcactcctcttg

SEQ ID NO: 102806 - DNA, 35 bp, Artificial Sequence
  Synthetic oligonucleotide
tatcacgtagtaggacccctgtcccctgtctccct

SEQ ID NO: 102807 - DNA, 36 bp, Artificial Sequence
  Synthetic oligonucleotide
ggtgcattgcttcttccttcactgctggaccccaaa

SEQ ID NO: 102808 - DNA, 36 bp, Artificial Sequence
  Synthetic oligonucleotide
gatggggccgttggtgatcaccgctgcttaaaacaa

SEQ ID NO: 102809 - DNA, 36 bp, Artificial Sequence
  Synthetic oligonucleotide
gtgccgcctaatggttttatgttaccccaaccccaa

SEQ ID NO: 102810 - DNA, 35 bp, Artificial Sequence
  Synthetic oligonucleotide
agtgctagggggacggtcttgggcgggggggataa

SEQ ID NO: 102811 - DNA, 37 bp, Artificial Sequence
  Synthetic oligonucleotide
gacacccagacttcacttccaccccatttggtttgca

SEQ ID NO: 102812 - DNA, 36 bp, Artificial Sequence
  Synthetic oligonucleotide
tccatctggtggtcatgtctttctattttggcatca

SEQ ID NO: 102813 - DNA, 37 bp, Artificial Sequence
  Synthetic oligonucleotide
gatcggtagcaccacaatccgcgctatcactccacga

SEQ ID NO: 102814 - DNA, 37 bp, Artificial Sequence
  Synthetic oligonucleotide
gatcgtgggcaaacgtggtgggggcgggggttcggga

SEQ ID NO: 102815 - DNA, 36 bp, Artificial Sequence
  Synthetic oligonucleotide
tgttcggacagaggtggaatagatgaaaatgggtga

SEQ ID NO: 102816 - DNA, 35 bp, Artificial Sequence
  Synthetic oligonucleotide
aacctggaccgcacttgtttccggggactccccta

SEQ ID NO: 102817 - DNA, 37 bp, Artificial Sequence
  Synthetic oligonucleotide
gttggtcgccgcccgaggaagccgcccaaatcctgta

SEQ ID NO: 102818 - DNA, 35 bp, Artificial Sequence
  Synthetic oligonucleotide
tctagccgacggacctctattgtccccaccctccc

SEQ ID NO: 102819 - DNA, 35 bp, Artificial Sequence
  Synthetic oligonucleotide
gaccggagccccctattgagcgatttatctgtttc

SEQ ID NO: 102820 - DNA, 35 bp, Artificial Sequence
  Synthetic oligonucleotide
ttttaccaccgtaccaggctttatcccactcaatt

SEQ ID NO: 102821 - DNA, 35 bp, Artificial Sequence
  Synthetic oligonucleotide
gtgtccttgcgcccaaccctgctgctccctcagtt

SEQ ID NO: 102822 - DNA, 35 bp, Artificial Sequence
  Synthetic oligonucleotide
ttgtcccccatcctaataacgtgaatcatatgttt

SEQ ID NO: 102823 - DNA, 36 bp, Artificial Sequence
  Synthetic oligonucleotide
tactcggacttcctggcaagccccatccacttagaa

SEQ ID NO: 102824 - DNA, 35 bp, Artificial Sequence
  Synthetic oligonucleotide
tagacgcacctcagcctttccccttttgaccaaga

SEQ ID NO: 102825 - DNA, 35 bp, Artificial Sequence
  Synthetic oligonucleotide
tgcaacccctccacgaacccgctgtgagtcctgcc

SEQ ID NO: 102826 - DNA, 35 bp, Artificial Sequence
  Synthetic oligonucleotide
tcactcctggggccctttcgctggcctagacctgc

SEQ ID NO: 102827 - DNA, 35 bp, Artificial Sequence
  Synthetic oligonucleotide
tttgggccccgctgctttctgttagctccatcctc

SEQ ID NO: 102828 - DNA, 35 bp, Artificial Sequence
  Synthetic oligonucleotide
agacgcatacattcgcgataccctgttccacccct

SEQ ID NO: 102829 - DNA, 35 bp, Artificial Sequence
  Synthetic oligonucleotide
gctacccacccgcctgtctagcgcctcccgttatt

SEQ ID NO: 102830 - DNA, 35 bp, Artificial Sequence
  Synthetic oligonucleotide
tacacccttcgcggtgtctcgcacaggcccacttt

SEQ ID NO: 102831 - DNA, 37 bp, Artificial Sequence
  Synthetic oligonucleotide
tcatgctccagctataactccccgtccctcacctaga

SEQ ID NO: 102832 - DNA, 36 bp, Artificial Sequence
  Synthetic oligonucleotide
caccatgccaactgaacatcttactccgacttacga

SEQ ID NO: 102833 - DNA, 36 bp, Artificial Sequence
  Synthetic oligonucleotide
gtacccaatacagtcccatctattactgcatttata

SEQ ID NO: 102834 - DNA, 35 bp, Artificial Sequence
  Synthetic oligonucleotide
tactcatcacgagtgctcctgcggttctcgcctta

SEQ ID NO: 102835 - DNA, 36 bp, Artificial Sequence
  Synthetic oligonucleotide
gcatggttagcagccgtcggtctcttcctcccgtta

SEQ ID NO: 102836 - DNA, 35 bp, Artificial Sequence
  Synthetic oligonucleotide
gtcgtgctgacatgttaggctccactctcacaacc

SEQ ID NO: 102837 - DNA, 35 bp, Artificial Sequence
  Synthetic oligonucleotide
gatgcctggctcctggtacgaattcttctccgctt

SEQ ID NO: 102838 - DNA, 36 bp, Artificial Sequence
  Synthetic oligonucleotide
gccgtacctgtatctgtaacctacctcctttccgca

SEQ ID NO: 102839 - DNA, 37 bp, Artificial Sequence
  Synthetic oligonucleotide
tcatccgtctgcagctttcaacgacaccctcttctga

SEQ ID NO: 102840 - DNA, 36 bp, Artificial Sequence
  Synthetic oligonucleotide
aacataccgtgcctcctgcgtgtacgtttcttcata

SEQ ID NO: 102841 - DNA, 35 bp, Artificial Sequence
  Synthetic oligonucleotide
tgggtatatccctagtttcctgtcgcctcatcacc

SEQ ID NO: 102842 - DNA, 35 bp, Artificial Sequence
  Synthetic oligonucleotide
tagtctcgcaagccaacacgatcccacccagttat

SEQ ID NO: 102843 - DNA, 35 bp, Artificial Sequence
  Synthetic oligonucleotide
gtccagggtcccatccttttgcctgtctccatttt

SEQ ID NO: 102844 - DNA, 38 bp, Artificial Sequence
  Synthetic oligonucleotide
gtgggggagctgttggtgcggaggtacagcatgtatga

SEQ ID NO: 102845 - DNA, 35 bp, Artificial Sequence
  Synthetic oligonucleotide
gctgtgtgccatcgataaccgaatgcttgcctcta

SEQ ID NO: 102846 - DNA, 35 bp, Artificial Sequence
  Synthetic oligonucleotide
accatcatcccgttaccttatgcagacacacggcc

SEQ ID NO: 102847 - DNA, 35 bp, Artificial Sequence
  Synthetic oligonucleotide
gttgggccccgcttctttctgttagctccatcctc

SEQ ID NO: 102848 - DNA, 35 bp, Artificial Sequence
  Synthetic oligonucleotide
tcacgaccccaaatggcaatgcaacctcttaagtc

SEQ ID NO: 102849 - DNA, 35 bp, Artificial Sequence
  Synthetic oligonucleotide
gatacatgcccccaccgtacacactctatcgtttc

SEQ ID NO: 102850 - DNA, 35 bp, Artificial Sequence
  Synthetic oligonucleotide
gacgggatagggggcaaaaaggataactagctcag

SEQ ID NO: 102851 - DNA, 35 bp, Artificial Sequence
  Synthetic oligonucleotide
tcacatgcaatctatctccctccactcccttcgtt

SEQ ID NO: 102852 - DNA, 35 bp, Artificial Sequence
  Synthetic oligonucleotide
gtgtcctcccccctgttctcagaacctgccatgtt

SEQ ID NO: 102853 - DNA, 36 bp, Artificial Sequence
  Synthetic oligonucleotide
acacacacacacattttaggtataacacagtacaaa

SEQ ID NO: 102854 - DNA, 35 bp, Artificial Sequence
  Synthetic oligonucleotide
gtgaacacaaccatgtagtgtattatacccttcca

SEQ ID NO: 102855 - DNA, 35 bp, Artificial Sequence
  Synthetic oligonucleotide
tgtcgaactgacgctgccaacccgatcttcccgga

SEQ ID NO: 102856 - DNA, 38 bp, Artificial Sequence
  Synthetic oligonucleotide
tcattacgcccttgctaaagtcctgccctgcctcctga

SEQ ID NO: 102857 - DNA, 35 bp, Artificial Sequence
  Synthetic oligonucleotide
gccaagcgctccaacggtttctcgcctctagcacc

SEQ ID NO: 102858 - DNA, 35 bp, Artificial Sequence
  Synthetic oligonucleotide
gaagcgtaccccccgttctgctgattctagcctcc

SEQ ID NO: 102859 - DNA, 35 bp, Artificial Sequence
  Synthetic oligonucleotide
gttgccccacgactctccccgccccgctcccgtgc

SEQ ID NO: 102860 - DNA, 35 bp, Artificial Sequence
  Synthetic oligonucleotide
tgcgtaggtgcaggtatccctttaacgtttttttc

SEQ ID NO: 102861 - DNA, 35 bp, Artificial Sequence
  Synthetic oligonucleotide
ggtgcccactcgacgccgaccgctccttttaatct

SEQ ID NO: 102862 - DNA, 35 bp, Artificial Sequence
  Synthetic oligonucleotide
acgcatcaggagcgcgtcataacttcatgccaggt

SEQ ID NO: 102863 - DNA, 36 bp, Artificial Sequence
  Synthetic oligonucleotide
gaccaccctggatcacgtgcctgttctgaataataa

SEQ ID NO: 102864 - DNA, 36 bp, Artificial Sequence
  Synthetic oligonucleotide
ggtcgggtgttggacgggattagggtgggcggaaca

SEQ ID NO: 102865 - DNA, 36 bp, Artificial Sequence
  Synthetic oligonucleotide
gtgcgcgaatttctgccctcgtcttgaccttgtcca

SEQ ID NO: 102866 - DNA, 36 bp, Artificial Sequence
  Synthetic oligonucleotide
gctgaacaaacttttgccaccccctcgctacttgga

SEQ ID NO: 102867 - DNA, 38 bp, Artificial Sequence
  Synthetic oligonucleotide
tgggccccgccgccatgactcaatctgtcgaagattga

SEQ ID NO: 102868 - DNA, 35 bp, Artificial Sequence
  Synthetic oligonucleotide
gtaccgttggcgacactatccgccgcctcatccat

SEQ ID NO: 102869 - DNA, 35 bp, Artificial Sequence
  Synthetic oligonucleotide
gcacaacgtgatacccgcagtggtttttattttat

SEQ ID NO: 102870 - DNA, 36 bp, Artificial Sequence
  Synthetic oligonucleotide
gtcgcacggacccaccttcttctccgatcacgccaa

SEQ ID NO: 102871 - DNA, 35 bp, Artificial Sequence
  Synthetic oligonucleotide
tctccccaccggttctctggtttgtcctatcccga

SEQ ID NO: 102872 - DNA, 37 bp, Artificial Sequence
  Synthetic oligonucleotide
tctgaacgtccctgtcacctactccttttgctcagga

SEQ ID NO: 102873 - DNA, 35 bp, Artificial Sequence
  Synthetic oligonucleotide
acatcccggccccctctggaacctcacacttagga

SEQ ID NO: 102874 - DNA, 37 bp, Artificial Sequence
  Synthetic oligonucleotide
gacattgctgttactaccgctcctactgggatactga

SEQ ID NO: 102875 - DNA, 37 bp, Artificial Sequence
  Synthetic oligonucleotide
tccatcctgcacttttattcctgcacctcactcctga

SEQ ID NO: 102876 - DNA, 38 bp, Artificial Sequence
  Synthetic oligonucleotide
agttactactgatcgctcttcctatgggtcacctttga

SEQ ID NO: 102877 - DNA, 35 bp, Artificial Sequence
  Synthetic oligonucleotide
gactcgccctctccatcgttcccgagcctgtctta

SEQ ID NO: 102878 - DNA, 36 bp, Artificial Sequence
  Synthetic oligonucleotide
actacaacacaatggaatatgggctcgccttggtta

SEQ ID NO: 102879 - DNA, 35 bp, Artificial Sequence
  Synthetic oligonucleotide
gtctcagtctcccgtgccagtctttctccttttcc

SEQ ID NO: 102880 - DNA, 35 bp, Artificial Sequence
  Synthetic oligonucleotide
tgtacgctgcgataccgagctgacctacctcctgc

SEQ ID NO: 102881 - DNA, 35 bp, Artificial Sequence
  Synthetic oligonucleotide
gagtgcgacacaatcaggcctatatcctattttcg

SEQ ID NO: 102882 - DNA, 36 bp, Artificial Sequence
  Synthetic oligonucleotide
ttgctctgcaaatttaaagttcctccggccatgcaa

SEQ ID NO: 102883 - DNA, 36 bp, Artificial Sequence
  Synthetic oligonucleotide
gatctccctcaggactagcaacgttgcccgatccca

SEQ ID NO: 102884 - DNA, 38 bp, Artificial Sequence
  Synthetic oligonucleotide
gcaccccagctccctggccgtcttacttgcgcccctga

SEQ ID NO: 102885 - DNA, 38 bp, Artificial Sequence
  Synthetic oligonucleotide
gatgcacctccggctagttatcgccacaattcccctga

SEQ ID NO: 102886 - DNA, 35 bp, Artificial Sequence
  Synthetic oligonucleotide
tcagtgcaattttcgaccatatcctgctggcctta

SEQ ID NO: 102887 - DNA, 35 bp, Artificial Sequence
  Synthetic oligonucleotide
gataacgtaggaggatagggtaagtgttatggtta

SEQ ID NO: 102888 - DNA, 36 bp, Artificial Sequence
  Synthetic oligonucleotide
taagcatcaggaggagaacgagacgggagttagatg

SEQ ID NO: 102889 - DNA, 36 bp, Artificial Sequence
  Synthetic oligonucleotide
acctccccccgaaggctagatacgcaccgcttacaa

SEQ ID NO: 102890 - DNA, 36 bp, Artificial Sequence
  Synthetic oligonucleotide
gtagacacgaactgcggcggtcaaaaacgggtgtaa

SEQ ID NO: 102891 - DNA, 34 bp, Artificial Sequence
  Synthetic oligonucleotide
gtgagcgctagcgacctatctgccaccacctcca

SEQ ID NO: 102892 - DNA, 37 bp, Artificial Sequence
  Synthetic oligonucleotide
ggacgggctgggaaacctgaacacggagtggaaatga

SEQ ID NO: 102893 - DNA, 37 bp, Artificial Sequence
  Synthetic oligonucleotide
gccctcgcgtgagctgtagctctatgcgctgacctga

SEQ ID NO: 102894 - DNA, 38 bp, Artificial Sequence
  Synthetic oligonucleotide
ttcgaaaacgacgggtgggtaagagggaggggagctga

SEQ ID NO: 102895 - DNA, 37 bp, Artificial Sequence
  Synthetic oligonucleotide
agtcaatgagccacagtaagtcccggcctttacttga

SEQ ID NO: 102896 - DNA, 35 bp, Artificial Sequence
  Synthetic oligonucleotide
gttaccaccgccacgcagccccgtaagcttggtgc

SEQ ID NO: 102897 - DNA, 34 bp, Artificial Sequence
  Synthetic oligonucleotide
gaccaaggccgcacctccatcaatagtcattctg

SEQ ID NO: 102898 - DNA, 35 bp, Artificial Sequence
  Synthetic oligonucleotide
tgtgaaccttacgcctgccccgtcgcactattcaa

SEQ ID NO: 102899 - DNA, 36 bp, Artificial Sequence
  Synthetic oligonucleotide
actagcgggagtcctagccccctgaccacccaagaa

SEQ ID NO: 102900 - DNA, 36 bp, Artificial Sequence
  Synthetic oligonucleotide
ttgccacttgctgttcccgccctccaggcctccgta

SEQ ID NO: 102901 - DNA, 36 bp, Artificial Sequence
  Synthetic oligonucleotide
tacaccctgcccggtcactgttatctgtttgtgtta

SEQ ID NO: 102902 - DNA, 35 bp, Artificial Sequence
  Synthetic oligonucleotide
gatgcggtccatctgttactcgcgcctgcacttta

SEQ ID NO: 102903 - DNA, 35 bp, Artificial Sequence
  Synthetic oligonucleotide
gggagtgccgcgcagctcctccatttgctttgtcc

SEQ ID NO: 102904 - DNA, 35 bp, Artificial Sequence
  Synthetic oligonucleotide
gccacccctgcttaagtaaaatccctcctttcatg

SEQ ID NO: 102905 - DNA, 35 bp, Artificial Sequence
  Synthetic oligonucleotide
actcacattgcgcaagaatcggaatcctcactcct

SEQ ID NO: 102906 - DNA, 35 bp, Artificial Sequence
  Synthetic oligonucleotide
tgctcacctcgtccacgctttgccattcgctcatt

SEQ ID NO: 102907 - DNA, 35 bp, Artificial Sequence
  Synthetic oligonucleotide
gtgaacgccactccttgctctccttgcccgcaaca

SEQ ID NO: 102908 - DNA, 36 bp, Artificial Sequence
  Synthetic oligonucleotide
tcgcacattcatcatatggtcctgctgcctccacca

SEQ ID NO: 102909 - DNA, 36 bp, Artificial Sequence
  Synthetic oligonucleotide
tctcacattcatcatctggtcctgctgcctccacca

SEQ ID NO: 102910 - DNA, 36 bp, Artificial Sequence
  Synthetic oligonucleotide
gcccagctgtccgcctctcgtctatcacatgtgcca

SEQ ID NO: 102911 - DNA, 37 bp, Artificial Sequence
  Synthetic oligonucleotide
aggagccgctacaattcctccttcacgcagactgcga

SEQ ID NO: 102912 - DNA, 38 bp, Artificial Sequence
  Synthetic oligonucleotide
ggtagaggaggaacgaagatcgggtcagaatgacatga

SEQ ID NO: 102913 - DNA, 37 bp, Artificial Sequence
  Synthetic oligonucleotide
gcgataccccgtgcaccgttcatgccattctacctga

SEQ ID NO: 102914 - DNA, 38 bp, Artificial Sequence
  Synthetic oligonucleotide
tgaacgagatagcatagaacgaaatgaggtgggtgtga

SEQ ID NO: 102915 - DNA, 38 bp, Artificial Sequence
  Synthetic oligonucleotide
tcagccccccccctcgaatccccgcaccaggcgtttga

SEQ ID NO: 102916 - DNA, 36 bp, Artificial Sequence
  Synthetic oligonucleotide
agtcccacgccacacccaagccgtccacaggtatta

SEQ ID NO: 102917 - DNA, 35 bp, Artificial Sequence
  Synthetic oligonucleotide
accctccgagaccacctccggaaccgccgtgcctc

SEQ ID NO: 102918 - DNA, 35 bp, Artificial Sequence
  Synthetic oligonucleotide
atactactcgccctgcttttggttttcacttggat

SEQ ID NO: 102919 - DNA, 35 bp, Artificial Sequence
  Synthetic oligonucleotide
aactcacaccactgagttcaaaaatcaaagtttaa

SEQ ID NO: 102920 - DNA, 36 bp, Artificial Sequence
  Synthetic oligonucleotide
acgcacacgcgggcaagcacacactaagttcacgga

SEQ ID NO: 102921 - DNA, 38 bp, Artificial Sequence
  Synthetic oligonucleotide
gctgccacccgaccgcaacacgagctgtctctacgtga

SEQ ID NO: 102922 - DNA, 36 bp, Artificial Sequence
  Synthetic oligonucleotide
ttatctcaagccaagtgacggcttgcatcccaacta

SEQ ID NO: 102923 - DNA, 35 bp, Artificial Sequence
  Synthetic oligonucleotide
tcccgccgcatttccctggctcaagccctcttgta

SEQ ID NO: 102924 - DNA, 35 bp, Artificial Sequence
  Synthetic oligonucleotide
gatgcgcttcgaagccctctagtaaatgccgtaac

SEQ ID NO: 102925 - DNA, 35 bp, Artificial Sequence
  Synthetic oligonucleotide
gttccactgcctcatagcttattccagccttaccc

SEQ ID NO: 102926 - DNA, 34 bp, Artificial Sequence
  Synthetic oligonucleotide
ttgagcgcttgctacgtgtcccccacatcatact

SEQ ID NO: 102927 - DNA, 35 bp, Artificial Sequence
  Synthetic oligonucleotide
gagggctcacgtcctccccccgcgccgcgtggtct

SEQ ID NO: 102928 - DNA, 35 bp, Artificial Sequence
  Synthetic oligonucleotide
ggagcccgcacaccggtaacttttggcctttttca

SEQ ID NO: 102929 - DNA, 34 bp, Artificial Sequence
  Synthetic oligonucleotide
gtgagcgctagctacctatctgccaccacctcga

SEQ ID NO: 102930 - DNA, 37 bp, Artificial Sequence
  Synthetic oligonucleotide
gcaaacacagtgggtgggtgagtaatgagtagcagga

SEQ ID NO: 102931 - DNA, 38 bp, Artificial Sequence
  Synthetic oligonucleotide
tacacatgaggtgagggaatgaggagggagtagggtga

SEQ ID NO: 102932 - DNA, 36 bp, Artificial Sequence
  Synthetic oligonucleotide
ttcccactgcaccgtgtctggctcccaataccgcta

SEQ ID NO: 102933 - DNA, 36 bp, Artificial Sequence
  Synthetic oligonucleotide
ggcgccaccgaaatctcacctttgccctgtgccaac

SEQ ID NO: 102934 - DNA, 35 bp, Artificial Sequence
  Synthetic oligonucleotide
acacgaagcgcttcccccatgccgtcactctgccc

SEQ ID NO: 102935 - DNA, 35 bp, Artificial Sequence
  Synthetic oligonucleotide
gctaatccggcgccttttctatgtctcaccctctt

SEQ ID NO: 102936 - DNA, 35 bp, Artificial Sequence
  Synthetic oligonucleotide
tttgccaccattcctcactgcacattgtaaagaca

SEQ ID NO: 102937 - DNA, 36 bp, Artificial Sequence
  Synthetic oligonucleotide
tccaccgtgaaacacgagctacaccgagcctggata

SEQ ID NO: 102938 - DNA, 35 bp, Artificial Sequence
  Synthetic oligonucleotide
accccacctgcgaatacttccttcacaccttggta

SEQ ID NO: 102939 - DNA, 36 bp, Artificial Sequence
  Synthetic oligonucleotide
tgtgtgcgtgatgcctcgattcccctttcgtcatta

SEQ ID NO: 102940 - DNA, 35 bp, Artificial Sequence
  Synthetic oligonucleotide
gcccatcaggagtcgtaggctctgcatccaccaac

SEQ ID NO: 102941 - DNA, 35 bp, Artificial Sequence
  Synthetic oligonucleotide
gtaccgattcctcatgcacctaaaccgcaatttgc

SEQ ID NO: 102942 - DNA, 35 bp, Artificial Sequence
  Synthetic oligonucleotide
tctctcatcaacatgagacacactgatggtttgtc

SEQ ID NO: 102943 - DNA, 36 bp, Artificial Sequence
  Synthetic oligonucleotide
gctgcactgctccatcttattgtgcgttctcgcacg

SEQ ID NO: 102944 - DNA, 35 bp, Artificial Sequence
  Synthetic oligonucleotide
atcacctgcactatctcgtcccgggctgccaacct

SEQ ID NO: 102945 - DNA, 35 bp, Artificial Sequence
  Synthetic oligonucleotide
tccagcattgctcataccaccccatacttcacatt

SEQ ID NO: 102946 - DNA, 35 bp, Artificial Sequence
  Synthetic oligonucleotide
gcgaccggcatcatacccaccacgcgcaacctaca

SEQ ID NO: 102947 - DNA, 36 bp, Artificial Sequence
  Synthetic oligonucleotide
tgagccttgccccattatctttcggttactgctcca

SEQ ID NO: 102948 - DNA, 36 bp, Artificial Sequence
  Synthetic oligonucleotide
gtcgtgcgaatagggggctgaaggagctaactagga

SEQ ID NO: 102949 - DNA, 38 bp, Artificial Sequence
  Synthetic oligonucleotide
acgctaagggtgggagggggactgaaacagaggcctga

SEQ ID NO: 102950 - DNA, 35 bp, Artificial Sequence
  Synthetic oligonucleotide
gttcccacaaccggggcctgcacaccaatacttta

SEQ ID NO: 102951 - DNA, 35 bp, Artificial Sequence
  Synthetic oligonucleotide
gttggtccccgctgctttctgttagctccatcctc

SEQ ID NO: 102952 - DNA, 35 bp, Artificial Sequence
  Synthetic oligonucleotide
acctacccactcctgtataatggacaacctagctc

SEQ ID NO: 102953 - DNA, 35 bp, Artificial Sequence
  Synthetic oligonucleotide
tacgctgggatctgccgcctcttgccgccttctat

SEQ ID NO: 102954 - DNA, 31 bp, Artificial Sequence
  Synthetic oligonucleotide
aatgcacccgcccccacatagctcatcaact

SEQ ID NO: 102955 - DNA, 36 bp, Artificial Sequence
  Synthetic oligonucleotide
cccgcactcctcggaactgtcccgccacatgctcaa

SEQ ID NO: 102956 - DNA, 36 bp, Artificial Sequence
  Synthetic oligonucleotide
gagctgaaggcacactaggtaggcggggaacgggaa

SEQ ID NO: 102957 - DNA, 35 bp, Artificial Sequence
  Synthetic oligonucleotide
tactacgggccctctacatcactcacgctccccga

SEQ ID NO: 102958 - DNA, 37 bp, Artificial Sequence
  Synthetic oligonucleotide
ggacgtttgagggcggaaagttgaggggtaggggcga

SEQ ID NO: 102959 - DNA, 37 bp, Artificial Sequence
  Synthetic oligonucleotide
cttgcccttcctccagccatcgctcctgtactttcga

SEQ ID NO: 102960 - DNA, 38 bp, Artificial Sequence
  Synthetic oligonucleotide
gctcccacggccctgggtgctgttcacctattccatga

SEQ ID NO: 102961 - DNA, 35 bp, Artificial Sequence
  Synthetic oligonucleotide
taccgacgtacgaagggtaccctgcccattatttc

SEQ ID NO: 102962 - DNA, 33 bp, Artificial Sequence
  Synthetic oligonucleotide
gtggtcccgcacattaccctggccctcgctcct

SEQ ID NO: 102963 - DNA, 35 bp, Artificial Sequence
  Synthetic oligonucleotide
gaggggtgccaaattagctttctacgttcccctgt

SEQ ID NO: 102964 - DNA, 37 bp, Artificial Sequence
  Synthetic oligonucleotide
tcacacgtcaggcgcgccgatcgccccttcgaataca

SEQ ID NO: 102965 - DNA, 38 bp, Artificial Sequence
  Synthetic oligonucleotide
gacgaccatcagggaattgctaatattgccaagtagga

SEQ ID NO: 102966 - DNA, 36 bp, Artificial Sequence
  Synthetic oligonucleotide
tgaaagtggtgtgtggtggggcacagcagagggtga

SEQ ID NO: 102967 - DNA, 35 bp, Artificial Sequence
  Synthetic oligonucleotide
ccgtgtaccggtccggccatgttaatgccaggcac

SEQ ID NO: 102968 - DNA, 35 bp, Artificial Sequence
  Synthetic oligonucleotide
tcaggggggggggatagcggtcgagagatgacagt

SEQ ID NO: 102969 - DNA, 35 bp, Artificial Sequence
  Synthetic oligonucleotide
gattgcaacgcactaggccctcactactatcccga

SEQ ID NO: 102970 - DNA, 38 bp, Artificial Sequence
  Synthetic oligonucleotide
acaactagcacagtagcacaaaggaggtctcggggtga

SEQ ID NO: 102971 - DNA, 37 bp, Artificial Sequence
  Synthetic oligonucleotide
accccggggcgtgggtaagggtgggggcatagattga

SEQ ID NO: 102972 - DNA, 36 bp, Artificial Sequence
  Synthetic oligonucleotide
tgctatgcaacgcctagtatccaatttgtctgccta

SEQ ID NO: 102973 - DNA, 36 bp, Artificial Sequence
  Synthetic oligonucleotide
gtgctccctcgctatatagcggctatcattcactta

SEQ ID NO: 102974 - DNA, 35 bp, Artificial Sequence
  Synthetic oligonucleotide
gtgcacgaccgcatatgatcgttctaccttgggcc

SEQ ID NO: 102975 - DNA, 35 bp, Artificial Sequence
  Synthetic oligonucleotide
atgcgcagttcacagcccagcctatcactacccgc

SEQ ID NO: 102976 - DNA, 35 bp, Artificial Sequence
  Synthetic oligonucleotide
taaacacgcctcctctttccatcgcgaagcctgct

SEQ ID NO: 102977 - DNA, 35 bp, Artificial Sequence
  Synthetic oligonucleotide
gagtgctgccatgtatttcttattgcatctcttgt

SEQ ID NO: 102978 - DNA, 33 bp, Artificial Sequence
  Synthetic oligonucleotide
gacgaaggtggaagggggttgatcaaagtcgaa

SEQ ID NO: 102979 - DNA, 36 bp, Artificial Sequence
  Synthetic oligonucleotide
gacgcattgcggagctctaacgacctaatcttcgca

SEQ ID NO: 102980 - DNA, 35 bp, Artificial Sequence
  Synthetic oligonucleotide
ttcagactgcgcgcctccgtcccccctgtaaccga

SEQ ID NO: 102981 - DNA, 38 bp, Artificial Sequence
  Synthetic oligonucleotide
tggtgcacgggggggaagctagtgaggggggcaaatga

SEQ ID NO: 102982 - DNA, 35 bp, Artificial Sequence
  Synthetic oligonucleotide
gttgctgcgcccgtctaactcccgccctcttcagc

SEQ ID NO: 102983 - DNA, 35 bp, Artificial Sequence
  Synthetic oligonucleotide
tgggaagaagggtggtagggggaaagaaatcgatg

SEQ ID NO: 102984 - DNA, 35 bp, Artificial Sequence
  Synthetic oligonucleotide
ccatgaaggtcgagtagctaattgaccataggggt

SEQ ID NO: 102985 - DNA, 36 bp, Artificial Sequence
  Synthetic oligonucleotide
tacaccctcggaccttcgggcacctgcaccctgtga

SEQ ID NO: 102986 - DNA, 36 bp, Artificial Sequence
  Synthetic oligonucleotide
gtggccggttaacgccaccctctactctttccttga

SEQ ID NO: 102987 - DNA, 35 bp, Artificial Sequence
  Synthetic oligonucleotide
aaactccacctgctacattacacaccttcagttga

SEQ ID NO: 102988 - DNA, 34 bp, Artificial Sequence
  Synthetic oligonucleotide
atccatcatcccaccgcaggcaactcctacagtc

SEQ ID NO: 102989 - DNA, 35 bp, Artificial Sequence
  Synthetic oligonucleotide
gttatacgctgccttgtctcacgtctacccccgtc

SEQ ID NO: 102990 - DNA, 35 bp, Artificial Sequence
  Synthetic oligonucleotide
ttagaccaccggcttgggatgggcttatgtgtact

SEQ ID NO: 102991 - DNA, 35 bp, Artificial Sequence
  Synthetic oligonucleotide
acgacgatccctccccgctagcaccacgctctctt

SEQ ID NO: 102992 - DNA, 36 bp, Artificial Sequence
  Synthetic oligonucleotide
tatccgccccctcggccttataaccgcacaactgaa

SEQ ID NO: 102993 - DNA, 37 bp, Artificial Sequence
  Synthetic oligonucleotide
gcccccacgctctcttttagtacacccacgggtgcga

SEQ ID NO: 102994 - DNA, 36 bp, Artificial Sequence
  Synthetic oligonucleotide
gtcaagcacccatccactttgatccccctacacgga

SEQ ID NO: 102995 - DNA, 37 bp, Artificial Sequence
  Synthetic oligonucleotide
ttcgcaaccctcgcttagtgaattctactgtgatgga

SEQ ID NO: 102996 - DNA, 36 bp, Artificial Sequence
  Synthetic oligonucleotide
acccgcctttcccacgcacaacagttacgctactta

SEQ ID NO: 102997 - DNA, 35 bp, Artificial Sequence
  Synthetic oligonucleotide
tgaccacttgctgcccttgtcttccatcaacacaa

SEQ ID NO: 102998 - DNA, 36 bp, Artificial Sequence
  Synthetic oligonucleotide
tactacccggctgttttcgttcacgcctgccatgca

SEQ ID NO: 102999 - DNA, 38 bp, Artificial Sequence
  Synthetic oligonucleotide
ccggatccgcccagcgcgcaatccccccacttccgtga

SEQ ID NO: 103000 - DNA, 38 bp, Artificial Sequence
  Synthetic oligonucleotide
tccctcccccctactttgttgatggtcggtccctttga

SEQ ID NO: 103001 - DNA, 36 bp, Artificial Sequence
  Synthetic oligonucleotide
gactcggacttcctggcaagccccatccacttagca

SEQ ID NO: 103002 - DNA, 35 bp, Artificial Sequence
  Synthetic oligonucleotide
accaaagcgctgccaacctcacttccttacgctca

SEQ ID NO: 103003 - DNA, 36 bp, Artificial Sequence
  Synthetic oligonucleotide
tttgccacggttgttttgtttttcgcgtgttggtca

SEQ ID NO: 103004 - DNA, 35 bp, Artificial Sequence
  Synthetic oligonucleotide
acacaacgggggtaacggtcataggggggtaaaga

SEQ ID NO: 103005 - DNA, 36 bp, Artificial Sequence
  Synthetic oligonucleotide
tgtgccaatgggccaatttggttctgatcaatccga

SEQ ID NO: 103006 - DNA, 37 bp, Artificial Sequence
  Synthetic oligonucleotide
gtgccctccaacgctactctcgcgatagcactcgcga

SEQ ID NO: 103007 - DNA, 37 bp, Artificial Sequence
  Synthetic oligonucleotide
ttgtgctgccaaggtgggaggtagagatatcgtcgga

SEQ ID NO: 103008 - DNA, 38 bp, Artificial Sequence
  Synthetic oligonucleotide
tgcctgataccgtgttacccgcaatctttgtgaattga

SEQ ID NO: 103009 - DNA, 36 bp, Artificial Sequence
  Synthetic oligonucleotide
gtgctcaggcagacgtcatttcccggcttctctgca

SEQ ID NO: 103010 - DNA, 38 bp, Artificial Sequence
  Synthetic oligonucleotide
tgcccccccacctgaattaagtcccgtcagggcactga

SEQ ID NO: 103011 - DNA, 38 bp, Artificial Sequence
  Synthetic oligonucleotide
aactccgagccctcagccgaggattcctctcgccttga

SEQ ID NO: 103012 - DNA, 38 bp, Artificial Sequence
  Synthetic oligonucleotide
tagagaagcagaagggtggcgtggaacgggttggttga

SEQ ID NO: 103013 - DNA, 36 bp, Artificial Sequence
  Synthetic oligonucleotide
gacccgcaatggggcagggttttttttgatatcgta

SEQ ID NO: 103014 - DNA, 35 bp, Artificial Sequence
  Synthetic oligonucleotide
gacgcgggacaggtcatcatctagcccacttttat

SEQ ID NO: 103015 - DNA, 35 bp, Artificial Sequence
  Synthetic oligonucleotide
aacatcccacccctgcgcgtaacgtctggcctgct

SEQ ID NO: 103016 - DNA, 37 bp, Artificial Sequence
  Synthetic oligonucleotide
gtcatcacgtacatcccttcccccgcccctcaccgca

SEQ ID NO: 103017 - DNA, 35 bp, Artificial Sequence
  Synthetic oligonucleotide
ttcagtcgccatccctagggatctccttgcactca

SEQ ID NO: 103018 - DNA, 36 bp, Artificial Sequence
  Synthetic oligonucleotide
tccctcacgcccggggagcctacgtgacgggagtca

SEQ ID NO: 103019 - DNA, 36 bp, Artificial Sequence
  Synthetic oligonucleotide
acaaactgccctcggaaccctcgactctcccaacga

SEQ ID NO: 103020 - DNA, 38 bp, Artificial Sequence
  Synthetic oligonucleotide
accacgtccaagctccaaagtgtgcctgctccttatga

SEQ ID NO: 103021 - DNA, 37 bp, Artificial Sequence
  Synthetic oligonucleotide
tacctcctgtttgatcccgaagtcgttttggccctga

SEQ ID NO: 103022 - DNA, 38 bp, Artificial Sequence
  Synthetic oligonucleotide
tactcccccccgccacttgtagttgaagaccggagtga

SEQ ID NO: 103023 - DNA, 38 bp, Artificial Sequence
  Synthetic oligonucleotide
gccgcctctatatacactgcaccctagatcgtacttga

SEQ ID NO: 103024 - DNA, 36 bp, Artificial Sequence
  Synthetic oligonucleotide
gacacgtacagtatctgacgcgaattggggggaata

SEQ ID NO: 103025 - DNA, 35 bp, Artificial Sequence
  Synthetic oligonucleotide
tgttcctaccacccgcgggacttacctgccctata

SEQ ID NO: 103026 - DNA, 35 bp, Artificial Sequence
  Synthetic oligonucleotide
gatcactcatggtactgtgcttatgcccctgtata

SEQ ID NO: 103027 - DNA, 35 bp, Artificial Sequence
  Synthetic oligonucleotide
agtcacgcgcactttgagtcatcacgccaccttta

SEQ ID NO: 103028 - DNA, 35 bp, Artificial Sequence
  Synthetic oligonucleotide
acaacgcaccgactcccccatcttgctgtctactc

SEQ ID NO: 103029 - DNA, 35 bp, Artificial Sequence
  Synthetic oligonucleotide
atctgcaatcaccgttgcctcatcttagaatcccg

SEQ ID NO: 103030 - DNA, 35 bp, Artificial Sequence
  Synthetic oligonucleotide
atcagagagggggggaatgagtggaaggggaattg

SEQ ID NO: 103031 - DNA, 36 bp, Artificial Sequence
  Synthetic oligonucleotide
gccatcaccagcgcgcaatcccttcctctacgtgca

SEQ ID NO: 103032 - DNA, 36 bp, Artificial Sequence
  Synthetic oligonucleotide
tagtccagcgtaaccactgcgaccccctacccctca

SEQ ID NO: 103033 - DNA, 36 bp, Artificial Sequence
  Synthetic oligonucleotide
aacacctcagtccgactgctatgtttacagtttaga

SEQ ID NO: 103034 - DNA, 37 bp, Artificial Sequence
  Synthetic oligonucleotide
acagaccatcatctacgctcagaccagctctgacgga

SEQ ID NO: 103035 - DNA, 38 bp, Artificial Sequence
  Synthetic oligonucleotide
gagccacgttacatgtgcgcttccgttcacttccatga

SEQ ID NO: 103036 - DNA, 35 bp, Artificial Sequence
  Synthetic oligonucleotide
agccacgagccccatctctagcaccacacactcta

SEQ ID NO: 103037 - DNA, 36 bp, Artificial Sequence
  Synthetic oligonucleotide
atccagccaggctgcgtactctggtccaccacttta

SEQ ID NO: 103038 - DNA, 35 bp, Artificial Sequence
  Synthetic oligonucleotide
tcatgcaagccgacggtgatcatccgaattcgtac

SEQ ID NO: 103039 - DNA, 35 bp, Artificial Sequence
  Synthetic oligonucleotide
atgcgccacaactttgcggagccaccaatcctgtc

SEQ ID NO: 103040 - DNA, 36 bp, Artificial Sequence
  Synthetic oligonucleotide
agtgaggggacggaggggagcgaagggtgcatagtg

SEQ ID NO: 103041 - DNA, 35 bp, Artificial Sequence
  Synthetic oligonucleotide
accaccgtaggtgtgccctgcctccttaatatggt

SEQ ID NO: 103042 - DNA, 36 bp, Artificial Sequence
  Synthetic oligonucleotide
gaggacgaaccacggaggagagcgagcgggtggcaa

SEQ ID NO: 103043 - DNA, 36 bp, Artificial Sequence
  Synthetic oligonucleotide
gcaatgcctcgaattgaccccctctgcacactccca

SEQ ID NO: 103044 - DNA, 37 bp, Artificial Sequence
  Synthetic oligonucleotide
tccatcctgcacttttattcctgcaccgcactcctca

SEQ ID NO: 103045 - DNA, 36 bp, Artificial Sequence
  Synthetic oligonucleotide
ggtaacctgcctgtaatgcaactcctacctgtgaga

SEQ ID NO: 103046 - DNA, 36 bp, Artificial Sequence
  Synthetic oligonucleotide
ttgtccagacccgccttcgaactgtccatactgtta

SEQ ID NO: 103047 - DNA, 35 bp, Artificial Sequence
  Synthetic oligonucleotide
tgacaccattcagtacctgtccaggcgattcaaac

SEQ ID NO: 103048 - DNA, 34 bp, Artificial Sequence
  Synthetic oligonucleotide
tcctccctcaccacccgagatacgcatatcgcgg

SEQ ID NO: 103049 - DNA, 36 bp, Artificial Sequence
  Synthetic oligonucleotide
aggtacaggaggggggtgaagcaaacacaatgggtg

SEQ ID NO: 103050 - DNA, 35 bp, Artificial Sequence
  Synthetic oligonucleotide
gactcatccgtgttgcagataataaccgattccaa

SEQ ID NO: 103051 - DNA, 36 bp, Artificial Sequence
  Synthetic oligonucleotide
gtcgccttaccaccgtttctacccgctccagagcaa

SEQ ID NO: 103052 - DNA, 36 bp, Artificial Sequence
  Synthetic oligonucleotide
atggaggaaagtggggcataggagctcaatcgacca

SEQ ID NO: 103053 - DNA, 35 bp, Artificial Sequence
  Synthetic oligonucleotide
gacctgacctcaattcccgatagtactcgggccca

SEQ ID NO: 103054 - DNA, 37 bp, Artificial Sequence
  Synthetic oligonucleotide
ttgagcgggaatggactggcggtgggggcgtaaggga

SEQ ID NO: 103055 - DNA, 38 bp, Artificial Sequence
  Synthetic oligonucleotide
acccaacgtatgtgaccttcccgtgttcgccgaaatga

SEQ ID NO: 103056 - DNA, 37 bp, Artificial Sequence
  Synthetic oligonucleotide
ggaacgtacagaacacgacagtcggaggaggggttga

SEQ ID NO: 103057 - DNA, 38 bp, Artificial Sequence
  Synthetic oligonucleotide
atggatggcgcgggggaggaaagggtgggatgatttga

SEQ ID NO: 103058 - DNA, 36 bp, Artificial Sequence
  Synthetic oligonucleotide
tcccactcactacctaagtccactaacttccggtta

SEQ ID NO: 103059 - DNA, 35 bp, Artificial Sequence
  Synthetic oligonucleotide
gttactgcctgcctaatcagttgccattcccttac

SEQ ID NO: 103060 - DNA, 35 bp, Artificial Sequence
  Synthetic oligonucleotide
actaaccctacaactgtttcaggtattcacctccc

SEQ ID NO: 103061 - DNA, 35 bp, Artificial Sequence
  Synthetic oligonucleotide
accaagctcacagctagcctttccagttctttgat

SEQ ID NO: 103062 - DNA, 35 bp, Artificial Sequence
  Synthetic oligonucleotide
acacaccacctaacatgttcgccgttccgctcttg

SEQ ID NO: 103063 - DNA, 38 bp, Artificial Sequence
  Synthetic oligonucleotide
tgagggcggagggaggggggtggatttggacggtatga

SEQ ID NO: 103064 - DNA, 35 bp, Artificial Sequence
  Synthetic oligonucleotide
tcccaccgccccatctttgcatatgccctgccacg

SEQ ID NO: 103065 - DNA, 37 bp, Artificial Sequence
  Synthetic oligonucleotide
ggaggtggtggggtggacttatggcggtacctgttga

SEQ ID NO: 103066 - DNA, 35 bp, Artificial Sequence
  Synthetic oligonucleotide
gacgcccctcatttctgtcctgcccgccctgtacg

SEQ ID NO: 103067 - DNA, 37 bp, Artificial Sequence
  Synthetic oligonucleotide
tggggagtggcggtttccatcctagggcggtggggga

SEQ ID NO: 103068 - DNA, 35 bp, Artificial Sequence
  Synthetic oligonucleotide
gggtggcgggggggttttgcggatggcacatcgcg

SEQ ID NO: 103069 - DNA, 35 bp, Artificial Sequence
  Synthetic oligonucleotide
gagagggtgggagggtactcattgctccgggggac

SEQ ID NO: 103070 - DNA, 35 bp, Artificial Sequence
  Synthetic oligonucleotide
aactcccgctccatgcgtctcccagcccctctgcc

SEQ ID NO: 103071 - DNA, 35 bp, Artificial Sequence
  Synthetic oligonucleotide
acaccacctcaccatctgtgcttcttaccctggcc

SEQ ID NO: 103072 - DNA, 36 bp, Artificial Sequence
  Synthetic oligonucleotide
ggggtgggcgcatgccataatatagtgaaagaggga

SEQ ID NO: 103073 - DNA, 34 bp, Artificial Sequence
  Synthetic oligonucleotide
ttcgccgccccattgcttgttccatccgtcttcc

SEQ ID NO: 103074 - DNA, 37 bp, Artificial Sequence
  Synthetic oligonucleotide
gttccgggcggggttgtttggggtgtcgctctgggga

SEQ ID NO: 103075 - DNA, 37 bp, Artificial Sequence
  Synthetic oligonucleotide
accacgggcggggttgtgttttgttggggagagggga

SEQ ID NO: 103076 - DNA, 35 bp, Artificial Sequence
  Synthetic oligonucleotide
gtcccccgccccttctgttcaagccccgtggccca

SEQ ID NO: 103077 - DNA, 35 bp, Artificial Sequence
  Synthetic oligonucleotide
gcaccaccccacatgtcacttagccgccctcacca

SEQ ID NO: 103078 - DNA, 35 bp, Artificial Sequence
  Synthetic oligonucleotide
ttggagagtgggtgggagggttctggcaccactgg

SEQ ID NO: 103079 - DNA, 36 bp, Artificial Sequence
  Synthetic oligonucleotide
tacctgccgggggggggtaaaatgctggggagggaa

SEQ ID NO: 103080 - DNA, 35 bp, Artificial Sequence
  Synthetic oligonucleotide
gatacatccgatagccttccgtccctgccgtgcct

SEQ ID NO: 103081 - DNA, 35 bp, Artificial Sequence
  Synthetic oligonucleotide
acctcccgcccctcatagtcgtaacgtacccactg

SEQ ID NO: 103082 - DNA, 35 bp, Artificial Sequence
  Synthetic oligonucleotide
acgctccacatgtccatccctcggtctgttccttc

SEQ ID NO: 103083 - DNA, 35 bp, Artificial Sequence
  Synthetic oligonucleotide
gaccaccacattcttcgttggacgctctcctccac

SEQ ID NO: 103084 - DNA, 29 bp, Artificial Sequence
  Synthetic oligonucleotide
ttgcgccctcaccctgtcgcccttactca

SEQ ID NO: 103085 - DNA, 35 bp, Artificial Sequence
  Synthetic oligonucleotide
tgtggcccccgaactgttttctcgcccgtaccgcc

SEQ ID NO: 103086 - DNA, 29 bp, Artificial Sequence
  Synthetic oligonucleotide
atgtgacatctccgccggttccttgctcc

SEQ ID NO: 103087 - DNA, 35 bp, Artificial Sequence
  Synthetic oligonucleotide
agcccatgcctccattattctcggttacctgcctc

SEQ ID NO: 103088 - DNA, 35 bp, Artificial Sequence
  Synthetic oligonucleotide
tccacatccgcactgcacagacctcagccccgtcc

SEQ ID NO: 103089 - DNA, 34 bp, Artificial Sequence
  Synthetic oligonucleotide
gtcgccccctccctgcattgttagctttcacctt

SEQ ID NO: 103090 - DNA, 35 bp, Artificial Sequence
  Synthetic oligonucleotide
agcgccccctctgcttttgttccgtctgctccatc

SEQ ID NO: 103091 - DNA, 35 bp, Artificial Sequence
  Synthetic oligonucleotide
tacgcccattccctccgcccgttatgctactgttc

SEQ ID NO: 103092 - DNA, 35 bp, Artificial Sequence
  Synthetic oligonucleotide
tgcgatccccctctgctgttttttcttgcgcctcc

SEQ ID NO: 103093 - DNA, 35 bp, Artificial Sequence
  Synthetic oligonucleotide
tctagccccgtccccacttaagcccccacgtccgt

SEQ ID NO: 103094 - DNA, 35 bp, Artificial Sequence
  Synthetic oligonucleotide
tccccctccccatgtatgatcacgcgaaccgccac

SEQ ID NO: 103095 - DNA, 35 bp, Artificial Sequence
  Synthetic oligonucleotide
gcctgccacacttgcgttcctatccgtttcccgta

SEQ ID NO: 103096 - DNA, 35 bp, Artificial Sequence
  Synthetic oligonucleotide
gacgggggaaggcaggagaggggaaggtggaggca

SEQ ID NO: 103097 - DNA, 36 bp, Artificial Sequence
  Synthetic oligonucleotide
acgctcgccctccactgttacatgcccaccgcctca

SEQ ID NO: 103098 - DNA, 35 bp, Artificial Sequence
  Synthetic oligonucleotide
tgtgtgcctcgcctgattatccctgcggcccttcc

SEQ ID NO: 103099 - DNA, 38 bp, Artificial Sequence
  Synthetic oligonucleotide
acaggaggcggatgggacgtggtgtgggcggatcttga

SEQ ID NO: 103100 - DNA, 35 bp, Artificial Sequence
  Synthetic oligonucleotide
gaccgcctgccacacatcttccatacgcccctccg

SEQ ID NO: 103101 - DNA, 35 bp, Artificial Sequence
  Synthetic oligonucleotide
tgcaagaggaggggagaaggaacggtacggagtgg

SEQ ID NO: 103102 - DNA, 35 bp, Artificial Sequence
  Synthetic oligonucleotide
acgccccactagctgcattccgtcgttccctgttg

SEQ ID NO: 103103 - DNA, 33 bp, Artificial Sequence
  Synthetic oligonucleotide
tcagacgctctgcgcttgttcctacacccccgc

SEQ ID NO: 103104 - DNA, 38 bp, Artificial Sequence
  Synthetic oligonucleotide
ggggcggggacagctggggttcaaggtacagggggtga

SEQ ID NO: 103105 - DNA, 35 bp, Artificial Sequence
  Synthetic oligonucleotide
gcgaacgccactaatctgttgtctcctccatctcg

SEQ ID NO: 103106 - DNA, 34 bp, Artificial Sequence
  Synthetic oligonucleotide
aagcaccagcccaacgtctgccgacccaccatca

SEQ ID NO: 103107 - DNA, 35 bp, Artificial Sequence
  Synthetic oligonucleotide
tcgcacttccatcccgtctatccttcgcctgttca

SEQ ID NO: 103108 - DNA, 35 bp, Artificial Sequence
  Synthetic oligonucleotide
gtcactcccctgtcctgctacatagtatgctctac

SEQ ID NO: 103109 - DNA, 35 bp, Artificial Sequence
  Synthetic oligonucleotide
atggtggagggggagggagggacgggctagagaca

SEQ ID NO: 103110 - DNA, 37 bp, Artificial Sequence
  Synthetic oligonucleotide
aagacgggactgttgtaggggacgtgagggagggaga

SEQ ID NO: 103111 - DNA, 36 bp, Artificial Sequence
  Synthetic oligonucleotide
ttggagagcgggtgggtgggtcgaacatgccaaata

SEQ ID NO: 103112 - DNA, 35 bp, Artificial Sequence
  Synthetic oligonucleotide
tcaccctcccatgctcgcatagtctgccccttgcc

SEQ ID NO: 103113 - DNA, 35 bp, Artificial Sequence
  Synthetic oligonucleotide
atgccacgcacctcccatgctgtccacttgtcctt

SEQ ID NO: 103114 - DNA, 30 bp, Artificial Sequence
  Synthetic oligonucleotide
tacatcccccctgcctgcccgtatctagca

SEQ ID NO: 103115 - DNA, 35 bp, Artificial Sequence
  Synthetic oligonucleotide
tgcatgttgggcggggcgcgtatgtatggtggctt

SEQ ID NO: 103116 - DNA, 35 bp, Artificial Sequence
  Synthetic oligonucleotide
gtggcggaggcggggggtggatggagggcaatcaa

SEQ ID NO: 103117 - DNA, 35 bp, Artificial Sequence
  Synthetic oligonucleotide
atggggggggagtgagacgggaaggggaagagaag

SEQ ID NO: 103118 - DNA, 35 bp, Artificial Sequence
  Synthetic oligonucleotide
acacaccgccactccttgtactgccagcccctctt

SEQ ID NO: 103119 - DNA, 35 bp, Artificial Sequence
  Synthetic oligonucleotide
tccagccccatttctatagccactgtcccgtcacc

SEQ ID NO: 103120 - DNA, 36 bp, Artificial Sequence
  Synthetic oligonucleotide
ggtgccacgcggcggtgggaagggacgggagggtga

SEQ ID NO: 103121 - DNA, 37 bp, Artificial Sequence
  Synthetic oligonucleotide
taaggtggaggcggggttggacggacagcatggtgga

SEQ ID NO: 103122 - DNA, 36 bp, Artificial Sequence
  Synthetic oligonucleotide
aactcatggcggaggagggggtcctgggtggtggca

SEQ ID NO: 103123 - DNA, 35 bp, Artificial Sequence
  Synthetic oligonucleotide
tccaccccccgtctagatgtatctgttcttcccct

SEQ ID NO: 103124 - DNA, 35 bp, Artificial Sequence
  Synthetic oligonucleotide
ggtgtcgcaccatgcctcgaatcgtcctcccgttc

SEQ ID NO: 103125 - DNA, 37 bp, Artificial Sequence
  Synthetic oligonucleotide
aactgggggcacatggggacaaactatcgggagggga

SEQ ID NO: 103126 - DNA, 35 bp, Artificial Sequence
  Synthetic oligonucleotide
ttccgccccagcttgtcccgccgtaaattatcctt

SEQ ID NO: 103127 - DNA, 35 bp, Artificial Sequence
  Synthetic oligonucleotide
gttccacgccccttgtcctcattacctagcccccg

SEQ ID NO: 103128 - DNA, 35 bp, Artificial Sequence
  Synthetic oligonucleotide
gataccaccaactgttcgtgtccctgctcccctta

SEQ ID NO: 103129 - DNA, 35 bp, Artificial Sequence
  Synthetic oligonucleotide
tcccccagcccattcgcttgaccacgcccccttgc

SEQ ID NO: 103130 - DNA, 36 bp, Artificial Sequence
  Synthetic oligonucleotide
tgcggggccaatgtgtggggtgggcacccaggggta

SEQ ID NO: 103131 - DNA, 35 bp, Artificial Sequence
  Synthetic oligonucleotide
tacaccccgcctttcgtatcctcgagccccaccgc

SEQ ID NO: 103132 - DNA, 35 bp, Artificial Sequence
  Synthetic oligonucleotide
gccatcccccgcttgttccggtgccctgtttactc

SEQ ID NO: 103133 - DNA, 35 bp, Artificial Sequence
  Synthetic oligonucleotide
agcagacgctcctccgtccatttccgtcttgcccc

SEQ ID NO: 103134 - DNA, 35 bp, Artificial Sequence
  Synthetic oligonucleotide
gcccagttccgcccgcttatcccacatgccattgc

SEQ ID NO: 103135 - DNA, 35 bp, Artificial Sequence
  Synthetic oligonucleotide
tccgccccttgtcaacgccggccccccgaatattg

SEQ ID NO: 103136 - DNA, 35 bp, Artificial Sequence
  Synthetic oligonucleotide
tacgcgcctctcattcctgtccatcgccccctggc

SEQ ID NO: 103137 - DNA, 35 bp, Artificial Sequence
  Synthetic oligonucleotide
gcccctgaccgctatatactgcatactccctcccg

SEQ ID NO: 103138 - DNA, 35 bp, Artificial Sequence
  Synthetic oligonucleotide
acgcaccccactgtcgcgcctacagacccgccgcc

SEQ ID NO: 103139 - DNA, 35 bp, Artificial Sequence
  Synthetic oligonucleotide
gcatccccgccacctgtctgttctccgtttctacg

SEQ ID NO: 103140 - DNA, 34 bp, Artificial Sequence
  Synthetic oligonucleotide
tccgcacctgctgccccctcgccgaactgagttc

SEQ ID NO: 103141 - DNA, 35 bp, Artificial Sequence
  Synthetic oligonucleotide
agtgcgctcctgccctgcccgtttctgtacccctc

SEQ ID NO: 103142 - DNA, 37 bp, Artificial Sequence
  Synthetic oligonucleotide
agcccggaggtggcggggatggatgggtggaatccga

SEQ ID NO: 103143 - DNA, 35 bp, Artificial Sequence
  Synthetic oligonucleotide
accccatcgccacaccgtctgccgattcctgctcc

SEQ ID NO: 103144 - DNA, 35 bp, Artificial Sequence
  Synthetic oligonucleotide
acccctgcctctgacccctcttgccaccctcaagg

SEQ ID NO: 103145 - DNA, 35 bp, Artificial Sequence
  Synthetic oligonucleotide
gccgccccgtccggtccttgtccatcagtcgctcc

SEQ ID NO: 103146 - DNA, 35 bp, Artificial Sequence
  Synthetic oligonucleotide
agatgtcccacctatcttgctccctgttttgtacg

SEQ ID NO: 103147 - DNA, 35 bp, Artificial Sequence
  Synthetic oligonucleotide
gcccccgcatcatgcacctgcgcccttccttgtcc

SEQ ID NO: 103148 - DNA, 36 bp, Artificial Sequence
  Synthetic oligonucleotide
gactaggcggtgaaacatggaggggtggaggcggta

SEQ ID NO: 103149 - DNA, 35 bp, Artificial Sequence
  Synthetic oligonucleotide
gccacactcctctgccgtactcagccttcacgctc

SEQ ID NO: 103150 - DNA, 35 bp, Artificial Sequence
  Synthetic oligonucleotide
gccccatccgccgacctgttacccttgccttgatc

SEQ ID NO: 103151 - DNA, 35 bp, Artificial Sequence
  Synthetic oligonucleotide
gcctcgcacacgtactatctccccctcttttaggt

SEQ ID NO: 103152 - DNA, 35 bp, Artificial Sequence
  Synthetic oligonucleotide
gcgcaccgccacaatcgttcttaccccgctccctg

SEQ ID NO: 103153 - DNA, 35 bp, Artificial Sequence
  Synthetic oligonucleotide
tcccgcccctgttgttgcctcacgctcggtcatcc

SEQ ID NO: 103154 - DNA, 35 bp, Artificial Sequence
  Synthetic oligonucleotide
gagccaacctctcctcgtgcttttcgctgttcacc

SEQ ID NO: 103155 - DNA, 35 bp, Artificial Sequence
  Synthetic oligonucleotide
ttcgctgcctccacttcgccgccgccccagctgcc

SEQ ID NO: 103156 - DNA, 35 bp, Artificial Sequence
  Synthetic oligonucleotide
acacccggcctccgatccgcaaattagctccgccc

SEQ ID NO: 103157 - DNA, 35 bp, Artificial Sequence
  Synthetic oligonucleotide
atcggaggtcacggtggggcggaggacggatgtca

SEQ ID NO: 103158 - DNA, 35 bp, Artificial Sequence
  Synthetic oligonucleotide
gtcccaccgcactaatgtttccgtcgcccttttcg

SEQ ID NO: 103159 - DNA, 35 bp, Artificial Sequence
  Synthetic oligonucleotide
gcaacgccccccctgtcatccctcctccgtgcgcg

SEQ ID NO: 103160 - DNA, 35 bp, Artificial Sequence
  Synthetic oligonucleotide
gtgtggcccaccctggttctcgtgactccctcgct

SEQ ID NO: 103161 - DNA, 35 bp, Artificial Sequence
  Synthetic oligonucleotide
tccgaccatccctctgtcccgtttgctactatgtc

SEQ ID NO: 103162 - DNA, 35 bp, Artificial Sequence
  Synthetic oligonucleotide
gcactcctccgcacccgccctgcctgtttaccagt

SEQ ID NO: 103163 - DNA, 37 bp, Artificial Sequence
  Synthetic oligonucleotide
gtgggcggtgcagtgggggtagaaggtgggatctcga

SEQ ID NO: 103164 - DNA, 35 bp, Artificial Sequence
  Synthetic oligonucleotide
tcccccctcgccacctgagccccccgcttttcggg

SEQ ID NO: 103165 - DNA, 36 bp, Artificial Sequence
  Synthetic oligonucleotide
accgcccctccacctgcatcctgtttcaacggttta

SEQ ID NO: 103166 - DNA, 35 bp, Artificial Sequence
  Synthetic oligonucleotide
gcaacctccgggtgccgtgccatttgcccttccct

SEQ ID NO: 103167 - DNA, 35 bp, Artificial Sequence
  Synthetic oligonucleotide
tatggcgcctactcctgttgtccctcacccacgcc

SEQ ID NO: 103168 - DNA, 38 bp, Artificial Sequence
  Synthetic oligonucleotide
gccgggggcacaggggagaatggggggacggagggaga

SEQ ID NO: 103169 - DNA, 36 bp, Artificial Sequence
  Synthetic oligonucleotide
accagccgccccgcttgccgtatatccaccccgcca

SEQ ID NO: 103170 - DNA, 35 bp, Artificial Sequence
  Synthetic oligonucleotide
gcccgccccgcccgtcgttcacccgttactcttgc

SEQ ID NO: 103171 - DNA, 35 bp, Artificial Sequence
  Synthetic oligonucleotide
gccaccctcgacctgcattgccatccacccatcca

SEQ ID NO: 103172 - DNA, 35 bp, Artificial Sequence
  Synthetic oligonucleotide
tcagacgcgcaactgtccaccttacgtcccccgcc

SEQ ID NO: 103173 - DNA, 35 bp, Artificial Sequence
  Synthetic oligonucleotide
gccacgcccgtggctgtttactcctgatcccactc

SEQ ID NO: 103174 - DNA, 36 bp, Artificial Sequence
  Synthetic oligonucleotide
atcccacccgctgacctgtcgctccagttacttcca

SEQ ID NO: 103175 - DNA, 35 bp, Artificial Sequence
  Synthetic oligonucleotide
agtaaagggagttgtggtggggtctgaggtggtac

SEQ ID NO: 103176 - DNA, 35 bp, Artificial Sequence
  Synthetic oligonucleotide
gaccccctcgctccgtttgcccacgtaccccggac

SEQ ID NO: 103177 - DNA, 35 bp, Artificial Sequence
  Synthetic oligonucleotide
gatcacgggggggaatgggttagggagggaagggg

SEQ ID NO: 103178 - DNA, 35 bp, Artificial Sequence
  Synthetic oligonucleotide
gcgatcaccgccctgtcatttccctggtccttctc

SEQ ID NO: 103179 - DNA, 37 bp, Artificial Sequence
  Synthetic oligonucleotide
ggggcgggtttgcattaggggtacagacccccgggga

SEQ ID NO: 103180 - DNA, 37 bp, Artificial Sequence
  Synthetic oligonucleotide
ggggagggacagatgggggactaggggtccactttga

SEQ ID NO: 103181 - DNA, 35 bp, Artificial Sequence
  Synthetic oligonucleotide
gtgggggtgggcgggtgtagtcgttcggggactca

SEQ ID NO: 103182 - DNA, 35 bp, Artificial Sequence
  Synthetic oligonucleotide
gccccacccgccattgactgcattaacgctccttt

SEQ ID NO: 103183 - DNA, 36 bp, Artificial Sequence
  Synthetic oligonucleotide
gacaagggagcaggggggtggacgggaggggaaata

SEQ ID NO: 103184 - DNA, 35 bp, Artificial Sequence
  Synthetic oligonucleotide
tccctcccccgctccttctgcatgacagcttgcca

SEQ ID NO: 103185 - DNA, 35 bp, Artificial Sequence
  Synthetic oligonucleotide
gaggccatcccgccttgttccgctcaccctgctgc

SEQ ID NO: 103186 - DNA, 35 bp, Artificial Sequence
  Synthetic oligonucleotide
tcacacgtgtctgtccctgtcgtccgtcgttgccc

SEQ ID NO: 103187 - DNA, 35 bp, Artificial Sequence
  Synthetic oligonucleotide
gttcaccaccgatcgtcttcacctggccttttctc

SEQ ID NO: 103188 - DNA, 33 bp, Artificial Sequence
  Synthetic oligonucleotide
acacgccggccccatccgtgatccacttctctg

SEQ ID NO: 103189 - DNA, 35 bp, Artificial Sequence
  Synthetic oligonucleotide
gccctcaccatcaacacttcgcgcgtgctgttcca

SEQ ID NO: 103190 - DNA, 35 bp, Artificial Sequence
  Synthetic oligonucleotide
tgtgcctcggttcagtctgctttttctgttccacc

SEQ ID NO: 103191 - DNA, 36 bp, Artificial Sequence
  Synthetic oligonucleotide
gggggcagttgctcgggtggggctgcaatgggggta

SEQ ID NO: 103192 - DNA, 34 bp, Artificial Sequence
  Synthetic oligonucleotide
tggtccacccgcatgctactcccctctatggtac

SEQ ID NO: 103193 - DNA, 35 bp, Artificial Sequence
  Synthetic oligonucleotide
tccgccttcccctggtgatatcttcccgacctgcc

SEQ ID NO: 103194 - DNA, 35 bp, Artificial Sequence
  Synthetic oligonucleotide
gacgggagggaacggaggggggggttaagtaacta

SEQ ID NO: 103195 - DNA, 37 bp, Artificial Sequence
  Synthetic oligonucleotide
ttatcgcagggggaccagggaagggcgggaacggaga

SEQ ID NO: 103196 - DNA, 35 bp, Artificial Sequence
  Synthetic oligonucleotide
acccaccctccgctccgtaaggattcgcccgatcc

SEQ ID NO: 103197 - DNA, 35 bp, Artificial Sequence
  Synthetic oligonucleotide
tagccatccatctgcctacgatcgtacctcctgtc

SEQ ID NO: 103198 - DNA, 35 bp, Artificial Sequence
  Synthetic oligonucleotide
gtggtcccgcacacctccttgcttacacatttacg

SEQ ID NO: 103199 - DNA, 35 bp, Artificial Sequence
  Synthetic oligonucleotide
tccacccacgaacgatcgctcccagtcacgccccc

SEQ ID NO: 103200 - DNA, 36 bp, Artificial Sequence
  Synthetic oligonucleotide
aacgagagggggatagggaagcgggaggggagaaca

SEQ ID NO: 103201 - DNA, 35 bp, Artificial Sequence
  Synthetic oligonucleotide
agccacatcacttgcccacgctgcattgctctaac

SEQ ID NO: 103202 - DNA, 35 bp, Artificial Sequence
  Synthetic oligonucleotide
gtctgggaggaggggcttatcttaggggcttggga

SEQ ID NO: 103203 - DNA, 35 bp, Artificial Sequence
  Synthetic oligonucleotide
gcgcccccgcctcgtgtgcataccttcgctcccca

SEQ ID NO: 103204 - DNA, 35 bp, Artificial Sequence
  Synthetic oligonucleotide
atgggagggaggggcgggtacgaggcagggggcat

SEQ ID NO: 103205 - DNA, 35 bp, Artificial Sequence
  Synthetic oligonucleotide
gtacccgccgggctattactgacccattttccgac

SEQ ID NO: 103206 - DNA, 35 bp, Artificial Sequence
  Synthetic oligonucleotide
gccgggggagggggggagaaggagatgaacaaggg

SEQ ID NO: 103207 - DNA, 34 bp, Artificial Sequence
  Synthetic oligonucleotide
aaccccgcccccctctccagacgcctttgagtgg

SEQ ID NO: 103208 - DNA, 35 bp, Artificial Sequence
  Synthetic oligonucleotide
tccccacaacacattctgctctatgccgccctccg

SEQ ID NO: 103209 - DNA, 35 bp, Artificial Sequence
  Synthetic oligonucleotide
gcctgccacccccctgccatacgtcccggccacag

SEQ ID NO: 103210 - DNA, 35 bp, Artificial Sequence
  Synthetic oligonucleotide
acaatgagggggagggggggctggataggtggaac

SEQ ID NO: 103211 - DNA, 35 bp, Artificial Sequence
  Synthetic oligonucleotide
atccaccccctcccgatgtccatcgttgtcgtact

SEQ ID NO: 103212 - DNA, 35 bp, Artificial Sequence
  Synthetic oligonucleotide
acctccgccccccagcatgcctagcgcccccgtta

SEQ ID NO: 103213 - DNA, 36 bp, Artificial Sequence
  Synthetic oligonucleotide
agccaccatcctgctagtgcctttcccgtaccctta

SEQ ID NO: 103214 - DNA, 36 bp, Artificial Sequence
  Synthetic oligonucleotide
gcccacgccccaattgtcctctttccctgctatgca

SEQ ID NO: 103215 - DNA, 35 bp, Artificial Sequence
  Synthetic oligonucleotide
ttgacccgcctcctgtctgcgaacgcctccttaca

SEQ ID NO: 103216 - DNA, 35 bp, Artificial Sequence
  Synthetic oligonucleotide
gcgatcgcccctccgctcccatccttaagacttct

SEQ ID NO: 103217 - DNA, 37 bp, Artificial Sequence
  Synthetic oligonucleotide
gcccgggcggggtgtcctaggggcgcgtattagggga

SEQ ID NO: 103218 - DNA, 36 bp, Artificial Sequence
  Synthetic oligonucleotide
tccacacatctggtttgattctgccaccccactgta

SEQ ID NO: 103219 - DNA, 35 bp, Artificial Sequence
  Synthetic oligonucleotide
tgcacgaccgccccccctaatgctgctcgtttacc

SEQ ID NO: 103220 - DNA, 35 bp, Artificial Sequence
  Synthetic oligonucleotide
acccatcccccgaacgtgacatatgcccacgcctc

SEQ ID NO: 103221 - DNA, 36 bp, Artificial Sequence
  Synthetic oligonucleotide
tccgtcccctctgcccatcattgtttcacgtccata

SEQ ID NO: 103222 - DNA, 35 bp, Artificial Sequence
  Synthetic oligonucleotide
gcgggatgggacggggggggagtgaggcatacaag

SEQ ID NO: 103223 - DNA, 35 bp, Artificial Sequence
  Synthetic oligonucleotide
tacgcccccctcctggtgactaatgctagctttcc

SEQ ID NO: 103224 - DNA, 35 bp, Artificial Sequence
  Synthetic oligonucleotide
tccgcacccgccgcttgtatacccgcccccatacc

SEQ ID NO: 103225 - DNA, 37 bp, Artificial Sequence
  Synthetic oligonucleotide
attggggagggcagtttaggggtaacgatgatgggga

SEQ ID NO: 103226 - DNA, 35 bp, Artificial Sequence
  Synthetic oligonucleotide
tcttgccctccgcctccacctgctgtttttgttcc

SEQ ID NO: 103227 - DNA, 35 bp, Artificial Sequence
  Synthetic oligonucleotide
aacgagggacgggagggcgggtcaagaggggacgg

SEQ ID NO: 103228 - DNA, 37 bp, Artificial Sequence
  Synthetic oligonucleotide
tgacacagggaggagtggggggggagcgggtgggaga

SEQ ID NO: 103229 - DNA, 35 bp, Artificial Sequence
  Synthetic oligonucleotide
tcatcaaccgccctgccttgtccatccatatgatc

SEQ ID NO: 103230 - DNA, 34 bp, Artificial Sequence
  Synthetic oligonucleotide
gaaccccccgtagctgccccacatctgtcctttc

SEQ ID NO: 103231 - DNA, 35 bp, Artificial Sequence
  Synthetic oligonucleotide
acaccccgtgtgcccccacttccgcacccgctctg

SEQ ID NO: 103232 - DNA, 35 bp, Artificial Sequence
  Synthetic oligonucleotide
gggggacaatcgggcgaggggggtacagagggtat

SEQ ID NO: 103233 - DNA, 35 bp, Artificial Sequence
  Synthetic oligonucleotide
tccccgcccgcctccatccgcccaatctttcggcg

SEQ ID NO: 103234 - DNA, 37 bp, Artificial Sequence
  Synthetic oligonucleotide
ggtacacgaacgggctggggaagggggcgggaaggga

SEQ ID NO: 103235 - DNA, 36 bp, Artificial Sequence
  Synthetic oligonucleotide
gtccacggcggatggtggggtcggacggtggagaaa

SEQ ID NO: 103236 - DNA, 35 bp, Artificial Sequence
  Synthetic oligonucleotide
gatgccccacattgtactcgcgatctaccaccctg

SEQ ID NO: 103237 - DNA, 35 bp, Artificial Sequence
  Synthetic oligonucleotide
acacccttccgtccgacgttgctcccgcgtttcct

SEQ ID NO: 103238 - DNA, 35 bp, Artificial Sequence
  Synthetic oligonucleotide
tcacctgccacactctgtccactaagcccacttca

SEQ ID NO: 103239 - DNA, 35 bp, Artificial Sequence
  Synthetic oligonucleotide
gccacttgccccagttgctttcctctaacctaaac

SEQ ID NO: 103240 - DNA, 35 bp, Artificial Sequence
  Synthetic oligonucleotide
aacgggggccgtaatgggggtgttctgggtgggga

SEQ ID NO: 103241 - DNA, 37 bp, Artificial Sequence
  Synthetic oligonucleotide
tcatgccctgccccttttgctactcgtgacacactga

SEQ ID NO: 103242 - DNA, 35 bp, Artificial Sequence
  Synthetic oligonucleotide
tcccccctccacttgctgtacccctgaccctgact

SEQ ID NO: 103243 - DNA, 35 bp, Artificial Sequence
  Synthetic oligonucleotide
acccactgccctcggactctctcacgtgcccccac

SEQ ID NO: 103244 - DNA, 35 bp, Artificial Sequence
  Synthetic oligonucleotide
acactcccgatgcgctacggtactccctctccttg

SEQ ID NO: 103245 - DNA, 35 bp, Artificial Sequence
  Synthetic oligonucleotide
tccatcctgacctgtttcgccgagcccaattgccc

SEQ ID NO: 103246 - DNA, 35 bp, Artificial Sequence
  Synthetic oligonucleotide
acaacacccgccatccgtgctcatcacgcacacgc

SEQ ID NO: 103247 - DNA, 35 bp, Artificial Sequence
  Synthetic oligonucleotide
gtcgcccctcccttttccccaagagccactctgac

SEQ ID NO: 103248 - DNA, 35 bp, Artificial Sequence
  Synthetic oligonucleotide
atcgccgtccacccgtttagccgccccacgttctt

SEQ ID NO: 103249 - DNA, 35 bp, Artificial Sequence
  Synthetic oligonucleotide
gtgccccccgcccacgccatcactgcccgttgaca

SEQ ID NO: 103250 - DNA, 35 bp, Artificial Sequence
  Synthetic oligonucleotide
tccgccacccctgcgtttcgctcttggcctgtccc

SEQ ID NO: 103251 - DNA, 35 bp, Artificial Sequence
  Synthetic oligonucleotide
tatcccaccgccccccagtagctgaccccaccgag

SEQ ID NO: 103252 - DNA, 35 bp, Artificial Sequence
  Synthetic oligonucleotide
tgtccactgccctgcccacttgcgcccccgtgcac

SEQ ID NO: 103253 - DNA, 35 bp, Artificial Sequence
  Synthetic oligonucleotide
tcgcggtccacgctgactatcgccccacattcctg

SEQ ID NO: 103254 - DNA, 35 bp, Artificial Sequence
  Synthetic oligonucleotide
ggacgacggcaccctcgttacatctgcctccttgc

SEQ ID NO: 103255 - DNA, 35 bp, Artificial Sequence
  Synthetic oligonucleotide
gatgcgccgcccccttgcgtacatttttccacctg

SEQ ID NO: 103256 - DNA, 35 bp, Artificial Sequence
  Synthetic oligonucleotide
accatcgggaggaggggaagcaagggggggaagga

SEQ ID NO: 103257 - DNA, 35 bp, Artificial Sequence
  Synthetic oligonucleotide
tcccgcccccatctctatctcatgtcgctaatgcc

SEQ ID NO: 103258 - DNA, 35 bp, Artificial Sequence
  Synthetic oligonucleotide
tcttgcaccgcctcatcgtctcctcctggttcccc

SEQ ID NO: 103259 - DNA, 35 bp, Artificial Sequence
  Synthetic oligonucleotide
actcactccactgcccgtttcattgcctgcttgct

SEQ ID NO: 103260 - DNA, 37 bp, Artificial Sequence
  Synthetic oligonucleotide
gggtggtggcgggggtatcggaggcggcaccaatcga

SEQ ID NO: 103261 - DNA, 35 bp, Artificial Sequence
  Synthetic oligonucleotide
tccccccgcccaaatttctcaccgtgttgtttcgc

SEQ ID NO: 103262 - DNA, 35 bp, Artificial Sequence
  Synthetic oligonucleotide
tagtgccccatccgttttgcttcatttggtcctcc

SEQ ID NO: 103263 - DNA, 35 bp, Artificial Sequence
  Synthetic oligonucleotide
tcgccacgccacaccgcgtaccctaactgcctttc

SEQ ID NO: 103264 - DNA, 35 bp, Artificial Sequence
  Synthetic oligonucleotide
tcaccgtacgccctcttaaatgcctggcttcatcc

SEQ ID NO: 103265 - DNA, 37 bp, Artificial Sequence
  Synthetic oligonucleotide
tggggaaagaccagggcgggggacgtctcttggggga

SEQ ID NO: 103266 - DNA, 35 bp, Artificial Sequence
  Synthetic oligonucleotide
tccgcccgacccagcgtttaccatcttagctccac

SEQ ID NO: 103267 - DNA, 35 bp, Artificial Sequence
  Synthetic oligonucleotide
acctgccccacccgcccacgagtttcactgtctta

SEQ ID NO: 103268 - DNA, 35 bp, Artificial Sequence
  Synthetic oligonucleotide
tccgcccccccactccctcaatggcctgttcttta

SEQ ID NO: 103269 - DNA, 35 bp, Artificial Sequence
  Synthetic oligonucleotide
tgctcccctcagtccgcctttgatgcccgttctcc

SEQ ID NO: 103270 - DNA, 35 bp, Artificial Sequence
  Synthetic oligonucleotide
tcaccgtccaccctgcctccttgttgccagcctta

SEQ ID NO: 103271 - DNA, 36 bp, Artificial Sequence
  Synthetic oligonucleotide
tgcacgccccagtttctgttacgtcttcctcctgca

SEQ ID NO: 103272 - DNA, 35 bp, Artificial Sequence
  Synthetic oligonucleotide
aaaccgtacctgcacacgccgcattccatccgatc

SEQ ID NO: 103273 - DNA, 35 bp, Artificial Sequence
  Synthetic oligonucleotide
tcgcactccatccatgcaagatcaccccccggccc

SEQ ID NO: 103274 - DNA, 35 bp, Artificial Sequence
  Synthetic oligonucleotide
tgcatcccccgctctctattagcctcctgtttaac

SEQ ID NO: 103275 - DNA, 37 bp, Artificial Sequence
  Synthetic oligonucleotide
gagagcagtcgggtggagcggggacggtgagggagga

SEQ ID NO: 103276 - DNA, 35 bp, Artificial Sequence
  Synthetic oligonucleotide
tcacccggtctttctcctcactgtcgcataccatc

SEQ ID NO: 103277 - DNA, 34 bp, Artificial Sequence
  Synthetic oligonucleotide
tcgccatccctctgccagccttgtcctaccgcct

SEQ ID NO: 103278 - DNA, 35 bp, Artificial Sequence
  Synthetic oligonucleotide
tacgtccccgtcgcctagttgcttatcgcctgtcc

SEQ ID NO: 103279 - DNA, 35 bp, Artificial Sequence
  Synthetic oligonucleotide
accgtgaccgccacatttgctcctcctctgtgcca

SEQ ID NO: 103280 - DNA, 35 bp, Artificial Sequence
  Synthetic oligonucleotide
atgggggtgacgatggggatggggttcagtgggtt

SEQ ID NO: 103281 - DNA, 37 bp, Artificial Sequence
  Synthetic oligonucleotide
agtccgggcggggtcgtgtggggtaaaatcatgggga

SEQ ID NO: 103282 - DNA, 35 bp, Artificial Sequence
  Synthetic oligonucleotide
gctccccttgccccgtccgactcgccttatgtctg

SEQ ID NO: 103283 - DNA, 35 bp, Artificial Sequence
  Synthetic oligonucleotide
taccccgcgagccgcacatgtacgcgccactcctt

SEQ ID NO: 103284 - DNA, 35 bp, Artificial Sequence
  Synthetic oligonucleotide
tccaccgctcggcctggccataccgtacttcgtcc

SEQ ID NO: 103285 - DNA, 35 bp, Artificial Sequence
  Synthetic oligonucleotide
tccccccgcctgcctctaaccgactcgcccagcct

SEQ ID NO: 103286 - DNA, 35 bp, Artificial Sequence
  Synthetic oligonucleotide
tcacgcctcgccctttgactatgacctgcccgacc

SEQ ID NO: 103287 - DNA, 35 bp, Artificial Sequence
  Synthetic oligonucleotide
acgacacccgcccgcttgactcgatcctgcctatc

SEQ ID NO: 103288 - DNA, 35 bp, Artificial Sequence
  Synthetic oligonucleotide
atgacccgcccccaaaggtcatacatgactccacc

SEQ ID NO: 103289 - DNA, 35 bp, Artificial Sequence
  Synthetic oligonucleotide
accaccgccccatgctggctcctttgcatccttca

SEQ ID NO: 103290 - DNA, 35 bp, Artificial Sequence
  Synthetic oligonucleotide
tcccacgcattccatcttgtaccatgttgcctacc

SEQ ID NO: 103291 - DNA, 36 bp, Artificial Sequence
  Synthetic oligonucleotide
gagtgtcctcaccccgttctcttcctgcccgcccga

SEQ ID NO: 103292 - DNA, 33 bp, Artificial Sequence
  Synthetic oligonucleotide
tcacatcctgccctcatctgtccttatgcatta

SEQ ID NO: 103293 - DNA, 35 bp, Artificial Sequence
  Synthetic oligonucleotide
agactacatccgttcccctgtcccgcccagccgtg

SEQ ID NO: 103294 - DNA, 35 bp, Artificial Sequence
  Synthetic oligonucleotide
ttagcccctcctgcctgtactgtatgctccattct

SEQ ID NO: 103295 - DNA, 30 bp, Artificial Sequence
  Synthetic oligonucleotide
gacccccccgcccactaccagaaccgttct

SEQ ID NO: 103296 - DNA, 35 bp, Artificial Sequence
  Synthetic oligonucleotide
atcagcacagctcagtccgtccttccctcccccgt

SEQ ID NO: 103297 - DNA, 35 bp, Artificial Sequence
  Synthetic oligonucleotide
accccccagcccgccatttgttatccttcgtctcc

SEQ ID NO: 103298 - DNA, 35 bp, Artificial Sequence
  Synthetic oligonucleotide
tattgcggtcgccccatccgtgttccttccccctg

SEQ ID NO: 103299 - DNA, 38 bp, Artificial Sequence
  Synthetic oligonucleotide
ggaggggatgggggaaagggtgatgggcgtaagggcga

SEQ ID NO: 103300 - DNA, 36 bp, Artificial Sequence
  Synthetic oligonucleotide
gtgacagggaagggcgaggggagggcgggcgcgtaa

SEQ ID NO: 103301 - DNA, 35 bp, Artificial Sequence
  Synthetic oligonucleotide
tcgcgcccctctcgaatgtctccgaccccgctccc

SEQ ID NO: 103302 - DNA, 35 bp, Artificial Sequence
  Synthetic oligonucleotide
gtggggctgagtacgggggggactagtaggaaggg

SEQ ID NO: 103303 - DNA, 35 bp, Artificial Sequence
  Synthetic oligonucleotide
tacacctcacctatgcccggtcctgcccgccctgt

SEQ ID NO: 103304 - DNA, 35 bp, Artificial Sequence
  Synthetic oligonucleotide
acaagccgccccatccgtcctcatgctagccgccc

SEQ ID NO: 103305 - DNA, 35 bp, Artificial Sequence
  Synthetic oligonucleotide
tctccccccccgccgatgccctatctccgcgaccc

SEQ ID NO: 103306 - DNA, 35 bp, Artificial Sequence
  Synthetic oligonucleotide
taccacgtccctttgctgagtcaccccccgcccat

SEQ ID NO: 103307 - DNA, 36 bp, Artificial Sequence
  Synthetic oligonucleotide
tccgaccgaccacaaggataatgtctgccttcccta

SEQ ID NO: 103308 - DNA, 35 bp, Artificial Sequence
  Synthetic oligonucleotide
gcaccgccctccgtctctgtttaccggccttcaac

SEQ ID NO: 103309 - DNA, 36 bp, Artificial Sequence
  Synthetic oligonucleotide
gtccatcctctgcctgccctgaacgtctaccgttca

SEQ ID NO: 103310 - DNA, 35 bp, Artificial Sequence
  Synthetic oligonucleotide
gtcctcctcacgtgtggcttccttggccccttact

SEQ ID NO: 103311 - DNA, 35 bp, Artificial Sequence
  Synthetic oligonucleotide
accacccgtccggcttatccgactcaccgcatccc

SEQ ID NO: 103312 - DNA, 36 bp, Artificial Sequence
  Synthetic oligonucleotide
ttcgcccttccgctcattcgttatgccctcgtttca

SEQ ID NO: 103313 - DNA, 35 bp, Artificial Sequence
  Synthetic oligonucleotide
tccccgtggcacccatgttcatctaccgcctccac

SEQ ID NO: 103314 - DNA, 35 bp, Artificial Sequence
  Synthetic oligonucleotide
gccacaacatatgcgcccctcaagcctggccctct

SEQ ID NO: 103315 - DNA, 35 bp, Artificial Sequence
  Synthetic oligonucleotide
gacccctccgctctcctgccatctacgacgcaccg

SEQ ID NO: 103316 - DNA, 35 bp, Artificial Sequence
  Synthetic oligonucleotide
atccacacaccaccgtccgccgtcgcctaccgccc

SEQ ID NO: 103317 - DNA, 37 bp, Artificial Sequence
  Synthetic oligonucleotide
ggggcgggatcaatagggggctctgaatagttgggga

SEQ ID NO: 103318 - DNA, 36 bp, Artificial Sequence
  Synthetic oligonucleotide
acccgcgccccctgcatacgtaacccctcctgtgcg

SEQ ID NO: 103319 - DNA, 35 bp, Artificial Sequence
  Synthetic oligonucleotide
gacccccccggtccgtacacagcccaccacttgcc

SEQ ID NO: 103320 - DNA, 35 bp, Artificial Sequence
  Synthetic oligonucleotide
gacgaacaaggggggaaggggggcggagacgagcg

SEQ ID NO: 103321 - DNA, 36 bp, Artificial Sequence
  Synthetic oligonucleotide
tgcccgccatccactaagccatttgccccgttgcca

SEQ ID NO: 103322 - DNA, 35 bp, Artificial Sequence
  Synthetic oligonucleotide
aacagggcgccgctgcttcgtaccatccctagtcc

SEQ ID NO: 103323 - DNA, 34 bp, Artificial Sequence
  Synthetic oligonucleotide
tcaggagggcgggtggggacatgggttgatttac

SEQ ID NO: 103324 - DNA, 35 bp, Artificial Sequence
  Synthetic oligonucleotide
tgtcccccgaccagttcttgcctttgttaccgtcc

SEQ ID NO: 103325 - DNA, 36 bp, Artificial Sequence
  Synthetic oligonucleotide
gacctgcctcatgttgctctccttgccgtccctcca

SEQ ID NO: 103326 - DNA, 36 bp, Artificial Sequence
  Synthetic oligonucleotide
tactgctcccgcctcccactcgtgtaacactctcga

SEQ ID NO: 103327 - DNA, 35 bp, Artificial Sequence
  Synthetic oligonucleotide
gcacccaccatcgtgcctgcccgcttccctcttcg

SEQ ID NO: 103328 - DNA, 36 bp, Artificial Sequence
  Synthetic oligonucleotide
tcgcccatccccctgttgtccgtactatccaccaca

SEQ ID NO: 103329 - DNA, 35 bp, Artificial Sequence
  Synthetic oligonucleotide
tgtacggccccatcacctgtcttctaacgccgccc

SEQ ID NO: 103330 - DNA, 35 bp, Artificial Sequence
  Synthetic oligonucleotide
aacgcctccctctgccatttcccacgcgtagacac

SEQ ID NO: 103331 - DNA, 35 bp, Artificial Sequence
  Synthetic oligonucleotide
ggtcacctgcctccctgactcgttatcctgccgcc

SEQ ID NO: 103332 - DNA, 35 bp, Artificial Sequence
  Synthetic oligonucleotide
gccggtccacccctctcgatctgtaagccccacgc

SEQ ID NO: 103333 - DNA, 37 bp, Artificial Sequence
  Synthetic oligonucleotide
ttacgggaggggcattacggggtccaaagtgcgggga

SEQ ID NO: 103334 - DNA, 36 bp, Artificial Sequence
  Synthetic oligonucleotide
tgatgcgccgccgcccaatatgcctcctcccttgga

SEQ ID NO: 103335 - DNA, 37 bp, Artificial Sequence
  Synthetic oligonucleotide
atgtgcgctagcccgatttaggccctgttccccccga

SEQ ID NO: 103336 - DNA, 35 bp, Artificial Sequence
  Synthetic oligonucleotide
tgagccggaggaagtggtggaggagagtgaacggg

SEQ ID NO: 103337 - DNA, 37 bp, Artificial Sequence
  Synthetic oligonucleotide
acgtacccgcctgctacccccctttggcatcacccga

SEQ ID NO: 103338 - DNA, 35 bp, Artificial Sequence
  Synthetic oligonucleotide
ttatgcccccgttcatcgccgtttcctagctgtcc

SEQ ID NO: 103339 - DNA, 35 bp, Artificial Sequence
  Synthetic oligonucleotide
acactacgtaccgccccatccccccagtttgatca

SEQ ID NO: 103340 - DNA, 36 bp, Artificial Sequence
  Synthetic oligonucleotide
gccaggggtggtcggtcggggttttgcggtggatca

SEQ ID NO: 103341 - DNA, 36 bp, Artificial Sequence
  Synthetic oligonucleotide
tgcctaccactgcgttgtcaactcgttccctgttca

SEQ ID NO: 103342 - DNA, 35 bp, Artificial Sequence
  Synthetic oligonucleotide
gttgccgcccccgaattatatgcccctcttacgtc

SEQ ID NO: 103343 - DNA, 35 bp, Artificial Sequence
  Synthetic oligonucleotide
tcccagccatccgccgtttccattcacagccaccc

SEQ ID NO: 103344 - DNA, 36 bp, Artificial Sequence
  Synthetic oligonucleotide
gccccccgaccacctctcatgtcttgtctctacgga

SEQ ID NO: 103345 - DNA, 35 bp, Artificial Sequence
  Synthetic oligonucleotide
tcagctcgtactgatgccatatcgcctgtcccgcc

SEQ ID NO: 103346 - DNA, 36 bp, Artificial Sequence
  Synthetic oligonucleotide
agagggggcataggggagggtaggggaagggaagga

SEQ ID NO: 103347 - DNA, 37 bp, Artificial Sequence
  Synthetic oligonucleotide
cccgggtggggacgaggggtttatcatgacttgggga

SEQ ID NO: 103348 - DNA, 35 bp, Artificial Sequence
  Synthetic oligonucleotide
ttgagcacgttcactcgttccatcctgttcccaca

SEQ ID NO: 103349 - DNA, 36 bp, Artificial Sequence
  Synthetic oligonucleotide
tacgcccgagttcagcgcgtttaccatccttccgtc

SEQ ID NO: 103350 - DNA, 35 bp, Artificial Sequence
  Synthetic oligonucleotide
gtggacgaagggaggaagggggatagggaatagaa

SEQ ID NO: 103351 - DNA, 35 bp, Artificial Sequence
  Synthetic oligonucleotide
gcacgcctccttgtcttactccactcctgctcgta

SEQ ID NO: 103352 - DNA, 35 bp, Artificial Sequence
  Synthetic oligonucleotide
tccagacgcccgcctcattctcgcctcttgccatg

SEQ ID NO: 103353 - DNA, 35 bp, Artificial Sequence
  Synthetic oligonucleotide
gcccccgtgccccttgatcccgttcctactcgttg

SEQ ID NO: 103354 - DNA, 35 bp, Artificial Sequence
  Synthetic oligonucleotide
gcgtagcaccgccctgcccttcttactgtcgtgtc

SEQ ID NO: 103355 - DNA, 35 bp, Artificial Sequence
  Synthetic oligonucleotide
tgcacatcccaccccgcccgtcacagtgtgcacca

SEQ ID NO: 103356 - DNA, 35 bp, Artificial Sequence
  Synthetic oligonucleotide
ggacgatgcccccccctcccgctgcggtgctctct

SEQ ID NO: 103357 - DNA, 35 bp, Artificial Sequence
  Synthetic oligonucleotide
gccaccccgccactcgcgccctcgacgccctacac

SEQ ID NO: 103358 - DNA, 35 bp, Artificial Sequence
  Synthetic oligonucleotide
gccatcccatcccatctggctcacgtactctttac

SEQ ID NO: 103359 - DNA, 35 bp, Artificial Sequence
  Synthetic oligonucleotide
ttgacaacctcacctgcgttcctcttcacatgcct

SEQ ID NO: 103360 - DNA, 35 bp, Artificial Sequence
  Synthetic oligonucleotide
gtgcacccgccatttatccacacgccttctcttgc

SEQ ID NO: 103361 - DNA, 35 bp, Artificial Sequence
  Synthetic oligonucleotide
tcacgtcgcaccgttgcttttccctcgcccccatg

SEQ ID NO: 103362 - DNA, 35 bp, Artificial Sequence
  Synthetic oligonucleotide
tgttcactccgagctcctttagttactgcctccac

SEQ ID NO: 103363 - DNA, 35 bp, Artificial Sequence
  Synthetic oligonucleotide
agccgacgccacgtttctgcctcccgtttgctccc

SEQ ID NO: 103364 - DNA, 35 bp, Artificial Sequence
  Synthetic oligonucleotide
actgaccccgtagttccctctgcctgccctattgc

SEQ ID NO: 103365 - DNA, 35 bp, Artificial Sequence
  Synthetic oligonucleotide
gcaccctccccactgtcgcgcccgtccctgcgagt

SEQ ID NO: 103366 - DNA, 35 bp, Artificial Sequence
  Synthetic oligonucleotide
gttaccgcccgatctgctttcgtacaccccttggc

SEQ ID NO: 103367 - DNA, 35 bp, Artificial Sequence
  Synthetic oligonucleotide
gtcgccccgtagtccccctcggtttctcctgctct

SEQ ID NO: 103368 - DNA, 35 bp, Artificial Sequence
  Synthetic oligonucleotide
tgactcccccccatgcggccgcgcgtagcctctat

SEQ ID NO: 103369 - DNA, 35 bp, Artificial Sequence
  Synthetic oligonucleotide
tcgatgtgcacaccgttctcctgcctgtttcctac

SEQ ID NO: 103370 - DNA, 34 bp, Artificial Sequence
  Synthetic oligonucleotide
ttgttccgcccctttgatcccagcctgcctcgca

SEQ ID NO: 103371 - DNA, 34 bp, Artificial Sequence
  Synthetic oligonucleotide
ggacccacaccttccatgtcgctcgcccccccga

SEQ ID NO: 103372 - DNA, 36 bp, Artificial Sequence
  Synthetic oligonucleotide
ggagtggggaggactgaggcatacttgggaagtgga

SEQ ID NO: 103373 - DNA, 36 bp, Artificial Sequence
  Synthetic oligonucleotide
accacacccgccccattgtacccatgtcgcccaaaa

SEQ ID NO: 103374 - DNA, 37 bp, Artificial Sequence
  Synthetic oligonucleotide
tgccaaccccgctcatctgttttacgctccctctcga

SEQ ID NO: 103375 - DNA, 34 bp, Artificial Sequence
  Synthetic oligonucleotide
tgctccgccacatcgtccactccctctctttcag

SEQ ID NO: 103376 - DNA, 35 bp, Artificial Sequence
  Synthetic oligonucleotide
tccatcctcaccttgtcaactgggcccccttcttg

SEQ ID NO: 103377 - DNA, 35 bp, Artificial Sequence
  Synthetic oligonucleotide
gtcgctccgccactcttcatgactcttctcctgcg

SEQ ID NO: 103378 - DNA, 35 bp, Artificial Sequence
  Synthetic oligonucleotide
tccatctgcccccagtgtcgcagcccccccctttc

SEQ ID NO: 103379 - DNA, 35 bp, Artificial Sequence
  Synthetic oligonucleotide
tccaccccctcgactgggttcgccacataactcgc

SEQ ID NO: 103380 - DNA, 35 bp, Artificial Sequence
  Synthetic oligonucleotide
atcgtcacccgccgacccccgcgtactttcgatac

SEQ ID NO: 103381 - DNA, 35 bp, Artificial Sequence
  Synthetic oligonucleotide
acccatgcagccacctcgtgtcaccgtcctgccac

SEQ ID NO: 103382 - DNA, 35 bp, Artificial Sequence
  Synthetic oligonucleotide
gtttgcctgccccattgccccctgttcgttcacta

SEQ ID NO: 103383 - DNA, 35 bp, Artificial Sequence
  Synthetic oligonucleotide
gatcccccgccatttggcatcgagccttcttcccg

SEQ ID NO: 103384 - DNA, 35 bp, Artificial Sequence
  Synthetic oligonucleotide
gcgtagcaccgtcgcccctgttctacccgtttttc

SEQ ID NO: 103385 - DNA, 37 bp, Artificial Sequence
  Synthetic oligonucleotide
gtcgattccggcggaaggtgggggctggatggccgga

SEQ ID NO: 103386 - DNA, 35 bp, Artificial Sequence
  Synthetic oligonucleotide
gccccccgccctgttctaggtagttcgccccccaa

SEQ ID NO: 103387 - DNA, 36 bp, Artificial Sequence
  Synthetic oligonucleotide
atcgccccacccaacagccttgttttacctgcctca

SEQ ID NO: 103388 - DNA, 35 bp, Artificial Sequence
  Synthetic oligonucleotide
acccacctccgctccctgtatcagtcactgcaggc

SEQ ID NO: 103389 - DNA, 36 bp, Artificial Sequence
  Synthetic oligonucleotide
ttcgcccctcactgtgccgttttagctcccttccga

SEQ ID NO: 103390 - DNA, 35 bp, Artificial Sequence
  Synthetic oligonucleotide
gcccatgcccacgatcctgtttttgccacacttcc

SEQ ID NO: 103391 - DNA, 35 bp, Artificial Sequence
  Synthetic oligonucleotide
tgcacacccgtcgatagacccgttgcccctccctc

SEQ ID NO: 103392 - DNA, 35 bp, Artificial Sequence
  Synthetic oligonucleotide
actgactgcctcccgacgctccccctttgttcttg

SEQ ID NO: 103393 - DNA, 35 bp, Artificial Sequence
  Synthetic oligonucleotide
gtccccgcatatcgctctccccacagcctgctcgc

SEQ ID NO: 103394 - DNA, 35 bp, Artificial Sequence
  Synthetic oligonucleotide
tgtgacacccacgcatttttctgacccatccccat

SEQ ID NO: 103395 - DNA, 35 bp, Artificial Sequence
  Synthetic oligonucleotide
agccccgccctcgaactgtcacttacctacgctct

SEQ ID NO: 103396 - DNA, 31 bp, Artificial Sequence
  Synthetic oligonucleotide
gatggggtgggactgtagtctgtacggcggt

SEQ ID NO: 103397 - DNA, 36 bp, Artificial Sequence
  Synthetic oligonucleotide
gtcggaatagggtggcggaggggtcgggtggatgga

SEQ ID NO: 103398 - DNA, 35 bp, Artificial Sequence
  Synthetic oligonucleotide
tagcagatcgccaccgcccttgatatgcccgctac

SEQ ID NO: 103399 - DNA, 36 bp, Artificial Sequence
  Synthetic oligonucleotide
gccaccgccggtgaaacgataccaccctcgcctcca

SEQ ID NO: 103400 - DNA, 35 bp, Artificial Sequence
  Synthetic oligonucleotide
acccgccctcgcacccacattttacgacgtgcccc

SEQ ID NO: 103401 - DNA, 35 bp, Artificial Sequence
  Synthetic oligonucleotide
tactcgccaactctgccgccctgtactcattcgcc

SEQ ID NO: 103402 - DNA, 35 bp, Artificial Sequence
  Synthetic oligonucleotide
gcacaacccactatgtcgttgcacccgcccctacc

SEQ ID NO: 103403 - DNA, 37 bp, Artificial Sequence
  Synthetic oligonucleotide
gacccgccgccacatgcctcctacccctccgagcgga

SEQ ID NO: 103404 - DNA, 35 bp, Artificial Sequence
  Synthetic oligonucleotide
actccgttcgatccccgtccccttccgcccgagtc

SEQ ID NO: 103405 - DNA, 35 bp, Artificial Sequence
  Synthetic oligonucleotide
gcagagcccccacttccttacgccccgctcctcga

SEQ ID NO: 103406 - DNA, 35 bp, Artificial Sequence
  Synthetic oligonucleotide
tacaccgccacaacatcttcactactgctcccgcc

SEQ ID NO: 103407 - DNA, 36 bp, Artificial Sequence
  Synthetic oligonucleotide
gacgcccctccccctgttgagtttctcgttctgaca

SEQ ID NO: 103408 - DNA, 37 bp, Artificial Sequence
  Synthetic oligonucleotide
ggaatgcggctatgaggggaggttagaacagggagga

SEQ ID NO: 103409 - DNA, 32 bp, Artificial Sequence
  Synthetic oligonucleotide
tcaacctcgctctggcccaaccacaccttgtc

SEQ ID NO: 103410 - DNA, 35 bp, Artificial Sequence
  Synthetic oligonucleotide
acgacacggctcagttccatctccagtgccccccc

SEQ ID NO: 103411 - DNA, 35 bp, Artificial Sequence
  Synthetic oligonucleotide
atgacagccacagtcctaccttcacctacgctgcc

SEQ ID NO: 103412 - DNA, 35 bp, Artificial Sequence
  Synthetic oligonucleotide
tgccacatcactatcgcttcctagtactcgccgcc

SEQ ID NO: 103413 - DNA, 35 bp, Artificial Sequence
  Synthetic oligonucleotide
tcccactcacatactttctccgctcgacaatcctg

SEQ ID NO: 103414 - DNA, 37 bp, Artificial Sequence
  Synthetic oligonucleotide
gacccccctcctccgacctgttacagtcgtcctctga

SEQ ID NO: 103415 - DNA, 36 bp, Artificial Sequence
  Synthetic oligonucleotide
gtgaggaaggggaggtggagcaggaagggctgggaa

SEQ ID NO: 103416 - DNA, 35 bp, Artificial Sequence
  Synthetic oligonucleotide
gccgaacacatccatgcgcatttgcctcccttctg

SEQ ID NO: 103417 - DNA, 35 bp, Artificial Sequence
  Synthetic oligonucleotide
tgcccccgcctcgaatgggtccttcgatttcgccc

SEQ ID NO: 103418 - DNA, 35 bp, Artificial Sequence
  Synthetic oligonucleotide
ccacgctctgcccatcctcgacgctttcgcctcgc

SEQ ID NO: 103419 - DNA, 35 bp, Artificial Sequence
  Synthetic oligonucleotide
tctcaccacacattgttctggccccactggttcta

SEQ ID NO: 103420 - DNA, 35 bp, Artificial Sequence
  Synthetic oligonucleotide
gaaccccatctatgcctaggcaccccgcccctgcc

SEQ ID NO: 103421 - DNA, 35 bp, Artificial Sequence
  Synthetic oligonucleotide
gacactgtccggccctccccagtgcttgttcttac

SEQ ID NO: 103422 - DNA, 34 bp, Artificial Sequence
  Synthetic oligonucleotide
acccatccctgttcgcccccgggcctaccgcacc

SEQ ID NO: 103423 - DNA, 34 bp, Artificial Sequence
  Synthetic oligonucleotide
acacatccgcccctgactaagcccctccctcgtc

SEQ ID NO: 103424 - DNA, 35 bp, Artificial Sequence
  Synthetic oligonucleotide
aacacccgcacccttttttgcgcccgacgctggtc

SEQ ID NO: 103425 - DNA, 35 bp, Artificial Sequence
  Synthetic oligonucleotide
aagtcatactccgcttctatctgtgcaacctctgc

SEQ ID NO: 103426 - DNA, 35 bp, Artificial Sequence
  Synthetic oligonucleotide
tgtgcaccgccccttctcccacggactccctgctg

SEQ ID NO: 103427 - DNA, 34 bp, Artificial Sequence
  Synthetic oligonucleotide
acccccctcccagccttcgtactaatggtccccc

SEQ ID NO: 103428 - DNA, 35 bp, Artificial Sequence
  Synthetic oligonucleotide
acacaccacctaacatgttcgcctttccgctcttg

SEQ ID NO: 103429 - DNA, 35 bp, Artificial Sequence
  Synthetic oligonucleotide
acatgggcgttggtcggggacgagggtgggtaaca

SEQ ID NO: 103430 - DNA, 36 bp, Artificial Sequence
  Synthetic oligonucleotide
gcacctgcctctatagttctaacctgtcctgcctca

SEQ ID NO: 103431 - DNA, 35 bp, Artificial Sequence
  Synthetic oligonucleotide
ttgtgacaccttctgcgaccctgatcccccctgtt

SEQ ID NO: 103432 - DNA, 34 bp, Artificial Sequence
  Synthetic oligonucleotide
gccacccgaccccgcttgcagtaactcgctttcc

SEQ ID NO: 103433 - DNA, 37 bp, Artificial Sequence
  Synthetic oligonucleotide
gcgaaccgtacgcctgttttagccctgcctttcccga

SEQ ID NO: 103434 - DNA, 35 bp, Artificial Sequence
  Synthetic oligonucleotide
tgcgatcctcgcccacctgattaagcccctgtgcc

SEQ ID NO: 103435 - DNA, 35 bp, Artificial Sequence
  Synthetic oligonucleotide
taccacctccgattcgcccctgcggtttccctcgc

SEQ ID NO: 103436 - DNA, 35 bp, Artificial Sequence
  Synthetic oligonucleotide
tcattcctccgtgcgctcacctctccaccgcgatc

SEQ ID NO: 103437 - DNA, 35 bp, Artificial Sequence
  Synthetic oligonucleotide
tcagggcgggatgggagggggccacgaaagatcag

SEQ ID NO: 103438 - DNA, 35 bp, Artificial Sequence
  Synthetic oligonucleotide
actcattccgccctgcccgtgcttttactatctcg

SEQ ID NO: 103439 - DNA, 35 bp, Artificial Sequence
  Synthetic oligonucleotide
gtgagcccctcgtccctctgcccgtttgttgccct

SEQ ID NO: 103440 - DNA, 35 bp, Artificial Sequence
  Synthetic oligonucleotide
tgacggactcctgccattgttctcaccccccgccg

SEQ ID NO: 103441 - DNA, 35 bp, Artificial Sequence
  Synthetic oligonucleotide
tagcgccgttcgctgccgttctttatgctctcttc

SEQ ID NO: 103442 - DNA, 36 bp, Artificial Sequence
  Synthetic oligonucleotide
tcccgcccatccgctatcatgtctatacgcctccca

SEQ ID NO: 103443 - DNA, 35 bp, Artificial Sequence
  Synthetic oligonucleotide
tctggagccctccatcacccacgcccataccgatg

SEQ ID NO: 103444 - DNA, 35 bp, Artificial Sequence
  Synthetic oligonucleotide
gatgcccctccagttaatggtctcctgtcccctcc

SEQ ID NO: 103445 - DNA, 35 bp, Artificial Sequence
  Synthetic oligonucleotide
agcatccgcccggtctctcgttttagtctgccacc

SEQ ID NO: 103446 - DNA, 35 bp, Artificial Sequence
  Synthetic oligonucleotide
gagatgggagggagggtactggagtggacgggatg

SEQ ID NO: 103447 - DNA, 35 bp, Artificial Sequence
  Synthetic oligonucleotide
gccatcccctgtaattgcgagccccgtgcctccac

SEQ ID NO: 103448 - DNA, 34 bp, Artificial Sequence
  Synthetic oligonucleotide
taacccgccaccgccctgccatactattccttgt

SEQ ID NO: 103449 - DNA, 35 bp, Artificial Sequence
  Synthetic oligonucleotide
tgtgcgctgcctccgccgctttaccatttacgttc

SEQ ID NO: 103450 - DNA, 35 bp, Artificial Sequence
  Synthetic oligonucleotide
tgtgccctagcctcactggtatcacgttcttcctc

SEQ ID NO: 103451 - DNA, 35 bp, Artificial Sequence
  Synthetic oligonucleotide
gcaaacgcggggaaggaacgggaggaggggaagcg

SEQ ID NO: 103452 - DNA, 36 bp, Artificial Sequence
  Synthetic oligonucleotide
gtgcgatagccggttcgctgttcttcgttccttcca

SEQ ID NO: 103453 - DNA, 35 bp, Artificial Sequence
  Synthetic oligonucleotide
gtgcaacgcactgtttacgtttccggcctttccac

SEQ ID NO: 103454 - DNA, 35 bp, Artificial Sequence
  Synthetic oligonucleotide
tagccggcctccgcaattgtttttacccgtccgca

SEQ ID NO: 103455 - DNA, 36 bp, Artificial Sequence
  Synthetic oligonucleotide
ggtggcaaaggggggcacgaggagaggggattgaca

SEQ ID NO: 103456 - DNA, 37 bp, Artificial Sequence
  Synthetic oligonucleotide
tgaccaacgcccccttgactcttttgctgcccgccga

SEQ ID NO: 103457 - DNA, 37 bp, Artificial Sequence
  Synthetic oligonucleotide
aaagtggggcctgagatggggggagggcaatgaggga

SEQ ID NO: 103458 - DNA, 35 bp, Artificial Sequence
  Synthetic oligonucleotide
tgagtggggtacgggtggggggagcaagggcggca

SEQ ID NO: 103459 - DNA, 35 bp, Artificial Sequence
  Synthetic oligonucleotide
gtggtggaggagggggcggaaggccaggatctgga

SEQ ID NO: 103460 - DNA, 35 bp, Artificial Sequence
  Synthetic oligonucleotide
tgacggtggtgagggcgaaggggagggtggaaagg

SEQ ID NO: 103461 - DNA, 36 bp, Artificial Sequence
  Synthetic oligonucleotide
ttccaccactcacttgtggtctcccctgttccttca

SEQ ID NO: 103462 - DNA, 35 bp, Artificial Sequence
  Synthetic oligonucleotide
tgcatgcctcagcttctctcgcccggccttctgtc

SEQ ID NO: 103463 - DNA, 35 bp, Artificial Sequence
  Synthetic oligonucleotide
gaaggggggctcaaaatctgggggcggggttcaac

SEQ ID NO: 103464 - DNA, 35 bp, Artificial Sequence
  Synthetic oligonucleotide
gacacctccatcatctgttcaggctcatttcctca

SEQ ID NO: 103465 - DNA, 35 bp, Artificial Sequence
  Synthetic oligonucleotide
tgacgcctccgaagcgtaaccatacttcctcctgt

SEQ ID NO: 103466 - DNA, 34 bp, Artificial Sequence
  Synthetic oligonucleotide
tccccccccatcctgtctgagtccatcctgtctc

SEQ ID NO: 103467 - DNA, 35 bp, Artificial Sequence
  Synthetic oligonucleotide
gtccccgccgttgtgcaccccccgcctttcccggc

SEQ ID NO: 103468 - DNA, 35 bp, Artificial Sequence
  Synthetic oligonucleotide
gttcccccagaccctgctcgcgccctgcccttgcc

SEQ ID NO: 103469 - DNA, 35 bp, Artificial Sequence
  Synthetic oligonucleotide
gttgcccccctctgtagctcccgggatccactctc

SEQ ID NO: 103470 - DNA, 35 bp, Artificial Sequence
  Synthetic oligonucleotide
atcgcctgccccgccacttccgacccgcctgatcc

SEQ ID NO: 103471 - DNA, 35 bp, Artificial Sequence
  Synthetic oligonucleotide
gccgacgcgctttgtctcttggtccactcccgcct

SEQ ID NO: 103472 - DNA, 38 bp, Artificial Sequence
  Synthetic oligonucleotide
tggggggagggttaggggttacgtattgggggccctga

SEQ ID NO: 103473 - DNA, 36 bp, Artificial Sequence
  Synthetic oligonucleotide
tggggaagtacggcacgggggggagcaaacggggga

SEQ ID NO: 103474 - DNA, 35 bp, Artificial Sequence
  Synthetic oligonucleotide
tccatcccaccgtgtagacacgtttacatccttcc

SEQ ID NO: 103475 - DNA, 35 bp, Artificial Sequence
  Synthetic oligonucleotide
accatccccccgccgtgcatcctgtacccaggcta

SEQ ID NO: 103476 - DNA, 35 bp, Artificial Sequence
  Synthetic oligonucleotide
attggagccaaaaggacgggggggaagggaagggg

SEQ ID NO: 103477 - DNA, 35 bp, Artificial Sequence
  Synthetic oligonucleotide
gatagtagccacagggaggtaagggggcgggaggg

SEQ ID NO: 103478 - DNA, 36 bp, Artificial Sequence
  Synthetic oligonucleotide
atcgacctcgcctccattcgtctccttccacgggcc

SEQ ID NO: 103479 - DNA, 35 bp, Artificial Sequence
  Synthetic oligonucleotide
tagtaccgctgctgcgtaccgctccctgtctctgc

SEQ ID NO: 103480 - DNA, 35 bp, Artificial Sequence
  Synthetic oligonucleotide
gtggcccccttgatctgtacctcgtggtcccttcc

SEQ ID NO: 103481 - DNA, 35 bp, Artificial Sequence
  Synthetic oligonucleotide
tacttggcgcaacccacccccattcgctacgtgcc

SEQ ID NO: 103482 - DNA, 35 bp, Artificial Sequence
  Synthetic oligonucleotide
aacataaccatcttgccagccagccccgctctcgc

SEQ ID NO: 103483 - DNA, 35 bp, Artificial Sequence
  Synthetic oligonucleotide
ggaccatcccgcccattgccttcgtagcacttttc

SEQ ID NO: 103484 - DNA, 37 bp, Artificial Sequence
  Synthetic oligonucleotide
ggggcggggtcttattcacggggcctagcattgggga

SEQ ID NO: 103485 - DNA, 36 bp, Artificial Sequence
  Synthetic oligonucleotide
atgatcccgccaccatgtccccgcattccagtctta

SEQ ID NO: 103486 - DNA, 35 bp, Artificial Sequence
  Synthetic oligonucleotide
acgtgccctctgtggtccccatacgttcctgccct

SEQ ID NO: 103487 - DNA, 36 bp, Artificial Sequence
  Synthetic oligonucleotide
tgatggagaggggaagacgaagggcgggttgggtga

SEQ ID NO: 103488 - DNA, 36 bp, Artificial Sequence
  Synthetic oligonucleotide
tctacacctgcccagctctctacgccatgtacccaa

SEQ ID NO: 103489 - DNA, 37 bp, Artificial Sequence
  Synthetic oligonucleotide
acacccaccgctcacctttccttgcgccacagttcga

SEQ ID NO: 103490 - DNA, 34 bp, Artificial Sequence
  Synthetic oligonucleotide
tgccctccgccgtttcctctcctgtactccctgg

SEQ ID NO: 103491 - DNA, 37 bp, Artificial Sequence
  Synthetic oligonucleotide
gggaggggtagatagtccttgggggttctttcgggga

SEQ ID NO: 103492 - DNA, 35 bp, Artificial Sequence
  Synthetic oligonucleotide
gtccctgccgccccttcgtttcgatacctcccccg

SEQ ID NO: 103493 - DNA, 37 bp, Artificial Sequence
  Synthetic oligonucleotide
agtgaaggtggcggaggggcggtttcggacggcacga

SEQ ID NO: 103494 - DNA, 35 bp, Artificial Sequence
  Synthetic oligonucleotide
gcctgccccgcccgctgtagcccctaactcttttg

SEQ ID NO: 103495 - DNA, 35 bp, Artificial Sequence
  Synthetic oligonucleotide
gacccggtggtgggaaagccggcggaggaggggtt

SEQ ID NO: 103496 - DNA, 38 bp, Artificial Sequence
  Synthetic oligonucleotide
gttggggcatgtcggattcgggaggggcgggacaatga

SEQ ID NO: 103497 - DNA, 35 bp, Artificial Sequence
  Synthetic oligonucleotide
tcacgactcccgctgcctccgccatcatgctcttg

SEQ ID NO: 103498 - DNA, 35 bp, Artificial Sequence
  Synthetic oligonucleotide
tcctgtgcatcacaggtctatcccccttcctcttt

SEQ ID NO: 103499 - DNA, 35 bp, Artificial Sequence
  Synthetic oligonucleotide
gccccagcctgttggtattcccgccgttactccct

SEQ ID NO: 103500 - DNA, 35 bp, Artificial Sequence
  Synthetic oligonucleotide
tcctacgccgcagtgtcctgcaccctggcctactc

SEQ ID NO: 103501 - DNA, 35 bp, Artificial Sequence
  Synthetic oligonucleotide
tcacctctcggaactctgcctcgatcccagctctg

SEQ ID NO: 103502 - DNA, 35 bp, Artificial Sequence
  Synthetic oligonucleotide
gacacgctcagataccttcccgtccacttctgcct

SEQ ID NO: 103503 - DNA, 35 bp, Artificial Sequence
  Synthetic oligonucleotide
gaccactgcgattcctcccaccatcgtgtacccct

SEQ ID NO: 103504 - DNA, 37 bp, Artificial Sequence
  Synthetic oligonucleotide
ttcgccactaccgctgcctgtactcaatgcctctcga

SEQ ID NO: 103505 - DNA, 35 bp, Artificial Sequence
  Synthetic oligonucleotide
tccactccacgatttgggatcccccgccacccgtt

SEQ ID NO: 103506 - DNA, 36 bp, Artificial Sequence
  Synthetic oligonucleotide
gccccgcccacgacctcgtttactcgcattacttcg

SEQ ID NO: 103507 - DNA, 36 bp, Artificial Sequence
  Synthetic oligonucleotide
acgaacaccctgctggtatacttccatccctccgca

SEQ ID NO: 103508 - DNA, 35 bp, Artificial Sequence
  Synthetic oligonucleotide
tgccatacctcctacactcgtgttagcaccatttc

SEQ ID NO: 103509 - DNA, 35 bp, Artificial Sequence
  Synthetic oligonucleotide
tcacacctcactgggccacccacaccccctctggt

SEQ ID NO: 103510 - DNA, 35 bp, Artificial Sequence
  Synthetic oligonucleotide
tcacgcggtcgcccctgttctgctctggtctactt

SEQ ID NO: 103511 - DNA, 35 bp, Artificial Sequence
  Synthetic oligonucleotide
ttagccccgctgatctctagtcccgcctgtaccac

SEQ ID NO: 103512 - DNA, 37 bp, Artificial Sequence
  Synthetic oligonucleotide
tgcccacccgctcctgctcgttcaaacacctcgccga

SEQ ID NO: 103513 - DNA, 35 bp, Artificial Sequence
  Synthetic oligonucleotide
ttgaccctgccgacgtttacttgcttctgcttcat

SEQ ID NO: 103514 - DNA, 35 bp, Artificial Sequence
  Synthetic oligonucleotide
tcctccaccagtgatatcgccccgacgccccgtcc

SEQ ID NO: 103515 - DNA, 35 bp, Artificial Sequence
  Synthetic oligonucleotide
atacgcgcacccccactgtttcatttggccctgtt

SEQ ID NO: 103516 - DNA, 35 bp, Artificial Sequence
  Synthetic oligonucleotide
accccctccccatgcccagatctactgcaccatgc

SEQ ID NO: 103517 - DNA, 35 bp, Artificial Sequence
  Synthetic oligonucleotide
gcacacccgccacctagctatcagcgttatccttc

SEQ ID NO: 103518 - DNA, 35 bp, Artificial Sequence
  Synthetic oligonucleotide
tagtgtccgccctcctgtctgcatttcgtccccta

SEQ ID NO: 103519 - DNA, 35 bp, Artificial Sequence
  Synthetic oligonucleotide
gcgtgctccagccctctgttcgctcattacgcctc

SEQ ID NO: 103520 - DNA, 37 bp, Artificial Sequence
  Synthetic oligonucleotide
ggtgcaaggggaagggaacgtagagggggaggtggga

SEQ ID NO: 103521 - DNA, 35 bp, Artificial Sequence
  Synthetic oligonucleotide
tgaggggagggtatgtaggggccatattgagggga

SEQ ID NO: 103522 - DNA, 35 bp, Artificial Sequence
  Synthetic oligonucleotide
atccccgcccccgctcgcttatcgtttttgtcttt

SEQ ID NO: 103523 - DNA, 35 bp, Artificial Sequence
  Synthetic oligonucleotide
tgcgacgtccttcctgtccgtccccagccgccgac

SEQ ID NO: 103524 - DNA, 35 bp, Artificial Sequence
  Synthetic oligonucleotide
atcgtccacccgctatcacatcgtcatgctgcctc

SEQ ID NO: 103525 - DNA, 35 bp, Artificial Sequence
  Synthetic oligonucleotide
ggggatgggtgggagtgggggggaaggccggctag

SEQ ID NO: 103526 - DNA, 34 bp, Artificial Sequence
  Synthetic oligonucleotide
tcctactccaccctctgcgtcccgccttgccccg

SEQ ID NO: 103527 - DNA, 35 bp, Artificial Sequence
  Synthetic oligonucleotide
gtcaccccgcccctttgtctgaatagattgtcccc

SEQ ID NO: 103528 - DNA, 35 bp, Artificial Sequence
  Synthetic oligonucleotide
taccgcccgcctcgcccttgttgctctagtactcg

SEQ ID NO: 103529 - DNA, 35 bp, Artificial Sequence
  Synthetic oligonucleotide
gttgctcagcctgccgcctcgttacacccacgcca

SEQ ID NO: 103530 - DNA, 35 bp, Artificial Sequence
  Synthetic oligonucleotide
tacccgtcacagctctcgccacccttgcccacgct

SEQ ID NO: 103531 - DNA, 35 bp, Artificial Sequence
  Synthetic oligonucleotide
tagttggtcagatctctccccagcccacgctccac

SEQ ID NO: 103532 - DNA, 35 bp, Artificial Sequence
  Synthetic oligonucleotide
tcgtacgttgcccaggtctaatccacaccctcgcc

SEQ ID NO: 103533 - DNA, 37 bp, Artificial Sequence
  Synthetic oligonucleotide
aatgtgcgcgggagcagggaggggacgggtggcagga

SEQ ID NO: 103534 - DNA, 35 bp, Artificial Sequence
  Synthetic oligonucleotide
ttaggcccacctcccacatgtctgtaccgcgctct

SEQ ID NO: 103535 - DNA, 35 bp, Artificial Sequence
  Synthetic oligonucleotide
acccgccacatgctctcgtttccctgttattaccg

SEQ ID NO: 103536 - DNA, 35 bp, Artificial Sequence
  Synthetic oligonucleotide
atcgctcccccatctgcatagggccacattcctta

SEQ ID NO: 103537 - DNA, 37 bp, Artificial Sequence
  Synthetic oligonucleotide
gtgaggaggaggggggcggaggagaactggatacaga

SEQ ID NO: 103538 - DNA, 35 bp, Artificial Sequence
  Synthetic oligonucleotide
gccctcccctctttgtcttagttcgagccctcccg

SEQ ID NO: 103539 - DNA, 35 bp, Artificial Sequence
  Synthetic oligonucleotide
acccatgtcccctgctccatctgttgcttcgcccc

SEQ ID NO: 103540 - DNA, 35 bp, Artificial Sequence
  Synthetic oligonucleotide
actcgacctccgcctggttctcccccatatggcct

SEQ ID NO: 103541 - DNA, 35 bp, Artificial Sequence
  Synthetic oligonucleotide
gtgaagcgcgcccaccgacccagctgccactctca

SEQ ID NO: 103542 - DNA, 35 bp, Artificial Sequence
  Synthetic oligonucleotide
gccaccccacacgagtcttacctgcactgattccc

SEQ ID NO: 103543 - DNA, 35 bp, Artificial Sequence
  Synthetic oligonucleotide
actccactcccagccgtacattacgtgcctctcac

SEQ ID NO: 103544 - DNA, 35 bp, Artificial Sequence
  Synthetic oligonucleotide
ttatcaccacagatccgtcgctccgcccccttgtc

SEQ ID NO: 103545 - DNA, 35 bp, Artificial Sequence
  Synthetic oligonucleotide
gaccacgggggagggggggagggaaggacaagtta

SEQ ID NO: 103546 - DNA, 35 bp, Artificial Sequence
  Synthetic oligonucleotide
ttgggaggtggaggggggttgaagggtgggccagg

SEQ ID NO: 103547 - DNA, 37 bp, Artificial Sequence
  Synthetic oligonucleotide
tcccgcctcccgagcctgcttacgccctgccccccga

SEQ ID NO: 103548 - DNA, 35 bp, Artificial Sequence
  Synthetic oligonucleotide
gtgatccgctgacccgagttccattggtccccccc

SEQ ID NO: 103549 - DNA, 35 bp, Artificial Sequence
  Synthetic oligonucleotide
acaccgcgatgctccattaccctgcctcctctggt

SEQ ID NO: 103550 - DNA, 35 bp, Artificial Sequence
  Synthetic oligonucleotide
gtcctgcccccgccacgtagtttgactcgcttcca

SEQ ID NO: 103551 - DNA, 35 bp, Artificial Sequence
  Synthetic oligonucleotide
tcaacccctcccgctcctccctcatgctatcggtg

SEQ ID NO: 103552 - DNA, 34 bp, Artificial Sequence
  Synthetic oligonucleotide
tacatccgcccctgatactgttccgtttaccttc

SEQ ID NO: 103553 - DNA, 35 bp, Artificial Sequence
  Synthetic oligonucleotide
tgcctgtgcactcgtgtgcccccgcccccttcctg

SEQ ID NO: 103554 - DNA, 37 bp, Artificial Sequence
  Synthetic oligonucleotide
agtacactgggcggggcgtataaggggtcctcgggga

SEQ ID NO: 103555 - DNA, 35 bp, Artificial Sequence
  Synthetic oligonucleotide
atgtgggtgggaggggtggaagatatgtcagggga

SEQ ID NO: 103556 - DNA, 35 bp, Artificial Sequence
  Synthetic oligonucleotide
tgaaccctctcggaatatccaccaactccctcccg

SEQ ID NO: 103557 - DNA, 35 bp, Artificial Sequence
  Synthetic oligonucleotide
gtagcaacccacgtgtgccatcgcccccccctagt

SEQ ID NO: 103558 - DNA, 28 bp, Artificial Sequence
  Synthetic oligonucleotide
atccacgcccatcccccattcgcccgga

SEQ ID NO: 103559 - DNA, 35 bp, Artificial Sequence
  Synthetic oligonucleotide
tcctgcccccatgattatggccctccgcttgaacc

SEQ ID NO: 103560 - DNA, 35 bp, Artificial Sequence
  Synthetic oligonucleotide
gccccgacccccctcgcgacagcccctgcacttcc

SEQ ID NO: 103561 - DNA, 36 bp, Artificial Sequence
  Synthetic oligonucleotide
gtccaacgcccactatcggtttcagccaccccccta

SEQ ID NO: 103562 - DNA, 35 bp, Artificial Sequence
  Synthetic oligonucleotide
atctggccgatactgcgcgccttcctcgtaatccc

SEQ ID NO: 103563 - DNA, 35 bp, Artificial Sequence
  Synthetic oligonucleotide
tgactcaccctccgctctggacgtgcctgtcccct

SEQ ID NO: 103564 - DNA, 35 bp, Artificial Sequence
  Synthetic oligonucleotide
tcaacgtcgactgtcctgttcacatcctggcccct

SEQ ID NO: 103565 - DNA, 35 bp, Artificial Sequence
  Synthetic oligonucleotide
gccctgctgccaatgctcgtcgtacctccttcgtc

SEQ ID NO: 103566 - DNA, 35 bp, Artificial Sequence
  Synthetic oligonucleotide
gttgcactgcactcctgcccctgtcgtaggccctc

SEQ ID NO: 103567 - DNA, 35 bp, Artificial Sequence
  Synthetic oligonucleotide
gcacccgccttggcatagcacatcctcccgccttc

SEQ ID NO: 103568 - DNA, 35 bp, Artificial Sequence
  Synthetic oligonucleotide
attcaccgtaccgccgtcttacaagtcctcctctg

SEQ ID NO: 103569 - DNA, 28 bp, Artificial Sequence
  Synthetic oligonucleotide
tttacaacactgtccgccccccgccgca

SEQ ID NO: 103570 - DNA, 35 bp, Artificial Sequence
  Synthetic oligonucleotide
ttagtccgacctcaccccatgttcttgtggcctcc

SEQ ID NO: 103571 - DNA, 35 bp, Artificial Sequence
  Synthetic oligonucleotide
gtcaccgccgcaaccttaccgcccgtcctgccgct

SEQ ID NO: 103572 - DNA, 35 bp, Artificial Sequence
  Synthetic oligonucleotide
tcattagcacggctatcacgtacctgtccatcttg

SEQ ID NO: 103573 - DNA, 35 bp, Artificial Sequence
  Synthetic oligonucleotide
atcaccgctaatgagcaacccgccgtcgcccgccc

SEQ ID NO: 103574 - DNA, 35 bp, Artificial Sequence
  Synthetic oligonucleotide
acgtgacccgcccgcttgtttttgaacccgttccc

SEQ ID NO: 103575 - DNA, 35 bp, Artificial Sequence
  Synthetic oligonucleotide
acaacgagggaaggatagggtggggcaggggggca

SEQ ID NO: 103576 - DNA, 35 bp, Artificial Sequence
  Synthetic oligonucleotide
ggtgaggggggaggggagacaagaggatggtgcaa

SEQ ID NO: 103577 - DNA, 35 bp, Artificial Sequence
  Synthetic oligonucleotide
gtgccctcctccacgtttgcgaacctctgtcttgc

SEQ ID NO: 103578 - DNA, 35 bp, Artificial Sequence
  Synthetic oligonucleotide
taaccagcccacctggtcattcaccgctttcttcc

SEQ ID NO: 103579 - DNA, 35 bp, Artificial Sequence
  Synthetic oligonucleotide
atccgaagggaagggagggtgggatggaagggaaa

SEQ ID NO: 103580 - DNA, 35 bp, Artificial Sequence
  Synthetic oligonucleotide
atcccgcgctcactccctgaatttgccacacgctc

SEQ ID NO: 103581 - DNA, 35 bp, Artificial Sequence
  Synthetic oligonucleotide
ggaccccgcaagctgcctccgacacgctctcgttc

SEQ ID NO: 103582 - DNA, 35 bp, Artificial Sequence
  Synthetic oligonucleotide
actcatgccctgcgtcatcttacttcttccccccg

SEQ ID NO: 103583 - DNA, 35 bp, Artificial Sequence
  Synthetic oligonucleotide
gcccatcccctgaggccctttctgttccagccctc

SEQ ID NO: 103584 - DNA, 35 bp, Artificial Sequence
  Synthetic oligonucleotide
ttgggggagggtgggccgtgttcggggactgtgaa

SEQ ID NO: 103585 - DNA, 35 bp, Artificial Sequence
  Synthetic oligonucleotide
actcgtcgaccgacacctgtgcccccccgcccgct

SEQ ID NO: 103586 - DNA, 35 bp, Artificial Sequence
  Synthetic oligonucleotide
cgacgccctaacctcagtgcttcgttcccgcccct

SEQ ID NO: 103587 - DNA, 35 bp, Artificial Sequence
  Synthetic oligonucleotide
tagtgcgccccatccagcccttcgttctcgcttgc

SEQ ID NO: 103588 - DNA, 35 bp, Artificial Sequence
  Synthetic oligonucleotide
atcgccgccccaccatgccgtttgtggttttcccg

SEQ ID NO: 103589 - DNA, 35 bp, Artificial Sequence
  Synthetic oligonucleotide
tccagcccctgccggagagcaccctagcccccacc

SEQ ID NO: 103590 - DNA, 35 bp, Artificial Sequence
  Synthetic oligonucleotide
gccaaacgcccggacgttttttcactccttggtcc

SEQ ID NO: 103591 - DNA, 29 bp, Artificial Sequence
  Synthetic oligonucleotide
ttgcccgcccggtaattcctgtctttcgc

SEQ ID NO: 103592 - DNA, 35 bp, Artificial Sequence
  Synthetic oligonucleotide
gatgcacgcccgttatccaccgctccgttacctgg

SEQ ID NO: 103593 - DNA, 36 bp, Artificial Sequence
  Synthetic oligonucleotide
gaccacccctccatgtgaccttcagcactaccccga

SEQ ID NO: 103594 - DNA, 35 bp, Artificial Sequence
  Synthetic oligonucleotide
gagcacccactgccttcccgcgccatctgtcgccc

SEQ ID NO: 103595 - DNA, 35 bp, Artificial Sequence
  Synthetic oligonucleotide
gcacctccttctctatcaccatgtcgttatcacgt

SEQ ID NO: 103596 - DNA, 35 bp, Artificial Sequence
  Synthetic oligonucleotide
gggggtgacggagggcgggaacggggcgtatgaaa

SEQ ID NO: 103597 - DNA, 35 bp, Artificial Sequence
  Synthetic oligonucleotide
atcacgcaagtgattaatacgcctacacacctcct

SEQ ID NO: 103598 - DNA, 35 bp, Artificial Sequence
  Synthetic oligonucleotide
gtgcgtagcggggagggcggagggggcaggggaag

SEQ ID NO: 103599 - DNA, 35 bp, Artificial Sequence
  Synthetic oligonucleotide
gtctcgccacctggcctgttgaacccatccttgcc

SEQ ID NO: 103600 - DNA, 35 bp, Artificial Sequence
  Synthetic oligonucleotide
gcaaacgccttcctgctgtcacccgctattttgtc

SEQ ID NO: 103601 - DNA, 35 bp, Artificial Sequence
  Synthetic oligonucleotide
gatcacccttctgcttgctaagtcccatgcccccc

SEQ ID NO: 103602 - DNA, 35 bp, Artificial Sequence
  Synthetic oligonucleotide
aatgtgggtaacagggcgggaaagggagggtgacg

SEQ ID NO: 103603 - DNA, 35 bp, Artificial Sequence
  Synthetic oligonucleotide
ggtggaggtgggggaaggcgatacaggtgggttta

SEQ ID NO: 103604 - DNA, 35 bp, Artificial Sequence
  Synthetic oligonucleotide
gccctgcctccatcttacaccctagtgcactgccc

SEQ ID NO: 103605 - DNA, 35 bp, Artificial Sequence
  Synthetic oligonucleotide
tcacacgccctgctgctaactgtactcgcctttcg

SEQ ID NO: 103606 - DNA, 34 bp, Artificial Sequence
  Synthetic oligonucleotide
acgcacgacagcactcacctccgctgccccgttt

SEQ ID NO: 103607 - DNA, 35 bp, Artificial Sequence
  Synthetic oligonucleotide
aacgccacccctcctttctgcgtaccccagtccca

SEQ ID NO: 103608 - DNA, 33 bp, Artificial Sequence
  Synthetic oligonucleotide
gaagcccgatccctctcttcgcgccgttaccac

SEQ ID NO: 103609 - DNA, 35 bp, Artificial Sequence
  Synthetic oligonucleotide
acaccccgccctccgtgctattaccaatgtatttc

SEQ ID NO: 103610 - DNA, 35 bp, Artificial Sequence
  Synthetic oligonucleotide
gaccatcatcaggcctcctgcacaccggtccttcc

SEQ ID NO: 103611 - DNA, 35 bp, Artificial Sequence
  Synthetic oligonucleotide
agcacgcctccgcccgcgtttgctcgatctccccc

SEQ ID NO: 103612 - DNA, 36 bp, Artificial Sequence
  Synthetic oligonucleotide
gccacccgtacctcttgtttgagcttcctttctcca

SEQ ID NO: 103613 - DNA, 35 bp, Artificial Sequence
  Synthetic oligonucleotide
aacgccctgcccccttacgttaacaacctcgcttg

SEQ ID NO: 103614 - DNA, 37 bp, Artificial Sequence
  Synthetic oligonucleotide
aacaattgctggagggggtaggggatggaggacggga

SEQ ID NO: 103615 - DNA, 35 bp, Artificial Sequence
  Synthetic oligonucleotide
acaaacggtggagaagggagtacggggaaggtaag

SEQ ID NO: 103616 - DNA, 38 bp, Artificial Sequence
  Synthetic oligonucleotide
atggggcaagtcaagggcggggcacaaccaggggatga

SEQ ID NO: 103617 - DNA, 35 bp, Artificial Sequence
  Synthetic oligonucleotide
accagccctcccttacctatagtccagctgttcct

SEQ ID NO: 103618 - DNA, 35 bp, Artificial Sequence
  Synthetic oligonucleotide
gcaccgcacgccagtattccccccccagtgcccct

SEQ ID NO: 103619 - DNA, 35 bp, Artificial Sequence
  Synthetic oligonucleotide
atgacccgcccctgtatttttggccgtattttctc

SEQ ID NO: 103620 - DNA, 35 bp, Artificial Sequence
  Synthetic oligonucleotide
tctcgcccatcacctggtctttttgccctcaacgc

SEQ ID NO: 103621 - DNA, 35 bp, Artificial Sequence
  Synthetic oligonucleotide
gtacgatgccgggaagggtgggaagggcgcgtgtc

SEQ ID NO: 103622 - DNA, 35 bp, Artificial Sequence
  Synthetic oligonucleotide
gaaaggaccgggggggaaagagtacgggtgggagg

SEQ ID NO: 103623 - DNA, 35 bp, Artificial Sequence
  Synthetic oligonucleotide
accccccgccacccgcctccaatgcgaagtacatt

SEQ ID NO: 103624 - DNA, 35 bp, Artificial Sequence
  Synthetic oligonucleotide
tcccgccccatgcagcagtatttagctgccctccc

SEQ ID NO: 103625 - DNA, 35 bp, Artificial Sequence
  Synthetic oligonucleotide
actgagggggagtaggggggtcgggctaggtggta

SEQ ID NO: 103626 - DNA, 35 bp, Artificial Sequence
  Synthetic oligonucleotide
gtcgcccccgctgcgagcacctccactttgttgcc

SEQ ID NO: 103627 - DNA, 36 bp, Artificial Sequence
  Synthetic oligonucleotide
tccccgcccgggtaggtcttttcgttgctccttgta

SEQ ID NO: 103628 - DNA, 35 bp, Artificial Sequence
  Synthetic oligonucleotide
acagcccgctcgcacactgttccaccgcccgccgc

SEQ ID NO: 103629 - DNA, 35 bp, Artificial Sequence
  Synthetic oligonucleotide
gccaacgcctcgtctgttacaccttcgtccttccc

SEQ ID NO: 103630 - DNA, 35 bp, Artificial Sequence
  Synthetic oligonucleotide
tcaaccgccccttttgtgctctcatgcttcactcg

SEQ ID NO: 103631 - DNA, 35 bp, Artificial Sequence
  Synthetic oligonucleotide
gagccatccctccgttcttgtgccatcttgcccga

SEQ ID NO: 103632 - DNA, 35 bp, Artificial Sequence
  Synthetic oligonucleotide
tcgctcacctcaatgcaagctgcccgcccgttccc

SEQ ID NO: 103633 - DNA, 35 bp, Artificial Sequence
  Synthetic oligonucleotide
tccagtcgccctgttcatttgctctacgattcctg

SEQ ID NO: 103634 - DNA, 36 bp, Artificial Sequence
  Synthetic oligonucleotide
aaggtggagaatggggtggggcagaacgaaagggca

SEQ ID NO: 103635 - DNA, 35 bp, Artificial Sequence
  Synthetic oligonucleotide
gaactgtccgcccgcctgccttgtcaccgcttatc

SEQ ID NO: 103636 - DNA, 38 bp, Artificial Sequence
  Synthetic oligonucleotide
atgggcggggtggggcggagggacaaggaagggcgtga

SEQ ID NO: 103637 - DNA, 36 bp, Artificial Sequence
  Synthetic oligonucleotide
tcagttcgccatgtgccccccgttccccccgttgta

SEQ ID NO: 103638 - DNA, 36 bp, Artificial Sequence
  Synthetic oligonucleotide
gggggcgagaaaagggtggggtaataattggggttt

SEQ ID NO: 103639 - DNA, 35 bp, Artificial Sequence
  Synthetic oligonucleotide
tgttcccgccctctgcactgtacagtactgtcctc

SEQ ID NO: 103640 - DNA, 36 bp, Artificial Sequence
  Synthetic oligonucleotide
atggtggtggagggggactggcgacgtcggtgggaa

SEQ ID NO: 103641 - DNA, 35 bp, Artificial Sequence
  Synthetic oligonucleotide
tgtgcccttcacgcccctcttgtctccggccctgc

SEQ ID NO: 103642 - DNA, 36 bp, Artificial Sequence
  Synthetic oligonucleotide
acccccgcccccacctagtacgtgatcctgtgatca

SEQ ID NO: 103643 - DNA, 35 bp, Artificial Sequence
  Synthetic oligonucleotide
actgcaccacgtacgccctctgtctccggttccac

SEQ ID NO: 103644 - DNA, 36 bp, Artificial Sequence
  Synthetic oligonucleotide
tgcacgccacatctcatcctggctgtccccccatta

SEQ ID NO: 103645 - DNA, 35 bp, Artificial Sequence
  Synthetic oligonucleotide
gacggaggggaccgaggggggaatggggacaaggg

SEQ ID NO: 103646 - DNA, 35 bp, Artificial Sequence
  Synthetic oligonucleotide
acccacctgttccgtcctgagcatttgcccccttc

SEQ ID NO: 103647 - DNA, 30 bp, Artificial Sequence
  Synthetic oligonucleotide
tcagagccgaggaagagtggagggtgggag

SEQ ID NO: 103648 - DNA, 35 bp, Artificial Sequence
  Synthetic oligonucleotide
gtccccgtccagcgcatgatttcgcgccccccgtc

SEQ ID NO: 103649 - DNA, 29 bp, Artificial Sequence
  Synthetic oligonucleotide
tagtcgtggacccccccccgtcctgcctt

SEQ ID NO: 103650 - DNA, 35 bp, Artificial Sequence
  Synthetic oligonucleotide
gttgccgtcgaccactcccggttcctgtcccacgc

SEQ ID NO: 103651 - DNA, 35 bp, Artificial Sequence
  Synthetic oligonucleotide
gcgcctcccacactgacctgcgacgtttctgcctc

SEQ ID NO: 103652 - DNA, 35 bp, Artificial Sequence
  Synthetic oligonucleotide
tccccgcccacccgcctgctgcgaactcccacttt

SEQ ID NO: 103653 - DNA, 35 bp, Artificial Sequence
  Synthetic oligonucleotide
gctgtgcacggtgcactacccacccatatcatgcc

SEQ ID NO: 103654 - DNA, 35 bp, Artificial Sequence
  Synthetic oligonucleotide
gcaccatggctacccctgccacccgccccttgggt

SEQ ID NO: 103655 - DNA, 35 bp, Artificial Sequence
  Synthetic oligonucleotide
gacctcacctttacgtgctcgcttgccttctcatc

SEQ ID NO: 103656 - DNA, 35 bp, Artificial Sequence
  Synthetic oligonucleotide
gatgtctcgccccatcttgctctctactggaccgc

SEQ ID NO: 103657 - DNA, 35 bp, Artificial Sequence
  Synthetic oligonucleotide
tcacgcccgccactgcttagttacttctcgatcac

SEQ ID NO: 103658 - DNA, 35 bp, Artificial Sequence
  Synthetic oligonucleotide
tccccgcctcacacttcggttatgtccattccttc

SEQ ID NO: 103659 - DNA, 35 bp, Artificial Sequence
  Synthetic oligonucleotide
tgttccatccgtgccgtattgccctagttcctctg

SEQ ID NO: 103660 - DNA, 35 bp, Artificial Sequence
  Synthetic oligonucleotide
tcacctccccactgattcgtcgatcctgctcacac

SEQ ID NO: 103661 - DNA, 38 bp, Artificial Sequence
  Synthetic oligonucleotide
tcgctggctccatcctgctacgtgccttccctgtttga

SEQ ID NO: 103662 - DNA, 35 bp, Artificial Sequence
  Synthetic oligonucleotide
gcacgaaagtgccgccgtagtacatccgcttcctc

SEQ ID NO: 103663 - DNA, 37 bp, Artificial Sequence
  Synthetic oligonucleotide
ggtggggaggggagaataggaggaagggggtgtaaga

SEQ ID NO: 103664 - DNA, 35 bp, Artificial Sequence
  Synthetic oligonucleotide
tcactgccccagctggctccgatcggccccattcc

SEQ ID NO: 103665 - DNA, 36 bp, Artificial Sequence
  Synthetic oligonucleotide
tccgccgaacgacagcagccccccgtactccgccga

SEQ ID NO: 103666 - DNA, 35 bp, Artificial Sequence
  Synthetic oligonucleotide
gcaaccgcacgtatttgcctatcgtttccagccct

SEQ ID NO: 103667 - DNA, 35 bp, Artificial Sequence
  Synthetic oligonucleotide
tgcacactactgccgtggactccctgactcccctc

SEQ ID NO: 103668 - DNA, 35 bp, Artificial Sequence
  Synthetic oligonucleotide
gatcagacacagtgggtgggtacgggggggcagaa

SEQ ID NO: 103669 - DNA, 35 bp, Artificial Sequence
  Synthetic oligonucleotide
ttagtcccaccctccacttttgtttaccgacttcc

SEQ ID NO: 103670 - DNA, 35 bp, Artificial Sequence
  Synthetic oligonucleotide
atccgacacagggggggaaggaaggaacgggaaag

SEQ ID NO: 103671 - DNA, 37 bp, Artificial Sequence
  Synthetic oligonucleotide
gggggaggtggggtggcacggacggtacaactatgga

SEQ ID NO: 103672 - DNA, 35 bp, Artificial Sequence
  Synthetic oligonucleotide
gatcgcccgccaccccctctccgcaccagtgacta

SEQ ID NO: 103673 - DNA, 35 bp, Artificial Sequence
  Synthetic oligonucleotide
tcgcactcccagcccccgttttatttgccccggcc

SEQ ID NO: 103674 - DNA, 35 bp, Artificial Sequence
  Synthetic oligonucleotide
acgtaccacctccaacttgccgacgcgcactcgcc

SEQ ID NO: 103675 - DNA, 35 bp, Artificial Sequence
  Synthetic oligonucleotide
tgcaccgacccctgttctatctgtcctcttatgta

SEQ ID NO: 103676 - DNA, 35 bp, Artificial Sequence
  Synthetic oligonucleotide
tcgcacgcccgtgcccgtatcctctcaatcctgcc

SEQ ID NO: 103677 - DNA, 34 bp, Artificial Sequence
  Synthetic oligonucleotide
ttggcacctccacatgatttaccccgccctgttc

SEQ ID NO: 103678 - DNA, 37 bp, Artificial Sequence
  Synthetic oligonucleotide
tcacctcgcctcctgtctatccctcctgctctatcga

SEQ ID NO: 103679 - DNA, 33 bp, Artificial Sequence
  Synthetic oligonucleotide
gcatcctactctttcctcgtcgctttcgtgcct

SEQ ID NO: 103680 - DNA, 35 bp, Artificial Sequence
  Synthetic oligonucleotide
aagaccacctcaccatctgccctcggagaaacctc

SEQ ID NO: 103681 - DNA, 35 bp, Artificial Sequence
  Synthetic oligonucleotide
atgcatccctctcagcgtgtctgtcgccttccatc

SEQ ID NO: 103682 - DNA, 35 bp, Artificial Sequence
  Synthetic oligonucleotide
ttcgactgcccccctgtaattcacgtgccatccct

SEQ ID NO: 103683 - DNA, 35 bp, Artificial Sequence
  Synthetic oligonucleotide
gacccgcctgactccccctgtttatcgctgctcta

SEQ ID NO: 103684 - DNA, 35 bp, Artificial Sequence
  Synthetic oligonucleotide
gtcggacaacactccagccgcaccacgctccctgc

SEQ ID NO: 103685 - DNA, 35 bp, Artificial Sequence
  Synthetic oligonucleotide
tccacgctcacccgtcctctcagtctccctgtacg

SEQ ID NO: 103686 - DNA, 35 bp, Artificial Sequence
  Synthetic oligonucleotide
gagcaccgcccctggtattcatcaccgcactcctt

SEQ ID NO: 103687 - DNA, 35 bp, Artificial Sequence
  Synthetic oligonucleotide
tacgccccgcctctcgcccgtgccgatttcctctt

SEQ ID NO: 103688 - DNA, 35 bp, Artificial Sequence
  Synthetic oligonucleotide
gacctggtctccacgatgttgctcccgttcccttt

SEQ ID NO: 103689 - DNA, 35 bp, Artificial Sequence
  Synthetic oligonucleotide
tgcccccctgtatactgcccaggcctgcccacccc

SEQ ID NO: 103690 - DNA, 35 bp, Artificial Sequence
  Synthetic oligonucleotide
atccgccccgccaatttttctactcgcccctccgt

SEQ ID NO: 103691 - DNA, 37 bp, Artificial Sequence
  Synthetic oligonucleotide
tagtggggtcaacatgaggggaggacaaggctgggga

SEQ ID NO: 103692 - DNA, 35 bp, Artificial Sequence
  Synthetic oligonucleotide
gacccctccacgcgcaccgccaacactcgccgtac

SEQ ID NO: 103693 - DNA, 35 bp, Artificial Sequence
  Synthetic oligonucleotide
tatgccacaccttctgactaattagcggccccctc

SEQ ID NO: 103694 - DNA, 35 bp, Artificial Sequence
  Synthetic oligonucleotide
atgaccctcgcctcccttgcagctgccctttctgg

SEQ ID NO: 103695 - DNA, 35 bp, Artificial Sequence
  Synthetic oligonucleotide
tgccccgccagcctgtctcgttcgatcgcactacc

SEQ ID NO: 103696 - DNA, 35 bp, Artificial Sequence
  Synthetic oligonucleotide
gctaactccgctactcatcatgccgttcccgcttt

SEQ ID NO: 103697 - DNA, 35 bp, Artificial Sequence
  Synthetic oligonucleotide
tcccgccctcttccgctatattggaccgacccctc

SEQ ID NO: 103698 - DNA, 35 bp, Artificial Sequence
  Synthetic oligonucleotide
gcccatcgtagcatgccagccgccccactctcgac

SEQ ID NO: 103699 - DNA, 35 bp, Artificial Sequence
  Synthetic oligonucleotide
gacgccgctgccctctgtccattgtcccgttacgt

SEQ ID NO: 103700 - DNA, 35 bp, Artificial Sequence
  Synthetic oligonucleotide
tcatcagagcagtgttcctttcgtaccgtccctct

SEQ ID NO: 103701 - DNA, 35 bp, Artificial Sequence
  Synthetic oligonucleotide
gccgccacgccaactcctatttcacgctgtctctc

SEQ ID NO: 103702 - DNA, 35 bp, Artificial Sequence
  Synthetic oligonucleotide
tgtccaccatcggtgagttttgcccttcttctcct

SEQ ID NO: 103703 - DNA, 36 bp, Artificial Sequence
  Synthetic oligonucleotide
acgcaccatcgcctagtctggtcccatctgcctcca

SEQ ID NO: 103704 - DNA, 35 bp, Artificial Sequence
  Synthetic oligonucleotide
tcttccgccctcccccccatctaagcgcagcctgg

SEQ ID NO: 103705 - DNA, 35 bp, Artificial Sequence
  Synthetic oligonucleotide
ttgatgccccactgctctcttccacccgtcccgcg

SEQ ID NO: 103706 - DNA, 35 bp, Artificial Sequence
  Synthetic oligonucleotide
aagtagcacgggtccactattccacgccctgcccc

SEQ ID NO: 103707 - DNA, 35 bp, Artificial Sequence
  Synthetic oligonucleotide
tgccaccgcactggtaccggctccctcctatactg

SEQ ID NO: 103708 - DNA, 35 bp, Artificial Sequence
  Synthetic oligonucleotide
accagctgacgcccctgtggcctccttcccgcctg

SEQ ID NO: 103709 - DNA, 36 bp, Artificial Sequence
  Synthetic oligonucleotide
tcgcacccccgtctccatctgcacgttccagtctta

SEQ ID NO: 103710 - DNA, 35 bp, Artificial Sequence
  Synthetic oligonucleotide
tacagggcgtcccgaatggctccatctttccatcc

SEQ ID NO: 103711 - DNA, 35 bp, Artificial Sequence
  Synthetic oligonucleotide
ttccgccaccgccaccgccccatgaagccacgcct

SEQ ID NO: 103712 - DNA, 35 bp, Artificial Sequence
  Synthetic oligonucleotide
tgcgcactgcacctcaccatctgccttcgacccct

SEQ ID NO: 103713 - DNA, 35 bp, Artificial Sequence
  Synthetic oligonucleotide
tcccccctccatgtgttctgctgaacgcttttccc

SEQ ID NO: 103714 - DNA, 36 bp, Artificial Sequence
  Synthetic oligonucleotide
gcaccaaccgctccatgttctctgctcttgtcccga

SEQ ID NO: 103715 - DNA, 36 bp, Artificial Sequence
  Synthetic oligonucleotide
gacgccctcacaccgtagttgatcaccctcctgcca

SEQ ID NO: 103716 - DNA, 35 bp, Artificial Sequence
  Synthetic oligonucleotide
gcacctccgcttttccccattcgtgccctgcctgc

SEQ ID NO: 103717 - DNA, 37 bp, Artificial Sequence
  Synthetic oligonucleotide
gagacaggaggggggggacgggggaagagggcactga

SEQ ID NO: 103718 - DNA, 36 bp, Artificial Sequence
  Synthetic oligonucleotide
gtcccgcctgcctcactttgcgcctatgccatccca

SEQ ID NO: 103719 - DNA, 36 bp, Artificial Sequence
  Synthetic oligonucleotide
gcccgccccgcccaattactatcccatggtcctcca

SEQ ID NO: 103720 - DNA, 35 bp, Artificial Sequence
  Synthetic oligonucleotide
atgtccgtacgcccttgtttcacctgtgtcctttc

SEQ ID NO: 103721 - DNA, 35 bp, Artificial Sequence
  Synthetic oligonucleotide
gccccactcccacgattctgtttgcttgttgcttc

SEQ ID NO: 103722 - DNA, 35 bp, Artificial Sequence
  Synthetic oligonucleotide
tctacaatcgcccaccgtgtccagccctcgctcgc

SEQ ID NO: 103723 - DNA, 35 bp, Artificial Sequence
  Synthetic oligonucleotide
tacgccgcccagttggtttccgccgccacgtctcc

SEQ ID NO: 103724 - DNA, 33 bp, Artificial Sequence
  Synthetic oligonucleotide
tatctcgcccccccatctgtactccattgccat

SEQ ID NO: 103725 - DNA, 27 bp, Artificial Sequence
  Synthetic oligonucleotide
tgactgcccgacccccctctgcagcta

SEQ ID NO: 103726 - DNA, 35 bp, Artificial Sequence
  Synthetic oligonucleotide
ataacatgcgcctcgactctccgccacctgttcac

SEQ ID NO: 103727 - DNA, 35 bp, Artificial Sequence
  Synthetic oligonucleotide
ggtgcccctgctgcatctgtcttccgtcgttacct

SEQ ID NO: 103728 - DNA, 35 bp, Artificial Sequence
  Synthetic oligonucleotide
gctgcctgccccaagcccgccctgtctccccggtc

SEQ ID NO: 103729 - DNA, 37 bp, Artificial Sequence
  Synthetic oligonucleotide
acacatggacgggtggggaaggggattctccggggga

SEQ ID NO: 103730 - DNA, 35 bp, Artificial Sequence
  Synthetic oligonucleotide
atcctgccggcctgctgtaacgcccccctgtgccc

SEQ ID NO: 103731 - DNA, 35 bp, Artificial Sequence
  Synthetic oligonucleotide
tcgtgcctccgcctacttgtacaaagcctcccccc

SEQ ID NO: 103732 - DNA, 35 bp, Artificial Sequence
  Synthetic oligonucleotide
gtccccgcccaccttattgtacgacttagttcctg

SEQ ID NO: 103733 - DNA, 35 bp, Artificial Sequence
  Synthetic oligonucleotide
acgcggactgccactgattctcgctcgcccttgcc

SEQ ID NO: 103734 - DNA, 36 bp, Artificial Sequence
  Synthetic oligonucleotide
tgtccacatccatgcgcataatccacccggccctta

SEQ ID NO: 103735 - DNA, 35 bp, Artificial Sequence
  Synthetic oligonucleotide
acaccttgcgcctcatttttgaccgtctgctccac

SEQ ID NO: 103736 - DNA, 36 bp, Artificial Sequence
  Synthetic oligonucleotide
taggatcgcacctgccctgtttttcccactgcccta

SEQ ID NO: 103737 - DNA, 35 bp, Artificial Sequence
  Synthetic oligonucleotide
gtacacctccgccaatccccgcccccagcgagacc

SEQ ID NO: 103738 - DNA, 35 bp, Artificial Sequence
  Synthetic oligonucleotide
tccatcccccattggttccttacggcccttcatgc

SEQ ID NO: 103739 - DNA, 35 bp, Artificial Sequence
  Synthetic oligonucleotide
acgaacaaggtgggcggagagggaggtgaggggtg

SEQ ID NO: 103740 - DNA, 35 bp, Artificial Sequence
  Synthetic oligonucleotide
gcgaacctcgtgtcgtccgccccttccggttcact

SEQ ID NO: 103741 - DNA, 35 bp, Artificial Sequence
  Synthetic oligonucleotide
gcgcccccgcgctcttcagtacccgtcccctgctc

SEQ ID NO: 103742 - DNA, 36 bp, Artificial Sequence
  Synthetic oligonucleotide
tgcccgcattccgccacatcgtatcctgtctcttca

SEQ ID NO: 103743 - DNA, 35 bp, Artificial Sequence
  Synthetic oligonucleotide
tgaggagagtggaagggaggggtgaagggaggaga

SEQ ID NO: 103744 - DNA, 35 bp, Artificial Sequence
  Synthetic oligonucleotide
tagcccaacccctatgctttggttacatcatccca

SEQ ID NO: 103745 - DNA, 36 bp, Artificial Sequence
  Synthetic oligonucleotide
tcgcaacccacagcagtttttgccccacgcccccca

SEQ ID NO: 103746 - DNA, 36 bp, Artificial Sequence
  Synthetic oligonucleotide
gcctcctacatcgtatacccgcgtctcgcacgccca

SEQ ID NO: 103747 - DNA, 31 bp, Artificial Sequence
  Synthetic oligonucleotide
tcatacacgccgccccaccgcttcgcttcga

SEQ ID NO: 103748 - DNA, 35 bp, Artificial Sequence
  Synthetic oligonucleotide
gcccgcccggaagccacgttaccctccacctcgcg

SEQ ID NO: 103749 - DNA, 35 bp, Artificial Sequence
  Synthetic oligonucleotide
gatgcacacagcgcgcgtacacccttccattcctg

SEQ ID NO: 103750 - DNA, 37 bp, Artificial Sequence
  Synthetic oligonucleotide
acccctgaccactgttgtcgcttgccccccttaatga

SEQ ID NO: 103751 - DNA, 37 bp, Artificial Sequence
  Synthetic oligonucleotide
gagataggaaacgcagtagggaggcaagggggacaga

SEQ ID NO: 103752 - DNA, 35 bp, Artificial Sequence
  Synthetic oligonucleotide
gggagggggggggtacgggcaatgaacggagggaa

SEQ ID NO: 103753 - DNA, 35 bp, Artificial Sequence
  Synthetic oligonucleotide
tacacctccgctgtgattccatacttcgcgcccca

SEQ ID NO: 103754 - DNA, 35 bp, Artificial Sequence
  Synthetic oligonucleotide
gaagtggggcggtgggtaggaggaaggggtgagat

SEQ ID NO: 103755 - DNA, 34 bp, Artificial Sequence
  Synthetic oligonucleotide
tcgttacgccgcagccccaccgccactcctctcg

SEQ ID NO: 103756 - DNA, 35 bp, Artificial Sequence
  Synthetic oligonucleotide
aaccacctctgttcgcttactttcctgctcattgc

SEQ ID NO: 103757 - DNA, 36 bp, Artificial Sequence
  Synthetic oligonucleotide
tagggaggggtcgaaatggggtagtctaatagggga

SEQ ID NO: 103758 - DNA, 35 bp, Artificial Sequence
  Synthetic oligonucleotide
gtgtcgcacggcacacgcgcccttcctacaccttt

SEQ ID NO: 103759 - DNA, 35 bp, Artificial Sequence
  Synthetic oligonucleotide
gcacagtgtccgagtctcgccgctgtcctcttcac

SEQ ID NO: 103760 - DNA, 35 bp, Artificial Sequence
  Synthetic oligonucleotide
tcaccccccccttgttgtgccattcgtgacttgtc

SEQ ID NO: 103761 - DNA, 35 bp, Artificial Sequence
  Synthetic oligonucleotide
gcacgtctgtccgcacgcccgatcgccttccctcg

SEQ ID NO: 103762 - DNA, 35 bp, Artificial Sequence
  Synthetic oligonucleotide
atgcacacacctggtatgcacccctcccacccctc

SEQ ID NO: 103763 - DNA, 35 bp, Artificial Sequence
  Synthetic oligonucleotide
gaccgccaacactcgcaccttcaccccctaccggg

SEQ ID NO: 103764 - DNA, 38 bp, Artificial Sequence
  Synthetic oligonucleotide
gccctgcccacgacggtacacgccccctcactctatga

SEQ ID NO: 103765 - DNA, 35 bp, Artificial Sequence
  Synthetic oligonucleotide
aaaggtggaggctggtggaagggcgggggaggggg

SEQ ID NO: 103766 - DNA, 35 bp, Artificial Sequence
  Synthetic oligonucleotide
tcaccccagaactgcatccctgaatgtcaccttcc

SEQ ID NO: 103767 - DNA, 36 bp, Artificial Sequence
  Synthetic oligonucleotide
accaccgccgaaatctgcattcaatccatcctccga

SEQ ID NO: 103768 - DNA, 35 bp, Artificial Sequence
  Synthetic oligonucleotide
ttagccccgcacatatcctgtttctgttctctttg

SEQ ID NO: 103769 - DNA, 35 bp, Artificial Sequence
  Synthetic oligonucleotide
actcccccgctgtacctcagccactgctctatccg

SEQ ID NO: 103770 - DNA, 35 bp, Artificial Sequence
  Synthetic oligonucleotide
aagcctgacccgaagctgccgcccctccgttccat

SEQ ID NO: 103771 - DNA, 35 bp, Artificial Sequence
  Synthetic oligonucleotide
gtgggagggaggggtgagagggtagaggagcgaag

SEQ ID NO: 103772 - DNA, 35 bp, Artificial Sequence
  Synthetic oligonucleotide
tgtccacccctgtctctatctttgcattacgcgcc

SEQ ID NO: 103773 - DNA, 35 bp, Artificial Sequence
  Synthetic oligonucleotide
gttcacactcgcccgaatctgttaatactcttccc

SEQ ID NO: 103774 - DNA, 35 bp, Artificial Sequence
  Synthetic oligonucleotide
gcctcctgccctcaactcgctatccctgatccatc

SEQ ID NO: 103775 - DNA, 35 bp, Artificial Sequence
  Synthetic oligonucleotide
tgttacccctgttcgtgcatggccccaccctgtta

SEQ ID NO: 103776 - DNA, 37 bp, Artificial Sequence
  Synthetic oligonucleotide
taatgggcgaaaggggggaggaagggcgggcagtaga

SEQ ID NO: 103777 - DNA, 33 bp, Artificial Sequence
  Synthetic oligonucleotide
tccccccctccgctcgttttgtacgcacatgcg

SEQ ID NO: 103778 - DNA, 35 bp, Artificial Sequence
  Synthetic oligonucleotide
taaacgtctccgcccgttccgtctcgactcgccca

SEQ ID NO: 103779 - DNA, 36 bp, Artificial Sequence
  Synthetic oligonucleotide
cgtgcaccagcctcctgcactttcgacactttgcta

SEQ ID NO: 103780 - DNA, 36 bp, Artificial Sequence
  Synthetic oligonucleotide
ggaacggggggggttagggaggggagcagagactga

SEQ ID NO: 103781 - DNA, 35 bp, Artificial Sequence
  Synthetic oligonucleotide
gacctcgccttgcattttaagccccagcccttccc

SEQ ID NO: 103782 - DNA, 35 bp, Artificial Sequence
  Synthetic oligonucleotide
gttgcgccttcacacctgttcttacgctgcttatc

SEQ ID NO: 103783 - DNA, 35 bp, Artificial Sequence
  Synthetic oligonucleotide
gacacccctccgccctgaccttgggaccctcaccc

SEQ ID NO: 103784 - DNA, 35 bp, Artificial Sequence
  Synthetic oligonucleotide
ttcccgcccactactaccctgcgccactgtgcccc

SEQ ID NO: 103785 - DNA, 30 bp, Artificial Sequence
  Synthetic oligonucleotide
gcacgccactgcgaacgcttctaccctctc

SEQ ID NO: 103786 - DNA, 37 bp, Artificial Sequence
  Synthetic oligonucleotide
tcaggaaggggggggagtagtaaacgggaggggagga

SEQ ID NO: 103787 - DNA, 35 bp, Artificial Sequence
  Synthetic oligonucleotide
gctgcccgcctgttctctgttccgcgcccccagca

SEQ ID NO: 103788 - DNA, 38 bp, Artificial Sequence
  Synthetic oligonucleotide
gcccagtgccactcagtgcttattcctcccccccatga

SEQ ID NO: 103789 - DNA, 35 bp, Artificial Sequence
  Synthetic oligonucleotide
tgattcccgcgccccccgtgcgtaccacactgttc

SEQ ID NO: 103790 - DNA, 35 bp, Artificial Sequence
  Synthetic oligonucleotide
taatcgccccgccccgtccaatcgtccctccatgg

SEQ ID NO: 103791 - DNA, 35 bp, Artificial Sequence
  Synthetic oligonucleotide
taaccccccgctccttaccccgtgagacagctcgt

SEQ ID NO: 103792 - DNA, 35 bp, Artificial Sequence
  Synthetic oligonucleotide
tgccactccattatcgtatagctctctcctccgtg

SEQ ID NO: 103793 - DNA, 35 bp, Artificial Sequence
  Synthetic oligonucleotide
taccgctcccgccttgtcccccgcactcatttctg

SEQ ID NO: 103794 - DNA, 37 bp, Artificial Sequence
  Synthetic oligonucleotide
agactggaggcggtgggggaaggtggttggccctgga

SEQ ID NO: 103795 - DNA, 35 bp, Artificial Sequence
  Synthetic oligonucleotide
tcacgtctgtaggtcgccacgtcccatcttctccg

SEQ ID NO: 103796 - DNA, 35 bp, Artificial Sequence
  Synthetic oligonucleotide
tacagtcgatccgcccccctctgtttacgccgctc

SEQ ID NO: 103797 - DNA, 35 bp, Artificial Sequence
  Synthetic oligonucleotide
ttgtggccccctgccgttatccttctgtcaccctt

SEQ ID NO: 103798 - DNA, 35 bp, Artificial Sequence
  Synthetic oligonucleotide
gactcatcgcacccatgttggttcgcacccttccc

SEQ ID NO: 103799 - DNA, 37 bp, Artificial Sequence
  Synthetic oligonucleotide
gtggggtcgtcgagggtggggtgaccctcttcgggga

SEQ ID NO: 103800 - DNA, 35 bp, Artificial Sequence
  Synthetic oligonucleotide
gtaccaccgctactctcttcccctgtaccatcgta

SEQ ID NO: 103801 - DNA, 35 bp, Artificial Sequence
  Synthetic oligonucleotide
tgcaccatccctcacgttccctgcatgcttgtttc

SEQ ID NO: 103802 - DNA, 35 bp, Artificial Sequence
  Synthetic oligonucleotide
accatccacccgttgttactattagccttatgcac

SEQ ID NO: 103803 - DNA, 35 bp, Artificial Sequence
  Synthetic oligonucleotide
gcccgccgcccctcgcttgaaagcaccctgttccg

SEQ ID NO: 103804 - DNA, 35 bp, Artificial Sequence
  Synthetic oligonucleotide
tcatctgccccatctgtttagcctaaccgtactcc

SEQ ID NO: 103805 - DNA, 35 bp, Artificial Sequence
  Synthetic oligonucleotide
gccgtcgcctctgtgcttctttcccttcctcgtcc

SEQ ID NO: 103806 - DNA, 37 bp, Artificial Sequence
  Synthetic oligonucleotide
acaccccgccctcatcgtgtctcgtccacctccgcga

SEQ ID NO: 103807 - DNA, 36 bp, Artificial Sequence
  Synthetic oligonucleotide
tcccccaccgccctcccactggcatcagtagcctta

SEQ ID NO: 103808 - DNA, 35 bp, Artificial Sequence
  Synthetic oligonucleotide
acatccctcattgttctatcactgccaatctccgc

SEQ ID NO: 103809 - DNA, 35 bp, Artificial Sequence
  Synthetic oligonucleotide
acccgtctcccctgcccactgacgctctttccatg

SEQ ID NO: 103810 - DNA, 35 bp, Artificial Sequence
  Synthetic oligonucleotide
gccctcgccggttccatcttttgcacgcctatttc

SEQ ID NO: 103811 - DNA, 34 bp, Artificial Sequence
  Synthetic oligonucleotide
gggcccgcacgatcgttacacacctcccccccgt

SEQ ID NO: 103812 - DNA, 35 bp, Artificial Sequence
  Synthetic oligonucleotide
agaccgcataccgctctcttctgccttatctttgc

SEQ ID NO: 103813 - DNA, 35 bp, Artificial Sequence
  Synthetic oligonucleotide
gaagagagggcggaggtggaagaaaggtcggaatg

SEQ ID NO: 103814 - DNA, 37 bp, Artificial Sequence
  Synthetic oligonucleotide
gccgacccgccccacgtagcttattctgtcacctgga

SEQ ID NO: 103815 - DNA, 35 bp, Artificial Sequence
  Synthetic oligonucleotide
gctgcctctcattgccggcgcctgtcttcctcccg

SEQ ID NO: 103816 - DNA, 37 bp, Artificial Sequence
  Synthetic oligonucleotide
tcccacctccgctacattgctttctgtcctacgtgga

SEQ ID NO: 103817 - DNA, 36 bp, Artificial Sequence
  Synthetic oligonucleotide
gacaaggtgggctggggtggaggggacggagcggca

SEQ ID NO: 103818 - DNA, 36 bp, Artificial Sequence
  Synthetic oligonucleotide
tgacatggacggaggtggggtggcggttgggtttca

SEQ ID NO: 103819 - DNA, 35 bp, Artificial Sequence
  Synthetic oligonucleotide
gtgttgccccactggtcgcctttcactgattcttc

SEQ ID NO: 103820 - DNA, 35 bp, Artificial Sequence
  Synthetic oligonucleotide
atatcccacacgccaatgcgccttccagcccgccc

SEQ ID NO: 103821 - DNA, 35 bp, Artificial Sequence
  Synthetic oligonucleotide
tgcccaacccatctgccgttacgattctacgcctc

SEQ ID NO: 103822 - DNA, 38 bp, Artificial Sequence
  Synthetic oligonucleotide
tggtctgaggtcaggttcccgtaggggaggggggagga

SEQ ID NO: 103823 - DNA, 35 bp, Artificial Sequence
  Synthetic oligonucleotide
tcgatccccacctgtatgcgctccctcttacgttc

SEQ ID NO: 103824 - DNA, 35 bp, Artificial Sequence
  Synthetic oligonucleotide
acttccccccttgtgctgcctgcctggtccatccc

SEQ ID NO: 103825 - DNA, 38 bp, Artificial Sequence
  Synthetic oligonucleotide
tgtgaccccgcccatctgcccttactgccatttcctga

SEQ ID NO: 103826 - DNA, 35 bp, Artificial Sequence
  Synthetic oligonucleotide
gcctgccccgctcttgtcccggtcattctatcccc

SEQ ID NO: 103827 - DNA, 35 bp, Artificial Sequence
  Synthetic oligonucleotide
gtgtgtcgcccgctccccgctgccgttttcccact

SEQ ID NO: 103828 - DNA, 35 bp, Artificial Sequence
  Synthetic oligonucleotide
atgacgtcgccctcgtagcctatctgcctggtccc

SEQ ID NO: 103829 - DNA, 35 bp, Artificial Sequence
  Synthetic oligonucleotide
atcgctcgctcccgtgccttctgcccatttcccgc

SEQ ID NO: 103830 - DNA, 35 bp, Artificial Sequence
  Synthetic oligonucleotide
gcccgcccctctttctgcaacagctccctccttgc

SEQ ID NO: 103831 - DNA, 35 bp, Artificial Sequence
  Synthetic oligonucleotide
gaccaccccctggattgttggttgtcccttatccc

SEQ ID NO: 103832 - DNA, 36 bp, Artificial Sequence
  Synthetic oligonucleotide
tcacgcaccacacgttctcccagctcctctccggta

SEQ ID NO: 103833 - DNA, 35 bp, Artificial Sequence
  Synthetic oligonucleotide
agcatggacggaggggtcacgggggattggcggtc

SEQ ID NO: 103834 - DNA, 35 bp, Artificial Sequence
  Synthetic oligonucleotide
tgccaaccctctgctccctcgtacgttcacatact

SEQ ID NO: 103835 - DNA, 35 bp, Artificial Sequence
  Synthetic oligonucleotide
acctccccaccatctggcccctttgagcagtacgc

SEQ ID NO: 103836 - DNA, 35 bp, Artificial Sequence
  Synthetic oligonucleotide
gatgacccgcacgaactgtaccttcgccaatccac

SEQ ID NO: 103837 - DNA, 35 bp, Artificial Sequence
  Synthetic oligonucleotide
gatcatcccaatgtggccgtaccccctccccttcg

SEQ ID NO: 103838 - DNA, 37 bp, Artificial Sequence
  Synthetic oligonucleotide
ggggctatgtcttgggtggggcaagagctaaggggga

SEQ ID NO: 103839 - DNA, 35 bp, Artificial Sequence
  Synthetic oligonucleotide
acgatgcactcgcctatcggttctggtgcccttcc

SEQ ID NO: 103840 - DNA, 35 bp, Artificial Sequence
  Synthetic oligonucleotide
gtcccccccctttatgtgtttttcctcgcctacgc

SEQ ID NO: 103841 - DNA, 36 bp, Artificial Sequence
  Synthetic oligonucleotide
tccaccccccatgctattacctcgacccgctgagca

SEQ ID NO: 103842 - DNA, 35 bp, Artificial Sequence
  Synthetic oligonucleotide
aacacccccgaccgttttagcatatagcgcgcccc

SEQ ID NO: 103843 - DNA, 35 bp, Artificial Sequence
  Synthetic oligonucleotide
tgactccgtagcccgttctttgttccgtctcccgc

SEQ ID NO: 103844 - DNA, 35 bp, Artificial Sequence
  Synthetic oligonucleotide
agccatggggggaggaggggttgcggacggctcca

SEQ ID NO: 103845 - DNA, 35 bp, Artificial Sequence
  Synthetic oligonucleotide
tagcccccctcgctgtcattaacatctgctcctca

SEQ ID NO: 103846 - DNA, 35 bp, Artificial Sequence
  Synthetic oligonucleotide
gagtgccccttgcctgttgcctgcctgagtccttc

SEQ ID NO: 103847 - DNA, 36 bp, Artificial Sequence
  Synthetic oligonucleotide
gccctgcccacacccgtgcatcccaatgccatccga

SEQ ID NO: 103848 - DNA, 35 bp, Artificial Sequence
  Synthetic oligonucleotide
tccgcccctggcacctgcgctaccttcctcccgga

SEQ ID NO: 103849 - DNA, 35 bp, Artificial Sequence
  Synthetic oligonucleotide
gatgcgccctcacgttttcatgtctctccctgtca

SEQ ID NO: 103850 - DNA, 35 bp, Artificial Sequence
  Synthetic oligonucleotide
gctgccacccgcctgagatctcgtgccttcccttc

SEQ ID NO: 103851 - DNA, 36 bp, Artificial Sequence
  Synthetic oligonucleotide
accgagggcggagtgggagggtgctactcaacctca

SEQ ID NO: 103852 - DNA, 35 bp, Artificial Sequence
  Synthetic oligonucleotide
accacgtcagctgttcgtccgctcccccgtttctc

SEQ ID NO: 103853 - DNA, 37 bp, Artificial Sequence
  Synthetic oligonucleotide
tgccgccaccgatctgtagcgtccccccttcccccga

SEQ ID NO: 103854 - DNA, 35 bp, Artificial Sequence
  Synthetic oligonucleotide
tcacccacctactgtttccctgtccactcctcgag

SEQ ID NO: 103855 - DNA, 35 bp, Artificial Sequence
  Synthetic oligonucleotide
tcgcacccatgacctcaccccgtcgctccctcgcg

SEQ ID NO: 103856 - DNA, 35 bp, Artificial Sequence
  Synthetic oligonucleotide
gccgtggccccaccttgacttagacctgccccctc

SEQ ID NO: 103857 - DNA, 38 bp, Artificial Sequence
  Synthetic oligonucleotide
tacctcctccgcccctgcacgagactgtcattcattga

SEQ ID NO: 103858 - DNA, 35 bp, Artificial Sequence
  Synthetic oligonucleotide
tatcacctgcccccgcctcgccgtaccgcctcacg

SEQ ID NO: 103859 - DNA, 36 bp, Artificial Sequence
  Synthetic oligonucleotide
tgcccagccccttctgcttttcgtcacggctcccga

SEQ ID NO: 103860 - DNA, 35 bp, Artificial Sequence
  Synthetic oligonucleotide
ttgagccgccatacgcgatatcgatcaccactccc

SEQ ID NO: 103861 - DNA, 35 bp, Artificial Sequence
  Synthetic oligonucleotide
accccacatctgagcctatactgaggccaccttcc

SEQ ID NO: 103862 - DNA, 35 bp, Artificial Sequence
  Synthetic oligonucleotide
gcccccaccccaccatgttcccacgacgagcaggc

SEQ ID NO: 103863 - DNA, 35 bp, Artificial Sequence
  Synthetic oligonucleotide
tagtgggtgctgatgggggtccgtgggcgggcata

SEQ ID NO: 103864 - DNA, 34 bp, Artificial Sequence
  Synthetic oligonucleotide
acgcaacctctgtctcttcatacctcgtcgcgcc

SEQ ID NO: 103865 - DNA, 35 bp, Artificial Sequence
  Synthetic oligonucleotide
gatgccactcgccgtcacccccccttccgtcttgg

SEQ ID NO: 103866 - DNA, 38 bp, Artificial Sequence
  Synthetic oligonucleotide
atgcctccgcctctttgtttctgcgctccgttccttga

SEQ ID NO: 103867 - DNA, 35 bp, Artificial Sequence
  Synthetic oligonucleotide
tgcatccgaccgtctggttaccccaccccactccg

SEQ ID NO: 103868 - DNA, 35 bp, Artificial Sequence
  Synthetic oligonucleotide
accccattccgctatgtatctccccgcccgggccc

SEQ ID NO: 103869 - DNA, 38 bp, Artificial Sequence
  Synthetic oligonucleotide
aactgccccatccccgtaatgtgccctcccgttggtga

SEQ ID NO: 103870 - DNA, 35 bp, Artificial Sequence
  Synthetic oligonucleotide
gccccaccctactgagcgtgcgctatccatcctta

SEQ ID NO: 103871 - DNA, 35 bp, Artificial Sequence
  Synthetic oligonucleotide
gtagggagggggcaccgtaatggggtaactggggt

SEQ ID NO: 103872 - DNA, 37 bp, Artificial Sequence
  Synthetic oligonucleotide
tccacccggcccatctgttcttttctccgctcgctga

SEQ ID NO: 103873 - DNA, 35 bp, Artificial Sequence
  Synthetic oligonucleotide
tccctcgccgacctttattgcctccgtcatcctca

SEQ ID NO: 103874 - DNA, 35 bp, Artificial Sequence
  Synthetic oligonucleotide
acccacctgtgcccgcttttcatacagtgcttccc

SEQ ID NO: 103875 - DNA, 37 bp, Artificial Sequence
  Synthetic oligonucleotide
tagtacggtcaccatctgctctactccacctccctga

SEQ ID NO: 103876 - DNA, 35 bp, Artificial Sequence
  Synthetic oligonucleotide
tcacccgcctctccactcccccagctcacgactgg

SEQ ID NO: 103877 - DNA, 38 bp, Artificial Sequence
  Synthetic oligonucleotide
gtgcaacgcacacggtatacttccttccccctttttga

SEQ ID NO: 103878 - DNA, 36 bp, Artificial Sequence
  Synthetic oligonucleotide
gcgctgccatccgccgtgcttcttcgcctccaccca

SEQ ID NO: 103879 - DNA, 35 bp, Artificial Sequence
  Synthetic oligonucleotide
tgtcccgcccgtgccccctttgcctttctagcgtg

SEQ ID NO: 103880 - DNA, 35 bp, Artificial Sequence
  Synthetic oligonucleotide
tcacagtcgccgccctgatccattcacccgtgtcc

SEQ ID NO: 103881 - DNA, 35 bp, Artificial Sequence
  Synthetic oligonucleotide
gtacacgtcccgccggcccaacactattcgcacgc

SEQ ID NO: 103882 - DNA, 38 bp, Artificial Sequence
  Synthetic oligonucleotide
tggggtggtggagggggatggagctacggcgggtttga

SEQ ID NO: 103883 - DNA, 35 bp, Artificial Sequence
  Synthetic oligonucleotide
gcccgatgagcgtttcccagccgttccctgccccc

SEQ ID NO: 103884 - DNA, 36 bp, Artificial Sequence
  Synthetic oligonucleotide
gcatgagggaaggggggaggaccggtggagcgagta

SEQ ID NO: 103885 - DNA, 32 bp, Artificial Sequence
  Synthetic oligonucleotide
tcagcccgtgctttcaccctccaccatagccc

SEQ ID NO: 103886 - DNA, 35 bp, Artificial Sequence
  Synthetic oligonucleotide
gtcaacggccgttccatctcgcctatcccgctgtc

SEQ ID NO: 103887 - DNA, 35 bp, Artificial Sequence
  Synthetic oligonucleotide
agaccacatcccgccccattggttcacgctcctac

SEQ ID NO: 103888 - DNA, 36 bp, Artificial Sequence
  Synthetic oligonucleotide
accctgccctactatgcgcaatccctgcatgattca

SEQ ID NO: 103889 - DNA, 35 bp, Artificial Sequence
  Synthetic oligonucleotide
agcaccaccattcagcgcgttaacctccgaccctc

SEQ ID NO: 103890 - DNA, 37 bp, Artificial Sequence
  Synthetic oligonucleotide
gtgggggggaacgaaagggagggcgacgggagagaga

SEQ ID NO: 103891 - DNA, 35 bp, Artificial Sequence
  Synthetic oligonucleotide
acacaccactccctgcgccctatccagcttacatg

SEQ ID NO: 103892 - DNA, 36 bp, Artificial Sequence
  Synthetic oligonucleotide
aagggagggggagtggggaaagggtgcgatggccaa

SEQ ID NO: 103893 - DNA, 35 bp, Artificial Sequence
  Synthetic oligonucleotide
tccaaccgccgacgagttatcgcccctctcaacac

SEQ ID NO: 103894 - DNA, 35 bp, Artificial Sequence
  Synthetic oligonucleotide
gtgccgatctcgctgccacaccctcccattatccc

SEQ ID NO: 103895 - DNA, 38 bp, Artificial Sequence
  Synthetic oligonucleotide
ggggctggccggaaatgcgcatacggtggggggggtga

SEQ ID NO: 103896 - DNA, 35 bp, Artificial Sequence
  Synthetic oligonucleotide
tgagcgatccctgtcttatcgccgactcctccccg

SEQ ID NO: 103897 - DNA, 35 bp, Artificial Sequence
  Synthetic oligonucleotide
acgcctgtcccgccccgtactgtcgccttgttgtc

SEQ ID NO: 103898 - DNA, 35 bp, Artificial Sequence
  Synthetic oligonucleotide
gaaccagcccatagtcttatcgtcctgctctcgta

SEQ ID NO: 103899 - DNA, 35 bp, Artificial Sequence
  Synthetic oligonucleotide
gccacacgcctgcctggtacttatctcgcaccacc

SEQ ID NO: 103900 - DNA, 37 bp, Artificial Sequence
  Synthetic oligonucleotide
tcgcaatcgccatccatgcgtcaccctgcccatctga

SEQ ID NO: 103901 - DNA, 35 bp, Artificial Sequence
  Synthetic oligonucleotide
gcttcccacaattacctcccagcgtttctgctcgc

SEQ ID NO: 103902 - DNA, 37 bp, Artificial Sequence
  Synthetic oligonucleotide
gaacggcgaggaggaagggaggttggggggacatgga

SEQ ID NO: 103903 - DNA, 35 bp, Artificial Sequence
  Synthetic oligonucleotide
tcccccacatcacctcatggtcttgtacacgcctc

SEQ ID NO: 103904 - DNA, 35 bp, Artificial Sequence
  Synthetic oligonucleotide
gatgcgcgcgaccatgtctcgatttcgccaccctt

SEQ ID NO: 103905 - DNA, 35 bp, Artificial Sequence
  Synthetic oligonucleotide
gagagcccatactcttcccgcccttgcatcctgcc

SEQ ID NO: 103906 - DNA, 36 bp, Artificial Sequence
  Synthetic oligonucleotide
tcctccacccctgcttacgtactggtccgttctaca

SEQ ID NO: 103907 - DNA, 35 bp, Artificial Sequence
  Synthetic oligonucleotide
tccccccccgcagatacccgcccattgtccatcgg

SEQ ID NO: 103908 - DNA, 35 bp, Artificial Sequence
  Synthetic oligonucleotide
tgtcagatccgctggtctgtaacgctccccctcct

SEQ ID NO: 103909 - DNA, 36 bp, Artificial Sequence
  Synthetic oligonucleotide
tgttgccctatggtccgcccccgttttcgccgccaa

SEQ ID NO: 103910 - DNA, 38 bp, Artificial Sequence
  Synthetic oligonucleotide
tgacgagcccccagcatctgttcccatcctctccgtga

SEQ ID NO: 103911 - DNA, 35 bp, Artificial Sequence
  Synthetic oligonucleotide
atgcccccccagcacccctttgatactgccctcct

SEQ ID NO: 103912 - DNA, 35 bp, Artificial Sequence
  Synthetic oligonucleotide
acatgcgcacgtgttttgcctccgtcctgtaccac

SEQ ID NO: 103913 - DNA, 36 bp, Artificial Sequence
  Synthetic oligonucleotide
tagcacccgcccgttcccttgcgtaaccaccactta

SEQ ID NO: 103914 - DNA, 35 bp, Artificial Sequence
  Synthetic oligonucleotide
tccgccccaactgttttactgggcaccatccatcc

SEQ ID NO: 103915 - DNA, 35 bp, Artificial Sequence
  Synthetic oligonucleotide
atgccccgttctatctctgtctgtgtcctgttcct

SEQ ID NO: 103916 - DNA, 36 bp, Artificial Sequence
  Synthetic oligonucleotide
actacccccgccacctggttacaacggaactcttca

SEQ ID NO: 103917 - DNA, 33 bp, Artificial Sequence
  Synthetic oligonucleotide
tacttccctccgccccacgagacgctttcctac

SEQ ID NO: 103918 - DNA, 35 bp, Artificial Sequence
  Synthetic oligonucleotide
acacacgcacatcgacttcacggccggcacccccc

SEQ ID NO: 103919 - DNA, 35 bp, Artificial Sequence
  Synthetic oligonucleotide
tcccctacgcccgtgctctacttcggttccatcgc

SEQ ID NO: 103920 - DNA, 35 bp, Artificial Sequence
  Synthetic oligonucleotide
acagacacctcctactctttagcctctgccgtggt

SEQ ID NO: 103921 - DNA, 35 bp, Artificial Sequence
  Synthetic oligonucleotide
gaccccattcaggccctgttcgccactcgcccatc

SEQ ID NO: 103922 - DNA, 35 bp, Artificial Sequence
  Synthetic oligonucleotide
aacgacaacccttccattcgtaacatactgccttc

SEQ ID NO: 103923 - DNA, 35 bp, Artificial Sequence
  Synthetic oligonucleotide
tatgaccgcctgcccccactcactgttcttggtcc

SEQ ID NO: 103924 - DNA, 35 bp, Artificial Sequence
  Synthetic oligonucleotide
aacaccctcgcccagacatttcagccggtcccctc

SEQ ID NO: 103925 - DNA, 35 bp, Artificial Sequence
  Synthetic oligonucleotide
tgttccacccgcctccctgttcgatcagccatcaa

SEQ ID NO: 103926 - DNA, 35 bp, Artificial Sequence
  Synthetic oligonucleotide
taccgacgctcgcaccactgttccatcccatctgg

SEQ ID NO: 103927 - DNA, 36 bp, Artificial Sequence
  Synthetic oligonucleotide
agctccacccgccctggtccgcattacctgcctgca

SEQ ID NO: 103928 - DNA, 35 bp, Artificial Sequence
  Synthetic oligonucleotide
gttgaggtgaggggggggataggggaagaaagggg

SEQ ID NO: 103929 - DNA, 35 bp, Artificial Sequence
  Synthetic oligonucleotide
tccaccgacatagccacttccaggtccctgtccct

SEQ ID NO: 103930 - DNA, 35 bp, Artificial Sequence
  Synthetic oligonucleotide
actccacgccgtcccgctccctctaggccaccctt

SEQ ID NO: 103931 - DNA, 35 bp, Artificial Sequence
  Synthetic oligonucleotide
gcgactggggaacatgggaaggggaggggagcagc

SEQ ID NO: 103932 - DNA, 35 bp, Artificial Sequence
  Synthetic oligonucleotide
tcaccccctgtgcacctctgcccttgaaacatgtt

SEQ ID NO: 103933 - DNA, 35 bp, Artificial Sequence
  Synthetic oligonucleotide
gcacatactccgggctgtcctgttctcgggctcct

SEQ ID NO: 103934 - DNA, 35 bp, Artificial Sequence
  Synthetic oligonucleotide
aagttcgcctccctcatgtaccgtgcctgccctca

SEQ ID NO: 103935 - DNA, 35 bp, Artificial Sequence
  Synthetic oligonucleotide
actccgcctccccatcggtatgcctatcaccttcg

SEQ ID NO: 103936 - DNA, 35 bp, Artificial Sequence
  Synthetic oligonucleotide
aacgccacatcttactgctgtccgcccccttttcc

SEQ ID NO: 103937 - DNA, 37 bp, Artificial Sequence
  Synthetic oligonucleotide
atgccccttcctgctggtctatggttcccgcccccga

SEQ ID NO: 103938 - DNA, 36 bp, Artificial Sequence
  Synthetic oligonucleotide
tatccagcctcctgcgcatacacctcgaatccccga

SEQ ID NO: 103939 - DNA, 35 bp, Artificial Sequence
  Synthetic oligonucleotide
tccggagccacaccggtggtcaatgccctcctacc

SEQ ID NO: 103940 - DNA, 35 bp, Artificial Sequence
  Synthetic oligonucleotide
tcagccccccagcttacgttcctatgtcctttttg

SEQ ID NO: 103941 - DNA, 35 bp, Artificial Sequence
  Synthetic oligonucleotide
tctcgccgccgccacaccatttaccccgccctggc

SEQ ID NO: 103942 - DNA, 35 bp, Artificial Sequence
  Synthetic oligonucleotide
tccgccgtcaaacgttagcccgcccacccgctctc

SEQ ID NO: 103943 - DNA, 35 bp, Artificial Sequence
  Synthetic oligonucleotide
acctccctgccatcggtactgcacttgaactcctc

SEQ ID NO: 103944 - DNA, 35 bp, Artificial Sequence
  Synthetic oligonucleotide
attgccaccggctgcatatacacatcccccgcctg

SEQ ID NO: 103945 - DNA, 35 bp, Artificial Sequence
  Synthetic oligonucleotide
tatccccccgctgttcctgccccgccatggattcc

SEQ ID NO: 103946 - DNA, 35 bp, Artificial Sequence
  Synthetic oligonucleotide
tatagcgccccttgtcccgatttgaacctgctccc

SEQ ID NO: 103947 - DNA, 36 bp, Artificial Sequence
  Synthetic oligonucleotide
tgacatccggcctcgctgccccgtacatccgcccca

SEQ ID NO: 103948 - DNA, 35 bp, Artificial Sequence
  Synthetic oligonucleotide
acccgccatcacatgaatataatgcgcctatcctc

SEQ ID NO: 103949 - DNA, 35 bp, Artificial Sequence
  Synthetic oligonucleotide
acaccgcgcactcacacgccgtttcccccgttgtc

SEQ ID NO: 103950 - DNA, 35 bp, Artificial Sequence
  Synthetic oligonucleotide
tgatgcactcctcctttgttcttttgctcacttcg

SEQ ID NO: 103951 - DNA, 35 bp, Artificial Sequence
  Synthetic oligonucleotide
gccatccccacgtagtacatattctgccgctttac

SEQ ID NO: 103952 - DNA, 35 bp, Artificial Sequence
  Synthetic oligonucleotide
gtccgaccctccgctgcctcgatcgcttccctatc

SEQ ID NO: 103953 - DNA, 37 bp, Artificial Sequence
  Synthetic oligonucleotide
gtattggcgggggggcatgctgtatggggatggtgga

SEQ ID NO: 103954 - DNA, 33 bp, Artificial Sequence
  Synthetic oligonucleotide
gagggtgggtggggacgatgggtaacattatca

SEQ ID NO: 103955 - DNA, 35 bp, Artificial Sequence
  Synthetic oligonucleotide
aatcccgcagccacattcgacccgccgcgtgcccc

SEQ ID NO: 103956 - DNA, 32 bp, Artificial Sequence
  Synthetic oligonucleotide
gtgcatgcgcagtttcctgtcctccccccgca

SEQ ID NO: 103957 - DNA, 35 bp, Artificial Sequence
  Synthetic oligonucleotide
atctagcgccctacagtcgtcctccttcacactcc

SEQ ID NO: 103958 - DNA, 36 bp, Artificial Sequence
  Synthetic oligonucleotide
acctcccgccggcggactgtcttattcgccccccca

SEQ ID NO: 103959 - DNA, 36 bp, Artificial Sequence
  Synthetic oligonucleotide
tgaccgtcgaccgcccaacatgcagttaatcggacc

SEQ ID NO: 103960 - DNA, 37 bp, Artificial Sequence
  Synthetic oligonucleotide
tccgcccactcatctgtcaccttttgtcccccgccga

SEQ ID NO: 103961 - DNA, 35 bp, Artificial Sequence
  Synthetic oligonucleotide
gggcccgcccgctgctcccatcacccgcctcccag

SEQ ID NO: 103962 - DNA, 35 bp, Artificial Sequence
  Synthetic oligonucleotide
gttgcatgcctccgacccgcctttgtttccgcatc

SEQ ID NO: 103963 - DNA, 38 bp, Artificial Sequence
  Synthetic oligonucleotide
gccccccgttctatcgcacccgttgtcacttgcggtga

SEQ ID NO: 103964 - DNA, 35 bp, Artificial Sequence
  Synthetic oligonucleotide
agtcgccccgcctgccccctaagctgtcctcccgt

SEQ ID NO: 103965 - DNA, 35 bp, Artificial Sequence
  Synthetic oligonucleotide
tcacccctagcgcacctcgcgttactctcgcccct

SEQ ID NO: 103966 - DNA, 35 bp, Artificial Sequence
  Synthetic oligonucleotide
acgttcatcctgttcgatctgcttctcgcccttgc

SEQ ID NO: 103967 - DNA, 31 bp, Artificial Sequence
  Synthetic oligonucleotide
ggacctccacctcagttcttactcgttcttc

SEQ ID NO: 103968 - DNA, 37 bp, Artificial Sequence
  Synthetic oligonucleotide
gtgaagagcgggagggcggagaagagggaagcagcga

SEQ ID NO: 103969 - DNA, 35 bp, Artificial Sequence
  Synthetic oligonucleotide
tcacacccctgagtcctatctccgacacttttcac

SEQ ID NO: 103970 - DNA, 36 bp, Artificial Sequence
  Synthetic oligonucleotide
atcgtgtcagtccgcctgcctgtccgtcttccctca

SEQ ID NO: 103971 - DNA, 35 bp, Artificial Sequence
  Synthetic oligonucleotide
atcagccgccatcttcatgcgccactctgcccttc

SEQ ID NO: 103972 - DNA, 35 bp, Artificial Sequence
  Synthetic oligonucleotide
tcccgcgccgccctgttctgccgctcttcttccgt

SEQ ID NO: 103973 - DNA, 37 bp, Artificial Sequence
  Synthetic oligonucleotide
gcagggcgggacaaggggagggaaggtgcgcacggga

SEQ ID NO: 103974 - DNA, 35 bp, Artificial Sequence
  Synthetic oligonucleotide
ttgccaccctgtcctgctcgccaattctagtaacc

SEQ ID NO: 103975 - DNA, 35 bp, Artificial Sequence
  Synthetic oligonucleotide
tccgcccgccgtaccgtcgtcctaagtcgcttccc

SEQ ID NO: 103976 - DNA, 35 bp, Artificial Sequence
  Synthetic oligonucleotide
accgccccccggccctcatgcaatcctagtgctcc

SEQ ID NO: 103977 - DNA, 36 bp, Artificial Sequence
  Synthetic oligonucleotide
accgccccactgcgctccaaagccttgtgcccccca

SEQ ID NO: 103978 - DNA, 36 bp, Artificial Sequence
  Synthetic oligonucleotide
gaatggggcgggtgggaacacgggggacacctcgaa

SEQ ID NO: 103979 - DNA, 37 bp, Artificial Sequence
  Synthetic oligonucleotide
tccactacagggacgatcggggataggggtagtggga

SEQ ID NO: 103980 - DNA, 35 bp, Artificial Sequence
  Synthetic oligonucleotide
tgcaacccacatgcgttcaccaccccgcgcaccga

SEQ ID NO: 103981 - DNA, 35 bp, Artificial Sequence
  Synthetic oligonucleotide
gactgtcgcaattcgctgcctgccataccttccgt

SEQ ID NO: 103982 - DNA, 37 bp, Artificial Sequence
  Synthetic oligonucleotide
tccaccccccctccgactttcccaggacaggccacga

SEQ ID NO: 103983 - DNA, 35 bp, Artificial Sequence
  Synthetic oligonucleotide
gacacatcctcctactcgttacgtccacgggcgtc

SEQ ID NO: 103984 - DNA, 35 bp, Artificial Sequence
  Synthetic oligonucleotide
gccctcccccgtgtagcagcgcagttccgctctct

SEQ ID NO: 103985 - DNA, 36 bp, Artificial Sequence
  Synthetic oligonucleotide
gtcgccctccgtctctggttctatcatccgccttga

SEQ ID NO: 103986 - DNA, 35 bp, Artificial Sequence
  Synthetic oligonucleotide
gatgtatgccctgcctttatcccttcttgttacct

SEQ ID NO: 103987 - DNA, 36 bp, Artificial Sequence
  Synthetic oligonucleotide
atcgcaccgcccggcctcatttcgcacccgcccaat

SEQ ID NO: 103988 - DNA, 35 bp, Artificial Sequence
  Synthetic oligonucleotide
gttccagcccgcgtgtctccctggctctaccccct

SEQ ID NO: 103989 - DNA, 35 bp, Artificial Sequence
  Synthetic oligonucleotide
gtgacgccggttccgttccctgtccagtcttcccc

SEQ ID NO: 103990 - DNA, 35 bp, Artificial Sequence
  Synthetic oligonucleotide
gagtgcgcccctcctgacgtttttgcaaccttacc

SEQ ID NO: 103991 - DNA, 35 bp, Artificial Sequence
  Synthetic oligonucleotide
gaccacctcgcgccgactattctacccctccctgg

SEQ ID NO: 103992 - DNA, 34 bp, Artificial Sequence
  Synthetic oligonucleotide
gacagccctttggccgccacgtaccctgcttctc

SEQ ID NO: 103993 - DNA, 34 bp, Artificial Sequence
  Synthetic oligonucleotide
tagtcaacggcacatcaccatacctccaccgcct

SEQ ID NO: 103994 - DNA, 35 bp, Artificial Sequence
  Synthetic oligonucleotide
tcgatcgcactgctgcccgcccatattcccaggtc

SEQ ID NO: 103995 - DNA, 35 bp, Artificial Sequence
  Synthetic oligonucleotide
tcctcaaccccgcctcaaccatgtcttcactgtcc

SEQ ID NO: 103996 - DNA, 35 bp, Artificial Sequence
  Synthetic oligonucleotide
ttgcccgccccgcgccgtttgcttctgcctccctc

SEQ ID NO: 103997 - DNA, 35 bp, Artificial Sequence
  Synthetic oligonucleotide
gtacgcctgcccgaccgccctggatctcaccgccc

SEQ ID NO: 103998 - DNA, 35 bp, Artificial Sequence
  Synthetic oligonucleotide
tatcagcccgttcctgccgcctcaatgacccactc

SEQ ID NO: 103999 - DNA, 36 bp, Artificial Sequence
  Synthetic oligonucleotide
tccgctccaccccgaccccttccttgagcacgttca

SEQ ID NO: 104000 - DNA, 35 bp, Artificial Sequence
  Synthetic oligonucleotide
gaccacccagtatctgcttctgtccccactcatgt

SEQ ID NO: 104001 - DNA, 35 bp, Artificial Sequence
  Synthetic oligonucleotide
accacgcacatcgctgcccgcctgcctacgccttt

SEQ ID NO: 104002 - DNA, 35 bp, Artificial Sequence
  Synthetic oligonucleotide
tgtggaggagtggagggcggtgggaggcggatgaa

SEQ ID NO: 104003 - DNA, 35 bp, Artificial Sequence
  Synthetic oligonucleotide
gtcctcccgcctgagcccctctacacgccctatgg

SEQ ID NO: 104004 - DNA, 35 bp, Artificial Sequence
  Synthetic oligonucleotide
gtgtgcccctccatccaccgatactgctttatgtc

SEQ ID NO: 104005 - DNA, 35 bp, Artificial Sequence
  Synthetic oligonucleotide
gacgggggggaaggaagtagataggcggcaaacag

SEQ ID NO: 104006 - DNA, 35 bp, Artificial Sequence
  Synthetic oligonucleotide
aatccctgcgcccatttatcgtcacccgcccctgt

SEQ ID NO: 104007 - DNA, 35 bp, Artificial Sequence
  Synthetic oligonucleotide
gtgccgcacgcacgcttattcccgccgatctgttc

SEQ ID NO: 104008 - DNA, 36 bp, Artificial Sequence
  Synthetic oligonucleotide
aaacgggagggggaagccggggcttatgacggggga

SEQ ID NO: 104009 - DNA, 36 bp, Artificial Sequence
  Synthetic oligonucleotide
tcaaacccctcatctcgcattgacgcacctcctcga

SEQ ID NO: 104010 - DNA, 35 bp, Artificial Sequence
  Synthetic oligonucleotide
gccgccggcccacctttgagtatcgctcgccctct

SEQ ID NO: 104011 - DNA, 35 bp, Artificial Sequence
  Synthetic oligonucleotide
gcaccttcagctttcgtttgcccacccccctctgt

SEQ ID NO: 104012 - DNA, 35 bp, Artificial Sequence
  Synthetic oligonucleotide
gcacacgccccattcgttactgccccatttccatc

SEQ ID NO: 104013 - DNA, 35 bp, Artificial Sequence
  Synthetic oligonucleotide
gtgcaatgcgcacatcaccgttcaactggccctct

SEQ ID NO: 104014 - DNA, 35 bp, Artificial Sequence
  Synthetic oligonucleotide
gcacccgttccctgatttattggcccgtacttccc

SEQ ID NO: 104015 - DNA, 35 bp, Artificial Sequence
  Synthetic oligonucleotide
taacgcctgcacaccgtctaaccgcctttaccccg

SEQ ID NO: 104016 - DNA, 35 bp, Artificial Sequence
  Synthetic oligonucleotide
acgttgacgcactgtgccgttgctccaccatcctt

SEQ ID NO: 104017 - DNA, 35 bp, Artificial Sequence
  Synthetic oligonucleotide
tgcttcccccgacccgctcccgccttcacgtaggc

SEQ ID NO: 104018 - DNA, 35 bp, Artificial Sequence
  Synthetic oligonucleotide
accgctacgcctccctacgcccgacgagtgccttc

SEQ ID NO: 104019 - DNA, 36 bp, Artificial Sequence
  Synthetic oligonucleotide
tctcgcccctgttgcttctcctacgatcccttgcta

SEQ ID NO: 104020 - DNA, 35 bp, Artificial Sequence
  Synthetic oligonucleotide
ggacatccgtccgcagcccacgcctcactgccgtc

SEQ ID NO: 104021 - DNA, 38 bp, Artificial Sequence
  Synthetic oligonucleotide
tacggggcggacggagaggagggggggcatgggtttga

SEQ ID NO: 104022 - DNA, 35 bp, Artificial Sequence
  Synthetic oligonucleotide
agcgccccatcgctctgaatcccgccgtgcccttc

SEQ ID NO: 104023 - DNA, 36 bp, Artificial Sequence
  Synthetic oligonucleotide
acccccgctcccacgtaaatgccttgttgccctcca

SEQ ID NO: 104024 - DNA, 37 bp, Artificial Sequence
  Synthetic oligonucleotide
aacgatcaggagcaagggggataggaagggagaagga

SEQ ID NO: 104025 - DNA, 35 bp, Artificial Sequence
  Synthetic oligonucleotide
gctacgcctaactataacatccgccggtcctacgc

SEQ ID NO: 104026 - DNA, 35 bp, Artificial Sequence
  Synthetic oligonucleotide
gtagccgactgcactgtctcattgtcctcttcccg

SEQ ID NO: 104027 - DNA, 35 bp, Artificial Sequence
  Synthetic oligonucleotide
ccgccctcccgcctagttacgagtagctttccact

SEQ ID NO: 104028 - DNA, 35 bp, Artificial Sequence
  Synthetic oligonucleotide
tgctccgccgctggcaccatcttcctgtcccctgg

SEQ ID NO: 104029 - DNA, 35 bp, Artificial Sequence
  Synthetic oligonucleotide
agagtgcatccgccgtgtccttgtccccctgttgt

SEQ ID NO: 104030 - DNA, 35 bp, Artificial Sequence
  Synthetic oligonucleotide
gtgccatcggcccgttcttgttctctgctgcctac

SEQ ID NO: 104031 - DNA, 35 bp, Artificial Sequence
  Synthetic oligonucleotide
gtcaataggaagggggggaaggaagggtggtctca

SEQ ID NO: 104032 - DNA, 36 bp, Artificial Sequence
  Synthetic oligonucleotide
gatttcaccgctgccttgcataacccctctgttcca

SEQ ID NO: 104033 - DNA, 35 bp, Artificial Sequence
  Synthetic oligonucleotide
tctccctgcccacccggatcattgactattaccac

SEQ ID NO: 104034 - DNA, 35 bp, Artificial Sequence
  Synthetic oligonucleotide
tgaccgtcctcgcattgcaatgttacatctccgcc

SEQ ID NO: 104035 - DNA, 35 bp, Artificial Sequence
  Synthetic oligonucleotide
atgcccgcctccagcctcgcctctcgaagttccac

SEQ ID NO: 104036 - DNA, 35 bp, Artificial Sequence
  Synthetic oligonucleotide
atccgccccctacttattgactacagtctgttgtc

SEQ ID NO: 104037 - DNA, 37 bp, Artificial Sequence
  Synthetic oligonucleotide
tcccacccgcacacctggcccttcacaggcgatacga

SEQ ID NO: 104038 - DNA, 35 bp, Artificial Sequence
  Synthetic oligonucleotide
gcccatgtcacattgcatcttccctcgctgtctcg

SEQ ID NO: 104039 - DNA, 36 bp, Artificial Sequence
  Synthetic oligonucleotide
accagcccaagccgtactccgcctcccatctctgga

SEQ ID NO: 104040 - DNA, 36 bp, Artificial Sequence
  Synthetic oligonucleotide
tacctgcggggggggggtaaaatgctggggagggaa

SEQ ID NO: 104041 - DNA, 35 bp, Artificial Sequence
  Synthetic oligonucleotide
tgcctcgcacgccttttacgcccactacaattgtt

SEQ ID NO: 104042 - DNA, 37 bp, Artificial Sequence
  Synthetic oligonucleotide
cccgagcctctggaggcgggggggatggaatggtgga

SEQ ID NO: 104043 - DNA, 35 bp, Artificial Sequence
  Synthetic oligonucleotide
acccaccctcgaagccatgcgcatccagccgctcc

SEQ ID NO: 104044 - DNA, 38 bp, Artificial Sequence
  Synthetic oligonucleotide
gtacgggcggggccgttttggggcgatcctggggttga

SEQ ID NO: 104045 - DNA, 35 bp, Artificial Sequence
  Synthetic oligonucleotide
acattccgccccaatgtcctcaccgcccccgccgc

SEQ ID NO: 104046 - DNA, 35 bp, Artificial Sequence
  Synthetic oligonucleotide
agcgtgcctccgtgccaagcccccgctccctccca

SEQ ID NO: 104047 - DNA, 35 bp, Artificial Sequence
  Synthetic oligonucleotide
tcccgccctcgacatatctgtccacacctcctcac

SEQ ID NO: 104048 - DNA, 35 bp, Artificial Sequence
  Synthetic oligonucleotide
ggtccactctcacacagttatgtggcttcccttcc

SEQ ID NO: 104049 - DNA, 35 bp, Artificial Sequence
  Synthetic oligonucleotide
gacgtagaggaaatgggagggacggggtagggtag

SEQ ID NO: 104050 - DNA, 35 bp, Artificial Sequence
  Synthetic oligonucleotide
tcccgaccctccaccccgtttcaatacatgccgtg

SEQ ID NO: 104051 - DNA, 37 bp, Artificial Sequence
  Synthetic oligonucleotide
gccccaccgccctatactgttctcacctgttcgttga

SEQ ID NO: 104052 - DNA, 36 bp, Artificial Sequence
  Synthetic oligonucleotide
gtcgcacacatggtcggagccacctgccccccttca

SEQ ID NO: 104053 - DNA, 35 bp, Artificial Sequence
  Synthetic oligonucleotide
atcagtgcccgcccgctgccttttttatgccatac

SEQ ID NO: 104054 - DNA, 35 bp, Artificial Sequence
  Synthetic oligonucleotide
tccgtgccccgcactttgccattcctcatgtactc

SEQ ID NO: 104055 - DNA, 35 bp, Artificial Sequence
  Synthetic oligonucleotide
accgcccccattcggccagagcttgccaccttttc

SEQ ID NO: 104056 - DNA, 35 bp, Artificial Sequence
  Synthetic oligonucleotide
tttggcccctcctgtcttcgcttttgtccccatcg

SEQ ID NO: 104057 - DNA, 35 bp, Artificial Sequence
  Synthetic oligonucleotide
acatctgccactcacctgtacgcccatccactgcc

SEQ ID NO: 104058 - DNA, 35 bp, Artificial Sequence
  Synthetic oligonucleotide
tcaggccgtccactcctctgccgccgctgtcccgc

SEQ ID NO: 104059 - DNA, 35 bp, Artificial Sequence
  Synthetic oligonucleotide
gcctcccccccgttcgcctcaattggttccctccg

SEQ ID NO: 104060 - DNA, 35 bp, Artificial Sequence
  Synthetic oligonucleotide
ggacgggggataggtgggggagcaaaggaaggcat

SEQ ID NO: 104061 - DNA, 36 bp, Artificial Sequence
  Synthetic oligonucleotide
gcccagagacgggagggacgggaaggggcagttgta

SEQ ID NO: 104062 - DNA, 35 bp, Artificial Sequence
  Synthetic oligonucleotide
accgccacgccgcaccatgtacaccttatcatccc

SEQ ID NO: 104063 - DNA, 35 bp, Artificial Sequence
  Synthetic oligonucleotide
gtcccccctcccgagtatctgcaccgcgcccccgc

SEQ ID NO: 104064 - DNA, 37 bp, Artificial Sequence
  Synthetic oligonucleotide
gacggagaggggaagggccgggggagagtagtgggga

SEQ ID NO: 104065 - DNA, 37 bp, Artificial Sequence
  Synthetic oligonucleotide
atccttccgccgttgcacttatgccccctcacctgga

SEQ ID NO: 104066 - DNA, 35 bp, Artificial Sequence
  Synthetic oligonucleotide
tcaccgcccagtgtcctttttgccagcctctcgct

SEQ ID NO: 104067 - DNA, 35 bp, Artificial Sequence
  Synthetic oligonucleotide
gtcccccccggtgctggagccttccattttccctc

SEQ ID NO: 104068 - DNA, 35 bp, Artificial Sequence
  Synthetic oligonucleotide
attgccccccctcgtttgctattgtagccccaact

SEQ ID NO: 104069 - DNA, 35 bp, Artificial Sequence
  Synthetic oligonucleotide
gggagacgccgattctctccgccccctgtcttgcc

SEQ ID NO: 104070 - DNA, 35 bp, Artificial Sequence
  Synthetic oligonucleotide
gctccaccctactgcctttactatagcacgcttgc

SEQ ID NO: 104071 - DNA, 34 bp, Artificial Sequence
  Synthetic oligonucleotide
ttccaccaccctcgttgggtaaaacacacccctc

SEQ ID NO: 104072 - DNA, 35 bp, Artificial Sequence
  Synthetic oligonucleotide
atcggagcacgttcacatccattctgtctcgctcc

SEQ ID NO: 104073 - DNA, 35 bp, Artificial Sequence
  Synthetic oligonucleotide
tgcaatcctccccactgagtcatcgttgcctcctt

SEQ ID NO: 104074 - DNA, 35 bp, Artificial Sequence
  Synthetic oligonucleotide
gaacagtgctccttccatgcttttccccgttttgg

SEQ ID NO: 104075 - DNA, 37 bp, Artificial Sequence
  Synthetic oligonucleotide
gagacaggcggaagggtcacgggagggggcgcaggga

SEQ ID NO: 104076 - DNA, 35 bp, Artificial Sequence
  Synthetic oligonucleotide
gcatccacccgatctattggcaccttagcacctcc

SEQ ID NO: 104077 - DNA, 35 bp, Artificial Sequence
  Synthetic oligonucleotide
tacgcccctcacctctcctgtgccggtattaaccg

SEQ ID NO: 104078 - DNA, 35 bp, Artificial Sequence
  Synthetic oligonucleotide
ttaagcccagccccctcaggtatcactgctccacc

SEQ ID NO: 104079 - DNA, 35 bp, Artificial Sequence
  Synthetic oligonucleotide
gtgccgggaggaaggggataggggttcgtggttat

SEQ ID NO: 104080 - DNA, 35 bp, Artificial Sequence
  Synthetic oligonucleotide
accctccgcgcaccggtgcacctccgctcccgtac

SEQ ID NO: 104081 - DNA, 35 bp, Artificial Sequence
  Synthetic oligonucleotide
agattgccctgccctgcatctgttcccgacccgct

SEQ ID NO: 104082 - DNA, 35 bp, Artificial Sequence
  Synthetic oligonucleotide
acaccgggggggaacgggtgggaacgagaaccatt

SEQ ID NO: 104083 - DNA, 35 bp, Artificial Sequence
  Synthetic oligonucleotide
tgccttgtacgccattcattgtctcgctcccctcg

SEQ ID NO: 104084 - DNA, 35 bp, Artificial Sequence
  Synthetic oligonucleotide
tagtacccctgctcctccgagacgttcgtagactt

SEQ ID NO: 104085 - DNA, 37 bp, Artificial Sequence
  Synthetic oligonucleotide
gagctccctcctgtttctatccctgcgtccccgccga

SEQ ID NO: 104086 - DNA, 35 bp, Artificial Sequence
  Synthetic oligonucleotide
gatggggtgacggtgggttagggggaggtagggcg

SEQ ID NO: 104087 - DNA, 35 bp, Artificial Sequence
  Synthetic oligonucleotide
tcaacagtgaagcaggggagcgggggggaagtagt

SEQ ID NO: 104088 - DNA, 35 bp, Artificial Sequence
  Synthetic oligonucleotide
gccaccacctttcgctgtcaacacgcctgcctgct

SEQ ID NO: 104089 - DNA, 37 bp, Artificial Sequence
  Synthetic oligonucleotide
gcacaggggctaggtgtctatgtgggtgggcggggga

SEQ ID NO: 104090 - DNA, 35 bp, Artificial Sequence
  Synthetic oligonucleotide
tcactgcgatccgccactgtcctcactcctgtccc

SEQ ID NO: 104091 - DNA, 35 bp, Artificial Sequence
  Synthetic oligonucleotide
gccccccgcgtgatcgttgccaccgtttgccctta

SEQ ID NO: 104092 - DNA, 35 bp, Artificial Sequence
  Synthetic oligonucleotide
tgcgcgccgccactgtccctggtattcctgtccgt

SEQ ID NO: 104093 - DNA, 35 bp, Artificial Sequence
  Synthetic oligonucleotide
acgtaccgccgccccctgttctatcaagccagcag

SEQ ID NO: 104094 - DNA, 36 bp, Artificial Sequence
  Synthetic oligonucleotide
ggtgaagggacggggaaaagggatgggaggagcgaa

SEQ ID NO: 104095 - DNA, 36 bp, Artificial Sequence
  Synthetic oligonucleotide
ggtgacgccctgcctgcctacagctccttgctcgct

SEQ ID NO: 104096 - DNA, 35 bp, Artificial Sequence
  Synthetic oligonucleotide
tgatgctcaggtcgccatgcccggttgcccccccc

SEQ ID NO: 104097 - DNA, 35 bp, Artificial Sequence
  Synthetic oligonucleotide
gtgttcgtggaaggggtggagtaagggggtgaggg

SEQ ID NO: 104098 - DNA, 36 bp, Artificial Sequence
  Synthetic oligonucleotide
tcccgccgcccctatagttgatcacgcgctctctac

SEQ ID NO: 104099 - DNA, 35 bp, Artificial Sequence
  Synthetic oligonucleotide
atcctagccatccatgtcctttgttgccttgtcct

SEQ ID NO: 104100 - DNA, 37 bp, Artificial Sequence
  Synthetic oligonucleotide
accacccgaccctgccattcgacgatctcccttgtga

SEQ ID NO: 104101 - DNA, 36 bp, Artificial Sequence
  Synthetic oligonucleotide
acacgcacctccgcactgaccgaatttgcaccttta

SEQ ID NO: 104102 - DNA, 35 bp, Artificial Sequence
  Synthetic oligonucleotide
gagccacctccccatttgaactaccgctgcctccg

SEQ ID NO: 104103 - DNA, 35 bp, Artificial Sequence
  Synthetic oligonucleotide
tccctctccgtccgcttctccacccatccgctagg

SEQ ID NO: 104104 - DNA, 36 bp, Artificial Sequence
  Synthetic oligonucleotide
gttgccccacttgccctatacgtgtcattgcaccga

SEQ ID NO: 104105 - DNA, 35 bp, Artificial Sequence
  Synthetic oligonucleotide
gttagggtggagtcgggcaaaggggtggggagggg

SEQ ID NO: 104106 - DNA, 35 bp, Artificial Sequence
  Synthetic oligonucleotide
tgatccacccacttggctaccccaacacggccccc

SEQ ID NO: 104107 - DNA, 35 bp, Artificial Sequence
  Synthetic oligonucleotide
gattgccccctcccgtatcgtgcctcgatcctaca

SEQ ID NO: 104108 - DNA, 35 bp, Artificial Sequence
  Synthetic oligonucleotide
ttgagcgcgcctcaccttccgtcctgcctccgggc

SEQ ID NO: 104109 - DNA, 37 bp, Artificial Sequence
  Synthetic oligonucleotide
aaggggggatgggagctgtagggaaggaggggaaaga

SEQ ID NO: 104110 - DNA, 35 bp, Artificial Sequence
  Synthetic oligonucleotide
atggggtgggacgcaccactatgggtctgactatg

SEQ ID NO: 104111 - DNA, 35 bp, Artificial Sequence
  Synthetic oligonucleotide
taactgcaccccgatactcccgtcctgctgcactt

SEQ ID NO: 104112 - DNA, 36 bp, Artificial Sequence
  Synthetic oligonucleotide
gccattgcaccatatagcctatacgtaccaccccga

SEQ ID NO: 104113 - DNA, 35 bp, Artificial Sequence
  Synthetic oligonucleotide
tccgttgccccgcaccgaatgtaccctttcgtatc

SEQ ID NO: 104114 - DNA, 35 bp, Artificial Sequence
  Synthetic oligonucleotide
tgtgttcgtggaggttagggggggatggtggaagg

SEQ ID NO: 104115 - DNA, 35 bp, Artificial Sequence
  Synthetic oligonucleotide
gacgcgccgcccgtgctccctgttagactccaccc

SEQ ID NO: 104116 - DNA, 37 bp, Artificial Sequence
  Synthetic oligonucleotide
ggaacagtcgaggggaaatggggggaggacgaagtga

SEQ ID NO: 104117 - DNA, 35 bp, Artificial Sequence
  Synthetic oligonucleotide
tcccgcatccctgcccatcccgctgtactccgtgc

SEQ ID NO: 104118 - DNA, 35 bp, Artificial Sequence
  Synthetic oligonucleotide
gttgccgcaattccgcttatgttctcccgtcctcg

SEQ ID NO: 104119 - DNA, 35 bp, Artificial Sequence
  Synthetic oligonucleotide
gcacacctccgttcctgtcatttttcgaaccctcc

SEQ ID NO: 104120 - DNA, 35 bp, Artificial Sequence
  Synthetic oligonucleotide
ttcaccacctgccgtgttctcgttcgggtaccccg

SEQ ID NO: 104121 - DNA, 35 bp, Artificial Sequence
  Synthetic oligonucleotide
ttccctgttcgccctattgtcctcatcctgtctag

SEQ ID NO: 104122 - DNA, 36 bp, Artificial Sequence
  Synthetic oligonucleotide
ttgccgcccagttgaatcctcctccgctgcccccca

SEQ ID NO: 104123 - DNA, 35 bp, Artificial Sequence
  Synthetic oligonucleotide
attgcccatccgagcccttctccagacccgttgcc

SEQ ID NO: 104124 - DNA, 35 bp, Artificial Sequence
  Synthetic oligonucleotide
tccgcccgcgggctccttctgtcatattccccctg

SEQ ID NO: 104125 - DNA, 33 bp, Artificial Sequence
  Synthetic oligonucleotide
atgcggggaatactaagggagggagggggtgca

SEQ ID NO: 104126 - DNA, 35 bp, Artificial Sequence
  Synthetic oligonucleotide
gccccggagccgatctgcaccctgccttccccagt

SEQ ID NO: 104127 - DNA, 35 bp, Artificial Sequence
  Synthetic oligonucleotide
tgcaacccagagtgctttgacccctctccgctgtc

SEQ ID NO: 104128 - DNA, 38 bp, Artificial Sequence
  Synthetic oligonucleotide
tcgatcccccgcctcctttgcaatgacctcgcccctga

SEQ ID NO: 104129 - DNA, 35 bp, Artificial Sequence
  Synthetic oligonucleotide
gtaaaccatcccccgccacaccatgactgcggtca

SEQ ID NO: 104130 - DNA, 37 bp, Artificial Sequence
  Synthetic oligonucleotide
tccagcccccacttgattgatccgcccgcctcaccga

SEQ ID NO: 104131 - DNA, 35 bp, Artificial Sequence
  Synthetic oligonucleotide
tgacactccccatgcctttcgtcctgtccccttcg

SEQ ID NO: 104132 - DNA, 33 bp, Artificial Sequence
  Synthetic oligonucleotide
gccccccccgccgacacctattgtcatcatggc

SEQ ID NO: 104133 - DNA, 35 bp, Artificial Sequence
  Synthetic oligonucleotide
gaccccgccccccctgcctattcgtgcctcatcac

SEQ ID NO: 104134 - DNA, 35 bp, Artificial Sequence
  Synthetic oligonucleotide
gacgcccatcgtgcttttattgttctcagctgtgc

SEQ ID NO: 104135 - DNA, 35 bp, Artificial Sequence
  Synthetic oligonucleotide
gccattggctcagggtacatgcgttactgctcccc

SEQ ID NO: 104136 - DNA, 35 bp, Artificial Sequence
  Synthetic oligonucleotide
tgcggaccacctgatcttctacccctgccgtgaac

SEQ ID NO: 104137 - DNA, 35 bp, Artificial Sequence
  Synthetic oligonucleotide
gtgagtgggggaagggtgggaagtaactgggggtt

SEQ ID NO: 104138 - DNA, 35 bp, Artificial Sequence
  Synthetic oligonucleotide
tacctgccggggggggtaaaatgctggggagggaa

SEQ ID NO: 104139 - DNA, 35 bp, Artificial Sequence
  Synthetic oligonucleotide
tcctctccagccctcctcgatattcgcctgccccg

SEQ ID NO: 104140 - DNA, 36 bp, Artificial Sequence
  Synthetic oligonucleotide
agcacatgccgtggcattgcgtccctcccgttgtta

SEQ ID NO: 104141 - DNA, 35 bp, Artificial Sequence
  Synthetic oligonucleotide
atcgccacggcgccctgccctcggaactgcccccc

SEQ ID NO: 104142 - DNA, 35 bp, Artificial Sequence
  Synthetic oligonucleotide
accacccacgctcaagtctcttgggacgcccttcc

SEQ ID NO: 104143 - DNA, 35 bp, Artificial Sequence
  Synthetic oligonucleotide
taatcccaccgcccactgtctacgtccttcctgta

SEQ ID NO: 104144 - DNA, 35 bp, Artificial Sequence
  Synthetic oligonucleotide
tgactccccctccgaggtctgtctttcacccgctc

SEQ ID NO: 104145 - DNA, 35 bp, Artificial Sequence
  Synthetic oligonucleotide
gagcaaaaggggcggagggggggaagggaaaagat

SEQ ID NO: 104146 - DNA, 36 bp, Artificial Sequence
  Synthetic oligonucleotide
acccgccaatcgtacctgtgcgccctgctccatcca

SEQ ID NO: 104147 - DNA, 35 bp, Artificial Sequence
  Synthetic oligonucleotide
tcagccagccatccgtagtccctagccaccctcac

SEQ ID NO: 104148 - DNA, 37 bp, Artificial Sequence
  Synthetic oligonucleotide
acaggtgagtgggggggagggttcgcgaattttacga

SEQ ID NO: 104149 - DNA, 35 bp, Artificial Sequence
  Synthetic oligonucleotide
gctgtgccgcctcattttccgcacccctgacctgc

SEQ ID NO: 104150 - DNA, 35 bp, Artificial Sequence
  Synthetic oligonucleotide
tgccaaccccccacttcggctcatacacagtcaca

SEQ ID NO: 104151 - DNA, 35 bp, Artificial Sequence
  Synthetic oligonucleotide
gcgaccgcccctgtacgattgccccccgctcccaa

SEQ ID NO: 104152 - DNA, 36 bp, Artificial Sequence
  Synthetic oligonucleotide
gtgtaccgcccccgctacgaaactgaacctccctta

SEQ ID NO: 104153 - DNA, 35 bp, Artificial Sequence
  Synthetic oligonucleotide
gtgacaccacctctgctatttagtatttttcgcct

SEQ ID NO: 104154 - DNA, 35 bp, Artificial Sequence
  Synthetic oligonucleotide
tgccaccatgttttgtgccgccgtatcctcctgcc

SEQ ID NO: 104155 - DNA, 33 bp, Artificial Sequence
  Synthetic oligonucleotide
attcacgcgccccccgcccttatgccacactga

SEQ ID NO: 104156 - DNA, 32 bp, Artificial Sequence
  Synthetic oligonucleotide
tcagccataaccccacgaccctgctgctgtac

SEQ ID NO: 104157 - DNA, 36 bp, Artificial Sequence
  Synthetic oligonucleotide
tgcctccgcctatgcatcttatcgcctgcccccata

SEQ ID NO: 104158 - DNA, 37 bp, Artificial Sequence
  Synthetic oligonucleotide
gggagaagcggcggggggggaggggaggcaggtctga

SEQ ID NO: 104159 - DNA, 35 bp, Artificial Sequence
  Synthetic oligonucleotide
tcccaccatgctcccccgtgccccgaattagaccg

SEQ ID NO: 104160 - DNA, 36 bp, Artificial Sequence
  Synthetic oligonucleotide
gatgcggaaaggggggggtggaggaaggggtcgtaa

SEQ ID NO: 104161 - DNA, 37 bp, Artificial Sequence
  Synthetic oligonucleotide
ggaggggccacggggggacaaagggaagggtggcgga

SEQ ID NO: 104162 - DNA, 35 bp, Artificial Sequence
  Synthetic oligonucleotide
tcacacccctcccccaccggcacctgagaccttgg

SEQ ID NO: 104163 - DNA, 35 bp, Artificial Sequence
  Synthetic oligonucleotide
tcagccctctctacgtattcgtgcaccccttgccc

SEQ ID NO: 104164 - DNA, 35 bp, Artificial Sequence
  Synthetic oligonucleotide
gcaatcgcccgccgcatcatctctccgtccgccca

SEQ ID NO: 104165 - DNA, 35 bp, Artificial Sequence
  Synthetic oligonucleotide
gagcccgcccccatgactctgttgtaacactccgc

SEQ ID NO: 104166 - DNA, 35 bp, Artificial Sequence
  Synthetic oligonucleotide
tcccaccgatccgttcgctttaccttgagttgtac

SEQ ID NO: 104167 - DNA, 35 bp, Artificial Sequence
  Synthetic oligonucleotide
gtccccgcccgcactgtaattgccatcattcgcac

SEQ ID NO: 104168 - DNA, 35 bp, Artificial Sequence
  Synthetic oligonucleotide
gcacaggcctcattcgttatcccgctcctcgcttt

SEQ ID NO: 104169 - DNA, 35 bp, Artificial Sequence
  Synthetic oligonucleotide
atggcgacccccacatgcgccttcttacgcctcct

SEQ ID NO: 104170 - DNA, 35 bp, Artificial Sequence
  Synthetic oligonucleotide
acccctgcccccacagttacttgccattacatgcc

SEQ ID NO: 104171 - DNA, 35 bp, Artificial Sequence
  Synthetic oligonucleotide
gtgcgccctctcacttgttaatgcctcacgttttc

SEQ ID NO: 104172 - DNA, 35 bp, Artificial Sequence
  Synthetic oligonucleotide
gtagccctccagctgatcccccaagtccaccgtcc

SEQ ID NO: 104173 - DNA, 35 bp, Artificial Sequence
  Synthetic oligonucleotide
gccacgcgcatcccgccttaatcctactcgctccg

SEQ ID NO: 104174 - DNA, 38 bp, Artificial Sequence
  Synthetic oligonucleotide
acgcaggaaggggggtaagggagggaggtaggggttga

SEQ ID NO: 104175 - DNA, 35 bp, Artificial Sequence
  Synthetic oligonucleotide
gaccatgcctgcgccccctgttgtcatccttggtc

SEQ ID NO: 104176 - DNA, 35 bp, Artificial Sequence
  Synthetic oligonucleotide
tcgtgaccgccactgaccccgccgcaatgttccat

SEQ ID NO: 104177 - DNA, 35 bp, Artificial Sequence
  Synthetic oligonucleotide
acgcccgaagcccctgcctgtctcattacgtttct

SEQ ID NO: 104178 - DNA, 35 bp, Artificial Sequence
  Synthetic oligonucleotide
ttgacaacccccatactccacaccacctgctgagg

SEQ ID NO: 104179 - DNA, 38 bp, Artificial Sequence
  Synthetic oligonucleotide
gagccacttccgcctggtcttactgctccttcacctga

SEQ ID NO: 104180 - DNA, 35 bp, Artificial Sequence
  Synthetic oligonucleotide
acagccgccacgccctgtttcaatctacgcccact

SEQ ID NO: 104181 - DNA, 35 bp, Artificial Sequence
  Synthetic oligonucleotide
atgacctccgaccccttgctagtatcggccactac

SEQ ID NO: 104182 - DNA, 35 bp, Artificial Sequence
  Synthetic oligonucleotide
tacgcgcctcacgtgccctcttccccttcgttgaa

SEQ ID NO: 104183 - DNA, 35 bp, Artificial Sequence
  Synthetic oligonucleotide
tagcccaccctggattagtgcctctcttcgttccg

SEQ ID NO: 104184 - DNA, 35 bp, Artificial Sequence
  Synthetic oligonucleotide
accctcccgcccctgactagcttccacagcaccgg

SEQ ID NO: 104185 - DNA, 35 bp, Artificial Sequence
  Synthetic oligonucleotide
tattgcagacctcacgcccgccctcgcccgctttt

SEQ ID NO: 104186 - DNA, 35 bp, Artificial Sequence
  Synthetic oligonucleotide
attgcacccggccatcgcttgcattatacctccct

SEQ ID NO: 104187 - DNA, 35 bp, Artificial Sequence
  Synthetic oligonucleotide
acctcgttacgccagcccgtttgctcccccgttcg

SEQ ID NO: 104188 - DNA, 35 bp, Artificial Sequence
  Synthetic oligonucleotide
gcacaaccctgtcacgctcgcctatgctcccttcg

SEQ ID NO: 104189 - DNA, 35 bp, Artificial Sequence
  Synthetic oligonucleotide
gcccccgtcgcacgtgctcgccatcgtttcttcct

SEQ ID NO: 104190 - DNA, 35 bp, Artificial Sequence
  Synthetic oligonucleotide
tagccccgcctgcgagtattcacacgtttctcctc

SEQ ID NO: 104191 - DNA, 35 bp, Artificial Sequence
  Synthetic oligonucleotide
gtccacaccgcgatacgcccctacttcttcgttgc

SEQ ID NO: 104192 - DNA, 35 bp, Artificial Sequence
  Synthetic oligonucleotide
gacccgccttactgatgcccctctccgcgttcgag

SEQ ID NO: 104193 - DNA, 35 bp, Artificial Sequence
  Synthetic oligonucleotide
gtgttccctccctgttgtcgctatacgttctctcc

SEQ ID NO: 104194 - DNA, 35 bp, Artificial Sequence
  Synthetic oligonucleotide
atgcgctgagcatgcgcgggtaactccttctactc

SEQ ID NO: 104195 - DNA, 36 bp, Artificial Sequence
  Synthetic oligonucleotide
tcacacccctccttctgttcttgacgtatgttcgta

SEQ ID NO: 104196 - DNA, 35 bp, Artificial Sequence
  Synthetic oligonucleotide
agacccgcccatgagtcgttcgcctccctcacctt

SEQ ID NO: 104197 - DNA, 35 bp, Artificial Sequence
  Synthetic oligonucleotide
taacatctgccacgcatgtccattattcgcctcac

SEQ ID NO: 104198 - DNA, 35 bp, Artificial Sequence
  Synthetic oligonucleotide
gacgcccgccctccatagttttgttgtcgctgtcc

SEQ ID NO: 104199 - DNA, 37 bp, Artificial Sequence
  Synthetic oligonucleotide
gacattgggccgaaaggggggtggggttggggaacga

SEQ ID NO: 104200 - DNA, 35 bp, Artificial Sequence
  Synthetic oligonucleotide
tcccctcgcactgctcctgacacctcccttagtgc

SEQ ID NO: 104201 - DNA, 35 bp, Artificial Sequence
  Synthetic oligonucleotide
gcctgccacctgttcttacgcgctctttcctggac

SEQ ID NO: 104202 - DNA, 35 bp, Artificial Sequence
  Synthetic oligonucleotide
ggaccacgccaacacagttctagcccggcccttcc

SEQ ID NO: 104203 - DNA, 35 bp, Artificial Sequence
  Synthetic oligonucleotide
tacacgtacagccctgattatccccgcgcaccacc

SEQ ID NO: 104204 - DNA, 36 bp, Artificial Sequence
  Synthetic oligonucleotide
tccacccagccctcaccgcgccctttgtccttcgta

SEQ ID NO: 104205 - DNA, 36 bp, Artificial Sequence
  Synthetic oligonucleotide
ggagccgcctctgttttcttcacttcgccttcgcca

SEQ ID NO: 104206 - DNA, 35 bp, Artificial Sequence
  Synthetic oligonucleotide
tgcatcccaccatccgtcgtcactaccggtaaccc

SEQ ID NO: 104207 - DNA, 35 bp, Artificial Sequence
  Synthetic oligonucleotide
tccgaccgtttttgctgccctattgcccggtttct

SEQ ID NO: 104208 - DNA, 35 bp, Artificial Sequence
  Synthetic oligonucleotide
tgtcacgttctgagcctctgttcgttcgcccccct

SEQ ID NO: 104209 - DNA, 37 bp, Artificial Sequence
  Synthetic oligonucleotide
tctcaccctgcctgcatagcccatgcccgtaccccga

SEQ ID NO: 104210 - DNA, 35 bp, Artificial Sequence
  Synthetic oligonucleotide
agacaacccgttctgcctctcggtgatccgccccc

SEQ ID NO: 104211 - DNA, 36 bp, Artificial Sequence
  Synthetic oligonucleotide
gacggggaagggcatgaggggaattgaggggacgta

SEQ ID NO: 104212 - DNA, 35 bp, Artificial Sequence
  Synthetic oligonucleotide
tcacctccgcccccttgcataatatgtatgctttg

SEQ ID NO: 104213 - DNA, 36 bp, Artificial Sequence
  Synthetic oligonucleotide
gatcccaccaccgctatggccccactttcgtagaaa

SEQ ID NO: 104214 - DNA, 35 bp, Artificial Sequence
  Synthetic oligonucleotide
ggaacggccacttgcatgcacctccgctctatccg

SEQ ID NO: 104215 - DNA, 34 bp, Artificial Sequence
  Synthetic oligonucleotide
gatcaccactctgacgtccccgccacactgtcgc

SEQ ID NO: 104216 - DNA, 35 bp, Artificial Sequence
  Synthetic oligonucleotide
gtgctaccactgaccgctatccaagtactccccgc

SEQ ID NO: 104217 - DNA, 35 bp, Artificial Sequence
  Synthetic oligonucleotide
gtccaccttccatttgtttccccgcggactcccac

SEQ ID NO: 104218 - DNA, 35 bp, Artificial Sequence
  Synthetic oligonucleotide
tgcccctccgacgttccgagtccatggccctcact

SEQ ID NO: 104219 - DNA, 35 bp, Artificial Sequence
  Synthetic oligonucleotide
tcgccaaccgaccgtcctttcatcgcctttgctcg

SEQ ID NO: 104220 - DNA, 38 bp, Artificial Sequence
  Synthetic oligonucleotide
gcctgcccgctgccttcgtatgcccacctgctccttga

SEQ ID NO: 104221 - DNA, 33 bp, Artificial Sequence
  Synthetic oligonucleotide
gccgcccacctctacccgtctgccatgtctttt

SEQ ID NO: 104222 - DNA, 37 bp, Artificial Sequence
  Synthetic oligonucleotide
gcccacctccattcctccgagccactctgtcttacga

SEQ ID NO: 104223 - DNA, 35 bp, Artificial Sequence
  Synthetic oligonucleotide
tacgatggcacacttcacctccgtctttcactacg

SEQ ID NO: 104224 - DNA, 27 bp, Artificial Sequence
  Synthetic oligonucleotide
ttccgagctcccctgcttcccgcctat

SEQ ID NO: 104225 - DNA, 35 bp, Artificial Sequence
  Synthetic oligonucleotide
ggacacatcgccctccgcacctccgcgcccgaacc

SEQ ID NO: 104226 - DNA, 35 bp, Artificial Sequence
  Synthetic oligonucleotide
gaaacccctcggcccccccttacaccggactttgg

SEQ ID NO: 104227 - DNA, 35 bp, Artificial Sequence
  Synthetic oligonucleotide
ttgcccccacctcgccgctcgcacgccctctggcc

SEQ ID NO: 104228 - DNA, 35 bp, Artificial Sequence
  Synthetic oligonucleotide
tccaccccgccccattccctttagctgctttgacc

SEQ ID NO: 104229 - DNA, 35 bp, Artificial Sequence
  Synthetic oligonucleotide
accactcagatcgtcgcctcctgttcccctcgctg

SEQ ID NO: 104230 - DNA, 35 bp, Artificial Sequence
  Synthetic oligonucleotide
acaaacctcccgtgatcttgcctggtccccattcc

SEQ ID NO: 104231 - DNA, 35 bp, Artificial Sequence
  Synthetic oligonucleotide
gtactcccgacccatgacttgtagcctgttcccca

SEQ ID NO: 104232 - DNA, 35 bp, Artificial Sequence
  Synthetic oligonucleotide
acccgaccgtgcgcctcgttctcaacccatctcgt

SEQ ID NO: 104233 - DNA, 35 bp, Artificial Sequence
  Synthetic oligonucleotide
tcatcacaccctcaatgcgtgccgcttatcgctct

SEQ ID NO: 104234 - DNA, 35 bp, Artificial Sequence
  Synthetic oligonucleotide
tgaacgaccccgtccccccggccccacctagccat

SEQ ID NO: 104235 - DNA, 35 bp, Artificial Sequence
  Synthetic oligonucleotide
gtgcctcagtgtacactccccccgaccctgctcct

SEQ ID NO: 104236 - DNA, 38 bp, Artificial Sequence
  Synthetic oligonucleotide
gccgtcgccgcatccccatagccacccgccccttctga

SEQ ID NO: 104237 - DNA, 34 bp, Artificial Sequence
  Synthetic oligonucleotide
tcaattgcgcggtcactgtctttccacctcacgc

SEQ ID NO: 104238 - DNA, 37 bp, Artificial Sequence
  Synthetic oligonucleotide
tcacctcagtgcgcttgacccacctcgcccccactga

SEQ ID NO: 104239 - DNA, 35 bp, Artificial Sequence
  Synthetic oligonucleotide
tcattacgccgttgtcctcgtctcccccccctcga

SEQ ID NO: 104240 - DNA, 37 bp, Artificial Sequence
  Synthetic oligonucleotide
gacaggagggagggggaggaaaggggagcctagccga

SEQ ID NO: 104241 - DNA, 35 bp, Artificial Sequence
  Synthetic oligonucleotide
gtgaggggaaaggaaggggtgcaggagaatgagag

SEQ ID NO: 104242 - DNA, 33 bp, Artificial Sequence
  Synthetic oligonucleotide
tgccgccgcgctccggctcccacgtcccttact

SEQ ID NO: 104243 - DNA, 35 bp, Artificial Sequence
  Synthetic oligonucleotide
gtgatggacggtggggaggcaagaagaggggggga

SEQ ID NO: 104244 - DNA, 35 bp, Artificial Sequence
  Synthetic oligonucleotide
ttgacgtcccttgccatctgtatcctgccccccat

SEQ ID NO: 104245 - DNA, 35 bp, Artificial Sequence
  Synthetic oligonucleotide
ttcgcacctttgcacttgattaagcccgccccact

SEQ ID NO: 104246 - DNA, 35 bp, Artificial Sequence
  Synthetic oligonucleotide
accgatcaccatcatgtcaccttacaccttggtcc

SEQ ID NO: 104247 - DNA, 35 bp, Artificial Sequence
  Synthetic oligonucleotide
tccgatgctgttccacctagtaatgcacgccctcc

SEQ ID NO: 104248 - DNA, 35 bp, Artificial Sequence
  Synthetic oligonucleotide
gccgtacgctccaactttctgttcatggcctgttc

SEQ ID NO: 104249 - DNA, 35 bp, Artificial Sequence
  Synthetic oligonucleotide
gtggtggaggagggttgggcggatggaaatgtttc

SEQ ID NO: 104250 - DNA, 35 bp, Artificial Sequence
  Synthetic oligonucleotide
gctcgcaccgcctctcgtcccgcgggttcctcctc

SEQ ID NO: 104251 - DNA, 35 bp, Artificial Sequence
  Synthetic oligonucleotide
acacaccacctaacatgttctccgttccgctcttg

SEQ ID NO: 104252 - DNA, 35 bp, Artificial Sequence
  Synthetic oligonucleotide
tgccgatgccgccctcgatcggtctatccaacctc

SEQ ID NO: 104253 - DNA, 35 bp, Artificial Sequence
  Synthetic oligonucleotide
gagatcgagggggaggaagggcggggaaaacgagg

SEQ ID NO: 104254 - DNA, 35 bp, Artificial Sequence
  Synthetic oligonucleotide
gatcacaccggtacaatgccttgccgcccccgctc

SEQ ID NO: 104255 - DNA, 35 bp, Artificial Sequence
  Synthetic oligonucleotide
gacaacgcgctgtctatctcctcggcctattttcc

SEQ ID NO: 104256 - DNA, 35 bp, Artificial Sequence
  Synthetic oligonucleotide
agccaccctccctgatgatccctgccctctctaac

SEQ ID NO: 104257 - DNA, 36 bp, Artificial Sequence
  Synthetic oligonucleotide
tcaaccgtgcaggtgctttcgcgtgccccccttcta

SEQ ID NO: 104258 - DNA, 35 bp, Artificial Sequence
  Synthetic oligonucleotide
tccatcgctcccactgcgtactatgccttaccgtt

SEQ ID NO: 104259 - DNA, 35 bp, Artificial Sequence
  Synthetic oligonucleotide
actcgtcctcttgcgtaagccctcgcctgtttcac

SEQ ID NO: 104260 - DNA, 35 bp, Artificial Sequence
  Synthetic oligonucleotide
gtccccgctatgaccataaaaccctgccccactgc

SEQ ID NO: 104261 - DNA, 35 bp, Artificial Sequence
  Synthetic oligonucleotide
tatccgcgccggtctcgatctaccgcatttccatc

SEQ ID NO: 104262 - DNA, 36 bp, Artificial Sequence
  Synthetic oligonucleotide
tctccactgcctcagcgcgtgttccccccctgccca

SEQ ID NO: 104263 - DNA, 35 bp, Artificial Sequence
  Synthetic oligonucleotide
aatccgccgccctccacctagctataatcttgtcc

SEQ ID NO: 104264 - DNA, 35 bp, Artificial Sequence
  Synthetic oligonucleotide
agcgagccaccctatgcactgtacctcccaccctg

SEQ ID NO: 104265 - DNA, 35 bp, Artificial Sequence
  Synthetic oligonucleotide
gccatgacgcctgctttaatccgtgaggcccctcc

SEQ ID NO: 104266 - DNA, 35 bp, Artificial Sequence
  Synthetic oligonucleotide
actcaacctccatgtccaaatgaacccgccccacc

SEQ ID NO: 104267 - DNA, 35 bp, Artificial Sequence
  Synthetic oligonucleotide
ggtccgcccctgcctgcaccttttgaactccctga

SEQ ID NO: 104268 - DNA, 35 bp, Artificial Sequence
  Synthetic oligonucleotide
taggacatccgcactgtcattagcctttctctcgc

SEQ ID NO: 104269 - DNA, 35 bp, Artificial Sequence
  Synthetic oligonucleotide
ggaaggggagggagcaggattggaacgggatgcag

SEQ ID NO: 104270 - DNA, 35 bp, Artificial Sequence
  Synthetic oligonucleotide
accaccggcgccctctagttttctcctgctgcccg

SEQ ID NO: 104271 - DNA, 37 bp, Artificial Sequence
  Synthetic oligonucleotide
atcactcgctttccactgttgtcctttccgtctctga

SEQ ID NO: 104272 - DNA, 35 bp, Artificial Sequence
  Synthetic oligonucleotide
tccgccccttcagcatagattttcgtcttcctccg

SEQ ID NO: 104273 - DNA, 35 bp, Artificial Sequence
  Synthetic oligonucleotide
tgttactctgcgcaacggccgcccccgaaccttcc

SEQ ID NO: 104274 - DNA, 35 bp, Artificial Sequence
  Synthetic oligonucleotide
tacccgcccctatcgtgctcccttttgtccccgct

SEQ ID NO: 104275 - DNA, 37 bp, Artificial Sequence
  Synthetic oligonucleotide
gtggggtgggagggctggggaggctgaactgcgggga

SEQ ID NO: 104276 - DNA, 35 bp, Artificial Sequence
  Synthetic oligonucleotide
gtacacgtgccccacccgccccactgcattgcagt

SEQ ID NO: 104277 - DNA, 35 bp, Artificial Sequence
  Synthetic oligonucleotide
acccgtaccccgcccattgctctatacatatccca

SEQ ID NO: 104278 - DNA, 35 bp, Artificial Sequence
  Synthetic oligonucleotide
gttcgtctcaccgccacctgcacgggcccccttcg

SEQ ID NO: 104279 - DNA, 35 bp, Artificial Sequence
  Synthetic oligonucleotide
tcagaggtggtggggcaacagtggaggggggcggg

SEQ ID NO: 104280 - DNA, 37 bp, Artificial Sequence
  Synthetic oligonucleotide
acgaagcagaacgggaggggggacgaagggagtgcga

SEQ ID NO: 104281 - DNA, 36 bp, Artificial Sequence
  Synthetic oligonucleotide
ttcacctgttccagccactgcctttgcgctccgcaa

SEQ ID NO: 104282 - DNA, 35 bp, Artificial Sequence
  Synthetic oligonucleotide
cagtactgcgggtcgcctctttccgtcacctttcc

SEQ ID NO: 104283 - DNA, 35 bp, Artificial Sequence
  Synthetic oligonucleotide
gtatgcgcaaggtatctccatcctccccgtgcccc

SEQ ID NO: 104284 - DNA, 35 bp, Artificial Sequence
  Synthetic oligonucleotide
tgccggtccacgacttttcccctgcagtattttcc

SEQ ID NO: 104285 - DNA, 37 bp, Artificial Sequence
  Synthetic oligonucleotide
gtggccacggtccctgcctacgacctcctcctgctga

SEQ ID NO: 104286 - DNA, 35 bp, Artificial Sequence
  Synthetic oligonucleotide
tcacacccgccttgcatctctcgtcgaagacccat

SEQ ID NO: 104287 - DNA, 35 bp, Artificial Sequence
  Synthetic oligonucleotide
gtctccgccattgatcgccccattgcccttgcaca

SEQ ID NO: 104288 - DNA, 35 bp, Artificial Sequence
  Synthetic oligonucleotide
agaccgtccgccccactgtctcagccgccatttcc

SEQ ID NO: 104289 - DNA, 35 bp, Artificial Sequence
  Synthetic oligonucleotide
acgcccccccgccgctataggcttctcccctgggc

SEQ ID NO: 104290 - DNA, 35 bp, Artificial Sequence
  Synthetic oligonucleotide
gcccccctccatggtaagcactcacgcccccgctg

SEQ ID NO: 104291 - DNA, 37 bp, Artificial Sequence
  Synthetic oligonucleotide
ggtgggggggcgggcggagagagccaggagcgcagga

SEQ ID NO: 104292 - DNA, 35 bp, Artificial Sequence
  Synthetic oligonucleotide
gcccccttcacctcgcgatgtcgctctgcctaccg

SEQ ID NO: 104293 - DNA, 35 bp, Artificial Sequence
  Synthetic oligonucleotide
acccccacacgcctcatctttcccgaccacggtcc

SEQ ID NO: 104294 - DNA, 35 bp, Artificial Sequence
  Synthetic oligonucleotide
atcacccccatcagtgcgctttctgttttgtccac

SEQ ID NO: 104295 - DNA, 35 bp, Artificial Sequence
  Synthetic oligonucleotide
atcgcgtggcctcaccccggtatctcgccctgctc

SEQ ID NO: 104296 - DNA, 34 bp, Artificial Sequence
  Synthetic oligonucleotide
actcctccccctcagccgtacctgacccctcgta

SEQ ID NO: 104297 - DNA, 35 bp, Artificial Sequence
  Synthetic oligonucleotide
atgggcacaccatgccaagtgctttcccttcctgc

SEQ ID NO: 104298 - DNA, 35 bp, Artificial Sequence
  Synthetic oligonucleotide
tacatcccaccttcgttcgttacatgacaccctgc

SEQ ID NO: 104299 - DNA, 35 bp, Artificial Sequence
  Synthetic oligonucleotide
tcaccatccgctcgctgtccatcgcggtctactat

SEQ ID NO: 104300 - DNA, 36 bp, Artificial Sequence
  Synthetic oligonucleotide
atcagccgccgtcaattgcccatcccatctgttcct

SEQ ID NO: 104301 - DNA, 36 bp, Artificial Sequence
  Synthetic oligonucleotide
tgtgccgtcacccgttagtccgtcgccgctatccca

SEQ ID NO: 104302 - DNA, 35 bp, Artificial Sequence
  Synthetic oligonucleotide
tcgctccacctgctcctgttaacccaccccgtttc

SEQ ID NO: 104303 - DNA, 35 bp, Artificial Sequence
  Synthetic oligonucleotide
gcaacgccgccctgccgcctggttctactgctgcc

SEQ ID NO: 104304 - DNA, 35 bp, Artificial Sequence
  Synthetic oligonucleotide
gttgcactgcagcctgttcatccacctgccctact

SEQ ID NO: 104305 - DNA, 35 bp, Artificial Sequence
  Synthetic oligonucleotide
tatcatccgtcagtctggccctccaccccgtccta

SEQ ID NO: 104306 - DNA, 35 bp, Artificial Sequence
  Synthetic oligonucleotide
gcctggcccccctggtcactgatgccacataatct

SEQ ID NO: 104307 - DNA, 35 bp, Artificial Sequence
  Synthetic oligonucleotide
tgcaacaatcctctccgtgccaatgtctgccttct

SEQ ID NO: 104308 - DNA, 35 bp, Artificial Sequence
  Synthetic oligonucleotide
actaacggggacgaggggaaggaggtcgggggagt

SEQ ID NO: 104309 - DNA, 35 bp, Artificial Sequence
  Synthetic oligonucleotide
tccaactccatcgcctatcgcccgcctgtcttgct

SEQ ID NO: 104310 - DNA, 35 bp, Artificial Sequence
  Synthetic oligonucleotide
gaccaaccttcccatggctatgcacccccttgctt

SEQ ID NO: 104311 - DNA, 35 bp, Artificial Sequence
  Synthetic oligonucleotide
gcattgcccccccgccgacacatggttactttccc

SEQ ID NO: 104312 - DNA, 35 bp, Artificial Sequence
  Synthetic oligonucleotide
acaccaccgctccccgactcccttatgcgctattg

SEQ ID NO: 104313 - DNA, 35 bp, Artificial Sequence
  Synthetic oligonucleotide
tccgcaggtccatcgcaatcagctcgtacccctcc

SEQ ID NO: 104314 - DNA, 35 bp, Artificial Sequence
  Synthetic oligonucleotide
gcacccccctcggattggcgctcccattcaccctg

SEQ ID NO: 104315 - DNA, 35 bp, Artificial Sequence
  Synthetic oligonucleotide
actgcgccgccgcccgtcctacgccgctacatcac

SEQ ID NO: 104316 - DNA, 35 bp, Artificial Sequence
  Synthetic oligonucleotide
aactcacgcacgtgttcctattactgccgcactcc

SEQ ID NO: 104317 - DNA, 35 bp, Artificial Sequence
  Synthetic oligonucleotide
gacgtccggtgatcaactccagcccacccccagcc

SEQ ID NO: 104318 - DNA, 35 bp, Artificial Sequence
  Synthetic oligonucleotide
actgacacacctcgcgccttctgcatctgtctctc

SEQ ID NO: 104319 - DNA, 38 bp, Artificial Sequence
  Synthetic oligonucleotide
acccatccgcctacgttatcgcttacactccactttga

SEQ ID NO: 104320 - DNA, 35 bp, Artificial Sequence
  Synthetic oligonucleotide
ggacacgacactccctattccgtgcctgtgcctcc

SEQ ID NO: 104321 - DNA, 35 bp, Artificial Sequence
  Synthetic oligonucleotide
atcccctgcctctccacccttgaacgacgtgacgt

SEQ ID NO: 104322 - DNA, 35 bp, Artificial Sequence
  Synthetic oligonucleotide
gtgcacctcctggcttgaattcatggtactccctg

SEQ ID NO: 104323 - DNA, 35 bp, Artificial Sequence
  Synthetic oligonucleotide
gacgtccgccccgcagtttctttttttcgtgctct

SEQ ID NO: 104324 - DNA, 35 bp, Artificial Sequence
  Synthetic oligonucleotide
tgcctcatcccgttgccccccctgtatctatggcg

SEQ ID NO: 104325 - DNA, 35 bp, Artificial Sequence
  Synthetic oligonucleotide
tcaaaccgtactgtaactgctttcggtcgccactc

SEQ ID NO: 104326 - DNA, 37 bp, Artificial Sequence
  Synthetic oligonucleotide
gtggggtggagaaatggggtggaggagaagcgggcga

SEQ ID NO: 104327 - DNA, 35 bp, Artificial Sequence
  Synthetic oligonucleotide
actcatccgccaacggttccatctgccacattact

SEQ ID NO: 104328 - DNA, 35 bp, Artificial Sequence
  Synthetic oligonucleotide
acgactcccgtgccatcccgtgccctccagctccc

SEQ ID NO: 104329 - DNA, 37 bp, Artificial Sequence
  Synthetic oligonucleotide
atgtgcatggtcggggaggagggaaacggagcgggga

SEQ ID NO: 104330 - DNA, 37 bp, Artificial Sequence
  Synthetic oligonucleotide
gcccagaggggaagggaataaacggggggagggtaga

SEQ ID NO: 104331 - DNA, 35 bp, Artificial Sequence
  Synthetic oligonucleotide
tcagtcctccagcgctccccccgtatcgtccctgc

SEQ ID NO: 104332 - DNA, 35 bp, Artificial Sequence
  Synthetic oligonucleotide
tacaccccgcttgccttagttttcgatcctgtctc

SEQ ID NO: 104333 - DNA, 36 bp, Artificial Sequence
  Synthetic oligonucleotide
agacgcaggaggagagggaaggggaagtgggcttga

SEQ ID NO: 104334 - DNA, 35 bp, Artificial Sequence
  Synthetic oligonucleotide
acaaccccgctgactttagcgcacccactccgcct

SEQ ID NO: 104335 - DNA, 36 bp, Artificial Sequence
  Synthetic oligonucleotide
ggagcaccccaagccatggtttcgcccactccccga

SEQ ID NO: 104336 - DNA, 37 bp, Artificial Sequence
  Synthetic oligonucleotide
accctgccacacttgactacttcgattgcccccccga

SEQ ID NO: 104337 - DNA, 35 bp, Artificial Sequence
  Synthetic oligonucleotide
gacacgggggggtaggctaaggaggggtcggttcg

SEQ ID NO: 104338 - DNA, 36 bp, Artificial Sequence
  Synthetic oligonucleotide
gacaacctcgagttgttctacttttctacctgccta

SEQ ID NO: 104339 - DNA, 33 bp, Artificial Sequence
  Synthetic oligonucleotide
gcccgggccctaccccgctccattgtccatcat

SEQ ID NO: 104340 - DNA, 37 bp, Artificial Sequence
  Synthetic oligonucleotide
taggagaggggggcggtggagggagaaggggagggga

SEQ ID NO: 104341 - DNA, 34 bp, Artificial Sequence
  Synthetic oligonucleotide
ggatgcccccccaccctatttcgcacccgcctcg

SEQ ID NO: 104342 - DNA, 35 bp, Artificial Sequence
  Synthetic oligonucleotide
acgacgccaccgccggacccatacgccctttccat

SEQ ID NO: 104343 - DNA, 36 bp, Artificial Sequence
  Synthetic oligonucleotide
tacagcctccacccgtgcgttatcctccccttctca

SEQ ID NO: 104344 - DNA, 35 bp, Artificial Sequence
  Synthetic oligonucleotide
gcaccccaccttgccacatccgccgatcgtctcgt

SEQ ID NO: 104345 - DNA, 35 bp, Artificial Sequence
  Synthetic oligonucleotide
gtggggtagaaggggaaaggtcgttaaaagggggg

SEQ ID NO: 104346 - DNA, 35 bp, Artificial Sequence
  Synthetic oligonucleotide
tctcacctgtccgctgccatgaattcgtcgtccct

SEQ ID NO: 104347 - DNA, 36 bp, Artificial Sequence
  Synthetic oligonucleotide
gtccaccgcacatgtggacgtctccgccatccccta

SEQ ID NO: 104348 - DNA, 38 bp, Artificial Sequence
  Synthetic oligonucleotide
ggggatctggcggtgggggtagtgcggcggggatatga

SEQ ID NO: 104349 - DNA, 35 bp, Artificial Sequence
  Synthetic oligonucleotide
atcgctcccctctgccctgtaccctgccatgtgtt

SEQ ID NO: 104350 - DNA, 35 bp, Artificial Sequence
  Synthetic oligonucleotide
taccccgcctccctttgtaagttgcgaacccccct

SEQ ID NO: 104351 - DNA, 35 bp, Artificial Sequence
  Synthetic oligonucleotide
gttgtcgccgccacccttattccagtattctgccc

SEQ ID NO: 104352 - DNA, 35 bp, Artificial Sequence
  Synthetic oligonucleotide
gtcaaccccctcgtgttctatgcaactcgcctctc

SEQ ID NO: 104353 - DNA, 30 bp, Artificial Sequence
  Synthetic oligonucleotide
ttgcccgctcccctccgtaactccttcctt

SEQ ID NO: 104354 - DNA, 35 bp, Artificial Sequence
  Synthetic oligonucleotide
gccatcacgcgctccagaacatcctcctccttcgt

SEQ ID NO: 104355 - DNA, 38 bp, Artificial Sequence
  Synthetic oligonucleotide
gacaagctcccccccgcatacgtccttgccccttacga

SEQ ID NO: 104356 - DNA, 36 bp, Artificial Sequence
  Synthetic oligonucleotide
tgaagcccccgtgcgccctttacctggtcttgtcca

SEQ ID NO: 104357 - DNA, 35 bp, Artificial Sequence
  Synthetic oligonucleotide
aaaggacgcagggagggaagggaatgacggggtgc

SEQ ID NO: 104358 - DNA, 36 bp, Artificial Sequence
  Synthetic oligonucleotide
accttcggcggtggcgaaaaaggtggaggtggggca

SEQ ID NO: 104359 - DNA, 36 bp, Artificial Sequence
  Synthetic oligonucleotide
gtcacccggccttcccttcgtaattcacagccttca

SEQ ID NO: 104360 - DNA, 35 bp, Artificial Sequence
  Synthetic oligonucleotide
gctgagcctccgcctattgtatccgtatctccctg

SEQ ID NO: 104361 - DNA, 35 bp, Artificial Sequence
  Synthetic oligonucleotide
gtcgccattccagtttctatttctcgctgtcccgc

SEQ ID NO: 104362 - DNA, 31 bp, Artificial Sequence
  Synthetic oligonucleotide
gtaccgtgcgccacccaaccgtcctgcttta

SEQ ID NO: 104363 - DNA, 35 bp, Artificial Sequence
  Synthetic oligonucleotide
actcatcgcacgtgcgctaacttgctctgtcctgc

SEQ ID NO: 104364 - DNA, 35 bp, Artificial Sequence
  Synthetic oligonucleotide
ggaacatccggccggccatctgcgcccctcccacc

SEQ ID NO: 104365 - DNA, 36 bp, Artificial Sequence
  Synthetic oligonucleotide
tgtgggcggggaggggaggggggcgactgacaatta

SEQ ID NO: 104366 - DNA, 34 bp, Artificial Sequence
  Synthetic oligonucleotide
ggtgccgtaagatcttcttctgctgcctttctcc

SEQ ID NO: 104367 - DNA, 35 bp, Artificial Sequence
  Synthetic oligonucleotide
tgcgcccctccctctcttgatcccagccctcggtg

SEQ ID NO: 104368 - DNA, 35 bp, Artificial Sequence
  Synthetic oligonucleotide
acgcccacaccgttgttcaggtcccgccctctatc

SEQ ID NO: 104369 - DNA, 35 bp, Artificial Sequence
  Synthetic oligonucleotide
atccgccccaccaaatgtttccacgctgccattga

SEQ ID NO: 104370 - DNA, 35 bp, Artificial Sequence
  Synthetic oligonucleotide
atcaccgccgccgcctcatctacgccgccacaaac

SEQ ID NO: 104371 - DNA, 35 bp, Artificial Sequence
  Synthetic oligonucleotide
ggagcacagtgtgtacgtccgctgccatacccccc

SEQ ID NO: 104372 - DNA, 36 bp, Artificial Sequence
  Synthetic oligonucleotide
gtcaccctgccctgccattggatacccttcacttga

SEQ ID NO: 104373 - DNA, 35 bp, Artificial Sequence
  Synthetic oligonucleotide
tcactctcccgccccgttgtattacccccgtgttg

SEQ ID NO: 104374 - DNA, 35 bp, Artificial Sequence
  Synthetic oligonucleotide
acccgacactgtccccatctcgtctgttacccctg

SEQ ID NO: 104375 - DNA, 36 bp, Artificial Sequence
  Synthetic oligonucleotide
ttgcaccccgccgccccgctgtattgtacccgttga

SEQ ID NO: 104376 - DNA, 36 bp, Artificial Sequence
  Synthetic oligonucleotide
tccgcccacgcctctggtatgtccccccgcacgcta

SEQ ID NO: 104377 - DNA, 37 bp, Artificial Sequence
  Synthetic oligonucleotide
tccgcctccgaccccgcatggttcactcccttctcga

SEQ ID NO: 104378 - DNA, 35 bp, Artificial Sequence
  Synthetic oligonucleotide
tcccccacattcagccatggttttcccgtctttcc

SEQ ID NO: 104379 - DNA, 37 bp, Artificial Sequence
  Synthetic oligonucleotide
ggggggggctcaaccatggggacctttcacttgggga

SEQ ID NO: 104380 - DNA, 36 bp, Artificial Sequence
  Synthetic oligonucleotide
tccctgccgggggggggtaaaatgctggggagggaa

SEQ ID NO: 104381 - DNA, 35 bp, Artificial Sequence
  Synthetic oligonucleotide
aagcccatccgccgttaatagttcgctcacccctc

SEQ ID NO: 104382 - DNA, 35 bp, Artificial Sequence
  Synthetic oligonucleotide
tcactccgttctggtctcttcgtatgctcccacgc

SEQ ID NO: 104383 - DNA, 35 bp, Artificial Sequence
  Synthetic oligonucleotide
tcacgcccgcacagccctttccctggtggtacctc

SEQ ID NO: 104384 - DNA, 35 bp, Artificial Sequence
  Synthetic oligonucleotide
accactgcactctgcctttcccctgtcttgcatcg

SEQ ID NO: 104385 - DNA, 35 bp, Artificial Sequence
  Synthetic oligonucleotide
attgcgcccgcccctgacgatactctcccgcctag

SEQ ID NO: 104386 - DNA, 35 bp, Artificial Sequence
  Synthetic oligonucleotide
acctgcaacgcaccaccatcctgcgacgcctttcc

SEQ ID NO: 104387 - DNA, 35 bp, Artificial Sequence
  Synthetic oligonucleotide
tccctgtcctgtccgtgcttcgctccttctattcg

SEQ ID NO: 104388 - DNA, 35 bp, Artificial Sequence
  Synthetic oligonucleotide
tacaggacgggggcaggggggggaatcgggaaaat

SEQ ID NO: 104389 - DNA, 37 bp, Artificial Sequence
  Synthetic oligonucleotide
atgccacgcccacctgatacgcctccgctttggccga

SEQ ID NO: 104390 - DNA, 35 bp, Artificial Sequence
  Synthetic oligonucleotide
gtcccgcgctcttgccgccctatcctgtgccctat

SEQ ID NO: 104391 - DNA, 35 bp, Artificial Sequence
  Synthetic oligonucleotide
gtggctcctccgcccattgtcttgtcgttcccgtc

SEQ ID NO: 104392 - DNA, 35 bp, Artificial Sequence
  Synthetic oligonucleotide
ttcccaccgcgccccatgcccgttactagcaccat

SEQ ID NO: 104393 - DNA, 35 bp, Artificial Sequence
  Synthetic oligonucleotide
gcgacatgacctatgcaccacccgccgcttgcagc

SEQ ID NO: 104394 - DNA, 38 bp, Artificial Sequence
  Synthetic oligonucleotide
gacgccgccttacgttcccgtttcctgtccgtccctga

SEQ ID NO: 104395 - DNA, 29 bp, Artificial Sequence
  Synthetic oligonucleotide
tccgcccccctgtctctggttctaattga

SEQ ID NO: 104396 - DNA, 35 bp, Artificial Sequence
  Synthetic oligonucleotide
tccagagtcacacagtacataccgccgccacccat

SEQ ID NO: 104397 - DNA, 35 bp, Artificial Sequence
  Synthetic oligonucleotide
gactccccacatccgtttcgccccgcgcgccccca

SEQ ID NO: 104398 - DNA, 35 bp, Artificial Sequence
  Synthetic oligonucleotide
gcatcaacctccgcccgtgattagctccctccatg

SEQ ID NO: 104399 - DNA, 35 bp, Artificial Sequence
  Synthetic oligonucleotide
gttgcccggaagtttttgcaccagccccctccgcc

SEQ ID NO: 104400 - DNA, 38 bp, Artificial Sequence
  Synthetic oligonucleotide
gcgggagggaggggcatagggaaaggaatcgggggtga

SEQ ID NO: 104401 - DNA, 35 bp, Artificial Sequence
  Synthetic oligonucleotide
ttaggcacccgcccccttgcggcactggcccttcc

SEQ ID NO: 104402 - DNA, 35 bp, Artificial Sequence
  Synthetic oligonucleotide
aatgccagcccgatcacattgtccttctgcgctct

SEQ ID NO: 104403 - DNA, 36 bp, Artificial Sequence
  Synthetic oligonucleotide
gcccatcccactgcaccaccgcctcaccgccgcgga

SEQ ID NO: 104404 - DNA, 35 bp, Artificial Sequence
  Synthetic oligonucleotide
gtaccctcgccccatgcactaaggcgaccccccgc

SEQ ID NO: 104405 - DNA, 35 bp, Artificial Sequence
  Synthetic oligonucleotide
agcgctccgccctgttcccttcgacgttcatcctc

SEQ ID NO: 104406 - DNA, 35 bp, Artificial Sequence
  Synthetic oligonucleotide
gaacgaagggagggagtggaagggctggaacgtat

SEQ ID NO: 104407 - DNA, 35 bp, Artificial Sequence
  Synthetic oligonucleotide
tgttcagcactcagtctccccctgccctacctgcg

SEQ ID NO: 104408 - DNA, 34 bp, Artificial Sequence
  Synthetic oligonucleotide
actcaaccgcggttgactatctacatgaacctcc

SEQ ID NO: 104409 - DNA, 36 bp, Artificial Sequence
  Synthetic oligonucleotide
gtgccaccatcccattgttaactctgacctctccta

SEQ ID NO: 104410 - DNA, 35 bp, Artificial Sequence
  Synthetic oligonucleotide
gtcgcccaatccaccatcacatgtacaccgtgccc

SEQ ID NO: 104411 - DNA, 35 bp, Artificial Sequence
  Synthetic oligonucleotide
gtccacccattgctatacggcccattttccctcgc

SEQ ID NO: 104412 - DNA, 36 bp, Artificial Sequence
  Synthetic oligonucleotide
gacgcagtcccgcccgtcttcgctcccttaccccta

SEQ ID NO: 104413 - DNA, 35 bp, Artificial Sequence
  Synthetic oligonucleotide
gggtactgcccctgttgcttcgtttcgccccgcct

SEQ ID NO: 104414 - DNA, 35 bp, Artificial Sequence
  Synthetic oligonucleotide
gtgcctcccgacccatctgcctcattgaacagtgc

SEQ ID NO: 104415 - DNA, 35 bp, Artificial Sequence
  Synthetic oligonucleotide
gttccgtcctcgctcctactgttcccagcctggtc

SEQ ID NO: 104416 - DNA, 35 bp, Artificial Sequence
  Synthetic oligonucleotide
agaatcaccgcccctgcctttaacgccgctgccca

SEQ ID NO: 104417 - DNA, 36 bp, Artificial Sequence
  Synthetic oligonucleotide
tgagaggcccgcctgtcccatcccgttcctgtttca

SEQ ID NO: 104418 - DNA, 35 bp, Artificial Sequence
  Synthetic oligonucleotide
tgcgctctgccccccagtggttaacgctccccctg

SEQ ID NO: 104419 - DNA, 35 bp, Artificial Sequence
  Synthetic oligonucleotide
tcaacaccccccgccttaggtactgccgatctctg

SEQ ID NO: 104420 - DNA, 35 bp, Artificial Sequence
  Synthetic oligonucleotide
tatgtcgccccacctgttttatggcatttcccgtc

SEQ ID NO: 104421 - DNA, 35 bp, Artificial Sequence
  Synthetic oligonucleotide
ttccacaccgaccactgtcttgttcatccctcccg

SEQ ID NO: 104422 - DNA, 35 bp, Artificial Sequence
  Synthetic oligonucleotide
tgcaccgcctttcgtgaccgcccgcattccctgcc

SEQ ID NO: 104423 - DNA, 35 bp, Artificial Sequence
  Synthetic oligonucleotide
aaagagagggggtagtcgggtaagagggaggggtt

SEQ ID NO: 104424 - DNA, 35 bp, Artificial Sequence
  Synthetic oligonucleotide
acgaccctctaccggattggttccttcgtgcctct

SEQ ID NO: 104425 - DNA, 35 bp, Artificial Sequence
  Synthetic oligonucleotide
gacctcgctcgcttgtctcccccgctttgttgccg

SEQ ID NO: 104426 - DNA, 35 bp, Artificial Sequence
  Synthetic oligonucleotide
tccctgccctggctcgttcattcgccctctctttg

SEQ ID NO: 104427 - DNA, 34 bp, Artificial Sequence
  Synthetic oligonucleotide
atgcccccatcctgcgtatacacccttagcctta

SEQ ID NO: 104428 - DNA, 37 bp, Artificial Sequence
  Synthetic oligonucleotide
gaccctcctccgcctgcatgcactgttcacacttcga

SEQ ID NO: 104429 - DNA, 35 bp, Artificial Sequence
  Synthetic oligonucleotide
tgacccccgtccctgcctttccatcgaagcctgtt

SEQ ID NO: 104430 - DNA, 35 bp, Artificial Sequence
  Synthetic oligonucleotide
gaccactacacctgtacacatcgagcctgtcctct

SEQ ID NO: 104431 - DNA, 37 bp, Artificial Sequence
  Synthetic oligonucleotide
gcgcactttcccgtactggtcgttcttcccgccttga

SEQ ID NO: 104432 - DNA, 35 bp, Artificial Sequence
  Synthetic oligonucleotide
ggtacccgccgaagtcgtcccttctcccaccgccc

SEQ ID NO: 104433 - DNA, 35 bp, Artificial Sequence
  Synthetic oligonucleotide
accgcccctcctttcatgtgatccaatcccccgca

SEQ ID NO: 104434 - DNA, 36 bp, Artificial Sequence
  Synthetic oligonucleotide
ttgtccgccccatcgactgcattagtccacatctca

SEQ ID NO: 104435 - DNA, 31 bp, Artificial Sequence
  Synthetic oligonucleotide
atggtgccagccttcccatcttcctaactgc

SEQ ID NO: 104436 - DNA, 35 bp, Artificial Sequence
  Synthetic oligonucleotide
atggacttgctccactgtgcccctacacctccgcc

SEQ ID NO: 104437 - DNA, 35 bp, Artificial Sequence
  Synthetic oligonucleotide
tcgccgccccctcctcactatggcgtaaccgttcc

SEQ ID NO: 104438 - DNA, 35 bp, Artificial Sequence
  Synthetic oligonucleotide
tcatgagccgttccgctgtccctttgttcctgtac

SEQ ID NO: 104439 - DNA, 36 bp, Artificial Sequence
  Synthetic oligonucleotide
gtccctgggcggggtgtgtatttgtagggtggggaa

SEQ ID NO: 104440 - DNA, 35 bp, Artificial Sequence
  Synthetic oligonucleotide
acactcctcgatcgtccacccgcgcaccccaggcc

SEQ ID NO: 104441 - DNA, 36 bp, Artificial Sequence
  Synthetic oligonucleotide
gttccactcctccgttcctcacgccctgtccatgga

SEQ ID NO: 104442 - DNA, 35 bp, Artificial Sequence
  Synthetic oligonucleotide
gtacgcctccccgacagacgtctctgcaccactct

SEQ ID NO: 104443 - DNA, 35 bp, Artificial Sequence
  Synthetic oligonucleotide
acgagagcccccgcatgccacatttgccgaccgtc

SEQ ID NO: 104444 - DNA, 35 bp, Artificial Sequence
  Synthetic oligonucleotide
gccactgcccgtagcctgctccacatcatgccttt

SEQ ID NO: 104445 - DNA, 35 bp, Artificial Sequence
  Synthetic oligonucleotide
aaccacgccttgccataccgcccagtccactccgt

SEQ ID NO: 104446 - DNA, 36 bp, Artificial Sequence
  Synthetic oligonucleotide
gaggaaggcaaagggagcactaggacggggagggaa

SEQ ID NO: 104447 - DNA, 35 bp, Artificial Sequence
  Synthetic oligonucleotide
ttccaccgctccttccctgtccttatgtacgctaa

SEQ ID NO: 104448 - DNA, 35 bp, Artificial Sequence
  Synthetic oligonucleotide
gagccccccgccacgtccacaagatcccctccccg

SEQ ID NO: 104449 - DNA, 26 bp, Artificial Sequence
  Synthetic oligonucleotide
ttgccatgccgcccccttcgattctt

SEQ ID NO: 104450 - DNA, 36 bp, Artificial Sequence
  Synthetic oligonucleotide
acacaacgccctgcccaacatccagcgctgcctcca

SEQ ID NO: 104451 - DNA, 36 bp, Artificial Sequence
  Synthetic oligonucleotide
tagggggggtggaggggcattgggaggagcgaagga

SEQ ID NO: 104452 - DNA, 35 bp, Artificial Sequence
  Synthetic oligonucleotide
aacaccctcgccccccttatagaccgcatcccggg

SEQ ID NO: 104453 - DNA, 35 bp, Artificial Sequence
  Synthetic oligonucleotide
gactgcgcaccttgctgctccccgaatccgcctgc

SEQ ID NO: 104454 - DNA, 35 bp, Artificial Sequence
  Synthetic oligonucleotide
tgataccgcaccatctgctcttatctgctttgcca

SEQ ID NO: 104455 - DNA, 36 bp, Artificial Sequence
  Synthetic oligonucleotide
tccgtccatccgcctccgctccgtactatgacccca

SEQ ID NO: 104456 - DNA, 37 bp, Artificial Sequence
  Synthetic oligonucleotide
tagtggggaacaaagtgggaggggagggaaacggtga

SEQ ID NO: 104457 - DNA, 35 bp, Artificial Sequence
  Synthetic oligonucleotide
gcatgccacacatccgtcgtcactgcagtcccttc

SEQ ID NO: 104458 - DNA, 35 bp, Artificial Sequence
  Synthetic oligonucleotide
gagacttcgaatccgaccccatagtgcctgtcctc

SEQ ID NO: 104459 - DNA, 35 bp, Artificial Sequence
  Synthetic oligonucleotide
gccccgccgccccccgtaccatctttgcatggtct

SEQ ID NO: 104460 - DNA, 35 bp, Artificial Sequence
  Synthetic oligonucleotide
tgggtgggaggggaggggggcgtatgggagcgtaa

SEQ ID NO: 104461 - DNA, 35 bp, Artificial Sequence
  Synthetic oligonucleotide
tgatgtcccaactgttgtactatcgcctactcatc

SEQ ID NO: 104462 - DNA, 35 bp, Artificial Sequence
  Synthetic oligonucleotide
gccacgcccttgcctctttctccgtcttgccggcc

SEQ ID NO: 104463 - DNA, 35 bp, Artificial Sequence
  Synthetic oligonucleotide
acccgtgtccgcctttgtcattgtacctcccttac

SEQ ID NO: 104464 - DNA, 35 bp, Artificial Sequence
  Synthetic oligonucleotide
tgagctccagtgtcttaccgtccgccgccctttac

SEQ ID NO: 104465 - DNA, 36 bp, Artificial Sequence
  Synthetic oligonucleotide
gtactcgcctcctgtattgtcctcccagccccggta

SEQ ID NO: 104466 - DNA, 35 bp, Artificial Sequence
  Synthetic oligonucleotide
gcacggttagtgtactgctgccccccgttccctac

SEQ ID NO: 104467 - DNA, 38 bp, Artificial Sequence
  Synthetic oligonucleotide
tgagcgctggcgagagggtgggagggtagccaaattga

SEQ ID NO: 104468 - DNA, 35 bp, Artificial Sequence
  Synthetic oligonucleotide
gtctcgcctcggttatcgcaccagtctttccttcc

SEQ ID NO: 104469 - DNA, 35 bp, Artificial Sequence
  Synthetic oligonucleotide
ttcctccatccaccgtgctcttggcctggcctatc

SEQ ID NO: 104470 - DNA, 35 bp, Artificial Sequence
  Synthetic oligonucleotide
tactgacttccgccgtgcacaaccttccgctttcg

SEQ ID NO: 104471 - DNA, 35 bp, Artificial Sequence
  Synthetic oligonucleotide
tcagatgcatcgcctgccccccggtcgtactgctc

SEQ ID NO: 104472 - DNA, 35 bp, Artificial Sequence
  Synthetic oligonucleotide
tccgccccacgatgctccttctactgcgctgtcct

SEQ ID NO: 104473 - DNA, 34 bp, Artificial Sequence
  Synthetic oligonucleotide
gacccccgttcccgtctcgccctgtcattccagt

SEQ ID NO: 104474 - DNA, 35 bp, Artificial Sequence
  Synthetic oligonucleotide
gcacaccatcatagttgtatggttccccgcccccc

SEQ ID NO: 104475 - DNA, 36 bp, Artificial Sequence
  Synthetic oligonucleotide
gaatggggggcggagtgagcgggaggaagatcggca

SEQ ID NO: 104476 - DNA, 35 bp, Artificial Sequence
  Synthetic oligonucleotide
aaccccacctctgccctgttagctctgtgaccatc

SEQ ID NO: 104477 - DNA, 36 bp, Artificial Sequence
  Synthetic oligonucleotide
gagccagccccgcccatgcacaccgctctgtcctca

SEQ ID NO: 104478 - DNA, 35 bp, Artificial Sequence
  Synthetic oligonucleotide
tccaccccccccctgcccgacgctccgtacttgtt

SEQ ID NO: 104479 - DNA, 35 bp, Artificial Sequence
  Synthetic oligonucleotide
tgtggtgcgtggacggggggtaggctggattgagg

SEQ ID NO: 104480 - DNA, 35 bp, Artificial Sequence
  Synthetic oligonucleotide
tgcgtatgccctgccctgttccgatcccatctccg

SEQ ID NO: 104481 - DNA, 34 bp, Artificial Sequence
  Synthetic oligonucleotide
gaagggaaggtgggcggagggaggccggatcgag

SEQ ID NO: 104482 - DNA, 36 bp, Artificial Sequence
  Synthetic oligonucleotide
acacaccgccatttgccccccggaggccgccttaca

SEQ ID NO: 104483 - DNA, 35 bp, Artificial Sequence
  Synthetic oligonucleotide
tcaccccgctgccttcactgtccgtcattccaagt

SEQ ID NO: 104484 - DNA, 35 bp, Artificial Sequence
  Synthetic oligonucleotide
tgtcgcccgcctcgaccgcactacgccccctacgc

SEQ ID NO: 104485 - DNA, 38 bp, Artificial Sequence
  Synthetic oligonucleotide
gaaacgggcggaggccgggatgggatggacggctgtga

SEQ ID NO: 104486 - DNA, 35 bp, Artificial Sequence
  Synthetic oligonucleotide
accccacttctcccctggtacgtactgtgccaaca

SEQ ID NO: 104487 - DNA, 35 bp, Artificial Sequence
  Synthetic oligonucleotide
acgcggaggggaagggggtatggggggaatccgga

SEQ ID NO: 104488 - DNA, 35 bp, Artificial Sequence
  Synthetic oligonucleotide
ggacgagcactgccgctcctttatagttccatccc

SEQ ID NO: 104489 - DNA, 35 bp, Artificial Sequence
  Synthetic oligonucleotide
tgcccccacctgtcctttacctgcaccatgctgtt

SEQ ID NO: 104490 - DNA, 35 bp, Artificial Sequence
  Synthetic oligonucleotide
gtccatgcatcaccccgtggctttcgttccacctc

SEQ ID NO: 104491 - DNA, 36 bp, Artificial Sequence
  Synthetic oligonucleotide
tcaccatcctcgaactgtaccatcgacattccttca

SEQ ID NO: 104492 - DNA, 36 bp, Artificial Sequence
  Synthetic oligonucleotide
atcccgcccccactcttgccgccatccttcgtagaa

SEQ ID NO: 104493 - DNA, 35 bp, Artificial Sequence
  Synthetic oligonucleotide
tcgtgcccacctgttggtacactttcccgccctgt

SEQ ID NO: 104494 - DNA, 35 bp, Artificial Sequence
  Synthetic oligonucleotide
gagacgccatccgtccaccataccccccgctttgc

SEQ ID NO: 104495 - DNA, 35 bp, Artificial Sequence
  Synthetic oligonucleotide
agtccgggccctactcataaccgacctgcctccac

SEQ ID NO: 104496 - DNA, 35 bp, Artificial Sequence
  Synthetic oligonucleotide
ttctgtgcacgccatcacccgtttagtcctgcctc

SEQ ID NO: 104497 - DNA, 33 bp, Artificial Sequence
  Synthetic oligonucleotide
gtggggttgacccgccacacgcacccttccatc

SEQ ID NO: 104498 - DNA, 37 bp, Artificial Sequence
  Synthetic oligonucleotide
gaagagggggggtggtggtatgaatgggagtgaagga

SEQ ID NO: 104499 - DNA, 35 bp, Artificial Sequence
  Synthetic oligonucleotide
gaagggaggggcgggagggataggttctacgacag

SEQ ID NO: 104500 - DNA, 38 bp, Artificial Sequence
  Synthetic oligonucleotide
tccccgccccatggctatctttcgccgcctgttcctga

SEQ ID NO: 104501 - DNA, 36 bp, Artificial Sequence
  Synthetic oligonucleotide
tgacccgcccatcgcctatcactggtccgctcttaa

SEQ ID NO: 104502 - DNA, 37 bp, Artificial Sequence
  Synthetic oligonucleotide
tagctgccctcaccctgcccgtgctcccacctcttga

SEQ ID NO: 104503 - DNA, 35 bp, Artificial Sequence
  Synthetic oligonucleotide
gcaaccgcacacttacgccgttttcgatcctgcct

SEQ ID NO: 104504 - DNA, 35 bp, Artificial Sequence
  Synthetic oligonucleotide
gtgcacacctcttgtctcgtcttcgcattggctcc

SEQ ID NO: 104505 - DNA, 38 bp, Artificial Sequence
  Synthetic oligonucleotide
gtggccctcgtggtaaaggggaggtagggaggatttga

SEQ ID NO: 104506 - DNA, 35 bp, Artificial Sequence
  Synthetic oligonucleotide
gccgaaccatccgcacctcccaccgctgcttagca

SEQ ID NO: 104507 - DNA, 35 bp, Artificial Sequence
  Synthetic oligonucleotide
tgattgcaccgaacctgctccgttttgcttcctcc

SEQ ID NO: 104508 - DNA, 35 bp, Artificial Sequence
  Synthetic oligonucleotide
accgaccccgccccgttcttgattctgccaccgcg

SEQ ID NO: 104509 - DNA, 35 bp, Artificial Sequence
  Synthetic oligonucleotide
gcttacccgcccgttcccgttatagtccacgtgcc

SEQ ID NO: 104510 - DNA, 35 bp, Artificial Sequence
  Synthetic oligonucleotide
tgtgcctgcctttcgccttcctgtcactgttcctt

SEQ ID NO: 104511 - DNA, 35 bp, Artificial Sequence
  Synthetic oligonucleotide
gcggatcgcatttttcgattgccccccttccgtgc

SEQ ID NO: 104512 - DNA, 35 bp, Artificial Sequence
  Synthetic oligonucleotide
tccgtcccatcacatgcccttcaattctggtcctg

SEQ ID NO: 104513 - DNA, 37 bp, Artificial Sequence
  Synthetic oligonucleotide
gatgcaggtcacacgcgtactcccgccccatctctga

SEQ ID NO: 104514 - DNA, 35 bp, Artificial Sequence
  Synthetic oligonucleotide
gccacagtccgccggtactccatctgctatttcat

SEQ ID NO: 104515 - DNA, 35 bp, Artificial Sequence
  Synthetic oligonucleotide
actcgccgcccccccgccgtttagggcctgcaaca

SEQ ID NO: 104516 - DNA, 35 bp, Artificial Sequence
  Synthetic oligonucleotide
taacagccgggggaaggattagggagggagggctg

SEQ ID NO: 104517 - DNA, 35 bp, Artificial Sequence
  Synthetic oligonucleotide
agtcgccccccaccgtgcttccaggcccattgcct

SEQ ID NO: 104518 - DNA, 35 bp, Artificial Sequence
  Synthetic oligonucleotide
gcaccactccgccacccgaatcaccaggctttgtc

SEQ ID NO: 104519 - DNA, 35 bp, Artificial Sequence
  Synthetic oligonucleotide
tccatcctccgccaggtacacccgtgcgtttccac

SEQ ID NO: 104520 - DNA, 37 bp, Artificial Sequence
  Synthetic oligonucleotide
gctggggaggagggggaatacgggttcagatggggga

SEQ ID NO: 104521 - DNA, 35 bp, Artificial Sequence
  Synthetic oligonucleotide
agcacgcccccttcgcccgcacgaccccatccggc

SEQ ID NO: 104522 - DNA, 38 bp, Artificial Sequence
  Synthetic oligonucleotide
gagagtgacggtgggcatggggggggcgggtgcggtga

SEQ ID NO: 104523 - DNA, 35 bp, Artificial Sequence
  Synthetic oligonucleotide
tagtacccggcctgcctgtccccatccgttttgcc

SEQ ID NO: 104524 - DNA, 36 bp, Artificial Sequence
  Synthetic oligonucleotide
tcccactaacgccgttgtacatctgctctccaccga

SEQ ID NO: 104525 - DNA, 35 bp, Artificial Sequence
  Synthetic oligonucleotide
gtgcatgccctttgctcttgacccgtacgccttgc

SEQ ID NO: 104526 - DNA, 36 bp, Artificial Sequence
  Synthetic oligonucleotide
gtagccctccgccactggtgtcacgttctactcgta

SEQ ID NO: 104527 - DNA, 35 bp, Artificial Sequence
  Synthetic oligonucleotide
tccccgggtcctgctctcgttcttgcaaccactac

SEQ ID NO: 104528 - DNA, 35 bp, Artificial Sequence
  Synthetic oligonucleotide
gctgccgaccgcctgatttgccacccctcccgccg

SEQ ID NO: 104529 - DNA, 35 bp, Artificial Sequence
  Synthetic oligonucleotide
gaccccctgttcgtacctcgtcgccactttccttc

SEQ ID NO: 104530 - DNA, 35 bp, Artificial Sequence
  Synthetic oligonucleotide
ttggtacgcctctacgttttacctgccgccttacc

SEQ ID NO: 104531 - DNA, 34 bp, Artificial Sequence
  Synthetic oligonucleotide
tgacaccccccttacgtgcctcctctcctactcg

SEQ ID NO: 104532 - DNA, 35 bp, Artificial Sequence
  Synthetic oligonucleotide
gtctgcctcctcgtactatctatccgtgcaccctc

SEQ ID NO: 104533 - DNA, 35 bp, Artificial Sequence
  Synthetic oligonucleotide
gccatccgctgatagtcttccccccggccctttcg

SEQ ID NO: 104534 - DNA, 35 bp, Artificial Sequence
  Synthetic oligonucleotide
gcacgcaacgatgtctagtctccatctgctcccca

SEQ ID NO: 104535 - DNA, 35 bp, Artificial Sequence
  Synthetic oligonucleotide
tcaccttgccccgatggcactgccgcacattctcc

SEQ ID NO: 104536 - DNA, 35 bp, Artificial Sequence
  Synthetic oligonucleotide
gtcagacgcaactgtcccctagccccatcgtgcca

SEQ ID NO: 104537 - DNA, 36 bp, Artificial Sequence
  Synthetic oligonucleotide
tactcactccctgccggtattatttgccacttctca

SEQ ID NO: 104538 - DNA, 35 bp, Artificial Sequence
  Synthetic oligonucleotide
tccgccccccctcgagctacgccatggcacccacc

SEQ ID NO: 104539 - DNA, 35 bp, Artificial Sequence
  Synthetic oligonucleotide
tgtccccgccatctagtacgtccagtccgtccacc

SEQ ID NO: 104540 - DNA, 36 bp, Artificial Sequence
  Synthetic oligonucleotide
tgacgggggagaagggggggtgggagtagggtgcaa

SEQ ID NO: 104541 - DNA, 35 bp, Artificial Sequence
  Synthetic oligonucleotide
tccgccatctgtttctccgccgctcttctaactcg

SEQ ID NO: 104542 - DNA, 36 bp, Artificial Sequence
  Synthetic oligonucleotide
tcccgctccgccgccatgtccatatccccaccttaa

SEQ ID NO: 104543 - DNA, 35 bp, Artificial Sequence
  Synthetic oligonucleotide
gcacccaccaattgttttcacttcgctccttggtc

SEQ ID NO: 104544 - DNA, 35 bp, Artificial Sequence
  Synthetic oligonucleotide
tgctccgccaatctgtccttgccgcaactccccac

SEQ ID NO: 104545 - DNA, 35 bp, Artificial Sequence
  Synthetic oligonucleotide
gcggtcccaccccctcagtcccgtcctcttgctag

SEQ ID NO: 104546 - DNA, 37 bp, Artificial Sequence
  Synthetic oligonucleotide
gaaggacagggtggagggggggtgattggggcggtga

SEQ ID NO: 104547 - DNA, 35 bp, Artificial Sequence
  Synthetic oligonucleotide
tcgtaggcatacaccgtgcgctactacttccttcc

SEQ ID NO: 104548 - DNA, 35 bp, Artificial Sequence
  Synthetic oligonucleotide
tatgaccccagaccgccctatttgccgacactgcc

SEQ ID NO: 104549 - DNA, 35 bp, Artificial Sequence
  Synthetic oligonucleotide
actccacccctatgtgcattagccctttgctcgtt

SEQ ID NO: 104550 - DNA, 35 bp, Artificial Sequence
  Synthetic oligonucleotide
actcaccgctcctaatgattctgcgtgcctttcct

SEQ ID NO: 104551 - DNA, 35 bp, Artificial Sequence
  Synthetic oligonucleotide
gcctcaccccccttatggtcattctgggcctttgc

SEQ ID NO: 104552 - DNA, 36 bp, Artificial Sequence
  Synthetic oligonucleotide
tctccacacccccacgctgttacttggtctgctcca

SEQ ID NO: 104553 - DNA, 35 bp, Artificial Sequence
  Synthetic oligonucleotide
acgtcgtggcatcgtactcgcccctcttttgctgc

SEQ ID NO: 104554 - DNA, 35 bp, Artificial Sequence
  Synthetic oligonucleotide
accacaccgagcgttatctgccactgtcccctatc

SEQ ID NO: 104555 - DNA, 37 bp, Artificial Sequence
  Synthetic oligonucleotide
tccgccctcacatgccgtctaatttcgttccttctga

SEQ ID NO: 104556 - DNA, 35 bp, Artificial Sequence
  Synthetic oligonucleotide
aacacccctgcctcactgtcttccattcgcctaag

SEQ ID NO: 104557 - DNA, 35 bp, Artificial Sequence
  Synthetic oligonucleotide
gtcccatccgttgtcgccctgttttccgtaggctt

SEQ ID NO: 104558 - DNA, 35 bp, Artificial Sequence
  Synthetic oligonucleotide
tctcccccacccgattgatctgctatcgcacccct

SEQ ID NO: 104559 - DNA, 35 bp, Artificial Sequence
  Synthetic oligonucleotide
tcactaccgccctaccgctgctccctgtgcctgca

SEQ ID NO: 104560 - DNA, 35 bp, Artificial Sequence
  Synthetic oligonucleotide
ttcccgcccccggtgctgtcctactaccccctagt

SEQ ID NO: 104561 - DNA, 35 bp, Artificial Sequence
  Synthetic oligonucleotide
gtcccgccttccgcacctctatatgcttgttccat

SEQ ID NO: 104562 - DNA, 35 bp, Artificial Sequence
  Synthetic oligonucleotide
gtaccacccggcactgttgcgtcaacgcctttcat

SEQ ID NO: 104563 - DNA, 35 bp, Artificial Sequence
  Synthetic oligonucleotide
aagagcccacgtgcttagccccgcccccccctccc

SEQ ID NO: 104564 - DNA, 35 bp, Artificial Sequence
  Synthetic oligonucleotide
gccaccgcccgccccttcgcatcccccaggtaacc

SEQ ID NO: 104565 - DNA, 38 bp, Artificial Sequence
  Synthetic oligonucleotide
gccacagggggggggatgggagtacagggtacatgtga

SEQ ID NO: 104566 - DNA, 35 bp, Artificial Sequence
  Synthetic oligonucleotide
acgctccgcccctttcgtctactaccctgcccggg

SEQ ID NO: 104567 - DNA, 38 bp, Artificial Sequence
  Synthetic oligonucleotide
tcccgcccaccactgcatctcagccttcactctcgtga

SEQ ID NO: 104568 - DNA, 35 bp, Artificial Sequence
  Synthetic oligonucleotide
tgtaccccctcgatcgcgcaccgtgctggctcatc

SEQ ID NO: 104569 - DNA, 35 bp, Artificial Sequence
  Synthetic oligonucleotide
tgataggggccaaggaggggggaggaaacggtggt

SEQ ID NO: 104570 - DNA, 38 bp, Artificial Sequence
  Synthetic oligonucleotide
gaccgagcgggggagggaagattcacatgaaggggtga

SEQ ID NO: 104571 - DNA, 36 bp, Artificial Sequence
  Synthetic oligonucleotide
tccctcctcgcatctacacccgatcctgtccccgta

SEQ ID NO: 104572 - DNA, 35 bp, Artificial Sequence
  Synthetic oligonucleotide
ttccgtctgtgcccccatatgtttcgtgctactcc

SEQ ID NO: 104573 - DNA, 35 bp, Artificial Sequence
  Synthetic oligonucleotide
tgttcacccctccctgccttgatatagaactacgc

SEQ ID NO: 104574 - DNA, 38 bp, Artificial Sequence
  Synthetic oligonucleotide
tgatagccctgccccgttttcaaagcccactccactga

SEQ ID NO: 104575 - DNA, 35 bp, Artificial Sequence
  Synthetic oligonucleotide
gtgggggggatggataggtgagggagtgggagctg

SEQ ID NO: 104576 - DNA, 35 bp, Artificial Sequence
  Synthetic oligonucleotide
actctaccgaccgcctttttacgcccgcccacgcg

SEQ ID NO: 104577 - DNA, 35 bp, Artificial Sequence
  Synthetic oligonucleotide
ttgcacgctgtcttgtcgtcccctctccgccgtcg

SEQ ID NO: 104578 - DNA, 35 bp, Artificial Sequence
  Synthetic oligonucleotide
aaaaacgcggccgggaggggagggggagggattca

SEQ ID NO: 104579 - DNA, 38 bp, Artificial Sequence
  Synthetic oligonucleotide
tacaggctgtcctcctatttgcgtttcctcccctgtga

SEQ ID NO: 104580 - DNA, 35 bp, Artificial Sequence
  Synthetic oligonucleotide
tcggagtagcagccctacccctccccctgttgccc

SEQ ID NO: 104581 - DNA, 35 bp, Artificial Sequence
  Synthetic oligonucleotide
tccgcgcaaccacgctgttctctgttcccctcgtc

SEQ ID NO: 104582 - DNA, 37 bp, Artificial Sequence
  Synthetic oligonucleotide
cactccactccgcttgactatccggctcgtttaccga

SEQ ID NO: 104583 - DNA, 35 bp, Artificial Sequence
  Synthetic oligonucleotide
aacctccgaactaaagcagtgcgccgcccccacta

SEQ ID NO: 104584 - DNA, 34 bp, Artificial Sequence
  Synthetic oligonucleotide
gactggaggggggggaggtgcgggaagtcaagcg

SEQ ID NO: 104585 - DNA, 35 bp, Artificial Sequence
  Synthetic oligonucleotide
attccacagggcgacgaggggataggggggcggtg

SEQ ID NO: 104586 - DNA, 35 bp, Artificial Sequence
  Synthetic oligonucleotide
tctgcacccgccgccatcccgttcaactcgattct

SEQ ID NO: 104587 - DNA, 35 bp, Artificial Sequence
  Synthetic oligonucleotide
gcacctgttgccggattgcgcaccacgacccctcc

SEQ ID NO: 104588 - DNA, 35 bp, Artificial Sequence
  Synthetic oligonucleotide
actgagggaaagcgggggagattacgaaggagtca

SEQ ID NO: 104589 - DNA, 35 bp, Artificial Sequence
  Synthetic oligonucleotide
ggacatgccgccgcccgtctcccctggcctctccg

SEQ ID NO: 104590 - DNA, 35 bp, Artificial Sequence
  Synthetic oligonucleotide
gttccaccgcctgttacactgttgcttctcttctc

SEQ ID NO: 104591 - DNA, 35 bp, Artificial Sequence
  Synthetic oligonucleotide
gatcgcctccccactgttgcctcttgccggcccgc

SEQ ID NO: 104592 - DNA, 35 bp, Artificial Sequence
  Synthetic oligonucleotide
ggaccccttcacagtaatatccgccgcgcactcgc

SEQ ID NO: 104593 - DNA, 35 bp, Artificial Sequence
  Synthetic oligonucleotide
tgcgcaccctctgcacccggttcacgcccatcgtc

SEQ ID NO: 104594 - DNA, 35 bp, Artificial Sequence
  Synthetic oligonucleotide
agtccgtcctctgcatgccccttgtgcccccttcg

SEQ ID NO: 104595 - DNA, 35 bp, Artificial Sequence
  Synthetic oligonucleotide
tcacacaccgattccgtgtgcccttccatctacgc

SEQ ID NO: 104596 - DNA, 36 bp, Artificial Sequence
  Synthetic oligonucleotide
gatgcccctcccgctgtttttcaatcattgccttga

SEQ ID NO: 104597 - DNA, 37 bp, Artificial Sequence
  Synthetic oligonucleotide
gcgagagcacgtcgggaggtcgggggggggacgtgga

SEQ ID NO: 104598 - DNA, 35 bp, Artificial Sequence
  Synthetic oligonucleotide
actgcactcccgccaccattcagcccgtaccgcta

SEQ ID NO: 104599 - DNA, 35 bp, Artificial Sequence
  Synthetic oligonucleotide
tcccaccctcactgtctctcctgaatctacgaact

SEQ ID NO: 104600 - DNA, 35 bp, Artificial Sequence
  Synthetic oligonucleotide
tatgtcggagggcgagggaagggtaggggtcacag

SEQ ID NO: 104601 - DNA, 35 bp, Artificial Sequence
  Synthetic oligonucleotide
gtgaccgcctctagcagccatcacgacgcccctcc

SEQ ID NO: 104602 - DNA, 35 bp, Artificial Sequence
  Synthetic oligonucleotide
tgccaccgcccggtacggtcctgctctttcacaac

SEQ ID NO: 104603 - DNA, 37 bp, Artificial Sequence
  Synthetic oligonucleotide
atgcgcagactagggggcgggggggaacggagggaga

SEQ ID NO: 104604 - DNA, 35 bp, Artificial Sequence
  Synthetic oligonucleotide
tgtatccatcaccgtactagtagcactgtcccacc

SEQ ID NO: 104605 - DNA, 35 bp, Artificial Sequence
  Synthetic oligonucleotide
tccaaagctcactgccgtcactaattcctcgttgc

SEQ ID NO: 104606 - DNA, 35 bp, Artificial Sequence
  Synthetic oligonucleotide
gctgccacatgtctcgtgctccgcccccttcccat

SEQ ID NO: 104607 - DNA, 35 bp, Artificial Sequence
  Synthetic oligonucleotide
atggaggtgcggcggggggggagggctggaagggg

SEQ ID NO: 104608 - DNA, 35 bp, Artificial Sequence
  Synthetic oligonucleotide
tcacgtcagagctacatccgctccttctatcctgt

SEQ ID NO: 104609 - DNA, 36 bp, Artificial Sequence
  Synthetic oligonucleotide
taccgccggagctgtctaaccactgtcctctcgcca

SEQ ID NO: 104610 - DNA, 35 bp, Artificial Sequence
  Synthetic oligonucleotide
agcccacctgcaccatctctaagggcccttgccct

SEQ ID NO: 104611 - DNA, 35 bp, Artificial Sequence
  Synthetic oligonucleotide
tcgacaatacctccacacgttgccttatcatgtcc

SEQ ID NO: 104612 - DNA, 35 bp, Artificial Sequence
  Synthetic oligonucleotide
tcacgaaccactctgctgcctctcgtacacccctg

SEQ ID NO: 104613 - DNA, 37 bp, Artificial Sequence
  Synthetic oligonucleotide
tccgacccgcctcccctgaacacagactcgtcctcga

SEQ ID NO: 104614 - DNA, 34 bp, Artificial Sequence
  Synthetic oligonucleotide
tcacgtcgccgtcctgtccacgctcttgccgttt

SEQ ID NO: 104615 - DNA, 35 bp, Artificial Sequence
  Synthetic oligonucleotide
ggtcgccccccgtcgttatcataccctctgtgcac

SEQ ID NO: 104616 - DNA, 32 bp, Artificial Sequence
  Synthetic oligonucleotide
ataccctccgtcgcctccctcttaatgtacac

SEQ ID NO: 104617 - DNA, 35 bp, Artificial Sequence
  Synthetic oligonucleotide
aagtgccatcctttcccccgttcgttcccggctac

SEQ ID NO: 104618 - DNA, 35 bp, Artificial Sequence
  Synthetic oligonucleotide
gccgcccaactcgtctcatctggttttttcccccg

SEQ ID NO: 104619 - DNA, 37 bp, Artificial Sequence
  Synthetic oligonucleotide
gaatgggggggtgaaatgggtttggggaaagggtcga

SEQ ID NO: 104620 - DNA, 35 bp, Artificial Sequence
  Synthetic oligonucleotide
agctgccctcacgcccacgttcgccgccattcttg

SEQ ID NO: 104621 - DNA, 35 bp, Artificial Sequence
  Synthetic oligonucleotide
gagccaccgccctgtctcctcctaggcctttatta

SEQ ID NO: 104622 - DNA, 35 bp, Artificial Sequence
  Synthetic oligonucleotide
accctgcccagctgcccgctatcctgccgtcctca

SEQ ID NO: 104623 - DNA, 34 bp, Artificial Sequence
  Synthetic oligonucleotide
aacaaggccgggcggacggggggggcaaagggaa

SEQ ID NO: 104624 - DNA, 35 bp, Artificial Sequence
  Synthetic oligonucleotide
tacgcccggcctccactgacgatcaatctgcccca

SEQ ID NO: 104625 - DNA, 35 bp, Artificial Sequence
  Synthetic oligonucleotide
tcaccaccctgcctgtttgtgtcgccacccagcct

SEQ ID NO: 104626 - DNA, 36 bp, Artificial Sequence
  Synthetic oligonucleotide
tccccccgcagacttgcacccctgttgatcgcctta

SEQ ID NO: 104627 - DNA, 35 bp, Artificial Sequence
  Synthetic oligonucleotide
gagggcaccacctccgttttcgatcctgtctgctc

SEQ ID NO: 104628 - DNA, 35 bp, Artificial Sequence
  Synthetic oligonucleotide
tcaaggcccgccgaccgcaactccccctgcctagc

SEQ ID NO: 104629 - DNA, 35 bp, Artificial Sequence
  Synthetic oligonucleotide
gtctccaccgccctacttccggttttcatccttat

SEQ ID NO: 104630 - DNA, 35 bp, Artificial Sequence
  Synthetic oligonucleotide
gtccacaccaccccgccagtctattgacctgctac

SEQ ID NO: 104631 - DNA, 35 bp, Artificial Sequence
  Synthetic oligonucleotide
aacaccatcccccgtcagccgttacgtctacctac

SEQ ID NO: 104632 - DNA, 35 bp, Artificial Sequence
  Synthetic oligonucleotide
tccacccccgccccatacttactatcaggaccctc

SEQ ID NO: 104633 - DNA, 35 bp, Artificial Sequence
  Synthetic oligonucleotide
gacatccacccaattctactagtgcccggtacctc

SEQ ID NO: 104634 - DNA, 35 bp, Artificial Sequence
  Synthetic oligonucleotide
tgcccacctgctgctatctctcggttatattttag

SEQ ID NO: 104635 - DNA, 35 bp, Artificial Sequence
  Synthetic oligonucleotide
gtccccagcgcaggttccagcccatctcgtcgcca

SEQ ID NO: 104636 - DNA, 37 bp, Artificial Sequence
  Synthetic oligonucleotide
gagggtggggtccgtattatgtgttgggtgggtatga

SEQ ID NO: 104637 - DNA, 36 bp, Artificial Sequence
  Synthetic oligonucleotide
tactccccgctcccgttcgtccagtaacgtagttaa

SEQ ID NO: 104638 - DNA, 36 bp, Artificial Sequence
  Synthetic oligonucleotide
ataccgccgccacactgttttctctttccgccagca

SEQ ID NO: 104639 - DNA, 35 bp, Artificial Sequence
  Synthetic oligonucleotide
gaagaggcggggaggggaatacgtgcggtgggggg

SEQ ID NO: 104640 - DNA, 35 bp, Artificial Sequence
  Synthetic oligonucleotide
acccgccgaccgccacaccgcgttttcttctcatt

SEQ ID NO: 104641 - DNA, 35 bp, Artificial Sequence
  Synthetic oligonucleotide
gaaaccccgcccctctccgtcaaacagcccgtgtg

SEQ ID NO: 104642 - DNA, 35 bp, Artificial Sequence
  Synthetic oligonucleotide
tccgacgtcacgcacattgcgtccctcccccgccc

SEQ ID NO: 104643 - DNA, 37 bp, Artificial Sequence
  Synthetic oligonucleotide
tcgcaccctctgctcctgcgctccccgtttccgtgga

SEQ ID NO: 104644 - DNA, 37 bp, Artificial Sequence
  Synthetic oligonucleotide
gcaaccccccccctgcgagtcccctgcttcctgcgga

SEQ ID NO: 104645 - DNA, 36 bp, Artificial Sequence
  Synthetic oligonucleotide
ggtaggcggagggggttggtggtggcctcaagctga

SEQ ID NO: 104646 - DNA, 35 bp, Artificial Sequence
  Synthetic oligonucleotide
acacaccgttatctctgccatcatggactcgcccc

SEQ ID NO: 104647 - DNA, 35 bp, Artificial Sequence
  Synthetic oligonucleotide
gttgcccctcttttgaaccgcgcgccctcatcccg

SEQ ID NO: 104648 - DNA, 35 bp, Artificial Sequence
  Synthetic oligonucleotide
gttgagccttccaatctgtttatcccatgtcctgc

SEQ ID NO: 104649 - DNA, 35 bp, Artificial Sequence
  Synthetic oligonucleotide
aagcccgcccggatcgcgttcaacaccgctgccct

SEQ ID NO: 104650 - DNA, 35 bp, Artificial Sequence
  Synthetic oligonucleotide
gctgcacgatagatcgtcacctgcgcccctctcct

SEQ ID NO: 104651 - DNA, 35 bp, Artificial Sequence
  Synthetic oligonucleotide
acccagctccttctgtacgtgctgcccccctctca

SEQ ID NO: 104652 - DNA, 35 bp, Artificial Sequence
  Synthetic oligonucleotide
gtgaccacccctccgcattcatactaacagcaacg

SEQ ID NO: 104653 - DNA, 35 bp, Artificial Sequence
  Synthetic oligonucleotide
gtgccactctcaactgcccacatatgcctgtttct

SEQ ID NO: 104654 - DNA, 36 bp, Artificial Sequence
  Synthetic oligonucleotide
agcacagagccactgtccatcgcccgaccccctgta

SEQ ID NO: 104655 - DNA, 36 bp, Artificial Sequence
  Synthetic oligonucleotide
agtgggaggggtgggggggaaaataggctggataaa

SEQ ID NO: 104656 - DNA, 34 bp, Artificial Sequence
  Synthetic oligonucleotide
gcactgtcagccctttcctcccgcgtgccctcca

SEQ ID NO: 104657 - DNA, 35 bp, Artificial Sequence
  Synthetic oligonucleotide
gcgggagccctcctgactgccccgtccccttgctc

SEQ ID NO: 104658 - DNA, 35 bp, Artificial Sequence
  Synthetic oligonucleotide
tccgaccacgcgctttcattctgtcatataccctc

SEQ ID NO: 104659 - DNA, 35 bp, Artificial Sequence
  Synthetic oligonucleotide
gagatacgcgctcccatgattcccttctgccgccc

SEQ ID NO: 104660 - DNA, 35 bp, Artificial Sequence
  Synthetic oligonucleotide
tgtgcgccacacatgtcgcctctctccttcgtggt

SEQ ID NO: 104661 - DNA, 36 bp, Artificial Sequence
  Synthetic oligonucleotide
gacaccacccgttgcaccatctatggcgacaagcca

SEQ ID NO: 104662 - DNA, 35 bp, Artificial Sequence
  Synthetic oligonucleotide
gtgtacaggggggggaaaggattgcggagggacgg

SEQ ID NO: 104663 - DNA, 35 bp, Artificial Sequence
  Synthetic oligonucleotide
gtcctcacgcgtacattgccttatcgtccacctct

SEQ ID NO: 104664 - DNA, 35 bp, Artificial Sequence
  Synthetic oligonucleotide
gaggggacgggcggggtagggaaataggacgtgat

SEQ ID NO: 104665 - DNA, 35 bp, Artificial Sequence
  Synthetic oligonucleotide
gtgcctcaacactggtattccgttgcccttccacc

SEQ ID NO: 104666 - DNA, 35 bp, Artificial Sequence
  Synthetic oligonucleotide
gcgaacccgcctccccaactgcccacctcgctggc

SEQ ID NO: 104667 - DNA, 35 bp, Artificial Sequence
  Synthetic oligonucleotide
tcgaccccccaatcctcccgtgcattgctgcctcc

SEQ ID NO: 104668 - DNA, 35 bp, Artificial Sequence
  Synthetic oligonucleotide
acaccaaggcagtcgttctttctctgcgttccatc

SEQ ID NO: 104669 - DNA, 35 bp, Artificial Sequence
  Synthetic oligonucleotide
tcccgtatcgcaacgtccatcctccgcccgccacg

SEQ ID NO: 104670 - DNA, 35 bp, Artificial Sequence
  Synthetic oligonucleotide
tgcccacctgttcgcttgctaaatccaccataaca

SEQ ID NO: 104671 - DNA, 36 bp, Artificial Sequence
  Synthetic oligonucleotide
tcagcatgtgcccgccgtatacgcacccacttccca

SEQ ID NO: 104672 - DNA, 36 bp, Artificial Sequence
  Synthetic oligonucleotide
atccagccctatgtcatcccattgcccccacgccca

SEQ ID NO: 104673 - DNA, 35 bp, Artificial Sequence
  Synthetic oligonucleotide
gtcgcacgtcgtccgcttaatcgccacttcgctcg

SEQ ID NO: 104674 - DNA, 36 bp, Artificial Sequence
  Synthetic oligonucleotide
tgctccatccgcgttgttactgtcacaccttctcta

SEQ ID NO: 104675 - DNA, 35 bp, Artificial Sequence
  Synthetic oligonucleotide
tgtacaccggcccgactccgttttagctgtttccc

SEQ ID NO: 104676 - DNA, 37 bp, Artificial Sequence
  Synthetic oligonucleotide
gacaagggagagagggtggggtagggcgtggaagcga

SEQ ID NO: 104677 - DNA, 32 bp, Artificial Sequence
  Synthetic oligonucleotide
tcactcgccctccccctcgttatcacgccaga

SEQ ID NO: 104678 - DNA, 33 bp, Artificial Sequence
  Synthetic oligonucleotide
gttggtggtcggggatagggggcgggggagtga

SEQ ID NO: 104679 - DNA, 37 bp, Artificial Sequence
  Synthetic oligonucleotide
ttgtcgcccactgttcgccctgcccatttcatgctga

SEQ ID NO: 104680 - DNA, 35 bp, Artificial Sequence
  Synthetic oligonucleotide
actgcgccacctgtacactcgtctcgcccttcgct

SEQ ID NO: 104681 - DNA, 35 bp, Artificial Sequence
  Synthetic oligonucleotide
gccgtgccccagttcctttagtccagctcccggtt

SEQ ID NO: 104682 - DNA, 37 bp, Artificial Sequence
  Synthetic oligonucleotide
gtgcatggggagggggggaagggcaacagcgttagga

SEQ ID NO: 104683 - DNA, 35 bp, Artificial Sequence
  Synthetic oligonucleotide
gcactccctcccctgtctatacccggttctccgag

SEQ ID NO: 104684 - DNA, 35 bp, Artificial Sequence
  Synthetic oligonucleotide
aatccgcccctgctattgcatacactttcacgccc

SEQ ID NO: 104685 - DNA, 35 bp, Artificial Sequence
  Synthetic oligonucleotide
ttcgacccgctcttgtagttcctccgttctcctgc

SEQ ID NO: 104686 - DNA, 35 bp, Artificial Sequence
  Synthetic oligonucleotide
gccgtaacatcctatgccgcctggatcgctccacc

SEQ ID NO: 104687 - DNA, 35 bp, Artificial Sequence
  Synthetic oligonucleotide
gccatcccaccacacgtacagacccatgtcttctg

SEQ ID NO: 104688 - DNA, 37 bp, Artificial Sequence
  Synthetic oligonucleotide
atccgcctccgccccatgaaaccagcctccatcccga

SEQ ID NO: 104689 - DNA, 35 bp, Artificial Sequence
  Synthetic oligonucleotide
ttcgccccccaggccttctatcgttgaccacgccg

SEQ ID NO: 104690 - DNA, 35 bp, Artificial Sequence
  Synthetic oligonucleotide
ggagcccacgcacattgttaccgccatctattctc

SEQ ID NO: 104691 - DNA, 35 bp, Artificial Sequence
  Synthetic oligonucleotide
taccccagcccattctcccattcatcaccttttgg

SEQ ID NO: 104692 - DNA, 35 bp, Artificial Sequence
  Synthetic oligonucleotide
tccgccccgctccatgacctcgctagctcgttccg

SEQ ID NO: 104693 - DNA, 36 bp, Artificial Sequence
  Synthetic oligonucleotide
gcatgccctcgctctctgtcgttcttgtgcttcgaa

SEQ ID NO: 104694 - DNA, 35 bp, Artificial Sequence
  Synthetic oligonucleotide
tccatccgcaatatgttccaagcgcccttcccacc

SEQ ID NO: 104695 - DNA, 35 bp, Artificial Sequence
  Synthetic oligonucleotide
ttacgtgcctgccatccgtttgctcttcgcttgtc

SEQ ID NO: 104696 - DNA, 35 bp, Artificial Sequence
  Synthetic oligonucleotide
tcttacccccgctcctatggttcttgttcgcttta

SEQ ID NO: 104697 - DNA, 36 bp, Artificial Sequence
  Synthetic oligonucleotide
tcaacacccctctatgaatctgcgcctgtccccaca

SEQ ID NO: 104698 - DNA, 35 bp, Artificial Sequence
  Synthetic oligonucleotide
gacgccctcctcttgtcgaatagcccatgtcgttc

SEQ ID NO: 104699 - DNA, 35 bp, Artificial Sequence
  Synthetic oligonucleotide
aagcccgccctctgccaattattgtcacgctacct

SEQ ID NO: 104700 - DNA, 35 bp, Artificial Sequence
  Synthetic oligonucleotide
accgttacccatcctgttcgctgacgatccccttc

SEQ ID NO: 104701 - DNA, 35 bp, Artificial Sequence
  Synthetic oligonucleotide
tccatcccagtagttgcctcgctcggtattccctc

SEQ ID NO: 104702 - DNA, 35 bp, Artificial Sequence
  Synthetic oligonucleotide
accattctccgcacacctgttacgcaggtaactcc

SEQ ID NO: 104703 - DNA, 35 bp, Artificial Sequence
  Synthetic oligonucleotide
tcagcccgctgcttttatccgaccagctcctgtcc

SEQ ID NO: 104704 - DNA, 36 bp, Artificial Sequence
  Synthetic oligonucleotide
atcaccacgcccagtcctgtcgttccatcctacaca

SEQ ID NO: 104705 - DNA, 35 bp, Artificial Sequence
  Synthetic oligonucleotide
tgctgggggtcgccgtatctgttctgttcccgttc

SEQ ID NO: 104706 - DNA, 35 bp, Artificial Sequence
  Synthetic oligonucleotide
ttgtcgccccggtgcattgttcctcctgcttggtt

SEQ ID NO: 104707 - DNA, 35 bp, Artificial Sequence
  Synthetic oligonucleotide
tcgcaccctcacccgttcttgtccctgggaaaacc

SEQ ID NO: 104708 - DNA, 35 bp, Artificial Sequence
  Synthetic oligonucleotide
atggaggtggtggggtggtctctcggatggcccgc

SEQ ID NO: 104709 - DNA, 38 bp, Artificial Sequence
  Synthetic oligonucleotide
gcaccaccgcctgttgccccacatatcaccccgcctga

SEQ ID NO: 104710 - DNA, 35 bp, Artificial Sequence
  Synthetic oligonucleotide
aacactgcctcgcttggatccaccttccctgtaac

SEQ ID NO: 104711 - DNA, 36 bp, Artificial Sequence
  Synthetic oligonucleotide
gtgtagggtgacggtgggaggagggggagcagggca

SEQ ID NO: 104712 - DNA, 35 bp, Artificial Sequence
  Synthetic oligonucleotide
ggagccctcctcgcctcttgtcaacccggtcttgt

SEQ ID NO: 104713 - DNA, 35 bp, Artificial Sequence
  Synthetic oligonucleotide
tcattccgcctctccatcttagctgcctacactgc

SEQ ID NO: 104714 - DNA, 36 bp, Artificial Sequence
  Synthetic oligonucleotide
tgtgtcgcccgttttgacccgcctgttgttgcctca

SEQ ID NO: 104715 - DNA, 35 bp, Artificial Sequence
  Synthetic oligonucleotide
gccctcccccccgtggttaacggccttcaattctt

SEQ ID NO: 104716 - DNA, 38 bp, Artificial Sequence
  Synthetic oligonucleotide
tcgcacccgccaccctatgttccttttctcgtccgtga

SEQ ID NO: 104717 - DNA, 35 bp, Artificial Sequence
  Synthetic oligonucleotide
tgcccccatccgtttctacattgctccgacctggt

SEQ ID NO: 104718 - DNA, 35 bp, Artificial Sequence
  Synthetic oligonucleotide
gacctccgcaccccgccactgacggttttccctgc

SEQ ID NO: 104719 - DNA, 35 bp, Artificial Sequence
  Synthetic oligonucleotide
gcaccaccctgcgcactattccaccgctgtacaca

SEQ ID NO: 104720 - DNA, 35 bp, Artificial Sequence
  Synthetic oligonucleotide
gcgtcacggcccatctgctttccacttctgccccg

SEQ ID NO: 104721 - DNA, 35 bp, Artificial Sequence
  Synthetic oligonucleotide
gctccctcaccggaacttcgccccctagtccctgc

SEQ ID NO: 104722 - DNA, 35 bp, Artificial Sequence
  Synthetic oligonucleotide
aactgaccacccccattgtgcccgacctcgcatct

SEQ ID NO: 104723 - DNA, 36 bp, Artificial Sequence
  Synthetic oligonucleotide
atgctgcctccctgatttcacgcctgccccttacga

SEQ ID NO: 104724 - DNA, 35 bp, Artificial Sequence
  Synthetic oligonucleotide
gaccccctcctcactgttttggactcgctttttgt

SEQ ID NO: 104725 - DNA, 35 bp, Artificial Sequence
  Synthetic oligonucleotide
tgctgcacccgttccgttctctcgtgcttatcccc

SEQ ID NO: 104726 - DNA, 35 bp, Artificial Sequence
  Synthetic oligonucleotide
ggactgccctcgcccggttcgttcctgtcatttca

SEQ ID NO: 104727 - DNA, 35 bp, Artificial Sequence
  Synthetic oligonucleotide
acctctcaccgcaccgatctccttttttgccacga

SEQ ID NO: 104728 - DNA, 36 bp, Artificial Sequence
  Synthetic oligonucleotide
gcgcacgctgcctcgcgttttccctagccccgttca

SEQ ID NO: 104729 - DNA, 35 bp, Artificial Sequence
  Synthetic oligonucleotide
gcacccacacggtgtacgtgtccaacctgcaattc

SEQ ID NO: 104730 - DNA, 38 bp, Artificial Sequence
  Synthetic oligonucleotide
ttgccactgccccccccctgagcctcgccttaacttga

SEQ ID NO: 104731 - DNA, 35 bp, Artificial Sequence
  Synthetic oligonucleotide
tgcaacatggccgcacccccctctctcgtcactgc

SEQ ID NO: 104732 - DNA, 35 bp, Artificial Sequence
  Synthetic oligonucleotide
aaccccgccatatctcgctcagccggccatccccg

SEQ ID NO: 104733 - DNA, 35 bp, Artificial Sequence
  Synthetic oligonucleotide
gcctctcaacccgatatgcgctgccccctcccccg

SEQ ID NO: 104734 - DNA, 35 bp, Artificial Sequence
  Synthetic oligonucleotide
gccccacctactcgttgttctttcccttctggtac

SEQ ID NO: 104735 - DNA, 35 bp, Artificial Sequence
  Synthetic oligonucleotide
acctcctgccggcctcccatacgttgttctctgtc

SEQ ID NO: 104736 - DNA, 34 bp, Artificial Sequence
  Synthetic oligonucleotide
tccaagcctcatgcttgctcccgtttcgtactac

SEQ ID NO: 104737 - DNA, 35 bp, Artificial Sequence
  Synthetic oligonucleotide
accccgcacttgtctcgtttcccggtctggcttcc

SEQ ID NO: 104738 - DNA, 35 bp, Artificial Sequence
  Synthetic oligonucleotide
ttcacctccgttgtcacccgctccctttacgagtt

SEQ ID NO: 104739 - DNA, 35 bp, Artificial Sequence
  Synthetic oligonucleotide
accaccatcgcggtccagcccaccaactcgcgccc

SEQ ID NO: 104740 - DNA, 33 bp, Artificial Sequence
  Synthetic oligonucleotide
accacgtctcccatccactgctgctcatcctcg

SEQ ID NO: 104741 - DNA, 35 bp, Artificial Sequence
  Synthetic oligonucleotide
gtcccgctcccaggttatcctgctttaacgccttc

SEQ ID NO: 104742 - DNA, 37 bp, Artificial Sequence
  Synthetic oligonucleotide
gccatgcctccatctgctccacctacttgccccgtga

SEQ ID NO: 104743 - DNA, 37 bp, Artificial Sequence
  Synthetic oligonucleotide
gtgcacgtcgcaggtcctagtttccgccgctccccga

SEQ ID NO: 104744 - DNA, 35 bp, Artificial Sequence
  Synthetic oligonucleotide
ttccccccgccagctgctaaaacgtcctgcaattc

SEQ ID NO: 104745 - DNA, 35 bp, Artificial Sequence
  Synthetic oligonucleotide
agtacgccgttgccgccttccgacacactcttcca

SEQ ID NO: 104746 - DNA, 35 bp, Artificial Sequence
  Synthetic oligonucleotide
gtgccgggggggggagaagggtggattcggagggt

SEQ ID NO: 104747 - DNA, 35 bp, Artificial Sequence
  Synthetic oligonucleotide
gatacgcgcctatgtctccaccactaccctctctt

SEQ ID NO: 104748 - DNA, 38 bp, Artificial Sequence
  Synthetic oligonucleotide
tcctgcctccccccgcattaccactgtcatgtacatga

SEQ ID NO: 104749 - DNA, 36 bp, Artificial Sequence
  Synthetic oligonucleotide
aacctccgccctgttacgttactgatactgcctcca

SEQ ID NO: 104750 - DNA, 37 bp, Artificial Sequence
  Synthetic oligonucleotide
ttggtacagggggcaagaggagaggggagatgggaga

SEQ ID NO: 104751 - DNA, 35 bp, Artificial Sequence
  Synthetic oligonucleotide
tgaccccctgttgcgatcccggcccatgtacatcc

SEQ ID NO: 104752 - DNA, 36 bp, Artificial Sequence
  Synthetic oligonucleotide
acgaccctcgcccacatgcccgttactgcaattcga

SEQ ID NO: 104753 - DNA, 38 bp, Artificial Sequence
  Synthetic oligonucleotide
gaagggggagtggggggagcagaaggggcggtgagtga

SEQ ID NO: 104754 - DNA, 37 bp, Artificial Sequence
  Synthetic oligonucleotide
tgccatccctccgctgtccaagtgcctctccgctcga

SEQ ID NO: 104755 - DNA, 36 bp, Artificial Sequence
  Synthetic oligonucleotide
tcgaagcctacgatccgcataggtcccgcctcccca

SEQ ID NO: 104756 - DNA, 35 bp, Artificial Sequence
  Synthetic oligonucleotide
gacgtcgcccgccctgtttctgtcttaacgttgta

SEQ ID NO: 104757 - DNA, 35 bp, Artificial Sequence
  Synthetic oligonucleotide
acctccacgcccctgtacactcatcacggtcttac

SEQ ID NO: 104758 - DNA, 35 bp, Artificial Sequence
  Synthetic oligonucleotide
tccacggtcagtgccactcgtaatggcctccctcc

SEQ ID NO: 104759 - DNA, 35 bp, Artificial Sequence
  Synthetic oligonucleotide
gtatccctgctatctctcgtcgaccctctgctgtc

SEQ ID NO: 104760 - DNA, 35 bp, Artificial Sequence
  Synthetic oligonucleotide
gtcccgtccttgctccctcgcctcggtcctaccgt

SEQ ID NO: 104761 - DNA, 36 bp, Artificial Sequence
  Synthetic oligonucleotide
agcagagccacaccgctttccgcctgctcccttgta

SEQ ID NO: 104762 - DNA, 35 bp, Artificial Sequence
  Synthetic oligonucleotide
gcaccagccaccgatacggctattgttctcctctc

SEQ ID NO: 104763 - DNA, 35 bp, Artificial Sequence
  Synthetic oligonucleotide
acacacgcctgagccccgctggatcctccgccccc

SEQ ID NO: 104764 - DNA, 35 bp, Artificial Sequence
  Synthetic oligonucleotide
gacccctctcacgcacggacccgcttcctttagag

SEQ ID NO: 104765 - DNA, 35 bp, Artificial Sequence
  Synthetic oligonucleotide
acccccacacgcccccatgtttcttccaacgacgc

SEQ ID NO: 104766 - DNA, 34 bp, Artificial Sequence
  Synthetic oligonucleotide
tgcacgtgcgtacattcctgttttctcgtcctac

SEQ ID NO: 104767 - DNA, 35 bp, Artificial Sequence
  Synthetic oligonucleotide
tgtacccatcccgaggtggaagcccacccatctct

SEQ ID NO: 104768 - DNA, 35 bp, Artificial Sequence
  Synthetic oligonucleotide
tcactcccccgcgctccttgtaccgttgccatcca

SEQ ID NO: 104769 - DNA, 35 bp, Artificial Sequence
  Synthetic oligonucleotide
gttacctcctccgttggacactcctatatgtttgc

SEQ ID NO: 104770 - DNA, 36 bp, Artificial Sequence
  Synthetic oligonucleotide
gtcaccccttgtctgttacgttcgcctgttccttca

SEQ ID NO: 104771 - DNA, 35 bp, Artificial Sequence
  Synthetic oligonucleotide
acctcccgcccgcctcattctcgcactaagacctc

SEQ ID NO: 104772 - DNA, 35 bp, Artificial Sequence
  Synthetic oligonucleotide
gttcgccatcagttttccagcctcgtccatcgctc

SEQ ID NO: 104773 - DNA, 35 bp, Artificial Sequence
  Synthetic oligonucleotide
tcctgcatgtaactgtccaagctgcaccactcttc

SEQ ID NO: 104774 - DNA, 36 bp, Artificial Sequence
  Synthetic oligonucleotide
acccaccatcaagttctcttcatcccaggccccgca

SEQ ID NO: 104775 - DNA, 36 bp, Artificial Sequence
  Synthetic oligonucleotide
agaccctgccattccgtatctgtccgttctcctcta

SEQ ID NO: 104776 - DNA, 35 bp, Artificial Sequence
  Synthetic oligonucleotide
accacggccgttatagcacgccaccattcccctgt

SEQ ID NO: 104777 - DNA, 35 bp, Artificial Sequence
  Synthetic oligonucleotide
tccaggcacgcagcccccctcctcttgtgccggtt

SEQ ID NO: 104778 - DNA, 35 bp, Artificial Sequence
  Synthetic oligonucleotide
gtcgttcgctccggtattcgtccctgctcctccgt

SEQ ID NO: 104779 - DNA, 35 bp, Artificial Sequence
  Synthetic oligonucleotide
taactccacgccgcccattatgaccctgcctgccc

SEQ ID NO: 104780 - DNA, 35 bp, Artificial Sequence
  Synthetic oligonucleotide
accactgccatggcttgagccccagttcccccact

SEQ ID NO: 104781 - DNA, 36 bp, Artificial Sequence
  Synthetic oligonucleotide
gattaagtcgggacgggaattgggagggagggagca

SEQ ID NO: 104782 - DNA, 35 bp, Artificial Sequence
  Synthetic oligonucleotide
tcacgccacttcgcccccgccgtacctcatgcttg

SEQ ID NO: 104783 - DNA, 37 bp, Artificial Sequence
  Synthetic oligonucleotide
gaagggactagggggacgaggggcaagggcaaagcga

SEQ ID NO: 104784 - DNA, 35 bp, Artificial Sequence
  Synthetic oligonucleotide
tcccgcccacacctccagttcccaaccagtcctgt

SEQ ID NO: 104785 - DNA, 35 bp, Artificial Sequence
  Synthetic oligonucleotide
gcattgcaccatccgaccgtaccgcatgtcctcca

SEQ ID NO: 104786 - DNA, 35 bp, Artificial Sequence
  Synthetic oligonucleotide
tcgagagcacctcctgcctgtaccctcttctgtca

SEQ ID NO: 104787 - DNA, 35 bp, Artificial Sequence
  Synthetic oligonucleotide
gactcacatcgcgctaccccgtgctccgcctttaa

SEQ ID NO: 104788 - DNA, 35 bp, Artificial Sequence
  Synthetic oligonucleotide
acttccccacccgccgcgatggacttcccttgccc

SEQ ID NO: 104789 - DNA, 36 bp, Artificial Sequence
  Synthetic oligonucleotide
agtgcgcccgcatcctgtccgagtcaacccccgcca

SEQ ID NO: 104790 - DNA, 37 bp, Artificial Sequence
  Synthetic oligonucleotide
atgcccacatccgctgcttttcgtatccctgcctcga

SEQ ID NO: 104791 - DNA, 35 bp, Artificial Sequence
  Synthetic oligonucleotide
agtcctccgccccgtgtcctcagtcgcgtctcccc

SEQ ID NO: 104792 - DNA, 37 bp, Artificial Sequence
  Synthetic oligonucleotide
gaagagaggtgggagggaactggggaggacggagtga

SEQ ID NO: 104793 - DNA, 36 bp, Artificial Sequence
  Synthetic oligonucleotide
atggtgccaccgacgctattctgttatcctctccga

SEQ ID NO: 104794 - DNA, 35 bp, Artificial Sequence
  Synthetic oligonucleotide
tttgcgcaattgcctgctgccatcgaccatttatc

SEQ ID NO: 104795 - DNA, 35 bp, Artificial Sequence
  Synthetic oligonucleotide
gcactgctacctctattgtcatcccccgggttacc

SEQ ID NO: 104796 - DNA, 35 bp, Artificial Sequence
  Synthetic oligonucleotide
tcccgcaacctcccgcccgcttacgtgtactatcc

SEQ ID NO: 104797 - DNA, 35 bp, Artificial Sequence
  Synthetic oligonucleotide
tcacccaccccttaatgatgcttggttcccatcct

SEQ ID NO: 104798 - DNA, 35 bp, Artificial Sequence
  Synthetic oligonucleotide
gcctcacaccccccgcgccacctagcacagctacg

SEQ ID NO: 104799 - DNA, 36 bp, Artificial Sequence
  Synthetic oligonucleotide
tgccaacttcgcccgtctactatcaacctgctccca

SEQ ID NO: 104800 - DNA, 35 bp, Artificial Sequence
  Synthetic oligonucleotide
tccccgccaccgccccactgtcacctcgggcttta

SEQ ID NO: 104801 - DNA, 35 bp, Artificial Sequence
  Synthetic oligonucleotide
gctgccccaccgctgcttcgtgtccttatcttccg

SEQ ID NO: 104802 - DNA, 35 bp, Artificial Sequence
  Synthetic oligonucleotide
tcgccccgcttatgactcgcgtatcgctccacccc

SEQ ID NO: 104803 - DNA, 35 bp, Artificial Sequence
  Synthetic oligonucleotide
gcacggtacaccttccgtactcgactcgctccccc

SEQ ID NO: 104804 - DNA, 31 bp, Artificial Sequence
  Synthetic oligonucleotide
tacttccgcgctctcccctcgattcaccgca

SEQ ID NO: 104805 - DNA, 35 bp, Artificial Sequence
  Synthetic oligonucleotide
tagcattgcccatatctccagcgctccctcctgtc

SEQ ID NO: 104806 - DNA, 35 bp, Artificial Sequence
  Synthetic oligonucleotide
ttaccagtgccagcgcctcgccttcccacgctgcc

SEQ ID NO: 104807 - DNA, 35 bp, Artificial Sequence
  Synthetic oligonucleotide
gccatcccctgcctttctgccatctgtgacaactt

SEQ ID NO: 104808 - DNA, 35 bp, Artificial Sequence
  Synthetic oligonucleotide
cgaccgaacccacaaccccactcgtgataagccgc

SEQ ID NO: 104809 - DNA, 35 bp, Artificial Sequence
  Synthetic oligonucleotide
acatcatgtccgccctgccactttccgtctatcat

SEQ ID NO: 104810 - DNA, 35 bp, Artificial Sequence
  Synthetic oligonucleotide
tggaggggatcacgttgttggggcgatgggcgggg

SEQ ID NO: 104811 - DNA, 35 bp, Artificial Sequence
  Synthetic oligonucleotide
tagcaatagccccccatgtctgccatccgccattg

SEQ ID NO: 104812 - DNA, 35 bp, Artificial Sequence
  Synthetic oligonucleotide
tacacccgtgtaacgtcgcgtagagcacccgcctc

SEQ ID NO: 104813 - DNA, 35 bp, Artificial Sequence
  Synthetic oligonucleotide
acatgcgggccacacgctattccacccattcttgc

SEQ ID NO: 104814 - DNA, 35 bp, Artificial Sequence
  Synthetic oligonucleotide
gacaccgccctccgttccgttcatcccatttgttc

SEQ ID NO: 104815 - DNA, 35 bp, Artificial Sequence
  Synthetic oligonucleotide
tcataccaccccctgctgactatcggtaatacttt

SEQ ID NO: 104816 - DNA, 36 bp, Artificial Sequence
  Synthetic oligonucleotide
tcagccacccgcccaagttctcccatagcgccccca

SEQ ID NO: 104817 - DNA, 35 bp, Artificial Sequence
  Synthetic oligonucleotide
tgcccacccgacccacatgctagcacctcgttttg

SEQ ID NO: 104818 - DNA, 35 bp, Artificial Sequence
  Synthetic oligonucleotide
gcctcaggtaccctgcctcactgctttgtcacctc

SEQ ID NO: 104819 - DNA, 35 bp, Artificial Sequence
  Synthetic oligonucleotide
ttggtacgccgccgttactctaagccctcccttat

SEQ ID NO: 104820 - DNA, 35 bp, Artificial Sequence
  Synthetic oligonucleotide
gggataacgggaacgggggggctaagggggctctg

SEQ ID NO: 104821 - DNA, 35 bp, Artificial Sequence
  Synthetic oligonucleotide
gagtgaggagggtggtgtgactggaggatggtgcg

SEQ ID NO: 104822 - DNA, 35 bp, Artificial Sequence
  Synthetic oligonucleotide
acgactgccgctccatctctaggtactgcatctct

SEQ ID NO: 104823 - DNA, 35 bp, Artificial Sequence
  Synthetic oligonucleotide
ttgtcgcacctcaccgtttccgcctccaccccggc

SEQ ID NO: 104824 - DNA, 35 bp, Artificial Sequence
  Synthetic oligonucleotide
gcatcacccgctccttggcttaaacgagtgccccc

SEQ ID NO: 104825 - DNA, 35 bp, Artificial Sequence
  Synthetic oligonucleotide
tagggggagcaggtggggtcgagtgggtggccctc

SEQ ID NO: 104826 - DNA, 35 bp, Artificial Sequence
  Synthetic oligonucleotide
gatcatgtcagtccgcgttccccctctctaccccg

SEQ ID NO: 104827 - DNA, 35 bp, Artificial Sequence
  Synthetic oligonucleotide
ttcgtgccccatcactagcttatttgccgatctct

SEQ ID NO: 104828 - DNA, 35 bp, Artificial Sequence
  Synthetic oligonucleotide
gctgagccgccgccctctgttaaattttcgatcgc

SEQ ID NO: 104829 - DNA, 37 bp, Artificial Sequence
  Synthetic oligonucleotide
tcactcgccactattcgccgccacacgcctaccggga

SEQ ID NO: 104830 - DNA, 33 bp, Artificial Sequence
  Synthetic oligonucleotide
tagcccaccccacgactctgctatcaatgaacc

SEQ ID NO: 104831 - DNA, 35 bp, Artificial Sequence
  Synthetic oligonucleotide
ttcgatcccgctgtccagttctgtccccgtccgcc

SEQ ID NO: 104832 - DNA, 35 bp, Artificial Sequence
  Synthetic oligonucleotide
gtccaccctgccatccggtaccctaccctctcgtg

SEQ ID NO: 104833 - DNA, 37 bp, Artificial Sequence
  Synthetic oligonucleotide
tagccacaccgccctgtcatagtttcatcctgtccga

SEQ ID NO: 104834 - DNA, 35 bp, Artificial Sequence
  Synthetic oligonucleotide
tagacccatgccgccagctcacaccctgctttccg

SEQ ID NO: 104835 - DNA, 35 bp, Artificial Sequence
  Synthetic oligonucleotide
gtccgcggccgccctgtcccctcgtacctttgccg

SEQ ID NO: 104836 - DNA, 35 bp, Artificial Sequence
  Synthetic oligonucleotide
tagaagccgtcaccccgtccgccgcttccgccctg

SEQ ID NO: 104837 - DNA, 35 bp, Artificial Sequence
  Synthetic oligonucleotide
ttagccctggcctcatctatctccgaccacgttct

SEQ ID NO: 104838 - DNA, 35 bp, Artificial Sequence
  Synthetic oligonucleotide
gttgcaaagatgcgcctgcctccgcctacacctgc

SEQ ID NO: 104839 - DNA, 35 bp, Artificial Sequence
  Synthetic oligonucleotide
gaaccatctgtccctattgcacaacgacccccgca

SEQ ID NO: 104840 - DNA, 37 bp, Artificial Sequence
  Synthetic oligonucleotide
agtggtaagcaaggggtggaaggaaggggcggtggga

SEQ ID NO: 104841 - DNA, 35 bp, Artificial Sequence
  Synthetic oligonucleotide
gtaccagcgcgctcattgagctaccccccccaccc

SEQ ID NO: 104842 - DNA, 35 bp, Artificial Sequence
  Synthetic oligonucleotide
gttatccatccgctggtcttgaggaccttccacct

SEQ ID NO: 104843 - DNA, 29 bp, Artificial Sequence
  Synthetic oligonucleotide
tccgcactgccaccttgatcaccatctgt

SEQ ID NO: 104844 - DNA, 35 bp, Artificial Sequence
  Synthetic oligonucleotide
tgcgccatcccactgtcaaatgcactccttccgcc

SEQ ID NO: 104845 - DNA, 36 bp, Artificial Sequence
  Synthetic oligonucleotide
acctctccaccgccgcccccatcggtacccccggta

SEQ ID NO: 104846 - DNA, 35 bp, Artificial Sequence
  Synthetic oligonucleotide
acaccaccgccttggctccaacgatcatggtccct

SEQ ID NO: 104847 - DNA, 35 bp, Artificial Sequence
  Synthetic oligonucleotide
ttctcccgctcccaccccatgcctccgttcctggt

SEQ ID NO: 104848 - DNA, 35 bp, Artificial Sequence
  Synthetic oligonucleotide
tgccctccccctatcgtttattctgcctttgtttg

SEQ ID NO: 104849 - DNA, 35 bp, Artificial Sequence
  Synthetic oligonucleotide
gccccctctcgccctctcgtgtctaatgccctgta

SEQ ID NO: 104850 - DNA, 36 bp, Artificial Sequence
  Synthetic oligonucleotide
agatacgtccgctgctgccttacttccttccgccgc

SEQ ID NO: 104851 - DNA, 38 bp, Artificial Sequence
  Synthetic oligonucleotide
acacgccgccatctctggtacctgccgcccacttttga

SEQ ID NO: 104852 - DNA, 35 bp, Artificial Sequence
  Synthetic oligonucleotide
ttgtcatgcagtcacgttcccgtaccaccctgctg

SEQ ID NO: 104853 - DNA, 35 bp, Artificial Sequence
  Synthetic oligonucleotide
gccccgacagaccatggcacctccctctcgctcgc

SEQ ID NO: 104854 - DNA, 37 bp, Artificial Sequence
  Synthetic oligonucleotide
gtgattcgcctccgctatatgctctcgccctcctgga

SEQ ID NO: 104855 - DNA, 34 bp, Artificial Sequence
  Synthetic oligonucleotide
tgtgcacccgccttaccctgcttcctaccagtta

SEQ ID NO: 104856 - DNA, 35 bp, Artificial Sequence
  Synthetic oligonucleotide
gatcacctcgccgtttttctgccgacaattcccca

SEQ ID NO: 104857 - DNA, 35 bp, Artificial Sequence
  Synthetic oligonucleotide
gacacatccgcgcccaccatgtgcgttcacccccc

SEQ ID NO: 104858 - DNA, 35 bp, Artificial Sequence
  Synthetic oligonucleotide
gaccacgccatttcttatcccgaaccacccgttgc

SEQ ID NO: 104859 - DNA, 36 bp, Artificial Sequence
  Synthetic oligonucleotide
aatgggtgtggtgggggggtcattgtagcggacgga

SEQ ID NO: 104860 - DNA, 35 bp, Artificial Sequence
  Synthetic oligonucleotide
tcacactcttacgcctcctgcccccaggctacgcc

SEQ ID NO: 104861 - DNA, 35 bp, Artificial Sequence
  Synthetic oligonucleotide
tgccaattcccgagtgcatcgtgcctagccgcccc

SEQ ID NO: 104862 - DNA, 36 bp, Artificial Sequence
  Synthetic oligonucleotide
tcccccgctccggttttctgcctcctgtacccggta

SEQ ID NO: 104863 - DNA, 35 bp, Artificial Sequence
  Synthetic oligonucleotide
gaccactccaccaccgccatgggattgcgcccttc

SEQ ID NO: 104864 - DNA, 35 bp, Artificial Sequence
  Synthetic oligonucleotide
ttccccaccgcgctcgtcgtcgcattacactcccc

SEQ ID NO: 104865 - DNA, 37 bp, Artificial Sequence
  Synthetic oligonucleotide
gtaacacgcacccattggcctcactctaccctgtcga

SEQ ID NO: 104866 - DNA, 35 bp, Artificial Sequence
  Synthetic oligonucleotide
acctccgccctgaagctcaaggttcaccactccct

SEQ ID NO: 104867 - DNA, 35 bp, Artificial Sequence
  Synthetic oligonucleotide
acgtcaacccagcttactccctggcctgttctatc

SEQ ID NO: 104868 - DNA, 36 bp, Artificial Sequence
  Synthetic oligonucleotide
tctggacggctggtagtggggaggtgggaggataca

SEQ ID NO: 104869 - DNA, 34 bp, Artificial Sequence
  Synthetic oligonucleotide
ttgcccccagttctccgatcgcttgcacaccacc

SEQ ID NO: 104870 - DNA, 36 bp, Artificial Sequence
  Synthetic oligonucleotide
tgccaccgcctgcgctgccccccttcgaactatgca

SEQ ID NO: 104871 - DNA, 35 bp, Artificial Sequence
  Synthetic oligonucleotide
tagacgcgctccatttgctcctttcgttcgccccc

SEQ ID NO: 104872 - DNA, 34 bp, Artificial Sequence
  Synthetic oligonucleotide
gacccacagccgccggcccttcgacgtacgcccc

SEQ ID NO: 104873 - DNA, 35 bp, Artificial Sequence
  Synthetic oligonucleotide
tgagtcccgccattgcgtcatttttctcgtccatc

SEQ ID NO: 104874 - DNA, 37 bp, Artificial Sequence
  Synthetic oligonucleotide
tcgagccctcaccatctgcccctcgctctacacagga

SEQ ID NO: 104875 - DNA, 35 bp, Artificial Sequence
  Synthetic oligonucleotide
cccgcctcctttgcacgattagcaaccgctcttac

SEQ ID NO: 104876 - DNA, 36 bp, Artificial Sequence
  Synthetic oligonucleotide
tgacgtcagttccgccccaccgcacccatccgttga

SEQ ID NO: 104877 - DNA, 35 bp, Artificial Sequence
  Synthetic oligonucleotide
ggtaccgctgcccttcctgtccgtctttaatgtac

SEQ ID NO: 104878 - DNA, 35 bp, Artificial Sequence
  Synthetic oligonucleotide
atcacgcccattactgtccccctcgcatggtgctc

SEQ ID NO: 104879 - DNA, 38 bp, Artificial Sequence
  Synthetic oligonucleotide
gttcgagcgcccggtttccgttactgcccgccccttga

SEQ ID NO: 104880 - DNA, 35 bp, Artificial Sequence
  Synthetic oligonucleotide
gccccgagcctcctgctcgttatcgtgccctctac

SEQ ID NO: 104881 - DNA, 37 bp, Artificial Sequence
  Synthetic oligonucleotide
gactgtccaccctgctcagtgcctctcctatccagga

SEQ ID NO: 104882 - DNA, 35 bp, Artificial Sequence
  Synthetic oligonucleotide
atccacccccgctgatgaatacggctcaattcatc

SEQ ID NO: 104883 - DNA, 35 bp, Artificial Sequence
  Synthetic oligonucleotide
tccgattcaccatcctgcctgtaacctccagtagc

SEQ ID NO: 104884 - DNA, 35 bp, Artificial Sequence
  Synthetic oligonucleotide
tcacgccctcatggcattcgctcacctctcaacac

SEQ ID NO: 104885 - DNA, 37 bp, Artificial Sequence
  Synthetic oligonucleotide
ggggagaggagggacgggaggattagggaacggtgga

SEQ ID NO: 104886 - DNA, 36 bp, Artificial Sequence
  Synthetic oligonucleotide
gagagggggagggttaggggcactggggatacacct

SEQ ID NO: 104887 - DNA, 35 bp, Artificial Sequence
  Synthetic oligonucleotide
tcccgtgcgccgccattcttcatctttccgtggcc

SEQ ID NO: 104888 - DNA, 35 bp, Artificial Sequence
  Synthetic oligonucleotide
tacggcccaatgctgccaccacgcctccaccaccg

SEQ ID NO: 104889 - DNA, 35 bp, Artificial Sequence
  Synthetic oligonucleotide
gtgcacatcccgccgctgttaaatcctcgccctgg

SEQ ID NO: 104890 - DNA, 35 bp, Artificial Sequence
  Synthetic oligonucleotide
taagcaaccgctgcccgcctagtgccacaccatct

SEQ ID NO: 104891 - DNA, 32 bp, Artificial Sequence
  Synthetic oligonucleotide
tccacgcatcgtgctcgcccctgtctacccgg

SEQ ID NO: 104892 - DNA, 35 bp, Artificial Sequence
  Synthetic oligonucleotide
tacaatgcacctcagcaatctgctgcaccccgtac

SEQ ID NO: 104893 - DNA, 35 bp, Artificial Sequence
  Synthetic oligonucleotide
tatccaccctctcgctgtcctattaatcagtcatc

SEQ ID NO: 104894 - DNA, 35 bp, Artificial Sequence
  Synthetic oligonucleotide
agggaccgtccacggtcagctcctccactttgtac

SEQ ID NO: 104895 - DNA, 35 bp, Artificial Sequence
  Synthetic oligonucleotide
tgaccgcacgccacactccatcgccctccatcgtc

SEQ ID NO: 104896 - DNA, 35 bp, Artificial Sequence
  Synthetic oligonucleotide
acgtgccaccgcacccttggtctctttccccctgg

SEQ ID NO: 104897 - DNA, 35 bp, Artificial Sequence
  Synthetic oligonucleotide
gccctgccaccgacctacttaacagcgcttctcac

SEQ ID NO: 104898 - DNA, 35 bp, Artificial Sequence
  Synthetic oligonucleotide
ttctgcccccagccctgctagcgctatcgctccac

SEQ ID NO: 104899 - DNA, 35 bp, Artificial Sequence
  Synthetic oligonucleotide
gaccccccgccgtgattaaccacacacgaatccct

SEQ ID NO: 104900 - DNA, 35 bp, Artificial Sequence
  Synthetic oligonucleotide
gagggggggaccggggagggttgcaagtgcagtgc

SEQ ID NO: 104901 - DNA, 35 bp, Artificial Sequence
  Synthetic oligonucleotide
acgtgcctgagtccagatccactgccgcccgccct

SEQ ID NO: 104902 - DNA, 35 bp, Artificial Sequence
  Synthetic oligonucleotide
tccgctccccgccccatttctatgccagacgcctt

SEQ ID NO: 104903 - DNA, 37 bp, Artificial Sequence
  Synthetic oligonucleotide
tgaaaggtgggaaaggggctgaagggacgggtgcgga

SEQ ID NO: 104904 - DNA, 35 bp, Artificial Sequence
  Synthetic oligonucleotide
aactacgcccccctgtgtcttccgcccgttaatcc

SEQ ID NO: 104905 - DNA, 35 bp, Artificial Sequence
  Synthetic oligonucleotide
gaggcacaacactgcacacccgccatgcccccgcc

SEQ ID NO: 104906 - DNA, 35 bp, Artificial Sequence
  Synthetic oligonucleotide
gacccatgccccacgtctgcctacatttctctctg

SEQ ID NO: 104907 - DNA, 33 bp, Artificial Sequence
  Synthetic oligonucleotide
tcctccgccgcaccatttcctactcgtgcttca

SEQ ID NO: 104908 - DNA, 36 bp, Artificial Sequence
  Synthetic oligonucleotide
agagggtgggatgggacaaggggggaggatgggaga

SEQ ID NO: 104909 - DNA, 35 bp, Artificial Sequence
  Synthetic oligonucleotide
tgcaaccctcaacccggtccgaccgcccacctggc

SEQ ID NO: 104910 - DNA, 35 bp, Artificial Sequence
  Synthetic oligonucleotide
gcccagccgcccaccgctccctttttagaccctct

SEQ ID NO: 104911 - DNA, 37 bp, Artificial Sequence
  Synthetic oligonucleotide
gatggagtgaggggaatagggaggttcaagggggaga

SEQ ID NO: 104912 - DNA, 35 bp, Artificial Sequence
  Synthetic oligonucleotide
gccacccactcggccttcacgaacgccatcctgcc

SEQ ID NO: 104913 - DNA, 35 bp, Artificial Sequence
  Synthetic oligonucleotide
gtttgccgtctctcagttggtcccctgttcttttc

SEQ ID NO: 104914 - DNA, 37 bp, Artificial Sequence
  Synthetic oligonucleotide
tccatcaccccgctgagaatgttagcctcccccccga

SEQ ID NO: 104915 - DNA, 37 bp, Artificial Sequence
  Synthetic oligonucleotide
tctggagtgaaaggaaggggggggcggagggagcgga

SEQ ID NO: 104916 - DNA, 36 bp, Artificial Sequence
  Synthetic oligonucleotide
gtacccgcccatcatgtcccaccaggcctcatgcta

SEQ ID NO: 104917 - DNA, 35 bp, Artificial Sequence
  Synthetic oligonucleotide
gtgcactccgcccgccccacccagaccaggttaca

SEQ ID NO: 104918 - DNA, 35 bp, Artificial Sequence
  Synthetic oligonucleotide
tcgcgacccctccttgtactacgcctccgtgcttg

SEQ ID NO: 104919 - DNA, 35 bp, Artificial Sequence
  Synthetic oligonucleotide
gacgccgttgagctcccgcgtggctcccttccacc

SEQ ID NO: 104920 - DNA, 35 bp, Artificial Sequence
  Synthetic oligonucleotide
agacaaccgggtcgggtgggatcgggacatacacg

SEQ ID NO: 104921 - DNA, 35 bp, Artificial Sequence
  Synthetic oligonucleotide
gcgaagacattgggggagggacgggtgggcaggtg

SEQ ID NO: 104922 - DNA, 35 bp, Artificial Sequence
  Synthetic oligonucleotide
gatgggaacggggggactgggaatgaaggtgtagg

SEQ ID NO: 104923 - DNA, 36 bp, Artificial Sequence
  Synthetic oligonucleotide
gacaccagcctgcacctttcctttgcccatcgcgga

SEQ ID NO: 104924 - DNA, 37 bp, Artificial Sequence
  Synthetic oligonucleotide
gcaaatggagggtggggctaaggggggaggatatgga

SEQ ID NO: 104925 - DNA, 36 bp, Artificial Sequence
  Synthetic oligonucleotide
ggtgtgcgggaggaagaaagggggatgaaaacggca

SEQ ID NO: 104926 - DNA, 35 bp, Artificial Sequence
  Synthetic oligonucleotide
gatcgcctcagcccgtattcccttctccctgttga

SEQ ID NO: 104927 - DNA, 35 bp, Artificial Sequence
  Synthetic oligonucleotide
acaccctcacctgtcacctcgtcttgcattactcg

SEQ ID NO: 104928 - DNA, 36 bp, Artificial Sequence
  Synthetic oligonucleotide
tagcgcatctatgccctccgtttcagccccccccca

SEQ ID NO: 104929 - DNA, 29 bp, Artificial Sequence
  Synthetic oligonucleotide
gttcccgcctgcccggtaccaaccttaac

SEQ ID NO: 104930 - DNA, 35 bp, Artificial Sequence
  Synthetic oligonucleotide
tcaccccccgctctgttccggttactactgtgccg

SEQ ID NO: 104931 - DNA, 37 bp, Artificial Sequence
  Synthetic oligonucleotide
tgaggaggggagaaggagcggagagggcaagtggtga

SEQ ID NO: 104932 - DNA, 35 bp, Artificial Sequence
  Synthetic oligonucleotide
acgtgcacgcacacgctttaccctgcatcaccgcc

SEQ ID NO: 104933 - DNA, 35 bp, Artificial Sequence
  Synthetic oligonucleotide
tttcccgccgacgcccaccgctccatgtactgtcc

SEQ ID NO: 104934 - DNA, 37 bp, Artificial Sequence
  Synthetic oligonucleotide
tgtaccgcccgccctcacgctccacaagtcccgtgga

SEQ ID NO: 104935 - DNA, 35 bp, Artificial Sequence
  Synthetic oligonucleotide
tgaaccaccctcgttaccacgccgcttttgtactc

SEQ ID NO: 104936 - DNA, 37 bp, Artificial Sequence
  Synthetic oligonucleotide
aacggggaggagggtacgggaaaggagctggtagaga

SEQ ID NO: 104937 - DNA, 35 bp, Artificial Sequence
  Synthetic oligonucleotide
tcatccctgtccttgtctctaccctgtgattctcg

SEQ ID NO: 104938 - DNA, 35 bp, Artificial Sequence
  Synthetic oligonucleotide
tagcccaccgcctccaatgtcctttcgaatccggt

SEQ ID NO: 104939 - DNA, 35 bp, Artificial Sequence
  Synthetic oligonucleotide
ttccctgccctcactgccgcctggccctggccatt

SEQ ID NO: 104940 - DNA, 35 bp, Artificial Sequence
  Synthetic oligonucleotide
acgccctctgcccgtgcactttcgcagctacgctc

SEQ ID NO: 104941 - DNA, 35 bp, Artificial Sequence
  Synthetic oligonucleotide
ggaagagggaggaggcgggaggcggtgggtggtct

SEQ ID NO: 104942 - DNA, 35 bp, Artificial Sequence
  Synthetic oligonucleotide
tgccccgccacgtttcccaggttatcgcccagccc

SEQ ID NO: 104943 - DNA, 37 bp, Artificial Sequence
  Synthetic oligonucleotide
acccgcggtggggtcgtgggggattgcttttggggga

SEQ ID NO: 104944 - DNA, 36 bp, Artificial Sequence
  Synthetic oligonucleotide
gaggagggacggaggaggtggtgcggtgggtaatca

SEQ ID NO: 104945 - DNA, 35 bp, Artificial Sequence
  Synthetic oligonucleotide
gattcgcccccatgatctggctcccaggcctctac

SEQ ID NO: 104946 - DNA, 35 bp, Artificial Sequence
  Synthetic oligonucleotide
gacgccgccctgccagatcaagccactcacccccc

SEQ ID NO: 104947 - DNA, 35 bp, Artificial Sequence
  Synthetic oligonucleotide
gtgatcccgcatatttgactcaaagcctggcccct

SEQ ID NO: 104948 - DNA, 35 bp, Artificial Sequence
  Synthetic oligonucleotide
tgtccacccgacagccctcttccatctcccgcgca

SEQ ID NO: 104949 - DNA, 36 bp, Artificial Sequence
  Synthetic oligonucleotide
gcacgccctcattgtttgccccctgtccgtcgataa

SEQ ID NO: 104950 - DNA, 34 bp, Artificial Sequence
  Synthetic oligonucleotide
gcacagatcgcccgctgtccttgttaacctatcg

SEQ ID NO: 104951 - DNA, 35 bp, Artificial Sequence
  Synthetic oligonucleotide
tttacaccatccgtacgggcattcacctgccatct

SEQ ID NO: 104952 - DNA, 34 bp, Artificial Sequence
  Synthetic oligonucleotide
ttccgcaccctccctgttatcttcttccgtgcga

SEQ ID NO: 104953 - DNA, 35 bp, Artificial Sequence
  Synthetic oligonucleotide
acctcctgccgaacgtgcctcatgaaccatcttac

SEQ ID NO: 104954 - DNA, 37 bp, Artificial Sequence
  Synthetic oligonucleotide
tgagagaggggccgaaaggggaagaagcgaagggaga

SEQ ID NO: 104955 - DNA, 36 bp, Artificial Sequence
  Synthetic oligonucleotide
gccccgcctccgtcacaccgccagccccgccctcca

SEQ ID NO: 104956 - DNA, 35 bp, Artificial Sequence
  Synthetic oligonucleotide
tccacacagccgttccgcttactgccctcccgctg

SEQ ID NO: 104957 - DNA, 37 bp, Artificial Sequence
  Synthetic oligonucleotide
ggggggaggaagaggaagcataggaaaacggaggcga

SEQ ID NO: 104958 - DNA, 35 bp, Artificial Sequence
  Synthetic oligonucleotide
tccccgttccgctagcaagtgcctttccttccgtc

SEQ ID NO: 104959 - DNA, 35 bp, Artificial Sequence
  Synthetic oligonucleotide
taggttcggcgccaacgtacccccccctcccatgt

SEQ ID NO: 104960 - DNA, 35 bp, Artificial Sequence
  Synthetic oligonucleotide
tcagtcccagcgcgccccttgccaaccacgccctt

SEQ ID NO: 104961 - DNA, 25 bp, Artificial Sequence
  Synthetic oligonucleotide
gagtcctcgcaaaccgctaccacct

SEQ ID NO: 104962 - DNA, 35 bp, Artificial Sequence
  Synthetic oligonucleotide
gcccaggcggtccgcactctgtccacattccttgt

SEQ ID NO: 104963 - DNA, 37 bp, Artificial Sequence
  Synthetic oligonucleotide
tcacctgcccggccgtcgattatgcccgttcctctga

SEQ ID NO: 104964 - DNA, 37 bp, Artificial Sequence
  Synthetic oligonucleotide
aaacgaggagggggtggtcgtgtcaggggagggcgga

SEQ ID NO: 104965 - DNA, 35 bp, Artificial Sequence
  Synthetic oligonucleotide
gtgcaccgcccgccttccgtgaatcggtatattcc

SEQ ID NO: 104966 - DNA, 38 bp, Artificial Sequence
  Synthetic oligonucleotide
gccctccgccgcccatcgctccagccacttcatggtga

SEQ ID NO: 104967 - DNA, 35 bp, Artificial Sequence
  Synthetic oligonucleotide
gaccggttccgcctgagcttttgacgcccccctcc

SEQ ID NO: 104968 - DNA, 35 bp, Artificial Sequence
  Synthetic oligonucleotide
tgtgcaacctcttctgctactggcctctttgcccc

SEQ ID NO: 104969 - DNA, 35 bp, Artificial Sequence
  Synthetic oligonucleotide
ctgccccatcccgtgctacgctccacccttgtaga

SEQ ID NO: 104970 - DNA, 34 bp, Artificial Sequence
  Synthetic oligonucleotide
tagtcgagctaccagccgctccattcccccgttc

SEQ ID NO: 104971 - DNA, 35 bp, Artificial Sequence
  Synthetic oligonucleotide
tagtgaggagggtgggtggggagggaaaacgatgg

SEQ ID NO: 104972 - DNA, 37 bp, Artificial Sequence
  Synthetic oligonucleotide
tcacactccgtatgctccgccctgccgccttctgcga

SEQ ID NO: 104973 - DNA, 35 bp, Artificial Sequence
  Synthetic oligonucleotide
gcccgtccgactcacccgctagtgccttcccgccc

SEQ ID NO: 104974 - DNA, 35 bp, Artificial Sequence
  Synthetic oligonucleotide
tccgcgtcgtccagctccttcctgctcggttttcc

SEQ ID NO: 104975 - DNA, 35 bp, Artificial Sequence
  Synthetic oligonucleotide
acgaccacgctgcccgcccgtcctgtgactccccg

SEQ ID NO: 104976 - DNA, 35 bp, Artificial Sequence
  Synthetic oligonucleotide
tgcgccaccgtaccgatcctatctccacccccgcc

SEQ ID NO: 104977 - DNA, 36 bp, Artificial Sequence
  Synthetic oligonucleotide
acctccccctcgcaccctatacaggcaagccttgcg

SEQ ID NO: 104978 - DNA, 36 bp, Artificial Sequence
  Synthetic oligonucleotide
gagcgggtagcacggggtagggcggtgggggggaca

SEQ ID NO: 104979 - DNA, 35 bp, Artificial Sequence
  Synthetic oligonucleotide
tccaccaccctgttctttaccactgtcgttaactc

SEQ ID NO: 104980 - DNA, 35 bp, Artificial Sequence
  Synthetic oligonucleotide
tcgttccctccatctgttctatcttggctctgcac

SEQ ID NO: 104981 - DNA, 36 bp, Artificial Sequence
  Synthetic oligonucleotide
gtctccgcctgccttgtcctattcctaacctcgttt

SEQ ID NO: 104982 - DNA, 35 bp, Artificial Sequence
  Synthetic oligonucleotide
tccccatcctcatgcacttccggccctacttcgcg

SEQ ID NO: 104983 - DNA, 36 bp, Artificial Sequence
  Synthetic oligonucleotide
tctacacgccgcctgcttctacctaccctccggtca

SEQ ID NO: 104984 - DNA, 35 bp, Artificial Sequence
  Synthetic oligonucleotide
gcctccgaccgtaacacctgcttcacagccctcgc

SEQ ID NO: 104985 - DNA, 35 bp, Artificial Sequence
  Synthetic oligonucleotide
gcccgagcccgatgtgttacaccgccccccattcc

SEQ ID NO: 104986 - DNA, 35 bp, Artificial Sequence
  Synthetic oligonucleotide
tcaccacctcaataccactgtctgcacaccctggc

SEQ ID NO: 104987 - DNA, 35 bp, Artificial Sequence
  Synthetic oligonucleotide
gattcaacggtgtcccccgctcttgtcgccactct

SEQ ID NO: 104988 - DNA, 35 bp, Artificial Sequence
  Synthetic oligonucleotide
tcgcaacattaatgcgcatactgaatgcccccgcc

SEQ ID NO: 104989 - DNA, 35 bp, Artificial Sequence
  Synthetic oligonucleotide
taccctcctgcatcgattgcgcctccccactgccc

SEQ ID NO: 104990 - DNA, 35 bp, Artificial Sequence
  Synthetic oligonucleotide
tgggcctcccacccggtgtaccttcgtgcctgtcc

SEQ ID NO: 104991 - DNA, 35 bp, Artificial Sequence
  Synthetic oligonucleotide
tcccgctccgaccaccccctcgttctactttggac

SEQ ID NO: 104992 - DNA, 35 bp, Artificial Sequence
  Synthetic oligonucleotide
gatgtactcatccggcgcggacccctcgcccgtcc

SEQ ID NO: 104993 - DNA, 35 bp, Artificial Sequence
  Synthetic oligonucleotide
gcactccccgcgccgtatcgacccttacctccgat

SEQ ID NO: 104994 - DNA, 35 bp, Artificial Sequence
  Synthetic oligonucleotide
tcgactacccctgcctgcacgaacgctgcacctcc

SEQ ID NO: 104995 - DNA, 35 bp, Artificial Sequence
  Synthetic oligonucleotide
gcgaggccatccctgcttccactcatgtcgtttcc

SEQ ID NO: 104996 - DNA, 35 bp, Artificial Sequence
  Synthetic oligonucleotide
gccgcccgacgcccataatgtcctagccgccccca

SEQ ID NO: 104997 - DNA, 36 bp, Artificial Sequence
  Synthetic oligonucleotide
tgaccggctccgacctttcctcgattctgcccccga

SEQ ID NO: 104998 - DNA, 35 bp, Artificial Sequence
  Synthetic oligonucleotide
atcaatggggaggaggcgacggggggacggatggg

SEQ ID NO: 104999 - DNA, 35 bp, Artificial Sequence
  Synthetic oligonucleotide
tccaccgccccactgtgacacaactgtctattcat

SEQ ID NO: 105000 - DNA, 36 bp, Artificial Sequence
  Synthetic oligonucleotide
acgtcacacctctgttttgctcctctgccacgctca

SEQ ID NO: 105001 - DNA, 36 bp, Artificial Sequence
  Synthetic oligonucleotide
tccgcgcatctgactacctgacgtcaatcgccccca

SEQ ID NO: 105002 - DNA, 35 bp, Artificial Sequence
  Synthetic oligonucleotide
ttcgcactcgcctagttatcatgctccactaccgt

SEQ ID NO: 105003 - DNA, 35 bp, Artificial Sequence
  Synthetic oligonucleotide
gttgaccaccgctttcccctcccgacgcgattcgc

SEQ ID NO: 105004 - DNA, 35 bp, Artificial Sequence
  Synthetic oligonucleotide
acccacccatgtgtcagttctttccgcctcccgtg

SEQ ID NO: 105005 - DNA, 35 bp, Artificial Sequence
  Synthetic oligonucleotide
gcccgcgaaccggatggctccccgctgtcccccct

SEQ ID NO: 105006 - DNA, 35 bp, Artificial Sequence
  Synthetic oligonucleotide
agacgacgtacatggtctccgtcccctctcacccc

SEQ ID NO: 105007 - DNA, 35 bp, Artificial Sequence
  Synthetic oligonucleotide
ttctgcgccgctgcccgttattaatcctcgtccat

SEQ ID NO: 105008 - DNA, 38 bp, Artificial Sequence
  Synthetic oligonucleotide
gcgagggcggggaggggttgagctgcctatggggctga

SEQ ID NO: 105009 - DNA, 38 bp, Artificial Sequence
  Synthetic oligonucleotide
tacggggtgggtgggtatgtgaggggggtttaacctga

SEQ ID NO: 105010 - DNA, 36 bp, Artificial Sequence
  Synthetic oligonucleotide
gctagggcggggttgttgtttcggggtgttggggat

SEQ ID NO: 105011 - DNA, 35 bp, Artificial Sequence
  Synthetic oligonucleotide
gccaaccaacgtccggacgcgcccttccgcccctt

SEQ ID NO: 105012 - DNA, 35 bp, Artificial Sequence
  Synthetic oligonucleotide
gcgccccccccgcttggaacctaccccacgtccgt

SEQ ID NO: 105013 - DNA, 35 bp, Artificial Sequence
  Synthetic oligonucleotide
tgagcacccccgcacatcgcatatgtctttctccg

SEQ ID NO: 105014 - DNA, 35 bp, Artificial Sequence
  Synthetic oligonucleotide
gcacgcttaccgcctgtcatcgatcgtccctgtcc

SEQ ID NO: 105015 - DNA, 37 bp, Artificial Sequence
  Synthetic oligonucleotide
tcccgcccaatgagcatcactacgcgcttcttcccga

SEQ ID NO: 105016 - DNA, 37 bp, Artificial Sequence
  Synthetic oligonucleotide
tgtccactcgcccagatcctcgtctctccgcccccga

SEQ ID NO: 105017 - DNA, 35 bp, Artificial Sequence
  Synthetic oligonucleotide
atgcacgcagcccttctaactaccactcctctggc

SEQ ID NO: 105018 - DNA, 35 bp, Artificial Sequence
  Synthetic oligonucleotide
actcctcaccgcaccagtgatacctctgccgatcc

SEQ ID NO: 105019 - DNA, 38 bp, Artificial Sequence
  Synthetic oligonucleotide
ggaacgagacggggatgggaagcaggggaagggattga

SEQ ID NO: 105020 - DNA, 35 bp, Artificial Sequence
  Synthetic oligonucleotide
ggaccccgaccgccacactccgctccccgctcgcg

SEQ ID NO: 105021 - DNA, 35 bp, Artificial Sequence
  Synthetic oligonucleotide
acagcccaccttaatcgccgtctgccacccgttcg

SEQ ID NO: 105022 - DNA, 36 bp, Artificial Sequence
  Synthetic oligonucleotide
acctccaccgacgaagggccctacaccactgatcca

SEQ ID NO: 105023 - DNA, 35 bp, Artificial Sequence
  Synthetic oligonucleotide
gaccggtacgatcgtgcccccctcggttctcttcc

SEQ ID NO: 105024 - DNA, 35 bp, Artificial Sequence
  Synthetic oligonucleotide
aacaccccccttcgcgataacggacgatccgtagc

SEQ ID NO: 105025 - DNA, 35 bp, Artificial Sequence
  Synthetic oligonucleotide
gtacctccgcactcacatccgccgttgccctcgcc

SEQ ID NO: 105026 - DNA, 35 bp, Artificial Sequence
  Synthetic oligonucleotide
tccacgagtcgcccccctgtccatcccacggttcg

SEQ ID NO: 105027 - DNA, 35 bp, Artificial Sequence
  Synthetic oligonucleotide
gtccccccccgtatccgttatcgttcgtagggccc

SEQ ID NO: 105028 - DNA, 35 bp, Artificial Sequence
  Synthetic oligonucleotide
atgtggcctacacctgttacatcctcacatgcctt

SEQ ID NO: 105029 - DNA, 35 bp, Artificial Sequence
  Synthetic oligonucleotide
ggatgccgccgctctccgccccccctacagtagcg

SEQ ID NO: 105030 - DNA, 35 bp, Artificial Sequence
  Synthetic oligonucleotide
tgttgccccacatcgctggcttacctactctcatc

SEQ ID NO: 105031 - DNA, 38 bp, Artificial Sequence
  Synthetic oligonucleotide
tgatgcgcacctgtcctactatgcctgcctcctcgtga

SEQ ID NO: 105032 - DNA, 35 bp, Artificial Sequence
  Synthetic oligonucleotide
gacaacctccccgtgctaactagtaacttccaccg

SEQ ID NO: 105033 - DNA, 35 bp, Artificial Sequence
  Synthetic oligonucleotide
tcgccccacctcagcgtcgcccgcgcgcacttcct

SEQ ID NO: 105034 - DNA, 36 bp, Artificial Sequence
  Synthetic oligonucleotide
gaagccgtcgggagggtggggaagggctgtacttga

SEQ ID NO: 105035 - DNA, 35 bp, Artificial Sequence
  Synthetic oligonucleotide
tagagcggaacggaggtggggggcgggagtgcaag

SEQ ID NO: 105036 - DNA, 35 bp, Artificial Sequence
  Synthetic oligonucleotide
tccctgctcccctcgcccgccgcctcggtaccgat

SEQ ID NO: 105037 - DNA, 35 bp, Artificial Sequence
  Synthetic oligonucleotide
gttccgccccacatctaattgagtgccgacccacc

SEQ ID NO: 105038 - DNA, 35 bp, Artificial Sequence
  Synthetic oligonucleotide
tacctgcccacctgactaccaccaccgtacctcta

SEQ ID NO: 105039 - DNA, 35 bp, Artificial Sequence
  Synthetic oligonucleotide
gtgccctcccacccagccacgtgtctcccgtgccc

SEQ ID NO: 105040 - DNA, 35 bp, Artificial Sequence
  Synthetic oligonucleotide
tgccacatctatgtctacactgacctctcacgctc

SEQ ID NO: 105041 - DNA, 35 bp, Artificial Sequence
  Synthetic oligonucleotide
tgccacgagttcagctcccttcgcctacagctccc

SEQ ID NO: 105042 - DNA, 35 bp, Artificial Sequence
  Synthetic oligonucleotide
ttcgacccacctgccaatcatcagtactgaaccat

SEQ ID NO: 105043 - DNA, 35 bp, Artificial Sequence
  Synthetic oligonucleotide
gaccccgcctcatgccttcccccaaaccgcgcatc

SEQ ID NO: 105044 - DNA, 35 bp, Artificial Sequence
  Synthetic oligonucleotide
aaccccgcctccaatagtctaactccctcgctgtc

SEQ ID NO: 105045 - DNA, 35 bp, Artificial Sequence
  Synthetic oligonucleotide
tatgcccctttcgccgtttgccccgtccttgccga

SEQ ID NO: 105046 - DNA, 36 bp, Artificial Sequence
  Synthetic oligonucleotide
tttgacccgcccattgccgtatgtcccctttggtta

SEQ ID NO: 105047 - DNA, 35 bp, Artificial Sequence
  Synthetic oligonucleotide
gagccgtgcctagctctatcctgccctacttctgt

SEQ ID NO: 105048 - DNA, 35 bp, Artificial Sequence
  Synthetic oligonucleotide
tgtgtgccctttgcccttggttgttgatttcgcca

SEQ ID NO: 105049 - DNA, 35 bp, Artificial Sequence
  Synthetic oligonucleotide
gaatctcgcccccattattgactattgttctaccg

SEQ ID NO: 105050 - DNA, 35 bp, Artificial Sequence
  Synthetic oligonucleotide
gcatgccagatacgctctctcgctccgcctgtccc

SEQ ID NO: 105051 - DNA, 35 bp, Artificial Sequence
  Synthetic oligonucleotide
taacaccgtcccactcgcccgcacgctgcccgtta

SEQ ID NO: 105052 - DNA, 36 bp, Artificial Sequence
  Synthetic oligonucleotide
atgtgcctcccctctcatggccttcgtgacccgtaa

SEQ ID NO: 105053 - DNA, 35 bp, Artificial Sequence
  Synthetic oligonucleotide
gcaacgcccggccccgacttccgcatcatcgtatc

SEQ ID NO: 105054 - DNA, 35 bp, Artificial Sequence
  Synthetic oligonucleotide
cgccctcccactatgtctgttactacactgccggt

SEQ ID NO: 105055 - DNA, 35 bp, Artificial Sequence
  Synthetic oligonucleotide
accccgcctagctgtctcaacctcgtggcccttcc

SEQ ID NO: 105056 - DNA, 35 bp, Artificial Sequence
  Synthetic oligonucleotide
tcctgtccacccgtgttatcagtcccctccacgct

SEQ ID NO: 105057 - DNA, 35 bp, Artificial Sequence
  Synthetic oligonucleotide
tgctacgccgccgtttcaactaaccatccctctat

SEQ ID NO: 105058 - DNA, 35 bp, Artificial Sequence
  Synthetic oligonucleotide
tccgcttggctcacacgcgcctcactccgttgccc

SEQ ID NO: 105059 - DNA, 35 bp, Artificial Sequence
  Synthetic oligonucleotide
agaaggtgagggtggtacgggggctgaggggcgag

SEQ ID NO: 105060 - DNA, 36 bp, Artificial Sequence
  Synthetic oligonucleotide
tgcccatccaacgtaagtccaccctgccttctcgca

SEQ ID NO: 105061 - DNA, 36 bp, Artificial Sequence
  Synthetic oligonucleotide
tcagcaacatcctagctgtcttatcccctccacgca

SEQ ID NO: 105062 - DNA, 35 bp, Artificial Sequence
  Synthetic oligonucleotide
gataagctcagatctctcctgcctgttcgtcctgt

SEQ ID NO: 105063 - DNA, 36 bp, Artificial Sequence
  Synthetic oligonucleotide
tcccacctcgctgtgcgctcttcccccctggcctga

SEQ ID NO: 105064 - DNA, 34 bp, Artificial Sequence
  Synthetic oligonucleotide
atacacctgcctccgacctgcctttttcaacccc

SEQ ID NO: 105065 - DNA, 35 bp, Artificial Sequence
  Synthetic oligonucleotide
tgatccactcgccacattcctttgaagccccctaa

SEQ ID NO: 105066 - DNA, 35 bp, Artificial Sequence
  Synthetic oligonucleotide
acacacgtccaaattgtaacacctctgtcctttcc

SEQ ID NO: 105067 - DNA, 37 bp, Artificial Sequence
  Synthetic oligonucleotide
aaggtgggggtggaacgggtgaagggaacggccggga

SEQ ID NO: 105068 - DNA, 35 bp, Artificial Sequence
  Synthetic oligonucleotide
gttggctcctgaccgtttctttcagtctaccgcta

SEQ ID NO: 105069 - DNA, 35 bp, Artificial Sequence
  Synthetic oligonucleotide
gcctccgccaaacatttaacagccgccgtgcccac

SEQ ID NO: 105070 - DNA, 35 bp, Artificial Sequence
  Synthetic oligonucleotide
tccatcctgattgcttgggtcccttccctacttcc

SEQ ID NO: 105071 - DNA, 36 bp, Artificial Sequence
  Synthetic oligonucleotide
acccgtcgcccggcggtctatctgctctttccctta

SEQ ID NO: 105072 - DNA, 36 bp, Artificial Sequence
  Synthetic oligonucleotide
tagggggggagggcgaggaaggatgtaggcgcgcga

SEQ ID NO: 105073 - DNA, 35 bp, Artificial Sequence
  Synthetic oligonucleotide
tatgcccgttcgctcctgtttgctttgtacttccc

SEQ ID NO: 105074 - DNA, 35 bp, Artificial Sequence
  Synthetic oligonucleotide
gatgtacccgcccctgactacttaacacagtcccc

SEQ ID NO: 105075 - DNA, 35 bp, Artificial Sequence
  Synthetic oligonucleotide
gccctccttcgatctgacctccgctacccccgttg

SEQ ID NO: 105076 - DNA, 35 bp, Artificial Sequence
  Synthetic oligonucleotide
gccgcccttcacggctagtgacatttttgcctccc

SEQ ID NO: 105077 - DNA, 35 bp, Artificial Sequence
  Synthetic oligonucleotide
tcccatgcactgcccactgggtccactccctagcc

SEQ ID NO: 105078 - DNA, 37 bp, Artificial Sequence
  Synthetic oligonucleotide
aagagacggacgggaacagacgaagggcgaaggggga

SEQ ID NO: 105079 - DNA, 36 bp, Artificial Sequence
  Synthetic oligonucleotide
taccgaagacgggagggggaaatgggagggtgtcga

SEQ ID NO: 105080 - DNA, 35 bp, Artificial Sequence
  Synthetic oligonucleotide
tgtctcactcctacctgtttgcggccacaccttct

SEQ ID NO: 105081 - DNA, 36 bp, Artificial Sequence
  Synthetic oligonucleotide
gaggggggccggggacgggagagggctgacacgtaa

SEQ ID NO: 105082 - DNA, 35 bp, Artificial Sequence
  Synthetic oligonucleotide
actgacgtcggcctccgtacacgatcacgcccttc

SEQ ID NO: 105083 - DNA, 35 bp, Artificial Sequence
  Synthetic oligonucleotide
ttactgccaccgcctggtactccgaccttccctca

SEQ ID NO: 105084 - DNA, 35 bp, Artificial Sequence
  Synthetic oligonucleotide
gtcaaccatcccatcatcgtgtccttgttaccgtt

SEQ ID NO: 105085 - DNA, 36 bp, Artificial Sequence
  Synthetic oligonucleotide
cactgcccccgcccgacctattgatgccccattgca

SEQ ID NO: 105086 - DNA, 35 bp, Artificial Sequence
  Synthetic oligonucleotide
gaccggaggggggaataagggaatggtggggcgaa

SEQ ID NO: 105087 - DNA, 34 bp, Artificial Sequence
  Synthetic oligonucleotide
gctcccctgacgcctatcacacctgcccacttga

SEQ ID NO: 105088 - DNA, 35 bp, Artificial Sequence
  Synthetic oligonucleotide
gtcctccgcccgcacggtcctcttccccttgcgcc

SEQ ID NO: 105089 - DNA, 36 bp, Artificial Sequence
  Synthetic oligonucleotide
gacaccgcctccccctgctgttcaaaccgtcgccga

SEQ ID NO: 105090 - DNA, 36 bp, Artificial Sequence
  Synthetic oligonucleotide
gtggaaacgccacgctgccctcctgtcgaccttcca

SEQ ID NO: 105091 - DNA, 35 bp, Artificial Sequence
  Synthetic oligonucleotide
gcgatagccctccactgtctactctcctttccctc

SEQ ID NO: 105092 - DNA, 35 bp, Artificial Sequence
  Synthetic oligonucleotide
acccccctccgctttccgtaaggaccgaaacatcc

SEQ ID NO: 105093 - DNA, 36 bp, Artificial Sequence
  Synthetic oligonucleotide
aatagggggcgggaagctatggggttattggggtga

SEQ ID NO: 105094 - DNA, 35 bp, Artificial Sequence
  Synthetic oligonucleotide
tccctcagcccactgctctaggcccacctctccac

SEQ ID NO: 105095 - DNA, 35 bp, Artificial Sequence
  Synthetic oligonucleotide
gtcgctcctgaccggctctcccacacccgccctgc

SEQ ID NO: 105096 - DNA, 32 bp, Artificial Sequence
  Synthetic oligonucleotide
gatgtatcgcccccacgagtcttttgcttccc

SEQ ID NO: 105097 - DNA, 35 bp, Artificial Sequence
  Synthetic oligonucleotide
gactcacccccccgattgctgccgtaccgccacgc

SEQ ID NO: 105098 - DNA, 35 bp, Artificial Sequence
  Synthetic oligonucleotide
tcacacccccgttcgccgtgcttattacaccatca

SEQ ID NO: 105099 - DNA, 35 bp, Artificial Sequence
  Synthetic oligonucleotide
ttcgcaattcatgcgttcccaccaccccgcttctg

SEQ ID NO: 105100 - DNA, 27 bp, Artificial Sequence
  Synthetic oligonucleotide
agtacaaaccgcactccaaccatgctc

SEQ ID NO: 105101 - DNA, 35 bp, Artificial Sequence
  Synthetic oligonucleotide
aacccacccgccttctctttgagctcggttgacac

SEQ ID NO: 105102 - DNA, 35 bp, Artificial Sequence
  Synthetic oligonucleotide
tcacctcagcccattgtatctctcgccgtcttgtc

SEQ ID NO: 105103 - DNA, 35 bp, Artificial Sequence
  Synthetic oligonucleotide
atccccctgcccctgcctctattgagatttactgt

SEQ ID NO: 105104 - DNA, 35 bp, Artificial Sequence
  Synthetic oligonucleotide
tccgcatcatgctcgcttaccccccgcccgctggc

SEQ ID NO: 105105 - DNA, 35 bp, Artificial Sequence
  Synthetic oligonucleotide
tcccacatcgccgcattaagtgtccttccttcgtc

SEQ ID NO: 105106 - DNA, 35 bp, Artificial Sequence
  Synthetic oligonucleotide
tcactcgcaatctgcaccttcccctctctcgttgg

SEQ ID NO: 105107 - DNA, 35 bp, Artificial Sequence
  Synthetic oligonucleotide
gatcacgccattgcttaacccccctgcacccatag

SEQ ID NO: 105108 - DNA, 36 bp, Artificial Sequence
  Synthetic oligonucleotide
aacacaggtggacggtggggatagggcggggagtta

SEQ ID NO: 105109 - DNA, 37 bp, Artificial Sequence
  Synthetic oligonucleotide
tcacttcgctaggtgttcggtgggggcggagggagga

SEQ ID NO: 105110 - DNA, 35 bp, Artificial Sequence
  Synthetic oligonucleotide
gtcccaccctcccatgccaaaggaattccgctacc

SEQ ID NO: 105111 - DNA, 35 bp, Artificial Sequence
  Synthetic oligonucleotide
tgccccccctcgagctcccttgttgcacacacccg

SEQ ID NO: 105112 - DNA, 35 bp, Artificial Sequence
  Synthetic oligonucleotide
tgccctccgcccctttggaatattcacgcctttac

SEQ ID NO: 105113 - DNA, 35 bp, Artificial Sequence
  Synthetic oligonucleotide
tccgaccacctctcactgtagcccgcatttctagg

SEQ ID NO: 105114 - DNA, 35 bp, Artificial Sequence
  Synthetic oligonucleotide
gccactctccccctatcgtaatgtgccatcgcttc

SEQ ID NO: 105115 - DNA, 35 bp, Artificial Sequence
  Synthetic oligonucleotide
tagtgcctcaagctctcgtagacttttcctccctg

SEQ ID NO: 105116 - DNA, 35 bp, Artificial Sequence
  Synthetic oligonucleotide
gtgtgcattccgcctgcccgctccatccctcggat

SEQ ID NO: 105117 - DNA, 36 bp, Artificial Sequence
  Synthetic oligonucleotide
gacaaaggggaggaagtatggggtgaagggcggtaa

SEQ ID NO: 105118 - DNA, 35 bp, Artificial Sequence
  Synthetic oligonucleotide
tctgacgccctatggtccccccactgtcacccctt

SEQ ID NO: 105119 - DNA, 35 bp, Artificial Sequence
  Synthetic oligonucleotide
gacccacaccggtcgcccatgttctttctgcctca

SEQ ID NO: 105120 - DNA, 35 bp, Artificial Sequence
  Synthetic oligonucleotide
attgccatcacccggtaagtgctcgctattcttcc

SEQ ID NO: 105121 - DNA, 35 bp, Artificial Sequence
  Synthetic oligonucleotide
acctgtcaaccgcctgtccctgttagctatttacc

SEQ ID NO: 105122 - DNA, 33 bp, Artificial Sequence
  Synthetic oligonucleotide
tccagcacctgctctcttgctcactccgttcta

SEQ ID NO: 105123 - DNA, 35 bp, Artificial Sequence
  Synthetic oligonucleotide
tgtgacccactctgttccttcccgcactactgacg

SEQ ID NO: 105124 - DNA, 35 bp, Artificial Sequence
  Synthetic oligonucleotide
tcccaactcgctgacccaagcagttcattcaacct

SEQ ID NO: 105125 - DNA, 36 bp, Artificial Sequence
  Synthetic oligonucleotide
gactcagtcgccgcctagtgctgcccacccctttca

SEQ ID NO: 105126 - DNA, 35 bp, Artificial Sequence
  Synthetic oligonucleotide
acgcccctccaaatgcgcatccatcaacacgcacc

SEQ ID NO: 105127 - DNA, 35 bp, Artificial Sequence
  Synthetic oligonucleotide
acgatgcttactttgtgccgccctgtactttaatg

SEQ ID NO: 105128 - DNA, 33 bp, Artificial Sequence
  Synthetic oligonucleotide
tgtagcctactcgttctgtccgttacctttccg

SEQ ID NO: 105129 - DNA, 36 bp, Artificial Sequence
  Synthetic oligonucleotide
gatatgcgagggggagaaatgggaaggtggggagga

SEQ ID NO: 105130 - DNA, 35 bp, Artificial Sequence
  Synthetic oligonucleotide
gagacacctaccgattgcctgccgccctactttct

SEQ ID NO: 105131 - DNA, 35 bp, Artificial Sequence
  Synthetic oligonucleotide
gtgcgttgcccaatccgttaactccgctctcctcg

SEQ ID NO: 105132 - DNA, 38 bp, Artificial Sequence
  Synthetic oligonucleotide
gtcgccccctcgccaaacctgtatcgccccccttgtga

SEQ ID NO: 105133 - DNA, 35 bp, Artificial Sequence
  Synthetic oligonucleotide
tgacaacatcacacaccctttgctcccggacctgc

SEQ ID NO: 105134 - DNA, 38 bp, Artificial Sequence
  Synthetic oligonucleotide
acacacgggaagggagggagggtcggtatcactcgtga

SEQ ID NO: 105135 - DNA, 35 bp, Artificial Sequence
  Synthetic oligonucleotide
tgtctcatccccgcttttaaagtaactgccctgcc

SEQ ID NO: 105136 - DNA, 37 bp, Artificial Sequence
  Synthetic oligonucleotide
ttcccagcccgcccgttcaacacctcgcttaccacga

SEQ ID NO: 105137 - DNA, 35 bp, Artificial Sequence
  Synthetic oligonucleotide
gacccatcccctaggtactatccgtagacacttcc

SEQ ID NO: 105138 - DNA, 35 bp, Artificial Sequence
  Synthetic oligonucleotide
ttcccagtccaccgccctgttatgctccagtttct

SEQ ID NO: 105139 - DNA, 37 bp, Artificial Sequence
  Synthetic oligonucleotide
tcgcccccgcccttcccccatgcttacacagtcgtga

SEQ ID NO: 105140 - DNA, 36 bp, Artificial Sequence
  Synthetic oligonucleotide
aacaccgctgttccgccccataatcctccagccatg

SEQ ID NO: 105141 - DNA, 35 bp, Artificial Sequence
  Synthetic oligonucleotide
tccccaacccctatatgtcatagcttgactccttt

SEQ ID NO: 105142 - DNA, 36 bp, Artificial Sequence
  Synthetic oligonucleotide
gcccgccccttctccagtcgtttgctgttccccgca

SEQ ID NO: 105143 - DNA, 35 bp, Artificial Sequence
  Synthetic oligonucleotide
gagagggaacgaacgaatgagcgggggtgtgcgtg

SEQ ID NO: 105144 - DNA, 35 bp, Artificial Sequence
  Synthetic oligonucleotide
gcgatgcaccggttgtaccatcctgctcttctcgc

SEQ ID NO: 105145 - DNA, 35 bp, Artificial Sequence
  Synthetic oligonucleotide
tgccctgcccatccttcacgtgagtcacccccacc

SEQ ID NO: 105146 - DNA, 36 bp, Artificial Sequence
  Synthetic oligonucleotide
gcccgccccgcacctcgtattaatagctccctgtca

SEQ ID NO: 105147 - DNA, 37 bp, Artificial Sequence
  Synthetic oligonucleotide
ggaaacgggggaaggcaagggaaatgggcggagagga

SEQ ID NO: 105148 - DNA, 35 bp, Artificial Sequence
  Synthetic oligonucleotide
gactcgcccccgtcgctatatcaatctgcttccct

SEQ ID NO: 105149 - DNA, 32 bp, Artificial Sequence
  Synthetic oligonucleotide
tgcctcctgccacatctaatcgcgaatgcctg

SEQ ID NO: 105150 - DNA, 35 bp, Artificial Sequence
  Synthetic oligonucleotide
accaacgcctatggtccccactctcgccctacggt

SEQ ID NO: 105151 - DNA, 35 bp, Artificial Sequence
  Synthetic oligonucleotide
gaccaccggccattttgcatcctatctgcgcactc

SEQ ID NO: 105152 - DNA, 37 bp, Artificial Sequence
  Synthetic oligonucleotide
agcccgcccagccgtcttccttcctgcacttcatcga

SEQ ID NO: 105153 - DNA, 36 bp, Artificial Sequence
  Synthetic oligonucleotide
atcaccctccatagcatacgccactcttgccacgca

SEQ ID NO: 105154 - DNA, 35 bp, Artificial Sequence
  Synthetic oligonucleotide
gctcgcccgcctcacgctactcactgatccctgta

SEQ ID NO: 105155 - DNA, 35 bp, Artificial Sequence
  Synthetic oligonucleotide
agccatcccgcccccacgaactgttaagttccatt

SEQ ID NO: 105156 - DNA, 35 bp, Artificial Sequence
  Synthetic oligonucleotide
gtccaaactgccctgattcccactctgccggtctc

SEQ ID NO: 105157 - DNA, 35 bp, Artificial Sequence
  Synthetic oligonucleotide
agggaggggtgggactggtgggcggaatagggagg

SEQ ID NO: 105158 - DNA, 35 bp, Artificial Sequence
  Synthetic oligonucleotide
gttcatccccgcacctttatgtcaggctaccgccc

SEQ ID NO: 105159 - DNA, 35 bp, Artificial Sequence
  Synthetic oligonucleotide
tctgtcgctcgtgcgcatacccctcccatctccgc

SEQ ID NO: 105160 - DNA, 35 bp, Artificial Sequence
  Synthetic oligonucleotide
cactcaccgccgcctgctatcactatatgtccctc

SEQ ID NO: 105161 - DNA, 35 bp, Artificial Sequence
  Synthetic oligonucleotide
tcgcaggggcgggaggggcgggcgaagaactagga

SEQ ID NO: 105162 - DNA, 35 bp, Artificial Sequence
  Synthetic oligonucleotide
tttggcccccctctgttgccgcacccgctatgtac

SEQ ID NO: 105163 - DNA, 35 bp, Artificial Sequence
  Synthetic oligonucleotide
tcgaccccctgtcttttcgtccgcaacgtgccttc

SEQ ID NO: 105164 - DNA, 35 bp, Artificial Sequence
  Synthetic oligonucleotide
gtccatcctcccaccgtaactgccggtttccctaa

SEQ ID NO: 105165 - DNA, 35 bp, Artificial Sequence
  Synthetic oligonucleotide
tcgaccagcccccacctactgctgcattactgttc

SEQ ID NO: 105166 - DNA, 34 bp, Artificial Sequence
  Synthetic oligonucleotide
acatccctagggcctctgtatcgtttctccacgc

SEQ ID NO: 105167 - DNA, 35 bp, Artificial Sequence
  Synthetic oligonucleotide
tccccatgtccgctccccccgccgtttgtcctaag

SEQ ID NO: 105168 - DNA, 35 bp, Artificial Sequence
  Synthetic oligonucleotide
atgccctgccgcccacgctcgacttaatagcccgc

SEQ ID NO: 105169 - DNA, 37 bp, Artificial Sequence
  Synthetic oligonucleotide
agcacaggttctgggcggaggcggggttcgggaagga

SEQ ID NO: 105170 - DNA, 35 bp, Artificial Sequence
  Synthetic oligonucleotide
aacacttcaccatgccgcacgcaaggcctcgttcc

SEQ ID NO: 105171 - DNA, 38 bp, Artificial Sequence
  Synthetic oligonucleotide
ggaggaggaggaggcggggcgggggacgaggccattga

SEQ ID NO: 105172 - DNA, 35 bp, Artificial Sequence
  Synthetic oligonucleotide
ttctcgcacccacaccatgccctcgcaggctttcc

SEQ ID NO: 105173 - DNA, 35 bp, Artificial Sequence
  Synthetic oligonucleotide
ttgcaaccaatctgctcccccctccctactgtgcg

SEQ ID NO: 105174 - DNA, 35 bp, Artificial Sequence
  Synthetic oligonucleotide
gagagacggaggggcggtaaaagggcgggattcgt

SEQ ID NO: 105175 - DNA, 35 bp, Artificial Sequence
  Synthetic oligonucleotide
tgcgcgccattcagctccttcgttttcggtcttcc

SEQ ID NO: 105176 - DNA, 35 bp, Artificial Sequence
  Synthetic oligonucleotide
tcacaatcggcgccgtatccctgcagttctccgcc

SEQ ID NO: 105177 - DNA, 35 bp, Artificial Sequence
  Synthetic oligonucleotide
tcctccgcccccattgtgccccacttcgtagttaa

SEQ ID NO: 105178 - DNA, 38 bp, Artificial Sequence
  Synthetic oligonucleotide
accgcctctcctgctgactatctccccaggccacttga

SEQ ID NO: 105179 - DNA, 35 bp, Artificial Sequence
  Synthetic oligonucleotide
aacaccccccactcggcacataccgcattcgcagt

SEQ ID NO: 105180 - DNA, 35 bp, Artificial Sequence
  Synthetic oligonucleotide
tcgcccccacccgtcgttccaatgcgctcaccctt

SEQ ID NO: 105181 - DNA, 35 bp, Artificial Sequence
  Synthetic oligonucleotide
tccgctcaccatatcgtatcatacccacgcgccct

SEQ ID NO: 105182 - DNA, 38 bp, Artificial Sequence
  Synthetic oligonucleotide
tccatcaaacgtgctatcttccctgctgcctttgctga

SEQ ID NO: 105183 - DNA, 35 bp, Artificial Sequence
  Synthetic oligonucleotide
tccagccgctcgctcccacccttacgtcacctggt

SEQ ID NO: 105184 - DNA, 36 bp, Artificial Sequence
  Synthetic oligonucleotide
atgtccacctacctttgttccagccgcctgtcccta

SEQ ID NO: 105185 - DNA, 36 bp, Artificial Sequence
  Synthetic oligonucleotide
tagacgccctgctgccgcatcgacccccctgattca

SEQ ID NO: 105186 - DNA, 35 bp, Artificial Sequence
  Synthetic oligonucleotide
tgacgaccgccatccttctctccgcgacccttcat

SEQ ID NO: 105187 - DNA, 36 bp, Artificial Sequence
  Synthetic oligonucleotide
tgcccagctcgtcactttgcctgctccctcttgcca

SEQ ID NO: 105188 - DNA, 36 bp, Artificial Sequence
  Synthetic oligonucleotide
ggactgccccagcggttgtctcgttgctctcactcc

SEQ ID NO: 105189 - DNA, 36 bp, Artificial Sequence
  Synthetic oligonucleotide
tcccccctccattcgctatacaacagttgcccggca

SEQ ID NO: 105190 - DNA, 36 bp, Artificial Sequence
  Synthetic oligonucleotide
accgcctgacccccgctcgcccctacgtacactgga

SEQ ID NO: 105191 - DNA, 35 bp, Artificial Sequence
  Synthetic oligonucleotide
atgcgcccgctcgccatcgaatcgctccctgtgcc

SEQ ID NO: 105192 - DNA, 35 bp, Artificial Sequence
  Synthetic oligonucleotide
gaacatcccgcctgactcctcctcagcacttggtg

SEQ ID NO: 105193 - DNA, 35 bp, Artificial Sequence
  Synthetic oligonucleotide
gccttactcgctgcgtccacccgcctgcctgttcc

SEQ ID NO: 105194 - DNA, 35 bp, Artificial Sequence
  Synthetic oligonucleotide
acatccaccatcgttgtcctgtctccgtctctacc

SEQ ID NO: 105195 - DNA, 35 bp, Artificial Sequence
  Synthetic oligonucleotide
tcacccggtcctggtacttccccgattgactcttt

SEQ ID NO: 105196 - DNA, 35 bp, Artificial Sequence
  Synthetic oligonucleotide
gtcccccccgctttccgttgcctgtatcacccagg

SEQ ID NO: 105197 - DNA, 35 bp, Artificial Sequence
  Synthetic oligonucleotide
accacgcctctttcgttctgttttgcacatgctct

SEQ ID NO: 105198 - DNA, 35 bp, Artificial Sequence
  Synthetic oligonucleotide
acacacctcctgtccttaatgtgcttctccctggt

SEQ ID NO: 105199 - DNA, 35 bp, Artificial Sequence
  Synthetic oligonucleotide
tctgacgccgccgccattttaccgtagtcttttcc

SEQ ID NO: 105200 - DNA, 34 bp, Artificial Sequence
  Synthetic oligonucleotide
tatggtcacctccccgccaatgtcttagcccttc

SEQ ID NO: 105201 - DNA, 36 bp, Artificial Sequence
  Synthetic oligonucleotide
ttgtgcacacatctgctctgctgccccctgccttta

SEQ ID NO: 105202 - DNA, 35 bp, Artificial Sequence
  Synthetic oligonucleotide
tccgcgctgccactgtgttcttgcccttcacctca

SEQ ID NO: 105203 - DNA, 35 bp, Artificial Sequence
  Synthetic oligonucleotide
tgcccccaccctccaatgtcctacctgccatgtta

SEQ ID NO: 105204 - DNA, 36 bp, Artificial Sequence
  Synthetic oligonucleotide
tgcccccactatgcctcttaatcgtaccggtttcta

SEQ ID NO: 105205 - DNA, 35 bp, Artificial Sequence
  Synthetic oligonucleotide
tgcgcaaccttgccacctgtttattgtcccctctt

SEQ ID NO: 105206 - DNA, 35 bp, Artificial Sequence
  Synthetic oligonucleotide
tgtccccggatgcccctatcgcctggtccaacctc

SEQ ID NO: 105207 - DNA, 34 bp, Artificial Sequence
  Synthetic oligonucleotide
tgtccaagccgtcacactctttcgttccgcctca

SEQ ID NO: 105208 - DNA, 35 bp, Artificial Sequence
  Synthetic oligonucleotide
gtttcaccgtcctttccctgtaccagtccgtgcct

SEQ ID NO: 105209 - DNA, 35 bp, Artificial Sequence
  Synthetic oligonucleotide
aagggggaagggcggggaaaaggcatgaggagaag

SEQ ID NO: 105210 - DNA, 36 bp, Artificial Sequence
  Synthetic oligonucleotide
gcactgcccttcatgtcttttagtgccacccccaca

SEQ ID NO: 105211 - DNA, 35 bp, Artificial Sequence
  Synthetic oligonucleotide
gcatccacacctacgtagtcacccgttccctgcac

SEQ ID NO: 105212 - DNA, 35 bp, Artificial Sequence
  Synthetic oligonucleotide
gcatccccgttacgctcgttccacccgttttccat

SEQ ID NO: 105213 - DNA, 36 bp, Artificial Sequence
  Synthetic oligonucleotide
gttccccgtcactgagccgacccgtcccccaccgca

SEQ ID NO: 105214 - DNA, 35 bp, Artificial Sequence
  Synthetic oligonucleotide
acccactcccggtccaactgttaaagtctctgctc

SEQ ID NO: 105215 - DNA, 37 bp, Artificial Sequence
  Synthetic oligonucleotide
tcccaccgccaatcccttgaccttccaccgttgtcga

SEQ ID NO: 105216 - DNA, 35 bp, Artificial Sequence
  Synthetic oligonucleotide
ttggggcctgccgccttgtcctctctccatttgtc

SEQ ID NO: 105217 - DNA, 35 bp, Artificial Sequence
  Synthetic oligonucleotide
tatgtcgccgtatcatcccctcctggtatctgtcc

SEQ ID NO: 105218 - DNA, 35 bp, Artificial Sequence
  Synthetic oligonucleotide
gacccccgcccattttaagccacggcccccattcc

SEQ ID NO: 105219 - DNA, 35 bp, Artificial Sequence
  Synthetic oligonucleotide
atgagcctcccaccatgttcccgtttgcactttgc

SEQ ID NO: 105220 - DNA, 37 bp, Artificial Sequence
  Synthetic oligonucleotide
gcaggggacggggagcattgacgggaggggcatcgga

SEQ ID NO: 105221 - DNA, 35 bp, Artificial Sequence
  Synthetic oligonucleotide
aagggaaaggtggagtggggtgggggaaaggcgag

SEQ ID NO: 105222 - DNA, 36 bp, Artificial Sequence
  Synthetic oligonucleotide
gacgcctccgagttaacccaccgagctccacctcca

SEQ ID NO: 105223 - DNA, 35 bp, Artificial Sequence
  Synthetic oligonucleotide
gtcacactgctcctgtggccctcacttccctttgt

SEQ ID NO: 105224 - DNA, 35 bp, Artificial Sequence
  Synthetic oligonucleotide
atctgctcgccagccgttctctccgccacttgtta

SEQ ID NO: 105225 - DNA, 35 bp, Artificial Sequence
  Synthetic oligonucleotide
ttctgcaccgcccttacttgcctgctctacctagc

SEQ ID NO: 105226 - DNA, 35 bp, Artificial Sequence
  Synthetic oligonucleotide
tccccacgccctttaccgcatcacatgtcagcccc

SEQ ID NO: 105227 - DNA, 35 bp, Artificial Sequence
  Synthetic oligonucleotide
gtcccacgtcgtttgagcttacttcctcctccgcc

SEQ ID NO: 105228 - DNA, 35 bp, Artificial Sequence
  Synthetic oligonucleotide
tatgagccgcccccgatacctgtccacctccctag

SEQ ID NO: 105229 - DNA, 36 bp, Artificial Sequence
  Synthetic oligonucleotide
gtcgctcccggcatgtttctggctcccgtttcatcc

SEQ ID NO: 105230 - DNA, 37 bp, Artificial Sequence
  Synthetic oligonucleotide
tttgccccctccgtttgttgtcctatctgtaccccga

SEQ ID NO: 105231 - DNA, 35 bp, Artificial Sequence
  Synthetic oligonucleotide
gagggggatcgagggggataggcaaggggtgagta

SEQ ID NO: 105232 - DNA, 37 bp, Artificial Sequence
  Synthetic oligonucleotide
gccggggatggcgggcgacaggcatggtgaacgggga

SEQ ID NO: 105233 - DNA, 35 bp, Artificial Sequence
  Synthetic oligonucleotide
ttgcaccatcgttcgtcctttaccattctctgcct

SEQ ID NO: 105234 - DNA, 35 bp, Artificial Sequence
  Synthetic oligonucleotide
tccgcggcccgcctcttttgtttcgcacctaccac

SEQ ID NO: 105235 - DNA, 35 bp, Artificial Sequence
  Synthetic oligonucleotide
accgccccccacctccgtagtttattctcccctgg

SEQ ID NO: 105236 - DNA, 37 bp, Artificial Sequence
  Synthetic oligonucleotide
tcgaaacacgggaggaaagggggtacggggacggtga

SEQ ID NO: 105237 - DNA, 35 bp, Artificial Sequence
  Synthetic oligonucleotide
tccacgctgtatcccacgctctcaccgcccatgcc

SEQ ID NO: 105238 - DNA, 35 bp, Artificial Sequence
  Synthetic oligonucleotide
gccgtgcctccttcgcgttctcggtcttgttaccc

SEQ ID NO: 105239 - DNA, 35 bp, Artificial Sequence
  Synthetic oligonucleotide
gacattacgcctgcccgctctaacgcccctcttag

SEQ ID NO: 105240 - DNA, 35 bp, Artificial Sequence
  Synthetic oligonucleotide
acacccgaccggaggttaaacccgacactgccccc

SEQ ID NO: 105241 - DNA, 37 bp, Artificial Sequence
  Synthetic oligonucleotide
tgaggggaatggatcggggaggaggcccacgtaggga

SEQ ID NO: 105242 - DNA, 35 bp, Artificial Sequence
  Synthetic oligonucleotide
tgccagatccatcatcggtgtcgttgtggccctcc

SEQ ID NO: 105243 - DNA, 36 bp, Artificial Sequence
  Synthetic oligonucleotide
tgctgcctccgctcctccgtccaacgtgcacttcta

SEQ ID NO: 105244 - DNA, 35 bp, Artificial Sequence
  Synthetic oligonucleotide
tgccctcgaccccatctgacatatttgccgccatc

SEQ ID NO: 105245 - DNA, 35 bp, Artificial Sequence
  Synthetic oligonucleotide
gcgcctcggcggctactgtacctgttccatccacc

SEQ ID NO: 105246 - DNA, 37 bp, Artificial Sequence
  Synthetic oligonucleotide
gggtggggaacgaggggttatgttgctaccgtgggga

SEQ ID NO: 105247 - DNA, 35 bp, Artificial Sequence
  Synthetic oligonucleotide
ttgtccctccacacgtaactgcgaactcgcttgcc

SEQ ID NO: 105248 - DNA, 36 bp, Artificial Sequence
  Synthetic oligonucleotide
tattccaccctcctccccgtgtcctgttctcctgaa

SEQ ID NO: 105249 - DNA, 35 bp, Artificial Sequence
  Synthetic oligonucleotide
tcacagtgggccgggaatgggggaagaaaggatag

SEQ ID NO: 105250 - DNA, 35 bp, Artificial Sequence
  Synthetic oligonucleotide
gacgcatactacatgctccggccctcccactcttt

SEQ ID NO: 105251 - DNA, 36 bp, Artificial Sequence
  Synthetic oligonucleotide
aacgccactgtcgtcgtcacgccctgccccttttgc

SEQ ID NO: 105252 - DNA, 37 bp, Artificial Sequence
  Synthetic oligonucleotide
tgaccggagggagggagtggaaggagtgaaggtctga

SEQ ID NO: 105253 - DNA, 35 bp, Artificial Sequence
  Synthetic oligonucleotide
acacccccgctctgttcgatcgagcttgctttgtc

SEQ ID NO: 105254 - DNA, 35 bp, Artificial Sequence
  Synthetic oligonucleotide
tgcactcacactcaccgatcctggcccattgtctc

SEQ ID NO: 105255 - DNA, 35 bp, Artificial Sequence
  Synthetic oligonucleotide
agactcgagcctgctttctgtacatacgccctctt

SEQ ID NO: 105256 - DNA, 35 bp, Artificial Sequence
  Synthetic oligonucleotide
gcgtgagcccctgttctacttttgtgccctctcca

SEQ ID NO: 105257 - DNA, 35 bp, Artificial Sequence
  Synthetic oligonucleotide
aactcacccgccctttagtgttcttgttcttttgc

SEQ ID NO: 105258 - DNA, 35 bp, Artificial Sequence
  Synthetic oligonucleotide
tgcaacaccctcctgctgctggttgaacactctcg

SEQ ID NO: 105259 - DNA, 35 bp, Artificial Sequence
  Synthetic oligonucleotide
tatccgcagacgttagagtcatcgcccgctccccc

SEQ ID NO: 105260 - DNA, 35 bp, Artificial Sequence
  Synthetic oligonucleotide
tcgacatgcctgctgcctaatgtccgcccactttt

SEQ ID NO: 105261 - DNA, 35 bp, Artificial Sequence
  Synthetic oligonucleotide
gactcctaccgctgtgcctctacgttcaactcttg

SEQ ID NO: 105262 - DNA, 36 bp, Artificial Sequence
  Synthetic oligonucleotide
tgcgcgctcctgttgtccgtcccttgccgtctttca

SEQ ID NO: 105263 - DNA, 37 bp, Artificial Sequence
  Synthetic oligonucleotide
gaaggggacggggtatgggcggggggcaataagtgga

SEQ ID NO: 105264 - DNA, 36 bp, Artificial Sequence
  Synthetic oligonucleotide
ggacaggggtggaaaaggaggagtgaagggtgtaag

SEQ ID NO: 105265 - DNA, 35 bp, Artificial Sequence
  Synthetic oligonucleotide
tgcgaagtcactctgcgtccctccgtctctccgct

SEQ ID NO: 105266 - DNA, 35 bp, Artificial Sequence
  Synthetic oligonucleotide
tgcccatagcgctccttgctatcctgcccctatcg

SEQ ID NO: 105267 - DNA, 35 bp, Artificial Sequence
  Synthetic oligonucleotide
gtcgccgtccctgtcttttagccctctctcgtctg

SEQ ID NO: 105268 - DNA, 38 bp, Artificial Sequence
  Synthetic oligonucleotide
acgtacggggagggcgggaagggagtcgacttcgatga

SEQ ID NO: 105269 - DNA, 35 bp, Artificial Sequence
  Synthetic oligonucleotide
gccaccccgccaagtacgtgctactgcctgccccc

SEQ ID NO: 105270 - DNA, 35 bp, Artificial Sequence
  Synthetic oligonucleotide
gaacagccctcttctgtcttatccacgctccctta

SEQ ID NO: 105271 - DNA, 35 bp, Artificial Sequence
  Synthetic oligonucleotide
acaccctgccctgactgttccagctcgcttctcat

SEQ ID NO: 105272 - DNA, 37 bp, Artificial Sequence
  Synthetic oligonucleotide
tgatacgcgtccaaggcccctgcacctacactttcga

SEQ ID NO: 105273 - DNA, 35 bp, Artificial Sequence
  Synthetic oligonucleotide
gtcacctgcccccgcgcgcttatctacgtttgcac

SEQ ID NO: 105274 - DNA, 35 bp, Artificial Sequence
  Synthetic oligonucleotide
tacgtccgtcccgccggtcatctcgttcacaactc

SEQ ID NO: 105275 - DNA, 35 bp, Artificial Sequence
  Synthetic oligonucleotide
gggcggagggtgggggccgggtggccgggttcgct

SEQ ID NO: 105276 - DNA, 35 bp, Artificial Sequence
  Synthetic oligonucleotide
atcacccaccgctacatggtcttcctcgaggtctc

SEQ ID NO: 105277 - DNA, 35 bp, Artificial Sequence
  Synthetic oligonucleotide
tctgtgtcatcatcccccccgctctacattcggcg

SEQ ID NO: 105278 - DNA, 36 bp, Artificial Sequence
  Synthetic oligonucleotide
gattcgggtgttgtaggggagtgaaagagggaggga

SEQ ID NO: 105279 - DNA, 35 bp, Artificial Sequence
  Synthetic oligonucleotide
tcgaccacgccattcgttagccccttttcccacgc

SEQ ID NO: 105280 - DNA, 35 bp, Artificial Sequence
  Synthetic oligonucleotide
gcaactatgcgcgctcttggaccgtcaccctcctt

SEQ ID NO: 105281 - DNA, 35 bp, Artificial Sequence
  Synthetic oligonucleotide
tacgccaacgttccacatgccgattccacccgtct

SEQ ID NO: 105282 - DNA, 35 bp, Artificial Sequence
  Synthetic oligonucleotide
gaccctccaccggtttgtcttttcacggtccttac

SEQ ID NO: 105283 - DNA, 35 bp, Artificial Sequence
  Synthetic oligonucleotide
acctcagtccctcccgcccgccacctggcccaccg

SEQ ID NO: 105284 - DNA, 38 bp, Artificial Sequence
  Synthetic oligonucleotide
tgcatgcaacggactgcaaccagcctcccctgccctga

SEQ ID NO: 105285 - DNA, 35 bp, Artificial Sequence
  Synthetic oligonucleotide
gccgcacccctgtcactcttctctatccgatggcg

SEQ ID NO: 105286 - DNA, 35 bp, Artificial Sequence
  Synthetic oligonucleotide
gcccagcctaccacatccgctgcatcaaccgccct

SEQ ID NO: 105287 - DNA, 35 bp, Artificial Sequence
  Synthetic oligonucleotide
tccccatacgcccgccggtgttaacttctgtccac

SEQ ID NO: 105288 - DNA, 37 bp, Artificial Sequence
  Synthetic oligonucleotide
acgatagggaaggttcgtggaggagagggagggagga

SEQ ID NO: 105289 - DNA, 35 bp, Artificial Sequence
  Synthetic oligonucleotide
tacacccccacgtacaccgtgtttctctctggttc

SEQ ID NO: 105290 - DNA, 35 bp, Artificial Sequence
  Synthetic oligonucleotide
gttaaccccgcctccccgttgaattgtgcctgtcc

SEQ ID NO: 105291 - DNA, 35 bp, Artificial Sequence
  Synthetic oligonucleotide
gaccccgccgccatgttatcgttttacgccgtcgt

SEQ ID NO: 105292 - DNA, 36 bp, Artificial Sequence
  Synthetic oligonucleotide
gtgcaacatcggtagttctgtccgccccacacgcca

SEQ ID NO: 105293 - DNA, 36 bp, Artificial Sequence
  Synthetic oligonucleotide
tacgcgtgctgccccttccctcccttgttgatcgga

SEQ ID NO: 105294 - DNA, 35 bp, Artificial Sequence
  Synthetic oligonucleotide
aaggatgaatgggtggagaagggagtgggtcgggg

SEQ ID NO: 105295 - DNA, 35 bp, Artificial Sequence
  Synthetic oligonucleotide
tgcgtgccgccgtgccatctagttctctcatgtcc

SEQ ID NO: 105296 - DNA, 35 bp, Artificial Sequence
  Synthetic oligonucleotide
gacccggtcctctcttagccctacttgcccttgtg

SEQ ID NO: 105297 - DNA, 35 bp, Artificial Sequence
  Synthetic oligonucleotide
gtacgccccgacccgaaggtttttttcgccacttc

SEQ ID NO: 105298 - DNA, 35 bp, Artificial Sequence
  Synthetic oligonucleotide
gccaccctcactgcaccctttcctcttgctctagg

SEQ ID NO: 105299 - DNA, 35 bp, Artificial Sequence
  Synthetic oligonucleotide
tcattgccccatccttgtcctcggagcggttttcg

SEQ ID NO: 105300 - DNA, 35 bp, Artificial Sequence
  Synthetic oligonucleotide
tccgcccttcacctttacatccacctgggttcaca

SEQ ID NO: 105301 - DNA, 35 bp, Artificial Sequence
  Synthetic oligonucleotide
atgtccgcagctggttctcgatctccccggccgcc

SEQ ID NO: 105302 - DNA, 34 bp, Artificial Sequence
  Synthetic oligonucleotide
gccccacgccgcccctcatccccttccttaacgc

SEQ ID NO: 105303 - DNA, 35 bp, Artificial Sequence
  Synthetic oligonucleotide
tccggatcgcctcgttatgctgccctctctcctgt

SEQ ID NO: 105304 - DNA, 35 bp, Artificial Sequence
  Synthetic oligonucleotide
aacagcatgccttccaccttatttagccaccctgc

SEQ ID NO: 105305 - DNA, 35 bp, Artificial Sequence
  Synthetic oligonucleotide
accggacgggggggacgggggtaagggagcgaact

SEQ ID NO: 105306 - DNA, 35 bp, Artificial Sequence
  Synthetic oligonucleotide
tgtgcgctcccttccgtctgcactccgtttgcctc

SEQ ID NO: 105307 - DNA, 37 bp, Artificial Sequence
  Synthetic oligonucleotide
acatgtcgcacactttgcatgcaccctccctcttgga

SEQ ID NO: 105308 - DNA, 35 bp, Artificial Sequence
  Synthetic oligonucleotide
gccaccgctgtgaccctgtcttacctctccttgcg

SEQ ID NO: 105309 - DNA, 35 bp, Artificial Sequence
  Synthetic oligonucleotide
tgctgcccactcccatccacacagctgccggctcc

SEQ ID NO: 105310 - DNA, 35 bp, Artificial Sequence
  Synthetic oligonucleotide
tgcttgccgccactctctttgctgccagtaactcc

SEQ ID NO: 105311 - DNA, 35 bp, Artificial Sequence
  Synthetic oligonucleotide
gatggcaacccgctgcccgtttctcccccccttta

SEQ ID NO: 105312 - DNA, 35 bp, Artificial Sequence
  Synthetic oligonucleotide
accaccccgcgatcatgccccacttgtgctcccgc

SEQ ID NO: 105313 - DNA, 35 bp, Artificial Sequence
  Synthetic oligonucleotide
gacgcgtgcatgcttgtgctcgccttcatccttcc

SEQ ID NO: 105314 - DNA, 35 bp, Artificial Sequence
  Synthetic oligonucleotide
tacagccgccaccatccctgatccccccggcgccc

SEQ ID NO: 105315 - DNA, 35 bp, Artificial Sequence
  Synthetic oligonucleotide
tgtacgcccctggtgtccctcctttcccccttata

SEQ ID NO: 105316 - DNA, 35 bp, Artificial Sequence
  Synthetic oligonucleotide
ttcacctccctacgatatgttcctcgatgccgccc

SEQ ID NO: 105317 - DNA, 35 bp, Artificial Sequence
  Synthetic oligonucleotide
gcacctcaactatgctttagtcaccgccttaccac

SEQ ID NO: 105318 - DNA, 35 bp, Artificial Sequence
  Synthetic oligonucleotide
gggaagcccacgcacgtatccgccatcctctcgct

SEQ ID NO: 105319 - DNA, 35 bp, Artificial Sequence
  Synthetic oligonucleotide
atcgacctccccatgtggcatctttcccgcactca

SEQ ID NO: 105320 - DNA, 35 bp, Artificial Sequence
  Synthetic oligonucleotide
gccgaccaccccaatcagcctcgtatttgccttct

SEQ ID NO: 105321 - DNA, 35 bp, Artificial Sequence
  Synthetic oligonucleotide
tgtcttacgccggtctgtcccgttttgtcctcgcc

SEQ ID NO: 105322 - DNA, 36 bp, Artificial Sequence
  Synthetic oligonucleotide
tgctaccccttgtgatttccgcctcgttacttctta

SEQ ID NO: 105323 - DNA, 35 bp, Artificial Sequence
  Synthetic oligonucleotide
gttgcacgctcaccccttttagtcgccgatttgcc

SEQ ID NO: 105324 - DNA, 35 bp, Artificial Sequence
  Synthetic oligonucleotide
atgttcaccgcccttgttttgcttgataactgtcc

SEQ ID NO: 105325 - DNA, 36 bp, Artificial Sequence
  Synthetic oligonucleotide
tgcctcccttccgaactgtttcgcgcttgtgcccca

SEQ ID NO: 105326 - DNA, 35 bp, Artificial Sequence
  Synthetic oligonucleotide
tccgtcgcagtccggaccgccttctccgtcccccg

SEQ ID NO: 105327 - DNA, 35 bp, Artificial Sequence
  Synthetic oligonucleotide
gaccccccccgcccgtggtcacagacgggacctaa

SEQ ID NO: 105328 - DNA, 36 bp, Artificial Sequence
  Synthetic oligonucleotide
gtcaccatcatgccctgcccccacctcccattggta

SEQ ID NO: 105329 - DNA, 33 bp, Artificial Sequence
  Synthetic oligonucleotide
ggtgcaataagggggatcaaggaacggggaggg

SEQ ID NO: 105330 - DNA, 37 bp, Artificial Sequence
  Synthetic oligonucleotide
gtgctccgaccacatcctgcccgccatttgcccctga

SEQ ID NO: 105331 - DNA, 35 bp, Artificial Sequence
  Synthetic oligonucleotide
acgaccactgcatcctttccgccgagcccctctga

SEQ ID NO: 105332 - DNA, 35 bp, Artificial Sequence
  Synthetic oligonucleotide
gagatcatccaccgcccccatcgcctgcttgccac

SEQ ID NO: 105333 - DNA, 35 bp, Artificial Sequence
  Synthetic oligonucleotide
actccgcctcactgtcttgatccttcaccctggct

SEQ ID NO: 105334 - DNA, 33 bp, Artificial Sequence
  Synthetic oligonucleotide
tacgccccccgctgacaacgcctcttttgcaaa

SEQ ID NO: 105335 - DNA, 35 bp, Artificial Sequence
  Synthetic oligonucleotide
acacctgcctcccactacgggtctccttgttccgc

SEQ ID NO: 105336 - DNA, 35 bp, Artificial Sequence
  Synthetic oligonucleotide
gactacctcccgttgtagcagtgcccttcccgctc

SEQ ID NO: 105337 - DNA, 36 bp, Artificial Sequence
  Synthetic oligonucleotide
acccatgccgttcctctctattatgtccgttcctca

SEQ ID NO: 105338 - DNA, 37 bp, Artificial Sequence
  Synthetic oligonucleotide
tcccatcctgatctgtttgctccacgctcatcctcga

SEQ ID NO: 105339 - DNA, 35 bp, Artificial Sequence
  Synthetic oligonucleotide
gaccaacccctttcctggtgagacccagaccctcc

SEQ ID NO: 105340 - DNA, 35 bp, Artificial Sequence
  Synthetic oligonucleotide
gtgcacccgcctcccctcccagtactgagcctatt

SEQ ID NO: 105341 - DNA, 35 bp, Artificial Sequence
  Synthetic oligonucleotide
gtccacctactgatctcccgtactggcccaattct

SEQ ID NO: 105342 - DNA, 34 bp, Artificial Sequence
  Synthetic oligonucleotide
acacacccacgttttcgttcttatactgccccga

SEQ ID NO: 105343 - DNA, 35 bp, Artificial Sequence
  Synthetic oligonucleotide
ttccacctcgggcagttgtactcctgccacgttac

SEQ ID NO: 105344 - DNA, 35 bp, Artificial Sequence
  Synthetic oligonucleotide
atgtcaccgctgaattttcctgtacgccatgcccc

SEQ ID NO: 105345 - DNA, 36 bp, Artificial Sequence
  Synthetic oligonucleotide
acgccctcccgccaacgccgtacttttcctgcccga

SEQ ID NO: 105346 - DNA, 35 bp, Artificial Sequence
  Synthetic oligonucleotide
tccaacacccggcccctcttgagccagccacgccc

SEQ ID NO: 105347 - DNA, 38 bp, Artificial Sequence
  Synthetic oligonucleotide
gtgaagggcaacggtgggggaggaaacggggcagctga

SEQ ID NO: 105348 - DNA, 35 bp, Artificial Sequence
  Synthetic oligonucleotide
acactccgcccactgatattcaagtcgcctgacct

SEQ ID NO: 105349 - DNA, 35 bp, Artificial Sequence
  Synthetic oligonucleotide
tcacgtccacgcacgccctcgcccctcaaccgggt

SEQ ID NO: 105350 - DNA, 35 bp, Artificial Sequence
  Synthetic oligonucleotide
gaggggagatagagggtgtagggatagtgggggtg

SEQ ID NO: 105351 - DNA, 35 bp, Artificial Sequence
  Synthetic oligonucleotide
gccacccgcctctcagagtatctcccctctctctg

SEQ ID NO: 105352 - DNA, 35 bp, Artificial Sequence
  Synthetic oligonucleotide
tctggcctcctcgccccactcgccagtttgccacc

SEQ ID NO: 105353 - DNA, 35 bp, Artificial Sequence
  Synthetic oligonucleotide
acgacctgggctcctgttgttttcgccttatccct

SEQ ID NO: 105354 - DNA, 35 bp, Artificial Sequence
  Synthetic oligonucleotide
aatcacctctcgcatatcacaatccttcccacggt

SEQ ID NO: 105355 - DNA, 35 bp, Artificial Sequence
  Synthetic oligonucleotide
ttaaccgcactatcagccgaccacacgcctccgcc

SEQ ID NO: 105356 - DNA, 35 bp, Artificial Sequence
  Synthetic oligonucleotide
gagccacccacttgccgtttaatcttcacacttga

SEQ ID NO: 105357 - DNA, 38 bp, Artificial Sequence
  Synthetic oligonucleotide
gcgaaacaagggaaggccgggggggaggtgggtagtga

SEQ ID NO: 105358 - DNA, 37 bp, Artificial Sequence
  Synthetic oligonucleotide
tgagcctgccgccactctgtctagctccccccccgga

SEQ ID NO: 105359 - DNA, 35 bp, Artificial Sequence
  Synthetic oligonucleotide
tccagtcacccgttctcttccgtccagccttgcgc

SEQ ID NO: 105360 - DNA, 35 bp, Artificial Sequence
  Synthetic oligonucleotide
agcacctcaagtcatcgtcacctgctcgccctccg

SEQ ID NO: 105361 - DNA, 35 bp, Artificial Sequence
  Synthetic oligonucleotide
gagagaggtgggtgatggcgggtgggagattaaga

SEQ ID NO: 105362 - DNA, 35 bp, Artificial Sequence
  Synthetic oligonucleotide
gccaaagagtcacgccgcccacacgtcagcacctc

SEQ ID NO: 105363 - DNA, 36 bp, Artificial Sequence
  Synthetic oligonucleotide
agtatgggggcgggacaaggaggacgggcgagggga

SEQ ID NO: 105364 - DNA, 35 bp, Artificial Sequence
  Synthetic oligonucleotide
tatatccgctgccacccctcgggcgacgcactgcc

SEQ ID NO: 105365 - DNA, 35 bp, Artificial Sequence
  Synthetic oligonucleotide
acaatcaccgcccatcaagtttaaccgttcgctac

SEQ ID NO: 105366 - DNA, 35 bp, Artificial Sequence
  Synthetic oligonucleotide
tcaccgactctgtccaacgcccgcccttgagttcc

SEQ ID NO: 105367 - DNA, 35 bp, Artificial Sequence
  Synthetic oligonucleotide
ttgtacgccccgagcttttctgcacctgccccgca

SEQ ID NO: 105368 - DNA, 35 bp, Artificial Sequence
  Synthetic oligonucleotide
gtcacctctgctctggtcgcctaccccatccacct

SEQ ID NO: 105369 - DNA, 35 bp, Artificial Sequence
  Synthetic oligonucleotide
attccgtcaggcctctgcttcctattcgtcactcc

SEQ ID NO: 105370 - DNA, 35 bp, Artificial Sequence
  Synthetic oligonucleotide
agcgtgccgttcacatctgctcggtacctcccatc

SEQ ID NO: 105371 - DNA, 35 bp, Artificial Sequence
  Synthetic oligonucleotide
acccgctcaatctcgtatcacccacctgtaacctg

SEQ ID NO: 105372 - DNA, 35 bp, Artificial Sequence
  Synthetic oligonucleotide
atcgttccgcactgccctttgcctgttattcctta

SEQ ID NO: 105373 - DNA, 36 bp, Artificial Sequence
  Synthetic oligonucleotide
tccatccaatgctctatcgctccctggtgtttctca

SEQ ID NO: 105374 - DNA, 36 bp, Artificial Sequence
  Synthetic oligonucleotide
gtgcctgccccgctgtttgctccctcctgattggca

SEQ ID NO: 105375 - DNA, 38 bp, Artificial Sequence
  Synthetic oligonucleotide
gccccactccgacgctgtcctaggccctcttcacttga

SEQ ID NO: 105376 - DNA, 35 bp, Artificial Sequence
  Synthetic oligonucleotide
gtgcgccgccttatatcattgtcacctgtcttctc

SEQ ID NO: 105377 - DNA, 35 bp, Artificial Sequence
  Synthetic oligonucleotide
acactcccctcactacgatataacgacacccgccc

SEQ ID NO: 105378 - DNA, 35 bp, Artificial Sequence
  Synthetic oligonucleotide
tgttgcccactccatcatgtccgtccatctcgccg

SEQ ID NO: 105379 - DNA, 34 bp, Artificial Sequence
  Synthetic oligonucleotide
actgccccttcccatacgctatgacgcccgtagc

SEQ ID NO: 105380 - DNA, 32 bp, Artificial Sequence
  Synthetic oligonucleotide
tccacaactccggaatggtctctgtctcttca

SEQ ID NO: 105381 - DNA, 37 bp, Artificial Sequence
  Synthetic oligonucleotide
gccctgccccctattgccttctcccgcctgtgccgga

SEQ ID NO: 105382 - DNA, 35 bp, Artificial Sequence
  Synthetic oligonucleotide
atggggtgagggcggtaggggggaggaagaccagt

SEQ ID NO: 105383 - DNA, 35 bp, Artificial Sequence
  Synthetic oligonucleotide
gtcgcggccaccgtcgttccgctccatccttcgtg

SEQ ID NO: 105384 - DNA, 35 bp, Artificial Sequence
  Synthetic oligonucleotide
tccaccgtcccggcccccccttcctttgggtgacc

SEQ ID NO: 105385 - DNA, 35 bp, Artificial Sequence
  Synthetic oligonucleotide
acgacatcccaccacactgccggcccctccacgca

SEQ ID NO: 105386 - DNA, 36 bp, Artificial Sequence
  Synthetic oligonucleotide
ttgcctccccccgcgtcctcgttcccgcttgctcta

SEQ ID NO: 105387 - DNA, 35 bp, Artificial Sequence
  Synthetic oligonucleotide
gccagaccgccccacgtgtacacttttttcccttc

SEQ ID NO: 105388 - DNA, 37 bp, Artificial Sequence
  Synthetic oligonucleotide
agagacagtcatggagggggagggatgggttggtgga

SEQ ID NO: 105389 - DNA, 37 bp, Artificial Sequence
  Synthetic oligonucleotide
tccccaccgcctctctccataagtctgtcgctttgga

SEQ ID NO: 105390 - DNA, 35 bp, Artificial Sequence
  Synthetic oligonucleotide
tgccccacactgctcgcatcataagacctcccgcc

SEQ ID NO: 105391 - DNA, 35 bp, Artificial Sequence
  Synthetic oligonucleotide
gtggtaggagggcggggggggaagaaaaaaggcga

SEQ ID NO: 105392 - DNA, 35 bp, Artificial Sequence
  Synthetic oligonucleotide
tgtccagtccccattggttctatatcgccctgttc

SEQ ID NO: 105393 - DNA, 35 bp, Artificial Sequence
  Synthetic oligonucleotide
tcctgactcccgttctcttatgccttgctacacgc

SEQ ID NO: 105394 - DNA, 36 bp, Artificial Sequence
  Synthetic oligonucleotide
gacctgacgtgccctttgtccccaggcctctaccta

SEQ ID NO: 105395 - DNA, 35 bp, Artificial Sequence
  Synthetic oligonucleotide
aacacccccaaatgaccatatatgcgcacacctcc

SEQ ID NO: 105396 - DNA, 35 bp, Artificial Sequence
  Synthetic oligonucleotide
aatccctgcgcccattgatcgtcacccgcccctgt

SEQ ID NO: 105397 - DNA, 35 bp, Artificial Sequence
  Synthetic oligonucleotide
gcctaacgcaaatgcatgttccatcctgtcccgtt

SEQ ID NO: 105398 - DNA, 35 bp, Artificial Sequence
  Synthetic oligonucleotide
taggtcgatcctcacgtttttctgcccatccctgt

SEQ ID NO: 105399 - DNA, 35 bp, Artificial Sequence
  Synthetic oligonucleotide
gcctaccccccccggttccgcttacattgtcgccc

SEQ ID NO: 105400 - DNA, 35 bp, Artificial Sequence
  Synthetic oligonucleotide
tgacgccctcctgcgttccactccaacggtcccac

SEQ ID NO: 105401 - DNA, 35 bp, Artificial Sequence
  Synthetic oligonucleotide
actccgaacccctgatcgttccccgctgggccccc

SEQ ID NO: 105402 - DNA, 30 bp, Artificial Sequence
  Synthetic oligonucleotide
gatgcccccgctttggacgacccccctaaa

SEQ ID NO: 105403 - DNA, 36 bp, Artificial Sequence
  Synthetic oligonucleotide
gagctgacgtcaattcattagccccttccccatgca

SEQ ID NO: 105404 - DNA, 35 bp, Artificial Sequence
  Synthetic oligonucleotide
gcacgccgcccccttccatgccttgaggtttactc

SEQ ID NO: 105405 - DNA, 37 bp, Artificial Sequence
  Synthetic oligonucleotide
atgagacaggggaactggtgaaggaggaaggggacga

SEQ ID NO: 105406 - DNA, 35 bp, Artificial Sequence
  Synthetic oligonucleotide
attcgcgccctcgctttggccacaactgaccccgc

SEQ ID NO: 105407 - DNA, 35 bp, Artificial Sequence
  Synthetic oligonucleotide
tgtcgcatcactccactgtctccgccccaccggcc

SEQ ID NO: 105408 - DNA, 35 bp, Artificial Sequence
  Synthetic oligonucleotide
gctgtagccgccgcttgcgtaaacgtccctgtccc

SEQ ID NO: 105409 - DNA, 35 bp, Artificial Sequence
  Synthetic oligonucleotide
aacgcgttcccgcccctccgccacccgtctctgtt

SEQ ID NO: 105410 - DNA, 35 bp, Artificial Sequence
  Synthetic oligonucleotide
tatgcacctccttccgcgtattgccctgactgccg

SEQ ID NO: 105411 - DNA, 35 bp, Artificial Sequence
  Synthetic oligonucleotide
tgccgccttctagcctgccctagctcgcccccgcc

SEQ ID NO: 105412 - DNA, 35 bp, Artificial Sequence
  Synthetic oligonucleotide
agacgcgctcgctggttccaatcgtccctccgctc

SEQ ID NO: 105413 - DNA, 35 bp, Artificial Sequence
  Synthetic oligonucleotide
gtccacctccctgtcacctatgctacttagccaca

SEQ ID NO: 105414 - DNA, 35 bp, Artificial Sequence
  Synthetic oligonucleotide
tccccgcatcccttatggctatagcgctcccctgc

SEQ ID NO: 105415 - DNA, 35 bp, Artificial Sequence
  Synthetic oligonucleotide
gacctacgccgttgtcttcactctttccgactgtc

SEQ ID NO: 105416 - DNA, 35 bp, Artificial Sequence
  Synthetic oligonucleotide
atctgacgcctgcgcgcggcccccgccctattccc

SEQ ID NO: 105417 - DNA, 36 bp, Artificial Sequence
  Synthetic oligonucleotide
gtactgctcccgcccgcatatgctcctcggtgccac

SEQ ID NO: 105418 - DNA, 35 bp, Artificial Sequence
  Synthetic oligonucleotide
gtatccactcccccgcttacgtacacctgccatgc

SEQ ID NO: 105419 - DNA, 35 bp, Artificial Sequence
  Synthetic oligonucleotide
attcaccccagatagcctcccggtacccctgccac

SEQ ID NO: 105420 - DNA, 34 bp, Artificial Sequence
  Synthetic oligonucleotide
gcaacgacgacttaccctgtgccagtcccctccc

SEQ ID NO: 105421 - DNA, 37 bp, Artificial Sequence
  Synthetic oligonucleotide
gagacgggagtgcgagaaggtgggaagggggggcgga

SEQ ID NO: 105422 - DNA, 35 bp, Artificial Sequence
  Synthetic oligonucleotide
ggcccccgccgctcccagttgcccgtactcctgac

SEQ ID NO: 105423 - DNA, 35 bp, Artificial Sequence
  Synthetic oligonucleotide
tcactcccctccctctgtagtaacgtacatagccc

SEQ ID NO: 105424 - DNA, 35 bp, Artificial Sequence
  Synthetic oligonucleotide
tcgggaagggtgggtgggtggaatgagggtatggg

SEQ ID NO: 105425 - DNA, 36 bp, Artificial Sequence
  Synthetic oligonucleotide
gcgcagacctctcgccctcgtatactgctccctgta

SEQ ID NO: 105426 - DNA, 35 bp, Artificial Sequence
  Synthetic oligonucleotide
gagccgtacgaaagtacgaaagccaccgcccctct

SEQ ID NO: 105427 - DNA, 38 bp, Artificial Sequence
  Synthetic oligonucleotide
acacgcaccgtttgcgttgtgcccccccccgcccttga

SEQ ID NO: 105428 - DNA, 35 bp, Artificial Sequence
  Synthetic oligonucleotide
accacaccatcatcctatagcgtaactccatctgg

SEQ ID NO: 105429 - DNA, 35 bp, Artificial Sequence
  Synthetic oligonucleotide
tgaagggtgggggagtgggagggcggtgttgaggg

SEQ ID NO: 105430 - DNA, 35 bp, Artificial Sequence
  Synthetic oligonucleotide
tatgagcccacttgccctgtccttgatattccatg

SEQ ID NO: 105431 - DNA, 35 bp, Artificial Sequence
  Synthetic oligonucleotide
gcaaacccgcccccgacgccgaatccacccgtatg

SEQ ID NO: 105432 - DNA, 35 bp, Artificial Sequence
  Synthetic oligonucleotide
gtgagccgcctgatcctgttcctttctgtccctat

SEQ ID NO: 105433 - DNA, 35 bp, Artificial Sequence
  Synthetic oligonucleotide
gtgtcacacactgcccccctttgctacttaagccc

SEQ ID NO: 105434 - DNA, 35 bp, Artificial Sequence
  Synthetic oligonucleotide
acccccgctgccccagccacctgtctctaagtttc

SEQ ID NO: 105435 - DNA, 35 bp, Artificial Sequence
  Synthetic oligonucleotide
gatgcacgacccgcgcaatgttccaccctctccac

SEQ ID NO: 105436 - DNA, 36 bp, Artificial Sequence
  Synthetic oligonucleotide
cccactctgatccgtccagcttctcctgcaattcga

SEQ ID NO: 105437 - DNA, 36 bp, Artificial Sequence
  Synthetic oligonucleotide
ttccacccagttgtgaagccctcctatcccgccgta

SEQ ID NO: 105438 - DNA, 35 bp, Artificial Sequence
  Synthetic oligonucleotide
ttgccaacctctcgtgatgtctcgccctgttgctc

SEQ ID NO: 105439 - DNA, 35 bp, Artificial Sequence
  Synthetic oligonucleotide
gtacacccctcgcccgtttatacaaggtacttcct

SEQ ID NO: 105440 - DNA, 35 bp, Artificial Sequence
  Synthetic oligonucleotide
tgtacggtcacctctccgccagtctactccccgtc

SEQ ID NO: 105441 - DNA, 35 bp, Artificial Sequence
  Synthetic oligonucleotide
gatcacccgccactcatccgagcctctcctatgcc

SEQ ID NO: 105442 - DNA, 37 bp, Artificial Sequence
  Synthetic oligonucleotide
ttaccgccccgcccctcacctattgtcagacacacga

SEQ ID NO: 105443 - DNA, 35 bp, Artificial Sequence
  Synthetic oligonucleotide
gcctccgcctcttttgatcgatctccccttgcctg

SEQ ID NO: 105444 - DNA, 34 bp, Artificial Sequence
  Synthetic oligonucleotide
acatcacccctcaagctcttgagcctcctgttct

SEQ ID NO: 105445 - DNA, 35 bp, Artificial Sequence
  Synthetic oligonucleotide
tgccacccatcgcgtgcaagtacgaccttccgctc

SEQ ID NO: 105446 - DNA, 37 bp, Artificial Sequence
  Synthetic oligonucleotide
gtcacgggaacaacgggtgaagggggggtgcgggtga

SEQ ID NO: 105447 - DNA, 36 bp, Artificial Sequence
  Synthetic oligonucleotide
agttcgccgccccgccctcgccctgagtcctctgca

SEQ ID NO: 105448 - DNA, 35 bp, Artificial Sequence
  Synthetic oligonucleotide
agaccaacgtcctgctctctgccgtccctctggcc

SEQ ID NO: 105449 - DNA, 35 bp, Artificial Sequence
  Synthetic oligonucleotide
gtccactcctccgaagttccgtgacttcctcgtac

SEQ ID NO: 105450 - DNA, 35 bp, Artificial Sequence
  Synthetic oligonucleotide
acgatccccgactgttaccgcctccgcccctccac

SEQ ID NO: 105451 - DNA, 35 bp, Artificial Sequence
  Synthetic oligonucleotide
tcgcttcccagccttgttcacgcgcccccctttca

SEQ ID NO: 105452 - DNA, 35 bp, Artificial Sequence
  Synthetic oligonucleotide
ggagcccacgctgccgttgtcatttctccccatct

SEQ ID NO: 105453 - DNA, 35 bp, Artificial Sequence
  Synthetic oligonucleotide
tgacacccctgattttcgctccggtccctgctccc

SEQ ID NO: 105454 - DNA, 37 bp, Artificial Sequence
  Synthetic oligonucleotide
tccgatcgcgcccatgtttccccctctttccccgtga

SEQ ID NO: 105455 - DNA, 35 bp, Artificial Sequence
  Synthetic oligonucleotide
gcaccgctcccggggtttcactgttcactgcctcc

SEQ ID NO: 105456 - DNA, 35 bp, Artificial Sequence
  Synthetic oligonucleotide
gcatacccgtcacactgtgtcatcgtccgccttcc

SEQ ID NO: 105457 - DNA, 35 bp, Artificial Sequence
  Synthetic oligonucleotide
tgcaccctcctcagtggccccgcttcactcttcat

SEQ ID NO: 105458 - DNA, 35 bp, Artificial Sequence
  Synthetic oligonucleotide
tgcgacctccgagcccgtttgccactatttcctag

SEQ ID NO: 105459 - DNA, 35 bp, Artificial Sequence
  Synthetic oligonucleotide
ttcgtcccccaccacactgcggatttggtcctttc

SEQ ID NO: 105460 - DNA, 35 bp, Artificial Sequence
  Synthetic oligonucleotide
ggaggctcacccatgtcatcctgctcttatcaccg

SEQ ID NO: 105461 - DNA, 35 bp, Artificial Sequence
  Synthetic oligonucleotide
gaatcacctccgctgccgcattcgccttcttccat

SEQ ID NO: 105462 - DNA, 36 bp, Artificial Sequence
  Synthetic oligonucleotide
gttttcccgcccgcataaacgccccatcctttcctg

SEQ ID NO: 105463 - DNA, 35 bp, Artificial Sequence
  Synthetic oligonucleotide
acttccgcccccctcatgatagccctgcgaatttc

SEQ ID NO: 105464 - DNA, 35 bp, Artificial Sequence
  Synthetic oligonucleotide
tctcgcccgcccgggttaccgatgccccacgcccc

SEQ ID NO: 105465 - DNA, 35 bp, Artificial Sequence
  Synthetic oligonucleotide
ggtgaagtggggcataggcgggggcaaggagggaa

SEQ ID NO: 105466 - DNA, 35 bp, Artificial Sequence
  Synthetic oligonucleotide
tttcccgctacgactagcctcccgtgcattcccca

SEQ ID NO: 105467 - DNA, 35 bp, Artificial Sequence
  Synthetic oligonucleotide
acgaccacctccgctctcacattagcgcacactat

SEQ ID NO: 105468 - DNA, 35 bp, Artificial Sequence
  Synthetic oligonucleotide
tatccaccccactacttgtccacgttgacaggact

SEQ ID NO: 105469 - DNA, 34 bp, Artificial Sequence
  Synthetic oligonucleotide
ttggagccgccatcccgcctagatcgtaccctcg

SEQ ID NO: 105470 - DNA, 37 bp, Artificial Sequence
  Synthetic oligonucleotide
ggggagggccagtgaaagggggcaactatcttgggga

SEQ ID NO: 105471 - DNA, 35 bp, Artificial Sequence
  Synthetic oligonucleotide
tacatcccgaagtgtatgccgcactccccgcctcc

SEQ ID NO: 105472 - DNA, 35 bp, Artificial Sequence
  Synthetic oligonucleotide
aaccccccgctcctgaacgtaacgctgatcgcttc

SEQ ID NO: 105473 - DNA, 37 bp, Artificial Sequence
  Synthetic oligonucleotide
gggagacgaagagttgggaagggctacggagggggga

SEQ ID NO: 105474 - DNA, 35 bp, Artificial Sequence
  Synthetic oligonucleotide
tagcccctcgcattgtcccgctggtacctcactca

SEQ ID NO: 105475 - DNA, 35 bp, Artificial Sequence
  Synthetic oligonucleotide
gtggatcccctccccgatgctatgccctctgttta

SEQ ID NO: 105476 - DNA, 35 bp, Artificial Sequence
  Synthetic oligonucleotide
tcaccgttgccgctccactatcgccttgtctatcc

SEQ ID NO: 105477 - DNA, 35 bp, Artificial Sequence
  Synthetic oligonucleotide
tcagtcgtcgtcctcctgttcacccgtttcgtgcc

SEQ ID NO: 105478 - DNA, 35 bp, Artificial Sequence
  Synthetic oligonucleotide
actcccgccactcgtaggtgaaaaccgacccccct

SEQ ID NO: 105479 - DNA, 35 bp, Artificial Sequence
  Synthetic oligonucleotide
atcacccctgtacctcctgtctagccatgtattgg

SEQ ID NO: 105480 - DNA, 35 bp, Artificial Sequence
  Synthetic oligonucleotide
accccccgctccactgtgctactaggtcgttcctt

SEQ ID NO: 105481 - DNA, 35 bp, Artificial Sequence
  Synthetic oligonucleotide
actgtcagtcgggaggaaggggtggtgggtgcggg

SEQ ID NO: 105482 - DNA, 35 bp, Artificial Sequence
  Synthetic oligonucleotide
attgccgagtcgcatctgccccgtactcttcccgc

SEQ ID NO: 105483 - DNA, 35 bp, Artificial Sequence
  Synthetic oligonucleotide
tgctcccccgcacgatggtctcttgctctccccgt

SEQ ID NO: 105484 - DNA, 30 bp, Artificial Sequence
  Synthetic oligonucleotide
tcacctgcccactgaagcccctagacctct

SEQ ID NO: 105485 - DNA, 35 bp, Artificial Sequence
  Synthetic oligonucleotide
agggtggtgccgtgggtacagaagtggggtattac

SEQ ID NO: 105486 - DNA, 35 bp, Artificial Sequence
  Synthetic oligonucleotide
gcaacgcacggccagtcactgtctccatcctgctc

SEQ ID NO: 105487 - DNA, 36 bp, Artificial Sequence
  Synthetic oligonucleotide
atgggggtgggcgggtgagctgtggggagacatcga

SEQ ID NO: 105488 - DNA, 36 bp, Artificial Sequence
  Synthetic oligonucleotide
gtgcaccgacgccgttgtccgtattcccacctctca

SEQ ID NO: 105489 - DNA, 35 bp, Artificial Sequence
  Synthetic oligonucleotide
gacattcatccgcccgtattagtcccctgccttgt

SEQ ID NO: 105490 - DNA, 35 bp, Artificial Sequence
  Synthetic oligonucleotide
gacaacaccgcccagccttgccggacactctacac

SEQ ID NO: 105491 - DNA, 36 bp, Artificial Sequence
  Synthetic oligonucleotide
ttatcgcccaactcgctctataccccccgctgggga

SEQ ID NO: 105492 - DNA, 36 bp, Artificial Sequence
  Synthetic oligonucleotide
atggtggtgggaggggataggggaaggtgacgtata

SEQ ID NO: 105493 - DNA, 35 bp, Artificial Sequence
  Synthetic oligonucleotide
tccttgctgccctagccccctgcattatagcccat

SEQ ID NO: 105494 - DNA, 35 bp, Artificial Sequence
  Synthetic oligonucleotide
tgttcacctcacaggttcgtctcagccctcctccc

SEQ ID NO: 105495 - DNA, 35 bp, Artificial Sequence
  Synthetic oligonucleotide
tccaccccccctgttctcccggcccgatatgcccg

SEQ ID NO: 105496 - DNA, 35 bp, Artificial Sequence
  Synthetic oligonucleotide
gacacgtcatcgtaccgtcccatcctcctactcga

SEQ ID NO: 105497 - DNA, 35 bp, Artificial Sequence
  Synthetic oligonucleotide
gcccatgcccctcctggcccctttaaaagacacca

SEQ ID NO: 105498 - DNA, 35 bp, Artificial Sequence
  Synthetic oligonucleotide
gaccccccggaactttcttagcgagcctgccccac

SEQ ID NO: 105499 - DNA, 35 bp, Artificial Sequence
  Synthetic oligonucleotide
gtgtcaccccgcctcccaagccagagggcttttcc

SEQ ID NO: 105500 - DNA, 35 bp, Artificial Sequence
  Synthetic oligonucleotide
tgtgccccctctctgatctgaatcaaccctgatca

SEQ ID NO: 105501 - DNA, 35 bp, Artificial Sequence
  Synthetic oligonucleotide
tccgtgcgcccgacgattactcctgcttccccgtt

SEQ ID NO: 105502 - DNA, 35 bp, Artificial Sequence
  Synthetic oligonucleotide
gactcctccactctcgtaaccagggacctctcact

SEQ ID NO: 105503 - DNA, 35 bp, Artificial Sequence
  Synthetic oligonucleotide
atgacctctaccgcctcgttaccctggcaccatgc

SEQ ID NO: 105504 - DNA, 36 bp, Artificial Sequence
  Synthetic oligonucleotide
gccctcgccagtttgcttgccctctgcttgtaccga

SEQ ID NO: 105505 - DNA, 35 bp, Artificial Sequence
  Synthetic oligonucleotide
gactaagcagctcatcacgcccgcatatgctcccc

SEQ ID NO: 105506 - DNA, 32 bp, Artificial Sequence
  Synthetic oligonucleotide
accccccacccactgttaaacggataacaccc

SEQ ID NO: 105507 - DNA, 35 bp, Artificial Sequence
  Synthetic oligonucleotide
atggtctccgcccccgcgtttaggtaactcccctc

SEQ ID NO: 105508 - DNA, 35 bp, Artificial Sequence
  Synthetic oligonucleotide
gcctcgcctccgtgccccattgttattcgtattcg

SEQ ID NO: 105509 - DNA, 35 bp, Artificial Sequence
  Synthetic oligonucleotide
agccaccctatgcctttattcgacccgtcgctccc

SEQ ID NO: 105510 - DNA, 35 bp, Artificial Sequence
  Synthetic oligonucleotide
tcgccatcctccatccttatgcctactgtttccgc

SEQ ID NO: 105511 - DNA, 36 bp, Artificial Sequence
  Synthetic oligonucleotide
aaagcggggggaggaaggggcactgagggacatcaa

SEQ ID NO: 105512 - DNA, 35 bp, Artificial Sequence
  Synthetic oligonucleotide
gccactctgactgctcccccccgactacgtccgct

SEQ ID NO: 105513 - DNA, 37 bp, Artificial Sequence
  Synthetic oligonucleotide
gaaacagaaggacgggagtggagggaggcgatcgaga

SEQ ID NO: 105514 - DNA, 35 bp, Artificial Sequence
  Synthetic oligonucleotide
tgacgggagcaagggaatggggggaggtagggcgt

SEQ ID NO: 105515 - DNA, 35 bp, Artificial Sequence
  Synthetic oligonucleotide
tcacgctgcaccgctctcatttcctactgccacac

SEQ ID NO: 105516 - DNA, 35 bp, Artificial Sequence
  Synthetic oligonucleotide
gagaaggacaacgagtaggaagggtggggggagga

SEQ ID NO: 105517 - DNA, 35 bp, Artificial Sequence
  Synthetic oligonucleotide
ttgcgtaggctacccaccctgttcggtcctcgctc

SEQ ID NO: 105518 - DNA, 36 bp, Artificial Sequence
  Synthetic oligonucleotide
ttcatcccgcccagactggccatgtccttgctttca

SEQ ID NO: 105519 - DNA, 35 bp, Artificial Sequence
  Synthetic oligonucleotide
taccccgacctacgctttttgccgccccccttggg

SEQ ID NO: 105520 - DNA, 35 bp, Artificial Sequence
  Synthetic oligonucleotide
atccccgctcacccgttttggactcggccttccta

SEQ ID NO: 105521 - DNA, 35 bp, Artificial Sequence
  Synthetic oligonucleotide
gcccctccctcctctcatcgcccgcttctttggtg

SEQ ID NO: 105522 - DNA, 38 bp, Artificial Sequence
  Synthetic oligonucleotide
gcaccgccgtgccatttggcctgtaccttcttccctga

SEQ ID NO: 105523 - DNA, 36 bp, Artificial Sequence
  Synthetic oligonucleotide
aactccacccctctgctgagcacctactactgttta

SEQ ID NO: 105524 - DNA, 35 bp, Artificial Sequence
  Synthetic oligonucleotide
gatgagggtgggaagggaagtaagtaatacgtggg

SEQ ID NO: 105525 - DNA, 35 bp, Artificial Sequence
  Synthetic oligonucleotide
tctggagccctcaatcacccacgcccataccgatg

SEQ ID NO: 105526 - DNA, 35 bp, Artificial Sequence
  Synthetic oligonucleotide
tgatgctctcctctgtccctgttctggcctcactg

SEQ ID NO: 105527 - DNA, 35 bp, Artificial Sequence
  Synthetic oligonucleotide
gctcgcctctgagcacgtaacttatatcacctcta

SEQ ID NO: 105528 - DNA, 35 bp, Artificial Sequence
  Synthetic oligonucleotide
acctccgcctggcgtatttccctgttcctggtctc

SEQ ID NO: 105529 - DNA, 35 bp, Artificial Sequence
  Synthetic oligonucleotide
tatccgccccccactttctaccgtcttgcgctcgc

SEQ ID NO: 105530 - DNA, 36 bp, Artificial Sequence
  Synthetic oligonucleotide
tcctgccctcactcgcctgttatgtaccccttgcta

SEQ ID NO: 105531 - DNA, 35 bp, Artificial Sequence
  Synthetic oligonucleotide
acatgccccggcatccccttatttcacgctcttcg

SEQ ID NO: 105532 - DNA, 35 bp, Artificial Sequence
  Synthetic oligonucleotide
gaccccctcacgtgcacgcatacagacctccaccc

SEQ ID NO: 105533 - DNA, 35 bp, Artificial Sequence
  Synthetic oligonucleotide
gtgtccaacccgtgcgcccaccccgcttatcatgc

SEQ ID NO: 105534 - DNA, 35 bp, Artificial Sequence
  Synthetic oligonucleotide
gttctccgcccgctctttttgtaccgcctgcacca

SEQ ID NO: 105535 - DNA, 35 bp, Artificial Sequence
  Synthetic oligonucleotide
tacgcccactgccccgatgttcgtctctctttgcc

SEQ ID NO: 105536 - DNA, 36 bp, Artificial Sequence
  Synthetic oligonucleotide
gtccccccgacgagctgtattcgtcacccttaccca

SEQ ID NO: 105537 - DNA, 35 bp, Artificial Sequence
  Synthetic oligonucleotide
gtagcccgccctcttctctgagccctctctcctgg

SEQ ID NO: 105538 - DNA, 35 bp, Artificial Sequence
  Synthetic oligonucleotide
tgcctgccgcctcatcttttctcccgttgatcctg

SEQ ID NO: 105539 - DNA, 35 bp, Artificial Sequence
  Synthetic oligonucleotide
accacaccccgagcctataaccgaaggccttgccc

SEQ ID NO: 105540 - DNA, 35 bp, Artificial Sequence
  Synthetic oligonucleotide
gcccttacgcctctatgccccatgttcacaactcg

SEQ ID NO: 105541 - DNA, 35 bp, Artificial Sequence
  Synthetic oligonucleotide
tacatcagatgcacaatgtcgctttctccccccgc

SEQ ID NO: 105542 - DNA, 35 bp, Artificial Sequence
  Synthetic oligonucleotide
gcctggtgccccccttgcccacccactagctacgc

SEQ ID NO: 105543 - DNA, 37 bp, Artificial Sequence
  Synthetic oligonucleotide
gcgcaaggtggggggtcgggagggaggggtgaaacga

SEQ ID NO: 105544 - DNA, 35 bp, Artificial Sequence
  Synthetic oligonucleotide
aacacccgaccggagctccgaccccccacaactat

SEQ ID NO: 105545 - DNA, 35 bp, Artificial Sequence
  Synthetic oligonucleotide
gtcacgcctcgccgccccgcccctcgtctacagct

SEQ ID NO: 105546 - DNA, 37 bp, Artificial Sequence
  Synthetic oligonucleotide
tccgccccctcgctgcccgccccatatccagacctga

SEQ ID NO: 105547 - DNA, 35 bp, Artificial Sequence
  Synthetic oligonucleotide
gtgccccgccctgccactcttttgcccgtctttga

SEQ ID NO: 105548 - DNA, 36 bp, Artificial Sequence
  Synthetic oligonucleotide
tgtaccccctcattgtttttggtcctttctatccga

SEQ ID NO: 105549 - DNA, 35 bp, Artificial Sequence
  Synthetic oligonucleotide
gtaccaggcctgttttcttttgagcgttgcctccc

SEQ ID NO: 105550 - DNA, 35 bp, Artificial Sequence
  Synthetic oligonucleotide
gccccaccttcatacgtgctcgattcaccttctta

SEQ ID NO: 105551 - DNA, 35 bp, Artificial Sequence
  Synthetic oligonucleotide
ttgcccacctatcaatgcatgcccccgcttaccac

SEQ ID NO: 105552 - DNA, 35 bp, Artificial Sequence
  Synthetic oligonucleotide
tccgctgccccccggccccacccatcatcggttcg

SEQ ID NO: 105553 - DNA, 35 bp, Artificial Sequence
  Synthetic oligonucleotide
actgcccggccaatttgacgctctcatgtaccacc

SEQ ID NO: 105554 - DNA, 36 bp, Artificial Sequence
  Synthetic oligonucleotide
atggagagagggtcagggagggtttccgagatagta

SEQ ID NO: 105555 - DNA, 35 bp, Artificial Sequence
  Synthetic oligonucleotide
accgcccatctggcctatgaaaccgctcccctcaa

SEQ ID NO: 105556 - DNA, 35 bp, Artificial Sequence
  Synthetic oligonucleotide
gcgtatcaacgccctccccgtccctgccccttagt

SEQ ID NO: 105557 - DNA, 35 bp, Artificial Sequence
  Synthetic oligonucleotide
tgccacctctacatctcgcatgggtccctccatcc

SEQ ID NO: 105558 - DNA, 35 bp, Artificial Sequence
  Synthetic oligonucleotide
gacgtctccgctctaccttgttcacgcctctctgt

SEQ ID NO: 105559 - DNA, 35 bp, Artificial Sequence
  Synthetic oligonucleotide
gccaaagggtggggatagagggaggggacggcata

SEQ ID NO: 105560 - DNA, 35 bp, Artificial Sequence
  Synthetic oligonucleotide
actaccccagcatgcctatgcctcgtcccttcctc

SEQ ID NO: 105561 - DNA, 34 bp, Artificial Sequence
  Synthetic oligonucleotide
ttgctatgtcgcagtccttcccgttcacccgccg

SEQ ID NO: 105562 - DNA, 37 bp, Artificial Sequence
  Synthetic oligonucleotide
ttgacccatcgcctgaggcatcgtaagcctcccccga

SEQ ID NO: 105563 - DNA, 36 bp, Artificial Sequence
  Synthetic oligonucleotide
gatagaagggtagaacgaagggggatggtataggta

SEQ ID NO: 105564 - DNA, 35 bp, Artificial Sequence
  Synthetic oligonucleotide
tcacctcccccctcgtatcatcattagacagggta

SEQ ID NO: 105565 - DNA, 35 bp, Artificial Sequence
  Synthetic oligonucleotide
tgtgtcctgccacatccccttgtctccgcctttcg

SEQ ID NO: 105566 - DNA, 37 bp, Artificial Sequence
  Synthetic oligonucleotide
acagaggggatagcgtgggaacgggaggagggggaga

SEQ ID NO: 105567 - DNA, 37 bp, Artificial Sequence
  Synthetic oligonucleotide
atccacctgccgtgctgttaccgattccaccccttga

SEQ ID NO: 105568 - DNA, 35 bp, Artificial Sequence
  Synthetic oligonucleotide
acccgccgcctgtagtctattgtcctcttccccat

SEQ ID NO: 105569 - DNA, 35 bp, Artificial Sequence
  Synthetic oligonucleotide
acacctctctgccgtgttctagatctcatccgtcc

SEQ ID NO: 105570 - DNA, 35 bp, Artificial Sequence
  Synthetic oligonucleotide
accacccgttactgtttaccacacgccgttattgc

SEQ ID NO: 105571 - DNA, 35 bp, Artificial Sequence
  Synthetic oligonucleotide
ggtcccctccgatcatgcccgtactccgccaacgc

SEQ ID NO: 105572 - DNA, 35 bp, Artificial Sequence
  Synthetic oligonucleotide
ttgcacccgccctctgccactatgccatctttaaa

SEQ ID NO: 105573 - DNA, 35 bp, Artificial Sequence
  Synthetic oligonucleotide
tatctcgcacccgccactgtgcgtgatcctttccc

SEQ ID NO: 105574 - DNA, 36 bp, Artificial Sequence
  Synthetic oligonucleotide
gcgaagggggaggggcgaagggggggaaacaatcaa

SEQ ID NO: 105575 - DNA, 35 bp, Artificial Sequence
  Synthetic oligonucleotide
tgtaccgcgccgcgcatcttcccccacgcccgcct

SEQ ID NO: 105576 - DNA, 35 bp, Artificial Sequence
  Synthetic oligonucleotide
tagcattgccgccgctcgttttatcctctctttac

SEQ ID NO: 105577 - DNA, 35 bp, Artificial Sequence
  Synthetic oligonucleotide
gcgcgcacccttcgcctcctgtcactactgcttgc

SEQ ID NO: 105578 - DNA, 37 bp, Artificial Sequence
  Synthetic oligonucleotide
tgaagcccctatcctgctcgccacatccccttcgtga

SEQ ID NO: 105579 - DNA, 35 bp, Artificial Sequence
  Synthetic oligonucleotide
gtgctcgccgtgcccatctttctgcgtgtctctct

SEQ ID NO: 105580 - DNA, 36 bp, Artificial Sequence
  Synthetic oligonucleotide
tccacccctctaatgacctcgccccgtactatcgta

SEQ ID NO: 105581 - DNA, 35 bp, Artificial Sequence
  Synthetic oligonucleotide
tgcggacgggagggcgggctagggcaaaaaagggt

SEQ ID NO: 105582 - DNA, 36 bp, Artificial Sequence
  Synthetic oligonucleotide
gatggctcgcccagtgtccgcccactctccctccga

SEQ ID NO: 105583 - DNA, 35 bp, Artificial Sequence
  Synthetic oligonucleotide
gagttgcaccatcctgtccacgctgacccttaact

SEQ ID NO: 105584 - DNA, 35 bp, Artificial Sequence
  Synthetic oligonucleotide
tgcaaccgttcccgtgcgcctggccctaccgttcc

SEQ ID NO: 105585 - DNA, 35 bp, Artificial Sequence
  Synthetic oligonucleotide
tcactgcacctcgcctactctcgtcgtttacgcca

SEQ ID NO: 105586 - DNA, 35 bp, Artificial Sequence
  Synthetic oligonucleotide
tcacccgcctgagccaacgcttctctgttccatca

SEQ ID NO: 105587 - DNA, 35 bp, Artificial Sequence
  Synthetic oligonucleotide
atgcgcccccgtctacaactgcgcccctcggttcc

SEQ ID NO: 105588 - DNA, 35 bp, Artificial Sequence
  Synthetic oligonucleotide
gtcactgcctgcatctctcgtacctccgcttatgg

SEQ ID NO: 105589 - DNA, 35 bp, Artificial Sequence
  Synthetic oligonucleotide
gcgaaaggggggagggaggatagggtttaagggtg

SEQ ID NO: 105590 - DNA, 36 bp, Artificial Sequence
  Synthetic oligonucleotide
tccacctcgttaccatcgcttactccagtgcctcca

SEQ ID NO: 105591 - DNA, 36 bp, Artificial Sequence
  Synthetic oligonucleotide
tcatatcccgcccgctccctccagtcctactgcgta

SEQ ID NO: 105592 - DNA, 35 bp, Artificial Sequence
  Synthetic oligonucleotide
gacgccctatgcgttttccgccttggtaccatcct

SEQ ID NO: 105593 - DNA, 35 bp, Artificial Sequence
  Synthetic oligonucleotide
tcactcccgatgagtacataacacccacacccttc

SEQ ID NO: 105594 - DNA, 35 bp, Artificial Sequence
  Synthetic oligonucleotide
gtcgctcagcccttctatggcccccacattcctcg

SEQ ID NO: 105595 - DNA, 35 bp, Artificial Sequence
  Synthetic oligonucleotide
ggatcaccctctcgatctttgtttttcacgctcgc

SEQ ID NO: 105596 - DNA, 35 bp, Artificial Sequence
  Synthetic oligonucleotide
gacgtatgtcagaagtccctccgtcccacctcatg

SEQ ID NO: 105597 - DNA, 35 bp, Artificial Sequence
  Synthetic oligonucleotide
gcactccgcatcacagtcccatgatccttctgcac

SEQ ID NO: 105598 - DNA, 35 bp, Artificial Sequence
  Synthetic oligonucleotide
gacctgaccttcgctatgtacgactctgcccatcc

SEQ ID NO: 105599 - DNA, 35 bp, Artificial Sequence
  Synthetic oligonucleotide
taccccatccatgcgagcgagagcaccgtcccacc

SEQ ID NO: 105600 - DNA, 35 bp, Artificial Sequence
  Synthetic oligonucleotide
tccgccctgacccgctgcgatactccatgttctcc

SEQ ID NO: 105601 - DNA, 38 bp, Artificial Sequence
  Synthetic oligonucleotide
ttcgagacgagggtggggagggggaaagggcacagtga

SEQ ID NO: 105602 - DNA, 35 bp, Artificial Sequence
  Synthetic oligonucleotide
gccaactcgccgccagctctcgccccatgtactcg

SEQ ID NO: 105603 - DNA, 36 bp, Artificial Sequence
  Synthetic oligonucleotide
tagtcccccccagtgcttgccccgacccatctcata

SEQ ID NO: 105604 - DNA, 36 bp, Artificial Sequence
  Synthetic oligonucleotide
gtgggacgtagggaaagcggggcagaggggaaggca

SEQ ID NO: 105605 - DNA, 38 bp, Artificial Sequence
  Synthetic oligonucleotide
ggaggtacgggaagggaataggggggacgggagagtga

SEQ ID NO: 105606 - DNA, 35 bp, Artificial Sequence
  Synthetic oligonucleotide
gacccccgaacgagttctgtcatggccatcccccc

SEQ ID NO: 105607 - DNA, 36 bp, Artificial Sequence
  Synthetic oligonucleotide
gcccaccgccctctgtgatcatacggttccttccca

SEQ ID NO: 105608 - DNA, 35 bp, Artificial Sequence
  Synthetic oligonucleotide
ttagggaggggagggtgggtactgtagtggcacgg

SEQ ID NO: 105609 - DNA, 35 bp, Artificial Sequence
  Synthetic oligonucleotide
gagacaggacgggagtgggggggacggttgtactg

SEQ ID NO: 105610 - DNA, 35 bp, Artificial Sequence
  Synthetic oligonucleotide
tttgacctgcctcggcctgcttacgtatccttctc

SEQ ID NO: 105611 - DNA, 35 bp, Artificial Sequence
  Synthetic oligonucleotide
tcaccgccggaacaagcgtacgcccgccccaccct

SEQ ID NO: 105612 - DNA, 35 bp, Artificial Sequence
  Synthetic oligonucleotide
tccgccatcgcgctctttatgttttgtacatcctc

SEQ ID NO: 105613 - DNA, 38 bp, Artificial Sequence
  Synthetic oligonucleotide
ttgcacacgctatctgctttttaccgccttcaccctga

SEQ ID NO: 105614 - DNA, 35 bp, Artificial Sequence
  Synthetic oligonucleotide
atcaccctcgaatctgtacgccgccccccacgtgg

SEQ ID NO: 105615 - DNA, 36 bp, Artificial Sequence
  Synthetic oligonucleotide
gcacacaccacctgcgtccagccgccgaccacaaca

SEQ ID NO: 105616 - DNA, 35 bp, Artificial Sequence
  Synthetic oligonucleotide
gtaggggccgatgaagacactagggtgggagggga

SEQ ID NO: 105617 - DNA, 35 bp, Artificial Sequence
  Synthetic oligonucleotide
aatggcgggggggcaatatgtggggaggaggagtc

SEQ ID NO: 105618 - DNA, 35 bp, Artificial Sequence
  Synthetic oligonucleotide
tgtacacctcgctgatcccaacctccggtctcgcc

SEQ ID NO: 105619 - DNA, 35 bp, Artificial Sequence
  Synthetic oligonucleotide
acaccgacctactcttgtacgccccccctctggtc

SEQ ID NO: 105620 - DNA, 35 bp, Artificial Sequence
  Synthetic oligonucleotide
accgcctcgactcccgtctattgttccctccaacg

SEQ ID NO: 105621 - DNA, 35 bp, Artificial Sequence
  Synthetic oligonucleotide
gccacgacccccccctatccgtccgccgcctgact

SEQ ID NO: 105622 - DNA, 35 bp, Artificial Sequence
  Synthetic oligonucleotide
atctcccacccgcattgttaaagtcgcccccataa

SEQ ID NO: 105623 - DNA, 34 bp, Artificial Sequence
  Synthetic oligonucleotide
ggtgcctcagaggctttgtcccgcctttcccccg

SEQ ID NO: 105624 - DNA, 35 bp, Artificial Sequence
  Synthetic oligonucleotide
atgtccgcccccatctccacgtcaggaacgtcctc

SEQ ID NO: 105625 - DNA, 35 bp, Artificial Sequence
  Synthetic oligonucleotide
aaccacccgccgactcatgtttcattgcgcgcacc

SEQ ID NO: 105626 - DNA, 36 bp, Artificial Sequence
  Synthetic oligonucleotide
gcccgccccttggttgtgtacccgttcttcccttca

SEQ ID NO: 105627 - DNA, 35 bp, Artificial Sequence
  Synthetic oligonucleotide
aacccgcgccctggcccccgtactttttcaccgtt

SEQ ID NO: 105628 - DNA, 35 bp, Artificial Sequence
  Synthetic oligonucleotide
tgctacttcccttacttccttggttcctcgtgggt

SEQ ID NO: 105629 - DNA, 35 bp, Artificial Sequence
  Synthetic oligonucleotide
gtgacacctcatatggcacatcttgttcactcccc

SEQ ID NO: 105630 - DNA, 35 bp, Artificial Sequence
  Synthetic oligonucleotide
gacgaagggggggtggcaagggggctagatcaaca

SEQ ID NO: 105631 - DNA, 35 bp, Artificial Sequence
  Synthetic oligonucleotide
acatcgccccccgccgcatcgcaattaggtcccgc

SEQ ID NO: 105632 - DNA, 35 bp, Artificial Sequence
  Synthetic oligonucleotide
tacccccctgccctattgacagctgtactctttgc

SEQ ID NO: 105633 - DNA, 35 bp, Artificial Sequence
  Synthetic oligonucleotide
gtgcgacctcctcgtgtaccgtgtccctccgctcg

SEQ ID NO: 105634 - DNA, 35 bp, Artificial Sequence
  Synthetic oligonucleotide
ttgcactgaatacggagagggggagggggggtccc

SEQ ID NO: 105635 - DNA, 35 bp, Artificial Sequence
  Synthetic oligonucleotide
gtatgccccgtccgttatcgtaatacccctcttcc

SEQ ID NO: 105636 - DNA, 30 bp, Artificial Sequence
  Synthetic oligonucleotide
tacttccccccgacccgtcctccgtaataa

SEQ ID NO: 105637 - DNA, 35 bp, Artificial Sequence
  Synthetic oligonucleotide
gaacacggcgccttgtctttcgctcccctacctgt

SEQ ID NO: 105638 - DNA, 35 bp, Artificial Sequence
  Synthetic oligonucleotide
tacgccacccacacccagtagcgactctgccctca

SEQ ID NO: 105639 - DNA, 37 bp, Artificial Sequence
  Synthetic oligonucleotide
agttacatccgccccatgtcgctcactgtacccttga

SEQ ID NO: 105640 - DNA, 35 bp, Artificial Sequence
  Synthetic oligonucleotide
agtcaactccagccacgccgatcttcctgcctccg

SEQ ID NO: 105641 - DNA, 35 bp, Artificial Sequence
  Synthetic oligonucleotide
tagtcccctcccgccctgttttcattgcacccatg

SEQ ID NO: 105642 - DNA, 35 bp, Artificial Sequence
  Synthetic oligonucleotide
gtcgtcctccgcacttgtgaccgctcctttgctgc

SEQ ID NO: 105643 - DNA, 35 bp, Artificial Sequence
  Synthetic oligonucleotide
tccagccccggctctctaaacgactcgcccttcgt

SEQ ID NO: 105644 - DNA, 35 bp, Artificial Sequence
  Synthetic oligonucleotide
agccgtcactgctaacccccgtgctggctctcccc

SEQ ID NO: 105645 - DNA, 38 bp, Artificial Sequence
  Synthetic oligonucleotide
gttgcccctcctgcgctttttgccgttctatctcctga

SEQ ID NO: 105646 - DNA, 35 bp, Artificial Sequence
  Synthetic oligonucleotide
tgtacggccactatacctaagatcccatgccccct

SEQ ID NO: 105647 - DNA, 36 bp, Artificial Sequence
  Synthetic oligonucleotide
acaccccgcccactgagctcattccgtccgctttta

SEQ ID NO: 105648 - DNA, 35 bp, Artificial Sequence
  Synthetic oligonucleotide
agcccgccccgcccacacctggatggttccctgtc

SEQ ID NO: 105649 - DNA, 35 bp, Artificial Sequence
  Synthetic oligonucleotide
gcataccgcctgtaacgccacccaccatcttactg

SEQ ID NO: 105650 - DNA, 35 bp, Artificial Sequence
  Synthetic oligonucleotide
gtcacatctgtgactgtaattcatccgctatatcc

SEQ ID NO: 105651 - DNA, 35 bp, Artificial Sequence
  Synthetic oligonucleotide
gtgtgtcagatctcctgccgcctccacgctccccc

SEQ ID NO: 105652 - DNA, 35 bp, Artificial Sequence
  Synthetic oligonucleotide
gcccacctcgccccgcaccctcatcttcctaatgt

SEQ ID NO: 105653 - DNA, 35 bp, Artificial Sequence
  Synthetic oligonucleotide
gggaacggggaagggcaaatagggcgatagcggcg

SEQ ID NO: 105654 - DNA, 35 bp, Artificial Sequence
  Synthetic oligonucleotide
tgccgtgccacctcgcccgtactactgacctcttc

SEQ ID NO: 105655 - DNA, 37 bp, Artificial Sequence
  Synthetic oligonucleotide
tcaggagccatcgggtgggcggtggaggaagggggga

SEQ ID NO: 105656 - DNA, 35 bp, Artificial Sequence
  Synthetic oligonucleotide
tacacaccggcttttgctctacgcccctcccatgc

SEQ ID NO: 105657 - DNA, 35 bp, Artificial Sequence
  Synthetic oligonucleotide
gtgtccgcctgtctgcacctccgccctcatcaccg

SEQ ID NO: 105658 - DNA, 33 bp, Artificial Sequence
  Synthetic oligonucleotide
gtctcgccctcacccgcacacctcttgcatgac

SEQ ID NO: 105659 - DNA, 35 bp, Artificial Sequence
  Synthetic oligonucleotide
ttcaccctctggctttatgatacactaccccttcc

SEQ ID NO: 105660 - DNA, 36 bp, Artificial Sequence
  Synthetic oligonucleotide
tgaaagggtggagcaggaaagagagggaggctagaa

SEQ ID NO: 105661 - DNA, 35 bp, Artificial Sequence
  Synthetic oligonucleotide
actgcccacgcccggttactttatgcctcctgtca

SEQ ID NO: 105662 - DNA, 34 bp, Artificial Sequence
  Synthetic oligonucleotide
accttcaccatctgtatcgtttgtttctcctgga

SEQ ID NO: 105663 - DNA, 35 bp, Artificial Sequence
  Synthetic oligonucleotide
gcccccctctacacgcccgccattcgtgggcatcc

SEQ ID NO: 105664 - DNA, 36 bp, Artificial Sequence
  Synthetic oligonucleotide
gccaacgcaactattttaccgcccaccgcacctgca

SEQ ID NO: 105665 - DNA, 35 bp, Artificial Sequence
  Synthetic oligonucleotide
ttgccgatctctgcgcactcctccgccactggtcc

SEQ ID NO: 105666 - DNA, 35 bp, Artificial Sequence
  Synthetic oligonucleotide
ggaaggtcacgcctcccctgtgtaccctgtccctc

SEQ ID NO: 105667 - DNA, 34 bp, Artificial Sequence
  Synthetic oligonucleotide
ttcgcaccgcctggtactcgggcctgtccttcct

SEQ ID NO: 105668 - DNA, 35 bp, Artificial Sequence
  Synthetic oligonucleotide
acccccccctgcgcactttatttacggtctcctgc

SEQ ID NO: 105669 - DNA, 35 bp, Artificial Sequence
  Synthetic oligonucleotide
tgcagtgccagagtctcactgccgccgttcgccct

SEQ ID NO: 105670 - DNA, 36 bp, Artificial Sequence
  Synthetic oligonucleotide
accgccgcccctgtccgtcaatttcgcttcgttcga

SEQ ID NO: 105671 - DNA, 34 bp, Artificial Sequence
  Synthetic oligonucleotide
gacgtgttccggccgtaccgcttcccatatcgct

SEQ ID NO: 105672 - DNA, 35 bp, Artificial Sequence
  Synthetic oligonucleotide
gtcccgccattcggttccaggattctacccctgcc

SEQ ID NO: 105673 - DNA, 36 bp, Artificial Sequence
  Synthetic oligonucleotide
tgcctacgccctccgcccgcctgactctggtaccga

SEQ ID NO: 105674 - DNA, 35 bp, Artificial Sequence
  Synthetic oligonucleotide
gatcactgccccttcttgagcaggtcccttcctcc

SEQ ID NO: 105675 - DNA, 34 bp, Artificial Sequence
  Synthetic oligonucleotide
ttttgcccttcctcgttgccgcattagctcctct

SEQ ID NO: 105676 - DNA, 35 bp, Artificial Sequence
  Synthetic oligonucleotide
gcattgccacaattcgcctgtttcgttactcccgc

SEQ ID NO: 105677 - DNA, 35 bp, Artificial Sequence
  Synthetic oligonucleotide
gccgacgtctggacgccgccaatgacccttccgcc

SEQ ID NO: 105678 - DNA, 35 bp, Artificial Sequence
  Synthetic oligonucleotide
tgttagccccgccccaccccgccgttacattggcg

SEQ ID NO: 105679 - DNA, 35 bp, Artificial Sequence
  Synthetic oligonucleotide
tcttcatccgcccgcagactttatgtccgtccctc

SEQ ID NO: 105680 - DNA, 35 bp, Artificial Sequence
  Synthetic oligonucleotide
tgtccgcccctcgttggttgcctactccgtgcccc

SEQ ID NO: 105681 - DNA, 35 bp, Artificial Sequence
  Synthetic oligonucleotide
gagaaggaaggtgcgaaagaggggacggggaggga

SEQ ID NO: 105682 - DNA, 35 bp, Artificial Sequence
  Synthetic oligonucleotide
tccttgcctaccgcgtgttttcgtctccttccgtc

SEQ ID NO: 105683 - DNA, 36 bp, Artificial Sequence
  Synthetic oligonucleotide
gtcgcctcccgcgtatccgaccaacacccttctttg

SEQ ID NO: 105684 - DNA, 35 bp, Artificial Sequence
  Synthetic oligonucleotide
tacgcgtcggtatattccgcccgcccttgatcccg

SEQ ID NO: 105685 - DNA, 35 bp, Artificial Sequence
  Synthetic oligonucleotide
ggttcgccctctggcccccctgctatcttgctact

SEQ ID NO: 105686 - DNA, 36 bp, Artificial Sequence
  Synthetic oligonucleotide
gatacgacgagggggcggacggaccagggagaagca

SEQ ID NO: 105687 - DNA, 35 bp, Artificial Sequence
  Synthetic oligonucleotide
ccgaccctgcccctatccgcgttcccccccacgcg

SEQ ID NO: 105688 - DNA, 35 bp, Artificial Sequence
  Synthetic oligonucleotide
tgcctcccgaggttatgttcattgtctcccccccc

SEQ ID NO: 105689 - DNA, 35 bp, Artificial Sequence
  Synthetic oligonucleotide
ttcgcaagtcccctccgttgttcctgctgttttgt

SEQ ID NO: 105690 - DNA, 35 bp, Artificial Sequence
  Synthetic oligonucleotide
tgtaaccctccattctgtaatagcctaccctcact

SEQ ID NO: 105691 - DNA, 38 bp, Artificial Sequence
  Synthetic oligonucleotide
cgacagagactcatctgtttgctcctccactgctttga

SEQ ID NO: 105692 - DNA, 38 bp, Artificial Sequence
  Synthetic oligonucleotide
gcgaggggaggttcggtaaaggcgaggaggaagggtga

SEQ ID NO: 105693 - DNA, 35 bp, Artificial Sequence
  Synthetic oligonucleotide
ttccatcctgccttcccgtacaatgccccattgtc

SEQ ID NO: 105694 - DNA, 35 bp, Artificial Sequence
  Synthetic oligonucleotide
aacaccgatacgttctgttgccatcccccccctgc

SEQ ID NO: 105695 - DNA, 36 bp, Artificial Sequence
  Synthetic oligonucleotide
gcaccctcataactccactcgcgctacccttgtcca

SEQ ID NO: 105696 - DNA, 37 bp, Artificial Sequence
  Synthetic oligonucleotide
atccgactgtgcctgccgtttacccacctccactgga

SEQ ID NO: 105697 - DNA, 35 bp, Artificial Sequence
  Synthetic oligonucleotide
gtgcggagccacctgcccgtgaaaccttacgcctc

SEQ ID NO: 105698 - DNA, 35 bp, Artificial Sequence
  Synthetic oligonucleotide
gagccacccccctgggtatataaaccgcccaccct

SEQ ID NO: 105699 - DNA, 35 bp, Artificial Sequence
  Synthetic oligonucleotide
ttcgccgccgctcgctattgaattgttctctctcg

SEQ ID NO: 105700 - DNA, 36 bp, Artificial Sequence
  Synthetic oligonucleotide
gcaccggtacggtgtcatctcttcgtgccatcccta

SEQ ID NO: 105701 - DNA, 35 bp, Artificial Sequence
  Synthetic oligonucleotide
tccatcgcatatacagtccctccctccggttacgc

SEQ ID NO: 105702 - DNA, 35 bp, Artificial Sequence
  Synthetic oligonucleotide
acctcccccgccttgttattcgaatacaccgccac

SEQ ID NO: 105703 - DNA, 36 bp, Artificial Sequence
  Synthetic oligonucleotide
gtacgtcgcctcgccctgtccttagccggtattcca

SEQ ID NO: 105704 - DNA, 37 bp, Artificial Sequence
  Synthetic oligonucleotide
gcaaaagaggagggatggaacggtgggggacatggga

SEQ ID NO: 105705 - DNA, 36 bp, Artificial Sequence
  Synthetic oligonucleotide
atccagggggctgtagggggttttgcgggagggata

SEQ ID NO: 105706 - DNA, 35 bp, Artificial Sequence
  Synthetic oligonucleotide
accccgcgcccatatgcctccgctctaccgtatct

SEQ ID NO: 105707 - DNA, 35 bp, Artificial Sequence
  Synthetic oligonucleotide
gtcaatgcccggcccacctgtctctgtctcccagt

SEQ ID NO: 105708 - DNA, 35 bp, Artificial Sequence
  Synthetic oligonucleotide
tccatcctccgcacgttgttccatcgttgttaaca

SEQ ID NO: 105709 - DNA, 37 bp, Artificial Sequence
  Synthetic oligonucleotide
tgagtcgccacagttgcatagccgcccctctcctcga

SEQ ID NO: 105710 - DNA, 35 bp, Artificial Sequence
  Synthetic oligonucleotide
gacgtcgccatcctactcccacccctgccagtggc

SEQ ID NO: 105711 - DNA, 34 bp, Artificial Sequence
  Synthetic oligonucleotide
gtgcccccgcctccgaccgccttcatcctaaaca

SEQ ID NO: 105712 - DNA, 36 bp, Artificial Sequence
  Synthetic oligonucleotide
tccgaaccacctcatctgcctattgacctcaccaca

SEQ ID NO: 105713 - DNA, 36 bp, Artificial Sequence
  Synthetic oligonucleotide
ttgaggccgcccttttgtcatctcacctacgctcca

SEQ ID NO: 105714 - DNA, 35 bp, Artificial Sequence
  Synthetic oligonucleotide
tcacccctgattacgcccctgtcatggaccctcgc

SEQ ID NO: 105715 - DNA, 35 bp, Artificial Sequence
  Synthetic oligonucleotide
aacctgctccccgctcccatgtccctataaccgca

SEQ ID NO: 105716 - DNA, 35 bp, Artificial Sequence
  Synthetic oligonucleotide
tcccccctgccgcccactgcctcgtggcccttaat

SEQ ID NO: 105717 - DNA, 35 bp, Artificial Sequence
  Synthetic oligonucleotide
gcccctgtcctcctgcatcaagcgctccaacctct

SEQ ID NO: 105718 - DNA, 37 bp, Artificial Sequence
  Synthetic oligonucleotide
aagacataggagcggagggggatagggacggggcaga

SEQ ID NO: 105719 - DNA, 37 bp, Artificial Sequence
  Synthetic oligonucleotide
tagccgcctagagtgcgtcatcaacctgcccctccga

SEQ ID NO: 105720 - DNA, 35 bp, Artificial Sequence
  Synthetic oligonucleotide
atgcaagccctcgcgatctagcgccccgcccactc

SEQ ID NO: 105721 - DNA, 35 bp, Artificial Sequence
  Synthetic oligonucleotide
tcccccctcatggtgccactcgagttctctgttca

SEQ ID NO: 105722 - DNA, 35 bp, Artificial Sequence
  Synthetic oligonucleotide
gagaccccactgctgtaccctccgtgctaccccct

SEQ ID NO: 105723 - DNA, 35 bp, Artificial Sequence
  Synthetic oligonucleotide
ttccgctcaccgccctcacatcatggcccacactg

SEQ ID NO: 105724 - DNA, 35 bp, Artificial Sequence
  Synthetic oligonucleotide
tcaagtcagtcgctcacttgccctcgtttagttcc

SEQ ID NO: 105725 - DNA, 35 bp, Artificial Sequence
  Synthetic oligonucleotide
acccacgcgcagatcacctccctccattctgtacg

SEQ ID NO: 105726 - DNA, 31 bp, Artificial Sequence
  Synthetic oligonucleotide
aagagccgaagagggaaagggcgaggggaag

SEQ ID NO: 105727 - DNA, 36 bp, Artificial Sequence
  Synthetic oligonucleotide
gagagacaagagggggatgagggctggctacaggga

SEQ ID NO: 105728 - DNA, 36 bp, Artificial Sequence
  Synthetic oligonucleotide
acctcacccgtccccacgtcctcctcactcagacga

SEQ ID NO: 105729 - DNA, 35 bp, Artificial Sequence
  Synthetic oligonucleotide
actgcacgcccccgtctatcctcgttcgttcccca

SEQ ID NO: 105730 - DNA, 35 bp, Artificial Sequence
  Synthetic oligonucleotide
atgcaccggcctttcggcgtccctccccacccgcc

SEQ ID NO: 105731 - DNA, 36 bp, Artificial Sequence
  Synthetic oligonucleotide
tcactccgcgcccactgcctcttatcgaaccatgca

SEQ ID NO: 105732 - DNA, 35 bp, Artificial Sequence
  Synthetic oligonucleotide
gagacacggggaagaaggcagaaggggagaagtgc

SEQ ID NO: 105733 - DNA, 35 bp, Artificial Sequence
  Synthetic oligonucleotide
tatcccacctgcatcccagcccgccccctgttcgc

SEQ ID NO: 105734 - DNA, 35 bp, Artificial Sequence
  Synthetic oligonucleotide
tgcaaagtcaacgtatcgcccgacgcccttcttcc

SEQ ID NO: 105735 - DNA, 37 bp, Artificial Sequence
  Synthetic oligonucleotide
acgcctcccatcattgctatttctgcatgcacccgga

SEQ ID NO: 105736 - DNA, 35 bp, Artificial Sequence
  Synthetic oligonucleotide
gcgctcaccatcccgttccctgtgcgttccctgct

SEQ ID NO: 105737 - DNA, 35 bp, Artificial Sequence
  Synthetic oligonucleotide
ttgcacgtcgactcccattgatcaccgccccctcc

SEQ ID NO: 105738 - DNA, 35 bp, Artificial Sequence
  Synthetic oligonucleotide
gtccaggcccgccccccctgctggtactcactacc

SEQ ID NO: 105739 - DNA, 35 bp, Artificial Sequence
  Synthetic oligonucleotide
acgtcgctcgccctcatctgtttccgttgcccatc

SEQ ID NO: 105740 - DNA, 35 bp, Artificial Sequence
  Synthetic oligonucleotide
gtgcaccacactagattatgcctggccctcctcgt

SEQ ID NO: 105741 - DNA, 35 bp, Artificial Sequence
  Synthetic oligonucleotide
ttaccgccctgggaggtccgaattgtgccctatct

SEQ ID NO: 105742 - DNA, 35 bp, Artificial Sequence
  Synthetic oligonucleotide
tactcggatgtgccgctccctacgtgtcttccttc

SEQ ID NO: 105743 - DNA, 38 bp, Artificial Sequence
  Synthetic oligonucleotide
gagccgtgcccgctttgtaatttgccccttctccctga

SEQ ID NO: 105744 - DNA, 35 bp, Artificial Sequence
  Synthetic oligonucleotide
gcccccccgataggcttgatacacccctgcacact

SEQ ID NO: 105745 - DNA, 36 bp, Artificial Sequence
  Synthetic oligonucleotide
aggggagggagcgaaggagggaggcgggtttgcaga

SEQ ID NO: 105746 - DNA, 36 bp, Artificial Sequence
  Synthetic oligonucleotide
gcccaccccatctgtcccactcagccctatcttcga

SEQ ID NO: 105747 - DNA, 35 bp, Artificial Sequence
  Synthetic oligonucleotide
aaccgcccccctgctccaactaccactccgccggt

SEQ ID NO: 105748 - DNA, 35 bp, Artificial Sequence
  Synthetic oligonucleotide
gatccacccgcccaatcccagcgaccaccatacgc

SEQ ID NO: 105749 - DNA, 36 bp, Artificial Sequence
  Synthetic oligonucleotide
ggtggggacagggcggggcgggggagatcatgggga

SEQ ID NO: 105750 - DNA, 36 bp, Artificial Sequence
  Synthetic oligonucleotide
aaccgtgcccgcctccgccttgtctaacatcctcta

SEQ ID NO: 105751 - DNA, 35 bp, Artificial Sequence
  Synthetic oligonucleotide
gacatcccctcagtcccacgcgatatcgtaccctc

SEQ ID NO: 105752 - DNA, 35 bp, Artificial Sequence
  Synthetic oligonucleotide
tccatcgcctcattacgcgtcatcctctgtctctc

SEQ ID NO: 105753 - DNA, 35 bp, Artificial Sequence
  Synthetic oligonucleotide
gcaccatcttccgcgttgtcttatcgcccggttac

SEQ ID NO: 105754 - DNA, 36 bp, Artificial Sequence
  Synthetic oligonucleotide
tactgcaccggtccttctgtctcagcttcacgccca

SEQ ID NO: 105755 - DNA, 36 bp, Artificial Sequence
  Synthetic oligonucleotide
tcccccgcccacgagtattatcgccactctacgtta

SEQ ID NO: 105756 - DNA, 35 bp, Artificial Sequence
  Synthetic oligonucleotide
ttcacgcctccctattctatcgtctctccgttggc

SEQ ID NO: 105757 - DNA, 35 bp, Artificial Sequence
  Synthetic oligonucleotide
tcactaccgtatttgccaagctccctggccctgtc

SEQ ID NO: 105758 - DNA, 35 bp, Artificial Sequence
  Synthetic oligonucleotide
gatcgtgctaccctcctgccttgtcttagttctgc

SEQ ID NO: 105759 - DNA, 35 bp, Artificial Sequence
  Synthetic oligonucleotide
gcacacctgcagttcgaattatttgcccccccctg

SEQ ID NO: 105760 - DNA, 36 bp, Artificial Sequence
  Synthetic oligonucleotide
gaccatccgtctgaacgctctaccatgtacctccgc

SEQ ID NO: 105761 - DNA, 37 bp, Artificial Sequence
  Synthetic oligonucleotide
gagtgaggggagtggagtggagggagtatcgggcgga

SEQ ID NO: 105762 - DNA, 36 bp, Artificial Sequence
  Synthetic oligonucleotide
tccctgcccactatcctgttatacacttggccttta

SEQ ID NO: 105763 - DNA, 35 bp, Artificial Sequence
  Synthetic oligonucleotide
ttccagtcgccatccgcccgctaatctatctatcg

SEQ ID NO: 105764 - DNA, 35 bp, Artificial Sequence
  Synthetic oligonucleotide
tgccccgctcctgcttacacctattccctccggaa

SEQ ID NO: 105765 - DNA, 35 bp, Artificial Sequence
  Synthetic oligonucleotide
tccactcccgtccctcgcgctgcaataggccttca

SEQ ID NO: 105766 - DNA, 35 bp, Artificial Sequence
  Synthetic oligonucleotide
tatcacactccgctggctcaagctctgtccaccgc

SEQ ID NO: 105767 - DNA, 35 bp, Artificial Sequence
  Synthetic oligonucleotide
gtgggccctccactgccgatagcaactgccttcct

SEQ ID NO: 105768 - DNA, 35 bp, Artificial Sequence
  Synthetic oligonucleotide
actgagccctcctgcgtcttagcacgccacccctt

SEQ ID NO: 105769 - DNA, 35 bp, Artificial Sequence
  Synthetic oligonucleotide
gcacgcaacctctgactatatttgtaccgcccacc

SEQ ID NO: 105770 - DNA, 35 bp, Artificial Sequence
  Synthetic oligonucleotide
gctcgcccacgctctgtctttcgctctctcctcga

SEQ ID NO: 105771 - DNA, 38 bp, Artificial Sequence
  Synthetic oligonucleotide
tacaccctccgatcgatttacctgcctcccgcgcttga

SEQ ID NO: 105772 - DNA, 32 bp, Artificial Sequence
  Synthetic oligonucleotide
gcccgacgctccacattaggcccttccattgc

SEQ ID NO: 105773 - DNA, 35 bp, Artificial Sequence
  Synthetic oligonucleotide
accagcctcaagttgtacgctcatgccccccccca

SEQ ID NO: 105774 - DNA, 34 bp, Artificial Sequence
  Synthetic oligonucleotide
atcccgctgcccgcctagtgcctctaaccctttg

SEQ ID NO: 105775 - DNA, 35 bp, Artificial Sequence
  Synthetic oligonucleotide
atgttgctgcagcccgtcgtttcacccccaacctt

SEQ ID NO: 105776 - DNA, 36 bp, Artificial Sequence
  Synthetic oligonucleotide
tcccacgagccccgttgtctcccttgttcctgccga

SEQ ID NO: 105777 - DNA, 37 bp, Artificial Sequence
  Synthetic oligonucleotide
tacaccgtccgacgctccatcctgtatcctccccgga

SEQ ID NO: 105778 - DNA, 35 bp, Artificial Sequence
  Synthetic oligonucleotide
gcagggacgggcggtgaccaatggggaggggtgag

SEQ ID NO: 105779 - DNA, 35 bp, Artificial Sequence
  Synthetic oligonucleotide
cgcccctacgctcccttccttgtccttgacttcga

SEQ ID NO: 105780 - DNA, 35 bp, Artificial Sequence
  Synthetic oligonucleotide
gactgctaccgctgctcccttaagtactctatctg

SEQ ID NO: 105781 - DNA, 35 bp, Artificial Sequence
  Synthetic oligonucleotide
acataaccccctcagacctgcctggttccagttcc

SEQ ID NO: 105782 - DNA, 35 bp, Artificial Sequence
  Synthetic oligonucleotide
atggtacgcagattctcattcgctccctgccccat

SEQ ID NO: 105783 - DNA, 35 bp, Artificial Sequence
  Synthetic oligonucleotide
gtgcgccccgtaggtggccctctaactcccttctc

SEQ ID NO: 105784 - DNA, 35 bp, Artificial Sequence
  Synthetic oligonucleotide
gagccacctcacgttgcgcttctcttacatccgtt

SEQ ID NO: 105785 - DNA, 35 bp, Artificial Sequence
  Synthetic oligonucleotide
gcattaccctcgccgtgcccccgtgccttctgacc

SEQ ID NO: 105786 - DNA, 35 bp, Artificial Sequence
  Synthetic oligonucleotide
gccaacctcccgatatgccggtgcctgccttgaac

SEQ ID NO: 105787 - DNA, 35 bp, Artificial Sequence
  Synthetic oligonucleotide
tcgtacccgcccagattcccttcccctccgtgcga

SEQ ID NO: 105788 - DNA, 36 bp, Artificial Sequence
  Synthetic oligonucleotide
tacgcacgcccacctgctcacgtgcttcccccgaca

SEQ ID NO: 105789 - DNA, 35 bp, Artificial Sequence
  Synthetic oligonucleotide
acaccgcctctttctaatcttaacgtcctgcctcg

SEQ ID NO: 105790 - DNA, 35 bp, Artificial Sequence
  Synthetic oligonucleotide
gatgccgtccatgctctcccccgtatttgtcactc

SEQ ID NO: 105791 - DNA, 35 bp, Artificial Sequence
  Synthetic oligonucleotide
ataccctcgcccgcatctgtcaccgaccactttcg

SEQ ID NO: 105792 - DNA, 35 bp, Artificial Sequence
  Synthetic oligonucleotide
tcaaccccgggttgtccctggttcctgcccctgcc

SEQ ID NO: 105793 - DNA, 37 bp, Artificial Sequence
  Synthetic oligonucleotide
tacggggtggaaaaggaataggaaaggtggagagtga

SEQ ID NO: 105794 - DNA, 35 bp, Artificial Sequence
  Synthetic oligonucleotide
tctcgcccacgcttagacccgcgtatctccccccg

SEQ ID NO: 105795 - DNA, 33 bp, Artificial Sequence
  Synthetic oligonucleotide
tgacgcattccgctttcctcgttctagtgtccc

SEQ ID NO: 105796 - DNA, 38 bp, Artificial Sequence
  Synthetic oligonucleotide
acacccgcccccatccgcgccctcacccttccgcgtga

SEQ ID NO: 105797 - DNA, 35 bp, Artificial Sequence
  Synthetic oligonucleotide
gcaacgacggtgtcctccttaggccgttacccccc

SEQ ID NO: 105798 - DNA, 35 bp, Artificial Sequence
  Synthetic oligonucleotide
gaccgccccatagctccaccaagtcctgattcctt

SEQ ID NO: 105799 - DNA, 37 bp, Artificial Sequence
  Synthetic oligonucleotide
gggtagagcagggggggaatagatggaggggagcgga

SEQ ID NO: 105800 - DNA, 35 bp, Artificial Sequence
  Synthetic oligonucleotide
ttcacactgccgactatttccgctcagccctcgcc

SEQ ID NO: 105801 - DNA, 35 bp, Artificial Sequence
  Synthetic oligonucleotide
tacgtgccaccacctgcccccctttgtgccaatgc

SEQ ID NO: 105802 - DNA, 35 bp, Artificial Sequence
  Synthetic oligonucleotide
tctgtccgcccatcagtcttttttcgtcactggtc

SEQ ID NO: 105803 - DNA, 38 bp, Artificial Sequence
  Synthetic oligonucleotide
gagtgtaggtggaggagggaggcgggataatcgactga

SEQ ID NO: 105804 - DNA, 35 bp, Artificial Sequence
  Synthetic oligonucleotide
taggacccactccgcctcattgcgatatgccctcc

SEQ ID NO: 105805 - DNA, 36 bp, Artificial Sequence
  Synthetic oligonucleotide
acctcacgccccacaattgcttcccttctctgtgaa

SEQ ID NO: 105806 - DNA, 35 bp, Artificial Sequence
  Synthetic oligonucleotide
ttgacctccccaccgatatcgtgattggctaccac

SEQ ID NO: 105807 - DNA, 35 bp, Artificial Sequence
  Synthetic oligonucleotide
gtgcgcccgccatgcctctggaccccctactctat

SEQ ID NO: 105808 - DNA, 34 bp, Artificial Sequence
  Synthetic oligonucleotide
gtccacgagaacgggtgagggggaagggggtggg

SEQ ID NO: 105809 - DNA, 35 bp, Artificial Sequence
  Synthetic oligonucleotide
ccgttcgcccgcatatccacagttacatgtcccca

SEQ ID NO: 105810 - DNA, 35 bp, Artificial Sequence
  Synthetic oligonucleotide
tctgcgccactagtctcgttctgcaacacccttca

SEQ ID NO: 105811 - DNA, 35 bp, Artificial Sequence
  Synthetic oligonucleotide
tctaaccccccacttgcccactgcgcacacctcgc

SEQ ID NO: 105812 - DNA, 35 bp, Artificial Sequence
  Synthetic oligonucleotide
gccctgcccccttctgtattaatcgttctcggtgc

SEQ ID NO: 105813 - DNA, 35 bp, Artificial Sequence
  Synthetic oligonucleotide
atgggagacacagacgggggggtgcacgttcgggg

SEQ ID NO: 105814 - DNA, 35 bp, Artificial Sequence
  Synthetic oligonucleotide
atactgccctcgccatccctcgtgctacatgctac

SEQ ID NO: 105815 - DNA, 35 bp, Artificial Sequence
  Synthetic oligonucleotide
tcccacgccccgtccagctacatctaagcaccacc

SEQ ID NO: 105816 - DNA, 35 bp, Artificial Sequence
  Synthetic oligonucleotide
ggtgggtaaggggaggggagggaacaaggatgtaa

SEQ ID NO: 105817 - DNA, 35 bp, Artificial Sequence
  Synthetic oligonucleotide
aacccgacccccatattgtgctatccgctctagtc

SEQ ID NO: 105818 - DNA, 36 bp, Artificial Sequence
  Synthetic oligonucleotide
acgagcccctcctgccctgttccccacacgtctcta

SEQ ID NO: 105819 - DNA, 35 bp, Artificial Sequence
  Synthetic oligonucleotide
tcatgttgcctcccactgtctgccagttgctatcc

SEQ ID NO: 105820 - DNA, 35 bp, Artificial Sequence
  Synthetic oligonucleotide
gaaaggtgaacaggaagggcgggggaccagtggcg

SEQ ID NO: 105821 - DNA, 35 bp, Artificial Sequence
  Synthetic oligonucleotide
acagggaggtgggagtacggggagagcacggcggt

SEQ ID NO: 105822 - DNA, 35 bp, Artificial Sequence
  Synthetic oligonucleotide
tagccgcccttccggcacgcatagaccaccccacg

SEQ ID NO: 105823 - DNA, 35 bp, Artificial Sequence
  Synthetic oligonucleotide
gcaccgcatatgcccaccgtccccaaccgttccag

SEQ ID NO: 105824 - DNA, 36 bp, Artificial Sequence
  Synthetic oligonucleotide
gatggggaggggtgggagtgggaagtaaagtccaga

SEQ ID NO: 105825 - DNA, 35 bp, Artificial Sequence
  Synthetic oligonucleotide
acattgcacgtgttatgccttgatattccaccccg

SEQ ID NO: 105826 - DNA, 36 bp, Artificial Sequence
  Synthetic oligonucleotide
aagagggtgggggaaggggtgggcggatccagggga

SEQ ID NO: 105827 - DNA, 35 bp, Artificial Sequence
  Synthetic oligonucleotide
tctcccccccgctttgtacacgaccatggaggttc

SEQ ID NO: 105828 - DNA, 35 bp, Artificial Sequence
  Synthetic oligonucleotide
acagctatccgccatgttcttgtccaccccccgct

SEQ ID NO: 105829 - DNA, 35 bp, Artificial Sequence
  Synthetic oligonucleotide
gaaggggggtggtgcggagggtggtacgggttcaa

SEQ ID NO: 105830 - DNA, 35 bp, Artificial Sequence
  Synthetic oligonucleotide
gatgcggccacggtttttcgttccttgctcccttt

SEQ ID NO: 105831 - DNA, 35 bp, Artificial Sequence
  Synthetic oligonucleotide
gacttccgccccagtctgcctaaccgtaacatcgc

SEQ ID NO: 105832 - DNA, 35 bp, Artificial Sequence
  Synthetic oligonucleotide
gcctccacacatgacatctgctaccacactctttg

SEQ ID NO: 105833 - DNA, 35 bp, Artificial Sequence
  Synthetic oligonucleotide
ttcgctgctcccgctatgctacgtccgccacgccc

SEQ ID NO: 105834 - DNA, 35 bp, Artificial Sequence
  Synthetic oligonucleotide
atcgcaacgcctgttcacctccttcttgccatgtc

SEQ ID NO: 105835 - DNA, 35 bp, Artificial Sequence
  Synthetic oligonucleotide
acatatccgttgccatccattgcgtcctgttctcc

SEQ ID NO: 105836 - DNA, 35 bp, Artificial Sequence
  Synthetic oligonucleotide
acttgggtggagggggggaagggcacaatggtagg

SEQ ID NO: 105837 - DNA, 35 bp, Artificial Sequence
  Synthetic oligonucleotide
tccagccggtccgctctcaattggctgaactttcc

SEQ ID NO: 105838 - DNA, 37 bp, Artificial Sequence
  Synthetic oligonucleotide
tcaccctctcgtattcgttacactcaccgttgacgga

SEQ ID NO: 105839 - DNA, 35 bp, Artificial Sequence
  Synthetic oligonucleotide
atgctccgccattttgctatcgctccaacgtttcc

SEQ ID NO: 105840 - DNA, 35 bp, Artificial Sequence
  Synthetic oligonucleotide
ttgactcctcaaatgctacccccctccgcctcggt

SEQ ID NO: 105841 - DNA, 35 bp, Artificial Sequence
  Synthetic oligonucleotide
acttcagagcgctcccagtccttattcgcctacac

SEQ ID NO: 105842 - DNA, 35 bp, Artificial Sequence
  Synthetic oligonucleotide
tgcaacatgcttgtgcggtctgccttctccgtagc

SEQ ID NO: 105843 - DNA, 35 bp, Artificial Sequence
  Synthetic oligonucleotide
gacacaccgctatccttctccgacagtcccgcctc

SEQ ID NO: 105844 - DNA, 35 bp, Artificial Sequence
  Synthetic oligonucleotide
actcaccgctacatacgcctgtgccatgcccttac

SEQ ID NO: 105845 - DNA, 35 bp, Artificial Sequence
  Synthetic oligonucleotide
tccccgtacccgcctctgtcgcattcgatgctttt

SEQ ID NO: 105846 - DNA, 35 bp, Artificial Sequence
  Synthetic oligonucleotide
tgcaccactgcaggtccctctccagccgcccatgc

SEQ ID NO: 105847 - DNA, 35 bp, Artificial Sequence
  Synthetic oligonucleotide
gcactcgccactatccacgtccctatacggccatc

SEQ ID NO: 105848 - DNA, 36 bp, Artificial Sequence
  Synthetic oligonucleotide
aagggacacggcagggaggggagggggacgaagcga

SEQ ID NO: 105849 - DNA, 35 bp, Artificial Sequence
  Synthetic oligonucleotide
gtcaccacccgccttcagtacgcattgccccacac

SEQ ID NO: 105850 - DNA, 35 bp, Artificial Sequence
  Synthetic oligonucleotide
tcatgtccggcccgacgtgcactttccatcccgtc

SEQ ID NO: 105851 - DNA, 35 bp, Artificial Sequence
  Synthetic oligonucleotide
tcgcggtacatcccctgttttgctcagttctccct

SEQ ID NO: 105852 - DNA, 37 bp, Artificial Sequence
  Synthetic oligonucleotide
ggggcggagggggtgtgctggtgagattggggactga

SEQ ID NO: 105853 - DNA, 35 bp, Artificial Sequence
  Synthetic oligonucleotide
tctccccctacgacgtgccctgttcctactgcccc

SEQ ID NO: 105854 - DNA, 34 bp, Artificial Sequence
  Synthetic oligonucleotide
gatctcacccgcccccgctttggaaccagctacg

SEQ ID NO: 105855 - DNA, 35 bp, Artificial Sequence
  Synthetic oligonucleotide
tcgcatcacgtcccctgcttatgtctacgtccctc

SEQ ID NO: 105856 - DNA, 37 bp, Artificial Sequence
  Synthetic oligonucleotide
accctcccccgctctgaacttcgccgccacagcttga

SEQ ID NO: 105857 - DNA, 36 bp, Artificial Sequence
  Synthetic oligonucleotide
ggggaaacggaggaaacggaatggagtggggcaaaa

SEQ ID NO: 105858 - DNA, 38 bp, Artificial Sequence
  Synthetic oligonucleotide
taagggacggagggaaggcggaggagaaagacaggtga

SEQ ID NO: 105859 - DNA, 35 bp, Artificial Sequence
  Synthetic oligonucleotide
agtgctccatccgcgcccctcatcccctagcgtgc

SEQ ID NO: 105860 - DNA, 35 bp, Artificial Sequence
  Synthetic oligonucleotide
gtcgcactccctgtctttggtctccttatggttcc

SEQ ID NO: 105861 - DNA, 35 bp, Artificial Sequence
  Synthetic oligonucleotide
ttcacgccacctgcccggcctttgctatacagcct

SEQ ID NO: 105862 - DNA, 37 bp, Artificial Sequence
  Synthetic oligonucleotide
ttgcccgcagtccctgtccttcacttcctgcctttga

SEQ ID NO: 105863 - DNA, 35 bp, Artificial Sequence
  Synthetic oligonucleotide
gaacaaggtgggggggtgttagaggggacggccaa

SEQ ID NO: 105864 - DNA, 35 bp, Artificial Sequence
  Synthetic oligonucleotide
gtaacaccgtacacccgcttattgactcccgcacc

SEQ ID NO: 105865 - DNA, 35 bp, Artificial Sequence
  Synthetic oligonucleotide
tgcccttgcccactgtggttttcgttgtacccacc

SEQ ID NO: 105866 - DNA, 35 bp, Artificial Sequence
  Synthetic oligonucleotide
atccgccgtaccgctctctacatacacgcacacac

SEQ ID NO: 105867 - DNA, 36 bp, Artificial Sequence
  Synthetic oligonucleotide
tcccgccccgtccactgatattccctgcgcccacaa

SEQ ID NO: 105868 - DNA, 35 bp, Artificial Sequence
  Synthetic oligonucleotide
gctatccccgtcctgcttcctctaacggccttgtt

SEQ ID NO: 105869 - DNA, 36 bp, Artificial Sequence
  Synthetic oligonucleotide
gtgcactctgtcgctatttggtctgtcccttcccca

SEQ ID NO: 105870 - DNA, 35 bp, Artificial Sequence
  Synthetic oligonucleotide
acatcccttccgcctgcaggggtcatccccgttcc

SEQ ID NO: 105871 - DNA, 35 bp, Artificial Sequence
  Synthetic oligonucleotide
gtgccccttcccccggtattagttgaacctccttt

SEQ ID NO: 105872 - DNA, 34 bp, Artificial Sequence
  Synthetic oligonucleotide
tagttccatcacagcgctgttactctcttgtcct

SEQ ID NO: 105873 - DNA, 36 bp, Artificial Sequence
  Synthetic oligonucleotide
gagagcccccgcttatgcatttaacctgtccactgc

SEQ ID NO: 105874 - DNA, 35 bp, Artificial Sequence
  Synthetic oligonucleotide
tcaccaccctctccgacgcgtgatcgtttacactc

SEQ ID NO: 105875 - DNA, 35 bp, Artificial Sequence
  Synthetic oligonucleotide
gccaccccgttagttattccggtactgcatccttc

SEQ ID NO: 105876 - DNA, 35 bp, Artificial Sequence
  Synthetic oligonucleotide
ttcagacagccgcctcgttttcttcgcacccctga

SEQ ID NO: 105877 - DNA, 36 bp, Artificial Sequence
  Synthetic oligonucleotide
tccacctccattcacgtaccgccctctgctcgacga

SEQ ID NO: 105878 - DNA, 35 bp, Artificial Sequence
  Synthetic oligonucleotide
acaccacttcgccccggtttcatcactgcctaggg

SEQ ID NO: 105879 - DNA, 37 bp, Artificial Sequence
  Synthetic oligonucleotide
ttacacgggagggggggaagggaagcataaagtgcga

SEQ ID NO: 105880 - DNA, 35 bp, Artificial Sequence
  Synthetic oligonucleotide
atcgccccgcactgccctgattcgccgtattctat

SEQ ID NO: 105881 - DNA, 38 bp, Artificial Sequence
  Synthetic oligonucleotide
tccacctccatcactatgtaccttgatgctccccttga

SEQ ID NO: 105882 - DNA, 35 bp, Artificial Sequence
  Synthetic oligonucleotide
atccctgccctcaccggttttatagctcgcttgtt

SEQ ID NO: 105883 - DNA, 35 bp, Artificial Sequence
  Synthetic oligonucleotide
tgtgcccatcctctgctgccaatcagtaacctcgc

SEQ ID NO: 105884 - DNA, 35 bp, Artificial Sequence
  Synthetic oligonucleotide
tcatcccccgcttgaacgcctgctacccgcttacc

SEQ ID NO: 105885 - DNA, 35 bp, Artificial Sequence
  Synthetic oligonucleotide
tgttcaccatcgcgatcgcatcacccacctccgca

SEQ ID NO: 105886 - DNA, 35 bp, Artificial Sequence
  Synthetic oligonucleotide
tgtgtggggcggtggggaggtggggggggcacggg

SEQ ID NO: 105887 - DNA, 38 bp, Artificial Sequence
  Synthetic oligonucleotide
tcgatacccccgccccccgtgtctcgtgaccacgatga

SEQ ID NO: 105888 - DNA, 35 bp, Artificial Sequence
  Synthetic oligonucleotide
acaccacccgctccggcactgcttagcaactacta

SEQ ID NO: 105889 - DNA, 35 bp, Artificial Sequence
  Synthetic oligonucleotide
tgcagggcggaggggagggcgggaatgaaagtcga

SEQ ID NO: 105890 - DNA, 35 bp, Artificial Sequence
  Synthetic oligonucleotide
gagcgggaggacggggaagggggacggttcttcag

SEQ ID NO: 105891 - DNA, 34 bp, Artificial Sequence
  Synthetic oligonucleotide
ttgccgcccttcctctcgtgcatctgctttaccg

SEQ ID NO: 105892 - DNA, 35 bp, Artificial Sequence
  Synthetic oligonucleotide
tgccccctctgcatttataattcggccttctcatc

SEQ ID NO: 105893 - DNA, 35 bp, Artificial Sequence
  Synthetic oligonucleotide
gtcccccccgctggagtaccgctcattgggctcac

SEQ ID NO: 105894 - DNA, 38 bp, Artificial Sequence
  Synthetic oligonucleotide
ttcgccccgcctcactccacccttggctacagacttga

SEQ ID NO: 105895 - DNA, 35 bp, Artificial Sequence
  Synthetic oligonucleotide
gttgatctccgcctggttggcccctcttgtacctc

SEQ ID NO: 105896 - DNA, 35 bp, Artificial Sequence
  Synthetic oligonucleotide
accacgccccgcctgcactcccggtcatcttaccc

SEQ ID NO: 105897 - DNA, 35 bp, Artificial Sequence
  Synthetic oligonucleotide
gccactgcacctgctcaatcttccatcatgctgct

SEQ ID NO: 105898 - DNA, 36 bp, Artificial Sequence
  Synthetic oligonucleotide
acgatcaccgcccagttcatttcccgttctcatcga

SEQ ID NO: 105899 - DNA, 35 bp, Artificial Sequence
  Synthetic oligonucleotide
tctcaccatcactcgcgctagccgccgcgccccta

SEQ ID NO: 105900 - DNA, 36 bp, Artificial Sequence
  Synthetic oligonucleotide
ggtgcgaggccgggggggggacaaagggcgggatga

SEQ ID NO: 105901 - DNA, 35 bp, Artificial Sequence
  Synthetic oligonucleotide
acaacacgccacgttgcccttcgtcatcgaccctc

SEQ ID NO: 105902 - DNA, 35 bp, Artificial Sequence
  Synthetic oligonucleotide
gaagaggaaggaggtgtacgtacggggggatggga

SEQ ID NO: 105903 - DNA, 35 bp, Artificial Sequence
  Synthetic oligonucleotide
gccacccctctttgcgactgttccctcctggttcg

SEQ ID NO: 105904 - DNA, 35 bp, Artificial Sequence
  Synthetic oligonucleotide
tgtctcccctccccgtgcccttaaagtctcagcct

SEQ ID NO: 105905 - DNA, 36 bp, Artificial Sequence
  Synthetic oligonucleotide
gaggaacgggcaaggcaatgggcgtgggggggggca

SEQ ID NO: 105906 - DNA, 35 bp, Artificial Sequence
  Synthetic oligonucleotide
gacgtctcctccgccattattacacgtgcctctga

SEQ ID NO: 105907 - DNA, 36 bp, Artificial Sequence
  Synthetic oligonucleotide
ttgacgctcagtggctcgcacccgtctccttcttca

SEQ ID NO: 105908 - DNA, 37 bp, Artificial Sequence
  Synthetic oligonucleotide
acgacgcctcatctccgtttttggtttcatctttcga

SEQ ID NO: 105909 - DNA, 35 bp, Artificial Sequence
  Synthetic oligonucleotide
gtttacccccttccactcttgctcctcctggtgag

SEQ ID NO: 105910 - DNA, 35 bp, Artificial Sequence
  Synthetic oligonucleotide
accgcatactccactcgtgcaacttcaccgctccc

SEQ ID NO: 105911 - DNA, 35 bp, Artificial Sequence
  Synthetic oligonucleotide
tagggggagggtggggaaagtggggatcggctata

SEQ ID NO: 105912 - DNA, 36 bp, Artificial Sequence
  Synthetic oligonucleotide
gtgggggcatagggaagggtggaatgacgggaggga

SEQ ID NO: 105913 - DNA, 34 bp, Artificial Sequence
  Synthetic oligonucleotide
accactgcgataccctggctgccttcgccccccc

SEQ ID NO: 105914 - DNA, 35 bp, Artificial Sequence
  Synthetic oligonucleotide
gcacacctgcagttcgaattatttgcccccccctt

SEQ ID NO: 105915 - DNA, 36 bp, Artificial Sequence
  Synthetic oligonucleotide
atcccaccccccatgatcgccgcttgcaggttccaa

SEQ ID NO: 105916 - DNA, 35 bp, Artificial Sequence
  Synthetic oligonucleotide
atgccaccatcggttgccccaattctgagcccctc

SEQ ID NO: 105917 - DNA, 37 bp, Artificial Sequence
  Synthetic oligonucleotide
gaacggcggggaaggcggaatagggcgggggagggga

SEQ ID NO: 105918 - DNA, 37 bp, Artificial Sequence
  Synthetic oligonucleotide
gaccaccgcccccaaagcccgcagtcttcactttaga

SEQ ID NO: 105919 - DNA, 35 bp, Artificial Sequence
  Synthetic oligonucleotide
cgcgcccaacgtttgcactgctataggttctgtgc

SEQ ID NO: 105920 - DNA, 36 bp, Artificial Sequence
  Synthetic oligonucleotide
tccgacggtgacgggggggggcaaagggcgggctaa

SEQ ID NO: 105921 - DNA, 37 bp, Artificial Sequence
  Synthetic oligonucleotide
gagaggggaagtaagggcgtgggggggagcatggaga

SEQ ID NO: 105922 - DNA, 35 bp, Artificial Sequence
  Synthetic oligonucleotide
gccaccattcggggccgcacatatcctcgttgtcc

SEQ ID NO: 105923 - DNA, 35 bp, Artificial Sequence
  Synthetic oligonucleotide
gcgaagcaccgttctcgccctcataatgttctcca

SEQ ID NO: 105924 - DNA, 35 bp, Artificial Sequence
  Synthetic oligonucleotide
gttcaactgccctgcctgccgtatcgtacacgctt

SEQ ID NO: 105925 - DNA, 35 bp, Artificial Sequence
  Synthetic oligonucleotide
tccctccgaccttgctgctattcccgctgctcctt

SEQ ID NO: 105926 - DNA, 35 bp, Artificial Sequence
  Synthetic oligonucleotide
ttgatgctgccctccgcctcgctgtcttttctctt

SEQ ID NO: 105927 - DNA, 35 bp, Artificial Sequence
  Synthetic oligonucleotide
tccgcctcgctccagtagatgcttccctccgccgc

SEQ ID NO: 105928 - DNA, 35 bp, Artificial Sequence
  Synthetic oligonucleotide
atgccttgcctcgcattactgtttacttgtcctcc

SEQ ID NO: 105929 - DNA, 37 bp, Artificial Sequence
  Synthetic oligonucleotide
gggtgggaggatggtagggggggaaatggatggtgga

SEQ ID NO: 105930 - DNA, 35 bp, Artificial Sequence
  Synthetic oligonucleotide
gcatggggcgggcgtgggggggtgggagagcgtca

SEQ ID NO: 105931 - DNA, 36 bp, Artificial Sequence
  Synthetic oligonucleotide
cccaacgcctcgacctgccatacgcacccctcccta

SEQ ID NO: 105932 - DNA, 36 bp, Artificial Sequence
  Synthetic oligonucleotide
aagccacgcacttatagtttttgccgtacctcccca

SEQ ID NO: 105933 - DNA, 35 bp, Artificial Sequence
  Synthetic oligonucleotide
acacgccgcccagctatcaaccgcttttcttcgtt

SEQ ID NO: 105934 - DNA, 35 bp, Artificial Sequence
  Synthetic oligonucleotide
attgacctcattgctccctcgcccacgccgccccg

SEQ ID NO: 105935 - DNA, 35 bp, Artificial Sequence
  Synthetic oligonucleotide
agcaggaagggaggaagggagggcgagggtaacgg

SEQ ID NO: 105936 - DNA, 35 bp, Artificial Sequence
  Synthetic oligonucleotide
tggaggccaacgctcctccccgctcttgacatggt

SEQ ID NO: 105937 - DNA, 35 bp, Artificial Sequence
  Synthetic oligonucleotide
tgcctacttcacgacgtagtgacctcccctgccct

SEQ ID NO: 105938 - DNA, 35 bp, Artificial Sequence
  Synthetic oligonucleotide
tcattggcaccttcgcctcgttacgtgctcccttc

SEQ ID NO: 105939 - DNA, 35 bp, Artificial Sequence
  Synthetic oligonucleotide
tagtccaaccatggacgttgttgttctctcctccg

SEQ ID NO: 105940 - DNA, 36 bp, Artificial Sequence
  Synthetic oligonucleotide
tgctccacagctgtatagtcctttcacctccctgca

SEQ ID NO: 105941 - DNA, 35 bp, Artificial Sequence
  Synthetic oligonucleotide
tcccagcccgtcgttccctgctctcctccgactct

SEQ ID NO: 105942 - DNA, 35 bp, Artificial Sequence
  Synthetic oligonucleotide
atcgatcagccgccgcacctcccgctcccatacgc

SEQ ID NO: 105943 - DNA, 35 bp, Artificial Sequence
  Synthetic oligonucleotide
tgcatcggcaaaccgtcctgctagcactcccccct

SEQ ID NO: 105944 - DNA, 37 bp, Artificial Sequence
  Synthetic oligonucleotide
gggagacaggaggctgcggggggcggggtggatggga

SEQ ID NO: 105945 - DNA, 35 bp, Artificial Sequence
  Synthetic oligonucleotide
attgacgcgccatgcatagcgtcccgtttcttctc

SEQ ID NO: 105946 - DNA, 35 bp, Artificial Sequence
  Synthetic oligonucleotide
tgagtgccgattgtttttgccgtccacccccgctc

SEQ ID NO: 105947 - DNA, 36 bp, Artificial Sequence
  Synthetic oligonucleotide
tcccctgcccgaccaccatgcctattcctagctcga

SEQ ID NO: 105948 - DNA, 36 bp, Artificial Sequence
  Synthetic oligonucleotide
gaacaccgattagctctgtcttactgctcgccccca

SEQ ID NO: 105949 - DNA, 34 bp, Artificial Sequence
  Synthetic oligonucleotide
tcactgcccctcccgttgcattccgacgactcaa

SEQ ID NO: 105950 - DNA, 35 bp, Artificial Sequence
  Synthetic oligonucleotide
gtggccaccctcgtagcgaatttagccttttccat

SEQ ID NO: 105951 - DNA, 33 bp, Artificial Sequence
  Synthetic oligonucleotide
tcctgtcctccgtgacgttttttcatgatcctc

SEQ ID NO: 105952 - DNA, 35 bp, Artificial Sequence
  Synthetic oligonucleotide
tcaccctcgtatgtccgcacccccttcgcctattg

SEQ ID NO: 105953 - DNA, 37 bp, Artificial Sequence
  Synthetic oligonucleotide
tacgttcaccgcccctctccatcccgcttcggttaga

SEQ ID NO: 105954 - DNA, 35 bp, Artificial Sequence
  Synthetic oligonucleotide
gcaagctgccatctgtccctgtccacggcctactc

SEQ ID NO: 105955 - DNA, 35 bp, Artificial Sequence
  Synthetic oligonucleotide
gaggactgcctatcccgggcgcaagtgcttcctcc

SEQ ID NO: 105956 - DNA, 35 bp, Artificial Sequence
  Synthetic oligonucleotide
tccctcactgcctcccttgtaactcagcctttagt

SEQ ID NO: 105957 - DNA, 35 bp, Artificial Sequence
  Synthetic oligonucleotide
gcacaacgacagtctacactgactcccgctccccc

SEQ ID NO: 105958 - DNA, 37 bp, Artificial Sequence
  Synthetic oligonucleotide
attggtcggaggatggaggggaaggaggttgccggga

SEQ ID NO: 105959 - DNA, 35 bp, Artificial Sequence
  Synthetic oligonucleotide
accgaccgcctctcccttgtccatcccttattgtg

SEQ ID NO: 105960 - DNA, 35 bp, Artificial Sequence
  Synthetic oligonucleotide
gggaggggaaaaccggtgggagcaagggggcatta

SEQ ID NO: 105961 - DNA, 38 bp, Artificial Sequence
  Synthetic oligonucleotide
atcagcacgcctacaccccgcccgcccccgtcccgtga

SEQ ID NO: 105962 - DNA, 35 bp, Artificial Sequence
  Synthetic oligonucleotide
tgtccagcacgcctatgtcgcccttctcacactct

SEQ ID NO: 105963 - DNA, 35 bp, Artificial Sequence
  Synthetic oligonucleotide
gccctcctccgaacgctacttagggaacgacctct

SEQ ID NO: 105964 - DNA, 35 bp, Artificial Sequence
  Synthetic oligonucleotide
cccccgccgcccccttactcagtcggtcttccgtt

SEQ ID NO: 105965 - DNA, 35 bp, Artificial Sequence
  Synthetic oligonucleotide
gatgcggtacgctgctattgtcctttccacccgtg

SEQ ID NO: 105966 - DNA, 35 bp, Artificial Sequence
  Synthetic oligonucleotide
tgtaggccctcactcgcttataacctgctgcctta

SEQ ID NO: 105967 - DNA, 35 bp, Artificial Sequence
  Synthetic oligonucleotide
tggttgcccccacatgcgcttcaactccttctcct

SEQ ID NO: 105968 - DNA, 34 bp, Artificial Sequence
  Synthetic oligonucleotide
atgtccacgcacttcccgttacccgccgttttgt

SEQ ID NO: 105969 - DNA, 35 bp, Artificial Sequence
  Synthetic oligonucleotide
gtttggcgccacctgttttacccctgctaatgtcc

SEQ ID NO: 105970 - DNA, 35 bp, Artificial Sequence
  Synthetic oligonucleotide
gcgtgcccctccagactccttacctgcccttgacc

SEQ ID NO: 105971 - DNA, 36 bp, Artificial Sequence
  Synthetic oligonucleotide
gccccacccctcccctgacttggtatgcaaacacta

SEQ ID NO: 105972 - DNA, 35 bp, Artificial Sequence
  Synthetic oligonucleotide
gcgccccatctaagcgcgttattgctctccccctg

SEQ ID NO: 105973 - DNA, 35 bp, Artificial Sequence
  Synthetic oligonucleotide
taccacaccgcccctctcttatgctcgattaccat

SEQ ID NO: 105974 - DNA, 35 bp, Artificial Sequence
  Synthetic oligonucleotide
tccgacccctccctcagacgttgcaccgggcaacc

SEQ ID NO: 105975 - DNA, 35 bp, Artificial Sequence
  Synthetic oligonucleotide
acgccccgagcctagcccttctcactgcctctctg

SEQ ID NO: 105976 - DNA, 36 bp, Artificial Sequence
  Synthetic oligonucleotide
acacagccccctcagttccttgttgccccacccgca

SEQ ID NO: 105977 - DNA, 37 bp, Artificial Sequence
  Synthetic oligonucleotide
tgcctactccgaactgcaagccccccgccacccacga

SEQ ID NO: 105978 - DNA, 35 bp, Artificial Sequence
  Synthetic oligonucleotide
attccgagcgacacaggtttttcgccacttccctc

SEQ ID NO: 105979 - DNA, 37 bp, Artificial Sequence
  Synthetic oligonucleotide
gaacgggtacgaggacgagagggagggcacaggacga

SEQ ID NO: 105980 - DNA, 35 bp, Artificial Sequence
  Synthetic oligonucleotide
tgatgcgccaccctcgcattattcctgccgcctgc

SEQ ID NO: 105981 - DNA, 35 bp, Artificial Sequence
  Synthetic oligonucleotide
gcgcaatcgcccgctgtccgtcctcacctgcatat

SEQ ID NO: 105982 - DNA, 36 bp, Artificial Sequence
  Synthetic oligonucleotide
ggacaccacccgaactgcgtatcgatccatctctca

SEQ ID NO: 105983 - DNA, 38 bp, Artificial Sequence
  Synthetic oligonucleotide
accgcccctctctttctggttccctgccactactgtga

SEQ ID NO: 105984 - DNA, 35 bp, Artificial Sequence
  Synthetic oligonucleotide
tacgcccacccgctttttttgttctagatgcctca

SEQ ID NO: 105985 - DNA, 35 bp, Artificial Sequence
  Synthetic oligonucleotide
tgtcacccacgcgatcgcccctaccggcttacctc

SEQ ID NO: 105986 - DNA, 35 bp, Artificial Sequence
  Synthetic oligonucleotide
aaagagaagcagagggcgggatcgaagggcggggg

SEQ ID NO: 105987 - DNA, 36 bp, Artificial Sequence
  Synthetic oligonucleotide
tagagggggggatggaggtgggcggagcacgggcga

SEQ ID NO: 105988 - DNA, 35 bp, Artificial Sequence
  Synthetic oligonucleotide
ttgccaaccgccttccatctgttatccgcaaattc

SEQ ID NO: 105989 - DNA, 38 bp, Artificial Sequence
  Synthetic oligonucleotide
accacccgcctccagcgtctcatactcgtcctgcttga

SEQ ID NO: 105990 - DNA, 35 bp, Artificial Sequence
  Synthetic oligonucleotide
gccaccctccgacttccgcattctgcctttacgca

SEQ ID NO: 105991 - DNA, 37 bp, Artificial Sequence
  Synthetic oligonucleotide
ggtggatggaggggttggacggtcgggttaaccttga

SEQ ID NO: 105992 - DNA, 35 bp, Artificial Sequence
  Synthetic oligonucleotide
ctcccccgccgttattgttgaactcggcaccgctc

SEQ ID NO: 105993 - DNA, 35 bp, Artificial Sequence
  Synthetic oligonucleotide
atcgcccccagcagcctctccggttggtgcctttc

SEQ ID NO: 105994 - DNA, 35 bp, Artificial Sequence
  Synthetic oligonucleotide
tgccgccgcacttttatgcacgctctctttctctg

SEQ ID NO: 105995 - DNA, 35 bp, Artificial Sequence
  Synthetic oligonucleotide
tacacgtgccaccgtgcctcatctgaacatccatt

SEQ ID NO: 105996 - DNA, 37 bp, Artificial Sequence
  Synthetic oligonucleotide
tccctacccccgacctattgcaccagcgcctttgcga

SEQ ID NO: 105997 - DNA, 35 bp, Artificial Sequence
  Synthetic oligonucleotide
atgtacaccttgccattgctttttgccactcgttt

SEQ ID NO: 105998 - DNA, 36 bp, Artificial Sequence
  Synthetic oligonucleotide
ttcccgcacctccgtcgttcctttagctcctggtca

SEQ ID NO: 105999 - DNA, 35 bp, Artificial Sequence
  Synthetic oligonucleotide
tagggtggagcaggcggggcggtggaggcgggcat

SEQ ID NO: 106000 - DNA, 35 bp, Artificial Sequence
  Synthetic oligonucleotide
gtgagtcacagctgcctaacttgccttgcccccca

SEQ ID NO: 106001 - DNA, 35 bp, Artificial Sequence
  Synthetic oligonucleotide
tcgttcccgccctgtcccgtctgtctacaattccc

SEQ ID NO: 106002 - DNA, 36 bp, Artificial Sequence
  Synthetic oligonucleotide
tcagccctgcctccgccccccaccgcctggacggga

SEQ ID NO: 106003 - DNA, 35 bp, Artificial Sequence
  Synthetic oligonucleotide
agttcgccctcccctctgcatttgcccatgtgatc

SEQ ID NO: 106004 - DNA, 37 bp, Artificial Sequence
  Synthetic oligonucleotide
aaacagggggggtggtagggaaaggggcggtgtgtga

SEQ ID NO: 106005 - DNA, 35 bp, Artificial Sequence
  Synthetic oligonucleotide
acggtccgccgcttctgtctgccttcgcctctcgc

SEQ ID NO: 106006 - DNA, 37 bp, Artificial Sequence
  Synthetic oligonucleotide
gatggttgagggggggtgggtgaggacgagagacaga

SEQ ID NO: 106007 - DNA, 35 bp, Artificial Sequence
  Synthetic oligonucleotide
tctgtcctccccgtaaatgcgtttgcccttaccct

SEQ ID NO: 106008 - DNA, 35 bp, Artificial Sequence
  Synthetic oligonucleotide
gaggacctcacctgttgtcaccttgctctcttgtc

SEQ ID NO: 106009 - DNA, 35 bp, Artificial Sequence
  Synthetic oligonucleotide
tgtgcacccccaccgatgccctagccctgccttcc

SEQ ID NO: 106010 - DNA, 35 bp, Artificial Sequence
  Synthetic oligonucleotide
gccccccgcccactcatctggcctcatacctgggc

SEQ ID NO: 106011 - DNA, 35 bp, Artificial Sequence
  Synthetic oligonucleotide
cccaacgccccggtttggtccatctcaccccacgt

SEQ ID NO: 106012 - DNA, 35 bp, Artificial Sequence
  Synthetic oligonucleotide
atcgcgcccggggcctcatacctgctcctttccat

SEQ ID NO: 106013 - DNA, 35 bp, Artificial Sequence
  Synthetic oligonucleotide
tcccaccttcgcctgctgctcctgacttaactacc

SEQ ID NO: 106014 - DNA, 35 bp, Artificial Sequence
  Synthetic oligonucleotide
gcacaccatgctgcgtgtcctgccctacctccagc

SEQ ID NO: 106015 - DNA, 38 bp, Artificial Sequence
  Synthetic oligonucleotide
acccgcagaccatcccgacgcgccctacgacaccttga

SEQ ID NO: 106016 - DNA, 35 bp, Artificial Sequence
  Synthetic oligonucleotide
cccctcaacccggccaacttgatggttcttgtccc

SEQ ID NO: 106017 - DNA, 35 bp, Artificial Sequence
  Synthetic oligonucleotide
gtgcatgacgcccctcgccatcgttcccgctacgc

SEQ ID NO: 106018 - DNA, 35 bp, Artificial Sequence
  Synthetic oligonucleotide
gtggcccccgccttgtgccacacgttaaccctttt

SEQ ID NO: 106019 - DNA, 35 bp, Artificial Sequence
  Synthetic oligonucleotide
gactccatcgctgttattgttcgccctgcataatc

SEQ ID NO: 106020 - DNA, 35 bp, Artificial Sequence
  Synthetic oligonucleotide
gaggacgcgcctcagtttatgtctctcctacgttc

SEQ ID NO: 106021 - DNA, 35 bp, Artificial Sequence
  Synthetic oligonucleotide
tgcctgtgccgccctttagcgccctggaatttccc

SEQ ID NO: 106022 - DNA, 35 bp, Artificial Sequence
  Synthetic oligonucleotide
tcgccgcccccaattggccctatgatttcaccgtt

SEQ ID NO: 106023 - DNA, 35 bp, Artificial Sequence
  Synthetic oligonucleotide
acgcaaccccctccgcacacccgctaggctgcacc

SEQ ID NO: 106024 - DNA, 35 bp, Artificial Sequence
  Synthetic oligonucleotide
acgtgtacgcccctccgccccactctcgctcatga

SEQ ID NO: 106025 - DNA, 35 bp, Artificial Sequence
  Synthetic oligonucleotide
actccatgtcatctatccccccccgtacgatggtg

SEQ ID NO: 106026 - DNA, 36 bp, Artificial Sequence
  Synthetic oligonucleotide
gcccctagcctccgtttttttttgccgactcttcca

SEQ ID NO: 106027 - DNA, 36 bp, Artificial Sequence
  Synthetic oligonucleotide
tgcaacctcgcatcttagtcccgccctctctgcgca

SEQ ID NO: 106028 - DNA, 35 bp, Artificial Sequence
  Synthetic oligonucleotide
tcccaccaacccactagtactagccacagacccac

SEQ ID NO: 106029 - DNA, 35 bp, Artificial Sequence
  Synthetic oligonucleotide
atgcctacgccccagttactgtccctccttagtct

SEQ ID NO: 106030 - DNA, 36 bp, Artificial Sequence
  Synthetic oligonucleotide
gtcgcccacccccctgccgtgcgaagcttatattca

SEQ ID NO: 106031 - DNA, 38 bp, Artificial Sequence
  Synthetic oligonucleotide
gggatgtggcgggacggcgggggaaggacggcaggtga

SEQ ID NO: 106032 - DNA, 35 bp, Artificial Sequence
  Synthetic oligonucleotide
gtcctgcccccactgatacacgcacaacttcgatt

SEQ ID NO: 106033 - DNA, 35 bp, Artificial Sequence
  Synthetic oligonucleotide
gtgccccctcctgtctcatccaacggacgtagtct

SEQ ID NO: 106034 - DNA, 35 bp, Artificial Sequence
  Synthetic oligonucleotide
gcacgtgcaccatcttatgcccccttacgccctgg

SEQ ID NO: 106035 - DNA, 35 bp, Artificial Sequence
  Synthetic oligonucleotide
tcgatacctccgcactcctctagcgcctcggccct

SEQ ID NO: 106036 - DNA, 37 bp, Artificial Sequence
  Synthetic oligonucleotide
gcatgggttcggaacaggggaagggaaggagggacga

SEQ ID NO: 106037 - DNA, 32 bp, Artificial Sequence
  Synthetic oligonucleotide
gtccaccccaccataaccgtgccttcatgcct

SEQ ID NO: 106038 - DNA, 35 bp, Artificial Sequence
  Synthetic oligonucleotide
ttcaccacccgcatctgcgctgcctctccgcaccg

SEQ ID NO: 106039 - DNA, 37 bp, Artificial Sequence
  Synthetic oligonucleotide
gacccgcttcacctcccttgcccgccccttcgacgga

SEQ ID NO: 106040 - DNA, 36 bp, Artificial Sequence
  Synthetic oligonucleotide
tcatcgccctgtccgtacccgccgatcgttaccata

SEQ ID NO: 106041 - DNA, 35 bp, Artificial Sequence
  Synthetic oligonucleotide
gtgcaaccacccgccgacctactcttgttccctcg

SEQ ID NO: 106042 - DNA, 35 bp, Artificial Sequence
  Synthetic oligonucleotide
gtgccccaaatgctaagtccccgtttgccccgtac

SEQ ID NO: 106043 - DNA, 35 bp, Artificial Sequence
  Synthetic oligonucleotide
ctgcgttctgcccctatgccctccccagctgacga

SEQ ID NO: 106044 - DNA, 35 bp, Artificial Sequence
  Synthetic oligonucleotide
accgtcccgcagtggaatttgcccccacccccatc

SEQ ID NO: 106045 - DNA, 35 bp, Artificial Sequence
  Synthetic oligonucleotide
ttttgcgccgctgagtaccgcctcccgacccctcc

SEQ ID NO: 106046 - DNA, 35 bp, Artificial Sequence
  Synthetic oligonucleotide
gacatgactgtttgctccctacacgctgggccctc

SEQ ID NO: 106047 - DNA, 35 bp, Artificial Sequence
  Synthetic oligonucleotide
tgtacgtcgcctccttgctctacatgcctgattcc

SEQ ID NO: 106048 - DNA, 37 bp, Artificial Sequence
  Synthetic oligonucleotide
aatgctgggtgggggaaagtaaagggccgaggtttga

SEQ ID NO: 106049 - DNA, 35 bp, Artificial Sequence
  Synthetic oligonucleotide
tacatcctcgcagcacctgcccttaccgactttcc

SEQ ID NO: 106050 - DNA, 35 bp, Artificial Sequence
  Synthetic oligonucleotide
gggggggagggaatgggttgggtgcgtagagaacg

SEQ ID NO: 106051 - DNA, 37 bp, Artificial Sequence
  Synthetic oligonucleotide
gcagggcggggcgggggggaggatcatcgggaactga

SEQ ID NO: 106052 - DNA, 35 bp, Artificial Sequence
  Synthetic oligonucleotide
gtcgcacgtcgcttcaacacgccgccactacgctc

SEQ ID NO: 106053 - DNA, 35 bp, Artificial Sequence
  Synthetic oligonucleotide
gccctgcgcttcggaccgttccgccacacccctcc

SEQ ID NO: 106054 - DNA, 35 bp, Artificial Sequence
  Synthetic oligonucleotide
tgtcgccctcaccgtctcccccatgccaggtcctg

SEQ ID NO: 106055 - DNA, 35 bp, Artificial Sequence
  Synthetic oligonucleotide
tcccctcgtgcctcccgctgtgcccccctgcaccc

SEQ ID NO: 106056 - DNA, 38 bp, Artificial Sequence
  Synthetic oligonucleotide
gctgacgtccgtccgctctatccatctcgtgcttatga

SEQ ID NO: 106057 - DNA, 35 bp, Artificial Sequence
  Synthetic oligonucleotide
tgcccacccccgatatctatacatttacgcccgct

SEQ ID NO: 106058 - DNA, 37 bp, Artificial Sequence
  Synthetic oligonucleotide
acctcgcccacgctgccttttctttgcgccaccttga

SEQ ID NO: 106059 - DNA, 37 bp, Artificial Sequence
  Synthetic oligonucleotide
tcagataatgtggaggctgggaagaagggaggggcga

SEQ ID NO: 106060 - DNA, 35 bp, Artificial Sequence
  Synthetic oligonucleotide
tatcccccccagatcccgcttatggagtccccgtc

SEQ ID NO: 106061 - DNA, 37 bp, Artificial Sequence
  Synthetic oligonucleotide
gtcacggatgagcgcgggttagggcgggggggtagga

SEQ ID NO: 106062 - DNA, 37 bp, Artificial Sequence
  Synthetic oligonucleotide
gtgatacggaggaaagggaagaacacgggtaggggga

SEQ ID NO: 106063 - DNA, 35 bp, Artificial Sequence
  Synthetic oligonucleotide
gttggtagggaagggggggtggcttgggaccagtg

SEQ ID NO: 106064 - DNA, 35 bp, Artificial Sequence
  Synthetic oligonucleotide
gtacacccgtatgcgccccatctacccacggtctt

SEQ ID NO: 106065 - DNA, 35 bp, Artificial Sequence
  Synthetic oligonucleotide
tccgatgcacacatggttgccctcttgcctcttct

SEQ ID NO: 106066 - DNA, 35 bp, Artificial Sequence
  Synthetic oligonucleotide
tatccgccccgtgctggtgcccccgtagtcccctt

SEQ ID NO: 106067 - DNA, 35 bp, Artificial Sequence
  Synthetic oligonucleotide
tagttcgccccatccgcccttcgcccgctttgtta

SEQ ID NO: 106068 - DNA, 34 bp, Artificial Sequence
  Synthetic oligonucleotide
atcccgacgtatcggtttgtggtcccgtcccacc

SEQ ID NO: 106069 - DNA, 37 bp, Artificial Sequence
  Synthetic oligonucleotide
actggtgagagggtgggtgggttacatgcctcgcgga

SEQ ID NO: 106070 - DNA, 35 bp, Artificial Sequence
  Synthetic oligonucleotide
tcccacacttggatccgtctgagccctgcccccga

SEQ ID NO: 106071 - DNA, 35 bp, Artificial Sequence
  Synthetic oligonucleotide
ttcctccacccgcgatgcctactcgttaccgcact

SEQ ID NO: 106072 - DNA, 35 bp, Artificial Sequence
  Synthetic oligonucleotide
gtaaggaggggcataggggaaggagtggtgtgttt

SEQ ID NO: 106073 - DNA, 35 bp, Artificial Sequence
  Synthetic oligonucleotide
accatccttcctttgtctaccccgcctggttgttc

SEQ ID NO: 106074 - DNA, 35 bp, Artificial Sequence
  Synthetic oligonucleotide
tcccacgccacttctccgcagtacctttcgtttgc

SEQ ID NO: 106075 - DNA, 35 bp, Artificial Sequence
  Synthetic oligonucleotide
gtgaagccgccattcccgttccatttagctcgttc

SEQ ID NO: 106076 - DNA, 35 bp, Artificial Sequence
  Synthetic oligonucleotide
tgcacgccgcactcgccctgatactctcccgccat

SEQ ID NO: 106077 - DNA, 37 bp, Artificial Sequence
  Synthetic oligonucleotide
tcaagggggggagggaaggcgggtaggagggaacaga

SEQ ID NO: 106078 - DNA, 35 bp, Artificial Sequence
  Synthetic oligonucleotide
ttcagacaccacctcgtccatcagtcccgcacctg

SEQ ID NO: 106079 - DNA, 37 bp, Artificial Sequence
  Synthetic oligonucleotide
accggaaggaggaggaaggatcaggagggtgggtaga

SEQ ID NO: 106080 - DNA, 35 bp, Artificial Sequence
  Synthetic oligonucleotide
tagggaccgctcctgcccgctatcactaattgccc

SEQ ID NO: 106081 - DNA, 36 bp, Artificial Sequence
  Synthetic oligonucleotide
accaaacggcggcaggaggggtaggaaatgggtgga

SEQ ID NO: 106082 - DNA, 35 bp, Artificial Sequence
  Synthetic oligonucleotide
tcaccgtcccggtcatctgtcccccgtcccgttcc

SEQ ID NO: 106083 - DNA, 34 bp, Artificial Sequence
  Synthetic oligonucleotide
gcgcaccctcgagtaccttgcatgtccgtcgccc

SEQ ID NO: 106084 - DNA, 36 bp, Artificial Sequence
  Synthetic oligonucleotide
ttgcatgccgtgatgggaacgggagggggggctgca

SEQ ID NO: 106085 - DNA, 36 bp, Artificial Sequence
  Synthetic oligonucleotide
tacgccgagcctccccctccccttgagtactatgca

SEQ ID NO: 106086 - DNA, 31 bp, Artificial Sequence
  Synthetic oligonucleotide
aactcaccactcgccctttaggttgtaacct

SEQ ID NO: 106087 - DNA, 35 bp, Artificial Sequence
  Synthetic oligonucleotide
tatgaacagcctccatgcgtgccgctcactctcct

SEQ ID NO: 106088 - DNA, 35 bp, Artificial Sequence
  Synthetic oligonucleotide
gtcagacgtacctcccgtgtgcctccatcttcgcc

SEQ ID NO: 106089 - DNA, 36 bp, Artificial Sequence
  Synthetic oligonucleotide
ttgacgcccccttgttgaactcgcgttgacccttct

SEQ ID NO: 106090 - DNA, 35 bp, Artificial Sequence
  Synthetic oligonucleotide
tcaaacccccccgcggtactaacacgaccctgtcc

SEQ ID NO: 106091 - DNA, 35 bp, Artificial Sequence
  Synthetic oligonucleotide
ttcccccacccagcaccgtgcctcagaacgctgcc

SEQ ID NO: 106092 - DNA, 35 bp, Artificial Sequence
  Synthetic oligonucleotide
gccaagcactgctctctttctccacggtaacttcc

SEQ ID NO: 106093 - DNA, 37 bp, Artificial Sequence
  Synthetic oligonucleotide
gcagggagggagggaaggggcaaaggtaatagccaga

SEQ ID NO: 106094 - DNA, 36 bp, Artificial Sequence
  Synthetic oligonucleotide
gcccctaccgcccggattgacctcgcctcgtaccta

SEQ ID NO: 106095 - DNA, 36 bp, Artificial Sequence
  Synthetic oligonucleotide
agcgaagtgggggaaaaggggcgggtggagcaggaa

SEQ ID NO: 106096 - DNA, 37 bp, Artificial Sequence
  Synthetic oligonucleotide
gagtggggagggaatggagacggggtttccacgggga

SEQ ID NO: 106097 - DNA, 35 bp, Artificial Sequence
  Synthetic oligonucleotide
aaccccgccccttctgtaatggtttcctgttaatc

SEQ ID NO: 106098 - DNA, 35 bp, Artificial Sequence
  Synthetic oligonucleotide
tcccccgccgcctactctccgccatgccgattgag

SEQ ID NO: 106099 - DNA, 35 bp, Artificial Sequence
  Synthetic oligonucleotide
gatgccccttgttgatccgttccctgcctggttta

SEQ ID NO: 106100 - DNA, 35 bp, Artificial Sequence
  Synthetic oligonucleotide
tcagctgtgcttgcgtgccttcctgtctgtaccat

SEQ ID NO: 106101 - DNA, 36 bp, Artificial Sequence
  Synthetic oligonucleotide
gttgtcctgcctccattatcacacgcgccctctgca

SEQ ID NO: 106102 - DNA, 36 bp, Artificial Sequence
  Synthetic oligonucleotide
atcgcaccgccgacccaccttttccactcgtactga

SEQ ID NO: 106103 - DNA, 35 bp, Artificial Sequence
  Synthetic oligonucleotide
ttagcatagtgggaagggggagcgaagggggcaaa

SEQ ID NO: 106104 - DNA, 37 bp, Artificial Sequence
  Synthetic oligonucleotide
atcccaccctccgacgttattcattgctccttgcgga

SEQ ID NO: 106105 - DNA, 36 bp, Artificial Sequence
  Synthetic oligonucleotide
acccgccgccactcgattccccgtccagtcattcca

SEQ ID NO: 106106 - DNA, 35 bp, Artificial Sequence
  Synthetic oligonucleotide
acttcgcccgccactcgccttctggtacatgtacc

SEQ ID NO: 106107 - DNA, 35 bp, Artificial Sequence
  Synthetic oligonucleotide
tcccatcccctcgcacacgccgccttcgagaagcc

SEQ ID NO: 106108 - DNA, 35 bp, Artificial Sequence
  Synthetic oligonucleotide
atccacttcgcgtgtctgctcctgcctttcccccg

SEQ ID NO: 106109 - DNA, 35 bp, Artificial Sequence
  Synthetic oligonucleotide
tgccatccacccatctcgtattcgatcattgcgca

SEQ ID NO: 106110 - DNA, 35 bp, Artificial Sequence
  Synthetic oligonucleotide
acgaggccgaaaggggggagggaaagagcgggcta

SEQ ID NO: 106111 - DNA, 35 bp, Artificial Sequence
  Synthetic oligonucleotide
tgccggtcctgtcttcgttgttcatgcccctcttt

SEQ ID NO: 106112 - DNA, 35 bp, Artificial Sequence
  Synthetic oligonucleotide
gtctccgccgataggtgcctttgtttcgccccatc

SEQ ID NO: 106113 - DNA, 35 bp, Artificial Sequence
  Synthetic oligonucleotide
tagacacgccccgctctatttgccactctttttcc

SEQ ID NO: 106114 - DNA, 35 bp, Artificial Sequence
  Synthetic oligonucleotide
gtgggagtgaaaggtagggatgagagaggggagcg

SEQ ID NO: 106115 - DNA, 35 bp, Artificial Sequence
  Synthetic oligonucleotide
gtacgccgtacgccaattagtttacatgcccttct

SEQ ID NO: 106116 - DNA, 35 bp, Artificial Sequence
  Synthetic oligonucleotide
tccaccggcaatttgccgcccctcgctccccgggt

SEQ ID NO: 106117 - DNA, 38 bp, Artificial Sequence
  Synthetic oligonucleotide
actcaccccgccacagtgttatttcccaccctccatga

SEQ ID NO: 106118 - DNA, 35 bp, Artificial Sequence
  Synthetic oligonucleotide
acccaatgccctgggctatatgtcctccgccaccc

SEQ ID NO: 106119 - DNA, 35 bp, Artificial Sequence
  Synthetic oligonucleotide
aaccaatcgctctcatggtctcctggctcccttcc

SEQ ID NO: 106120 - DNA, 36 bp, Artificial Sequence
  Synthetic oligonucleotide
actgggaggggggggtggaggtgggaagtttcggaa

SEQ ID NO: 106121 - DNA, 35 bp, Artificial Sequence
  Synthetic oligonucleotide
atccgccccatgtttctcctcctgacgctcattgc

SEQ ID NO: 106122 - DNA, 35 bp, Artificial Sequence
  Synthetic oligonucleotide
tgtgcctttccgccggtcctttcgcctatcctgcc

SEQ ID NO: 106123 - DNA, 35 bp, Artificial Sequence
  Synthetic oligonucleotide
agtggagaaacgggggaaggggaggaggaggtcat

SEQ ID NO: 106124 - DNA, 35 bp, Artificial Sequence
  Synthetic oligonucleotide
atgtacgcaggccttagttttttcatcgtcccgcc

SEQ ID NO: 106125 - DNA, 37 bp, Artificial Sequence
  Synthetic oligonucleotide
acacattgggtgggatagggagggcgataaagggaga

SEQ ID NO: 106126 - DNA, 35 bp, Artificial Sequence
  Synthetic oligonucleotide
agcacacttcgttgcctcatccccacccgccctgc

SEQ ID NO: 106127 - DNA, 35 bp, Artificial Sequence
  Synthetic oligonucleotide
tgacactccgtttccatttgtttgtccctgccacc

SEQ ID NO: 106128 - DNA, 35 bp, Artificial Sequence
  Synthetic oligonucleotide
gtagggaagagagcatgggtaggggaagggcgtag

SEQ ID NO: 106129 - DNA, 38 bp, Artificial Sequence
  Synthetic oligonucleotide
acaacccgcactgtgcttctccgtcctccactccatga

SEQ ID NO: 106130 - DNA, 35 bp, Artificial Sequence
  Synthetic oligonucleotide
ttgacgcctcccgggccctgccactatatgctccc

SEQ ID NO: 106131 - DNA, 36 bp, Artificial Sequence
  Synthetic oligonucleotide
tgcgttgccccgaccccccgcccagtggtcctccca

SEQ ID NO: 106132 - DNA, 37 bp, Artificial Sequence
  Synthetic oligonucleotide
acagtgaggggcggggaggaggagaagagggcgcaga

SEQ ID NO: 106133 - DNA, 35 bp, Artificial Sequence
  Synthetic oligonucleotide
tgccctgacagcgtgcttaccgtttcctgccctta

SEQ ID NO: 106134 - DNA, 35 bp, Artificial Sequence
  Synthetic oligonucleotide
ttggtgcggaagccttataccacgtgcgtccctct

SEQ ID NO: 106135 - DNA, 35 bp, Artificial Sequence
  Synthetic oligonucleotide
actataggaggtggcggggccggttaggcggttaa

SEQ ID NO: 106136 - DNA, 35 bp, Artificial Sequence
  Synthetic oligonucleotide
tctcccacctcatggactgtgtcctcctcttcccc

SEQ ID NO: 106137 - DNA, 35 bp, Artificial Sequence
  Synthetic oligonucleotide
tacgacgcctctacgcatgcaccccggcccatcct

SEQ ID NO: 106138 - DNA, 35 bp, Artificial Sequence
  Synthetic oligonucleotide
tccgactagctctttgtcttctaccccctgtcgcc

SEQ ID NO: 106139 - DNA, 35 bp, Artificial Sequence
  Synthetic oligonucleotide
aacatcatcacggtcgtactggcccctcccgttac

SEQ ID NO: 106140 - DNA, 37 bp, Artificial Sequence
  Synthetic oligonucleotide
gcagaggagtagggaacaagggggtagtgcggtcgga

SEQ ID NO: 106141 - DNA, 35 bp, Artificial Sequence
  Synthetic oligonucleotide
ggtgaggaaggctaagggggggaggggcgggataa

SEQ ID NO: 106142 - DNA, 35 bp, Artificial Sequence
  Synthetic oligonucleotide
tagcaactccgcccccagcacccccaggcctcgcc

SEQ ID NO: 106143 - DNA, 35 bp, Artificial Sequence
  Synthetic oligonucleotide
aatggcacgccgcccacacatgcaccccaccgtcc

SEQ ID NO: 106144 - DNA, 35 bp, Artificial Sequence
  Synthetic oligonucleotide
tgtccctccgaccgtcacaaagcccgccgtctccg

SEQ ID NO: 106145 - DNA, 35 bp, Artificial Sequence
  Synthetic oligonucleotide
cagacccgctgccatctctatatcttcgcctggtc

SEQ ID NO: 106146 - DNA, 35 bp, Artificial Sequence
  Synthetic oligonucleotide
accacccgctccatcttaaggcgatggcctccctc

SEQ ID NO: 106147 - DNA, 35 bp, Artificial Sequence
  Synthetic oligonucleotide
ttcatcacccgcccgctctccgatcaactggacct

SEQ ID NO: 106148 - DNA, 35 bp, Artificial Sequence
  Synthetic oligonucleotide
ttgcccttgccacacgccgcattacactacgctct

SEQ ID NO: 106149 - DNA, 35 bp, Artificial Sequence
  Synthetic oligonucleotide
tcagcctatccttgtgcaccaaccaccgctctcgc

SEQ ID NO: 106150 - DNA, 35 bp, Artificial Sequence
  Synthetic oligonucleotide
gtatccgacctcgccctctcatgtgctccactgtc

SEQ ID NO: 106151 - DNA, 35 bp, Artificial Sequence
  Synthetic oligonucleotide
taccaccgtcaactgctccagtatttcacgccctc

SEQ ID NO: 106152 - DNA, 35 bp, Artificial Sequence
  Synthetic oligonucleotide
tgatactcgccattggtctcccacccgccgtttcc

SEQ ID NO: 106153 - DNA, 36 bp, Artificial Sequence
  Synthetic oligonucleotide
tctcgccctccgtccttcctcgatccatctccggga

SEQ ID NO: 106154 - DNA, 35 bp, Artificial Sequence
  Synthetic oligonucleotide
ttcacccccacgaagttcgcattgtttgccgtgcc

SEQ ID NO: 106155 - DNA, 35 bp, Artificial Sequence
  Synthetic oligonucleotide
gccgtacactcgcctcgccatgttcttcccctctg

SEQ ID NO: 106156 - DNA, 35 bp, Artificial Sequence
  Synthetic oligonucleotide
agccacgtaccctgttctcctgtctgcgcgattcc

SEQ ID NO: 106157 - DNA, 36 bp, Artificial Sequence
  Synthetic oligonucleotide
acccaaaggcggaggagggggtaaaaaaggggtgga

SEQ ID NO: 106158 - DNA, 35 bp, Artificial Sequence
  Synthetic oligonucleotide
gcccacctcctttgcgcttcaaaccagttctccac

SEQ ID NO: 106159 - DNA, 36 bp, Artificial Sequence
  Synthetic oligonucleotide
ggggaggggctgaagactggggcggttaaggggtta

SEQ ID NO: 106160 - DNA, 35 bp, Artificial Sequence
  Synthetic oligonucleotide
tctgccgcacgcgcaacctagccctgtctgccttc

SEQ ID NO: 106161 - DNA, 36 bp, Artificial Sequence
  Synthetic oligonucleotide
ttcgccctccccgtattgtaggtcttacacttgcca

SEQ ID NO: 106162 - DNA, 35 bp, Artificial Sequence
  Synthetic oligonucleotide
gtcgggcaatcctgcattatcacctggccccgttc

SEQ ID NO: 106163 - DNA, 36 bp, Artificial Sequence
  Synthetic oligonucleotide
tcgagctccccaccgcccgccttctacgctctgcga

SEQ ID NO: 106164 - DNA, 34 bp, Artificial Sequence
  Synthetic oligonucleotide
ggactccgcccctgctcctccaaatagaccctag

SEQ ID NO: 106165 - DNA, 35 bp, Artificial Sequence
  Synthetic oligonucleotide
gacctcgccgacttgccccaccactcttgcacttg

SEQ ID NO: 106166 - DNA, 35 bp, Artificial Sequence
  Synthetic oligonucleotide
acccgtcctctgatggcatttgcctccgcccccgc

SEQ ID NO: 106167 - DNA, 37 bp, Artificial Sequence
  Synthetic oligonucleotide
taagatggagggcgtagtacgaatgggggggagtgga

SEQ ID NO: 106168 - DNA, 35 bp, Artificial Sequence
  Synthetic oligonucleotide
acatgctgtcaagaactctcctgctccctccggtc

SEQ ID NO: 106169 - DNA, 35 bp, Artificial Sequence
  Synthetic oligonucleotide
actgccaccgcacgcgtcccttactgctatccccc

SEQ ID NO: 106170 - DNA, 35 bp, Artificial Sequence
  Synthetic oligonucleotide
tcaccctcgtccgtccatccccattcgcctagtcg

SEQ ID NO: 106171 - DNA, 35 bp, Artificial Sequence
  Synthetic oligonucleotide
gattcacccgcctgttacctaaacagtgttgcctc

SEQ ID NO: 106172 - DNA, 35 bp, Artificial Sequence
  Synthetic oligonucleotide
acgcccaaccttctttctgttccactgccccagca

SEQ ID NO: 106173 - DNA, 36 bp, Artificial Sequence
  Synthetic oligonucleotide
acctccaccactgctccctttagacaacagttatta

SEQ ID NO: 106174 - DNA, 35 bp, Artificial Sequence
  Synthetic oligonucleotide
tgcccccatttggtctgttacttgcttcatcctgc

SEQ ID NO: 106175 - DNA, 35 bp, Artificial Sequence
  Synthetic oligonucleotide
attgagggggaggaagggtaatgggaggattgaaa

SEQ ID NO: 106176 - DNA, 36 bp, Artificial Sequence
  Synthetic oligonucleotide
tgatgtcccctgtgtgcgctgctgcccgcttctcca

SEQ ID NO: 106177 - DNA, 35 bp, Artificial Sequence
  Synthetic oligonucleotide
gcacgcatcctgtatcacgcccgcctctccaatga

SEQ ID NO: 106178 - DNA, 35 bp, Artificial Sequence
  Synthetic oligonucleotide
atgcccggtccgttccttattcccctggctaccct

SEQ ID NO: 106179 - DNA, 37 bp, Artificial Sequence
  Synthetic oligonucleotide
tgcacatgggagggtgggagggggaacgatcgaacga

SEQ ID NO: 106180 - DNA, 35 bp, Artificial Sequence
  Synthetic oligonucleotide
gttcgcatcctcctttccctttggtcctgcaattg

SEQ ID NO: 106181 - DNA, 35 bp, Artificial Sequence
  Synthetic oligonucleotide
actccccctacccgctgcctatcgttccttgtgac

SEQ ID NO: 106182 - DNA, 35 bp, Artificial Sequence
  Synthetic oligonucleotide
acgtgccccatctcgcccgaccatattgcgttgct

SEQ ID NO: 106183 - DNA, 37 bp, Artificial Sequence
  Synthetic oligonucleotide
tcccgccccccatgacatacgctggtccctgttacga

SEQ ID NO: 106184 - DNA, 35 bp, Artificial Sequence
  Synthetic oligonucleotide
tgccaccccaccacgaataggctcatgcccaggcc

SEQ ID NO: 106185 - DNA, 35 bp, Artificial Sequence
  Synthetic oligonucleotide
aagcatccgccgatgccacccaccgccctcaccgt

SEQ ID NO: 106186 - DNA, 35 bp, Artificial Sequence
  Synthetic oligonucleotide
gacgccgctcccctccgtcgattcgttgttcgctc

SEQ ID NO: 106187 - DNA, 36 bp, Artificial Sequence
  Synthetic oligonucleotide
tgcgacccctcgccgttcctcccccacgtatttgaa

SEQ ID NO: 106188 - DNA, 36 bp, Artificial Sequence
  Synthetic oligonucleotide
gggggagagtggaaggagggagggcggtagaaagta

SEQ ID NO: 106189 - DNA, 35 bp, Artificial Sequence
  Synthetic oligonucleotide
gcgatgcgtccgccccgccttccctttcccttggc

SEQ ID NO: 106190 - DNA, 35 bp, Artificial Sequence
  Synthetic oligonucleotide
gcgatccccacctccctctcacgtccgaccctgtc

SEQ ID NO: 106191 - DNA, 35 bp, Artificial Sequence
  Synthetic oligonucleotide
accacaaccccggcctgtcgcattagctgccaccc

SEQ ID NO: 106192 - DNA, 35 bp, Artificial Sequence
  Synthetic oligonucleotide
cagacaacagctacgcacctcccggcctctctccg

SEQ ID NO: 106193 - DNA, 37 bp, Artificial Sequence
  Synthetic oligonucleotide
tcacctggtccttttgcttctgcagccttacttccga

SEQ ID NO: 106194 - DNA, 35 bp, Artificial Sequence
  Synthetic oligonucleotide
ggggtgggaggggaggcatggagtagttggaggga

SEQ ID NO: 106195 - DNA, 35 bp, Artificial Sequence
  Synthetic oligonucleotide
atgccatccaactgctcccgttatccgacttcgac

SEQ ID NO: 106196 - DNA, 35 bp, Artificial Sequence
  Synthetic oligonucleotide
gacccacgcccccttttaacgctgccggacctggc

SEQ ID NO: 106197 - DNA, 35 bp, Artificial Sequence
  Synthetic oligonucleotide
accgcactacatctgccgcaactcacaatccttcg

SEQ ID NO: 106198 - DNA, 36 bp, Artificial Sequence
  Synthetic oligonucleotide
gagtaggggagggggaagggggcggagggttaaaga

SEQ ID NO: 106199 - DNA, 35 bp, Artificial Sequence
  Synthetic oligonucleotide
gcactcacacgtcctatcctgcaaagtcccttcgt

SEQ ID NO: 106200 - DNA, 35 bp, Artificial Sequence
  Synthetic oligonucleotide
gggaacacaccgagagccgccgcaagcccccgccc

SEQ ID NO: 106201 - DNA, 36 bp, Artificial Sequence
  Synthetic oligonucleotide
gatccagccgtagtttcctattgtgcacccctccca

SEQ ID NO: 106202 - DNA, 35 bp, Artificial Sequence
  Synthetic oligonucleotide
tctagccgcaacccgatcggtttcctgcctttcac

SEQ ID NO: 106203 - DNA, 35 bp, Artificial Sequence
  Synthetic oligonucleotide
tatgcgtcacagtgactaccctccctcctgccccc

SEQ ID NO: 106204 - DNA, 35 bp, Artificial Sequence
  Synthetic oligonucleotide
ggtgcctccgctccgccgtatacattgtctcctgt

SEQ ID NO: 106205 - DNA, 35 bp, Artificial Sequence
  Synthetic oligonucleotide
tgagcgccatcgcccctgtttgcttattcgcctta

SEQ ID NO: 106206 - DNA, 35 bp, Artificial Sequence
  Synthetic oligonucleotide
tgcttgcccgttcccgttcgtcttttcccatccta

SEQ ID NO: 106207 - DNA, 36 bp, Artificial Sequence
  Synthetic oligonucleotide
gtgatccgcctgccttttgcacaacgcacactctta

SEQ ID NO: 106208 - DNA, 36 bp, Artificial Sequence
  Synthetic oligonucleotide
ggggtgggtgatcggggtcgcatgctagtagtggga

SEQ ID NO: 106209 - DNA, 35 bp, Artificial Sequence
  Synthetic oligonucleotide
tgccgtgtcccctgcctggcccgagttttcttccc

SEQ ID NO: 106210 - DNA, 35 bp, Artificial Sequence
  Synthetic oligonucleotide
tcaacagcccgccaatccatgttacctaccccttg

SEQ ID NO: 106211 - DNA, 35 bp, Artificial Sequence
  Synthetic oligonucleotide
gctcctcctcccaacatgcgttctccgggcctctc

SEQ ID NO: 106212 - DNA, 35 bp, Artificial Sequence
  Synthetic oligonucleotide
gccatctccacggacgtgcccaatcaccccacctg

SEQ ID NO: 106213 - DNA, 36 bp, Artificial Sequence
  Synthetic oligonucleotide
gctgcctccttccgctgattatgctccactgtacta

SEQ ID NO: 106214 - DNA, 35 bp, Artificial Sequence
  Synthetic oligonucleotide
gcgcctcccacatccgctagcccgactccctaccg

SEQ ID NO: 106215 - DNA, 35 bp, Artificial Sequence
  Synthetic oligonucleotide
tgcacctttccgcatcgtggcccttatcatcttcc

SEQ ID NO: 106216 - DNA, 35 bp, Artificial Sequence
  Synthetic oligonucleotide
tcacactccgcacaatggccagttctatcgctacc

SEQ ID NO: 106217 - DNA, 35 bp, Artificial Sequence
  Synthetic oligonucleotide
acatccgtccaatgagccttcctgccgttccacca

SEQ ID NO: 106218 - DNA, 35 bp, Artificial Sequence
  Synthetic oligonucleotide
tagcacatagtatctgctccatccacccattcgcc

SEQ ID NO: 106219 - DNA, 35 bp, Artificial Sequence
  Synthetic oligonucleotide
tgccccccacatccacgcgaactgacgcaatgcct

SEQ ID NO: 106220 - DNA, 37 bp, Artificial Sequence
  Synthetic oligonucleotide
ggggttggtcgacttagtctaataggctgggtgggga

SEQ ID NO: 106221 - DNA, 35 bp, Artificial Sequence
  Synthetic oligonucleotide
gtccacgcatcatccgccactatcctcgagtaacc

SEQ ID NO: 106222 - DNA, 37 bp, Artificial Sequence
  Synthetic oligonucleotide
tccgccccccgattgctaggttacgctaccgccccga

SEQ ID NO: 106223 - DNA, 36 bp, Artificial Sequence
  Synthetic oligonucleotide
gcttccatccgcatgaactgtctaccctccgtgcca

SEQ ID NO: 106224 - DNA, 36 bp, Artificial Sequence
  Synthetic oligonucleotide
gcctcccgccgcccacatgccgcaatctattctcga

SEQ ID NO: 106225 - DNA, 35 bp, Artificial Sequence
  Synthetic oligonucleotide
acccaccgccttgccctcccgttccacaaagtgta

SEQ ID NO: 106226 - DNA, 35 bp, Artificial Sequence
  Synthetic oligonucleotide
aaatgcacgcccgtcctgctccttacacctttgac

SEQ ID NO: 106227 - DNA, 35 bp, Artificial Sequence
  Synthetic oligonucleotide
tccaccgacccgctatatctgcactcgatgcctgt

SEQ ID NO: 106228 - DNA, 36 bp, Artificial Sequence
  Synthetic oligonucleotide
tcaacccgcccgcattgtttactcttcctgcatcca

SEQ ID NO: 106229 - DNA, 35 bp, Artificial Sequence
  Synthetic oligonucleotide
gatctggagggggtggtgaacgacgggaggggagg

SEQ ID NO: 106230 - DNA, 35 bp, Artificial Sequence
  Synthetic oligonucleotide
gttgcatctccatctgcttctcagcgcatttcgct

SEQ ID NO: 106231 - DNA, 35 bp, Artificial Sequence
  Synthetic oligonucleotide
aatacccgcccctgattttacccacgcgtgccgcc

SEQ ID NO: 106232 - DNA, 35 bp, Artificial Sequence
  Synthetic oligonucleotide
tagtcacccctgcttgccccgaccttctgctcgca

SEQ ID NO: 106233 - DNA, 31 bp, Artificial Sequence
  Synthetic oligonucleotide
gaccccgctgatcctgctttacctaactatt

SEQ ID NO: 106234 - DNA, 35 bp, Artificial Sequence
  Synthetic oligonucleotide
ggactccccccgttcctgtccatcgcccccctgta

SEQ ID NO: 106235 - DNA, 37 bp, Artificial Sequence
  Synthetic oligonucleotide
gaggggggggaggggagggacgggaagaagggcgtga

SEQ ID NO: 106236 - DNA, 34 bp, Artificial Sequence
  Synthetic oligonucleotide
gcacccgccgctcccctcgtctactggtaactgt

SEQ ID NO: 106237 - DNA, 35 bp, Artificial Sequence
  Synthetic oligonucleotide
tttagccgcctgcaccctattcgtgatcctcctag

SEQ ID NO: 106238 - DNA, 36 bp, Artificial Sequence
  Synthetic oligonucleotide
acctgccggcctccaatgccccctacgaaccaccca

SEQ ID NO: 106239 - DNA, 35 bp, Artificial Sequence
  Synthetic oligonucleotide
tccttcaccgacctgcaccacgagctcgctaacac

SEQ ID NO: 106240 - DNA, 36 bp, Artificial Sequence
  Synthetic oligonucleotide
gtacctccgccgcatttctgacacctgctaccttga

SEQ ID NO: 106241 - DNA, 35 bp, Artificial Sequence
  Synthetic oligonucleotide
gtggagggaagggaggggcctgtagtgatgggaat

SEQ ID NO: 106242 - DNA, 35 bp, Artificial Sequence
  Synthetic oligonucleotide
acgccccgccccattattgcattatccctgaggca

SEQ ID NO: 106243 - DNA, 37 bp, Artificial Sequence
  Synthetic oligonucleotide
atgccccccgattagccgcctatattgccccccccga

SEQ ID NO: 106244 - DNA, 35 bp, Artificial Sequence
  Synthetic oligonucleotide
ttggtctgcctcatcaatcgccgcaccttctccga

SEQ ID NO: 106245 - DNA, 35 bp, Artificial Sequence
  Synthetic oligonucleotide
tcgcctccacccgccaaactgcctgatagcattcc

SEQ ID NO: 106246 - DNA, 35 bp, Artificial Sequence
  Synthetic oligonucleotide
gacccgctgagcttgcgtgcttttccatccacccc

SEQ ID NO: 106247 - DNA, 35 bp, Artificial Sequence
  Synthetic oligonucleotide
tacgccacacacaatttgctaacgccctcttcgcc

SEQ ID NO: 106248 - DNA, 35 bp, Artificial Sequence
  Synthetic oligonucleotide
acgcggaggaaggaagggggtatcggggtgaagat

SEQ ID NO: 106249 - DNA, 36 bp, Artificial Sequence
  Synthetic oligonucleotide
attggcacccccgtcacaccctcccgatccttggtc

SEQ ID NO: 106250 - DNA, 36 bp, Artificial Sequence
  Synthetic oligonucleotide
tgcccggtccgcccccctgcatggtatcctttttca

SEQ ID NO: 106251 - DNA, 35 bp, Artificial Sequence
  Synthetic oligonucleotide
gagctcccgccgccgtattgtcctcccgcgttttg

SEQ ID NO: 106252 - DNA, 36 bp, Artificial Sequence
  Synthetic oligonucleotide
gttgcagagggaggggggaacaagcagggtgaagga

SEQ ID NO: 106253 - DNA, 36 bp, Artificial Sequence
  Synthetic oligonucleotide
tacgcaccctccctgtattcacgtacaaccgccaca

SEQ ID NO: 106254 - DNA, 35 bp, Artificial Sequence
  Synthetic oligonucleotide
accactgccccatcaggagtctcgcccctataccc

SEQ ID NO: 106255 - DNA, 36 bp, Artificial Sequence
  Synthetic oligonucleotide
tccgcccctccctctacctgttttggacaattgcta

SEQ ID NO: 106256 - DNA, 37 bp, Artificial Sequence
  Synthetic oligonucleotide
ttggataggggaagggcgggaactagggcatgggaga

SEQ ID NO: 106257 - DNA, 35 bp, Artificial Sequence
  Synthetic oligonucleotide
tcccacgcgcatttattccggattccgccacgccc

SEQ ID NO: 106258 - DNA, 35 bp, Artificial Sequence
  Synthetic oligonucleotide
ggacgccccggtgtagtttcgctcccccccttgct

SEQ ID NO: 106259 - DNA, 36 bp, Artificial Sequence
  Synthetic oligonucleotide
gtcgccccctccacagcggttttgaccaccccacca

SEQ ID NO: 106260 - DNA, 35 bp, Artificial Sequence
  Synthetic oligonucleotide
attccatgccgccgatattttggttgcctccaccc

SEQ ID NO: 106261 - DNA, 35 bp, Artificial Sequence
  Synthetic oligonucleotide
gagcccctccacggctgtcccgtaccccgcttgtc

SEQ ID NO: 106262 - DNA, 35 bp, Artificial Sequence
  Synthetic oligonucleotide
tagctgccccctcagctctgccccagctcccatca

SEQ ID NO: 106263 - DNA, 35 bp, Artificial Sequence
  Synthetic oligonucleotide
tgcgatctccgctcaactcgtacactgctttcctc

SEQ ID NO: 106264 - DNA, 35 bp, Artificial Sequence
  Synthetic oligonucleotide
gagggaggggtgctcatgggggacgattagggggc

SEQ ID NO: 106265 - DNA, 35 bp, Artificial Sequence
  Synthetic oligonucleotide
atgccagctcctgtcttctgcgctcccgtcctcca

SEQ ID NO: 106266 - DNA, 35 bp, Artificial Sequence
  Synthetic oligonucleotide
tccatcactcacacatgacttggtttccccgtgga

SEQ ID NO: 106267 - DNA, 35 bp, Artificial Sequence
  Synthetic oligonucleotide
tcacacacctccactggttgttgcccatgccctcc

SEQ ID NO: 106268 - DNA, 35 bp, Artificial Sequence
  Synthetic oligonucleotide
gccctaccatccgtgtaagcccatcgttaccccgt

SEQ ID NO: 106269 - DNA, 35 bp, Artificial Sequence
  Synthetic oligonucleotide
gctgctcctccgcctgagttctgtcgaattacccc

SEQ ID NO: 106270 - DNA, 35 bp, Artificial Sequence
  Synthetic oligonucleotide
accccgtgccaagtaccagcgccccatcctccgca

SEQ ID NO: 106271 - DNA, 37 bp, Artificial Sequence
  Synthetic oligonucleotide
tccgtcccagcggtcctcctgtcatctcctccgccga

SEQ ID NO: 106272 - DNA, 36 bp, Artificial Sequence
  Synthetic oligonucleotide
ggagcgcccgccgccgacaccaggaccccgcctcca

SEQ ID NO: 106273 - DNA, 35 bp, Artificial Sequence
  Synthetic oligonucleotide
tcgcacacctcacgtgtcctactctcgcttcccct

SEQ ID NO: 106274 - DNA, 36 bp, Artificial Sequence
  Synthetic oligonucleotide
gcatgtacagatggacccccgccccctctcattcca

SEQ ID NO: 106275 - DNA, 35 bp, Artificial Sequence
  Synthetic oligonucleotide
ggggagaggggcggataagggtggggtgaggaaga

SEQ ID NO: 106276 - DNA, 35 bp, Artificial Sequence
  Synthetic oligonucleotide
tccactccgacctgtcttattacggcttaacactc

SEQ ID NO: 106277 - DNA, 35 bp, Artificial Sequence
  Synthetic oligonucleotide
atgaagggggtagaaggtcgggtgaggggaaggga

SEQ ID NO: 106278 - DNA, 35 bp, Artificial Sequence
  Synthetic oligonucleotide
atggacgacctgtctgtcttttgtcgcctctccgc

SEQ ID NO: 106279 - DNA, 35 bp, Artificial Sequence
  Synthetic oligonucleotide
ccgatccacctttgctcatgtctcgcgagccgttc

SEQ ID NO: 106280 - DNA, 35 bp, Artificial Sequence
  Synthetic oligonucleotide
tgtgtccaccgttttctgctctatgccctccactg

SEQ ID NO: 106281 - DNA, 35 bp, Artificial Sequence
  Synthetic oligonucleotide
tcgacgcccttctgcgccctacccaccacccggga

SEQ ID NO: 106282 - DNA, 35 bp, Artificial Sequence
  Synthetic oligonucleotide
gcctatccgatcattgccttctgtcacacagggtc

SEQ ID NO: 106283 - DNA, 35 bp, Artificial Sequence
  Synthetic oligonucleotide
tgcactcgccacatgtatgctttcgtgcacctctc

SEQ ID NO: 106284 - DNA, 35 bp, Artificial Sequence
  Synthetic oligonucleotide
acccgccaccccgtaacctgtacctccacgcgccc

SEQ ID NO: 106285 - DNA, 35 bp, Artificial Sequence
  Synthetic oligonucleotide
gcaccaactgcacatggtttttccctccgctcatt

SEQ ID NO: 106286 - DNA, 36 bp, Artificial Sequence
  Synthetic oligonucleotide
tccagaaccgccggcccaactgcttgtactactcta

SEQ ID NO: 106287 - DNA, 36 bp, Artificial Sequence
  Synthetic oligonucleotide
ttcgatgatctgcctgtaccctgctctgcccctcgg

SEQ ID NO: 106288 - DNA, 33 bp, Artificial Sequence
  Synthetic oligonucleotide
ccgcccaccaccgcttcgcacctgatccctggt

SEQ ID NO: 106289 - DNA, 35 bp, Artificial Sequence
  Synthetic oligonucleotide
agtggccactgccggtctgttacgcaccacttcct

SEQ ID NO: 106290 - DNA, 37 bp, Artificial Sequence
  Synthetic oligonucleotide
ttcgacaccgacccgttccatcaatgccacttcttga

SEQ ID NO: 106291 - DNA, 38 bp, Artificial Sequence
  Synthetic oligonucleotide
tcactcccccctgtcttagccagccttcccttcggtga

SEQ ID NO: 106292 - DNA, 35 bp, Artificial Sequence
  Synthetic oligonucleotide
attccatcccactctgtcacgttccgtctcacgac

SEQ ID NO: 106293 - DNA, 38 bp, Artificial Sequence
  Synthetic oligonucleotide
ttagtgctgcaggtagcggtgaggggggcggagggtga

SEQ ID NO: 106294 - DNA, 35 bp, Artificial Sequence
  Synthetic oligonucleotide
aaccccgccccgttccaccttgaccacagctaccc

SEQ ID NO: 106295 - DNA, 33 bp, Artificial Sequence
  Synthetic oligonucleotide
gaccatcccacttgcatgtttgtttaccctcgc

SEQ ID NO: 106296 - DNA, 35 bp, Artificial Sequence
  Synthetic oligonucleotide
acacctctgctcggccgtatacctgcccccgtttt

SEQ ID NO: 106297 - DNA, 35 bp, Artificial Sequence
  Synthetic oligonucleotide
gactcccacccccaatgtcgacatcttgtgccccg

SEQ ID NO: 106298 - DNA, 35 bp, Artificial Sequence
  Synthetic oligonucleotide
ggtggggacgagggtggggaaacgagctggggacg

SEQ ID NO: 106299 - DNA, 37 bp, Artificial Sequence
  Synthetic oligonucleotide
gtgcatccctgtctactcaccttgccgcctccgccga

SEQ ID NO: 106300 - DNA, 35 bp, Artificial Sequence
  Synthetic oligonucleotide
gacccaccgctcacttgtcctcacaaacccttgca

SEQ ID NO: 106301 - DNA, 36 bp, Artificial Sequence
  Synthetic oligonucleotide
atggtcaccggtcggtcgtgctcgccccgttcttcc

SEQ ID NO: 106302 - DNA, 35 bp, Artificial Sequence
  Synthetic oligonucleotide
gccggtgaacacctctctgccccatctctcagatc

SEQ ID NO: 106303 - DNA, 35 bp, Artificial Sequence
  Synthetic oligonucleotide
tacacccctccagcgctcgctacgtttgtaccacc

SEQ ID NO: 106304 - DNA, 35 bp, Artificial Sequence
  Synthetic oligonucleotide
actcaccaccattcgtagtccaagccaccaacgct

SEQ ID NO: 106305 - DNA, 35 bp, Artificial Sequence
  Synthetic oligonucleotide
tcgaacagtccgaccccacgccacaccaccgctcg

SEQ ID NO: 106306 - DNA, 35 bp, Artificial Sequence
  Synthetic oligonucleotide
gcagtcctccgctcgccctcccgttgtccagtcta

SEQ ID NO: 106307 - DNA, 35 bp, Artificial Sequence
  Synthetic oligonucleotide
agttcccgcacacgtgtctttgccgtttcctccgc

SEQ ID NO: 106308 - DNA, 37 bp, Artificial Sequence
  Synthetic oligonucleotide
acggggaggagaggagggtgagtgaaggaatggcgga

SEQ ID NO: 106309 - DNA, 35 bp, Artificial Sequence
  Synthetic oligonucleotide
tacgcactcattattcctttgtcacccacccttgg

SEQ ID NO: 106310 - DNA, 36 bp, Artificial Sequence
  Synthetic oligonucleotide
gagaggaggaagggagggtacagggaactaagacaa

SEQ ID NO: 106311 - DNA, 35 bp, Artificial Sequence
  Synthetic oligonucleotide
gcccatccgactcgcctcccatctgccgatccgca

SEQ ID NO: 106312 - DNA, 35 bp, Artificial Sequence
  Synthetic oligonucleotide
aggtgcaccgccagtccctcgcctttcactcctcg

SEQ ID NO: 106313 - DNA, 35 bp, Artificial Sequence
  Synthetic oligonucleotide
gttcaggcgcgaccccacgttcctgttgttccatc

SEQ ID NO: 106314 - DNA, 35 bp, Artificial Sequence
  Synthetic oligonucleotide
tgacagtcagcccgtcctgcacctccctacttgat

SEQ ID NO: 106315 - DNA, 35 bp, Artificial Sequence
  Synthetic oligonucleotide
acacatcactgtttacatccgaccgtttatttttc

SEQ ID NO: 106316 - DNA, 35 bp, Artificial Sequence
  Synthetic oligonucleotide
tccattctgcagctcgccgtcctgtccgtctctgt

SEQ ID NO: 106317 - DNA, 35 bp, Artificial Sequence
  Synthetic oligonucleotide
gtatcagcccaattttttcaccgctcgctccatcg

SEQ ID NO: 106318 - DNA, 35 bp, Artificial Sequence
  Synthetic oligonucleotide
gtccgacctcctttgatgctggcccccgatgctcc

SEQ ID NO: 106319 - DNA, 37 bp, Artificial Sequence
  Synthetic oligonucleotide
acaccaccatgtgcctctgtctatcgccttttaccga

SEQ ID NO: 106320 - DNA, 35 bp, Artificial Sequence
  Synthetic oligonucleotide
tgacgccctcgccatgccgctgcctctatcttaga

SEQ ID NO: 106321 - DNA, 36 bp, Artificial Sequence
  Synthetic oligonucleotide
gacgatggggcttagagaggggacatggggtgggta

SEQ ID NO: 106322 - DNA, 35 bp, Artificial Sequence
  Synthetic oligonucleotide
tgtaacgccccacgctcgcactgtacgctccccca

SEQ ID NO: 106323 - DNA, 35 bp, Artificial Sequence
  Synthetic oligonucleotide
ggaaccgcagttatccgaagcgtcctccgccgccc

SEQ ID NO: 106324 - DNA, 35 bp, Artificial Sequence
  Synthetic oligonucleotide
acaccccccacttcgatcctccttggagaccgcca

SEQ ID NO: 106325 - DNA, 35 bp, Artificial Sequence
  Synthetic oligonucleotide
gtgacaccgcccctttaactgcatgatttcaccac

SEQ ID NO: 106326 - DNA, 35 bp, Artificial Sequence
  Synthetic oligonucleotide
accaaccgtatggcacgttctccatcgcccctgtc

SEQ ID NO: 106327 - DNA, 37 bp, Artificial Sequence
  Synthetic oligonucleotide
gtcggagggggaaggttagcgggaaaacggcgaggga

SEQ ID NO: 106328 - DNA, 38 bp, Artificial Sequence
  Synthetic oligonucleotide
tatggatgagggtgggaagggtaccgggagagacctga

SEQ ID NO: 106329 - DNA, 35 bp, Artificial Sequence
  Synthetic oligonucleotide
gccccatctcatctgctccacgtatttggtcttct

SEQ ID NO: 106330 - DNA, 35 bp, Artificial Sequence
  Synthetic oligonucleotide
atcgatcgcccaaatgcagttcctccctagccccc

SEQ ID NO: 106331 - DNA, 35 bp, Artificial Sequence
  Synthetic oligonucleotide
gtccctccactgattacatcgcacctgaacctgct

SEQ ID NO: 106332 - DNA, 35 bp, Artificial Sequence
  Synthetic oligonucleotide
tgccactgtagttgcccccccacgttcctgcctcc

SEQ ID NO: 106333 - DNA, 35 bp, Artificial Sequence
  Synthetic oligonucleotide
atcgcctcgccaaccgcatgggccctccaccctta

SEQ ID NO: 106334 - DNA, 35 bp, Artificial Sequence
  Synthetic oligonucleotide
tcacccccactgatcattttctgcaccacttgctg

SEQ ID NO: 106335 - DNA, 37 bp, Artificial Sequence
  Synthetic oligonucleotide
gtttagtcgcccaccgcctccctgttctgtaccgtga

SEQ ID NO: 106336 - DNA, 37 bp, Artificial Sequence
  Synthetic oligonucleotide
acagacaaagggggccggtgggaagaacaagggcaga

SEQ ID NO: 106337 - DNA, 37 bp, Artificial Sequence
  Synthetic oligonucleotide
tatcgaggtacggagggggatggggaaggaggaggga

SEQ ID NO: 106338 - DNA, 35 bp, Artificial Sequence
  Synthetic oligonucleotide
tgatccttccgtcctgtctcccacctcgcgtaccg

SEQ ID NO: 106339 - DNA, 34 bp, Artificial Sequence
  Synthetic oligonucleotide
tagagcacctccccgttttattgcctctgtttgc

SEQ ID NO: 106340 - DNA, 36 bp, Artificial Sequence
  Synthetic oligonucleotide
acttcccgctcacagcttgcgtaatatcctgcccta

SEQ ID NO: 106341 - DNA, 35 bp, Artificial Sequence
  Synthetic oligonucleotide
ttggccctcccctgggtgccctattttgttctgcc

SEQ ID NO: 106342 - DNA, 35 bp, Artificial Sequence
  Synthetic oligonucleotide
gatgtgcgcccccgttacgacgctcgccacttttt

SEQ ID NO: 106343 - DNA, 35 bp, Artificial Sequence
  Synthetic oligonucleotide
gtgccatcgcacgtccgccactcctgccacacgta

SEQ ID NO: 106344 - DNA, 34 bp, Artificial Sequence
  Synthetic oligonucleotide
ttgtataccgctcacctgtccctgggtctcgctc

SEQ ID NO: 106345 - DNA, 35 bp, Artificial Sequence
  Synthetic oligonucleotide
agaccaccaccccgcttgttgcctcttgattggcc

SEQ ID NO: 106346 - DNA, 35 bp, Artificial Sequence
  Synthetic oligonucleotide
acattcgctccatatcctgccgttcatccactccg

SEQ ID NO: 106347 - DNA, 35 bp, Artificial Sequence
  Synthetic oligonucleotide
ttcagcgacccgacccgttcttgcgcctgaccacc

SEQ ID NO: 106348 - DNA, 38 bp, Artificial Sequence
  Synthetic oligonucleotide
gtccaccgcctcgctgccttctagtagttcctcactga

SEQ ID NO: 106349 - DNA, 35 bp, Artificial Sequence
  Synthetic oligonucleotide
tgtctcgcctcttctactccgcactgcctttagcc

SEQ ID NO: 106350 - DNA, 36 bp, Artificial Sequence
  Synthetic oligonucleotide
aatgggggcgggcaggggagtggcttgttggggtga

SEQ ID NO: 106351 - DNA, 35 bp, Artificial Sequence
  Synthetic oligonucleotide
tgatctgcctccacaccgcgcatgacacgctctac

SEQ ID NO: 106352 - DNA, 35 bp, Artificial Sequence
  Synthetic oligonucleotide
tgccccctcctccaccggccattaacgtgaccccc

SEQ ID NO: 106353 - DNA, 37 bp, Artificial Sequence
  Synthetic oligonucleotide
ttcgcccccaccgctgcccctcgctcatcgcctctga

SEQ ID NO: 106354 - DNA, 35 bp, Artificial Sequence
  Synthetic oligonucleotide
ttcagttccccccctgccgtatcgccctgtcttca

SEQ ID NO: 106355 - DNA, 35 bp, Artificial Sequence
  Synthetic oligonucleotide
atccacccacctgttatcctactgacactttggtt

SEQ ID NO: 106356 - DNA, 36 bp, Artificial Sequence
  Synthetic oligonucleotide
gctgacacccgtccatccgctgcaccacacctctta

SEQ ID NO: 106357 - DNA, 35 bp, Artificial Sequence
  Synthetic oligonucleotide
tctaccaccctcagccggtctgtacaccccgtttt

SEQ ID NO: 106358 - DNA, 35 bp, Artificial Sequence
  Synthetic oligonucleotide
agccgcgccccgtcccctgaattgttgctgccgcc

SEQ ID NO: 106359 - DNA, 35 bp, Artificial Sequence
  Synthetic oligonucleotide
acatcacggcggtcttttctatctgctacatcgtc

SEQ ID NO: 106360 - DNA, 35 bp, Artificial Sequence
  Synthetic oligonucleotide
tcaacgcgttcacccccgtgcgtacttacctccat

SEQ ID NO: 106361 - DNA, 35 bp, Artificial Sequence
  Synthetic oligonucleotide
gtacagtcggatcaccggcgctctatccatcctgt

SEQ ID NO: 106362 - DNA, 36 bp, Artificial Sequence
  Synthetic oligonucleotide
tgacatgtcctgcctccacctgcccctcgggaacga

SEQ ID NO: 106363 - DNA, 36 bp, Artificial Sequence
  Synthetic oligonucleotide
gtgttcgcccgtgctttgtctatccgctccccacga

SEQ ID NO: 106364 - DNA, 37 bp, Artificial Sequence
  Synthetic oligonucleotide
gtgggagggggaggaaggcagaggaggttgccggtga

SEQ ID NO: 106365 - DNA, 37 bp, Artificial Sequence
  Synthetic oligonucleotide
tctcgggcgagtggggtttgtttgggggcgtgtggga

SEQ ID NO: 106366 - DNA, 35 bp, Artificial Sequence
  Synthetic oligonucleotide
acagccccctcaatgcactccaccagccctatctc

SEQ ID NO: 106367 - DNA, 35 bp, Artificial Sequence
  Synthetic oligonucleotide
gaagacgtcgcgatcgccccccccgtttacccgac

SEQ ID NO: 106368 - DNA, 35 bp, Artificial Sequence
  Synthetic oligonucleotide
ttgaccgcactatgtcctcgccgcccatcctatca

SEQ ID NO: 106369 - DNA, 35 bp, Artificial Sequence
  Synthetic oligonucleotide
aatcaccccccgccacgctatgtagcacccctgcg

SEQ ID NO: 106370 - DNA, 35 bp, Artificial Sequence
  Synthetic oligonucleotide
gctgggcccccctctactcatcgccacccgtttcg

SEQ ID NO: 106371 - DNA, 35 bp, Artificial Sequence
  Synthetic oligonucleotide
tagtgaggaggggaagaggaggggtgttgaggagg

SEQ ID NO: 106372 - DNA, 35 bp, Artificial Sequence
  Synthetic oligonucleotide
tgaccacaagctagtcttgcttaacacctgccccc

SEQ ID NO: 106373 - DNA, 35 bp, Artificial Sequence
  Synthetic oligonucleotide
ctacacccgtgtgggtgccggtcttacccctttac

SEQ ID NO: 106374 - DNA, 35 bp, Artificial Sequence
  Synthetic oligonucleotide
agtcatcccgcaccaccggtcagcccgttccacca

SEQ ID NO: 106375 - DNA, 35 bp, Artificial Sequence
  Synthetic oligonucleotide
ggacgcatcgccccccgacccgtgtacacctgttg

SEQ ID NO: 106376 - DNA, 36 bp, Artificial Sequence
  Synthetic oligonucleotide
tccgcccctctccgcccctcgtcacagaccccagta

SEQ ID NO: 106377 - DNA, 35 bp, Artificial Sequence
  Synthetic oligonucleotide
accgccccctttccagtctatctttggcctttgcc

SEQ ID NO: 106378 - DNA, 36 bp, Artificial Sequence
  Synthetic oligonucleotide
gcccaccccttcaccttccctgataagaccaattta

SEQ ID NO: 106379 - DNA, 37 bp, Artificial Sequence
  Synthetic oligonucleotide
gtcgccccacacctcgacttcaccccttcagacgtga

SEQ ID NO: 106380 - DNA, 35 bp, Artificial Sequence
  Synthetic oligonucleotide
agagcccatcctgtcctatacctccacagctttcc

SEQ ID NO: 106381 - DNA, 37 bp, Artificial Sequence
  Synthetic oligonucleotide
gtagcgcaagggcggggctggggacgaaatgagggga

SEQ ID NO: 106382 - DNA, 35 bp, Artificial Sequence
  Synthetic oligonucleotide
gccagcacacacctccgccaacccccgtattcgcg

SEQ ID NO: 106383 - DNA, 35 bp, Artificial Sequence
  Synthetic oligonucleotide
agccgccacaatttcgtgtttccccgtcctccctg

SEQ ID NO: 106384 - DNA, 35 bp, Artificial Sequence
  Synthetic oligonucleotide
gtcccttaccgctgaattttacgaccctgccatcc

SEQ ID NO: 106385 - DNA, 35 bp, Artificial Sequence
  Synthetic oligonucleotide
ggagcaccccctaggtaaatacggtcgccctcctc

SEQ ID NO: 106386 - DNA, 34 bp, Artificial Sequence
  Synthetic oligonucleotide
tacgaccacctctccgcctatgttcgtgtttgcc

SEQ ID NO: 106387 - DNA, 35 bp, Artificial Sequence
  Synthetic oligonucleotide
acccattgccccgcccatgctattcctatcgagtc

SEQ ID NO: 106388 - DNA, 35 bp, Artificial Sequence
  Synthetic oligonucleotide
gtcgccaccccccactccgatctgtgaccttggtt

SEQ ID NO: 106389 - DNA, 35 bp, Artificial Sequence
  Synthetic oligonucleotide
gtcccggcccgctgccaccgctcgtctcgccttgc

SEQ ID NO: 106390 - DNA, 35 bp, Artificial Sequence
  Synthetic oligonucleotide
gaccctcccgcacatcgttgtcatatcgcggttca

SEQ ID NO: 106391 - DNA, 37 bp, Artificial Sequence
  Synthetic oligonucleotide
ggggcacaactggggcggaataggatttgggtgggga

SEQ ID NO: 106392 - DNA, 35 bp, Artificial Sequence
  Synthetic oligonucleotide
attgccgtcgcccgccggttgacgaccctccccac

SEQ ID NO: 106393 - DNA, 35 bp, Artificial Sequence
  Synthetic oligonucleotide
gtcaccccgcctggtgccctgtttgaatgttttcc

SEQ ID NO: 106394 - DNA, 35 bp, Artificial Sequence
  Synthetic oligonucleotide
actccgcccgacctcgcctctcatgtatgttctcc

SEQ ID NO: 106395 - DNA, 35 bp, Artificial Sequence
  Synthetic oligonucleotide
gtggggtctccggggtggggatttacgttggggtt

SEQ ID NO: 106396 - DNA, 36 bp, Artificial Sequence
  Synthetic oligonucleotide
ggagaaggggtgggtgaggcttgggaacgggtggga

SEQ ID NO: 106397 - DNA, 35 bp, Artificial Sequence
  Synthetic oligonucleotide
gccgccctttgttccacgatcccctccttggcgtt

SEQ ID NO: 106398 - DNA, 35 bp, Artificial Sequence
  Synthetic oligonucleotide
gtgggacatgtaggaggggggagaaagagagtcag

SEQ ID NO: 106399 - DNA, 36 bp, Artificial Sequence
  Synthetic oligonucleotide
gcacgccctcacgcatctggcctccgagctacgcca

SEQ ID NO: 106400 - DNA, 37 bp, Artificial Sequence
  Synthetic oligonucleotide
atccccatcccgatcgcccattatcagtccctagtga

SEQ ID NO: 106401 - DNA, 33 bp, Artificial Sequence
  Synthetic oligonucleotide
acccgtacgccgtgtcgtcttacctcgctctgc

SEQ ID NO: 106402 - DNA, 37 bp, Artificial Sequence
  Synthetic oligonucleotide
tccgcccttctatccgttttttttgacccgcccttga

SEQ ID NO: 106403 - DNA, 35 bp, Artificial Sequence
  Synthetic oligonucleotide
ttgtgccacgcccgcttttgaacgtcaccttgcct

SEQ ID NO: 106404 - DNA, 36 bp, Artificial Sequence
  Synthetic oligonucleotide
tacatccgccgccctgatctcctcgttacccttgga

SEQ ID NO: 106405 - DNA, 35 bp, Artificial Sequence
  Synthetic oligonucleotide
acgcccccgattcagtctcctccgcccatgcttgg

SEQ ID NO: 106406 - DNA, 38 bp, Artificial Sequence
  Synthetic oligonucleotide
gccacccacaaatgtgccccgccccccgttgccgttga

SEQ ID NO: 106407 - DNA, 36 bp, Artificial Sequence
  Synthetic oligonucleotide
aagagggaagggtgacgggggagggaacgaccaaaa

SEQ ID NO: 106408 - DNA, 36 bp, Artificial Sequence
  Synthetic oligonucleotide
gccatcccgctcgacgccctctactgcacactgaca

SEQ ID NO: 106409 - DNA, 36 bp, Artificial Sequence
  Synthetic oligonucleotide
gagggagagaaaagtgtgggggaacggggagggcga

SEQ ID NO: 106410 - DNA, 35 bp, Artificial Sequence
  Synthetic oligonucleotide
gttatgccaccctgttccttattagcgatgcttcc

SEQ ID NO: 106411 - DNA, 36 bp, Artificial Sequence
  Synthetic oligonucleotide
accgccccctttcactagtgccacgtttcccacata

SEQ ID NO: 106412 - DNA, 35 bp, Artificial Sequence
  Synthetic oligonucleotide
tcagccacgcctgaccgccctacctctctagaatc

SEQ ID NO: 106413 - DNA, 35 bp, Artificial Sequence
  Synthetic oligonucleotide
atagaccgcccacttgttgattcacttccccctgt

SEQ ID NO: 106414 - DNA, 35 bp, Artificial Sequence
  Synthetic oligonucleotide
gcaaacccccacctgccgcaaggaccaccgctcct

SEQ ID NO: 106415 - DNA, 35 bp, Artificial Sequence
  Synthetic oligonucleotide
tgacacccccctttgctttaaccacagcgttgtcc

SEQ ID NO: 106416 - DNA, 35 bp, Artificial Sequence
  Synthetic oligonucleotide
tgccaccccggagtcttccctgtcgcttccctggc

SEQ ID NO: 106417 - DNA, 35 bp, Artificial Sequence
  Synthetic oligonucleotide
acccactccgctctgctagacctatcttctcgaac

SEQ ID NO: 106418 - DNA, 35 bp, Artificial Sequence
  Synthetic oligonucleotide
gggtcccccgcttgctgccattactaggccttccc

SEQ ID NO: 106419 - DNA, 36 bp, Artificial Sequence
  Synthetic oligonucleotide
accggagggcttaagatgggtggggggggcttaaaa

SEQ ID NO: 106420 - DNA, 35 bp, Artificial Sequence
  Synthetic oligonucleotide
gccactccgcagcatgtatatcggttcccttcttc

SEQ ID NO: 106421 - DNA, 35 bp, Artificial Sequence
  Synthetic oligonucleotide
gtccatcccctccattccgttaagcgatggctacc

SEQ ID NO: 106422 - DNA, 35 bp, Artificial Sequence
  Synthetic oligonucleotide
ttcccctccactttgctgtcttcactagcccatgc

SEQ ID NO: 106423 - DNA, 34 bp, Artificial Sequence
  Synthetic oligonucleotide
gaccaccctgccaaagagcataactactcgctcc

SEQ ID NO: 106424 - DNA, 35 bp, Artificial Sequence
  Synthetic oligonucleotide
ccacctcttgccctcgttctcgggactcgtatact

SEQ ID NO: 106425 - DNA, 35 bp, Artificial Sequence
  Synthetic oligonucleotide
accgcccctcgacctatctgcttttggatcatgct

SEQ ID NO: 106426 - DNA, 37 bp, Artificial Sequence
  Synthetic oligonucleotide
tcgcaccgctgcttttatcgacccgccttcattccga

SEQ ID NO: 106427 - DNA, 35 bp, Artificial Sequence
  Synthetic oligonucleotide
tctcgccccactgttgccattcagtccctacaaac

SEQ ID NO: 106428 - DNA, 35 bp, Artificial Sequence
  Synthetic oligonucleotide
acgccctccagcccttgtacgcgcacctcctcatc

SEQ ID NO: 106429 - DNA, 35 bp, Artificial Sequence
  Synthetic oligonucleotide
acaacgcagctcggtttcccctacccgttcccgcc

SEQ ID NO: 106430 - DNA, 35 bp, Artificial Sequence
  Synthetic oligonucleotide
acttgcccctgtcgcgtcttccgctgccctccctg

SEQ ID NO: 106431 - DNA, 35 bp, Artificial Sequence
  Synthetic oligonucleotide
gttgccccctcgctgccatatactaggtttcatct

SEQ ID NO: 106432 - DNA, 35 bp, Artificial Sequence
  Synthetic oligonucleotide
agagggggaggcaaaaggagggatatgggatagta

SEQ ID NO: 106433 - DNA, 35 bp, Artificial Sequence
  Synthetic oligonucleotide
ggtagtgccgccaatcactccgcatacgttcaatc

SEQ ID NO: 106434 - DNA, 35 bp, Artificial Sequence
  Synthetic oligonucleotide
gacctcctccacttgtcgcgtgcccgacgaccctc

SEQ ID NO: 106435 - DNA, 35 bp, Artificial Sequence
  Synthetic oligonucleotide
tcgcacaccgcgccctctcttccctggttgattat

SEQ ID NO: 106436 - DNA, 35 bp, Artificial Sequence
  Synthetic oligonucleotide
gcccccctcgtttgttactgcacccacaccgtacc

SEQ ID NO: 106437 - DNA, 33 bp, Artificial Sequence
  Synthetic oligonucleotide
gtccagatcgcccgctcccatcgttttccgtat

SEQ ID NO: 106438 - DNA, 37 bp, Artificial Sequence
  Synthetic oligonucleotide
ttacgactccctgcttattgccaccgccggtccccga

SEQ ID NO: 106439 - DNA, 35 bp, Artificial Sequence
  Synthetic oligonucleotide
tacgactatcgtacctcgtttggttctctgccttc

SEQ ID NO: 106440 - DNA, 36 bp, Artificial Sequence
  Synthetic oligonucleotide
tttgccccctccgtatcctttataatcgcattgcga

SEQ ID NO: 106441 - DNA, 36 bp, Artificial Sequence
  Synthetic oligonucleotide
gcccccgcccgctgctcccatctcgccgatatatca

SEQ ID NO: 106442 - DNA, 35 bp, Artificial Sequence
  Synthetic oligonucleotide
acacctctgacgcatccactggaccttcactttca

SEQ ID NO: 106443 - DNA, 35 bp, Artificial Sequence
  Synthetic oligonucleotide
gatatcacccgccatctgtaccgacttctaccgcg

SEQ ID NO: 106444 - DNA, 36 bp, Artificial Sequence
  Synthetic oligonucleotide
gccgccctcaccgttcccgctctgcaccatggacca

SEQ ID NO: 106445 - DNA, 35 bp, Artificial Sequence
  Synthetic oligonucleotide
ttcccctccgtcgcatgcccactttggctccttac

SEQ ID NO: 106446 - DNA, 35 bp, Artificial Sequence
  Synthetic oligonucleotide
ttgttctggccccgggtgtccaccgctcccacatc

SEQ ID NO: 106447 - DNA, 33 bp, Artificial Sequence
  Synthetic oligonucleotide
gccgcccacctctacccgtctgccaggtctttt

SEQ ID NO: 106448 - DNA, 35 bp, Artificial Sequence
  Synthetic oligonucleotide
tccctcccataggcccctgcacgtgctaccgccgc

SEQ ID NO: 106449 - DNA, 35 bp, Artificial Sequence
  Synthetic oligonucleotide
gagagccaccaccatgcgcacacttactttccatc

SEQ ID NO: 106450 - DNA, 37 bp, Artificial Sequence
  Synthetic oligonucleotide
gcccatctctgtttttcatcgtactgctccatcctga

SEQ ID NO: 106451 - DNA, 35 bp, Artificial Sequence
  Synthetic oligonucleotide
gtgaggagaggggtgaacgacgggggtgggcggtc

SEQ ID NO: 106452 - DNA, 35 bp, Artificial Sequence
  Synthetic oligonucleotide
accctccgcctccaatgcctagaaagctataccac

SEQ ID NO: 106453 - DNA, 36 bp, Artificial Sequence
  Synthetic oligonucleotide
taactgcgcacgcccctgttctgcacccttggctca

SEQ ID NO: 106454 - DNA, 35 bp, Artificial Sequence
  Synthetic oligonucleotide
tgaccgttacatttgcctttgtccgaccttcaccc

SEQ ID NO: 106455 - DNA, 35 bp, Artificial Sequence
  Synthetic oligonucleotide
actgggggaggagcagggagggatgatttagcggt

SEQ ID NO: 106456 - DNA, 35 bp, Artificial Sequence
  Synthetic oligonucleotide
gagacacccgcccgttgcaccccctctacgtacat

SEQ ID NO: 106457 - DNA, 35 bp, Artificial Sequence
  Synthetic oligonucleotide
gaccacccgtggtgcttgcccctgtagccctcctt

SEQ ID NO: 106458 - DNA, 35 bp, Artificial Sequence
  Synthetic oligonucleotide
accccccgtcagactactttgcctcctctgcactt

SEQ ID NO: 106459 - DNA, 35 bp, Artificial Sequence
  Synthetic oligonucleotide
tcacgccaatcttggtgttctccactcctccgtgc

SEQ ID NO: 106460 - DNA, 35 bp, Artificial Sequence
  Synthetic oligonucleotide
agtacccgcccggacctgtttcaggttgctatcct

SEQ ID NO: 106461 - DNA, 34 bp, Artificial Sequence
  Synthetic oligonucleotide
gaccgcccacctacgcctgctgaagcacaccttg

SEQ ID NO: 106462 - DNA, 35 bp, Artificial Sequence
  Synthetic oligonucleotide
gttgtgtcgctcgccccttggcctctgccttcgtc

SEQ ID NO: 106463 - DNA, 35 bp, Artificial Sequence
  Synthetic oligonucleotide
agcactccaccgcaccatcttacagacttccgctg

SEQ ID NO: 106464 - DNA, 35 bp, Artificial Sequence
  Synthetic oligonucleotide
gatggggtccaaagggtaaggggagggttggggat

SEQ ID NO: 106465 - DNA, 35 bp, Artificial Sequence
  Synthetic oligonucleotide
tgtaaccccaacatgccttacgtgacctacactat

SEQ ID NO: 106466 - DNA, 35 bp, Artificial Sequence
  Synthetic oligonucleotide
tccccgctgcatctgcccaccattgcttcttcgtc

SEQ ID NO: 106467 - DNA, 36 bp, Artificial Sequence
  Synthetic oligonucleotide
aagggggggcgagggggcggggagtaagaaggccaa

SEQ ID NO: 106468 - DNA, 35 bp, Artificial Sequence
  Synthetic oligonucleotide
tacgacttctccgcctgttgacccgctgcctatcc

SEQ ID NO: 106469 - DNA, 36 bp, Artificial Sequence
  Synthetic oligonucleotide
tgcacattcctcgtctgcaccgtcgtcactctcgcc

SEQ ID NO: 106470 - DNA, 36 bp, Artificial Sequence
  Synthetic oligonucleotide
tgttgcccatccgcccgtgctacatctgtccaccaa

SEQ ID NO: 106471 - DNA, 36 bp, Artificial Sequence
  Synthetic oligonucleotide
cacaccccgccgccgcatgctctatttgcaacacca

SEQ ID NO: 106472 - DNA, 35 bp, Artificial Sequence
  Synthetic oligonucleotide
atgaccacgcttatcgtgcacttccgtttacttcc

SEQ ID NO: 106473 - DNA, 38 bp, Artificial Sequence
  Synthetic oligonucleotide
tgcatacggcccacctgcaccatcccctgtccctgtga

SEQ ID NO: 106474 - DNA, 35 bp, Artificial Sequence
  Synthetic oligonucleotide
aaccccaccgctaaacttgtcgcaccctccgggcc

SEQ ID NO: 106475 - DNA, 35 bp, Artificial Sequence
  Synthetic oligonucleotide
tccatccctcgttagctgtcccacccgttattgtc

SEQ ID NO: 106476 - DNA, 36 bp, Artificial Sequence
  Synthetic oligonucleotide
acgcccccctgcagtcgatcgcgtccctccgtttca

SEQ ID NO: 106477 - DNA, 35 bp, Artificial Sequence
  Synthetic oligonucleotide
tgtacatccagctctggctctcctccgcactctcg

SEQ ID NO: 106478 - DNA, 35 bp, Artificial Sequence
  Synthetic oligonucleotide
accccccactcactatggcttttgacttactcttc

SEQ ID NO: 106479 - DNA, 35 bp, Artificial Sequence
  Synthetic oligonucleotide
gtgcctcctcgatcttggtccatcttcgactctgg

SEQ ID NO: 106480 - DNA, 35 bp, Artificial Sequence
  Synthetic oligonucleotide
tttgagtcgcgcaccattgtttctgttgtccctct

SEQ ID NO: 106481 - DNA, 36 bp, Artificial Sequence
  Synthetic oligonucleotide
tcacagcccgcctcgttcgtcccatactagcacata

SEQ ID NO: 106482 - DNA, 35 bp, Artificial Sequence
  Synthetic oligonucleotide
tcacaccgcctgggccctttagctcctcaaccctc

SEQ ID NO: 106483 - DNA, 35 bp, Artificial Sequence
  Synthetic oligonucleotide
gcccgcacaccggtttttccgctccttctcatttc

SEQ ID NO: 106484 - DNA, 37 bp, Artificial Sequence
  Synthetic oligonucleotide
ggaacgagggaagacggagggcaaaggtagggtagga

SEQ ID NO: 106485 - DNA, 36 bp, Artificial Sequence
  Synthetic oligonucleotide
tgcgacccacctgcctaaagcgcgccgccttcacca

SEQ ID NO: 106486 - DNA, 35 bp, Artificial Sequence
  Synthetic oligonucleotide
gtccacatgccgccctgtctatccatccacgcgca

SEQ ID NO: 106487 - DNA, 35 bp, Artificial Sequence
  Synthetic oligonucleotide
tagcataaccaccatctcgcacccgccccgcccgg

SEQ ID NO: 106488 - DNA, 36 bp, Artificial Sequence
  Synthetic oligonucleotide
gcgccaaggagggcggagcgagggggggcgggtgga

SEQ ID NO: 106489 - DNA, 35 bp, Artificial Sequence
  Synthetic oligonucleotide
gcccgcccctatatacatctggccgtactcactcc

SEQ ID NO: 106490 - DNA, 36 bp, Artificial Sequence
  Synthetic oligonucleotide
tgaggggggagggcgggcttggtaagcaagggagga

SEQ ID NO: 106491 - DNA, 35 bp, Artificial Sequence
  Synthetic oligonucleotide
atgtcccgcgccgtaatagcgtcctccttccctct

SEQ ID NO: 106492 - DNA, 35 bp, Artificial Sequence
  Synthetic oligonucleotide
tcctccccctccgcaattggacatcacggccccac

SEQ ID NO: 106493 - DNA, 35 bp, Artificial Sequence
  Synthetic oligonucleotide
gcgccccacggttcttatttcgcctgcaccttctc

SEQ ID NO: 106494 - DNA, 35 bp, Artificial Sequence
  Synthetic oligonucleotide
tagccggtgcccctctgtgtcgtcctctgtctcac

SEQ ID NO: 106495 - DNA, 35 bp, Artificial Sequence
  Synthetic oligonucleotide
tatcggtccgttctgcacactgcgctccacctcgc

SEQ ID NO: 106496 - DNA, 35 bp, Artificial Sequence
  Synthetic oligonucleotide
gcccaccctcccattttgcgtatgcaaggttgcct

SEQ ID NO: 106497 - DNA, 35 bp, Artificial Sequence
  Synthetic oligonucleotide
acccacgcttcctgcctccccctttgtacaggtca

SEQ ID NO: 106498 - DNA, 35 bp, Artificial Sequence
  Synthetic oligonucleotide
gactcaccgctcgccactttgctccccgcattgcg

SEQ ID NO: 106499 - DNA, 35 bp, Artificial Sequence
  Synthetic oligonucleotide
gcaacccggtctcgtattcttgtaactgcctccct

SEQ ID NO: 106500 - DNA, 36 bp, Artificial Sequence
  Synthetic oligonucleotide
gacctgtgctcctgtttaccgccattgctttcacta

SEQ ID NO: 106501 - DNA, 35 bp, Artificial Sequence
  Synthetic oligonucleotide
tacgcatgccgtattatgcaccaccctctccatgg

SEQ ID NO: 106502 - DNA, 35 bp, Artificial Sequence
  Synthetic oligonucleotide
tcacccttcactgtgttgcttcagtctctccttcc

SEQ ID NO: 106503 - DNA, 36 bp, Artificial Sequence
  Synthetic oligonucleotide
gagaggggatagaacgtgcgggcaggagggtaggga

SEQ ID NO: 106504 - DNA, 37 bp, Artificial Sequence
  Synthetic oligonucleotide
gtggggcgggaggggcacaatcgcatcttaccgggga

SEQ ID NO: 106505 - DNA, 36 bp, Artificial Sequence
  Synthetic oligonucleotide
gctcgcaccatctatactgctatacctgttcaccga

SEQ ID NO: 106506 - DNA, 35 bp, Artificial Sequence
  Synthetic oligonucleotide
agtgcaccatgtctatcctcccctgctctcctttg

SEQ ID NO: 106507 - DNA, 36 bp, Artificial Sequence
  Synthetic oligonucleotide
ggtagaagggaggggcgggggcgaggagggtggtca

SEQ ID NO: 106508 - DNA, 35 bp, Artificial Sequence
  Synthetic oligonucleotide
atgctcccctcgctggcaatacgatcacgccctta

SEQ ID NO: 106509 - DNA, 35 bp, Artificial Sequence
  Synthetic oligonucleotide
cctgactcctcgccgttctccgatgccccccgtcc

SEQ ID NO: 106510 - DNA, 35 bp, Artificial Sequence
  Synthetic oligonucleotide
gactcccagctgtttctgtctcccctttatcgtgc

SEQ ID NO: 106511 - DNA, 35 bp, Artificial Sequence
  Synthetic oligonucleotide
ggtcgccccctgttgcacctatctaccgctgttat

SEQ ID NO: 106512 - DNA, 35 bp, Artificial Sequence
  Synthetic oligonucleotide
accaccccgatttgtgttccccttgtccgtgctta

SEQ ID NO: 106513 - DNA, 35 bp, Artificial Sequence
  Synthetic oligonucleotide
ggtcaccgcctgtcgcgtcttacgaccttccttct

SEQ ID NO: 106514 - DNA, 35 bp, Artificial Sequence
  Synthetic oligonucleotide
tgcggagctgatcgtgcgtgccccttctctcgccc

SEQ ID NO: 106515 - DNA, 35 bp, Artificial Sequence
  Synthetic oligonucleotide
acctcacccgccaacaactgtaccatagtataccc

SEQ ID NO: 106516 - DNA, 35 bp, Artificial Sequence
  Synthetic oligonucleotide
ggggcacgcccaccttccctgtatcgccatctacg

SEQ ID NO: 106517 - DNA, 35 bp, Artificial Sequence
  Synthetic oligonucleotide
agacacgtcgattcccccgtccctcctgtctagcc

SEQ ID NO: 106518 - DNA, 36 bp, Artificial Sequence
  Synthetic oligonucleotide
aatggcgggtgcgagggggtttgggttcggtgggta

SEQ ID NO: 106519 - DNA, 35 bp, Artificial Sequence
  Synthetic oligonucleotide
caccgaccccgctctatccgcttgcatctacggtc

SEQ ID NO: 106520 - DNA, 35 bp, Artificial Sequence
  Synthetic oligonucleotide
acgagcaccaccggttgatcttcccgcccttcttc

SEQ ID NO: 106521 - DNA, 35 bp, Artificial Sequence
  Synthetic oligonucleotide
atcacgcttgtctcacgttcctttcagcattccac

SEQ ID NO: 106522 - DNA, 37 bp, Artificial Sequence
  Synthetic oligonucleotide
gagagaagggaaggggagcttgcgagagaggatggga

SEQ ID NO: 106523 - DNA, 34 bp, Artificial Sequence
  Synthetic oligonucleotide
actcccccgctgcccagcttatcatccccgtgtg

SEQ ID NO: 106524 - DNA, 36 bp, Artificial Sequence
  Synthetic oligonucleotide
gtcctgttccgcctatcctgtattactccccgtgca

SEQ ID NO: 106525 - DNA, 35 bp, Artificial Sequence
  Synthetic oligonucleotide
tgcgcccctcctactccgtgcctgaacgcaccgct

SEQ ID NO: 106526 - DNA, 35 bp, Artificial Sequence
  Synthetic oligonucleotide
gcatccccccacgttcatgcaccaacgcgccctcg

SEQ ID NO: 106527 - DNA, 37 bp, Artificial Sequence
  Synthetic oligonucleotide
tcaccccgcccccccatgcttgatagaaaccgctaga

SEQ ID NO: 106528 - DNA, 37 bp, Artificial Sequence
  Synthetic oligonucleotide
tcacacctccgtccgccgtgccatttacacctgttga

SEQ ID NO: 106529 - DNA, 37 bp, Artificial Sequence
  Synthetic oligonucleotide
accctatcccggcagatgtccgccccccttcacacga

SEQ ID NO: 106530 - DNA, 35 bp, Artificial Sequence
  Synthetic oligonucleotide
gaaacgcacccatggctatctagcactttcccatt

SEQ ID NO: 106531 - DNA, 35 bp, Artificial Sequence
  Synthetic oligonucleotide
gtcgcactcatcgacgccccccgtccaccccctgt

SEQ ID NO: 106532 - DNA, 35 bp, Artificial Sequence
  Synthetic oligonucleotide
acctcaccaccatcccccggacagtgacggactca

SEQ ID NO: 106533 - DNA, 37 bp, Artificial Sequence
  Synthetic oligonucleotide
gagtaggaggagaggagagggagccttacggggggga

SEQ ID NO: 106534 - DNA, 35 bp, Artificial Sequence
  Synthetic oligonucleotide
acccgccattgctccctcgtgttcgtaccaccgac

SEQ ID NO: 106535 - DNA, 35 bp, Artificial Sequence
  Synthetic oligonucleotide
gccccaaccgccgccccgaatgctactggatctta

SEQ ID NO: 106536 - DNA, 36 bp, Artificial Sequence
  Synthetic oligonucleotide
tccacgccccctcgcgcctgcattgaggccacccta

SEQ ID NO: 106537 - DNA, 35 bp, Artificial Sequence
  Synthetic oligonucleotide
tgcccaccgacacatcttgccagtccgcttttcca

SEQ ID NO: 106538 - DNA, 35 bp, Artificial Sequence
  Synthetic oligonucleotide
tcactactccgcactgtgacttccgtgagttcctc

SEQ ID NO: 106539 - DNA, 35 bp, Artificial Sequence
  Synthetic oligonucleotide
gacgccatgcccccaccagttttaatctcgcttcg

SEQ ID NO: 106540 - DNA, 37 bp, Artificial Sequence
  Synthetic oligonucleotide
acgaccaggggaggggaaagcgaggggaacgggtcga

SEQ ID NO: 106541 - DNA, 35 bp, Artificial Sequence
  Synthetic oligonucleotide
attagccgccccatctccgccatctgagccagccc

SEQ ID NO: 106542 - DNA, 35 bp, Artificial Sequence
  Synthetic oligonucleotide
ggtgagccgcaccttgtccatcttgcctcagtctc

SEQ ID NO: 106543 - DNA, 35 bp, Artificial Sequence
  Synthetic oligonucleotide
gtcccgctacgcccttgtagtacatgtaccaccct

SEQ ID NO: 106544 - DNA, 37 bp, Artificial Sequence
  Synthetic oligonucleotide
ggaacgggacgggatggggtgcaaatggggcgggcga

SEQ ID NO: 106545 - DNA, 35 bp, Artificial Sequence
  Synthetic oligonucleotide
atgacagaagggagggagtgatgggcagggatttg

SEQ ID NO: 106546 - DNA, 35 bp, Artificial Sequence
  Synthetic oligonucleotide
tgaatcaggaaccgcagctgcctttgccctccctc

SEQ ID NO: 106547 - DNA, 35 bp, Artificial Sequence
  Synthetic oligonucleotide
gacattctcgctcatccgttattgccactcctccg

SEQ ID NO: 106548 - DNA, 37 bp, Artificial Sequence
  Synthetic oligonucleotide
gacctccaccgaatgtatgcgccttctcatccccgga

SEQ ID NO: 106549 - DNA, 37 bp, Artificial Sequence
  Synthetic oligonucleotide
gcaccctcccactgctccctcacgtccatataatgga

SEQ ID NO: 106550 - DNA, 35 bp, Artificial Sequence
  Synthetic oligonucleotide
gacgagccgcccctaactatgccgtttgccaccac

SEQ ID NO: 106551 - DNA, 35 bp, Artificial Sequence
  Synthetic oligonucleotide
gtactccccccctgttaacacactgtgcactagcc

SEQ ID NO: 106552 - DNA, 37 bp, Artificial Sequence
  Synthetic oligonucleotide
agcacatcgccttccatcgcctgccatccacccgtga

SEQ ID NO: 106553 - DNA, 35 bp, Artificial Sequence
  Synthetic oligonucleotide
gcgactcccagtcctccagtccagcccccctcgca

SEQ ID NO: 106554 - DNA, 35 bp, Artificial Sequence
  Synthetic oligonucleotide
acgcccctcgcccgctattgtaatcgttacaccgt

SEQ ID NO: 106555 - DNA, 35 bp, Artificial Sequence
  Synthetic oligonucleotide
aatccgtgaggggtgggggggagagaagggttcgg

SEQ ID NO: 106556 - DNA, 37 bp, Artificial Sequence
  Synthetic oligonucleotide
gattagggagaaggtagggaggggcggtgggcggaga

SEQ ID NO: 106557 - DNA, 37 bp, Artificial Sequence
  Synthetic oligonucleotide
tccgatcccgcctcccttttgtactctgttgattcga

SEQ ID NO: 106558 - DNA, 37 bp, Artificial Sequence
  Synthetic oligonucleotide
acaggacgggaggagggttaaagtagcaggggaatga

SEQ ID NO: 106559 - DNA, 35 bp, Artificial Sequence
  Synthetic oligonucleotide
tgccacccgcctcccttatgcatctgttagacagt

SEQ ID NO: 106560 - DNA, 35 bp, Artificial Sequence
  Synthetic oligonucleotide
tgcctactccacctttgtgactgcatccatctttt

SEQ ID NO: 106561 - DNA, 35 bp, Artificial Sequence
  Synthetic oligonucleotide
gatccgcgcccaatcggcttgaaccatctaccctc

SEQ ID NO: 106562 - DNA, 35 bp, Artificial Sequence
  Synthetic oligonucleotide
gccacgcccgctgctaactgctttctggcctcact

SEQ ID NO: 106563 - DNA, 35 bp, Artificial Sequence
  Synthetic oligonucleotide
tggtgcccctccgcatagtacggcccttcttacat

SEQ ID NO: 106564 - DNA, 35 bp, Artificial Sequence
  Synthetic oligonucleotide
tgcaccgaacgccattactgcctccctcgtgctgc

SEQ ID NO: 106565 - DNA, 37 bp, Artificial Sequence
  Synthetic oligonucleotide
gcaacacgtactgctccctcgccttacccctagccga

SEQ ID NO: 106566 - DNA, 35 bp, Artificial Sequence
  Synthetic oligonucleotide
acaaggagggggagggggggctggataggtggaac

SEQ ID NO: 106567 - DNA, 36 bp, Artificial Sequence
  Synthetic oligonucleotide
actggccccctcaccttgtcatggcaaagcacccca

SEQ ID NO: 106568 - DNA, 36 bp, Artificial Sequence
  Synthetic oligonucleotide
gataggcggggggggtgggtcgaagggcaccgacta

SEQ ID NO: 106569 - DNA, 37 bp, Artificial Sequence
  Synthetic oligonucleotide
acccacctcacctgcaacactccacagtctctaggga

SEQ ID NO: 106570 - DNA, 35 bp, Artificial Sequence
  Synthetic oligonucleotide
gtggccccctatcacctttgtttctgtacatcgcg

SEQ ID NO: 106571 - DNA, 35 bp, Artificial Sequence
  Synthetic oligonucleotide
tcaccggccatccccacatgtactatttattcatc

SEQ ID NO: 106572 - DNA, 35 bp, Artificial Sequence
  Synthetic oligonucleotide
tgccacgacggttcatttcggcctcccaccccatt

SEQ ID NO: 106573 - DNA, 35 bp, Artificial Sequence
  Synthetic oligonucleotide
gactgacccaatgtttcttctctgctgttttttcc

SEQ ID NO: 106574 - DNA, 34 bp, Artificial Sequence
  Synthetic oligonucleotide
accccgccacttcccggacaactgcttcatatta

SEQ ID NO: 106575 - DNA, 35 bp, Artificial Sequence
  Synthetic oligonucleotide
tccgaagacgtcagcccctactcgccgcttcaccg

SEQ ID NO: 106576 - DNA, 37 bp, Artificial Sequence
  Synthetic oligonucleotide
tgccatgcccccgcgtgctactgcatctcccttatga

SEQ ID NO: 106577 - DNA, 35 bp, Artificial Sequence
  Synthetic oligonucleotide
ttgactcccatccagtgatccaggttcccctttcc

SEQ ID NO: 106578 - DNA, 35 bp, Artificial Sequence
  Synthetic oligonucleotide
gtccaccgtctcgaactcctgcgctgtcttcttgc

SEQ ID NO: 106579 - DNA, 35 bp, Artificial Sequence
  Synthetic oligonucleotide
gcccctccccgtgaataccctggagccctcacgcc

SEQ ID NO: 106580 - DNA, 35 bp, Artificial Sequence
  Synthetic oligonucleotide
tgttcccctccttgcatgaaaatctgccccttcgg

SEQ ID NO: 106581 - DNA, 35 bp, Artificial Sequence
  Synthetic oligonucleotide
taacccctccccctgtgtcctgaccagctcgttca

SEQ ID NO: 106582 - DNA, 35 bp, Artificial Sequence
  Synthetic oligonucleotide
tgatccccacatcgcctctgccgccgaacacggcc

SEQ ID NO: 106583 - DNA, 35 bp, Artificial Sequence
  Synthetic oligonucleotide
atcacctcgtgatcgtagtaagttcctcccctgcc

SEQ ID NO: 106584 - DNA, 35 bp, Artificial Sequence
  Synthetic oligonucleotide
gaaacgggtaataacggtggaggagaagaggggtg

SEQ ID NO: 106585 - DNA, 36 bp, Artificial Sequence
  Synthetic oligonucleotide
tcccgctaccgcccacctgtaccgctcaggcgcaac

SEQ ID NO: 106586 - DNA, 35 bp, Artificial Sequence
  Synthetic oligonucleotide
tgtccaccttcaagttctcagtgccttgcccctac

SEQ ID NO: 106587 - DNA, 35 bp, Artificial Sequence
  Synthetic oligonucleotide
attgatgcaacccagtccgccacctctccggttgc

SEQ ID NO: 106588 - DNA, 35 bp, Artificial Sequence
  Synthetic oligonucleotide
gagtgagggcgaagaggaacggggggtggggtggt

SEQ ID NO: 106589 - DNA, 35 bp, Artificial Sequence
  Synthetic oligonucleotide
ttgtggctccactgaattatcgtacctcccctccg

SEQ ID NO: 106590 - DNA, 36 bp, Artificial Sequence
  Synthetic oligonucleotide
acacgccacccgcctagatttcccggcttccttgca

SEQ ID NO: 106591 - DNA, 35 bp, Artificial Sequence
  Synthetic oligonucleotide
taccaccctaatgcacatgtgaacggtcgccctcc

SEQ ID NO: 106592 - DNA, 35 bp, Artificial Sequence
  Synthetic oligonucleotide
tcccagctcaagccttctgcacgtgccctccttga

SEQ ID NO: 106593 - DNA, 36 bp, Artificial Sequence
  Synthetic oligonucleotide
tcgcaacccccccctgtgtcaccgcgtaccccgcca

SEQ ID NO: 106594 - DNA, 37 bp, Artificial Sequence
  Synthetic oligonucleotide
gactcgcctctcatccgttactttgactctcactcga

SEQ ID NO: 106595 - DNA, 38 bp, Artificial Sequence
  Synthetic oligonucleotide
taccacctcattcgtgctttgctttacctcatttctga

SEQ ID NO: 106596 - DNA, 36 bp, Artificial Sequence
  Synthetic oligonucleotide
tacgacgcctgtccctgtccttttggttccacttaa

SEQ ID NO: 106597 - DNA, 35 bp, Artificial Sequence
  Synthetic oligonucleotide
gcaatcctccaacatcgttcgcctgttcgacctgc

SEQ ID NO: 106598 - DNA, 35 bp, Artificial Sequence
  Synthetic oligonucleotide
gaggggacacgggtgaaagagaagggctggaatgg

SEQ ID NO: 106599 - DNA, 37 bp, Artificial Sequence
  Synthetic oligonucleotide
accgaggggggtggtggggcgaagcggaggacacgga

SEQ ID NO: 106600 - DNA, 35 bp, Artificial Sequence
  Synthetic oligonucleotide
agagtggcggaggaggggggaacaggcgggattgg

SEQ ID NO: 106601 - DNA, 35 bp, Artificial Sequence
  Synthetic oligonucleotide
gaggaaccgcctgctcgccgttttcttcccgttat

SEQ ID NO: 106602 - DNA, 36 bp, Artificial Sequence
  Synthetic oligonucleotide
gggtaggagggaggggggtggcttgcggatcgggga

SEQ ID NO: 106603 - DNA, 35 bp, Artificial Sequence
  Synthetic oligonucleotide
aatgcctagctgtcacccacgtctgttctggcctc

SEQ ID NO: 106604 - DNA, 36 bp, Artificial Sequence
  Synthetic oligonucleotide
actccaccccgccgccgtgctcgttccgtctaatga

SEQ ID NO: 106605 - DNA, 35 bp, Artificial Sequence
  Synthetic oligonucleotide
gcaccaccgccgctctcttcttaacttctggcttc

SEQ ID NO: 106606 - DNA, 35 bp, Artificial Sequence
  Synthetic oligonucleotide
tcacaccgccgtggcctgttactcccgctccagcc

SEQ ID NO: 106607 - DNA, 35 bp, Artificial Sequence
  Synthetic oligonucleotide
ttataccgccatccttgccaccacccgttagggtc

SEQ ID NO: 106608 - DNA, 36 bp, Artificial Sequence
  Synthetic oligonucleotide
acccccccctggctcacctgtcgttttacaccgcca

SEQ ID NO: 106609 - DNA, 35 bp, Artificial Sequence
  Synthetic oligonucleotide
ggggccccgagctggctgctctctctccccttttc

SEQ ID NO: 106610 - DNA, 35 bp, Artificial Sequence
  Synthetic oligonucleotide
gccttggggccgagaggggagggggattgggacta

SEQ ID NO: 106611 - DNA, 35 bp, Artificial Sequence
  Synthetic oligonucleotide
gcgaggtaatatcaccgcacgccaccaccacgcct

SEQ ID NO: 106612 - DNA, 35 bp, Artificial Sequence
  Synthetic oligonucleotide
tcgcattccgcccgtacgcctggaccccgtagctc

SEQ ID NO: 106613 - DNA, 35 bp, Artificial Sequence
  Synthetic oligonucleotide
tccttgcgtacagctccctttcctgccgccccgta

SEQ ID NO: 106614 - DNA, 35 bp, Artificial Sequence
  Synthetic oligonucleotide
tgcatacctcctgctcgccatccgatcctataggc

SEQ ID NO: 106615 - DNA, 36 bp, Artificial Sequence
  Synthetic oligonucleotide
atactgcccaccattgtctctttccgcgctcacgca

SEQ ID NO: 106616 - DNA, 35 bp, Artificial Sequence
  Synthetic oligonucleotide
ggtcacaccgcctgcctttaactccttgtcgctac

SEQ ID NO: 106617 - DNA, 35 bp, Artificial Sequence
  Synthetic oligonucleotide
accccccccgccgagtttgaatccttcgcacaccg

SEQ ID NO: 106618 - DNA, 35 bp, Artificial Sequence
  Synthetic oligonucleotide
acaccccttccgacgcgtcctctccttggccctcg

SEQ ID NO: 106619 - DNA, 37 bp, Artificial Sequence
  Synthetic oligonucleotide
tgtagggcggacggggcaaagaagagggggttaggga

SEQ ID NO: 106620 - DNA, 35 bp, Artificial Sequence
  Synthetic oligonucleotide
ggggagagttaagaaggggaggatggtgcggggag

SEQ ID NO: 106621 - DNA, 35 bp, Artificial Sequence
  Synthetic oligonucleotide
tccccgacgaccactctgcacctgccacattcttc

SEQ ID NO: 106622 - DNA, 35 bp, Artificial Sequence
  Synthetic oligonucleotide
aagccacgggcgggaagggcttgggaacggattgg

SEQ ID NO: 106623 - DNA, 37 bp, Artificial Sequence
  Synthetic oligonucleotide
accacccactgaccctgctcatcacccaccctgttga

SEQ ID NO: 106624 - DNA, 35 bp, Artificial Sequence
  Synthetic oligonucleotide
tccgctcgtagcctcctactcacgaccctgtcctc

SEQ ID NO: 106625 - DNA, 35 bp, Artificial Sequence
  Synthetic oligonucleotide
tgctggtgtacgctctccatccgctttccatatgt

SEQ ID NO: 106626 - DNA, 36 bp, Artificial Sequence
  Synthetic oligonucleotide
ggtaacgcgggagggaggggcgggcaatcgttgaaa

SEQ ID NO: 106627 - DNA, 35 bp, Artificial Sequence
  Synthetic oligonucleotide
gtggaacgacgggggcaatatgggggcggagtgtg

SEQ ID NO: 106628 - DNA, 38 bp, Artificial Sequence
  Synthetic oligonucleotide
cgcctccccgccccctccatgggtgtataagcctatga

SEQ ID NO: 106629 - DNA, 35 bp, Artificial Sequence
  Synthetic oligonucleotide
gtagcatcggtctcgccgcgcccctgccccattcg

SEQ ID NO: 106630 - DNA, 37 bp, Artificial Sequence
  Synthetic oligonucleotide
gaggtcgggggagggggggaaggtccgggaggtacga

SEQ ID NO: 106631 - DNA, 35 bp, Artificial Sequence
  Synthetic oligonucleotide
gcaacgaccgactctgcttttcgttctccctgtgc

SEQ ID NO: 106632 - DNA, 35 bp, Artificial Sequence
  Synthetic oligonucleotide
gtaaacgtaaacgggagtgggggggatggggatgt

SEQ ID NO: 106633 - DNA, 35 bp, Artificial Sequence
  Synthetic oligonucleotide
ttacatcccccagccgcctgcgcgttccacttttt

SEQ ID NO: 106634 - DNA, 35 bp, Artificial Sequence
  Synthetic oligonucleotide
tgacgccacttccgttttgaccattcttgctgctc

SEQ ID NO: 106635 - DNA, 34 bp, Artificial Sequence
  Synthetic oligonucleotide
acacatccgcacacccgcacgccccgttacctta

SEQ ID NO: 106636 - DNA, 37 bp, Artificial Sequence
  Synthetic oligonucleotide
gcgaatcgatagatgagcctacccttaccacccccga

SEQ ID NO: 106637 - DNA, 35 bp, Artificial Sequence
  Synthetic oligonucleotide
gccacccgcccacccggtaactcgtgaccgcctat

SEQ ID NO: 106638 - DNA, 37 bp, Artificial Sequence
  Synthetic oligonucleotide
gttgggtgggggtcgagggggagtagggcaggatgga

SEQ ID NO: 106639 - DNA, 36 bp, Artificial Sequence
  Synthetic oligonucleotide
gcctccacctcttgccacgtattccgcaccacgtga

SEQ ID NO: 106640 - DNA, 35 bp, Artificial Sequence
  Synthetic oligonucleotide
gcacccatctccgccgccccccatgacaacgtgcg

SEQ ID NO: 106641 - DNA, 36 bp, Artificial Sequence
  Synthetic oligonucleotide
acacctgcctcacctctgttacttcatctggttaca

SEQ ID NO: 106642 - DNA, 35 bp, Artificial Sequence
  Synthetic oligonucleotide
gatcgaacagggggagtaggggcgggggggatccg

SEQ ID NO: 106643 - DNA, 36 bp, Artificial Sequence
  Synthetic oligonucleotide
acaccgcccatcaccttggttcactgcccagtaata

SEQ ID NO: 106644 - DNA, 35 bp, Artificial Sequence
  Synthetic oligonucleotide
tgatccactccattgtgccgtccacctctggctct

SEQ ID NO: 106645 - DNA, 37 bp, Artificial Sequence
  Synthetic oligonucleotide
acgccctgaacgcccctgtatcctgctctcccccgga

SEQ ID NO: 106646 - DNA, 36 bp, Artificial Sequence
  Synthetic oligonucleotide
ccgtcgccaacgtgctcctttgccccagttcaacca

SEQ ID NO: 106647 - DNA, 35 bp, Artificial Sequence
  Synthetic oligonucleotide
tccacgatacggatctgcctgccgcctttctcgct

SEQ ID NO: 106648 - DNA, 35 bp, Artificial Sequence
  Synthetic oligonucleotide
tacgcccccccagtaatttggcctctgttgcattc

SEQ ID NO: 106649 - DNA, 37 bp, Artificial Sequence
  Synthetic oligonucleotide
tgcccgtcgccgttctttacacctatctgccctccga

SEQ ID NO: 106650 - DNA, 35 bp, Artificial Sequence
  Synthetic oligonucleotide
gaagggaggggcagggagggggtgtaatggtgctc

SEQ ID NO: 106651 - DNA, 35 bp, Artificial Sequence
  Synthetic oligonucleotide
tgccctctccacgttcctcgactgtcttacccggt

SEQ ID NO: 106652 - DNA, 35 bp, Artificial Sequence
  Synthetic oligonucleotide
agttccatccgcctagctgctaatttcggtccttc

SEQ ID NO: 106653 - DNA, 35 bp, Artificial Sequence
  Synthetic oligonucleotide
agcgtaagcaggacgggtcggggggggagtgggag

SEQ ID NO: 106654 - DNA, 34 bp, Artificial Sequence
  Synthetic oligonucleotide
gaccccctctccgccccacaatggacgtagtccc

SEQ ID NO: 106655 - DNA, 36 bp, Artificial Sequence
  Synthetic oligonucleotide
gatacccttgcagccgtcacctgtcccctcccacca

SEQ ID NO: 106656 - DNA, 37 bp, Artificial Sequence
  Synthetic oligonucleotide
tctccagccccggtactgcccagcctctctcctccga

SEQ ID NO: 106657 - DNA, 35 bp, Artificial Sequence
  Synthetic oligonucleotide
gcctacgcgcctcccattgtcagaccgtctgcccc

SEQ ID NO: 106658 - DNA, 35 bp, Artificial Sequence
  Synthetic oligonucleotide
gaacacgtccgtggtctacaccccgcctttaccac

SEQ ID NO: 106659 - DNA, 35 bp, Artificial Sequence
  Synthetic oligonucleotide
tgccccatctatgcctacaacgcccgccacattct

SEQ ID NO: 106660 - DNA, 37 bp, Artificial Sequence
  Synthetic oligonucleotide
tccccaccactccctggacccataaagacgcctccga

SEQ ID NO: 106661 - DNA, 35 bp, Artificial Sequence
  Synthetic oligonucleotide
gcatcgcgcctggctactccctgttactcgtcttc

SEQ ID NO: 106662 - DNA, 37 bp, Artificial Sequence
  Synthetic oligonucleotide
aacgaagagcagaaagaggggggagagcgggggagga

SEQ ID NO: 106663 - DNA, 37 bp, Artificial Sequence
  Synthetic oligonucleotide
tctcagccgagaggaatgggggcgtggtgggggcgga

SEQ ID NO: 106664 - DNA, 35 bp, Artificial Sequence
  Synthetic oligonucleotide
ttcgacccttgccacaatgtcaattctccggtccc

SEQ ID NO: 106665 - DNA, 35 bp, Artificial Sequence
  Synthetic oligonucleotide
acgctcccctgggccccctcttcactcgactaccg

SEQ ID NO: 106666 - DNA, 35 bp, Artificial Sequence
  Synthetic oligonucleotide
ttaccctctgctgatgtcttccgtgcccccttctc

SEQ ID NO: 106667 - DNA, 35 bp, Artificial Sequence
  Synthetic oligonucleotide
tgacacgacacttatgcctcatgccaccgtcttcg

SEQ ID NO: 106668 - DNA, 35 bp, Artificial Sequence
  Synthetic oligonucleotide
tgcacgttgcccccaatggtctcgctcccctccca

SEQ ID NO: 106669 - DNA, 37 bp, Artificial Sequence
  Synthetic oligonucleotide
gactaggaagggggtaggagaggtgagggaggaacga

SEQ ID NO: 106670 - DNA, 35 bp, Artificial Sequence
  Synthetic oligonucleotide
atggagggctgggtgggatggggtacttgttatac

SEQ ID NO: 106671 - DNA, 35 bp, Artificial Sequence
  Synthetic oligonucleotide
gcagagtcacatcgtatctcctttacccccgctcc

SEQ ID NO: 106672 - DNA, 35 bp, Artificial Sequence
  Synthetic oligonucleotide
atcgcccctatgtctccccgctcctgtgtccccaa

SEQ ID NO: 106673 - DNA, 37 bp, Artificial Sequence
  Synthetic oligonucleotide
tcgtacggaggggaggcgatacggaggggcgggggga

SEQ ID NO: 106674 - DNA, 35 bp, Artificial Sequence
  Synthetic oligonucleotide
gtgcccaccgcccatttgcgcctcctgcacaacat

SEQ ID NO: 106675 - DNA, 35 bp, Artificial Sequence
  Synthetic oligonucleotide
agttaccgccacagtcgctataaccccgtccctcc

SEQ ID NO: 106676 - DNA, 35 bp, Artificial Sequence
  Synthetic oligonucleotide
acacccgcctttaccgtcactcacgctcccgccgg

SEQ ID NO: 106677 - DNA, 35 bp, Artificial Sequence
  Synthetic oligonucleotide
gtcgcagacacccgatctacctaccgctccagctc

SEQ ID NO: 106678 - DNA, 37 bp, Artificial Sequence
  Synthetic oligonucleotide
gttccgccctgatcctaccgcctcgacccacactgga

SEQ ID NO: 106679 - DNA, 35 bp, Artificial Sequence
  Synthetic oligonucleotide
atccaccctaagcccaccgccaattgtcatcgctc

SEQ ID NO: 106680 - DNA, 36 bp, Artificial Sequence
  Synthetic oligonucleotide
acacccccgtcgtcgggttatgcccgttacttccca

SEQ ID NO: 106681 - DNA, 35 bp, Artificial Sequence
  Synthetic oligonucleotide
gtttcgcaccgtccctcctgtattccccgttccct

SEQ ID NO: 106682 - DNA, 37 bp, Artificial Sequence
  Synthetic oligonucleotide
gactccgacctcctggtttcaatatccgttcctccga

SEQ ID NO: 106683 - DNA, 37 bp, Artificial Sequence
  Synthetic oligonucleotide
gtcgccccacacggtatcgcccattgccttttctcga

SEQ ID NO: 106684 - DNA, 35 bp, Artificial Sequence
  Synthetic oligonucleotide
accgcacacgtaacatcttggcctttctcgtttcc

SEQ ID NO: 106685 - DNA, 35 bp, Artificial Sequence
  Synthetic oligonucleotide
ttgttcccccccttcagtttcgcctagggcactcc

SEQ ID NO: 106686 - DNA, 37 bp, Artificial Sequence
  Synthetic oligonucleotide
ggaggaaggaggacgggtgacgaaagggctggagaga

SEQ ID NO: 106687 - DNA, 38 bp, Artificial Sequence
  Synthetic oligonucleotide
atagggcggggcatccagtcatggggtagagggggtga

SEQ ID NO: 106688 - DNA, 37 bp, Artificial Sequence
  Synthetic oligonucleotide
gtgcgggggggatcgggagggtagacagtgtgagtga

SEQ ID NO: 106689 - DNA, 35 bp, Artificial Sequence
  Synthetic oligonucleotide
tccgcatatagccgctgcccgtttagccttcttca

SEQ ID NO: 106690 - DNA, 38 bp, Artificial Sequence
  Synthetic oligonucleotide
tagagcacccggcacccgtgcgccactcccccccgtga

SEQ ID NO: 106691 - DNA, 35 bp, Artificial Sequence
  Synthetic oligonucleotide
tactcccccgtccctgccgctttatgtacgtcaac

SEQ ID NO: 106692 - DNA, 35 bp, Artificial Sequence
  Synthetic oligonucleotide
gcgcacccgccacggctccaatcttctccttcgcc

SEQ ID NO: 106693 - DNA, 35 bp, Artificial Sequence
  Synthetic oligonucleotide
atgaggagggaggtgggggagggagtggctcattc

SEQ ID NO: 106694 - DNA, 35 bp, Artificial Sequence
  Synthetic oligonucleotide
tccgttccctcactgtcttcgtgtctgctcgtttc

SEQ ID NO: 106695 - DNA, 35 bp, Artificial Sequence
  Synthetic oligonucleotide
gttgccccgtgcatatcttaccgcttgttcacgcc

SEQ ID NO: 106696 - DNA, 35 bp, Artificial Sequence
  Synthetic oligonucleotide
acgctcctgtcctcagccggtttcccttctgcctt

SEQ ID NO: 106697 - DNA, 36 bp, Artificial Sequence
  Synthetic oligonucleotide
tcacgttgcatcctgatccgtctcctccgacctcaa

SEQ ID NO: 106698 - DNA, 36 bp, Artificial Sequence
  Synthetic oligonucleotide
tcatcttccgccgcccatgttacgtccctccggtaa

SEQ ID NO: 106699 - DNA, 35 bp, Artificial Sequence
  Synthetic oligonucleotide
tcgtgcatgccactcctgttaactcgctcgtcctc

SEQ ID NO: 106700 - DNA, 35 bp, Artificial Sequence
  Synthetic oligonucleotide
gccccccccgccgtgaattgttctctgtccaggtt

SEQ ID NO: 106701 - DNA, 36 bp, Artificial Sequence
  Synthetic oligonucleotide
gtcacgcaattctatctaccgccccgctctatcgca

SEQ ID NO: 106702 - DNA, 35 bp, Artificial Sequence
  Synthetic oligonucleotide
tgatgccgcgtaatcgttctgcctatctgctccat

SEQ ID NO: 106703 - DNA, 38 bp, Artificial Sequence
  Synthetic oligonucleotide
gtgggaggggagggtcgggaacaagtgggagaaggtga

SEQ ID NO: 106704 - DNA, 35 bp, Artificial Sequence
  Synthetic oligonucleotide
tgtgtgtgccctgaatcctcgttgtcgctgtccac

SEQ ID NO: 106705 - DNA, 35 bp, Artificial Sequence
  Synthetic oligonucleotide
gccacccgagttcgacccatccgccatgtcgctgc

SEQ ID NO: 106706 - DNA, 35 bp, Artificial Sequence
  Synthetic oligonucleotide
gaccatgccgttctctatgtgccccttcgttcctg

SEQ ID NO: 106707 - DNA, 35 bp, Artificial Sequence
  Synthetic oligonucleotide
tccgatccaccacacctgcatatgtcccccttgct

SEQ ID NO: 106708 - DNA, 35 bp, Artificial Sequence
  Synthetic oligonucleotide
attgccgtcccccacatgtctcccgaatagtccct

SEQ ID NO: 106709 - DNA, 35 bp, Artificial Sequence
  Synthetic oligonucleotide
acatcatgcacgcgtaccttcgcccctctgcctct

SEQ ID NO: 106710 - DNA, 35 bp, Artificial Sequence
  Synthetic oligonucleotide
tcaacggtcgcccgtgcgtccctgccaccaccttt

SEQ ID NO: 106711 - DNA, 38 bp, Artificial Sequence
  Synthetic oligonucleotide
gtcacaaaggaggggaagggcgaacacggtgagggtga

SEQ ID NO: 106712 - DNA, 35 bp, Artificial Sequence
  Synthetic oligonucleotide
taagcgtgcacgctgcccttgtgacgccctcccct

SEQ ID NO: 106713 - DNA, 35 bp, Artificial Sequence
  Synthetic oligonucleotide
acacgtccaacggtaattgctacccctgctcctgc

SEQ ID NO: 106714 - DNA, 35 bp, Artificial Sequence
  Synthetic oligonucleotide
tttatgcgccgcctgccttcgtctttcatgactcc

SEQ ID NO: 106715 - DNA, 35 bp, Artificial Sequence
  Synthetic oligonucleotide
atcgccccccaacatggccccctcgtcctcggcgc

SEQ ID NO: 106716 - DNA, 37 bp, Artificial Sequence
  Synthetic oligonucleotide
atgagcggtacacggggggaggaagaacggggctgga

SEQ ID NO: 106717 - DNA, 35 bp, Artificial Sequence
  Synthetic oligonucleotide
atcactgtccacatcagcccgcccccatcggttcc

SEQ ID NO: 106718 - DNA, 35 bp, Artificial Sequence
  Synthetic oligonucleotide
gactgaccgccctctctgctatcatgatccgaaca

SEQ ID NO: 106719 - DNA, 35 bp, Artificial Sequence
  Synthetic oligonucleotide
gatccgccctcactgccctgcatttaatgcaccgc

SEQ ID NO: 106720 - DNA, 34 bp, Artificial Sequence
  Synthetic oligonucleotide
tgcacacctgcacccccccctttaagctcccggc

SEQ ID NO: 106721 - DNA, 35 bp, Artificial Sequence
  Synthetic oligonucleotide
tcacactcagccctctccaccctgaggcataccct

SEQ ID NO: 106722 - DNA, 37 bp, Artificial Sequence
  Synthetic oligonucleotide
gaccgcctgacccatgtacaccgcccttcatccacga

SEQ ID NO: 106723 - DNA, 37 bp, Artificial Sequence
  Synthetic oligonucleotide
tgcccagtccatgttgctccccacgcccgtaccccga

SEQ ID NO: 106724 - DNA, 33 bp, Artificial Sequence
  Synthetic oligonucleotide
tcacgtgctgggtgggcgggatgtcattgggca

SEQ ID NO: 106725 - DNA, 35 bp, Artificial Sequence
  Synthetic oligonucleotide
gaagccgcctgcatacacgctggaccatctgcccc

SEQ ID NO: 106726 - DNA, 37 bp, Artificial Sequence
  Synthetic oligonucleotide
ggaggggggcacaatggctgggtgggtggaggggcga

SEQ ID NO: 106727 - DNA, 35 bp, Artificial Sequence
  Synthetic oligonucleotide
gtccgtcctcgtaggctatcctggttctcattccc

SEQ ID NO: 106728 - DNA, 35 bp, Artificial Sequence
  Synthetic oligonucleotide
acgaagtaagggagggaatggaggtaggactgggg

SEQ ID NO: 106729 - DNA, 35 bp, Artificial Sequence
  Synthetic oligonucleotide
atgccggtccactgagccccgccccttctttgatc

SEQ ID NO: 106730 - DNA, 35 bp, Artificial Sequence
  Synthetic oligonucleotide
tcgccccgatggataccgtcgccctcgcctttgcc

SEQ ID NO: 106731 - DNA, 35 bp, Artificial Sequence
  Synthetic oligonucleotide
accgcccgcgcattttgcacccacccccttttggt

SEQ ID NO: 106732 - DNA, 35 bp, Artificial Sequence
  Synthetic oligonucleotide
gccacgcgcatagtagcccgaccagctccccccac

SEQ ID NO: 106733 - DNA, 35 bp, Artificial Sequence
  Synthetic oligonucleotide
gcgacgcgatcattgctcccctccgtccgtttacc

SEQ ID NO: 106734 - DNA, 37 bp, Artificial Sequence
  Synthetic oligonucleotide
ccatgggaggccgggggttagcggtcctttgggggga

SEQ ID NO: 106735 - DNA, 35 bp, Artificial Sequence
  Synthetic oligonucleotide
atcgtccaccagcctccgcacgactgcccctactc

SEQ ID NO: 106736 - DNA, 35 bp, Artificial Sequence
  Synthetic oligonucleotide
atccaccgccccctcgcgaattaaagcttttcgcg

SEQ ID NO: 106737 - DNA, 36 bp, Artificial Sequence
  Synthetic oligonucleotide
gagtcgcccactcgttatttgcttccccttggctca

SEQ ID NO: 106738 - DNA, 35 bp, Artificial Sequence
  Synthetic oligonucleotide
gtttgctcccccagccgtccgtctagccgcccgct

SEQ ID NO: 106739 - DNA, 35 bp, Artificial Sequence
  Synthetic oligonucleotide
tagtccaccactgtccgtcccgtcttctgcctact

SEQ ID NO: 106740 - DNA, 35 bp, Artificial Sequence
  Synthetic oligonucleotide
acccacgcaggcgttgctccaagccgttcccactc

SEQ ID NO: 106741 - DNA, 32 bp, Artificial Sequence
  Synthetic oligonucleotide
gtgcctgcttaccgagccctatctgaccctgc

SEQ ID NO: 106742 - DNA, 35 bp, Artificial Sequence
  Synthetic oligonucleotide
tcctctcgcaccctcgctgatcctggcccttcgca

SEQ ID NO: 106743 - DNA, 35 bp, Artificial Sequence
  Synthetic oligonucleotide
atgcgcctcagcacctccgtattgttatcctccgc

SEQ ID NO: 106744 - DNA, 35 bp, Artificial Sequence
  Synthetic oligonucleotide
tcaccaccatccatcccggagcctctcattcgtgc

SEQ ID NO: 106745 - DNA, 35 bp, Artificial Sequence
  Synthetic oligonucleotide
tgctgtagccccccgcgcgttcctcctgcccatat

SEQ ID NO: 106746 - DNA, 37 bp, Artificial Sequence
  Synthetic oligonucleotide
acgaggggaggggaaggggacggaggacgattgacga

SEQ ID NO: 106747 - DNA, 35 bp, Artificial Sequence
  Synthetic oligonucleotide
gcccacctatctgcccgcatcccctttgacgtgcg

SEQ ID NO: 106748 - DNA, 38 bp, Artificial Sequence
  Synthetic oligonucleotide
atcccccccagttcctgcattgccgtacgtccatctga

SEQ ID NO: 106749 - DNA, 35 bp, Artificial Sequence
  Synthetic oligonucleotide
tcagcgggcctccacctgtaacacgattccacgcc

SEQ ID NO: 106750 - DNA, 36 bp, Artificial Sequence
  Synthetic oligonucleotide
atgccaccctctcgtaatctgtcttcactcatggca

SEQ ID NO: 106751 - DNA, 35 bp, Artificial Sequence
  Synthetic oligonucleotide
tacatcccaggctccaccccgctgcacaggtctcc

SEQ ID NO: 106752 - DNA, 36 bp, Artificial Sequence
  Synthetic oligonucleotide
gccgccgctcacactcgcccttcccgtgtcgcccta

SEQ ID NO: 106753 - DNA, 35 bp, Artificial Sequence
  Synthetic oligonucleotide
tgcgcaacacctgccctcgctctgaagtcccgcct

SEQ ID NO: 106754 - DNA, 35 bp, Artificial Sequence
  Synthetic oligonucleotide
aacgcgacctacgcgctgtccctttgttccccttt

SEQ ID NO: 106755 - DNA, 35 bp, Artificial Sequence
  Synthetic oligonucleotide
tgtgcatcagcgtgtaccttcgttccatccgcgca

SEQ ID NO: 106756 - DNA, 34 bp, Artificial Sequence
  Synthetic oligonucleotide
acctaccgccctctcacatagtctagccagtccc

SEQ ID NO: 106757 - DNA, 35 bp, Artificial Sequence
  Synthetic oligonucleotide
tccgccctatccagacgctccatttccacctgtac

SEQ ID NO: 106758 - DNA, 34 bp, Artificial Sequence
  Synthetic oligonucleotide
tcccactcgtacacatccagcatgtcccgcacct

SEQ ID NO: 106759 - DNA, 35 bp, Artificial Sequence
  Synthetic oligonucleotide
tcactccctgctgcctgttctggtccatgtactac

SEQ ID NO: 106760 - DNA, 36 bp, Artificial Sequence
  Synthetic oligonucleotide
tccccgcccctctgaccgcgcatggttaccctcata

SEQ ID NO: 106761 - DNA, 35 bp, Artificial Sequence
  Synthetic oligonucleotide
gcccacccgcacccgtgtttacatgctaacccgac

SEQ ID NO: 106762 - DNA, 35 bp, Artificial Sequence
  Synthetic oligonucleotide
gtgcccttcatcgtcttttatcctggctgcacacc

SEQ ID NO: 106763 - DNA, 35 bp, Artificial Sequence
  Synthetic oligonucleotide
gcacccgcacctttggccccctaactttccgtgcc

SEQ ID NO: 106764 - DNA, 35 bp, Artificial Sequence
  Synthetic oligonucleotide
atccccatcccaccagtcgcctcgcatgaaccccg

SEQ ID NO: 106765 - DNA, 35 bp, Artificial Sequence
  Synthetic oligonucleotide
tctaccacgttgcttgatgcgcccgcccgtccctc

SEQ ID NO: 106766 - DNA, 35 bp, Artificial Sequence
  Synthetic oligonucleotide
ttcccccccggccgtccgctgatgccacgcctcgc

SEQ ID NO: 106767 - DNA, 34 bp, Artificial Sequence
  Synthetic oligonucleotide
acgtcgccacgagccctcacacccatacgcctgt

SEQ ID NO: 106768 - DNA, 36 bp, Artificial Sequence
  Synthetic oligonucleotide
gttgcctttcgttcgaatcacacccctgtcctgcca

SEQ ID NO: 106769 - DNA, 35 bp, Artificial Sequence
  Synthetic oligonucleotide
gtcccgcccttactttgtctcgagccctacttcca

SEQ ID NO: 106770 - DNA, 35 bp, Artificial Sequence
  Synthetic oligonucleotide
gccgacctctatctgcttatcgtacttcccgaatt

SEQ ID NO: 106771 - DNA, 35 bp, Artificial Sequence
  Synthetic oligonucleotide
gactccgccctcgactgttccccctgtattctagc

SEQ ID NO: 106772 - DNA, 35 bp, Artificial Sequence
  Synthetic oligonucleotide
acccgcccctggttttgtccacgagtgcttcctac

SEQ ID NO: 106773 - DNA, 35 bp, Artificial Sequence
  Synthetic oligonucleotide
ggggcccaccatctgttgccattttctccgctcca

SEQ ID NO: 106774 - DNA, 35 bp, Artificial Sequence
  Synthetic oligonucleotide
gttacccctagatcgtccaaccattgcgccccgcc

SEQ ID NO: 106775 - DNA, 35 bp, Artificial Sequence
  Synthetic oligonucleotide
ttccgcccactctcagccactgctggttgctcctt

SEQ ID NO: 106776 - DNA, 36 bp, Artificial Sequence
  Synthetic oligonucleotide
gagacgacggaggggggaggaggagtggagtgcgta

SEQ ID NO: 106777 - DNA, 35 bp, Artificial Sequence
  Synthetic oligonucleotide
tatgccccactgtccccggtgactccccgtgcgcc

SEQ ID NO: 106778 - DNA, 35 bp, Artificial Sequence
  Synthetic oligonucleotide
gtacgtgtctgccgctctatctgtttctgttctct

SEQ ID NO: 106779 - DNA, 35 bp, Artificial Sequence
  Synthetic oligonucleotide
acgatcacctccatgctagaaccggttcttcctct

SEQ ID NO: 106780 - DNA, 37 bp, Artificial Sequence
  Synthetic oligonucleotide
ttccgttgccccctgctctgtctctgtcctatcacga

SEQ ID NO: 106781 - DNA, 35 bp, Artificial Sequence
  Synthetic oligonucleotide
agccccaccatcgtcatccttgtccttcccgcccg

SEQ ID NO: 106782 - DNA, 37 bp, Artificial Sequence
  Synthetic oligonucleotide
gcgaacgggcagggaggggggggacggataattctga

SEQ ID NO: 106783 - DNA, 35 bp, Artificial Sequence
  Synthetic oligonucleotide
tgaccgccggtttacgtcgcgccgtttcttcctcc

SEQ ID NO: 106784 - DNA, 35 bp, Artificial Sequence
  Synthetic oligonucleotide
gagcgatcatgtcttctccggtccgttttgccgcc

SEQ ID NO: 106785 - DNA, 35 bp, Artificial Sequence
  Synthetic oligonucleotide
gccaccctgtgctgccattccaaaactgatctcct

SEQ ID NO: 106786 - DNA, 35 bp, Artificial Sequence
  Synthetic oligonucleotide
gacgtggagggggtgggcggaaggtaacgcgcagg

SEQ ID NO: 106787 - DNA, 37 bp, Artificial Sequence
  Synthetic oligonucleotide
tgcggtggaggtggggataaagagatagggtggtgga

SEQ ID NO: 106788 - DNA, 35 bp, Artificial Sequence
  Synthetic oligonucleotide
tctgagtggaaggagggaggggagtggatggggta

SEQ ID NO: 106789 - DNA, 35 bp, Artificial Sequence
  Synthetic oligonucleotide
tcacttcacctctgaccgtttttatggtactgccc

SEQ ID NO: 106790 - DNA, 35 bp, Artificial Sequence
  Synthetic oligonucleotide
atcccggtcctgggtccatttccttgtcacgcctc

SEQ ID NO: 106791 - DNA, 35 bp, Artificial Sequence
  Synthetic oligonucleotide
acgacggccgtgctcgtttgcccccgttgccccca

SEQ ID NO: 106792 - DNA, 35 bp, Artificial Sequence
  Synthetic oligonucleotide
atccccccatccgccgcaccagcctctgtcaccga

SEQ ID NO: 106793 - DNA, 36 bp, Artificial Sequence
  Synthetic oligonucleotide
ttcactgcgccgtagcttctcgtgcctttccaccca

SEQ ID NO: 106794 - DNA, 36 bp, Artificial Sequence
  Synthetic oligonucleotide
gccaacgtccaccgctctcgctgtctttgtctttca

SEQ ID NO: 106795 - DNA, 37 bp, Artificial Sequence
  Synthetic oligonucleotide
gaaggtgggtgagggagatatcagggggcggtgggga

SEQ ID NO: 106796 - DNA, 35 bp, Artificial Sequence
  Synthetic oligonucleotide
atgggatgggggagggcgggtactgagttagcggg

SEQ ID NO: 106797 - DNA, 37 bp, Artificial Sequence
  Synthetic oligonucleotide
ggaagggggtgaggcggtgaaacatggggcggaagga

SEQ ID NO: 106798 - DNA, 35 bp, Artificial Sequence
  Synthetic oligonucleotide
gtcgcccaactccccggtcccagacttcgtagccc

SEQ ID NO: 106799 - DNA, 35 bp, Artificial Sequence
  Synthetic oligonucleotide
tgctgtgcccacctcgccctccgccacatggtgcc

SEQ ID NO: 106800 - DNA, 35 bp, Artificial Sequence
  Synthetic oligonucleotide
gtgctccagcctccctcccgctgccctgtgactgc

SEQ ID NO: 106801 - DNA, 35 bp, Artificial Sequence
  Synthetic oligonucleotide
tccgtcctctgcctgctatacttgatcctgcctaa

SEQ ID NO: 106802 - DNA, 37 bp, Artificial Sequence
  Synthetic oligonucleotide
tacaacgccgccgcacattcactgcccacctcttcga

SEQ ID NO: 106803 - DNA, 35 bp, Artificial Sequence
  Synthetic oligonucleotide
tagtactcgccccccgaccccgctgcccggtgact

SEQ ID NO: 106804 - DNA, 35 bp, Artificial Sequence
  Synthetic oligonucleotide
gtatcgcccgccgatcctgctgagctccacctacc

SEQ ID NO: 106805 - DNA, 36 bp, Artificial Sequence
  Synthetic oligonucleotide
gctccccgcactgaacctgacactgctcctgcgcta

SEQ ID NO: 106806 - DNA, 35 bp, Artificial Sequence
  Synthetic oligonucleotide
tcgacccttcccagccgcccctacgttgcccttct

SEQ ID NO: 106807 - DNA, 36 bp, Artificial Sequence
  Synthetic oligonucleotide
aagaggggggtggtgaacgggtagaagggtgtcgga

SEQ ID NO: 106808 - DNA, 35 bp, Artificial Sequence
  Synthetic oligonucleotide
attggcgcctccatcctgtctctaatccacctctc

SEQ ID NO: 106809 - DNA, 35 bp, Artificial Sequence
  Synthetic oligonucleotide
aacaccctcagttccgcgacgcccctctttctgcg

SEQ ID NO: 106810 - DNA, 35 bp, Artificial Sequence
  Synthetic oligonucleotide
ggtgcacatcctgcgttatccccccgttactccat

SEQ ID NO: 106811 - DNA, 36 bp, Artificial Sequence
  Synthetic oligonucleotide
acccgctacccgtcctctcattgttccagctttcca

SEQ ID NO: 106812 - DNA, 36 bp, Artificial Sequence
  Synthetic oligonucleotide
tcattgccacctgcttataatcatcttgcccccgta

SEQ ID NO: 106813 - DNA, 35 bp, Artificial Sequence
  Synthetic oligonucleotide
gccttgctcacctcgttttatgcccatatccttgt

SEQ ID NO: 106814 - DNA, 35 bp, Artificial Sequence
  Synthetic oligonucleotide
gcccacgccactacgaactccagccagacgctgcc

SEQ ID NO: 106815 - DNA, 35 bp, Artificial Sequence
  Synthetic oligonucleotide
ggtcgccctcgcgtctcccctgtttacccgccacc

SEQ ID NO: 106816 - DNA, 35 bp, Artificial Sequence
  Synthetic oligonucleotide
tacacgccctgttctatctgcatctttctagcatt

SEQ ID NO: 106817 - DNA, 35 bp, Artificial Sequence
  Synthetic oligonucleotide
tacgcacgccgccccttactcactgttccttcaga

SEQ ID NO: 106818 - DNA, 37 bp, Artificial Sequence
  Synthetic oligonucleotide
attgccctccccctgttacgcaagtgaccgcccttga

SEQ ID NO: 106819 - DNA, 35 bp, Artificial Sequence
  Synthetic oligonucleotide
atgtgcggttcaccatctggttttctcccttgccc

SEQ ID NO: 106820 - DNA, 35 bp, Artificial Sequence
  Synthetic oligonucleotide
tgtgatccgccacttttcccataagccgtacctac

SEQ ID NO: 106821 - DNA, 35 bp, Artificial Sequence
  Synthetic oligonucleotide
actgcccgcctcaccacccaccgcgcacgcgcctc

SEQ ID NO: 106822 - DNA, 35 bp, Artificial Sequence
  Synthetic oligonucleotide
ggggggggttcggaagtggggtaagggaaatgcag

SEQ ID NO: 106823 - DNA, 35 bp, Artificial Sequence
  Synthetic oligonucleotide
acgagtccgccgccccatctctgtgcagtcttctt

SEQ ID NO: 106824 - DNA, 36 bp, Artificial Sequence
  Synthetic oligonucleotide
gcgtccgtcccgctgcactacctcacacaccgttca

SEQ ID NO: 106825 - DNA, 35 bp, Artificial Sequence
  Synthetic oligonucleotide
tccgaaccctgtcacccgcttatgatccacaacgc

SEQ ID NO: 106826 - DNA, 36 bp, Artificial Sequence
  Synthetic oligonucleotide
acctagtgccacatgcccagccgttcccctctcgta

SEQ ID NO: 106827 - DNA, 35 bp, Artificial Sequence
  Synthetic oligonucleotide
gcaccgatccccctggctcgtctctcccgcactgc

SEQ ID NO: 106828 - DNA, 35 bp, Artificial Sequence
  Synthetic oligonucleotide
gagaccccacccatgcgatagaccacctcggttcc

SEQ ID NO: 106829 - DNA, 35 bp, Artificial Sequence
  Synthetic oligonucleotide
gtgcccgaacaaatctgccatcctgctacctagcc

SEQ ID NO: 106830 - DNA, 35 bp, Artificial Sequence
  Synthetic oligonucleotide
agtgagagggtagggggggaggcgggggactgggc

SEQ ID NO: 106831 - DNA, 35 bp, Artificial Sequence
  Synthetic oligonucleotide
gtccgaccgttcagccctcgtgtcttccttgcgcc

SEQ ID NO: 106832 - DNA, 35 bp, Artificial Sequence
  Synthetic oligonucleotide
actcaacgcctgtccttgcagcctcctgtccttgc

SEQ ID NO: 106833 - DNA, 35 bp, Artificial Sequence
  Synthetic oligonucleotide
gccgcacttccgcccccgcccactgtcgccctgta

SEQ ID NO: 106834 - DNA, 35 bp, Artificial Sequence
  Synthetic oligonucleotide
gagtctcgcctctctcgccgtgtttcacctctatc

SEQ ID NO: 106835 - DNA, 35 bp, Artificial Sequence
  Synthetic oligonucleotide
ttccgcacatggctcgcttggtctctgcacacctc

SEQ ID NO: 106836 - DNA, 35 bp, Artificial Sequence
  Synthetic oligonucleotide
tgcatatcccccgtgcgctgctttcacccgttcta

SEQ ID NO: 106837 - DNA, 35 bp, Artificial Sequence
  Synthetic oligonucleotide
tattcgcctcccctgacgccttgtatccatcttgt

SEQ ID NO: 106838 - DNA, 35 bp, Artificial Sequence
  Synthetic oligonucleotide
atacccccggtctggccttactatgagctccctct

SEQ ID NO: 106839 - DNA, 36 bp, Artificial Sequence
  Synthetic oligonucleotide
gagtgacggggagggggcggagtgaacgggtggcaa

SEQ ID NO: 106840 - DNA, 36 bp, Artificial Sequence
  Synthetic oligonucleotide
gtccctcacccctcacctgctgtcttagctggccaa

SEQ ID NO: 106841 - DNA, 35 bp, Artificial Sequence
  Synthetic oligonucleotide
gtcccgctactgcctgttgacccttcccctatgca

SEQ ID NO: 106842 - DNA, 35 bp, Artificial Sequence
  Synthetic oligonucleotide
tcgcggttcctcgagttcctgtcctccacgctgcc

SEQ ID NO: 106843 - DNA, 35 bp, Artificial Sequence
  Synthetic oligonucleotide
gcacccacggccctggaccatccgctcacttcgtc

SEQ ID NO: 106844 - DNA, 35 bp, Artificial Sequence
  Synthetic oligonucleotide
gtacgtgcgtcgcctgtcttcacgcctgttctttc

SEQ ID NO: 106845 - DNA, 35 bp, Artificial Sequence
  Synthetic oligonucleotide
gaccccacgcgttccctcgctccttttcgcctgct

SEQ ID NO: 106846 - DNA, 36 bp, Artificial Sequence
  Synthetic oligonucleotide
aaggatagggcgggggaggagggcgtgggagcgaaa

SEQ ID NO: 106847 - DNA, 35 bp, Artificial Sequence
  Synthetic oligonucleotide
tcatatgttccatccagccgcctccatctccggta

SEQ ID NO: 106848 - DNA, 35 bp, Artificial Sequence
  Synthetic oligonucleotide
ggacccgccggtcacacacgcctacatgccgcccc

SEQ ID NO: 106849 - DNA, 35 bp, Artificial Sequence
  Synthetic oligonucleotide
ggtccaccctcaacccccccacgccagttcaccgg

SEQ ID NO: 106850 - DNA, 35 bp, Artificial Sequence
  Synthetic oligonucleotide
tgacgcgacagccttccctttcacttcttgccctg

SEQ ID NO: 106851 - DNA, 35 bp, Artificial Sequence
  Synthetic oligonucleotide
tcccaccccccgttttctaacaccgtgtccgcact

SEQ ID NO: 106852 - DNA, 36 bp, Artificial Sequence
  Synthetic oligonucleotide
tagtacgcccacataatgttctgctccccgattcga

SEQ ID NO: 106853 - DNA, 35 bp, Artificial Sequence
  Synthetic oligonucleotide
accgagcggggcggagtggagggaaggtgtgtgtg

SEQ ID NO: 106854 - DNA, 36 bp, Artificial Sequence
  Synthetic oligonucleotide
tccattctgccctccatctctattcagccacctgga

SEQ ID NO: 106855 - DNA, 35 bp, Artificial Sequence
  Synthetic oligonucleotide
accgacgcctcccatgtccttcctatattccaaac

SEQ ID NO: 106856 - DNA, 35 bp, Artificial Sequence
  Synthetic oligonucleotide
taaagccggaggaagacgagagggaagggtgagcg

SEQ ID NO: 106857 - DNA, 33 bp, Artificial Sequence
  Synthetic oligonucleotide
gtagttcgccccggttttttggtccctttctcg

SEQ ID NO: 106858 - DNA, 37 bp, Artificial Sequence
  Synthetic oligonucleotide
gtgggggaagggaaaaaagggagacacggggatggga

SEQ ID NO: 106859 - DNA, 35 bp, Artificial Sequence
  Synthetic oligonucleotide
tcaacgccccatagcgtgagctcctccctctgcac

SEQ ID NO: 106860 - DNA, 35 bp, Artificial Sequence
  Synthetic oligonucleotide
gattggaagcgcaccagcctgtccgccctgttacc

SEQ ID NO: 106861 - DNA, 35 bp, Artificial Sequence
  Synthetic oligonucleotide
ggtccctcgccccctatttccacgcgctccttgca

SEQ ID NO: 106862 - DNA, 37 bp, Artificial Sequence
  Synthetic oligonucleotide
tacaaccctcacccgactaagcctcgtcccctgctga

SEQ ID NO: 106863 - DNA, 35 bp, Artificial Sequence
  Synthetic oligonucleotide
gtctctgtcgcaatgtcctcgcctcgcctcacccg

SEQ ID NO: 106864 - DNA, 35 bp, Artificial Sequence
  Synthetic oligonucleotide
atcgcataccgccggtcacaccctactgtaccatc

SEQ ID NO: 106865 - DNA, 36 bp, Artificial Sequence
  Synthetic oligonucleotide
gcctccccaccatctgcccagagccttccggtaaca

SEQ ID NO: 106866 - DNA, 35 bp, Artificial Sequence
  Synthetic oligonucleotide
tccccgctcttgccgctgctaccccagtttcttcc

SEQ ID NO: 106867 - DNA, 35 bp, Artificial Sequence
  Synthetic oligonucleotide
gcccccatccttggtacgtgagcccctcccatgat

SEQ ID NO: 106868 - DNA, 35 bp, Artificial Sequence
  Synthetic oligonucleotide
acgtgtggtcccgccctgcctgttattcattccga

SEQ ID NO: 106869 - DNA, 35 bp, Artificial Sequence
  Synthetic oligonucleotide
tcaccccgtgcatgcgagtagcatgtcgttccatc

SEQ ID NO: 106870 - DNA, 35 bp, Artificial Sequence
  Synthetic oligonucleotide
gcccgcccccgcagcacttcctcacgtacatgcct

SEQ ID NO: 106871 - DNA, 36 bp, Artificial Sequence
  Synthetic oligonucleotide
gttccccccctccctgatatcgagtcgtcgatatga

SEQ ID NO: 106872 - DNA, 35 bp, Artificial Sequence
  Synthetic oligonucleotide
tcctcccccactctggtccgcctaggtgcaatcac

SEQ ID NO: 106873 - DNA, 36 bp, Artificial Sequence
  Synthetic oligonucleotide
gcatgcccctgtctatcccgctccatccttctacaa

SEQ ID NO: 106874 - DNA, 35 bp, Artificial Sequence
  Synthetic oligonucleotide
ttccgcctttcaccgtattcgttctgtctcttggc

SEQ ID NO: 106875 - DNA, 37 bp, Artificial Sequence
  Synthetic oligonucleotide
gcatccgaggggagggaagaaaaggagggacgaagga

SEQ ID NO: 106876 - DNA, 35 bp, Artificial Sequence
  Synthetic oligonucleotide
gatgggaagtaggggggtcaagggagccgtggacg

SEQ ID NO: 106877 - DNA, 36 bp, Artificial Sequence
  Synthetic oligonucleotide
agaccgcaccctcgggctttgtacaccaccctccca

SEQ ID NO: 106878 - DNA, 37 bp, Artificial Sequence
  Synthetic oligonucleotide
atcaccccctgccccgtagcatgcgaagtcccctcga

SEQ ID NO: 106879 - DNA, 35 bp, Artificial Sequence
  Synthetic oligonucleotide
tcataagggtgggtgataggggatgtgcgtgtggg

SEQ ID NO: 106880 - DNA, 35 bp, Artificial Sequence
  Synthetic oligonucleotide
tctcactggcgccaaccccgtgctcccgtttctcc

SEQ ID NO: 106881 - DNA, 35 bp, Artificial Sequence
  Synthetic oligonucleotide
gcaccaccgtcgtttccatcttattgcccgtgtcg

SEQ ID NO: 106882 - DNA, 35 bp, Artificial Sequence
  Synthetic oligonucleotide
gtccctcccctcatgccctgattgtctgtatccac

SEQ ID NO: 106883 - DNA, 26 bp, Artificial Sequence
  Synthetic oligonucleotide
aattcgtgaccccgaagcccccatcc

SEQ ID NO: 106884 - DNA, 35 bp, Artificial Sequence
  Synthetic oligonucleotide
tgccccctgtaccgcatttgtttctcgctccatcg

SEQ ID NO: 106885 - DNA, 38 bp, Artificial Sequence
  Synthetic oligonucleotide
tccgtcctgcccccactgaattgattcaagctcgttga

SEQ ID NO: 106886 - DNA, 35 bp, Artificial Sequence
  Synthetic oligonucleotide
gccaccccggatcgacgccagggcctcttcacctc

SEQ ID NO: 106887 - DNA, 35 bp, Artificial Sequence
  Synthetic oligonucleotide
gcaccgccccctctatatggtccatcacacaggtc

SEQ ID NO: 106888 - DNA, 35 bp, Artificial Sequence
  Synthetic oligonucleotide
gtgcgatctcggccgtcacacctgtctcccaagtc

SEQ ID NO: 106889 - DNA, 35 bp, Artificial Sequence
  Synthetic oligonucleotide
ttcgccccggcccctctcgtgcatgtttcacattc

SEQ ID NO: 106890 - DNA, 37 bp, Artificial Sequence
  Synthetic oligonucleotide
tgatgtagttacggaggtggtgggttgggatggagga

SEQ ID NO: 106891 - DNA, 36 bp, Artificial Sequence
  Synthetic oligonucleotide
acggggagaacggtaagggggcggtggaaaagggca

SEQ ID NO: 106892 - DNA, 35 bp, Artificial Sequence
  Synthetic oligonucleotide
gatcattctgtccacatcctgtaccaaccgcactc

SEQ ID NO: 106893 - DNA, 36 bp, Artificial Sequence
  Synthetic oligonucleotide
gccgcctatgcgagcatctactggtcccgccctcca

SEQ ID NO: 106894 - DNA, 37 bp, Artificial Sequence
  Synthetic oligonucleotide
ttacccacgccgttgccctattgcattccccctgcga

SEQ ID NO: 106895 - DNA, 35 bp, Artificial Sequence
  Synthetic oligonucleotide
gcacgaccgttatcgctcccgcttgcatccatcct

SEQ ID NO: 106896 - DNA, 35 bp, Artificial Sequence
  Synthetic oligonucleotide
acgagcccagcgcgcgcccccagctctaccgcacc

SEQ ID NO: 106897 - DNA, 35 bp, Artificial Sequence
  Synthetic oligonucleotide
tgtccacgttcccttggtgtccttcctgcatgtcc

SEQ ID NO: 106898 - DNA, 36 bp, Artificial Sequence
  Synthetic oligonucleotide
gttatccaccgcacgtggcctactccatgttccaca

SEQ ID NO: 106899 - DNA, 35 bp, Artificial Sequence
  Synthetic oligonucleotide
ggacgcaccgctcgcaccttctgctttgacccgcc

SEQ ID NO: 106900 - DNA, 35 bp, Artificial Sequence
  Synthetic oligonucleotide
ggtcgccctgctcccccgcgccgccccttacgcct

SEQ ID NO: 106901 - DNA, 35 bp, Artificial Sequence
  Synthetic oligonucleotide
tgctacccatcatgcccctttgttaccgcacatac

SEQ ID NO: 106902 - DNA, 34 bp, Artificial Sequence
  Synthetic oligonucleotide
tatccgcccgactttgacgctgtttgttcactcc

SEQ ID NO: 106903 - DNA, 35 bp, Artificial Sequence
  Synthetic oligonucleotide
agcccgcccgcctactgccttccgtgatctgccga

SEQ ID NO: 106904 - DNA, 35 bp, Artificial Sequence
  Synthetic oligonucleotide
tgagcgacctgcccgccgcgcctgccccggacctc

SEQ ID NO: 106905 - DNA, 36 bp, Artificial Sequence
  Synthetic oligonucleotide
gtggcctcaatggtcttctgcccgtctcttccctca

SEQ ID NO: 106906 - DNA, 35 bp, Artificial Sequence
  Synthetic oligonucleotide
atgcgcaaccctatctggtttgagcccgtaccccc

SEQ ID NO: 106907 - DNA, 35 bp, Artificial Sequence
  Synthetic oligonucleotide
agccgccgacgcctatcagtccacgtctcttcgcc

SEQ ID NO: 106908 - DNA, 35 bp, Artificial Sequence
  Synthetic oligonucleotide
tcgactccccgcatctcgacccgttttcaccctcg

SEQ ID NO: 106909 - DNA, 35 bp, Artificial Sequence
  Synthetic oligonucleotide
gcgtgacctcccgtgcgtacttactcttcttcagc

SEQ ID NO: 106910 - DNA, 37 bp, Artificial Sequence
  Synthetic oligonucleotide
aaagacagggtggacgcaggggggaagaggaatggga

SEQ ID NO: 106911 - DNA, 36 bp, Artificial Sequence
  Synthetic oligonucleotide
tacccctccaccgatgtctccgctactgtgttccga

SEQ ID NO: 106912 - DNA, 36 bp, Artificial Sequence
  Synthetic oligonucleotide
tgccctccccacatgtcgcgtatccatcccacataa

SEQ ID NO: 106913 - DNA, 35 bp, Artificial Sequence
  Synthetic oligonucleotide
tcgccccttcgccctctcgattgcaatgaccccct

SEQ ID NO: 106914 - DNA, 36 bp, Artificial Sequence
  Synthetic oligonucleotide
acgaccccactccgcttttgtagctcccccctgaga

SEQ ID NO: 106915 - DNA, 35 bp, Artificial Sequence
  Synthetic oligonucleotide
tgcatcaccgcatagccgtgcctcactccaactac

SEQ ID NO: 106916 - DNA, 35 bp, Artificial Sequence
  Synthetic oligonucleotide
accctgtcccattgcctcaccagctgggttgcccc

SEQ ID NO: 106917 - DNA, 35 bp, Artificial Sequence
  Synthetic oligonucleotide
tcacccccgaccgcgtcttcgtagcgcaccctcct

SEQ ID NO: 106918 - DNA, 35 bp, Artificial Sequence
  Synthetic oligonucleotide
gatatgcctccggttctcgtactcgctctgtaaca

SEQ ID NO: 106919 - DNA, 37 bp, Artificial Sequence
  Synthetic oligonucleotide
tccatcaccgttccggtacccctgttcaatccactga

SEQ ID NO: 106920 - DNA, 36 bp, Artificial Sequence
  Synthetic oligonucleotide
actcgggcacccctcgcttgtctccctttcggttca

SEQ ID NO: 106921 - DNA, 35 bp, Artificial Sequence
  Synthetic oligonucleotide
agacaatgtcctcgctgctagctactactctcctt

SEQ ID NO: 106922 - DNA, 35 bp, Artificial Sequence
  Synthetic oligonucleotide
tctatgcccccccgtgagcgtgctcctcccctgaa

SEQ ID NO: 106923 - DNA, 35 bp, Artificial Sequence
  Synthetic oligonucleotide
tctaggccctcctccgctgtctcccgctaggacct

SEQ ID NO: 106924 - DNA, 36 bp, Artificial Sequence
  Synthetic oligonucleotide
gagagaccaggggaaaagtaggggacggggtggcga

SEQ ID NO: 106925 - DNA, 35 bp, Artificial Sequence
  Synthetic oligonucleotide
agaccacgccccttttgtctttatcaatacgcctc

SEQ ID NO: 106926 - DNA, 35 bp, Artificial Sequence
  Synthetic oligonucleotide
agccacccccttcgtccctgatccattgcccgctc

SEQ ID NO: 106927 - DNA, 35 bp, Artificial Sequence
  Synthetic oligonucleotide
atgcccacccgtttgctagtttcctgtacgcctta

SEQ ID NO: 106928 - DNA, 36 bp, Artificial Sequence
  Synthetic oligonucleotide
gacgacaccttgcgtattacctccagttcactcgcc

SEQ ID NO: 106929 - DNA, 34 bp, Artificial Sequence
  Synthetic oligonucleotide
gacacagccttatagcgcccaccctccttgctgc

SEQ ID NO: 106930 - DNA, 35 bp, Artificial Sequence
  Synthetic oligonucleotide
tgttcgccccccggtctatttccacgttccgttgc

SEQ ID NO: 106931 - DNA, 35 bp, Artificial Sequence
  Synthetic oligonucleotide
gagtacccagtccgttttttgcacgctccatcctt

SEQ ID NO: 106932 - DNA, 35 bp, Artificial Sequence
  Synthetic oligonucleotide
gacgccaacccgctccttgctacgatttccagttc

SEQ ID NO: 106933 - DNA, 35 bp, Artificial Sequence
  Synthetic oligonucleotide
tggaggggaacacgagggggtacgatagggatggg

SEQ ID NO: 106934 - DNA, 35 bp, Artificial Sequence
  Synthetic oligonucleotide
tgatgacgcagcccacttaagtcctgtagccctct

SEQ ID NO: 106935 - DNA, 35 bp, Artificial Sequence
  Synthetic oligonucleotide
accgacctcacatacgctgttaccccgttctttac

SEQ ID NO: 106936 - DNA, 28 bp, Artificial Sequence
  Synthetic oligonucleotide
acaacatgcctccgtaactcgccatcac

SEQ ID NO: 106937 - DNA, 35 bp, Artificial Sequence
  Synthetic oligonucleotide
acactcctcctattgtctcatgcgtacttcccgcc

SEQ ID NO: 106938 - DNA, 35 bp, Artificial Sequence
  Synthetic oligonucleotide
acgccccccagcccgaccacatgccctctaacgtg

SEQ ID NO: 106939 - DNA, 35 bp, Artificial Sequence
  Synthetic oligonucleotide
tcgatatgcctcactctctcgcgtcctgcccgcca

SEQ ID NO: 106940 - DNA, 35 bp, Artificial Sequence
  Synthetic oligonucleotide
gccggcccaccgaccaccgtttatgcccctgtgcc

SEQ ID NO: 106941 - DNA, 35 bp, Artificial Sequence
  Synthetic oligonucleotide
gcctcccccacctcattggattcgctgtctcgccc

SEQ ID NO: 106942 - DNA, 36 bp, Artificial Sequence
  Synthetic oligonucleotide
gaatgcaaacttcacgtcgcgctgcctccacctgca

SEQ ID NO: 106943 - DNA, 35 bp, Artificial Sequence
  Synthetic oligonucleotide
gacccctcggttcctgtatcacccttctcggacct

SEQ ID NO: 106944 - DNA, 36 bp, Artificial Sequence
  Synthetic oligonucleotide
gtggggtgggtgggggtagcaatggggatcttttaa

SEQ ID NO: 106945 - DNA, 36 bp, Artificial Sequence
  Synthetic oligonucleotide
aaacaccgccgcttatctgttcactccctttagcga

SEQ ID NO: 106946 - DNA, 35 bp, Artificial Sequence
  Synthetic oligonucleotide
gctgcgtattgagcctgttccccctcctgcccgcc

SEQ ID NO: 106947 - DNA, 38 bp, Artificial Sequence
  Synthetic oligonucleotide
gtcatcttggcggtggagggaagggttggtacaggtga

SEQ ID NO: 106948 - DNA, 35 bp, Artificial Sequence
  Synthetic oligonucleotide
tgtatccacatccgcatttagtatctgtttcatcc

SEQ ID NO: 106949 - DNA, 35 bp, Artificial Sequence
  Synthetic oligonucleotide
atgagcgcccgaacggtcctcgatactaccccctg

SEQ ID NO: 106950 - DNA, 35 bp, Artificial Sequence
  Synthetic oligonucleotide
atcctctgcccccgattgagcgtattcctcactgc

SEQ ID NO: 106951 - DNA, 38 bp, Artificial Sequence
  Synthetic oligonucleotide
gttcccgcccctatccctgtaacttcagtcttgcatga

SEQ ID NO: 106952 - DNA, 35 bp, Artificial Sequence
  Synthetic oligonucleotide
tcccccgcttgttttctcggtcctccgcattagcg

SEQ ID NO: 106953 - DNA, 35 bp, Artificial Sequence
  Synthetic oligonucleotide
accctaccttgcgcactgcattagctccattcctc

SEQ ID NO: 106954 - DNA, 35 bp, Artificial Sequence
  Synthetic oligonucleotide
accccaccctcgcatcggtgacgagtcgactcgcc

SEQ ID NO: 106955 - DNA, 35 bp, Artificial Sequence
  Synthetic oligonucleotide
gtgcaggcccgcaccgcctcccgtgcctacatcgc

SEQ ID NO: 106956 - DNA, 35 bp, Artificial Sequence
  Synthetic oligonucleotide
tctcgtcaccgcccgcgctctccccgttactgcat

SEQ ID NO: 106957 - DNA, 35 bp, Artificial Sequence
  Synthetic oligonucleotide
aacgctcccgcctctgtcttacggacctcggttcc

SEQ ID NO: 106958 - DNA, 35 bp, Artificial Sequence
  Synthetic oligonucleotide
gatgtgccgtacttttgcctgctctcctgttctcg

SEQ ID NO: 106959 - DNA, 35 bp, Artificial Sequence
  Synthetic oligonucleotide
tgactagcgcacatgctcctatgctgatccccccc

SEQ ID NO: 106960 - DNA, 34 bp, Artificial Sequence
  Synthetic oligonucleotide
acgttgcctccagcccgctgcactagccttctcc

SEQ ID NO: 106961 - DNA, 37 bp, Artificial Sequence
  Synthetic oligonucleotide
accacctacctcgaactgcccatgtcgtctctaacga

SEQ ID NO: 106962 - DNA, 35 bp, Artificial Sequence
  Synthetic oligonucleotide
ttgcccccgatctccgagcctccgcttctaacgcc

SEQ ID NO: 106963 - DNA, 37 bp, Artificial Sequence
  Synthetic oligonucleotide
ggacaggaggcaaggacgggacgaaaaatagggcaga

SEQ ID NO: 106964 - DNA, 37 bp, Artificial Sequence
  Synthetic oligonucleotide
acccaccccccgccaccttgagtatatcacgtgttga

SEQ ID NO: 106965 - DNA, 37 bp, Artificial Sequence
  Synthetic oligonucleotide
gttgagggcggggtgggctagctcgtcgtcccgggga

SEQ ID NO: 106966 - DNA, 35 bp, Artificial Sequence
  Synthetic oligonucleotide
ttccgtgccaacgctcgatgaccttcgtgcccttc

SEQ ID NO: 106967 - DNA, 35 bp, Artificial Sequence
  Synthetic oligonucleotide
atggccgtacagttttttcgcgccatgtccctccc

SEQ ID NO: 106968 - DNA, 36 bp, Artificial Sequence
  Synthetic oligonucleotide
gttgtcgcagccgatctgcccttctcgttccatcaa

SEQ ID NO: 106969 - DNA, 35 bp, Artificial Sequence
  Synthetic oligonucleotide
atgctggccctatcgccgcgtccaccgacctccct

SEQ ID NO: 106970 - DNA, 35 bp, Artificial Sequence
  Synthetic oligonucleotide
gagccacccccgttacccgactcgctgttcgctcg

SEQ ID NO: 106971 - DNA, 35 bp, Artificial Sequence
  Synthetic oligonucleotide
tcagcattctcgcctgccatactgtccttaccatc

SEQ ID NO: 106972 - DNA, 35 bp, Artificial Sequence
  Synthetic oligonucleotide
gcaacacattcgcctgtcctcaccgactccgcctg

SEQ ID NO: 106973 - DNA, 35 bp, Artificial Sequence
  Synthetic oligonucleotide
tgctccccctgctgactcttatctgtgtccatccc

SEQ ID NO: 106974 - DNA, 35 bp, Artificial Sequence
  Synthetic oligonucleotide
ttcggatcgccgtcctccatgcctcagccctgttc

SEQ ID NO: 106975 - DNA, 35 bp, Artificial Sequence
  Synthetic oligonucleotide
tcgcattgcccacgctttccttctgagttcctctg

SEQ ID NO: 106976 - DNA, 36 bp, Artificial Sequence
  Synthetic oligonucleotide
acacaaccacctccattgccttccgacagtgcgaaa

SEQ ID NO: 106977 - DNA, 35 bp, Artificial Sequence
  Synthetic oligonucleotide
gtggggggggaacatgagcggaagtagaggggaca

SEQ ID NO: 106978 - DNA, 31 bp, Artificial Sequence
  Synthetic oligonucleotide
gttgccccggagccacgcgatacacattcct

SEQ ID NO: 106979 - DNA, 35 bp, Artificial Sequence
  Synthetic oligonucleotide
gcccgcaacgccctgctccaacccgctagcatttc

SEQ ID NO: 106980 - DNA, 37 bp, Artificial Sequence
  Synthetic oligonucleotide
ttttcatccgccctttgcctatcgggtccaactccga

SEQ ID NO: 106981 - DNA, 37 bp, Artificial Sequence
  Synthetic oligonucleotide
gttagagggcgggtaggcagggggacgagggagggga

SEQ ID NO: 106982 - DNA, 37 bp, Artificial Sequence
  Synthetic oligonucleotide
gtcgccctcctcgccctgtcatgcccccgctctgcga

SEQ ID NO: 106983 - DNA, 35 bp, Artificial Sequence
  Synthetic oligonucleotide
gggacgggataaagggagggcaaggaaggcacgcg

SEQ ID NO: 106984 - DNA, 34 bp, Artificial Sequence
  Synthetic oligonucleotide
tccgctccactggccactgttatcatccgcttat

SEQ ID NO: 106985 - DNA, 35 bp, Artificial Sequence
  Synthetic oligonucleotide
atggtccgcgccccagtcatgatctcgcgccctcc

SEQ ID NO: 106986 - DNA, 38 bp, Artificial Sequence
  Synthetic oligonucleotide
tcagcatactgtccgtcctgcttatgcgccttccctga

SEQ ID NO: 106987 - DNA, 35 bp, Artificial Sequence
  Synthetic oligonucleotide
gtcaccacagctgcaccctctacgcaatcttcgcc

SEQ ID NO: 106988 - DNA, 35 bp, Artificial Sequence
  Synthetic oligonucleotide
ttgaccgccacttccgactcccgtattcatccgtt

SEQ ID NO: 106989 - DNA, 35 bp, Artificial Sequence
  Synthetic oligonucleotide
tagacaccaccagttctccccttatccgctcctct

SEQ ID NO: 106990 - DNA, 35 bp, Artificial Sequence
  Synthetic oligonucleotide
gagccccgccagcggttcgtcacacctacgtctcc

SEQ ID NO: 106991 - DNA, 35 bp, Artificial Sequence
  Synthetic oligonucleotide
atcgcaccgccggtcatccgttttactttatcctc

SEQ ID NO: 106992 - DNA, 35 bp, Artificial Sequence
  Synthetic oligonucleotide
gacacgcctcacatccgtggcacacccccattcgc

SEQ ID NO: 106993 - DNA, 35 bp, Artificial Sequence
  Synthetic oligonucleotide
agcacggtctgggggcggaaggaatggaggggcga

SEQ ID NO: 106994 - DNA, 36 bp, Artificial Sequence
  Synthetic oligonucleotide
acacgccatccgtttccgcgccattcacccgctgta

SEQ ID NO: 106995 - DNA, 35 bp, Artificial Sequence
  Synthetic oligonucleotide
gccacccccaaattgtactatccgccggtgcgata

SEQ ID NO: 106996 - DNA, 35 bp, Artificial Sequence
  Synthetic oligonucleotide
acacaccgcatgtgtctcgtctctatcacacggcc

SEQ ID NO: 106997 - DNA, 35 bp, Artificial Sequence
  Synthetic oligonucleotide
tccccgtccagccctctaggagtaactcgccaccc

SEQ ID NO: 106998 - DNA, 35 bp, Artificial Sequence
  Synthetic oligonucleotide
tcacgtgcaaaaaggggaaagggagggcttagggg

SEQ ID NO: 106999 - DNA, 35 bp, Artificial Sequence
  Synthetic oligonucleotide
gattagcctccatcggtctacttgtcctcattcct

SEQ ID NO: 107000 - DNA, 35 bp, Artificial Sequence
  Synthetic oligonucleotide
gcaccctctgctgcctttttctacatctgattcaa

SEQ ID NO: 107001 - DNA, 35 bp, Artificial Sequence
  Synthetic oligonucleotide
tgaacccccgccctatgatttattttgccgatatc

SEQ ID NO: 107002 - DNA, 35 bp, Artificial Sequence
  Synthetic oligonucleotide
tgtgccgatcttcgttctgtccatccttgctatgc

SEQ ID NO: 107003 - DNA, 35 bp, Artificial Sequence
  Synthetic oligonucleotide
accctcccccgtaatatctggtcttcattgccctg

SEQ ID NO: 107004 - DNA, 35 bp, Artificial Sequence
  Synthetic oligonucleotide
tgacacctacctgcgttccttgttcgttcccaccg

SEQ ID NO: 107005 - DNA, 35 bp, Artificial Sequence
  Synthetic oligonucleotide
tacaccggggcggaggaggggggccatgtggagga

SEQ ID NO: 107006 - DNA, 35 bp, Artificial Sequence
  Synthetic oligonucleotide
gccccccccccatctgtcctttggaatggttagcc

SEQ ID NO: 107007 - DNA, 35 bp, Artificial Sequence
  Synthetic oligonucleotide
ttactcgccccccgatccctttacgtgacatacca

SEQ ID NO: 107008 - DNA, 35 bp, Artificial Sequence
  Synthetic oligonucleotide
acgcctgcacgtatgtcacgtcactcgttccaccc

SEQ ID NO: 107009 - DNA, 35 bp, Artificial Sequence
  Synthetic oligonucleotide
tcacaaccgccaatttcagtccttcgcgtactcgc

SEQ ID NO: 107010 - DNA, 34 bp, Artificial Sequence
  Synthetic oligonucleotide
gtcccctgcccccgtagttgcttctgcgacttca

SEQ ID NO: 107011 - DNA, 35 bp, Artificial Sequence
  Synthetic oligonucleotide
atctccagacgtacgcccctgccccacactttgcc

SEQ ID NO: 107012 - DNA, 35 bp, Artificial Sequence
  Synthetic oligonucleotide
tccgtcactcgatgccgccgctgtttcgccctact

SEQ ID NO: 107013 - DNA, 38 bp, Artificial Sequence
  Synthetic oligonucleotide
tcactgcgcctgctactccatcgccgttactccgctga

SEQ ID NO: 107014 - DNA, 37 bp, Artificial Sequence
  Synthetic oligonucleotide
gcactccccaggctgtaccaccgtattcctccacgga

SEQ ID NO: 107015 - DNA, 35 bp, Artificial Sequence
  Synthetic oligonucleotide
tcccgcccccttcccctgcctactttagcccccgg

SEQ ID NO: 107016 - DNA, 35 bp, Artificial Sequence
  Synthetic oligonucleotide
tcatcagcccgctcccgacaggctccctcctccac

SEQ ID NO: 107017 - DNA, 35 bp, Artificial Sequence
  Synthetic oligonucleotide
acgccccgcactaccttctatagtcaccactttag

SEQ ID NO: 107018 - DNA, 35 bp, Artificial Sequence
  Synthetic oligonucleotide
acgaacattcgcacctcttattcggaacaccttgc

SEQ ID NO: 107019 - DNA, 35 bp, Artificial Sequence
  Synthetic oligonucleotide
acctcgtccggctctccttcctgcttcgtatcaat

SEQ ID NO: 107020 - DNA, 37 bp, Artificial Sequence
  Synthetic oligonucleotide
accactgtcccgtagttgatccactgcccccccttga

SEQ ID NO: 107021 - DNA, 35 bp, Artificial Sequence
  Synthetic oligonucleotide
tagctggggcaaggggggaagagggagaagacaga

SEQ ID NO: 107022 - DNA, 35 bp, Artificial Sequence
  Synthetic oligonucleotide
gtgccactgccgttttcccttggttcttgttcctc

SEQ ID NO: 107023 - DNA, 36 bp, Artificial Sequence
  Synthetic oligonucleotide
gcaccactgccgcccgactttcgcgccttacctgta

SEQ ID NO: 107024 - DNA, 35 bp, Artificial Sequence
  Synthetic oligonucleotide
gtaccgtcacacgccgtttacgccccccgtcgcct

SEQ ID NO: 107025 - DNA, 35 bp, Artificial Sequence
  Synthetic oligonucleotide
gcaacatcttctcgtcccgccggtccaatcaactg

SEQ ID NO: 107026 - DNA, 35 bp, Artificial Sequence
  Synthetic oligonucleotide
ggaccgcacgcccattgaccgacccttcactttgc

SEQ ID NO: 107027 - DNA, 35 bp, Artificial Sequence
  Synthetic oligonucleotide
gccctcaccgtcctctcgtctgactatccggtacc

SEQ ID NO: 107028 - DNA, 35 bp, Artificial Sequence
  Synthetic oligonucleotide
gacccgccccctccgtttggtgtctcttatgccct

SEQ ID NO: 107029 - DNA, 35 bp, Artificial Sequence
  Synthetic oligonucleotide
actcatctccacctcacgttacgcccaccctggcg

SEQ ID NO: 107030 - DNA, 35 bp, Artificial Sequence
  Synthetic oligonucleotide
gctacctccggctgtccatttcgtcgctccttctg

SEQ ID NO: 107031 - DNA, 35 bp, Artificial Sequence
  Synthetic oligonucleotide
tactcctcgggacccccgccttgccctaacgtacg

SEQ ID NO: 107032 - DNA, 35 bp, Artificial Sequence
  Synthetic oligonucleotide
atcaccaaccctcccatcccgttaaggacccagta

SEQ ID NO: 107033 - DNA, 35 bp, Artificial Sequence
  Synthetic oligonucleotide
gagctcaatccgtcatggccctgttctatcgcctc

SEQ ID NO: 107034 - DNA, 37 bp, Artificial Sequence
  Synthetic oligonucleotide
gtactgacggaagggggggcgtgcacggggtggagga

SEQ ID NO: 107035 - DNA, 37 bp, Artificial Sequence
  Synthetic oligonucleotide
atccgggaggcaggaggggacggaggtaggccccgga

SEQ ID NO: 107036 - DNA, 35 bp, Artificial Sequence
  Synthetic oligonucleotide
gccactcacgactattgctctcactgcctaaccgc

SEQ ID NO: 107037 - DNA, 35 bp, Artificial Sequence
  Synthetic oligonucleotide
taacctcctcacttgtttcttcctgtctggcactc

SEQ ID NO: 107038 - DNA, 37 bp, Artificial Sequence
  Synthetic oligonucleotide
gcccactcccattgtaacggttcactctcatacctga

SEQ ID NO: 107039 - DNA, 35 bp, Artificial Sequence
  Synthetic oligonucleotide
gttggcccatgcctaaatgcctattgtcgcccttc

SEQ ID NO: 107040 - DNA, 35 bp, Artificial Sequence
  Synthetic oligonucleotide
gtctccccccgcaatgcgtaacatgctcgtccccc

SEQ ID NO: 107041 - DNA, 36 bp, Artificial Sequence
  Synthetic oligonucleotide
gtcgcagggggcagggggggaaaacggggcctcaaa

SEQ ID NO: 107042 - DNA, 35 bp, Artificial Sequence
  Synthetic oligonucleotide
atgatcagccgcttacatgcccaccgtctctagcc

SEQ ID NO: 107043 - DNA, 35 bp, Artificial Sequence
  Synthetic oligonucleotide
tgaagccgctgtccaccattctgtcttattctgtc

SEQ ID NO: 107044 - DNA, 35 bp, Artificial Sequence
  Synthetic oligonucleotide
actgcctcctctgccgttttatgaccacttcctga

SEQ ID NO: 107045 - DNA, 36 bp, Artificial Sequence
  Synthetic oligonucleotide
gagggaggaacatagatgggaagggtggcggggtta

SEQ ID NO: 107046 - DNA, 35 bp, Artificial Sequence
  Synthetic oligonucleotide
tgtgcactgcctcgctcctctgtctctgtccaggc

SEQ ID NO: 107047 - DNA, 37 bp, Artificial Sequence
  Synthetic oligonucleotide
acgccatgccccctgatccctccttggccacacacga

SEQ ID NO: 107048 - DNA, 35 bp, Artificial Sequence
  Synthetic oligonucleotide
gtccccaccgtcttacggttatattgttccctggt

SEQ ID NO: 107049 - DNA, 35 bp, Artificial Sequence
  Synthetic oligonucleotide
gtatccccctgccgttttacccgtatcgtgccctt

SEQ ID NO: 107050 - DNA, 35 bp, Artificial Sequence
  Synthetic oligonucleotide
tccatctgccgctccatctggttttaatgcctcat

SEQ ID NO: 107051 - DNA, 35 bp, Artificial Sequence
  Synthetic oligonucleotide
accctgccaccgcaatatgacatacctcgcacatc

SEQ ID NO: 107052 - DNA, 38 bp, Artificial Sequence
  Synthetic oligonucleotide
aacatcgccctgcctgcttctactggaccccgccctga

SEQ ID NO: 107053 - DNA, 35 bp, Artificial Sequence
  Synthetic oligonucleotide
gtcatcctcacactacactggcctcatcttgcgct

SEQ ID NO: 107054 - DNA, 35 bp, Artificial Sequence
  Synthetic oligonucleotide
tcagtgcttcctggttgcgccctagtccattcccc

SEQ ID NO: 107055 - DNA, 34 bp, Artificial Sequence
  Synthetic oligonucleotide
gtccccccactatgccttgaatcagcctaattgc

SEQ ID NO: 107056 - DNA, 37 bp, Artificial Sequence
  Synthetic oligonucleotide
ttgcatccctccttcgctatgccctcctctccgtgga

SEQ ID NO: 107057 - DNA, 36 bp, Artificial Sequence
  Synthetic oligonucleotide
acccgctccatttcaacccggatactgccctcgtta

SEQ ID NO: 107058 - DNA, 35 bp, Artificial Sequence
  Synthetic oligonucleotide
ttgtactccgcccttatttcttgttgtcccatcac

SEQ ID NO: 107059 - DNA, 35 bp, Artificial Sequence
  Synthetic oligonucleotide
atcctagcgcatgcagccttttacgcccacccacc

SEQ ID NO: 107060 - DNA, 35 bp, Artificial Sequence
  Synthetic oligonucleotide
gacgctgacctctgcggcatttcttcttgctcctc

SEQ ID NO: 107061 - DNA, 35 bp, Artificial Sequence
  Synthetic oligonucleotide
gtcccccacgcactccctgtacacattcgtgtaac

SEQ ID NO: 107062 - DNA, 35 bp, Artificial Sequence
  Synthetic oligonucleotide
tcccgctcgcctagctgaattctccggtcccctgt

SEQ ID NO: 107063 - DNA, 35 bp, Artificial Sequence
  Synthetic oligonucleotide
tctcggtcggatccacgttgcgctccatctttacc

SEQ ID NO: 107064 - DNA, 35 bp, Artificial Sequence
  Synthetic oligonucleotide
acacaccaccctcctcaaatgtattatgcttcccg

SEQ ID NO: 107065 - DNA, 35 bp, Artificial Sequence
  Synthetic oligonucleotide
tggagggtgggcggggtacatagggtttacggttt

SEQ ID NO: 107066 - DNA, 34 bp, Artificial Sequence
  Synthetic oligonucleotide
actgtgcccgcgtgctcctgtctccgccgtatcc

SEQ ID NO: 107067 - DNA, 34 bp, Artificial Sequence
  Synthetic oligonucleotide
ttagcccacccctgtcgtgctgtcactgcattct

SEQ ID NO: 107068 - DNA, 35 bp, Artificial Sequence
  Synthetic oligonucleotide
gcccgcaactgtcctgtcacacgcttcctttgctc

SEQ ID NO: 107069 - DNA, 35 bp, Artificial Sequence
  Synthetic oligonucleotide
ttacctcagcgctccaccatggtccgtctttcccg

SEQ ID NO: 107070 - DNA, 35 bp, Artificial Sequence
  Synthetic oligonucleotide
gtgggagggagggggattgcggggagatcgaggta

SEQ ID NO: 107071 - DNA, 35 bp, Artificial Sequence
  Synthetic oligonucleotide
gcgcaagtcacgcggtcttcctgtcatcccccatt

SEQ ID NO: 107072 - DNA, 35 bp, Artificial Sequence
  Synthetic oligonucleotide
gatcccctcagcccaaccgtccattggtgcccccc

SEQ ID NO: 107073 - DNA, 35 bp, Artificial Sequence
  Synthetic oligonucleotide
agccccgccctttgcttcatttcgccctgattggc

SEQ ID NO: 107074 - DNA, 35 bp, Artificial Sequence
  Synthetic oligonucleotide
gtaaccacgccctttccgtatgccaccatagccct

SEQ ID NO: 107075 - DNA, 35 bp, Artificial Sequence
  Synthetic oligonucleotide
ttacatcgccctcaccatgctcaccgttcctgatc

SEQ ID NO: 107076 - DNA, 36 bp, Artificial Sequence
  Synthetic oligonucleotide
gacggggatcacggggagggaggggagggtttgcta

SEQ ID NO: 107077 - DNA, 35 bp, Artificial Sequence
  Synthetic oligonucleotide
tacccagccatccaattttgtccgccggctatacc

SEQ ID NO: 107078 - DNA, 35 bp, Artificial Sequence
  Synthetic oligonucleotide
accccactgttgccgttaccgattctccttccttg

SEQ ID NO: 107079 - DNA, 35 bp, Artificial Sequence
  Synthetic oligonucleotide
tccctaccccgcgcatattcgttgctactagcccc

SEQ ID NO: 107080 - DNA, 36 bp, Artificial Sequence
  Synthetic oligonucleotide
gtcgcaaccgcctcttggtccagctcctacccacga

SEQ ID NO: 107081 - DNA, 33 bp, Artificial Sequence
  Synthetic oligonucleotide
tcgaacaggaccgcctgacctcatccctcctca

SEQ ID NO: 107082 - DNA, 35 bp, Artificial Sequence
  Synthetic oligonucleotide
gcaccccttgttgttgtcctcaccgacccccatcc

SEQ ID NO: 107083 - DNA, 35 bp, Artificial Sequence
  Synthetic oligonucleotide
gttgactccccgccgtatccgttgctcatctttag

SEQ ID NO: 107084 - DNA, 35 bp, Artificial Sequence
  Synthetic oligonucleotide
gcccttgtcagcatccccctgcgcgaacctacctg

SEQ ID NO: 107085 - DNA, 38 bp, Artificial Sequence
  Synthetic oligonucleotide
tcactgccccccgagtgccttactgatatttcccttga

SEQ ID NO: 107086 - DNA, 35 bp, Artificial Sequence
  Synthetic oligonucleotide
gcgatcgaaccatctcagcgccgccctgtcccttg

SEQ ID NO: 107087 - DNA, 38 bp, Artificial Sequence
  Synthetic oligonucleotide
tccacagccggcggagaaaggaaggagggcgggggtga

SEQ ID NO: 107088 - DNA, 35 bp, Artificial Sequence
  Synthetic oligonucleotide
ttcctcacccgccgataccatgaacccgctttgca

SEQ ID NO: 107089 - DNA, 36 bp, Artificial Sequence
  Synthetic oligonucleotide
agaccccaccccctgcccggtattggtcaaccctga

SEQ ID NO: 107090 - DNA, 37 bp, Artificial Sequence
  Synthetic oligonucleotide
gttccctctccgaactgccttccacatcgttctacga

SEQ ID NO: 107091 - DNA, 35 bp, Artificial Sequence
  Synthetic oligonucleotide
tgtccacccctgcctctccgctgactacagttggc

SEQ ID NO: 107092 - DNA, 35 bp, Artificial Sequence
  Synthetic oligonucleotide
atcgcccaccacctccggacgttcgcctaatttcc

SEQ ID NO: 107093 - DNA, 35 bp, Artificial Sequence
  Synthetic oligonucleotide
gacgctgatcgtgttattcagtccttcccgccctc

SEQ ID NO: 107094 - DNA, 35 bp, Artificial Sequence
  Synthetic oligonucleotide
tcgacacccactcttcccgcactccgctttacggt

SEQ ID NO: 107095 - DNA, 35 bp, Artificial Sequence
  Synthetic oligonucleotide
gaatgcaaagaagggacgggggataggggcatgta

SEQ ID NO: 107096 - DNA, 35 bp, Artificial Sequence
  Synthetic oligonucleotide
acatcgtactccctgtgccgtatctgccttcccct

SEQ ID NO: 107097 - DNA, 35 bp, Artificial Sequence
  Synthetic oligonucleotide
gcgccacgcagttaggtcccttttgcccgcccgct

SEQ ID NO: 107098 - DNA, 35 bp, Artificial Sequence
  Synthetic oligonucleotide
tcactcagaccacatgccattccctccagccttgc

SEQ ID NO: 107099 - DNA, 35 bp, Artificial Sequence
  Synthetic oligonucleotide
gcaccacacctcaagccggtcgccgtttcactcta

SEQ ID NO: 107100 - DNA, 35 bp, Artificial Sequence
  Synthetic oligonucleotide
aaccaggcctcacgctgccgtcccaagcccagccc

SEQ ID NO: 107101 - DNA, 35 bp, Artificial Sequence
  Synthetic oligonucleotide
tgtgcgccctcacctctggttcaccgtgtctccca

SEQ ID NO: 107102 - DNA, 35 bp, Artificial Sequence
  Synthetic oligonucleotide
gtcccctccgactctgccccaaggacccacttacg

SEQ ID NO: 107103 - DNA, 38 bp, Artificial Sequence
  Synthetic oligonucleotide
tatacggaggtggtggggtaggtggagggttgaactga

SEQ ID NO: 107104 - DNA, 35 bp, Artificial Sequence
  Synthetic oligonucleotide
tttgatcaccgcacctatcaccgccctgctatggc

SEQ ID NO: 107105 - DNA, 35 bp, Artificial Sequence
  Synthetic oligonucleotide
atgttgccaccttgcagcattgagccattcccctt

SEQ ID NO: 107106 - DNA, 36 bp, Artificial Sequence
  Synthetic oligonucleotide
agcaccactgcctcctctgctattgcctttgcccaa

SEQ ID NO: 107107 - DNA, 36 bp, Artificial Sequence
  Synthetic oligonucleotide
ttatccgccccctgtacttgttgttgtcgtgactga

SEQ ID NO: 107108 - DNA, 38 bp, Artificial Sequence
  Synthetic oligonucleotide
ttgtaccgccatcatcctcgcccttcactggtccgtga

SEQ ID NO: 107109 - DNA, 37 bp, Artificial Sequence
  Synthetic oligonucleotide
tcacagctcgctacccgccgcccgcccttataccgga

SEQ ID NO: 107110 - DNA, 35 bp, Artificial Sequence
  Synthetic oligonucleotide
tgcctcctcgcttcgggcctgctacaaccgcctcc

SEQ ID NO: 107111 - DNA, 35 bp, Artificial Sequence
  Synthetic oligonucleotide
accgccccgagctgttataccgcgattcctactct

SEQ ID NO: 107112 - DNA, 35 bp, Artificial Sequence
  Synthetic oligonucleotide
ttcacatgctccgtgctgttctcttccctgctccc

SEQ ID NO: 107113 - DNA, 35 bp, Artificial Sequence
  Synthetic oligonucleotide
acgcccccctctaatgctaccagctgctgccatcg

SEQ ID NO: 107114 - DNA, 35 bp, Artificial Sequence
  Synthetic oligonucleotide
gtcctcgcctcatccgattactgtcgttgccacca

SEQ ID NO: 107115 - DNA, 35 bp, Artificial Sequence
  Synthetic oligonucleotide
gcccatcccatgtactcccgcctcaagccgaaacc

SEQ ID NO: 107116 - DNA, 35 bp, Artificial Sequence
  Synthetic oligonucleotide
acgacacacggcttgtctccatcgtgcccactttc

SEQ ID NO: 107117 - DNA, 36 bp, Artificial Sequence
  Synthetic oligonucleotide
agccacacgctatccgttcatgcccgtctcctgcca

SEQ ID NO: 107118 - DNA, 35 bp, Artificial Sequence
  Synthetic oligonucleotide
gagccccagcccaccccgtgcgttttcgccatgat

SEQ ID NO: 107119 - DNA, 35 bp, Artificial Sequence
  Synthetic oligonucleotide
tcccccggcccttgggttacaatgccctcttgctc

SEQ ID NO: 107120 - DNA, 35 bp, Artificial Sequence
  Synthetic oligonucleotide
acgtcacccgcctttctgtcctaataccgtgcttt

SEQ ID NO: 107121 - DNA, 37 bp, Artificial Sequence
  Synthetic oligonucleotide
gtccccgcaacacggtaaaatagccgccccgacccga

SEQ ID NO: 107122 - DNA, 35 bp, Artificial Sequence
  Synthetic oligonucleotide
gccgtcaatcggtacgatccgctcgcccagtttcc

SEQ ID NO: 107123 - DNA, 37 bp, Artificial Sequence
  Synthetic oligonucleotide
ggggtgggctcaagcaccgtgggggttgctccttaga

SEQ ID NO: 107124 - DNA, 35 bp, Artificial Sequence
  Synthetic oligonucleotide
taccaccttacagacccctcgaccctgcccactgc

SEQ ID NO: 107125 - DNA, 35 bp, Artificial Sequence
  Synthetic oligonucleotide
accgaccccccctgtccttccatgaaactgcccgc

SEQ ID NO: 107126 - DNA, 35 bp, Artificial Sequence
  Synthetic oligonucleotide
acaggagccgtcaccacgccgtcctcccctctcac

SEQ ID NO: 107127 - DNA, 35 bp, Artificial Sequence
  Synthetic oligonucleotide
acctcccactcgcctttagtgcaatacgacctaac

SEQ ID NO: 107128 - DNA, 27 bp, Artificial Sequence
  Synthetic oligonucleotide
acctacgcctcaccttccgatcgtaca

SEQ ID NO: 107129 - DNA, 35 bp, Artificial Sequence
  Synthetic oligonucleotide
gtccaccgcactgaagcctcatttttgctccttcc

SEQ ID NO: 107130 - DNA, 35 bp, Artificial Sequence
  Synthetic oligonucleotide
tgcgacccctttcggtaatacgtttttggcctccc

SEQ ID NO: 107131 - DNA, 35 bp, Artificial Sequence
  Synthetic oligonucleotide
gccgcgacaggaatcgccgcttccctccgttcgcc

SEQ ID NO: 107132 - DNA, 35 bp, Artificial Sequence
  Synthetic oligonucleotide
gacacgactcgccttcgccgctataaaactcctca

SEQ ID NO: 107133 - DNA, 35 bp, Artificial Sequence
  Synthetic oligonucleotide
acaccaccctcacgtagaactgtccccagtggccc

SEQ ID NO: 107134 - DNA, 35 bp, Artificial Sequence
  Synthetic oligonucleotide
gcccgacgcactgctgtttgcatacgccctcctca

SEQ ID NO: 107135 - DNA, 35 bp, Artificial Sequence
  Synthetic oligonucleotide
gtcctcacgcgctcctgtcttactcggtccattca

SEQ ID NO: 107136 - DNA, 38 bp, Artificial Sequence
  Synthetic oligonucleotide
gccagcccactcctgtccccgtctgttccattccatga

SEQ ID NO: 107137 - DNA, 37 bp, Artificial Sequence
  Synthetic oligonucleotide
tcaccctgtacccccgtttatatatcgctcctgcaga

SEQ ID NO: 107138 - DNA, 36 bp, Artificial Sequence
  Synthetic oligonucleotide
gtagggaatgagtgaaaagggaagggggaacggcaa

SEQ ID NO: 107139 - DNA, 35 bp, Artificial Sequence
  Synthetic oligonucleotide
agttgcacccaccccgcacctgtcgaacactttgg

SEQ ID NO: 107140 - DNA, 35 bp, Artificial Sequence
  Synthetic oligonucleotide
accctccgtaggcataccctgatccacctgccttg

SEQ ID NO: 107141 - DNA, 37 bp, Artificial Sequence
  Synthetic oligonucleotide
aggaggtggcggggcaaggtggtggtcaccacctaga

SEQ ID NO: 107142 - DNA, 35 bp, Artificial Sequence
  Synthetic oligonucleotide
gcgatcgctgcctgggccataaccgcacctctatc

SEQ ID NO: 107143 - DNA, 35 bp, Artificial Sequence
  Synthetic oligonucleotide
accagccgcatcctcggttcctctttgttcccatg

SEQ ID NO: 107144 - DNA, 35 bp, Artificial Sequence
  Synthetic oligonucleotide
tacgctcccccatttgcgtcacctcgagtgcccct

SEQ ID NO: 107145 - DNA, 35 bp, Artificial Sequence
  Synthetic oligonucleotide
acccctctgcactgaatccgtggtctatcgccctc

SEQ ID NO: 107146 - DNA, 35 bp, Artificial Sequence
  Synthetic oligonucleotide
gcccccccttggactcgctgttatatccccgcagg

SEQ ID NO: 107147 - DNA, 35 bp, Artificial Sequence
  Synthetic oligonucleotide
gccatacctccgagcgcgcatccgccctatactcc

SEQ ID NO: 107148 - DNA, 35 bp, Artificial Sequence
  Synthetic oligonucleotide
gtcgccccttcacccacatctgaacagtagccacc

SEQ ID NO: 107149 - DNA, 35 bp, Artificial Sequence
  Synthetic oligonucleotide
acaatgcgcgcatcccccgtcctgccctacggcgc

SEQ ID NO: 107150 - DNA, 35 bp, Artificial Sequence
  Synthetic oligonucleotide
acactcccgccttcattgagcaccccgcctcggtg

SEQ ID NO: 107151 - DNA, 35 bp, Artificial Sequence
  Synthetic oligonucleotide
acaccctggggcctaatgtcctgttccatcctaca

SEQ ID NO: 107152 - DNA, 35 bp, Artificial Sequence
  Synthetic oligonucleotide
tcacctctcctgtccatgtccacctcaaagtcctt

SEQ ID NO: 107153 - DNA, 31 bp, Artificial Sequence
  Synthetic oligonucleotide
tgagtccggtaccccgcccttgccgccgcct

SEQ ID NO: 107154 - DNA, 35 bp, Artificial Sequence
  Synthetic oligonucleotide
tcagcgcgccctccccatgcgtttttggattctcc

SEQ ID NO: 107155 - DNA, 38 bp, Artificial Sequence
  Synthetic oligonucleotide
tcagacgcctgcaccatgttccacctctccttcagtga

SEQ ID NO: 107156 - DNA, 35 bp, Artificial Sequence
  Synthetic oligonucleotide
ccacgcccccctgcccccggagctgccccctgttt

SEQ ID NO: 107157 - DNA, 35 bp, Artificial Sequence
  Synthetic oligonucleotide
accccgccccaggcaccgtggtaccaggtcctcct

SEQ ID NO: 107158 - DNA, 35 bp, Artificial Sequence
  Synthetic oligonucleotide
tctgacatcaccctctcgttccgttaatacgcctc

SEQ ID NO: 107159 - DNA, 35 bp, Artificial Sequence
  Synthetic oligonucleotide
gcgcaatcctcccccccaccgctcacatgcttgac

SEQ ID NO: 107160 - DNA, 36 bp, Artificial Sequence
  Synthetic oligonucleotide
gccgccctgcccgttctttgctacttacgcccccca

SEQ ID NO: 107161 - DNA, 35 bp, Artificial Sequence
  Synthetic oligonucleotide
tagcagtaagtccaccgtcctagtcaccccctccg

SEQ ID NO: 107162 - DNA, 35 bp, Artificial Sequence
  Synthetic oligonucleotide
gatgcccccacgatcatttgcctacgttgcgctcc

SEQ ID NO: 107163 - DNA, 37 bp, Artificial Sequence
  Synthetic oligonucleotide
ttccgctccccctcgattgtaccacctgccacactga

SEQ ID NO: 107164 - DNA, 36 bp, Artificial Sequence
  Synthetic oligonucleotide
gcaaagagaaggacgaggtgggagggccggagagga

SEQ ID NO: 107165 - DNA, 35 bp, Artificial Sequence
  Synthetic oligonucleotide
gtgtcaccacctcccgcctgcttttcctcgatctc

SEQ ID NO: 107166 - DNA, 37 bp, Artificial Sequence
  Synthetic oligonucleotide
gagacagagttgcaggtgagcgggggacgggggtgga

SEQ ID NO: 107167 - DNA, 37 bp, Artificial Sequence
  Synthetic oligonucleotide
gccggatacccgcctattgtaccgctcccatcttcga

SEQ ID NO: 107168 - DNA, 36 bp, Artificial Sequence
  Synthetic oligonucleotide
tcctccgccacccttgtgcacgataatgcacttcca

SEQ ID NO: 107169 - DNA, 35 bp, Artificial Sequence
  Synthetic oligonucleotide
gcctcccgtctgcatccgtcccgcaattccacccg

SEQ ID NO: 107170 - DNA, 36 bp, Artificial Sequence
  Synthetic oligonucleotide
atcgtagggcggggggggagcacagggtaacaccaa

SEQ ID NO: 107171 - DNA, 35 bp, Artificial Sequence
  Synthetic oligonucleotide
gaccgccacggcaccagagaccttccccccctgcc

SEQ ID NO: 107172 - DNA, 35 bp, Artificial Sequence
  Synthetic oligonucleotide
ttcaccccgccgtaccccttgcctgattggttctt

SEQ ID NO: 107173 - DNA, 37 bp, Artificial Sequence
  Synthetic oligonucleotide
gaagggctgacggagggtaggtaggggaggggatgga

SEQ ID NO: 107174 - DNA, 38 bp, Artificial Sequence
  Synthetic oligonucleotide
acaccccagcgtaatgtataccatcctcccctcattga

SEQ ID NO: 107175 - DNA, 35 bp, Artificial Sequence
  Synthetic oligonucleotide
tagagcccgactatcccctttgcttccttgcgacc

SEQ ID NO: 107176 - DNA, 35 bp, Artificial Sequence
  Synthetic oligonucleotide
tctacaccccacactgatgtcgcccgactcttacc

SEQ ID NO: 107177 - DNA, 35 bp, Artificial Sequence
  Synthetic oligonucleotide
actccctgtcgtatgatcccgccaccccgttacgc

SEQ ID NO: 107178 - DNA, 35 bp, Artificial Sequence
  Synthetic oligonucleotide
aacacccagccccccgtatgcccctgttttcgttt

SEQ ID NO: 107179 - DNA, 35 bp, Artificial Sequence
  Synthetic oligonucleotide
tgactgcaagtcacctaccctatattggccgctcc

SEQ ID NO: 107180 - DNA, 36 bp, Artificial Sequence
  Synthetic oligonucleotide
ggtgcctcgcctcgactctttttgctgctcccttaa

SEQ ID NO: 107181 - DNA, 37 bp, Artificial Sequence
  Synthetic oligonucleotide
gtgggacgaggtgcggcatgcaggagaggggggggga

SEQ ID NO: 107182 - DNA, 35 bp, Artificial Sequence
  Synthetic oligonucleotide
gcaggccatctgtaaccttgcacacttcccctgtc

SEQ ID NO: 107183 - DNA, 35 bp, Artificial Sequence
  Synthetic oligonucleotide
gcgtgtgctccattgcctcttagtccagcctttcc

SEQ ID NO: 107184 - DNA, 35 bp, Artificial Sequence
  Synthetic oligonucleotide
gcatgccgcacatggttttctcttgcctctcatgc

SEQ ID NO: 107185 - DNA, 35 bp, Artificial Sequence
  Synthetic oligonucleotide
tccgacctgcccattgttcgcgcgcttcaccggcc

SEQ ID NO: 107186 - DNA, 37 bp, Artificial Sequence
  Synthetic oligonucleotide
gccatctcgcacctgatatcacttgtccctcgctcga

SEQ ID NO: 107187 - DNA, 35 bp, Artificial Sequence
  Synthetic oligonucleotide
gacacggatcatgccccacccgccttactgacgcc

SEQ ID NO: 107188 - DNA, 36 bp, Artificial Sequence
  Synthetic oligonucleotide
ggtcaggtcaaacgccgtcccgccccccgccgtgca

SEQ ID NO: 107189 - DNA, 36 bp, Artificial Sequence
  Synthetic oligonucleotide
ttgtgccccctcccatccgaattaagactcgatcca

SEQ ID NO: 107190 - DNA, 37 bp, Artificial Sequence
  Synthetic oligonucleotide
agcaccactccgctgtacgttaccctctccttagtga

SEQ ID NO: 107191 - DNA, 35 bp, Artificial Sequence
  Synthetic oligonucleotide
gccacgcccgacgcacacgtatgtttctcttctcc

SEQ ID NO: 107192 - DNA, 35 bp, Artificial Sequence
  Synthetic oligonucleotide
tacggcgggtcggcgggggggcttgggatatgact

SEQ ID NO: 107193 - DNA, 31 bp, Artificial Sequence
  Synthetic oligonucleotide
gatcaccgcacccccgcttaacaccaagtga

SEQ ID NO: 107194 - DNA, 35 bp, Artificial Sequence
  Synthetic oligonucleotide
tccactcgatccgctccggtacacccgcctagttc

SEQ ID NO: 107195 - DNA, 35 bp, Artificial Sequence
  Synthetic oligonucleotide
gctgattgcttctccaccttcggcccagccctgcc

SEQ ID NO: 107196 - DNA, 35 bp, Artificial Sequence
  Synthetic oligonucleotide
gttcgctctcctattcttgtgccgtgcctcttgcc

SEQ ID NO: 107197 - DNA, 35 bp, Artificial Sequence
  Synthetic oligonucleotide
tccgaacccacctgctcgctgccgtacccatcgta

SEQ ID NO: 107198 - DNA, 35 bp, Artificial Sequence
  Synthetic oligonucleotide
acaccgcctccgcccgtcagctcacgtcacacctg

SEQ ID NO: 107199 - DNA, 38 bp, Artificial Sequence
  Synthetic oligonucleotide
gccgctcgtccgacggctcccactccattgccccctga

SEQ ID NO: 107200 - DNA, 35 bp, Artificial Sequence
  Synthetic oligonucleotide
gacacttgcctcgcttatgttcatggattcccctt

SEQ ID NO: 107201 - DNA, 35 bp, Artificial Sequence
  Synthetic oligonucleotide
tgttccgtcccgcgttcgggccattcgctttcctc

SEQ ID NO: 107202 - DNA, 35 bp, Artificial Sequence
  Synthetic oligonucleotide
tccatgccatccccacatgcgccactcgttcgttc

SEQ ID NO: 107203 - DNA, 36 bp, Artificial Sequence
  Synthetic oligonucleotide
tccgattccaccgctgcccccccgctaactgtccta

SEQ ID NO: 107204 - DNA, 38 bp, Artificial Sequence
  Synthetic oligonucleotide
tcccacctcatcccttataacggcactgcctcctttga

SEQ ID NO: 107205 - DNA, 35 bp, Artificial Sequence
  Synthetic oligonucleotide
gttgccccagtgcttcacgcctcctgttttctcat

SEQ ID NO: 107206 - DNA, 35 bp, Artificial Sequence
  Synthetic oligonucleotide
tccccaaccctcgcctgcacgctgttaccgcagcc

SEQ ID NO: 107207 - DNA, 35 bp, Artificial Sequence
  Synthetic oligonucleotide
gtcctccacctgtcgctgttctcccacatactctc

SEQ ID NO: 107208 - DNA, 35 bp, Artificial Sequence
  Synthetic oligonucleotide
ttgacgctaccatcttgctccctcctgcggttacg

SEQ ID NO: 107209 - DNA, 32 bp, Artificial Sequence
  Synthetic oligonucleotide
accccctccctatgtccttcctcggtcagttc

SEQ ID NO: 107210 - DNA, 35 bp, Artificial Sequence
  Synthetic oligonucleotide
tattcacacaccttcccagacgtcgcaacccggtc

SEQ ID NO: 107211 - DNA, 35 bp, Artificial Sequence
  Synthetic oligonucleotide
acccacactccctgctgtttttattgatatgccac

SEQ ID NO: 107212 - DNA, 35 bp, Artificial Sequence
  Synthetic oligonucleotide
atcctgtcgcccggttcgtcttctacatcttcctc

SEQ ID NO: 107213 - DNA, 35 bp, Artificial Sequence
  Synthetic oligonucleotide
gccgccacattctgttcctgcccggttcccaactt

SEQ ID NO: 107214 - DNA, 35 bp, Artificial Sequence
  Synthetic oligonucleotide
ttggtcacccccgccctgccataccctttcgtata

SEQ ID NO: 107215 - DNA, 36 bp, Artificial Sequence
  Synthetic oligonucleotide
gacgcaccaccaaattgtctgccaccggttcttgca

SEQ ID NO: 107216 - DNA, 35 bp, Artificial Sequence
  Synthetic oligonucleotide
gaccggcccctcggtttcgtttgttctccttgccc

SEQ ID NO: 107217 - DNA, 35 bp, Artificial Sequence
  Synthetic oligonucleotide
gttcccccctcgctctcgtatgggacctccctgac

SEQ ID NO: 107218 - DNA, 35 bp, Artificial Sequence
  Synthetic oligonucleotide
tgccgcatgcccccgtaacgtcgtcccctctggct

SEQ ID NO: 107219 - DNA, 36 bp, Artificial Sequence
  Synthetic oligonucleotide
tgcacctcatgctacccctcgcgttactgcctcgca

SEQ ID NO: 107220 - DNA, 35 bp, Artificial Sequence
  Synthetic oligonucleotide
agacactcgcaccgtgagcctcgtttcccacccac

SEQ ID NO: 107221 - DNA, 35 bp, Artificial Sequence
  Synthetic oligonucleotide
tcctggcccatacgattaaacgcccctgccccgct

SEQ ID NO: 107222 - DNA, 35 bp, Artificial Sequence
  Synthetic oligonucleotide
tctgacagctgcccccatgctcataacccctctgc

SEQ ID NO: 107223 - DNA, 35 bp, Artificial Sequence
  Synthetic oligonucleotide
tagtcccccctgcccgttgccccagcttgcataac

SEQ ID NO: 107224 - DNA, 36 bp, Artificial Sequence
  Synthetic oligonucleotide
gatcctgcgcactgaacccctcgtccgtaccaccca

SEQ ID NO: 107225 - DNA, 37 bp, Artificial Sequence
  Synthetic oligonucleotide
actggaagggggaggggagttaggggactgataggga

SEQ ID NO: 107226 - DNA, 36 bp, Artificial Sequence
  Synthetic oligonucleotide
acattcctgccccattgcgtagcctattgtccctta

SEQ ID NO: 107227 - DNA, 35 bp, Artificial Sequence
  Synthetic oligonucleotide
gacgcacgagccgttgcctcgatactgttccatca

SEQ ID NO: 107228 - DNA, 35 bp, Artificial Sequence
  Synthetic oligonucleotide
gacacgtccactaccgcgcctgtggacttctttcc

SEQ ID NO: 107229 - DNA, 35 bp, Artificial Sequence
  Synthetic oligonucleotide
actgagacccgccgccgacctgatcacttccctcg

SEQ ID NO: 107230 - DNA, 35 bp, Artificial Sequence
  Synthetic oligonucleotide
acaccgaccacgcgcgactcacttccgcccatgcc

SEQ ID NO: 107231 - DNA, 36 bp, Artificial Sequence
  Synthetic oligonucleotide
acctcaacgtcgatcccgtccttctctcctgcctca

SEQ ID NO: 107232 - DNA, 37 bp, Artificial Sequence
  Synthetic oligonucleotide
gagaatggggagtggtggaaggaaagctgaaggagga

SEQ ID NO: 107233 - DNA, 35 bp, Artificial Sequence
  Synthetic oligonucleotide
tctcgaccgcactctgctgcattttggctcccacc

SEQ ID NO: 107234 - DNA, 35 bp, Artificial Sequence
  Synthetic oligonucleotide
tctcacccgcccacactgatctccgacttgttaat

SEQ ID NO: 107235 - DNA, 35 bp, Artificial Sequence
  Synthetic oligonucleotide
gcctgactcccattgtacgcgctggttgcacttct

SEQ ID NO: 107236 - DNA, 35 bp, Artificial Sequence
  Synthetic oligonucleotide
gctcagcatcattgttcctgtccgcgcgctccatc

SEQ ID NO: 107237 - DNA, 36 bp, Artificial Sequence
  Synthetic oligonucleotide
gaagggtgggagggagcagagggttgacgtcttcga

SEQ ID NO: 107238 - DNA, 35 bp, Artificial Sequence
  Synthetic oligonucleotide
caattgggatggcggaaggggtaggcggtggcttc

SEQ ID NO: 107239 - DNA, 35 bp, Artificial Sequence
  Synthetic oligonucleotide
gccgtcctcgcgccccgttgttcttctctagatcg

SEQ ID NO: 107240 - DNA, 30 bp, Artificial Sequence
  Synthetic oligonucleotide
tcattgccctcttgggaccctcccctccga

SEQ ID NO: 107241 - DNA, 35 bp, Artificial Sequence
  Synthetic oligonucleotide
ttgcctcaccactgttgtcggcgttaccttctacc

SEQ ID NO: 107242 - DNA, 35 bp, Artificial Sequence
  Synthetic oligonucleotide
tcagtgtccatgaatatgcctgctttgttttcctc

SEQ ID NO: 107243 - DNA, 36 bp, Artificial Sequence
  Synthetic oligonucleotide
ttaccgcgccactgttccctatgttctatcctctga

SEQ ID NO: 107244 - DNA, 36 bp, Artificial Sequence
  Synthetic oligonucleotide
atgggacggtccttggagggcgggccttactctcta

SEQ ID NO: 107245 - DNA, 35 bp, Artificial Sequence
  Synthetic oligonucleotide
gcacccgcccgagcgcaggacactagtcttccctc

SEQ ID NO: 107246 - DNA, 35 bp, Artificial Sequence
  Synthetic oligonucleotide
tcaactcccggcaggccccccaattcacccgctcg

SEQ ID NO: 107247 - DNA, 35 bp, Artificial Sequence
  Synthetic oligonucleotide
tccacgccgccgcccacaagaaatgcctgactcgc

SEQ ID NO: 107248 - DNA, 36 bp, Artificial Sequence
  Synthetic oligonucleotide
gtgtgtactccggttgtatcgccactcgccttccca

SEQ ID NO: 107249 - DNA, 37 bp, Artificial Sequence
  Synthetic oligonucleotide
attggaggtaggggggctatgggggtggcggactcga

SEQ ID NO: 107250 - DNA, 35 bp, Artificial Sequence
  Synthetic oligonucleotide
gttaccctccgttgtcgcctgcctccttggaatct

SEQ ID NO: 107251 - DNA, 35 bp, Artificial Sequence
  Synthetic oligonucleotide
tgtcgttccgctcccattctcctgtgccagttctc

SEQ ID NO: 107252 - DNA, 36 bp, Artificial Sequence
  Synthetic oligonucleotide
tccagcggacagccctgcctttcttccgtatcgcca

SEQ ID NO: 107253 - DNA, 38 bp, Artificial Sequence
  Synthetic oligonucleotide
gtcacgtggggaggggggaagaagcgggatggatatga

SEQ ID NO: 107254 - DNA, 36 bp, Artificial Sequence
  Synthetic oligonucleotide
taggggaaggatacggggagggagagcaggggggaa

SEQ ID NO: 107255 - DNA, 35 bp, Artificial Sequence
  Synthetic oligonucleotide
tgttggtccacctgtgttgcctccacgctcctacc

SEQ ID NO: 107256 - DNA, 35 bp, Artificial Sequence
  Synthetic oligonucleotide
accagcctcgcttacgttctttgattctagtcctt

SEQ ID NO: 107257 - DNA, 37 bp, Artificial Sequence
  Synthetic oligonucleotide
gacaagtttgcaggtggtggaggggtggtaggttgga

SEQ ID NO: 107258 - DNA, 38 bp, Artificial Sequence
  Synthetic oligonucleotide
attacggaggggggactgggggaggcggagggctatga

SEQ ID NO: 107259 - DNA, 35 bp, Artificial Sequence
  Synthetic oligonucleotide
accccccctgccccatccgtcaggcccggattccc

SEQ ID NO: 107260 - DNA, 36 bp, Artificial Sequence
  Synthetic oligonucleotide
gcaggaggaggtgagcgggtggggagggtacgaaag

SEQ ID NO: 107261 - DNA, 37 bp, Artificial Sequence
  Synthetic oligonucleotide
gcgaggggcgggcgctatggggagcaatgactgggga

SEQ ID NO: 107262 - DNA, 35 bp, Artificial Sequence
  Synthetic oligonucleotide
gttcggtcggtgcccccgttcgtttttgccgtttc

SEQ ID NO: 107263 - DNA, 35 bp, Artificial Sequence
  Synthetic oligonucleotide
accgcactccgcacgatcattcgctccctgacggt

SEQ ID NO: 107264 - DNA, 35 bp, Artificial Sequence
  Synthetic oligonucleotide
tccgttgccatatcctgttcgtctaccacctctgc

SEQ ID NO: 107265 - DNA, 35 bp, Artificial Sequence
  Synthetic oligonucleotide
accgctccagagccctgtctgcccacacttcgccg

SEQ ID NO: 107266 - DNA, 35 bp, Artificial Sequence
  Synthetic oligonucleotide
gaccctgtccatcctgttaattcgtcccccactcc

SEQ ID NO: 107267 - DNA, 35 bp, Artificial Sequence
  Synthetic oligonucleotide
ttgcagttcccgccctgtatgctcaccacctcgca

SEQ ID NO: 107268 - DNA, 37 bp, Artificial Sequence
  Synthetic oligonucleotide
accaaagggaagaaggtaagcaagggaatggaggaga

SEQ ID NO: 107269 - DNA, 35 bp, Artificial Sequence
  Synthetic oligonucleotide
acccagctgctgtgatcttgttccatcccttctcc

SEQ ID NO: 107270 - DNA, 35 bp, Artificial Sequence
  Synthetic oligonucleotide
gcattccccgccgcccatatccttggcttctgcca

SEQ ID NO: 107271 - DNA, 35 bp, Artificial Sequence
  Synthetic oligonucleotide
ttagtccgcctactattgttctttcctcgtggccc

SEQ ID NO: 107272 - DNA, 37 bp, Artificial Sequence
  Synthetic oligonucleotide
gcacctgttggtgcttactctcgccctcccttcccga

SEQ ID NO: 107273 - DNA, 35 bp, Artificial Sequence
  Synthetic oligonucleotide
tgggacaacacactgctggttttcgccctatcctc

SEQ ID NO: 107274 - DNA, 35 bp, Artificial Sequence
  Synthetic oligonucleotide
tccacaacgcagttcctgtttctttacgctttctc

SEQ ID NO: 107275 - DNA, 35 bp, Artificial Sequence
  Synthetic oligonucleotide
acctcccacgtcaagacctctaccagtccccctgc

SEQ ID NO: 107276 - DNA, 36 bp, Artificial Sequence
  Synthetic oligonucleotide
acactccgccccttccacacacatagtgctcgccta

SEQ ID NO: 107277 - DNA, 35 bp, Artificial Sequence
  Synthetic oligonucleotide
tcaggtgttcgcctatctgttttcttgccctcgtc

SEQ ID NO: 107278 - DNA, 37 bp, Artificial Sequence
  Synthetic oligonucleotide
ggggggagaaggtggaacggaggaggaagatcggaga

SEQ ID NO: 107279 - DNA, 37 bp, Artificial Sequence
  Synthetic oligonucleotide
acctgccgccaccgctccattcgcccacagttcttga

SEQ ID NO: 107280 - DNA, 35 bp, Artificial Sequence
  Synthetic oligonucleotide
agcagccccccgcgcgcctccgaccctcgaagact

SEQ ID NO: 107281 - DNA, 35 bp, Artificial Sequence
  Synthetic oligonucleotide
gagacacacactggggaaggagggacaacggggaa

SEQ ID NO: 107282 - DNA, 35 bp, Artificial Sequence
  Synthetic oligonucleotide
agaacgcctctgccttttccattgtctcacatctc

SEQ ID NO: 107283 - DNA, 35 bp, Artificial Sequence
  Synthetic oligonucleotide
gaatgtacacgggaaggggataggggggaggggcg

SEQ ID NO: 107284 - DNA, 35 bp, Artificial Sequence
  Synthetic oligonucleotide
ttgggcccctgtcccccctccatatgccagctacc

SEQ ID NO: 107285 - DNA, 35 bp, Artificial Sequence
  Synthetic oligonucleotide
gtccacttgtgtcgatgcctacgcccgcctgcccc

SEQ ID NO: 107286 - DNA, 37 bp, Artificial Sequence
  Synthetic oligonucleotide
gcatccacgcccccatgttacctcactcgccacttga

SEQ ID NO: 107287 - DNA, 35 bp, Artificial Sequence
  Synthetic oligonucleotide
gcatagcgcggactgcatcgacatctgttctcccc

SEQ ID NO: 107288 - DNA, 35 bp, Artificial Sequence
  Synthetic oligonucleotide
tgtgactgatacacccctgcactatgctatcctcg

SEQ ID NO: 107289 - DNA, 37 bp, Artificial Sequence
  Synthetic oligonucleotide
tccctcgacctgctctttgccccgccacttcctgtga

SEQ ID NO: 107290 - DNA, 35 bp, Artificial Sequence
  Synthetic oligonucleotide
accccatgtcggctttgactttcccttccctcaca

SEQ ID NO: 107291 - DNA, 35 bp, Artificial Sequence
  Synthetic oligonucleotide
acagccccgcccgggttttgatcccaccctttccg

SEQ ID NO: 107292 - DNA, 33 bp, Artificial Sequence
  Synthetic oligonucleotide
gagggacatgggaggggaggtagtaacaagtgg

SEQ ID NO: 107293 - DNA, 36 bp, Artificial Sequence
  Synthetic oligonucleotide
tgcgcccctctgcctcgtcgcgtccttccttggtca

SEQ ID NO: 107294 - DNA, 36 bp, Artificial Sequence
  Synthetic oligonucleotide
tgtgcctccgccgttgccctcacccatcattcccaa

SEQ ID NO: 107295 - DNA, 38 bp, Artificial Sequence
  Synthetic oligonucleotide
ggtgcccctcctgctgaccaatattagccttcccttga

SEQ ID NO: 107296 - DNA, 35 bp, Artificial Sequence
  Synthetic oligonucleotide
tcgacctcccatccgtatctgttccgcatattccc

SEQ ID NO: 107297 - DNA, 36 bp, Artificial Sequence
  Synthetic oligonucleotide
atgggcggctggaggggttttcgggatggaaatgta

SEQ ID NO: 107298 - DNA, 35 bp, Artificial Sequence
  Synthetic oligonucleotide
gtacgcgctatactgctccccttggctcccgccgc

SEQ ID NO: 107299 - DNA, 35 bp, Artificial Sequence
  Synthetic oligonucleotide
tgtctacgtacctcccgttgctgcccgctgttcca

SEQ ID NO: 107300 - DNA, 38 bp, Artificial Sequence
  Synthetic oligonucleotide
gtccctaccacctatgttctatctgaccctctccgtga

SEQ ID NO: 107301 - DNA, 35 bp, Artificial Sequence
  Synthetic oligonucleotide
gcgatacaccgaccacgcgtattctatctcgttcc

SEQ ID NO: 107302 - DNA, 35 bp, Artificial Sequence
  Synthetic oligonucleotide
atgccctcacctgctgacctgacacgaatcgccca

SEQ ID NO: 107303 - DNA, 35 bp, Artificial Sequence
  Synthetic oligonucleotide
tccacccccgcgctgtccgccagtcgagtcccgcc

SEQ ID NO: 107304 - DNA, 35 bp, Artificial Sequence
  Synthetic oligonucleotide
atgccccccactgggctgctttgccgaactccccc

SEQ ID NO: 107305 - DNA, 37 bp, Artificial Sequence
  Synthetic oligonucleotide
gcacccgtctcctgcctccgtccgacctttctctcga

SEQ ID NO: 107306 - DNA, 35 bp, Artificial Sequence
  Synthetic oligonucleotide
gaatgcgagggggaaggtgaggcgggtcaacgtag

SEQ ID NO: 107307 - DNA, 35 bp, Artificial Sequence
  Synthetic oligonucleotide
gacagcaagtgggagggaggaaagcgggaatggat

SEQ ID NO: 107308 - DNA, 35 bp, Artificial Sequence
  Synthetic oligonucleotide
tgtgccccccgttgcccgcgccgactccttcattg

SEQ ID NO: 107309 - DNA, 35 bp, Artificial Sequence
  Synthetic oligonucleotide
tgcgcattcccgtatcctgacgtttctttgccccc

SEQ ID NO: 107310 - DNA, 35 bp, Artificial Sequence
  Synthetic oligonucleotide
tcgccgtgccactgcctgtctcacttccggaactc

SEQ ID NO: 107311 - DNA, 35 bp, Artificial Sequence
  Synthetic oligonucleotide
ttccatcaccgcacgctcgcccctttggtccctat

SEQ ID NO: 107312 - DNA, 35 bp, Artificial Sequence
  Synthetic oligonucleotide
gcgccccccctcgttcatgttcgctggcttcctta

SEQ ID NO: 107313 - DNA, 35 bp, Artificial Sequence
  Synthetic oligonucleotide
gccacaccttagttggccttcccctctgttcctcg

SEQ ID NO: 107314 - DNA, 35 bp, Artificial Sequence
  Synthetic oligonucleotide
accgctcacccgcctgtctaacccaactcctttgg

SEQ ID NO: 107315 - DNA, 36 bp, Artificial Sequence
  Synthetic oligonucleotide
ggaggggggggagtaggctcgggatagaggaagtga

SEQ ID NO: 107316 - DNA, 35 bp, Artificial Sequence
  Synthetic oligonucleotide
tccctgagcaggcgtctaccctccgtcccgctgcc

SEQ ID NO: 107317 - DNA, 37 bp, Artificial Sequence
  Synthetic oligonucleotide
gtcgccgcagccgccgctatgctccgccaccccttga

SEQ ID NO: 107318 - DNA, 35 bp, Artificial Sequence
  Synthetic oligonucleotide
accaccacctgacaccttgaagcatgatcctgcct

SEQ ID NO: 107319 - DNA, 36 bp, Artificial Sequence
  Synthetic oligonucleotide
ttcggtctcagcctccactccgccacccgccgttga

SEQ ID NO: 107320 - DNA, 35 bp, Artificial Sequence
  Synthetic oligonucleotide
tcgcacctccactggttggttcatcttatctgctc

SEQ ID NO: 107321 - DNA, 35 bp, Artificial Sequence
  Synthetic oligonucleotide
gcacgctgcctaccctggtcatgtccctgttcgtt

SEQ ID NO: 107322 - DNA, 35 bp, Artificial Sequence
  Synthetic oligonucleotide
tacgcacagcccgtctttgaaccttcacacgctcc

SEQ ID NO: 107323 - DNA, 35 bp, Artificial Sequence
  Synthetic oligonucleotide
tatgcgctcgggtcttgcgtcgtccggctcttttc

SEQ ID NO: 107324 - DNA, 36 bp, Artificial Sequence
  Synthetic oligonucleotide
acacccctcgtaacacgttctatatcgaccctccca

SEQ ID NO: 107325 - DNA, 35 bp, Artificial Sequence
  Synthetic oligonucleotide
tcaccccacgtacctctgccgttccgctgtctcca

SEQ ID NO: 107326 - DNA, 35 bp, Artificial Sequence
  Synthetic oligonucleotide
gcatgcacgtccacaccccagatctgctcccactc

SEQ ID NO: 107327 - DNA, 34 bp, Artificial Sequence
  Synthetic oligonucleotide
gactttgccgccgatccctccgttctcgcttcca

SEQ ID NO: 107328 - DNA, 36 bp, Artificial Sequence
  Synthetic oligonucleotide
gccatcgccggtccattgccatcacgtcttgtctca

SEQ ID NO: 107329 - DNA, 35 bp, Artificial Sequence
  Synthetic oligonucleotide
tgctcaccaccgcacgactggtcactagtaccttc

SEQ ID NO: 107330 - DNA, 35 bp, Artificial Sequence
  Synthetic oligonucleotide
atctacgcccccacataacacactggttcccggcc

SEQ ID NO: 107331 - DNA, 38 bp, Artificial Sequence
  Synthetic oligonucleotide
gaagggggcggaaagggggctggaggcggtacctatga

SEQ ID NO: 107332 - DNA, 38 bp, Artificial Sequence
  Synthetic oligonucleotide
gaccagccgccccatgcaacgccctgacacccccctga

SEQ ID NO: 107333 - DNA, 35 bp, Artificial Sequence
  Synthetic oligonucleotide
gcacactttctcgccgcgctacgtatcccgctgtg

SEQ ID NO: 107334 - DNA, 35 bp, Artificial Sequence
  Synthetic oligonucleotide
atcatccccgcccgccgcgtacgagccatcctttt

SEQ ID NO: 107335 - DNA, 35 bp, Artificial Sequence
  Synthetic oligonucleotide
tgctgcccccgactcttggattatacgtgcctacc

SEQ ID NO: 107336 - DNA, 36 bp, Artificial Sequence
  Synthetic oligonucleotide
ggggggaaggtgaagtggaagaagggcagcattaga

SEQ ID NO: 107337 - DNA, 35 bp, Artificial Sequence
  Synthetic oligonucleotide
ttacctgcccccgtgcacacaccgcactttagtcc

SEQ ID NO: 107338 - DNA, 35 bp, Artificial Sequence
  Synthetic oligonucleotide
tcacggcgggagtgtggagggagggggagtggggg

SEQ ID NO: 107339 - DNA, 35 bp, Artificial Sequence
  Synthetic oligonucleotide
accccgcactgctccgaccctgcgactgtactctc

SEQ ID NO: 107340 - DNA, 35 bp, Artificial Sequence
  Synthetic oligonucleotide
ttgcctggtgctcctgttctgcttatatcccttgg

SEQ ID NO: 107341 - DNA, 35 bp, Artificial Sequence
  Synthetic oligonucleotide
gacgctgctgatcttccatttgccatgcctgctcc

SEQ ID NO: 107342 - DNA, 35 bp, Artificial Sequence
  Synthetic oligonucleotide
gccaccccccgccgtgacaggtctacgccgcttct

SEQ ID NO: 107343 - DNA, 35 bp, Artificial Sequence
  Synthetic oligonucleotide
tccgccgtcctccgccatcccttgccttattaggc

SEQ ID NO: 107344 - DNA, 35 bp, Artificial Sequence
  Synthetic oligonucleotide
gaccttacgcccatgtcgtcctgcctctatccata

SEQ ID NO: 107345 - DNA, 35 bp, Artificial Sequence
  Synthetic oligonucleotide
tacgccgctgactagcgtaagtttcccgccctcgc

SEQ ID NO: 107346 - DNA, 35 bp, Artificial Sequence
  Synthetic oligonucleotide
tacatcgcggccatctcgtaattccttgctccttc

SEQ ID NO: 107347 - DNA, 35 bp, Artificial Sequence
  Synthetic oligonucleotide
accccccccgcccgtatgtaattactctcaggacc

SEQ ID NO: 107348 - DNA, 37 bp, Artificial Sequence
  Synthetic oligonucleotide
aaatggccggtggagggagaagggcaaggggggcaga

SEQ ID NO: 107349 - DNA, 35 bp, Artificial Sequence
  Synthetic oligonucleotide
tagggggcccaattgatccgtctccccttgtccgc

SEQ ID NO: 107350 - DNA, 35 bp, Artificial Sequence
  Synthetic oligonucleotide
gagaccagcggtcacattgttcccgccccctcctg

SEQ ID NO: 107351 - DNA, 35 bp, Artificial Sequence
  Synthetic oligonucleotide
tcaccaccccacatgtcacttagccgccctcacca

SEQ ID NO: 107352 - DNA, 37 bp, Artificial Sequence
  Synthetic oligonucleotide
atcacctgtcctgcttcatgtcttcgcgtccctccga

SEQ ID NO: 107353 - DNA, 35 bp, Artificial Sequence
  Synthetic oligonucleotide
tccgacctttgcctgtctcgcccatgctttcactc

SEQ ID NO: 107354 - DNA, 38 bp, Artificial Sequence
  Synthetic oligonucleotide
tgagacggggataggtcgggcgggaacgggtagggtga

SEQ ID NO: 107355 - DNA, 35 bp, Artificial Sequence
  Synthetic oligonucleotide
tcccaccctctgccttcgtcgagtagtcaccatcc

SEQ ID NO: 107356 - DNA, 35 bp, Artificial Sequence
  Synthetic oligonucleotide
gacgtgctcctctgacgacgtttcttctctgttct

SEQ ID NO: 107357 - DNA, 38 bp, Artificial Sequence
  Synthetic oligonucleotide
ggggcgggccactcggggcctcacttcttaaggggtga

SEQ ID NO: 107358 - DNA, 36 bp, Artificial Sequence
  Synthetic oligonucleotide
taacccccccgctccatctgactatgtcggactcta

SEQ ID NO: 107359 - DNA, 35 bp, Artificial Sequence
  Synthetic oligonucleotide
gccccgtcatgtatcgtcctgcttgttccgttgtc

SEQ ID NO: 107360 - DNA, 35 bp, Artificial Sequence
  Synthetic oligonucleotide
ttagatgggggcgggtgagggcgggtgggcgcgtc

SEQ ID NO: 107361 - DNA, 35 bp, Artificial Sequence
  Synthetic oligonucleotide
gagaccacccctcacgcatcattgtgaccaccctc

SEQ ID NO: 107362 - DNA, 35 bp, Artificial Sequence
  Synthetic oligonucleotide
tcatttgccctccaggtctgtccctcttgccccgc

SEQ ID NO: 107363 - DNA, 36 bp, Artificial Sequence
  Synthetic oligonucleotide
gccacctcccctgttttaaatagtccccagttctca

SEQ ID NO: 107364 - DNA, 37 bp, Artificial Sequence
  Synthetic oligonucleotide
agcacgggggggggacttgaacagggcaaaagggaga

SEQ ID NO: 107365 - DNA, 35 bp, Artificial Sequence
  Synthetic oligonucleotide
gtccacccgacgcctccctgagcctgcccctgccc

SEQ ID NO: 107366 - DNA, 35 bp, Artificial Sequence
  Synthetic oligonucleotide
gcccgctgcaagtgcctacgccagctccctccatc

SEQ ID NO: 107367 - DNA, 37 bp, Artificial Sequence
  Synthetic oligonucleotide
ggggagagtgaacgtggagggagcggctagggaggga

SEQ ID NO: 107368 - DNA, 35 bp, Artificial Sequence
  Synthetic oligonucleotide
tgtaccgcccgtagctccttgttttctggccctta

SEQ ID NO: 107369 - DNA, 35 bp, Artificial Sequence
  Synthetic oligonucleotide
gcgaggcgccgccctcgttgggtttttcgctttcc

SEQ ID NO: 107370 - DNA, 35 bp, Artificial Sequence
  Synthetic oligonucleotide
tcccccgacgcctttgcatttatccctctcacgac

SEQ ID NO: 107371 - DNA, 35 bp, Artificial Sequence
  Synthetic oligonucleotide
gaccacccgttcactgcgcattcacccggtgaccc

SEQ ID NO: 107372 - DNA, 35 bp, Artificial Sequence
  Synthetic oligonucleotide
acaccacccgtgcccagtgatacattacgttacct

SEQ ID NO: 107373 - DNA, 35 bp, Artificial Sequence
  Synthetic oligonucleotide
tcacaccgctctgtgcgttccgttccgcccccgca

SEQ ID NO: 107374 - DNA, 35 bp, Artificial Sequence
  Synthetic oligonucleotide
tgctgacgcatggtccttcctgcccccgccctgtc

SEQ ID NO: 107375 - DNA, 35 bp, Artificial Sequence
  Synthetic oligonucleotide
ggagggagggccgaggtaaggggaggcaagaccag

SEQ ID NO: 107376 - DNA, 35 bp, Artificial Sequence
  Synthetic oligonucleotide
gacaaggggaggaacatagcggaacggggaagtga

SEQ ID NO: 107377 - DNA, 35 bp, Artificial Sequence
  Synthetic oligonucleotide
gagccatcctccgtgcagcagacccgcaccacttt

SEQ ID NO: 107378 - DNA, 35 bp, Artificial Sequence
  Synthetic oligonucleotide
gttgccgccctcctccatgccatattgctaccgag

SEQ ID NO: 107379 - DNA, 36 bp, Artificial Sequence
  Synthetic oligonucleotide
taggtggaggtggggcatatggatggacggttcgca

SEQ ID NO: 107380 - DNA, 35 bp, Artificial Sequence
  Synthetic oligonucleotide
tttcgcaccctttagctggtcttcacttacctccg

SEQ ID NO: 107381 - DNA, 35 bp, Artificial Sequence
  Synthetic oligonucleotide
tccaccacgccacttgcttcacaccctatccagta

SEQ ID NO: 107382 - DNA, 35 bp, Artificial Sequence
  Synthetic oligonucleotide
tgttcatcccgccctagtttttgtcccacgaccat

SEQ ID NO: 107383 - DNA, 35 bp, Artificial Sequence
  Synthetic oligonucleotide
accagtcacatcgtgtgcctgcccgtttccttgta

SEQ ID NO: 107384 - DNA, 35 bp, Artificial Sequence
  Synthetic oligonucleotide
gtgcgagacagtgccgcggcgccccccctctctgt

SEQ ID NO: 107385 - DNA, 35 bp, Artificial Sequence
  Synthetic oligonucleotide
tgtcatacgccccctgataccctcctcttgctccg

SEQ ID NO: 107386 - DNA, 35 bp, Artificial Sequence
  Synthetic oligonucleotide
ttcgctgccccgccgtgcctaatgcgctcttgcca

SEQ ID NO: 107387 - DNA, 35 bp, Artificial Sequence
  Synthetic oligonucleotide
actgtcacacccaccatgttcggccttattatctt

SEQ ID NO: 107388 - DNA, 35 bp, Artificial Sequence
  Synthetic oligonucleotide
tcaccgatccaactggtcattcttattgtctcgcc

SEQ ID NO: 107389 - DNA, 35 bp, Artificial Sequence
  Synthetic oligonucleotide
tccacttgcctctccagccgacctttacccgtcca

SEQ ID NO: 107390 - DNA, 35 bp, Artificial Sequence
  Synthetic oligonucleotide
gtccacacgcggctcactccctccgtgcgcctcct

SEQ ID NO: 107391 - DNA, 37 bp, Artificial Sequence
  Synthetic oligonucleotide
accgcaagccctcgttcttattcgctacatcccctga

SEQ ID NO: 107392 - DNA, 35 bp, Artificial Sequence
  Synthetic oligonucleotide
tgatgcccctcatttgctttccctacggtctttat

SEQ ID NO: 107393 - DNA, 35 bp, Artificial Sequence
  Synthetic oligonucleotide
atgaccggtgggtaggtatcggggggaagggaggg

SEQ ID NO: 107394 - DNA, 35 bp, Artificial Sequence
  Synthetic oligonucleotide
tccgacgcaccctcttgccgcactattagcctggc

SEQ ID NO: 107395 - DNA, 36 bp, Artificial Sequence
  Synthetic oligonucleotide
gaaccgcgccggtcgcctctacgtttgcactttcca

SEQ ID NO: 107396 - DNA, 35 bp, Artificial Sequence
  Synthetic oligonucleotide
tccacactcctcatccaagcgaaaccgctccacgc

SEQ ID NO: 107397 - DNA, 32 bp, Artificial Sequence
  Synthetic oligonucleotide
gaagcgcttccactgctgctctcttttgttct

SEQ ID NO: 107398 - DNA, 35 bp, Artificial Sequence
  Synthetic oligonucleotide
gcacaggcccctgctccggatgttcgccccccccg

SEQ ID NO: 107399 - DNA, 35 bp, Artificial Sequence
  Synthetic oligonucleotide
acccccccccagcgatggcaccatctcgacctcac

SEQ ID NO: 107400 - DNA, 35 bp, Artificial Sequence
  Synthetic oligonucleotide
gcaccgctgtatactcaattgtctgcccttcttgc

SEQ ID NO: 107401 - DNA, 38 bp, Artificial Sequence
  Synthetic oligonucleotide
tgtgcgcatcccttttcgccgccattactgccctgtga

SEQ ID NO: 107402 - DNA, 35 bp, Artificial Sequence
  Synthetic oligonucleotide
tacacccgccccaccatctgaattcacgtatgcaa

SEQ ID NO: 107403 - DNA, 35 bp, Artificial Sequence
  Synthetic oligonucleotide
attgtcccgtactgctcccccatcatggccgtttc

SEQ ID NO: 107404 - DNA, 36 bp, Artificial Sequence
  Synthetic oligonucleotide
ggagacggcgcccgccttgtaccgccccgcaaccta

SEQ ID NO: 107405 - DNA, 36 bp, Artificial Sequence
  Synthetic oligonucleotide
gatgggtggtggggcggggagagagggaccggggga

SEQ ID NO: 107406 - DNA, 36 bp, Artificial Sequence
  Synthetic oligonucleotide
gaccccaggccagacgttgtaactgctcccccccta

SEQ ID NO: 107407 - DNA, 37 bp, Artificial Sequence
  Synthetic oligonucleotide
acacccgccacttttccccctaagtcgtcccaccgga

SEQ ID NO: 107408 - DNA, 35 bp, Artificial Sequence
  Synthetic oligonucleotide
tccaccctgtaccgtgcgttacgaaacgcaaacct

SEQ ID NO: 107409 - DNA, 35 bp, Artificial Sequence
  Synthetic oligonucleotide
ttcagtcagtgttattcccgctcgttccatctgct

SEQ ID NO: 107410 - DNA, 35 bp, Artificial Sequence
  Synthetic oligonucleotide
gccatctcacacatgcgctattcttaccctccgca

SEQ ID NO: 107411 - DNA, 38 bp, Artificial Sequence
  Synthetic oligonucleotide
gtgcccatccattgcaccgtcctcctctccatagctga

SEQ ID NO: 107412 - DNA, 35 bp, Artificial Sequence
  Synthetic oligonucleotide
gcctacatctggtctttcaccgctcaacctctttg

SEQ ID NO: 107413 - DNA, 35 bp, Artificial Sequence
  Synthetic oligonucleotide
gcgcacctgtaatgtccctgtgctcctgtccgtcc

SEQ ID NO: 107414 - DNA, 35 bp, Artificial Sequence
  Synthetic oligonucleotide
gttccacctgtcctttcgagttcgcaccagctttc

SEQ ID NO: 107415 - DNA, 35 bp, Artificial Sequence
  Synthetic oligonucleotide
ccccgcccccactgacccgtttcgccacacaggca

SEQ ID NO: 107416 - DNA, 35 bp, Artificial Sequence
  Synthetic oligonucleotide
tgcgacgcccccccggcctatgacacgcgccactc

SEQ ID NO: 107417 - DNA, 35 bp, Artificial Sequence
  Synthetic oligonucleotide
gcacgtgcacttgtacctactcatcgccctcactg

SEQ ID NO: 107418 - DNA, 37 bp, Artificial Sequence
  Synthetic oligonucleotide
gatgtcgcgacaggggggacggaggaggaggcgcgga

SEQ ID NO: 107419 - DNA, 34 bp, Artificial Sequence
  Synthetic oligonucleotide
gcgtcccacccgcagctcgccgaatcaccgcatc

SEQ ID NO: 107420 - DNA, 33 bp, Artificial Sequence
  Synthetic oligonucleotide
atcgattcgccccctaggttcttcagccaccac

SEQ ID NO: 107421 - DNA, 35 bp, Artificial Sequence
  Synthetic oligonucleotide
gcatgacactatgccccttcaccacgatactcgtc

SEQ ID NO: 107422 - DNA, 38 bp, Artificial Sequence
  Synthetic oligonucleotide
gccgcccagccgttcgtacacgccccatctccgcttga

SEQ ID NO: 107423 - DNA, 35 bp, Artificial Sequence
  Synthetic oligonucleotide
ttacaacctgcgatgccttcccccacgtgcgctcc

SEQ ID NO: 107424 - DNA, 37 bp, Artificial Sequence
  Synthetic oligonucleotide
ggttcgaacggagggggggggaaagggtgggcaagga

SEQ ID NO: 107425 - DNA, 35 bp, Artificial Sequence
  Synthetic oligonucleotide
ttgccccaccagtctgccctcattcacgcacttta

SEQ ID NO: 107426 - DNA, 35 bp, Artificial Sequence
  Synthetic oligonucleotide
gagcacctccctcttctgtcttggggcgatccacc

SEQ ID NO: 107427 - DNA, 35 bp, Artificial Sequence
  Synthetic oligonucleotide
gccaccgcacgtcggcccccaccgcgtaaactgct

SEQ ID NO: 107428 - DNA, 35 bp, Artificial Sequence
  Synthetic oligonucleotide
gccgaacctgccgttccctctgccatacctgttta

SEQ ID NO: 107429 - DNA, 35 bp, Artificial Sequence
  Synthetic oligonucleotide
gtgtcaccttcgttctcccgtatcctccgcgtgcc

SEQ ID NO: 107430 - DNA, 35 bp, Artificial Sequence
  Synthetic oligonucleotide
gccccactcacaagtcacccgagcttcttacccgt

SEQ ID NO: 107431 - DNA, 36 bp, Artificial Sequence
  Synthetic oligonucleotide
gtcgcaagccgtattgctcgtcttacccacttctta

SEQ ID NO: 107432 - DNA, 35 bp, Artificial Sequence
  Synthetic oligonucleotide
tagaaacgggaaggcacggggggggacgtgaggta

SEQ ID NO: 107433 - DNA, 36 bp, Artificial Sequence
  Synthetic oligonucleotide
accgcgacctctgttcaccgtgccgccgacccttta

SEQ ID NO: 107434 - DNA, 36 bp, Artificial Sequence
  Synthetic oligonucleotide
tgctgcccccagcgcgtctagcttttcgccccgcca

SEQ ID NO: 107435 - DNA, 35 bp, Artificial Sequence
  Synthetic oligonucleotide
gaccagccctcgcagatcttacaccttcgcctcct

SEQ ID NO: 107436 - DNA, 35 bp, Artificial Sequence
  Synthetic oligonucleotide
tagtaccacagttcgcagtcccctccctttcctcg

SEQ ID NO: 107437 - DNA, 35 bp, Artificial Sequence
  Synthetic oligonucleotide
ttgcaccgccccgtcgccccaccagcatgatcact

SEQ ID NO: 107438 - DNA, 35 bp, Artificial Sequence
  Synthetic oligonucleotide
acgtacacccaggtgttccgtcccagccgccctcc

SEQ ID NO: 107439 - DNA, 37 bp, Artificial Sequence
  Synthetic oligonucleotide
tgaaccgggcggaggggaggggaatactaggtggaga

SEQ ID NO: 107440 - DNA, 35 bp, Artificial Sequence
  Synthetic oligonucleotide
gtgacaacccagcgtgctaccatcccctcgttgtg

SEQ ID NO: 107441 - DNA, 35 bp, Artificial Sequence
  Synthetic oligonucleotide
acaacaccctgccctcaccccgttactgttgggac

SEQ ID NO: 107442 - DNA, 35 bp, Artificial Sequence
  Synthetic oligonucleotide
tgcactccttccgcccttttttgccgtcagttcca

SEQ ID NO: 107443 - DNA, 36 bp, Artificial Sequence
  Synthetic oligonucleotide
agatggaaacgggaacgggggcgataaatagggtga

SEQ ID NO: 107444 - DNA, 35 bp, Artificial Sequence
  Synthetic oligonucleotide
aacctgcctcacgcctaacctacactgctggtact

SEQ ID NO: 107445 - DNA, 38 bp, Artificial Sequence
  Synthetic oligonucleotide
aacatgcctcagatcagttctccctgccgctcctttga

SEQ ID NO: 107446 - DNA, 34 bp, Artificial Sequence
  Synthetic oligonucleotide
tctcatcctcgcctttatttttgcacgccatcac

SEQ ID NO: 107447 - DNA, 33 bp, Artificial Sequence
  Synthetic oligonucleotide
ttccgacgccgatcttcaacttcctgtccttct

SEQ ID NO: 107448 - DNA, 37 bp, Artificial Sequence
  Synthetic oligonucleotide
ggaacgtaaggggaggacaaaggcgggggggtagaga

SEQ ID NO: 107449 - DNA, 37 bp, Artificial Sequence
  Synthetic oligonucleotide
ccacacgccacccgccgtactgccctctctcctgtga

SEQ ID NO: 107450 - DNA, 37 bp, Artificial Sequence
  Synthetic oligonucleotide
accacctccacccagattgtcctttcccctcccgcga

SEQ ID NO: 107451 - DNA, 35 bp, Artificial Sequence
  Synthetic oligonucleotide
gcgagccttcgccgtaccccacttttgtgcacctc

SEQ ID NO: 107452 - DNA, 35 bp, Artificial Sequence
  Synthetic oligonucleotide
actgaggaggggaaaaggggatctgagggtgggga

SEQ ID NO: 107453 - DNA, 35 bp, Artificial Sequence
  Synthetic oligonucleotide
aagtcacctgtgcccccccactgtgttatccttcc

SEQ ID NO: 107454 - DNA, 35 bp, Artificial Sequence
  Synthetic oligonucleotide
tccaccactcgctttaactcctgctcaagggccct

SEQ ID NO: 107455 - DNA, 35 bp, Artificial Sequence
  Synthetic oligonucleotide
gttcgccccatcatctccaaggccatgttgctcct

SEQ ID NO: 107456 - DNA, 35 bp, Artificial Sequence
  Synthetic oligonucleotide
gcgcccacgcctcatcgtcatccttttccacctgg

SEQ ID NO: 107457 - DNA, 33 bp, Artificial Sequence
  Synthetic oligonucleotide
tgaacctccccccttgtgactaattgcctgtga

SEQ ID NO: 107458 - DNA, 35 bp, Artificial Sequence
  Synthetic oligonucleotide
tccccaccgcagcacccgcccgagaatctttcctc

SEQ ID NO: 107459 - DNA, 35 bp, Artificial Sequence
  Synthetic oligonucleotide
tgaagagacaagttggaggaaaggggcgggaggga

SEQ ID NO: 107460 - DNA, 35 bp, Artificial Sequence
  Synthetic oligonucleotide
acagccctgcctcctgcccgcacagtaacggaacc

SEQ ID NO: 107461 - DNA, 36 bp, Artificial Sequence
  Synthetic oligonucleotide
tgaccccccagttgcgcacctccttagtatacttcc

SEQ ID NO: 107462 - DNA, 35 bp, Artificial Sequence
  Synthetic oligonucleotide
aacgacgccatctattttatttcgcaccgctcctc

SEQ ID NO: 107463 - DNA, 35 bp, Artificial Sequence
  Synthetic oligonucleotide
ttccctcgccgtagtcgcatcactgtaccgcttcc

SEQ ID NO: 107464 - DNA, 36 bp, Artificial Sequence
  Synthetic oligonucleotide
gccctgccccccccttacgccacagtttagtgccga

SEQ ID NO: 107465 - DNA, 37 bp, Artificial Sequence
  Synthetic oligonucleotide
gagggaagggccgtatgcggggggagcaggagaagga

SEQ ID NO: 107466 - DNA, 35 bp, Artificial Sequence
  Synthetic oligonucleotide
atcccgcgcggttgcttttttcctcgttcgtcgtc

SEQ ID NO: 107467 - DNA, 35 bp, Artificial Sequence
  Synthetic oligonucleotide
gtgattcccgcccgctctgctccgttctactaccg

SEQ ID NO: 107468 - DNA, 35 bp, Artificial Sequence
  Synthetic oligonucleotide
gacgcccctcattcgcccaccctcgttgccataca

SEQ ID NO: 107469 - DNA, 36 bp, Artificial Sequence
  Synthetic oligonucleotide
ttagcgccaatcgtccactgccacaccacccgccga

SEQ ID NO: 107470 - DNA, 35 bp, Artificial Sequence
  Synthetic oligonucleotide
gccatagcgaacggggggagggaggattgggaggg

SEQ ID NO: 107471 - DNA, 36 bp, Artificial Sequence
  Synthetic oligonucleotide
tcgcacctccacccgtcctttaacacccacgccgca

SEQ ID NO: 107472 - DNA, 35 bp, Artificial Sequence
  Synthetic oligonucleotide
gcacccgggcaactggtaccggtcactacaccccc

SEQ ID NO: 107473 - DNA, 37 bp, Artificial Sequence
  Synthetic oligonucleotide
gggacggtatgacggggtggggaaggggagcggttga

SEQ ID NO: 107474 - DNA, 35 bp, Artificial Sequence
  Synthetic oligonucleotide
gatcgctagaggagggaatgggggaaaggggatgg

SEQ ID NO: 107475 - DNA, 35 bp, Artificial Sequence
  Synthetic oligonucleotide
gagtcgctcacctgtttgtccgtttgcctccatgc

SEQ ID NO: 107476 - DNA, 36 bp, Artificial Sequence
  Synthetic oligonucleotide
gaagggagggatagaacagtggaagggcagggtata

SEQ ID NO: 107477 - DNA, 35 bp, Artificial Sequence
  Synthetic oligonucleotide
tcgctgccgcaaatacgctgattcacctgctcctc

SEQ ID NO: 107478 - DNA, 37 bp, Artificial Sequence
  Synthetic oligonucleotide
gcccaccgccctgttctattgccgttcgattcgttga

SEQ ID NO: 107479 - DNA, 35 bp, Artificial Sequence
  Synthetic oligonucleotide
taggaggtggaggtgacggggggcgggcaacgggg

SEQ ID NO: 107480 - DNA, 35 bp, Artificial Sequence
  Synthetic oligonucleotide
gactggggcgggtgggttaaaccatcccacggggt

SEQ ID NO: 107481 - DNA, 37 bp, Artificial Sequence
  Synthetic oligonucleotide
tgccgcgcccccgtatgcctcctgtcctcttctccga

SEQ ID NO: 107482 - DNA, 35 bp, Artificial Sequence
  Synthetic oligonucleotide
tcccaccatcgattcgatctgcacctggttactcg

SEQ ID NO: 107483 - DNA, 37 bp, Artificial Sequence
  Synthetic oligonucleotide
ggggggacggagaggttaggggcgagagtaggtcaga

SEQ ID NO: 107484 - DNA, 37 bp, Artificial Sequence
  Synthetic oligonucleotide
gttgtccccatctgttgttccttccgccattcaatga

SEQ ID NO: 107485 - DNA, 35 bp, Artificial Sequence
  Synthetic oligonucleotide
gacgcctccgacccttcgccgtactataactcctc

SEQ ID NO: 107486 - DNA, 35 bp, Artificial Sequence
  Synthetic oligonucleotide
gtcctcccacatggcttctcgctgacccatttttt

SEQ ID NO: 107487 - DNA, 35 bp, Artificial Sequence
  Synthetic oligonucleotide
ataccaccatccatgccctaggtgtgcgcaacacc

SEQ ID NO: 107488 - DNA, 35 bp, Artificial Sequence
  Synthetic oligonucleotide
ttggacgccttgccctacccctcgttgccctgatc

SEQ ID NO: 107489 - DNA, 38 bp, Artificial Sequence
  Synthetic oligonucleotide
atggacaggtaacggtggggtaagggggcgggaggtga

SEQ ID NO: 107490 - DNA, 35 bp, Artificial Sequence
  Synthetic oligonucleotide
acgagaggaccggaattggggagggaagcggggat

SEQ ID NO: 107491 - DNA, 35 bp, Artificial Sequence
  Synthetic oligonucleotide
gcaaccacccatcgcacattacgacaagcctccac

SEQ ID NO: 107492 - DNA, 35 bp, Artificial Sequence
  Synthetic oligonucleotide
gtcacccctctggtgagaacgattaacaccctgcc

SEQ ID NO: 107493 - DNA, 35 bp, Artificial Sequence
  Synthetic oligonucleotide
gctgcccccccacccgattatattgctgcgcttca

SEQ ID NO: 107494 - DNA, 36 bp, Artificial Sequence
  Synthetic oligonucleotide
tatcccgccaatcctgccccacagactcagctccca

SEQ ID NO: 107495 - DNA, 35 bp, Artificial Sequence
  Synthetic oligonucleotide
tgaccccagccccaaacattgctactcgcgtgccc

SEQ ID NO: 107496 - DNA, 35 bp, Artificial Sequence
  Synthetic oligonucleotide
gtggtgtgtgacgaaaggggggcgatgggaaggga

SEQ ID NO: 107497 - DNA, 37 bp, Artificial Sequence
  Synthetic oligonucleotide
tctgacgacgtcagccggcccatagttcctccatcga

SEQ ID NO: 107498 - DNA, 37 bp, Artificial Sequence
  Synthetic oligonucleotide
ttcagggggagggtgggcaaagttacaggacagggga

SEQ ID NO: 107499 - DNA, 36 bp, Artificial Sequence
  Synthetic oligonucleotide
gttaaggatggctgggaagaagggcggggaggggga

SEQ ID NO: 107500 - DNA, 35 bp, Artificial Sequence
  Synthetic oligonucleotide
gatgctaccaccgccgttatccaggcaacctcgcc

SEQ ID NO: 107501 - DNA, 35 bp, Artificial Sequence
  Synthetic oligonucleotide
tttcgtccccctctccatgctacctccacgtcgat

SEQ ID NO: 107502 - DNA, 35 bp, Artificial Sequence
  Synthetic oligonucleotide
gcacacaacaccgctcccgacgctgatatcccgcc

SEQ ID NO: 107503 - DNA, 35 bp, Artificial Sequence
  Synthetic oligonucleotide
agttaccgcccaccgcccgtccatgctcggtccgc

SEQ ID NO: 107504 - DNA, 35 bp, Artificial Sequence
  Synthetic oligonucleotide
aaccacccgatccttcatgcacctggcctactcca

SEQ ID NO: 107505 - DNA, 35 bp, Artificial Sequence
  Synthetic oligonucleotide
ttcccatcccctcgccatatgaccactggtttccc

SEQ ID NO: 107506 - DNA, 35 bp, Artificial Sequence
  Synthetic oligonucleotide
ttccaagccccccccgcagccttctccgttgttca

SEQ ID NO: 107507 - DNA, 35 bp, Artificial Sequence
  Synthetic oligonucleotide
gcacacagcctcctcacttgtcacacgccatccga

SEQ ID NO: 107508 - DNA, 35 bp, Artificial Sequence
  Synthetic oligonucleotide
gccccttcccgctatatccctgctcgttcgcgatc

SEQ ID NO: 107509 - DNA, 35 bp, Artificial Sequence
  Synthetic oligonucleotide
ttcaccatcaccgtatagcgccttagcctccccaa

SEQ ID NO: 107510 - DNA, 35 bp, Artificial Sequence
  Synthetic oligonucleotide
ttccacgccgccacgatctgcacactcacacctgc

SEQ ID NO: 107511 - DNA, 37 bp, Artificial Sequence
  Synthetic oligonucleotide
gaagggtgagagagtggaggggggggacgtggatcga

SEQ ID NO: 107512 - DNA, 38 bp, Artificial Sequence
  Synthetic oligonucleotide
gccgtacgcccgttgcaattactgccccttcttgttga

SEQ ID NO: 107513 - DNA, 35 bp, Artificial Sequence
  Synthetic oligonucleotide
gtgcggactgcaggttatttctgatcctccgcccc

SEQ ID NO: 107514 - DNA, 35 bp, Artificial Sequence
  Synthetic oligonucleotide
gggaccgtcgtctgtcttctttggcccgtttttcc

SEQ ID NO: 107515 - DNA, 35 bp, Artificial Sequence
  Synthetic oligonucleotide
taagcgcagattcacgtttcctgcctgtatcttcc

SEQ ID NO: 107516 - DNA, 35 bp, Artificial Sequence
  Synthetic oligonucleotide
tctgggggaaagggaggatcaagaaaaggggggca

SEQ ID NO: 107517 - DNA, 36 bp, Artificial Sequence
  Synthetic oligonucleotide
acgaaggggagaggggggagagggacggtgatatta

SEQ ID NO: 107518 - DNA, 35 bp, Artificial Sequence
  Synthetic oligonucleotide
atccgccccggccctcccatccgcacggtcttaca

SEQ ID NO: 107519 - DNA, 37 bp, Artificial Sequence
  Synthetic oligonucleotide
tccgcgcattctgtcgtttcgcgcactcctcctctga

SEQ ID NO: 107520 - DNA, 35 bp, Artificial Sequence
  Synthetic oligonucleotide
tcctacccccatccgttttaagtgcgacctgctgc

SEQ ID NO: 107521 - DNA, 34 bp, Artificial Sequence
  Synthetic oligonucleotide
gagccgtctgcccctatagatgcccctcgtccca

SEQ ID NO: 107522 - DNA, 35 bp, Artificial Sequence
  Synthetic oligonucleotide
tcgcacctccctgcactgcgccccggtcacctgga

SEQ ID NO: 107523 - DNA, 33 bp, Artificial Sequence
  Synthetic oligonucleotide
ctcacccacccgccatttgttccttggttccct

SEQ ID NO: 107524 - DNA, 35 bp, Artificial Sequence
  Synthetic oligonucleotide
tcatgacgacgtcagtagcgcctccccacttttca

SEQ ID NO: 107525 - DNA, 35 bp, Artificial Sequence
  Synthetic oligonucleotide
tcacctcccgcctactttattggagtctttcacct

SEQ ID NO: 107526 - DNA, 34 bp, Artificial Sequence
  Synthetic oligonucleotide
gcgcccttcgcacgtattacactccccccacaca

SEQ ID NO: 107527 - DNA, 34 bp, Artificial Sequence
  Synthetic oligonucleotide
gtactgtcacggtccctgcctccccttttcaacg

SEQ ID NO: 107528 - DNA, 37 bp, Artificial Sequence
  Synthetic oligonucleotide
tccgcaagcggagcttcgtaacatctgcccctcttga

SEQ ID NO: 107529 - DNA, 35 bp, Artificial Sequence
  Synthetic oligonucleotide
aacatggggaggtgagggaggagtaaggaatgatg

SEQ ID NO: 107530 - DNA, 35 bp, Artificial Sequence
  Synthetic oligonucleotide
actccctctgcccctcgattcgcgaccacccgcac

SEQ ID NO: 107531 - DNA, 37 bp, Artificial Sequence
  Synthetic oligonucleotide
tacccgccacatggttgccacatccctcgcgccccga

SEQ ID NO: 107532 - DNA, 36 bp, Artificial Sequence
  Synthetic oligonucleotide
actgtgccactgcccgttatccccctccacgtatga

SEQ ID NO: 107533 - DNA, 37 bp, Artificial Sequence
  Synthetic oligonucleotide
aatcacaggggggggaatggggtcagggggaaccgga

SEQ ID NO: 107534 - DNA, 36 bp, Artificial Sequence
  Synthetic oligonucleotide
tccagatgctgtctctgttttgccaccatacttcca

SEQ ID NO: 107535 - DNA, 37 bp, Artificial Sequence
  Synthetic oligonucleotide
aagtgtggaaggcgaagggagaaggggacgagtcaga

SEQ ID NO: 107536 - DNA, 35 bp, Artificial Sequence
  Synthetic oligonucleotide
ggtaacatgccgttgtcctcctccaccgccgccgg

SEQ ID NO: 107537 - DNA, 35 bp, Artificial Sequence
  Synthetic oligonucleotide
gtcacactcccctgccctattgtagtaaacgttct

SEQ ID NO: 107538 - DNA, 36 bp, Artificial Sequence
  Synthetic oligonucleotide
ttcacccccccaccgtacgacttgaccttgggtcaa

SEQ ID NO: 107539 - DNA, 37 bp, Artificial Sequence
  Synthetic oligonucleotide
gtcagggagggcgggtgaagggaagatagcggatgga

SEQ ID NO: 107540 - DNA, 35 bp, Artificial Sequence
  Synthetic oligonucleotide
tgtagaccgccgtatgtccgcgtgccgttccttct

SEQ ID NO: 107541 - DNA, 35 bp, Artificial Sequence
  Synthetic oligonucleotide
tatcagcccggccccttatatgcacgtcgccactc

SEQ ID NO: 107542 - DNA, 38 bp, Artificial Sequence
  Synthetic oligonucleotide
gaccctccatccgccccccctccagtcagcacatctga

SEQ ID NO: 107543 - DNA, 36 bp, Artificial Sequence
  Synthetic oligonucleotide
ttccatcccgtcagatcgtctccaaccctcacccca

SEQ ID NO: 107544 - DNA, 36 bp, Artificial Sequence
  Synthetic oligonucleotide
tcccacccaccttctgcacatgcacccgttggttca

SEQ ID NO: 107545 - DNA, 35 bp, Artificial Sequence
  Synthetic oligonucleotide
ttgactcttccgccttgtatctcgtgttttccgcc

SEQ ID NO: 107546 - DNA, 35 bp, Artificial Sequence
  Synthetic oligonucleotide
tcctcctccacagacgcatacacaccagctctttt

SEQ ID NO: 107547 - DNA, 35 bp, Artificial Sequence
  Synthetic oligonucleotide
actgcaccccctgtacccctgcctcgacatcggcc

SEQ ID NO: 107548 - DNA, 38 bp, Artificial Sequence
  Synthetic oligonucleotide
gagaagggggtggtggaagacagggaggggatgactga

SEQ ID NO: 107549 - DNA, 35 bp, Artificial Sequence
  Synthetic oligonucleotide
accctcgccgtgcccgttatttccatacgtacctt

SEQ ID NO: 107550 - DNA, 35 bp, Artificial Sequence
  Synthetic oligonucleotide
gcgaccatttccgccgctgtttaacccgctcctca

SEQ ID NO: 107551 - DNA, 35 bp, Artificial Sequence
  Synthetic oligonucleotide
gcataccccgcccgactcgccccttggtcattccc

SEQ ID NO: 107552 - DNA, 35 bp, Artificial Sequence
  Synthetic oligonucleotide
acagacggcgcccatattctgccctttcccatgtc

SEQ ID NO: 107553 - DNA, 35 bp, Artificial Sequence
  Synthetic oligonucleotide
tttccacccgcctaccgaatcggttgaatccttat

SEQ ID NO: 107554 - DNA, 36 bp, Artificial Sequence
  Synthetic oligonucleotide
ttgcgccgcacatttctacgtctatcccctctcgga

SEQ ID NO: 107555 - DNA, 35 bp, Artificial Sequence
  Synthetic oligonucleotide
actgggagggagggggtctaatggggtgcctgtaa

SEQ ID NO: 107556 - DNA, 35 bp, Artificial Sequence
  Synthetic oligonucleotide
gtctcaagccaccaatttgcccgccggttccacca

SEQ ID NO: 107557 - DNA, 35 bp, Artificial Sequence
  Synthetic oligonucleotide
tcccgcacttatggttccgctcctcgctttctgcg

SEQ ID NO: 107558 - DNA, 35 bp, Artificial Sequence
  Synthetic oligonucleotide
tcgccggccacctggttccgttgctttttacctcc

SEQ ID NO: 107559 - DNA, 35 bp, Artificial Sequence
  Synthetic oligonucleotide
gaccctgccatcgcattctttgatccactctcgtc

SEQ ID NO: 107560 - DNA, 35 bp, Artificial Sequence
  Synthetic oligonucleotide
gccccgtcgctttcttgcatgttccccctgtgccc

SEQ ID NO: 107561 - DNA, 35 bp, Artificial Sequence
  Synthetic oligonucleotide
acttcctgcccacacgctctccatatgctcattcc

SEQ ID NO: 107562 - DNA, 35 bp, Artificial Sequence
  Synthetic oligonucleotide
gtccacgccttcctgcttccaatcggagattggcc

SEQ ID NO: 107563 - DNA, 35 bp, Artificial Sequence
  Synthetic oligonucleotide
atcgcacccgccccacaatgccctgttccgaacct

SEQ ID NO: 107564 - DNA, 36 bp, Artificial Sequence
  Synthetic oligonucleotide
gagggggaatcatggggagggggatggaggtgacaa

SEQ ID NO: 107565 - DNA, 35 bp, Artificial Sequence
  Synthetic oligonucleotide
agttgcatccagcccgccgttctatctggtacctt

SEQ ID NO: 107566 - DNA, 35 bp, Artificial Sequence
  Synthetic oligonucleotide
tgtggttggagtagggggcatgggggacggacgga

SEQ ID NO: 107567 - DNA, 35 bp, Artificial Sequence
  Synthetic oligonucleotide
acaccccgtccgcgcgctttgagccctgctaatct

SEQ ID NO: 107568 - DNA, 36 bp, Artificial Sequence
  Synthetic oligonucleotide
gtgacaccctcctgcgctttcactcaatgctccaca

SEQ ID NO: 107569 - DNA, 35 bp, Artificial Sequence
  Synthetic oligonucleotide
gtgcgtaacgctccttccctatgtcctgcttgctg

SEQ ID NO: 107570 - DNA, 35 bp, Artificial Sequence
  Synthetic oligonucleotide
tccaccctctcaccgctcgcttctgtaaccggtct

SEQ ID NO: 107571 - DNA, 36 bp, Artificial Sequence
  Synthetic oligonucleotide
gcccccctccgtctgttgccatccgatcgtgctgca

SEQ ID NO: 107572 - DNA, 36 bp, Artificial Sequence
  Synthetic oligonucleotide
tcccacgccacagccctccgaacacacgcccgttga

SEQ ID NO: 107573 - DNA, 35 bp, Artificial Sequence
  Synthetic oligonucleotide
tctcccccgatgcgccctcaccgacttcttactcg

SEQ ID NO: 107574 - DNA, 35 bp, Artificial Sequence
  Synthetic oligonucleotide
aaactaggcgggggacggacgggggtgggcggaaa

SEQ ID NO: 107575 - DNA, 38 bp, Artificial Sequence
  Synthetic oligonucleotide
gaccgagcaggtcacctattcgcccccgcctttcctga

SEQ ID NO: 107576 - DNA, 35 bp, Artificial Sequence
  Synthetic oligonucleotide
taagccgcccgaagtcgtcatggcctcattctctc

SEQ ID NO: 107577 - DNA, 35 bp, Artificial Sequence
  Synthetic oligonucleotide
gggaccccgccgcttctacatattcctgctgatcc

SEQ ID NO: 107578 - DNA, 36 bp, Artificial Sequence
  Synthetic oligonucleotide
ttgggcgggatgggtagggaacaatatcatttatca

SEQ ID NO: 107579 - DNA, 35 bp, Artificial Sequence
  Synthetic oligonucleotide
gtgcctcctccatgtcgttcgtcccgctttgcccc

SEQ ID NO: 107580 - DNA, 36 bp, Artificial Sequence
  Synthetic oligonucleotide
acagaggggggagggtcggggacggggttagagaaa

SEQ ID NO: 107581 - DNA, 37 bp, Artificial Sequence
  Synthetic oligonucleotide
accgacgcctcttccctgccacatcagtcccccctga

SEQ ID NO: 107582 - DNA, 38 bp, Artificial Sequence
  Synthetic oligonucleotide
ggagagagggcgggtgggtctccctgtcaaagtagtga

SEQ ID NO: 107583 - DNA, 35 bp, Artificial Sequence
  Synthetic oligonucleotide
acgctcggggaaagggtggtgaagggggatgaaca

SEQ ID NO: 107584 - DNA, 36 bp, Artificial Sequence
  Synthetic oligonucleotide
gtggggcaaggggacgggggggtctaagtggtgagg

SEQ ID NO: 107585 - DNA, 34 bp, Artificial Sequence
  Synthetic oligonucleotide
gagccgctctctttccgtgatcgatcgcccctcc

SEQ ID NO: 107586 - DNA, 35 bp, Artificial Sequence
  Synthetic oligonucleotide
gatgcctgggtaaggcccggcccaaaacacctcta

SEQ ID NO: 107587 - DNA, 35 bp, Artificial Sequence
  Synthetic oligonucleotide
tgagacccctcattgctttgttcgcgtgctaccgc

SEQ ID NO: 107588 - DNA, 35 bp, Artificial Sequence
  Synthetic oligonucleotide
gattagccgtctgcccctagtacacctgccccgtc

SEQ ID NO: 107589 - DNA, 35 bp, Artificial Sequence
  Synthetic oligonucleotide
tgagccacccttccgcatatgtacttcatcacttc

SEQ ID NO: 107590 - DNA, 35 bp, Artificial Sequence
  Synthetic oligonucleotide
tgaacccaccactacctcacagagcgagtacatct

SEQ ID NO: 107591 - DNA, 35 bp, Artificial Sequence
  Synthetic oligonucleotide
atgccctgccgctatcttttcccgacccggtatct

SEQ ID NO: 107592 - DNA, 35 bp, Artificial Sequence
  Synthetic oligonucleotide
tgggacccgctgccccgttatatctccggtccaac

SEQ ID NO: 107593 - DNA, 35 bp, Artificial Sequence
  Synthetic oligonucleotide
tcatccgccttcccgttatgtccctatttgtgcta

SEQ ID NO: 107594 - DNA, 35 bp, Artificial Sequence
  Synthetic oligonucleotide
acacccgcgccgccgtgcctttacttttctgcata

SEQ ID NO: 107595 - DNA, 35 bp, Artificial Sequence
  Synthetic oligonucleotide
tccatggtgcctcctgttaaaccgcccccgctact

SEQ ID NO: 107596 - DNA, 37 bp, Artificial Sequence
  Synthetic oligonucleotide
gggacacggggcaagaaggcggtggagggcgcgggga

SEQ ID NO: 107597 - DNA, 35 bp, Artificial Sequence
  Synthetic oligonucleotide
accccaaccgccctccgcgcatacaccactgttcc

SEQ ID NO: 107598 - DNA, 35 bp, Artificial Sequence
  Synthetic oligonucleotide
tttgacacccgactctatctcttagcgtgcccatc

SEQ ID NO: 107599 - DNA, 38 bp, Artificial Sequence
  Synthetic oligonucleotide
ggacatcagggagaagaagcgggggggcgaggggatga

SEQ ID NO: 107600 - DNA, 35 bp, Artificial Sequence
  Synthetic oligonucleotide
taaccctgccacactgcctagcctccacgcttttt

SEQ ID NO: 107601 - DNA, 31 bp, Artificial Sequence
  Synthetic oligonucleotide
atgggaatggggtgaggagaggggatgaggg

SEQ ID NO: 107602 - DNA, 35 bp, Artificial Sequence
  Synthetic oligonucleotide
accgccgtctcgccgcctttatacctcatacgttg

SEQ ID NO: 107603 - DNA, 35 bp, Artificial Sequence
  Synthetic oligonucleotide
ggagaaggtggtgggtgggatagggtcgcccggcg

SEQ ID NO: 107604 - DNA, 35 bp, Artificial Sequence
  Synthetic oligonucleotide
gatccgccactcgtactttgactattatccctccg

SEQ ID NO: 107605 - DNA, 35 bp, Artificial Sequence
  Synthetic oligonucleotide
tcgtgacgtcatgatatatgctccctgccctgtcc

SEQ ID NO: 107606 - DNA, 29 bp, Artificial Sequence
  Synthetic oligonucleotide
gcgaaacctccactccaccgcctgctctg

SEQ ID NO: 107607 - DNA, 34 bp, Artificial Sequence
  Synthetic oligonucleotide
accatcctcagtttcgtactccaatcttcgcgcc

SEQ ID NO: 107608 - DNA, 35 bp, Artificial Sequence
  Synthetic oligonucleotide
acgaccacggatatgtcgatccccgtccacacccc

SEQ ID NO: 107609 - DNA, 37 bp, Artificial Sequence
  Synthetic oligonucleotide
gaggcacctcggggccatatttgagggtgggtgggga

SEQ ID NO: 107610 - DNA, 37 bp, Artificial Sequence
  Synthetic oligonucleotide
atggtacgggggaggagggtaaggggaatacgaatga

SEQ ID NO: 107611 - DNA, 35 bp, Artificial Sequence
  Synthetic oligonucleotide
tcccaacaccacatctgtattacctcaatcactcg

SEQ ID NO: 107612 - DNA, 35 bp, Artificial Sequence
  Synthetic oligonucleotide
tccgctcacgtcctctttgccttgatttgcgcttc

SEQ ID NO: 107613 - DNA, 35 bp, Artificial Sequence
  Synthetic oligonucleotide
tgcccggcgcatcgctactcagtgccccgttcccc

SEQ ID NO: 107614 - DNA, 35 bp, Artificial Sequence
  Synthetic oligonucleotide
tagccccgtgcgttggtctcgttctctccctctgg

SEQ ID NO: 107615 - DNA, 35 bp, Artificial Sequence
  Synthetic oligonucleotide
acaccagccgcctccacctgccgttcaaattacac

SEQ ID NO: 107616 - DNA, 36 bp, Artificial Sequence
  Synthetic oligonucleotide
gtcaccccctcctccagtgcagttagtgcacttaca

SEQ ID NO: 107617 - DNA, 35 bp, Artificial Sequence
  Synthetic oligonucleotide
gtgcctccctaccatccgcctcgccgtgctatcga

SEQ ID NO: 107618 - DNA, 35 bp, Artificial Sequence
  Synthetic oligonucleotide
gtgtgcatcccgcttcctttagtagatctgcctcc

SEQ ID NO: 107619 - DNA, 36 bp, Artificial Sequence
  Synthetic oligonucleotide
gagaaacgtggggggaaaaagggcggtccgggggca

SEQ ID NO: 107620 - DNA, 35 bp, Artificial Sequence
  Synthetic oligonucleotide
gagccctatcgcgcttcttttgcaccctttcaccg

SEQ ID NO: 107621 - DNA, 35 bp, Artificial Sequence
  Synthetic oligonucleotide
gaaccgtacctgctttgtcacgtcccttttgctcc

SEQ ID NO: 107622 - DNA, 35 bp, Artificial Sequence
  Synthetic oligonucleotide
atcaacgcccaccggctactcaggacctcctcccg

SEQ ID NO: 107623 - DNA, 35 bp, Artificial Sequence
  Synthetic oligonucleotide
acctcctcactcgctgtttttatctacactgcctc

SEQ ID NO: 107624 - DNA, 37 bp, Artificial Sequence
  Synthetic oligonucleotide
agcgcataggaaggggggacgggaggaggggctgaga

SEQ ID NO: 107625 - DNA, 35 bp, Artificial Sequence
  Synthetic oligonucleotide
tagtaccacctatctccggagaattcaccccatgg

SEQ ID NO: 107626 - DNA, 36 bp, Artificial Sequence
  Synthetic oligonucleotide
tagaccatcacccggtcgtgtcgtttccccttgcct

SEQ ID NO: 107627 - DNA, 35 bp, Artificial Sequence
  Synthetic oligonucleotide
gcactccacacgtgcttatatatcatactgtcccc

SEQ ID NO: 107628 - DNA, 35 bp, Artificial Sequence
  Synthetic oligonucleotide
gccctcccccgttccgcctttcgagcccttgacat

SEQ ID NO: 107629 - DNA, 36 bp, Artificial Sequence
  Synthetic oligonucleotide
ttacccacacatttgcctaatgaacccgctcttgcc

SEQ ID NO: 107630 - DNA, 36 bp, Artificial Sequence
  Synthetic oligonucleotide
aatggtgcagtaagtggggggatttggggaagggaa

SEQ ID NO: 107631 - DNA, 38 bp, Artificial Sequence
  Synthetic oligonucleotide
cactgggagagagggttgggagggtagaactacggtga

SEQ ID NO: 107632 - DNA, 35 bp, Artificial Sequence
  Synthetic oligonucleotide
acgcacgcctccgctctcgctccttcccccgccga

SEQ ID NO: 107633 - DNA, 35 bp, Artificial Sequence
  Synthetic oligonucleotide
gtgcccgtaattgtcgccttatgctgccgtttccc

SEQ ID NO: 107634 - DNA, 38 bp, Artificial Sequence
  Synthetic oligonucleotide
gctcatcctcccgttgccgttatgcctctccaccttga

SEQ ID NO: 107635 - DNA, 36 bp, Artificial Sequence
  Synthetic oligonucleotide
tagaacgcagagctgcccgtccttcactgttccacc

SEQ ID NO: 107636 - DNA, 35 bp, Artificial Sequence
  Synthetic oligonucleotide
agcccgtcactgccatgatcacccactccacccgc

SEQ ID NO: 107637 - DNA, 35 bp, Artificial Sequence
  Synthetic oligonucleotide
acttccgcctccgattgctctctccacatcgctgc

SEQ ID NO: 107638 - DNA, 35 bp, Artificial Sequence
  Synthetic oligonucleotide
gcactagcccccgatgccaccctacccttattcgg

SEQ ID NO: 107639 - DNA, 35 bp, Artificial Sequence
  Synthetic oligonucleotide
ttcgtacccgcccttctggttgctcgtttatctct

SEQ ID NO: 107640 - DNA, 35 bp, Artificial Sequence
  Synthetic oligonucleotide
gcgaaacgcgcaacgtgggaagggatgggtgggct

SEQ ID NO: 107641 - DNA, 36 bp, Artificial Sequence
  Synthetic oligonucleotide
gcctccgccgacgagtttcgccctcctagccaccaa

SEQ ID NO: 107642 - DNA, 35 bp, Artificial Sequence
  Synthetic oligonucleotide
atccacatccggtcacgtgacactgccccttctca

SEQ ID NO: 107643 - DNA, 37 bp, Artificial Sequence
  Synthetic oligonucleotide
accgcacccgctcgcctgcattgtttcatcccctaga

SEQ ID NO: 107644 - DNA, 37 bp, Artificial Sequence
  Synthetic oligonucleotide
atgcacccctgttcttcggcccgctgccttctcgcta

SEQ ID NO: 107645 - DNA, 35 bp, Artificial Sequence
  Synthetic oligonucleotide
tgtcctccctgcctggtcgcgacccgtttccctaa

SEQ ID NO: 107646 - DNA, 35 bp, Artificial Sequence
  Synthetic oligonucleotide
tacgcttgccctcacgtttgaccgcacaccacttc

SEQ ID NO: 107647 - DNA, 35 bp, Artificial Sequence
  Synthetic oligonucleotide
acatcccatcactgtttgcaccggtttaatccgct

SEQ ID NO: 107648 - DNA, 37 bp, Artificial Sequence
  Synthetic oligonucleotide
atccccacccctgctggtttctggaaccgccctttga

SEQ ID NO: 107649 - DNA, 36 bp, Artificial Sequence
  Synthetic oligonucleotide
tgtggcactgaggggcgggaaggggggaagaagggg

SEQ ID NO: 107650 - DNA, 34 bp, Artificial Sequence
  Synthetic oligonucleotide
tagtgcgcagccccgactccgcccctgatacctc

SEQ ID NO: 107651 - DNA, 35 bp, Artificial Sequence
  Synthetic oligonucleotide
gacccgccacctggtcctttatagataactctgtc

SEQ ID NO: 107652 - DNA, 36 bp, Artificial Sequence
  Synthetic oligonucleotide
taccgctcgcccctcgtagttaccacgacccctgta

SEQ ID NO: 107653 - DNA, 35 bp, Artificial Sequence
  Synthetic oligonucleotide
gtccctccaccgctcctgtcgttattcatcgtaaa

SEQ ID NO: 107654 - DNA, 35 bp, Artificial Sequence
  Synthetic oligonucleotide
taccgcctacgttgcctccgtttgcctcccttgtc

SEQ ID NO: 107655 - DNA, 35 bp, Artificial Sequence
  Synthetic oligonucleotide
gaaaacagaaggggggaggctcaggcgggagtgga

SEQ ID NO: 107656 - DNA, 36 bp, Artificial Sequence
  Synthetic oligonucleotide
gatgacctccgcccgagtttttgccctatttcatta

SEQ ID NO: 107657 - DNA, 35 bp, Artificial Sequence
  Synthetic oligonucleotide
tgaaccggtcacagtattgcttctagtgttcctcc

SEQ ID NO: 107658 - DNA, 35 bp, Artificial Sequence
  Synthetic oligonucleotide
tcatgcgctttccttcgcccgctgtttcctccatg

SEQ ID NO: 107659 - DNA, 35 bp, Artificial Sequence
  Synthetic oligonucleotide
tctgccagcacctccacatgtccttccacgccaat

SEQ ID NO: 107660 - DNA, 36 bp, Artificial Sequence
  Synthetic oligonucleotide
atccaccctcggcgcgtacactacccacgcccgcca

SEQ ID NO: 107661 - DNA, 35 bp, Artificial Sequence
  Synthetic oligonucleotide
gagccactccgccgatcgtacatccatcaccatca

SEQ ID NO: 107662 - DNA, 35 bp, Artificial Sequence
  Synthetic oligonucleotide
tcacagcagatcacctactccatgtccctcgtgcc

SEQ ID NO: 107663 - DNA, 35 bp, Artificial Sequence
  Synthetic oligonucleotide
tgctgccccttgtcgacctgtctgccgcactcctt

SEQ ID NO: 107664 - DNA, 35 bp, Artificial Sequence
  Synthetic oligonucleotide
gcagggagggggtgggagaaaaaagggctatgagg

SEQ ID NO: 107665 - DNA, 35 bp, Artificial Sequence
  Synthetic oligonucleotide
accgcccctccccactgactccgtattgcaaagct

SEQ ID NO: 107666 - DNA, 35 bp, Artificial Sequence
  Synthetic oligonucleotide
gcacgttgcggtagtcctttcccctgtttccctcc

SEQ ID NO: 107667 - DNA, 35 bp, Artificial Sequence
  Synthetic oligonucleotide
tgcatctcccgctgacatgggccggtcgcattttt

SEQ ID NO: 107668 - DNA, 36 bp, Artificial Sequence
  Synthetic oligonucleotide
tcaccccctcgccccgctgtcgtcctgacatactca

SEQ ID NO: 107669 - DNA, 37 bp, Artificial Sequence
  Synthetic oligonucleotide
accgtcgacacatctgccccacatccccgcccttgga

SEQ ID NO: 107670 - DNA, 35 bp, Artificial Sequence
  Synthetic oligonucleotide
gaggggacgggaatggagggggtgcgagtccgagg

SEQ ID NO: 107671 - DNA, 35 bp, Artificial Sequence
  Synthetic oligonucleotide
tactatgcgccgtccagttaacatatgctcccctc

SEQ ID NO: 107672 - DNA, 35 bp, Artificial Sequence
  Synthetic oligonucleotide
gctgtccacttttagccgctttcgacccttacgca

SEQ ID NO: 107673 - DNA, 35 bp, Artificial Sequence
  Synthetic oligonucleotide
tgggaccgcctctgtactcgttcgttccgtgtccc

SEQ ID NO: 107674 - DNA, 35 bp, Artificial Sequence
  Synthetic oligonucleotide
gtgcacattccatcagccccgtcggaccctgctcc

SEQ ID NO: 107675 - DNA, 35 bp, Artificial Sequence
  Synthetic oligonucleotide
gaacgcccgctgctctctctcgctacccatacttg

SEQ ID NO: 107676 - DNA, 35 bp, Artificial Sequence
  Synthetic oligonucleotide
gtgcgcaccccccgcgacgttttcaccgtccctcc

SEQ ID NO: 107677 - DNA, 36 bp, Artificial Sequence
  Synthetic oligonucleotide
ttgcccgccctcgctcccgtttgttcagctgttcca

SEQ ID NO: 107678 - DNA, 35 bp, Artificial Sequence
  Synthetic oligonucleotide
acgatgcctaccctgttttcccccggcgtatagcc

SEQ ID NO: 107679 - DNA, 34 bp, Artificial Sequence
  Synthetic oligonucleotide
tgcccctcggcccatttgctttgcgtttttccac

SEQ ID NO: 107680 - DNA, 35 bp, Artificial Sequence
  Synthetic oligonucleotide
acgcgagctcttgtctgcttgcgccccccttcttc

SEQ ID NO: 107681 - DNA, 35 bp, Artificial Sequence
  Synthetic oligonucleotide
tgcacgccctttccaccgtgttcaccttgtacctt

SEQ ID NO: 107682 - DNA, 37 bp, Artificial Sequence
  Synthetic oligonucleotide
aagtggggtggagcacgagggggatagtacggaggga

SEQ ID NO: 107683 - DNA, 36 bp, Artificial Sequence
  Synthetic oligonucleotide
gtagccccaacttgtactccaccgcacctccgccga

SEQ ID NO: 107684 - DNA, 37 bp, Artificial Sequence
  Synthetic oligonucleotide
ggggcactatcaccgggtgggggagtcacggggatga

SEQ ID NO: 107685 - DNA, 35 bp, Artificial Sequence
  Synthetic oligonucleotide
tccatcctgcccttcagcaaagccctaggctccct

SEQ ID NO: 107686 - DNA, 35 bp, Artificial Sequence
  Synthetic oligonucleotide
tacgcggacatgaccctgcgattccagtttcttcc

SEQ ID NO: 107687 - DNA, 35 bp, Artificial Sequence
  Synthetic oligonucleotide
taatcgcgcctgtccttaccccgtctgccctttgt

SEQ ID NO: 107688 - DNA, 35 bp, Artificial Sequence
  Synthetic oligonucleotide
ttaccggtcgccctgctagttctttcgtgcctctc

SEQ ID NO: 107689 - DNA, 36 bp, Artificial Sequence
  Synthetic oligonucleotide
agactcaggtaagggcgggtgaggcgggaggggtga

SEQ ID NO: 107690 - DNA, 37 bp, Artificial Sequence
  Synthetic oligonucleotide
gtggtggcggtggcgggcaacggagggcgggaaccga

SEQ ID NO: 107691 - DNA, 37 bp, Artificial Sequence
  Synthetic oligonucleotide
ggacactgcccgttccgcatatacgacccacctctga

SEQ ID NO: 107692 - DNA, 37 bp, Artificial Sequence
  Synthetic oligonucleotide
gatgccccatttggaactgttacgctccctccttgga

SEQ ID NO: 107693 - DNA, 35 bp, Artificial Sequence
  Synthetic oligonucleotide
tgcccaactttgttgttgtaactccttcttgtccc

SEQ ID NO: 107694 - DNA, 36 bp, Artificial Sequence
  Synthetic oligonucleotide
tgccccttcccctgtgccgaatttgccaccttatta

SEQ ID NO: 107695 - DNA, 35 bp, Artificial Sequence
  Synthetic oligonucleotide
tgctactgcccagttctctttgtcctgtcgccaca

SEQ ID NO: 107696 - DNA, 38 bp, Artificial Sequence
  Synthetic oligonucleotide
tacccctgccatcacattctctactctgtcctgcctga

SEQ ID NO: 107697 - DNA, 35 bp, Artificial Sequence
  Synthetic oligonucleotide
tgcccctcgccatttcaaagccagcactttctccc

SEQ ID NO: 107698 - DNA, 35 bp, Artificial Sequence
  Synthetic oligonucleotide
agcgttgccccgttcaccatggtacgtccctcact

SEQ ID NO: 107699 - DNA, 34 bp, Artificial Sequence
  Synthetic oligonucleotide
tgccacccctgccccatactcctgtctcagagac

SEQ ID NO: 107700 - DNA, 35 bp, Artificial Sequence
  Synthetic oligonucleotide
tctgtcgtccgccgcactgttttgcccgccctgtc

SEQ ID NO: 107701 - DNA, 35 bp, Artificial Sequence
  Synthetic oligonucleotide
atccgccacgcctctctgtccactttcgttacccc

SEQ ID NO: 107702 - DNA, 35 bp, Artificial Sequence
  Synthetic oligonucleotide
acccgtccacggtcatataccacccatttcccacg

SEQ ID NO: 107703 - DNA, 33 bp, Artificial Sequence
  Synthetic oligonucleotide
ttcctccgccttgcttgttaccctcgccatcct

SEQ ID NO: 107704 - DNA, 35 bp, Artificial Sequence
  Synthetic oligonucleotide
tccactcgaagccgcccgtatcgtcgttcgcctcc

SEQ ID NO: 107705 - DNA, 35 bp, Artificial Sequence
  Synthetic oligonucleotide
gaggggatgacggggggacaaggctggttcgagcg

SEQ ID NO: 107706 - DNA, 27 bp, Artificial Sequence
  Synthetic oligonucleotide
tgtcccctccgaccttctgccacccac

SEQ ID NO: 107707 - DNA, 35 bp, Artificial Sequence
  Synthetic oligonucleotide
gacctgcctgctgtgcctctttgccacgcccttgc

SEQ ID NO: 107708 - DNA, 38 bp, Artificial Sequence
  Synthetic oligonucleotide
tgagcacgggttaggggaaggaggggggagggacctga

SEQ ID NO: 107709 - DNA, 35 bp, Artificial Sequence
  Synthetic oligonucleotide
gccacccctctccgcctctgtacccggccggatat

SEQ ID NO: 107710 - DNA, 37 bp, Artificial Sequence
  Synthetic oligonucleotide
gaactgccacactctgcataacctacccccctgctga

SEQ ID NO: 107711 - DNA, 35 bp, Artificial Sequence
  Synthetic oligonucleotide
agtgcacccttcacctagtttcctcaccgctggcg

SEQ ID NO: 107712 - DNA, 37 bp, Artificial Sequence
  Synthetic oligonucleotide
taggggggggggtgcggaaggggcaaggcggaagaga

SEQ ID NO: 107713 - DNA, 36 bp, Artificial Sequence
  Synthetic oligonucleotide
tcccccttccgacgttataacaagcacactctccta

SEQ ID NO: 107714 - DNA, 38 bp, Artificial Sequence
  Synthetic oligonucleotide
gaacactcacctcacgtgctatttgccctcacccttga

SEQ ID NO: 107715 - DNA, 35 bp, Artificial Sequence
  Synthetic oligonucleotide
tgcgtactgcccctcgagcgtagcacatcctgtcc

SEQ ID NO: 107716 - DNA, 35 bp, Artificial Sequence
  Synthetic oligonucleotide
gagctccgcgccagcctggcccctccccccttcga

SEQ ID NO: 107717 - DNA, 34 bp, Artificial Sequence
  Synthetic oligonucleotide
tgctccatcccgccccgcaactctgactccccag

SEQ ID NO: 107718 - DNA, 35 bp, Artificial Sequence
  Synthetic oligonucleotide
gctgtccggtcggaagcgtaatcttctcgttccac

SEQ ID NO: 107719 - DNA, 35 bp, Artificial Sequence
  Synthetic oligonucleotide
tgactgaccgctgcaatagtacgccaccctcttcg

SEQ ID NO: 107720 - DNA, 35 bp, Artificial Sequence
  Synthetic oligonucleotide
tccacgttatggtctgcgtgacctgcccccaccct

SEQ ID NO: 107721 - DNA, 34 bp, Artificial Sequence
  Synthetic oligonucleotide
atcgacgcctgtccgcgtttatcctttccgcttt

SEQ ID NO: 107722 - DNA, 35 bp, Artificial Sequence
  Synthetic oligonucleotide
ggtaccccgcccaatatccccgtcatgtgagctcc

SEQ ID NO: 107723 - DNA, 37 bp, Artificial Sequence
  Synthetic oligonucleotide
agtcgtggaggtggcggggtgaggttggacggccgga

SEQ ID NO: 107724 - DNA, 35 bp, Artificial Sequence
  Synthetic oligonucleotide
gcacgagccccaggatttatcgttacttcccgcct

SEQ ID NO: 107725 - DNA, 35 bp, Artificial Sequence
  Synthetic oligonucleotide
gagagccccatgcccttttgtctgctgaatcctca

SEQ ID NO: 107726 - DNA, 35 bp, Artificial Sequence
  Synthetic oligonucleotide
gcaaagcagctgcccttccgccccttacacctgtg

SEQ ID NO: 107727 - DNA, 35 bp, Artificial Sequence
  Synthetic oligonucleotide
gatcggtcatccgttcagccgccccactccactcc

SEQ ID NO: 107728 - DNA, 35 bp, Artificial Sequence
  Synthetic oligonucleotide
tacgcaacttacctgctgcactcgtaaatacctcc

SEQ ID NO: 107729 - DNA, 36 bp, Artificial Sequence
  Synthetic oligonucleotide
tgacagacatccgcatctgccatcttcgacctccga

SEQ ID NO: 107730 - DNA, 35 bp, Artificial Sequence
  Synthetic oligonucleotide
acacccgcctaatctgcccccttgcttggtctctc

SEQ ID NO: 107731 - DNA, 35 bp, Artificial Sequence
  Synthetic oligonucleotide
acgcccacctctcaccgctgaaacacattggtacc

SEQ ID NO: 107732 - DNA, 36 bp, Artificial Sequence
  Synthetic oligonucleotide
tcagtgagtgggtgggagtagggggctgggtggaca

SEQ ID NO: 107733 - DNA, 35 bp, Artificial Sequence
  Synthetic oligonucleotide
tgacagggtaggggcggggggaatgcgtgcggtag

SEQ ID NO: 107734 - DNA, 35 bp, Artificial Sequence
  Synthetic oligonucleotide
tccatcgcctcacctcagctctcccccaggttcca

SEQ ID NO: 107735 - DNA, 36 bp, Artificial Sequence
  Synthetic oligonucleotide
gcccaccgcccttgaccttatcacaggataccccca

SEQ ID NO: 107736 - DNA, 36 bp, Artificial Sequence
  Synthetic oligonucleotide
gaccagggggctgggagggaaggagggttggtaaga

SEQ ID NO: 107737 - DNA, 35 bp, Artificial Sequence
  Synthetic oligonucleotide
gcacccgctgacttagcctcccgcaacccggaccc

SEQ ID NO: 107738 - DNA, 37 bp, Artificial Sequence
  Synthetic oligonucleotide
ggagccatcaatccgtccaccttcggtacttctccga

SEQ ID NO: 107739 - DNA, 35 bp, Artificial Sequence
  Synthetic oligonucleotide
tcaacggagttgggggaggagggggtagaaaggga

SEQ ID NO: 107740 - DNA, 35 bp, Artificial Sequence
  Synthetic oligonucleotide
tccgccccatcaccctaattcattgtccgtgctcc

SEQ ID NO: 107741 - DNA, 35 bp, Artificial Sequence
  Synthetic oligonucleotide
gccctgtcgccgttgcctcattccgttctagtcgt

SEQ ID NO: 107742 - DNA, 36 bp, Artificial Sequence
  Synthetic oligonucleotide
agtcacactccaccgtggttctatcacctgccccta

SEQ ID NO: 107743 - DNA, 35 bp, Artificial Sequence
  Synthetic oligonucleotide
gtgactccgctgtatctgccccccctcgtgtgttg

SEQ ID NO: 107744 - DNA, 35 bp, Artificial Sequence
  Synthetic oligonucleotide
aaccatcccattcgatctgtgccgaccctgcctct

SEQ ID NO: 107745 - DNA, 37 bp, Artificial Sequence
  Synthetic oligonucleotide
tgcatatgccacattttttgatccaccgccgccccga

SEQ ID NO: 107746 - DNA, 36 bp, Artificial Sequence
  Synthetic oligonucleotide
tcccacaccgctcctcgccccagtattgactaccaa

SEQ ID NO: 107747 - DNA, 36 bp, Artificial Sequence
  Synthetic oligonucleotide
tgtacaccgctatgcccccgtgtcgcccgaccttca

SEQ ID NO: 107748 - DNA, 35 bp, Artificial Sequence
  Synthetic oligonucleotide
gtactcgccctcgccacatttcctttgagccctca

SEQ ID NO: 107749 - DNA, 35 bp, Artificial Sequence
  Synthetic oligonucleotide
tgcgacgtaccgtcgtaggttattgctcctctcgc

SEQ ID NO: 107750 - DNA, 35 bp, Artificial Sequence
  Synthetic oligonucleotide
acgctgtgccgcgatatccctgttcccctgccaat

SEQ ID NO: 107751 - DNA, 35 bp, Artificial Sequence
  Synthetic oligonucleotide
acccctgaccgcctgctctctctccatacaacgtg

SEQ ID NO: 107752 - DNA, 38 bp, Artificial Sequence
  Synthetic oligonucleotide
gctcaccgctcccccgcgatatgcctgccttcccctga

SEQ ID NO: 107753 - DNA, 35 bp, Artificial Sequence
  Synthetic oligonucleotide
gacgtgccagttccccgccccgccttgagtccccc

SEQ ID NO: 107754 - DNA, 38 bp, Artificial Sequence
  Synthetic oligonucleotide
gcttagaccgtggaggtggtgggggtggtcggtggtga

SEQ ID NO: 107755 - DNA, 35 bp, Artificial Sequence
  Synthetic oligonucleotide
tcctcgggccctactgcctggttttttgccctgac

SEQ ID NO: 107756 - DNA, 35 bp, Artificial Sequence
  Synthetic oligonucleotide
gagaagagaaggatggggtggactaggagaggagg

SEQ ID NO: 107757 - DNA, 35 bp, Artificial Sequence
  Synthetic oligonucleotide
gcatgccgccctcgcattacgtctactagccgcac

SEQ ID NO: 107758 - DNA, 35 bp, Artificial Sequence
  Synthetic oligonucleotide
gccgatccgccctcctgatacttgccgatttctat

SEQ ID NO: 107759 - DNA, 36 bp, Artificial Sequence
  Synthetic oligonucleotide
ttccgctcccggtttgcgacgccttagttccttcca

SEQ ID NO: 107760 - DNA, 35 bp, Artificial Sequence
  Synthetic oligonucleotide
atctcgcctcttgctcccgccgtccatctcgccgc

SEQ ID NO: 107761 - DNA, 37 bp, Artificial Sequence
  Synthetic oligonucleotide
gcgccaccccactgccgtgcacacattacactctcga

SEQ ID NO: 107762 - DNA, 35 bp, Artificial Sequence
  Synthetic oligonucleotide
tctggccacggagtctattctgaccgccctccctc

SEQ ID NO: 107763 - DNA, 35 bp, Artificial Sequence
  Synthetic oligonucleotide
gccacgtccagttattctttcggatcgcctctctc

SEQ ID NO: 107764 - DNA, 35 bp, Artificial Sequence
  Synthetic oligonucleotide
gtagcctcacttgaatattttgtccgtccccagtc

SEQ ID NO: 107765 - DNA, 35 bp, Artificial Sequence
  Synthetic oligonucleotide
tgtgatccatcctcagcccgccccttgactcgaag

SEQ ID NO: 107766 - DNA, 36 bp, Artificial Sequence
  Synthetic oligonucleotide
ggtgtcgcgctgtcatcttgtcgcctcgttccacca

SEQ ID NO: 107767 - DNA, 37 bp, Artificial Sequence
  Synthetic oligonucleotide
tgacttccgccccatttataatcctgtgtcctgccga

SEQ ID NO: 107768 - DNA, 36 bp, Artificial Sequence
  Synthetic oligonucleotide
ggtcccccgccgccgggtctacgcccttcccctcga

SEQ ID NO: 107769 - DNA, 35 bp, Artificial Sequence
  Synthetic oligonucleotide
tgtctcttgccacacaatgtccatcctgccttgtc

SEQ ID NO: 107770 - DNA, 35 bp, Artificial Sequence
  Synthetic oligonucleotide
gacgtttccgtgccattccctgttctgtgccaatc

SEQ ID NO: 107771 - DNA, 35 bp, Artificial Sequence
  Synthetic oligonucleotide
gtgtggatacggggagggagttaaggtggaggggg

SEQ ID NO: 107772 - DNA, 36 bp, Artificial Sequence
  Synthetic oligonucleotide
atcgccacccgcattcattgtacttctgccctcgta

SEQ ID NO: 107773 - DNA, 35 bp, Artificial Sequence
  Synthetic oligonucleotide
gttgccattgacctattataacctgccccctgcca

SEQ ID NO: 107774 - DNA, 35 bp, Artificial Sequence
  Synthetic oligonucleotide
gattcaccccatttgcttattgcatcaggttcctc

SEQ ID NO: 107775 - DNA, 35 bp, Artificial Sequence
  Synthetic oligonucleotide
tcactccgacccttgtcccagacgttcctgcattc

SEQ ID NO: 107776 - DNA, 37 bp, Artificial Sequence
  Synthetic oligonucleotide
ggaccctcctccgcttgactcaaacgacgccccttga

SEQ ID NO: 107777 - DNA, 35 bp, Artificial Sequence
  Synthetic oligonucleotide
ttcagggaaggaggggaacggatgcaggaagggga

SEQ ID NO: 107778 - DNA, 36 bp, Artificial Sequence
  Synthetic oligonucleotide
ggtgtgggaggagagggaatatacgggaggagataa

SEQ ID NO: 107779 - DNA, 35 bp, Artificial Sequence
  Synthetic oligonucleotide
tgcctacgtctgcgctcgatatccccgctcctctc

SEQ ID NO: 107780 - DNA, 36 bp, Artificial Sequence
  Synthetic oligonucleotide
tcccgacgtccggatcccaccctccctcccggtcga

SEQ ID NO: 107781 - DNA, 35 bp, Artificial Sequence
  Synthetic oligonucleotide
gccctcgcgcgtacagccgcctatctactcgcttc

SEQ ID NO: 107782 - DNA, 37 bp, Artificial Sequence
  Synthetic oligonucleotide
atcagctgggggctgctggtaggggtgagtgggcgga

SEQ ID NO: 107783 - DNA, 35 bp, Artificial Sequence
  Synthetic oligonucleotide
gcccacccgcattctgccttcgttacaacacttag

SEQ ID NO: 107784 - DNA, 38 bp, Artificial Sequence
  Synthetic oligonucleotide
tgcgaatgtggacggggtatgggggggaggggccgtga

SEQ ID NO: 107785 - DNA, 36 bp, Artificial Sequence
  Synthetic oligonucleotide
acaccgaccatgccttacctccctgcgcatctgcta

SEQ ID NO: 107786 - DNA, 35 bp, Artificial Sequence
  Synthetic oligonucleotide
aaacactccgcaatgtatatctgccgcccctcttc

SEQ ID NO: 107787 - DNA, 37 bp, Artificial Sequence
  Synthetic oligonucleotide
gccgccacctccgttcgtcccccgcctcaatattgga

SEQ ID NO: 107788 - DNA, 35 bp, Artificial Sequence
  Synthetic oligonucleotide
attgtggccctcctttgttctattacgccctcgcc

SEQ ID NO: 107789 - DNA, 35 bp, Artificial Sequence
  Synthetic oligonucleotide
tcacaccgaaacatgcacattcgaatacgcctccc

SEQ ID NO: 107790 - DNA, 35 bp, Artificial Sequence
  Synthetic oligonucleotide
tcgatgtgtcagcatcttctcatgtccctttgcct

SEQ ID NO: 107791 - DNA, 35 bp, Artificial Sequence
  Synthetic oligonucleotide
gtccgcccccaactcccctccttacagccgcatgc

SEQ ID NO: 107792 - DNA, 35 bp, Artificial Sequence
  Synthetic oligonucleotide
tacgccgcataggtgtcgctctctttacttcactg

SEQ ID NO: 107793 - DNA, 35 bp, Artificial Sequence
  Synthetic oligonucleotide
atgtgtacacgcttaaccgccgttgcccccccccg

SEQ ID NO: 107794 - DNA, 35 bp, Artificial Sequence
  Synthetic oligonucleotide
gaaccacccccctgctattggatagccgatccaat

SEQ ID NO: 107795 - DNA, 36 bp, Artificial Sequence
  Synthetic oligonucleotide
tccacgtcccttcgagtccgcctgcccaccgcacca

SEQ ID NO: 107796 - DNA, 35 bp, Artificial Sequence
  Synthetic oligonucleotide
gcgccaccccccaccgattgctgttttattatcct

SEQ ID NO: 107797 - DNA, 36 bp, Artificial Sequence
  Synthetic oligonucleotide
gctcaacctctgactctgctagtttcccctgttcga

SEQ ID NO: 107798 - DNA, 35 bp, Artificial Sequence
  Synthetic oligonucleotide
atcacgtccgtcagctgtcctcgactcgccgcccc

SEQ ID NO: 107799 - DNA, 35 bp, Artificial Sequence
  Synthetic oligonucleotide
ttcgccccacgcattcctattatctcactttagtg

SEQ ID NO: 107800 - DNA, 35 bp, Artificial Sequence
  Synthetic oligonucleotide
gattgccagcccacccgtgccattccgcgattctt

SEQ ID NO: 107801 - DNA, 37 bp, Artificial Sequence
  Synthetic oligonucleotide
agacaacctcctgtccgttcctatctcccctccggga

SEQ ID NO: 107802 - DNA, 37 bp, Artificial Sequence
  Synthetic oligonucleotide
aacacgtctaggggggggtaaggatgggaaggggaga

SEQ ID NO: 107803 - DNA, 35 bp, Artificial Sequence
  Synthetic oligonucleotide
acctcaatcgacccgtgccgtccaggctcctcgcc

SEQ ID NO: 107804 - DNA, 35 bp, Artificial Sequence
  Synthetic oligonucleotide
gaaagggggtagaggggagtgactggttgggggag

SEQ ID NO: 107805 - DNA, 35 bp, Artificial Sequence
  Synthetic oligonucleotide
agccgcctcaccgctcccgttccttggtgacgccc

SEQ ID NO: 107806 - DNA, 36 bp, Artificial Sequence
  Synthetic oligonucleotide
ttccccgttccatgcattacgatttacattcgctca

SEQ ID NO: 107807 - DNA, 37 bp, Artificial Sequence
  Synthetic oligonucleotide
tgctgctccagcctccgcactaccgagcccttcccga

SEQ ID NO: 107808 - DNA, 38 bp, Artificial Sequence
  Synthetic oligonucleotide
ttaggacgggtggtatgttatggcggcggtggggctga

SEQ ID NO: 107809 - DNA, 35 bp, Artificial Sequence
  Synthetic oligonucleotide
gtgcctcaccgcttatgataaccagccccccatac

SEQ ID NO: 107810 - DNA, 37 bp, Artificial Sequence
  Synthetic oligonucleotide
tccgcccaccaccctgttcctagcttccggaccttga

SEQ ID NO: 107811 - DNA, 30 bp, Artificial Sequence
  Synthetic oligonucleotide
gttacctctcatcgtgacttactactacct

SEQ ID NO: 107812 - DNA, 35 bp, Artificial Sequence
  Synthetic oligonucleotide
gttcgtctccccccagctgcttacttcctgtttac

SEQ ID NO: 107813 - DNA, 35 bp, Artificial Sequence
  Synthetic oligonucleotide
gacgccaccgcccgaaccccctccaacgcgtgtaa

SEQ ID NO: 107814 - DNA, 34 bp, Artificial Sequence
  Synthetic oligonucleotide
tagttcccccgctgagccgctttatctcactttc

SEQ ID NO: 107815 - DNA, 36 bp, Artificial Sequence
  Synthetic oligonucleotide
accaccattaatgtgccagccgcccctccaaccgta

SEQ ID NO: 107816 - DNA, 33 bp, Artificial Sequence
  Synthetic oligonucleotide
gccctcagcatccgactctggccactttcgtac

SEQ ID NO: 107817 - DNA, 35 bp, Artificial Sequence
  Synthetic oligonucleotide
tgccactcccatggttcgttacatcctattgcttt

SEQ ID NO: 107818 - DNA, 35 bp, Artificial Sequence
  Synthetic oligonucleotide
gtcgagctgcactcgctcccatcactccgccactg

SEQ ID NO: 107819 - DNA, 35 bp, Artificial Sequence
  Synthetic oligonucleotide
agcccggtctcgaccgtttacacgcctcgctccgc

SEQ ID NO: 107820 - DNA, 35 bp, Artificial Sequence
  Synthetic oligonucleotide
gcacaaaagggggcgggtagggagggcttctgcga

SEQ ID NO: 107821 - DNA, 35 bp, Artificial Sequence
  Synthetic oligonucleotide
ttgcatcccccattccacaccacctcgcgccgccg

SEQ ID NO: 107822 - DNA, 37 bp, Artificial Sequence
  Synthetic oligonucleotide
tccacccccgcccgcttgttattcacatgaattatta

SEQ ID NO: 107823 - DNA, 35 bp, Artificial Sequence
  Synthetic oligonucleotide
tccttagccattgctgattacgctccactcctgtt

SEQ ID NO: 107824 - DNA, 35 bp, Artificial Sequence
  Synthetic oligonucleotide
accagtcaccgctcatcaccaccgccactgcgctt

SEQ ID NO: 107825 - DNA, 35 bp, Artificial Sequence
  Synthetic oligonucleotide
tgcgccccatccttctgcgtggtatagcctccctg

SEQ ID NO: 107826 - DNA, 37 bp, Artificial Sequence
  Synthetic oligonucleotide
gcatgggcataggcgggaacgggggaaggattggaga

SEQ ID NO: 107827 - DNA, 35 bp, Artificial Sequence
  Synthetic oligonucleotide
gagtccgtcgttaaccctatccagcctgcccccgc

SEQ ID NO: 107828 - DNA, 34 bp, Artificial Sequence
  Synthetic oligonucleotide
tagccaacgttggtcccctccgtcgtccacactc

SEQ ID NO: 107829 - DNA, 36 bp, Artificial Sequence
  Synthetic oligonucleotide
gccaccaccccgccgtatatgcctctccgagtctta

SEQ ID NO: 107830 - DNA, 35 bp, Artificial Sequence
  Synthetic oligonucleotide
gcttgcacggcacttccttgttcattcgtccccgg

SEQ ID NO: 107831 - DNA, 35 bp, Artificial Sequence
  Synthetic oligonucleotide
gacacccccaccactcgtatcgactctcgctattg

SEQ ID NO: 107832 - DNA, 35 bp, Artificial Sequence
  Synthetic oligonucleotide
acacccaccgcttcacttgggctactcctggtctt

SEQ ID NO: 107833 - DNA, 38 bp, Artificial Sequence
  Synthetic oligonucleotide
tcatcagcccctgaatactgcccctgcccaccgcttga

SEQ ID NO: 107834 - DNA, 36 bp, Artificial Sequence
  Synthetic oligonucleotide
gtgcgccacactttgctaccatcattacgctccgca

SEQ ID NO: 107835 - DNA, 35 bp, Artificial Sequence
  Synthetic oligonucleotide
aatcgcacccgacccccactgtccaaattgcctta

SEQ ID NO: 107836 - DNA, 35 bp, Artificial Sequence
  Synthetic oligonucleotide
tcatcatgccacttgttccgctaaaacactccacc

SEQ ID NO: 107837 - DNA, 35 bp, Artificial Sequence
  Synthetic oligonucleotide
tgtcccccacacctcggccccctctgccctgcgat

SEQ ID NO: 107838 - DNA, 35 bp, Artificial Sequence
  Synthetic oligonucleotide
taccccccccgcctcagtcgtcagtcgccctatta

SEQ ID NO: 107839 - DNA, 35 bp, Artificial Sequence
  Synthetic oligonucleotide
aaggtggtgggggggtggcatggaggggttcatgt

SEQ ID NO: 107840 - DNA, 35 bp, Artificial Sequence
  Synthetic oligonucleotide
aacgccctcacatcgtcgttcttcacttttcgggc

SEQ ID NO: 107841 - DNA, 36 bp, Artificial Sequence
  Synthetic oligonucleotide
tgccaacatctgcccgcgccccggaacgccttacca

SEQ ID NO: 107842 - DNA, 36 bp, Artificial Sequence
  Synthetic oligonucleotide
tccccatgtactcacatcattcgttgctccacgcca

SEQ ID NO: 107843 - DNA, 35 bp, Artificial Sequence
  Synthetic oligonucleotide
tcccccagccatccgggtggtctcttacttttcct

SEQ ID NO: 107844 - DNA, 35 bp, Artificial Sequence
  Synthetic oligonucleotide
atccctccccctccgccgcttgttttaggcaagac

SEQ ID NO: 107845 - DNA, 36 bp, Artificial Sequence
  Synthetic oligonucleotide
acatccacattgtgccgtatcaaagcctccccccca

SEQ ID NO: 107846 - DNA, 38 bp, Artificial Sequence
  Synthetic oligonucleotide
acccgccctccgagctttacgccccatgcctttactga

SEQ ID NO: 107847 - DNA, 33 bp, Artificial Sequence
  Synthetic oligonucleotide
tcagcacagcatctgtaccttttcatcctcgtc

SEQ ID NO: 107848 - DNA, 38 bp, Artificial Sequence
  Synthetic oligonucleotide
gttcaccgccattctgcaccccgacatcccctttgtga

SEQ ID NO: 107849 - DNA, 35 bp, Artificial Sequence
  Synthetic oligonucleotide
tgtacccctcccgtattggtccccgttattcctac

SEQ ID NO: 107850 - DNA, 35 bp, Artificial Sequence
  Synthetic oligonucleotide
gtccactttctgctcttgttatcgccacccagttc

SEQ ID NO: 107851 - DNA, 36 bp, Artificial Sequence
  Synthetic oligonucleotide
tatggccccatcccattgccccccgctcgttttgcg

SEQ ID NO: 107852 - DNA, 35 bp, Artificial Sequence
  Synthetic oligonucleotide
tggtcacccccgtgttccgccgatttccgccttct

SEQ ID NO: 107853 - DNA, 36 bp, Artificial Sequence
  Synthetic oligonucleotide
tgcacgcctgtctcgtccgtcttcgttccacttgta

SEQ ID NO: 107854 - DNA, 35 bp, Artificial Sequence
  Synthetic oligonucleotide
tccgactctcagctttgcctattgcccccctgaaa

SEQ ID NO: 107855 - DNA, 34 bp, Artificial Sequence
  Synthetic oligonucleotide
tttcacatccggtctgttatcaccttctgtccaa

SEQ ID NO: 107856 - DNA, 35 bp, Artificial Sequence
  Synthetic oligonucleotide
gaccctgacctctattgcatccgtggacttccacc

SEQ ID NO: 107857 - DNA, 35 bp, Artificial Sequence
  Synthetic oligonucleotide
ttttgccaccacccatttgtctgttcgctgccccg

SEQ ID NO: 107858 - DNA, 27 bp, Artificial Sequence
  Synthetic oligonucleotide
gagtgatctccacctgcccgcacccat

SEQ ID NO: 107859 - DNA, 34 bp, Artificial Sequence
  Synthetic oligonucleotide
tccatcgtagctcgccacactaccaccgctttca

SEQ ID NO: 107860 - DNA, 35 bp, Artificial Sequence
  Synthetic oligonucleotide
gacccccccatttgtcttgtttgacctgccttccg

SEQ ID NO: 107861 - DNA, 35 bp, Artificial Sequence
  Synthetic oligonucleotide
gtcgccctggaccctcatcacgttaacgaccctct

SEQ ID NO: 107862 - DNA, 35 bp, Artificial Sequence
  Synthetic oligonucleotide
gacccacccctattcatgtataccacacttcttgc

SEQ ID NO: 107863 - DNA, 35 bp, Artificial Sequence
  Synthetic oligonucleotide
tgtccctccaggtttcggacgccactcttactgcc

SEQ ID NO: 107864 - DNA, 35 bp, Artificial Sequence
  Synthetic oligonucleotide
ttcacctctcgccattggacactttactgctccgc

SEQ ID NO: 107865 - DNA, 36 bp, Artificial Sequence
  Synthetic oligonucleotide
gctcgtggggaaggttaggggtgggtgggaacctga

SEQ ID NO: 107866 - DNA, 35 bp, Artificial Sequence
  Synthetic oligonucleotide
gagcgcacgggcgacgggatgggaaggggtgtacg

SEQ ID NO: 107867 - DNA, 35 bp, Artificial Sequence
  Synthetic oligonucleotide
atagccccccgcccgtttttttattatgccaacct

SEQ ID NO: 107868 - DNA, 35 bp, Artificial Sequence
  Synthetic oligonucleotide
gtgccatagaggtggggtgggcggaggcggggggt

SEQ ID NO: 107869 - DNA, 35 bp, Artificial Sequence
  Synthetic oligonucleotide
tcaacgccccggtcccggtgatccctctccatctt

SEQ ID NO: 107870 - DNA, 38 bp, Artificial Sequence
  Synthetic oligonucleotide
acccatcgaccatggccctcctcgcacctccttcgtga

SEQ ID NO: 107871 - DNA, 35 bp, Artificial Sequence
  Synthetic oligonucleotide
attcgtaccctgcccactaatgagcccccccctgc

SEQ ID NO: 107872 - DNA, 35 bp, Artificial Sequence
  Synthetic oligonucleotide
tcaagccccgggcgttagctgccgccattctccac

SEQ ID NO: 107873 - DNA, 35 bp, Artificial Sequence
  Synthetic oligonucleotide
gacactgtaccggcccttgcgaattgcgcaccatc

SEQ ID NO: 107874 - DNA, 35 bp, Artificial Sequence
  Synthetic oligonucleotide
tgacacgaaccacaggtctttccccagtcccgctc

SEQ ID NO: 107875 - DNA, 37 bp, Artificial Sequence
  Synthetic oligonucleotide
ttccgcacgccctgtgtcatccctcttcattcttctg

SEQ ID NO: 107876 - DNA, 37 bp, Artificial Sequence
  Synthetic oligonucleotide
gactgagagaaggcagggaatacgagggaggggcgga

SEQ ID NO: 107877 - DNA, 35 bp, Artificial Sequence
  Synthetic oligonucleotide
taagtgtgcgctgccctttcgtatcccgttccttc

SEQ ID NO: 107878 - DNA, 36 bp, Artificial Sequence
  Synthetic oligonucleotide
tcccaaccgcctcattatattttcttcgctccgtga

SEQ ID NO: 107879 - DNA, 36 bp, Artificial Sequence
  Synthetic oligonucleotide
gatcaggaggaggaagggaaattaaggaatagggca

SEQ ID NO: 107880 - DNA, 35 bp, Artificial Sequence
  Synthetic oligonucleotide
gcctcccccatcattgttgacttcgcgccctagcc

SEQ ID NO: 107881 - DNA, 35 bp, Artificial Sequence
  Synthetic oligonucleotide
gcccccgctcctgtccgcccgtcacacgctcgctt

SEQ ID NO: 107882 - DNA, 35 bp, Artificial Sequence
  Synthetic oligonucleotide
tgacgcccctgcctatatattgttcgggtccctct

SEQ ID NO: 107883 - DNA, 36 bp, Artificial Sequence
  Synthetic oligonucleotide
ttccccgtacactccagtgcgtctacctgccttcta

SEQ ID NO: 107884 - DNA, 35 bp, Artificial Sequence
  Synthetic oligonucleotide
tctcccttcccgccctgccccgtgcgtaacggact

SEQ ID NO: 107885 - DNA, 37 bp, Artificial Sequence
  Synthetic oligonucleotide
tgccaccctcgccggtctcgcctccccactaccacga

SEQ ID NO: 107886 - DNA, 36 bp, Artificial Sequence
  Synthetic oligonucleotide
aaggggagcaaaggcatgggggggtgaagaaggtaa

SEQ ID NO: 107887 - DNA, 36 bp, Artificial Sequence
  Synthetic oligonucleotide
ctggtccacccgccacgctcgctcacatgacatcca

SEQ ID NO: 107888 - DNA, 35 bp, Artificial Sequence
  Synthetic oligonucleotide
tagctccaaccgcacatctcgtcgcctactggctc

SEQ ID NO: 107889 - DNA, 35 bp, Artificial Sequence
  Synthetic oligonucleotide
gaccatcctgcttagccctctgttacgattagccc

SEQ ID NO: 107890 - DNA, 37 bp, Artificial Sequence
  Synthetic oligonucleotide
gcaccaccaccgctttcgcgacccgccccttcccgga

SEQ ID NO: 107891 - DNA, 35 bp, Artificial Sequence
  Synthetic oligonucleotide
acgaccctgccacaccaatctaccccacccgctcg

SEQ ID NO: 107892 - DNA, 36 bp, Artificial Sequence
  Synthetic oligonucleotide
gggagggaggggaaggcggtggaaaaagtgcagata

SEQ ID NO: 107893 - DNA, 35 bp, Artificial Sequence
  Synthetic oligonucleotide
ttccgcgccctctgtccttccactactttcctcga

SEQ ID NO: 107894 - DNA, 38 bp, Artificial Sequence
  Synthetic oligonucleotide
agaccgtccgccgctgctcacacttctgtccactctga

SEQ ID NO: 107895 - DNA, 35 bp, Artificial Sequence
  Synthetic oligonucleotide
gatcccaccgcccgtcgatcctaggatcgttgcca

SEQ ID NO: 107896 - DNA, 35 bp, Artificial Sequence
  Synthetic oligonucleotide
accagtcgcggtcgctcccccaagctccttccctg

SEQ ID NO: 107897 - DNA, 35 bp, Artificial Sequence
  Synthetic oligonucleotide
gagcctcccgtacggccccggtcccttcctccgtc

SEQ ID NO: 107898 - DNA, 35 bp, Artificial Sequence
  Synthetic oligonucleotide
gcacggtcggactgttcccctgtgttttgttccac

SEQ ID NO: 107899 - DNA, 35 bp, Artificial Sequence
  Synthetic oligonucleotide
tgcctggccccctctagtgttttctttgttactct

SEQ ID NO: 107900 - DNA, 36 bp, Artificial Sequence
  Synthetic oligonucleotide
tacgatctctctcctgtctcatccgtgtctgttcaa

SEQ ID NO: 107901 - DNA, 35 bp, Artificial Sequence
  Synthetic oligonucleotide
atccccatctggctccggggtccacctttaccatc

SEQ ID NO: 107902 - DNA, 38 bp, Artificial Sequence
  Synthetic oligonucleotide
gaggccatcaagtggggggaagggaggggacgggctga

SEQ ID NO: 107903 - DNA, 35 bp, Artificial Sequence
  Synthetic oligonucleotide
tctgttcaaccgtgtgcagcctgcccacccctgcc

SEQ ID NO: 107904 - DNA, 36 bp, Artificial Sequence
  Synthetic oligonucleotide
actctccgtcagctttaatcccgtcgcccgccacca

SEQ ID NO: 107905 - DNA, 35 bp, Artificial Sequence
  Synthetic oligonucleotide
gcccagacccccacgcggtgtctagttcctgcccc

SEQ ID NO: 107906 - DNA, 36 bp, Artificial Sequence
  Synthetic oligonucleotide
tcaagggagggggggttacggacgggcaatgaggta

SEQ ID NO: 107907 - DNA, 35 bp, Artificial Sequence
  Synthetic oligonucleotide
gagatgaggggcaagggaggtcgggtgatgggcaa

SEQ ID NO: 107908 - DNA, 35 bp, Artificial Sequence
  Synthetic oligonucleotide
acgccccgttccatcgcttaacttgctctcatccg

SEQ ID NO: 107909 - DNA, 36 bp, Artificial Sequence
  Synthetic oligonucleotide
ttccgcccccacgctccctgcattattggatgcata

SEQ ID NO: 107910 - DNA, 35 bp, Artificial Sequence
  Synthetic oligonucleotide
tctcgccccgaacatgcctacctttatatcgcacc

SEQ ID NO: 107911 - DNA, 35 bp, Artificial Sequence
  Synthetic oligonucleotide
atagagggggtacgatagggggaaggcggagagga

SEQ ID NO: 107912 - DNA, 35 bp, Artificial Sequence
  Synthetic oligonucleotide
tccacaggtcccgcatgcactacacttccccttcg

SEQ ID NO: 107913 - DNA, 35 bp, Artificial Sequence
  Synthetic oligonucleotide
gtccgctcatcatcccgccatctggtctgttccac

SEQ ID NO: 107914 - DNA, 35 bp, Artificial Sequence
  Synthetic oligonucleotide
gttggcccctcacctgcttattcaactttccccgc

SEQ ID NO: 107915 - DNA, 37 bp, Artificial Sequence
  Synthetic oligonucleotide
tcccatcaaccccagatctgcctacctactcgttcga

SEQ ID NO: 107916 - DNA, 35 bp, Artificial Sequence
  Synthetic oligonucleotide
tgctggaccgcgccaccgtcgcatatttctgcctc

SEQ ID NO: 107917 - DNA, 35 bp, Artificial Sequence
  Synthetic oligonucleotide
ccgattccgcccctttggtactgtacataactttc

SEQ ID NO: 107918 - DNA, 37 bp, Artificial Sequence
  Synthetic oligonucleotide
tgatcgcaggagtagggaatagggtggggcgggagga

SEQ ID NO: 107919 - DNA, 35 bp, Artificial Sequence
  Synthetic oligonucleotide
tgctctcaccgccaactactgtccttcctcaggcc

SEQ ID NO: 107920 - DNA, 35 bp, Artificial Sequence
  Synthetic oligonucleotide
gtccaaccccgtgcccctataaaccgacctacctg

SEQ ID NO: 107921 - DNA, 35 bp, Artificial Sequence
  Synthetic oligonucleotide
tcccatccgccaccttgtttgttttcctgtagagg

SEQ ID NO: 107922 - DNA, 35 bp, Artificial Sequence
  Synthetic oligonucleotide
aagcctgcgcccatcgattagctccacgcccgtcc

SEQ ID NO: 107923 - DNA, 35 bp, Artificial Sequence
  Synthetic oligonucleotide
tccaccgtaggctattcctgtccggcttgtttcac

SEQ ID NO: 107924 - DNA, 35 bp, Artificial Sequence
  Synthetic oligonucleotide
gccccccttccgtgcgattttggttcgattccgct

SEQ ID NO: 107925 - DNA, 35 bp, Artificial Sequence
  Synthetic oligonucleotide
tgtatccaccacctcttgctgcatttaatgcactc

SEQ ID NO: 107926 - DNA, 35 bp, Artificial Sequence
  Synthetic oligonucleotide
gtgcacgccccatgactacataccgccgtgcttct

SEQ ID NO: 107927 - DNA, 35 bp, Artificial Sequence
  Synthetic oligonucleotide
aacgatgtcccctccgtgccgtttaaccctctccg

SEQ ID NO: 107928 - DNA, 35 bp, Artificial Sequence
  Synthetic oligonucleotide
acccacgtcggaagccccagttatctgccgcccca

SEQ ID NO: 107929 - DNA, 36 bp, Artificial Sequence
  Synthetic oligonucleotide
aacgggcaagggtgggtgggtcgactggccggttta

SEQ ID NO: 107930 - DNA, 36 bp, Artificial Sequence
  Synthetic oligonucleotide
gccctggtccgcctctcataacttgacgttccacca

SEQ ID NO: 107931 - DNA, 35 bp, Artificial Sequence
  Synthetic oligonucleotide
tccccccccctccggtcatcattgctgctgtgcgc

SEQ ID NO: 107932 - DNA, 35 bp, Artificial Sequence
  Synthetic oligonucleotide
tgatcccccgtcctgcctgaacgcccaggtttctc

SEQ ID NO: 107933 - DNA, 35 bp, Artificial Sequence
  Synthetic oligonucleotide
gcctcacatccggtgctcccccttttttggtactg

SEQ ID NO: 107934 - DNA, 35 bp, Artificial Sequence
  Synthetic oligonucleotide
gtaccccgccatatcttgccccttggttctcagtc

SEQ ID NO: 107935 - DNA, 35 bp, Artificial Sequence
  Synthetic oligonucleotide
tcgatcccccctgccgtcgcgagtcgactccatct

SEQ ID NO: 107936 - DNA, 37 bp, Artificial Sequence
  Synthetic oligonucleotide
gtggggaggcatgggaggaaagggataggtgcaggga

SEQ ID NO: 107937 - DNA, 37 bp, Artificial Sequence
  Synthetic oligonucleotide
acttgggagggggaggggcaaaacggtggtggaccga

SEQ ID NO: 107938 - DNA, 35 bp, Artificial Sequence
  Synthetic oligonucleotide
gactgccggcctgtccatgtactcccttccccctt

SEQ ID NO: 107939 - DNA, 35 bp, Artificial Sequence
  Synthetic oligonucleotide
atcgcctcaccccgccacgatcgcctccgcggatc

SEQ ID NO: 107940 - DNA, 38 bp, Artificial Sequence
  Synthetic oligonucleotide
tgctggggggcggtaggggggatgctaggatggtggga

SEQ ID NO: 107941 - DNA, 35 bp, Artificial Sequence
  Synthetic oligonucleotide
gggggaacgggggggcaagaattggcaggcacgga

SEQ ID NO: 107942 - DNA, 35 bp, Artificial Sequence
  Synthetic oligonucleotide
ttggacaggaggaagggtggaggagtgggttagag

SEQ ID NO: 107943 - DNA, 35 bp, Artificial Sequence
  Synthetic oligonucleotide
tccgcgtcgccctgcccatgaaccatcttatgcca

SEQ ID NO: 107944 - DNA, 35 bp, Artificial Sequence
  Synthetic oligonucleotide
gacgctccccctccggccatggctgtttgctatcc

SEQ ID NO: 107945 - DNA, 34 bp, Artificial Sequence
  Synthetic oligonucleotide
tgcctgccccgactgctgatcgattccctgcaca

SEQ ID NO: 107946 - DNA, 33 bp, Artificial Sequence
  Synthetic oligonucleotide
tcagacgctctgctcttgttcctacacccccgc

SEQ ID NO: 107947 - DNA, 36 bp, Artificial Sequence
  Synthetic oligonucleotide
tgctccaccatcgcgcctgcctacgcttccatagta

SEQ ID NO: 107948 - DNA, 35 bp, Artificial Sequence
  Synthetic oligonucleotide
gcgcacaggcccttctgcacctccacgatcactac

SEQ ID NO: 107949 - DNA, 35 bp, Artificial Sequence
  Synthetic oligonucleotide
ttgtgccgtcgacgtcctatttccgttctcctagc

SEQ ID NO: 107950 - DNA, 35 bp, Artificial Sequence
  Synthetic oligonucleotide
gtgacgaagtccgccctccagcccgtgccacctca

SEQ ID NO: 107951 - DNA, 36 bp, Artificial Sequence
  Synthetic oligonucleotide
gtcaccgctccggtatttgcgcccgtttctccgcta

SEQ ID NO: 107952 - DNA, 37 bp, Artificial Sequence
  Synthetic oligonucleotide
tgccccttgcccacctgctactaatgcttacaccgga

SEQ ID NO: 107953 - DNA, 34 bp, Artificial Sequence
  Synthetic oligonucleotide
accgccctaacgaaccgaccgcccacccgcctgc

SEQ ID NO: 107954 - DNA, 35 bp, Artificial Sequence
  Synthetic oligonucleotide
gacaccatgcctgtcgaccgcccccattctggctc

SEQ ID NO: 107955 - DNA, 37 bp, Artificial Sequence
  Synthetic oligonucleotide
gtgacatggggggtcgggaagggaggtggagttggga

SEQ ID NO: 107956 - DNA, 35 bp, Artificial Sequence
  Synthetic oligonucleotide
tacatgacccagcccgcgataaccgcacttcctta

SEQ ID NO: 107957 - DNA, 36 bp, Artificial Sequence
  Synthetic oligonucleotide
ggtccagccgccgactggccattccgttctccttca

SEQ ID NO: 107958 - DNA, 35 bp, Artificial Sequence
  Synthetic oligonucleotide
ttcaccttcaccgtgccctttccatgccatagcct

SEQ ID NO: 107959 - DNA, 38 bp, Artificial Sequence
  Synthetic oligonucleotide
gccaggttggaggaggggcgggcggaggcggggtttga

SEQ ID NO: 107960 - DNA, 35 bp, Artificial Sequence
  Synthetic oligonucleotide
tccgctacccgccgtccatctgtccctgccctcgc

SEQ ID NO: 107961 - DNA, 37 bp, Artificial Sequence
  Synthetic oligonucleotide
gagtccgggcggaggtggaagggggcttggaacggga

SEQ ID NO: 107962 - DNA, 35 bp, Artificial Sequence
  Synthetic oligonucleotide
tgctccccgacctgtaatcctgtcaacctgctcgc

SEQ ID NO: 107963 - DNA, 37 bp, Artificial Sequence
  Synthetic oligonucleotide
ttgcgcaacggcggtggtggggattgggagggatgga

SEQ ID NO: 107964 - DNA, 35 bp, Artificial Sequence
  Synthetic oligonucleotide
tgacccatgcgcgccatgtcccgtcacatcgttcc

SEQ ID NO: 107965 - DNA, 35 bp, Artificial Sequence
  Synthetic oligonucleotide
acacgcgcgggagggagtgagggagggtacaatct

SEQ ID NO: 107966 - DNA, 35 bp, Artificial Sequence
  Synthetic oligonucleotide
gtgtcggggcctgggcggtagggggggaggtggaa

SEQ ID NO: 107967 - DNA, 35 bp, Artificial Sequence
  Synthetic oligonucleotide
aaactccaccgccctgtgcttccgaattcgcttct

SEQ ID NO: 107968 - DNA, 36 bp, Artificial Sequence
  Synthetic oligonucleotide
tcccacttcgctctatgcgtaaagcatccccaccta

SEQ ID NO: 107969 - DNA, 34 bp, Artificial Sequence
  Synthetic oligonucleotide
tccgccgcctgcgtattgccttccgtctgcccgg

SEQ ID NO: 107970 - DNA, 35 bp, Artificial Sequence
  Synthetic oligonucleotide
tgcgtcccttactcgccccccgtcctgtcaccgtg

SEQ ID NO: 107971 - DNA, 35 bp, Artificial Sequence
  Synthetic oligonucleotide
accagcggtacgccctgattctcgtgctactccac

SEQ ID NO: 107972 - DNA, 35 bp, Artificial Sequence
  Synthetic oligonucleotide
tctccgccccctgctgaccgtctccttgtgccacc

SEQ ID NO: 107973 - DNA, 35 bp, Artificial Sequence
  Synthetic oligonucleotide
atcattaccctcgccatgcccacacgttctcccgc

SEQ ID NO: 107974 - DNA, 35 bp, Artificial Sequence
  Synthetic oligonucleotide
acgccctccgcattatggcgttcgacctccctagc

SEQ ID NO: 107975 - DNA, 35 bp, Artificial Sequence
  Synthetic oligonucleotide
tcccataggcctagtcgaacctaccgccctgccct

SEQ ID NO: 107976 - DNA, 35 bp, Artificial Sequence
  Synthetic oligonucleotide
gacctctcattgtcttcactcgtttcctgccttgc

SEQ ID NO: 107977 - DNA, 35 bp, Artificial Sequence
  Synthetic oligonucleotide
tcacgtagctgctcctcgtgcttcccgccttcctc

SEQ ID NO: 107978 - DNA, 35 bp, Artificial Sequence
  Synthetic oligonucleotide
gcgccctcccaccatcatatacgccgtccataccg

SEQ ID NO: 107979 - DNA, 35 bp, Artificial Sequence
  Synthetic oligonucleotide
taagcacccccttgttatctagttcgttcttccac

SEQ ID NO: 107980 - DNA, 37 bp, Artificial Sequence
  Synthetic oligonucleotide
accgacccactcttgctgtttgatctaccttcctgga

SEQ ID NO: 107981 - DNA, 34 bp, Artificial Sequence
  Synthetic oligonucleotide
acgcccccatccgcccaaatctacgagccttcac

SEQ ID NO: 107982 - DNA, 35 bp, Artificial Sequence
  Synthetic oligonucleotide
tacatgcgcttatgctggcattcactccaccctcc

SEQ ID NO: 107983 - DNA, 35 bp, Artificial Sequence
  Synthetic oligonucleotide
gtggcccatctcgctgttacagtcctatcctacct

SEQ ID NO: 107984 - DNA, 37 bp, Artificial Sequence
  Synthetic oligonucleotide
gaatgggagggtgacggggtgagggtggggctaatga

SEQ ID NO: 107985 - DNA, 35 bp, Artificial Sequence
  Synthetic oligonucleotide
tcagaccgcacccccgcagctccgcatttacgctc

SEQ ID NO: 107986 - DNA, 35 bp, Artificial Sequence
  Synthetic oligonucleotide
atcagtgcgcgatcagccgtcactccacccttcat

SEQ ID NO: 107987 - DNA, 35 bp, Artificial Sequence
  Synthetic oligonucleotide
tccatccatcgcggttattactcgtccaggccctc

SEQ ID NO: 107988 - DNA, 35 bp, Artificial Sequence
  Synthetic oligonucleotide
tacgagcgccctgtccgccgctcctgaacccgcct

SEQ ID NO: 107989 - DNA, 35 bp, Artificial Sequence
  Synthetic oligonucleotide
ggggaggggtggggcgggaccaacggatagcattg

SEQ ID NO: 107990 - DNA, 37 bp, Artificial Sequence
  Synthetic oligonucleotide
agagacgaagacggggcgggtaggagcggttaacgga

SEQ ID NO: 107991 - DNA, 35 bp, Artificial Sequence
  Synthetic oligonucleotide
tccacccttctgcgtttctattcaccccctttagc

SEQ ID NO: 107992 - DNA, 35 bp, Artificial Sequence
  Synthetic oligonucleotide
gttcagcctttgtaacctccgtcgccctgtttcgt

SEQ ID NO: 107993 - DNA, 35 bp, Artificial Sequence
  Synthetic oligonucleotide
atccacctcatttctgtctcactcgcgtacatccg

SEQ ID NO: 107994 - DNA, 35 bp, Artificial Sequence
  Synthetic oligonucleotide
ttacgcactcccctcgttatagacctcctggtgcc

SEQ ID NO: 107995 - DNA, 35 bp, Artificial Sequence
  Synthetic oligonucleotide
gccaaccccaacacttggacaccacgccccttccg

SEQ ID NO: 107996 - DNA, 38 bp, Artificial Sequence
  Synthetic oligonucleotide
ggtggtggaggggctggaaggcggaagtctagtagtga

SEQ ID NO: 107997 - DNA, 35 bp, Artificial Sequence
  Synthetic oligonucleotide
accgcccctacatttttacagacctgctatctaac

SEQ ID NO: 107998 - DNA, 35 bp, Artificial Sequence
  Synthetic oligonucleotide
acgcaccacctctcactgctgagcgcatgtagccc

SEQ ID NO: 107999 - DNA, 35 bp, Artificial Sequence
  Synthetic oligonucleotide
gtcctcccacgcccaatattgagaatcgcatcctc

SEQ ID NO: 108000 - DNA, 36 bp, Artificial Sequence
  Synthetic oligonucleotide
gacacccacggtgtttatcctttacgcttccctcta

SEQ ID NO: 108001 - DNA, 35 bp, Artificial Sequence
  Synthetic oligonucleotide
gagtggacggggtgggggatcaaagggggagaaac

SEQ ID NO: 108002 - DNA, 35 bp, Artificial Sequence
  Synthetic oligonucleotide
tcattaccaccgcccggctaagtgcccgtcgccct

SEQ ID NO: 108003 - DNA, 35 bp, Artificial Sequence
  Synthetic oligonucleotide
ttcacggatgtggtcttttcgttcctgttccgtcc

SEQ ID NO: 108004 - DNA, 35 bp, Artificial Sequence
  Synthetic oligonucleotide
acctccccccgttcgcactttactcagaggcacaa

SEQ ID NO: 108005 - DNA, 36 bp, Artificial Sequence
  Synthetic oligonucleotide
tagccccaacttccgcctccgttgcccgagaaacta

SEQ ID NO: 108006 - DNA, 35 bp, Artificial Sequence
  Synthetic oligonucleotide
ttggtccctccgttgtccgtgttccttcctgccac

SEQ ID NO: 108007 - DNA, 35 bp, Artificial Sequence
  Synthetic oligonucleotide
tgtcgtccgccatcgcccgtaagccagttatcgcc

SEQ ID NO: 108008 - DNA, 35 bp, Artificial Sequence
  Synthetic oligonucleotide
ttccgaccgccgcttgccttttccgtgtgcactct

SEQ ID NO: 108009 - DNA, 36 bp, Artificial Sequence
  Synthetic oligonucleotide
ttcgccctctcgccctgccgtgattttttcttccga

SEQ ID NO: 108010 - DNA, 35 bp, Artificial Sequence
  Synthetic oligonucleotide
tccccaccctgactcgttaccatcgccactcggtc

SEQ ID NO: 108011 - DNA, 35 bp, Artificial Sequence
  Synthetic oligonucleotide
gatagggaaggtggcgggaagggagcaatttaaag

SEQ ID NO: 108012 - DNA, 35 bp, Artificial Sequence
  Synthetic oligonucleotide
gacgcccctccgcccgacacattgttctcgcagca

SEQ ID NO: 108013 - DNA, 35 bp, Artificial Sequence
  Synthetic oligonucleotide
atcgaccccgccttggttgcaccctaattcgttcc

SEQ ID NO: 108014 - DNA, 34 bp, Artificial Sequence
  Synthetic oligonucleotide
accgcccccatgcctctttcctgccgaaagccct

SEQ ID NO: 108015 - DNA, 35 bp, Artificial Sequence
  Synthetic oligonucleotide
tgtaagcactgctgcatcattacccttgctcccgc

SEQ ID NO: 108016 - DNA, 35 bp, Artificial Sequence
  Synthetic oligonucleotide
gttgccctgctctgtgctcaatgctccccactcgt

SEQ ID NO: 108017 - DNA, 35 bp, Artificial Sequence
  Synthetic oligonucleotide
acaccctcggtaccagtgctttgcctttcctttcc

SEQ ID NO: 108018 - DNA, 35 bp, Artificial Sequence
  Synthetic oligonucleotide
gtagtggtgcggggggcggggtgagggatgaaagg

SEQ ID NO: 108019 - DNA, 38 bp, Artificial Sequence
  Synthetic oligonucleotide
acgacagacgggagcagggggggagcgatagggtctga

SEQ ID NO: 108020 - DNA, 38 bp, Artificial Sequence
  Synthetic oligonucleotide
gaagaaggaagggagggcaggagggtcgggcaaattga

SEQ ID NO: 108021 - DNA, 35 bp, Artificial Sequence
  Synthetic oligonucleotide
gccacgtactcgctatatacgtactctctcatgcc

SEQ ID NO: 108022 - DNA, 35 bp, Artificial Sequence
  Synthetic oligonucleotide
gcccactctcggtttgtttccccgtacattatctc

SEQ ID NO: 108023 - DNA, 36 bp, Artificial Sequence
  Synthetic oligonucleotide
gacactcccgtgcccttctgtataccctgtccaaca

SEQ ID NO: 108024 - DNA, 36 bp, Artificial Sequence
  Synthetic oligonucleotide
tccatgccctcttactcctcctgccgatcctacgga

SEQ ID NO: 108025 - DNA, 38 bp, Artificial Sequence
  Synthetic oligonucleotide
tcccgtcccgccgcccttgtttaccagctttattttga

SEQ ID NO: 108026 - DNA, 35 bp, Artificial Sequence
  Synthetic oligonucleotide
atcacactgcccacacttctatgatctgtctccca

SEQ ID NO: 108027 - DNA, 35 bp, Artificial Sequence
  Synthetic oligonucleotide
gatcgatggcggaggggaggcgggggaaagcggta

SEQ ID NO: 108028 - DNA, 35 bp, Artificial Sequence
  Synthetic oligonucleotide
tcgcccctcgaagtcgtaccatcccatgccagccg

SEQ ID NO: 108029 - DNA, 38 bp, Artificial Sequence
  Synthetic oligonucleotide
tcccgctccatccagcgtattgcaactgccgtccctga

SEQ ID NO: 108030 - DNA, 37 bp, Artificial Sequence
  Synthetic oligonucleotide
accacaccctcacctgccgtttcgaaagctcttgcga

SEQ ID NO: 108031 - DNA, 35 bp, Artificial Sequence
  Synthetic oligonucleotide
gacgtactccccgtgcacacccccgattatctgct

SEQ ID NO: 108032 - DNA, 37 bp, Artificial Sequence
  Synthetic oligonucleotide
atccgggcccctcctgccttattcgtcgtttctccga

SEQ ID NO: 108033 - DNA, 36 bp, Artificial Sequence
  Synthetic oligonucleotide
tgccaatcacctgtgctctgtctacgctcttcacgc

SEQ ID NO: 108034 - DNA, 35 bp, Artificial Sequence
  Synthetic oligonucleotide
gattagggagttgcggattggggctttgaggcgga

SEQ ID NO: 108035 - DNA, 34 bp, Artificial Sequence
  Synthetic oligonucleotide
tttgcaaccgctgtactacctgctcacactgcca

SEQ ID NO: 108036 - DNA, 35 bp, Artificial Sequence
  Synthetic oligonucleotide
gacaccgtaatacgccaccctgccgccaccatggc

SEQ ID NO: 108037 - DNA, 37 bp, Artificial Sequence
  Synthetic oligonucleotide
taacaacgctgttacgtgccgcccctcgccatctcga

SEQ ID NO: 108038 - DNA, 38 bp, Artificial Sequence
  Synthetic oligonucleotide
tgagacaggtgaggaaggggacgaggcgggggacttga

SEQ ID NO: 108039 - DNA, 38 bp, Artificial Sequence
  Synthetic oligonucleotide
gtgccctgttcatgcgtcgtactccctcctgcctttga

SEQ ID NO: 108040 - DNA, 36 bp, Artificial Sequence
  Synthetic oligonucleotide
acagtccctgcagtattgccccacgtccccctgctc

SEQ ID NO: 108041 - DNA, 35 bp, Artificial Sequence
  Synthetic oligonucleotide
gcgccctccacgtgactcgccagccccatctcaat

SEQ ID NO: 108042 - DNA, 35 bp, Artificial Sequence
  Synthetic oligonucleotide
tcatggctctccccccccgctgttgattatctcgc

SEQ ID NO: 108043 - DNA, 35 bp, Artificial Sequence
  Synthetic oligonucleotide
ttacccccgcccacagtcgacattacgacggtatc

SEQ ID NO: 108044 - DNA, 36 bp, Artificial Sequence
  Synthetic oligonucleotide
gtgggaaaggcgggagggggaggaccggtgattgtg

SEQ ID NO: 108045 - DNA, 35 bp, Artificial Sequence
  Synthetic oligonucleotide
gtgacacccacacggtgctacttattaaccctctt

SEQ ID NO: 108046 - DNA, 38 bp, Artificial Sequence
  Synthetic oligonucleotide
tctcgatccaccactcgcatgtcctacccagtctctga

SEQ ID NO: 108047 - DNA, 36 bp, Artificial Sequence
  Synthetic oligonucleotide
gacccccacaccccgcccccttagatggaacagtag

SEQ ID NO: 108048 - DNA, 35 bp, Artificial Sequence
  Synthetic oligonucleotide
tagccccagagctccacctgcggatttctaccctt

SEQ ID NO: 108049 - DNA, 35 bp, Artificial Sequence
  Synthetic oligonucleotide
gtacttgccccatcatccgtttaaccactgttatc

SEQ ID NO: 108050 - DNA, 34 bp, Artificial Sequence
  Synthetic oligonucleotide
accgcccacacggctgcaatactcacgctcctgt

SEQ ID NO: 108051 - DNA, 35 bp, Artificial Sequence
  Synthetic oligonucleotide
tccagccccgtttctctacgttctatcgcctggta

SEQ ID NO: 108052 - DNA, 35 bp, Artificial Sequence
  Synthetic oligonucleotide
gccccgccaccgtatgccccagcccaccgacatgc

SEQ ID NO: 108053 - DNA, 37 bp, Artificial Sequence
  Synthetic oligonucleotide
aatggggtagggggggttaagtggaaggtggtggcga

SEQ ID NO: 108054 - DNA, 35 bp, Artificial Sequence
  Synthetic oligonucleotide
tgcgtgccctccctcgagccgttccccagactgcc

SEQ ID NO: 108055 - DNA, 35 bp, Artificial Sequence
  Synthetic oligonucleotide
tccatccctcccgcctgccatccgtgctctctgga

SEQ ID NO: 108056 - DNA, 35 bp, Artificial Sequence
  Synthetic oligonucleotide
actgtgccagcccccaccgcccaacgtcccgttcc

SEQ ID NO: 108057 - DNA, 35 bp, Artificial Sequence
  Synthetic oligonucleotide
atgccatgtcacctgcttctcgtttgccacacctc

SEQ ID NO: 108058 - DNA, 37 bp, Artificial Sequence
  Synthetic oligonucleotide
gtgggggcattaacgaggggtaggggtactttgggga

SEQ ID NO: 108059 - DNA, 35 bp, Artificial Sequence
  Synthetic oligonucleotide
gccattgccctatgacccttcgtaacgatcacttc

SEQ ID NO: 108060 - DNA, 35 bp, Artificial Sequence
  Synthetic oligonucleotide
ggattcgccctggttccgctccagtccccccgtac

SEQ ID NO: 108061 - DNA, 35 bp, Artificial Sequence
  Synthetic oligonucleotide
accccccccgtacatgactcaacagtggttgctac

SEQ ID NO: 108062 - DNA, 35 bp, Artificial Sequence
  Synthetic oligonucleotide
tatccaccgccacccgacaccatccccgaataacg

SEQ ID NO: 108063 - DNA, 35 bp, Artificial Sequence
  Synthetic oligonucleotide
gcaccctcctgtacggcttaggtttccacggtccc

SEQ ID NO: 108064 - DNA, 35 bp, Artificial Sequence
  Synthetic oligonucleotide
aatggtgcgcagcctatagtcattacccccgtccc

SEQ ID NO: 108065 - DNA, 35 bp, Artificial Sequence
  Synthetic oligonucleotide
aacgccccgatcacgctggtctcctgccctccctg

SEQ ID NO: 108066 - DNA, 35 bp, Artificial Sequence
  Synthetic oligonucleotide
tgctaacccgacctgctgaattcacgcccacctga

SEQ ID NO: 108067 - DNA, 35 bp, Artificial Sequence
  Synthetic oligonucleotide
tccccgccctccccgtgtctttgcgtaggtaattc

SEQ ID NO: 108068 - DNA, 35 bp, Artificial Sequence
  Synthetic oligonucleotide
tgcctccgcgcgctgtccactgaggtctccccttc

SEQ ID NO: 108069 - DNA, 36 bp, Artificial Sequence
  Synthetic oligonucleotide
taccacatcccctgctatagacagagccgcccccta

SEQ ID NO: 108070 - DNA, 35 bp, Artificial Sequence
  Synthetic oligonucleotide
tccaaaccctcgatcctccgaccacagtgccctgt

SEQ ID NO: 108071 - DNA, 35 bp, Artificial Sequence
  Synthetic oligonucleotide
gcccattggcccttgttttagcacccgccgttcca

SEQ ID NO: 108072 - DNA, 35 bp, Artificial Sequence
  Synthetic oligonucleotide
tgcaatgggcgggtgggggtctatgggactttgtt

SEQ ID NO: 108073 - DNA, 35 bp, Artificial Sequence
  Synthetic oligonucleotide
atgcccgccccccacgatctagcgacccactttct

SEQ ID NO: 108074 - DNA, 36 bp, Artificial Sequence
  Synthetic oligonucleotide
gaccagcatcacctgccgtccaactccatactgcca

SEQ ID NO: 108075 - DNA, 35 bp, Artificial Sequence
  Synthetic oligonucleotide
tgctcccgcaccactgccccggttcgctccgccca

SEQ ID NO: 108076 - DNA, 35 bp, Artificial Sequence
  Synthetic oligonucleotide
tctgggggtggggcgttacttcatggggaggggta

SEQ ID NO: 108077 - DNA, 35 bp, Artificial Sequence
  Synthetic oligonucleotide
actagtattgcccagttcgtcccgtccctccagcc

SEQ ID NO: 108078 - DNA, 37 bp, Artificial Sequence
  Synthetic oligonucleotide
gacctcccgcccctgtcgtaccgttccacgtaagtga

SEQ ID NO: 108079 - DNA, 35 bp, Artificial Sequence
  Synthetic oligonucleotide
tgaccccttccccgtgcgattcgttgacttctttc

SEQ ID NO: 108080 - DNA, 35 bp, Artificial Sequence
  Synthetic oligonucleotide
ttatcccgccccaccgcccaactgggcatccgact

SEQ ID NO: 108081 - DNA, 35 bp, Artificial Sequence
  Synthetic oligonucleotide
tctggtcgggggagtcataggggcggggggggaca

SEQ ID NO: 108082 - DNA, 35 bp, Artificial Sequence
  Synthetic oligonucleotide
tacccgaccgttcgtttcttctcgttttcgtgcca

SEQ ID NO: 108083 - DNA, 35 bp, Artificial Sequence
  Synthetic oligonucleotide
tcttgccaccgcactccttctattagttcctgggc

SEQ ID NO: 108084 - DNA, 35 bp, Artificial Sequence
  Synthetic oligonucleotide
gggtgggtgcggggggggcatatagcagcgagttt

SEQ ID NO: 108085 - DNA, 36 bp, Artificial Sequence
  Synthetic oligonucleotide
acacacctcgcctcatctctggtctgagccaactcg

SEQ ID NO: 108086 - DNA, 35 bp, Artificial Sequence
  Synthetic oligonucleotide
gtccgacgcctcatccgacattcgttcctgctttt

SEQ ID NO: 108087 - DNA, 35 bp, Artificial Sequence
  Synthetic oligonucleotide
tatggttccgcctcatgccctcccgttgttaccgc

SEQ ID NO: 108088 - DNA, 35 bp, Artificial Sequence
  Synthetic oligonucleotide
acgtactatcctctgccgttcccgtggttcacaca

SEQ ID NO: 108089 - DNA, 32 bp, Artificial Sequence
  Synthetic oligonucleotide
tattcacggcccacccagtaccaccgcacatc

SEQ ID NO: 108090 - DNA, 36 bp, Artificial Sequence
  Synthetic oligonucleotide
tagccctcctttgcgttcgactccttgcccttgtca

SEQ ID NO: 108091 - DNA, 35 bp, Artificial Sequence
  Synthetic oligonucleotide
tgcccatcttggtgccgtcccttctccatgccccc

SEQ ID NO: 108092 - DNA, 35 bp, Artificial Sequence
  Synthetic oligonucleotide
taccggactgcgcttaattgtctccttcgttcctg

SEQ ID NO: 108093 - DNA, 35 bp, Artificial Sequence
  Synthetic oligonucleotide
agcaatcgcgatgagcactccccgtcctgctatct

SEQ ID NO: 108094 - DNA, 36 bp, Artificial Sequence
  Synthetic oligonucleotide
cccactatcccgtcgtttcgtcctgccacttgagaa

SEQ ID NO: 108095 - DNA, 35 bp, Artificial Sequence
  Synthetic oligonucleotide
tcaccgtgagtgcccatcaatcagccgccgctccc

SEQ ID NO: 108096 - DNA, 36 bp, Artificial Sequence
  Synthetic oligonucleotide
gaacccccctccgccgcctgaccagttgacttcgta

SEQ ID NO: 108097 - DNA, 36 bp, Artificial Sequence
  Synthetic oligonucleotide
tgtcaccgccctgccacgatcccgccgacgccctga

SEQ ID NO: 108098 - DNA, 35 bp, Artificial Sequence
  Synthetic oligonucleotide
tcgatactcttgcgtgttcacttccgtcctgctcc

SEQ ID NO: 108099 - DNA, 34 bp, Artificial Sequence
  Synthetic oligonucleotide
tcttgcccaggacctagctaacacctctgcatca

SEQ ID NO: 108100 - DNA, 35 bp, Artificial Sequence
  Synthetic oligonucleotide
tgcaccccgttctgacacgcgccacccttgtccta

SEQ ID NO: 108101 - DNA, 34 bp, Artificial Sequence
  Synthetic oligonucleotide
gcccccccccgcgctttgatcatattcacctaca

SEQ ID NO: 108102 - DNA, 35 bp, Artificial Sequence
  Synthetic oligonucleotide
gacgcccctatctgccccatgttcgatgcaatcac

SEQ ID NO: 108103 - DNA, 35 bp, Artificial Sequence
  Synthetic oligonucleotide
ttccagcccacctgcccatcattgactttctcatg

SEQ ID NO: 108104 - DNA, 35 bp, Artificial Sequence
  Synthetic oligonucleotide
gccacgctagacctgctccgaccgactccccactg

SEQ ID NO: 108105 - DNA, 37 bp, Artificial Sequence
  Synthetic oligonucleotide
ggcgtctggtggagggggggacggttggacggactga

SEQ ID NO: 108106 - DNA, 36 bp, Artificial Sequence
  Synthetic oligonucleotide
gccgttgggccgatcccatatatgttccatccttca

SEQ ID NO: 108107 - DNA, 36 bp, Artificial Sequence
  Synthetic oligonucleotide
tgtggtgtacggagggggggataggggcggggttca

SEQ ID NO: 108108 - DNA, 36 bp, Artificial Sequence
  Synthetic oligonucleotide
atcaccactgctcctgttctaaagttctttccttca

SEQ ID NO: 108109 - DNA, 36 bp, Artificial Sequence
  Synthetic oligonucleotide
acactcgcccttgttccttcgactcattaccccgga

SEQ ID NO: 108110 - DNA, 36 bp, Artificial Sequence
  Synthetic oligonucleotide
ggggtgggcgcattccataatatagtgaaagaggga

SEQ ID NO: 108111 - DNA, 35 bp, Artificial Sequence
  Synthetic oligonucleotide
actctgccgcccagttccagttcttcgctcccgtt

SEQ ID NO: 108112 - DNA, 35 bp, Artificial Sequence
  Synthetic oligonucleotide
ttgtcgcctaacaccttgcttgtattcctgtccga

SEQ ID NO: 108113 - DNA, 35 bp, Artificial Sequence
  Synthetic oligonucleotide
gaaggaaagggaagggcgtgagggggggtaaacct

SEQ ID NO: 108114 - DNA, 37 bp, Artificial Sequence
  Synthetic oligonucleotide
tttggcgctcagcctccctgctctctcgaatcctcga

SEQ ID NO: 108115 - DNA, 37 bp, Artificial Sequence
  Synthetic oligonucleotide
tactgctccacctccgccttttagacctgtcccagga

SEQ ID NO: 108116 - DNA, 35 bp, Artificial Sequence
  Synthetic oligonucleotide
ggatgctactgcctgcccgcctactctcgatcgct

SEQ ID NO: 108117 - DNA, 36 bp, Artificial Sequence
  Synthetic oligonucleotide
accgccccctcgccttccctcttttatgtgcatcca

SEQ ID NO: 108118 - DNA, 35 bp, Artificial Sequence
  Synthetic oligonucleotide
tgcgaccgttccttgctaatgcccgacccccgaac

SEQ ID NO: 108119 - DNA, 37 bp, Artificial Sequence
  Synthetic oligonucleotide
gaggggaagggtgatacgaacaaggggggcgagagga

SEQ ID NO: 108120 - DNA, 36 bp, Artificial Sequence
  Synthetic oligonucleotide
tgcctacccgccgcaagtgcctgcgtgcacctctca

SEQ ID NO: 108121 - DNA, 27 bp, Artificial Sequence
  Synthetic oligonucleotide
ttaaaggaggaagggggggtggaggga

SEQ ID NO: 108122 - DNA, 35 bp, Artificial Sequence
  Synthetic oligonucleotide
tctagctcaccaccgttcgtccatgccactgccta

SEQ ID NO: 108123 - DNA, 37 bp, Artificial Sequence
  Synthetic oligonucleotide
acgcgtgaagggtggtggtggaggaaggtaggcagga

SEQ ID NO: 108124 - DNA, 35 bp, Artificial Sequence
  Synthetic oligonucleotide
ggagccctcggatccccggccccttcgctctcccg

SEQ ID NO: 108125 - DNA, 34 bp, Artificial Sequence
  Synthetic oligonucleotide
ttactgcatcaacgtgcccccctcccccgtattg

SEQ ID NO: 108126 - DNA, 35 bp, Artificial Sequence
  Synthetic oligonucleotide
gtccgccgcagcccgcaagacaccctctccgtttt

SEQ ID NO: 108127 - DNA, 35 bp, Artificial Sequence
  Synthetic oligonucleotide
gtgccctcgtatggcaccactcccctcctcttcga

SEQ ID NO: 108128 - DNA, 37 bp, Artificial Sequence
  Synthetic oligonucleotide
tagggtggtaggaggtacaaagggcatgggggtgtga

SEQ ID NO: 108129 - DNA, 35 bp, Artificial Sequence
  Synthetic oligonucleotide
tgcacaccaccgccagtctcttgaactatcctttg

SEQ ID NO: 108130 - DNA, 35 bp, Artificial Sequence
  Synthetic oligonucleotide
gcacaaccccccgccacatcggccccgcacctcgt

SEQ ID NO: 108131 - DNA, 36 bp, Artificial Sequence
  Synthetic oligonucleotide
aagccagagcagattccctccgccaattgtccctta

SEQ ID NO: 108132 - DNA, 35 bp, Artificial Sequence
  Synthetic oligonucleotide
gccaacctctatgatcgccgccacatttttcacat

SEQ ID NO: 108133 - DNA, 35 bp, Artificial Sequence
  Synthetic oligonucleotide
gatctggctcccatcgtgctccggaccctttttcc

SEQ ID NO: 108134 - DNA, 35 bp, Artificial Sequence
  Synthetic oligonucleotide
actccactcgtattggccagccaccgcatacttcc

SEQ ID NO: 108135 - DNA, 35 bp, Artificial Sequence
  Synthetic oligonucleotide
agaccgaaccccctatgtgttgtgtcgcccctctc

SEQ ID NO: 108136 - DNA, 35 bp, Artificial Sequence
  Synthetic oligonucleotide
acacatgcgggggttcgcggggtcattggggttgc

SEQ ID NO: 108137 - DNA, 35 bp, Artificial Sequence
  Synthetic oligonucleotide
atcgtccatacgccgtttctgacttccctatcctg

SEQ ID NO: 108138 - DNA, 35 bp, Artificial Sequence
  Synthetic oligonucleotide
ttagcaacccgcctgtgtcctcgttttccatctac

SEQ ID NO: 108139 - DNA, 34 bp, Artificial Sequence
  Synthetic oligonucleotide
gcgatcaccctgtttgccctagccggttgcactc

SEQ ID NO: 108140 - DNA, 35 bp, Artificial Sequence
  Synthetic oligonucleotide
tggacggccgatatgtgcactctcgctcccccctc

SEQ ID NO: 108141 - DNA, 35 bp, Artificial Sequence
  Synthetic oligonucleotide
tcccacccagtctcacctcgcacagccttttccat

SEQ ID NO: 108142 - DNA, 38 bp, Artificial Sequence
  Synthetic oligonucleotide
atggatgggggaggcatgggaattgacgggaggggtga

SEQ ID NO: 108143 - DNA, 37 bp, Artificial Sequence
  Synthetic oligonucleotide
gccgggagggcactggtagaaggggggggcctcaaga

SEQ ID NO: 108144 - DNA, 35 bp, Artificial Sequence
  Synthetic oligonucleotide
acttacgcacggcggcccgcccatgttcccatccc

SEQ ID NO: 108145 - DNA, 35 bp, Artificial Sequence
  Synthetic oligonucleotide
gcccaccctcgcctcatgcgggtttatttgtctcc

SEQ ID NO: 108146 - DNA, 36 bp, Artificial Sequence
  Synthetic oligonucleotide
gacccatcctcgttgcgttgctccccttttctacaa

SEQ ID NO: 108147 - DNA, 35 bp, Artificial Sequence
  Synthetic oligonucleotide
tatcactcgcccttcttgtctttcacactgcaagc

SEQ ID NO: 108148 - DNA, 35 bp, Artificial Sequence
  Synthetic oligonucleotide
tgcctccctatatgtccttgtccgggtcccgctct

SEQ ID NO: 108149 - DNA, 35 bp, Artificial Sequence
  Synthetic oligonucleotide
gacagtcgccctacgtaccgatcccttgccttgcc

SEQ ID NO: 108150 - DNA, 35 bp, Artificial Sequence
  Synthetic oligonucleotide
agcctaccccctgcgctgactatgctactcttacc

SEQ ID NO: 108151 - DNA, 34 bp, Artificial Sequence
  Synthetic oligonucleotide
aagtgcccctccgtttattctacttcccgccccg

SEQ ID NO: 108152 - DNA, 37 bp, Artificial Sequence
  Synthetic oligonucleotide
tagcaagggcgggactgggggggatggacagatggga

SEQ ID NO: 108153 - DNA, 35 bp, Artificial Sequence
  Synthetic oligonucleotide
ttcaccccgctcacattaactaggtcttctcctgg

SEQ ID NO: 108154 - DNA, 37 bp, Artificial Sequence
  Synthetic oligonucleotide
gctgggggaggaacgggggaaatgagaccaggccgga

SEQ ID NO: 108155 - DNA, 35 bp, Artificial Sequence
  Synthetic oligonucleotide
gcccatccgctcccatctgcggccttccacaacac

SEQ ID NO: 108156 - DNA, 37 bp, Artificial Sequence
  Synthetic oligonucleotide
tgaacatgcctcacgctgctccatcctgttacaccga

SEQ ID NO: 108157 - DNA, 35 bp, Artificial Sequence
  Synthetic oligonucleotide
actggtgccctctccgctatgtcattgacgccctt

SEQ ID NO: 108158 - DNA, 35 bp, Artificial Sequence
  Synthetic oligonucleotide
gccatcactcacacgttgcaacacccgtacaccat

SEQ ID NO: 108159 - DNA, 35 bp, Artificial Sequence
  Synthetic oligonucleotide
aatacccgccacatccctgtcgcttcctgaccact

SEQ ID NO: 108160 - DNA, 35 bp, Artificial Sequence
  Synthetic oligonucleotide
agcgtacggggggggaagggcggggacggtgggac

SEQ ID NO: 108161 - DNA, 35 bp, Artificial Sequence
  Synthetic oligonucleotide
gatgtcccgccacccttccgccaattacgacctgt

SEQ ID NO: 108162 - DNA, 35 bp, Artificial Sequence
  Synthetic oligonucleotide
gcatccgccgtatcccctgttgtaaaccatctcgc

SEQ ID NO: 108163 - DNA, 34 bp, Artificial Sequence
  Synthetic oligonucleotide
ggaagggggacggtggagttaactgaggggggtg

SEQ ID NO: 108164 - DNA, 35 bp, Artificial Sequence
  Synthetic oligonucleotide
attcccgcctcacttgtccgctgactgctaccaat

SEQ ID NO: 108165 - DNA, 35 bp, Artificial Sequence
  Synthetic oligonucleotide
tgcacccgcctcattgcgacagatcctaccctttc

SEQ ID NO: 108166 - DNA, 35 bp, Artificial Sequence
  Synthetic oligonucleotide
agccggccctcacagctcacccgcgcacttcgtta

SEQ ID NO: 108167 - DNA, 37 bp, Artificial Sequence
  Synthetic oligonucleotide
agtcctcacccgccctcaatagtcgccgcccctccga

SEQ ID NO: 108168 - DNA, 35 bp, Artificial Sequence
  Synthetic oligonucleotide
acccgccgcacgctagtgcaacacccttgtctcgc

SEQ ID NO: 108169 - DNA, 35 bp, Artificial Sequence
  Synthetic oligonucleotide
tgcgcatgctgcctgctcgtccctgggccaccttc

SEQ ID NO: 108170 - DNA, 37 bp, Artificial Sequence
  Synthetic oligonucleotide
gaggaaggaagccggaacggggaagacggcggaggga

SEQ ID NO: 108171 - DNA, 36 bp, Artificial Sequence
  Synthetic oligonucleotide
gaacctgccttccactgccctgcgccccttacctga

SEQ ID NO: 108172 - DNA, 35 bp, Artificial Sequence
  Synthetic oligonucleotide
gcccacttcgcgcctggtactccactgtctgtgcc

SEQ ID NO: 108173 - DNA, 36 bp, Artificial Sequence
  Synthetic oligonucleotide
agaagggagtggaaggtggtaggaggggtgtgcatc

SEQ ID NO: 108174 - DNA, 35 bp, Artificial Sequence
  Synthetic oligonucleotide
tgcccccacggtctggccccctttacacacttctc

SEQ ID NO: 108175 - DNA, 37 bp, Artificial Sequence
  Synthetic oligonucleotide
gaatggtgaggaaagcgggggactagggagtgaggga

SEQ ID NO: 108176 - DNA, 35 bp, Artificial Sequence
  Synthetic oligonucleotide
atgtcaccggcactcgacccttatgctacctttca

SEQ ID NO: 108177 - DNA, 35 bp, Artificial Sequence
  Synthetic oligonucleotide
atccgccccccctgtgctcccttggatgccaatat

SEQ ID NO: 108178 - DNA, 35 bp, Artificial Sequence
  Synthetic oligonucleotide
agtcacaccctcaacgcctatcgtgaccctctttc

SEQ ID NO: 108179 - DNA, 34 bp, Artificial Sequence
  Synthetic oligonucleotide
acctcctccccctccggctcaccttgtccgccgg

SEQ ID NO: 108180 - DNA, 36 bp, Artificial Sequence
  Synthetic oligonucleotide
gtgccccctgcattcccccacacagtccggttcgaa

SEQ ID NO: 108181 - DNA, 35 bp, Artificial Sequence
  Synthetic oligonucleotide
ttgtcccccccgctccatgccaccttgggtcgtac

SEQ ID NO: 108182 - DNA, 35 bp, Artificial Sequence
  Synthetic oligonucleotide
gacaagaccgttcgtcgttctgccctccccctgtg

SEQ ID NO: 108183 - DNA, 37 bp, Artificial Sequence
  Synthetic oligonucleotide
tcccgccatcattgtgctactctcccctccctctgga

SEQ ID NO: 108184 - DNA, 38 bp, Artificial Sequence
  Synthetic oligonucleotide
gaccctcgcccgccccttttctcagttgtagtccctga

SEQ ID NO: 108185 - DNA, 37 bp, Artificial Sequence
  Synthetic oligonucleotide
gaatcaggggggagaaatggacgggggacgcgaggga

SEQ ID NO: 108186 - DNA, 35 bp, Artificial Sequence
  Synthetic oligonucleotide
gacatgcctcatctctgctttacaacaccttgcgt

SEQ ID NO: 108187 - DNA, 35 bp, Artificial Sequence
  Synthetic oligonucleotide
gtctcccatgcggccagtttcgtccctctgccttt

SEQ ID NO: 108188 - DNA, 38 bp, Artificial Sequence
  Synthetic oligonucleotide
tgagtggtggtggagagcgggtgggaggggcctggtga

SEQ ID NO: 108189 - DNA, 35 bp, Artificial Sequence
  Synthetic oligonucleotide
gcagtgcctgagccacatctttgctgccccccgtc

SEQ ID NO: 108190 - DNA, 35 bp, Artificial Sequence
  Synthetic oligonucleotide
acacgcccgtctgccgctgtctcttcctgcttccg

SEQ ID NO: 108191 - DNA, 36 bp, Artificial Sequence
  Synthetic oligonucleotide
actggtggaggggtggttgggagaaatgggggagga

SEQ ID NO: 108192 - DNA, 35 bp, Artificial Sequence
  Synthetic oligonucleotide
gttcacctgcgccatctttacccctccgttccatg

SEQ ID NO: 108193 - DNA, 35 bp, Artificial Sequence
  Synthetic oligonucleotide
gcccgcccctgtcacgtactaccgtgtggctcccc

SEQ ID NO: 108194 - DNA, 35 bp, Artificial Sequence
  Synthetic oligonucleotide
tcccatcccgcccctgaaatggtgacccactacct

SEQ ID NO: 108195 - DNA, 35 bp, Artificial Sequence
  Synthetic oligonucleotide
gcccccacccgcactctccgaaccccagtttcgcg

SEQ ID NO: 108196 - DNA, 37 bp, Artificial Sequence
  Synthetic oligonucleotide
tgtagagcgaggggtggcaagggaggggagggtgaga

SEQ ID NO: 108197 - DNA, 35 bp, Artificial Sequence
  Synthetic oligonucleotide
tccccccctccgccaaagtgttcgggtactcctcg

SEQ ID NO: 108198 - DNA, 36 bp, Artificial Sequence
  Synthetic oligonucleotide
gacaacggggaagggggtagggggaccggcgttcaa

SEQ ID NO: 108199 - DNA, 35 bp, Artificial Sequence
  Synthetic oligonucleotide
acacctcatgtccgtatctatgcctacgccctaac

SEQ ID NO: 108200 - DNA, 35 bp, Artificial Sequence
  Synthetic oligonucleotide
acctcccgccactagccccgtacgggtgacaaacc

SEQ ID NO: 108201 - DNA, 35 bp, Artificial Sequence
  Synthetic oligonucleotide
tacacccgcttggtgggtctctattcttgtcttcc

SEQ ID NO: 108202 - DNA, 35 bp, Artificial Sequence
  Synthetic oligonucleotide
actcatcctccgccggtcgctatgcccgcagtact

SEQ ID NO: 108203 - DNA, 35 bp, Artificial Sequence
  Synthetic oligonucleotide
tgtggacgggaggagggggagtgggtacttgtaag

SEQ ID NO: 108204 - DNA, 36 bp, Artificial Sequence
  Synthetic oligonucleotide
ttgccctgcctccaacgcgccctcgagctcctagca

SEQ ID NO: 108205 - DNA, 37 bp, Artificial Sequence
  Synthetic oligonucleotide
tctgtggagggcgaggaagtgggaaggggccggcaga

SEQ ID NO: 108206 - DNA, 37 bp, Artificial Sequence
  Synthetic oligonucleotide
aacgggagggacgaaaggggtcagggcgagacgggga

SEQ ID NO: 108207 - DNA, 36 bp, Artificial Sequence
  Synthetic oligonucleotide
gacctccccacttgtagtaccatggcccactgaaca

SEQ ID NO: 108208 - DNA, 37 bp, Artificial Sequence
  Synthetic oligonucleotide
aagaaggggggagggtgatacacggggacggtgacga

SEQ ID NO: 108209 - DNA, 35 bp, Artificial Sequence
  Synthetic oligonucleotide
gaccgccccagcctgtttctgttttcgggttctat

SEQ ID NO: 108210 - DNA, 35 bp, Artificial Sequence
  Synthetic oligonucleotide
gtcacctaccgttatccgtatctgccgtatctccg

SEQ ID NO: 108211 - DNA, 36 bp, Artificial Sequence
  Synthetic oligonucleotide
tgactggccggatatctgtcttttcctgttccccca

SEQ ID NO: 108212 - DNA, 35 bp, Artificial Sequence
  Synthetic oligonucleotide
gcgcctccacctggttgtccatcgtacgccttggc

SEQ ID NO: 108213 - DNA, 35 bp, Artificial Sequence
  Synthetic oligonucleotide
gcaagtaggggtggggcgggttgcatggggttagc

SEQ ID NO: 108214 - DNA, 37 bp, Artificial Sequence
  Synthetic oligonucleotide
tcacactgcctcctccctctgtgctcatggaacatga

SEQ ID NO: 108215 - DNA, 35 bp, Artificial Sequence
  Synthetic oligonucleotide
acccctgcgctatcaatcccgtcgtccttggcctt

SEQ ID NO: 108216 - DNA, 35 bp, Artificial Sequence
  Synthetic oligonucleotide
taccaccgccgctttatccccgagtgccttttgaa

SEQ ID NO: 108217 - DNA, 35 bp, Artificial Sequence
  Synthetic oligonucleotide
gacccctctccgttgctttaggacaacgtttcatc

SEQ ID NO: 108218 - DNA, 35 bp, Artificial Sequence
  Synthetic oligonucleotide
atcatcggcctcacatctccagcccctctctgcgc

SEQ ID NO: 108219 - DNA, 35 bp, Artificial Sequence
  Synthetic oligonucleotide
acaccggtcagtacgatttccctgtctcctcactg

SEQ ID NO: 108220 - DNA, 35 bp, Artificial Sequence
  Synthetic oligonucleotide
acccgctatctcctccgttcgtcctcttgctgaca

SEQ ID NO: 108221 - DNA, 35 bp, Artificial Sequence
  Synthetic oligonucleotide
acactgccctactgccttgcttacattgtcctgtc

SEQ ID NO: 108222 - DNA, 35 bp, Artificial Sequence
  Synthetic oligonucleotide
tgcacctgactgactcggcccatccaccctgcgca

SEQ ID NO: 108223 - DNA, 35 bp, Artificial Sequence
  Synthetic oligonucleotide
accgcgcgcatgtagctaccccctctcacccctgt

SEQ ID NO: 108224 - DNA, 35 bp, Artificial Sequence
  Synthetic oligonucleotide
gcaggaagggtgagggggggcggtcataggagaag

SEQ ID NO: 108225 - DNA, 37 bp, Artificial Sequence
  Synthetic oligonucleotide
atagcccccgcccagttcgcccaaccgatgcccccga

SEQ ID NO: 108226 - DNA, 35 bp, Artificial Sequence
  Synthetic oligonucleotide
tcccgttcccagccgccctaagctcgttttggtac

SEQ ID NO: 108227 - DNA, 35 bp, Artificial Sequence
  Synthetic oligonucleotide
ttccacccctgctgccaccatccacgtttccacag

SEQ ID NO: 108228 - DNA, 35 bp, Artificial Sequence
  Synthetic oligonucleotide
tgcacctgccccctgttcctactggcgtatatcct

SEQ ID NO: 108229 - DNA, 36 bp, Artificial Sequence
  Synthetic oligonucleotide
gtgttccctccccccgtgtttgtatggtcacctcca

SEQ ID NO: 108230 - DNA, 35 bp, Artificial Sequence
  Synthetic oligonucleotide
tcgcacccacactgctacatcatcttcctcccttg

SEQ ID NO: 108231 - DNA, 34 bp, Artificial Sequence
  Synthetic oligonucleotide
actggcccgccgctgtcatctttcacctgcccga

SEQ ID NO: 108232 - DNA, 35 bp, Artificial Sequence
  Synthetic oligonucleotide
gcattcgccgtagttccgccgcacccgctctttac

SEQ ID NO: 108233 - DNA, 35 bp, Artificial Sequence
  Synthetic oligonucleotide
tcgccccctgcccatctgatcgcctatctcatgta

SEQ ID NO: 108234 - DNA, 38 bp, Artificial Sequence
  Synthetic oligonucleotide
gccaacccctgtcccgataatgcctcgtcccccggtga

SEQ ID NO: 108235 - DNA, 35 bp, Artificial Sequence
  Synthetic oligonucleotide
tgtacgtcaacatcactgttccgccctcgccacgg

SEQ ID NO: 108236 - DNA, 36 bp, Artificial Sequence
  Synthetic oligonucleotide
aggacgagagggcgggggggaagggcttgaaagtga

SEQ ID NO: 108237 - DNA, 35 bp, Artificial Sequence
  Synthetic oligonucleotide
tacctgccccgcctctcgttgtgtcccctgatccg

SEQ ID NO: 108238 - DNA, 38 bp, Artificial Sequence
  Synthetic oligonucleotide
tagagggcggggagggtacgtgtcatagaggggcctga

SEQ ID NO: 108239 - DNA, 35 bp, Artificial Sequence
  Synthetic oligonucleotide
gatgagtggggtcgggcggaggagggagcgaatta

SEQ ID NO: 108240 - DNA, 35 bp, Artificial Sequence
  Synthetic oligonucleotide
aacccatccgttcaccatcaggaagcacacctccc

SEQ ID NO: 108241 - DNA, 37 bp, Artificial Sequence
  Synthetic oligonucleotide
atcgctgtagcaatggggacggggcggtgggggggga

SEQ ID NO: 108242 - DNA, 38 bp, Artificial Sequence
  Synthetic oligonucleotide
gttgcaccccactatgctccaccatggccccgctttga

SEQ ID NO: 108243 - DNA, 35 bp, Artificial Sequence
  Synthetic oligonucleotide
gcacacgaatacccgccgcccacttacgtcgacgc

SEQ ID NO: 108244 - DNA, 36 bp, Artificial Sequence
  Synthetic oligonucleotide
gccatcttcgcctgccactcgctgtcttcgcaccca

SEQ ID NO: 108245 - DNA, 35 bp, Artificial Sequence
  Synthetic oligonucleotide
tccgcctaccccctgtacgcccgactcctgggacg

SEQ ID NO: 108246 - DNA, 35 bp, Artificial Sequence
  Synthetic oligonucleotide
acccctcaccaactctgtccatcgctggagccacc

SEQ ID NO: 108247 - DNA, 35 bp, Artificial Sequence
  Synthetic oligonucleotide
accagtccctgccgccgccctacattactatgtgc

SEQ ID NO: 108248 - DNA, 35 bp, Artificial Sequence
  Synthetic oligonucleotide
atgcctccgtccgcgccacctcgttccgaccccag

SEQ ID NO: 108249 - DNA, 35 bp, Artificial Sequence
  Synthetic oligonucleotide
tcaacctccccatgcgcatggaaacgtgcactctc

SEQ ID NO: 108250 - DNA, 36 bp, Artificial Sequence
  Synthetic oligonucleotide
gtccacgcactcaccgttatcgagtccccccaccga

SEQ ID NO: 108251 - DNA, 35 bp, Artificial Sequence
  Synthetic oligonucleotide
tcgcaacctagagccgctaccttcatccgttcgcc

SEQ ID NO: 108252 - DNA, 35 bp, Artificial Sequence
  Synthetic oligonucleotide
tgttcgcaccgtccatatcaccatcctttcgccgg

SEQ ID NO: 108253 - DNA, 35 bp, Artificial Sequence
  Synthetic oligonucleotide
tccttgcctcactcgcgcctcctcttccgcatttg

SEQ ID NO: 108254 - DNA, 35 bp, Artificial Sequence
  Synthetic oligonucleotide
actgtccaacctcattctcgctatacctgctgttt

SEQ ID NO: 108255 - DNA, 35 bp, Artificial Sequence
  Synthetic oligonucleotide
tggtcgcccccctcacgtctgttacatcttcgttc

SEQ ID NO: 108256 - DNA, 35 bp, Artificial Sequence
  Synthetic oligonucleotide
gtgatgggcgggtgggaacgggttgacctcttata

SEQ ID NO: 108257 - DNA, 35 bp, Artificial Sequence
  Synthetic oligonucleotide
accccaagccgcacagttccgttcccacttgcctt

SEQ ID NO: 108258 - DNA, 35 bp, Artificial Sequence
  Synthetic oligonucleotide
tcccgccgatgcggcagtccatccccgcaccccta

SEQ ID NO: 108259 - DNA, 35 bp, Artificial Sequence
  Synthetic oligonucleotide
ggtcgacctcggctgtactcccaccctctctcttg

SEQ ID NO: 108260 - DNA, 35 bp, Artificial Sequence
  Synthetic oligonucleotide
attccccaatgcgtcccattcccgtcacgttccat

SEQ ID NO: 108261 - DNA, 37 bp, Artificial Sequence
  Synthetic oligonucleotide
gagcgggtgaagggtgggggggactactataggcaga

SEQ ID NO: 108262 - DNA, 35 bp, Artificial Sequence
  Synthetic oligonucleotide
ttcccacaccgccgaattccaggtctgtcttcttc

SEQ ID NO: 108263 - DNA, 36 bp, Artificial Sequence
  Synthetic oligonucleotide
accgccgtccacctgtcctatactgcgtaccctgca

SEQ ID NO: 108264 - DNA, 35 bp, Artificial Sequence
  Synthetic oligonucleotide
acgctctacctctatccgtttaatctgcccgttgc

SEQ ID NO: 108265 - DNA, 35 bp, Artificial Sequence
  Synthetic oligonucleotide
gttccatccggcccctatcgctgaacctctgtgcc

SEQ ID NO: 108266 - DNA, 35 bp, Artificial Sequence
  Synthetic oligonucleotide
tgaatcccgctcgctctatccatggaccccctgct

SEQ ID NO: 108267 - DNA, 37 bp, Artificial Sequence
  Synthetic oligonucleotide
gatgtgcaacagtggagggtggggacgggggagatga

SEQ ID NO: 108268 - DNA, 35 bp, Artificial Sequence
  Synthetic oligonucleotide
ttcgccccgccgccatatagttggccgatccgctc

SEQ ID NO: 108269 - DNA, 35 bp, Artificial Sequence
  Synthetic oligonucleotide
acctcccgcacctggtttatgtcctgtcctcgttc

SEQ ID NO: 108270 - DNA, 35 bp, Artificial Sequence
  Synthetic oligonucleotide
gaacggactgctgcgatcgacttcccccccctgta

SEQ ID NO: 108271 - DNA, 35 bp, Artificial Sequence
  Synthetic oligonucleotide
acctacatggcgtcccctccgctcgctcccgctcc

SEQ ID NO: 108272 - DNA, 35 bp, Artificial Sequence
  Synthetic oligonucleotide
tacgttccccgcaagcactccctccgtcctggcct

SEQ ID NO: 108273 - DNA, 37 bp, Artificial Sequence
  Synthetic oligonucleotide
acgccatccacatcacgccgcaccccacattgtccga

SEQ ID NO: 108274 - DNA, 35 bp, Artificial Sequence
  Synthetic oligonucleotide
acatccgcgcgggccgcctacgatcctaccttcct

SEQ ID NO: 108275 - DNA, 37 bp, Artificial Sequence
  Synthetic oligonucleotide
tgtgaaggttaaggtgggcggagaggggggcatggga

SEQ ID NO: 108276 - DNA, 35 bp, Artificial Sequence
  Synthetic oligonucleotide
tcccctcctacctcgcatggctgtgaagccctact

SEQ ID NO: 108277 - DNA, 37 bp, Artificial Sequence
  Synthetic oligonucleotide
accactgcgcaccgctgccgtttcctcccgtttagga

SEQ ID NO: 108278 - DNA, 35 bp, Artificial Sequence
  Synthetic oligonucleotide
gtaacgccgtccggcccccgttcttagtctccatc

SEQ ID NO: 108279 - DNA, 35 bp, Artificial Sequence
  Synthetic oligonucleotide
ttgcacctgttcagtctctgcttactgctttcgtt

SEQ ID NO: 108280 - DNA, 35 bp, Artificial Sequence
  Synthetic oligonucleotide
gtaccatcctcggcttatacagctccgtccacgaa

SEQ ID NO: 108281 - DNA, 35 bp, Artificial Sequence
  Synthetic oligonucleotide
ttcgccgcccattcgtttgcttaactgttctgtac

SEQ ID NO: 108282 - DNA, 35 bp, Artificial Sequence
  Synthetic oligonucleotide
gaatgcaaccgtcctcctgcaccaccctatcgctg

SEQ ID NO: 108283 - DNA, 35 bp, Artificial Sequence
  Synthetic oligonucleotide
aacccgccccacactgcttgagcatttcgatatac

SEQ ID NO: 108284 - DNA, 36 bp, Artificial Sequence
  Synthetic oligonucleotide
gtcgcaatccgcctctgtaaaccccgccctcgcata

SEQ ID NO: 108285 - DNA, 35 bp, Artificial Sequence
  Synthetic oligonucleotide
atacgccatccccaaattgctacatgacttcccac

SEQ ID NO: 108286 - DNA, 35 bp, Artificial Sequence
  Synthetic oligonucleotide
tccacattccgttgttgccgtactttaatccctca

SEQ ID NO: 108287 - DNA, 35 bp, Artificial Sequence
  Synthetic oligonucleotide
tagccacttacgcgtgtcctgaatctgctgccccc

SEQ ID NO: 108288 - DNA, 34 bp, Artificial Sequence
  Synthetic oligonucleotide
tccctcacctcccatttgcatgacctgaactcct

SEQ ID NO: 108289 - DNA, 37 bp, Artificial Sequence
  Synthetic oligonucleotide
gccggacgcagtacgttatatcttcccttctcctcga

SEQ ID NO: 108290 - DNA, 37 bp, Artificial Sequence
  Synthetic oligonucleotide
aattgccacccgcccattgcttacccgatcgccttga

SEQ ID NO: 108291 - DNA, 35 bp, Artificial Sequence
  Synthetic oligonucleotide
gtcgcttgtgccgggtctgtccaccgttgcctttc

SEQ ID NO: 108292 - DNA, 35 bp, Artificial Sequence
  Synthetic oligonucleotide
tcaccgccgtgccctgcctccgcaacatcattacg

SEQ ID NO: 108293 - DNA, 35 bp, Artificial Sequence
  Synthetic oligonucleotide
gctgatgggagggtggtgggggtagaggacgggta

SEQ ID NO: 108294 - DNA, 31 bp, Artificial Sequence
  Synthetic oligonucleotide
agtgacccattgccgctggctccctgaccct

SEQ ID NO: 108295 - DNA, 35 bp, Artificial Sequence
  Synthetic oligonucleotide
tgtgtcccgccgacgcgcaacttggtcttccccgc

SEQ ID NO: 108296 - DNA, 35 bp, Artificial Sequence
  Synthetic oligonucleotide
gtacaccgccgtcacccctacatccgctggtcccg

SEQ ID NO: 108297 - DNA, 36 bp, Artificial Sequence
  Synthetic oligonucleotide
gccacctcgctcgtataatctcttcccgccttccga

SEQ ID NO: 108298 - DNA, 35 bp, Artificial Sequence
  Synthetic oligonucleotide
tttccccacacctgcctttgataccgagccttgtc

SEQ ID NO: 108299 - DNA, 28 bp, Artificial Sequence
  Synthetic oligonucleotide
tctgccccccaagtttccctgctttcgc

SEQ ID NO: 108300 - DNA, 35 bp, Artificial Sequence
  Synthetic oligonucleotide
gagatggggagggggtatgaaaggggttgaaggat

SEQ ID NO: 108301 - DNA, 35 bp, Artificial Sequence
  Synthetic oligonucleotide
tttggtcgccctcccgatgcacagatcgcctttcc

SEQ ID NO: 108302 - DNA, 35 bp, Artificial Sequence
  Synthetic oligonucleotide
gttacgctccgtccttagctgcccttcttcggtct

SEQ ID NO: 108303 - DNA, 35 bp, Artificial Sequence
  Synthetic oligonucleotide
acaccgcctcgccctcgtagcacccatcatcccct

SEQ ID NO: 108304 - DNA, 36 bp, Artificial Sequence
  Synthetic oligonucleotide
tctatcatccccgaccgcctgttcttatatgttcta

SEQ ID NO: 108305 - DNA, 35 bp, Artificial Sequence
  Synthetic oligonucleotide
gacttgacatccgtgcgtactcccctgctacatcc

SEQ ID NO: 108306 - DNA, 35 bp, Artificial Sequence
  Synthetic oligonucleotide
ggtggaagaggaggaggtaataaacaggggagggg

SEQ ID NO: 108307 - DNA, 35 bp, Artificial Sequence
  Synthetic oligonucleotide
gtcacccctgttgcttttcaaacgttccctgaccc

SEQ ID NO: 108308 - DNA, 36 bp, Artificial Sequence
  Synthetic oligonucleotide
gatgtgcgcacacatgataattctcctccgcttcga

SEQ ID NO: 108309 - DNA, 33 bp, Artificial Sequence
  Synthetic oligonucleotide
ggggggagggatgggtcgggataatctggttcg

SEQ ID NO: 108310 - DNA, 35 bp, Artificial Sequence
  Synthetic oligonucleotide
gcccccacttggtgtcattgttccgtcctttccta

SEQ ID NO: 108311 - DNA, 35 bp, Artificial Sequence
  Synthetic oligonucleotide
gcccattgctcccccgcgtgttttcgttatcttca

SEQ ID NO: 108312 - DNA, 35 bp, Artificial Sequence
  Synthetic oligonucleotide
aaaccacgcccttggtgctctccatacgttacctt

SEQ ID NO: 108313 - DNA, 35 bp, Artificial Sequence
  Synthetic oligonucleotide
agtcacaacccgctgtctctgcccctcgctctcga

SEQ ID NO: 108314 - DNA, 35 bp, Artificial Sequence
  Synthetic oligonucleotide
gcccgcctcccacccggtatggtcacaggctcctt

SEQ ID NO: 108315 - DNA, 35 bp, Artificial Sequence
  Synthetic oligonucleotide
acactcgcccatatgcccccaggcaccctccgtta

SEQ ID NO: 108316 - DNA, 35 bp, Artificial Sequence
  Synthetic oligonucleotide
tctatgctacctcctccaagtgtcgttccttcgcc

SEQ ID NO: 108317 - DNA, 35 bp, Artificial Sequence
  Synthetic oligonucleotide
tcaggtgggaagggcggaacggaaaggtgtggcat

SEQ ID NO: 108318 - DNA, 37 bp, Artificial Sequence
  Synthetic oligonucleotide
tgcgacagggaggcgggatagggcgggggacgattga

SEQ ID NO: 108319 - DNA, 35 bp, Artificial Sequence
  Synthetic oligonucleotide
gccatccccctatgcctcgtaagtctgcacaccac

SEQ ID NO: 108320 - DNA, 35 bp, Artificial Sequence
  Synthetic oligonucleotide
ttacgactccctgccactttctgcattttaagccc

SEQ ID NO: 108321 - DNA, 35 bp, Artificial Sequence
  Synthetic oligonucleotide
tgcaccttcccgaatctccatccagcccccagcgg

SEQ ID NO: 108322 - DNA, 35 bp, Artificial Sequence
  Synthetic oligonucleotide
gagaacctgccccacatcgctaccagaaacattcc

SEQ ID NO: 108323 - DNA, 35 bp, Artificial Sequence
  Synthetic oligonucleotide
atgtctggcgataccatgcgttcgcggccctcccc

SEQ ID NO: 108324 - DNA, 35 bp, Artificial Sequence
  Synthetic oligonucleotide
ttgcacccatcaagaatgcgcccttctcgctccct

SEQ ID NO: 108325 - DNA, 36 bp, Artificial Sequence
  Synthetic oligonucleotide
agtgcatgggaaagggtgggaagggtagaatttgta

SEQ ID NO: 108326 - DNA, 35 bp, Artificial Sequence
  Synthetic oligonucleotide
tgtgagcctatccgtatctacagttccctgccctc

SEQ ID NO: 108327 - DNA, 33 bp, Artificial Sequence
  Synthetic oligonucleotide
accatgctaccccgctctgctccatgtaccgcc

SEQ ID NO: 108328 - DNA, 35 bp, Artificial Sequence
  Synthetic oligonucleotide
tccctggatccgctccttttcgacctcgcctttgc

SEQ ID NO: 108329 - DNA, 37 bp, Artificial Sequence
  Synthetic oligonucleotide
tagacacatctgccccacgtccatcgcctcctttcga

SEQ ID NO: 108330 - DNA, 35 bp, Artificial Sequence
  Synthetic oligonucleotide
attacacccggtccgtcctgtctccgcctccacta

SEQ ID NO: 108331 - DNA, 35 bp, Artificial Sequence
  Synthetic oligonucleotide
gtggcccccgcgtgcactcgccctatttttctcgc

SEQ ID NO: 108332 - DNA, 36 bp, Artificial Sequence
  Synthetic oligonucleotide
tgcccacccagttggcctaccttcccctgcctacca

SEQ ID NO: 108333 - DNA, 37 bp, Artificial Sequence
  Synthetic oligonucleotide
tccgaacctccatgttgccattagggcccctctttga

SEQ ID NO: 108334 - DNA, 35 bp, Artificial Sequence
  Synthetic oligonucleotide
taccacccccttgttcgtcgtcgctgacatgcaac

SEQ ID NO: 108335 - DNA, 35 bp, Artificial Sequence
  Synthetic oligonucleotide
tatccggccggacacgctctccctgatccaccatc

SEQ ID NO: 108336 - DNA, 35 bp, Artificial Sequence
  Synthetic oligonucleotide
tccccgacaccgcctaaggttatctcttcctgcca

SEQ ID NO: 108337 - DNA, 35 bp, Artificial Sequence
  Synthetic oligonucleotide
gagccccccatgcctatccgtgactcgataatccc

SEQ ID NO: 108338 - DNA, 35 bp, Artificial Sequence
  Synthetic oligonucleotide
atccgccgccccgttcgccggactaccatttgttt

SEQ ID NO: 108339 - DNA, 37 bp, Artificial Sequence
  Synthetic oligonucleotide
gccccactcagcggttcttcgcccttctcgcccatga

SEQ ID NO: 108340 - DNA, 35 bp, Artificial Sequence
  Synthetic oligonucleotide
ttgtgtgtcacgcgccctcatcctgtcatacccac

SEQ ID NO: 108341 - DNA, 35 bp, Artificial Sequence
  Synthetic oligonucleotide
gagtgcaaggggggagtggggacgggggggtagag

SEQ ID NO: 108342 - DNA, 37 bp, Artificial Sequence
  Synthetic oligonucleotide
gggagtggaggcggaggggggagtatggagggcgaga

SEQ ID NO: 108343 - DNA, 35 bp, Artificial Sequence
  Synthetic oligonucleotide
acatacccgccgagccggtttcactttacatgccc

SEQ ID NO: 108344 - DNA, 35 bp, Artificial Sequence
  Synthetic oligonucleotide
gaggtgggtcggggggggaaggctaactaggataa

SEQ ID NO: 108345 - DNA, 35 bp, Artificial Sequence
  Synthetic oligonucleotide
tgatcgactcaccagcttattgacacaccgtccac

SEQ ID NO: 108346 - DNA, 35 bp, Artificial Sequence
  Synthetic oligonucleotide
gtgcaagcctgtctgtgtctcttctgtgccccccg

SEQ ID NO: 108347 - DNA, 35 bp, Artificial Sequence
  Synthetic oligonucleotide
taggactacgcccccctggcccgccataacgcccc

SEQ ID NO: 108348 - DNA, 35 bp, Artificial Sequence
  Synthetic oligonucleotide
gcctagggccaggggaaaggtagggaggggctgga

SEQ ID NO: 108349 - DNA, 35 bp, Artificial Sequence
  Synthetic oligonucleotide
gatgacaaacccgtcagtcctccctgttcttttac

SEQ ID NO: 108350 - DNA, 35 bp, Artificial Sequence
  Synthetic oligonucleotide
tccctgcctcccgtatcttgtccccgacccgtcaa

SEQ ID NO: 108351 - DNA, 37 bp, Artificial Sequence
  Synthetic oligonucleotide
agggaaggcggggggggaaggaggcgggtaaaataga

SEQ ID NO: 108352 - DNA, 36 bp, Artificial Sequence
  Synthetic oligonucleotide
tcaccctctccactatgtctcattccgctgacatta

SEQ ID NO: 108353 - DNA, 35 bp, Artificial Sequence
  Synthetic oligonucleotide
aaggtggtactgggcagggaagggaggggctgcaa

SEQ ID NO: 108354 - DNA, 36 bp, Artificial Sequence
  Synthetic oligonucleotide
atcagcccgctcccttggtatttacgcttcacctga

SEQ ID NO: 108355 - DNA, 35 bp, Artificial Sequence
  Synthetic oligonucleotide
gacacccacgtttggtccctgttccctactgtaca

SEQ ID NO: 108356 - DNA, 36 bp, Artificial Sequence
  Synthetic oligonucleotide
tcaaccaccctatcacgtgcattttgtctcttcgta

SEQ ID NO: 108357 - DNA, 35 bp, Artificial Sequence
  Synthetic oligonucleotide
tgttgtcccgccgccttgtgttcatcactttctcc

SEQ ID NO: 108358 - DNA, 35 bp, Artificial Sequence
  Synthetic oligonucleotide
agtaccgcacccgcctctccggacccgtgaacctc

SEQ ID NO: 108359 - DNA, 36 bp, Artificial Sequence
  Synthetic oligonucleotide
gcactgcgcgctcttgttactgctctatccctccga

SEQ ID NO: 108360 - DNA, 37 bp, Artificial Sequence
  Synthetic oligonucleotide
ggtcgacgcaggaggcctctcgtcccaccctccacga

SEQ ID NO: 108361 - DNA, 35 bp, Artificial Sequence
  Synthetic oligonucleotide
tagcatccacgatacgcacgcccctaccgctccgc

SEQ ID NO: 108362 - DNA, 35 bp, Artificial Sequence
  Synthetic oligonucleotide
acctcgcaggttttgctctacgccgtcgcttccac

SEQ ID NO: 108363 - DNA, 35 bp, Artificial Sequence
  Synthetic oligonucleotide
tcgccatccttcaccttgggcctcctccagtcctc

SEQ ID NO: 108364 - DNA, 36 bp, Artificial Sequence
  Synthetic oligonucleotide
tactacgttgctgcccaccatggttctcgcttccta

SEQ ID NO: 108365 - DNA, 36 bp, Artificial Sequence
  Synthetic oligonucleotide
tccgaccccctgctacctttctaaatgaccgctaca

SEQ ID NO: 108366 - DNA, 35 bp, Artificial Sequence
  Synthetic oligonucleotide
tgtgaccgccatatgcttgcatccgcctacctctt

SEQ ID NO: 108367 - DNA, 37 bp, Artificial Sequence
  Synthetic oligonucleotide
tgagatcgtcaatgtcccatccgtgccctcctctaga

SEQ ID NO: 108368 - DNA, 35 bp, Artificial Sequence
  Synthetic oligonucleotide
tgcacactcctccgttgcagaacccgcctgccttc

SEQ ID NO: 108369 - DNA, 35 bp, Artificial Sequence
  Synthetic oligonucleotide
agaaccgggtgggagtaggagggagaatgatgacg

SEQ ID NO: 108370 - DNA, 37 bp, Artificial Sequence
  Synthetic oligonucleotide
gagacatggtggtggggatggttggggaaaggtggga

SEQ ID NO: 108371 - DNA, 37 bp, Artificial Sequence
  Synthetic oligonucleotide
atgtcccctctgttcgcctgtccttcctttgttccga

SEQ ID NO: 108372 - DNA, 37 bp, Artificial Sequence
  Synthetic oligonucleotide
taggggaggagggcgtgaaggagggcgggcgggttga

SEQ ID NO: 108373 - DNA, 35 bp, Artificial Sequence
  Synthetic oligonucleotide
ttgagtggcgtcccatgtttgccctttgcccccct

SEQ ID NO: 108374 - DNA, 36 bp, Artificial Sequence
  Synthetic oligonucleotide
tccagtggtgggggcggaaaggaaggggaatatgga

SEQ ID NO: 108375 - DNA, 35 bp, Artificial Sequence
  Synthetic oligonucleotide
gatgctccccctccagcttctatgagctcacactc

SEQ ID NO: 108376 - DNA, 35 bp, Artificial Sequence
  Synthetic oligonucleotide
gactcaccgctctatctcacgttcggctttattcc

SEQ ID NO: 108377 - DNA, 35 bp, Artificial Sequence
  Synthetic oligonucleotide
ttccccaaccggcctccatgctcgtcactacccgc

SEQ ID NO: 108378 - DNA, 33 bp, Artificial Sequence
  Synthetic oligonucleotide
gcgctccgttgatcgccggctccccccccttga

SEQ ID NO: 108379 - DNA, 35 bp, Artificial Sequence
  Synthetic oligonucleotide
tagccccattccgccgatatcattatgccccttat

SEQ ID NO: 108380 - DNA, 35 bp, Artificial Sequence
  Synthetic oligonucleotide
atcccatcccgcctacttgagaagaggagtcttct

SEQ ID NO: 108381 - DNA, 35 bp, Artificial Sequence
  Synthetic oligonucleotide
tcaggcctccatgtcgtccgttcccttgccattcc

SEQ ID NO: 108382 - DNA, 35 bp, Artificial Sequence
  Synthetic oligonucleotide
tcagccgctgtacctctcactgtctttgtcctacc

SEQ ID NO: 108383 - DNA, 34 bp, Artificial Sequence
  Synthetic oligonucleotide
gtaacctcagcccccacgtccatgcttactcttc

SEQ ID NO: 108384 - DNA, 35 bp, Artificial Sequence
  Synthetic oligonucleotide
acatgcgtcgatttttcactatgcctcccccccgt

SEQ ID NO: 108385 - DNA, 35 bp, Artificial Sequence
  Synthetic oligonucleotide
tcgccccccttcattacgcccttgccatgccgttg

SEQ ID NO: 108386 - DNA, 37 bp, Artificial Sequence
  Synthetic oligonucleotide
gccactccacatggtttctcgctctgctccgcttcga

SEQ ID NO: 108387 - DNA, 35 bp, Artificial Sequence
  Synthetic oligonucleotide
atgacgctgtcccctttcccggcttggctccttcc

SEQ ID NO: 108388 - DNA, 37 bp, Artificial Sequence
  Synthetic oligonucleotide
actgtgtgcagtggaggggaaaggcacggagggggga

SEQ ID NO: 108389 - DNA, 37 bp, Artificial Sequence
  Synthetic oligonucleotide
tgtcccctcaagcttactgcacgctatccctcataga

SEQ ID NO: 108390 - DNA, 37 bp, Artificial Sequence
  Synthetic oligonucleotide
gaacggacggaggatcctgggaagtggggaggggtga

SEQ ID NO: 108391 - DNA, 35 bp, Artificial Sequence
  Synthetic oligonucleotide
gtccacccggcccagcccactccgcagtccgcttc

SEQ ID NO: 108392 - DNA, 36 bp, Artificial Sequence
  Synthetic oligonucleotide
gatacacctgtctcgctgtctccctcgttcctgcca

SEQ ID NO: 108393 - DNA, 36 bp, Artificial Sequence
  Synthetic oligonucleotide
acgccacctcgccctgtctcccttagttaagcctta

SEQ ID NO: 108394 - DNA, 35 bp, Artificial Sequence
  Synthetic oligonucleotide
gaactgcccgctctagcgtggtctaaccccactcc

SEQ ID NO: 108395 - DNA, 35 bp, Artificial Sequence
  Synthetic oligonucleotide
tccccatccgccgacctgttacccttgccttgatc

SEQ ID NO: 108396 - DNA, 35 bp, Artificial Sequence
  Synthetic oligonucleotide
tcccttgccgccattgtcattcgtttcccgcttta

SEQ ID NO: 108397 - DNA, 35 bp, Artificial Sequence
  Synthetic oligonucleotide
tccgtgcgtcctcccttgttaaccagcccatcgtc

SEQ ID NO: 108398 - DNA, 35 bp, Artificial Sequence
  Synthetic oligonucleotide
tgcaccgtacttgttgcttagccgctcctacctac

SEQ ID NO: 108399 - DNA, 35 bp, Artificial Sequence
  Synthetic oligonucleotide
gtggtatatccacacgtcgcatcgcttatctccgc

SEQ ID NO: 108400 - DNA, 35 bp, Artificial Sequence
  Synthetic oligonucleotide
tccaccctcaagccccagccctctacatggaccac

SEQ ID NO: 108401 - DNA, 37 bp, Artificial Sequence
  Synthetic oligonucleotide
ggacaagcgggaggagggaataggcggggaggagaga

SEQ ID NO: 108402 - DNA, 35 bp, Artificial Sequence
  Synthetic oligonucleotide
tgcccactcctctcctcaggcactctcgcgaacct

SEQ ID NO: 108403 - DNA, 35 bp, Artificial Sequence
  Synthetic oligonucleotide
actaccccctccgatcccgcactcgtgttttagca

SEQ ID NO: 108404 - DNA, 35 bp, Artificial Sequence
  Synthetic oligonucleotide
gtcacacagttacctcgccccaactccgttgactc

SEQ ID NO: 108405 - DNA, 35 bp, Artificial Sequence
  Synthetic oligonucleotide
gaatcgagggagaaaaggggggggtgggatgtaca

SEQ ID NO: 108406 - DNA, 36 bp, Artificial Sequence
  Synthetic oligonucleotide
gaccattatcacccatcggtttcgatgcactgtaca

SEQ ID NO: 108407 - DNA, 35 bp, Artificial Sequence
  Synthetic oligonucleotide
tctatacaccctcacgctcgccctctcgacccgcg

SEQ ID NO: 108408 - DNA, 36 bp, Artificial Sequence
  Synthetic oligonucleotide
gacaagggaagagaaggggtgaggggtgtagcaata

SEQ ID NO: 108409 - DNA, 37 bp, Artificial Sequence
  Synthetic oligonucleotide
tgactcgcccctgcttacacctctcgtgcttaaacga

SEQ ID NO: 108410 - DNA, 35 bp, Artificial Sequence
  Synthetic oligonucleotide
gccacatctcgccggtcataacaaacgcaccttat

SEQ ID NO: 108411 - DNA, 35 bp, Artificial Sequence
  Synthetic oligonucleotide
acctcaccctcctatcccgctgtttaagcgtaccg

SEQ ID NO: 108412 - DNA, 38 bp, Artificial Sequence
  Synthetic oligonucleotide
ggggggcgggaagcaggggcagggaacggcatggtaga

SEQ ID NO: 108413 - DNA, 35 bp, Artificial Sequence
  Synthetic oligonucleotide
tgcaccaggaagtcttatccacctcggctttccac

SEQ ID NO: 108414 - DNA, 35 bp, Artificial Sequence
  Synthetic oligonucleotide
gcacacctagcccacgccgatcgctcttggaaacc

SEQ ID NO: 108415 - DNA, 35 bp, Artificial Sequence
  Synthetic oligonucleotide
tcagtacgcaccgactcttcttagcgctcccccgc

SEQ ID NO: 108416 - DNA, 35 bp, Artificial Sequence
  Synthetic oligonucleotide
tcccagtcgcacttgactatcgtctcctctctcta

SEQ ID NO: 108417 - DNA, 35 bp, Artificial Sequence
  Synthetic oligonucleotide
atcggagcaaccatccgtacatccctgccgtttcc

SEQ ID NO: 108418 - DNA, 35 bp, Artificial Sequence
  Synthetic oligonucleotide
atgcacgctctatgtcctccttctttttcgccttt

SEQ ID NO: 108419 - DNA, 35 bp, Artificial Sequence
  Synthetic oligonucleotide
gcacccatccgttgttcgccgcaattgtcccgctc

SEQ ID NO: 108420 - DNA, 37 bp, Artificial Sequence
  Synthetic oligonucleotide
gtggagtcgaaaagggagcggggacgggggtatggga

SEQ ID NO: 108421 - DNA, 38 bp, Artificial Sequence
  Synthetic oligonucleotide
tacaccgccctcaccatcccagcccgacctcaggctga

SEQ ID NO: 108422 - DNA, 35 bp, Artificial Sequence
  Synthetic oligonucleotide
tttacccgtcgttctgcctattgcactcgccaccc

SEQ ID NO: 108423 - DNA, 35 bp, Artificial Sequence
  Synthetic oligonucleotide
tgacccccacaggctccttgaaccgacccttggcc

SEQ ID NO: 108424 - DNA, 35 bp, Artificial Sequence
  Synthetic oligonucleotide
gtggtagaggggggtggagagaagtagagtggatg

SEQ ID NO: 108425 - DNA, 37 bp, Artificial Sequence
  Synthetic oligonucleotide
tagagggtggggtgggggccccttttatacgcgggga

SEQ ID NO: 108426 - DNA, 38 bp, Artificial Sequence
  Synthetic oligonucleotide
tgacctgcgccgttcccgtaccatcccagccttcgtga

SEQ ID NO: 108427 - DNA, 35 bp, Artificial Sequence
  Synthetic oligonucleotide
acattgcacgaggcgccgtcctttcgctgtacccc

SEQ ID NO: 108428 - DNA, 36 bp, Artificial Sequence
  Synthetic oligonucleotide
gagtcgcccccattccgtgctttcactggctcacta

SEQ ID NO: 108429 - DNA, 36 bp, Artificial Sequence
  Synthetic oligonucleotide
tgtgcgcaccccgtacctgcctcctctcgttccgca

SEQ ID NO: 108430 - DNA, 37 bp, Artificial Sequence
  Synthetic oligonucleotide
tagcccgggagggcgggaagggctagtttcaacggga

SEQ ID NO: 108431 - DNA, 34 bp, Artificial Sequence
  Synthetic oligonucleotide
gccaaccactcgctgcatgtcactgacgcaccac

SEQ ID NO: 108432 - DNA, 35 bp, Artificial Sequence
  Synthetic oligonucleotide
gaccctcggtatcctgtttcctgccacctactgtc

SEQ ID NO: 108433 - DNA, 37 bp, Artificial Sequence
  Synthetic oligonucleotide
acttccccacccccctgtcccattcagtgtgatacga

SEQ ID NO: 108434 - DNA, 35 bp, Artificial Sequence
  Synthetic oligonucleotide
gtacgctacacatgccgttatttgttctcccatcc

SEQ ID NO: 108435 - DNA, 33 bp, Artificial Sequence
  Synthetic oligonucleotide
actcacacatccctgtcttctaaaggctctcca

SEQ ID NO: 108436 - DNA, 35 bp, Artificial Sequence
  Synthetic oligonucleotide
tttgtacatcgccttctgctttccacattggtgcc

SEQ ID NO: 108437 - DNA, 35 bp, Artificial Sequence
  Synthetic oligonucleotide
gccctgttccgcccccatccaccagttggcgatcc

SEQ ID NO: 108438 - DNA, 35 bp, Artificial Sequence
  Synthetic oligonucleotide
acaggggggtggagcaaggggacgcgggccggtaa

SEQ ID NO: 108439 - DNA, 35 bp, Artificial Sequence
  Synthetic oligonucleotide
gttccccgcccgccagaccatgtaccttcccgcct

SEQ ID NO: 108440 - DNA, 35 bp, Artificial Sequence
  Synthetic oligonucleotide
tgcaccccccaatgcccctgactccgatcgcgcca

SEQ ID NO: 108441 - DNA, 35 bp, Artificial Sequence
  Synthetic oligonucleotide
tttacgctccgcctgagatccattccgcctgttca

SEQ ID NO: 108442 - DNA, 35 bp, Artificial Sequence
  Synthetic oligonucleotide
gaccgtctctgcccgccgcctataccttttactgc

SEQ ID NO: 108443 - DNA, 36 bp, Artificial Sequence
  Synthetic oligonucleotide
acctgatcgcccgccctttttttgacctgttcatga

SEQ ID NO: 108444 - DNA, 35 bp, Artificial Sequence
  Synthetic oligonucleotide
tcagtcacctcttacgcatgcggccccctcgccac

SEQ ID NO: 108445 - DNA, 36 bp, Artificial Sequence
  Synthetic oligonucleotide
attcgaacccttccgcccctgtggtctactgaccaa

SEQ ID NO: 108446 - DNA, 35 bp, Artificial Sequence
  Synthetic oligonucleotide
gacagggaggaggggaccggagattggaaaggtga

SEQ ID NO: 108447 - DNA, 35 bp, Artificial Sequence
  Synthetic oligonucleotide
ttcgacacctctactgtttagttagccctacccgc

SEQ ID NO: 108448 - DNA, 35 bp, Artificial Sequence
  Synthetic oligonucleotide
tcaccgtgcacatgacctaaaaaaccgcgctccct

SEQ ID NO: 108449 - DNA, 36 bp, Artificial Sequence
  Synthetic oligonucleotide
gaccccaccacattgccaacgagtgcgcaccttaca

SEQ ID NO: 108450 - DNA, 37 bp, Artificial Sequence
  Synthetic oligonucleotide
gtgggggtggtgaggcacgcaaggaggggaagaggga

SEQ ID NO: 108451 - DNA, 36 bp, Artificial Sequence
  Synthetic oligonucleotide
tgcaccccccctttgtccgttccctctggttctcaa

SEQ ID NO: 108452 - DNA, 37 bp, Artificial Sequence
  Synthetic oligonucleotide
tccccacgcagctcagtccaaccatccgcctcctcga

SEQ ID NO: 108453 - DNA, 35 bp, Artificial Sequence
  Synthetic oligonucleotide
aacacctgctctctcgtgctattgcttccttggtc

SEQ ID NO: 108454 - DNA, 37 bp, Artificial Sequence
  Synthetic oligonucleotide
tggtgcatctgctgcgcctttgccctctttaccctga

SEQ ID NO: 108455 - DNA, 35 bp, Artificial Sequence
  Synthetic oligonucleotide
ttccacccctccagtgccaacgttgcaggtcccgc

SEQ ID NO: 108456 - DNA, 36 bp, Artificial Sequence
  Synthetic oligonucleotide
acacctcgccttgcccttatatatgccgcctacgga

SEQ ID NO: 108457 - DNA, 35 bp, Artificial Sequence
  Synthetic oligonucleotide
ggtcccgccccccgagccgattaccccacactgtg

SEQ ID NO: 108458 - DNA, 35 bp, Artificial Sequence
  Synthetic oligonucleotide
gaggtcaacggggtaggcggcggagggaggggcga

SEQ ID NO: 108459 - DNA, 36 bp, Artificial Sequence
  Synthetic oligonucleotide
gccccccgcacatcttgttcctggtctggttttgca

SEQ ID NO: 108460 - DNA, 35 bp, Artificial Sequence
  Synthetic oligonucleotide
gctccacccgtacggcactctccccggtttccggc

SEQ ID NO: 108461 - DNA, 35 bp, Artificial Sequence
  Synthetic oligonucleotide
aatccgcccttgcccctcactgtccatttgacaaa

SEQ ID NO: 108462 - DNA, 35 bp, Artificial Sequence
  Synthetic oligonucleotide
gcacgcagtgggggggagggagggaattgccgagt

SEQ ID NO: 108463 - DNA, 35 bp, Artificial Sequence
  Synthetic oligonucleotide
atgatccaccgcctggctatgtcccttcttaatca

SEQ ID NO: 108464 - DNA, 37 bp, Artificial Sequence
  Synthetic oligonucleotide
acgccctcactcgctgctccttttggcctccccttga

SEQ ID NO: 108465 - DNA, 35 bp, Artificial Sequence
  Synthetic oligonucleotide
gacccacgctgcctcccttgtctagctccgaattc

SEQ ID NO: 108466 - DNA, 34 bp, Artificial Sequence
  Synthetic oligonucleotide
atcgcaaggtaagtcccgcccatcagccgccgcc

SEQ ID NO: 108467 - DNA, 37 bp, Artificial Sequence
  Synthetic oligonucleotide
gaggtgtgggaagcaagaatgggggatagggggcgga

SEQ ID NO: 108468 - DNA, 36 bp, Artificial Sequence
  Synthetic oligonucleotide
ttgacaccctcgatcctccccgcacatgctagctca

SEQ ID NO: 108469 - DNA, 35 bp, Artificial Sequence
  Synthetic oligonucleotide
gccactcctgggcctattctcaactgtacacctct

SEQ ID NO: 108470 - DNA, 36 bp, Artificial Sequence
  Synthetic oligonucleotide
tgcgcccccgccttcatctggtacaccaactcctga

SEQ ID NO: 108471 - DNA, 35 bp, Artificial Sequence
  Synthetic oligonucleotide
ttccgagcgcatgcctgacgcaacacctccgctac

SEQ ID NO: 108472 - DNA, 37 bp, Artificial Sequence
  Synthetic oligonucleotide
aaagggcggacggggggggtgagagggggtagatgga

SEQ ID NO: 108473 - DNA, 38 bp, Artificial Sequence
  Synthetic oligonucleotide
atcaggggaaggggggatgggaggggagtgctgggtga

SEQ ID NO: 108474 - DNA, 35 bp, Artificial Sequence
  Synthetic oligonucleotide
tcccgcaccatcgcgctgccttacattacaggaac

SEQ ID NO: 108475 - DNA, 35 bp, Artificial Sequence
  Synthetic oligonucleotide
tcagccggttcgccttctatcctccagccgttgtc

SEQ ID NO: 108476 - DNA, 36 bp, Artificial Sequence
  Synthetic oligonucleotide
tcgccccgcccgtttccatagccacagacgccgcca

SEQ ID NO: 108477 - DNA, 36 bp, Artificial Sequence
  Synthetic oligonucleotide
tttcacacactgaatgcctcgctcccctcttgctga

SEQ ID NO: 108478 - DNA, 35 bp, Artificial Sequence
  Synthetic oligonucleotide
cgcgtcgatcagcatgtcgcccccatactgccgcc

SEQ ID NO: 108479 - DNA, 35 bp, Artificial Sequence
  Synthetic oligonucleotide
aacccctccgcctgtcccgtactctacggtcctaa

SEQ ID NO: 108480 - DNA, 35 bp, Artificial Sequence
  Synthetic oligonucleotide
agcactcatctgtctccctgtttactctcgcccca

SEQ ID NO: 108481 - DNA, 36 bp, Artificial Sequence
  Synthetic oligonucleotide
tagcacccacgccgtatcgctcgaccctgtagccca

SEQ ID NO: 108482 - DNA, 35 bp, Artificial Sequence
  Synthetic oligonucleotide
accactagcccctcccgtcctcgcacagctattac

SEQ ID NO: 108483 - DNA, 37 bp, Artificial Sequence
  Synthetic oligonucleotide
tccgaccagccacactgctctctatacgcccgatcga

SEQ ID NO: 108484 - DNA, 35 bp, Artificial Sequence
  Synthetic oligonucleotide
agtccccgcactcccgcaacattgactctaccccg

SEQ ID NO: 108485 - DNA, 35 bp, Artificial Sequence
  Synthetic oligonucleotide
tcccgccatcactgctagccaccagtttcctacgc

SEQ ID NO: 108486 - DNA, 35 bp, Artificial Sequence
  Synthetic oligonucleotide
gaccgccctcggtgggtcactttaatccccttcct

SEQ ID NO: 108487 - DNA, 35 bp, Artificial Sequence
  Synthetic oligonucleotide
atggcgccatcactcccgctattattatctgtcgc

SEQ ID NO: 108488 - DNA, 35 bp, Artificial Sequence
  Synthetic oligonucleotide
tagtgccgtgagcgctccgtccccgcctttttgcc

SEQ ID NO: 108489 - DNA, 35 bp, Artificial Sequence
  Synthetic oligonucleotide
tcgcccccagtttggtttcttcgcccgcatcactt

SEQ ID NO: 108490 - DNA, 35 bp, Artificial Sequence
  Synthetic oligonucleotide
acaccacctcaccatctgtgcttcttaccctgtcc

SEQ ID NO: 108491 - DNA, 35 bp, Artificial Sequence
  Synthetic oligonucleotide
gtgtgtgcctgctgagtgtctacgcccctccgtcc

SEQ ID NO: 108492 - DNA, 37 bp, Artificial Sequence
  Synthetic oligonucleotide
gaattgaaaggctgaggaagggacggggggtaaagga

SEQ ID NO: 108493 - DNA, 35 bp, Artificial Sequence
  Synthetic oligonucleotide
tccctccccctgttgttagccgaccctctaagtaa

SEQ ID NO: 108494 - DNA, 36 bp, Artificial Sequence
  Synthetic oligonucleotide
attcgccgcccccgctttcttatgctcaggtcccca

SEQ ID NO: 108495 - DNA, 35 bp, Artificial Sequence
  Synthetic oligonucleotide
gatagggcacagaacgagagggggggaatggggag

SEQ ID NO: 108496 - DNA, 37 bp, Artificial Sequence
  Synthetic oligonucleotide
acgcaaagggaagagataggaagaagggaggacaaga

SEQ ID NO: 108497 - DNA, 35 bp, Artificial Sequence
  Synthetic oligonucleotide
gtatgaaagggggggcgaggggagcgggaccaaga

SEQ ID NO: 108498 - DNA, 35 bp, Artificial Sequence
  Synthetic oligonucleotide
accgtcccgccttcccgtattcctgtttgggttac

SEQ ID NO: 108499 - DNA, 36 bp, Artificial Sequence
  Synthetic oligonucleotide
gtacgcacacacaagcccccttatgtacaccctcca

SEQ ID NO: 108500 - DNA, 37 bp, Artificial Sequence
  Synthetic oligonucleotide
gtgcgtcgtaaggggcaaacgggggagggtggagtga

SEQ ID NO: 108501 - DNA, 35 bp, Artificial Sequence
  Synthetic oligonucleotide
acctgccgcctctgcactgcacatgttctggttct

SEQ ID NO: 108502 - DNA, 36 bp, Artificial Sequence
  Synthetic oligonucleotide
gcgttgcctccccatgtctgccactaaggtcctcca

SEQ ID NO: 108503 - DNA, 35 bp, Artificial Sequence
  Synthetic oligonucleotide
tcccacccgaaaacgacgcccactccaccggcctc

SEQ ID NO: 108504 - DNA, 35 bp, Artificial Sequence
  Synthetic oligonucleotide
tgccacaccctgctgctttggttctcccgataggc

SEQ ID NO: 108505 - DNA, 35 bp, Artificial Sequence
  Synthetic oligonucleotide
ggtacagccccccgagcgtgccatctgtactccat

SEQ ID NO: 108506 - DNA, 35 bp, Artificial Sequence
  Synthetic oligonucleotide
aagatagggcggggggggacggaatatgctgagag

SEQ ID NO: 108507 - DNA, 34 bp, Artificial Sequence
  Synthetic oligonucleotide
ttgcacgctcgtatttccgcccgttctaccctcg

SEQ ID NO: 108508 - DNA, 35 bp, Artificial Sequence
  Synthetic oligonucleotide
accccgccgcacccgttaaccacatctgtaaccac

SEQ ID NO: 108509 - DNA, 34 bp, Artificial Sequence
  Synthetic oligonucleotide
gctgcgctcctatccctcatacgtccggccctgt

SEQ ID NO: 108510 - DNA, 35 bp, Artificial Sequence
  Synthetic oligonucleotide
actgcccctacatgttctccaacccctcggctcca

SEQ ID NO: 108511 - DNA, 38 bp, Artificial Sequence
  Synthetic oligonucleotide
accgcccccaccgttcctattgcgaaagcaccccttga

SEQ ID NO: 108512 - DNA, 36 bp, Artificial Sequence
  Synthetic oligonucleotide
tcagactatccgccgtgccgttccttgccatctgta

SEQ ID NO: 108513 - DNA, 37 bp, Artificial Sequence
  Synthetic oligonucleotide
gccgggagggttgggaaggggtacacggtcatcctga

SEQ ID NO: 108514 - DNA, 37 bp, Artificial Sequence
  Synthetic oligonucleotide
gataggtggaatcggaaggaaaggaggggagatggga

SEQ ID NO: 108515 - DNA, 35 bp, Artificial Sequence
  Synthetic oligonucleotide
atcacccgccgttcttctcttttgtcgaaccttcc

SEQ ID NO: 108516 - DNA, 35 bp, Artificial Sequence
  Synthetic oligonucleotide
tcgtaacaccatctgcgccatccaccccgcatgtt

SEQ ID NO: 108517 - DNA, 35 bp, Artificial Sequence
  Synthetic oligonucleotide
acatgccacattggctcctatagtcgccttcccac

SEQ ID NO: 108518 - DNA, 35 bp, Artificial Sequence
  Synthetic oligonucleotide
ttgcacgtcccattccgcaatcctgcctgtgcccc

SEQ ID NO: 108519 - DNA, 35 bp, Artificial Sequence
  Synthetic oligonucleotide
gcaaaggccacctttgctgttaattattcttgccc

SEQ ID NO: 108520 - DNA, 35 bp, Artificial Sequence
  Synthetic oligonucleotide
tgcatgttcattcgcgccccgattaggccttcctc

SEQ ID NO: 108521 - DNA, 36 bp, Artificial Sequence
  Synthetic oligonucleotide
ggtggcggttaagcacattggaggaggcggggctta

SEQ ID NO: 108522 - DNA, 35 bp, Artificial Sequence
  Synthetic oligonucleotide
atggaggggaagggtagccagggatgggaggtgcg

SEQ ID NO: 108523 - DNA, 36 bp, Artificial Sequence
  Synthetic oligonucleotide
tcaccgggaggggacggagaggggaacgaggataca

SEQ ID NO: 108524 - DNA, 35 bp, Artificial Sequence
  Synthetic oligonucleotide
gacatgcacgtaagtcgcctccatacctgccctgc

SEQ ID NO: 108525 - DNA, 35 bp, Artificial Sequence
  Synthetic oligonucleotide
tccccccagcgccctctgcttatctatatcatctc

SEQ ID NO: 108526 - DNA, 35 bp, Artificial Sequence
  Synthetic oligonucleotide
tcactctgcctcactgcacatccgccgtacaactt

SEQ ID NO: 108527 - DNA, 37 bp, Artificial Sequence
  Synthetic oligonucleotide
tggacggcgggggggatggtctaggtggctctttaga

SEQ ID NO: 108528 - DNA, 29 bp, Artificial Sequence
  Synthetic oligonucleotide
tacaatcaccccctcctgcatttggctca

SEQ ID NO: 108529 - DNA, 38 bp, Artificial Sequence
  Synthetic oligonucleotide
tccgttcccgccccttgatatgtccacccgccatttga

SEQ ID NO: 108530 - DNA, 35 bp, Artificial Sequence
  Synthetic oligonucleotide
gcctcgcccacacgtggtttctgttaaccttccgc

SEQ ID NO: 108531 - DNA, 35 bp, Artificial Sequence
  Synthetic oligonucleotide
gccatccacacacgatatttgacccgtttcatgct

SEQ ID NO: 108532 - DNA, 35 bp, Artificial Sequence
  Synthetic oligonucleotide
gattccccagctggtctgtgccggtcccctccctg

SEQ ID NO: 108533 - DNA, 38 bp, Artificial Sequence
  Synthetic oligonucleotide
tccccactcctcaatagttgctcaccttcactccgtga

SEQ ID NO: 108534 - DNA, 35 bp, Artificial Sequence
  Synthetic oligonucleotide
tcccgcccccttctgtctccgtccaagcggtacaa

SEQ ID NO: 108535 - DNA, 35 bp, Artificial Sequence
  Synthetic oligonucleotide
ggtggagaggaaacggtgattacaacggaggaggg

SEQ ID NO: 108536 - DNA, 35 bp, Artificial Sequence
  Synthetic oligonucleotide
gtctacgcccgacccacttgccccttgattcctgt

SEQ ID NO: 108537 - DNA, 35 bp, Artificial Sequence
  Synthetic oligonucleotide
tatcgcctcgctccgttctagcatacgttctcgcc

SEQ ID NO: 108538 - DNA, 35 bp, Artificial Sequence
  Synthetic oligonucleotide
gaacgtcccctgccgagtctcctatccatcgttgc

SEQ ID NO: 108539 - DNA, 35 bp, Artificial Sequence
  Synthetic oligonucleotide
tcctccgccctcccgatacccacggtagtctatca

SEQ ID NO: 108540 - DNA, 35 bp, Artificial Sequence
  Synthetic oligonucleotide
acttacgcccttcgtcccccctgtagctctccagt

SEQ ID NO: 108541 - DNA, 37 bp, Artificial Sequence
  Synthetic oligonucleotide
gtgaaggggaattggggaagaggcgggatacgggtga

SEQ ID NO: 108542 - DNA, 35 bp, Artificial Sequence
  Synthetic oligonucleotide
ttcgccgcccgacaccactgcaaccgaggccacac

SEQ ID NO: 108543 - DNA, 35 bp, Artificial Sequence
  Synthetic oligonucleotide
accgcctcctccgtgacgctcatcttcattccatc

SEQ ID NO: 108544 - DNA, 35 bp, Artificial Sequence
  Synthetic oligonucleotide
tcctcaccctgtgttacatgctcctacgcttcctt

SEQ ID NO: 108545 - DNA, 36 bp, Artificial Sequence
  Synthetic oligonucleotide
tccacactccctgccccgacctgtattcgtatagga

SEQ ID NO: 108546 - DNA, 35 bp, Artificial Sequence
  Synthetic oligonucleotide
tctgactctcatctcgtatctgatctctatccttc

SEQ ID NO: 108547 - DNA, 38 bp, Artificial Sequence
  Synthetic oligonucleotide
taccgccccgcctcatgcacccacgctcagttctttga

SEQ ID NO: 108548 - DNA, 37 bp, Artificial Sequence
  Synthetic oligonucleotide
tcaccgccctgacggttgctattggccctactcccga

SEQ ID NO: 108549 - DNA, 38 bp, Artificial Sequence
  Synthetic oligonucleotide
tcagcgcagatcctgatcacatgctcgcctccccctga

SEQ ID NO: 108550 - DNA, 34 bp, Artificial Sequence
  Synthetic oligonucleotide
ttacgtccggtcatcctcggcttccctgttcctc

SEQ ID NO: 108551 - DNA, 35 bp, Artificial Sequence
  Synthetic oligonucleotide
tgaccggtacgtagtccattagccgcccctttcac

SEQ ID NO: 108552 - DNA, 35 bp, Artificial Sequence
  Synthetic oligonucleotide
tgtgtgctccgattactatgccccccgtttgtcct

SEQ ID NO: 108553 - DNA, 35 bp, Artificial Sequence
  Synthetic oligonucleotide
accacgcacaccatctggctccattatcgatgtcc

SEQ ID NO: 108554 - DNA, 35 bp, Artificial Sequence
  Synthetic oligonucleotide
gcacgccgcctcatccatcataccggtgatccacc

SEQ ID NO: 108555 - DNA, 35 bp, Artificial Sequence
  Synthetic oligonucleotide
tcgcacccttccgggtttcaatgttcacctctctc

SEQ ID NO: 108556 - DNA, 35 bp, Artificial Sequence
  Synthetic oligonucleotide
gccatccttcacggtgccttctccactgcccttct

SEQ ID NO: 108557 - DNA, 34 bp, Artificial Sequence
  Synthetic oligonucleotide
tcgatcagccatcccgcctgcactacttcctcgt

SEQ ID NO: 108558 - DNA, 37 bp, Artificial Sequence
  Synthetic oligonucleotide
accgcctccccgcatgcgcatcatcacggactttcga

SEQ ID NO: 108559 - DNA, 36 bp, Artificial Sequence
  Synthetic oligonucleotide
tcacccgccccgttccactctcccccgttgccggta

SEQ ID NO: 108560 - DNA, 36 bp, Artificial Sequence
  Synthetic oligonucleotide
gcgacccgcgcatcagccctttgtctgtcccctcca

SEQ ID NO: 108561 - DNA, 37 bp, Artificial Sequence
  Synthetic oligonucleotide
tccatgccacttatgctgcccatccccccttgcccga

SEQ ID NO: 108562 - DNA, 35 bp, Artificial Sequence
  Synthetic oligonucleotide
aaccgcccctcgcctcatcgacccgcccctcagga

SEQ ID NO: 108563 - DNA, 35 bp, Artificial Sequence
  Synthetic oligonucleotide
ttgcccctctcattgtggtatttcctctgcgctcc

SEQ ID NO: 108564 - DNA, 34 bp, Artificial Sequence
  Synthetic oligonucleotide
gaagaaggcggtgggtggaataggggggtaggaa

SEQ ID NO: 108565 - DNA, 35 bp, Artificial Sequence
  Synthetic oligonucleotide
atgtgcgctccgtgtgcatctctacctcctcgtcc

SEQ ID NO: 108566 - DNA, 36 bp, Artificial Sequence
  Synthetic oligonucleotide
tcccaccatcgttgtttctttacctgctctacacga

SEQ ID NO: 108567 - DNA, 35 bp, Artificial Sequence
  Synthetic oligonucleotide
gcgaaggggtcggggggggatggaaagggcattgg

SEQ ID NO: 108568 - DNA, 38 bp, Artificial Sequence
  Synthetic oligonucleotide
acacccccgtccatgccttctgttctccccagcactga

SEQ ID NO: 108569 - DNA, 35 bp, Artificial Sequence
  Synthetic oligonucleotide
gatcaccccgcctttctgcctaaggtcttctgtaa

SEQ ID NO: 108570 - DNA, 38 bp, Artificial Sequence
  Synthetic oligonucleotide
ttgtgtgggggacagtggggcaagtaaggggagggtga

SEQ ID NO: 108571 - DNA, 35 bp, Artificial Sequence
  Synthetic oligonucleotide
ttccccaagcccccgtgcctcgtactgaccatagc

SEQ ID NO: 108572 - DNA, 37 bp, Artificial Sequence
  Synthetic oligonucleotide
gtgggtagggggaaggggggaagcaataggcagagga

SEQ ID NO: 108573 - DNA, 36 bp, Artificial Sequence
  Synthetic oligonucleotide
gtgaacagtggagggttagagggaacggcgggtgga

SEQ ID NO: 108574 - DNA, 35 bp, Artificial Sequence
  Synthetic oligonucleotide
atcacccctccagtcgagtattcgcccaaccttat

SEQ ID NO: 108575 - DNA, 38 bp, Artificial Sequence
  Synthetic oligonucleotide
acgccacgatccttttgcctagtacgctccacctttga

SEQ ID NO: 108576 - DNA, 33 bp, Artificial Sequence
  Synthetic oligonucleotide
gacacactctcctgatcgctaatgccgctccaa

SEQ ID NO: 108577 - DNA, 35 bp, Artificial Sequence
  Synthetic oligonucleotide
tcgcactcccgctgattccgtattgcccccttatc

SEQ ID NO: 108578 - DNA, 37 bp, Artificial Sequence
  Synthetic oligonucleotide
gaaatggggctgggggtggtcttgtttttggagggga

SEQ ID NO: 108579 - DNA, 35 bp, Artificial Sequence
  Synthetic oligonucleotide
gctaccacccttctgccgccgcccaggattttgcc

SEQ ID NO: 108580 - DNA, 35 bp, Artificial Sequence
  Synthetic oligonucleotide
gtccccaacgcagatgaatgccttctgctcccctt

SEQ ID NO: 108581 - DNA, 35 bp, Artificial Sequence
  Synthetic oligonucleotide
tcttgtcccatcctgttcatccgcccatttgtggt

SEQ ID NO: 108582 - DNA, 37 bp, Artificial Sequence
  Synthetic oligonucleotide
ggggagagcgcagtaggggggaaggggtataggtgga

SEQ ID NO: 108583 - DNA, 35 bp, Artificial Sequence
  Synthetic oligonucleotide
gtctctcacctgctattatgccacagcccgccttc

SEQ ID NO: 108584 - DNA, 35 bp, Artificial Sequence
  Synthetic oligonucleotide
gtatgcgcgcgggtggggtgcggtggggagggcaa

SEQ ID NO: 108585 - DNA, 35 bp, Artificial Sequence
  Synthetic oligonucleotide
tgcagagtcccaccatgcgctgtcccttccaccac

SEQ ID NO: 108586 - DNA, 35 bp, Artificial Sequence
  Synthetic oligonucleotide
gcacaacgttacacgcgcccctgactcatcgctgc

SEQ ID NO: 108587 - DNA, 33 bp, Artificial Sequence
  Synthetic oligonucleotide
gctccttgccactatctgcccctgccccataaa

SEQ ID NO: 108588 - DNA, 36 bp, Artificial Sequence
  Synthetic oligonucleotide
gagtcgcccatctgacccccgtgccattgctgacca

SEQ ID NO: 108589 - DNA, 36 bp, Artificial Sequence
  Synthetic oligonucleotide
gacggatagtgacacggggagggaggcggggggcaa

SEQ ID NO: 108590 - DNA, 35 bp, Artificial Sequence
  Synthetic oligonucleotide
actacgcgctggttttttattgcccactctccgaa

SEQ ID NO: 108591 - DNA, 35 bp, Artificial Sequence
  Synthetic oligonucleotide
tgttaacaccgccttgcctcccgacgctgcctctc

SEQ ID NO: 108592 - DNA, 35 bp, Artificial Sequence
  Synthetic oligonucleotide
tttgcacccacacctgccccatctgatctgctggc

SEQ ID NO: 108593 - DNA, 35 bp, Artificial Sequence
  Synthetic oligonucleotide
accgcgccactgtattcgtttcttctccggttatc

SEQ ID NO: 108594 - DNA, 35 bp, Artificial Sequence
  Synthetic oligonucleotide
tgcctgcttatctgttctcctcgctgtccccgtag

SEQ ID NO: 108595 - DNA, 35 bp, Artificial Sequence
  Synthetic oligonucleotide
tatgcgctcgccaacttctgtttcttgctacttct

SEQ ID NO: 108596 - DNA, 35 bp, Artificial Sequence
  Synthetic oligonucleotide
ggacacccctgattttcgctccggtccctgctccc

SEQ ID NO: 108597 - DNA, 36 bp, Artificial Sequence
  Synthetic oligonucleotide
tgagcacggtgagggaatgggggggaatgcatggta

SEQ ID NO: 108598 - DNA, 37 bp, Artificial Sequence
  Synthetic oligonucleotide
gaaacgtgatggggaagggcaatggtggggatgaaga

SEQ ID NO: 108599 - DNA, 35 bp, Artificial Sequence
  Synthetic oligonucleotide
gtccactcaccagcatgcctcctatccccaccacg

SEQ ID NO: 108600 - DNA, 37 bp, Artificial Sequence
  Synthetic oligonucleotide
gtagaggtgggggggatcgaggagggcggcatccgga

SEQ ID NO: 108601 - DNA, 35 bp, Artificial Sequence
  Synthetic oligonucleotide
attcacgccccttggttccctcgttctctgtacga

SEQ ID NO: 108602 - DNA, 37 bp, Artificial Sequence
  Synthetic oligonucleotide
tctccgcccctgaccctgtctttcccgccctgtgcga

SEQ ID NO: 108603 - DNA, 35 bp, Artificial Sequence
  Synthetic oligonucleotide
gttcccctcccatgtccctgctgtacgtgcccggt

SEQ ID NO: 108604 - DNA, 34 bp, Artificial Sequence
  Synthetic oligonucleotide
gccacgctgatgtttcttagttttcgcctccctt

SEQ ID NO: 108605 - DNA, 35 bp, Artificial Sequence
  Synthetic oligonucleotide
agcccctccaacagctgccctaatttgccatccca

SEQ ID NO: 108606 - DNA, 35 bp, Artificial Sequence
  Synthetic oligonucleotide
gactgtccctcatggattatctcctccgctatacg

SEQ ID NO: 108607 - DNA, 35 bp, Artificial Sequence
  Synthetic oligonucleotide
tccgccgtagatctgaccatcatcatcccgttccg

SEQ ID NO: 108608 - DNA, 36 bp, Artificial Sequence
  Synthetic oligonucleotide
tagtccccgtcatcggttcgccgttccccgcctgcc

SEQ ID NO: 108609 - DNA, 36 bp, Artificial Sequence
  Synthetic oligonucleotide
ttaagccctgccgctgccactaattttcgcccatca

SEQ ID NO: 108610 - DNA, 35 bp, Artificial Sequence
  Synthetic oligonucleotide
ggagaggagtggggagtgaggaagttggagaaggt

SEQ ID NO: 108611 - DNA, 36 bp, Artificial Sequence
  Synthetic oligonucleotide
tgcccccctcaatgccgtactttgttcctcgcttgt

SEQ ID NO: 108612 - DNA, 36 bp, Artificial Sequence
  Synthetic oligonucleotide
atcaacgtcgttgccctctgtgccttatccccccga

SEQ ID NO: 108613 - DNA, 35 bp, Artificial Sequence
  Synthetic oligonucleotide
tacacctcaccgtctccgtcctgggcttaaccttt

SEQ ID NO: 108614 - DNA, 37 bp, Artificial Sequence
  Synthetic oligonucleotide
aatgccggccccccattgattctgtaccacccttcga

SEQ ID NO: 108615 - DNA, 35 bp, Artificial Sequence
  Synthetic oligonucleotide
ttgccaccaccggccacgggttaccgatccccatc

SEQ ID NO: 108616 - DNA, 35 bp, Artificial Sequence
  Synthetic oligonucleotide
gtcccccgccccttctgttcaagccccgtgtccca

SEQ ID NO: 108617 - DNA, 36 bp, Artificial Sequence
  Synthetic oligonucleotide
tcaaccggtacagttgttactgccgccccttcttca

SEQ ID NO: 108618 - DNA, 36 bp, Artificial Sequence
  Synthetic oligonucleotide
gtcctccaccaccatgctcctgtacctctctatgta

SEQ ID NO: 108619 - DNA, 35 bp, Artificial Sequence
  Synthetic oligonucleotide
acaactcccgctgtctttggatcacctggcgcctc

SEQ ID NO: 108620 - DNA, 35 bp, Artificial Sequence
  Synthetic oligonucleotide
acaccactcacaagcgtacttcgccggcactttcc

SEQ ID NO: 108621 - DNA, 38 bp, Artificial Sequence
  Synthetic oligonucleotide
gtcacccgccctcatcctgccgtgaagtactaccgtga

SEQ ID NO: 108622 - DNA, 38 bp, Artificial Sequence
  Synthetic oligonucleotide
gtctgcccctcgtacttctttgagctcgccccacttga

SEQ ID NO: 108623 - DNA, 35 bp, Artificial Sequence
  Synthetic oligonucleotide
gtacctccgcccatgtacaacgctttttgagcccc

SEQ ID NO: 108624 - DNA, 36 bp, Artificial Sequence
  Synthetic oligonucleotide
ggtgccacccaccttgcttactacctgcctcgtgca

SEQ ID NO: 108625 - DNA, 35 bp, Artificial Sequence
  Synthetic oligonucleotide
acgatacgctatgtctctacccgcaccgttcctcc

SEQ ID NO: 108626 - DNA, 35 bp, Artificial Sequence
  Synthetic oligonucleotide
atcacagcaaggcggggaggagaaaggtggtggag

SEQ ID NO: 108627 - DNA, 36 bp, Artificial Sequence
  Synthetic oligonucleotide
gacacagtcccgagtctccctcacgttacacctgca

SEQ ID NO: 108628 - DNA, 35 bp, Artificial Sequence
  Synthetic oligonucleotide
gacaagccccgggagggtagggacgggccgagcta

SEQ ID NO: 108629 - DNA, 35 bp, Artificial Sequence
  Synthetic oligonucleotide
tcacgtctccacctgtttaatccgttgtctttctg

SEQ ID NO: 108630 - DNA, 36 bp, Artificial Sequence
  Synthetic oligonucleotide
accccgcccgcctgaatgcggcactttatacttcca

SEQ ID NO: 108631 - DNA, 35 bp, Artificial Sequence
  Synthetic oligonucleotide
gcccccatccgtgaccctgtacttcgttgcactca

SEQ ID NO: 108632 - DNA, 36 bp, Artificial Sequence
  Synthetic oligonucleotide
acgccccattgtttgtctatccgtcgttaccctcca

SEQ ID NO: 108633 - DNA, 36 bp, Artificial Sequence
  Synthetic oligonucleotide
gcggaatggtggaggtggggaaattcgggggtggaa

SEQ ID NO: 108634 - DNA, 35 bp, Artificial Sequence
  Synthetic oligonucleotide
tttcgcccgccccccaactcgttctgtaacagatc

SEQ ID NO: 108635 - DNA, 36 bp, Artificial Sequence
  Synthetic oligonucleotide
gtacaccccccgccgatcctgaagtcccattgctga

SEQ ID NO: 108636 - DNA, 34 bp, Artificial Sequence
  Synthetic oligonucleotide
gtgggtgatggggcggaagggggcaggctagggg

SEQ ID NO: 108637 - DNA, 35 bp, Artificial Sequence
  Synthetic oligonucleotide
atcccgcaggccccacttgcaccccgtgaccacta

SEQ ID NO: 108638 - DNA, 35 bp, Artificial Sequence
  Synthetic oligonucleotide
gaacaccccgtccctcctttaagcacttgcctctt

SEQ ID NO: 108639 - DNA, 35 bp, Artificial Sequence
  Synthetic oligonucleotide
aagccccctccttgtcccttgcgcccttgcatcgc

SEQ ID NO: 108640 - DNA, 35 bp, Artificial Sequence
  Synthetic oligonucleotide
tcaccacttgcctcctgtcactgccttcacgtgca

SEQ ID NO: 108641 - DNA, 36 bp, Artificial Sequence
  Synthetic oligonucleotide
gccaccttgactgctttaccgcgactctgctttcta

SEQ ID NO: 108642 - DNA, 35 bp, Artificial Sequence
  Synthetic oligonucleotide
atgccggggggggttcaaaggtcagtgaggatggg

SEQ ID NO: 108643 - DNA, 35 bp, Artificial Sequence
  Synthetic oligonucleotide
gccgtcgccgctgctcttgttcttaaacccgccat

SEQ ID NO: 108644 - DNA, 37 bp, Artificial Sequence
  Synthetic oligonucleotide
ttgcatgccctgagcgtttctccctccccatccgtga

SEQ ID NO: 108645 - DNA, 38 bp, Artificial Sequence
  Synthetic oligonucleotide
tgtccacccgacgttcctttttaagccccccttgttga

SEQ ID NO: 108646 - DNA, 35 bp, Artificial Sequence
  Synthetic oligonucleotide
accgcaactcggtgtcccttccggctccccctctg

SEQ ID NO: 108647 - DNA, 36 bp, Artificial Sequence
  Synthetic oligonucleotide
ttgaggtggtagtggaggggggtggaaggaggtcaa

SEQ ID NO: 108648 - DNA, 36 bp, Artificial Sequence
  Synthetic oligonucleotide
gccacgtcctcccctccagcccgtttcgcttgtcaa

SEQ ID NO: 108649 - DNA, 35 bp, Artificial Sequence
  Synthetic oligonucleotide
tccgaatccccatgccgtgaataacgtctccccac

SEQ ID NO: 108650 - DNA, 35 bp, Artificial Sequence
  Synthetic oligonucleotide
atgtaccctctcgtgtgcgtcgttccattcctgcc

SEQ ID NO: 108651 - DNA, 35 bp, Artificial Sequence
  Synthetic oligonucleotide
tgcacgctcgaatcatgtcaatctgtccgctctac

SEQ ID NO: 108652 - DNA, 35 bp, Artificial Sequence
  Synthetic oligonucleotide
agatacctgtcacatcctctcttcgcccgccggtc

SEQ ID NO: 108653 - DNA, 35 bp, Artificial Sequence
  Synthetic oligonucleotide
accactcttgcgcttgacccaaccaccgttccgcg

SEQ ID NO: 108654 - DNA, 38 bp, Artificial Sequence
  Synthetic oligonucleotide
aaagggggcggaggggtggaataccggtggagtgctga

SEQ ID NO: 108655 - DNA, 37 bp, Artificial Sequence
  Synthetic oligonucleotide
gatgggacggggggggaaggtagggtgcggttcgtga

SEQ ID NO: 108656 - DNA, 35 bp, Artificial Sequence
  Synthetic oligonucleotide
ttgcgcgctccagcttctcagttccttgctctgtc

SEQ ID NO: 108657 - DNA, 35 bp, Artificial Sequence
  Synthetic oligonucleotide
accgacccgggcctcacagtgttacgtcctccccg

SEQ ID NO: 108658 - DNA, 36 bp, Artificial Sequence
  Synthetic oligonucleotide
gtggccgtatccatgttcatgcctcgccttccctta

SEQ ID NO: 108659 - DNA, 37 bp, Artificial Sequence
  Synthetic oligonucleotide
gataggggcggtaggatatgtttggggcgggcgggga

SEQ ID NO: 108660 - DNA, 35 bp, Artificial Sequence
  Synthetic oligonucleotide
ccgcctcaccacatggtactccggcaacaatctgc

SEQ ID NO: 108661 - DNA, 37 bp, Artificial Sequence
  Synthetic oligonucleotide
tatcgcccccctcgacacgttattcctgccctttaga

SEQ ID NO: 108662 - DNA, 35 bp, Artificial Sequence
  Synthetic oligonucleotide
tcacggagcgtcttgctcttcttcacctgtcccgc

SEQ ID NO: 108663 - DNA, 35 bp, Artificial Sequence
  Synthetic oligonucleotide
gccgctaccgccggtgccctactcacttgatccat

SEQ ID NO: 108664 - DNA, 35 bp, Artificial Sequence
  Synthetic oligonucleotide
tccccgtcctcccgttttgccgcataatggcgccc

SEQ ID NO: 108665 - DNA, 35 bp, Artificial Sequence
  Synthetic oligonucleotide
gcatagggggagggggtggatagggttcaacacag

SEQ ID NO: 108666 - DNA, 35 bp, Artificial Sequence
  Synthetic oligonucleotide
ttcagcgaccttcttccgccgttccgatctcgtct

SEQ ID NO: 108667 - DNA, 35 bp, Artificial Sequence
  Synthetic oligonucleotide
gcatacgcactgccaccaccttctcgccccgaggt

SEQ ID NO: 108668 - DNA, 35 bp, Artificial Sequence
  Synthetic oligonucleotide
acacgaacgctcagccgtatccctctattcccgac

SEQ ID NO: 108669 - DNA, 35 bp, Artificial Sequence
  Synthetic oligonucleotide
tgcatagcctcatgcctagccgccctcgcccactg

SEQ ID NO: 108670 - DNA, 35 bp, Artificial Sequence
  Synthetic oligonucleotide
tcgttcagtccccctgttcttgcttaggtctgccc

SEQ ID NO: 108671 - DNA, 35 bp, Artificial Sequence
  Synthetic oligonucleotide
ggataggaggggcgggtatggggggagagcgagaa

SEQ ID NO: 108672 - DNA, 35 bp, Artificial Sequence
  Synthetic oligonucleotide
tcccgcccagtcctttgcatccttactgttaatcc

SEQ ID NO: 108673 - DNA, 35 bp, Artificial Sequence
  Synthetic oligonucleotide
atcgcacacacgtcgccgctcccactgtccgttta

SEQ ID NO: 108674 - DNA, 35 bp, Artificial Sequence
  Synthetic oligonucleotide
acgaccaattgcccgatcctccttgtcctaatgtc

SEQ ID NO: 108675 - DNA, 35 bp, Artificial Sequence
  Synthetic oligonucleotide
gcctacgtcccatctaactaccctgtccgcgtgtc

SEQ ID NO: 108676 - DNA, 35 bp, Artificial Sequence
  Synthetic oligonucleotide
gacaacccagccctatcccagtatcacctgcgttt

SEQ ID NO: 108677 - DNA, 36 bp, Artificial Sequence
  Synthetic oligonucleotide
tcacgtcttcctgtttggtccattctccctgctgta

SEQ ID NO: 108678 - DNA, 38 bp, Artificial Sequence
  Synthetic oligonucleotide
acgtggagcccccggtgcgttggcccttcccttgttga

SEQ ID NO: 108679 - DNA, 34 bp, Artificial Sequence
  Synthetic oligonucleotide
ccagtccgccagccctatcccctcccgctccgcc

SEQ ID NO: 108680 - DNA, 35 bp, Artificial Sequence
  Synthetic oligonucleotide
gtcccaccgccgacgcaatctgttttcatttcgcc

SEQ ID NO: 108681 - DNA, 35 bp, Artificial Sequence
  Synthetic oligonucleotide
acggtgcatcgacctctgcgctcccttcctgtgcc

SEQ ID NO: 108682 - DNA, 35 bp, Artificial Sequence
  Synthetic oligonucleotide
agttgtgccctcccgctcgctgataactgccctta

SEQ ID NO: 108683 - DNA, 34 bp, Artificial Sequence
  Synthetic oligonucleotide
atcaccgccatccggatgcagccttctactccgc

SEQ ID NO: 108684 - DNA, 37 bp, Artificial Sequence
  Synthetic oligonucleotide
gatgcggtatagacggggggggaaaggtgcgagggga

SEQ ID NO: 108685 - DNA, 35 bp, Artificial Sequence
  Synthetic oligonucleotide
agtggggtgcggctgggggacggtggagggcgtat

SEQ ID NO: 108686 - DNA, 36 bp, Artificial Sequence
  Synthetic oligonucleotide
aacccgttgccctcccgcgtagttcgttcctacgga

SEQ ID NO: 108687 - DNA, 35 bp, Artificial Sequence
  Synthetic oligonucleotide
atgtccacccacgactcccaccttagacagcactt

SEQ ID NO: 108688 - DNA, 36 bp, Artificial Sequence
  Synthetic oligonucleotide
gccgactacccgccatgctgtccccccatgtttaca

SEQ ID NO: 108689 - DNA, 35 bp, Artificial Sequence
  Synthetic oligonucleotide
agtttgccctcacccgtttcccaagttgtctgcct

SEQ ID NO: 108690 - DNA, 35 bp, Artificial Sequence
  Synthetic oligonucleotide
acccatcccgacgtagcaacacacaagcctctttc

SEQ ID NO: 108691 - DNA, 36 bp, Artificial Sequence
  Synthetic oligonucleotide
tacgccgcctttttccatcctcccgacggtctggga

SEQ ID NO: 108692 - DNA, 38 bp, Artificial Sequence
  Synthetic oligonucleotide
gccgcctcggccttgtatccctgtggctccccctttga

SEQ ID NO: 108693 - DNA, 35 bp, Artificial Sequence
  Synthetic oligonucleotide
gtcccatgcatcttaggcatcatagttccatctct

SEQ ID NO: 108694 - DNA, 36 bp, Artificial Sequence
  Synthetic oligonucleotide
tccggtgcctgtctcggttcctaagtcctccctcca

SEQ ID NO: 108695 - DNA, 37 bp, Artificial Sequence
  Synthetic oligonucleotide
acaccccatccgccccaatgttatcttgtcccatcga

SEQ ID NO: 108696 - DNA, 35 bp, Artificial Sequence
  Synthetic oligonucleotide
gacggttgccaaggggagggtgggagagagggcgg

SEQ ID NO: 108697 - DNA, 35 bp, Artificial Sequence
  Synthetic oligonucleotide
gtcccgccccgcccggtgacccacactcgtttcgc

SEQ ID NO: 108698 - DNA, 35 bp, Artificial Sequence
  Synthetic oligonucleotide
tagccccctccgtccgacttgccgttttttagcgt

SEQ ID NO: 108699 - DNA, 35 bp, Artificial Sequence
  Synthetic oligonucleotide
atcaccctccgccaagtttacaagccacgctttgt

SEQ ID NO: 108700 - DNA, 35 bp, Artificial Sequence
  Synthetic oligonucleotide
gcctaccgcctgttgcatcccctgaattaccttgc

SEQ ID NO: 108701 - DNA, 35 bp, Artificial Sequence
  Synthetic oligonucleotide
atgatgtcaaccgcgatgtagccccgccctgtccc

SEQ ID NO: 108702 - DNA, 36 bp, Artificial Sequence
  Synthetic oligonucleotide
tcaaccctgcgaccacgtttctcatccgccacccga

SEQ ID NO: 108703 - DNA, 35 bp, Artificial Sequence
  Synthetic oligonucleotide
gatgccagcttcgtccttttatgccccaagccctt

SEQ ID NO: 108704 - DNA, 37 bp, Artificial Sequence
  Synthetic oligonucleotide
tcgttcaccacaccctccatgcatccgtagctcacga

SEQ ID NO: 108705 - DNA, 35 bp, Artificial Sequence
  Synthetic oligonucleotide
gactaagggggaggggtctacggggttggttggac

SEQ ID NO: 108706 - DNA, 35 bp, Artificial Sequence
  Synthetic oligonucleotide
tttcggtaaccgccctgcctattcgcacagccctc

SEQ ID NO: 108707 - DNA, 35 bp, Artificial Sequence
  Synthetic oligonucleotide
tggaacccctctccgtgctccctgtatcgccaccc

SEQ ID NO: 108708 - DNA, 35 bp, Artificial Sequence
  Synthetic oligonucleotide
acagcgtgctgcccgtccgtcgcttccttgtcacg

SEQ ID NO: 108709 - DNA, 35 bp, Artificial Sequence
  Synthetic oligonucleotide
actctcgccccgctacagttgcctttctcgcccgc

SEQ ID NO: 108710 - DNA, 35 bp, Artificial Sequence
  Synthetic oligonucleotide
actacgctcgctctatgtctcatcccatccttcgt

SEQ ID NO: 108711 - DNA, 35 bp, Artificial Sequence
  Synthetic oligonucleotide
tacgacatccgcccttttctgctatcctggtatca

SEQ ID NO: 108712 - DNA, 36 bp, Artificial Sequence
  Synthetic oligonucleotide
acaccaccaccacccaatgcctagactcacgtacca

SEQ ID NO: 108713 - DNA, 36 bp, Artificial Sequence
  Synthetic oligonucleotide
acggggggccgggagggaaacgaagagctgggataa

SEQ ID NO: 108714 - DNA, 37 bp, Artificial Sequence
  Synthetic oligonucleotide
gccccattcgccccaacccttattgcccagtcttgga

SEQ ID NO: 108715 - DNA, 35 bp, Artificial Sequence
  Synthetic oligonucleotide
tgagcccccactggtgtttttctttcttccctagg

SEQ ID NO: 108716 - DNA, 36 bp, Artificial Sequence
  Synthetic oligonucleotide
tgtctgccatccgctcggtaacacactccccctgca

SEQ ID NO: 108717 - DNA, 38 bp, Artificial Sequence
  Synthetic oligonucleotide
tcgtgcccatccatgtttcttacgcctttgccctgtga

SEQ ID NO: 108718 - DNA, 35 bp, Artificial Sequence
  Synthetic oligonucleotide
gccgatcgcccccagccaacgaaaacttccttgcc

SEQ ID NO: 108719 - DNA, 35 bp, Artificial Sequence
  Synthetic oligonucleotide
ttgcaccctgccggtattccctgcccgtacacctg

SEQ ID NO: 108720 - DNA, 35 bp, Artificial Sequence
  Synthetic oligonucleotide
gcctcgccctaaacaactcgtcgacctgcccgtta

SEQ ID NO: 108721 - DNA, 35 bp, Artificial Sequence
  Synthetic oligonucleotide
tgactgcgcactccgtccttgcgctccacccatat

SEQ ID NO: 108722 - DNA, 36 bp, Artificial Sequence
  Synthetic oligonucleotide
ttcgcctccactgcctattgttcactctacatagta

SEQ ID NO: 108723 - DNA, 26 bp, Artificial Sequence
  Synthetic oligonucleotide
gcgatgagcatcagcgcacgccttcc

SEQ ID NO: 108724 - DNA, 36 bp, Artificial Sequence
  Synthetic oligonucleotide
tcccgtgcccccccctacttctgtatctccagacga

SEQ ID NO: 108725 - DNA, 35 bp, Artificial Sequence
  Synthetic oligonucleotide
gtgttcgtactgctccttgatcgtccgcctttcgc

SEQ ID NO: 108726 - DNA, 36 bp, Artificial Sequence
  Synthetic oligonucleotide
tgcatcaaccatgcgcatttcgtactacctcctaaa

SEQ ID NO: 108727 - DNA, 35 bp, Artificial Sequence
  Synthetic oligonucleotide
gagggggggaccatgatggggcttttggggaggga

SEQ ID NO: 108728 - DNA, 37 bp, Artificial Sequence
  Synthetic oligonucleotide
gcgtacaacgcctattcgcatttgaccccccccttga

SEQ ID NO: 108729 - DNA, 35 bp, Artificial Sequence
  Synthetic oligonucleotide
aacaccttcacctccgcctacagggctccaggctc

SEQ ID NO: 108730 - DNA, 36 bp, Artificial Sequence
  Synthetic oligonucleotide
ggagggtagggtggggggaggcatgatggggtgaca

SEQ ID NO: 108731 - DNA, 35 bp, Artificial Sequence
  Synthetic oligonucleotide
tctgccccctatactgccttgccacgagcccccga

SEQ ID NO: 108732 - DNA, 35 bp, Artificial Sequence
  Synthetic oligonucleotide
aaccacctcactcccgtccctccatggccccggtt

SEQ ID NO: 108733 - DNA, 35 bp, Artificial Sequence
  Synthetic oligonucleotide
gaagacagccctctgcttctaaatcgcttctcgcc

SEQ ID NO: 108734 - DNA, 36 bp, Artificial Sequence
  Synthetic oligonucleotide
ttgcagggggggaagggggtgggagctacggggacg

SEQ ID NO: 108735 - DNA, 35 bp, Artificial Sequence
  Synthetic oligonucleotide
gccacgcccaaatgctcgctgattgctcccttcgt

SEQ ID NO: 108736 - DNA, 35 bp, Artificial Sequence
  Synthetic oligonucleotide
tagccaccttccggtcatgtttcgtctctctcggt

SEQ ID NO: 108737 - DNA, 36 bp, Artificial Sequence
  Synthetic oligonucleotide
gtcaaccctaccgccgcccctctgagcctttgacta

SEQ ID NO: 108738 - DNA, 35 bp, Artificial Sequence
  Synthetic oligonucleotide
acacctcacctcagcatcgccgaataacctgtcct

SEQ ID NO: 108739 - DNA, 35 bp, Artificial Sequence
  Synthetic oligonucleotide
agacatgtccgcctctgttaccatcgccgtttcca

SEQ ID NO: 108740 - DNA, 37 bp, Artificial Sequence
  Synthetic oligonucleotide
tagacccgcagtctttcgccctgtcctccgtttccga

SEQ ID NO: 108741 - DNA, 35 bp, Artificial Sequence
  Synthetic oligonucleotide
ttgaatcgtcgaccgcccctcgcccgtagttctcc

SEQ ID NO: 108742 - DNA, 35 bp, Artificial Sequence
  Synthetic oligonucleotide
gagtcacccgccccaggtccgcctcttccacatac

SEQ ID NO: 108743 - DNA, 35 bp, Artificial Sequence
  Synthetic oligonucleotide
gacgcaactcccgcctttatccctcctcgcctttg

SEQ ID NO: 108744 - DNA, 35 bp, Artificial Sequence
  Synthetic oligonucleotide
gctccacctcagcgcagtctaaattgcctctcctt

SEQ ID NO: 108745 - DNA, 35 bp, Artificial Sequence
  Synthetic oligonucleotide
gaccaccacctgccgtactagccccgggaatcatc

SEQ ID NO: 108746 - DNA, 35 bp, Artificial Sequence
  Synthetic oligonucleotide
gatgagggaaggataagtgggcacagggttgggcg

SEQ ID NO: 108747 - DNA, 35 bp, Artificial Sequence
  Synthetic oligonucleotide
attgccccgccccatgcctcgctcagctggcccta

SEQ ID NO: 108748 - DNA, 35 bp, Artificial Sequence
  Synthetic oligonucleotide
acgtcgcatgcctccgttctggcaccccccgttac

SEQ ID NO: 108749 - DNA, 35 bp, Artificial Sequence
  Synthetic oligonucleotide
gtactgtgccttgcctattctgccattccccctga

SEQ ID NO: 108750 - DNA, 35 bp, Artificial Sequence
  Synthetic oligonucleotide
tgcacgtgctcgacccctggcctttcctgcccccg

SEQ ID NO: 108751 - DNA, 38 bp, Artificial Sequence
  Synthetic oligonucleotide
tgagccgacagggggagggggaaaggtgaaggcattga

SEQ ID NO: 108752 - DNA, 35 bp, Artificial Sequence
  Synthetic oligonucleotide
tgatcgctgccataccgtaactttgcccctgcctc

SEQ ID NO: 108753 - DNA, 35 bp, Artificial Sequence
  Synthetic oligonucleotide
tccgcaccaatcgtattttgcctcttccggtctcc

SEQ ID NO: 108754 - DNA, 35 bp, Artificial Sequence
  Synthetic oligonucleotide
acgcacctctagcccgcccttgccctgtctggcca

SEQ ID NO: 108755 - DNA, 36 bp, Artificial Sequence
  Synthetic oligonucleotide
gtcgccgcccccgccctcgtgtacatataacgtcga

SEQ ID NO: 108756 - DNA, 37 bp, Artificial Sequence
  Synthetic oligonucleotide
gagaagggggggacggagtgggagtaaggaagccaga

SEQ ID NO: 108757 - DNA, 37 bp, Artificial Sequence
  Synthetic oligonucleotide
tgtggccggaggggttatccatgggggatggtggaga

SEQ ID NO: 108758 - DNA, 35 bp, Artificial Sequence
  Synthetic oligonucleotide
ataactccgcctccagttcatcctgtctctacgtg

SEQ ID NO: 108759 - DNA, 35 bp, Artificial Sequence
  Synthetic oligonucleotide
gaccacggactggccttgcgagcactaccccccct

SEQ ID NO: 108760 - DNA, 35 bp, Artificial Sequence
  Synthetic oligonucleotide
tgcaccgatccgtattcttacgccgcacctttcct

SEQ ID NO: 108761 - DNA, 35 bp, Artificial Sequence
  Synthetic oligonucleotide
gctgctccacgcacatctggctttggcttccctct

SEQ ID NO: 108762 - DNA, 35 bp, Artificial Sequence
  Synthetic oligonucleotide
aaccccccgtccatgttactattatctgctcacct

SEQ ID NO: 108763 - DNA, 35 bp, Artificial Sequence
  Synthetic oligonucleotide
tagtacgtcactacgctgtcactttggtcacctct

SEQ ID NO: 108764 - DNA, 35 bp, Artificial Sequence
  Synthetic oligonucleotide
actgctacctccccgttgtccttacgtgctgaacc

SEQ ID NO: 108765 - DNA, 35 bp, Artificial Sequence
  Synthetic oligonucleotide
tgttcctgcctcacattcctttcagctcggactcc

SEQ ID NO: 108766 - DNA, 34 bp, Artificial Sequence
  Synthetic oligonucleotide
tgcagtagccgccacaacgtattttcctcgtttt

SEQ ID NO: 108767 - DNA, 36 bp, Artificial Sequence
  Synthetic oligonucleotide
gccacatccctctgtactattaggttcaccgcccga

SEQ ID NO: 108768 - DNA, 35 bp, Artificial Sequence
  Synthetic oligonucleotide
gctcctcgtccaaacgtctctgcgcacccacctgc

SEQ ID NO: 108769 - DNA, 36 bp, Artificial Sequence
  Synthetic oligonucleotide
tcgagggaggtaggagagagggggaaaggcatagaa

SEQ ID NO: 108770 - DNA, 36 bp, Artificial Sequence
  Synthetic oligonucleotide
catcctcgcctgtgtcttttgccgcttgcattctca

SEQ ID NO: 108771 - DNA, 35 bp, Artificial Sequence
  Synthetic oligonucleotide
tgtcgagtcgaattcacccctgctcccactgtacg

SEQ ID NO: 108772 - DNA, 35 bp, Artificial Sequence
  Synthetic oligonucleotide
agttcacccctcgctttctccgtccttgcttcgcg

SEQ ID NO: 108773 - DNA, 35 bp, Artificial Sequence
  Synthetic oligonucleotide
tcacggtttgcctgcccctttggtccctgtttccc

SEQ ID NO: 108774 - DNA, 35 bp, Artificial Sequence
  Synthetic oligonucleotide
acacacacatgcttttttctcgtgcccaccaattt

SEQ ID NO: 108775 - DNA, 35 bp, Artificial Sequence
  Synthetic oligonucleotide
actttcagcacagccgttccgccgatcctttcctc

SEQ ID NO: 108776 - DNA, 35 bp, Artificial Sequence
  Synthetic oligonucleotide
gcgtgccacgcccatcccttccgccccactagcgt

SEQ ID NO: 108777 - DNA, 35 bp, Artificial Sequence
  Synthetic oligonucleotide
atgtcccccccgcccagtacgcccgcgcatacgca

SEQ ID NO: 108778 - DNA, 35 bp, Artificial Sequence
  Synthetic oligonucleotide
gtcttcaccgcctctgtatcgcactttaccatcgc

SEQ ID NO: 108779 - DNA, 35 bp, Artificial Sequence
  Synthetic oligonucleotide
gtacctgcgaactgagtctatccgcccttcttcat

SEQ ID NO: 108780 - DNA, 37 bp, Artificial Sequence
  Synthetic oligonucleotide
gccatcacccgtagtcgtacctcgccctatctctgga

SEQ ID NO: 108781 - DNA, 35 bp, Artificial Sequence
  Synthetic oligonucleotide
atgatccacccgtgtgttttcgtttttactgcccc

SEQ ID NO: 108782 - DNA, 35 bp, Artificial Sequence
  Synthetic oligonucleotide
aacccgcgtcaaacccccccgctcgctttattgcc

SEQ ID NO: 108783 - DNA, 35 bp, Artificial Sequence
  Synthetic oligonucleotide
atgctcctcccgccgtgatccacgtttatacctcc

SEQ ID NO: 108784 - DNA, 36 bp, Artificial Sequence
  Synthetic oligonucleotide
acagggggggaagaagggaggagagcatgctgggga

SEQ ID NO: 108785 - DNA, 35 bp, Artificial Sequence
  Synthetic oligonucleotide
ggtacccatcgccctgcccggacacacacatacac

SEQ ID NO: 108786 - DNA, 35 bp, Artificial Sequence
  Synthetic oligonucleotide
gggaagaggagagggggtggagagttaactgaggg

SEQ ID NO: 108787 - DNA, 36 bp, Artificial Sequence
  Synthetic oligonucleotide
tccacgtcatgttcttccctgccctcccatagtgca

SEQ ID NO: 108788 - DNA, 35 bp, Artificial Sequence
  Synthetic oligonucleotide
gtcacctgcccgaccccgtgcgccccgttcataca

SEQ ID NO: 108789 - DNA, 35 bp, Artificial Sequence
  Synthetic oligonucleotide
gcaggccccgccctaatgtctcgtcgcaacatccc

SEQ ID NO: 108790 - DNA, 38 bp, Artificial Sequence
  Synthetic oligonucleotide
acccgcccttcaatattgttcgctatcctgccctttga

SEQ ID NO: 108791 - DNA, 35 bp, Artificial Sequence
  Synthetic oligonucleotide
tacttcccgccttggggtatagtctgccctccccc

SEQ ID NO: 108792 - DNA, 35 bp, Artificial Sequence
  Synthetic oligonucleotide
aacacaccgctgttcgcctcccttcctatttcgta

SEQ ID NO: 108793 - DNA, 35 bp, Artificial Sequence
  Synthetic oligonucleotide
tccccgaccggattctgtccttcgcctccttggta

SEQ ID NO: 108794 - DNA, 36 bp, Artificial Sequence
  Synthetic oligonucleotide
ggggggagggtgggttgcggggcttggtatgcacca

SEQ ID NO: 108795 - DNA, 37 bp, Artificial Sequence
  Synthetic oligonucleotide
tcccacccgcctcccatcagtcgcactgccggctcga

SEQ ID NO: 108796 - DNA, 35 bp, Artificial Sequence
  Synthetic oligonucleotide
gacgacagtcgcacccgccatagcgccttcccgtc

SEQ ID NO: 108797 - DNA, 37 bp, Artificial Sequence
  Synthetic oligonucleotide
agatgcggggagggggaaagggacggacagaaggtga

SEQ ID NO: 108798 - DNA, 35 bp, Artificial Sequence
  Synthetic oligonucleotide
agtcccaccgcccatttaggtactgctccattatt

SEQ ID NO: 108799 - DNA, 36 bp, Artificial Sequence
  Synthetic oligonucleotide
tatgcatccgctgccccgttctatcttgtaccttaa

SEQ ID NO: 108800 - DNA, 35 bp, Artificial Sequence
  Synthetic oligonucleotide
tgcccccccgcccctgggttctggaatcccatatc

SEQ ID NO: 108801 - DNA, 35 bp, Artificial Sequence
  Synthetic oligonucleotide
ttcgcccccgcgtgattgtccaatcaccgacctcc

SEQ ID NO: 108802 - DNA, 38 bp, Artificial Sequence
  Synthetic oligonucleotide
actggggagggttgcagggtatcggggcggggatttga

SEQ ID NO: 108803 - DNA, 35 bp, Artificial Sequence
  Synthetic oligonucleotide
acgacgactactagtccccatccgcttttgtctcc

SEQ ID NO: 108804 - DNA, 35 bp, Artificial Sequence
  Synthetic oligonucleotide
tcaccgagcgctaacatttctatccagtcaccatc

SEQ ID NO: 108805 - DNA, 32 bp, Artificial Sequence
  Synthetic oligonucleotide
gcgagtggggcccctctacctgcactcatcct

SEQ ID NO: 108806 - DNA, 35 bp, Artificial Sequence
  Synthetic oligonucleotide
gaggacgcacggggttatggagggtgggtggaggt

SEQ ID NO: 108807 - DNA, 36 bp, Artificial Sequence
  Synthetic oligonucleotide
acccccatcccctccagtcctgtactaccgcccgca

SEQ ID NO: 108808 - DNA, 37 bp, Artificial Sequence
  Synthetic oligonucleotide
gcgccggtcactaatttgtctttggcccttcctcctg

SEQ ID NO: 108809 - DNA, 35 bp, Artificial Sequence
  Synthetic oligonucleotide
acataggagagggagggcggtaggagaagctaatg

SEQ ID NO: 108810 - DNA, 35 bp, Artificial Sequence
  Synthetic oligonucleotide
gtgccatcgccctctcatgtttatgcctaccttct

SEQ ID NO: 108811 - DNA, 35 bp, Artificial Sequence
  Synthetic oligonucleotide
accagtagcggttgccggccctatcctgtcccttc

SEQ ID NO: 108812 - DNA, 35 bp, Artificial Sequence
  Synthetic oligonucleotide
aacagccacttcatgcttcattgcgtccgttccac

SEQ ID NO: 108813 - DNA, 35 bp, Artificial Sequence
  Synthetic oligonucleotide
gagagggaggggggatcgggaagggtgggtttcaa

SEQ ID NO: 108814 - DNA, 37 bp, Artificial Sequence
  Synthetic oligonucleotide
acaaccaccgttcgccctgtccattctcacccgacga

SEQ ID NO: 108815 - DNA, 35 bp, Artificial Sequence
  Synthetic oligonucleotide
agttggggaggggacggggaacaacggaaaatgga

SEQ ID NO: 108816 - DNA, 35 bp, Artificial Sequence
  Synthetic oligonucleotide
tgccaccttcagtctatcactatagaccgccttcc

SEQ ID NO: 108817 - DNA, 35 bp, Artificial Sequence
  Synthetic oligonucleotide
tacgttgacgccgcctctgccttagctttccattc

SEQ ID NO: 108818 - DNA, 37 bp, Artificial Sequence
  Synthetic oligonucleotide
ttgcccggccgctgactatcccttcccctctatgcga

SEQ ID NO: 108819 - DNA, 35 bp, Artificial Sequence
  Synthetic oligonucleotide
aggagccccggtctatcattcgcttggttcctgtc

SEQ ID NO: 108820 - DNA, 34 bp, Artificial Sequence
  Synthetic oligonucleotide
aacctgccactggcacatcatagctccacccgct

SEQ ID NO: 108821 - DNA, 35 bp, Artificial Sequence
  Synthetic oligonucleotide
ttgaccggctactctgttacttcgttgacccctcc

SEQ ID NO: 108822 - DNA, 35 bp, Artificial Sequence
  Synthetic oligonucleotide
ttcgacgcgtgctgcgttgttttacctgtccccct

SEQ ID NO: 108823 - DNA, 35 bp, Artificial Sequence
  Synthetic oligonucleotide
atcccgccgctgatccgccatcaattagcccccac

SEQ ID NO: 108824 - DNA, 37 bp, Artificial Sequence
  Synthetic oligonucleotide
ggacctcgccgcccatccgtgaacgtgcactacccga

SEQ ID NO: 108825 - DNA, 37 bp, Artificial Sequence
  Synthetic oligonucleotide
tcctcccaccttccatgtgattacataccacccatga

SEQ ID NO: 108826 - DNA, 35 bp, Artificial Sequence
  Synthetic oligonucleotide
gtcagtcccagttcttatcatttgctccgccctcc

SEQ ID NO: 108827 - DNA, 38 bp, Artificial Sequence
  Synthetic oligonucleotide
ggtcgccaccgctgcccttcaccccgtcccacgtgtga

SEQ ID NO: 108828 - DNA, 38 bp, Artificial Sequence
  Synthetic oligonucleotide
atgtgcccgcagtgccctgctattctaccctccattga

SEQ ID NO: 108829 - DNA, 36 bp, Artificial Sequence
  Synthetic oligonucleotide
gaagcggtcgtccgccactgtccttcgcctgcatta

SEQ ID NO: 108830 - DNA, 35 bp, Artificial Sequence
  Synthetic oligonucleotide
gtggtgtcccctgattccgttccctgtttggcttc

SEQ ID NO: 108831 - DNA, 35 bp, Artificial Sequence
  Synthetic oligonucleotide
tacgacaccctcccccatgatacactacagacgca

SEQ ID NO: 108832 - DNA, 35 bp, Artificial Sequence
  Synthetic oligonucleotide
gttagaatcgaaggggaggggagttgtggtagagg

SEQ ID NO: 108833 - DNA, 35 bp, Artificial Sequence
  Synthetic oligonucleotide
acccccacacatgttatctccaacgcattcttgct

SEQ ID NO: 108834 - DNA, 37 bp, Artificial Sequence
  Synthetic oligonucleotide
gatcgccccacatgttactcctatcgaaacctctgga

SEQ ID NO: 108835 - DNA, 34 bp, Artificial Sequence
  Synthetic oligonucleotide
attcaccacagctgcatttaccgcacctatcctt

SEQ ID NO: 108836 - DNA, 36 bp, Artificial Sequence
  Synthetic oligonucleotide
ggagggacacgggaaacaagcaggaagtgggtagaa

SEQ ID NO: 108837 - DNA, 35 bp, Artificial Sequence
  Synthetic oligonucleotide
acgaggccttctgccgttatactcacctcgcccat

SEQ ID NO: 108838 - DNA, 35 bp, Artificial Sequence
  Synthetic oligonucleotide
acctcttgccccccgccgccgctctacacgaagtt

SEQ ID NO: 108839 - DNA, 35 bp, Artificial Sequence
  Synthetic oligonucleotide
tcccctcgccatttcgttcactccagcactcgggc

SEQ ID NO: 108840 - DNA, 35 bp, Artificial Sequence
  Synthetic oligonucleotide
tgctcatccgcttgctgcacttatcaggtcctctc

SEQ ID NO: 108841 - DNA, 36 bp, Artificial Sequence
  Synthetic oligonucleotide
gagaagggggatggaaaaagcagaaggggtgggcga

SEQ ID NO: 108842 - DNA, 35 bp, Artificial Sequence
  Synthetic oligonucleotide
gccgagtgctgccacgtgtctcattgcccttccac

SEQ ID NO: 108843 - DNA, 35 bp, Artificial Sequence
  Synthetic oligonucleotide
atcgttgccctctccttcgaaatagaacccctccg

SEQ ID NO: 108844 - DNA, 35 bp, Artificial Sequence
  Synthetic oligonucleotide
ttcctgctacccgacgcgtatgctcgccccccttc

SEQ ID NO: 108845 - DNA, 35 bp, Artificial Sequence
  Synthetic oligonucleotide
ggagcgcacttgtcgttttctctccgcccctccta

SEQ ID NO: 108846 - DNA, 35 bp, Artificial Sequence
  Synthetic oligonucleotide
gttgtccgtcgcccaccgtatgtcctggttcttgt

SEQ ID NO: 108847 - DNA, 35 bp, Artificial Sequence
  Synthetic oligonucleotide
acagccgccccccagccttatacccgtcgattcca

SEQ ID NO: 108848 - DNA, 35 bp, Artificial Sequence
  Synthetic oligonucleotide
tagctccgctgccccctgtgcccccacacttgaac

SEQ ID NO: 108849 - DNA, 35 bp, Artificial Sequence
  Synthetic oligonucleotide
tcagctccctcaccatactcgcctcgttccctcgg

SEQ ID NO: 108850 - DNA, 35 bp, Artificial Sequence
  Synthetic oligonucleotide
gccgccccgaattgcccgccgcccctagttctcgt

SEQ ID NO: 108851 - DNA, 36 bp, Artificial Sequence
  Synthetic oligonucleotide
gccttcgccgcccccgttattggtcccattctcaca

SEQ ID NO: 108852 - DNA, 35 bp, Artificial Sequence
  Synthetic oligonucleotide
accgcccctgcacctgtcttttggagctcgctact

SEQ ID NO: 108853 - DNA, 34 bp, Artificial Sequence
  Synthetic oligonucleotide
tcacccgcccctttccctatgtcatttataccat

SEQ ID NO: 108854 - DNA, 36 bp, Artificial Sequence
  Synthetic oligonucleotide
tgcacgcattcgctccctctcacctgggcttccaca

SEQ ID NO: 108855 - DNA, 35 bp, Artificial Sequence
  Synthetic oligonucleotide
gcatttccacctgtcctttcaagctacgcccttgc

SEQ ID NO: 108856 - DNA, 35 bp, Artificial Sequence
  Synthetic oligonucleotide
gccccaaaccaccagtgtgtccatccccccctttg

SEQ ID NO: 108857 - DNA, 35 bp, Artificial Sequence
  Synthetic oligonucleotide
tgtccgcccccgctgctactcctaagttatggcct

SEQ ID NO: 108858 - DNA, 35 bp, Artificial Sequence
  Synthetic oligonucleotide
tgtgatgaggcgggcgggggggctagggtcgaggg

SEQ ID NO: 108859 - DNA, 35 bp, Artificial Sequence
  Synthetic oligonucleotide
gctgtccgtcggtcgttagcccccttctcacccct

SEQ ID NO: 108860 - DNA, 35 bp, Artificial Sequence
  Synthetic oligonucleotide
gaaccgccgatcaccctctgtcatgcgcacctcct

SEQ ID NO: 108861 - DNA, 35 bp, Artificial Sequence
  Synthetic oligonucleotide
atccgcatcacataatatggcccctgctctactcc

SEQ ID NO: 108862 - DNA, 35 bp, Artificial Sequence
  Synthetic oligonucleotide
gcaaagtcgcgaggatggggaggggagggaagggg

SEQ ID NO: 108863 - DNA, 36 bp, Artificial Sequence
  Synthetic oligonucleotide
attccccagccgtcacctccgcctgtttaccgctga

SEQ ID NO: 108864 - DNA, 35 bp, Artificial Sequence
  Synthetic oligonucleotide
tttgcctcgcaattcccctatattgaaccacctgc

SEQ ID NO: 108865 - DNA, 35 bp, Artificial Sequence
  Synthetic oligonucleotide
gacccccctcgagaaaccgacgcccctagccaatg

SEQ ID NO: 108866 - DNA, 35 bp, Artificial Sequence
  Synthetic oligonucleotide
acatccgagcctccattgcgctccactgacactgc

SEQ ID NO: 108867 - DNA, 36 bp, Artificial Sequence
  Synthetic oligonucleotide
tccaccgcctccccccccaaccagcgctgccttgaa

SEQ ID NO: 108868 - DNA, 35 bp, Artificial Sequence
  Synthetic oligonucleotide
acgctcggacttgctacgtactcacaccttccctg

SEQ ID NO: 108869 - DNA, 35 bp, Artificial Sequence
  Synthetic oligonucleotide
agccgacgccccgtctaatagctctccgtacactt

SEQ ID NO: 108870 - DNA, 35 bp, Artificial Sequence
  Synthetic oligonucleotide
acaacaccctctccgtacagttacaatcgcccgcc

SEQ ID NO: 108871 - DNA, 35 bp, Artificial Sequence
  Synthetic oligonucleotide
acccgacgccctccctccttgacaacggagccctg

SEQ ID NO: 108872 - DNA, 36 bp, Artificial Sequence
  Synthetic oligonucleotide
tcttgggaggggtccttcatatacggggatagggga

SEQ ID NO: 108873 - DNA, 35 bp, Artificial Sequence
  Synthetic oligonucleotide
tcgatgccgtccgccatttgttcgctgtttctctc

SEQ ID NO: 108874 - DNA, 35 bp, Artificial Sequence
  Synthetic oligonucleotide
tacccctgactcaactgtaccccgcaacccctcgc

SEQ ID NO: 108875 - DNA, 38 bp, Artificial Sequence
  Synthetic oligonucleotide
ttgatgcgtgactcttgtaccacctgcccccctgttga

SEQ ID NO: 108876 - DNA, 35 bp, Artificial Sequence
  Synthetic oligonucleotide
acccatgtcgtccgtttccttgttatccatccacc

SEQ ID NO: 108877 - DNA, 35 bp, Artificial Sequence
  Synthetic oligonucleotide
gcgctccgccacccctgcctgtttgtccctagggt

SEQ ID NO: 108878 - DNA, 35 bp, Artificial Sequence
  Synthetic oligonucleotide
gatggggcgggcacagcagggggaagctgagggga

SEQ ID NO: 108879 - DNA, 35 bp, Artificial Sequence
  Synthetic oligonucleotide
atctcaccgctgtacgacttcgcttttccttgccc

SEQ ID NO: 108880 - DNA, 35 bp, Artificial Sequence
  Synthetic oligonucleotide
tccgactctcactgccccttgacgcatattgttcc

SEQ ID NO: 108881 - DNA, 35 bp, Artificial Sequence
  Synthetic oligonucleotide
acccaggcccctactccttgtcgctggttaccttc

SEQ ID NO: 108882 - DNA, 36 bp, Artificial Sequence
  Synthetic oligonucleotide
atgcatgtgctaattgcttccccccgtccgttatca

SEQ ID NO: 108883 - DNA, 35 bp, Artificial Sequence
  Synthetic oligonucleotide
cacacgacccaattcgtatcctcgccgccccttgt

SEQ ID NO: 108884 - DNA, 35 bp, Artificial Sequence
  Synthetic oligonucleotide
tcaccgcatctctcgccccgcctgtgacaaccgcc

SEQ ID NO: 108885 - DNA, 35 bp, Artificial Sequence
  Synthetic oligonucleotide
gactcctctcgatcgtctcctcaatgccaccttat

SEQ ID NO: 108886 - DNA, 35 bp, Artificial Sequence
  Synthetic oligonucleotide
ttggggggcgggcgggtagcacgagttggggccac

SEQ ID NO: 108887 - DNA, 34 bp, Artificial Sequence
  Synthetic oligonucleotide
gttgcaacactatggcacctcactctcctcacgc

SEQ ID NO: 108888 - DNA, 37 bp, Artificial Sequence
  Synthetic oligonucleotide
gcgccgccaacagcactgtccctcccccagccgccga

SEQ ID NO: 108889 - DNA, 36 bp, Artificial Sequence
  Synthetic oligonucleotide
tgccccgccttgacccacgccgccccttggccgcca

SEQ ID NO: 108890 - DNA, 35 bp, Artificial Sequence
  Synthetic oligonucleotide
tgtgcccgcctccgttctgtcctcgcacctctcta

SEQ ID NO: 108891 - DNA, 35 bp, Artificial Sequence
  Synthetic oligonucleotide
gacgaggtgggggaaaagtaagagcggggtgcagt

SEQ ID NO: 108892 - DNA, 34 bp, Artificial Sequence
  Synthetic oligonucleotide
tctcaacagccgacaccgctccgtcttggccttc

SEQ ID NO: 108893 - DNA, 35 bp, Artificial Sequence
  Synthetic oligonucleotide
gtgatcccccccatatgtttgtttgccgattatct

SEQ ID NO: 108894 - DNA, 35 bp, Artificial Sequence
  Synthetic oligonucleotide
gtgccccttccgttcgccacgggtcgtaccctcca

SEQ ID NO: 108895 - DNA, 35 bp, Artificial Sequence
  Synthetic oligonucleotide
tttgccccttggatctgtccctgcctttctgaaac

SEQ ID NO: 108896 - DNA, 35 bp, Artificial Sequence
  Synthetic oligonucleotide
tgcgccctcaacaatcggtcttctgctacacttca

SEQ ID NO: 108897 - DNA, 35 bp, Artificial Sequence
  Synthetic oligonucleotide
cccaccccgccgaccgttgtcctcccttgttacac

SEQ ID NO: 108898 - DNA, 35 bp, Artificial Sequence
  Synthetic oligonucleotide
tccgtgcgcgctattcccactgtcttttttgcgcc

SEQ ID NO: 108899 - DNA, 35 bp, Artificial Sequence
  Synthetic oligonucleotide
tgctcacgcttcgtgactgcgaccccccccctccc

SEQ ID NO: 108900 - DNA, 35 bp, Artificial Sequence
  Synthetic oligonucleotide
tgcacacctgccggctctcccccctggaccctacc

SEQ ID NO: 108901 - DNA, 35 bp, Artificial Sequence
  Synthetic oligonucleotide
gaccccccgcctttgctaaggcctgacttataccc

SEQ ID NO: 108902 - DNA, 35 bp, Artificial Sequence
  Synthetic oligonucleotide
aagtaggacggggtaggggaagaaggggtggcgct

SEQ ID NO: 108903 - DNA, 34 bp, Artificial Sequence
  Synthetic oligonucleotide
tgtggtgacacttccccccgtacctgccccctca

SEQ ID NO: 108904 - DNA, 35 bp, Artificial Sequence
  Synthetic oligonucleotide
ttggtaaggcgcgggggtaagggggcggaggttgg

SEQ ID NO: 108905 - DNA, 38 bp, Artificial Sequence
  Synthetic oligonucleotide
gcccaggggcacggtggtctggggcttgggaaggctga

SEQ ID NO: 108906 - DNA, 36 bp, Artificial Sequence
  Synthetic oligonucleotide
tactcgcccctgcactctgtcctccgtgcccattga

SEQ ID NO: 108907 - DNA, 35 bp, Artificial Sequence
  Synthetic oligonucleotide
actcctgccccgacatagttcattcgttcctctcg

SEQ ID NO: 108908 - DNA, 37 bp, Artificial Sequence
  Synthetic oligonucleotide
gagtacggaggggggagaccggggcagaccagggaga

SEQ ID NO: 108909 - DNA, 35 bp, Artificial Sequence
  Synthetic oligonucleotide
gccccttgttgcacctaactcgccctgctccccgc

SEQ ID NO: 108910 - DNA, 36 bp, Artificial Sequence
  Synthetic oligonucleotide
accacccgcacttttcctcggagctcaggcctcgca

SEQ ID NO: 108911 - DNA, 36 bp, Artificial Sequence
  Synthetic oligonucleotide
tacgacaacccccagcactcgaccatgccaccacga

SEQ ID NO: 108912 - DNA, 35 bp, Artificial Sequence
  Synthetic oligonucleotide
tatccgcccgctctatcgttccccatgtgctattg

SEQ ID NO: 108913 - DNA, 35 bp, Artificial Sequence
  Synthetic oligonucleotide
gtaccccgccggtcctttctgctcctccggccatg

SEQ ID NO: 108914 - DNA, 37 bp, Artificial Sequence
  Synthetic oligonucleotide
gcacgcttcctgttctgcttatctccctctgtaccga

SEQ ID NO: 108915 - DNA, 35 bp, Artificial Sequence
  Synthetic oligonucleotide
gagccctgctatgtaactcccctctggtgcactcc

SEQ ID NO: 108916 - DNA, 35 bp, Artificial Sequence
  Synthetic oligonucleotide
gcaccaccccccaggcccacgttatccagaacgtt

SEQ ID NO: 108917 - DNA, 35 bp, Artificial Sequence
  Synthetic oligonucleotide
tggggggcggagggggtaatgggatggagcggtga

SEQ ID NO: 108918 - DNA, 35 bp, Artificial Sequence
  Synthetic oligonucleotide
tcctgttggcctcccatcttgtttatctaccctcc

SEQ ID NO: 108919 - DNA, 35 bp, Artificial Sequence
  Synthetic oligonucleotide
tcccacacctctattatattacaccgtgtctccgc

SEQ ID NO: 108920 - DNA, 35 bp, Artificial Sequence
  Synthetic oligonucleotide
tatacgacgaggaggaaggcggaagggagtaaggg

SEQ ID NO: 108921 - DNA, 30 bp, Artificial Sequence
  Synthetic oligonucleotide
tcacgggtagggtggaggggggggtaacga

SEQ ID NO: 108922 - DNA, 35 bp, Artificial Sequence
  Synthetic oligonucleotide
tccgcccaatcgcttgctttctatatatgatctcc

SEQ ID NO: 108923 - DNA, 36 bp, Artificial Sequence
  Synthetic oligonucleotide
gagggtggtagtgtggggggccgcaggtaggaagaa

SEQ ID NO: 108924 - DNA, 35 bp, Artificial Sequence
  Synthetic oligonucleotide
gttgacacctcccctcgcctgccttttcgttcgcg

SEQ ID NO: 108925 - DNA, 36 bp, Artificial Sequence
  Synthetic oligonucleotide
tcctcccctcgtcaatgtgtcgtaccaccttactaa

SEQ ID NO: 108926 - DNA, 35 bp, Artificial Sequence
  Synthetic oligonucleotide
taagcccactctccatgtcgtgcctcgtatcctcc

SEQ ID NO: 108927 - DNA, 34 bp, Artificial Sequence
  Synthetic oligonucleotide
gcgcccaacgagcgggagggagggatgggacgcc

SEQ ID NO: 108928 - DNA, 35 bp, Artificial Sequence
  Synthetic oligonucleotide
ttgaccatccctttgctttgcgaccgtactctccg

SEQ ID NO: 108929 - DNA, 34 bp, Artificial Sequence
  Synthetic oligonucleotide
atcgtaccaccggtccggtcctacttcccttact

SEQ ID NO: 108930 - DNA, 35 bp, Artificial Sequence
  Synthetic oligonucleotide
accccaacctctagttctgctgtttcactctacct

SEQ ID NO: 108931 - DNA, 35 bp, Artificial Sequence
  Synthetic oligonucleotide
accaactgccccgtccctcctgactctgcgctgtc

SEQ ID NO: 108932 - DNA, 32 bp, Artificial Sequence
  Synthetic oligonucleotide
gccggtcgcactcctcctcgttgggccgcccc

SEQ ID NO: 108933 - DNA, 36 bp, Artificial Sequence
  Synthetic oligonucleotide
gggagggagggagcggagggggagttgcactgtgaa

SEQ ID NO: 108934 - DNA, 37 bp, Artificial Sequence
  Synthetic oligonucleotide
gcccctcgccgaattgtagttaccgccccccttttga

SEQ ID NO: 108935 - DNA, 36 bp, Artificial Sequence
  Synthetic oligonucleotide
ggaacgcctccaccccggtattgccctttgcctgaa

SEQ ID NO: 108936 - DNA, 36 bp, Artificial Sequence
  Synthetic oligonucleotide
gccccccaccccctgtggttcgttaccgagccttga

SEQ ID NO: 108937 - DNA, 35 bp, Artificial Sequence
  Synthetic oligonucleotide
gtcacagcccggaccatacgccgccccaccctgcg

SEQ ID NO: 108938 - DNA, 35 bp, Artificial Sequence
  Synthetic oligonucleotide
acccccaccggtccatccctacgaccccacctcga

SEQ ID NO: 108939 - DNA, 35 bp, Artificial Sequence
  Synthetic oligonucleotide
tccacctgccgcccggttctgctctctcaaggtaa

SEQ ID NO: 108940 - DNA, 35 bp, Artificial Sequence
  Synthetic oligonucleotide
ggacccacatgacgcttgcactccgaccactttgc

SEQ ID NO: 108941 - DNA, 35 bp, Artificial Sequence
  Synthetic oligonucleotide
tccatccggtgaaagttactgcgctccactcatac

SEQ ID NO: 108942 - DNA, 35 bp, Artificial Sequence
  Synthetic oligonucleotide
aacccctgctctctcgattgccgtctcccgtacgc

SEQ ID NO: 108943 - DNA, 35 bp, Artificial Sequence
  Synthetic oligonucleotide
actcagtccgcccatcattccccaaccgccgccgg

SEQ ID NO: 108944 - DNA, 35 bp, Artificial Sequence
  Synthetic oligonucleotide
gccccaccctcgcactcatcgtacgacccgcaccc

SEQ ID NO: 108945 - DNA, 35 bp, Artificial Sequence
  Synthetic oligonucleotide
tgattgcgctactttgctgattcgctcctctctcg

SEQ ID NO: 108946 - DNA, 35 bp, Artificial Sequence
  Synthetic oligonucleotide
acccgttacgacctgtctcatcttaccgttccacc

SEQ ID NO: 108947 - DNA, 35 bp, Artificial Sequence
  Synthetic oligonucleotide
tcgcgggccgcctgctcccaccgatacacttttca

SEQ ID NO: 108948 - DNA, 35 bp, Artificial Sequence
  Synthetic oligonucleotide
gctcagcgcaaggtatcttcctcgcctgcctccct

SEQ ID NO: 108949 - DNA, 35 bp, Artificial Sequence
  Synthetic oligonucleotide
aattgttgcgccgaagtttcaccttgcctccctct

SEQ ID NO: 108950 - DNA, 35 bp, Artificial Sequence
  Synthetic oligonucleotide
aaggaacgtgggtggggtgggaagggcaaacttct

SEQ ID NO: 108951 - DNA, 35 bp, Artificial Sequence
  Synthetic oligonucleotide
gcccgtacccctgcgtcccattactccccagtgtc

SEQ ID NO: 108952 - DNA, 35 bp, Artificial Sequence
  Synthetic oligonucleotide
gagccctcaccccttgtccgcgtaccgtgcccact

SEQ ID NO: 108953 - DNA, 36 bp, Artificial Sequence
  Synthetic oligonucleotide
gccgggggtggggtgggtggtgggcggcagtcctta

SEQ ID NO: 108954 - DNA, 35 bp, Artificial Sequence
  Synthetic oligonucleotide
atgccccttcccagagcgccgtttcctgtttaccc

SEQ ID NO: 108955 - DNA, 35 bp, Artificial Sequence
  Synthetic oligonucleotide
tgaccctccaccgttcccttggttctcccgcctgc

SEQ ID NO: 108956 - DNA, 36 bp, Artificial Sequence
  Synthetic oligonucleotide
gtgtcccgccgcctttccctgccctttggtcattca

SEQ ID NO: 108957 - DNA, 37 bp, Artificial Sequence
  Synthetic oligonucleotide
tgccaccccccgccctcgattacaaagtccctgtgga

SEQ ID NO: 108958 - DNA, 35 bp, Artificial Sequence
  Synthetic oligonucleotide
tgaccaggaccagatcctactcctttagcccttcc

SEQ ID NO: 108959 - DNA, 37 bp, Artificial Sequence
  Synthetic oligonucleotide
gaacgcgcaacgtgctcatcctccgctttccatccga

SEQ ID NO: 108960 - DNA, 35 bp, Artificial Sequence
  Synthetic oligonucleotide
tgacagttgcacattctgtttaggcctccccccat

SEQ ID NO: 108961 - DNA, 35 bp, Artificial Sequence
  Synthetic oligonucleotide
tcccccgccactccaccacatggccctgccgtact

SEQ ID NO: 108962 - DNA, 35 bp, Artificial Sequence
  Synthetic oligonucleotide
atccgcccccgattttcttctcccggtctgttagc

SEQ ID NO: 108963 - DNA, 35 bp, Artificial Sequence
  Synthetic oligonucleotide
gcccgacgtgactgtctgtcccccgccctctcaca

SEQ ID NO: 108964 - DNA, 35 bp, Artificial Sequence
  Synthetic oligonucleotide
gacatagcatcagcgtaacccttccgccctcctga

SEQ ID NO: 108965 - DNA, 38 bp, Artificial Sequence
  Synthetic oligonucleotide
tagcattgcctgccctgcctcccatcactcacacttga

SEQ ID NO: 108966 - DNA, 35 bp, Artificial Sequence
  Synthetic oligonucleotide
gaaaagtgggaaggtgagaggtaaggagggcgtag

SEQ ID NO: 108967 - DNA, 35 bp, Artificial Sequence
  Synthetic oligonucleotide
gatgtgtcgagggtggtgggtgggtcaataggtgg

SEQ ID NO: 108968 - DNA, 35 bp, Artificial Sequence
  Synthetic oligonucleotide
acacaccacctaacatgttcgccgttcctctcttg

SEQ ID NO: 108969 - DNA, 35 bp, Artificial Sequence
  Synthetic oligonucleotide
gacacatctacatctgttgtgacccccttcttcac

SEQ ID NO: 108970 - DNA, 37 bp, Artificial Sequence
  Synthetic oligonucleotide
atgggtgagcaggggggggcggagggtaaggttggga

SEQ ID NO: 108971 - DNA, 36 bp, Artificial Sequence
  Synthetic oligonucleotide
acgaaccgctcacctcttatcctgtctgcacctcga

SEQ ID NO: 108972 - DNA, 35 bp, Artificial Sequence
  Synthetic oligonucleotide
atccacctgcctccacacggtgccctacgattatc

SEQ ID NO: 108973 - DNA, 35 bp, Artificial Sequence
  Synthetic oligonucleotide
accaccccctgttgtatctgttgtatcccgatttc

SEQ ID NO: 108974 - DNA, 34 bp, Artificial Sequence
  Synthetic oligonucleotide
tatgcaacgcacttccctccatcgtactctctca

SEQ ID NO: 108975 - DNA, 36 bp, Artificial Sequence
  Synthetic oligonucleotide
atcgcccacgccgctccccccaaccggcccctccga

SEQ ID NO: 108976 - DNA, 31 bp, Artificial Sequence
  Synthetic oligonucleotide
gttgctgtcctaccttattgcgccccccccg

SEQ ID NO: 108977 - DNA, 35 bp, Artificial Sequence
  Synthetic oligonucleotide
gtcaacacgcccttcgtcactacgctattcttcgc

SEQ ID NO: 108978 - DNA, 35 bp, Artificial Sequence
  Synthetic oligonucleotide
ttggcgctctccatctttacgtgctgctctttcat

SEQ ID NO: 108979 - DNA, 35 bp, Artificial Sequence
  Synthetic oligonucleotide
tgagcaccatattcgctgttcaccgtcactcatcc

SEQ ID NO: 108980 - DNA, 35 bp, Artificial Sequence
  Synthetic oligonucleotide
tactccccggccctgactgtcaccctatggccctc

SEQ ID NO: 108981 - DNA, 37 bp, Artificial Sequence
  Synthetic oligonucleotide
atgtccccgttcctgactgatctcctcgttcgttcga

SEQ ID NO: 108982 - DNA, 35 bp, Artificial Sequence
  Synthetic oligonucleotide
cgactgccccccgttattgccagccgaactatgcc

SEQ ID NO: 108983 - DNA, 35 bp, Artificial Sequence
  Synthetic oligonucleotide
gtgcacccctatgccttatgtccgtgccccgaaaa

SEQ ID NO: 108984 - DNA, 36 bp, Artificial Sequence
  Synthetic oligonucleotide
aaccaccctccgctgatataacactcatctcgtaca

SEQ ID NO: 108985 - DNA, 35 bp, Artificial Sequence
  Synthetic oligonucleotide
gatgctggttcccctccgccccttttccctgaatg

SEQ ID NO: 108986 - DNA, 37 bp, Artificial Sequence
  Synthetic oligonucleotide
ttgccccgcccctgtccgtcgtctatgctttcactga

SEQ ID NO: 108987 - DNA, 36 bp, Artificial Sequence
  Synthetic oligonucleotide
tgctgtaccgcccagtcgctgccccatatcctctca

SEQ ID NO: 108988 - DNA, 35 bp, Artificial Sequence
  Synthetic oligonucleotide
tcagctgcctccccttttcgtctattgttgctctt

SEQ ID NO: 108989 - DNA, 35 bp, Artificial Sequence
  Synthetic oligonucleotide
agtccaccccaagtcgccatagctcaccccttcac

SEQ ID NO: 108990 - DNA, 35 bp, Artificial Sequence
  Synthetic oligonucleotide
tccctcacctccatgtataccgattccacctatac

SEQ ID NO: 108991 - DNA, 36 bp, Artificial Sequence
  Synthetic oligonucleotide
tgcccccccgactcggtctcgttccatagcaaacca

SEQ ID NO: 108992 - DNA, 36 bp, Artificial Sequence
  Synthetic oligonucleotide
gatgggcgggagttgggtgggttagacccttgctca

SEQ ID NO: 108993 - DNA, 35 bp, Artificial Sequence
  Synthetic oligonucleotide
tccccgcctcacggggttataaaccaccacctatc

SEQ ID NO: 108994 - DNA, 35 bp, Artificial Sequence
  Synthetic oligonucleotide
tttccacccaccaacgtgttctacccggcccacgc

SEQ ID NO: 108995 - DNA, 35 bp, Artificial Sequence
  Synthetic oligonucleotide
taatacagccgcagccgccatcgcgccccacctca

SEQ ID NO: 108996 - DNA, 35 bp, Artificial Sequence
  Synthetic oligonucleotide
gttgctcaacagatcgccgcctccgccctctatcc

SEQ ID NO: 108997 - DNA, 35 bp, Artificial Sequence
  Synthetic oligonucleotide
ttccgccgtgcccctctctgccctaagggttttac

SEQ ID NO: 108998 - DNA, 36 bp, Artificial Sequence
  Synthetic oligonucleotide
taacctacgcccgcttgtattcgctccctgcccgaa

SEQ ID NO: 108999 - DNA, 35 bp, Artificial Sequence
  Synthetic oligonucleotide
gcgacagtccctcgccgccatgttcagtccctcac

SEQ ID NO: 109000 - DNA, 37 bp, Artificial Sequence
  Synthetic oligonucleotide
gtcacgtagctgggcgggggggagcgggtatcgtgga

SEQ ID NO: 109001 - DNA, 37 bp, Artificial Sequence
  Synthetic oligonucleotide
aacgggggtgaaggggaaaatgagggcttagggggga

SEQ ID NO: 109002 - DNA, 36 bp, Artificial Sequence
  Synthetic oligonucleotide
attccaccaccgcatgcattgttctctactccttga

SEQ ID NO: 109003 - DNA, 35 bp, Artificial Sequence
  Synthetic oligonucleotide
tcaccaccacgatactgcttaactttcttgctttc

SEQ ID NO: 109004 - DNA, 36 bp, Artificial Sequence
  Synthetic oligonucleotide
gccacctcctcgcattcgtacatgcccatattctta

SEQ ID NO: 109005 - DNA, 35 bp, Artificial Sequence
  Synthetic oligonucleotide
acaccccctgctttagacgcccttacgacccacac

SEQ ID NO: 109006 - DNA, 37 bp, Artificial Sequence
  Synthetic oligonucleotide
tgggacgaatgacggagggagtggggtgaggcgggga

SEQ ID NO: 109007 - DNA, 36 bp, Artificial Sequence
  Synthetic oligonucleotide
gtccgtcccgcccccacttgctgctgcgccctctca

SEQ ID NO: 109008 - DNA, 35 bp, Artificial Sequence
  Synthetic oligonucleotide
acgcaccctcacgctgctcccactggctctcgcca

SEQ ID NO: 109009 - DNA, 35 bp, Artificial Sequence
  Synthetic oligonucleotide
acacgcctactcgcatcgctccatgaccccttggc

SEQ ID NO: 109010 - DNA, 35 bp, Artificial Sequence
  Synthetic oligonucleotide
gcccccctcacacgtccacatgccctcttctgcct

SEQ ID NO: 109011 - DNA, 36 bp, Artificial Sequence
  Synthetic oligonucleotide
tgcctcccctacgctggctttactactgtttccgta

SEQ ID NO: 109012 - DNA, 35 bp, Artificial Sequence
  Synthetic oligonucleotide
acttgccacccccgccttcacttgtacgatcaacc

SEQ ID NO: 109013 - DNA, 35 bp, Artificial Sequence
  Synthetic oligonucleotide
gcgtcaccacgccgccttggtttagccctcaccca

SEQ ID NO: 109014 - DNA, 35 bp, Artificial Sequence
  Synthetic oligonucleotide
tgtgccccttccatcgtgcgttatcgttccggttt

SEQ ID NO: 109015 - DNA, 35 bp, Artificial Sequence
  Synthetic oligonucleotide
gccccctcacatgtcaactccccgtaactcttgtt

SEQ ID NO: 109016 - DNA, 35 bp, Artificial Sequence
  Synthetic oligonucleotide
tgtccaccaactgccagttgtgacattccctcccc

SEQ ID NO: 109017 - DNA, 35 bp, Artificial Sequence
  Synthetic oligonucleotide
gtgccgacggttttcttgctgcctattcccttgct

SEQ ID NO: 109018 - DNA, 35 bp, Artificial Sequence
  Synthetic oligonucleotide
tgctcgcttgatcttggttctccgcccctctacgc

SEQ ID NO: 109019 - DNA, 35 bp, Artificial Sequence
  Synthetic oligonucleotide
gccgtcactccgcattttgttttcttcagtccctt

SEQ ID NO: 109020 - DNA, 35 bp, Artificial Sequence
  Synthetic oligonucleotide
accagcctcccatattccctgcgatcacgccaccg

SEQ ID NO: 109021 - DNA, 36 bp, Artificial Sequence
  Synthetic oligonucleotide
agtcccatcctgcttgctgtaattctccatgctcca

SEQ ID NO: 109022 - DNA, 36 bp, Artificial Sequence
  Synthetic oligonucleotide
atagggagggggagactgggcgggagggcaaagtga

SEQ ID NO: 109023 - DNA, 34 bp, Artificial Sequence
  Synthetic oligonucleotide
gtgccggggggggagaagggtggattcggagggt

SEQ ID NO: 109024 - DNA, 37 bp, Artificial Sequence
  Synthetic oligonucleotide
tatccccgccccccccttaggccatagtccttacgga

SEQ ID NO: 109025 - DNA, 35 bp, Artificial Sequence
  Synthetic oligonucleotide
gacgggccatccgctcccccatgttacattcatcc

SEQ ID NO: 109026 - DNA, 35 bp, Artificial Sequence
  Synthetic oligonucleotide
agtgtgacggagagggagtaggggacgtggatggg

SEQ ID NO: 109027 - DNA, 36 bp, Artificial Sequence
  Synthetic oligonucleotide
agcacggtcaccccccgcattgggccatcctcgcca

SEQ ID NO: 109028 - DNA, 35 bp, Artificial Sequence
  Synthetic oligonucleotide
tcccagccctacgtgaattgtcccgccgctggtcc

SEQ ID NO: 109029 - DNA, 35 bp, Artificial Sequence
  Synthetic oligonucleotide
ttacccttccgctgccctcctaagcgctcgttcat

SEQ ID NO: 109030 - DNA, 38 bp, Artificial Sequence
  Synthetic oligonucleotide
agacgtagtgacgggaagaagggccggaaaggggttga

SEQ ID NO: 109031 - DNA, 35 bp, Artificial Sequence
  Synthetic oligonucleotide
tgctcacccacgtggtactcatttccgttcatcac

SEQ ID NO: 109032 - DNA, 35 bp, Artificial Sequence
  Synthetic oligonucleotide
tgtccctccgtccagccccatgtctatattccctg

SEQ ID NO: 109033 - DNA, 35 bp, Artificial Sequence
  Synthetic oligonucleotide
tccgcctcagacattcagcagtcccttccaccgcc

SEQ ID NO: 109034 - DNA, 38 bp, Artificial Sequence
  Synthetic oligonucleotide
accgtagacggaggggggtggatagcaatgaggggtga

SEQ ID NO: 109035 - DNA, 36 bp, Artificial Sequence
  Synthetic oligonucleotide
gagggggtgacgggtgggaaggaatggggtgccaaa

SEQ ID NO: 109036 - DNA, 36 bp, Artificial Sequence
  Synthetic oligonucleotide
gagagtgggggtagggcgtgaaagggcaggagacga

SEQ ID NO: 109037 - DNA, 35 bp, Artificial Sequence
  Synthetic oligonucleotide
acccgccttgtgatccctgcccaactttctatcgc

SEQ ID NO: 109038 - DNA, 36 bp, Artificial Sequence
  Synthetic oligonucleotide
tccgactcccggtcccctgtttgattcttcgccaca

SEQ ID NO: 109039 - DNA, 36 bp, Artificial Sequence
  Synthetic oligonucleotide
gttgcccctcggctgtcgtcacaagccccctcacta

SEQ ID NO: 109040 - DNA, 35 bp, Artificial Sequence
  Synthetic oligonucleotide
tgtgagtcgatagccgtcgcttactatcccccctc

SEQ ID NO: 109041 - DNA, 35 bp, Artificial Sequence
  Synthetic oligonucleotide
accacccatctatgtgcctagtcccacacgcccat

SEQ ID NO: 109042 - DNA, 35 bp, Artificial Sequence
  Synthetic oligonucleotide
aaccgcaacatcacgttaagccgtcctgctccttt

SEQ ID NO: 109043 - DNA, 35 bp, Artificial Sequence
  Synthetic oligonucleotide
gtctcgccccccccaatgtcatcggagtcctgttt

SEQ ID NO: 109044 - DNA, 35 bp, Artificial Sequence
  Synthetic oligonucleotide
ttggacgccgccctgaccctctgccttacatcctc

SEQ ID NO: 109045 - DNA, 35 bp, Artificial Sequence
  Synthetic oligonucleotide
acacaccatctctgccgtttcttttttgtcaccca

SEQ ID NO: 109046 - DNA, 36 bp, Artificial Sequence
  Synthetic oligonucleotide
tagacacaacgccgtccccgcacaactcctcctcga

SEQ ID NO: 109047 - DNA, 35 bp, Artificial Sequence
  Synthetic oligonucleotide
tcccggtcccttactccatctgtgccttaccttgg

SEQ ID NO: 109048 - DNA, 35 bp, Artificial Sequence
  Synthetic oligonucleotide
ttccgccgctccccccatctttctgaaacagcgtt

SEQ ID NO: 109049 - DNA, 35 bp, Artificial Sequence
  Synthetic oligonucleotide
taatggggagggaggtgggcggtagtgggagtggg

SEQ ID NO: 109050 - DNA, 35 bp, Artificial Sequence
  Synthetic oligonucleotide
tccgacccgtatcgccctctatctagcctggacca

SEQ ID NO: 109051 - DNA, 35 bp, Artificial Sequence
  Synthetic oligonucleotide
tgtgacgctctgcccgcatttgcacatcccaccgc

SEQ ID NO: 109052 - DNA, 35 bp, Artificial Sequence
  Synthetic oligonucleotide
gtcctcccaatccctgtctattagcgcaccttttt

SEQ ID NO: 109053 - DNA, 36 bp, Artificial Sequence
  Synthetic oligonucleotide
agtatctctgcacccctagtttcttgttctttagta

SEQ ID NO: 109054 - DNA, 35 bp, Artificial Sequence
  Synthetic oligonucleotide
accccgccatacgccacgttttacacggttccttt

SEQ ID NO: 109055 - DNA, 36 bp, Artificial Sequence
  Synthetic oligonucleotide
gggagggtgggtgcttgtcgggaaaggggggaggga

SEQ ID NO: 109056 - DNA, 35 bp, Artificial Sequence
  Synthetic oligonucleotide
actgccttgcaatcccaacccctgccttactagtc

SEQ ID NO: 109057 - DNA, 36 bp, Artificial Sequence
  Synthetic oligonucleotide
tagccccccgactcatctggatcctcgcattcttta

SEQ ID NO: 109058 - DNA, 37 bp, Artificial Sequence
  Synthetic oligonucleotide
tcccacctccatggccctcatagagtccccaactgga

SEQ ID NO: 109059 - DNA, 37 bp, Artificial Sequence
  Synthetic oligonucleotide
atgcgccggccttgttcctattatctgccttcaccga

SEQ ID NO: 109060 - DNA, 35 bp, Artificial Sequence
  Synthetic oligonucleotide
tgaacgcagatgccacatttaacttcccgtcctgc

SEQ ID NO: 109061 - DNA, 35 bp, Artificial Sequence
  Synthetic oligonucleotide
tcccgaccacatcaagccatgttctactcctcctg

SEQ ID NO: 109062 - DNA, 35 bp, Artificial Sequence
  Synthetic oligonucleotide
tgccactccgctagccccaacctgcctgccgttta

SEQ ID NO: 109063 - DNA, 36 bp, Artificial Sequence
  Synthetic oligonucleotide
gatacagtcagcatgccgttgccccacccctccgca

SEQ ID NO: 109064 - DNA, 37 bp, Artificial Sequence
  Synthetic oligonucleotide
ttctgccgcgcaatcttgtcttcccctcgctgcccga

SEQ ID NO: 109065 - DNA, 35 bp, Artificial Sequence
  Synthetic oligonucleotide
atggagggttgcaggggggaagggcggatggacaa

SEQ ID NO: 109066 - DNA, 35 bp, Artificial Sequence
  Synthetic oligonucleotide
actccatccgggccgtctctttcgcgctgttgccc

SEQ ID NO: 109067 - DNA, 35 bp, Artificial Sequence
  Synthetic oligonucleotide
ttcaccgagatcgccccccctgcccaggtcctgac

SEQ ID NO: 109068 - DNA, 35 bp, Artificial Sequence
  Synthetic oligonucleotide
acgactcccgcacccattgttcttaagctcctatt

SEQ ID NO: 109069 - DNA, 35 bp, Artificial Sequence
  Synthetic oligonucleotide
aatatccagggcggtggagggacgggtggtggtct

SEQ ID NO: 109070 - DNA, 35 bp, Artificial Sequence
  Synthetic oligonucleotide
taccaccacattagattcgatacctgtgccccccg

SEQ ID NO: 109071 - DNA, 35 bp, Artificial Sequence
  Synthetic oligonucleotide
acacagtggctcatttgctcctccactcccctgct

SEQ ID NO: 109072 - DNA, 35 bp, Artificial Sequence
  Synthetic oligonucleotide
gtccaccgcatgtggtctccccgtagctctacccc

SEQ ID NO: 109073 - DNA, 31 bp, Artificial Sequence
  Synthetic oligonucleotide
tgtggcgcttatccgttcgtttttcaccatc

SEQ ID NO: 109074 - DNA, 35 bp, Artificial Sequence
  Synthetic oligonucleotide
ttcactcctccacgtgcgcctctgctttgcttcct

SEQ ID NO: 109075 - DNA, 36 bp, Artificial Sequence
  Synthetic oligonucleotide
accgcccctttccgtcggttcaaccatgcctgttca

SEQ ID NO: 109076 - DNA, 36 bp, Artificial Sequence
  Synthetic oligonucleotide
gcccccctccgcccattttaacgccgtctgaacgga

SEQ ID NO: 109077 - DNA, 35 bp, Artificial Sequence
  Synthetic oligonucleotide
gtgacggaacacggaggaaatagggagggctggta

SEQ ID NO: 109078 - DNA, 35 bp, Artificial Sequence
  Synthetic oligonucleotide
ttgcctctgcccatccccatgtacgcgcttttgca

SEQ ID NO: 109079 - DNA, 37 bp, Artificial Sequence
  Synthetic oligonucleotide
ctgtaccaccctgtcacccatcagatgttccgttcga

SEQ ID NO: 109080 - DNA, 32 bp, Artificial Sequence
  Synthetic oligonucleotide
gaaacgatcatggggagggaagatggaaggaa

SEQ ID NO: 109081 - DNA, 37 bp, Artificial Sequence
  Synthetic oligonucleotide
acccgcctcccccattcgcgctgactgctttggccga

SEQ ID NO: 109082 - DNA, 35 bp, Artificial Sequence
  Synthetic oligonucleotide
atactccccctcagctgttaccatagtctcacccc

SEQ ID NO: 109083 - DNA, 37 bp, Artificial Sequence
  Synthetic oligonucleotide
actgggggtggaggggaattgctaggtggtggtgcga

SEQ ID NO: 109084 - DNA, 35 bp, Artificial Sequence
  Synthetic oligonucleotide
tttgtccccgtcgtatctgtcctctttgctctgtc

SEQ ID NO: 109085 - DNA, 35 bp, Artificial Sequence
  Synthetic oligonucleotide
tattccaccgtacgttccttcaagggccccttttc

SEQ ID NO: 109086 - DNA, 35 bp, Artificial Sequence
  Synthetic oligonucleotide
agaaggggaggcatgggggaggggcgagcaacctg

SEQ ID NO: 109087 - DNA, 35 bp, Artificial Sequence
  Synthetic oligonucleotide
atcggacgccattcattgttgtttcccctgccgtc

SEQ ID NO: 109088 - DNA, 36 bp, Artificial Sequence
  Synthetic oligonucleotide
gaagtgggcgggaggaggacggggtagtttgaggga

SEQ ID NO: 109089 - DNA, 33 bp, Artificial Sequence
  Synthetic oligonucleotide
gccgttcgcgcccccattggtcccaccttctcc

SEQ ID NO: 109090 - DNA, 36 bp, Artificial Sequence
  Synthetic oligonucleotide
gcaccctcgctggtgtaccccaacgccccccctaca

SEQ ID NO: 109091 - DNA, 35 bp, Artificial Sequence
  Synthetic oligonucleotide
tactcgtgcattctctgttcgctccctcctccgac

SEQ ID NO: 109092 - DNA, 36 bp, Artificial Sequence
  Synthetic oligonucleotide
gacgctcgacgtgtgcacctccacttctctctccga

SEQ ID NO: 109093 - DNA, 35 bp, Artificial Sequence
  Synthetic oligonucleotide
gtgggaagggagagacgtgagtgagtaggggcggg

SEQ ID NO: 109094 - DNA, 35 bp, Artificial Sequence
  Synthetic oligonucleotide
agtacacctgctgattcctacacaatgcccccccg

SEQ ID NO: 109095 - DNA, 35 bp, Artificial Sequence
  Synthetic oligonucleotide
accacccgcctctcgacccgattcgcccgccgact

SEQ ID NO: 109096 - DNA, 35 bp, Artificial Sequence
  Synthetic oligonucleotide
tctccgccgccccttcaagtatcgcagcaagcctt

SEQ ID NO: 109097 - DNA, 35 bp, Artificial Sequence
  Synthetic oligonucleotide
atcccgcctcgcccgccgctgtacctgtgacttgg

SEQ ID NO: 109098 - DNA, 35 bp, Artificial Sequence
  Synthetic oligonucleotide
ttgtcacgcactcacccgccactctctgccgcact

SEQ ID NO: 109099 - DNA, 37 bp, Artificial Sequence
  Synthetic oligonucleotide
gacccacccgcctcgcccgtgccaaagtacgtttgga

SEQ ID NO: 109100 - DNA, 35 bp, Artificial Sequence
  Synthetic oligonucleotide
atttgcgccgccacttcatcttgctccgttatagt

SEQ ID NO: 109101 - DNA, 35 bp, Artificial Sequence
  Synthetic oligonucleotide
tagggacagggagggggggagctagtgggtgtgga

SEQ ID NO: 109102 - DNA, 35 bp, Artificial Sequence
  Synthetic oligonucleotide
tttcacccgcctgtcttgcccgtaatgctcctcac

SEQ ID NO: 109103 - DNA, 30 bp, Artificial Sequence
  Synthetic oligonucleotide
gcaatgaagcccattcctcctgttcccgcc

SEQ ID NO: 109104 - DNA, 35 bp, Artificial Sequence
  Synthetic oligonucleotide
atcccacatcatataggctctttggcccctgttcc

SEQ ID NO: 109105 - DNA, 31 bp, Artificial Sequence
  Synthetic oligonucleotide
aaccctgcccgataaatgctacccgcccaaa

SEQ ID NO: 109106 - DNA, 35 bp, Artificial Sequence
  Synthetic oligonucleotide
acccacttccatcttcggtcacctagcctttacgg

SEQ ID NO: 109107 - DNA, 35 bp, Artificial Sequence
  Synthetic oligonucleotide
ttccccgccaccttctgagttcgctacgccacacc

SEQ ID NO: 109108 - DNA, 35 bp, Artificial Sequence
  Synthetic oligonucleotide
atcgggcacgtgcaccccgctctcacgttacacgc

SEQ ID NO: 109109 - DNA, 35 bp, Artificial Sequence
  Synthetic oligonucleotide
tcccccgtacctgaacccatacactgctattcgcc

SEQ ID NO: 109110 - DNA, 35 bp, Artificial Sequence
  Synthetic oligonucleotide
ggatacgaagggaacgggggaggggaggaaatggg

SEQ ID NO: 109111 - DNA, 35 bp, Artificial Sequence
  Synthetic oligonucleotide
gcgcacaccgtcccccgttctccctgctactgtca

SEQ ID NO: 109112 - DNA, 35 bp, Artificial Sequence
  Synthetic oligonucleotide
accacacctccatttcttgactcccgccattagtg

SEQ ID NO: 109113 - DNA, 35 bp, Artificial Sequence
  Synthetic oligonucleotide
agctgccccacattgccaccagcgaccgctactac

SEQ ID NO: 109114 - DNA, 35 bp, Artificial Sequence
  Synthetic oligonucleotide
tgcttacacccgtcaccttcccgcttcgcacgtgc

SEQ ID NO: 109115 - DNA, 35 bp, Artificial Sequence
  Synthetic oligonucleotide
agttacccgccactggttctctaaatgctcgcctc

SEQ ID NO: 109116 - DNA, 35 bp, Artificial Sequence
  Synthetic oligonucleotide
tgccggaagcaatccatgtccctcccccccaggtc

SEQ ID NO: 109117 - DNA, 35 bp, Artificial Sequence
  Synthetic oligonucleotide
tccgtgagctcccggtgcttctgccggttccttcc

SEQ ID NO: 109118 - DNA, 36 bp, Artificial Sequence
  Synthetic oligonucleotide
gtgagggcgggagggcttttcttatctgggtgacga

SEQ ID NO: 109119 - DNA, 37 bp, Artificial Sequence
  Synthetic oligonucleotide
tgcgggggggaatggggacgaaggtggaccaggcgga

SEQ ID NO: 109120 - DNA, 35 bp, Artificial Sequence
  Synthetic oligonucleotide
gtgtcacgcatcttgtcgatattccttccccttct

SEQ ID NO: 109121 - DNA, 33 bp, Artificial Sequence
  Synthetic oligonucleotide
gactaccccaccacgccatcatcgctatcgtat

SEQ ID NO: 109122 - DNA, 35 bp, Artificial Sequence
  Synthetic oligonucleotide
gacagggacatggggtgcagggcggggaggatgga

SEQ ID NO: 109123 - DNA, 38 bp, Artificial Sequence
  Synthetic oligonucleotide
gagaccccgccctgtccgtgcctccctgttcttgatga

SEQ ID NO: 109124 - DNA, 35 bp, Artificial Sequence
  Synthetic oligonucleotide
tcgtggccgcgggctcttcgttttgctccctgttc

SEQ ID NO: 109125 - DNA, 35 bp, Artificial Sequence
  Synthetic oligonucleotide
gtagcactgtcaagtcttcgtcgttccctgctgct

SEQ ID NO: 109126 - DNA, 36 bp, Artificial Sequence
  Synthetic oligonucleotide
tctgcccctcctgccgaccaccaagtgccctttcta

SEQ ID NO: 109127 - DNA, 35 bp, Artificial Sequence
  Synthetic oligonucleotide
atcgtcctccacgccctttgtctatctgattggcc

SEQ ID NO: 109128 - DNA, 36 bp, Artificial Sequence
  Synthetic oligonucleotide
gatccctcctcagctatatatcttgcgctccacccg

SEQ ID NO: 109129 - DNA, 37 bp, Artificial Sequence
  Synthetic oligonucleotide
gacgttccagagagggggagaaaggcgggcggtggga

SEQ ID NO: 109130 - DNA, 35 bp, Artificial Sequence
  Synthetic oligonucleotide
agcccacccagttagtcgccaccacgcttccgcac

SEQ ID NO: 109131 - DNA, 36 bp, Artificial Sequence
  Synthetic oligonucleotide
accgacaccgctcttctgcgaaatgcccaccaccaa

SEQ ID NO: 109132 - DNA, 35 bp, Artificial Sequence
  Synthetic oligonucleotide
tccatcacctgatttttgttcatccgccgcactgc

SEQ ID NO: 109133 - DNA, 35 bp, Artificial Sequence
  Synthetic oligonucleotide
tgtttctccgccccccgtacgtgctttgccccgct

SEQ ID NO: 109134 - DNA, 35 bp, Artificial Sequence
  Synthetic oligonucleotide
atgtgccccccctccttctgttctgcacggaaatc

SEQ ID NO: 109135 - DNA, 37 bp, Artificial Sequence
  Synthetic oligonucleotide
tatcggggtgattatgggggtgggcccttcccgggga

SEQ ID NO: 109136 - DNA, 37 bp, Artificial Sequence
  Synthetic oligonucleotide
tgccccatgcgcctgctcccaataccctcctgctgga

SEQ ID NO: 109137 - DNA, 38 bp, Artificial Sequence
  Synthetic oligonucleotide
gacgaccaggggggaggagtgggggaatcggagtgtga

SEQ ID NO: 109138 - DNA, 35 bp, Artificial Sequence
  Synthetic oligonucleotide
gaccaacatctctctgtcaagcccctggtaactcc

SEQ ID NO: 109139 - DNA, 35 bp, Artificial Sequence
  Synthetic oligonucleotide
acaacgcccctgctcgtccacgacagccatttttc

SEQ ID NO: 109140 - DNA, 35 bp, Artificial Sequence
  Synthetic oligonucleotide
gcgcatgcagttcgcgcctgcccctttttacgccg

SEQ ID NO: 109141 - DNA, 37 bp, Artificial Sequence
  Synthetic oligonucleotide
tccctccctccacgtgtgccttaacctacggttccga

SEQ ID NO: 109142 - DNA, 35 bp, Artificial Sequence
  Synthetic oligonucleotide
gctgcactccatcctatgacacacctgtgccctgc

SEQ ID NO: 109143 - DNA, 37 bp, Artificial Sequence
  Synthetic oligonucleotide
tgccccaagtcagtccctctaatgtacgccctctcga

SEQ ID NO: 109144 - DNA, 35 bp, Artificial Sequence
  Synthetic oligonucleotide
gacgctgcggtcagatcttcttcgccggcccctca

SEQ ID NO: 109145 - DNA, 35 bp, Artificial Sequence
  Synthetic oligonucleotide
atccacccatcctccgcccccgaccgtgcttccac

SEQ ID NO: 109146 - DNA, 35 bp, Artificial Sequence
  Synthetic oligonucleotide
acctgcccgactgctccgccccgaccgcgcatcac

SEQ ID NO: 109147 - DNA, 35 bp, Artificial Sequence
  Synthetic oligonucleotide
tttacgtccagtccgtcttccctccttttcccgtg

SEQ ID NO: 109148 - DNA, 35 bp, Artificial Sequence
  Synthetic oligonucleotide
gatcgccctcattgctctttcgttgtttacgtaat

SEQ ID NO: 109149 - DNA, 35 bp, Artificial Sequence
  Synthetic oligonucleotide
cccaccccgtcctccattcgtttggcctgattact

SEQ ID NO: 109150 - DNA, 37 bp, Artificial Sequence
  Synthetic oligonucleotide
ttgagggtgagggtgggcgggcaaggacaggggacga

SEQ ID NO: 109151 - DNA, 37 bp, Artificial Sequence
  Synthetic oligonucleotide
tgagggtgggttcggaagggcgaggaggaaagggtga

SEQ ID NO: 109152 - DNA, 34 bp, Artificial Sequence
  Synthetic oligonucleotide
gagaggggggaggggatagggttagggtatgtac

SEQ ID NO: 109153 - DNA, 35 bp, Artificial Sequence
  Synthetic oligonucleotide
atcgtctcccacctgctgccctgttaatacccttt

SEQ ID NO: 109154 - DNA, 37 bp, Artificial Sequence
  Synthetic oligonucleotide
gccgactcactgccttatcgtacactctatctcttga

SEQ ID NO: 109155 - DNA, 35 bp, Artificial Sequence
  Synthetic oligonucleotide
gacccgggaggggaggggatggtggggctaggtta

SEQ ID NO: 109156 - DNA, 35 bp, Artificial Sequence
  Synthetic oligonucleotide
gccagccgcctcgtccgccttgactgtctcatccc

SEQ ID NO: 109157 - DNA, 35 bp, Artificial Sequence
  Synthetic oligonucleotide
accgccccgatagtccgtgatggtcgccccgcctc

SEQ ID NO: 109158 - DNA, 35 bp, Artificial Sequence
  Synthetic oligonucleotide
tcccaccccggatctccccgccgagaagttctcgt

SEQ ID NO: 109159 - DNA, 35 bp, Artificial Sequence
  Synthetic oligonucleotide
ttgtaccacccgactcgcaccgcctcggtccgaaa

SEQ ID NO: 109160 - DNA, 35 bp, Artificial Sequence
  Synthetic oligonucleotide
gtactgcccccccccagtgacccatggttttcccc

SEQ ID NO: 109161 - DNA, 35 bp, Artificial Sequence
  Synthetic oligonucleotide
tgcctccccaacttgcattaacgccctcatatccg

SEQ ID NO: 109162 - DNA, 35 bp, Artificial Sequence
  Synthetic oligonucleotide
ggtcgacgccacactaagtcccgactcgtccctcc

SEQ ID NO: 109163 - DNA, 37 bp, Artificial Sequence
  Synthetic oligonucleotide
gacacccgtccggctatcggcccgcctgcctccctga

SEQ ID NO: 109164 - DNA, 36 bp, Artificial Sequence
  Synthetic oligonucleotide
gttagggggaggaggggacgggagggcctgccggaa

SEQ ID NO: 109165 - DNA, 35 bp, Artificial Sequence
  Synthetic oligonucleotide
gacggaaaggtgggcaatttgggtgaacggggggg

SEQ ID NO: 109166 - DNA, 36 bp, Artificial Sequence
  Synthetic oligonucleotide
tgccgatgccgctccatccattcccttaccgagcca

SEQ ID NO: 109167 - DNA, 35 bp, Artificial Sequence
  Synthetic oligonucleotide
gaacctcccgatctatctcgcgtatcgtgccactc

SEQ ID NO: 109168 - DNA, 35 bp, Artificial Sequence
  Synthetic oligonucleotide
tgactacatctgctactgttccctgttccgttacg

SEQ ID NO: 109169 - DNA, 36 bp, Artificial Sequence
  Synthetic oligonucleotide
tccgtacccgccgaggctgtcacatcatggccctca

SEQ ID NO: 109170 - DNA, 36 bp, Artificial Sequence
  Synthetic oligonucleotide
ttcccgacaccctcctatgtacacaactcactcgta

SEQ ID NO: 109171 - DNA, 35 bp, Artificial Sequence
  Synthetic oligonucleotide
gctagcccatgcaccatcgtactgtcttactcgct

SEQ ID NO: 109172 - DNA, 36 bp, Artificial Sequence
  Synthetic oligonucleotide
gactcgccaatttccgttacgtccgcccctacgcta

SEQ ID NO: 109173 - DNA, 37 bp, Artificial Sequence
  Synthetic oligonucleotide
tcacccgccggttttaccttgaccaattgccccctga

SEQ ID NO: 109174 - DNA, 36 bp, Artificial Sequence
  Synthetic oligonucleotide
tacgtgcccctgctctgccgtgcctaactttctcga

SEQ ID NO: 109175 - DNA, 35 bp, Artificial Sequence
  Synthetic oligonucleotide
tccgcctgtcgcgatctccttgtaactcttcgccc

SEQ ID NO: 109176 - DNA, 37 bp, Artificial Sequence
  Synthetic oligonucleotide
tcccgcccctctctgtaccgtattgttatccatgtga

SEQ ID NO: 109177 - DNA, 35 bp, Artificial Sequence
  Synthetic oligonucleotide
gatccacatccgtctttggttcacccgcccttgtt

SEQ ID NO: 109178 - DNA, 35 bp, Artificial Sequence
  Synthetic oligonucleotide
gcaacacactgtttgcgtactcttccgtcccacct

SEQ ID NO: 109179 - DNA, 35 bp, Artificial Sequence
  Synthetic oligonucleotide
actcactcaccactcgatatgccacggatccctga

SEQ ID NO: 109180 - DNA, 36 bp, Artificial Sequence
  Synthetic oligonucleotide
gatcactcgcaatccgccattagtactgcccccata

SEQ ID NO: 109181 - DNA, 35 bp, Artificial Sequence
  Synthetic oligonucleotide
gaacaccgccggcccccgcccaaaccccgctggta

SEQ ID NO: 109182 - DNA, 35 bp, Artificial Sequence
  Synthetic oligonucleotide
agctgagcacatagtctcaccgaactgcctccgcc

SEQ ID NO: 109183 - DNA, 35 bp, Artificial Sequence
  Synthetic oligonucleotide
gctggtcagatcttcccatttccccggtccgtgtc

SEQ ID NO: 109184 - DNA, 35 bp, Artificial Sequence
  Synthetic oligonucleotide
tcatgcgacagcctctctgtctcctccgtgctccg

SEQ ID NO: 109185 - DNA, 38 bp, Artificial Sequence
  Synthetic oligonucleotide
ggggggagggacatgtggggagatgggcacgaggctga

SEQ ID NO: 109186 - DNA, 35 bp, Artificial Sequence
  Synthetic oligonucleotide
aaacatggagagagggtggggcacgggtggtaatt

SEQ ID NO: 109187 - DNA, 36 bp, Artificial Sequence
  Synthetic oligonucleotide
tcccctcgcaccatgtaacttccatctcgtaaacga

SEQ ID NO: 109188 - DNA, 36 bp, Artificial Sequence
  Synthetic oligonucleotide
gagccccatcctgtaatttctcgtgccacgctgcta

SEQ ID NO: 109189 - DNA, 36 bp, Artificial Sequence
  Synthetic oligonucleotide
tatgaccccagttgatactaatgcccgccactccca

SEQ ID NO: 109190 - DNA, 36 bp, Artificial Sequence
  Synthetic oligonucleotide
acgtggcccattgatactgcacccccgcttccacga

SEQ ID NO: 109191 - DNA, 35 bp, Artificial Sequence
  Synthetic oligonucleotide
taccaccgccaaaggtacagttgcttcccctcctt

SEQ ID NO: 109192 - DNA, 34 bp, Artificial Sequence
  Synthetic oligonucleotide
gccatcattcgttcacaccgccacactcgggctc

SEQ ID NO: 109193 - DNA, 35 bp, Artificial Sequence
  Synthetic oligonucleotide
ttgtgacacactcggtgtaaactgttccatctctc

SEQ ID NO: 109194 - DNA, 35 bp, Artificial Sequence
  Synthetic oligonucleotide
tgtgccgtgtatagctgtcctttcgcgtttctgtc

SEQ ID NO: 109195 - DNA, 35 bp, Artificial Sequence
  Synthetic oligonucleotide
gatccgggagggcatgggagggctattgtgacagt

SEQ ID NO: 109196 - DNA, 37 bp, Artificial Sequence
  Synthetic oligonucleotide
ttaccgcccccgccgccatgactgccccgttttttga

SEQ ID NO: 109197 - DNA, 34 bp, Artificial Sequence
  Synthetic oligonucleotide
acacccatgccaccatcctgattttgtttatgta

SEQ ID NO: 109198 - DNA, 35 bp, Artificial Sequence
  Synthetic oligonucleotide
accatcacttcccctgagcgatcaggacgctcccc

SEQ ID NO: 109199 - DNA, 35 bp, Artificial Sequence
  Synthetic oligonucleotide
acactgcccaccggccttgactgcccctacccccg

SEQ ID NO: 109200 - DNA, 35 bp, Artificial Sequence
  Synthetic oligonucleotide
gttggctagggaggaggggtcgggcggagataggg

SEQ ID NO: 109201 - DNA, 36 bp, Artificial Sequence
  Synthetic oligonucleotide
taggggaggaatggggcgagataaggagggataaca

SEQ ID NO: 109202 - DNA, 36 bp, Artificial Sequence
  Synthetic oligonucleotide
tgcccattcgcctgttgcccttgtctcgtccataaa

SEQ ID NO: 109203 - DNA, 37 bp, Artificial Sequence
  Synthetic oligonucleotide
gacggtaaggcgggaagggtagggtgggagggcagga

SEQ ID NO: 109204 - DNA, 35 bp, Artificial Sequence
  Synthetic oligonucleotide
tccggactcgctcttacatggaccctctcgcttcc

SEQ ID NO: 109205 - DNA, 35 bp, Artificial Sequence
  Synthetic oligonucleotide
gaaccgcccaccgtgccgctaatccaggatcttct

SEQ ID NO: 109206 - DNA, 35 bp, Artificial Sequence
  Synthetic oligonucleotide
tgtgagcgcacttagtcccgtacttgcctccctca

SEQ ID NO: 109207 - DNA, 35 bp, Artificial Sequence
  Synthetic oligonucleotide
tcaacgagcgatcgcactgccaccaacccctttcg

SEQ ID NO: 109208 - DNA, 35 bp, Artificial Sequence
  Synthetic oligonucleotide
tcactggccgtccgtcatacacccgcccccttgta

SEQ ID NO: 109209 - DNA, 35 bp, Artificial Sequence
  Synthetic oligonucleotide
ttgacgtgacagccatccgcgctgccccccgcctc

SEQ ID NO: 109210 - DNA, 37 bp, Artificial Sequence
  Synthetic oligonucleotide
aaaggggcgagcggggggagggccgtcacaaagggga

SEQ ID NO: 109211 - DNA, 37 bp, Artificial Sequence
  Synthetic oligonucleotide
gaatgggaggggaatggtaggggtctcgcactgggga

SEQ ID NO: 109212 - DNA, 35 bp, Artificial Sequence
  Synthetic oligonucleotide
ggtcgctcagtcgcattcgtttctgttccatccat

SEQ ID NO: 109213 - DNA, 36 bp, Artificial Sequence
  Synthetic oligonucleotide
gggaccacgccacattgaagctccctgtcccctcaa

SEQ ID NO: 109214 - DNA, 35 bp, Artificial Sequence
  Synthetic oligonucleotide
tcagccaccttctgccacatctgcggacccattgc

SEQ ID NO: 109215 - DNA, 35 bp, Artificial Sequence
  Synthetic oligonucleotide
tactccctccggcccatatacacctcaggtccctg

SEQ ID NO: 109216 - DNA, 35 bp, Artificial Sequence
  Synthetic oligonucleotide
acccaccccgaccaaacttgttgcacccacgcttc

SEQ ID NO: 109217 - DNA, 35 bp, Artificial Sequence
  Synthetic oligonucleotide
gtgtgctcagctagtcactcgtctcgctcctggtc

SEQ ID NO: 109218 - DNA, 35 bp, Artificial Sequence
  Synthetic oligonucleotide
gatcacccgcaacacgctacaccaccgacgcatac

SEQ ID NO: 109219 - DNA, 35 bp, Artificial Sequence
  Synthetic oligonucleotide
acgacaacaccttgccaatcgcccttatctgccgc

SEQ ID NO: 109220 - DNA, 35 bp, Artificial Sequence
  Synthetic oligonucleotide
ttcacggggaatcagggggacaaaaagggaggggc

SEQ ID NO: 109221 - DNA, 35 bp, Artificial Sequence
  Synthetic oligonucleotide
ttcacacccgcccgaacgtagacgcctcgattatc

SEQ ID NO: 109222 - DNA, 35 bp, Artificial Sequence
  Synthetic oligonucleotide
atagccgacgcccccccagcgtccaagattccctc

SEQ ID NO: 109223 - DNA, 35 bp, Artificial Sequence
  Synthetic oligonucleotide
tccatctcgccacgttggcaccgctttcgcatctc

SEQ ID NO: 109224 - DNA, 35 bp, Artificial Sequence
  Synthetic oligonucleotide
tacaccgaccacgactccccctacacacatgcgac

SEQ ID NO: 109225 - DNA, 35 bp, Artificial Sequence
  Synthetic oligonucleotide
gatccccgcccatcgcgctagtgccttaacctccg

SEQ ID NO: 109226 - DNA, 36 bp, Artificial Sequence
  Synthetic oligonucleotide
aagggcgaagccagccgtttctcgttcccccgttga

SEQ ID NO: 109227 - DNA, 38 bp, Artificial Sequence
  Synthetic oligonucleotide
gcacgcgtgccgcagctgccttcctgaacctcttttga

SEQ ID NO: 109228 - DNA, 35 bp, Artificial Sequence
  Synthetic oligonucleotide
gagcgcctccgcgtagtccttccctgttagttcca

SEQ ID NO: 109229 - DNA, 35 bp, Artificial Sequence
  Synthetic oligonucleotide
gagggcctggctcattgggcctcccccactttttt

SEQ ID NO: 109230 - DNA, 37 bp, Artificial Sequence
  Synthetic oligonucleotide
gggtcaaaaagcgggtggaggtagggcgggcggggga

SEQ ID NO: 109231 - DNA, 35 bp, Artificial Sequence
  Synthetic oligonucleotide
gagagcgcaccaaccctgatatcaactgtcccccg

SEQ ID NO: 109232 - DNA, 35 bp, Artificial Sequence
  Synthetic oligonucleotide
gcccgcagtctccgccgccttatagcccaacccgt

SEQ ID NO: 109233 - DNA, 35 bp, Artificial Sequence
  Synthetic oligonucleotide
tccacacattgccctttgagtcttgtcttccatac

SEQ ID NO: 109234 - DNA, 35 bp, Artificial Sequence
  Synthetic oligonucleotide
gtctgcccctatgcccttttttggccacatacctt

SEQ ID NO: 109235 - DNA, 36 bp, Artificial Sequence
  Synthetic oligonucleotide
atgtcacggctcccgatccgctctacctactcagta

SEQ ID NO: 109236 - DNA, 35 bp, Artificial Sequence
  Synthetic oligonucleotide
gtcctacctctgaatggcaccaccctctcttgctc

SEQ ID NO: 109237 - DNA, 35 bp, Artificial Sequence
  Synthetic oligonucleotide
aacaccaaccgtactaatgtccctcatgcactgcc

SEQ ID NO: 109238 - DNA, 35 bp, Artificial Sequence
  Synthetic oligonucleotide
ttgccgtccgagcggtcctccctcagtctatccac

SEQ ID NO: 109239 - DNA, 35 bp, Artificial Sequence
  Synthetic oligonucleotide
accaaccccgttccatcgatctctcaagactacgc

SEQ ID NO: 109240 - DNA, 38 bp, Artificial Sequence
  Synthetic oligonucleotide
ggataggggggaagggctcgggagggagaacggattga

SEQ ID NO: 109241 - DNA, 36 bp, Artificial Sequence
  Synthetic oligonucleotide
ttgccgaatccatgacatgtcgccccctccacccca

SEQ ID NO: 109242 - DNA, 35 bp, Artificial Sequence
  Synthetic oligonucleotide
atcgcctctgaagcgtacatcaccgcaactccgcc

SEQ ID NO: 109243 - DNA, 35 bp, Artificial Sequence
  Synthetic oligonucleotide
agcccaccactctgctgagcatcacctgcgcctcc

SEQ ID NO: 109244 - DNA, 35 bp, Artificial Sequence
  Synthetic oligonucleotide
actcgccctctcaccgctgccgtcgttggtccctt

SEQ ID NO: 109245 - DNA, 35 bp, Artificial Sequence
  Synthetic oligonucleotide
gatcgcccccacatctgtagaacgggtccccgcct

SEQ ID NO: 109246 - DNA, 35 bp, Artificial Sequence
  Synthetic oligonucleotide
gacgatcacccgcccatacgcgtacacagcacctg

SEQ ID NO: 109247 - DNA, 35 bp, Artificial Sequence
  Synthetic oligonucleotide
aacacgcacgccccttcagctcactgctgcccccg

SEQ ID NO: 109248 - DNA, 35 bp, Artificial Sequence
  Synthetic oligonucleotide
aacaacatctgtccgacgtcgtctcaccttctctg

SEQ ID NO: 109249 - DNA, 35 bp, Artificial Sequence
  Synthetic oligonucleotide
ttcagagcccctcgtgctaactcgccatatctcgc

SEQ ID NO: 109250 - DNA, 38 bp, Artificial Sequence
  Synthetic oligonucleotide
gatggacagggttcgggagggagggtgcacggggatga

SEQ ID NO: 109251 - DNA, 35 bp, Artificial Sequence
  Synthetic oligonucleotide
ttccgattcccgtccgtctgcccggccttcgcccc

SEQ ID NO: 109252 - DNA, 35 bp, Artificial Sequence
  Synthetic oligonucleotide
ttaacgccgtgcgttcacctgccctatcaacctca

SEQ ID NO: 109253 - DNA, 36 bp, Artificial Sequence
  Synthetic oligonucleotide
cccaccgcccattgctagttccctcgccttacctga

SEQ ID NO: 109254 - DNA, 35 bp, Artificial Sequence
  Synthetic oligonucleotide
tccgttccctgccctggtcgtgttcccgttaccgt

SEQ ID NO: 109255 - DNA, 35 bp, Artificial Sequence
  Synthetic oligonucleotide
tgtggggagggaggagtgggtcgcaaagcggagtg

SEQ ID NO: 109256 - DNA, 35 bp, Artificial Sequence
  Synthetic oligonucleotide
accgcccctccacgccgaaatttgccatacgcctg

SEQ ID NO: 109257 - DNA, 37 bp, Artificial Sequence
  Synthetic oligonucleotide
atccacccgcccatctgcatggagcccactaacctga

SEQ ID NO: 109258 - DNA, 35 bp, Artificial Sequence
  Synthetic oligonucleotide
tccgcccctgactgccgacgtttcgatccttggtc

SEQ ID NO: 109259 - DNA, 37 bp, Artificial Sequence
  Synthetic oligonucleotide
acaccatccgccctaggttccttacgtcgctcaacga

SEQ ID NO: 109260 - DNA, 36 bp, Artificial Sequence
  Synthetic oligonucleotide
agaggagagggaaagagagggattggcggacgggga

SEQ ID NO: 109261 - DNA, 35 bp, Artificial Sequence
  Synthetic oligonucleotide
gaacgctactgcccgtgcccgctgtccgccccatc

SEQ ID NO: 109262 - DNA, 35 bp, Artificial Sequence
  Synthetic oligonucleotide
gtacgccactgataacccttacgttcaccaccttg

SEQ ID NO: 109263 - DNA, 37 bp, Artificial Sequence
  Synthetic oligonucleotide
accaggccgcaagtaattagccccctctccacccgga

SEQ ID NO: 109264 - DNA, 35 bp, Artificial Sequence
  Synthetic oligonucleotide
tacttgcgcccggccacgcacatctcggttcctcc

SEQ ID NO: 109265 - DNA, 35 bp, Artificial Sequence
  Synthetic oligonucleotide
ttagcgcggacctctccgaccattacgtgccttcc

SEQ ID NO: 109266 - DNA, 35 bp, Artificial Sequence
  Synthetic oligonucleotide
tcgccgtgcctcgcctctctacacccaccggtttc

SEQ ID NO: 109267 - DNA, 35 bp, Artificial Sequence
  Synthetic oligonucleotide
gtgccaccctcacctcctgaaatgctttaacatcg

SEQ ID NO: 109268 - DNA, 35 bp, Artificial Sequence
  Synthetic oligonucleotide
acccgcaccgacctttgcaccatacccatccgcgg

SEQ ID NO: 109269 - DNA, 35 bp, Artificial Sequence
  Synthetic oligonucleotide
ctgacccgcctgcaggtacctcccacacacgcaat

SEQ ID NO: 109270 - DNA, 35 bp, Artificial Sequence
  Synthetic oligonucleotide
tgcactttcggtcatcgccctacctttactattgc

SEQ ID NO: 109271 - DNA, 35 bp, Artificial Sequence
  Synthetic oligonucleotide
gccgacttgccctttgtctgccgctcttaatctcg

SEQ ID NO: 109272 - DNA, 35 bp, Artificial Sequence
  Synthetic oligonucleotide
acgccaccccaagcccttgtcgatcccttcccttg

SEQ ID NO: 109273 - DNA, 35 bp, Artificial Sequence
  Synthetic oligonucleotide
tttacacccgccgtctctctccgcacattgtcgcg

SEQ ID NO: 109274 - DNA, 35 bp, Artificial Sequence
  Synthetic oligonucleotide
atcaccatcgctggaccgtctcattcatctctgcc

SEQ ID NO: 109275 - DNA, 35 bp, Artificial Sequence
  Synthetic oligonucleotide
tctgcctccctggaattgagtcttctccttcgcca

SEQ ID NO: 109276 - DNA, 35 bp, Artificial Sequence
  Synthetic oligonucleotide
acctacgccgtctctggtccatctcatcgcacgtt

SEQ ID NO: 109277 - DNA, 35 bp, Artificial Sequence
  Synthetic oligonucleotide
gcgatcaaagggggtgaagggcggaggagtaagga

SEQ ID NO: 109278 - DNA, 35 bp, Artificial Sequence
  Synthetic oligonucleotide
atggccgtcaccgctgcgctaacgttctgtccccc

SEQ ID NO: 109279 - DNA, 35 bp, Artificial Sequence
  Synthetic oligonucleotide
tgtcagtcccaccctgtatttgccgtcacgtcctc

SEQ ID NO: 109280 - DNA, 35 bp, Artificial Sequence
  Synthetic oligonucleotide
gccctcctctacatgtgtacgtcactgtatctctc

SEQ ID NO: 109281 - DNA, 35 bp, Artificial Sequence
  Synthetic oligonucleotide
ggacaccgcgcagctcccatatatccgccccgcct

SEQ ID NO: 109282 - DNA, 35 bp, Artificial Sequence
  Synthetic oligonucleotide
tgcgccatccttccatgtcccgctcccttcgaagt

SEQ ID NO: 109283 - DNA, 35 bp, Artificial Sequence
  Synthetic oligonucleotide
aactcgccagttgcacgcgatttcactgcctctat

SEQ ID NO: 109284 - DNA, 35 bp, Artificial Sequence
  Synthetic oligonucleotide
tcaccaccctgtcccggatcccatgttgacactct

SEQ ID NO: 109285 - DNA, 35 bp, Artificial Sequence
  Synthetic oligonucleotide
acataccgagacagcaccatcttgtcacgttctct

SEQ ID NO: 109286 - DNA, 36 bp, Artificial Sequence
  Synthetic oligonucleotide
tgatcccgccagccgttttttcgactcactctttca

SEQ ID NO: 109287 - DNA, 35 bp, Artificial Sequence
  Synthetic oligonucleotide
gtgttggtcgccctgtcgccttggttccgctttta

SEQ ID NO: 109288 - DNA, 35 bp, Artificial Sequence
  Synthetic oligonucleotide
aatgtgcccccacccgtgttctactctttaatgcc

SEQ ID NO: 109289 - DNA, 35 bp, Artificial Sequence
  Synthetic oligonucleotide
ttcccaccccgtactgctcgatactcaatacctat

SEQ ID NO: 109290 - DNA, 36 bp, Artificial Sequence
  Synthetic oligonucleotide
gaccaccaccccccgctcatgccgttatcgatcgaa

SEQ ID NO: 109291 - DNA, 35 bp, Artificial Sequence
  Synthetic oligonucleotide
aagcctgccgcaagcgcactccgcctccccgccgc

SEQ ID NO: 109292 - DNA, 35 bp, Artificial Sequence
  Synthetic oligonucleotide
gattccccgccaccttgctaatagcgcgtgccctt

SEQ ID NO: 109293 - DNA, 37 bp, Artificial Sequence
  Synthetic oligonucleotide
aacgggacgatgcaggaaggagggaaggggcaattga

SEQ ID NO: 109294 - DNA, 35 bp, Artificial Sequence
  Synthetic oligonucleotide
aacggtggacggggaggcgggaaagggagacattg

SEQ ID NO: 109295 - DNA, 34 bp, Artificial Sequence
  Synthetic oligonucleotide
accaccgacccgtactcgtctttcttgccatatt

SEQ ID NO: 109296 - DNA, 35 bp, Artificial Sequence
  Synthetic oligonucleotide
actccatccgtaccgctgaggcatattctcatccc

SEQ ID NO: 109297 - DNA, 35 bp, Artificial Sequence
  Synthetic oligonucleotide
ttgcattcctccctcggtccgtacaccccattggc

SEQ ID NO: 109298 - DNA, 35 bp, Artificial Sequence
  Synthetic oligonucleotide
gtccactgcccacgggttctatcggtgcacctgcc

SEQ ID NO: 109299 - DNA, 35 bp, Artificial Sequence
  Synthetic oligonucleotide
gcaccactgcacttggtttgcccgacttctgcttc

SEQ ID NO: 109300 - DNA, 37 bp, Artificial Sequence
  Synthetic oligonucleotide
gccccccacccgccgtgcacgttccttcgccacccga

SEQ ID NO: 109301 - DNA, 37 bp, Artificial Sequence
  Synthetic oligonucleotide
ggacggtcgggagggggtcgggtcggtgatggtggga

SEQ ID NO: 109302 - DNA, 35 bp, Artificial Sequence
  Synthetic oligonucleotide
gcccccgcactttctcatggctccagctgatctac

SEQ ID NO: 109303 - DNA, 35 bp, Artificial Sequence
  Synthetic oligonucleotide
gacaccctcccactgtacgaaaacgctgtcgcact

SEQ ID NO: 109304 - DNA, 36 bp, Artificial Sequence
  Synthetic oligonucleotide
gagctagctcctgcaagtgcaacccccgccccccca

SEQ ID NO: 109305 - DNA, 35 bp, Artificial Sequence
  Synthetic oligonucleotide
gtttccgccccctccgcatgctagctcgaacgtac

SEQ ID NO: 109306 - DNA, 35 bp, Artificial Sequence
  Synthetic oligonucleotide
tgagtgggccgcccctcgctcctccatccacgctc

SEQ ID NO: 109307 - DNA, 35 bp, Artificial Sequence
  Synthetic oligonucleotide
gccaccgccgagtcatcgtcgcctatcgttcctcg

SEQ ID NO: 109308 - DNA, 36 bp, Artificial Sequence
  Synthetic oligonucleotide
tgagtggggaaatgaggggactcctgggaggggaca

SEQ ID NO: 109309 - DNA, 35 bp, Artificial Sequence
  Synthetic oligonucleotide
gtccacccgcctttgcctaaattctgtgatttgtc

SEQ ID NO: 109310 - DNA, 35 bp, Artificial Sequence
  Synthetic oligonucleotide
gtcgcccccccctcccgtatgtagtctgactcgcg

SEQ ID NO: 109311 - DNA, 35 bp, Artificial Sequence
  Synthetic oligonucleotide
tccgtgctgtccgacacacctgtcttcttccaccc

SEQ ID NO: 109312 - DNA, 35 bp, Artificial Sequence
  Synthetic oligonucleotide
tgagcacggaaagggggagggcggtgagggataag

SEQ ID NO: 109313 - DNA, 35 bp, Artificial Sequence
  Synthetic oligonucleotide
agatccggaggaaggagtagggtggaggtgggagg

SEQ ID NO: 109314 - DNA, 37 bp, Artificial Sequence
  Synthetic oligonucleotide
aagagggcgggaggcattggacgcaggtggaggggga

SEQ ID NO: 109315 - DNA, 35 bp, Artificial Sequence
  Synthetic oligonucleotide
tccgacctcctctacgcgctatacgtttccggtct

SEQ ID NO: 109316 - DNA, 35 bp, Artificial Sequence
  Synthetic oligonucleotide
taccccgccgctagcttaacgtggccgtacccctc

SEQ ID NO: 109317 - DNA, 35 bp, Artificial Sequence
  Synthetic oligonucleotide
tcgatgcgaccgccgcacttcaagccacccatcct

SEQ ID NO: 109318 - DNA, 35 bp, Artificial Sequence
  Synthetic oligonucleotide
accactccaccatgctgctcgcataactttgttca

SEQ ID NO: 109319 - DNA, 35 bp, Artificial Sequence
  Synthetic oligonucleotide
gccaccgcgatcaccctgctcctgtccttttgtta

SEQ ID NO: 109320 - DNA, 35 bp, Artificial Sequence
  Synthetic oligonucleotide
acctaccgtcccgtgcttgcaaacatgtcccccct

SEQ ID NO: 109321 - DNA, 36 bp, Artificial Sequence
  Synthetic oligonucleotide
ttaccatgccccccgctagcccctccgtccgtcgga

SEQ ID NO: 109322 - DNA, 35 bp, Artificial Sequence
  Synthetic oligonucleotide
tcccagcgtgcacgcaccatctgcctgttcccgca

SEQ ID NO: 109323 - DNA, 35 bp, Artificial Sequence
  Synthetic oligonucleotide
gtgcactccacttgttctttccgtcgccccaggtt

SEQ ID NO: 109324 - DNA, 35 bp, Artificial Sequence
  Synthetic oligonucleotide
tgcccgagaccgcaatggttcttctgtccctcccc

SEQ ID NO: 109325 - DNA, 35 bp, Artificial Sequence
  Synthetic oligonucleotide
acactcgtcagcattcttcccgctcgctgttctca

SEQ ID NO: 109326 - DNA, 35 bp, Artificial Sequence
  Synthetic oligonucleotide
gtcatccatcgccccgttcacatgtctttcacgta

SEQ ID NO: 109327 - DNA, 35 bp, Artificial Sequence
  Synthetic oligonucleotide
accacctccccccatgcttagaggctatagcatta

SEQ ID NO: 109328 - DNA, 35 bp, Artificial Sequence
  Synthetic oligonucleotide
tcccttcgtctgccattacacgtgcccgtcccccc

SEQ ID NO: 109329 - DNA, 35 bp, Artificial Sequence
  Synthetic oligonucleotide
attcgccccaggcctcacaatgtgatgtcccccgc

SEQ ID NO: 109330 - DNA, 36 bp, Artificial Sequence
  Synthetic oligonucleotide
gtggggaggaggtagaaaacaagggggtgaaacgaa

SEQ ID NO: 109331 - DNA, 36 bp, Artificial Sequence
  Synthetic oligonucleotide
tgccacattcgatgctgccttcgccctctcttcaca

SEQ ID NO: 109332 - DNA, 35 bp, Artificial Sequence
  Synthetic oligonucleotide
gcacgaccctgttcacacgcttagacgatctcccg

SEQ ID NO: 109333 - DNA, 35 bp, Artificial Sequence
  Synthetic oligonucleotide
agataccccctgatctgtccattcctccggtatac

SEQ ID NO: 109334 - DNA, 35 bp, Artificial Sequence
  Synthetic oligonucleotide
gccacctcctccaacccgtttattcgccgacgctc

SEQ ID NO: 109335 - DNA, 36 bp, Artificial Sequence
  Synthetic oligonucleotide
aaagccgagggggggtgggaagggagtgtcagcaaa

SEQ ID NO: 109336 - DNA, 35 bp, Artificial Sequence
  Synthetic oligonucleotide
tatcccccgtgtgctatgacgtcaccctcttgctc

SEQ ID NO: 109337 - DNA, 35 bp, Artificial Sequence
  Synthetic oligonucleotide
gaacgcccgatgacatatcgtctagcaccttcctc

SEQ ID NO: 109338 - DNA, 35 bp, Artificial Sequence
  Synthetic oligonucleotide
ggttgctcccgtatcttgcccgcccctcgcctgtc

SEQ ID NO: 109339 - DNA, 35 bp, Artificial Sequence
  Synthetic oligonucleotide
atctccacctcactctatgtcacacaggtcttggc

SEQ ID NO: 109340 - DNA, 37 bp, Artificial Sequence
  Synthetic oligonucleotide
tcaagaaggggaaatggtgagtgggggtaacggagga

SEQ ID NO: 109341 - DNA, 36 bp, Artificial Sequence
  Synthetic oligonucleotide
tacccccgccgccctaccgttagggaatgtccctga

SEQ ID NO: 109342 - DNA, 35 bp, Artificial Sequence
  Synthetic oligonucleotide
tacatagcagccaccgcgtactctggccccttttt

SEQ ID NO: 109343 - DNA, 35 bp, Artificial Sequence
  Synthetic oligonucleotide
tatccgcacgcccgccgcttgatcccaccaccaca

SEQ ID NO: 109344 - DNA, 36 bp, Artificial Sequence
  Synthetic oligonucleotide
tacccccgtgccccccgccagccatgctttaaccta

SEQ ID NO: 109345 - DNA, 36 bp, Artificial Sequence
  Synthetic oligonucleotide
gatcacacgtgagtcgcgtacctccccactgcccaa

SEQ ID NO: 109346 - DNA, 35 bp, Artificial Sequence
  Synthetic oligonucleotide
tactgccccgcactccgcttaaatccctcgttcca

SEQ ID NO: 109347 - DNA, 36 bp, Artificial Sequence
  Synthetic oligonucleotide
aacgcggccactgacgcctttcaccatttccctgca

SEQ ID NO: 109348 - DNA, 36 bp, Artificial Sequence
  Synthetic oligonucleotide
gcccccgttcgcccgctttgaacctttgcccttgga

SEQ ID NO: 109349 - DNA, 35 bp, Artificial Sequence
  Synthetic oligonucleotide
atccacgcgctcacgttcatctatctcagcttcct

SEQ ID NO: 109350 - DNA, 36 bp, Artificial Sequence
  Synthetic oligonucleotide
aaggaggaaaccagggaggggattaggggatgggta

SEQ ID NO: 109351 - DNA, 35 bp, Artificial Sequence
  Synthetic oligonucleotide
ggagccctctcgccgtgccagtattccaactcccg

SEQ ID NO: 109352 - DNA, 36 bp, Artificial Sequence
  Synthetic oligonucleotide
tctccaccgcggtccttcgcgtgcccttctttcgaa

SEQ ID NO: 109353 - DNA, 35 bp, Artificial Sequence
  Synthetic oligonucleotide
tccgctgtccattcctataccacagctcgctcccc

SEQ ID NO: 109354 - DNA, 35 bp, Artificial Sequence
  Synthetic oligonucleotide
gtggtgggtgggagggcctccttgatggggtgcct

SEQ ID NO: 109355 - DNA, 35 bp, Artificial Sequence
  Synthetic oligonucleotide
aatccaaccctgctgttcctcgttaccacctgtcg

SEQ ID NO: 109356 - DNA, 35 bp, Artificial Sequence
  Synthetic oligonucleotide
tccacatccctcgctgcattctcgtctctacccgg

SEQ ID NO: 109357 - DNA, 35 bp, Artificial Sequence
  Synthetic oligonucleotide
tacgaccggtcccatcagttcgacacctgccctta

SEQ ID NO: 109358 - DNA, 35 bp, Artificial Sequence
  Synthetic oligonucleotide
tgtgcccgttagccctcgtgcccgtttttccccac

SEQ ID NO: 109359 - DNA, 35 bp, Artificial Sequence
  Synthetic oligonucleotide
ttcactgccttcctacttgttcctagacgccggtc

SEQ ID NO: 109360 - DNA, 37 bp, Artificial Sequence
  Synthetic oligonucleotide
tgccgcccctccattgttctgttatcctccgtcttga

SEQ ID NO: 109361 - DNA, 35 bp, Artificial Sequence
  Synthetic oligonucleotide
tagccccccatgtacctgtccctgtattgtcccca

SEQ ID NO: 109362 - DNA, 35 bp, Artificial Sequence
  Synthetic oligonucleotide
gagggagctgaacgggtgaggatgaagggcgggat

SEQ ID NO: 109363 - DNA, 35 bp, Artificial Sequence
  Synthetic oligonucleotide
tgttcgtccacgcctgtctctgtctccgttcgttc

SEQ ID NO: 109364 - DNA, 36 bp, Artificial Sequence
  Synthetic oligonucleotide
atttgccccctccatgcgcttcccgccattatcgaa

SEQ ID NO: 109365 - DNA, 35 bp, Artificial Sequence
  Synthetic oligonucleotide
ggaccgactcagggtcattatctcgcccgccccca

SEQ ID NO: 109366 - DNA, 35 bp, Artificial Sequence
  Synthetic oligonucleotide
ttcacggccacttcccccgttgccctgcatggttc

SEQ ID NO: 109367 - DNA, 35 bp, Artificial Sequence
  Synthetic oligonucleotide
acacatcagcactttaccttccccgccgttctctg

SEQ ID NO: 109368 - DNA, 35 bp, Artificial Sequence
  Synthetic oligonucleotide
tcccgacgcccatctgacctactctcagcctacag

SEQ ID NO: 109369 - DNA, 35 bp, Artificial Sequence
  Synthetic oligonucleotide
agccccatcacctgcctcattgtcggcctttgaca

SEQ ID NO: 109370 - DNA, 36 bp, Artificial Sequence
  Synthetic oligonucleotide
agcccacggcaggtcgctaacaagcccaccctccca

SEQ ID NO: 109371 - DNA, 38 bp, Artificial Sequence
  Synthetic oligonucleotide
gctgaactgcgctgacgtcctccctccaccctgcctga

SEQ ID NO: 109372 - DNA, 35 bp, Artificial Sequence
  Synthetic oligonucleotide
acgagaaggggaggacggggaaaggctgattatgg

SEQ ID NO: 109373 - DNA, 35 bp, Artificial Sequence
  Synthetic oligonucleotide
acctgtccctcttcatgtcgccgatagcactccca

SEQ ID NO: 109374 - DNA, 37 bp, Artificial Sequence
  Synthetic oligonucleotide
acaagcactgtccgccgcgtatttttccccctctcga

SEQ ID NO: 109375 - DNA, 37 bp, Artificial Sequence
  Synthetic oligonucleotide
agaggggaatgcgggggaaagggagtagggctcggga

SEQ ID NO: 109376 - DNA, 38 bp, Artificial Sequence
  Synthetic oligonucleotide
gtgacacagcagctgtttaaaccccctccgccctctga

SEQ ID NO: 109377 - DNA, 35 bp, Artificial Sequence
  Synthetic oligonucleotide
tacatcgcacctacccggtctgatccatcccctgt

SEQ ID NO: 109378 - DNA, 38 bp, Artificial Sequence
  Synthetic oligonucleotide
ggatcagagcggtgggaaggggaggaaggggggcatga

SEQ ID NO: 109379 - DNA, 35 bp, Artificial Sequence
  Synthetic oligonucleotide
gcgtacctgcagttacccccaatgactgtccctcc

SEQ ID NO: 109380 - DNA, 35 bp, Artificial Sequence
  Synthetic oligonucleotide
acaacgcctgctcgctttcttgtctttgcccgctt

SEQ ID NO: 109381 - DNA, 35 bp, Artificial Sequence
  Synthetic oligonucleotide
gtgaacgttccctctttcctccgctgcccctgcta

SEQ ID NO: 109382 - DNA, 36 bp, Artificial Sequence
  Synthetic oligonucleotide
accgcctcgccccgctcgactctaggctacccttta

SEQ ID NO: 109383 - DNA, 35 bp, Artificial Sequence
  Synthetic oligonucleotide
tgtatcgacccgtctttagtgctctatctcctcac

SEQ ID NO: 109384 - DNA, 36 bp, Artificial Sequence
  Synthetic oligonucleotide
gggtcgccgctacatgcacctgccctgtttcaccca

SEQ ID NO: 109385 - DNA, 35 bp, Artificial Sequence
  Synthetic oligonucleotide
gtgacaccaggaggctggcgggggggggaggaggc

SEQ ID NO: 109386 - DNA, 35 bp, Artificial Sequence
  Synthetic oligonucleotide
tctgctctcctcgtgttgttcgtcccacctctggc

SEQ ID NO: 109387 - DNA, 35 bp, Artificial Sequence
  Synthetic oligonucleotide
gcaccgaccctcatccccagcaacggctcctgtcc

SEQ ID NO: 109388 - DNA, 36 bp, Artificial Sequence
  Synthetic oligonucleotide
tccaccctctatcccgtctaggccgcatgtacgcca

SEQ ID NO: 109389 - DNA, 35 bp, Artificial Sequence
  Synthetic oligonucleotide
tcgccccctcgcccgttcaaccatgtcgctgtttg

SEQ ID NO: 109390 - DNA, 34 bp, Artificial Sequence
  Synthetic oligonucleotide
gcctccgccacgttcacacttttgtgccatccac

SEQ ID NO: 109391 - DNA, 35 bp, Artificial Sequence
  Synthetic oligonucleotide
acccgccccggacgagtccgtacctaaccatcttg

SEQ ID NO: 109392 - DNA, 35 bp, Artificial Sequence
  Synthetic oligonucleotide
tgcgaaagctggcgccgtctcgtctactacctcac

SEQ ID NO: 109393 - DNA, 35 bp, Artificial Sequence
  Synthetic oligonucleotide
gcccactctgccgtccatcctaatcacgttcccac

SEQ ID NO: 109394 - DNA, 35 bp, Artificial Sequence
  Synthetic oligonucleotide
gggagtctccccgcgcccaccgttgatcttacctg

SEQ ID NO: 109395 - DNA, 36 bp, Artificial Sequence
  Synthetic oligonucleotide
gatgcccttcccttgttgaccgtacccgctcctgca

SEQ ID NO: 109396 - DNA, 35 bp, Artificial Sequence
  Synthetic oligonucleotide
tcgagacatcgtcaagttagctcgcccccccgcca

SEQ ID NO: 109397 - DNA, 35 bp, Artificial Sequence
  Synthetic oligonucleotide
gcggggaggggtgggaggtaggaggggacacaatt

SEQ ID NO: 109398 - DNA, 35 bp, Artificial Sequence
  Synthetic oligonucleotide
tgacccagccaccgtcccgccccgcccttagagcc

SEQ ID NO: 109399 - DNA, 35 bp, Artificial Sequence
  Synthetic oligonucleotide
gagtaacgcaggaggggggtgggtttggcatagcg

SEQ ID NO: 109400 - DNA, 37 bp, Artificial Sequence
  Synthetic oligonucleotide
ttgcaagaggtaggagagggacgagggtagtagggga

SEQ ID NO: 109401 - DNA, 35 bp, Artificial Sequence
  Synthetic oligonucleotide
agcctgcccatgttcgtccccacctagtgcctccg

SEQ ID NO: 109402 - DNA, 35 bp, Artificial Sequence
  Synthetic oligonucleotide
gctgtgatcgaggagtggggaggaggcgggaaggg

SEQ ID NO: 109403 - DNA, 36 bp, Artificial Sequence
  Synthetic oligonucleotide
gcgcgagtcacgacgtcatcgccacatcgccctcca

SEQ ID NO: 109404 - DNA, 35 bp, Artificial Sequence
  Synthetic oligonucleotide
tgtgctcccagccatgcctttgactcccctcgccg

SEQ ID NO: 109405 - DNA, 35 bp, Artificial Sequence
  Synthetic oligonucleotide
tagtcccccgctcctaggtatctgcatttactcct

SEQ ID NO: 109406 - DNA, 35 bp, Artificial Sequence
  Synthetic oligonucleotide
agtacgtcgggttcagccggttcgctccctttcct

SEQ ID NO: 109407 - DNA, 35 bp, Artificial Sequence
  Synthetic oligonucleotide
gatgatacccccagccactgttccccaccgccctg

SEQ ID NO: 109408 - DNA, 35 bp, Artificial Sequence
  Synthetic oligonucleotide
atccaccgcaaatccggttccctgtcccgttactt

SEQ ID NO: 109409 - DNA, 35 bp, Artificial Sequence
  Synthetic oligonucleotide
gttcacgaacatccatgtttatgccttctgccccc

SEQ ID NO: 109410 - DNA, 35 bp, Artificial Sequence
  Synthetic oligonucleotide
ttcatggtcgcccctcctctcgtgcacaattgtcc

SEQ ID NO: 109411 - DNA, 35 bp, Artificial Sequence
  Synthetic oligonucleotide
atctccgccccgttgaattgaaccatcctgttatc

SEQ ID NO: 109412 - DNA, 35 bp, Artificial Sequence
  Synthetic oligonucleotide
tgccacgttctgttcctatgcgtcacttttgctac

SEQ ID NO: 109413 - DNA, 35 bp, Artificial Sequence
  Synthetic oligonucleotide
tgtcagtccacccacgtttgtatcgcctgcccgga

SEQ ID NO: 109414 - DNA, 35 bp, Artificial Sequence
  Synthetic oligonucleotide
gccccctcgctgcgccgtctacctcatcacgcctc

SEQ ID NO: 109415 - DNA, 35 bp, Artificial Sequence
  Synthetic oligonucleotide
gttgtcctctgtcgcttttttcatggtgcccctcg

SEQ ID NO: 109416 - DNA, 38 bp, Artificial Sequence
  Synthetic oligonucleotide
atcgacactctcctgccctgtctatcccggtctactga

SEQ ID NO: 109417 - DNA, 35 bp, Artificial Sequence
  Synthetic oligonucleotide
gcccgcaaacagcatacacgaactgtccctcgccc

SEQ ID NO: 109418 - DNA, 35 bp, Artificial Sequence
  Synthetic oligonucleotide
gtcgtactgccccctccctgttcaaaacagtcaaa

SEQ ID NO: 109419 - DNA, 35 bp, Artificial Sequence
  Synthetic oligonucleotide
ataccgtcacaactgtctactcgggcccaccaccc

SEQ ID NO: 109420 - DNA, 35 bp, Artificial Sequence
  Synthetic oligonucleotide
tcatgcccagcgcagatctccccccccgtgccatc

SEQ ID NO: 109421 - DNA, 35 bp, Artificial Sequence
  Synthetic oligonucleotide
gttccgacccctgagctatttttgcgcctgcctcg

SEQ ID NO: 109422 - DNA, 37 bp, Artificial Sequence
  Synthetic oligonucleotide
ttcggtgggaggcggaagggggaaaggcgggtaggga

SEQ ID NO: 109423 - DNA, 35 bp, Artificial Sequence
  Synthetic oligonucleotide
ttcaggccggtgtttgctttctatcagcccgttcc

SEQ ID NO: 109424 - DNA, 36 bp, Artificial Sequence
  Synthetic oligonucleotide
tcatactgggtgcggttggtatggggaggaggagga

SEQ ID NO: 109425 - DNA, 36 bp, Artificial Sequence
  Synthetic oligonucleotide
aatgagggggaggggacgggtaagttacggcgcaga

SEQ ID NO: 109426 - DNA, 36 bp, Artificial Sequence
  Synthetic oligonucleotide
actcatgcgacgcatcgtaccttcttcccccgctga

SEQ ID NO: 109427 - DNA, 35 bp, Artificial Sequence
  Synthetic oligonucleotide
gccaaccgctatgatcctgcattactctgctaccc

SEQ ID NO: 109428 - DNA, 35 bp, Artificial Sequence
  Synthetic oligonucleotide
accacacagacttgtcctcacacctgtctcttatc

SEQ ID NO: 109429 - DNA, 35 bp, Artificial Sequence
  Synthetic oligonucleotide
atcgcccaccgcccggctatttgcacttgttaacg

SEQ ID NO: 109430 - DNA, 37 bp, Artificial Sequence
  Synthetic oligonucleotide
tagcgccgccactcctgttacaccactcaccgaccga

SEQ ID NO: 109431 - DNA, 37 bp, Artificial Sequence
  Synthetic oligonucleotide
ttcgccgccgcctcgctcccccgacctcacttcggga

SEQ ID NO: 109432 - DNA, 35 bp, Artificial Sequence
  Synthetic oligonucleotide
tacgccctgcgcccctgaccccttcctgagtgatc

SEQ ID NO: 109433 - DNA, 35 bp, Artificial Sequence
  Synthetic oligonucleotide
atgccaccatatcttgcccgtgagacccctccccg

SEQ ID NO: 109434 - DNA, 35 bp, Artificial Sequence
  Synthetic oligonucleotide
tgaagcctgttctggttagccacatcccctgtctc

SEQ ID NO: 109435 - DNA, 35 bp, Artificial Sequence
  Synthetic oligonucleotide
actgtcgttctgccttaccttgccctgtagtcttg

SEQ ID NO: 109436 - DNA, 35 bp, Artificial Sequence
  Synthetic oligonucleotide
acttcacgccccaggttccatcttaggcgaccctc

SEQ ID NO: 109437 - DNA, 35 bp, Artificial Sequence
  Synthetic oligonucleotide
tcgacattgccgggctgcctacgctatacacctcc

SEQ ID NO: 109438 - DNA, 35 bp, Artificial Sequence
  Synthetic oligonucleotide
tccaccacccagaaccgaacccgacccccgttagg

SEQ ID NO: 109439 - DNA, 35 bp, Artificial Sequence
  Synthetic oligonucleotide
tcgaaccatcagcccgacctgcatccatttcctcg

SEQ ID NO: 109440 - DNA, 35 bp, Artificial Sequence
  Synthetic oligonucleotide
tgcaccccaccacccgtcactgcgacctcgtgtca

SEQ ID NO: 109441 - DNA, 38 bp, Artificial Sequence
  Synthetic oligonucleotide
tacgagtcgcatgggggggaggggcggtgggttactga

SEQ ID NO: 109442 - DNA, 36 bp, Artificial Sequence
  Synthetic oligonucleotide
tgccaccctcgctcagcccactcgttagcctctcga

SEQ ID NO: 109443 - DNA, 35 bp, Artificial Sequence
  Synthetic oligonucleotide
ttccgcatccctggttttatcaatcgcctcacatc

SEQ ID NO: 109444 - DNA, 35 bp, Artificial Sequence
  Synthetic oligonucleotide
atcggtagtcgcccggttcctgcttttcgtttctt

SEQ ID NO: 109445 - DNA, 35 bp, Artificial Sequence
  Synthetic oligonucleotide
gtaacacgtcattgtcacccggccacccctttccc

SEQ ID NO: 109446 - DNA, 35 bp, Artificial Sequence
  Synthetic oligonucleotide
gatccgcccccctcatatggtgaacactactatcc

SEQ ID NO: 109447 - DNA, 34 bp, Artificial Sequence
  Synthetic oligonucleotide
tcgacggtaccatctgctctcccccagctctgtg

SEQ ID NO: 109448 - DNA, 35 bp, Artificial Sequence
  Synthetic oligonucleotide
taagcccacgccacatccagcccgcctcgaaatca

SEQ ID NO: 109449 - DNA, 35 bp, Artificial Sequence
  Synthetic oligonucleotide
accccacgtccccccggtccatttcggcgcctatc

SEQ ID NO: 109450 - DNA, 35 bp, Artificial Sequence
  Synthetic oligonucleotide
gccgccccgcttctctggcgttattgttttccttc

SEQ ID NO: 109451 - DNA, 35 bp, Artificial Sequence
  Synthetic oligonucleotide
gggtgggaggagggaagagaaggacaggcttgcgg

SEQ ID NO: 109452 - DNA, 35 bp, Artificial Sequence
  Synthetic oligonucleotide
accgcgcccctccagctcaatcagaccctgttact

SEQ ID NO: 109453 - DNA, 35 bp, Artificial Sequence
  Synthetic oligonucleotide
gggtcacccgccccatactatgacgcaccagccct

SEQ ID NO: 109454 - DNA, 35 bp, Artificial Sequence
  Synthetic oligonucleotide
gacaggagggaagggcggtgaagtgggatgttctg

SEQ ID NO: 109455 - DNA, 35 bp, Artificial Sequence
  Synthetic oligonucleotide
tctcaccgccctttgcgcatggtcgttttgctcca

SEQ ID NO: 109456 - DNA, 35 bp, Artificial Sequence
  Synthetic oligonucleotide
agttcggtccacctgcccttggttcttacattgcc

SEQ ID NO: 109457 - DNA, 35 bp, Artificial Sequence
  Synthetic oligonucleotide
aatgcgacgtcactctggttctcccggtcccgttc

SEQ ID NO: 109458 - DNA, 34 bp, Artificial Sequence
  Synthetic oligonucleotide
gtctcgtccctgccatcgctccttctgttcccat

SEQ ID NO: 109459 - DNA, 35 bp, Artificial Sequence
  Synthetic oligonucleotide
gtcactgtcgccctccgtccctcgccagcaccggt

SEQ ID NO: 109460 - DNA, 34 bp, Artificial Sequence
  Synthetic oligonucleotide
tgccaccacgtagacgccccacatatcctcgccg

SEQ ID NO: 109461 - DNA, 35 bp, Artificial Sequence
  Synthetic oligonucleotide
tcctcctcactctgctcgtgacctcgattactccc

SEQ ID NO: 109462 - DNA, 35 bp, Artificial Sequence
  Synthetic oligonucleotide
gactccgctttatggtaaaccgtcctaccccgcct

SEQ ID NO: 109463 - DNA, 35 bp, Artificial Sequence
  Synthetic oligonucleotide
tgtgcggacgccacattcccattgctcacggtcct

SEQ ID NO: 109464 - DNA, 35 bp, Artificial Sequence
  Synthetic oligonucleotide
tacttcacccccgaccattcgtaatgcccgtttca

SEQ ID NO: 109465 - DNA, 36 bp, Artificial Sequence
  Synthetic oligonucleotide
tgagacattagcggaggcggggggacggcgagagga

SEQ ID NO: 109466 - DNA, 35 bp, Artificial Sequence
  Synthetic oligonucleotide
accacctcactgtccacgaatacccggtctcccaa

SEQ ID NO: 109467 - DNA, 35 bp, Artificial Sequence
  Synthetic oligonucleotide
gacgtggggtaaacgggcgggggaccgggaaggga

SEQ ID NO: 109468 - DNA, 35 bp, Artificial Sequence
  Synthetic oligonucleotide
acgactctcatgtctccccacgcctggaccgcttc

SEQ ID NO: 109469 - DNA, 35 bp, Artificial Sequence
  Synthetic oligonucleotide
gctacctccgccttcctcctgatgcctatgtcgct

SEQ ID NO: 109470 - DNA, 36 bp, Artificial Sequence
  Synthetic oligonucleotide
atccgccctgtccgcccttaccctactagtggaact

SEQ ID NO: 109471 - DNA, 35 bp, Artificial Sequence
  Synthetic oligonucleotide
gtggtgaccgtgcccttattgtctagcccccttcc

SEQ ID NO: 109472 - DNA, 35 bp, Artificial Sequence
  Synthetic oligonucleotide
tcgtggcgccgacgttctgctgccttccgcccctc

SEQ ID NO: 109473 - DNA, 35 bp, Artificial Sequence
  Synthetic oligonucleotide
ataccacccccaatcggtacatgaccacctaacga

SEQ ID NO: 109474 - DNA, 37 bp, Artificial Sequence
  Synthetic oligonucleotide
aactctccgccgtgccatcccagccctcgtaccgtga

SEQ ID NO: 109475 - DNA, 37 bp, Artificial Sequence
  Synthetic oligonucleotide
tgagcctccgactgcctcatccttcactcctcgctga

SEQ ID NO: 109476 - DNA, 35 bp, Artificial Sequence
  Synthetic oligonucleotide
tcacctccccactgtaatacgagtggtccattccc

SEQ ID NO: 109477 - DNA, 37 bp, Artificial Sequence
  Synthetic oligonucleotide
gtcctgggggagaagggggaacgttgggaggggacga

SEQ ID NO: 109478 - DNA, 37 bp, Artificial Sequence
  Synthetic oligonucleotide
gccgtactccgcctcattcctgtccctcccgcacgga

SEQ ID NO: 109479 - DNA, 37 bp, Artificial Sequence
  Synthetic oligonucleotide
gtgggatagaagaagaggagggggagctaggggatga

SEQ ID NO: 109480 - DNA, 35 bp, Artificial Sequence
  Synthetic oligonucleotide
agcacctggcggaatgggggggggaggggagctag

SEQ ID NO: 109481 - DNA, 35 bp, Artificial Sequence
  Synthetic oligonucleotide
tccgcccttccacttgttcagccactcatcgaccg

SEQ ID NO: 109482 - DNA, 35 bp, Artificial Sequence
  Synthetic oligonucleotide
actgaactgcccatcgaatggtcatctgcccctcc

SEQ ID NO: 109483 - DNA, 35 bp, Artificial Sequence
  Synthetic oligonucleotide
tcaagccctcatccctcgcccccctggtttaatgc

SEQ ID NO: 109484 - DNA, 35 bp, Artificial Sequence
  Synthetic oligonucleotide
gcccccccgttgaccacctgacgctcccttatcga

SEQ ID NO: 109485 - DNA, 35 bp, Artificial Sequence
  Synthetic oligonucleotide
tccgggccctcacgcacttgaccatcccttcttgc

SEQ ID NO: 109486 - DNA, 35 bp, Artificial Sequence
  Synthetic oligonucleotide
ttgaccaccccgcccgcttctggtacaccccttag

SEQ ID NO: 109487 - DNA, 38 bp, Artificial Sequence
  Synthetic oligonucleotide
acgtgataccgggagggtggggaagggcaggagaatga

SEQ ID NO: 109488 - DNA, 35 bp, Artificial Sequence
  Synthetic oligonucleotide
agtgggggaaggagcacggcgaagaggagggctgg

SEQ ID NO: 109489 - DNA, 37 bp, Artificial Sequence
  Synthetic oligonucleotide
gtcaagggcacagggagcaaggtagggaggggtagga

SEQ ID NO: 109490 - DNA, 38 bp, Artificial Sequence
  Synthetic oligonucleotide
atcaaccgccccatgcaataccctgtcacatcccttga

SEQ ID NO: 109491 - DNA, 35 bp, Artificial Sequence
  Synthetic oligonucleotide
ttagccccctcccgttgcagctgccccgccccaca

SEQ ID NO: 109492 - DNA, 36 bp, Artificial Sequence
  Synthetic oligonucleotide
ttgatccctgtcagatcccgtacgctctgcccttca

SEQ ID NO: 109493 - DNA, 35 bp, Artificial Sequence
  Synthetic oligonucleotide
atctccctcccccccgtcttcgcgcgccacgactc

SEQ ID NO: 109494 - DNA, 35 bp, Artificial Sequence
  Synthetic oligonucleotide
tccctacccggtcgttgtatttcgaaccgtctccc

SEQ ID NO: 109495 - DNA, 35 bp, Artificial Sequence
  Synthetic oligonucleotide
tcacacccatcctgacgcctatgtacttacacctc

SEQ ID NO: 109496 - DNA, 36 bp, Artificial Sequence
  Synthetic oligonucleotide
ggtcagtccgcctccatcgtaccatgcccccgatca

SEQ ID NO: 109497 - DNA, 36 bp, Artificial Sequence
  Synthetic oligonucleotide
acgccgtccccatggtcgtcacgtttcctctttcta

SEQ ID NO: 109498 - DNA, 35 bp, Artificial Sequence
  Synthetic oligonucleotide
tccaccccctcatgccctatccaaccttgtgcatc

SEQ ID NO: 109499 - DNA, 35 bp, Artificial Sequence
  Synthetic oligonucleotide
tctcagcccctcctctatgtcccatctccctttgg

SEQ ID NO: 109500 - DNA, 34 bp, Artificial Sequence
  Synthetic oligonucleotide
atacaccatccccacgtcctcgatctcgtgctta

SEQ ID NO: 109501 - DNA, 35 bp, Artificial Sequence
  Synthetic oligonucleotide
ggatgaccagccaccgttgtccactgctcccttac

SEQ ID NO: 109502 - DNA, 35 bp, Artificial Sequence
  Synthetic oligonucleotide
tctcgcaccccctctttgctaacacgcgaactctc

SEQ ID NO: 109503 - DNA, 35 bp, Artificial Sequence
  Synthetic oligonucleotide
gtacccgcctccggttctatcctggttcatgccaa

SEQ ID NO: 109504 - DNA, 35 bp, Artificial Sequence
  Synthetic oligonucleotide
tgcacccgcccccgggtagctacacttctttgcct

SEQ ID NO: 109505 - DNA, 35 bp, Artificial Sequence
  Synthetic oligonucleotide
ttcactgccctctgcatctttctctacgaactcgc

SEQ ID NO: 109506 - DNA, 35 bp, Artificial Sequence
  Synthetic oligonucleotide
atctagcgtcctgctcagctgttccgcccctcgtc

SEQ ID NO: 109507 - DNA, 35 bp, Artificial Sequence
  Synthetic oligonucleotide
gggagggagaagggaggttcggatcataggaggga

SEQ ID NO: 109508 - DNA, 38 bp, Artificial Sequence
  Synthetic oligonucleotide
gtgagcaccgccgtacttccctagcatctgttccatga

SEQ ID NO: 109509 - DNA, 35 bp, Artificial Sequence
  Synthetic oligonucleotide
accatcactcaggaatactccactggccccgcacc

SEQ ID NO: 109510 - DNA, 35 bp, Artificial Sequence
  Synthetic oligonucleotide
gactaggcaagggaaagcagggggggtggtacaca

SEQ ID NO: 109511 - DNA, 35 bp, Artificial Sequence
  Synthetic oligonucleotide
gctgtccttgccgccttggttcctgcccctcctcg

SEQ ID NO: 109512 - DNA, 35 bp, Artificial Sequence
  Synthetic oligonucleotide
tcccacactcggcagttactggcccatcgctcctg

SEQ ID NO: 109513 - DNA, 35 bp, Artificial Sequence
  Synthetic oligonucleotide
tcccgcgcggtcgacctgcgttctactcccgccca

SEQ ID NO: 109514 - DNA, 36 bp, Artificial Sequence
  Synthetic oligonucleotide
acgatgtgccacatgtctatctctgtccgtttcata

SEQ ID NO: 109515 - DNA, 37 bp, Artificial Sequence
  Synthetic oligonucleotide
tccacccccacgcttctgtttaccctccgcccaggga

SEQ ID NO: 109516 - DNA, 37 bp, Artificial Sequence
  Synthetic oligonucleotide
ttagacggggcaagggtggagtcgggggattggtgga

SEQ ID NO: 109517 - DNA, 35 bp, Artificial Sequence
  Synthetic oligonucleotide
ttaatgaccgcggcactcacccatccccttacctg

SEQ ID NO: 109518 - DNA, 36 bp, Artificial Sequence
  Synthetic oligonucleotide
gcctgcctgcctccgcccaccccttgcctgccacga

SEQ ID NO: 109519 - DNA, 35 bp, Artificial Sequence
  Synthetic oligonucleotide
taccgagcgtgccctatccgtttatccccgtcgca

SEQ ID NO: 109520 - DNA, 35 bp, Artificial Sequence
  Synthetic oligonucleotide
gctaggagggtggaagtagcggaggggaagacggc

SEQ ID NO: 109521 - DNA, 35 bp, Artificial Sequence
  Synthetic oligonucleotide
acgctcgccccctcctcgcgttacatttccgccgg

SEQ ID NO: 109522 - DNA, 37 bp, Artificial Sequence
  Synthetic oligonucleotide
gagccctgccactgttcattgtccacctctttccaga

SEQ ID NO: 109523 - DNA, 35 bp, Artificial Sequence
  Synthetic oligonucleotide
ggagggcggtggggctcttggggtgcggtggtaac

SEQ ID NO: 109524 - DNA, 35 bp, Artificial Sequence
  Synthetic oligonucleotide
tcacgcgccgctcaggtcccttctcatgcatgtcc

SEQ ID NO: 109525 - DNA, 35 bp, Artificial Sequence
  Synthetic oligonucleotide
gcatgaccgctttgctcctcgctggttcaccttcc

SEQ ID NO: 109526 - DNA, 35 bp, Artificial Sequence
  Synthetic oligonucleotide
tgcacacactatcgaatccagtccctgtcatggct

SEQ ID NO: 109527 - DNA, 35 bp, Artificial Sequence
  Synthetic oligonucleotide
tagacccgccgatgacgcccgccccaactcatatc

SEQ ID NO: 109528 - DNA, 35 bp, Artificial Sequence
  Synthetic oligonucleotide
aacatgaaggggaagtaggataggacgaagggccg

SEQ ID NO: 109529 - DNA, 35 bp, Artificial Sequence
  Synthetic oligonucleotide
gtactcccgtcgatacctgtcctctcgtcaccctt

SEQ ID NO: 109530 - DNA, 36 bp, Artificial Sequence
  Synthetic oligonucleotide
gggggacagttcgggggagagagttacggggcggga

SEQ ID NO: 109531 - DNA, 35 bp, Artificial Sequence
  Synthetic oligonucleotide
tcaacgcgtcgcccacttcgcgaccttcttgcctc

SEQ ID NO: 109532 - DNA, 35 bp, Artificial Sequence
  Synthetic oligonucleotide
tcgctcctcgccgtttgccattgccgccccatagt

SEQ ID NO: 109533 - DNA, 35 bp, Artificial Sequence
  Synthetic oligonucleotide
gccccccatctatgccggatttcgtccccgtttcc

SEQ ID NO: 109534 - DNA, 35 bp, Artificial Sequence
  Synthetic oligonucleotide
atcacccaccttctcgcttgtcacctgacactgtt

SEQ ID NO: 109535 - DNA, 35 bp, Artificial Sequence
  Synthetic oligonucleotide
gcccccgtcgtcgaccgtcgtctgtaccatctttt

SEQ ID NO: 109536 - DNA, 38 bp, Artificial Sequence
  Synthetic oligonucleotide
gcagagggggacagggaaggggaaaataagggaggtga

SEQ ID NO: 109537 - DNA, 35 bp, Artificial Sequence
  Synthetic oligonucleotide
aacccgcaacgtcgccacgcatatctcacctcccg

SEQ ID NO: 109538 - DNA, 35 bp, Artificial Sequence
  Synthetic oligonucleotide
atgaaccacgacgggttgggggggtaagtagggtg

SEQ ID NO: 109539 - DNA, 35 bp, Artificial Sequence
  Synthetic oligonucleotide
gtgccgatttcacattgccgttccgaccaccatgc

SEQ ID NO: 109540 - DNA, 35 bp, Artificial Sequence
  Synthetic oligonucleotide
tcgtgacaccaccacctgggccctactccgcaacc

SEQ ID NO: 109541 - DNA, 35 bp, Artificial Sequence
  Synthetic oligonucleotide
tgcctcattcagcccccccagccgacacatacttc

SEQ ID NO: 109542 - DNA, 35 bp, Artificial Sequence
  Synthetic oligonucleotide
gcaccccccgatggccactttgtctatttgccccg

SEQ ID NO: 109543 - DNA, 35 bp, Artificial Sequence
  Synthetic oligonucleotide
gcctgcccttctgccgactcgcctctacggttccg

SEQ ID NO: 109544 - DNA, 37 bp, Artificial Sequence
  Synthetic oligonucleotide
catgtagccggagggggagggggtggaggtacctgga

SEQ ID NO: 109545 - DNA, 35 bp, Artificial Sequence
  Synthetic oligonucleotide
atccgccgccacgcatcttttcattctagtccccc

SEQ ID NO: 109546 - DNA, 35 bp, Artificial Sequence
  Synthetic oligonucleotide
actcgccgtccaaagtcccccggtgtcatccccca

SEQ ID NO: 109547 - DNA, 35 bp, Artificial Sequence
  Synthetic oligonucleotide
gccagcccatgccttcaatgccctactccttcgtg

SEQ ID NO: 109548 - DNA, 35 bp, Artificial Sequence
  Synthetic oligonucleotide
gaagccatgggaggagcgggggggaaatttcagca

SEQ ID NO: 109549 - DNA, 38 bp, Artificial Sequence
  Synthetic oligonucleotide
tgacgactcgccgcctgtttctgcatactctctcctga

SEQ ID NO: 109550 - DNA, 36 bp, Artificial Sequence
  Synthetic oligonucleotide
gatgccgccgccgtgccattcctatttcagctctca

SEQ ID NO: 109551 - DNA, 37 bp, Artificial Sequence
  Synthetic oligonucleotide
tagacactcacagtagttatctgcccccactccccga

SEQ ID NO: 109552 - DNA, 36 bp, Artificial Sequence
  Synthetic oligonucleotide
acactgcgcgcacatcacctcacctgtttaccatca

SEQ ID NO: 109553 - DNA, 36 bp, Artificial Sequence
  Synthetic oligonucleotide
accacgttccatcgccgtttttcgcccaatctacga

SEQ ID NO: 109554 - DNA, 37 bp, Artificial Sequence
  Synthetic oligonucleotide
tgcggggggataaactgggtgggagggggctcttgga

SEQ ID NO: 109555 - DNA, 35 bp, Artificial Sequence
  Synthetic oligonucleotide
tccagtcacacagtcgctcctcgttcctagtttcc

SEQ ID NO: 109556 - DNA, 38 bp, Artificial Sequence
  Synthetic oligonucleotide
aacgctccgcctgctcctctcctgtacgtccatcatga

SEQ ID NO: 109557 - DNA, 36 bp, Artificial Sequence
  Synthetic oligonucleotide
agggacagatgcgcattacagggtgggcgggttcaa

SEQ ID NO: 109558 - DNA, 35 bp, Artificial Sequence
  Synthetic oligonucleotide
tccggggtggggcttgtgtgtagggtggggtgatg

SEQ ID NO: 109559 - DNA, 35 bp, Artificial Sequence
  Synthetic oligonucleotide
tgtccgtaccacaggtttatctccccatgcccgcc

SEQ ID NO: 109560 - DNA, 38 bp, Artificial Sequence
  Synthetic oligonucleotide
attgacagccgcctctatctcacgccccccgcccgtga

SEQ ID NO: 109561 - DNA, 35 bp, Artificial Sequence
  Synthetic oligonucleotide
ttgtgccccgcggttgtatttcgccacccccgtct

SEQ ID NO: 109562 - DNA, 35 bp, Artificial Sequence
  Synthetic oligonucleotide
gtctgcccactggttcatgcccaccgactcaactt

SEQ ID NO: 109563 - DNA, 35 bp, Artificial Sequence
  Synthetic oligonucleotide
acgcacccccgccacatcattatatcagtgcgtcc

SEQ ID NO: 109564 - DNA, 35 bp, Artificial Sequence
  Synthetic oligonucleotide
tcctggcccacaccatcttgagtacttaccactct

SEQ ID NO: 109565 - DNA, 37 bp, Artificial Sequence
  Synthetic oligonucleotide
aacctggggaggggtaaacggaggggtctcaagggga

SEQ ID NO: 109566 - DNA, 36 bp, Artificial Sequence
  Synthetic oligonucleotide
gtgtcacccctcgcttgtttcactctatcactttga

SEQ ID NO: 109567 - DNA, 35 bp, Artificial Sequence
  Synthetic oligonucleotide
accacacgcgccgccttccatgtacaccgcccgcg

SEQ ID NO: 109568 - DNA, 35 bp, Artificial Sequence
  Synthetic oligonucleotide
tacctagcgacgccacaccaccgcccccacccggt

SEQ ID NO: 109569 - DNA, 35 bp, Artificial Sequence
  Synthetic oligonucleotide
tccgcaccctcaactaccgtcccgctctatcgcca

SEQ ID NO: 109570 - DNA, 35 bp, Artificial Sequence
  Synthetic oligonucleotide
acaccccatcctgaattagtttctatgacttcgct

SEQ ID NO: 109571 - DNA, 36 bp, Artificial Sequence
  Synthetic oligonucleotide
agtgccaccgcccgacctcctaatgccaacgtgtca

SEQ ID NO: 109572 - DNA, 35 bp, Artificial Sequence
  Synthetic oligonucleotide
tagtcgccgtaccatcgctggcttatgacccgtac

SEQ ID NO: 109573 - DNA, 35 bp, Artificial Sequence
  Synthetic oligonucleotide
gcctatcccgctcccagcagtgtccctcctgcctc

SEQ ID NO: 109574 - DNA, 35 bp, Artificial Sequence
  Synthetic oligonucleotide
gtctgtcgcactctggttcgctctttcccctccct

SEQ ID NO: 109575 - DNA, 34 bp, Artificial Sequence
  Synthetic oligonucleotide
gctactcgctcccatatctgcatcgtaccccgcc

SEQ ID NO: 109576 - DNA, 35 bp, Artificial Sequence
  Synthetic oligonucleotide
gatgtacagtgggtgggatgggaggggcttttggt

SEQ ID NO: 109577 - DNA, 37 bp, Artificial Sequence
  Synthetic oligonucleotide
acgtgcaagtacaaagggcagagggaggggggggaga

SEQ ID NO: 109578 - DNA, 36 bp, Artificial Sequence
  Synthetic oligonucleotide
acgaggagtgggaggtaggacgggtgagtggtgcga

SEQ ID NO: 109579 - DNA, 35 bp, Artificial Sequence
  Synthetic oligonucleotide
gtagcctcacgttacgctgtcctccgtcgcctagc

SEQ ID NO: 109580 - DNA, 35 bp, Artificial Sequence
  Synthetic oligonucleotide
tgccctctccggtcgttattgcctcctgctcttct

SEQ ID NO: 109581 - DNA, 35 bp, Artificial Sequence
  Synthetic oligonucleotide
accacgcctatcatgtgccctcacctgcgccactt

SEQ ID NO: 109582 - DNA, 35 bp, Artificial Sequence
  Synthetic oligonucleotide
ggtacagacaggggatgggagtggatggggcgtac

SEQ ID NO: 109583 - DNA, 36 bp, Artificial Sequence
  Synthetic oligonucleotide
atgtgtgcgggatggtcaatgggggggagggaatca

SEQ ID NO: 109584 - DNA, 35 bp, Artificial Sequence
  Synthetic oligonucleotide
gtgtcgcacctccgccaccctcattcgagtactgc

SEQ ID NO: 109585 - DNA, 35 bp, Artificial Sequence
  Synthetic oligonucleotide
gccagccacgtccgtctcgcccactgtcatattcc

SEQ ID NO: 109586 - DNA, 34 bp, Artificial Sequence
  Synthetic oligonucleotide
gacccctccacgcccaacgcatccctgagtcctt

SEQ ID NO: 109587 - DNA, 35 bp, Artificial Sequence
  Synthetic oligonucleotide
agtccacgctcccgttctatccctaccgcttcgta

SEQ ID NO: 109588 - DNA, 35 bp, Artificial Sequence
  Synthetic oligonucleotide
gacgcgggtccgtctcggtttcatttcgcccttca

SEQ ID NO: 109589 - DNA, 37 bp, Artificial Sequence
  Synthetic oligonucleotide
acccccgccctgatccgaccccgtacgtattgcctga

SEQ ID NO: 109590 - DNA, 35 bp, Artificial Sequence
  Synthetic oligonucleotide
tcaatgacgcgggtttttgccccatctgttccatc

SEQ ID NO: 109591 - DNA, 35 bp, Artificial Sequence
  Synthetic oligonucleotide
tgcggggggaggggggagaatggtaggcgtggcat

SEQ ID NO: 109592 - DNA, 35 bp, Artificial Sequence
  Synthetic oligonucleotide
ttcgacccccgtgctgtacgtgcgcctctctcgtg

SEQ ID NO: 109593 - DNA, 36 bp, Artificial Sequence
  Synthetic oligonucleotide
actccgccacccccatgtccgttggttcccgctgaa

SEQ ID NO: 109594 - DNA, 37 bp, Artificial Sequence
  Synthetic oligonucleotide
tgcacgccgactattgctatcgcactccccctttcga

SEQ ID NO: 109595 - DNA, 37 bp, Artificial Sequence
  Synthetic oligonucleotide
gccctcgcccatgctttgtctacatcttcacccatga

SEQ ID NO: 109596 - DNA, 35 bp, Artificial Sequence
  Synthetic oligonucleotide
gccctcctcatctgtccccaacgactatgttggct

SEQ ID NO: 109597 - DNA, 35 bp, Artificial Sequence
  Synthetic oligonucleotide
accccatcacgatcgttacacgtgcctcatctgtc

SEQ ID NO: 109598 - DNA, 35 bp, Artificial Sequence
  Synthetic oligonucleotide
tcacgcctgtagcactgcacccatcctctcatctg

SEQ ID NO: 109599 - DNA, 35 bp, Artificial Sequence
  Synthetic oligonucleotide
acgcatactcaccgccgctgctgcttgatcaccct

SEQ ID NO: 109600 - DNA, 37 bp, Artificial Sequence
  Synthetic oligonucleotide
tcgaccaccgctaatggtggtacctcccctcacttga

SEQ ID NO: 109601 - DNA, 36 bp, Artificial Sequence
  Synthetic oligonucleotide
ggtggggcgggaaggaagggctaggtgatgatggga

SEQ ID NO: 109602 - DNA, 35 bp, Artificial Sequence
  Synthetic oligonucleotide
acagccacacatgcgaccatcgcctcccgcctatc

SEQ ID NO: 109603 - DNA, 35 bp, Artificial Sequence
  Synthetic oligonucleotide
gttcatcaccgccatagctttgcgctcccctcctc

SEQ ID NO: 109604 - DNA, 35 bp, Artificial Sequence
  Synthetic oligonucleotide
agcggagccaattgcgctttgccgaccgttcctct

SEQ ID NO: 109605 - DNA, 35 bp, Artificial Sequence
  Synthetic oligonucleotide
agtcaaccctctgtttcgttcgccccacggctcca

SEQ ID NO: 109606 - DNA, 37 bp, Artificial Sequence
  Synthetic oligonucleotide
accgggggcggttagataagtatggagggagggggga

SEQ ID NO: 109607 - DNA, 35 bp, Artificial Sequence
  Synthetic oligonucleotide
tacattccgccttgctcacctgccgggtcttctcc

SEQ ID NO: 109608 - DNA, 35 bp, Artificial Sequence
  Synthetic oligonucleotide
tatgcgtgcccgcctctgctcccgttcttcttaca

SEQ ID NO: 109609 - DNA, 35 bp, Artificial Sequence
  Synthetic oligonucleotide
tcccatgaccatggttttcacgatagtgcccttcc

SEQ ID NO: 109610 - DNA, 35 bp, Artificial Sequence
  Synthetic oligonucleotide
gaccaccacatttgtgatggacccttctcgtttcc

SEQ ID NO: 109611 - DNA, 35 bp, Artificial Sequence
  Synthetic oligonucleotide
gcgcctgggcaccctctccgtcacgtccccctccg

SEQ ID NO: 109612 - DNA, 35 bp, Artificial Sequence
  Synthetic oligonucleotide
attgcctcgccctctgccataacgttgcccgcaca

SEQ ID NO: 109613 - DNA, 37 bp, Artificial Sequence
  Synthetic oligonucleotide
tatcccctcaatgctctatctgcgcacacactcccga

SEQ ID NO: 109614 - DNA, 35 bp, Artificial Sequence
  Synthetic oligonucleotide
atcgcgccagccctgctctgatcccttacctatcc

SEQ ID NO: 109615 - DNA, 36 bp, Artificial Sequence
  Synthetic oligonucleotide
gatctgtccccccgcttgtctcttagccattcccca

SEQ ID NO: 109616 - DNA, 35 bp, Artificial Sequence
  Synthetic oligonucleotide
tgggggtgacggggtggtaggtacggaacgggcga

SEQ ID NO: 109617 - DNA, 35 bp, Artificial Sequence
  Synthetic oligonucleotide
tacgccgcccggtcgctttactccacttgctcgtg

SEQ ID NO: 109618 - DNA, 36 bp, Artificial Sequence
  Synthetic oligonucleotide
tcattgctcgccccgtactggttttgcacaccttca

SEQ ID NO: 109619 - DNA, 35 bp, Artificial Sequence
  Synthetic oligonucleotide
aaccacgccttccgtagcaccatgtattccttccg

SEQ ID NO: 109620 - DNA, 36 bp, Artificial Sequence
  Synthetic oligonucleotide
taccgggcggggacgggagggaagggtgtgtaggaa

SEQ ID NO: 109621 - DNA, 35 bp, Artificial Sequence
  Synthetic oligonucleotide
agccgccgacgcgtttcgtttttgttctaccgcct

SEQ ID NO: 109622 - DNA, 35 bp, Artificial Sequence
  Synthetic oligonucleotide
acacgcacctccgtttctttctttaggttcccgtt

SEQ ID NO: 109623 - DNA, 36 bp, Artificial Sequence
  Synthetic oligonucleotide
accgttgccctcctccttttgtttccgccttgccga

SEQ ID NO: 109624 - DNA, 36 bp, Artificial Sequence
  Synthetic oligonucleotide
tgcaccgccgcccccatgctttaggtcacgtttcca

SEQ ID NO: 109625 - DNA, 34 bp, Artificial Sequence
  Synthetic oligonucleotide
ttgaacgccgaccatcatctgtccccccctttgc

SEQ ID NO: 109626 - DNA, 36 bp, Artificial Sequence
  Synthetic oligonucleotide
tcccgtatccctcgtcctgtcgctgtctccgcccca

SEQ ID NO: 109627 - DNA, 35 bp, Artificial Sequence
  Synthetic oligonucleotide
gccgccgtttccgtcctcatgtccttctgcggcac

SEQ ID NO: 109628 - DNA, 37 bp, Artificial Sequence
  Synthetic oligonucleotide
gaggaagaggagagggggcgtttggaaaggggaagga

SEQ ID NO: 109629 - DNA, 37 bp, Artificial Sequence
  Synthetic oligonucleotide
gactccgcccatgatccgtctgctatcttccctcgga

SEQ ID NO: 109630 - DNA, 35 bp, Artificial Sequence
  Synthetic oligonucleotide
gcccatcgcaccatccaacgaaccccggggtccac

SEQ ID NO: 109631 - DNA, 35 bp, Artificial Sequence
  Synthetic oligonucleotide
gagcactcccgccgacgctccatttaatggcctct

SEQ ID NO: 109632 - DNA, 35 bp, Artificial Sequence
  Synthetic oligonucleotide
gaatcacctccatggtcctgtcctgccctcttgta

SEQ ID NO: 109633 - DNA, 35 bp, Artificial Sequence
  Synthetic oligonucleotide
acctcccgtccattttcattgccacgtaccctcgt

SEQ ID NO: 109634 - DNA, 36 bp, Artificial Sequence
  Synthetic oligonucleotide
tcgcgacgcctcgccacaagccacacaccacgctca

SEQ ID NO: 109635 - DNA, 35 bp, Artificial Sequence
  Synthetic oligonucleotide
tgcccaccgtcgtcgcgcatcccaccataaccggc

SEQ ID NO: 109636 - DNA, 35 bp, Artificial Sequence
  Synthetic oligonucleotide
aatgctacccagatcgccgccacgcccctcgtttc

SEQ ID NO: 109637 - DNA, 35 bp, Artificial Sequence
  Synthetic oligonucleotide
gctgctacgcctcgcaccctttctgccatcacctg

SEQ ID NO: 109638 - DNA, 34 bp, Artificial Sequence
  Synthetic oligonucleotide
tctaccgctcctttgcactgcctcatttgctcca

SEQ ID NO: 109639 - DNA, 35 bp, Artificial Sequence
  Synthetic oligonucleotide
tgtgacgggctccacttgttgcttcacctctacga

SEQ ID NO: 109640 - DNA, 37 bp, Artificial Sequence
  Synthetic oligonucleotide
atcccccccatctatgtcttcgaggcttcagactcga

SEQ ID NO: 109641 - DNA, 35 bp, Artificial Sequence
  Synthetic oligonucleotide
gcctcctgccgttattgctcacctgacctccttga

SEQ ID NO: 109642 - DNA, 36 bp, Artificial Sequence
  Synthetic oligonucleotide
gtcgcctatccctgcccccgtgtgtacgccgctgta

SEQ ID NO: 109643 - DNA, 35 bp, Artificial Sequence
  Synthetic oligonucleotide
gcacagcccgttcaacgccgttcgcatcacgcctc

SEQ ID NO: 109644 - DNA, 35 bp, Artificial Sequence
  Synthetic oligonucleotide
gcaacgccccccctggcatccctcctccgtgcgcg

SEQ ID NO: 109645 - DNA, 35 bp, Artificial Sequence
  Synthetic oligonucleotide
gaatgcaccattctgccttagaaccgtttcctcca

SEQ ID NO: 109646 - DNA, 35 bp, Artificial Sequence
  Synthetic oligonucleotide
taagccgcacttgaaaagcttgtcccctgcttccc

SEQ ID NO: 109647 - DNA, 35 bp, Artificial Sequence
  Synthetic oligonucleotide
gagacccgctccacgcccttacagtttacccctcg

SEQ ID NO: 109648 - DNA, 35 bp, Artificial Sequence
  Synthetic oligonucleotide
tgcgagtatgggggcaagggaatgaactggagggg

SEQ ID NO: 109649 - DNA, 36 bp, Artificial Sequence
  Synthetic oligonucleotide
gccgccgccctccaccagttaatgtcgttgcttcca

SEQ ID NO: 109650 - DNA, 38 bp, Artificial Sequence
  Synthetic oligonucleotide
gtggttcaccgccctcttgcccttacagtcctcgttga

SEQ ID NO: 109651 - DNA, 36 bp, Artificial Sequence
  Synthetic oligonucleotide
gttacaccctgtccctgtcgcaattgccacgcatta

SEQ ID NO: 109652 - DNA, 35 bp, Artificial Sequence
  Synthetic oligonucleotide
atacaccacgcccccgagtacgttttccatttgcc

SEQ ID NO: 109653 - DNA, 35 bp, Artificial Sequence
  Synthetic oligonucleotide
aactcccccgccgacgcacccgaagtacactatca

SEQ ID NO: 109654 - DNA, 35 bp, Artificial Sequence
  Synthetic oligonucleotide
tccgcctgccctcttatagtaaccgatcttgccac

SEQ ID NO: 109655 - DNA, 35 bp, Artificial Sequence
  Synthetic oligonucleotide
acgtggagggacgggccggagtggaggggaaggat

SEQ ID NO: 109656 - DNA, 35 bp, Artificial Sequence
  Synthetic oligonucleotide
acacaggccgtacacatcgatcacgaacctccgcc

SEQ ID NO: 109657 - DNA, 38 bp, Artificial Sequence
  Synthetic oligonucleotide
tcatgccgctaccccgttctacctcccgcgctgcctga

SEQ ID NO: 109658 - DNA, 35 bp, Artificial Sequence
  Synthetic oligonucleotide
gaagagagaggaggaggtgtaggggtcggctgttg

SEQ ID NO: 109659 - DNA, 37 bp, Artificial Sequence
  Synthetic oligonucleotide
tccagaggggatggaggaggggggggagtagggccga

SEQ ID NO: 109660 - DNA, 37 bp, Artificial Sequence
  Synthetic oligonucleotide
tgacgagggagatagaagggcggggaaggaaactcga

SEQ ID NO: 109661 - DNA, 35 bp, Artificial Sequence
  Synthetic oligonucleotide
acctcaatcgcacgtgcctatcattgcccgatttc

SEQ ID NO: 109662 - DNA, 35 bp, Artificial Sequence
  Synthetic oligonucleotide
gtaggaaggaggaggaatagggaatgggatcacgg

SEQ ID NO: 109663 - DNA, 35 bp, Artificial Sequence
  Synthetic oligonucleotide
ggttcgacacctcccgccacagttgccgttccccc

SEQ ID NO: 109664 - DNA, 35 bp, Artificial Sequence
  Synthetic oligonucleotide
aacaccgcctgcgagtttggtcgccccctgctatt

SEQ ID NO: 109665 - DNA, 37 bp, Artificial Sequence
  Synthetic oligonucleotide
gacggagacaggggcggaggatggaaagtgtgtcaga

SEQ ID NO: 109666 - DNA, 35 bp, Artificial Sequence
  Synthetic oligonucleotide
ttcgtcccacccgccgcaatcaaatggtctcctcg

SEQ ID NO: 109667 - DNA, 35 bp, Artificial Sequence
  Synthetic oligonucleotide
gtcgtcctccgttaccgagttcatgttccgttccc

SEQ ID NO: 109668 - DNA, 35 bp, Artificial Sequence
  Synthetic oligonucleotide
taagcacgccgcgtcctccctttgtgcctcctctg

SEQ ID NO: 109669 - DNA, 36 bp, Artificial Sequence
  Synthetic oligonucleotide
aaactggagggggagggtgggagagctgggggtgca

SEQ ID NO: 109670 - DNA, 35 bp, Artificial Sequence
  Synthetic oligonucleotide
gggaggagcacgggagggaggtaaacggataaggg

SEQ ID NO: 109671 - DNA, 35 bp, Artificial Sequence
  Synthetic oligonucleotide
acgcccccaaccgcccgccttgacatattaagcca

SEQ ID NO: 109672 - DNA, 36 bp, Artificial Sequence
  Synthetic oligonucleotide
tgatttccacgccacctgtcctgtttctcacctgta

SEQ ID NO: 109673 - DNA, 35 bp, Artificial Sequence
  Synthetic oligonucleotide
gacactgactcaacgcctgtaaagccccctctcgc

SEQ ID NO: 109674 - DNA, 36 bp, Artificial Sequence
  Synthetic oligonucleotide
gtgccacgctccctcactgttagtccaccccgcaca

SEQ ID NO: 109675 - DNA, 35 bp, Artificial Sequence
  Synthetic oligonucleotide
gagcgcctatcaacgtgtcccatcaccactgctcc

SEQ ID NO: 109676 - DNA, 35 bp, Artificial Sequence
  Synthetic oligonucleotide
gcccaaccagcaccgccttctgttaccatccctgc

SEQ ID NO: 109677 - DNA, 35 bp, Artificial Sequence
  Synthetic oligonucleotide
tacccgcctactacccagccctacccccgagtgct

SEQ ID NO: 109678 - DNA, 37 bp, Artificial Sequence
  Synthetic oligonucleotide
gtacgaggggtaggggtgatcgggcggggaacggaga

SEQ ID NO: 109679 - DNA, 36 bp, Artificial Sequence
  Synthetic oligonucleotide
tgcataacgtgggagggtggattaggggggtgggca

SEQ ID NO: 109680 - DNA, 36 bp, Artificial Sequence
  Synthetic oligonucleotide
gttcgctgccctgcctttctaccgtcttcatccagt

SEQ ID NO: 109681 - DNA, 36 bp, Artificial Sequence
  Synthetic oligonucleotide
tcatgccccccgcttgcatatggaccatcctacgca

SEQ ID NO: 109682 - DNA, 36 bp, Artificial Sequence
  Synthetic oligonucleotide
ttcgcgtcgcaacatcgagtgtcccctgtttcccca

SEQ ID NO: 109683 - DNA, 35 bp, Artificial Sequence
  Synthetic oligonucleotide
gacacccccgattccctggaccccccgattaacgc

SEQ ID NO: 109684 - DNA, 35 bp, Artificial Sequence
  Synthetic oligonucleotide
gcactgctgcaaattctatcgtcctggccattctg

SEQ ID NO: 109685 - DNA, 34 bp, Artificial Sequence
  Synthetic oligonucleotide
tctgcccctccgccctcggcccgatccctgacca

SEQ ID NO: 109686 - DNA, 35 bp, Artificial Sequence
  Synthetic oligonucleotide
tcactgccaccttcatacatactcgcgatctacgc

SEQ ID NO: 109687 - DNA, 36 bp, Artificial Sequence
  Synthetic oligonucleotide
tacgtctgccaccctccgttgtttgttccttgcgca

SEQ ID NO: 109688 - DNA, 37 bp, Artificial Sequence
  Synthetic oligonucleotide
acatagggaagggcaaagggggcgggggataccggga

SEQ ID NO: 109689 - DNA, 38 bp, Artificial Sequence
  Synthetic oligonucleotide
acacgccctcgccgaccgcctctttgaacaccttctga

SEQ ID NO: 109690 - DNA, 36 bp, Artificial Sequence
  Synthetic oligonucleotide
gcatgcattgtccgtttgctacccccgtccctgcta

SEQ ID NO: 109691 - DNA, 35 bp, Artificial Sequence
  Synthetic oligonucleotide
acccgatcatccgctccatatagcttcgccatgcc

SEQ ID NO: 109692 - DNA, 35 bp, Artificial Sequence
  Synthetic oligonucleotide
acacgggtgggagggagaggaaacgggaagcgttg

SEQ ID NO: 109693 - DNA, 36 bp, Artificial Sequence
  Synthetic oligonucleotide
tggacgccaccgctgcccttagttccttcacgctta

SEQ ID NO: 109694 - DNA, 35 bp, Artificial Sequence
  Synthetic oligonucleotide
tgccgacctcccatccttaagtcacctccaacgct

SEQ ID NO: 109695 - DNA, 35 bp, Artificial Sequence
  Synthetic oligonucleotide
agcccacactttgcttgttttcgtacgcctatgcc

SEQ ID NO: 109696 - DNA, 35 bp, Artificial Sequence
  Synthetic oligonucleotide
gacggggggacgggaggaagttaaactagagggcg

SEQ ID NO: 109697 - DNA, 35 bp, Artificial Sequence
  Synthetic oligonucleotide
gacgcacactattgatttcacggttgtctccttcc

SEQ ID NO: 109698 - DNA, 35 bp, Artificial Sequence
  Synthetic oligonucleotide
acacgcctgtatcgcccactccaacgtttcctttg

SEQ ID NO: 109699 - DNA, 36 bp, Artificial Sequence
  Synthetic oligonucleotide
taggaggggcagggaggggaggggcaccaacaaaaa

SEQ ID NO: 109700 - DNA, 35 bp, Artificial Sequence
  Synthetic oligonucleotide
agccgggaaggggggggtgaggtggactatgggga

SEQ ID NO: 109701 - DNA, 35 bp, Artificial Sequence
  Synthetic oligonucleotide
ttgcactcgccctatcgcatggaccccagttcacc

SEQ ID NO: 109702 - DNA, 35 bp, Artificial Sequence
  Synthetic oligonucleotide
gcccgcccttgtttcatccagtgtcattctcaccg

SEQ ID NO: 109703 - DNA, 36 bp, Artificial Sequence
  Synthetic oligonucleotide
gactccttcgtccgttctacgctactgcccttcgca

SEQ ID NO: 109704 - DNA, 37 bp, Artificial Sequence
  Synthetic oligonucleotide
aaagcgccgggtggtcaacggggggaaggggcgcgga

SEQ ID NO: 109705 - DNA, 35 bp, Artificial Sequence
  Synthetic oligonucleotide
tccatccgcgcttttggtctgcggctcttctactt

SEQ ID NO: 109706 - DNA, 35 bp, Artificial Sequence
  Synthetic oligonucleotide
tcacgccctgtcctccagtttcttgtcccgggctc

SEQ ID NO: 109707 - DNA, 36 bp, Artificial Sequence
  Synthetic oligonucleotide
gaccgcaagccgccctcctgcgccacgttcttctta

SEQ ID NO: 109708 - DNA, 34 bp, Artificial Sequence
  Synthetic oligonucleotide
gtcaccttccggatctggcccatcgctttcaaca

SEQ ID NO: 109709 - DNA, 37 bp, Artificial Sequence
  Synthetic oligonucleotide
tcgtatcggcccctggtttctggtccactcccttcga

SEQ ID NO: 109710 - DNA, 35 bp, Artificial Sequence
  Synthetic oligonucleotide
gtcacatcccatctccatacggcctcccttaggta

SEQ ID NO: 109711 - DNA, 35 bp, Artificial Sequence
  Synthetic oligonucleotide
gcaacctaccctcccctgtaacattcgcccgtcca

SEQ ID NO: 109712 - DNA, 36 bp, Artificial Sequence
  Synthetic oligonucleotide
gttgaagggcggggggacacggaggaaatagaggga

SEQ ID NO: 109713 - DNA, 35 bp, Artificial Sequence
  Synthetic oligonucleotide
attgtcaatagcctgcccgccctatgcgccgcccc

SEQ ID NO: 109714 - DNA, 37 bp, Artificial Sequence
  Synthetic oligonucleotide
gaccgatcagccgttcgcttgcctgcctttcccgtga

SEQ ID NO: 109715 - DNA, 35 bp, Artificial Sequence
  Synthetic oligonucleotide
gtgccactcctgtatcctcgcccttgtaactgacc

SEQ ID NO: 109716 - DNA, 35 bp, Artificial Sequence
  Synthetic oligonucleotide
gcacccgaccgtcccctcatcgccgcactagctgt

SEQ ID NO: 109717 - DNA, 35 bp, Artificial Sequence
  Synthetic oligonucleotide
gagtgggggggagccgcgttagggaagggcgatag

SEQ ID NO: 109718 - DNA, 37 bp, Artificial Sequence
  Synthetic oligonucleotide
gccgtaggccccaccaggttttttgtacttcccccga

SEQ ID NO: 109719 - DNA, 38 bp, Artificial Sequence
  Synthetic oligonucleotide
gtggaccgccgcctgcgactacttctgccactctttga

SEQ ID NO: 109720 - DNA, 35 bp, Artificial Sequence
  Synthetic oligonucleotide
tacgctcaacctcctggaactgttcccgctatacc

SEQ ID NO: 109721 - DNA, 36 bp, Artificial Sequence
  Synthetic oligonucleotide
acgatccgtgccgccttgcctctgtaccgccattaa

SEQ ID NO: 109722 - DNA, 37 bp, Artificial Sequence
  Synthetic oligonucleotide
gaccagccgctgctcttctacgttcacgcctcccgga

SEQ ID NO: 109723 - DNA, 35 bp, Artificial Sequence
  Synthetic oligonucleotide
agcccgcaccccctgacccctctctggccccttgc

SEQ ID NO: 109724 - DNA, 35 bp, Artificial Sequence
  Synthetic oligonucleotide
tcgtgaggtcccgtttcctcctttcatgtctcgcc

SEQ ID NO: 109725 - DNA, 35 bp, Artificial Sequence
  Synthetic oligonucleotide
acccccgcatactcgtgcactccgaacatctacac

SEQ ID NO: 109726 - DNA, 35 bp, Artificial Sequence
  Synthetic oligonucleotide
tctgcgccgccatctttcgttacccgctgttccac

SEQ ID NO: 109727 - DNA, 35 bp, Artificial Sequence
  Synthetic oligonucleotide
acgccaccccgaacgtgtgtccgccctttcttgct

SEQ ID NO: 109728 - DNA, 35 bp, Artificial Sequence
  Synthetic oligonucleotide
tccccccgctccatcagaacccactttcatctggc

SEQ ID NO: 109729 - DNA, 35 bp, Artificial Sequence
  Synthetic oligonucleotide
ttggaccccgccacaccccgtagctcgcttacaag

SEQ ID NO: 109730 - DNA, 35 bp, Artificial Sequence
  Synthetic oligonucleotide
tagaacgggttcaggggggaagggatacgataagg

SEQ ID NO: 109731 - DNA, 38 bp, Artificial Sequence
  Synthetic oligonucleotide
tacgtccccccccaggttttatcgttccgtccttttga

SEQ ID NO: 109732 - DNA, 35 bp, Artificial Sequence
  Synthetic oligonucleotide
tgctgccccgattagcatcactgtccattcgccct

SEQ ID NO: 109733 - DNA, 36 bp, Artificial Sequence
  Synthetic oligonucleotide
ttgaccccagcgtgtctttacctccactgcatgtca

SEQ ID NO: 109734 - DNA, 35 bp, Artificial Sequence
  Synthetic oligonucleotide
ataccctgccctcaagcatcccagcccgtacctgc

SEQ ID NO: 109735 - DNA, 36 bp, Artificial Sequence
  Synthetic oligonucleotide
tgcctcccctcctgctgtccgtttagaactttcaga

SEQ ID NO: 109736 - DNA, 35 bp, Artificial Sequence
  Synthetic oligonucleotide
attcacaccctccctgacctggttgttgacactct

SEQ ID NO: 109737 - DNA, 37 bp, Artificial Sequence
  Synthetic oligonucleotide
tccacaccccactcttgtttgcgcatgacactacgga

SEQ ID NO: 109738 - DNA, 35 bp, Artificial Sequence
  Synthetic oligonucleotide
tccgactcgctgtagcccccacatgactgcctctc

SEQ ID NO: 109739 - DNA, 35 bp, Artificial Sequence
  Synthetic oligonucleotide
gtgccgagaccgaccctccattgtgcccccgcccg

SEQ ID NO: 109740 - DNA, 38 bp, Artificial Sequence
  Synthetic oligonucleotide
tcgcccaccgccaccatccccgtgagctgcccttttga

SEQ ID NO: 109741 - DNA, 35 bp, Artificial Sequence
  Synthetic oligonucleotide
gcatccgccttcccactctgcgcgcttatttcgct

SEQ ID NO: 109742 - DNA, 35 bp, Artificial Sequence
  Synthetic oligonucleotide
tatgcgtgcgccctctatcgtaccgtaccgtttct

SEQ ID NO: 109743 - DNA, 35 bp, Artificial Sequence
  Synthetic oligonucleotide
gggactcccaccacattgcgcttgaacggccttct

SEQ ID NO: 109744 - DNA, 35 bp, Artificial Sequence
  Synthetic oligonucleotide
tatggcaccattagcaagttgctgctccacccctc

SEQ ID NO: 109745 - DNA, 38 bp, Artificial Sequence
  Synthetic oligonucleotide
ggtccaggagggtgggaggaagggagcggaaattatga

SEQ ID NO: 109746 - DNA, 31 bp, Artificial Sequence
  Synthetic oligonucleotide
tgacaaacgtacactcccactgtaactcgcc

SEQ ID NO: 109747 - DNA, 35 bp, Artificial Sequence
  Synthetic oligonucleotide
acgtactgatcgccccctggtagccccacgcctct

SEQ ID NO: 109748 - DNA, 35 bp, Artificial Sequence
  Synthetic oligonucleotide
tccacccgccggtgttccgtagcgtaggctccctt

SEQ ID NO: 109749 - DNA, 35 bp, Artificial Sequence
  Synthetic oligonucleotide
ttcagcctcacttcgcgatctccttgcctaccccg

SEQ ID NO: 109750 - DNA, 35 bp, Artificial Sequence
  Synthetic oligonucleotide
acccccgtatggcccgtgcgtaaaccctgctctca

SEQ ID NO: 109751 - DNA, 35 bp, Artificial Sequence
  Synthetic oligonucleotide
gccccgccccctggtatatctgcccgacactacat

SEQ ID NO: 109752 - DNA, 35 bp, Artificial Sequence
  Synthetic oligonucleotide
gacccgccacacattcgcgtacaatatctggctct

SEQ ID NO: 109753 - DNA, 36 bp, Artificial Sequence
  Synthetic oligonucleotide
gcgcggaggctggaggccggaaaaggtggaggtata

SEQ ID NO: 109754 - DNA, 35 bp, Artificial Sequence
  Synthetic oligonucleotide
atgaccctccactgctgtatagccactctcactcg

SEQ ID NO: 109755 - DNA, 35 bp, Artificial Sequence
  Synthetic oligonucleotide
tcgaaccgcaccacctatgcgcactacacttacgc

SEQ ID NO: 109756 - DNA, 37 bp, Artificial Sequence
  Synthetic oligonucleotide
gggtggggggcgaggggacggggactaggtcagacga

SEQ ID NO: 109757 - DNA, 37 bp, Artificial Sequence
  Synthetic oligonucleotide
tcgaccgggctcggtctcgaactctccctttcaccga

SEQ ID NO: 109758 - DNA, 34 bp, Artificial Sequence
  Synthetic oligonucleotide
ttcatacaccgccctctcgaatgcacatatacac

SEQ ID NO: 109759 - DNA, 35 bp, Artificial Sequence
  Synthetic oligonucleotide
tccgttcctccgctccgactgttccaactgttaca

SEQ ID NO: 109760 - DNA, 35 bp, Artificial Sequence
  Synthetic oligonucleotide
gccccacacttctgccatcccgaccaagaccctgc

SEQ ID NO: 109761 - DNA, 36 bp, Artificial Sequence
  Synthetic oligonucleotide
tgactccccctttggccctactgtccctttcaagca

SEQ ID NO: 109762 - DNA, 35 bp, Artificial Sequence
  Synthetic oligonucleotide
acttcaccgcaagtgtctccccccttgccccgcac

SEQ ID NO: 109763 - DNA, 36 bp, Artificial Sequence
  Synthetic oligonucleotide
tcctgccttagcctgcccactgtttcgctctcgtta

SEQ ID NO: 109764 - DNA, 35 bp, Artificial Sequence
  Synthetic oligonucleotide
tcatgccacccttccctctccagacggctcgaggc

SEQ ID NO: 109765 - DNA, 35 bp, Artificial Sequence
  Synthetic oligonucleotide
tcctccgagggagtagtagtgcttcatccaccttc

SEQ ID NO: 109766 - DNA, 38 bp, Artificial Sequence
  Synthetic oligonucleotide
gagccccgatcaattgattccgccctgccatcccctga

SEQ ID NO: 109767 - DNA, 35 bp, Artificial Sequence
  Synthetic oligonucleotide
ggacgcatcgccccgactctatatcgcctgcctgt

SEQ ID NO: 109768 - DNA, 35 bp, Artificial Sequence
  Synthetic oligonucleotide
taccccgctgttggtgtcactgccggccttcccta

SEQ ID NO: 109769 - DNA, 35 bp, Artificial Sequence
  Synthetic oligonucleotide
atcaccacccactccgatccttgtctgactcttgg

SEQ ID NO: 109770 - DNA, 35 bp, Artificial Sequence
  Synthetic oligonucleotide
gtccatctccgtcacccatgatttcctgctgcatt

SEQ ID NO: 109771 - DNA, 36 bp, Artificial Sequence
  Synthetic oligonucleotide
gagagggggggagtacggggacgaagagagcctata

SEQ ID NO: 109772 - DNA, 36 bp, Artificial Sequence
  Synthetic oligonucleotide
aatgctgacctcgccctgtccactaaggcctttcca

SEQ ID NO: 109773 - DNA, 35 bp, Artificial Sequence
  Synthetic oligonucleotide
gcccgtctgtctccgcacacgccacttggtccctc

SEQ ID NO: 109774 - DNA, 38 bp, Artificial Sequence
  Synthetic oligonucleotide
tttcacccccatggtctacacgctgcacctcccgctga

SEQ ID NO: 109775 - DNA, 35 bp, Artificial Sequence
  Synthetic oligonucleotide
accccatccggaccacctttgtctttctctgctcg

SEQ ID NO: 109776 - DNA, 35 bp, Artificial Sequence
  Synthetic oligonucleotide
gaccacgtatccgtgggcttatattcgttcccgcc

SEQ ID NO: 109777 - DNA, 35 bp, Artificial Sequence
  Synthetic oligonucleotide
acccaaccacgacaccgctgctttactacgctcct

SEQ ID NO: 109778 - DNA, 35 bp, Artificial Sequence
  Synthetic oligonucleotide
gacaccctgcgtcagctctccccgtccgttgccta

SEQ ID NO: 109779 - DNA, 36 bp, Artificial Sequence
  Synthetic oligonucleotide
aatcctccgcccccgtgatatcaaagcccggccccc

SEQ ID NO: 109780 - DNA, 35 bp, Artificial Sequence
  Synthetic oligonucleotide
tttgccatcagtgctgcctttcctctcgccttttt

SEQ ID NO: 109781 - DNA, 35 bp, Artificial Sequence
  Synthetic oligonucleotide
gccgtcgcaccaccgtctagcccccacttatcgca

SEQ ID NO: 109782 - DNA, 38 bp, Artificial Sequence
  Synthetic oligonucleotide
gcgcacgacagcactgccattggcctccatcctcttga

SEQ ID NO: 109783 - DNA, 35 bp, Artificial Sequence
  Synthetic oligonucleotide
ttcgccacttctctgctgtcgttaggctccccctt

SEQ ID NO: 109784 - DNA, 35 bp, Artificial Sequence
  Synthetic oligonucleotide
tcccgcccggccccctgcatagcctcataacctcc

SEQ ID NO: 109785 - DNA, 35 bp, Artificial Sequence
  Synthetic oligonucleotide
gccaccccacagacatctccctcacgcgcccttcc

SEQ ID NO: 109786 - DNA, 38 bp, Artificial Sequence
  Synthetic oligonucleotide
gatggggtggacggtgggtaaggtagcaatggaggtga

SEQ ID NO: 109787 - DNA, 37 bp, Artificial Sequence
  Synthetic oligonucleotide
tccgccctccctcgctgtttccttgactcggcacaga

SEQ ID NO: 109788 - DNA, 35 bp, Artificial Sequence
  Synthetic oligonucleotide
gtgaaacaccacatcgccccccgtgacatcctggt

SEQ ID NO: 109789 - DNA, 37 bp, Artificial Sequence
  Synthetic oligonucleotide
cccaggggctccaatgggggtgtatagggcggggaga

SEQ ID NO: 109790 - DNA, 35 bp, Artificial Sequence
  Synthetic oligonucleotide
gccgcctcgcacgctttatataaatttgccctcct

SEQ ID NO: 109791 - DNA, 35 bp, Artificial Sequence
  Synthetic oligonucleotide
tcaaacccacaccttgcctctatcgcctcgggaac

SEQ ID NO: 109792 - DNA, 36 bp, Artificial Sequence
  Synthetic oligonucleotide
gcccacctccaccgcaccttagtttgtttatgcaaa

SEQ ID NO: 109793 - DNA, 35 bp, Artificial Sequence
  Synthetic oligonucleotide
tacccccacacagccgtattcgccccactgccctt

SEQ ID NO: 109794 - DNA, 35 bp, Artificial Sequence
  Synthetic oligonucleotide
actgagcacgtgcggctgcatatcgctttcttctc

SEQ ID NO: 109795 - DNA, 35 bp, Artificial Sequence
  Synthetic oligonucleotide
gtgcagtcgcacatagtttcccccttactccactc

SEQ ID NO: 109796 - DNA, 35 bp, Artificial Sequence
  Synthetic oligonucleotide
gttgcgcatctgaccaccaccgagccttgttgtcc

SEQ ID NO: 109797 - DNA, 35 bp, Artificial Sequence
  Synthetic oligonucleotide
atgccccgtttcattgctgcacgtccggtccccgc

SEQ ID NO: 109798 - DNA, 35 bp, Artificial Sequence
  Synthetic oligonucleotide
cctggaactcatgcacctaagcactggcccccgtc

SEQ ID NO: 109799 - DNA, 35 bp, Artificial Sequence
  Synthetic oligonucleotide
tgatgggaggggagggattgagtgaacgggttgcg

SEQ ID NO: 109800 - DNA, 35 bp, Artificial Sequence
  Synthetic oligonucleotide
tgaggcggagtagaggggcggaaagggtagggagg

SEQ ID NO: 109801 - DNA, 35 bp, Artificial Sequence
  Synthetic oligonucleotide
tgtatagcacacttgcctcccagcctcccgctcca

SEQ ID NO: 109802 - DNA, 36 bp, Artificial Sequence
  Synthetic oligonucleotide
tctgtctcgccccccaactgtttgaccacatcttca

SEQ ID NO: 109803 - DNA, 38 bp, Artificial Sequence
  Synthetic oligonucleotide
gccgggcgggtcgggcagggtattgatctctctgttga

SEQ ID NO: 109804 - DNA, 35 bp, Artificial Sequence
  Synthetic oligonucleotide
atgtgcccctccagccatgagtaatcctcattcac

SEQ ID NO: 109805 - DNA, 35 bp, Artificial Sequence
  Synthetic oligonucleotide
agcccctcctcgcctgtctcttgcgttctgcgctc

SEQ ID NO: 109806 - DNA, 35 bp, Artificial Sequence
  Synthetic oligonucleotide
actgtcaccctccgcacttgtccaatttaccaacg

SEQ ID NO: 109807 - DNA, 37 bp, Artificial Sequence
  Synthetic oligonucleotide
gacgcctcgcatctgcccaccaacccccccttaggga

SEQ ID NO: 109808 - DNA, 37 bp, Artificial Sequence
  Synthetic oligonucleotide
taccaccactctcgttctgtttggccatctctcacga

SEQ ID NO: 109809 - DNA, 35 bp, Artificial Sequence
  Synthetic oligonucleotide
gcccaacgcctttcctcgcatatagatatccatcc

SEQ ID NO: 109810 - DNA, 35 bp, Artificial Sequence
  Synthetic oligonucleotide
gacacagtctcgacgcccctctaatttccctcgct

SEQ ID NO: 109811 - DNA, 35 bp, Artificial Sequence
  Synthetic oligonucleotide
gcgtcggtcaactgcaccatccctacttcctccgt

SEQ ID NO: 109812 - DNA, 35 bp, Artificial Sequence
  Synthetic oligonucleotide
tcatccatcctcgcctgatcacgctaccccgggcg

SEQ ID NO: 109813 - DNA, 36 bp, Artificial Sequence
  Synthetic oligonucleotide
ggaaagggggggctggggaatgcggggtgataacta

SEQ ID NO: 109814 - DNA, 34 bp, Artificial Sequence
  Synthetic oligonucleotide
gaagccatcctctacactatcattgcacgcccgc

SEQ ID NO: 109815 - DNA, 35 bp, Artificial Sequence
  Synthetic oligonucleotide
agatgctcccctcctgtcgtacctcctttgttgcg

SEQ ID NO: 109816 - DNA, 35 bp, Artificial Sequence
  Synthetic oligonucleotide
tccgctgtgcaactccgcctcgcccgactccttat

SEQ ID NO: 109817 - DNA, 35 bp, Artificial Sequence
  Synthetic oligonucleotide
acttcctccgccctatgttattgttcctccacgac

SEQ ID NO: 109818 - DNA, 35 bp, Artificial Sequence
  Synthetic oligonucleotide
accaatcccgccgtgttcctgcattcattcggttc

SEQ ID NO: 109819 - DNA, 36 bp, Artificial Sequence
  Synthetic oligonucleotide
ggggtggggaatgtagggggcaaaggaaggccggag

SEQ ID NO: 109820 - DNA, 35 bp, Artificial Sequence
  Synthetic oligonucleotide
tgtaccgcctatgcgcgaatcagcccgctccaccg

SEQ ID NO: 109821 - DNA, 35 bp, Artificial Sequence
  Synthetic oligonucleotide
tgcatagccgcactcgacgcctttttacgcccctg

SEQ ID NO: 109822 - DNA, 35 bp, Artificial Sequence
  Synthetic oligonucleotide
ttgcacagccccacgcccgttctttgctatttgtc

SEQ ID NO: 109823 - DNA, 35 bp, Artificial Sequence
  Synthetic oligonucleotide
gtcgccccccggcgcagaccgaaactctcttgccg

SEQ ID NO: 109824 - DNA, 35 bp, Artificial Sequence
  Synthetic oligonucleotide
gccacctgtcctgtgccgaccgctacgcccttact

SEQ ID NO: 109825 - DNA, 35 bp, Artificial Sequence
  Synthetic oligonucleotide
tatgcggacgcgtgtcgttcagatcatttccttcc

SEQ ID NO: 109826 - DNA, 35 bp, Artificial Sequence
  Synthetic oligonucleotide
acgccccgacacaaattgcctgtttctccgcccta

SEQ ID NO: 109827 - DNA, 35 bp, Artificial Sequence
  Synthetic oligonucleotide
ggtgaccctcccttgccgcttgaggactttgcctc

SEQ ID NO: 109828 - DNA, 35 bp, Artificial Sequence
  Synthetic oligonucleotide
gcccagccacttgtcccattcgcctcagtcactat

SEQ ID NO: 109829 - DNA, 34 bp, Artificial Sequence
  Synthetic oligonucleotide
ggagcaccgcatgcccctcttctgcactctttca

SEQ ID NO: 109830 - DNA, 36 bp, Artificial Sequence
  Synthetic oligonucleotide
agcccccctctgcctgagcagtaacgatacccgccc

SEQ ID NO: 109831 - DNA, 36 bp, Artificial Sequence
  Synthetic oligonucleotide
gagtgcaatcgctccatctggccccttctcatccga

SEQ ID NO: 109832 - DNA, 35 bp, Artificial Sequence
  Synthetic oligonucleotide
gacgcacacaagtgtccttctgccttccgtattgc

SEQ ID NO: 109833 - DNA, 35 bp, Artificial Sequence
  Synthetic oligonucleotide
ggacaagggaacaggtagaggggcaattgaacagt

SEQ ID NO: 109834 - DNA, 35 bp, Artificial Sequence
  Synthetic oligonucleotide
tacaccgtgcgttgtcacctcctgcgctacttcct

SEQ ID NO: 109835 - DNA, 35 bp, Artificial Sequence
  Synthetic oligonucleotide
gaagaaggtgaggggggaagaacggacacggttga

SEQ ID NO: 109836 - DNA, 36 bp, Artificial Sequence
  Synthetic oligonucleotide
acgcacgaggtggagggatggggaggggattggata

SEQ ID NO: 109837 - DNA, 35 bp, Artificial Sequence
  Synthetic oligonucleotide
ttcggtgcgcactttcctgtctcattccctcgcgc

SEQ ID NO: 109838 - DNA, 35 bp, Artificial Sequence
  Synthetic oligonucleotide
ttgtccgtccggctcatatgtcagatcttctcctg

SEQ ID NO: 109839 - DNA, 37 bp, Artificial Sequence
  Synthetic oligonucleotide
gctccgactccagcctgtaccgtcaccttcccccgga

SEQ ID NO: 109840 - DNA, 35 bp, Artificial Sequence
  Synthetic oligonucleotide
acctcctgacctcgcctcgcaaagacgcacgcccc

SEQ ID NO: 109841 - DNA, 33 bp, Artificial Sequence
  Synthetic oligonucleotide
taatggtaggggcgggggagtatgggggcacga

SEQ ID NO: 109842 - DNA, 35 bp, Artificial Sequence
  Synthetic oligonucleotide
aaccgccatcctcttgcatttcgacatactctgcc

SEQ ID NO: 109843 - DNA, 33 bp, Artificial Sequence
  Synthetic oligonucleotide
tcctctcggcggtcgtatgcgcctccacctccg

SEQ ID NO: 109844 - DNA, 35 bp, Artificial Sequence
  Synthetic oligonucleotide
tgccagccgcctgaccttctccatattctccctgg

SEQ ID NO: 109845 - DNA, 35 bp, Artificial Sequence
  Synthetic oligonucleotide
tcagccaccgtcaatacatctgtcacacgccaccc

SEQ ID NO: 109846 - DNA, 35 bp, Artificial Sequence
  Synthetic oligonucleotide
gaaacgccacccgacccatgcgccttagttccctc

SEQ ID NO: 109847 - DNA, 38 bp, Artificial Sequence
  Synthetic oligonucleotide
acaggggcaagttgataagggaggggcgcagggggtga

SEQ ID NO: 109848 - DNA, 35 bp, Artificial Sequence
  Synthetic oligonucleotide
atacccggcacagcctctccgttcccgtctacacc

SEQ ID NO: 109849 - DNA, 35 bp, Artificial Sequence
  Synthetic oligonucleotide
ttggcacaccacgtttctgctcccggctttcactc

SEQ ID NO: 109850 - DNA, 37 bp, Artificial Sequence
  Synthetic oligonucleotide
acccgccatccggccccctctctctatgtgacctcga

SEQ ID NO: 109851 - DNA, 35 bp, Artificial Sequence
  Synthetic oligonucleotide
tgccaacccgccgaaggtcgactgtcccgccctta

SEQ ID NO: 109852 - DNA, 35 bp, Artificial Sequence
  Synthetic oligonucleotide
gcaacgagtcccccggccccttccacccatcctgt

SEQ ID NO: 109853 - DNA, 35 bp, Artificial Sequence
  Synthetic oligonucleotide
gtgcgacgcacacaggtcgtactctcgccctttcc

SEQ ID NO: 109854 - DNA, 35 bp, Artificial Sequence
  Synthetic oligonucleotide
gtcaatccatcctctgttgtgatgtaatctctcct

SEQ ID NO: 109855 - DNA, 35 bp, Artificial Sequence
  Synthetic oligonucleotide
gtccaactcacctcctatgattaacgtgtctcccc

SEQ ID NO: 109856 - DNA, 35 bp, Artificial Sequence
  Synthetic oligonucleotide
acgttgaccacacgcatgttacctaacgcctcctc

SEQ ID NO: 109857 - DNA, 36 bp, Artificial Sequence
  Synthetic oligonucleotide
tgtcgcaccgccccatttacgtacactcgccaccaa

SEQ ID NO: 109858 - DNA, 35 bp, Artificial Sequence
  Synthetic oligonucleotide
tgatcctccacctgtcctgtaatccgtgccggact

SEQ ID NO: 109859 - DNA, 35 bp, Artificial Sequence
  Synthetic oligonucleotide
tgtccccgtaccgctccccatcgagggcttttacc

SEQ ID NO: 109860 - DNA, 37 bp, Artificial Sequence
  Synthetic oligonucleotide
gacgtagggcacgggtaggcggggggtgggaggtaga

SEQ ID NO: 109861 - DNA, 35 bp, Artificial Sequence
  Synthetic oligonucleotide
ggggcccatccgatctgccacttctgaatctctcg

SEQ ID NO: 109862 - DNA, 35 bp, Artificial Sequence
  Synthetic oligonucleotide
gaggtggaggctggggctggacgtctgtggaggtg

SEQ ID NO: 109863 - DNA, 35 bp, Artificial Sequence
  Synthetic oligonucleotide
gcaccgtgctgctgtccctttgctcattcctccag

SEQ ID NO: 109864 - DNA, 35 bp, Artificial Sequence
  Synthetic oligonucleotide
gtcacatcgcccgatatcgtcgtacatctccacct

SEQ ID NO: 109865 - DNA, 35 bp, Artificial Sequence
  Synthetic oligonucleotide
ttggccaccacctgcttgtttacctccagtatttt

SEQ ID NO: 109866 - DNA, 35 bp, Artificial Sequence
  Synthetic oligonucleotide
taatgcgccgctgttctaccgattgcacgtccctt

SEQ ID NO: 109867 - DNA, 35 bp, Artificial Sequence
  Synthetic oligonucleotide
accactccccagttggtgctactacataccgtttt

SEQ ID NO: 109868 - DNA, 36 bp, Artificial Sequence
  Synthetic oligonucleotide
tagactagccacgtgccatccctcttccgtactcca

SEQ ID NO: 109869 - DNA, 36 bp, Artificial Sequence
  Synthetic oligonucleotide
gacgccccgccgattaatgaattgttcctccgttca

SEQ ID NO: 109870 - DNA, 37 bp, Artificial Sequence
  Synthetic oligonucleotide
ggaaagggaggggtggggaagggcggtaacggtccga

SEQ ID NO: 109871 - DNA, 35 bp, Artificial Sequence
  Synthetic oligonucleotide
gtcgcagcccttcaatgtccgccgcccgatcctta

SEQ ID NO: 109872 - DNA, 35 bp, Artificial Sequence
  Synthetic oligonucleotide
tgtcccggactgcctccccattgctcatgttaccc

SEQ ID NO: 109873 - DNA, 36 bp, Artificial Sequence
  Synthetic oligonucleotide
tgctcatcccgctagctgtccacccgatccattcct

SEQ ID NO: 109874 - DNA, 36 bp, Artificial Sequence
  Synthetic oligonucleotide
tatcaccactcgcctccttctgtaaagatcctctga

SEQ ID NO: 109875 - DNA, 37 bp, Artificial Sequence
  Synthetic oligonucleotide
ggggcggggaatcaccacggggtgaaatatttgggga

SEQ ID NO: 109876 - DNA, 38 bp, Artificial Sequence
  Synthetic oligonucleotide
gacgatcctgtcgtgtaccatccccctactgttagtga

SEQ ID NO: 109877 - DNA, 34 bp, Artificial Sequence
  Synthetic oligonucleotide
gtgcgccgtccacaccagattcccgccgcccccc

SEQ ID NO: 109878 - DNA, 35 bp, Artificial Sequence
  Synthetic oligonucleotide
ggacccaccgccgccgctactattgactcggtcat

SEQ ID NO: 109879 - DNA, 35 bp, Artificial Sequence
  Synthetic oligonucleotide
acattgctcgctgctgccgtaccatcatgctcctt

SEQ ID NO: 109880 - DNA, 35 bp, Artificial Sequence
  Synthetic oligonucleotide
gtcaccccgcaatcccgccctgtcgacgcattctt

SEQ ID NO: 109881 - DNA, 36 bp, Artificial Sequence
  Synthetic oligonucleotide
accctgctacacccgtgctccatgtttacccgttta

SEQ ID NO: 109882 - DNA, 35 bp, Artificial Sequence
  Synthetic oligonucleotide
tgattcggtccaacgctacgtttaactgctccatc

SEQ ID NO: 109883 - DNA, 35 bp, Artificial Sequence
  Synthetic oligonucleotide
tatgtataccgctgcgtgttttcccgtcgtccctc

SEQ ID NO: 109884 - DNA, 37 bp, Artificial Sequence
  Synthetic oligonucleotide
gcccataccgccgctcttacttcgttctgtctttaga

SEQ ID NO: 109885 - DNA, 37 bp, Artificial Sequence
  Synthetic oligonucleotide
gagacagggcgagactgactggagggggggaagcgga

SEQ ID NO: 109886 - DNA, 35 bp, Artificial Sequence
  Synthetic oligonucleotide
gacgccctccccctatgtcccgtcacgttagtgcc

SEQ ID NO: 109887 - DNA, 35 bp, Artificial Sequence
  Synthetic oligonucleotide
tgcacgcctcctctgcttttacccatgacatctct

SEQ ID NO: 109888 - DNA, 36 bp, Artificial Sequence
  Synthetic oligonucleotide
acactcatggcctgactgctccctaagcacttccca

SEQ ID NO: 109889 - DNA, 35 bp, Artificial Sequence
  Synthetic oligonucleotide
agttaccgtgccgctagtgtcatctccgcccctcg

SEQ ID NO: 109890 - DNA, 36 bp, Artificial Sequence
  Synthetic oligonucleotide
acgtccgcccgcccctgtactatacacccatcgcca

SEQ ID NO: 109891 - DNA, 35 bp, Artificial Sequence
  Synthetic oligonucleotide
taatcacctcacgccggtacatcacgctcgccctc

SEQ ID NO: 109892 - DNA, 36 bp, Artificial Sequence
  Synthetic oligonucleotide
gtacagcctcacacatccgtaaatatcacgccgcca

SEQ ID NO: 109893 - DNA, 37 bp, Artificial Sequence
  Synthetic oligonucleotide
gcaccgggggaagaatggtggggcaaggggggaagga

SEQ ID NO: 109894 - DNA, 37 bp, Artificial Sequence
  Synthetic oligonucleotide
atcccgcccgctccgtctcccccagccatgactctga

SEQ ID NO: 109895 - DNA, 35 bp, Artificial Sequence
  Synthetic oligonucleotide
acaccgtgctttcgtgtctctggccattcctgctc

SEQ ID NO: 109896 - DNA, 35 bp, Artificial Sequence
  Synthetic oligonucleotide
gcccgcgcatccctcgccgtttttagtaactccct

SEQ ID NO: 109897 - DNA, 35 bp, Artificial Sequence
  Synthetic oligonucleotide
ttgaacatgcactgcatcgcaatgacgtaccatcc

SEQ ID NO: 109898 - DNA, 35 bp, Artificial Sequence
  Synthetic oligonucleotide
gagccagccctacccgcccgccatgtcccctcgcc

SEQ ID NO: 109899 - DNA, 35 bp, Artificial Sequence
  Synthetic oligonucleotide
acgcatgtccgatgctcccccctcgtcctttcccc

SEQ ID NO: 109900 - DNA, 35 bp, Artificial Sequence
  Synthetic oligonucleotide
acacggaggaacttaagtaggtagggatagggggg

SEQ ID NO: 109901 - DNA, 35 bp, Artificial Sequence
  Synthetic oligonucleotide
tcgctacacaacaccgcgcaggcctataccccgct

SEQ ID NO: 109902 - DNA, 36 bp, Artificial Sequence
  Synthetic oligonucleotide
atgtgcccccctctcctggtgtccggactttccgta

SEQ ID NO: 109903 - DNA, 35 bp, Artificial Sequence
  Synthetic oligonucleotide
tcgaccccgtgtgtctgtttctctcgtgcttcacc

SEQ ID NO: 109904 - DNA, 32 bp, Artificial Sequence
  Synthetic oligonucleotide
tccctacccgcactgataaccgtttccaccaa

SEQ ID NO: 109905 - DNA, 35 bp, Artificial Sequence
  Synthetic oligonucleotide
gaggttaagcctcgttcgtcgcccctctgttagtc

SEQ ID NO: 109906 - DNA, 34 bp, Artificial Sequence
  Synthetic oligonucleotide
acccacccacttctcgcattggaccctttacact

SEQ ID NO: 109907 - DNA, 38 bp, Artificial Sequence
  Synthetic oligonucleotide
ttgcgcgcagtcgcattttgttactatctcctccgtgc

SEQ ID NO: 109908 - DNA, 35 bp, Artificial Sequence
  Synthetic oligonucleotide
gcccccgcccccaccatgcgcatgccgcatcggtt

SEQ ID NO: 109909 - DNA, 38 bp, Artificial Sequence
  Synthetic oligonucleotide
gagtgaggagggtgggagaagatggaccggcggggtga

SEQ ID NO: 109910 - DNA, 37 bp, Artificial Sequence
  Synthetic oligonucleotide
tgatcgcccctcactctatcgcctccacagtctgtga

SEQ ID NO: 109911 - DNA, 35 bp, Artificial Sequence
  Synthetic oligonucleotide
atgtgttcaccgggtctcctccttcgccgattcca

SEQ ID NO: 109912 - DNA, 37 bp, Artificial Sequence
  Synthetic oligonucleotide
gtcgcaaggcggagggaaggggtgcaaggtgggctga

SEQ ID NO: 109913 - DNA, 35 bp, Artificial Sequence
  Synthetic oligonucleotide
gatccaacccagacgtgtgctcatcgttcgctctt

SEQ ID NO: 109914 - DNA, 36 bp, Artificial Sequence
  Synthetic oligonucleotide
gacatgacccccgtgccttctaaaccctgtgtttca

SEQ ID NO: 109915 - DNA, 35 bp, Artificial Sequence
  Synthetic oligonucleotide
tctcgtccccggtccgttcgccctaatgttttgcc

SEQ ID NO: 109916 - DNA, 35 bp, Artificial Sequence
  Synthetic oligonucleotide
gacactcctcccctcgtccgagcgcatttggccca

SEQ ID NO: 109917 - DNA, 35 bp, Artificial Sequence
  Synthetic oligonucleotide
agcgatgacgaaatggggcgaagaggagggaagtg

SEQ ID NO: 109918 - DNA, 37 bp, Artificial Sequence
  Synthetic oligonucleotide
gaggggggaggataggaggtaaaactaaggggaaaga

SEQ ID NO: 109919 - DNA, 37 bp, Artificial Sequence
  Synthetic oligonucleotide
tagggtcatagcaagggggtgggatcatgcacaggga

SEQ ID NO: 109920 - DNA, 38 bp, Artificial Sequence
  Synthetic oligonucleotide
ataggggggagcatagggggactcaatgggcggggtga

SEQ ID NO: 109921 - DNA, 35 bp, Artificial Sequence
  Synthetic oligonucleotide
atccgccgtgatacgtgcactgtcccatacccatc

SEQ ID NO: 109922 - DNA, 35 bp, Artificial Sequence
  Synthetic oligonucleotide
gtgggacggaaagacggaaaggtggggggtggcaa

SEQ ID NO: 109923 - DNA, 36 bp, Artificial Sequence
  Synthetic oligonucleotide
tacgcatcacctatcgttatcctgccccccggtcca

SEQ ID NO: 109924 - DNA, 35 bp, Artificial Sequence
  Synthetic oligonucleotide
gagtgccccccgctgctatctctacgcgtcctacg

SEQ ID NO: 109925 - DNA, 37 bp, Artificial Sequence
  Synthetic oligonucleotide
atcactctcacatctgtttcactccacgttgccacga

SEQ ID NO: 109926 - DNA, 35 bp, Artificial Sequence
  Synthetic oligonucleotide
gcccccgcctccgactatgtagatcccgccgcata

SEQ ID NO: 109927 - DNA, 38 bp, Artificial Sequence
  Synthetic oligonucleotide
accccatcgcacgcccctccctcttcgtctgtccatga

SEQ ID NO: 109928 - DNA, 35 bp, Artificial Sequence
  Synthetic oligonucleotide
tcgccactacgctttctatcgccgaccttttcaac

SEQ ID NO: 109929 - DNA, 35 bp, Artificial Sequence
  Synthetic oligonucleotide
tgtcgccccaccgtaaatcgtacgcgccctaagcc

SEQ ID NO: 109930 - DNA, 38 bp, Artificial Sequence
  Synthetic oligonucleotide
tcgatccccgcccaccctgcaaaataggcctcacctga

SEQ ID NO: 109931 - DNA, 35 bp, Artificial Sequence
  Synthetic oligonucleotide
gtgctgtacccccctgctcctataactgccctgac

SEQ ID NO: 109932 - DNA, 36 bp, Artificial Sequence
  Synthetic oligonucleotide
tccgggggaaagtggggaagggctaggggaaacgcg

SEQ ID NO: 109933 - DNA, 36 bp, Artificial Sequence
  Synthetic oligonucleotide
gggagggaatggagtagggggagggggtgtcacaga

SEQ ID NO: 109934 - DNA, 35 bp, Artificial Sequence
  Synthetic oligonucleotide
tacgccccagttgcgccttggacactccttgccac

SEQ ID NO: 109935 - DNA, 35 bp, Artificial Sequence
  Synthetic oligonucleotide
tctgacccctccacttgatcttctaaagccccagg

SEQ ID NO: 109936 - DNA, 35 bp, Artificial Sequence
  Synthetic oligonucleotide
tcacccgatgaccaggtagctctggcctcttcgcc

SEQ ID NO: 109937 - DNA, 35 bp, Artificial Sequence
  Synthetic oligonucleotide
tccaccctcttctctatattgggtcacctgtacac

SEQ ID NO: 109938 - DNA, 34 bp, Artificial Sequence
  Synthetic oligonucleotide
acccccgcttaggtgccttcgtggactctctccc

SEQ ID NO: 109939 - DNA, 35 bp, Artificial Sequence
  Synthetic oligonucleotide
gggatgggacagggcgggtgggtatggacggcagg

SEQ ID NO: 109940 - DNA, 35 bp, Artificial Sequence
  Synthetic oligonucleotide
tcttacgtagctgccctgccccccattcatccgcc

SEQ ID NO: 109941 - DNA, 35 bp, Artificial Sequence
  Synthetic oligonucleotide
aaagccaagccaccgatctaactccgcccccgacg

SEQ ID NO: 109942 - DNA, 36 bp, Artificial Sequence
  Synthetic oligonucleotide
aacgtcgtcgtctgcctccttccgcgccccctgcca

SEQ ID NO: 109943 - DNA, 35 bp, Artificial Sequence
  Synthetic oligonucleotide
gtcccacccgccgtaccccgtcgaaatgatccgcc

SEQ ID NO: 109944 - DNA, 35 bp, Artificial Sequence
  Synthetic oligonucleotide
tgcaccacaccacctgctcgcgcctgaattcatca

SEQ ID NO: 109945 - DNA, 37 bp, Artificial Sequence
  Synthetic oligonucleotide
ggagggtgggtgacgcctccgccctctttgggtggga

SEQ ID NO: 109946 - DNA, 35 bp, Artificial Sequence
  Synthetic oligonucleotide
tcccgcgctatgtgcgcctttcttacccctccctc

SEQ ID NO: 109947 - DNA, 35 bp, Artificial Sequence
  Synthetic oligonucleotide
gatcgcgctcccccggtctttgtgtcgccctcccg

SEQ ID NO: 109948 - DNA, 35 bp, Artificial Sequence
  Synthetic oligonucleotide
ttaggccggaaggtgggggtggaatggtggttctc

SEQ ID NO: 109949 - DNA, 36 bp, Artificial Sequence
  Synthetic oligonucleotide
tcgatcaccccccgcactataaccagacccctgtta

SEQ ID NO: 109950 - DNA, 35 bp, Artificial Sequence
  Synthetic oligonucleotide
actcaccgccatcccgcaagtctgccctgctgctc

SEQ ID NO: 109951 - DNA, 35 bp, Artificial Sequence
  Synthetic oligonucleotide
ttcctcacctcaatgcttaaacaacggtcctcccc

SEQ ID NO: 109952 - DNA, 35 bp, Artificial Sequence
  Synthetic oligonucleotide
gccgtctcgcgcttcatccggccccttccctgctc

SEQ ID NO: 109953 - DNA, 38 bp, Artificial Sequence
  Synthetic oligonucleotide
gagagggtgggaggggtaactattggagatgggtttga

SEQ ID NO: 109954 - DNA, 35 bp, Artificial Sequence
  Synthetic oligonucleotide
tcagtcccgacccgccttatgtcgcctagtgccac

SEQ ID NO: 109955 - DNA, 35 bp, Artificial Sequence
  Synthetic oligonucleotide
tccatccgcgcccctcctggtctacattttctgtt

SEQ ID NO: 109956 - DNA, 36 bp, Artificial Sequence
  Synthetic oligonucleotide
tccccccccccataatgtactgtggctctcctccga

SEQ ID NO: 109957 - DNA, 35 bp, Artificial Sequence
  Synthetic oligonucleotide
gcccccctccggctacccacactcgcacgttccta

SEQ ID NO: 109958 - DNA, 35 bp, Artificial Sequence
  Synthetic oligonucleotide
gggacagagggcggaaaggggggagtagaaggaga

SEQ ID NO: 109959 - DNA, 35 bp, Artificial Sequence
  Synthetic oligonucleotide
gctcacaggtccggccccctctttgataccacctg

SEQ ID NO: 109960 - DNA, 35 bp, Artificial Sequence
  Synthetic oligonucleotide
tacatgccccgctacgtcttaacctggctacacct

SEQ ID NO: 109961 - DNA, 35 bp, Artificial Sequence
  Synthetic oligonucleotide
tgctcccactccgacacccgtttttgctgattcct

SEQ ID NO: 109962 - DNA, 35 bp, Artificial Sequence
  Synthetic oligonucleotide
tcctgccctcgccttacgtggttgggtcccttttc

SEQ ID NO: 109963 - DNA, 35 bp, Artificial Sequence
  Synthetic oligonucleotide
gtcccctgtcctggcccatcgcttgtctacctcgt

SEQ ID NO: 109964 - DNA, 35 bp, Artificial Sequence
  Synthetic oligonucleotide
actgtccacctctcgatccacgttgcgcaactcac

SEQ ID NO: 109965 - DNA, 35 bp, Artificial Sequence
  Synthetic oligonucleotide
acccccgtgtcgattggccgtcgcttaccccttca

SEQ ID NO: 109966 - DNA, 35 bp, Artificial Sequence
  Synthetic oligonucleotide
ggaccggtccggcctcacacccaacgtacatccgc

SEQ ID NO: 109967 - DNA, 37 bp, Artificial Sequence
  Synthetic oligonucleotide
gcgatgccgtgctcttgatatcgcgcccctcccccga

SEQ ID NO: 109968 - DNA, 35 bp, Artificial Sequence
  Synthetic oligonucleotide
gtgctgcccccactcgcgtgccatgaaatacctct

SEQ ID NO: 109969 - DNA, 35 bp, Artificial Sequence
  Synthetic oligonucleotide
gtgtcacctcgcatttgtacccatttatccctcgt

SEQ ID NO: 109970 - DNA, 36 bp, Artificial Sequence
  Synthetic oligonucleotide
acgatcggaggaggagggagcgagggcaagatgcga

SEQ ID NO: 109971 - DNA, 35 bp, Artificial Sequence
  Synthetic oligonucleotide
accgccccctctcctgttgtattgtttgattccga

SEQ ID NO: 109972 - DNA, 34 bp, Artificial Sequence
  Synthetic oligonucleotide
gtgagccccgtagccgatagttagccttcccctg

SEQ ID NO: 109973 - DNA, 36 bp, Artificial Sequence
  Synthetic oligonucleotide
ttgcaccctgcatgtgccccgtctgctcccttacta

SEQ ID NO: 109974 - DNA, 36 bp, Artificial Sequence
  Synthetic oligonucleotide
gccaccccccatcggagatcgagcaaccccgcttta

SEQ ID NO: 109975 - DNA, 35 bp, Artificial Sequence
  Synthetic oligonucleotide
acccccgcaaggtgactctttgttccgtcctttac

SEQ ID NO: 109976 - DNA, 36 bp, Artificial Sequence
  Synthetic oligonucleotide
gcccttgcctcagctcgttctcactcttccatgcca

SEQ ID NO: 109977 - DNA, 35 bp, Artificial Sequence
  Synthetic oligonucleotide
gtccctcatgccgccgccttccgctatgccacgac

SEQ ID NO: 109978 - DNA, 35 bp, Artificial Sequence
  Synthetic oligonucleotide
gacagggggcggcgggggactaggacgcagcgggg

SEQ ID NO: 109979 - DNA, 35 bp, Artificial Sequence
  Synthetic oligonucleotide
gcttccctgtgggccccccgtacttacgtttcatt

SEQ ID NO: 109980 - DNA, 36 bp, Artificial Sequence
  Synthetic oligonucleotide
gggatatgcgccgccttcgtcctccgcctgtttcca

SEQ ID NO: 109981 - DNA, 35 bp, Artificial Sequence
  Synthetic oligonucleotide
gcgtcactgccccctcgttcactcgccacgctatc

SEQ ID NO: 109982 - DNA, 35 bp, Artificial Sequence
  Synthetic oligonucleotide
gtgccgctgctgttacttcaccccacctgattgcg

SEQ ID NO: 109983 - DNA, 35 bp, Artificial Sequence
  Synthetic oligonucleotide
actgcccctgtgttgatttgcaccaccctcttacc

SEQ ID NO: 109984 - DNA, 35 bp, Artificial Sequence
  Synthetic oligonucleotide
accccgccgacgtgtcccgctgctctaactgttcc

SEQ ID NO: 109985 - DNA, 35 bp, Artificial Sequence
  Synthetic oligonucleotide
actccagccctcttgcttgcctgtctcccaacgtt

SEQ ID NO: 109986 - DNA, 35 bp, Artificial Sequence
  Synthetic oligonucleotide
gcaccctcatccagtgcctcccatttcgctgacct

SEQ ID NO: 109987 - DNA, 35 bp, Artificial Sequence
  Synthetic oligonucleotide
atcaccaccgcatgggaactatgtctctcactcca

SEQ ID NO: 109988 - DNA, 38 bp, Artificial Sequence
  Synthetic oligonucleotide
gcacgaagggcgagtaggggtggcgggcggtgggttga

SEQ ID NO: 109989 - DNA, 38 bp, Artificial Sequence
  Synthetic oligonucleotide
acgagggggtacgaacagacgacttggggtgggaatga

SEQ ID NO: 109990 - DNA, 35 bp, Artificial Sequence
  Synthetic oligonucleotide
ggtcacctgccgcgtgtgcacaccatcctcacttc

SEQ ID NO: 109991 - DNA, 35 bp, Artificial Sequence
  Synthetic oligonucleotide
gcactgctgttcccccccctcgtcgttcatgcacg

SEQ ID NO: 109992 - DNA, 38 bp, Artificial Sequence
  Synthetic oligonucleotide
tcagaccgccctccttatacgcccaccaccctacgtga

SEQ ID NO: 109993 - DNA, 35 bp, Artificial Sequence
  Synthetic oligonucleotide
acacaccacctaacattttcgccgttccgctcttg

SEQ ID NO: 109994 - DNA, 35 bp, Artificial Sequence
  Synthetic oligonucleotide
tgacattcatcgtttcctccgttccggcactccgc

SEQ ID NO: 109995 - DNA, 35 bp, Artificial Sequence
  Synthetic oligonucleotide
tgtctcctcaccgcctggcacctgactcacctcct

SEQ ID NO: 109996 - DNA, 35 bp, Artificial Sequence
  Synthetic oligonucleotide
tctgaccacgttctgcgttcgtttgacccctctca

SEQ ID NO: 109997 - DNA, 35 bp, Artificial Sequence
  Synthetic oligonucleotide
agagcctatcacctgtctcctgctacccccctggc

SEQ ID NO: 109998 - DNA, 35 bp, Artificial Sequence
  Synthetic oligonucleotide
ttgccccacccatcaccgaccctttactacgctcg

SEQ ID NO: 109999 - DNA, 38 bp, Artificial Sequence
  Synthetic oligonucleotide
tgatcctccgccacatctttagttcttcaacatgttga

SEQ ID NO: 110000 - DNA, 36 bp, Artificial Sequence
  Synthetic oligonucleotide
aaagccagcccccgccgccaagacgacccgccgcta

SEQ ID NO: 110001 - DNA, 35 bp, Artificial Sequence
  Synthetic oligonucleotide
tcagtcatacgaccatcttgcgtgctggccctccc

SEQ ID NO: 110002 - DNA, 33 bp, Artificial Sequence
  Synthetic oligonucleotide
tcccgcggccacttctgcctatggttcacttct

SEQ ID NO: 110003 - DNA, 35 bp, Artificial Sequence
  Synthetic oligonucleotide
gagctgtctccaccgccgccgttctctcgccttgg

SEQ ID NO: 110004 - DNA, 35 bp, Artificial Sequence
  Synthetic oligonucleotide
acgctaaccccagccctcgatttttgtgcccgccc

SEQ ID NO: 110005 - DNA, 37 bp, Artificial Sequence
  Synthetic oligonucleotide
gggaggcaagaatgggaggggaggaattacgggggga

SEQ ID NO: 110006 - DNA, 35 bp, Artificial Sequence
  Synthetic oligonucleotide
tccgtccatgccactcctgagttaatgcccccctc

SEQ ID NO: 110007 - DNA, 36 bp, Artificial Sequence
  Synthetic oligonucleotide
tctcacatcctctccatttgtactatcgttgcacca

SEQ ID NO: 110008 - DNA, 37 bp, Artificial Sequence
  Synthetic oligonucleotide
ttggggcggggaacgacttggggttttaacttgggga

SEQ ID NO: 110009 - DNA, 35 bp, Artificial Sequence
  Synthetic oligonucleotide
gtcccgtccgatcacgatcgccgctacttccttcc

SEQ ID NO: 110010 - DNA, 35 bp, Artificial Sequence
  Synthetic oligonucleotide
gctcgcctccactttatccacgccgattcctgggc

SEQ ID NO: 110011 - DNA, 35 bp, Artificial Sequence
  Synthetic oligonucleotide
gcatcccgctgatgcactgatacccgccctcactt

SEQ ID NO: 110012 - DNA, 35 bp, Artificial Sequence
  Synthetic oligonucleotide
accaccctctccgactatgtttcacgctcaatctc

SEQ ID NO: 110013 - DNA, 35 bp, Artificial Sequence
  Synthetic oligonucleotide
accccatgcagacctgctgctacccgtgattccca

SEQ ID NO: 110014 - DNA, 36 bp, Artificial Sequence
  Synthetic oligonucleotide
ggaacctgcgccccagtttcggccccttccccatca

SEQ ID NO: 110015 - DNA, 36 bp, Artificial Sequence
  Synthetic oligonucleotide
tgcaccccgccattgacctgatccgcctgacccata

SEQ ID NO: 110016 - DNA, 35 bp, Artificial Sequence
  Synthetic oligonucleotide
tccttccgccggcctctcgcatctggttacttacc

SEQ ID NO: 110017 - DNA, 35 bp, Artificial Sequence
  Synthetic oligonucleotide
aaacccagtctgcgcgtttagtcttcccgtttctt

SEQ ID NO: 110018 - DNA, 36 bp, Artificial Sequence
  Synthetic oligonucleotide
ggggtgccaaggtggtggggagatcacggtggtaaa

SEQ ID NO: 110019 - DNA, 37 bp, Artificial Sequence
  Synthetic oligonucleotide
ggggggtcaaagggggtgggttgagtccagtagggga

SEQ ID NO: 110020 - DNA, 38 bp, Artificial Sequence
  Synthetic oligonucleotide
tgtgggtggcggtcgagggcttgggatggctcggttga

SEQ ID NO: 110021 - DNA, 35 bp, Artificial Sequence
  Synthetic oligonucleotide
atcagctgtgccctctgctgtccttgactttcccc

SEQ ID NO: 110022 - DNA, 35 bp, Artificial Sequence
  Synthetic oligonucleotide
gctcgctccaactgacacgctcctccacttacgcc

SEQ ID NO: 110023 - DNA, 35 bp, Artificial Sequence
  Synthetic oligonucleotide
gtcccccacgcccccagtacttgcatgcaacttat

SEQ ID NO: 110024 - DNA, 37 bp, Artificial Sequence
  Synthetic oligonucleotide
gcccttgccacttgttctatcgtgccaatacctttga

SEQ ID NO: 110025 - DNA, 35 bp, Artificial Sequence
  Synthetic oligonucleotide
ggttcgccgcctgatatcttccgtcctaccgccgt

SEQ ID NO: 110026 - DNA, 38 bp, Artificial Sequence
  Synthetic oligonucleotide
tgacagtacggcgagggagggcggaaaaacgggggtga

SEQ ID NO: 110027 - DNA, 35 bp, Artificial Sequence
  Synthetic oligonucleotide
actgtggtcgtcacaggccccttttagctctctca

SEQ ID NO: 110028 - DNA, 38 bp, Artificial Sequence
  Synthetic oligonucleotide
gagacgagtcgagggtggagaggatgggggtcggatga

SEQ ID NO: 110029 - DNA, 34 bp, Artificial Sequence
  Synthetic oligonucleotide
acgtttcgcaccctgtttcgctgcatccccttcc

SEQ ID NO: 110030 - DNA, 35 bp, Artificial Sequence
  Synthetic oligonucleotide
tcatccctccgactaagccctggatccggttcatc

SEQ ID NO: 110031 - DNA, 35 bp, Artificial Sequence
  Synthetic oligonucleotide
ggtacgtgcgcccgtcacctgtcctactgtcctcg

SEQ ID NO: 110032 - DNA, 35 bp, Artificial Sequence
  Synthetic oligonucleotide
gacttcccccccctgtctcgtgctaccggaactcc

SEQ ID NO: 110033 - DNA, 35 bp, Artificial Sequence
  Synthetic oligonucleotide
tgcttgccacatcccgctgactcgtgcactctatc

SEQ ID NO: 110034 - DNA, 35 bp, Artificial Sequence
  Synthetic oligonucleotide
tcacgcctcgcgttataatccatcatttgccctgc

SEQ ID NO: 110035 - DNA, 35 bp, Artificial Sequence
  Synthetic oligonucleotide
gacccgccccttgagaaccccagcccatcctcttg

SEQ ID NO: 110036 - DNA, 35 bp, Artificial Sequence
  Synthetic oligonucleotide
tccccgcaccccagctttattcttgtttgatcgct

SEQ ID NO: 110037 - DNA, 35 bp, Artificial Sequence
  Synthetic oligonucleotide
tccccccctctcgccgcctggccttgtgctttggt

SEQ ID NO: 110038 - DNA, 35 bp, Artificial Sequence
  Synthetic oligonucleotide
tctcgccccccaaccgacttgtcaaataactgtcc

SEQ ID NO: 110039 - DNA, 37 bp, Artificial Sequence
  Synthetic oligonucleotide
tccggcccagcctgcgctattcgtactctccctccga

SEQ ID NO: 110040 - DNA, 37 bp, Artificial Sequence
  Synthetic oligonucleotide
gtagggtgggaatgggaagtagggggagcgcgacgga

SEQ ID NO: 110041 - DNA, 35 bp, Artificial Sequence
  Synthetic oligonucleotide
agcccccacgcgccccttatttatgtccggtagcc

SEQ ID NO: 110042 - DNA, 35 bp, Artificial Sequence
  Synthetic oligonucleotide
ttcatcccgcgacctctgtttccctgccttgtgtc

SEQ ID NO: 110043 - DNA, 35 bp, Artificial Sequence
  Synthetic oligonucleotide
acaacatgcaccaacgccgcccgctcgctctctgt

SEQ ID NO: 110044 - DNA, 35 bp, Artificial Sequence
  Synthetic oligonucleotide
gtttacccgccactgcccacacacttgttctctcc

SEQ ID NO: 110045 - DNA, 35 bp, Artificial Sequence
  Synthetic oligonucleotide
gagacgtcactcactctctagcatcacgccgccgc

SEQ ID NO: 110046 - DNA, 36 bp, Artificial Sequence
  Synthetic oligonucleotide
gccacgccccacgtacaccgatcgataccactgcca

SEQ ID NO: 110047 - DNA, 37 bp, Artificial Sequence
  Synthetic oligonucleotide
accacctccgaggattattgcaccacttcctttccga

SEQ ID NO: 110048 - DNA, 35 bp, Artificial Sequence
  Synthetic oligonucleotide
gttgcctcccttcgtgttgacttcctgccattgtc

SEQ ID NO: 110049 - DNA, 37 bp, Artificial Sequence
  Synthetic oligonucleotide
acgcccccctcgacgtaacgactctcattctccctga

SEQ ID NO: 110050 - DNA, 35 bp, Artificial Sequence
  Synthetic oligonucleotide
tgcacgcaccccctgccggtatctgtctcgctccc

SEQ ID NO: 110051 - DNA, 35 bp, Artificial Sequence
  Synthetic oligonucleotide
tgcaccagtacagtacttatggccttcacctctcg

SEQ ID NO: 110052 - DNA, 36 bp, Artificial Sequence
  Synthetic oligonucleotide
gattgagggtggtgggggcggaggagctatggggga

SEQ ID NO: 110053 - DNA, 35 bp, Artificial Sequence
  Synthetic oligonucleotide
gaggtacgagcaaggggaatcgggggggagcggta

SEQ ID NO: 110054 - DNA, 38 bp, Artificial Sequence
  Synthetic oligonucleotide
gcgaaagccgcccgctgttccctccccgcctgccatga

SEQ ID NO: 110055 - DNA, 37 bp, Artificial Sequence
  Synthetic oligonucleotide
agcccaccctccacatttgctaacggatccccatcga

SEQ ID NO: 110056 - DNA, 34 bp, Artificial Sequence
  Synthetic oligonucleotide
gatgtcgctctcccctcgctagtattttgcgccc

SEQ ID NO: 110057 - DNA, 35 bp, Artificial Sequence
  Synthetic oligonucleotide
gcacctacaatggtgcattttgtccgtatcctcca

SEQ ID NO: 110058 - DNA, 35 bp, Artificial Sequence
  Synthetic oligonucleotide
acgcctcgccggctatcgcttacctcccttctcgc

SEQ ID NO: 110059 - DNA, 35 bp, Artificial Sequence
  Synthetic oligonucleotide
tcttgccgccctccatgccacgtccgactttcgag

SEQ ID NO: 110060 - DNA, 35 bp, Artificial Sequence
  Synthetic oligonucleotide
gagccccaccgcctgccaccgccgactgtccgcaa

SEQ ID NO: 110061 - DNA, 33 bp, Artificial Sequence
  Synthetic oligonucleotide
acaccctcgccggttccttctacacttaaatga

SEQ ID NO: 110062 - DNA, 35 bp, Artificial Sequence
  Synthetic oligonucleotide
gcacgactcagctctctgcaaacctccctggccac

SEQ ID NO: 110063 - DNA, 35 bp, Artificial Sequence
  Synthetic oligonucleotide
atcctcggcctgtttctgtcttacgccgcccgacc

SEQ ID NO: 110064 - DNA, 35 bp, Artificial Sequence
  Synthetic oligonucleotide
tgtgccccggtccactttgcagagcgctttcctcc

SEQ ID NO: 110065 - DNA, 35 bp, Artificial Sequence
  Synthetic oligonucleotide
tccggatcgcccctcatgccgtctatcctgcttgc

SEQ ID NO: 110066 - DNA, 35 bp, Artificial Sequence
  Synthetic oligonucleotide
acgccccggacccatcccccatgacgtgctccatc

SEQ ID NO: 110067 - DNA, 35 bp, Artificial Sequence
  Synthetic oligonucleotide
ttcacccccccatccgcaccctgtacgttaccatg

SEQ ID NO: 110068 - DNA, 35 bp, Artificial Sequence
  Synthetic oligonucleotide
tgttagcaaccctgtgctgctctatctcgcttcct

SEQ ID NO: 110069 - DNA, 35 bp, Artificial Sequence
  Synthetic oligonucleotide
gatcccccctgatgccctccgcatgaatccgttct

SEQ ID NO: 110070 - DNA, 35 bp, Artificial Sequence
  Synthetic oligonucleotide
gccagcccgcctgtccgccacccattgatttctgt

SEQ ID NO: 110071 - DNA, 35 bp, Artificial Sequence
  Synthetic oligonucleotide
atccctcgccctgattatgcctaatgcttccctcc

SEQ ID NO: 110072 - DNA, 35 bp, Artificial Sequence
  Synthetic oligonucleotide
tgtcgcacctctgtttcgacttgctgacacccccc

SEQ ID NO: 110073 - DNA, 35 bp, Artificial Sequence
  Synthetic oligonucleotide
gtccacccatacccgttaaagctcacgcccgaagc

SEQ ID NO: 110074 - DNA, 29 bp, Artificial Sequence
  Synthetic oligonucleotide
tagttccgcctcacaggcctcctgcactc

SEQ ID NO: 110075 - DNA, 35 bp, Artificial Sequence
  Synthetic oligonucleotide
tccccaccctcgtatgtcgttctcgtcatccctta

SEQ ID NO: 110076 - DNA, 34 bp, Artificial Sequence
  Synthetic oligonucleotide
aatgaactgcctcgcccttgcaccatctcttcat

SEQ ID NO: 110077 - DNA, 35 bp, Artificial Sequence
  Synthetic oligonucleotide
tccccttgcccccaatgcccagtggacaccacaca

SEQ ID NO: 110078 - DNA, 35 bp, Artificial Sequence
  Synthetic oligonucleotide
gcagaaacgctgccggccctatcttgttctcccga

SEQ ID NO: 110079 - DNA, 35 bp, Artificial Sequence
  Synthetic oligonucleotide
actgcccccgcaattcgttcccctagtagcataca

SEQ ID NO: 110080 - DNA, 35 bp, Artificial Sequence
  Synthetic oligonucleotide
acatcggcactccatctctgtcctactgcacgcca

SEQ ID NO: 110081 - DNA, 35 bp, Artificial Sequence
  Synthetic oligonucleotide
taacttcaccgccaatttccgagctcgacaccctc

SEQ ID NO: 110082 - DNA, 35 bp, Artificial Sequence
  Synthetic oligonucleotide
gacacgaggggagatgggaggcggggtcggtacat

SEQ ID NO: 110083 - DNA, 35 bp, Artificial Sequence
  Synthetic oligonucleotide
acccacctttgtatcgcaccgccctgtggcgcccc

SEQ ID NO: 110084 - DNA, 35 bp, Artificial Sequence
  Synthetic oligonucleotide
aaatcacagcccgcagccggaccgaccccctttcc

SEQ ID NO: 110085 - DNA, 35 bp, Artificial Sequence
  Synthetic oligonucleotide
atgtccgcccggtccctgtttcgtacgccccctgc

SEQ ID NO: 110086 - DNA, 35 bp, Artificial Sequence
  Synthetic oligonucleotide
agtgcgacgcctatccgtgccttcaacgcttacct

SEQ ID NO: 110087 - DNA, 37 bp, Artificial Sequence
  Synthetic oligonucleotide
gtgccccgcccacctcaccatgactgcccagtaacga

SEQ ID NO: 110088 - DNA, 34 bp, Artificial Sequence
  Synthetic oligonucleotide
ggggtggggacggggtctataggggaattgagga

SEQ ID NO: 110089 - DNA, 35 bp, Artificial Sequence
  Synthetic oligonucleotide
gaaggaaggagaagtgggaaaggtagggcaacgtc

SEQ ID NO: 110090 - DNA, 35 bp, Artificial Sequence
  Synthetic oligonucleotide
gacctgctgcaatgggcgccctctcctcctctcgg

SEQ ID NO: 110091 - DNA, 35 bp, Artificial Sequence
  Synthetic oligonucleotide
tccctgcccgccgtcaatatattccacgttctatc

SEQ ID NO: 110092 - DNA, 37 bp, Artificial Sequence
  Synthetic oligonucleotide
ttgccggaagggagtgggagctagggggtaacgggga

SEQ ID NO: 110093 - DNA, 35 bp, Artificial Sequence
  Synthetic oligonucleotide
gtgcaccggcatcattagttttcgtgcccttcgcc

SEQ ID NO: 110094 - DNA, 35 bp, Artificial Sequence
  Synthetic oligonucleotide
ttcgtccccgccgacgttaattaaacttgccccat

SEQ ID NO: 110095 - DNA, 38 bp, Artificial Sequence
  Synthetic oligonucleotide
gcaccctcgcacccgccgctccgagccatctttgctga

SEQ ID NO: 110096 - DNA, 35 bp, Artificial Sequence
  Synthetic oligonucleotide
tccaccttggtgcacgttctacccttctccgctgg

SEQ ID NO: 110097 - DNA, 35 bp, Artificial Sequence
  Synthetic oligonucleotide
gccactctgcgccgtactgcctgattcatcattcc

SEQ ID NO: 110098 - DNA, 37 bp, Artificial Sequence
  Synthetic oligonucleotide
tccaaccgtcattttccaccgcccctcgctcgccgga

SEQ ID NO: 110099 - DNA, 35 bp, Artificial Sequence
  Synthetic oligonucleotide
tgcgttgcctctcatacggtttccatggcccctca

SEQ ID NO: 110100 - DNA, 35 bp, Artificial Sequence
  Synthetic oligonucleotide
ggacagatcatgcgtcatcactgcccccattcgcc

SEQ ID NO: 110101 - DNA, 35 bp, Artificial Sequence
  Synthetic oligonucleotide
gagggtgccgaaggttgcgggaaggggggtaagga

SEQ ID NO: 110102 - DNA, 35 bp, Artificial Sequence
  Synthetic oligonucleotide
tgccgaagcctctcaccttgcccaagccgttatcc

SEQ ID NO: 110103 - DNA, 35 bp, Artificial Sequence
  Synthetic oligonucleotide
gacgagctcactccctcctcctggcccatgactgc

SEQ ID NO: 110104 - DNA, 35 bp, Artificial Sequence
  Synthetic oligonucleotide
accacgtaccatcccctgcacgctgcacagccttc

SEQ ID NO: 110105 - DNA, 35 bp, Artificial Sequence
  Synthetic oligonucleotide
gccactcacctgctcccccgaacagtcagaatgca

SEQ ID NO: 110106 - DNA, 36 bp, Artificial Sequence
  Synthetic oligonucleotide
gaccaacgggaagaacgcaggatgaggggggggtca

SEQ ID NO: 110107 - DNA, 35 bp, Artificial Sequence
  Synthetic oligonucleotide
tgccaggcactgagttaccgccgctgtctatcctc

SEQ ID NO: 110108 - DNA, 35 bp, Artificial Sequence
  Synthetic oligonucleotide
ttgcacctccctttcgtctcaccgtcgcatctccg

SEQ ID NO: 110109 - DNA, 38 bp, Artificial Sequence
  Synthetic oligonucleotide
atccgcaccatcagccttgttctctgctcctctcgtga

SEQ ID NO: 110110 - DNA, 35 bp, Artificial Sequence
  Synthetic oligonucleotide
gtctgccccgactaagccacccacgcctgcacccc

SEQ ID NO: 110111 - DNA, 36 bp, Artificial Sequence
  Synthetic oligonucleotide
acatcctgcctccgccgtgcatttctgtccccaata

SEQ ID NO: 110112 - DNA, 37 bp, Artificial Sequence
  Synthetic oligonucleotide
acccatccccgctccagtgctaccgccgtgccaccga

SEQ ID NO: 110113 - DNA, 35 bp, Artificial Sequence
  Synthetic oligonucleotide
tcctctctgcccgccccggatccaccttgccccgc

SEQ ID NO: 110114 - DNA, 36 bp, Artificial Sequence
  Synthetic oligonucleotide
tcaacctgacgccccccctctatgaggctacttcca

SEQ ID NO: 110115 - DNA, 35 bp, Artificial Sequence
  Synthetic oligonucleotide
gttgctccttcacctactagtggcggcctcccacc

SEQ ID NO: 110116 - DNA, 35 bp, Artificial Sequence
  Synthetic oligonucleotide
tctgaccgtcgatatactagtcctcgtcccctcgc

SEQ ID NO: 110117 - DNA, 35 bp, Artificial Sequence
  Synthetic oligonucleotide
gttgccacctgccatctcgtcttgtacactacttg

SEQ ID NO: 110118 - DNA, 36 bp, Artificial Sequence
  Synthetic oligonucleotide
acaagagacaaggagaaagagagggtgagtggacga

SEQ ID NO: 110119 - DNA, 36 bp, Artificial Sequence
  Synthetic oligonucleotide
gccaactgtcgtcctcctctcctcgctcccgtcgga

SEQ ID NO: 110120 - DNA, 35 bp, Artificial Sequence
  Synthetic oligonucleotide
acccgccactcgtttaaattcgcctttgttgcttt

SEQ ID NO: 110121 - DNA, 35 bp, Artificial Sequence
  Synthetic oligonucleotide
gaccctcggggcgacctccttcactccgctctgtc

SEQ ID NO: 110122 - DNA, 36 bp, Artificial Sequence
  Synthetic oligonucleotide
ggtcccttcatcccgtattgcaccgtacgcccccca

SEQ ID NO: 110123 - DNA, 35 bp, Artificial Sequence
  Synthetic oligonucleotide
gaccacatcgcccacagtctgctacttgctttctc

SEQ ID NO: 110124 - DNA, 35 bp, Artificial Sequence
  Synthetic oligonucleotide
gccctaacctcgccgcctgacctttattggttcct

SEQ ID NO: 110125 - DNA, 37 bp, Artificial Sequence
  Synthetic oligonucleotide
gtcgaagggaccgacgggggggaaaagggggtgtaga

SEQ ID NO: 110126 - DNA, 36 bp, Artificial Sequence
  Synthetic oligonucleotide
acctagcccgccttgtccatctctgctacatacgta

SEQ ID NO: 110127 - DNA, 36 bp, Artificial Sequence
  Synthetic oligonucleotide
tacgtgcccgccccacccccgcattaaaactggtca

SEQ ID NO: 110128 - DNA, 35 bp, Artificial Sequence
  Synthetic oligonucleotide
gcccataccagtgtacgcgcacctttcctgccatc

SEQ ID NO: 110129 - DNA, 37 bp, Artificial Sequence
  Synthetic oligonucleotide
gcgaacacgcctcattcgtcatcatcactgccgctga

SEQ ID NO: 110130 - DNA, 36 bp, Artificial Sequence
  Synthetic oligonucleotide
agatgcaccccctgtccgcctgggcccttctgccta

SEQ ID NO: 110131 - DNA, 35 bp, Artificial Sequence
  Synthetic oligonucleotide
ttccctgctcctcatccctaccccgctccggaacg

SEQ ID NO: 110132 - DNA, 35 bp, Artificial Sequence
  Synthetic oligonucleotide
actgtcgtagcatccttttaacagtcccccctctc

SEQ ID NO: 110133 - DNA, 37 bp, Artificial Sequence
  Synthetic oligonucleotide
acgacctcccctgaacgttaccattatgcacccccga

SEQ ID NO: 110134 - DNA, 35 bp, Artificial Sequence
  Synthetic oligonucleotide
acctccccaccgctatccgtaattgagtctattcc

SEQ ID NO: 110135 - DNA, 35 bp, Artificial Sequence
  Synthetic oligonucleotide
gccccgtagcatctatacgtcccgcccccccgatg

SEQ ID NO: 110136 - DNA, 35 bp, Artificial Sequence
  Synthetic oligonucleotide
tctgacctctcaccccccatatgaacgtgttacac

SEQ ID NO: 110137 - DNA, 35 bp, Artificial Sequence
  Synthetic oligonucleotide
agccgggtgggaacgggatggggtgattgggagac

SEQ ID NO: 110138 - DNA, 38 bp, Artificial Sequence
  Synthetic oligonucleotide
tgactccatcctgctctgtcctccatctagccctttga

SEQ ID NO: 110139 - DNA, 36 bp, Artificial Sequence
  Synthetic oligonucleotide
aacgctcagcctgtctccccgcgtgatccccctgta

SEQ ID NO: 110140 - DNA, 35 bp, Artificial Sequence
  Synthetic oligonucleotide
accgactcccctctgtccacatccgtcatcttggc

SEQ ID NO: 110141 - DNA, 35 bp, Artificial Sequence
  Synthetic oligonucleotide
gagaggggaagataggaggaaaaggtatatcaggg

SEQ ID NO: 110142 - DNA, 35 bp, Artificial Sequence
  Synthetic oligonucleotide
gttccctccgccctgcatgacatcgtgtgcatgct

SEQ ID NO: 110143 - DNA, 38 bp, Artificial Sequence
  Synthetic oligonucleotide
acccccatcgcaccttgtttcaaacacttcctcgctga

SEQ ID NO: 110144 - DNA, 35 bp, Artificial Sequence
  Synthetic oligonucleotide
gcacccgccccgttacgtacgccttgtttcttgaa

SEQ ID NO: 110145 - DNA, 35 bp, Artificial Sequence
  Synthetic oligonucleotide
gccatcttcgtggcccactctgtgcttctaccgcc

SEQ ID NO: 110146 - DNA, 36 bp, Artificial Sequence
  Synthetic oligonucleotide
gatgagcgccaccatacctgtctgttcactgtgcca

SEQ ID NO: 110147 - DNA, 35 bp, Artificial Sequence
  Synthetic oligonucleotide
ccaggcgcgatgttctgccccacacgttacacccc

SEQ ID NO: 110148 - DNA, 35 bp, Artificial Sequence
  Synthetic oligonucleotide
tatgtgccgcccgcctacggttgttccgccgctcc

SEQ ID NO: 110149 - DNA, 35 bp, Artificial Sequence
  Synthetic oligonucleotide
gagggacgggcgattggggaggggccacggaaaag

SEQ ID NO: 110150 - DNA, 35 bp, Artificial Sequence
  Synthetic oligonucleotide
tatccgctaggcgtcctacgttaccctcctgcccc

SEQ ID NO: 110151 - DNA, 37 bp, Artificial Sequence
  Synthetic oligonucleotide
acaccgcccttgccgccacgaacttcttctacgacga

SEQ ID NO: 110152 - DNA, 36 bp, Artificial Sequence
  Synthetic oligonucleotide
tagaccgcccccagtactccctcagctcctgaccga

SEQ ID NO: 110153 - DNA, 35 bp, Artificial Sequence
  Synthetic oligonucleotide
tcccccccgctcttctacagacgctctcttgcgct

SEQ ID NO: 110154 - DNA, 37 bp, Artificial Sequence
  Synthetic oligonucleotide
agacagccactgccgccgataatcgttccaccaccga

SEQ ID NO: 110155 - DNA, 38 bp, Artificial Sequence
  Synthetic oligonucleotide
ggtccacgccttaattgttctcgccccactcctttaga

SEQ ID NO: 110156 - DNA, 35 bp, Artificial Sequence
  Synthetic oligonucleotide
tgcgtcgtagatcgtcgctccccgttcccttaccc

SEQ ID NO: 110157 - DNA, 35 bp, Artificial Sequence
  Synthetic oligonucleotide
atgcactacctgccccatcctagagactcccgcct

SEQ ID NO: 110158 - DNA, 35 bp, Artificial Sequence
  Synthetic oligonucleotide
acgaaccaatcactgcccccccgacacagctgaac

SEQ ID NO: 110159 - DNA, 35 bp, Artificial Sequence
  Synthetic oligonucleotide
gactaccgcccacgtttccctatatgttcaaccgt

SEQ ID NO: 110160 - DNA, 35 bp, Artificial Sequence
  Synthetic oligonucleotide
tctccaccacggctttttcgggccccgttcccact

SEQ ID NO: 110161 - DNA, 35 bp, Artificial Sequence
  Synthetic oligonucleotide
aacaggtcccgtgtctccgttcgttccctgcccca

SEQ ID NO: 110162 - DNA, 37 bp, Artificial Sequence
  Synthetic oligonucleotide
acggggcaccctcttccctgtttacccacctcgctga

SEQ ID NO: 110163 - DNA, 36 bp, Artificial Sequence
  Synthetic oligonucleotide
tgtgagtcgtagcaggggggaggaggggatggacaa

SEQ ID NO: 110164 - DNA, 35 bp, Artificial Sequence
  Synthetic oligonucleotide
actcctcattgcatattcccgctaccaccgcttgc

SEQ ID NO: 110165 - DNA, 37 bp, Artificial Sequence
  Synthetic oligonucleotide
gcccctccgacttcacccgcggtttctctcgtaccga

SEQ ID NO: 110166 - DNA, 37 bp, Artificial Sequence
  Synthetic oligonucleotide
ggggtgacagagagggcgaaggcgacggggagcagga

SEQ ID NO: 110167 - DNA, 36 bp, Artificial Sequence
  Synthetic oligonucleotide
agacaagtaggggggaaaggagaagcacggggagga

SEQ ID NO: 110168 - DNA, 35 bp, Artificial Sequence
  Synthetic oligonucleotide
gtttcggccacatgtgtcacatccgccgccgctcc

SEQ ID NO: 110169 - DNA, 37 bp, Artificial Sequence
  Synthetic oligonucleotide
gaggaacgaggggaagcagggtgaggaacgggaaaga

SEQ ID NO: 110170 - DNA, 36 bp, Artificial Sequence
  Synthetic oligonucleotide
gagtagccacacccatccgtttcttcagccgttcca

SEQ ID NO: 110171 - DNA, 35 bp, Artificial Sequence
  Synthetic oligonucleotide
gacgatcctccgcactatctacgaatacgtttcca

SEQ ID NO: 110172 - DNA, 36 bp, Artificial Sequence
  Synthetic oligonucleotide
tcaacagtcgggggggaggagaggggccgggggata

SEQ ID NO: 110173 - DNA, 35 bp, Artificial Sequence
  Synthetic oligonucleotide
tccgctccatcaacgtttattgctgcctcctccgc

SEQ ID NO: 110174 - DNA, 35 bp, Artificial Sequence
  Synthetic oligonucleotide
ttcggtccctttgcctcccctgccatcgcgcttgc

SEQ ID NO: 110175 - DNA, 35 bp, Artificial Sequence
  Synthetic oligonucleotide
gagcacctccgccgctcctttacttctggctatca

SEQ ID NO: 110176 - DNA, 35 bp, Artificial Sequence
  Synthetic oligonucleotide
gacccgcccaacgctccctcgtccgttctgatcca

SEQ ID NO: 110177 - DNA, 34 bp, Artificial Sequence
  Synthetic oligonucleotide
ggagactgttgtggctccacgtgcaccctcctcc

SEQ ID NO: 110178 - DNA, 35 bp, Artificial Sequence
  Synthetic oligonucleotide
gaaaggaaggaaaggtagcagggtagagagggcgt

SEQ ID NO: 110179 - DNA, 36 bp, Artificial Sequence
  Synthetic oligonucleotide
gtccgcccaccatggcaatggttcctacctgcttta

SEQ ID NO: 110180 - DNA, 35 bp, Artificial Sequence
  Synthetic oligonucleotide
tacacaccgccggacgactcccgctgcgagcctcc

SEQ ID NO: 110181 - DNA, 35 bp, Artificial Sequence
  Synthetic oligonucleotide
agcacacccgcccatcgcgttactgccgcaatgcc

SEQ ID NO: 110182 - DNA, 38 bp, Artificial Sequence
  Synthetic oligonucleotide
gtgggcgggaagggggactaggggcgaaacgcagttga

SEQ ID NO: 110183 - DNA, 35 bp, Artificial Sequence
  Synthetic oligonucleotide
aaaccgcccctgtccacatattagttcggtccatc

SEQ ID NO: 110184 - DNA, 37 bp, Artificial Sequence
  Synthetic oligonucleotide
gtgggtggggtttcacaagggggccttaggtagggga

SEQ ID NO: 110185 - DNA, 35 bp, Artificial Sequence
  Synthetic oligonucleotide
ttgctctcctccgaccattgtcctaccagcccctc

SEQ ID NO: 110186 - DNA, 35 bp, Artificial Sequence
  Synthetic oligonucleotide
tgaccgagcatcggctctgcctatatcgcccttct

SEQ ID NO: 110187 - DNA, 37 bp, Artificial Sequence
  Synthetic oligonucleotide
atacccgcgtcacctctgcctcgcccccacctcggga

SEQ ID NO: 110188 - DNA, 35 bp, Artificial Sequence
  Synthetic oligonucleotide
gagccactccacgcctacggtttgtacttctccct

SEQ ID NO: 110189 - DNA, 35 bp, Artificial Sequence
  Synthetic oligonucleotide
gtcacgtggggcgggctagggtgggcgctgaaaca

SEQ ID NO: 110190 - DNA, 35 bp, Artificial Sequence
  Synthetic oligonucleotide
tgccatcccccccctttcttcagttagtgcttttg

SEQ ID NO: 110191 - DNA, 35 bp, Artificial Sequence
  Synthetic oligonucleotide
gacggggcaagatagggcgtgagggggggatgcaa

SEQ ID NO: 110192 - DNA, 35 bp, Artificial Sequence
  Synthetic oligonucleotide
gcgacggccctcgcttttagatccctcccttcgcc

SEQ ID NO: 110193 - DNA, 35 bp, Artificial Sequence
  Synthetic oligonucleotide
tgcgctgtcccctcgttcggttctcactctggttc

SEQ ID NO: 110194 - DNA, 35 bp, Artificial Sequence
  Synthetic oligonucleotide
tttgggactgggggcggggattgggatggcagtag

SEQ ID NO: 110195 - DNA, 35 bp, Artificial Sequence
  Synthetic oligonucleotide
gtagggaagggggggggtcgacgcggaatcgaagg

SEQ ID NO: 110196 - DNA, 35 bp, Artificial Sequence
  Synthetic oligonucleotide
tgcatcaagctgtagttcctccccgcgcctctgcc

SEQ ID NO: 110197 - DNA, 35 bp, Artificial Sequence
  Synthetic oligonucleotide
aacgaagtcaaacagctgatgtccctcctccgtcc

SEQ ID NO: 110198 - DNA, 35 bp, Artificial Sequence
  Synthetic oligonucleotide
tctccctccgtcctgactcagcgggagtcctttac

SEQ ID NO: 110199 - DNA, 35 bp, Artificial Sequence
  Synthetic oligonucleotide
gaccagcctcgccgccccttaaactctgctcccat

SEQ ID NO: 110200 - DNA, 36 bp, Artificial Sequence
  Synthetic oligonucleotide
ttaccacggccgacccgccacagtccgtgcctccca

SEQ ID NO: 110201 - DNA, 35 bp, Artificial Sequence
  Synthetic oligonucleotide
gggagtggagaggagggtgggggatcggcgtagga

SEQ ID NO: 110202 - DNA, 35 bp, Artificial Sequence
  Synthetic oligonucleotide
gcccaacgtacattccggaatcacgccactcccgc

SEQ ID NO: 110203 - DNA, 35 bp, Artificial Sequence
  Synthetic oligonucleotide
tagtccgtcgccacctgcacctgctcactttgcct

SEQ ID NO: 110204 - DNA, 35 bp, Artificial Sequence
  Synthetic oligonucleotide
acttgcccagccgcaccctgctctgtacgctctca

SEQ ID NO: 110205 - DNA, 36 bp, Artificial Sequence
  Synthetic oligonucleotide
tatctgggtcaagaggtggtgggggttgggacggca

SEQ ID NO: 110206 - DNA, 35 bp, Artificial Sequence
  Synthetic oligonucleotide
tcaccccgctctgagcccgatttggtcgctcccgc

SEQ ID NO: 110207 - DNA, 37 bp, Artificial Sequence
  Synthetic oligonucleotide
tccctccgctccccccctgtctgtagcgcaacactga

SEQ ID NO: 110208 - DNA, 37 bp, Artificial Sequence
  Synthetic oligonucleotide
tcccatcgcgagcctcgtccctgcgccatcctgttga

SEQ ID NO: 110209 - DNA, 36 bp, Artificial Sequence
  Synthetic oligonucleotide
accctccgccgggatcgattgcgagccttaccctta

SEQ ID NO: 110210 - DNA, 35 bp, Artificial Sequence
  Synthetic oligonucleotide
tgagccacaacgaatgttgatccccttcgcccctc

SEQ ID NO: 110211 - DNA, 38 bp, Artificial Sequence
  Synthetic oligonucleotide
acccccaccgccatgcctagcaaccgttacatacctga

SEQ ID NO: 110212 - DNA, 36 bp, Artificial Sequence
  Synthetic oligonucleotide
ggagggggtgggtggtaaggcaaggtgaaggggtaa

SEQ ID NO: 110213 - DNA, 35 bp, Artificial Sequence
  Synthetic oligonucleotide
accacactccgagcttatatcaaccaccctcacac

SEQ ID NO: 110214 - DNA, 35 bp, Artificial Sequence
  Synthetic oligonucleotide
tcgcaattaccgccccgttcgcctgcccctcgctg

SEQ ID NO: 110215 - DNA, 35 bp, Artificial Sequence
  Synthetic oligonucleotide
atcacacctcgctctcaccatccgcacgccgcttg

SEQ ID NO: 110216 - DNA, 36 bp, Artificial Sequence
  Synthetic oligonucleotide
gattgcgcggggggaacatagcatggggaggggaca

SEQ ID NO: 110217 - DNA, 37 bp, Artificial Sequence
  Synthetic oligonucleotide
tatatggaggcccgtaggaggggtggaggacggccga

SEQ ID NO: 110218 - DNA, 35 bp, Artificial Sequence
  Synthetic oligonucleotide
ttgggggtaagggagtaatgggggaacggagtgga

SEQ ID NO: 110219 - DNA, 35 bp, Artificial Sequence
  Synthetic oligonucleotide
gcaactcagtttctgtcgccccattttcaccggtc

SEQ ID NO: 110220 - DNA, 37 bp, Artificial Sequence
  Synthetic oligonucleotide
gtccgcccccgttatttcctcgcctattgtcgctcga

SEQ ID NO: 110221 - DNA, 35 bp, Artificial Sequence
  Synthetic oligonucleotide
attgcccatccgacgtaccctcaatccttttcgag

SEQ ID NO: 110222 - DNA, 35 bp, Artificial Sequence
  Synthetic oligonucleotide
gtgcgcccctctgttgacgtcattgcttagtccct

SEQ ID NO: 110223 - DNA, 37 bp, Artificial Sequence
  Synthetic oligonucleotide
atttgacggcggaatgggggtacgggggggagggtga

SEQ ID NO: 110224 - DNA, 35 bp, Artificial Sequence
  Synthetic oligonucleotide
atgtggaaggggggcgggaggtaagaagcgtaggg

SEQ ID NO: 110225 - DNA, 35 bp, Artificial Sequence
  Synthetic oligonucleotide
gtcgacacctctacgttacctgcgtgccaccctca

SEQ ID NO: 110226 - DNA, 35 bp, Artificial Sequence
  Synthetic oligonucleotide
gttgcgcccttccctatgtacgtggttccctctgg

SEQ ID NO: 110227 - DNA, 35 bp, Artificial Sequence
  Synthetic oligonucleotide
gacagccctcatgtgtaacaccctcccgtccgcac

SEQ ID NO: 110228 - DNA, 35 bp, Artificial Sequence
  Synthetic oligonucleotide
acccgcccccgcctccgttcactcacggaattgca

SEQ ID NO: 110229 - DNA, 36 bp, Artificial Sequence
  Synthetic oligonucleotide
gagacggggtgggtgggttgtcatcgggtacccgga

SEQ ID NO: 110230 - DNA, 35 bp, Artificial Sequence
  Synthetic oligonucleotide
attgctcccgatactccgcccgtccccttcctcgc

SEQ ID NO: 110231 - DNA, 35 bp, Artificial Sequence
  Synthetic oligonucleotide
tcaccgcccgactccatgggctgccttaacatatc

SEQ ID NO: 110232 - DNA, 35 bp, Artificial Sequence
  Synthetic oligonucleotide
aaagcaccgcaactgctctgccccgttcccacacg

SEQ ID NO: 110233 - DNA, 37 bp, Artificial Sequence
  Synthetic oligonucleotide
gctatacggagagggggggaggaaggggatcgtggga

SEQ ID NO: 110234 - DNA, 35 bp, Artificial Sequence
  Synthetic oligonucleotide
gccatgcccgccggtccgtccgtcgctccgttgcc

SEQ ID NO: 110235 - DNA, 35 bp, Artificial Sequence
  Synthetic oligonucleotide
ttcgtaccccccaccagcagcacgttcctgcattc

SEQ ID NO: 110236 - DNA, 36 bp, Artificial Sequence
  Synthetic oligonucleotide
ttgtcccccgccctctcatgacagcggttactccaa

SEQ ID NO: 110237 - DNA, 35 bp, Artificial Sequence
  Synthetic oligonucleotide
gatgcccatctttgcacagaggcccttatccctcc

SEQ ID NO: 110238 - DNA, 35 bp, Artificial Sequence
  Synthetic oligonucleotide
gacatgtccacggtctccgcctcattccatccact

SEQ ID NO: 110239 - DNA, 35 bp, Artificial Sequence
  Synthetic oligonucleotide
gccatcctccccccgtcttataggaactcacactt

SEQ ID NO: 110240 - DNA, 36 bp, Artificial Sequence
  Synthetic oligonucleotide
gcccatacgctttgtcacctagctgccactccctga

SEQ ID NO: 110241 - DNA, 38 bp, Artificial Sequence
  Synthetic oligonucleotide
gtagagacagaggcagaaggaacagggggagggtttga

SEQ ID NO: 110242 - DNA, 35 bp, Artificial Sequence
  Synthetic oligonucleotide
gacccctgtctgaggattactgtgccgttgtcctg

SEQ ID NO: 110243 - DNA, 36 bp, Artificial Sequence
  Synthetic oligonucleotide
tctgacgggtggggtggggcggggagagacgtttca

SEQ ID NO: 110244 - DNA, 35 bp, Artificial Sequence
  Synthetic oligonucleotide
tgtgccgccaaggatcgtctattcatcccgccgcc

SEQ ID NO: 110245 - DNA, 35 bp, Artificial Sequence
  Synthetic oligonucleotide
tgcccatgccgccacaccacagaccagcaccggcc

SEQ ID NO: 110246 - DNA, 35 bp, Artificial Sequence
  Synthetic oligonucleotide
gatgcgtcgtccgctggtccaccctcgcccgtgcc

SEQ ID NO: 110247 - DNA, 35 bp, Artificial Sequence
  Synthetic oligonucleotide
gaccgtccaccatgtaccgcctacccccacgcgtc

SEQ ID NO: 110248 - DNA, 35 bp, Artificial Sequence
  Synthetic oligonucleotide
ggagggctaatcagggggggagggggccatattac

SEQ ID NO: 110249 - DNA, 35 bp, Artificial Sequence
  Synthetic oligonucleotide
acgtggcatcctcgcttagttctttctgctgttca

SEQ ID NO: 110250 - DNA, 34 bp, Artificial Sequence
  Synthetic oligonucleotide
attcgtcccggcacccctccttcgcatggcctca

SEQ ID NO: 110251 - DNA, 36 bp, Artificial Sequence
  Synthetic oligonucleotide
gccacccactgctgatttcccatggtctgtctcgta

SEQ ID NO: 110252 - DNA, 38 bp, Artificial Sequence
  Synthetic oligonucleotide
tgctgcctccgaccatttagccgccatcaccaacctga

SEQ ID NO: 110253 - DNA, 38 bp, Artificial Sequence
  Synthetic oligonucleotide
gcgacactccgctcctgtcccgaaagtgccctccttga

SEQ ID NO: 110254 - DNA, 35 bp, Artificial Sequence
  Synthetic oligonucleotide
ggggtgggcgggtgcagggttgggaatgagggagg

SEQ ID NO: 110255 - DNA, 35 bp, Artificial Sequence
  Synthetic oligonucleotide
gaggagtaggtggttggaggcggaatgggtgggtg

SEQ ID NO: 110256 - DNA, 36 bp, Artificial Sequence
  Synthetic oligonucleotide
gtgtaccctctgctgttcccaaagccgccacctaca

SEQ ID NO: 110257 - DNA, 35 bp, Artificial Sequence
  Synthetic oligonucleotide
tttgactagctctgcccccatcgttttagccccca

SEQ ID NO: 110258 - DNA, 35 bp, Artificial Sequence
  Synthetic oligonucleotide
gtggcgatcctgtcctgttctatgctctcctccgt

SEQ ID NO: 110259 - DNA, 35 bp, Artificial Sequence
  Synthetic oligonucleotide
tccgccccgctccgtgacggcctcatagtaatctc

SEQ ID NO: 110260 - DNA, 37 bp, Artificial Sequence
  Synthetic oligonucleotide
acccgttcgacgccagccctcgctcccccactcgtga

SEQ ID NO: 110261 - DNA, 36 bp, Artificial Sequence
  Synthetic oligonucleotide
aaagccaaccgcatttgttcgtctcccccgtgccca

SEQ ID NO: 110262 - DNA, 35 bp, Artificial Sequence
  Synthetic oligonucleotide
gtcgccttcctcgcatgtcttacgccccgggctaa

SEQ ID NO: 110263 - DNA, 37 bp, Artificial Sequence
  Synthetic oligonucleotide
gctgacgtccatcgtcagccgacacctctccacccga

SEQ ID NO: 110264 - DNA, 35 bp, Artificial Sequence
  Synthetic oligonucleotide
gccatcgcgcgtggcccctccctcgccaaaatgcc

SEQ ID NO: 110265 - DNA, 35 bp, Artificial Sequence
  Synthetic oligonucleotide
gtccccgcttgccgcccaatatttacctgtccttg

SEQ ID NO: 110266 - DNA, 35 bp, Artificial Sequence
  Synthetic oligonucleotide
tcaggggagacagggaaggcggtagggagtcaaga

SEQ ID NO: 110267 - DNA, 35 bp, Artificial Sequence
  Synthetic oligonucleotide
gccatccaatatctccaccgctgctgggccccccc

SEQ ID NO: 110268 - DNA, 35 bp, Artificial Sequence
  Synthetic oligonucleotide
accatgaaccgcttgaatctttagccactgcccca

SEQ ID NO: 110269 - DNA, 35 bp, Artificial Sequence
  Synthetic oligonucleotide
ttgtcaccgcgtatgccctcctgttcgcctgtttt

SEQ ID NO: 110270 - DNA, 35 bp, Artificial Sequence
  Synthetic oligonucleotide
gccaccgttcagcagtctctaactgctcctcgccc

SEQ ID NO: 110271 - DNA, 35 bp, Artificial Sequence
  Synthetic oligonucleotide
acactaccacccccgtcctatacgtgaccatcatc

SEQ ID NO: 110272 - DNA, 35 bp, Artificial Sequence
  Synthetic oligonucleotide
acgaacgggaatatgggtgggagggttcgagggag

SEQ ID NO: 110273 - DNA, 34 bp, Artificial Sequence
  Synthetic oligonucleotide
gatcgccatcagacttccttgctgctctccatca

SEQ ID NO: 110274 - DNA, 35 bp, Artificial Sequence
  Synthetic oligonucleotide
tctcgactccgccccccttttggtttattgtttca

SEQ ID NO: 110275 - DNA, 35 bp, Artificial Sequence
  Synthetic oligonucleotide
tagcacatctcgaaccgttcccgtgcacgtactac

SEQ ID NO: 110276 - DNA, 35 bp, Artificial Sequence
  Synthetic oligonucleotide
ttgcctgctgtccttctatctaacgtcgccgctgt

SEQ ID NO: 110277 - DNA, 35 bp, Artificial Sequence
  Synthetic oligonucleotide
acacccccccgcacccctgccatgttcagccggga

SEQ ID NO: 110278 - DNA, 35 bp, Artificial Sequence
  Synthetic oligonucleotide
ttcgcattggtccgtttagtcccccgcccgctccg

SEQ ID NO: 110279 - DNA, 36 bp, Artificial Sequence
  Synthetic oligonucleotide
acacgtgtccgctccatctattttgtccgcgcccca

SEQ ID NO: 110280 - DNA, 36 bp, Artificial Sequence
  Synthetic oligonucleotide
agctcacctccaccttagtatgcgtcgaccacctca

SEQ ID NO: 110281 - DNA, 35 bp, Artificial Sequence
  Synthetic oligonucleotide
gccagcaccgctcttgaccgcccctccctgattgc

SEQ ID NO: 110282 - DNA, 35 bp, Artificial Sequence
  Synthetic oligonucleotide
tcccctcgccgatcacacattcccctataagcctc

SEQ ID NO: 110283 - DNA, 37 bp, Artificial Sequence
  Synthetic oligonucleotide
tcccacactcccgttgatccagggcccactccaaaga

SEQ ID NO: 110284 - DNA, 37 bp, Artificial Sequence
  Synthetic oligonucleotide
gatggtacccgagatgagggtagggggagggggagga

SEQ ID NO: 110285 - DNA, 35 bp, Artificial Sequence
  Synthetic oligonucleotide
actgcgatcagccggtcacctccacccaaccattc

SEQ ID NO: 110286 - DNA, 38 bp, Artificial Sequence
  Synthetic oligonucleotide
gagggtagacgggcgcggtgtaagggggggaagggtga

SEQ ID NO: 110287 - DNA, 35 bp, Artificial Sequence
  Synthetic oligonucleotide
ttacgcccaccccgcactatggtttactgttacga

SEQ ID NO: 110288 - DNA, 35 bp, Artificial Sequence
  Synthetic oligonucleotide
ttgcccatttccgcatgctttacaccctggtttcc

SEQ ID NO: 110289 - DNA, 37 bp, Artificial Sequence
  Synthetic oligonucleotide
accgccgtcgtttctcatcctcgccttcacgtgccga

SEQ ID NO: 110290 - DNA, 35 bp, Artificial Sequence
  Synthetic oligonucleotide
accagtcgtactttcgcgatccatacccgtcccac

SEQ ID NO: 110291 - DNA, 35 bp, Artificial Sequence
  Synthetic oligonucleotide
acagagaggtggagggtggggagccaaggtcagag

SEQ ID NO: 110292 - DNA, 35 bp, Artificial Sequence
  Synthetic oligonucleotide
gctccaccgccgactcaccatacaacgattgcccc

SEQ ID NO: 110293 - DNA, 35 bp, Artificial Sequence
  Synthetic oligonucleotide
gccatcaccactttgctcccgatatcctctggttt

SEQ ID NO: 110294 - DNA, 35 bp, Artificial Sequence
  Synthetic oligonucleotide
agtcgccacgccccatccctccccccgaggagacg

SEQ ID NO: 110295 - DNA, 35 bp, Artificial Sequence
  Synthetic oligonucleotide
gaacagcccgttcccgcctgcctgacttcttcctg

SEQ ID NO: 110296 - DNA, 35 bp, Artificial Sequence
  Synthetic oligonucleotide
tccgcacctagtgttccctcccctacctccattgt

SEQ ID NO: 110297 - DNA, 36 bp, Artificial Sequence
  Synthetic oligonucleotide
ttggccgtcacattcacgcttctgcacctcgccgca

SEQ ID NO: 110298 - DNA, 35 bp, Artificial Sequence
  Synthetic oligonucleotide
tgtaccgcccgtgtttcacccttcttccatccata

SEQ ID NO: 110299 - DNA, 35 bp, Artificial Sequence
  Synthetic oligonucleotide
tgagcaccccttatacggtccagttctcccgctcc

SEQ ID NO: 110300 - DNA, 35 bp, Artificial Sequence
  Synthetic oligonucleotide
tctctcgcacactgctctgttcctagcctccccaa

SEQ ID NO: 110301 - DNA, 36 bp, Artificial Sequence
  Synthetic oligonucleotide
tggtcctgtccgttctcctcctcgtcgccttgcaca

SEQ ID NO: 110302 - DNA, 36 bp, Artificial Sequence
  Synthetic oligonucleotide
attggggaggggaatctgtgggggatctaatgggga

SEQ ID NO: 110303 - DNA, 35 bp, Artificial Sequence
  Synthetic oligonucleotide
gactccccgctgttctatccgtttccttagcgatg

SEQ ID NO: 110304 - DNA, 35 bp, Artificial Sequence
  Synthetic oligonucleotide
actcgccgccgtcgtgacactccatatcgccctct

SEQ ID NO: 110305 - DNA, 35 bp, Artificial Sequence
  Synthetic oligonucleotide
gtccaccgcccttcttgtcccgaggactagcctaa

SEQ ID NO: 110306 - DNA, 35 bp, Artificial Sequence
  Synthetic oligonucleotide
gggcgtggcgacgcctcctccactccccgtcctcc

SEQ ID NO: 110307 - DNA, 35 bp, Artificial Sequence
  Synthetic oligonucleotide
tatgtgccccagaccctcctattccgaccgacctc

SEQ ID NO: 110308 - DNA, 35 bp, Artificial Sequence
  Synthetic oligonucleotide
gccacctgccctctatgctccttgaacgaccacag

SEQ ID NO: 110309 - DNA, 35 bp, Artificial Sequence
  Synthetic oligonucleotide
agctccagcccgccttcttgtcaaattcctgccct

SEQ ID NO: 110310 - DNA, 35 bp, Artificial Sequence
  Synthetic oligonucleotide
tttacgccacgctccccgactaagcaccccctcgc

SEQ ID NO: 110311 - DNA, 35 bp, Artificial Sequence
  Synthetic oligonucleotide
gtctacgcaaatccttatcgcccccctgtgctggc

SEQ ID NO: 110312 - DNA, 35 bp, Artificial Sequence
  Synthetic oligonucleotide
ttcgccgtgcggtctcgtttcgcggcttttctatc

SEQ ID NO: 110313 - DNA, 35 bp, Artificial Sequence
  Synthetic oligonucleotide
gccctacgtccgcccctgtcctcatatgaaactcc

SEQ ID NO: 110314 - DNA, 35 bp, Artificial Sequence
  Synthetic oligonucleotide
gaacaccctctattgaagcactcgtacacctttgc

SEQ ID NO: 110315 - DNA, 35 bp, Artificial Sequence
  Synthetic oligonucleotide
tcgctgatccaccccctgtccatgcaaccagtttc

SEQ ID NO: 110316 - DNA, 34 bp, Artificial Sequence
  Synthetic oligonucleotide
cctgcccttcccccgcagggtaccgaggactctt

SEQ ID NO: 110317 - DNA, 35 bp, Artificial Sequence
  Synthetic oligonucleotide
tgacccgtcgtaccgccgcgattatcttgtccccc

SEQ ID NO: 110318 - DNA, 35 bp, Artificial Sequence
  Synthetic oligonucleotide
acacccaccactatctcactgtcccgtcgccgggc

SEQ ID NO: 110319 - DNA, 34 bp, Artificial Sequence
  Synthetic oligonucleotide
tccacccaccgttccgcgctcgcacacagcccct

SEQ ID NO: 110320 - DNA, 38 bp, Artificial Sequence
  Synthetic oligonucleotide
accgaccctcctcgcttgcatcctgacacagaccgtga

SEQ ID NO: 110321 - DNA, 35 bp, Artificial Sequence
  Synthetic oligonucleotide
ttatccaccgccacaccattcccttgctgtatttg

SEQ ID NO: 110322 - DNA, 38 bp, Artificial Sequence
  Synthetic oligonucleotide
gtccaccccgctcttatctgcggccatcattcctttga

SEQ ID NO: 110323 - DNA, 36 bp, Artificial Sequence
  Synthetic oligonucleotide
atgtctcccgcattgttttcccgtccgtccacgtta

SEQ ID NO: 110324 - DNA, 35 bp, Artificial Sequence
  Synthetic oligonucleotide
atcccgcacctggcatgtgcgccctactttctcgc

SEQ ID NO: 110325 - DNA, 35 bp, Artificial Sequence
  Synthetic oligonucleotide
accccgttccagatgcccccgtcccttttcaccca

SEQ ID NO: 110326 - DNA, 35 bp, Artificial Sequence
  Synthetic oligonucleotide
gcgcccacagcgcggtcaccccctcccatggcccc

SEQ ID NO: 110327 - DNA, 35 bp, Artificial Sequence
  Synthetic oligonucleotide
gatctcaccgccctcatacatatcatcgcttttcg

SEQ ID NO: 110328 - DNA, 35 bp, Artificial Sequence
  Synthetic oligonucleotide
accgagtgtcggggcctaggaggggagggaggagg

SEQ ID NO: 110329 - DNA, 35 bp, Artificial Sequence
  Synthetic oligonucleotide
gtcccccgcgtatcagccagttcttgatccccctg

SEQ ID NO: 110330 - DNA, 35 bp, Artificial Sequence
  Synthetic oligonucleotide
acgctctgtcccccatgcgatcactgccccatgta

SEQ ID NO: 110331 - DNA, 35 bp, Artificial Sequence
  Synthetic oligonucleotide
tccgacgctcgggttattttgtaccacccattatc

SEQ ID NO: 110332 - DNA, 35 bp, Artificial Sequence
  Synthetic oligonucleotide
tgacttcccggtcgccatgtaaacccctgcctctc

SEQ ID NO: 110333 - DNA, 36 bp, Artificial Sequence
  Synthetic oligonucleotide
gtgcgctactcctcgcggtctgttttttttggccca

SEQ ID NO: 110334 - DNA, 35 bp, Artificial Sequence
  Synthetic oligonucleotide
tcatcccccccacatcttgatactttcgagcctta

SEQ ID NO: 110335 - DNA, 35 bp, Artificial Sequence
  Synthetic oligonucleotide
gctgctcccgcccttgctgtcgttggccatattcc

SEQ ID NO: 110336 - DNA, 38 bp, Artificial Sequence
  Synthetic oligonucleotide
tgacactgcctgttcgctaacaccgtacctccctgtaa

SEQ ID NO: 110337 - DNA, 35 bp, Artificial Sequence
  Synthetic oligonucleotide
agtagggtgggcggggctaagattcatgggggttc

SEQ ID NO: 110338 - DNA, 36 bp, Artificial Sequence
  Synthetic oligonucleotide
tcccccgccccaccatattgagttagctcgcctaaa

SEQ ID NO: 110339 - DNA, 36 bp, Artificial Sequence
  Synthetic oligonucleotide
gtcgcccgccgccgccctacgctcgtacctctacca

SEQ ID NO: 110340 - DNA, 36 bp, Artificial Sequence
  Synthetic oligonucleotide
ggacggggggggcagaatggtagggcttgcgtgcca

SEQ ID NO: 110341 - DNA, 37 bp, Artificial Sequence
  Synthetic oligonucleotide
tccccccgccactccgacaatatgcaacccgctccga

SEQ ID NO: 110342 - DNA, 35 bp, Artificial Sequence
  Synthetic oligonucleotide
tccgcatcaacccgtacgtgccctccgacccttac

SEQ ID NO: 110343 - DNA, 36 bp, Artificial Sequence
  Synthetic oligonucleotide
gttcccaaccccactgtgcctctccgcctttggcca

SEQ ID NO: 110344 - DNA, 36 bp, Artificial Sequence
  Synthetic oligonucleotide
accagcacgcagcaatcgttacacctaccgtcctca

SEQ ID NO: 110345 - DNA, 35 bp, Artificial Sequence
  Synthetic oligonucleotide
catctgtgccacccgttccgaccgctattcgttat

SEQ ID NO: 110346 - DNA, 38 bp, Artificial Sequence
  Synthetic oligonucleotide
gagtgggtggaggggccataagggtgatcggtggtact

SEQ ID NO: 110347 - DNA, 35 bp, Artificial Sequence
  Synthetic oligonucleotide
tttccccaccgcgccactatatcgtccagtccact

SEQ ID NO: 110348 - DNA, 37 bp, Artificial Sequence
  Synthetic oligonucleotide
acgccctgcccccccaacgcttatatgtacctctgga

SEQ ID NO: 110349 - DNA, 35 bp, Artificial Sequence
  Synthetic oligonucleotide
gacccgtccggaagattctctctcatcgctgcccc

SEQ ID NO: 110350 - DNA, 35 bp, Artificial Sequence
  Synthetic oligonucleotide
gtcgcctcccgctgtcgacccctgtccttaacgct

SEQ ID NO: 110351 - DNA, 35 bp, Artificial Sequence
  Synthetic oligonucleotide
tgcgacccttcctgaatgtctacccctctgcttat

SEQ ID NO: 110352 - DNA, 35 bp, Artificial Sequence
  Synthetic oligonucleotide
atgccccaccattcgacctttatagtgcttgtcca

SEQ ID NO: 110353 - DNA, 36 bp, Artificial Sequence
  Synthetic oligonucleotide
gctaactgcagtctctgtgcacctccccccctctca

SEQ ID NO: 110354 - DNA, 35 bp, Artificial Sequence
  Synthetic oligonucleotide
acagccccccgccaacgtagagtttcccacctgtc

SEQ ID NO: 110355 - DNA, 35 bp, Artificial Sequence
  Synthetic oligonucleotide
agccccacctccggattccgatttatgtctacgcc

SEQ ID NO: 110356 - DNA, 35 bp, Artificial Sequence
  Synthetic oligonucleotide
atcctgaccaccgcatctactatcgacccactacg

SEQ ID NO: 110357 - DNA, 35 bp, Artificial Sequence
  Synthetic oligonucleotide
aactgcccccgttccgacctagttgcggttttgcc

SEQ ID NO: 110358 - DNA, 35 bp, Artificial Sequence
  Synthetic oligonucleotide
ggatacgggaaggaggaggggagggccggtcatga

SEQ ID NO: 110359 - DNA, 35 bp, Artificial Sequence
  Synthetic oligonucleotide
gggatcccccgccggtatattaccagtactccacc

SEQ ID NO: 110360 - DNA, 35 bp, Artificial Sequence
  Synthetic oligonucleotide
agcccatcccgccgcccactagcgactatcctggc

SEQ ID NO: 110361 - DNA, 35 bp, Artificial Sequence
  Synthetic oligonucleotide
taagggaggggacgggggttctttacgaggggggc

SEQ ID NO: 110362 - DNA, 35 bp, Artificial Sequence
  Synthetic oligonucleotide
tgaggtcagtttctgctccatcgccgcacctacca

SEQ ID NO: 110363 - DNA, 37 bp, Artificial Sequence
  Synthetic oligonucleotide
gccccaccccattgccgcttcatgctcgagagcatga

SEQ ID NO: 110364 - DNA, 35 bp, Artificial Sequence
  Synthetic oligonucleotide
tccccgcgtgcacctgctcaacttcatcatgccgc

SEQ ID NO: 110365 - DNA, 35 bp, Artificial Sequence
  Synthetic oligonucleotide
tcacaccccctcgtgttagcccccttagagttttc

SEQ ID NO: 110366 - DNA, 32 bp, Artificial Sequence
  Synthetic oligonucleotide
aaccctattggcaggtcactctttctaccccc

SEQ ID NO: 110367 - DNA, 35 bp, Artificial Sequence
  Synthetic oligonucleotide
tccgtaggtgcgatcagcgccgtccatcctctcct

SEQ ID NO: 110368 - DNA, 35 bp, Artificial Sequence
  Synthetic oligonucleotide
gtgtcaccacctcgtttcgttcagttccccggttt

SEQ ID NO: 110369 - DNA, 36 bp, Artificial Sequence
  Synthetic oligonucleotide
gtgggtaggcgagagggggggtcgaaagcaggacaa

SEQ ID NO: 110370 - DNA, 36 bp, Artificial Sequence
  Synthetic oligonucleotide
ttagcctgcctccacatcgtaacttctcctctgaca

SEQ ID NO: 110371 - DNA, 35 bp, Artificial Sequence
  Synthetic oligonucleotide
gttccgcccgtccgcgttccgtctccaaggtcctt

SEQ ID NO: 110372 - DNA, 37 bp, Artificial Sequence
  Synthetic oligonucleotide
gactctccacatgctccctgtcgctgttctctcctga

SEQ ID NO: 110373 - DNA, 35 bp, Artificial Sequence
  Synthetic oligonucleotide
tatccgtgcgcagcctgacattaacgtcctcctct

SEQ ID NO: 110374 - DNA, 35 bp, Artificial Sequence
  Synthetic oligonucleotide
accaactgcccgctatcttaacaagtcgaccccca

SEQ ID NO: 110375 - DNA, 35 bp, Artificial Sequence
  Synthetic oligonucleotide
agccgccacggcactctgtgcttttccaccctcca

SEQ ID NO: 110376 - DNA, 35 bp, Artificial Sequence
  Synthetic oligonucleotide
aagaccgagatcacattagcccgtgttgcacttcc

SEQ ID NO: 110377 - DNA, 35 bp, Artificial Sequence
  Synthetic oligonucleotide
gggaacacctggaccacggagctcttgccctttcc

SEQ ID NO: 110378 - DNA, 35 bp, Artificial Sequence
  Synthetic oligonucleotide
tcatcaccgcttgtagcgtgatttacaacatccct

SEQ ID NO: 110379 - DNA, 36 bp, Artificial Sequence
  Synthetic oligonucleotide
tgccaccccgctaccgtatctccaacgcctcaggca

SEQ ID NO: 110380 - DNA, 38 bp, Artificial Sequence
  Synthetic oligonucleotide
gccgccctcagcagcggccacccctgccccccctgtga

SEQ ID NO: 110381 - DNA, 35 bp, Artificial Sequence
  Synthetic oligonucleotide
gtcaccccgagggctcatcggacttcctttccata

SEQ ID NO: 110382 - DNA, 36 bp, Artificial Sequence
  Synthetic oligonucleotide
accgcccccctgtaccgctgtcgtgaatcccttgca

SEQ ID NO: 110383 - DNA, 35 bp, Artificial Sequence
  Synthetic oligonucleotide
aatgccgcctacgttacgttactggtcccacttcc

SEQ ID NO: 110384 - DNA, 35 bp, Artificial Sequence
  Synthetic oligonucleotide
tgtccactcccagcgctaatacgcctcgttaccgc

SEQ ID NO: 110385 - DNA, 37 bp, Artificial Sequence
  Synthetic oligonucleotide
gtgggatgcccaagatgggtgggagggatacctgaga

SEQ ID NO: 110386 - DNA, 35 bp, Artificial Sequence
  Synthetic oligonucleotide
atgacagtggggagggaagtagggtgccggggttg

SEQ ID NO: 110387 - DNA, 35 bp, Artificial Sequence
  Synthetic oligonucleotide
tccatcctatccgcctccagtcctgcctcctatgt

SEQ ID NO: 110388 - DNA, 36 bp, Artificial Sequence
  Synthetic oligonucleotide
gcatggctcaatgttcgctcgcctctgtccttacca

SEQ ID NO: 110389 - DNA, 35 bp, Artificial Sequence
  Synthetic oligonucleotide
gctgactcagcggtcgcctccattcaccttctgcg

SEQ ID NO: 110390 - DNA, 35 bp, Artificial Sequence
  Synthetic oligonucleotide
aggacgacgccagccgatcccaacacccgcccgct

SEQ ID NO: 110391 - DNA, 35 bp, Artificial Sequence
  Synthetic oligonucleotide
gccacacgccttatcctcgcctgcctcccaggccc

SEQ ID NO: 110392 - DNA, 35 bp, Artificial Sequence
  Synthetic oligonucleotide
gcccccgcatacatcccgatcgtttaccccttgtc

SEQ ID NO: 110393 - DNA, 35 bp, Artificial Sequence
  Synthetic oligonucleotide
tctcacctcactgctggcctactggatcttcatca

SEQ ID NO: 110394 - DNA, 35 bp, Artificial Sequence
  Synthetic oligonucleotide
tcttgccgccagatcttgtctcccttgtgcgcgcc

SEQ ID NO: 110395 - DNA, 35 bp, Artificial Sequence
  Synthetic oligonucleotide
tggtccacctctgctgtctgccgccgacgcattcc

SEQ ID NO: 110396 - DNA, 35 bp, Artificial Sequence
  Synthetic oligonucleotide
tctagcccacgcctcccccccgtgttataccttcg

SEQ ID NO: 110397 - DNA, 35 bp, Artificial Sequence
  Synthetic oligonucleotide
aatgtgcactctcacgcccatcgccgcactcccct

SEQ ID NO: 110398 - DNA, 35 bp, Artificial Sequence
  Synthetic oligonucleotide
ggggagagggggaagaggggccgaaaacaggtaaa

SEQ ID NO: 110399 - DNA, 36 bp, Artificial Sequence
  Synthetic oligonucleotide
atcaagggcgagggggggaggaagcaaaaaaatcaa

SEQ ID NO: 110400 - DNA, 35 bp, Artificial Sequence
  Synthetic oligonucleotide
tacagacaaagggcgtgggggggtgaggggcgtat

SEQ ID NO: 110401 - DNA, 35 bp, Artificial Sequence
  Synthetic oligonucleotide
gccaccgctacctcgcccatccaggccatatgcgc

SEQ ID NO: 110402 - DNA, 35 bp, Artificial Sequence
  Synthetic oligonucleotide
tgaaaacgaaggggggcgagggaaatgagagcgat

SEQ ID NO: 110403 - DNA, 34 bp, Artificial Sequence
  Synthetic oligonucleotide
gacgccatcaaatgtcgtgctccatcgccgccac

SEQ ID NO: 110404 - DNA, 35 bp, Artificial Sequence
  Synthetic oligonucleotide
gcgaccaccgtgcccttttccgcatcgaccctctg

SEQ ID NO: 110405 - DNA, 35 bp, Artificial Sequence
  Synthetic oligonucleotide
gaacctgcgcccaccctgtttactgtctattcgta

SEQ ID NO: 110406 - DNA, 35 bp, Artificial Sequence
  Synthetic oligonucleotide
tacgatcaccctgtctgcttctctttctttgatca

SEQ ID NO: 110407 - DNA, 35 bp, Artificial Sequence
  Synthetic oligonucleotide
gtcagccccggccctgaccgtaagtaccccctcgc

SEQ ID NO: 110408 - DNA, 35 bp, Artificial Sequence
  Synthetic oligonucleotide
gatccgccccgcagttctttggctccctttctgtt

SEQ ID NO: 110409 - DNA, 35 bp, Artificial Sequence
  Synthetic oligonucleotide
acccgcccctccgttacggtgcctttcttgccttg

SEQ ID NO: 110410 - DNA, 35 bp, Artificial Sequence
  Synthetic oligonucleotide
gccacctttgccgtttctcccagccaccgcgttga

SEQ ID NO: 110411 - DNA, 35 bp, Artificial Sequence
  Synthetic oligonucleotide
gtgctcgccgcggtagcgataccttcttgatcctc

SEQ ID NO: 110412 - DNA, 35 bp, Artificial Sequence
  Synthetic oligonucleotide
tagatgtcgccacccgtccctcgcaaggctactcc

SEQ ID NO: 110413 - DNA, 35 bp, Artificial Sequence
  Synthetic oligonucleotide
accccacatcgcgtctgtcacccccgccgttcacg

SEQ ID NO: 110414 - DNA, 38 bp, Artificial Sequence
  Synthetic oligonucleotide
ggaaccagccctccccttcgctccgtcccgtgccttga

SEQ ID NO: 110415 - DNA, 36 bp, Artificial Sequence
  Synthetic oligonucleotide
tgaagccccgaacgctagcgcctccactcctgctga

SEQ ID NO: 110416 - DNA, 35 bp, Artificial Sequence
  Synthetic oligonucleotide
acacagtcacgatagtgccccgtgtaccatctact

SEQ ID NO: 110417 - DNA, 37 bp, Artificial Sequence
  Synthetic oligonucleotide
agcaccgcctgaactttactatctcctccgcctccga

SEQ ID NO: 110418 - DNA, 36 bp, Artificial Sequence
  Synthetic oligonucleotide
attccacaccgctacttgcctccacgccgcccggga

SEQ ID NO: 110419 - DNA, 35 bp, Artificial Sequence
  Synthetic oligonucleotide
tgtgccaccgcatctccccgctggagtttcacacc

SEQ ID NO: 110420 - DNA, 37 bp, Artificial Sequence
  Synthetic oligonucleotide
tgagtaccatccgaccggcattctgcaccagccccga

SEQ ID NO: 110421 - DNA, 33 bp, Artificial Sequence
  Synthetic oligonucleotide
tccgaactgatccgccctgttctctcatcttga

SEQ ID NO: 110422 - DNA, 35 bp, Artificial Sequence
  Synthetic oligonucleotide
gtgtcacgttcgtgatccgcttaatcgcccgctcc

SEQ ID NO: 110423 - DNA, 35 bp, Artificial Sequence
  Synthetic oligonucleotide
ttcgctcaactgttccgttttgcccttcgccgttc

SEQ ID NO: 110424 - DNA, 36 bp, Artificial Sequence
  Synthetic oligonucleotide
tcacacgtaccgcctatatcccgagtgcctgcccca

SEQ ID NO: 110425 - DNA, 35 bp, Artificial Sequence
  Synthetic oligonucleotide
gcaccatacatctgacgctgctcctttttcttgtc

SEQ ID NO: 110426 - DNA, 35 bp, Artificial Sequence
  Synthetic oligonucleotide
gggaacgccgtctagacctgtcttttctccctcct

SEQ ID NO: 110427 - DNA, 36 bp, Artificial Sequence
  Synthetic oligonucleotide
acgatgcccccccgtatgctctcgctccccgaacga

SEQ ID NO: 110428 - DNA, 36 bp, Artificial Sequence
  Synthetic oligonucleotide
gcaacaccactgcgatacgccccgctacctccctga

SEQ ID NO: 110429 - DNA, 35 bp, Artificial Sequence
  Synthetic oligonucleotide
gtccgcagatgtcgttcctggtcttctctgcgttt

SEQ ID NO: 110430 - DNA, 35 bp, Artificial Sequence
  Synthetic oligonucleotide
gatcctgctcacaatgtcctgtttgtcaccctcgt

SEQ ID NO: 110431 - DNA, 35 bp, Artificial Sequence
  Synthetic oligonucleotide
tgaacgaccatggccgcaccgttacgcccccattc

SEQ ID NO: 110432 - DNA, 35 bp, Artificial Sequence
  Synthetic oligonucleotide
tcgatcctacccccgcatggtacttgttaaccact

SEQ ID NO: 110433 - DNA, 35 bp, Artificial Sequence
  Synthetic oligonucleotide
gatatcatccggcgcgattgttcctcttctccgtt

SEQ ID NO: 110434 - DNA, 35 bp, Artificial Sequence
  Synthetic oligonucleotide
actgcatccacaggccttccaccgcaccacctgtt

SEQ ID NO: 110435 - DNA, 35 bp, Artificial Sequence
  Synthetic oligonucleotide
gctcagtatcgccgatcgtcaccttcgccactcca

SEQ ID NO: 110436 - DNA, 36 bp, Artificial Sequence
  Synthetic oligonucleotide
gtggtcccagctggcccctatacgctccatccttca

SEQ ID NO: 110437 - DNA, 35 bp, Artificial Sequence
  Synthetic oligonucleotide
gaacgcaccttgcgctagttttccatccctccgtc

SEQ ID NO: 110438 - DNA, 36 bp, Artificial Sequence
  Synthetic oligonucleotide
gggtgaggggagggaaagacggaaacaaagcggaca

SEQ ID NO: 110439 - DNA, 33 bp, Artificial Sequence
  Synthetic oligonucleotide
agcgcctcaggccgcggtcttccatcatcttct

SEQ ID NO: 110440 - DNA, 36 bp, Artificial Sequence
  Synthetic oligonucleotide
gcccacctgccccgcttataatagcctgtccgccaa

SEQ ID NO: 110441 - DNA, 38 bp, Artificial Sequence
  Synthetic oligonucleotide
gcccaactcccagcctttattgttcgttgcctctgtga

SEQ ID NO: 110442 - DNA, 35 bp, Artificial Sequence
  Synthetic oligonucleotide
ttgccagccacctttcttcgttgcgccagtccgcc

SEQ ID NO: 110443 - DNA, 36 bp, Artificial Sequence
  Synthetic oligonucleotide
gtggaggtcaggtggaacggtgtcgggggtggggga

SEQ ID NO: 110444 - DNA, 35 bp, Artificial Sequence
  Synthetic oligonucleotide
tcaactatcgcacctggtctgcattcctgccattc

SEQ ID NO: 110445 - DNA, 35 bp, Artificial Sequence
  Synthetic oligonucleotide
gccagagggtgggaggggtgggaggactcctagca

SEQ ID NO: 110446 - DNA, 35 bp, Artificial Sequence
  Synthetic oligonucleotide
gcgccaccccggttctgtcgtcgtccacccgcccc

SEQ ID NO: 110447 - DNA, 35 bp, Artificial Sequence
  Synthetic oligonucleotide
ttggaacacccgccacgaacaccaagggcacccct

SEQ ID NO: 110448 - DNA, 36 bp, Artificial Sequence
  Synthetic oligonucleotide
tcaaccgcgcgcctacacctgcttcgttgaccctta

SEQ ID NO: 110449 - DNA, 35 bp, Artificial Sequence
  Synthetic oligonucleotide
gcaccgatcgcctctgaatgccagccaccttcgac

SEQ ID NO: 110450 - DNA, 35 bp, Artificial Sequence
  Synthetic oligonucleotide
gacaaagtcccatatgcccagtgccccaatccctg

SEQ ID NO: 110451 - DNA, 35 bp, Artificial Sequence
  Synthetic oligonucleotide
gttgactccgctccctgttttcgttcctttccgct

SEQ ID NO: 110452 - DNA, 37 bp, Artificial Sequence
  Synthetic oligonucleotide
ttcgtcgccccccgtgttgtcctatttcctctaccga

SEQ ID NO: 110453 - DNA, 35 bp, Artificial Sequence
  Synthetic oligonucleotide
tagtcatacgtacgctgtccctccgccgcatctac

SEQ ID NO: 110454 - DNA, 35 bp, Artificial Sequence
  Synthetic oligonucleotide
accccaccccccattatgacaatcagtgtatcacc

SEQ ID NO: 110455 - DNA, 35 bp, Artificial Sequence
  Synthetic oligonucleotide
aactcgtccgccctatctatgcccgacccacctag

SEQ ID NO: 110456 - DNA, 36 bp, Artificial Sequence
  Synthetic oligonucleotide
gaaggtggggtggtgggggggcagggatgaccaata

SEQ ID NO: 110457 - DNA, 37 bp, Artificial Sequence
  Synthetic oligonucleotide
gtggaccagtaggggggtacgggacggggaagtgcga

SEQ ID NO: 110458 - DNA, 36 bp, Artificial Sequence
  Synthetic oligonucleotide
aacagatgcctcgttgttgctaacctctctctctga

SEQ ID NO: 110459 - DNA, 37 bp, Artificial Sequence
  Synthetic oligonucleotide
gatacacagtggggtggaacgtggaggggaaagggga

SEQ ID NO: 110460 - DNA, 35 bp, Artificial Sequence
  Synthetic oligonucleotide
ggatgagcctctgtccggcgttatacctccccctc

SEQ ID NO: 110461 - DNA, 35 bp, Artificial Sequence
  Synthetic oligonucleotide
tctcgcctcactatgcccggcccctttgctgcctg

SEQ ID NO: 110462 - DNA, 35 bp, Artificial Sequence
  Synthetic oligonucleotide
taactgctgccaggctctgctccccctccagcccc

SEQ ID NO: 110463 - DNA, 35 bp, Artificial Sequence
  Synthetic oligonucleotide
acttgaactcccctgatcgtgcttactgttgcctc

SEQ ID NO: 110464 - DNA, 35 bp, Artificial Sequence
  Synthetic oligonucleotide
acccgcctatctgcctgactcgtactcctaatcct

SEQ ID NO: 110465 - DNA, 28 bp, Artificial Sequence
  Synthetic oligonucleotide
gacgcacgccccgggcctccatttccac

SEQ ID NO: 110466 - DNA, 38 bp, Artificial Sequence
  Synthetic oligonucleotide
gagaaacacggacgggtggacggggcaaaggaggaaga

SEQ ID NO: 110467 - DNA, 35 bp, Artificial Sequence
  Synthetic oligonucleotide
gcaccgccccccctgccgtgaatttagctaccgcg

SEQ ID NO: 110468 - DNA, 35 bp, Artificial Sequence
  Synthetic oligonucleotide
actgacaaccgttcgctccccccgctgattacgtt

SEQ ID NO: 110469 - DNA, 36 bp, Artificial Sequence
  Synthetic oligonucleotide
ttccccccgcccgctcgaacgctcccccgtacgtta

SEQ ID NO: 110470 - DNA, 37 bp, Artificial Sequence
  Synthetic oligonucleotide
acaccatcaccaagttgaattttgcccccccctgtga

SEQ ID NO: 110471 - DNA, 35 bp, Artificial Sequence
  Synthetic oligonucleotide
gatgcccccaatgttgggctaactgccatccccca

SEQ ID NO: 110472 - DNA, 36 bp, Artificial Sequence
  Synthetic oligonucleotide
tttgcccacctcgattctgcttcctgcgtgcatgca

SEQ ID NO: 110473 - DNA, 35 bp, Artificial Sequence
  Synthetic oligonucleotide
accgcagtgcactgtacctgtcctgcgctacaacc

SEQ ID NO: 110474 - DNA, 35 bp, Artificial Sequence
  Synthetic oligonucleotide
gcctgatgcgcgagcatcggatccctcctgtcccc

SEQ ID NO: 110475 - DNA, 35 bp, Artificial Sequence
  Synthetic oligonucleotide
acgaaccgtctgtgacccatgcgcccctgtaccct

SEQ ID NO: 110476 - DNA, 36 bp, Artificial Sequence
  Synthetic oligonucleotide
acctatacgcacatgtcccctttcgcatccatccga

SEQ ID NO: 110477 - DNA, 36 bp, Artificial Sequence
  Synthetic oligonucleotide
gtcacgcttatcccaccacgtccccttctgctggca

SEQ ID NO: 110478 - DNA, 38 bp, Artificial Sequence
  Synthetic oligonucleotide
tccgcgctatcggttacgctccatgcactctctcttga

SEQ ID NO: 110479 - DNA, 35 bp, Artificial Sequence
  Synthetic oligonucleotide
tccactcctgggcccttcgatagcataacctccgc

SEQ ID NO: 110480 - DNA, 35 bp, Artificial Sequence
  Synthetic oligonucleotide
tacaggccaagccttcctctcaacaccacctcgcg

SEQ ID NO: 110481 - DNA, 37 bp, Artificial Sequence
  Synthetic oligonucleotide
ggaccgggaaggtgggaaggatggaacggagtataga

SEQ ID NO: 110482 - DNA, 35 bp, Artificial Sequence
  Synthetic oligonucleotide
tatcccagtccactcctgccccatgttcgtgcctt

SEQ ID NO: 110483 - DNA, 35 bp, Artificial Sequence
  Synthetic oligonucleotide
gacgtcccccctgccgctactaaccagtgttctcg

SEQ ID NO: 110484 - DNA, 36 bp, Artificial Sequence
  Synthetic oligonucleotide
ggggggagaaggaatgagcacgggggaggacgtcaa

SEQ ID NO: 110485 - DNA, 37 bp, Artificial Sequence
  Synthetic oligonucleotide
gacacagggagggaaagggatagattagaggagggga

SEQ ID NO: 110486 - DNA, 35 bp, Artificial Sequence
  Synthetic oligonucleotide
gcttggcaggggaaaagggaacgggggggaaagta

SEQ ID NO: 110487 - DNA, 35 bp, Artificial Sequence
  Synthetic oligonucleotide
gccgttctatctgcagccccctgtccacttgctac

SEQ ID NO: 110488 - DNA, 38 bp, Artificial Sequence
  Synthetic oligonucleotide
agtcgccctggctgtttctgtccgtccaccgcccttga

SEQ ID NO: 110489 - DNA, 36 bp, Artificial Sequence
  Synthetic oligonucleotide
tgcaccgccttgcacaccctatgacccctccgcgca

SEQ ID NO: 110490 - DNA, 35 bp, Artificial Sequence
  Synthetic oligonucleotide
aagcactgtcacgtacagctaccaccatcacctcc

SEQ ID NO: 110491 - DNA, 35 bp, Artificial Sequence
  Synthetic oligonucleotide
acgcgaccgcagcaatttgcgtgcaccccctccct

SEQ ID NO: 110492 - DNA, 35 bp, Artificial Sequence
  Synthetic oligonucleotide
tcgaccccgccatatcgacctttacgtaactgtcc

SEQ ID NO: 110493 - DNA, 35 bp, Artificial Sequence
  Synthetic oligonucleotide
gtctgaccaatgcgctactggcaccgctttcacct

SEQ ID NO: 110494 - DNA, 35 bp, Artificial Sequence
  Synthetic oligonucleotide
tgtcccggcccaactttctacgcctccctttccgg

SEQ ID NO: 110495 - DNA, 35 bp, Artificial Sequence
  Synthetic oligonucleotide
gcactcccctctgtctcttaggaccgtgcctcgac

SEQ ID NO: 110496 - DNA, 35 bp, Artificial Sequence
  Synthetic oligonucleotide
agtgacaccgccgcccgaacgttcgtccactcatc

SEQ ID NO: 110497 - DNA, 35 bp, Artificial Sequence
  Synthetic oligonucleotide
acacccgctcgaggctccatgctccttagttactc

SEQ ID NO: 110498 - DNA, 37 bp, Artificial Sequence
  Synthetic oligonucleotide
ttggactggtggtggtggggattttcggcggacggga

SEQ ID NO: 110499 - DNA, 35 bp, Artificial Sequence
  Synthetic oligonucleotide
gtcgctactgcctcgctcccttgtgtttcgtcccc

SEQ ID NO: 110500 - DNA, 35 bp, Artificial Sequence
  Synthetic oligonucleotide
tccgtctccgcccataacctgtatattatcgctcc

SEQ ID NO: 110501 - DNA, 37 bp, Artificial Sequence
  Synthetic oligonucleotide
gtgtgggcggggtgggggaggagagggccaacaacga

SEQ ID NO: 110502 - DNA, 35 bp, Artificial Sequence
  Synthetic oligonucleotide
tccacctatctgttatggttataccactccacgcc

SEQ ID NO: 110503 - DNA, 37 bp, Artificial Sequence
  Synthetic oligonucleotide
tcccgctgccccctccctatgcgatatctaccagcaa

SEQ ID NO: 110504 - DNA, 35 bp, Artificial Sequence
  Synthetic oligonucleotide
actgacaggcgcccctcctcccgttttcgctcatc

SEQ ID NO: 110505 - DNA, 35 bp, Artificial Sequence
  Synthetic oligonucleotide
tccgttccgccattcgtctttgcgcagcacctgtc

SEQ ID NO: 110506 - DNA, 35 bp, Artificial Sequence
  Synthetic oligonucleotide
atctgctccctcgccgttccacacgacttcgtcgt

SEQ ID NO: 110507 - DNA, 37 bp, Artificial Sequence
  Synthetic oligonucleotide
ggagtgggtaagggtagggaagggcggtgacttgaga

SEQ ID NO: 110508 - DNA, 35 bp, Artificial Sequence
  Synthetic oligonucleotide
taaccgccttagcccgcctccccttcagtgcgcta

SEQ ID NO: 110509 - DNA, 35 bp, Artificial Sequence
  Synthetic oligonucleotide
tttgccgcccctttgtcccgttctatacattatgc

SEQ ID NO: 110510 - DNA, 35 bp, Artificial Sequence
  Synthetic oligonucleotide
ttggagccactgctatttcacctcccgccatcccg

SEQ ID NO: 110511 - DNA, 35 bp, Artificial Sequence
  Synthetic oligonucleotide
gctgctggagctcatactcctatatgcccctgtcc

SEQ ID NO: 110512 - DNA, 35 bp, Artificial Sequence
  Synthetic oligonucleotide
gctgagtgaaggccgggggagggagggaggtgcca

SEQ ID NO: 110513 - DNA, 35 bp, Artificial Sequence
  Synthetic oligonucleotide
aatggtgggaaggggtggggagggagacaccatgc

SEQ ID NO: 110514 - DNA, 35 bp, Artificial Sequence
  Synthetic oligonucleotide
gccaccgccacccatcaagtagttcgcattcattc

SEQ ID NO: 110515 - DNA, 35 bp, Artificial Sequence
  Synthetic oligonucleotide
gttgtgacgggagtattataggggagggtggaaag

SEQ ID NO: 110516 - DNA, 35 bp, Artificial Sequence
  Synthetic oligonucleotide
accccgcgttaacgcttcccgcatttccgtactgc

SEQ ID NO: 110517 - DNA, 35 bp, Artificial Sequence
  Synthetic oligonucleotide
aagttcgggggggagggtgcaaggagggaggggtt

SEQ ID NO: 110518 - DNA, 35 bp, Artificial Sequence
  Synthetic oligonucleotide
atcacctccctacactgtgtaatatccgtcctgtt

SEQ ID NO: 110519 - DNA, 35 bp, Artificial Sequence
  Synthetic oligonucleotide
tcctacgtccatccgaccctcccttcttccaggca

SEQ ID NO: 110520 - DNA, 35 bp, Artificial Sequence
  Synthetic oligonucleotide
gtgccagcctcccttgggtcccgtacgcttgccac

SEQ ID NO: 110521 - DNA, 35 bp, Artificial Sequence
  Synthetic oligonucleotide
gcacgtttgcccagtgccccccttcaccgtccagc

SEQ ID NO: 110522 - DNA, 35 bp, Artificial Sequence
  Synthetic oligonucleotide
gaacacaatcaatgcgctttgctctacctggcctc

SEQ ID NO: 110523 - DNA, 38 bp, Artificial Sequence
  Synthetic oligonucleotide
tcccacccggagagtttgtgcgctcgccctcctattga

SEQ ID NO: 110524 - DNA, 36 bp, Artificial Sequence
  Synthetic oligonucleotide
tcccggtagcctgcgtcgtcctctgttcctcccgta

SEQ ID NO: 110525 - DNA, 35 bp, Artificial Sequence
  Synthetic oligonucleotide
gtccccactcgcgtatgcatccctaccacctgttt

SEQ ID NO: 110526 - DNA, 38 bp, Artificial Sequence
  Synthetic oligonucleotide
ttctgccaccgccgcggttcctcgcccccactctatga

SEQ ID NO: 110527 - DNA, 35 bp, Artificial Sequence
  Synthetic oligonucleotide
gctgtcagatcctcgtgccgccaccccgcaccccc

SEQ ID NO: 110528 - DNA, 38 bp, Artificial Sequence
  Synthetic oligonucleotide
gattcactcgccctccctgccgcactccactttagtga

SEQ ID NO: 110529 - DNA, 35 bp, Artificial Sequence
  Synthetic oligonucleotide
gtccacatccccttccgtgctcgagtctcaccttc

SEQ ID NO: 110530 - DNA, 36 bp, Artificial Sequence
  Synthetic oligonucleotide
acccactgactccctgctgtttttctacactctcca

SEQ ID NO: 110531 - DNA, 35 bp, Artificial Sequence
  Synthetic oligonucleotide
gcacgccccccgatagtctctaattgcttgccgtt

SEQ ID NO: 110532 - DNA, 36 bp, Artificial Sequence
  Synthetic oligonucleotide
gacagcccactgtgctactcccgttgatgcccccca

SEQ ID NO: 110533 - DNA, 38 bp, Artificial Sequence
  Synthetic oligonucleotide
gccgccgcccctatcatttcgagcactcccatgcctga

SEQ ID NO: 110534 - DNA, 35 bp, Artificial Sequence
  Synthetic oligonucleotide
gccaagcgtttctcctgtccacgccgccttattgc

SEQ ID NO: 110535 - DNA, 38 bp, Artificial Sequence
  Synthetic oligonucleotide
atgctaccgccatcttcgtttacgctcctgcaccttga

SEQ ID NO: 110536 - DNA, 36 bp, Artificial Sequence
  Synthetic oligonucleotide
tacgctccctgtccacgccatccgacccgaggtcca

SEQ ID NO: 110537 - DNA, 36 bp, Artificial Sequence
  Synthetic oligonucleotide
tccttgcatgcatctgcccacgtccactcgcctgta

SEQ ID NO: 110538 - DNA, 35 bp, Artificial Sequence
  Synthetic oligonucleotide
gaatcgggtgaagggggcacataggggaggtagag

SEQ ID NO: 110539 - DNA, 34 bp, Artificial Sequence
  Synthetic oligonucleotide
gtcagtatgtacccgctccgtcttccgttgtcac

SEQ ID NO: 110540 - DNA, 37 bp, Artificial Sequence
  Synthetic oligonucleotide
tttccgggcggggttgtttggggtgtcgctctgggga

SEQ ID NO: 110541 - DNA, 36 bp, Artificial Sequence
  Synthetic oligonucleotide
gcgagtgatcaggaggacgggagaaggggtggtgga

SEQ ID NO: 110542 - DNA, 35 bp, Artificial Sequence
  Synthetic oligonucleotide
agtcgccacaccttgttcatcgctcatcccatacg

SEQ ID NO: 110543 - DNA, 34 bp, Artificial Sequence
  Synthetic oligonucleotide
tgttccctgcgcacttgcccttgtacattccctg

SEQ ID NO: 110544 - DNA, 35 bp, Artificial Sequence
  Synthetic oligonucleotide
tgcctgttccttccatgttgcgatcttccccctgg

SEQ ID NO: 110545 - DNA, 35 bp, Artificial Sequence
  Synthetic oligonucleotide
actcacggtccttgtctaccgcctcatacgcccat

SEQ ID NO: 110546 - DNA, 36 bp, Artificial Sequence
  Synthetic oligonucleotide
tcagtgcgcggattccatgtaccgttacccccccgc

SEQ ID NO: 110547 - DNA, 35 bp, Artificial Sequence
  Synthetic oligonucleotide
gcttgcccccccgtatcattggcctgtattttttc

SEQ ID NO: 110548 - DNA, 30 bp, Artificial Sequence
  Synthetic oligonucleotide
gcaaagcacggcgaggggggcgggtggaag

SEQ ID NO: 110549 - DNA, 37 bp, Artificial Sequence
  Synthetic oligonucleotide
atgaccgcccaattgccataccttccccatctgccga

SEQ ID NO: 110550 - DNA, 35 bp, Artificial Sequence
  Synthetic oligonucleotide
tgctccgtgctatggttgcagcccttctttccacc

SEQ ID NO: 110551 - DNA, 36 bp, Artificial Sequence
  Synthetic oligonucleotide
acccagcgccccatccaccctacctgccggccttga

SEQ ID NO: 110552 - DNA, 35 bp, Artificial Sequence
  Synthetic oligonucleotide
tacggggagaaaggaggcggactggggaggggggg

SEQ ID NO: 110553 - DNA, 36 bp, Artificial Sequence
  Synthetic oligonucleotide
tttgtccagccccagcctatcgtccatgtctcctca

SEQ ID NO: 110554 - DNA, 35 bp, Artificial Sequence
  Synthetic oligonucleotide
ttgccccctctcgcgtatgtacgccattgttacgc

SEQ ID NO: 110555 - DNA, 35 bp, Artificial Sequence
  Synthetic oligonucleotide
acgccaccctggcgctttcctgtatcattcttgtt

SEQ ID NO: 110556 - DNA, 37 bp, Artificial Sequence
  Synthetic oligonucleotide
atggggagggtggaggaacaacgggcaagattcgaga

SEQ ID NO: 110557 - DNA, 37 bp, Artificial Sequence
  Synthetic oligonucleotide
acaccccgccatgccctgtccccgacttcaatatcga

SEQ ID NO: 110558 - DNA, 36 bp, Artificial Sequence
  Synthetic oligonucleotide
tcaacgctccagccgcccgcccggtttttcgcccta

SEQ ID NO: 110559 - DNA, 35 bp, Artificial Sequence
  Synthetic oligonucleotide
tacaccatctccacgcctgtagctaggccatttac

SEQ ID NO: 110560 - DNA, 35 bp, Artificial Sequence
  Synthetic oligonucleotide
gctaacgtgagcgctgttcttgtcgcccgcctctc

SEQ ID NO: 110561 - DNA, 35 bp, Artificial Sequence
  Synthetic oligonucleotide
gatagggtccgtcctaaagccgctcacccccgttc

SEQ ID NO: 110562 - DNA, 35 bp, Artificial Sequence
  Synthetic oligonucleotide
gcaagacgacggggagggcgtcacggagggaaggg

SEQ ID NO: 110563 - DNA, 37 bp, Artificial Sequence
  Synthetic oligonucleotide
tccaaagccggagtgggggaaaagggggagatcggga

SEQ ID NO: 110564 - DNA, 36 bp, Artificial Sequence
  Synthetic oligonucleotide
gccgacaagcatccgccgctgtttcttgctcgccta

SEQ ID NO: 110565 - DNA, 36 bp, Artificial Sequence
  Synthetic oligonucleotide
accgccccacttaccgtatggcccctagttgcacca

SEQ ID NO: 110566 - DNA, 38 bp, Artificial Sequence
  Synthetic oligonucleotide
accacccgctcctctgcgtaaggccttccgaaccctga

SEQ ID NO: 110567 - DNA, 35 bp, Artificial Sequence
  Synthetic oligonucleotide
acgtcaacctcacatgatcatacccgttcgctgcc

SEQ ID NO: 110568 - DNA, 35 bp, Artificial Sequence
  Synthetic oligonucleotide
tcaaggacgacaaaggaggtggggcgggtggaggc

SEQ ID NO: 110569 - DNA, 35 bp, Artificial Sequence
  Synthetic oligonucleotide
tctgcctccctgtgctttccactatctctcggtgc

SEQ ID NO: 110570 - DNA, 35 bp, Artificial Sequence
  Synthetic oligonucleotide
tcaagcggtccgccgactttcttttacgcctgttc

SEQ ID NO: 110571 - DNA, 35 bp, Artificial Sequence
  Synthetic oligonucleotide
tagcggtacctcacattcttatcgccctccccacg

SEQ ID NO: 110572 - DNA, 35 bp, Artificial Sequence
  Synthetic oligonucleotide
tctgtcacccgccctacctgacgcagaagctactc

SEQ ID NO: 110573 - DNA, 35 bp, Artificial Sequence
  Synthetic oligonucleotide
tggagcctctcactgttgcacctaccgccactccg

SEQ ID NO: 110574 - DNA, 35 bp, Artificial Sequence
  Synthetic oligonucleotide
tccccgttccgacatttagcattccccctgtgtcg

SEQ ID NO: 110575 - DNA, 36 bp, Artificial Sequence
  Synthetic oligonucleotide
acagcctccccgcgctccgcctccacatccgctgca

SEQ ID NO: 110576 - DNA, 35 bp, Artificial Sequence
  Synthetic oligonucleotide
tccgtacgccttcatccctcatccactcccggggt

SEQ ID NO: 110577 - DNA, 36 bp, Artificial Sequence
  Synthetic oligonucleotide
atcagcacagctctacgctcgccccatccacttcga

SEQ ID NO: 110578 - DNA, 35 bp, Artificial Sequence
  Synthetic oligonucleotide
gacgtcctcacgctgtcgcccccccatttgcatta

SEQ ID NO: 110579 - DNA, 36 bp, Artificial Sequence
  Synthetic oligonucleotide
cgtcagagcctcacctggtggtttcctctactgtta

SEQ ID NO: 110580 - DNA, 37 bp, Artificial Sequence
  Synthetic oligonucleotide
tgacatagcctcgcacgtgtctctccatcctctctga

SEQ ID NO: 110581 - DNA, 38 bp, Artificial Sequence
  Synthetic oligonucleotide
tttcaaccgcacaactgttctcgcctcgccttccttga

SEQ ID NO: 110582 - DNA, 35 bp, Artificial Sequence
  Synthetic oligonucleotide
agtaagggccggggggaggatatgggtggtggtcg

SEQ ID NO: 110583 - DNA, 35 bp, Artificial Sequence
  Synthetic oligonucleotide
taatgcatcccgccgctgtgcagaacctgcccttc

SEQ ID NO: 110584 - DNA, 36 bp, Artificial Sequence
  Synthetic oligonucleotide
tgagtgacgcagtacggaggagggaggacggggaca

SEQ ID NO: 110585 - DNA, 35 bp, Artificial Sequence
  Synthetic oligonucleotide
acctcccgcccctcatagtcgtaacttacccactg

SEQ ID NO: 110586 - DNA, 35 bp, Artificial Sequence
  Synthetic oligonucleotide
tactatgccccgccccaaggtccacatctctacct

SEQ ID NO: 110587 - DNA, 38 bp, Artificial Sequence
  Synthetic oligonucleotide
acccaccgacctcgctgacccaacccgctgtcccttga

SEQ ID NO: 110588 - DNA, 35 bp, Artificial Sequence
  Synthetic oligonucleotide
gacgtctcgcctctcctcgtccaccgcccatccgg

SEQ ID NO: 110589 - DNA, 35 bp, Artificial Sequence
  Synthetic oligonucleotide
gccctgcacccacgcactcattcgcgccccgctcg

SEQ ID NO: 110590 - DNA, 35 bp, Artificial Sequence
  Synthetic oligonucleotide
atgggggtagcggggaaagaagaagggaggtgcgg

SEQ ID NO: 110591 - DNA, 35 bp, Artificial Sequence
  Synthetic oligonucleotide
gaatcccccgcgtgtccccgttgcacctaccttgc

SEQ ID NO: 110592 - DNA, 36 bp, Artificial Sequence
  Synthetic oligonucleotide
acgcgaggggtaagcgggtgggaacggaacgggtaa

SEQ ID NO: 110593 - DNA, 36 bp, Artificial Sequence
  Synthetic oligonucleotide
gtccccctcctgacgtgcactgaaatccgcatccta

SEQ ID NO: 110594 - DNA, 35 bp, Artificial Sequence
  Synthetic oligonucleotide
gccgcccgctcccattgtatgactcacccttttcc

SEQ ID NO: 110595 - DNA, 35 bp, Artificial Sequence
  Synthetic oligonucleotide
gaccataccgccccacatgcaaatctgactctcat

SEQ ID NO: 110596 - DNA, 35 bp, Artificial Sequence
  Synthetic oligonucleotide
agcccctgcccctacgttcccaccacttgcgctat

SEQ ID NO: 110597 - DNA, 35 bp, Artificial Sequence
  Synthetic oligonucleotide
accaccatgccttactggactaagccgcctccttc

SEQ ID NO: 110598 - DNA, 35 bp, Artificial Sequence
  Synthetic oligonucleotide
tgatctggcccattcgttttacactcccctgctca

SEQ ID NO: 110599 - DNA, 37 bp, Artificial Sequence
  Synthetic oligonucleotide
tcctgcgccccgccgttgtaatccctgctccgaccga

SEQ ID NO: 110600 - DNA, 34 bp, Artificial Sequence
  Synthetic oligonucleotide
accactggtccatccgtgccctttgacttgctta

SEQ ID NO: 110601 - DNA, 35 bp, Artificial Sequence
  Synthetic oligonucleotide
gcccccccccaccatccactgggccattccacgcc

SEQ ID NO: 110602 - DNA, 35 bp, Artificial Sequence
  Synthetic oligonucleotide
tccccacccgttccgcgctagccatgtaatgccca

SEQ ID NO: 110603 - DNA, 33 bp, Artificial Sequence
  Synthetic oligonucleotide
tgggagtccgccccagtccctcgctattcctgc

SEQ ID NO: 110604 - DNA, 35 bp, Artificial Sequence
  Synthetic oligonucleotide
tgcaccttattgtttctcgcctggcttattttccg

SEQ ID NO: 110605 - DNA, 35 bp, Artificial Sequence
  Synthetic oligonucleotide
gtcgcgcgcgcgcatcctgccctccgtgcccttgt

SEQ ID NO: 110606 - DNA, 36 bp, Artificial Sequence
  Synthetic oligonucleotide
gcaccacaactggcacggagcacgccctccacctca

SEQ ID NO: 110607 - DNA, 35 bp, Artificial Sequence
  Synthetic oligonucleotide
tcccgcctcactcgcccctattactcccagtagga

SEQ ID NO: 110608 - DNA, 37 bp, Artificial Sequence
  Synthetic oligonucleotide
gccacccgccccaccaatggtattgccaccttaatga

SEQ ID NO: 110609 - DNA, 35 bp, Artificial Sequence
  Synthetic oligonucleotide
aactgcccctcctgaactcgtcgttggcttaacca

SEQ ID NO: 110610 - DNA, 38 bp, Artificial Sequence
  Synthetic oligonucleotide
tcagcacgggcgggaatggggggggcgtagacgtatga

SEQ ID NO: 110611 - DNA, 35 bp, Artificial Sequence
  Synthetic oligonucleotide
gaccctgccatatgccgctcgctctttacgctccc

SEQ ID NO: 110612 - DNA, 35 bp, Artificial Sequence
  Synthetic oligonucleotide
tcacgcgctccaccttctccgccgatccaatgggt

SEQ ID NO: 110613 - DNA, 36 bp, Artificial Sequence
  Synthetic oligonucleotide
tgctcgttgccgcccgtgccttcccaattctcgcca

SEQ ID NO: 110614 - DNA, 36 bp, Artificial Sequence
  Synthetic oligonucleotide
tccgccgaagcagttgtcccgcccttacgccccgca

SEQ ID NO: 110615 - DNA, 38 bp, Artificial Sequence
  Synthetic oligonucleotide
acgcaccatcaccatgtccctatctcacctactcctga

SEQ ID NO: 110616 - DNA, 35 bp, Artificial Sequence
  Synthetic oligonucleotide
gccccaccttccgccctctcctgatctatacgacc

SEQ ID NO: 110617 - DNA, 35 bp, Artificial Sequence
  Synthetic oligonucleotide
aatacgccctattggtaccaacacaccctgccccc

SEQ ID NO: 110618 - DNA, 37 bp, Artificial Sequence
  Synthetic oligonucleotide
acaccgccatcctgttgccaactcccgtaccccccga

SEQ ID NO: 110619 - DNA, 35 bp, Artificial Sequence
  Synthetic oligonucleotide
tgcccaatccctctgttgagttgacccatccagcc

SEQ ID NO: 110620 - DNA, 35 bp, Artificial Sequence
  Synthetic oligonucleotide
agccactcacttgagtttctccgattgccgccgcc

SEQ ID NO: 110621 - DNA, 35 bp, Artificial Sequence
  Synthetic oligonucleotide
gaacaggcagagtgtttcgttgcgtctcccttctc

SEQ ID NO: 110622 - DNA, 35 bp, Artificial Sequence
  Synthetic oligonucleotide
aacgctaccacatctgtatttctccccatttccat

SEQ ID NO: 110623 - DNA, 35 bp, Artificial Sequence
  Synthetic oligonucleotide
tgagaaacgggagggggggtgaggcatgccgtgct

SEQ ID NO: 110624 - DNA, 35 bp, Artificial Sequence
  Synthetic oligonucleotide
gccactgctacatctcgtgtgggccccttcccttt

SEQ ID NO: 110625 - DNA, 36 bp, Artificial Sequence
  Synthetic oligonucleotide
ttcagcacccctttggacttttgcgactccctccca

SEQ ID NO: 110626 - DNA, 38 bp, Artificial Sequence
  Synthetic oligonucleotide
acgacctggccgcccttgggccatacgaccctccttga

SEQ ID NO: 110627 - DNA, 35 bp, Artificial Sequence
  Synthetic oligonucleotide
tattccaccccagcggttcgctccatcccgtacac

SEQ ID NO: 110628 - DNA, 35 bp, Artificial Sequence
  Synthetic oligonucleotide
gatgaggagaggggaaggggaaaagagtcatggtt

SEQ ID NO: 110629 - DNA, 35 bp, Artificial Sequence
  Synthetic oligonucleotide
tccacgcgcgcatcctatcgaccaccggcgttccc

SEQ ID NO: 110630 - DNA, 35 bp, Artificial Sequence
  Synthetic oligonucleotide
tacgcgcgccggttcccactccgccttcacacgtc

SEQ ID NO: 110631 - DNA, 35 bp, Artificial Sequence
  Synthetic oligonucleotide
catgggagggagggagggggtaccgactgattctt

SEQ ID NO: 110632 - DNA, 36 bp, Artificial Sequence
  Synthetic oligonucleotide
aaccgaacctcccctcctggcgtcagtgctctctca

SEQ ID NO: 110633 - DNA, 36 bp, Artificial Sequence
  Synthetic oligonucleotide
gctcgctgcctgtcccccgttgtacctcacctctga

SEQ ID NO: 110634 - DNA, 37 bp, Artificial Sequence
  Synthetic oligonucleotide
aaccgggtggacggggggaggtgaggggaatcggtga

SEQ ID NO: 110635 - DNA, 35 bp, Artificial Sequence
  Synthetic oligonucleotide
tctgttacgccccagctctgtagcccacttcttgc

SEQ ID NO: 110636 - DNA, 35 bp, Artificial Sequence
  Synthetic oligonucleotide
atgcacgtagccctcgcatcacctcctccacggat

SEQ ID NO: 110637 - DNA, 31 bp, Artificial Sequence
  Synthetic oligonucleotide
gtacccacgaaacgactgccccttcctacac

SEQ ID NO: 110638 - DNA, 35 bp, Artificial Sequence
  Synthetic oligonucleotide
aagaggggcggtagctgtacgggggtatagagggt

SEQ ID NO: 110639 - DNA, 35 bp, Artificial Sequence
  Synthetic oligonucleotide
ttcaacacctctgtcgtactatactcgcttggccc

SEQ ID NO: 110640 - DNA, 35 bp, Artificial Sequence
  Synthetic oligonucleotide
gcctgttcaagttccctgtccacccgtttataccg

SEQ ID NO: 110641 - DNA, 37 bp, Artificial Sequence
  Synthetic oligonucleotide
tcatcaccgccttttttcgtattcgatccttccgcga

SEQ ID NO: 110642 - DNA, 37 bp, Artificial Sequence
  Synthetic oligonucleotide
gttgccggcacactgccctccgtgcctttctcttgga

SEQ ID NO: 110643 - DNA, 35 bp, Artificial Sequence
  Synthetic oligonucleotide
tgacatgtaatgtcacgccctctgttaccgtgccc

SEQ ID NO: 110644 - DNA, 36 bp, Artificial Sequence
  Synthetic oligonucleotide
tgacaagtccgtaagctgcccccagccgatccccca

SEQ ID NO: 110645 - DNA, 35 bp, Artificial Sequence
  Synthetic oligonucleotide
actccaacccaccgaagtcgtcttttcacacgtcc

SEQ ID NO: 110646 - DNA, 35 bp, Artificial Sequence
  Synthetic oligonucleotide
ttcagcccaccagcttacttctccacctctgccgt

SEQ ID NO: 110647 - DNA, 35 bp, Artificial Sequence
  Synthetic oligonucleotide
accgtacgcccctgcattcactgaagacctctgac

SEQ ID NO: 110648 - DNA, 35 bp, Artificial Sequence
  Synthetic oligonucleotide
acgattagtcggcccccccttgtctacgttccccc

SEQ ID NO: 110649 - DNA, 35 bp, Artificial Sequence
  Synthetic oligonucleotide
tacagccactgacctctggctattattgctttctc

SEQ ID NO: 110650 - DNA, 36 bp, Artificial Sequence
  Synthetic oligonucleotide
ggtgtgtgcgtagcggggagggagcgggggggttca

SEQ ID NO: 110651 - DNA, 36 bp, Artificial Sequence
  Synthetic oligonucleotide
tcctcccgtgcactgattcgttccgctaccccttga

SEQ ID NO: 110652 - DNA, 35 bp, Artificial Sequence
  Synthetic oligonucleotide
tgtgtcccgctgcaccgcttcctcatgcccactcc

SEQ ID NO: 110653 - DNA, 35 bp, Artificial Sequence
  Synthetic oligonucleotide
gcctcacactcattggtctgtgccagccccacccc

SEQ ID NO: 110654 - DNA, 37 bp, Artificial Sequence
  Synthetic oligonucleotide
ttggtagggccagggaaggggaagtggggtgtgggga

SEQ ID NO: 110655 - DNA, 35 bp, Artificial Sequence
  Synthetic oligonucleotide
ttgtcacacccgtaccccccgtccaatctctttga

SEQ ID NO: 110656 - DNA, 35 bp, Artificial Sequence
  Synthetic oligonucleotide
tgcacaatcgtccacaccgcctactgcccgccgta

SEQ ID NO: 110657 - DNA, 36 bp, Artificial Sequence
  Synthetic oligonucleotide
agtagacgtgacggagggggggcgggatcacgggta

SEQ ID NO: 110658 - DNA, 35 bp, Artificial Sequence
  Synthetic oligonucleotide
tccccacgaacctccgttattgcatccgcactcgc

SEQ ID NO: 110659 - DNA, 36 bp, Artificial Sequence
  Synthetic oligonucleotide
tgacctcccgcactgacatgttcctcatcacctcga

SEQ ID NO: 110660 - DNA, 35 bp, Artificial Sequence
  Synthetic oligonucleotide
tcgaccgttaatcgtctgaccaccacgcctgcccc

SEQ ID NO: 110661 - DNA, 35 bp, Artificial Sequence
  Synthetic oligonucleotide
gtgcacgccccgcatgcttcttgttttcctctacg

SEQ ID NO: 110662 - DNA, 35 bp, Artificial Sequence
  Synthetic oligonucleotide
tctaccacccggctggatagttacccctttcatcg

SEQ ID NO: 110663 - DNA, 36 bp, Artificial Sequence
  Synthetic oligonucleotide
ggacggaaggggggaagggtaagtggcaccgtaaca

SEQ ID NO: 110664 - DNA, 35 bp, Artificial Sequence
  Synthetic oligonucleotide
tcacctgctcctttgcgattggtaccctctctgtc

SEQ ID NO: 110665 - DNA, 33 bp, Artificial Sequence
  Synthetic oligonucleotide
agcaagcccgcattaagcgcccctctctcgtac

SEQ ID NO: 110666 - DNA, 35 bp, Artificial Sequence
  Synthetic oligonucleotide
tcgggaacgacgctgcctatacttggtccctccgc

SEQ ID NO: 110667 - DNA, 35 bp, Artificial Sequence
  Synthetic oligonucleotide
gcgaatgggggggcgggggaggaacgcgggtacgt

SEQ ID NO: 110668 - DNA, 36 bp, Artificial Sequence
  Synthetic oligonucleotide
tccgtgcacctgacacttccttcccgcgacccttca

SEQ ID NO: 110669 - DNA, 35 bp, Artificial Sequence
  Synthetic oligonucleotide
accacgctccctgctttcgagtcggcttcttttac

SEQ ID NO: 110670 - DNA, 35 bp, Artificial Sequence
  Synthetic oligonucleotide
tacgccctctggacgccccttacgaccgtgcaacc

SEQ ID NO: 110671 - DNA, 35 bp, Artificial Sequence
  Synthetic oligonucleotide
ggggtagtgggcggggggggtaaataggaaacaca

SEQ ID NO: 110672 - DNA, 35 bp, Artificial Sequence
  Synthetic oligonucleotide
ttgcgccgatagcccatttgttctagttccctccg

SEQ ID NO: 110673 - DNA, 36 bp, Artificial Sequence
  Synthetic oligonucleotide
acaccaccacatctgtaggccttccccgactttaca

SEQ ID NO: 110674 - DNA, 38 bp, Artificial Sequence
  Synthetic oligonucleotide
gagacagttggcgggatggtggggaggactggaaatga

SEQ ID NO: 110675 - DNA, 35 bp, Artificial Sequence
  Synthetic oligonucleotide
taaccaccctttcccgctgccactgcccctagtcc

SEQ ID NO: 110676 - DNA, 37 bp, Artificial Sequence
  Synthetic oligonucleotide
tccaccgttcgctgtttttacggccccccccttgcga

SEQ ID NO: 110677 - DNA, 35 bp, Artificial Sequence
  Synthetic oligonucleotide
atgcctgacccgtgacgtctgtactcccccgccta

SEQ ID NO: 110678 - DNA, 35 bp, Artificial Sequence
  Synthetic oligonucleotide
gtccccactcgctatttgactagtcgttccccccc

SEQ ID NO: 110679 - DNA, 35 bp, Artificial Sequence
  Synthetic oligonucleotide
ttccgctgtcccccgttcgtgctctcattaccatg

SEQ ID NO: 110680 - DNA, 35 bp, Artificial Sequence
  Synthetic oligonucleotide
gagccccagctgttgcctctgctcgccggttccct

SEQ ID NO: 110681 - DNA, 37 bp, Artificial Sequence
  Synthetic oligonucleotide
tcagcacccccaggtcttattcgcccatccaactcga

SEQ ID NO: 110682 - DNA, 35 bp, Artificial Sequence
  Synthetic oligonucleotide
gctgagcactgttgatcgacccgcccccatgttcc

SEQ ID NO: 110683 - DNA, 35 bp, Artificial Sequence
  Synthetic oligonucleotide
tgtcacaccgcactcgcaatgccatctttagccgc

SEQ ID NO: 110684 - DNA, 35 bp, Artificial Sequence
  Synthetic oligonucleotide
accccccacactcagccctgtcttcccggttatta

SEQ ID NO: 110685 - DNA, 35 bp, Artificial Sequence
  Synthetic oligonucleotide
tccctcgcctcgaacaccttggcccatcccctggc

SEQ ID NO: 110686 - DNA, 35 bp, Artificial Sequence
  Synthetic oligonucleotide
gtcaccattgcctcttgaatttgcgccatctttgc

SEQ ID NO: 110687 - DNA, 35 bp, Artificial Sequence
  Synthetic oligonucleotide
tctgtcccacctccgaaggatacaagtatcaccat

SEQ ID NO: 110688 - DNA, 37 bp, Artificial Sequence
  Synthetic oligonucleotide
gacctcgccttccgtgcccactacagccctctctcga

SEQ ID NO: 110689 - DNA, 36 bp, Artificial Sequence
  Synthetic oligonucleotide
acgatgccgccgcccgtccgtactttgccttgcata

SEQ ID NO: 110690 - DNA, 35 bp, Artificial Sequence
  Synthetic oligonucleotide
gaccaccctatgtctctctaccctccaccgcgttg

SEQ ID NO: 110691 - DNA, 35 bp, Artificial Sequence
  Synthetic oligonucleotide
gtgaacctccttccatcctgtctttgagcatgaac

SEQ ID NO: 110692 - DNA, 36 bp, Artificial Sequence
  Synthetic oligonucleotide
tcccatccaccactgctgaactttctcctggacata

SEQ ID NO: 110693 - DNA, 35 bp, Artificial Sequence
  Synthetic oligonucleotide
actcgatcatgctacatctcttgtatttcacctgc

SEQ ID NO: 110694 - DNA, 35 bp, Artificial Sequence
  Synthetic oligonucleotide
tgagtggcgctgatgtctcccgcccccttgtgccc

SEQ ID NO: 110695 - DNA, 35 bp, Artificial Sequence
  Synthetic oligonucleotide
agcccactcgccgcgaatgacgcacttcttctccc

SEQ ID NO: 110696 - DNA, 35 bp, Artificial Sequence
  Synthetic oligonucleotide
tccacaacgccctccctgacgagacctcgtttgct

SEQ ID NO: 110697 - DNA, 37 bp, Artificial Sequence
  Synthetic oligonucleotide
tacgccgccaccattgcctgttctcacctttccacga

SEQ ID NO: 110698 - DNA, 35 bp, Artificial Sequence
  Synthetic oligonucleotide
gacatgattgcccgttgcgccgttccaccctcacc

SEQ ID NO: 110699 - DNA, 35 bp, Artificial Sequence
  Synthetic oligonucleotide
aacccagtgtccatttgctccacgtcctgctgaac

SEQ ID NO: 110700 - DNA, 35 bp, Artificial Sequence
  Synthetic oligonucleotide
actgaccactggtcgttcctgagtttctgtttccc

SEQ ID NO: 110701 - DNA, 35 bp, Artificial Sequence
  Synthetic oligonucleotide
acgttccccgcctccgcctctattcgcttttaatg

SEQ ID NO: 110702 - DNA, 36 bp, Artificial Sequence
  Synthetic oligonucleotide
ggagaaaggggcggtggggaggtcggaacgggggta

SEQ ID NO: 110703 - DNA, 35 bp, Artificial Sequence
  Synthetic oligonucleotide
gacatgtaccaggtccctatcgattccggcccacc

SEQ ID NO: 110704 - DNA, 35 bp, Artificial Sequence
  Synthetic oligonucleotide
tccccgccctctttaaccgtgcctcgccacgccgc

SEQ ID NO: 110705 - DNA, 35 bp, Artificial Sequence
  Synthetic oligonucleotide
tatgccccgcgcaacttgttacatttgccacttct

SEQ ID NO: 110706 - DNA, 35 bp, Artificial Sequence
  Synthetic oligonucleotide
tcctgtccgccttcccattcagtcaaacgtactcc

SEQ ID NO: 110707 - DNA, 35 bp, Artificial Sequence
  Synthetic oligonucleotide
ttgaccccgccctcgagcgatctactgagtctctc

SEQ ID NO: 110708 - DNA, 35 bp, Artificial Sequence
  Synthetic oligonucleotide
ttcacaggccttcaccgcgtgccccccactgcacc

SEQ ID NO: 110709 - DNA, 35 bp, Artificial Sequence
  Synthetic oligonucleotide
actggcgcacacggtcttacgcagcctcctcaccc

SEQ ID NO: 110710 - DNA, 35 bp, Artificial Sequence
  Synthetic oligonucleotide
gacaaccccctgtccatgtcttttccgccggtttc

SEQ ID NO: 110711 - DNA, 35 bp, Artificial Sequence
  Synthetic oligonucleotide
accaccgcaccgcccggcgatctcacacgatcctt

SEQ ID NO: 110712 - DNA, 36 bp, Artificial Sequence
  Synthetic oligonucleotide
agcgccgtcactgtcctgcctcgttcttcctttata

SEQ ID NO: 110713 - DNA, 35 bp, Artificial Sequence
  Synthetic oligonucleotide
tcgaccgtcccgtttttacctttgccgccggtttc

SEQ ID NO: 110714 - DNA, 35 bp, Artificial Sequence
  Synthetic oligonucleotide
tagagcgcgccctcagcgttatccgtcctgccaac

SEQ ID NO: 110715 - DNA, 36 bp, Artificial Sequence
  Synthetic oligonucleotide
tgccctgcctcgagctacgtccaccccccacccgta

SEQ ID NO: 110716 - DNA, 35 bp, Artificial Sequence
  Synthetic oligonucleotide
gtaggcctcattgccgcatccgtttcacactgccc

SEQ ID NO: 110717 - DNA, 35 bp, Artificial Sequence
  Synthetic oligonucleotide
gacctcaccttgcatttgatcgaccacctccttgt

SEQ ID NO: 110718 - DNA, 36 bp, Artificial Sequence
  Synthetic oligonucleotide
aagccctcacagctgtcacatctactcgcccccgta

SEQ ID NO: 110719 - DNA, 35 bp, Artificial Sequence
  Synthetic oligonucleotide
acatcacgaacgccgccccgtgccacactgttgcc

SEQ ID NO: 110720 - DNA, 35 bp, Artificial Sequence
  Synthetic oligonucleotide
gcgaaccctccccaactgttgctaaggtactccgc

SEQ ID NO: 110721 - DNA, 35 bp, Artificial Sequence
  Synthetic oligonucleotide
gacgggcgggtgggtttcgcctggggatctagcct

SEQ ID NO: 110722 - DNA, 35 bp, Artificial Sequence
  Synthetic oligonucleotide
tcccgcctcatgcgtgcgttccttcccgtgccgaa

SEQ ID NO: 110723 - DNA, 37 bp, Artificial Sequence
  Synthetic oligonucleotide
tatgccatcgcacgccgcacccccccgtctgtcctga

SEQ ID NO: 110724 - DNA, 35 bp, Artificial Sequence
  Synthetic oligonucleotide
gaccaccacaagccgttctgtacccacgtctccgc

SEQ ID NO: 110725 - DNA, 36 bp, Artificial Sequence
  Synthetic oligonucleotide
gttcccatccgcccttgagtgtcctagcttcattca

SEQ ID NO: 110726 - DNA, 37 bp, Artificial Sequence
  Synthetic oligonucleotide
gggggtcgggtaggggagggtgacaaggaaggggaga

SEQ ID NO: 110727 - DNA, 37 bp, Artificial Sequence
  Synthetic oligonucleotide
gatagccaggggtgggtggtgcgggcggtggggacga

SEQ ID NO: 110728 - DNA, 35 bp, Artificial Sequence
  Synthetic oligonucleotide
gtcccagagccagcccgtccccctttctatctgtc

SEQ ID NO: 110729 - DNA, 37 bp, Artificial Sequence
  Synthetic oligonucleotide
ggagggaacaaggggaagggggaagtgcgcagatcga

SEQ ID NO: 110730 - DNA, 38 bp, Artificial Sequence
  Synthetic oligonucleotide
aaggaaggaacacgaggacgggggggcgggacagctga

SEQ ID NO: 110731 - DNA, 35 bp, Artificial Sequence
  Synthetic oligonucleotide
ggaaaacaggagggggaggggaacgggagtgcgca

SEQ ID NO: 110732 - DNA, 35 bp, Artificial Sequence
  Synthetic oligonucleotide
acgtccccgtgccgctggggccttctgttcatttc

SEQ ID NO: 110733 - DNA, 37 bp, Artificial Sequence
  Synthetic oligonucleotide
atgtgagggggcgggagtatgggaggggtgtaacaga

SEQ ID NO: 110734 - DNA, 36 bp, Artificial Sequence
  Synthetic oligonucleotide
gtcaccgcatccatttttacggcgccctgttccata

SEQ ID NO: 110735 - DNA, 33 bp, Artificial Sequence
  Synthetic oligonucleotide
atgccacttcaacacgcgttggtcgccttttcc

SEQ ID NO: 110736 - DNA, 38 bp, Artificial Sequence
  Synthetic oligonucleotide
gtctccacactgctgtttcttgcgccgcccactcatga

SEQ ID NO: 110737 - DNA, 38 bp, Artificial Sequence
  Synthetic oligonucleotide
gaaccgtcgacgtgatctgctcccccccctcacactga

SEQ ID NO: 110738 - DNA, 35 bp, Artificial Sequence
  Synthetic oligonucleotide
atctggctccctctgttttccaagttgccctaccc

SEQ ID NO: 110739 - DNA, 35 bp, Artificial Sequence
  Synthetic oligonucleotide
gaacctccactcccacgacggatcgccttcaatcc

SEQ ID NO: 110740 - DNA, 38 bp, Artificial Sequence
  Synthetic oligonucleotide
tcagtcgagcctctgtggtaacccgcctgcccccctga

SEQ ID NO: 110741 - DNA, 34 bp, Artificial Sequence
  Synthetic oligonucleotide
tcatgccgactgggcatgaagccacttccacctt

SEQ ID NO: 110742 - DNA, 38 bp, Artificial Sequence
  Synthetic oligonucleotide
gaaaaggagggggagtggggtacacgggggcaaggtga

SEQ ID NO: 110743 - DNA, 36 bp, Artificial Sequence
  Synthetic oligonucleotide
tcctcctcaccctgggcctccatggacatgtttata

SEQ ID NO: 110744 - DNA, 33 bp, Artificial Sequence
  Synthetic oligonucleotide
tgttcactcaccggtccatctgcatatgctcgc

SEQ ID NO: 110745 - DNA, 37 bp, Artificial Sequence
  Synthetic oligonucleotide
gagggagggcgtagagaaagaaatgaaggggcgggga

SEQ ID NO: 110746 - DNA, 35 bp, Artificial Sequence
  Synthetic oligonucleotide
gttaccctgccctgtagttcaactcactgtacccc

SEQ ID NO: 110747 - DNA, 35 bp, Artificial Sequence
  Synthetic oligonucleotide
acctccgtcatccgctgctctttcttatgccccag

SEQ ID NO: 110748 - DNA, 36 bp, Artificial Sequence
  Synthetic oligonucleotide
taccggccgggggggggtaaaatgctggggagggaa

SEQ ID NO: 110749 - DNA, 35 bp, Artificial Sequence
  Synthetic oligonucleotide
tagccgccgagctatcattccgccccatcaccatg

SEQ ID NO: 110750 - DNA, 36 bp, Artificial Sequence
  Synthetic oligonucleotide
tcactcccctgccaatgcagtattgctttcctcaca

SEQ ID NO: 110751 - DNA, 37 bp, Artificial Sequence
  Synthetic oligonucleotide
gaaaggagggatccggagagatggggagggtaaggga

SEQ ID NO: 110752 - DNA, 35 bp, Artificial Sequence
  Synthetic oligonucleotide
tacaccgcactccttcgcctccgttaacacactcc

SEQ ID NO: 110753 - DNA, 35 bp, Artificial Sequence
  Synthetic oligonucleotide
acgccctccccccgacgcccgcactacgctcgtat

SEQ ID NO: 110754 - DNA, 35 bp, Artificial Sequence
  Synthetic oligonucleotide
gccgcccccgcatccgtcacctttctggtccccct

SEQ ID NO: 110755 - DNA, 35 bp, Artificial Sequence
  Synthetic oligonucleotide
atgatccatccgccgcgctgcctgttcggctctct

SEQ ID NO: 110756 - DNA, 35 bp, Artificial Sequence
  Synthetic oligonucleotide
acgaggacaggaaggcggagtatggaggaatgatg

SEQ ID NO: 110757 - DNA, 35 bp, Artificial Sequence
  Synthetic oligonucleotide
gtacgctccaatgcggtacacgccctcataccact

SEQ ID NO: 110758 - DNA, 35 bp, Artificial Sequence
  Synthetic oligonucleotide
tgctccctcccggccgtacttaggcctcgcccaca

SEQ ID NO: 110759 - DNA, 36 bp, Artificial Sequence
  Synthetic oligonucleotide
gacaacgtatgaaaactgtcctgccgtcgcccccca

SEQ ID NO: 110760 - DNA, 35 bp, Artificial Sequence
  Synthetic oligonucleotide
gtaggcccctgccgacccatccgaacgccattcct

SEQ ID NO: 110761 - DNA, 35 bp, Artificial Sequence
  Synthetic oligonucleotide
agtacatgggggggaagggcgaggtaaaactgggt

SEQ ID NO: 110762 - DNA, 35 bp, Artificial Sequence
  Synthetic oligonucleotide
ttgccccactcagctgctacgctccgcgcccctcc

SEQ ID NO: 110763 - DNA, 35 bp, Artificial Sequence
  Synthetic oligonucleotide
gacccgccatgttcgcctgccgagttctatccctt

SEQ ID NO: 110764 - DNA, 35 bp, Artificial Sequence
  Synthetic oligonucleotide
acgagtgcatccatagtttgcgaccctcttgctcc

SEQ ID NO: 110765 - DNA, 35 bp, Artificial Sequence
  Synthetic oligonucleotide
gcctgcccacgattaaatgcgcttctgttcccggc

SEQ ID NO: 110766 - DNA, 35 bp, Artificial Sequence
  Synthetic oligonucleotide
tcgctcccgatcatcctgttacgttccgcatccct

SEQ ID NO: 110767 - DNA, 35 bp, Artificial Sequence
  Synthetic oligonucleotide
gtcccccacggttgggttgcccctatgacccgtcc

SEQ ID NO: 110768 - DNA, 35 bp, Artificial Sequence
  Synthetic oligonucleotide
gttgaccctgcccctgagccatacttaagtctctt

SEQ ID NO: 110769 - DNA, 35 bp, Artificial Sequence
  Synthetic oligonucleotide
tgataccagcccctacgcccgttaagctgccctcc

SEQ ID NO: 110770 - DNA, 32 bp, Artificial Sequence
  Synthetic oligonucleotide
actaccctctggatcgaatacacccccccgtg

SEQ ID NO: 110771 - DNA, 35 bp, Artificial Sequence
  Synthetic oligonucleotide
tgcgatccgcgatccacattgtttggtcccccctt

SEQ ID NO: 110772 - DNA, 35 bp, Artificial Sequence
  Synthetic oligonucleotide
gccacatctcctgtccatctttttgggtccagttc

SEQ ID NO: 110773 - DNA, 35 bp, Artificial Sequence
  Synthetic oligonucleotide
gtgggagggggcatagggggttggaagttggcaag

SEQ ID NO: 110774 - DNA, 36 bp, Artificial Sequence
  Synthetic oligonucleotide
aagcgagtgtgctggtggggttgggaggggggtgga

SEQ ID NO: 110775 - DNA, 35 bp, Artificial Sequence
  Synthetic oligonucleotide
aacccgcgcacatgccctgctttcttccctaccat

SEQ ID NO: 110776 - DNA, 35 bp, Artificial Sequence
  Synthetic oligonucleotide
gcgcacctcacgcgaactgccgccctgtttctcat

SEQ ID NO: 110777 - DNA, 37 bp, Artificial Sequence
  Synthetic oligonucleotide
tccccatcccaccttttgtgagtgtccgttaccttga

SEQ ID NO: 110778 - DNA, 35 bp, Artificial Sequence
  Synthetic oligonucleotide
aagtgacgtcacatagcctgccctcctgtctactc

SEQ ID NO: 110779 - DNA, 36 bp, Artificial Sequence
  Synthetic oligonucleotide
gacggggcccccgttccattcccaccatagccttga

SEQ ID NO: 110780 - DNA, 35 bp, Artificial Sequence
  Synthetic oligonucleotide
ggggagggagtaattaagggggacatagggggtaa

SEQ ID NO: 110781 - DNA, 35 bp, Artificial Sequence
  Synthetic oligonucleotide
gcccatcacctctcattgtcctctgattcggtttc

SEQ ID NO: 110782 - DNA, 35 bp, Artificial Sequence
  Synthetic oligonucleotide
ttggcgcaactcgttgtcgctgcttaccccctccg

SEQ ID NO: 110783 - DNA, 35 bp, Artificial Sequence
  Synthetic oligonucleotide
gcagggcccccgctgttcactagccactaccttgc

SEQ ID NO: 110784 - DNA, 35 bp, Artificial Sequence
  Synthetic oligonucleotide
tcatccgccaggcgtctcggtccaccccctcttgt

SEQ ID NO: 110785 - DNA, 36 bp, Artificial Sequence
  Synthetic oligonucleotide
agacgcggtctcatcgtcatgtccgcccatcttcca

SEQ ID NO: 110786 - DNA, 35 bp, Artificial Sequence
  Synthetic oligonucleotide
gtgacccgcgatcctgtccctctcttgcgataacc

SEQ ID NO: 110787 - DNA, 35 bp, Artificial Sequence
  Synthetic oligonucleotide
aggtgccactcctgtccctgatccttccgtgcccc

SEQ ID NO: 110788 - DNA, 27 bp, Artificial Sequence
  Synthetic oligonucleotide
gggacaccttcgaacttacacttgccc

SEQ ID NO: 110789 - DNA, 37 bp, Artificial Sequence
  Synthetic oligonucleotide
ggtacaaggtcggagaagaaatgaggagggggaagga

SEQ ID NO: 110790 - DNA, 38 bp, Artificial Sequence
  Synthetic oligonucleotide
ttgaccaccctgtttcctcctgtgcctgtcatgtttga

SEQ ID NO: 110791 - DNA, 37 bp, Artificial Sequence
  Synthetic oligonucleotide
ttcaccgtccgcatgcaatagcccctctctcgtccga

SEQ ID NO: 110792 - DNA, 35 bp, Artificial Sequence
  Synthetic oligonucleotide
acaccccagcacgccctcgccccgactatagacgc

SEQ ID NO: 110793 - DNA, 35 bp, Artificial Sequence
  Synthetic oligonucleotide
tcacctgccacattatatctttaccccgtttacgc

SEQ ID NO: 110794 - DNA, 35 bp, Artificial Sequence
  Synthetic oligonucleotide
tgccattgtgcacttccccgtctttacgctctcgc

SEQ ID NO: 110795 - DNA, 32 bp, Artificial Sequence
  Synthetic oligonucleotide
gcaccttcgcgcccggattccactcttccctc

SEQ ID NO: 110796 - DNA, 36 bp, Artificial Sequence
  Synthetic oligonucleotide
gcctacccctccacttgttcctcgacgagccctgca

SEQ ID NO: 110797 - DNA, 36 bp, Artificial Sequence
  Synthetic oligonucleotide
acaggagccgcccttatgtacttcctcgcccccgga

SEQ ID NO: 110798 - DNA, 32 bp, Artificial Sequence
  Synthetic oligonucleotide
ttacaccaccactggcctcctgacgctgttga

SEQ ID NO: 110799 - DNA, 37 bp, Artificial Sequence
  Synthetic oligonucleotide
tgtgccgcacgccatcttgagcctcccttccgccttc

SEQ ID NO: 110800 - DNA, 35 bp, Artificial Sequence
  Synthetic oligonucleotide
tccacaccggtccttatttatgacggcttcctcca

SEQ ID NO: 110801 - DNA, 35 bp, Artificial Sequence
  Synthetic oligonucleotide
tcctgcgaacattcgtacacacccatccgccctga

SEQ ID NO: 110802 - DNA, 38 bp, Artificial Sequence
  Synthetic oligonucleotide
gtggacgggacgggagggtgggtgcatgttacatgtga

SEQ ID NO: 110803 - DNA, 36 bp, Artificial Sequence
  Synthetic oligonucleotide
tagcctccgcttcctttgtctgttcggggctccctc

SEQ ID NO: 110804 - DNA, 37 bp, Artificial Sequence
  Synthetic oligonucleotide
acgcccaagcgtaccgttccatctccccatgtcctga

SEQ ID NO: 110805 - DNA, 36 bp, Artificial Sequence
  Synthetic oligonucleotide
tgtccaccgcctccatacacccgagtactgctctta

SEQ ID NO: 110806 - DNA, 35 bp, Artificial Sequence
  Synthetic oligonucleotide
tccccctaccctccccgttgatattagttcacaac

SEQ ID NO: 110807 - DNA, 35 bp, Artificial Sequence
  Synthetic oligonucleotide
tgatcacgccctcacttgactacatacgccactgc

SEQ ID NO: 110808 - DNA, 35 bp, Artificial Sequence
  Synthetic oligonucleotide
gctatgcgaaggggaggggaggggaaggaaattgc

SEQ ID NO: 110809 - DNA, 35 bp, Artificial Sequence
  Synthetic oligonucleotide
ggtccccgcctctgttcactataccaccttgtttc

SEQ ID NO: 110810 - DNA, 35 bp, Artificial Sequence
  Synthetic oligonucleotide
gtactcaagcgccctccgttcctcgtgccaccccg

SEQ ID NO: 110811 - DNA, 37 bp, Artificial Sequence
  Synthetic oligonucleotide
gagacaggtagggagatcggggggcgaagagcgagga

SEQ ID NO: 110812 - DNA, 37 bp, Artificial Sequence
  Synthetic oligonucleotide
ttgacccagcccgccgccctaagccacccaagcttga

SEQ ID NO: 110813 - DNA, 36 bp, Artificial Sequence
  Synthetic oligonucleotide
tccggaccgttgggtatctctgccctccccccgcca

SEQ ID NO: 110814 - DNA, 37 bp, Artificial Sequence
  Synthetic oligonucleotide
tagccgaacgcccgccggttttgccacccatctccga

SEQ ID NO: 110815 - DNA, 37 bp, Artificial Sequence
  Synthetic oligonucleotide
tgaggggccatcatgcggagggggagggacatgggga

SEQ ID NO: 110816 - DNA, 37 bp, Artificial Sequence
  Synthetic oligonucleotide
actccgcccactcggttctttcctgccatcttgggga

SEQ ID NO: 110817 - DNA, 35 bp, Artificial Sequence
  Synthetic oligonucleotide
atggcgccccgtgctcgttcgttcttctctcttgt

SEQ ID NO: 110818 - DNA, 35 bp, Artificial Sequence
  Synthetic oligonucleotide
ggagaaggcatggaagcaggaactggacgggaggg

SEQ ID NO: 110819 - DNA, 35 bp, Artificial Sequence
  Synthetic oligonucleotide
agaacgggcgggggggagagagcagggcgccatgg

SEQ ID NO: 110820 - DNA, 35 bp, Artificial Sequence
  Synthetic oligonucleotide
tgccactgccgaacccctctgccacccctaccggt

SEQ ID NO: 110821 - DNA, 37 bp, Artificial Sequence
  Synthetic oligonucleotide
tgtccaaccccgaccctgtgttaacgcccttccctga

SEQ ID NO: 110822 - DNA, 35 bp, Artificial Sequence
  Synthetic oligonucleotide
tccgccctcgctcctacccgtcacactgatggtcc

SEQ ID NO: 110823 - DNA, 35 bp, Artificial Sequence
  Synthetic oligonucleotide
tgagctcgcatcactcgtcctggtcccgtccaatc

SEQ ID NO: 110824 - DNA, 35 bp, Artificial Sequence
  Synthetic oligonucleotide
tgcagatcccatgttcctctgcgccctctgttgtt

SEQ ID NO: 110825 - DNA, 35 bp, Artificial Sequence
  Synthetic oligonucleotide
gatgaggggtgggggaagtgaagacggatagcgag

SEQ ID NO: 110826 - DNA, 35 bp, Artificial Sequence
  Synthetic oligonucleotide
tctgccatgccctagtatgctcgttaacgcctccc

SEQ ID NO: 110827 - DNA, 34 bp, Artificial Sequence
  Synthetic oligonucleotide
gtgccctcacccgccgtaaaatttcgcattgccc

SEQ ID NO: 110828 - DNA, 36 bp, Artificial Sequence
  Synthetic oligonucleotide
tgcgcccacatgaaaccctactcgccttcgcccgta

SEQ ID NO: 110829 - DNA, 35 bp, Artificial Sequence
  Synthetic oligonucleotide
tactccatccctccgtttcgaatctagacctggtc

SEQ ID NO: 110830 - DNA, 35 bp, Artificial Sequence
  Synthetic oligonucleotide
gagcgacgcttgctctgtaccccgcccggctcact

SEQ ID NO: 110831 - DNA, 35 bp, Artificial Sequence
  Synthetic oligonucleotide
tccccccgcctctaacctttgcgtatatcgctcgt

SEQ ID NO: 110832 - DNA, 34 bp, Artificial Sequence
  Synthetic oligonucleotide
tccacccccccctgcccgacgctccgtacttgtt

SEQ ID NO: 110833 - DNA, 35 bp, Artificial Sequence
  Synthetic oligonucleotide
gatgtccccccctgtcgtttgattcagcctcgacc

SEQ ID NO: 110834 - DNA, 35 bp, Artificial Sequence
  Synthetic oligonucleotide
tggacctgcgacgtttcagcccttctctcgttgcc

SEQ ID NO: 110835 - DNA, 35 bp, Artificial Sequence
  Synthetic oligonucleotide
acccgccgttgacgttacatatcccccctttccag

SEQ ID NO: 110836 - DNA, 36 bp, Artificial Sequence
  Synthetic oligonucleotide
agccgccgctcgcacttgcctacctgccacttctta

SEQ ID NO: 110837 - DNA, 34 bp, Artificial Sequence
  Synthetic oligonucleotide
gagacacctccaccccccctggcccaggaccgta

SEQ ID NO: 110838 - DNA, 35 bp, Artificial Sequence
  Synthetic oligonucleotide
ttcccgggcacacttagcttgaatcactccccctc

SEQ ID NO: 110839 - DNA, 35 bp, Artificial Sequence
  Synthetic oligonucleotide
gactgacctcacgtgatccctcttttctacccccg

SEQ ID NO: 110840 - DNA, 35 bp, Artificial Sequence
  Synthetic oligonucleotide
ttgccggctcttctgccttcgttcgtcccgtgcca

SEQ ID NO: 110841 - DNA, 35 bp, Artificial Sequence
  Synthetic oligonucleotide
gtgcaacgtacctccctgcctcaccccatattgcc

SEQ ID NO: 110842 - DNA, 36 bp, Artificial Sequence
  Synthetic oligonucleotide
ggtggggaggggcaggtgggtggaatcggcgcacaa

SEQ ID NO: 110843 - DNA, 35 bp, Artificial Sequence
  Synthetic oligonucleotide
tccactgccaccgctgggttcccacctgctctcgc

SEQ ID NO: 110844 - DNA, 34 bp, Artificial Sequence
  Synthetic oligonucleotide
gatagccgggcggggggggatgggccatacttgc

SEQ ID NO: 110845 - DNA, 35 bp, Artificial Sequence
  Synthetic oligonucleotide
cccgcacgcagcatcactcctgctggccccctgtt

SEQ ID NO: 110846 - DNA, 34 bp, Artificial Sequence
  Synthetic oligonucleotide
gtgatcaccctcatatcgaccacgctgttcctta

SEQ ID NO: 110847 - DNA, 36 bp, Artificial Sequence
  Synthetic oligonucleotide
accgatccctcagattccactccccgctgccatcca

SEQ ID NO: 110848 - DNA, 35 bp, Artificial Sequence
  Synthetic oligonucleotide
gtaccacccccctctcgattcccgtcttatgagtc

SEQ ID NO: 110849 - DNA, 34 bp, Artificial Sequence
  Synthetic oligonucleotide
tcactccaccgttcctgcccgcctcatctccgtg

SEQ ID NO: 110850 - DNA, 35 bp, Artificial Sequence
  Synthetic oligonucleotide
aaccggtcgccatcctctcgccctgccctgacttg

SEQ ID NO: 110851 - DNA, 36 bp, Artificial Sequence
  Synthetic oligonucleotide
tgacgggagggggggtttaaggggtgaatgcttcca

SEQ ID NO: 110852 - DNA, 35 bp, Artificial Sequence
  Synthetic oligonucleotide
tccccgcccggtctactatgccttgaattccatca

SEQ ID NO: 110853 - DNA, 35 bp, Artificial Sequence
  Synthetic oligonucleotide
tccagcaacgaccgtcccataccacctgcttatac

SEQ ID NO: 110854 - DNA, 35 bp, Artificial Sequence
  Synthetic oligonucleotide
tagccctcgagccttctgttattcgctttccgctc

SEQ ID NO: 110855 - DNA, 35 bp, Artificial Sequence
  Synthetic oligonucleotide
gcaggtcccaccatccatccgtgtcgctgttcccc

SEQ ID NO: 110856 - DNA, 32 bp, Artificial Sequence
  Synthetic oligonucleotide
gatgcccgtaaacctgtaatcgtctccttgcc

SEQ ID NO: 110857 - DNA, 35 bp, Artificial Sequence
  Synthetic oligonucleotide
gtgtgtgtcccgtcggcttcctaagcactcccctc

SEQ ID NO: 110858 - DNA, 35 bp, Artificial Sequence
  Synthetic oligonucleotide
ttcgtccgctcctgagcattgtcccccgtcctcgc

SEQ ID NO: 110859 - DNA, 35 bp, Artificial Sequence
  Synthetic oligonucleotide
atatccggacgcctcctccatctgtttcactcctg

SEQ ID NO: 110860 - DNA, 35 bp, Artificial Sequence
  Synthetic oligonucleotide
tcaatacgcctcatgctcatccggaaccgtgctcc

SEQ ID NO: 110861 - DNA, 35 bp, Artificial Sequence
  Synthetic oligonucleotide
gtgtgctcgtgctgttcagcctctcctcgttgtcc

SEQ ID NO: 110862 - DNA, 35 bp, Artificial Sequence
  Synthetic oligonucleotide
tgagacgccctactcgttggtttgccccctcgttc

SEQ ID NO: 110863 - DNA, 35 bp, Artificial Sequence
  Synthetic oligonucleotide
gggtgggaagttagggaggggggactagggaggaa

SEQ ID NO: 110864 - DNA, 37 bp, Artificial Sequence
  Synthetic oligonucleotide
tcaccatcctcacacagtcgttgccgacatctttcga

SEQ ID NO: 110865 - DNA, 35 bp, Artificial Sequence
  Synthetic oligonucleotide
gcctgcgatccaaaccccgtcgtcccgtgtccccg

SEQ ID NO: 110866 - DNA, 35 bp, Artificial Sequence
  Synthetic oligonucleotide
acacacctacattccgcatctatcatcagcccctg

SEQ ID NO: 110867 - DNA, 37 bp, Artificial Sequence
  Synthetic oligonucleotide
tacaggcgcacgacgtttcctgcctccctccactcga

SEQ ID NO: 110868 - DNA, 35 bp, Artificial Sequence
  Synthetic oligonucleotide
gcccccactgcttagcctatgactctctgcctcct

SEQ ID NO: 110869 - DNA, 37 bp, Artificial Sequence
  Synthetic oligonucleotide
aatcatgcgagaaggtagtagggggggggatatggga

SEQ ID NO: 110870 - DNA, 35 bp, Artificial Sequence
  Synthetic oligonucleotide
tcctcccccgtccatagaatatcgtaactctggtc

SEQ ID NO: 110871 - DNA, 35 bp, Artificial Sequence
  Synthetic oligonucleotide
ggggtgggcggttgaggggaagactcattgggggt

SEQ ID NO: 110872 - DNA, 35 bp, Artificial Sequence
  Synthetic oligonucleotide
gcccccctgtagctacctttcgtaacgccacgtac

SEQ ID NO: 110873 - DNA, 35 bp, Artificial Sequence
  Synthetic oligonucleotide
tatgatccacgcgccacccatctatttagccttca

SEQ ID NO: 110874 - DNA, 35 bp, Artificial Sequence
  Synthetic oligonucleotide
tccacgtcctcacgtatcgtttcatcccaggcccg

SEQ ID NO: 110875 - DNA, 35 bp, Artificial Sequence
  Synthetic oligonucleotide
gtcaccttcccaccatagttgtttacgcctttgcg

SEQ ID NO: 110876 - DNA, 35 bp, Artificial Sequence
  Synthetic oligonucleotide
gaccattaacccgccgtccccattccgtgcccttg

SEQ ID NO: 110877 - DNA, 36 bp, Artificial Sequence
  Synthetic oligonucleotide
acccctgcccgatgacgctccatcacttgctcacca

SEQ ID NO: 110878 - DNA, 35 bp, Artificial Sequence
  Synthetic oligonucleotide
tcttcgcccacccccactgctcagttaagcagtcc

SEQ ID NO: 110879 - DNA, 38 bp, Artificial Sequence
  Synthetic oligonucleotide
tcatccccccgtagacgcccgtgttgtaccttccctga

SEQ ID NO: 110880 - DNA, 35 bp, Artificial Sequence
  Synthetic oligonucleotide
ttcgtagacttcctgcccttcgtatttgtccatcc

SEQ ID NO: 110881 - DNA, 35 bp, Artificial Sequence
  Synthetic oligonucleotide
gtaccccccctgcctgttactatcagtcattctca

SEQ ID NO: 110882 - DNA, 35 bp, Artificial Sequence
  Synthetic oligonucleotide
accccaccgcatgtgtgaagcttcgctcactcccc

SEQ ID NO: 110883 - DNA, 35 bp, Artificial Sequence
  Synthetic oligonucleotide
atgtcctgcacttgatctacacggcctccttttcc

SEQ ID NO: 110884 - DNA, 35 bp, Artificial Sequence
  Synthetic oligonucleotide
ggggggggaactggggtgagcaggagagagagaaa

SEQ ID NO: 110885 - DNA, 35 bp, Artificial Sequence
  Synthetic oligonucleotide
tgtggtcccccctttgttatcaatacactgtcctc

SEQ ID NO: 110886 - DNA, 35 bp, Artificial Sequence
  Synthetic oligonucleotide
acgtggaggggtaaggccgggggaagggacgaggg

SEQ ID NO: 110887 - DNA, 35 bp, Artificial Sequence
  Synthetic oligonucleotide
tccacctcgctcgttaacaccatctcttgtcgcta

SEQ ID NO: 110888 - DNA, 35 bp, Artificial Sequence
  Synthetic oligonucleotide
attagcccagccgttcctcctctgcttggttagcc

SEQ ID NO: 110889 - DNA, 35 bp, Artificial Sequence
  Synthetic oligonucleotide
gcctgtacctgccccaccaccgactccttgggtct

SEQ ID NO: 110890 - DNA, 36 bp, Artificial Sequence
  Synthetic oligonucleotide
gagagagggggaatggctaagcatgggagggagaaa

SEQ ID NO: 110891 - DNA, 37 bp, Artificial Sequence
  Synthetic oligonucleotide
cacgacgctccgtgctcactgttcttccctgcctaga

SEQ ID NO: 110892 - DNA, 37 bp, Artificial Sequence
  Synthetic oligonucleotide
tagccgccccgctgctcctccgttcgagttcctctga

SEQ ID NO: 110893 - DNA, 35 bp, Artificial Sequence
  Synthetic oligonucleotide
gtccctcctgccgttcatagcccctgctcccgatt

SEQ ID NO: 110894 - DNA, 35 bp, Artificial Sequence
  Synthetic oligonucleotide
acctcgccgctgttccacccgcagccaatattctt

SEQ ID NO: 110895 - DNA, 36 bp, Artificial Sequence
  Synthetic oligonucleotide
gaacgggggtggagtaggggagtgggggagggatca

SEQ ID NO: 110896 - DNA, 37 bp, Artificial Sequence
  Synthetic oligonucleotide
gacaatccgcactattgctgttcacccactcctttga

SEQ ID NO: 110897 - DNA, 35 bp, Artificial Sequence
  Synthetic oligonucleotide
attcgcgtaagcgattcgttgacccctccctccca

SEQ ID NO: 110898 - DNA, 35 bp, Artificial Sequence
  Synthetic oligonucleotide
gtacccgccaccacacattttcgtagcatgatcct

SEQ ID NO: 110899 - DNA, 35 bp, Artificial Sequence
  Synthetic oligonucleotide
gtcatcgggagggtgtagggggtggcggagggaga

SEQ ID NO: 110900 - DNA, 37 bp, Artificial Sequence
  Synthetic oligonucleotide
taccatcgcccgccgcattccctagtcctggccacga

SEQ ID NO: 110901 - DNA, 35 bp, Artificial Sequence
  Synthetic oligonucleotide
atcagccgcccctctttcctgttgaacacctatgc

SEQ ID NO: 110902 - DNA, 35 bp, Artificial Sequence
  Synthetic oligonucleotide
gtgcatcacttggtcctcctcgcttgtagtgcctc

SEQ ID NO: 110903 - DNA, 35 bp, Artificial Sequence
  Synthetic oligonucleotide
ggacaagccgtctcgatcctaacacacccgtcctc

SEQ ID NO: 110904 - DNA, 35 bp, Artificial Sequence
  Synthetic oligonucleotide
gagccgttcactgcattgcatccagtcctcctctc

SEQ ID NO: 110905 - DNA, 35 bp, Artificial Sequence
  Synthetic oligonucleotide
attccccacagatcgctatccttagcccgacgccc

SEQ ID NO: 110906 - DNA, 35 bp, Artificial Sequence
  Synthetic oligonucleotide
acccgcacctgccttaggaataaggcactccctct

SEQ ID NO: 110907 - DNA, 37 bp, Artificial Sequence
  Synthetic oligonucleotide
ggtcaccccagctgcatgcttacatttcaccccccga

SEQ ID NO: 110908 - DNA, 36 bp, Artificial Sequence
  Synthetic oligonucleotide
actgacacccccgctgcttttccatccgttgcatga

SEQ ID NO: 110909 - DNA, 37 bp, Artificial Sequence
  Synthetic oligonucleotide
ttccacacgcctattggtacaccgcccccgacctcga

SEQ ID NO: 110910 - DNA, 35 bp, Artificial Sequence
  Synthetic oligonucleotide
atcctccgcctacccagtttaaatgcctggatccc

SEQ ID NO: 110911 - DNA, 35 bp, Artificial Sequence
  Synthetic oligonucleotide
acgttgtcccgcccctgttttgtgcatgcgctgtc

SEQ ID NO: 110912 - DNA, 35 bp, Artificial Sequence
  Synthetic oligonucleotide
gccccactccgcttctgttcgccccgcgtactctg

SEQ ID NO: 110913 - DNA, 37 bp, Artificial Sequence
  Synthetic oligonucleotide
ggactccgtgctccatccccgtatcgcctatccttga

SEQ ID NO: 110914 - DNA, 35 bp, Artificial Sequence
  Synthetic oligonucleotide
gatccctctctgtattgcatgcccacggactcgcc

SEQ ID NO: 110915 - DNA, 35 bp, Artificial Sequence
  Synthetic oligonucleotide
gtttagcggcaccctcaccctcgcccgtgctttcc

SEQ ID NO: 110916 - DNA, 35 bp, Artificial Sequence
  Synthetic oligonucleotide
atcagtcgcctcgcgcataaggccaccccccctgc

SEQ ID NO: 110917 - DNA, 36 bp, Artificial Sequence
  Synthetic oligonucleotide
tgcacggggggtgtggggagtgggcggggtgacata

SEQ ID NO: 110918 - DNA, 38 bp, Artificial Sequence
  Synthetic oligonucleotide
gagtgacgccgggatgggacgggggggtgttgaattga

SEQ ID NO: 110919 - DNA, 35 bp, Artificial Sequence
  Synthetic oligonucleotide
gttcactcccccgccccgttaagagacgcacacta

SEQ ID NO: 110920 - DNA, 35 bp, Artificial Sequence
  Synthetic oligonucleotide
taccgggggaggaaagagcggggtgaagggcagga

SEQ ID NO: 110921 - DNA, 37 bp, Artificial Sequence
  Synthetic oligonucleotide
gacctgccacccccacgtggttaaacgcccaccttga

SEQ ID NO: 110922 - DNA, 35 bp, Artificial Sequence
  Synthetic oligonucleotide
ttaccctgcccccgaccgtcacttggacgcacgtt

SEQ ID NO: 110923 - DNA, 36 bp, Artificial Sequence
  Synthetic oligonucleotide
gccactgcagaacctcctttgccgccttacctggga

SEQ ID NO: 110924 - DNA, 35 bp, Artificial Sequence
  Synthetic oligonucleotide
gtagcatcagcacgcgcttctcctgtctatcttct

SEQ ID NO: 110925 - DNA, 35 bp, Artificial Sequence
  Synthetic oligonucleotide
accgcaccctcgctcgccgtatctaggcctacgtt

SEQ ID NO: 110926 - DNA, 35 bp, Artificial Sequence
  Synthetic oligonucleotide
gtgatcccgccgttaccgctagcccttgtaccgct

SEQ ID NO: 110927 - DNA, 38 bp, Artificial Sequence
  Synthetic oligonucleotide
ggaaagagagggcggggaagtaagggacgggcggatga

SEQ ID NO: 110928 - DNA, 35 bp, Artificial Sequence
  Synthetic oligonucleotide
gatacgtggggtgggggggcgcaagtaccaagggt

SEQ ID NO: 110929 - DNA, 37 bp, Artificial Sequence
  Synthetic oligonucleotide
tacaggccaggtctcccatgcgcccccctttccgtga

SEQ ID NO: 110930 - DNA, 36 bp, Artificial Sequence
  Synthetic oligonucleotide
accgccccccggctcatacctgcgattgcttgccta

SEQ ID NO: 110931 - DNA, 35 bp, Artificial Sequence
  Synthetic oligonucleotide
tcgctcatcgctgcttcctgccctcagtcacatcc

SEQ ID NO: 110932 - DNA, 36 bp, Artificial Sequence
  Synthetic oligonucleotide
gccgcccggtaactatctgccaccactcctgctgca

SEQ ID NO: 110933 - DNA, 37 bp, Artificial Sequence
  Synthetic oligonucleotide
tcacaacactgactgggcccttctccgccgttaccga

SEQ ID NO: 110934 - DNA, 35 bp, Artificial Sequence
  Synthetic oligonucleotide
tgatcgccctatgtcctcgtcccacccagcagtta

SEQ ID NO: 110935 - DNA, 35 bp, Artificial Sequence
  Synthetic oligonucleotide
tctccaccatgtcttctgacggcttataccttgtc

SEQ ID NO: 110936 - DNA, 35 bp, Artificial Sequence
  Synthetic oligonucleotide
gagcccccccggcgacgttgtctcccgtccctacg

SEQ ID NO: 110937 - DNA, 35 bp, Artificial Sequence
  Synthetic oligonucleotide
accccagtccctgacccgacctcgtgatatccccg

SEQ ID NO: 110938 - DNA, 35 bp, Artificial Sequence
  Synthetic oligonucleotide
tcagtcctgcacagtgcccttcgctcccgcccttg

SEQ ID NO: 110939 - DNA, 38 bp, Artificial Sequence
  Synthetic oligonucleotide
gacactgccacccgttcttagcctatcgcttccactga

SEQ ID NO: 110940 - DNA, 37 bp, Artificial Sequence
  Synthetic oligonucleotide
gccccacatcgtgtccctatgcccccgtacgtaccga

SEQ ID NO: 110941 - DNA, 37 bp, Artificial Sequence
  Synthetic oligonucleotide
gccgaaccgaagtagctgggtagtagggggggaggga

SEQ ID NO: 110942 - DNA, 35 bp, Artificial Sequence
  Synthetic oligonucleotide
tgcacgccagtctctttaagctctccaccctgtac

SEQ ID NO: 110943 - DNA, 35 bp, Artificial Sequence
  Synthetic oligonucleotide
ttagtccccagccgtcctcatgtctgacccgcccc

SEQ ID NO: 110944 - DNA, 35 bp, Artificial Sequence
  Synthetic oligonucleotide
atcagacgcgcatgtttggtcccgcctcacgttcc

SEQ ID NO: 110945 - DNA, 36 bp, Artificial Sequence
  Synthetic oligonucleotide
taccgtagcccccggagttcttgcccctcgcccgca

SEQ ID NO: 110946 - DNA, 35 bp, Artificial Sequence
  Synthetic oligonucleotide
tgcagacccttcatcgtacttttgttgtccccccg

SEQ ID NO: 110947 - DNA, 35 bp, Artificial Sequence
  Synthetic oligonucleotide
tgcccgccttagccgtccccaccagtcctgtcttt

SEQ ID NO: 110948 - DNA, 37 bp, Artificial Sequence
  Synthetic oligonucleotide
gagggtggggggagtagggtaatatcggggtcacgga

SEQ ID NO: 110949 - DNA, 35 bp, Artificial Sequence
  Synthetic oligonucleotide
gcccacccgcacccctagcccacatgtacgcaacc

SEQ ID NO: 110950 - DNA, 35 bp, Artificial Sequence
  Synthetic oligonucleotide
tgtacgagcctctccaagccgcctcacccccttgc

SEQ ID NO: 110951 - DNA, 35 bp, Artificial Sequence
  Synthetic oligonucleotide
gatacccctcctctgtttttgagccccttggttga

SEQ ID NO: 110952 - DNA, 35 bp, Artificial Sequence
  Synthetic oligonucleotide
gtgtcaccacactgtgctggtattccctgcttgcc

SEQ ID NO: 110953 - DNA, 35 bp, Artificial Sequence
  Synthetic oligonucleotide
gccattttccgccattgtccttagcccgcccttgc

SEQ ID NO: 110954 - DNA, 36 bp, Artificial Sequence
  Synthetic oligonucleotide
gccgagtatgagacgcagagggggcggggggggaca

SEQ ID NO: 110955 - DNA, 37 bp, Artificial Sequence
  Synthetic oligonucleotide
tcgtgagcgaggggggcgtgggtgggtgggaacgtga

SEQ ID NO: 110956 - DNA, 35 bp, Artificial Sequence
  Synthetic oligonucleotide
tgcaaatcgcccatcggtgcccccgctaatcttcc

SEQ ID NO: 110957 - DNA, 35 bp, Artificial Sequence
  Synthetic oligonucleotide
tcatccccacgccatcttcagtaacagtgcccctc

SEQ ID NO: 110958 - DNA, 35 bp, Artificial Sequence
  Synthetic oligonucleotide
tacagccacattactcctcgccaccactgctatcg

SEQ ID NO: 110959 - DNA, 35 bp, Artificial Sequence
  Synthetic oligonucleotide
attcccgcccgctattgtcctcccccacctacgac

SEQ ID NO: 110960 - DNA, 35 bp, Artificial Sequence
  Synthetic oligonucleotide
tcccaccccaccgttgcgtggttttgtaaacttcc

SEQ ID NO: 110961 - DNA, 35 bp, Artificial Sequence
  Synthetic oligonucleotide
accgatcaccatcgtcgtttcgctccctcgttatc

SEQ ID NO: 110962 - DNA, 37 bp, Artificial Sequence
  Synthetic oligonucleotide
gtgcagggaaaagtaggacaaaggcggtggaggagga

SEQ ID NO: 110963 - DNA, 37 bp, Artificial Sequence
  Synthetic oligonucleotide
ggggagggaggggatggttaagttaaggtctggggga

SEQ ID NO: 110964 - DNA, 36 bp, Artificial Sequence
  Synthetic oligonucleotide
actccgaggatgaggtaaggggaggccctgggagga

SEQ ID NO: 110965 - DNA, 35 bp, Artificial Sequence
  Synthetic oligonucleotide
gtccttccccgtgccgccgcccctcgatctgttct

SEQ ID NO: 110966 - DNA, 34 bp, Artificial Sequence
  Synthetic oligonucleotide
gcacgcccggccctcccgagattctgcccgctcc

SEQ ID NO: 110967 - DNA, 35 bp, Artificial Sequence
  Synthetic oligonucleotide
tgatcacctgtgtgttgccgttatgccccttttcc

SEQ ID NO: 110968 - DNA, 35 bp, Artificial Sequence
  Synthetic oligonucleotide
accactcccccacccacttattacgacggttacgc

SEQ ID NO: 110969 - DNA, 35 bp, Artificial Sequence
  Synthetic oligonucleotide
tgctcgcccctcccgtttagctccgcgtatccact

SEQ ID NO: 110970 - DNA, 35 bp, Artificial Sequence
  Synthetic oligonucleotide
acatcaccctttcctgccgcccatagctcgctggc

SEQ ID NO: 110971 - DNA, 37 bp, Artificial Sequence
  Synthetic oligonucleotide
tgctccaccgcctccactttcccgatgaccatcgcga

SEQ ID NO: 110972 - DNA, 36 bp, Artificial Sequence
  Synthetic oligonucleotide
taaacatccgctcgctgccttttagtcccactgcca

SEQ ID NO: 110973 - DNA, 37 bp, Artificial Sequence
  Synthetic oligonucleotide
aatggatggaacggtagggggacgggcgcgtgtcgga

SEQ ID NO: 110974 - DNA, 37 bp, Artificial Sequence
  Synthetic oligonucleotide
ttacaccgctctttgcattacgcctttccacaaacga

SEQ ID NO: 110975 - DNA, 35 bp, Artificial Sequence
  Synthetic oligonucleotide
gtactcccgctcccttctgtgccacctttttgggg

SEQ ID NO: 110976 - DNA, 36 bp, Artificial Sequence
  Synthetic oligonucleotide
gtagccagaaggtggagggggctgagaggggggaga

SEQ ID NO: 110977 - DNA, 37 bp, Artificial Sequence
  Synthetic oligonucleotide
gaacacgagtgaggaagtagcaggaggggcaacgaga

SEQ ID NO: 110978 - DNA, 35 bp, Artificial Sequence
  Synthetic oligonucleotide
atgaagccccccctagcatggtaccgctcccagcc

SEQ ID NO: 110979 - DNA, 35 bp, Artificial Sequence
  Synthetic oligonucleotide
gccacctgaccttctcccgtcgttaccgctatacg

SEQ ID NO: 110980 - DNA, 35 bp, Artificial Sequence
  Synthetic oligonucleotide
gcgatgcctgcttagccgtttcccgctcccctgga

SEQ ID NO: 110981 - DNA, 35 bp, Artificial Sequence
  Synthetic oligonucleotide
gacgccacagttccatcctatagtcccccttacat

SEQ ID NO: 110982 - DNA, 34 bp, Artificial Sequence
  Synthetic oligonucleotide
gacacactcagcgggtactgctcccgtttttcac

SEQ ID NO: 110983 - DNA, 35 bp, Artificial Sequence
  Synthetic oligonucleotide
gacactcgtcacagagtctcccgcgaaccacttcc

SEQ ID NO: 110984 - DNA, 35 bp, Artificial Sequence
  Synthetic oligonucleotide
actccaccatctcgactcgcattccctgcggacca

SEQ ID NO: 110985 - DNA, 35 bp, Artificial Sequence
  Synthetic oligonucleotide
tgttgtgcgccgtttgctgccttcatcgtacttac

SEQ ID NO: 110986 - DNA, 35 bp, Artificial Sequence
  Synthetic oligonucleotide
tgtcacactgcccttccctactgtccccgtgacta

SEQ ID NO: 110987 - DNA, 35 bp, Artificial Sequence
  Synthetic oligonucleotide
atacgccccgctcgcgatctctatggcttttctca

SEQ ID NO: 110988 - DNA, 35 bp, Artificial Sequence
  Synthetic oligonucleotide
gtgcgctccttctcgcctgtctgtcttcggtacat

SEQ ID NO: 110989 - DNA, 36 bp, Artificial Sequence
  Synthetic oligonucleotide
acaccacgttaaagtggtacctgctccctcctcaaa

SEQ ID NO: 110990 - DNA, 36 bp, Artificial Sequence
  Synthetic oligonucleotide
atgcccccgccgcctttcgtacggtcaggtccccca

SEQ ID NO: 110991 - DNA, 35 bp, Artificial Sequence
  Synthetic oligonucleotide
ggagcaccccccgcccctcctacgtaacgcgcgac

SEQ ID NO: 110992 - DNA, 35 bp, Artificial Sequence
  Synthetic oligonucleotide
gagcggacacctcgataccgtgccctgccattgcc

SEQ ID NO: 110993 - DNA, 35 bp, Artificial Sequence
  Synthetic oligonucleotide
atcctgtgccgtcatcgtcccgcttcactctcctg

SEQ ID NO: 110994 - DNA, 37 bp, Artificial Sequence
  Synthetic oligonucleotide
gtgacggtgtcacgggaggggggttaggggggaaaga

SEQ ID NO: 110995 - DNA, 35 bp, Artificial Sequence
  Synthetic oligonucleotide
gcaccctccgcactgccacgcccaacggtaaacgc

SEQ ID NO: 110996 - DNA, 36 bp, Artificial Sequence
  Synthetic oligonucleotide
atgtcctcgcccctgtgggtcatgttaccccttcca

SEQ ID NO: 110997 - DNA, 35 bp, Artificial Sequence
  Synthetic oligonucleotide
aacacggaagggaagggcgggtgagttacggtggt

SEQ ID NO: 110998 - DNA, 35 bp, Artificial Sequence
  Synthetic oligonucleotide
tgatccgacgccagggtccgtctcgcgctcctcca

SEQ ID NO: 110999 - DNA, 35 bp, Artificial Sequence
  Synthetic oligonucleotide
tgctccgccgctcgccttgatgaccccccccggca

SEQ ID NO: 111000 - DNA, 35 bp, Artificial Sequence
  Synthetic oligonucleotide
gggaaacaaagggggaaaggtacgtgacggggtgg

SEQ ID NO: 111001 - DNA, 35 bp, Artificial Sequence
  Synthetic oligonucleotide
tccaactccaatgcctgtttgccgttctctttttt

SEQ ID NO: 111002 - DNA, 36 bp, Artificial Sequence
  Synthetic oligonucleotide
gccacctccgttcccagtgccgcctacattcactca

SEQ ID NO: 111003 - DNA, 35 bp, Artificial Sequence
  Synthetic oligonucleotide
gaaccctcaccccgcaccgatgccctgtccaccat

SEQ ID NO: 111004 - DNA, 35 bp, Artificial Sequence
  Synthetic oligonucleotide
tctcaccgccttaccgtaatccatgctctccaggc

SEQ ID NO: 111005 - DNA, 37 bp, Artificial Sequence
  Synthetic oligonucleotide
gatacggtggtggaggtggaggggggaggctctcgga

SEQ ID NO: 111006 - DNA, 35 bp, Artificial Sequence
  Synthetic oligonucleotide
tactacaccgcttgcttaagcaccgcaacaccctc

SEQ ID NO: 111007 - DNA, 37 bp, Artificial Sequence
  Synthetic oligonucleotide
atgtcccccaccgctctacctagctcagtctttgcga

SEQ ID NO: 111008 - DNA, 35 bp, Artificial Sequence
  Synthetic oligonucleotide
aacgccaaccactgcaatcgtatatcccttcttgg

SEQ ID NO: 111009 - DNA, 35 bp, Artificial Sequence
  Synthetic oligonucleotide
ttgggacggaaaaaatggagggaaggcggccgggg

SEQ ID NO: 111010 - DNA, 37 bp, Artificial Sequence
  Synthetic oligonucleotide
gtgggcccgagagtcggggtgggcagtcgaatgggga

SEQ ID NO: 111011 - DNA, 37 bp, Artificial Sequence
  Synthetic oligonucleotide
tgacatctgccgcctcgcctctcggctgccccctgga

SEQ ID NO: 111012 - DNA, 35 bp, Artificial Sequence
  Synthetic oligonucleotide
gcttcgacccgccgtccatctgctcgccctaggcc

SEQ ID NO: 111013 - DNA, 37 bp, Artificial Sequence
  Synthetic oligonucleotide
gaaggacggggggagtgggggtagggctatctcggga

SEQ ID NO: 111014 - DNA, 35 bp, Artificial Sequence
  Synthetic oligonucleotide
gtgtcgcctctaaccgcatatagtttgccctccga

SEQ ID NO: 111015 - DNA, 35 bp, Artificial Sequence
  Synthetic oligonucleotide
gttcacgttcccacggtccttcccattcttggtcc

SEQ ID NO: 111016 - DNA, 35 bp, Artificial Sequence
  Synthetic oligonucleotide
agccgcccgccctgcccttcaaacacggttgtctc

SEQ ID NO: 111017 - DNA, 37 bp, Artificial Sequence
  Synthetic oligonucleotide
gtagggggggacgaggaaaaaaaggtggaaagacgga

SEQ ID NO: 111018 - DNA, 35 bp, Artificial Sequence
  Synthetic oligonucleotide
acgaccatcgtccattgcgccgttcttccttcata

SEQ ID NO: 111019 - DNA, 35 bp, Artificial Sequence
  Synthetic oligonucleotide
gccgcggatctgagtgaccgccatcccccccttcc

SEQ ID NO: 111020 - DNA, 35 bp, Artificial Sequence
  Synthetic oligonucleotide
acattcacgcgcctctccgagccttccctctccgc

SEQ ID NO: 111021 - DNA, 35 bp, Artificial Sequence
  Synthetic oligonucleotide
tctgtacagccgctaccgcccgtaactatccctgc

SEQ ID NO: 111022 - DNA, 35 bp, Artificial Sequence
  Synthetic oligonucleotide
acgacagacccggtgtctacactcttcctgccccc

SEQ ID NO: 111023 - DNA, 35 bp, Artificial Sequence
  Synthetic oligonucleotide
atagtgccgctgcccatcctgcctggttgctttcc

SEQ ID NO: 111024 - DNA, 35 bp, Artificial Sequence
  Synthetic oligonucleotide
gtcccgagcctcacaactctttcagccgctcccgc

SEQ ID NO: 111025 - DNA, 35 bp, Artificial Sequence
  Synthetic oligonucleotide
gcccactacgtgccgtcctgtcctccttcttcgtc

SEQ ID NO: 111026 - DNA, 37 bp, Artificial Sequence
  Synthetic oligonucleotide
acgagggggggagccggaaggggacaagggtggtcga

SEQ ID NO: 111027 - DNA, 38 bp, Artificial Sequence
  Synthetic oligonucleotide
gcacgtgcatctctgtccttgttctgttcccaccgtga

SEQ ID NO: 111028 - DNA, 35 bp, Artificial Sequence
  Synthetic oligonucleotide
accatgctgacacccagatgccgttcttgccccct

SEQ ID NO: 111029 - DNA, 35 bp, Artificial Sequence
  Synthetic oligonucleotide
tatcacggccgttgtccactgcctccgagtcccgc

SEQ ID NO: 111030 - DNA, 35 bp, Artificial Sequence
  Synthetic oligonucleotide
tcctgacgctcctcctttctgctacgggaacactc

SEQ ID NO: 111031 - DNA, 35 bp, Artificial Sequence
  Synthetic oligonucleotide
gtggggggggtggggtggttgtctggatggttctc

SEQ ID NO: 111032 - DNA, 35 bp, Artificial Sequence
  Synthetic oligonucleotide
gctggaatcagcacgcatatgacgtcttcccctac

SEQ ID NO: 111033 - DNA, 35 bp, Artificial Sequence
  Synthetic oligonucleotide
atcttagccccgtcctcgctgtcgaatgttccccc

SEQ ID NO: 111034 - DNA, 35 bp, Artificial Sequence
  Synthetic oligonucleotide
acagcacgccctcccgctgacccttcttgtagtcc

SEQ ID NO: 111035 - DNA, 37 bp, Artificial Sequence
  Synthetic oligonucleotide
gcgatcagttcagcacgtgccccttccatcctgccga

SEQ ID NO: 111036 - DNA, 35 bp, Artificial Sequence
  Synthetic oligonucleotide
tgcctccctctatgattaaccggccccatgacccc

SEQ ID NO: 111037 - DNA, 37 bp, Artificial Sequence
  Synthetic oligonucleotide
tctgtcatcccttccgctgattaacgcccatgcttga

SEQ ID NO: 111038 - DNA, 36 bp, Artificial Sequence
  Synthetic oligonucleotide
acctggtcagaggtccgtcttcgccctgtctcacta

SEQ ID NO: 111039 - DNA, 36 bp, Artificial Sequence
  Synthetic oligonucleotide
gtcacccgcaaatggcttcttacgctgaccccacca

SEQ ID NO: 111040 - DNA, 35 bp, Artificial Sequence
  Synthetic oligonucleotide
gagaggaggccgaacaataggggaggcgaggggta

SEQ ID NO: 111041 - DNA, 37 bp, Artificial Sequence
  Synthetic oligonucleotide
gctaaggggagtagggaggggacggttggggaactga

SEQ ID NO: 111042 - DNA, 35 bp, Artificial Sequence
  Synthetic oligonucleotide
tacaacccccgcccgtcgtagtcctcgattctctc

SEQ ID NO: 111043 - DNA, 35 bp, Artificial Sequence
  Synthetic oligonucleotide
ggagggtgtgacgggggggaagttgtcgggctgag

SEQ ID NO: 111044 - DNA, 35 bp, Artificial Sequence
  Synthetic oligonucleotide
gtgaaggagaattggtagggggaggggagggggcg

SEQ ID NO: 111045 - DNA, 36 bp, Artificial Sequence
  Synthetic oligonucleotide
ggaggagtgggcatctaaagggggacagggagcaga

SEQ ID NO: 111046 - DNA, 37 bp, Artificial Sequence
  Synthetic oligonucleotide
gcgtcccccccgcttgtccgtccaccatcgtctttga

SEQ ID NO: 111047 - DNA, 37 bp, Artificial Sequence
  Synthetic oligonucleotide
gtgcaccactggtctctgtccttcactatcccccgga

SEQ ID NO: 111048 - DNA, 35 bp, Artificial Sequence
  Synthetic oligonucleotide
cacacccccagcctcgcaccatccacccctccgag

SEQ ID NO: 111049 - DNA, 36 bp, Artificial Sequence
  Synthetic oligonucleotide
gtgagggcgggcggggagggaccatcggtgggacta

SEQ ID NO: 111050 - DNA, 36 bp, Artificial Sequence
  Synthetic oligonucleotide
tagccgtcatggaatcatcacctgtgcccgccccca

SEQ ID NO: 111051 - DNA, 37 bp, Artificial Sequence
  Synthetic oligonucleotide
gaacaaagacagggtaacggagcggaaggggagggga

SEQ ID NO: 111052 - DNA, 35 bp, Artificial Sequence
  Synthetic oligonucleotide
tgcttgtcacggctaagccacttctttctccctgt

SEQ ID NO: 111053 - DNA, 35 bp, Artificial Sequence
  Synthetic oligonucleotide
tacgccgttgcgccctatctatttcgtacatggtc

SEQ ID NO: 111054 - DNA, 35 bp, Artificial Sequence
  Synthetic oligonucleotide
agccacgatccgttttaatctccttcgcccgtgtc

SEQ ID NO: 111055 - DNA, 36 bp, Artificial Sequence
  Synthetic oligonucleotide
gcccccgtccggttcctctagtcagccgcaccaaca

SEQ ID NO: 111056 - DNA, 36 bp, Artificial Sequence
  Synthetic oligonucleotide
gatggtggagatcggaatgagggaggggcttggaga

SEQ ID NO: 111057 - DNA, 35 bp, Artificial Sequence
  Synthetic oligonucleotide
tcccccccggcctacgcacacgtaccatcgtaccc

SEQ ID NO: 111058 - DNA, 35 bp, Artificial Sequence
  Synthetic oligonucleotide
acaacgcttaccctgctcgctccccgtccttctcg

SEQ ID NO: 111059 - DNA, 37 bp, Artificial Sequence
  Synthetic oligonucleotide
gagtacgaccatctatcactgcgcctcccaaccccga

SEQ ID NO: 111060 - DNA, 35 bp, Artificial Sequence
  Synthetic oligonucleotide
ttggaacctgccctgaactggccttctacacactc

SEQ ID NO: 111061 - DNA, 37 bp, Artificial Sequence
  Synthetic oligonucleotide
agtcgaccccacatagcccagagcacccttccctcga

SEQ ID NO: 111062 - DNA, 37 bp, Artificial Sequence
  Synthetic oligonucleotide
gtgtcacgccatcggatccgccccctgccccagtcga

SEQ ID NO: 111063 - DNA, 36 bp, Artificial Sequence
  Synthetic oligonucleotide
gtggcgcaccgttgcgctatccttccttccatccaa

SEQ ID NO: 111064 - DNA, 36 bp, Artificial Sequence
  Synthetic oligonucleotide
tccagcaccgctatcttctgccatcagtccttccca

SEQ ID NO: 111065 - DNA, 35 bp, Artificial Sequence
  Synthetic oligonucleotide
agcgccccgttcgcatccgcactcctgttccctca

SEQ ID NO: 111066 - DNA, 35 bp, Artificial Sequence
  Synthetic oligonucleotide
agtctgcccgcagcagtccacggcccactttgtcc

SEQ ID NO: 111067 - DNA, 35 bp, Artificial Sequence
  Synthetic oligonucleotide
tgaccgtactgctccccgcatattgtcttctacgc

SEQ ID NO: 111068 - DNA, 35 bp, Artificial Sequence
  Synthetic oligonucleotide
gcaacccccagctctgtttgctacgcttacacctt

SEQ ID NO: 111069 - DNA, 36 bp, Artificial Sequence
  Synthetic oligonucleotide
atgcccccgtctcccattcgccgacctgttaccgca

SEQ ID NO: 111070 - DNA, 35 bp, Artificial Sequence
  Synthetic oligonucleotide
gagagcgggggtaaggagggagggaaaagaataag

SEQ ID NO: 111071 - DNA, 36 bp, Artificial Sequence
  Synthetic oligonucleotide
tgttgacgcagacctttgccgccgccctctttgtta

SEQ ID NO: 111072 - DNA, 35 bp, Artificial Sequence
  Synthetic oligonucleotide
acccccatgtacgagccgtttcactaagcctccct

SEQ ID NO: 111073 - DNA, 35 bp, Artificial Sequence
  Synthetic oligonucleotide
atccgaccctctgacctgtccacttacttggccca

SEQ ID NO: 111074 - DNA, 36 bp, Artificial Sequence
  Synthetic oligonucleotide
atacctccgcccctcattgcgacccccaccgtacga

SEQ ID NO: 111075 - DNA, 37 bp, Artificial Sequence
  Synthetic oligonucleotide
ggggggggggaggggagggacgggaagaagggcgtga

SEQ ID NO: 111076 - DNA, 37 bp, Artificial Sequence
  Synthetic oligonucleotide
gaccgtcccgccccgctgttcctccgtacgttattga

SEQ ID NO: 111077 - DNA, 37 bp, Artificial Sequence
  Synthetic oligonucleotide
gacgccttccgtttgcgcctttgactcgtgcccttga

SEQ ID NO: 111078 - DNA, 35 bp, Artificial Sequence
  Synthetic oligonucleotide
tgggtctgctctcgttcgcgctctacccacacttc

SEQ ID NO: 111079 - DNA, 36 bp, Artificial Sequence
  Synthetic oligonucleotide
atccacccctcagatgccataattaatcgcccccca

SEQ ID NO: 111080 - DNA, 36 bp, Artificial Sequence
  Synthetic oligonucleotide
gcagacaagggaccggggtgataggaagggggcgga

SEQ ID NO: 111081 - DNA, 35 bp, Artificial Sequence
  Synthetic oligonucleotide
atcactcccctcgcccattggtgacgaagttgccc

SEQ ID NO: 111082 - DNA, 35 bp, Artificial Sequence
  Synthetic oligonucleotide
tcgacccactctcgagcgattgccttccccgtttc

SEQ ID NO: 111083 - DNA, 35 bp, Artificial Sequence
  Synthetic oligonucleotide
gagcgggtgggcgtggagggggggctaacgtttga

SEQ ID NO: 111084 - DNA, 35 bp, Artificial Sequence
  Synthetic oligonucleotide
tttgtcctgcctagtgtgctcctgctttcccttac

SEQ ID NO: 111085 - DNA, 35 bp, Artificial Sequence
  Synthetic oligonucleotide
ttgccgttgcagagctccccccgttcctctattca

SEQ ID NO: 111086 - DNA, 35 bp, Artificial Sequence
  Synthetic oligonucleotide
gccggagcacaacgggtcttggtcctgcttcctct

SEQ ID NO: 111087 - DNA, 37 bp, Artificial Sequence
  Synthetic oligonucleotide
atgaggggggggatcgggcgggtagggcacggggaga

SEQ ID NO: 111088 - DNA, 35 bp, Artificial Sequence
  Synthetic oligonucleotide
gaggacatgggagggaaatgagaggtgaatggtgg

SEQ ID NO: 111089 - DNA, 35 bp, Artificial Sequence
  Synthetic oligonucleotide
tgcaccttccaggcataaccgtaccccctggccca

SEQ ID NO: 111090 - DNA, 35 bp, Artificial Sequence
  Synthetic oligonucleotide
gctgattgctcgcacgccatgcaccaccggtgttc

SEQ ID NO: 111091 - DNA, 35 bp, Artificial Sequence
  Synthetic oligonucleotide
acagggcaaatgccacgtccgctccactccctctg

SEQ ID NO: 111092 - DNA, 35 bp, Artificial Sequence
  Synthetic oligonucleotide
tgaacacccccgccactgtacttaactaatagtcc

SEQ ID NO: 111093 - DNA, 35 bp, Artificial Sequence
  Synthetic oligonucleotide
tccgcctcctcttgcgcttccagcagaattgcacc

SEQ ID NO: 111094 - DNA, 35 bp, Artificial Sequence
  Synthetic oligonucleotide
tgcgcgcttagccgttccatccgccttcttaatcg

SEQ ID NO: 111095 - DNA, 37 bp, Artificial Sequence
  Synthetic oligonucleotide
gattgcgttaacatgcctctgccgctccaccctccga

SEQ ID NO: 111096 - DNA, 35 bp, Artificial Sequence
  Synthetic oligonucleotide
tcgacgcccggctcactgtcgtccgtaatgccccc

SEQ ID NO: 111097 - DNA, 35 bp, Artificial Sequence
  Synthetic oligonucleotide
accaccagtccggctcgtctctaccacccttggcg

SEQ ID NO: 111098 - DNA, 35 bp, Artificial Sequence
  Synthetic oligonucleotide
gaacgccctgcctccctctccgtgttggtccatga

SEQ ID NO: 111099 - DNA, 34 bp, Artificial Sequence
  Synthetic oligonucleotide
ttccccgcctgcctcatccctcaagagtcctccc

SEQ ID NO: 111100 - DNA, 35 bp, Artificial Sequence
  Synthetic oligonucleotide
gacgggggaaggagagaaggacggagcgtgtaggg

SEQ ID NO: 111101 - DNA, 36 bp, Artificial Sequence
  Synthetic oligonucleotide
acccgcctccgaaccgcttcaccctcccagcttgca

SEQ ID NO: 111102 - DNA, 36 bp, Artificial Sequence
  Synthetic oligonucleotide
ttgtccgccaccattttgttccttctcccctatgga

SEQ ID NO: 111103 - DNA, 35 bp, Artificial Sequence
  Synthetic oligonucleotide
tgcaacggccacaacttcctatccacgcctgtcta

SEQ ID NO: 111104 - DNA, 37 bp, Artificial Sequence
  Synthetic oligonucleotide
gatgccgccctgtcccttgttccatctcgctatctga

SEQ ID NO: 111105 - DNA, 35 bp, Artificial Sequence
  Synthetic oligonucleotide
atgcgccacgcatggcaatctagcctatacttcct

SEQ ID NO: 111106 - DNA, 36 bp, Artificial Sequence
  Synthetic oligonucleotide
gatgtgcaccaccaccctgcttccgcgtgaccccaa

SEQ ID NO: 111107 - DNA, 34 bp, Artificial Sequence
  Synthetic oligonucleotide
acccgcctcggagtggcgttttccgacccctaca

SEQ ID NO: 111108 - DNA, 38 bp, Artificial Sequence
  Synthetic oligonucleotide
tctaggtgcgggtgggggcatgaggagggaaggggtga

SEQ ID NO: 111109 - DNA, 35 bp, Artificial Sequence
  Synthetic oligonucleotide
gcatgcccattggtcttctcgaatagccccgcacc

SEQ ID NO: 111110 - DNA, 37 bp, Artificial Sequence
  Synthetic oligonucleotide
gtgagggaggggctatggaagggagtggtgaggcaga

SEQ ID NO: 111111 - DNA, 35 bp, Artificial Sequence
  Synthetic oligonucleotide
gctcgcagtgcccgcccttctcctgtagcctgtac

SEQ ID NO: 111112 - DNA, 38 bp, Artificial Sequence
  Synthetic oligonucleotide
gtgacatccctatgctgcctttccgtgtctccccgtga

SEQ ID NO: 111113 - DNA, 35 bp, Artificial Sequence
  Synthetic oligonucleotide
ttacccccctctgcctcgactgtcccagtgctatc

SEQ ID NO: 111114 - DNA, 35 bp, Artificial Sequence
  Synthetic oligonucleotide
gacctgacccctgccatcggtttcatctgtccttc

SEQ ID NO: 111115 - DNA, 35 bp, Artificial Sequence
  Synthetic oligonucleotide
acacagccccgcacccacattcgtcttattatgcc

SEQ ID NO: 111116 - DNA, 35 bp, Artificial Sequence
  Synthetic oligonucleotide
tttggcggccgcccacacctctgcttctctccttg

SEQ ID NO: 111117 - DNA, 35 bp, Artificial Sequence
  Synthetic oligonucleotide
ttcccgcctcgaacgactttatagctagctccatc

SEQ ID NO: 111118 - DNA, 35 bp, Artificial Sequence
  Synthetic oligonucleotide
agccatcctccgccttgtcgtgtcacgatccgttc

SEQ ID NO: 111119 - DNA, 37 bp, Artificial Sequence
  Synthetic oligonucleotide
gatgagtcggagagggagggggctggttaggggcgga

SEQ ID NO: 111120 - DNA, 35 bp, Artificial Sequence
  Synthetic oligonucleotide
agcccatccgccgcctatcgccaactagactccag

SEQ ID NO: 111121 - DNA, 35 bp, Artificial Sequence
  Synthetic oligonucleotide
tcatctgcgttccacaatctgccatgctccccctg

SEQ ID NO: 111122 - DNA, 37 bp, Artificial Sequence
  Synthetic oligonucleotide
gtgggtgggtggggggataggggaaagacaggtgcga

SEQ ID NO: 111123 - DNA, 35 bp, Artificial Sequence
  Synthetic oligonucleotide
ttcgccgttcgctcgtgcttcctcgccattacgtc

SEQ ID NO: 111124 - DNA, 35 bp, Artificial Sequence
  Synthetic oligonucleotide
gtccacccgcaactgagctcactaccttgaccgac

SEQ ID NO: 111125 - DNA, 35 bp, Artificial Sequence
  Synthetic oligonucleotide
gccaacacccagctcctccccagctgccctactgg

SEQ ID NO: 111126 - DNA, 36 bp, Artificial Sequence
  Synthetic oligonucleotide
attggccgtgctctctcgttgttcgttcttccccta

SEQ ID NO: 111127 - DNA, 36 bp, Artificial Sequence
  Synthetic oligonucleotide
aacgccttagccaccattgtcccacttgcacctcta

SEQ ID NO: 111128 - DNA, 35 bp, Artificial Sequence
  Synthetic oligonucleotide
tccccacgcccccatgaaagcccagcccttacagt

SEQ ID NO: 111129 - DNA, 35 bp, Artificial Sequence
  Synthetic oligonucleotide
tgagggcgggccgggagggagtaatgccgctctcc

SEQ ID NO: 111130 - DNA, 35 bp, Artificial Sequence
  Synthetic oligonucleotide
gtacatccccccgcactgtcgtcgccctctcacct

SEQ ID NO: 111131 - DNA, 35 bp, Artificial Sequence
  Synthetic oligonucleotide
gccgggtcacctcttgcgatacgttgttcctctgt

SEQ ID NO: 111132 - DNA, 35 bp, Artificial Sequence
  Synthetic oligonucleotide
tgcgatgcgcattcgccctcatcagcccctctgca

SEQ ID NO: 111133 - DNA, 35 bp, Artificial Sequence
  Synthetic oligonucleotide
tcgccacgcaccaccacgatcgccccagccccctc

SEQ ID NO: 111134 - DNA, 35 bp, Artificial Sequence
  Synthetic oligonucleotide
gcatgctccgtatcgtctctcgtacctcgcacctt

SEQ ID NO: 111135 - DNA, 35 bp, Artificial Sequence
  Synthetic oligonucleotide
atgtcatgggaggggatagtgggggaggaggaaca

SEQ ID NO: 111136 - DNA, 36 bp, Artificial Sequence
  Synthetic oligonucleotide
gtgcgccttcccatgtctcagatcacggctctctca

SEQ ID NO: 111137 - DNA, 37 bp, Artificial Sequence
  Synthetic oligonucleotide
gggggaacgcggattggtagtcaagggaggtggggga

SEQ ID NO: 111138 - DNA, 38 bp, Artificial Sequence
  Synthetic oligonucleotide
gagggtgggaaagaaggttgggaaagggatgagggtga

SEQ ID NO: 111139 - DNA, 35 bp, Artificial Sequence
  Synthetic oligonucleotide
gccgccaccacgctcctatcgctcctcctacgtcg

SEQ ID NO: 111140 - DNA, 36 bp, Artificial Sequence
  Synthetic oligonucleotide
accccgttcaacctgcttttgatccttcctaccgaa

SEQ ID NO: 111141 - DNA, 35 bp, Artificial Sequence
  Synthetic oligonucleotide
acttggagaggtgggggggacggattggtggccag

SEQ ID NO: 111142 - DNA, 35 bp, Artificial Sequence
  Synthetic oligonucleotide
acgcgtatccgccgacacctgctagcccacctccg

SEQ ID NO: 111143 - DNA, 35 bp, Artificial Sequence
  Synthetic oligonucleotide
ttcccaccatccgttcccgaagcagtattgcctgt

SEQ ID NO: 111144 - DNA, 35 bp, Artificial Sequence
  Synthetic oligonucleotide
atgccccatcccaaaggtgattgtttcatgccccc

SEQ ID NO: 111145 - DNA, 35 bp, Artificial Sequence
  Synthetic oligonucleotide
tagcgcccttcccgacctatcgttccctgtggcct

SEQ ID NO: 111146 - DNA, 34 bp, Artificial Sequence
  Synthetic oligonucleotide
gcatgacaacgcccgtaccacctttacctccatc

SEQ ID NO: 111147 - DNA, 37 bp, Artificial Sequence
  Synthetic oligonucleotide
tctcgcccgcccacgcatatgttcaccgttttcccga

SEQ ID NO: 111148 - DNA, 35 bp, Artificial Sequence
  Synthetic oligonucleotide
gtccccgccccaagtgtatcgcatcgtttctcatt

SEQ ID NO: 111149 - DNA, 37 bp, Artificial Sequence
  Synthetic oligonucleotide
acctctgcccctgctccgtactcttgcttgttgcaga

SEQ ID NO: 111150 - DNA, 36 bp, Artificial Sequence
  Synthetic oligonucleotide
gataggacagaggaagtgggtgggtgagcgggggga

SEQ ID NO: 111151 - DNA, 36 bp, Artificial Sequence
  Synthetic oligonucleotide
tagccgccacgccgcccttaactactggtgatccca

SEQ ID NO: 111152 - DNA, 35 bp, Artificial Sequence
  Synthetic oligonucleotide
aggaccgccctctacttggtaactccgccccagcc

SEQ ID NO: 111153 - DNA, 35 bp, Artificial Sequence
  Synthetic oligonucleotide
tgtgtggtctagggggaaaatggggaagggagtaa

SEQ ID NO: 111154 - DNA, 36 bp, Artificial Sequence
  Synthetic oligonucleotide
tgtgccgtcacctgttagtccgtcgccgctatccca

SEQ ID NO: 111155 - DNA, 36 bp, Artificial Sequence
  Synthetic oligonucleotide
gccacatgccattggcttaacacctacgccctgcca

SEQ ID NO: 111156 - DNA, 35 bp, Artificial Sequence
  Synthetic oligonucleotide
aacactgacgccccctttgctatgctttcagttta

SEQ ID NO: 111157 - DNA, 35 bp, Artificial Sequence
  Synthetic oligonucleotide
aacctcagatgtacccggtctgatcgcctttccct

SEQ ID NO: 111158 - DNA, 35 bp, Artificial Sequence
  Synthetic oligonucleotide
ttggtccctcctgctgcccttttaagtttaaacct

SEQ ID NO: 111159 - DNA, 37 bp, Artificial Sequence
  Synthetic oligonucleotide
gtgactcgccccatgctccaccgtatgtaccattcga

SEQ ID NO: 111160 - DNA, 35 bp, Artificial Sequence
  Synthetic oligonucleotide
cacacctccccatcccagtggatccctcttaggga

SEQ ID NO: 111161 - DNA, 35 bp, Artificial Sequence
  Synthetic oligonucleotide
gtccacttccgctgttcactagtctgcgcataacc

SEQ ID NO: 111162 - DNA, 35 bp, Artificial Sequence
  Synthetic oligonucleotide
aaccgccacctcacatcgtgtcgaattcacttccc

SEQ ID NO: 111163 - DNA, 35 bp, Artificial Sequence
  Synthetic oligonucleotide
ggacaaccgcgtctgcctctgcccgttcgacccac

SEQ ID NO: 111164 - DNA, 35 bp, Artificial Sequence
  Synthetic oligonucleotide
gttgctcaccgtctcagcttttttgtccccttcgg

SEQ ID NO: 111165 - DNA, 35 bp, Artificial Sequence
  Synthetic oligonucleotide
gccccaaccgtcccgaactgcgctttcctccctcc

SEQ ID NO: 111166 - DNA, 35 bp, Artificial Sequence
  Synthetic oligonucleotide
gtccccatcaggaactgtttcacgccacactatct

SEQ ID NO: 111167 - DNA, 37 bp, Artificial Sequence
  Synthetic oligonucleotide
tgcccatgcctcctgccgtttcccgattcccagtgga

SEQ ID NO: 111168 - DNA, 34 bp, Artificial Sequence
  Synthetic oligonucleotide
gcatagtcacagtctttcctttacccatctctcg

SEQ ID NO: 111169 - DNA, 35 bp, Artificial Sequence
  Synthetic oligonucleotide
ttcagaacggcccactgttgctttactccccttcc

SEQ ID NO: 111170 - DNA, 35 bp, Artificial Sequence
  Synthetic oligonucleotide
tcgccacccgtcctatccgccccagacgttgccac

SEQ ID NO: 111171 - DNA, 35 bp, Artificial Sequence
  Synthetic oligonucleotide
atcctatccgtcccagactacgtaatcatgctgcc

SEQ ID NO: 111172 - DNA, 35 bp, Artificial Sequence
  Synthetic oligonucleotide
tcccgctgtcccggccggccctccgcacacttctc

SEQ ID NO: 111173 - DNA, 37 bp, Artificial Sequence
  Synthetic oligonucleotide
gttacgagccggaggaaagtgaatggggagtggacga

SEQ ID NO: 111174 - DNA, 35 bp, Artificial Sequence
  Synthetic oligonucleotide
gtacgttcagtgctcgtcccccgcctctaaatata

SEQ ID NO: 111175 - DNA, 35 bp, Artificial Sequence
  Synthetic oligonucleotide
tgtgagcgcacacggcccattgatcttgtttccat

SEQ ID NO: 111176 - DNA, 35 bp, Artificial Sequence
  Synthetic oligonucleotide
accgccacaccctcatatcatttgttctcgccgtt

SEQ ID NO: 111177 - DNA, 35 bp, Artificial Sequence
  Synthetic oligonucleotide
gccaccactctggtcctgccacaactccatcttcc

SEQ ID NO: 111178 - DNA, 35 bp, Artificial Sequence
  Synthetic oligonucleotide
acagacctgcgatgctggtctcccctgttccttgc

SEQ ID NO: 111179 - DNA, 35 bp, Artificial Sequence
  Synthetic oligonucleotide
ttcacctgctgatcccgtttctggtccttgctctc

SEQ ID NO: 111180 - DNA, 35 bp, Artificial Sequence
  Synthetic oligonucleotide
tccgtcccttcaccggccattaccgtacttcggtc

SEQ ID NO: 111181 - DNA, 35 bp, Artificial Sequence
  Synthetic oligonucleotide
tcatcaccttcacgccttttgggtctttagccttc

SEQ ID NO: 111182 - DNA, 35 bp, Artificial Sequence
  Synthetic oligonucleotide
gagctcatcgccccctcgtgcacactacacgctcg

SEQ ID NO: 111183 - DNA, 37 bp, Artificial Sequence
  Synthetic oligonucleotide
ttgggcggggccttcacctggggaaagaattagggga

SEQ ID NO: 111184 - DNA, 36 bp, Artificial Sequence
  Synthetic oligonucleotide
agcccacgcattgggttttgtctcctcgccctgtta

SEQ ID NO: 111185 - DNA, 35 bp, Artificial Sequence
  Synthetic oligonucleotide
accgcaagcgctgaaggtacgccccctcatctcgc

SEQ ID NO: 111186 - DNA, 35 bp, Artificial Sequence
  Synthetic oligonucleotide
tcactctgagagcatatccagggcccttcctcctc

SEQ ID NO: 111187 - DNA, 35 bp, Artificial Sequence
  Synthetic oligonucleotide
gcgccttcccagtcctatccatcggtcccccgctc

SEQ ID NO: 111188 - DNA, 35 bp, Artificial Sequence
  Synthetic oligonucleotide
gcactgtattgccgcctcgcccttcgttttttctg

SEQ ID NO: 111189 - DNA, 35 bp, Artificial Sequence
  Synthetic oligonucleotide
tccgccggagtccttatcagcatcacgtccctgct

SEQ ID NO: 111190 - DNA, 33 bp, Artificial Sequence
  Synthetic oligonucleotide
agccccaccccactcgcgtactttatggcctaa

SEQ ID NO: 111191 - DNA, 35 bp, Artificial Sequence
  Synthetic oligonucleotide
gttgccctgcctcaatcttgcttgcccctggtctc

SEQ ID NO: 111192 - DNA, 35 bp, Artificial Sequence
  Synthetic oligonucleotide
gcacccccacgattacacgcgttcgctacctcctg

SEQ ID NO: 111193 - DNA, 36 bp, Artificial Sequence
  Synthetic oligonucleotide
gcccatcctggtgtcttccttcctctcgtacttgga

SEQ ID NO: 111194 - DNA, 36 bp, Artificial Sequence
  Synthetic oligonucleotide
agaccacccgcccgttactatcccctgcatgattca

SEQ ID NO: 111195 - DNA, 37 bp, Artificial Sequence
  Synthetic oligonucleotide
taccgggccagggggagaaggatgggagggggacaga

SEQ ID NO: 111196 - DNA, 35 bp, Artificial Sequence
  Synthetic oligonucleotide
accacctcgcgcgaagttattggcgcatgtccccc

SEQ ID NO: 111197 - DNA, 35 bp, Artificial Sequence
  Synthetic oligonucleotide
gtcaccccaatacttcaccgtcatttcaatccggg

SEQ ID NO: 111198 - DNA, 35 bp, Artificial Sequence
  Synthetic oligonucleotide
gcccacgtggcaactgttcccagccgttcccaccc

SEQ ID NO: 111199 - DNA, 35 bp, Artificial Sequence
  Synthetic oligonucleotide
tgcaccccgttcactatcgatcccccttatggcaa

SEQ ID NO: 111200 - DNA, 33 bp, Artificial Sequence
  Synthetic oligonucleotide
gttacgctcgcccccagccgcggttctctctta

SEQ ID NO: 111201 - DNA, 35 bp, Artificial Sequence
  Synthetic oligonucleotide
tctctgcctcccgcatctatacctcgtggactctc

SEQ ID NO: 111202 - DNA, 36 bp, Artificial Sequence
  Synthetic oligonucleotide
ttgccccggtcgccaatgcctcgccccctttacgca

SEQ ID NO: 111203 - DNA, 37 bp, Artificial Sequence
  Synthetic oligonucleotide
gttgcccccggacacgtcccgccttatctaccgccga

SEQ ID NO: 111204 - DNA, 35 bp, Artificial Sequence
  Synthetic oligonucleotide
gcacgttcactcctgcctcctcgctctgagttgcc

SEQ ID NO: 111205 - DNA, 35 bp, Artificial Sequence
  Synthetic oligonucleotide
gtagcctcgcccctcactttaccaagcctggttac

SEQ ID NO: 111206 - DNA, 35 bp, Artificial Sequence
  Synthetic oligonucleotide
tatgtgctgcccctctggcgtttccgctacaccct

SEQ ID NO: 111207 - DNA, 38 bp, Artificial Sequence
  Synthetic oligonucleotide
tgactcccgtcgcgatgtccttccgcccgttttcctga

SEQ ID NO: 111208 - DNA, 35 bp, Artificial Sequence
  Synthetic oligonucleotide
taacccgctatctggattccctcccgcctccgtgc

SEQ ID NO: 111209 - DNA, 35 bp, Artificial Sequence
  Synthetic oligonucleotide
gcctcaccccgccacacttgcttaactcgcaagag

SEQ ID NO: 111210 - DNA, 37 bp, Artificial Sequence
  Synthetic oligonucleotide
gcacgcgaccgatcgactcacgccctccctgccctca

SEQ ID NO: 111211 - DNA, 37 bp, Artificial Sequence
  Synthetic oligonucleotide
aaagggggctacgaggggcacgagtctgggtggggga

SEQ ID NO: 111212 - DNA, 35 bp, Artificial Sequence
  Synthetic oligonucleotide
tgagtgcgagtgccgggttcaatgcgtcccccccc

SEQ ID NO: 111213 - DNA, 35 bp, Artificial Sequence
  Synthetic oligonucleotide
gtcgtacctcccacgctttctatgcacatgtctcg

SEQ ID NO: 111214 - DNA, 35 bp, Artificial Sequence
  Synthetic oligonucleotide
gaccccagcccacacccccatcgccgacttcagga

SEQ ID NO: 111215 - DNA, 35 bp, Artificial Sequence
  Synthetic oligonucleotide
acaacccatcggcccccccctcgcgcgcgcccgcc

SEQ ID NO: 111216 - DNA, 35 bp, Artificial Sequence
  Synthetic oligonucleotide
gtccactcatccgccactgcgttaaatctcccccc

SEQ ID NO: 111217 - DNA, 35 bp, Artificial Sequence
  Synthetic oligonucleotide
gccatgcctgaacagtaccccgcgccagtttcccc

SEQ ID NO: 111218 - DNA, 35 bp, Artificial Sequence
  Synthetic oligonucleotide
gcacctccgttgatgcgtcagcccgccgctcttct

SEQ ID NO: 111219 - DNA, 37 bp, Artificial Sequence
  Synthetic oligonucleotide
tttggggcgggcggggaacctgacatgatacggggga

SEQ ID NO: 111220 - DNA, 37 bp, Artificial Sequence
  Synthetic oligonucleotide
tcagggtgaaggaagggaagggggatgcggtcatgga

SEQ ID NO: 111221 - DNA, 38 bp, Artificial Sequence
  Synthetic oligonucleotide
tgaccaccgtgctccgcctctatgaccgcccttcctga

SEQ ID NO: 111222 - DNA, 35 bp, Artificial Sequence
  Synthetic oligonucleotide
tcccgacgtcaccagtccctccataggttctcgcc

SEQ ID NO: 111223 - DNA, 35 bp, Artificial Sequence
  Synthetic oligonucleotide
attccccgcaggtcaacatgcttccgttaccctcg

SEQ ID NO: 111224 - DNA, 37 bp, Artificial Sequence
  Synthetic oligonucleotide
gaatgggaggagcgaggggcatagggcgggtggatga

SEQ ID NO: 111225 - DNA, 37 bp, Artificial Sequence
  Synthetic oligonucleotide
actgcacccctccagcgcctatactaccttcatctga

SEQ ID NO: 111226 - DNA, 35 bp, Artificial Sequence
  Synthetic oligonucleotide
ttggccgcccgtatcatcgcccatgcccacctccg

SEQ ID NO: 111227 - DNA, 35 bp, Artificial Sequence
  Synthetic oligonucleotide
gtccagtgtcacatctagccaccatctgtaccgcc

SEQ ID NO: 111228 - DNA, 35 bp, Artificial Sequence
  Synthetic oligonucleotide
attgcgccctcacggttgatcgtacttgctatctt

SEQ ID NO: 111229 - DNA, 36 bp, Artificial Sequence
  Synthetic oligonucleotide
tccgcgcatccctgtctcctttgttccgtttctaca

SEQ ID NO: 111230 - DNA, 35 bp, Artificial Sequence
  Synthetic oligonucleotide
cccgacgcctcacctttcgcgcctcccccgccgac

SEQ ID NO: 111231 - DNA, 35 bp, Artificial Sequence
  Synthetic oligonucleotide
ggaggtcgtccagccggccttccttctttcgaatc

SEQ ID NO: 111232 - DNA, 38 bp, Artificial Sequence
  Synthetic oligonucleotide
tcaacgccccgtacaatttgcctctgtgctccctctga

SEQ ID NO: 111233 - DNA, 35 bp, Artificial Sequence
  Synthetic oligonucleotide
gcgccggccaccacccctttagcctccgatctccg

SEQ ID NO: 111234 - DNA, 35 bp, Artificial Sequence
  Synthetic oligonucleotide
taggaccactcccgtttctatatgccctttgctct

SEQ ID NO: 111235 - DNA, 35 bp, Artificial Sequence
  Synthetic oligonucleotide
atccgattccctcctgtttgtttgcgttgccccac

SEQ ID NO: 111236 - DNA, 35 bp, Artificial Sequence
  Synthetic oligonucleotide
gtccgagctctctcgcccatctgtaatgtaccctc

SEQ ID NO: 111237 - DNA, 36 bp, Artificial Sequence
  Synthetic oligonucleotide
tctcatcgccctctggtcatcttgcactcatcccca

SEQ ID NO: 111238 - DNA, 37 bp, Artificial Sequence
  Synthetic oligonucleotide
ggagggcgggaggtgggtggatagcaggaggaggaga

SEQ ID NO: 111239 - DNA, 37 bp, Artificial Sequence
  Synthetic oligonucleotide
taccaccacctgatgccgccgcacctttagtccatga

SEQ ID NO: 111240 - DNA, 28 bp, Artificial Sequence
  Synthetic oligonucleotide
ttaccgttgccccgccctcaatcgctga

SEQ ID NO: 111241 - DNA, 37 bp, Artificial Sequence
  Synthetic oligonucleotide
tccgacaggaaaaagcaggggatagggaaaggggtga

SEQ ID NO: 111242 - DNA, 35 bp, Artificial Sequence
  Synthetic oligonucleotide
actcccaccgctttctgtgctccattggtgattac

SEQ ID NO: 111243 - DNA, 35 bp, Artificial Sequence
  Synthetic oligonucleotide
tcactcctacgttgctgtacccgcccctttcgatc

SEQ ID NO: 111244 - DNA, 35 bp, Artificial Sequence
  Synthetic oligonucleotide
gtcctgccacccatgggtcttttcgtatcttatct

SEQ ID NO: 111245 - DNA, 35 bp, Artificial Sequence
  Synthetic oligonucleotide
gattttgcccccccgtgttgtactcgcacctcctt

SEQ ID NO: 111246 - DNA, 35 bp, Artificial Sequence
  Synthetic oligonucleotide
gagtacccgccccactctttagaatagttccatac

SEQ ID NO: 111247 - DNA, 35 bp, Artificial Sequence
  Synthetic oligonucleotide
atgagcgccaccgcctgctgtaatactccccgtac

SEQ ID NO: 111248 - DNA, 35 bp, Artificial Sequence
  Synthetic oligonucleotide
gacctccgccaatctttaccgtccactcttggggc

SEQ ID NO: 111249 - DNA, 35 bp, Artificial Sequence
  Synthetic oligonucleotide
gacccgccgccgtcgccccccggtgtccgtttatt

SEQ ID NO: 111250 - DNA, 36 bp, Artificial Sequence
  Synthetic oligonucleotide
gccctcacctccgaatccgcctttcagagccgccca

SEQ ID NO: 111251 - DNA, 37 bp, Artificial Sequence
  Synthetic oligonucleotide
ttcaaccccctgtgctacatccgccgacttccccgga

SEQ ID NO: 111252 - DNA, 35 bp, Artificial Sequence
  Synthetic oligonucleotide
acgctgcccgactcctgttcccgtccgaccgcgcc

SEQ ID NO: 111253 - DNA, 35 bp, Artificial Sequence
  Synthetic oligonucleotide
atccctgccgcatccctatatggtgcaacccttcc

SEQ ID NO: 111254 - DNA, 35 bp, Artificial Sequence
  Synthetic oligonucleotide
atccaccacctgtctcacgccattgaagcgtatcg

SEQ ID NO: 111255 - DNA, 36 bp, Artificial Sequence
  Synthetic oligonucleotide
atcgccgcccctcacaacgcccccccctcagagcca

SEQ ID NO: 111256 - DNA, 33 bp, Artificial Sequence
  Synthetic oligonucleotide
tccagcattcaccatgcccttctgtgccttgcc

SEQ ID NO: 111257 - DNA, 35 bp, Artificial Sequence
  Synthetic oligonucleotide
gggtggcgggggggttttgcggatggcacatctcg

SEQ ID NO: 111258 - DNA, 38 bp, Artificial Sequence
  Synthetic oligonucleotide
tccgcccaggccccccggcgtgcattctactcccttga

SEQ ID NO: 111259 - DNA, 35 bp, Artificial Sequence
  Synthetic oligonucleotide
acacgcagacggagggcgatcgggggggaaatggg

SEQ ID NO: 111260 - DNA, 36 bp, Artificial Sequence
  Synthetic oligonucleotide
atttgaggctgggtgcttatgtggaggtcggggtga

SEQ ID NO: 111261 - DNA, 35 bp, Artificial Sequence
  Synthetic oligonucleotide
gctctacccacgaatggtcctcagatctgctccac

SEQ ID NO: 111262 - DNA, 34 bp, Artificial Sequence
  Synthetic oligonucleotide
gtggtcagtcagtccaacctgtcccctgtacctg

SEQ ID NO: 111263 - DNA, 35 bp, Artificial Sequence
  Synthetic oligonucleotide
tcacgccccgtacgctcaccctctctttgatcgct

SEQ ID NO: 111264 - DNA, 35 bp, Artificial Sequence
  Synthetic oligonucleotide
tcctcacccatagaactgcacccactgcttcctac

SEQ ID NO: 111265 - DNA, 35 bp, Artificial Sequence
  Synthetic oligonucleotide
gcccggcctccctcgttgctcccctgttcactgtg

SEQ ID NO: 111266 - DNA, 35 bp, Artificial Sequence
  Synthetic oligonucleotide
acgcactgtgttttcgctccgttggcccctctcca

SEQ ID NO: 111267 - DNA, 35 bp, Artificial Sequence
  Synthetic oligonucleotide
tcatcactgatctatgcctgtcttaccgactcccg

SEQ ID NO: 111268 - DNA, 38 bp, Artificial Sequence
  Synthetic oligonucleotide
gagccaccttccttgcgatacccgctgttctcccgtga

SEQ ID NO: 111269 - DNA, 35 bp, Artificial Sequence
  Synthetic oligonucleotide
acgatctaccgcccatgcatgtccgccacttgccc

SEQ ID NO: 111270 - DNA, 35 bp, Artificial Sequence
  Synthetic oligonucleotide
accccgcgcccctatctttgttccgcctatacccg

SEQ ID NO: 111271 - DNA, 38 bp, Artificial Sequence
  Synthetic oligonucleotide
gggaggagggaacgcggtgaggaggaacggaggggtga

SEQ ID NO: 111272 - DNA, 35 bp, Artificial Sequence
  Synthetic oligonucleotide
gatctccgccatctataccatggacactgctttac

SEQ ID NO: 111273 - DNA, 34 bp, Artificial Sequence
  Synthetic oligonucleotide
gcacgagccgcctctgccgccccaggaaatatcc

SEQ ID NO: 111274 - DNA, 37 bp, Artificial Sequence
  Synthetic oligonucleotide
tccccacctcgcattgccacccaccaccggttctcga

SEQ ID NO: 111275 - DNA, 37 bp, Artificial Sequence
  Synthetic oligonucleotide
agggcggggcgaggcattaggggttatctcatgggga

SEQ ID NO: 111276 - DNA, 35 bp, Artificial Sequence
  Synthetic oligonucleotide
tgtcaacctcccttggtcccatgtacagccctgtt

SEQ ID NO: 111277 - DNA, 35 bp, Artificial Sequence
  Synthetic oligonucleotide
gggagggacggaagggatggccgggcggggggttt

SEQ ID NO: 111278 - DNA, 38 bp, Artificial Sequence
  Synthetic oligonucleotide
gagggtggagaggggtgagggactatcgggtcatgtga

SEQ ID NO: 111279 - DNA, 36 bp, Artificial Sequence
  Synthetic oligonucleotide
gccacgccgtgcctcccccgcccatcgtaaattcga

SEQ ID NO: 111280 - DNA, 37 bp, Artificial Sequence
  Synthetic oligonucleotide
atgtccgccgtccgtccgaacttgccgcctaccttga

SEQ ID NO: 111281 - DNA, 36 bp, Artificial Sequence
  Synthetic oligonucleotide
gcccgccacctgcggcttcttggacccatctcacca

SEQ ID NO: 111282 - DNA, 35 bp, Artificial Sequence
  Synthetic oligonucleotide
taccagggcgggaaggggcgggacttgcgcttaag

SEQ ID NO: 111283 - DNA, 35 bp, Artificial Sequence
  Synthetic oligonucleotide
gattgcactgcgctgtgtcctgtcaattcgccctt

SEQ ID NO: 111284 - DNA, 35 bp, Artificial Sequence
  Synthetic oligonucleotide
aatgcctggcgcccctccccgtactaacgaccggc

SEQ ID NO: 111285 - DNA, 35 bp, Artificial Sequence
  Synthetic oligonucleotide
tgaactcaacgccccccgcctaccacccctactgg

SEQ ID NO: 111286 - DNA, 36 bp, Artificial Sequence
  Synthetic oligonucleotide
aagacgccccaccacatgactcgaatcgccgttcca

SEQ ID NO: 111287 - DNA, 35 bp, Artificial Sequence
  Synthetic oligonucleotide
ttcaacccgccctgccgtattggcacccccccatt

SEQ ID NO: 111288 - DNA, 35 bp, Artificial Sequence
  Synthetic oligonucleotide
atgcacacaccccctgctactcgtcaagagccctt

SEQ ID NO: 111289 - DNA, 36 bp, Artificial Sequence
  Synthetic oligonucleotide
tgttgcatccaatctgtcgtactcctccgcttatca

SEQ ID NO: 111290 - DNA, 37 bp, Artificial Sequence
  Synthetic oligonucleotide
tgaggggggagggtgaaatggggcggggttagtgaga

SEQ ID NO: 111291 - DNA, 35 bp, Artificial Sequence
  Synthetic oligonucleotide
acccaccaccattactgccttatgctcaagccccg

SEQ ID NO: 111292 - DNA, 36 bp, Artificial Sequence
  Synthetic oligonucleotide
gaggagatgagggtgttggggtggtgcggaggtaga

SEQ ID NO: 111293 - DNA, 35 bp, Artificial Sequence
  Synthetic oligonucleotide
tcatcccgctttccgcccaaccccatgacgccgtg

SEQ ID NO: 111294 - DNA, 36 bp, Artificial Sequence
  Synthetic oligonucleotide
gtacgtgccccatccttgttatgtccttggcttcta

SEQ ID NO: 111295 - DNA, 35 bp, Artificial Sequence
  Synthetic oligonucleotide
gacccaccgcctcgcgtcaatgttccatctcccgg

SEQ ID NO: 111296 - DNA, 36 bp, Artificial Sequence
  Synthetic oligonucleotide
gactacaccacccgatcctctcgccgcctgtcgcta

SEQ ID NO: 111297 - DNA, 35 bp, Artificial Sequence
  Synthetic oligonucleotide
tcacacacctctccgcatagcccacccacgtatgt

SEQ ID NO: 111298 - DNA, 35 bp, Artificial Sequence
  Synthetic oligonucleotide
atctggggaaggggggtgggaatgcagagagggaa

SEQ ID NO: 111299 - DNA, 35 bp, Artificial Sequence
  Synthetic oligonucleotide
ttttaccaccggccgaccgttcttagcgctcccct

SEQ ID NO: 111300 - DNA, 35 bp, Artificial Sequence
  Synthetic oligonucleotide
tccacactcctctgccgtactcagccttcacgctc

SEQ ID NO: 111301 - DNA, 35 bp, Artificial Sequence
  Synthetic oligonucleotide
gtcacttcgccatgagttagcgctgccctctcctt

SEQ ID NO: 111302 - DNA, 36 bp, Artificial Sequence
  Synthetic oligonucleotide
acaaccgtaggggcaaatgagtcagggagggtggga

SEQ ID NO: 111303 - DNA, 35 bp, Artificial Sequence
  Synthetic oligonucleotide
tgatcgtgcatatcctatctctgctcctgttcgcc

SEQ ID NO: 111304 - DNA, 35 bp, Artificial Sequence
  Synthetic oligonucleotide
tacgtgcacaccgactcacttcgcctcaccttggt

SEQ ID NO: 111305 - DNA, 36 bp, Artificial Sequence
  Synthetic oligonucleotide
gaccccgctgacgacgcgcccccaccactgtactca

SEQ ID NO: 111306 - DNA, 35 bp, Artificial Sequence
  Synthetic oligonucleotide
ggggtgctccgtgcccgttcccgtgtcccttgtct

SEQ ID NO: 111307 - DNA, 35 bp, Artificial Sequence
  Synthetic oligonucleotide
ttgcatctgccgctggcccggccccctgatccacc

SEQ ID NO: 111308 - DNA, 35 bp, Artificial Sequence
  Synthetic oligonucleotide
tccattcgtactctgctggttccacgactttcgcc

SEQ ID NO: 111309 - DNA, 35 bp, Artificial Sequence
  Synthetic oligonucleotide
tgatgggacgaagaagggggcgggtggtacgtggg

SEQ ID NO: 111310 - DNA, 35 bp, Artificial Sequence
  Synthetic oligonucleotide
accgcaagggcctaatgtctcgcgctccccgttca

SEQ ID NO: 111311 - DNA, 36 bp, Artificial Sequence
  Synthetic oligonucleotide
agtgcaccccctggctgctatctccacttatgccta

SEQ ID NO: 111312 - DNA, 35 bp, Artificial Sequence
  Synthetic oligonucleotide
ttcgtccctcagcacgctgcccgccctgcctgact

SEQ ID NO: 111313 - DNA, 35 bp, Artificial Sequence
  Synthetic oligonucleotide
aatggcgcatcccaaccgttggccgcctgtttcct

SEQ ID NO: 111314 - DNA, 35 bp, Artificial Sequence
  Synthetic oligonucleotide
tccgcacggcaaccccccatcaccgtatcgtgtcc

SEQ ID NO: 111315 - DNA, 35 bp, Artificial Sequence
  Synthetic oligonucleotide
gaaccgtagggaagggatgcgggagggatatcgtg

SEQ ID NO: 111316 - DNA, 37 bp, Artificial Sequence
  Synthetic oligonucleotide
gtgtggggagggtgggaatgtcggtgccgtttgggga

SEQ ID NO: 111317 - DNA, 35 bp, Artificial Sequence
  Synthetic oligonucleotide
gccttccctcactctatgctcggacctgggcctcc

SEQ ID NO: 111318 - DNA, 34 bp, Artificial Sequence
  Synthetic oligonucleotide
gaccgcctcgcctttatttgctctaacgccttcg

SEQ ID NO: 111319 - DNA, 36 bp, Artificial Sequence
  Synthetic oligonucleotide
actcgttctgcggtgtcctcgccctgctcttgctga

SEQ ID NO: 111320 - DNA, 35 bp, Artificial Sequence
  Synthetic oligonucleotide
gaccaccacattcttcgttggaagctctcctccac

SEQ ID NO: 111321 - DNA, 35 bp, Artificial Sequence
  Synthetic oligonucleotide
gtccccatcgcccgccgctattgcggagtccatct

SEQ ID NO: 111322 - DNA, 34 bp, Artificial Sequence
  Synthetic oligonucleotide
tccggaagcagcaccgccaagcacgccacccccc

SEQ ID NO: 111323 - DNA, 35 bp, Artificial Sequence
  Synthetic oligonucleotide
gcccgcccgaagtcgcaccaccgatatgctgccct

SEQ ID NO: 111324 - DNA, 36 bp, Artificial Sequence
  Synthetic oligonucleotide
tgcatctgctgtcggcccgctcgccctgtccaccca

SEQ ID NO: 111325 - DNA, 35 bp, Artificial Sequence
  Synthetic oligonucleotide
agtgaatgccaccaccctgcgtatgaaccaccctt

SEQ ID NO: 111326 - DNA, 35 bp, Artificial Sequence
  Synthetic oligonucleotide
gtgtgccacgttgattttcttccggtcctgctttc

SEQ ID NO: 111327 - DNA, 37 bp, Artificial Sequence
  Synthetic oligonucleotide
gaccgggcggggtgtcctaggggcgcgtattagggga

SEQ ID NO: 111328 - DNA, 35 bp, Artificial Sequence
  Synthetic oligonucleotide
acctaccgcctcatctgtcttcactgcgcatattg

SEQ ID NO: 111329 - DNA, 37 bp, Artificial Sequence
  Synthetic oligonucleotide
atcccagggaggggggaggataaggtaaggggtggga

SEQ ID NO: 111330 - DNA, 37 bp, Artificial Sequence
  Synthetic oligonucleotide
gccgtacctcactgctcgtatacacctttctcactga

SEQ ID NO: 111331 - DNA, 35 bp, Artificial Sequence
  Synthetic oligonucleotide
gtcgagcacatgccttccacctcgccccggggccc

SEQ ID NO: 111332 - DNA, 35 bp, Artificial Sequence
  Synthetic oligonucleotide
tcaccacgatgacgatttgcccgccgcactactcc

SEQ ID NO: 111333 - DNA, 36 bp, Artificial Sequence
  Synthetic oligonucleotide
gacgctgtccagtcttaaatactccgcgccctgcca

SEQ ID NO: 111334 - DNA, 36 bp, Artificial Sequence
  Synthetic oligonucleotide
gagcggggacctggagggggcacagggcgggacgta

SEQ ID NO: 111335 - DNA, 35 bp, Artificial Sequence
  Synthetic oligonucleotide
gccggcccatgatgtgactgcccatcctgtccccc

SEQ ID NO: 111336 - DNA, 35 bp, Artificial Sequence
  Synthetic oligonucleotide
gtgcgacctcgatgtattgctcccccattcgctca

SEQ ID NO: 111337 - DNA, 38 bp, Artificial Sequence
  Synthetic oligonucleotide
gcgcctccccccacttacggtcgcctgccccttcttga

SEQ ID NO: 111338 - DNA, 35 bp, Artificial Sequence
  Synthetic oligonucleotide
tatcccccccaaccgcgccgcttgcttattcgtcc

SEQ ID NO: 111339 - DNA, 35 bp, Artificial Sequence
  Synthetic oligonucleotide
tgatcccaccgccgagtacgaatctaccgctccgc

SEQ ID NO: 111340 - DNA, 35 bp, Artificial Sequence
  Synthetic oligonucleotide
atcaccaccctcgacgatgtattcccctgtcgtgt

SEQ ID NO: 111341 - DNA, 36 bp, Artificial Sequence
  Synthetic oligonucleotide
atgcctccacccgagggttccttcgcttcatcgcta

SEQ ID NO: 111342 - DNA, 35 bp, Artificial Sequence
  Synthetic oligonucleotide
acaacgtcctttccatcgtgagcccgcgccctccc

SEQ ID NO: 111343 - DNA, 35 bp, Artificial Sequence
  Synthetic oligonucleotide
tttgcccctcgatcgccccccgacataggagccct

SEQ ID NO: 111344 - DNA, 36 bp, Artificial Sequence
  Synthetic oligonucleotide
accgcatgagcgggacgggtaggggtgggcacaaga

SEQ ID NO: 111345 - DNA, 37 bp, Artificial Sequence
  Synthetic oligonucleotide
gtacaaagacagagggaggctaagggagaagggtgga

SEQ ID NO: 111346 - DNA, 36 bp, Artificial Sequence
  Synthetic oligonucleotide
ttaacccctcataccgcgtgcatttcacctatcgta

SEQ ID NO: 111347 - DNA, 35 bp, Artificial Sequence
  Synthetic oligonucleotide
gtctacgcccccatcggctgtgcttctccctctac

SEQ ID NO: 111348 - DNA, 35 bp, Artificial Sequence
  Synthetic oligonucleotide
gccatgcgcccgtccttgttccacgtctccatctc

SEQ ID NO: 111349 - DNA, 35 bp, Artificial Sequence
  Synthetic oligonucleotide
tcgacgcccctgcccatcccggtctcgccccactt

SEQ ID NO: 111350 - DNA, 35 bp, Artificial Sequence
  Synthetic oligonucleotide
tgccaggcctgtgcttttacgtcgccgcctctcaa

SEQ ID NO: 111351 - DNA, 34 bp, Artificial Sequence
  Synthetic oligonucleotide
tctccccgtactagcccggttatctatccccccc

SEQ ID NO: 111352 - DNA, 35 bp, Artificial Sequence
  Synthetic oligonucleotide
gagtgaacagggtcggggcgggagtagggaagggc

SEQ ID NO: 111353 - DNA, 35 bp, Artificial Sequence
  Synthetic oligonucleotide
tctgctcatccggtgcgtaatctaccttgtccttc

SEQ ID NO: 111354 - DNA, 37 bp, Artificial Sequence
  Synthetic oligonucleotide
gtaacgtcctgaactatctcctgccctgcctgcctga

SEQ ID NO: 111355 - DNA, 35 bp, Artificial Sequence
  Synthetic oligonucleotide
acgccccacacacgctcgaccttgcttctttctgg

SEQ ID NO: 111356 - DNA, 35 bp, Artificial Sequence
  Synthetic oligonucleotide
tgatatgcaggcgcatctttcctgtccctcccggc

SEQ ID NO: 111357 - DNA, 35 bp, Artificial Sequence
  Synthetic oligonucleotide
gaatgccagaaccgacaccccctcctcgccgctgc

SEQ ID NO: 111358 - DNA, 35 bp, Artificial Sequence
  Synthetic oligonucleotide
tgctccatcccaccttcgcctcgcgcacagttgtc

SEQ ID NO: 111359 - DNA, 35 bp, Artificial Sequence
  Synthetic oligonucleotide
agcccccccgccttcttaacgtgatttctgcgctt

SEQ ID NO: 111360 - DNA, 35 bp, Artificial Sequence
  Synthetic oligonucleotide
atccgccccttctatgaccaaacaagacctgccgc

SEQ ID NO: 111361 - DNA, 37 bp, Artificial Sequence
  Synthetic oligonucleotide
acccgccacctgcgatatatccccctccacttttgga

SEQ ID NO: 111362 - DNA, 35 bp, Artificial Sequence
  Synthetic oligonucleotide
gatcccccatgctgacggcctgacgcttgtccctc

SEQ ID NO: 111363 - DNA, 36 bp, Artificial Sequence
  Synthetic oligonucleotide
ttgaccccccctccgcccacgcctttgtcttttgga

SEQ ID NO: 111364 - DNA, 35 bp, Artificial Sequence
  Synthetic oligonucleotide
taacatcgcgccttcactcgctccgtcccttttgc

SEQ ID NO: 111365 - DNA, 35 bp, Artificial Sequence
  Synthetic oligonucleotide
atcccactcgctgtgaaacattgccttcctcctat

SEQ ID NO: 111366 - DNA, 36 bp, Artificial Sequence
  Synthetic oligonucleotide
atcaccctcaccctgcttttttgaacaacttatgga

SEQ ID NO: 111367 - DNA, 35 bp, Artificial Sequence
  Synthetic oligonucleotide
tgtcctgcccttcagcgaatacgcactcacacctc

SEQ ID NO: 111368 - DNA, 36 bp, Artificial Sequence
  Synthetic oligonucleotide
gtaaggtgaggggagggggagcgacggctaaatgga

SEQ ID NO: 111369 - DNA, 35 bp, Artificial Sequence
  Synthetic oligonucleotide
cagcccgctcccccctgtgcgccgagctacacccg

SEQ ID NO: 111370 - DNA, 35 bp, Artificial Sequence
  Synthetic oligonucleotide
gacgaccttctctccgctgatatgcagccatgcca

SEQ ID NO: 111371 - DNA, 36 bp, Artificial Sequence
  Synthetic oligonucleotide
gtcagagcgaatcggcggggttgggaggcggggaga

SEQ ID NO: 111372 - DNA, 37 bp, Artificial Sequence
  Synthetic oligonucleotide
tctagccagccccgccccgtgaactctctccattgga

SEQ ID NO: 111373 - DNA, 37 bp, Artificial Sequence
  Synthetic oligonucleotide
gacgggggtggagaaatacgggaaaggagggggcaga

SEQ ID NO: 111374 - DNA, 35 bp, Artificial Sequence
  Synthetic oligonucleotide
taaccacccgccctgtgttatccacctcaatttcc

SEQ ID NO: 111375 - DNA, 35 bp, Artificial Sequence
  Synthetic oligonucleotide
acctccacctgttcattccccgttatccctctggg

SEQ ID NO: 111376 - DNA, 35 bp, Artificial Sequence
  Synthetic oligonucleotide
ttatggccgccccccctttgtttttgcccggctat

SEQ ID NO: 111377 - DNA, 28 bp, Artificial Sequence
  Synthetic oligonucleotide
gatcacaccttttgcaggctcattccct

SEQ ID NO: 111378 - DNA, 35 bp, Artificial Sequence
  Synthetic oligonucleotide
gatcgcgacagatcgcgcatttgctccttacctcc

SEQ ID NO: 111379 - DNA, 35 bp, Artificial Sequence
  Synthetic oligonucleotide
tgcatggttcgcctttgtctcctttccgccttcgc

SEQ ID NO: 111380 - DNA, 35 bp, Artificial Sequence
  Synthetic oligonucleotide
ttcccacccgctttgtttgattcgtcgcaatactc

SEQ ID NO: 111381 - DNA, 36 bp, Artificial Sequence
  Synthetic oligonucleotide
atccccgcccgcccaggcttcattacacgtttggca

SEQ ID NO: 111382 - DNA, 37 bp, Artificial Sequence
  Synthetic oligonucleotide
gttccgggcggggttgtttggggtgtctctctgggga

SEQ ID NO: 111383 - DNA, 35 bp, Artificial Sequence
  Synthetic oligonucleotide
tcacatcgcccccctgttgattcattccagtgctg

SEQ ID NO: 111384 - DNA, 36 bp, Artificial Sequence
  Synthetic oligonucleotide
gctgtgccagtctctacaagttcgctgctccaccca

SEQ ID NO: 111385 - DNA, 35 bp, Artificial Sequence
  Synthetic oligonucleotide
atccgcacacgctagtgcgttcttcaccttggttt

SEQ ID NO: 111386 - DNA, 36 bp, Artificial Sequence
  Synthetic oligonucleotide
gcccacgcagtcgcctttcgtttttagtttcctcca

SEQ ID NO: 111387 - DNA, 35 bp, Artificial Sequence
  Synthetic oligonucleotide
gccccgcagacacagtgcgttcgcccactccaccc

SEQ ID NO: 111388 - DNA, 35 bp, Artificial Sequence
  Synthetic oligonucleotide
tcgccttccatccacccgtgccgatctgctctcac

SEQ ID NO: 111389 - DNA, 35 bp, Artificial Sequence
  Synthetic oligonucleotide
gttaccgcctacctgttgccactcccatggagcct

SEQ ID NO: 111390 - DNA, 36 bp, Artificial Sequence
  Synthetic oligonucleotide
tccctcctctcgcccgccgacgtgtccaattcgaca

SEQ ID NO: 111391 - DNA, 37 bp, Artificial Sequence
  Synthetic oligonucleotide
gacatcccacctgctgcgagccccctcttgttcacga

SEQ ID NO: 111392 - DNA, 37 bp, Artificial Sequence
  Synthetic oligonucleotide
atgttcgcccctttgcctgaccagtcgttccaccgga

SEQ ID NO: 111393 - DNA, 35 bp, Artificial Sequence
  Synthetic oligonucleotide
tttggccacccttttcagttgactctctccccctc

SEQ ID NO: 111394 - DNA, 35 bp, Artificial Sequence
  Synthetic oligonucleotide
atggccccactgcccccgcctcagacccttgtctc

SEQ ID NO: 111395 - DNA, 35 bp, Artificial Sequence
  Synthetic oligonucleotide
gtgcatacatccatggcgccatcccacctcttgcc

SEQ ID NO: 111396 - DNA, 36 bp, Artificial Sequence
  Synthetic oligonucleotide
acccccgtgcccccccttcgactcttcccatgggaa

SEQ ID NO: 111397 - DNA, 36 bp, Artificial Sequence
  Synthetic oligonucleotide
gggtgggtcgggaggggttatcccatctttatagga

SEQ ID NO: 111398 - DNA, 36 bp, Artificial Sequence
  Synthetic oligonucleotide
atcgccaccgtggccctaccgcccttgttctccgta

SEQ ID NO: 111399 - DNA, 35 bp, Artificial Sequence
  Synthetic oligonucleotide
gtcgatcactgcacagtgtacaccgccctttctgc

SEQ ID NO: 111400 - DNA, 36 bp, Artificial Sequence
  Synthetic oligonucleotide
aacgcactcgctcctgcttttaatatgcacctcgca

SEQ ID NO: 111401 - DNA, 36 bp, Artificial Sequence
  Synthetic oligonucleotide
tgactcgcacccgcccccctttccgctggtcaccga

SEQ ID NO: 111402 - DNA, 35 bp, Artificial Sequence
  Synthetic oligonucleotide
tagtcccccatgttcgtacacgcaagatcttcaca

SEQ ID NO: 111403 - DNA, 35 bp, Artificial Sequence
  Synthetic oligonucleotide
gtgccttgcctctgcctcgattcggtccttttttg

SEQ ID NO: 111404 - DNA, 35 bp, Artificial Sequence
  Synthetic oligonucleotide
acctcaccccttctgtttttaatatgttccgttgc

SEQ ID NO: 111405 - DNA, 36 bp, Artificial Sequence
  Synthetic oligonucleotide
aagagggggggtgtgagaaggggcattggacaggga

SEQ ID NO: 111406 - DNA, 35 bp, Artificial Sequence
  Synthetic oligonucleotide
gtatccccgcctgcctggtctacctgttacggttc

SEQ ID NO: 111407 - DNA, 36 bp, Artificial Sequence
  Synthetic oligonucleotide
gagtgccggtgggggaggtgggagggcttggataca

SEQ ID NO: 111408 - DNA, 35 bp, Artificial Sequence
  Synthetic oligonucleotide
acatgcagttcccgtctatgtcctccgcgccccca

SEQ ID NO: 111409 - DNA, 35 bp, Artificial Sequence
  Synthetic oligonucleotide
gcctcgccctcactcgccggtcatctcccgtagca

SEQ ID NO: 111410 - DNA, 37 bp, Artificial Sequence
  Synthetic oligonucleotide
tgttgaccccgccctgtccgccacgcgatggcctcga

SEQ ID NO: 111411 - DNA, 35 bp, Artificial Sequence
  Synthetic oligonucleotide
ttaccgccgcccgctcgcccactccctggataagg

SEQ ID NO: 111412 - DNA, 37 bp, Artificial Sequence
  Synthetic oligonucleotide
acccgccgtcctgccacgctttctcggttccccccga

SEQ ID NO: 111413 - DNA, 37 bp, Artificial Sequence
  Synthetic oligonucleotide
ggagccataacagggggaggggaagggagttcgcgga

SEQ ID NO: 111414 - DNA, 36 bp, Artificial Sequence
  Synthetic oligonucleotide
gtgcgaagcggaggagggaacggatggaaggagtga

SEQ ID NO: 111415 - DNA, 35 bp, Artificial Sequence
  Synthetic oligonucleotide
gacgcccacggtcctgttcgcttacgtagtactct

SEQ ID NO: 111416 - DNA, 38 bp, Artificial Sequence
  Synthetic oligonucleotide
atggccccctcatcctgtccctgtccgccggtacctga

SEQ ID NO: 111417 - DNA, 35 bp, Artificial Sequence
  Synthetic oligonucleotide
gacccgattccacctgttcagggcacaccttttat

SEQ ID NO: 111418 - DNA, 37 bp, Artificial Sequence
  Synthetic oligonucleotide
acctctcgccccctgtgcgcccatgaatccacctcga

SEQ ID NO: 111419 - DNA, 37 bp, Artificial Sequence
  Synthetic oligonucleotide
gaccggtaggaggggtgggtgcgggttaggtggggga

SEQ ID NO: 111420 - DNA, 35 bp, Artificial Sequence
  Synthetic oligonucleotide
tcgaacccagatcgtaccatccaaccaccttgtcc

SEQ ID NO: 111421 - DNA, 35 bp, Artificial Sequence
  Synthetic oligonucleotide
atgtgggaatggaggggagtattggtgataggtgg

SEQ ID NO: 111422 - DNA, 35 bp, Artificial Sequence
  Synthetic oligonucleotide
gcacacctcatgaaagcaactgcccttcgttccct

SEQ ID NO: 111423 - DNA, 32 bp, Artificial Sequence
  Synthetic oligonucleotide
gcttgcacgcactcccattccatcatctcgga

SEQ ID NO: 111424 - DNA, 35 bp, Artificial Sequence
  Synthetic oligonucleotide
gtgagtgcccaagtttgcgacgacccgcccccttc

SEQ ID NO: 111425 - DNA, 35 bp, Artificial Sequence
  Synthetic oligonucleotide
atgcgctactatctgccgtaactctcctcctggct

SEQ ID NO: 111426 - DNA, 35 bp, Artificial Sequence
  Synthetic oligonucleotide
gagaggggggcaggggcgggaggcgaggacgtgtt

SEQ ID NO: 111427 - DNA, 35 bp, Artificial Sequence
  Synthetic oligonucleotide
gatgaggggcgggtgtagaggcggagatgggaagg

SEQ ID NO: 111428 - DNA, 36 bp, Artificial Sequence
  Synthetic oligonucleotide
gttgcctctgtccacccatgtctcgttcatccatca

SEQ ID NO: 111429 - DNA, 35 bp, Artificial Sequence
  Synthetic oligonucleotide
ttcccctcacccctcttatgtgccggcttaccttc

SEQ ID NO: 111430 - DNA, 35 bp, Artificial Sequence
  Synthetic oligonucleotide
gacacagtcacgctgttccaccatggccatctcac

SEQ ID NO: 111431 - DNA, 35 bp, Artificial Sequence
  Synthetic oligonucleotide
tgctccaccactttttgctgaacgtgcctatgccc

SEQ ID NO: 111432 - DNA, 35 bp, Artificial Sequence
  Synthetic oligonucleotide
tgtgtcagcatcacatcgtatcctctaccgctccc

SEQ ID NO: 111433 - DNA, 35 bp, Artificial Sequence
  Synthetic oligonucleotide
agcacaaccgccatcctctcacagtccgggctgcc

SEQ ID NO: 111434 - DNA, 35 bp, Artificial Sequence
  Synthetic oligonucleotide
gtttcgcccccgaccctcctgatctccgcgctatg

SEQ ID NO: 111435 - DNA, 35 bp, Artificial Sequence
  Synthetic oligonucleotide
ttgtccaccactgtatcgcggttttcctgttttct

SEQ ID NO: 111436 - DNA, 35 bp, Artificial Sequence
  Synthetic oligonucleotide
tcatcaccgaatgctggtttttccgttctccattt

SEQ ID NO: 111437 - DNA, 34 bp, Artificial Sequence
  Synthetic oligonucleotide
tcgcctgcccttcgttgccggtgctttccactcc

SEQ ID NO: 111438 - DNA, 35 bp, Artificial Sequence
  Synthetic oligonucleotide
gccccgctcatgccttgcacaattgttccgctcct

SEQ ID NO: 111439 - DNA, 35 bp, Artificial Sequence
  Synthetic oligonucleotide
gactctcacctctgtccgtgacatccagtttcgct

SEQ ID NO: 111440 - DNA, 35 bp, Artificial Sequence
  Synthetic oligonucleotide
gccattcgcatgacatactccaccgggttccctct

SEQ ID NO: 111441 - DNA, 36 bp, Artificial Sequence
  Synthetic oligonucleotide
aagaggatcgagggtggcgtaggggaaggagggaaa

SEQ ID NO: 111442 - DNA, 35 bp, Artificial Sequence
  Synthetic oligonucleotide
gacaaaccgttgtctctgtaagctccttccattcc

SEQ ID NO: 111443 - DNA, 35 bp, Artificial Sequence
  Synthetic oligonucleotide
gacaccggctatatccttcgcgcgagccctgcctt

SEQ ID NO: 111444 - DNA, 37 bp, Artificial Sequence
  Synthetic oligonucleotide
tttcaccccgacacttgtgcttttgctatcccctcga

SEQ ID NO: 111445 - DNA, 35 bp, Artificial Sequence
  Synthetic oligonucleotide
ggggaggggaggcggagcgaatcagtgggcggcaa

SEQ ID NO: 111446 - DNA, 35 bp, Artificial Sequence
  Synthetic oligonucleotide
gatccccccgcccgcttctcctgtttcgcgtgaaa

SEQ ID NO: 111447 - DNA, 35 bp, Artificial Sequence
  Synthetic oligonucleotide
tgtgccttccagccgcgcccctatcgcccctagca

SEQ ID NO: 111448 - DNA, 37 bp, Artificial Sequence
  Synthetic oligonucleotide
gttgagggagaaggggttgggaggtaggaggtcgcga

SEQ ID NO: 111449 - DNA, 37 bp, Artificial Sequence
  Synthetic oligonucleotide
gactccgcctctgggttatgttttatctccctcctga

SEQ ID NO: 111450 - DNA, 35 bp, Artificial Sequence
  Synthetic oligonucleotide
acgttacccccgcagagtaacagcccgcccatcct

SEQ ID NO: 111451 - DNA, 35 bp, Artificial Sequence
  Synthetic oligonucleotide
atatcgcaggcccccgcgtcgaagcccccctgcct

SEQ ID NO: 111452 - DNA, 35 bp, Artificial Sequence
  Synthetic oligonucleotide
tattgcgcacattgccgttccctgctattccactt

SEQ ID NO: 111453 - DNA, 36 bp, Artificial Sequence
  Synthetic oligonucleotide
gatacgcctcccgtgctcagccctgacttctccgca

SEQ ID NO: 111454 - DNA, 37 bp, Artificial Sequence
  Synthetic oligonucleotide
ttggtggaggggactagggggtattgctaaggctgga

SEQ ID NO: 111455 - DNA, 35 bp, Artificial Sequence
  Synthetic oligonucleotide
tagttctaccccatcgccctatgctacaggcatcc

SEQ ID NO: 111456 - DNA, 35 bp, Artificial Sequence
  Synthetic oligonucleotide
gcaggagggagggatgggataaagttatacttgag

SEQ ID NO: 111457 - DNA, 37 bp, Artificial Sequence
  Synthetic oligonucleotide
gaaccacgggcatgaaggggcgggtgggaattactga

SEQ ID NO: 111458 - DNA, 36 bp, Artificial Sequence
  Synthetic oligonucleotide
gtgccccagttcgccgtcaaccgccgcctttcccta

SEQ ID NO: 111459 - DNA, 35 bp, Artificial Sequence
  Synthetic oligonucleotide
tctccaccccccgactcgttgccagagattgcgat

SEQ ID NO: 111460 - DNA, 35 bp, Artificial Sequence
  Synthetic oligonucleotide
gcccccccctgaatttgctacaggtcacgactcct

SEQ ID NO: 111461 - DNA, 35 bp, Artificial Sequence
  Synthetic oligonucleotide
tactggaggggggggaggagcggggaagtcactta

SEQ ID NO: 111462 - DNA, 35 bp, Artificial Sequence
  Synthetic oligonucleotide
actacctccctcgaagtgctcaaccataccgcctg

SEQ ID NO: 111463 - DNA, 35 bp, Artificial Sequence
  Synthetic oligonucleotide
gtccgccccgccgtcactatactgttgcccgcccc

SEQ ID NO: 111464 - DNA, 35 bp, Artificial Sequence
  Synthetic oligonucleotide
ttcaggcggaggagacgggcggggggagagggatg

SEQ ID NO: 111465 - DNA, 35 bp, Artificial Sequence
  Synthetic oligonucleotide
cccatcctctcgacgcttgacgtgcactgttccat

SEQ ID NO: 111466 - DNA, 35 bp, Artificial Sequence
  Synthetic oligonucleotide
acccactgccctcggactctctcacgtgcacccac

SEQ ID NO: 111467 - DNA, 35 bp, Artificial Sequence
  Synthetic oligonucleotide
tccggctagagtcttcgtccgtttgcgcccccccc

SEQ ID NO: 111468 - DNA, 35 bp, Artificial Sequence
  Synthetic oligonucleotide
tcatgtgccgacgctgtttccctggtcatcctccc

SEQ ID NO: 111469 - DNA, 35 bp, Artificial Sequence
  Synthetic oligonucleotide
tgcatccgccccgcacctcccatcatttcacggcc

SEQ ID NO: 111470 - DNA, 37 bp, Artificial Sequence
  Synthetic oligonucleotide
aaggactggaggaaggaggaagggacatgagaggaga

SEQ ID NO: 111471 - DNA, 35 bp, Artificial Sequence
  Synthetic oligonucleotide
acgcccctgctatccacttgccttttcgccccgga

SEQ ID NO: 111472 - DNA, 35 bp, Artificial Sequence
  Synthetic oligonucleotide
accaccccgactcaccgcgctgctccatcgtgccc

SEQ ID NO: 111473 - DNA, 35 bp, Artificial Sequence
  Synthetic oligonucleotide
ggataccaccccctgccgctaatttcctgctccgt

SEQ ID NO: 111474 - DNA, 35 bp, Artificial Sequence
  Synthetic oligonucleotide
gagccaccctgcggaacagcctatctctcgctcgc

SEQ ID NO: 111475 - DNA, 35 bp, Artificial Sequence
  Synthetic oligonucleotide
gtcggtatgccgcgccgccgtttacgtttcccctc

SEQ ID NO: 111476 - DNA, 35 bp, Artificial Sequence
  Synthetic oligonucleotide
acccccgcccctctctgtgctcgctgtctcctccg

SEQ ID NO: 111477 - DNA, 35 bp, Artificial Sequence
  Synthetic oligonucleotide
tcgacgagtgcctaacgcgtatcgtctccgctccc

SEQ ID NO: 111478 - DNA, 35 bp, Artificial Sequence
  Synthetic oligonucleotide
tgtacacgcctccatgcgtaggtatcccttcttca

SEQ ID NO: 111479 - DNA, 35 bp, Artificial Sequence
  Synthetic oligonucleotide
accgccacagcctgacccgctcccacagcatactt

SEQ ID NO: 111480 - DNA, 35 bp, Artificial Sequence
  Synthetic oligonucleotide
tagcccaaccagcttttccagccgcccacccgcgc

SEQ ID NO: 111481 - DNA, 35 bp, Artificial Sequence
  Synthetic oligonucleotide
gcccactccgacgcatttttctacacgcttttttg

SEQ ID NO: 111482 - DNA, 35 bp, Artificial Sequence
  Synthetic oligonucleotide
tcccccctcgtccagacccgaccatccatctctgt

SEQ ID NO: 111483 - DNA, 37 bp, Artificial Sequence
  Synthetic oligonucleotide
taacgcccccgttgactgttacgcaccctccccctga

SEQ ID NO: 111484 - DNA, 35 bp, Artificial Sequence
  Synthetic oligonucleotide
atcgcaggccgggtatactgcggtcctcctctctc

SEQ ID NO: 111485 - DNA, 36 bp, Artificial Sequence
  Synthetic oligonucleotide
accgtccccacggatgtgccgccccttgccctttta

SEQ ID NO: 111486 - DNA, 35 bp, Artificial Sequence
  Synthetic oligonucleotide
tccgtcctgcacccccgctttgtgctgccctctac

SEQ ID NO: 111487 - DNA, 35 bp, Artificial Sequence
  Synthetic oligonucleotide
gccaaccgtccctgcatacactttttctgtctcgc

SEQ ID NO: 111488 - DNA, 35 bp, Artificial Sequence
  Synthetic oligonucleotide
tcaccacccatccacgctgttaccgcccgtctatt

SEQ ID NO: 111489 - DNA, 35 bp, Artificial Sequence
  Synthetic oligonucleotide
tcaccgcggcgatacttccctgttcggttttccac

SEQ ID NO: 111490 - DNA, 35 bp, Artificial Sequence
  Synthetic oligonucleotide
ggtcagaccttgcccatgtgcctcgctcacctttc

SEQ ID NO: 111491 - DNA, 36 bp, Artificial Sequence
  Synthetic oligonucleotide
gttcacccccccgctatattgcagatgcctgccgca

SEQ ID NO: 111492 - DNA, 35 bp, Artificial Sequence
  Synthetic oligonucleotide
tagccatccgattgccggcccatgacgttccttcc

SEQ ID NO: 111493 - DNA, 35 bp, Artificial Sequence
  Synthetic oligonucleotide
gtcccgccccaagcttactcggtattcacttttcc

SEQ ID NO: 111494 - DNA, 35 bp, Artificial Sequence
  Synthetic oligonucleotide
gtcgcaacatcacctgtctcgacttccatcttccg

SEQ ID NO: 111495 - DNA, 36 bp, Artificial Sequence
  Synthetic oligonucleotide
gtgactgcccatatgcgtctctcccgctaccactca

SEQ ID NO: 111496 - DNA, 35 bp, Artificial Sequence
  Synthetic oligonucleotide
tgaccccctcctcgcacacgacactgctcttagga

SEQ ID NO: 111497 - DNA, 37 bp, Artificial Sequence
  Synthetic oligonucleotide
gggacactgcagagaggggataggaaggagggatgga

SEQ ID NO: 111498 - DNA, 35 bp, Artificial Sequence
  Synthetic oligonucleotide
aaccggcggtgaggggaggggagggcaataggagt

SEQ ID NO: 111499 - DNA, 35 bp, Artificial Sequence
  Synthetic oligonucleotide
gatgccgcccaatcgcccttattacaccttagcgc

SEQ ID NO: 111500 - DNA, 35 bp, Artificial Sequence
  Synthetic oligonucleotide
atctcagcctccccacactgtcccttgcctgcagg

SEQ ID NO: 111501 - DNA, 35 bp, Artificial Sequence
  Synthetic oligonucleotide
accaccgcctaccttacatctcaagcctgcccgtg

SEQ ID NO: 111502 - DNA, 35 bp, Artificial Sequence
  Synthetic oligonucleotide
tccgtgccctcgccgccctgtctctgactgctcct

SEQ ID NO: 111503 - DNA, 35 bp, Artificial Sequence
  Synthetic oligonucleotide
gtgatggggaggtggaggacggtggtgcggcgtaa

SEQ ID NO: 111504 - DNA, 36 bp, Artificial Sequence
  Synthetic oligonucleotide
ttgcaacgtacatccgccgtccattgggccacctca

SEQ ID NO: 111505 - DNA, 35 bp, Artificial Sequence
  Synthetic oligonucleotide
tccatgcgtacgtgcagtgcaccttccccttccat

SEQ ID NO: 111506 - DNA, 37 bp, Artificial Sequence
  Synthetic oligonucleotide
atggtggtggcgggggtagttcggatggcggctatga

SEQ ID NO: 111507 - DNA, 36 bp, Artificial Sequence
  Synthetic oligonucleotide
gatccaccggtcctgctgtgcccgctcgccgccgta

SEQ ID NO: 111508 - DNA, 35 bp, Artificial Sequence
  Synthetic oligonucleotide
agttaacgtaccgcatgcccattagcccactccct

SEQ ID NO: 111509 - DNA, 37 bp, Artificial Sequence
  Synthetic oligonucleotide
aaaccaccgcctaatctcgcatagcctcccccgttga

SEQ ID NO: 111510 - DNA, 35 bp, Artificial Sequence
  Synthetic oligonucleotide
tcgccgacagtcggattgccaccgctccctccttc

SEQ ID NO: 111511 - DNA, 35 bp, Artificial Sequence
  Synthetic oligonucleotide
ggggggggagtgggtgaaagggggaaatgagatgg

SEQ ID NO: 111512 - DNA, 36 bp, Artificial Sequence
  Synthetic oligonucleotide
ttcgcagtgttcctgcgtcactaacctgtcccctca

SEQ ID NO: 111513 - DNA, 36 bp, Artificial Sequence
  Synthetic oligonucleotide
ttgtccgccccacccttggctatgcattcaacttta

SEQ ID NO: 111514 - DNA, 35 bp, Artificial Sequence
  Synthetic oligonucleotide
ttgatgcttcctgctccctgatggacttcgccccc

SEQ ID NO: 111515 - DNA, 35 bp, Artificial Sequence
  Synthetic oligonucleotide
aacttcctccccagccgttgtatcctccccttggc

SEQ ID NO: 111516 - DNA, 35 bp, Artificial Sequence
  Synthetic oligonucleotide
acacctcgtgggcccttgtactgccgctggccatc

SEQ ID NO: 111517 - DNA, 37 bp, Artificial Sequence
  Synthetic oligonucleotide
ttggccccatgatttgcagcctccacccgttccttga

SEQ ID NO: 111518 - DNA, 35 bp, Artificial Sequence
  Synthetic oligonucleotide
tccacgtgccagcacgtgactatgtactacgttcc

SEQ ID NO: 111519 - DNA, 35 bp, Artificial Sequence
  Synthetic oligonucleotide
agagggggaaagggtcgaggggggcagaaggagca

SEQ ID NO: 111520 - DNA, 36 bp, Artificial Sequence
  Synthetic oligonucleotide
gccaacatccagttctcgttcccatctctcaaatta

SEQ ID NO: 111521 - DNA, 35 bp, Artificial Sequence
  Synthetic oligonucleotide
gcgcaagtactcctgttcctgtacgttctgtcctc

SEQ ID NO: 111522 - DNA, 35 bp, Artificial Sequence
  Synthetic oligonucleotide
tatccgccaccattctgctgttcttcctttcggtg

SEQ ID NO: 111523 - DNA, 35 bp, Artificial Sequence
  Synthetic oligonucleotide
tccccaggcccatggttcatcgctactactagttt

SEQ ID NO: 111524 - DNA, 36 bp, Artificial Sequence
  Synthetic oligonucleotide
tgtcgcctccctctccatatgcctagcgggtaccca

SEQ ID NO: 111525 - DNA, 36 bp, Artificial Sequence
  Synthetic oligonucleotide
tcacagcggcacgctttccgccctgttcgtttccta

SEQ ID NO: 111526 - DNA, 35 bp, Artificial Sequence
  Synthetic oligonucleotide
gcgcccccactccactgccgagcccggatcaccac

SEQ ID NO: 111527 - DNA, 35 bp, Artificial Sequence
  Synthetic oligonucleotide
acaaagccgcaatactgctcccctgccctcaaccg

SEQ ID NO: 111528 - DNA, 35 bp, Artificial Sequence
  Synthetic oligonucleotide
acccgcccacagctgcctacccgggtccccaccaa

SEQ ID NO: 111529 - DNA, 36 bp, Artificial Sequence
  Synthetic oligonucleotide
ggtcgccgccttcgatctcctggttcctcgctagca

SEQ ID NO: 111530 - DNA, 37 bp, Artificial Sequence
  Synthetic oligonucleotide
tgcatcctccattcgtgcttgatcccacctccaaaga

SEQ ID NO: 111531 - DNA, 35 bp, Artificial Sequence
  Synthetic oligonucleotide
gttcacacacgcctccgcccaccgatcccgttagc

SEQ ID NO: 111532 - DNA, 35 bp, Artificial Sequence
  Synthetic oligonucleotide
gttcactcccgcctgtactaccccccaggacctgg

SEQ ID NO: 111533 - DNA, 34 bp, Artificial Sequence
  Synthetic oligonucleotide
gctcaagcgcatgttttcaatccccgtccccgtg

SEQ ID NO: 111534 - DNA, 35 bp, Artificial Sequence
  Synthetic oligonucleotide
gtcactccctccagttcctatgttaggcctccgca

SEQ ID NO: 111535 - DNA, 35 bp, Artificial Sequence
  Synthetic oligonucleotide
gaccaactgtcgcgctgccaccatcatacactttc

SEQ ID NO: 111536 - DNA, 36 bp, Artificial Sequence
  Synthetic oligonucleotide
gcactctgtcgctacatgcccagcccttcctgctca

SEQ ID NO: 111537 - DNA, 35 bp, Artificial Sequence
  Synthetic oligonucleotide
agcactcctcgctgcccgtttttcacgctagtctc

SEQ ID NO: 111538 - DNA, 36 bp, Artificial Sequence
  Synthetic oligonucleotide
gctcgccccctctgtcctgctcataccaatgctaca

SEQ ID NO: 111539 - DNA, 33 bp, Artificial Sequence
  Synthetic oligonucleotide
tcttccccaccgtgaccccgccctgcatttaca

SEQ ID NO: 111540 - DNA, 35 bp, Artificial Sequence
  Synthetic oligonucleotide
gcccacgtccggtttcgcacactcacatgctcctt

SEQ ID NO: 111541 - DNA, 36 bp, Artificial Sequence
  Synthetic oligonucleotide
aatgcccaccgcatcgtatccacccttgcttggcaa

SEQ ID NO: 111542 - DNA, 35 bp, Artificial Sequence
  Synthetic oligonucleotide
gccctccctccgcccgtttgtgacattgtttctag

SEQ ID NO: 111543 - DNA, 35 bp, Artificial Sequence
  Synthetic oligonucleotide
ttcccaccccatgcctattatgaggacactctcat

SEQ ID NO: 111544 - DNA, 35 bp, Artificial Sequence
  Synthetic oligonucleotide
tagagccaccccagcttcactgctttcccacctgt

SEQ ID NO: 111545 - DNA, 37 bp, Artificial Sequence
  Synthetic oligonucleotide
gcgatcccccagttgcgctctgcccaccactcccgga

SEQ ID NO: 111546 - DNA, 38 bp, Artificial Sequence
  Synthetic oligonucleotide
ggacgcatgtcccgtttctttatgcactcctctattga

SEQ ID NO: 111547 - DNA, 35 bp, Artificial Sequence
  Synthetic oligonucleotide
tgtgccgttcctttgcctttctccggtctgttgcc

SEQ ID NO: 111548 - DNA, 34 bp, Artificial Sequence
  Synthetic oligonucleotide
tgccaccgccgacttgctcaacactctagcccga

SEQ ID NO: 111549 - DNA, 37 bp, Artificial Sequence
  Synthetic oligonucleotide
acccccacgctgattctgcccaccgcctttcatgtga

SEQ ID NO: 111550 - DNA, 35 bp, Artificial Sequence
  Synthetic oligonucleotide
gccccctggcgcagcctactttacgttgtccttcc

SEQ ID NO: 111551 - DNA, 35 bp, Artificial Sequence
  Synthetic oligonucleotide
ggtgcccacaggctgccactgacaacccgatcctg

SEQ ID NO: 111552 - DNA, 35 bp, Artificial Sequence
  Synthetic oligonucleotide
gtcagtcaccagcccttgtttcgtttttcctcctg

SEQ ID NO: 111553 - DNA, 37 bp, Artificial Sequence
  Synthetic oligonucleotide
ggagagaggagggacaagggggcaaggagtgtacgga

SEQ ID NO: 111554 - DNA, 35 bp, Artificial Sequence
  Synthetic oligonucleotide
tgactaccgccccctgcgatttaaatatggtcccc

SEQ ID NO: 111555 - DNA, 35 bp, Artificial Sequence
  Synthetic oligonucleotide
atccctctcgccttcattggatccttcgtgccatt

SEQ ID NO: 111556 - DNA, 35 bp, Artificial Sequence
  Synthetic oligonucleotide
aagtcgcccccccctgcgtgaatcaactgccaaca

SEQ ID NO: 111557 - DNA, 37 bp, Artificial Sequence
  Synthetic oligonucleotide
acgtgccacagggtcggagggggtggcgggtggtgga

SEQ ID NO: 111558 - DNA, 38 bp, Artificial Sequence
  Synthetic oligonucleotide
tcccgcccgccttgctccgatctgccacacccgcgtga

SEQ ID NO: 111559 - DNA, 35 bp, Artificial Sequence
  Synthetic oligonucleotide
acacgcgccccatcatcaatcacagccgcattacc

SEQ ID NO: 111560 - DNA, 35 bp, Artificial Sequence
  Synthetic oligonucleotide
gccacccgacacgagccccgcctagtaactgctcc

SEQ ID NO: 111561 - DNA, 35 bp, Artificial Sequence
  Synthetic oligonucleotide
tgacccctcccattgccggcctccgaatatcctgc

SEQ ID NO: 111562 - DNA, 35 bp, Artificial Sequence
  Synthetic oligonucleotide
tccgccccttgtcaacgcctgccccccgaatattg

SEQ ID NO: 111563 - DNA, 38 bp, Artificial Sequence
  Synthetic oligonucleotide
tgagggaggagggaggggggtggatttggacggtatga

SEQ ID NO: 111564 - DNA, 35 bp, Artificial Sequence
  Synthetic oligonucleotide
tactcacctgcgaacgcagtagtatcacccttacc

SEQ ID NO: 111565 - DNA, 35 bp, Artificial Sequence
  Synthetic oligonucleotide
ttgcacactcgccaacattccgggctcccactccc

SEQ ID NO: 111566 - DNA, 35 bp, Artificial Sequence
  Synthetic oligonucleotide
gatccgtcacgcgcccgccctgttaaagccccgtc

SEQ ID NO: 111567 - DNA, 35 bp, Artificial Sequence
  Synthetic oligonucleotide
gaaccttgcccgccgctgagctctaccatctccgt

SEQ ID NO: 111568 - DNA, 35 bp, Artificial Sequence
  Synthetic oligonucleotide
tagcacggaatgcactttggccgctctacacttcc

SEQ ID NO: 111569 - DNA, 35 bp, Artificial Sequence
  Synthetic oligonucleotide
cacaccttgtgggcggtctccttgatctacctccg

SEQ ID NO: 111570 - DNA, 35 bp, Artificial Sequence
  Synthetic oligonucleotide
tcaaggcataccgggggggaggcgggcggggaata

SEQ ID NO: 111571 - DNA, 36 bp, Artificial Sequence
  Synthetic oligonucleotide
attcactgcgctgcattcgtcccgtaccgctcccta

SEQ ID NO: 111572 - DNA, 36 bp, Artificial Sequence
  Synthetic oligonucleotide
atcactcggccatgtgacccgcgacccctctctgca

SEQ ID NO: 111573 - DNA, 38 bp, Artificial Sequence
  Synthetic oligonucleotide
gccctgcccccgctttcttccgaccttgcccttggtga

SEQ ID NO: 111574 - DNA, 35 bp, Artificial Sequence
  Synthetic oligonucleotide
gtaccgccctggttctaaaacacgttaaccctccc

SEQ ID NO: 111575 - DNA, 35 bp, Artificial Sequence
  Synthetic oligonucleotide
actctgcgcccatagcatcgtcatcccctgccccg

SEQ ID NO: 111576 - DNA, 36 bp, Artificial Sequence
  Synthetic oligonucleotide
gaaagggcggaaggctagacgaggtggtggagggga

SEQ ID NO: 111577 - DNA, 37 bp, Artificial Sequence
  Synthetic oligonucleotide
tacgcactccgccctgacttgtttaccgccacgctga

SEQ ID NO: 111578 - DNA, 38 bp, Artificial Sequence
  Synthetic oligonucleotide
gtccccagccgcatattctactcgctgcttattaatga

SEQ ID NO: 111579 - DNA, 37 bp, Artificial Sequence
  Synthetic oligonucleotide
ttgtgcccgccattgctttccttgccgactctcgtga

SEQ ID NO: 111580 - DNA, 35 bp, Artificial Sequence
  Synthetic oligonucleotide
acaccactctgccgactcgtttcaatgacgctgcc

SEQ ID NO: 111581 - DNA, 35 bp, Artificial Sequence
  Synthetic oligonucleotide
actatcgctcctcgctggggttcttcctgtccttc

SEQ ID NO: 111582 - DNA, 35 bp, Artificial Sequence
  Synthetic oligonucleotide
tagccctgcgcctttcgtcgtactcgcattcttct

SEQ ID NO: 111583 - DNA, 36 bp, Artificial Sequence
  Synthetic oligonucleotide
gtggcctatgcctctgccctgtcttacccttcgaca

SEQ ID NO: 111584 - DNA, 38 bp, Artificial Sequence
  Synthetic oligonucleotide
gccgacgtagggcaggggggagggaaagtacgagatga

SEQ ID NO: 111585 - DNA, 35 bp, Artificial Sequence
  Synthetic oligonucleotide
gccgtttcagctctgcttacccttcccgattggcc

SEQ ID NO: 111586 - DNA, 34 bp, Artificial Sequence
  Synthetic oligonucleotide
gttgcggatctagccctttattacgtgccccttc

SEQ ID NO: 111587 - DNA, 35 bp, Artificial Sequence
  Synthetic oligonucleotide
gcttactccgccgacgacgtaccacgtcccttctc

SEQ ID NO: 111588 - DNA, 37 bp, Artificial Sequence
  Synthetic oligonucleotide
gagacacggggaggtggaggggtaacggaatgcaaga

SEQ ID NO: 111589 - DNA, 38 bp, Artificial Sequence
  Synthetic oligonucleotide
gcacgctgccctctgctttatgggctccctcctcttga

SEQ ID NO: 111590 - DNA, 35 bp, Artificial Sequence
  Synthetic oligonucleotide
gtcatctgccgctccacatccggattgctactcac

SEQ ID NO: 111591 - DNA, 38 bp, Artificial Sequence
  Synthetic oligonucleotide
tttgccacccctgccctgtgctcgttctctgatcttga

SEQ ID NO: 111592 - DNA, 37 bp, Artificial Sequence
  Synthetic oligonucleotide
ccagggggagggtacaggatgggaaaaaagggaagga

SEQ ID NO: 111593 - DNA, 35 bp, Artificial Sequence
  Synthetic oligonucleotide
tgcccaccccttggccacatcgtatcaaccaccgc

SEQ ID NO: 111594 - DNA, 35 bp, Artificial Sequence
  Synthetic oligonucleotide
ttgaccgccctccccgtaaatcagcatatacccat

SEQ ID NO: 111595 - DNA, 35 bp, Artificial Sequence
  Synthetic oligonucleotide
gatgcaccgactgtcctgtgcgtcccttgccaacc

SEQ ID NO: 111596 - DNA, 35 bp, Artificial Sequence
  Synthetic oligonucleotide
tgccccggcctcctaccccttacgctccctttggc

SEQ ID NO: 111597 - DNA, 36 bp, Artificial Sequence
  Synthetic oligonucleotide
gatctcgccctggtatgctaccttttccccccgcaa

SEQ ID NO: 111598 - DNA, 35 bp, Artificial Sequence
  Synthetic oligonucleotide
ggtcgcctccagccgagcctttgtaacctttctca

SEQ ID NO: 111599 - DNA, 35 bp, Artificial Sequence
  Synthetic oligonucleotide
tcccccgccgctctctattcactaccgatcacccg

SEQ ID NO: 111600 - DNA, 35 bp, Artificial Sequence
  Synthetic oligonucleotide
acaccgtcccggccttcgacgctgaatcccgcctt

SEQ ID NO: 111601 - DNA, 35 bp, Artificial Sequence
  Synthetic oligonucleotide
tactgatcgaccgtttttgccccttgccgaccacc

SEQ ID NO: 111602 - DNA, 35 bp, Artificial Sequence
  Synthetic oligonucleotide
tctggcccctcaggacgttagccccccggtccccc

SEQ ID NO: 111603 - DNA, 35 bp, Artificial Sequence
  Synthetic oligonucleotide
atgtccccgctccctcgttgatagcatctggcttt

SEQ ID NO: 111604 - DNA, 37 bp, Artificial Sequence
  Synthetic oligonucleotide
tcacctcctcctatgttgtacgacccattacccctga

SEQ ID NO: 111605 - DNA, 35 bp, Artificial Sequence
  Synthetic oligonucleotide
tcgtgaccacaacagggatagacgggtgggagggc

SEQ ID NO: 111606 - DNA, 34 bp, Artificial Sequence
  Synthetic oligonucleotide
acagtgatcgccatctcgcctgtcattacccctt

SEQ ID NO: 111607 - DNA, 35 bp, Artificial Sequence
  Synthetic oligonucleotide
gccacgtgggcctcatctttcacctctctgcctgc

SEQ ID NO: 111608 - DNA, 35 bp, Artificial Sequence
  Synthetic oligonucleotide
tgtgcccacttcacctgctgcctatgtaacattat

SEQ ID NO: 111609 - DNA, 35 bp, Artificial Sequence
  Synthetic oligonucleotide
gtttgggcctccatcttgtttcttcagtctgcctt

SEQ ID NO: 111610 - DNA, 35 bp, Artificial Sequence
  Synthetic oligonucleotide
taccgagccacatgtcctgatcctggtttcttctt

SEQ ID NO: 111611 - DNA, 35 bp, Artificial Sequence
  Synthetic oligonucleotide
gaccgcatccctcgatcccggccttccccaactga

SEQ ID NO: 111612 - DNA, 35 bp, Artificial Sequence
  Synthetic oligonucleotide
ttgcaaccacagtgcgcccacatattccttctgtc

SEQ ID NO: 111613 - DNA, 38 bp, Artificial Sequence
  Synthetic oligonucleotide
acagcaaccgggaggggcgatatggggttcggggttga

SEQ ID NO: 111614 - DNA, 35 bp, Artificial Sequence
  Synthetic oligonucleotide
gtacccccgacgggtccttgcccattgattctctc

SEQ ID NO: 111615 - DNA, 35 bp, Artificial Sequence
  Synthetic oligonucleotide
tgccccccgccctcgttcctgtggccccgcaacaa

SEQ ID NO: 111616 - DNA, 37 bp, Artificial Sequence
  Synthetic oligonucleotide
ttacgagggaaggagggggagggatgatgcgggcgga

SEQ ID NO: 111617 - DNA, 37 bp, Artificial Sequence
  Synthetic oligonucleotide
tttacgggcggggggaacgaacgggaaaagggggtga

SEQ ID NO: 111618 - DNA, 35 bp, Artificial Sequence
  Synthetic oligonucleotide
tcgcagacctctcttgcgtttaacccaatgccctc

SEQ ID NO: 111619 - DNA, 37 bp, Artificial Sequence
  Synthetic oligonucleotide
gccatgactcgcaccgctcccccctcagttaggacga

SEQ ID NO: 111620 - DNA, 35 bp, Artificial Sequence
  Synthetic oligonucleotide
gtgcccgccaggccccctcgcaccttcatactttg

SEQ ID NO: 111621 - DNA, 36 bp, Artificial Sequence
  Synthetic oligonucleotide
tcagtcctcccataagtcatcgtcgcccgcccctca

SEQ ID NO: 111622 - DNA, 37 bp, Artificial Sequence
  Synthetic oligonucleotide
tttgcccgtcctggtgggaaagggagggaggggacga

SEQ ID NO: 111623 - DNA, 38 bp, Artificial Sequence
  Synthetic oligonucleotide
ggaacgtaggcagggggcatggagggggatggacgtga

SEQ ID NO: 111624 - DNA, 35 bp, Artificial Sequence
  Synthetic oligonucleotide
accgagcccctccatttgactgtctgcccgggccc

SEQ ID NO: 111625 - DNA, 35 bp, Artificial Sequence
  Synthetic oligonucleotide
taagaccgccaccgcccccgacgacccgccaattc

SEQ ID NO: 111626 - DNA, 34 bp, Artificial Sequence
  Synthetic oligonucleotide
agtttgccccgtttgccttgtccattcccatcct

SEQ ID NO: 111627 - DNA, 36 bp, Artificial Sequence
  Synthetic oligonucleotide
gaacgagcaacatgataggggtcgggcgggatggga

SEQ ID NO: 111628 - DNA, 37 bp, Artificial Sequence
  Synthetic oligonucleotide
gttgcccttcgttgtcgctcccgttacgctgccttga

SEQ ID NO: 111629 - DNA, 35 bp, Artificial Sequence
  Synthetic oligonucleotide
tagccgctcatccctgctcggaccttcgcctgccc

SEQ ID NO: 111630 - DNA, 35 bp, Artificial Sequence
  Synthetic oligonucleotide
gcccgctcctcttccgtcaaagctcctacctcgcg

SEQ ID NO: 111631 - DNA, 35 bp, Artificial Sequence
  Synthetic oligonucleotide
actacatccggcctgaactcctttggaccatcatt

SEQ ID NO: 111632 - DNA, 35 bp, Artificial Sequence
  Synthetic oligonucleotide
gttagccacacacctcgcaccgatcgcattgcttc

SEQ ID NO: 111633 - DNA, 35 bp, Artificial Sequence
  Synthetic oligonucleotide
tcgacactcgcccacccgattcgagccccgcttct

SEQ ID NO: 111634 - DNA, 37 bp, Artificial Sequence
  Synthetic oligonucleotide
tataggtcgtggcacgtgggatggatgggaggtgtga

SEQ ID NO: 111635 - DNA, 35 bp, Artificial Sequence
  Synthetic oligonucleotide
gcgtgccgcccctccccagtgtctctttctgttgt

SEQ ID NO: 111636 - DNA, 38 bp, Artificial Sequence
  Synthetic oligonucleotide
ggggaaacaagggagtatgggagggagtgggggggtga

SEQ ID NO: 111637 - DNA, 35 bp, Artificial Sequence
  Synthetic oligonucleotide
gccccgcatgtgacgtttcaagttttttccccctg

SEQ ID NO: 111638 - DNA, 35 bp, Artificial Sequence
  Synthetic oligonucleotide
atgagcgccctctcgtgtacttccgtccctcttct

SEQ ID NO: 111639 - DNA, 35 bp, Artificial Sequence
  Synthetic oligonucleotide
tggtcgtgtcaattgcttcaccccaccgtccctgc

SEQ ID NO: 111640 - DNA, 35 bp, Artificial Sequence
  Synthetic oligonucleotide
tacccaacattctgatccttcctgcccccatgtgc

SEQ ID NO: 111641 - DNA, 35 bp, Artificial Sequence
  Synthetic oligonucleotide
gttggggggtgcagggtggggagatcgtgcgtcgt

SEQ ID NO: 111642 - DNA, 37 bp, Artificial Sequence
  Synthetic oligonucleotide
agcccctcagtcgcgttcgacactcccctccctctga

SEQ ID NO: 111643 - DNA, 35 bp, Artificial Sequence
  Synthetic oligonucleotide
tctgtcctgccgtcttactttctgtctcacgccac

SEQ ID NO: 111644 - DNA, 35 bp, Artificial Sequence
  Synthetic oligonucleotide
tcgccaccccatgtatctatccctcggtatgccac

SEQ ID NO: 111645 - DNA, 35 bp, Artificial Sequence
  Synthetic oligonucleotide
actcgcccctgttagcccccgcacgccgagccctc

SEQ ID NO: 111646 - DNA, 36 bp, Artificial Sequence
  Synthetic oligonucleotide
ttccaccacgatcccgatttcagaaagcgcacctca

SEQ ID NO: 111647 - DNA, 34 bp, Artificial Sequence
  Synthetic oligonucleotide
agtgccgtgtccgcgtcttacccacaacctccac

SEQ ID NO: 111648 - DNA, 35 bp, Artificial Sequence
  Synthetic oligonucleotide
aaacacgccggcccttctagtgtcagcaaccttcc

SEQ ID NO: 111649 - DNA, 35 bp, Artificial Sequence
  Synthetic oligonucleotide
tatgcccatcattgccctatctccctcacggcctc

SEQ ID NO: 111650 - DNA, 35 bp, Artificial Sequence
  Synthetic oligonucleotide
tgtcactaggtcgcgcttcatccctggcaccacca

SEQ ID NO: 111651 - DNA, 36 bp, Artificial Sequence
  Synthetic oligonucleotide
acgccccgcctcctcccttgctgcgatggtcttcta

SEQ ID NO: 111652 - DNA, 35 bp, Artificial Sequence
  Synthetic oligonucleotide
gagccccgcctacagccgtcttttcagccctttct

SEQ ID NO: 111653 - DNA, 35 bp, Artificial Sequence
  Synthetic oligonucleotide
gctcagggggaataggggatgaagggattggcgaa

SEQ ID NO: 111654 - DNA, 35 bp, Artificial Sequence
  Synthetic oligonucleotide
tcaagcactcaccacgtcctgtctcccctgtaaac

SEQ ID NO: 111655 - DNA, 35 bp, Artificial Sequence
  Synthetic oligonucleotide
gccaacacaccctgtctctctatatcgcctgagcg

SEQ ID NO: 111656 - DNA, 37 bp, Artificial Sequence
  Synthetic oligonucleotide
ttacctccccattgctacttgaaccacgtcccttcga

SEQ ID NO: 111657 - DNA, 35 bp, Artificial Sequence
  Synthetic oligonucleotide
gcttcaggccagcctacgaccctcccctgcgctgc

SEQ ID NO: 111658 - DNA, 37 bp, Artificial Sequence
  Synthetic oligonucleotide
ttgcgtggagaggggctaacaatgggaggggggtgga

SEQ ID NO: 111659 - DNA, 35 bp, Artificial Sequence
  Synthetic oligonucleotide
tcttcaccagtcacccatcgtccatcccaacccgg

SEQ ID NO: 111660 - DNA, 38 bp, Artificial Sequence
  Synthetic oligonucleotide
tgacgcccatgtccttcgcccctcgtcatccaccctga

SEQ ID NO: 111661 - DNA, 35 bp, Artificial Sequence
  Synthetic oligonucleotide
gcctgacctcctattcgtgttagcgcctctattac

SEQ ID NO: 111662 - DNA, 35 bp, Artificial Sequence
  Synthetic oligonucleotide
acacagcgcaagccacgctcgccactcctacgttc

SEQ ID NO: 111663 - DNA, 36 bp, Artificial Sequence
  Synthetic oligonucleotide
tgttgcccccctcgcattgctacaccttttaacgga

SEQ ID NO: 111664 - DNA, 35 bp, Artificial Sequence
  Synthetic oligonucleotide
aagcagtcacctggctcgtcctcctgcccctcgct

SEQ ID NO: 111665 - DNA, 35 bp, Artificial Sequence
  Synthetic oligonucleotide
tccccacgcctcttgccctcctcatagtaccgcgt

SEQ ID NO: 111666 - DNA, 36 bp, Artificial Sequence
  Synthetic oligonucleotide
atcgcggggacgtttggggaataaagggcggggtaa

SEQ ID NO: 111667 - DNA, 35 bp, Artificial Sequence
  Synthetic oligonucleotide
aacccctcccgtccccaggcagtagcgtgtctatc

SEQ ID NO: 111668 - DNA, 35 bp, Artificial Sequence
  Synthetic oligonucleotide
acccgccccacactcctcttaagtacgccatctat

SEQ ID NO: 111669 - DNA, 37 bp, Artificial Sequence
  Synthetic oligonucleotide
ttccgccccagccccaaacgtactcgttatttcttga

SEQ ID NO: 111670 - DNA, 34 bp, Artificial Sequence
  Synthetic oligonucleotide
gtgacaacactcccgattcagtttctgccattct

SEQ ID NO: 111671 - DNA, 35 bp, Artificial Sequence
  Synthetic oligonucleotide
acaccactccggctttccgtttggcgactacaccc

SEQ ID NO: 111672 - DNA, 35 bp, Artificial Sequence
  Synthetic oligonucleotide
ccatcccacatgttactcgccttccctggttagcc

SEQ ID NO: 111673 - DNA, 37 bp, Artificial Sequence; identical to SEQ ID NO: 23627
  Synthetic oligonucleotide

SEQ ID NO: 111674 - DNA, 35 bp, Artificial Sequence
  Synthetic oligonucleotide
tgacgtccccgcctgaatcgttcccatacatcgtc

SEQ ID NO: 111675 - DNA, 35 bp, Artificial Sequence
  Synthetic oligonucleotide
acgctccctcgcccgccaacagcctggttcttgtc

SEQ ID NO: 111676 - DNA, 35 bp, Artificial Sequence
  Synthetic oligonucleotide
accatcaatccattgcgcttaaggtctttctccct

SEQ ID NO: 111677 - DNA, 36 bp, Artificial Sequence
  Synthetic oligonucleotide
ttatacgcgaaccgcgtcgcccctgttccgccccca

SEQ ID NO: 111678 - DNA, 37 bp, Artificial Sequence
  Synthetic oligonucleotide
ggacacccagctgcttttcccgtctgctcgaccccga

SEQ ID NO: 111679 - DNA, 36 bp, Artificial Sequence
  Synthetic oligonucleotide
gcaagagacgtgcagggggggagatttgggcaggga

SEQ ID NO: 111680 - DNA, 35 bp, Artificial Sequence
  Synthetic oligonucleotide
tacccgcccacaacctacatccgagcacttgccgc

SEQ ID NO: 111681 - DNA, 35 bp, Artificial Sequence
  Synthetic oligonucleotide
tccgccacactctgatcggcttctttgtttgtctc

SEQ ID NO: 111682 - DNA, 35 bp, Artificial Sequence
  Synthetic oligonucleotide
gcctagccccccatggttattcgcgggtcgccttc

SEQ ID NO: 111683 - DNA, 35 bp, Artificial Sequence
  Synthetic oligonucleotide
agaccctccgctccatactgcttcctgccgttacg

SEQ ID NO: 111684 - DNA, 35 bp, Artificial Sequence
  Synthetic oligonucleotide
tatccaccacactccactatgcgcaccgtgcaacg

SEQ ID NO: 111685 - DNA, 35 bp, Artificial Sequence
  Synthetic oligonucleotide
acccgcaccgcccatccgaatgcgattcacccaat

SEQ ID NO: 111686 - DNA, 38 bp, Artificial Sequence
  Synthetic oligonucleotide
gaagggaacaggcggaggcaagggagcgtgatatgtga

SEQ ID NO: 111687 - DNA, 35 bp, Artificial Sequence
  Synthetic oligonucleotide
ggaccaaccgcctgtgcatatcggccattcacatc

SEQ ID NO: 111688 - DNA, 35 bp, Artificial Sequence
  Synthetic oligonucleotide
ggacattgccggtgcgttcttcctgcgcgttccac

SEQ ID NO: 111689 - DNA, 35 bp, Artificial Sequence
  Synthetic oligonucleotide
agcaccctcggctcacttgcgccttgacctcctca

SEQ ID NO: 111690 - DNA, 35 bp, Artificial Sequence
  Synthetic oligonucleotide
aactccccctgacgcccgattgagcacccgcgccc

SEQ ID NO: 111691 - DNA, 35 bp, Artificial Sequence
  Synthetic oligonucleotide
gacgatcacgggcacgcgggttcactagttcctcc

SEQ ID NO: 111692 - DNA, 35 bp, Artificial Sequence
  Synthetic oligonucleotide
gttagcccctgtgcctcttcactgtttcattgcct

SEQ ID NO: 111693 - DNA, 35 bp, Artificial Sequence
  Synthetic oligonucleotide
acaccagctcgccgttactctcgacctcgccgctt

SEQ ID NO: 111694 - DNA, 35 bp, Artificial Sequence
  Synthetic oligonucleotide
gacaccgcctgtaacccaggtcctaccatgccgcc

SEQ ID NO: 111695 - DNA, 36 bp, Artificial Sequence
  Synthetic oligonucleotide
tcccattccgctgactttacaacctgtgtcttcgca

SEQ ID NO: 111696 - DNA, 35 bp, Artificial Sequence
  Synthetic oligonucleotide
gacagcccgtctggcattcgcactctccgcccttc

SEQ ID NO: 111697 - DNA, 35 bp, Artificial Sequence
  Synthetic oligonucleotide
atggccgtacatgcgcgcccactgctcctatcttc

SEQ ID NO: 111698 - DNA, 35 bp, Artificial Sequence
  Synthetic oligonucleotide
gctaccatccgtccttgtcctcctctatgctcgcc

SEQ ID NO: 111699 - DNA, 35 bp, Artificial Sequence
  Synthetic oligonucleotide
tcgacatggctcactatatgcacccaccatgcctc

SEQ ID NO: 111700 - DNA, 30 bp, Artificial Sequence
  Synthetic oligonucleotide
gtgcccaccactcagccctggtttacgttc

SEQ ID NO: 111701 - DNA, 35 bp, Artificial Sequence
  Synthetic oligonucleotide
ttcgattcctcgttctgacgtctcctcgccccttg

SEQ ID NO: 111702 - DNA, 35 bp, Artificial Sequence
  Synthetic oligonucleotide
gcgacgggcgggtgggacgttacagtgagggtcct

SEQ ID NO: 111703 - DNA, 35 bp, Artificial Sequence
  Synthetic oligonucleotide
ttggcgtgtacattgccgttctccccccctacgct

SEQ ID NO: 111704 - DNA, 35 bp, Artificial Sequence
  Synthetic oligonucleotide
tcatccctcgtgttatcccattgcctgacctttct

SEQ ID NO: 111705 - DNA, 36 bp, Artificial Sequence
  Synthetic oligonucleotide
actgggggacgttacggctgggaaggggaaggggga

SEQ ID NO: 111706 - DNA, 35 bp, Artificial Sequence
  Synthetic oligonucleotide
tcagatcgctcactaccagtctttgaacctaccac

SEQ ID NO: 111707 - DNA, 35 bp, Artificial Sequence
  Synthetic oligonucleotide
accccatgtccactacagtcgatacttgcactccc

SEQ ID NO: 111708 - DNA, 35 bp, Artificial Sequence
  Synthetic oligonucleotide
tgtttctgcacccacctgtcttcagactcgcccct

SEQ ID NO: 111709 - DNA, 35 bp, Artificial Sequence
  Synthetic oligonucleotide
tatcctcgccctgtacaagcctgttatcctttctt

SEQ ID NO: 111710 - DNA, 35 bp, Artificial Sequence
  Synthetic oligonucleotide
gactggtcacttgcgcgtgccggccattcatcccc

SEQ ID NO: 111711 - DNA, 35 bp, Artificial Sequence
  Synthetic oligonucleotide
tgaaaacgggtgggtggggagggcatgaagttttc

SEQ ID NO: 111712 - DNA, 36 bp, Artificial Sequence
  Synthetic oligonucleotide
atggccgcccatcgctctgtaccggccactcactca

SEQ ID NO: 111713 - DNA, 38 bp, Artificial Sequence
  Synthetic oligonucleotide
ggggacaaggggacgggaaagggataacagagatgtga

SEQ ID NO: 111714 - DNA, 36 bp, Artificial Sequence
  Synthetic oligonucleotide
ggactacccgctagttcgtattggcccccctcccca

SEQ ID NO: 111715 - DNA, 37 bp, Artificial Sequence
  Synthetic oligonucleotide
gagcacccactacaccttatgccctctgctctgctga

SEQ ID NO: 111716 - DNA, 35 bp, Artificial Sequence
  Synthetic oligonucleotide
accccatcgccacaccgtctgcctattcctgctcc

SEQ ID NO: 111717 - DNA, 35 bp, Artificial Sequence
  Synthetic oligonucleotide
tcatcatgtcgccctgtcttgcctctctgctgatc

SEQ ID NO: 111718 - DNA, 36 bp, Artificial Sequence
  Synthetic oligonucleotide
gcactgtgacagggggggattgggggaaggcgtgca

SEQ ID NO: 111719 - DNA, 35 bp, Artificial Sequence
  Synthetic oligonucleotide
ttgcgtcgatcggcccgttgtgcactacccaccct

SEQ ID NO: 111720 - DNA, 35 bp, Artificial Sequence
  Synthetic oligonucleotide
tcagtaccatccccgcggcccagttttattcctca

SEQ ID NO: 111721 - DNA, 36 bp, Artificial Sequence
  Synthetic oligonucleotide
ttaccccgccgcctgactaatttctgtgacccccga

SEQ ID NO: 111722 - DNA, 35 bp, Artificial Sequence
  Synthetic oligonucleotide
ttgacattacgccacgaccccgccctctgcacctg

SEQ ID NO: 111723 - DNA, 36 bp, Artificial Sequence
  Synthetic oligonucleotide
aacatccgccccgccgagacatgcgatctacctgca

SEQ ID NO: 111724 - DNA, 37 bp, Artificial Sequence
  Synthetic oligonucleotide
tgtacgcctcatactttgccctgccccctacgcccga

SEQ ID NO: 111725 - DNA, 35 bp, Artificial Sequence
  Synthetic oligonucleotide
tacgtcgccaccttctgctgaactcacgccctggt

SEQ ID NO: 111726 - DNA, 35 bp, Artificial Sequence
  Synthetic oligonucleotide
gagacatgggcttggtgggaatgaagggtggagga

SEQ ID NO: 111727 - DNA, 36 bp, Artificial Sequence
  Synthetic oligonucleotide
gtagtgtagccgccctcttatactgccccccttgga

SEQ ID NO: 111728 - DNA, 38 bp, Artificial Sequence
  Synthetic oligonucleotide
gatgtgtcagcagggcaagagggaggatgagaaggtga

SEQ ID NO: 111729 - DNA, 35 bp, Artificial Sequence
  Synthetic oligonucleotide
acctggcccacacccatggccttactctagactac

SEQ ID NO: 111730 - DNA, 35 bp, Artificial Sequence
  Synthetic oligonucleotide
tgttccacggctcatgggagggagggggggcaata

SEQ ID NO: 111731 - DNA, 35 bp, Artificial Sequence
  Synthetic oligonucleotide
aatcccccgcccctgtttcgaatagcacctccgaa

SEQ ID NO: 111732 - DNA, 35 bp, Artificial Sequence
  Synthetic oligonucleotide
gcttgacgcctactctgtttcaggcccttctctca

SEQ ID NO: 111733 - DNA, 35 bp, Artificial Sequence
  Synthetic oligonucleotide
gcgtgacggtcttagccctgtactatcgttcctac

SEQ ID NO: 111734 - DNA, 35 bp, Artificial Sequence
  Synthetic oligonucleotide
gcactgcaggcgcctgtttcttgtccttgctcatc

SEQ ID NO: 111735 - DNA, 35 bp, Artificial Sequence
  Synthetic oligonucleotide
tgagtgcctcgctccactgctgttttggtctcccg

SEQ ID NO: 111736 - DNA, 36 bp, Artificial Sequence
  Synthetic oligonucleotide
gcccctgccgtcacagccttcctatgcctcttccca

SEQ ID NO: 111737 - DNA, 37 bp, Artificial Sequence
  Synthetic oligonucleotide
acgatgccccttatctcccgccgctgtccctggagga

SEQ ID NO: 111738 - DNA, 37 bp, Artificial Sequence
  Synthetic oligonucleotide
tatgcatggggatgatgggggactggggggcgaggga

SEQ ID NO: 111739 - DNA, 35 bp, Artificial Sequence
  Synthetic oligonucleotide
gcccacgtactggggatcctacgctcttctccgct

SEQ ID NO: 111740 - DNA, 35 bp, Artificial Sequence
  Synthetic oligonucleotide
tgccccgccccgacccgataggccttattgtctac

SEQ ID NO: 111741 - DNA, 35 bp, Artificial Sequence
  Synthetic oligonucleotide
tcatccccctcgccggtgccaaaatcacacttctg

SEQ ID NO: 111742 - DNA, 37 bp, Artificial Sequence
  Synthetic oligonucleotide
tgtaccacatttgttgctccctcacctcccaccggga

SEQ ID NO: 111743 - DNA, 35 bp, Artificial Sequence
  Synthetic oligonucleotide
acgcccaactccacgctccacaccgctgtttttac

SEQ ID NO: 111744 - DNA, 35 bp, Artificial Sequence
  Synthetic oligonucleotide
attcctattcagtgcaccacgcgcctctgccactc

SEQ ID NO: 111745 - DNA, 35 bp, Artificial Sequence
  Synthetic oligonucleotide
ggtcgggggaggaggtagagtaggccatgggggtg

SEQ ID NO: 111746 - DNA, 35 bp, Artificial Sequence
  Synthetic oligonucleotide
tcacccgttcgccacggctccccttcgctcccggt

SEQ ID NO: 111747 - DNA, 35 bp, Artificial Sequence
  Synthetic oligonucleotide
gcagatccgcgtgtctccatcgccccctcgtttca

SEQ ID NO: 111748 - DNA, 37 bp, Artificial Sequence
  Synthetic oligonucleotide
gtacagaggatcgggaagggggaaggggagttaagga

SEQ ID NO: 111749 - DNA, 35 bp, Artificial Sequence
  Synthetic oligonucleotide
tcacatccgtgctgtgctcttcaaccgatctcccg

SEQ ID NO: 111750 - DNA, 35 bp, Artificial Sequence
  Synthetic oligonucleotide
ggacctgccctgttcccgtctctgagtttcctttg

SEQ ID NO: 111751 - DNA, 35 bp, Artificial Sequence
  Synthetic oligonucleotide
accctgagccaatggcgctcactcctgaccccttt

SEQ ID NO: 111752 - DNA, 37 bp, Artificial Sequence
  Synthetic oligonucleotide
tgccatcccacaggtcctcgccgtttttgttcctcga

SEQ ID NO: 111753 - DNA, 35 bp, Artificial Sequence
  Synthetic oligonucleotide
tcagctgaccgcccacgtctcctccagccaatgtc

SEQ ID NO: 111754 - DNA, 35 bp, Artificial Sequence
  Synthetic oligonucleotide
accttcccctcccgtgggtcataaacctgcactct

SEQ ID NO: 111755 - DNA, 36 bp, Artificial Sequence
  Synthetic oligonucleotide
gttttcgcccgtcccgttcgcgtttcctgttcatca

SEQ ID NO: 111756 - DNA, 35 bp, Artificial Sequence
  Synthetic oligonucleotide
gtgtgaagggggggaggttgaaggaatggaacgga

SEQ ID NO: 111757 - DNA, 35 bp, Artificial Sequence
  Synthetic oligonucleotide
gacccccccgcataccctgttgttcgtctccggac

SEQ ID NO: 111758 - DNA, 35 bp, Artificial Sequence
  Synthetic oligonucleotide
ttgacgccccgtaattatttaatagcctgaccccc

SEQ ID NO: 111759 - DNA, 35 bp, Artificial Sequence
  Synthetic oligonucleotide
tgccgcaccccgggtcttctcatctatcgcgcgat

SEQ ID NO: 111760 - DNA, 35 bp, Artificial Sequence
  Synthetic oligonucleotide
tgaagtcgccggtaaatcgccagcctccctcttct

SEQ ID NO: 111761 - DNA, 35 bp, Artificial Sequence
  Synthetic oligonucleotide
tccgccgaccctgtccctctttaaatgcatccgcg

SEQ ID NO: 111762 - DNA, 36 bp, Artificial Sequence
  Synthetic oligonucleotide
gacgggggggcaaggaccggaggaaacgtgagggga

SEQ ID NO: 111763 - DNA, 35 bp, Artificial Sequence
  Synthetic oligonucleotide
gtcattggcacatgctcccctcacccgccattggc

SEQ ID NO: 111764 - DNA, 35 bp, Artificial Sequence
  Synthetic oligonucleotide
tgatggcccaatatcgagcgcgagaccgcaccttc

SEQ ID NO: 111765 - DNA, 35 bp, Artificial Sequence
  Synthetic oligonucleotide
atgccccagccgccctatgccctcgttccttcatt

SEQ ID NO: 111766 - DNA, 35 bp, Artificial Sequence
  Synthetic oligonucleotide
tgcacacccgcccatgcggcccattaaccctctca

SEQ ID NO: 111767 - DNA, 34 bp, Artificial Sequence
  Synthetic oligonucleotide
gcaccaccacgctctgggacttattttcactcgc

SEQ ID NO: 111768 - DNA, 35 bp, Artificial Sequence
  Synthetic oligonucleotide
tactccgacctctgcttattccttgacccatcccg

SEQ ID NO: 111769 - DNA, 35 bp, Artificial Sequence
  Synthetic oligonucleotide
gcccccacagcgtccgtcccttatagcccgtcact

SEQ ID NO: 111770 - DNA, 35 bp, Artificial Sequence
  Synthetic oligonucleotide
tcatcgcatcacgcgttatacacattctgcccacc

SEQ ID NO: 111771 - DNA, 35 bp, Artificial Sequence
  Synthetic oligonucleotide
aagtcacgccggtccgacccctcctcacatttggc

SEQ ID NO: 111772 - DNA, 34 bp, Artificial Sequence
  Synthetic oligonucleotide
aacaccgccgggacctcacttctcacttgcctag

SEQ ID NO: 111773 - DNA, 35 bp, Artificial Sequence
  Synthetic oligonucleotide
gccccctgtagtgcccaccatcccgttttcgaagg

SEQ ID NO: 111774 - DNA, 35 bp, Artificial Sequence
  Synthetic oligonucleotide
tcaccattctgacgctcacaattgctccacctttg

SEQ ID NO: 111775 - DNA, 35 bp, Artificial Sequence
  Synthetic oligonucleotide
gacccagactccccccttgtatgaattgtgctccc

SEQ ID NO: 111776 - DNA, 35 bp, Artificial Sequence
  Synthetic oligonucleotide
tgccctgaagcacggcacggagcgccttcacctcc

SEQ ID NO: 111777 - DNA, 35 bp, Artificial Sequence
  Synthetic oligonucleotide
tccacgtcgacttatcttcgctcttcatcccccgt

SEQ ID NO: 111778 - DNA, 36 bp, Artificial Sequence
  Synthetic oligonucleotide
atctgccccgtccatactctctcctgctcaagcgca

SEQ ID NO: 111779 - DNA, 35 bp, Artificial Sequence
  Synthetic oligonucleotide
agactccctcccatctgtcccgatttcctccctga

SEQ ID NO: 111780 - DNA, 35 bp, Artificial Sequence
  Synthetic oligonucleotide
tccaccccgcatcaactcctgctctaatggtcaac

SEQ ID NO: 111781 - DNA, 35 bp, Artificial Sequence
  Synthetic oligonucleotide
atcgtgcacgctgttcctttacgctgctttccttc

SEQ ID NO: 111782 - DNA, 35 bp, Artificial Sequence
  Synthetic oligonucleotide
gccgctgctccactccgcttaatgcaccactcgcg

SEQ ID NO: 111783 - DNA, 35 bp, Artificial Sequence
  Synthetic oligonucleotide
gtccttcgcacacctgccatcctctctgagctcgc

SEQ ID NO: 111784 - DNA, 35 bp, Artificial Sequence
  Synthetic oligonucleotide
tcctgctcccacgttaataccggtctgtagctctc

SEQ ID NO: 111785 - DNA, 35 bp, Artificial Sequence
  Synthetic oligonucleotide
gcctaccatgcccctcgtgagtcgtttggccttcc

SEQ ID NO: 111786 - DNA, 35 bp, Artificial Sequence
  Synthetic oligonucleotide
atggtcgcctgactgacttccccactcgcacactc

SEQ ID NO: 111787 - DNA, 35 bp, Artificial Sequence
  Synthetic oligonucleotide
tctcggtcgagtgcccaagctttcccccccgcacc

SEQ ID NO: 111788 - DNA, 38 bp, Artificial Sequence
  Synthetic oligonucleotide
tgccactcgcctatccggttctgatgaattcctcctga

SEQ ID NO: 111789 - DNA, 35 bp, Artificial Sequence
  Synthetic oligonucleotide
gagagggacgaagcgggagtcgcgggagggggagc

SEQ ID NO: 111790 - DNA, 35 bp, Artificial Sequence
  Synthetic oligonucleotide
gtgggtgggggggcgaggaaagagctgaggctcag

SEQ ID NO: 111791 - DNA, 37 bp, Artificial Sequence
  Synthetic oligonucleotide
ggaggggcggatggtggttcctttgtcaggaggctga

SEQ ID NO: 111792 - DNA, 35 bp, Artificial Sequence
  Synthetic oligonucleotide
tacccgcatccctcggtatctttgccaacctcatc

SEQ ID NO: 111793 - DNA, 32 bp, Artificial Sequence
  Synthetic oligonucleotide
acgcttccacccgacgtaaaccatcctcaccg

SEQ ID NO: 111794 - DNA, 35 bp, Artificial Sequence
  Synthetic oligonucleotide
gatggaacggagagggacgggatggggcctgaaaa

SEQ ID NO: 111795 - DNA, 36 bp, Artificial Sequence
  Synthetic oligonucleotide
actcacctgtcttaccatcagcgacgtcgtccccca

SEQ ID NO: 111796 - DNA, 35 bp, Artificial Sequence
  Synthetic oligonucleotide
tagtacatgtccgcccagtatcgcactctctctac

SEQ ID NO: 111797 - DNA, 35 bp, Artificial Sequence
  Synthetic oligonucleotide
tatgccccgccccaatcgtttcctttgttaacaca

SEQ ID NO: 111798 - DNA, 35 bp, Artificial Sequence
  Synthetic oligonucleotide
gtcgccgccatcttcttctacgccgctcgttatca

SEQ ID NO: 111799 - DNA, 37 bp, Artificial Sequence
  Synthetic oligonucleotide
acgcatcggaaccgttgcatcccgccctcctgcccga

SEQ ID NO: 111800 - DNA, 37 bp, Artificial Sequence
  Synthetic oligonucleotide
tcacacctccgttgatgcccgctcctccgccctggga

SEQ ID NO: 111801 - DNA, 36 bp, Artificial Sequence
  Synthetic oligonucleotide
tgaccacgcacggggtccgtactttcatctctccta

SEQ ID NO: 111802 - DNA, 35 bp, Artificial Sequence
  Synthetic oligonucleotide
tccacgtcgacacgccccgctatcgcctccttatc

SEQ ID NO: 111803 - DNA, 35 bp, Artificial Sequence
  Synthetic oligonucleotide
tacccgcgtcctgtcttttagtccccatgctccgt

SEQ ID NO: 111804 - DNA, 37 bp, Artificial Sequence
  Synthetic oligonucleotide
ttggtccgtcgactgccgtgccatccccatccgctga

SEQ ID NO: 111805 - DNA, 35 bp, Artificial Sequence
  Synthetic oligonucleotide
ggggctacgcaatctgtaacgccaccactcccccc

SEQ ID NO: 111806 - DNA, 37 bp, Artificial Sequence
  Synthetic oligonucleotide
attcccattcgccacctgtctactcgtgccttcacga

SEQ ID NO: 111807 - DNA, 35 bp, Artificial Sequence
  Synthetic oligonucleotide
atccgcggtcctcctcagccctgttttcgtttttc

SEQ ID NO: 111808 - DNA, 35 bp, Artificial Sequence
  Synthetic oligonucleotide
gaccctcccatccaccggtatttgggacacccgcc

SEQ ID NO: 111809 - DNA, 35 bp, Artificial Sequence
  Synthetic oligonucleotide
gcccccgccgataccaccgaggcttactggttctc

SEQ ID NO: 111810 - DNA, 37 bp, Artificial Sequence
  Synthetic oligonucleotide
atgggaagggcgggcgggatgcctttaatggcaatga

SEQ ID NO: 111811 - DNA, 35 bp, Artificial Sequence
  Synthetic oligonucleotide
aaccgacctctgttgcgcactcgcattttgcctac

SEQ ID NO: 111812 - DNA, 35 bp, Artificial Sequence
  Synthetic oligonucleotide
tcacgcatgtgtgccatactaccatatccatcgcc

SEQ ID NO: 111813 - DNA, 34 bp, Artificial Sequence
  Synthetic oligonucleotide
tctaacgaacgtagtcatacaccctcctgccttt

SEQ ID NO: 111814 - DNA, 35 bp, Artificial Sequence
  Synthetic oligonucleotide
ggggtggggacagttcagtaaggggccgatggggg

SEQ ID NO: 111815 - DNA, 35 bp, Artificial Sequence
  Synthetic oligonucleotide
tcccaccgcctctggatcagcctcggccttaattt

SEQ ID NO: 111816 - DNA, 37 bp, Artificial Sequence
  Synthetic oligonucleotide
aacaccaccgccgcatttcccttcgctcttccatgga

SEQ ID NO: 111817 - DNA, 38 bp, Artificial Sequence
  Synthetic oligonucleotide
gcgctcccgccatcccgcctatcagcccgccttcgtga

SEQ ID NO: 111818 - DNA, 35 bp, Artificial Sequence
  Synthetic oligonucleotide
gctgaccccccctgttttgctgccagcttacccag

SEQ ID NO: 111819 - DNA, 35 bp, Artificial Sequence
  Synthetic oligonucleotide
ttgtgcatgccacactcatctccctactcctgtcg

SEQ ID NO: 111820 - DNA, 35 bp, Artificial Sequence
  Synthetic oligonucleotide
gtcgcgattgcctccgcctcccggtcttaagcccc

SEQ ID NO: 111821 - DNA, 35 bp, Artificial Sequence
  Synthetic oligonucleotide
gccctcacctgtttgtcccctggagttgatccctt

SEQ ID NO: 111822 - DNA, 36 bp, Artificial Sequence
  Synthetic oligonucleotide
gaggtggaggtggttgcggggcggtagggggagtga

SEQ ID NO: 111823 - DNA, 34 bp, Artificial Sequence
  Synthetic oligonucleotide
gcaggcgaccgggcggggaggggggggagtgata

SEQ ID NO: 111824 - DNA, 35 bp, Artificial Sequence
  Synthetic oligonucleotide
tttcacctccacatgtctaccaacttcgtcttcta

SEQ ID NO: 111825 - DNA, 35 bp, Artificial Sequence
  Synthetic oligonucleotide
gccaagcgccgctcctcctcaggttccgccacgct

SEQ ID NO: 111826 - DNA, 38 bp, Artificial Sequence
  Synthetic oligonucleotide
ttgaccccgccctggccatcacctccatcctgttgtga

SEQ ID NO: 111827 - DNA, 35 bp, Artificial Sequence
  Synthetic oligonucleotide
tctccccccctgtgcctcaagtcgttcctctgttt

SEQ ID NO: 111828 - DNA, 35 bp, Artificial Sequence
  Synthetic oligonucleotide
acagcaccgccttgaatctgccctcgttcttcttg

SEQ ID NO: 111829 - DNA, 35 bp, Artificial Sequence
  Synthetic oligonucleotide
gctaagccgccgccagcattccgtctactccttac

SEQ ID NO: 111830 - DNA, 33 bp, Artificial Sequence
  Synthetic oligonucleotide
tactgctccctctcgcactgaattggaatcccg

SEQ ID NO: 111831 - DNA, 35 bp, Artificial Sequence
  Synthetic oligonucleotide
gcccccttaatctgcacccgccacgacctcccgct

SEQ ID NO: 111832 - DNA, 36 bp, Artificial Sequence
  Synthetic oligonucleotide
taagcgcaacattgcttagtttcggtctactctcca

SEQ ID NO: 111833 - DNA, 36 bp, Artificial Sequence
  Synthetic oligonucleotide
gcacccttctcctgccatacgcgtcgcccaaccgta

SEQ ID NO: 111834 - DNA, 35 bp, Artificial Sequence
  Synthetic oligonucleotide
tctggcccgaatccgaagttaatccccccgcccgc

SEQ ID NO: 111835 - DNA, 35 bp, Artificial Sequence
  Synthetic oligonucleotide
tacgccgggccacagcttctaacacgcctcacctt

SEQ ID NO: 111836 - DNA, 36 bp, Artificial Sequence
  Synthetic oligonucleotide
tgctccgcctccgcttcgtttgtctcccgcatcgta

SEQ ID NO: 111837 - DNA, 35 bp, Artificial Sequence
  Synthetic oligonucleotide
tatgcgccccgttgaggttcctcgttccatctgcg

SEQ ID NO: 111838 - DNA, 35 bp, Artificial Sequence
  Synthetic oligonucleotide
aagtcacccctcgttctgctcttgaccactatatt

SEQ ID NO: 111839 - DNA, 35 bp, Artificial Sequence
  Synthetic oligonucleotide
gcaccccgccctgtttttttttggcccccgcagtt

SEQ ID NO: 111840 - DNA, 35 bp, Artificial Sequence
  Synthetic oligonucleotide
tctccatccccagatctgctctcggattcttcttt

SEQ ID NO: 111841 - DNA, 35 bp, Artificial Sequence
  Synthetic oligonucleotide
atagccacgtttcgctttgacccagccttcacacc

SEQ ID NO: 111842 - DNA, 35 bp, Artificial Sequence
  Synthetic oligonucleotide
actctatcacgtgcctgcctactcgccccactgtc

SEQ ID NO: 111843 - DNA, 35 bp, Artificial Sequence
  Synthetic oligonucleotide
tccgcggtggaagttcgtcacgccctgccctattc

SEQ ID NO: 111844 - DNA, 35 bp, Artificial Sequence
  Synthetic oligonucleotide
gtcgatgcacacccattataacatcttgcccctgt

SEQ ID NO: 111845 - DNA, 34 bp, Artificial Sequence
  Synthetic oligonucleotide
gcccctcaccactcgacgtgttttcgttatcctt

SEQ ID NO: 111846 - DNA, 35 bp, Artificial Sequence
  Synthetic oligonucleotide
ttccacccgcaccaaatcgttactgacgccgctaa

SEQ ID NO: 111847 - DNA, 35 bp, Artificial Sequence
  Synthetic oligonucleotide
gccgctccccctgttccggcctgttttaccgcata

SEQ ID NO: 111848 - DNA, 35 bp, Artificial Sequence
  Synthetic oligonucleotide
acgatcatcaaacgcctgtccgtccctgtaccctc

SEQ ID NO: 111849 - DNA, 35 bp, Artificial Sequence
  Synthetic oligonucleotide
tactgccacactctgtaccgtagaatcacttccct

SEQ ID NO: 111850 - DNA, 35 bp, Artificial Sequence
  Synthetic oligonucleotide
gacgcctccccccgttaacttagcaataccctgtt

SEQ ID NO: 111851 - DNA, 38 bp, Artificial Sequence
  Synthetic oligonucleotide
tgagggcggagggaggggggtggatttggacggtatta

SEQ ID NO: 111852 - DNA, 36 bp, Artificial Sequence
  Synthetic oligonucleotide
gaagagggcgggttaagggcagggggccaaggtcaa

SEQ ID NO: 111853 - DNA, 36 bp, Artificial Sequence
  Synthetic oligonucleotide
gatcacccgcctgcattttccgccctatagcccgga

SEQ ID NO: 111854 - DNA, 37 bp, Artificial Sequence
  Synthetic oligonucleotide
agggggaggggcacacggggtaaagtcggaatgggga

SEQ ID NO: 111855 - DNA, 36 bp, Artificial Sequence
  Synthetic oligonucleotide
tccacgaacgccacatcctgtccatccctccattta

SEQ ID NO: 111856 - DNA, 36 bp, Artificial Sequence
  Synthetic oligonucleotide
gccctccatcccatgctctcgtgaccgtaatgttta

SEQ ID NO: 111857 - DNA, 35 bp, Artificial Sequence
  Synthetic oligonucleotide
tatgctcatgcatgcaccgttcactcctgtacacc

SEQ ID NO: 111858 - DNA, 35 bp, Artificial Sequence
  Synthetic oligonucleotide
gtctgcgtgcccttagtctgcccccctctcattcg

SEQ ID NO: 111859 - DNA, 34 bp, Artificial Sequence
  Synthetic oligonucleotide
gcctcagcacaccccttcctccagccaggtcctt

SEQ ID NO: 111860 - DNA, 35 bp, Artificial Sequence
  Synthetic oligonucleotide
gttggccccttattcacgcccgtccctgctctgca

SEQ ID NO: 111861 - DNA, 37 bp, Artificial Sequence
  Synthetic oligonucleotide
actacggggaaaagtgggctggaggggatcgggggga

SEQ ID NO: 111862 - DNA, 35 bp, Artificial Sequence
  Synthetic oligonucleotide
tacccgtcctgcattttccctgcctccatcgcact

SEQ ID NO: 111863 - DNA, 35 bp, Artificial Sequence
  Synthetic oligonucleotide
tcacgccaccagttaagccaccaccaccacatcct

SEQ ID NO: 111864 - DNA, 35 bp, Artificial Sequence
  Synthetic oligonucleotide
acatggccctcctgcttcttgaactactccttgct

SEQ ID NO: 111865 - DNA, 35 bp, Artificial Sequence
  Synthetic oligonucleotide
taggtcagcctctccgcacccccgcccgttctgtt

SEQ ID NO: 111866 - DNA, 36 bp, Artificial Sequence
  Synthetic oligonucleotide
gtcccctgccacccctagatataatgcccacttgca

SEQ ID NO: 111867 - DNA, 35 bp, Artificial Sequence
  Synthetic oligonucleotide
gtgctcaccgtttcattgtcctcagcccgatcccc

SEQ ID NO: 111868 - DNA, 35 bp, Artificial Sequence
  Synthetic oligonucleotide
acgccctcacgcctgagtctctacacacacaattc

SEQ ID NO: 111869 - DNA, 35 bp, Artificial Sequence
  Synthetic oligonucleotide
atgtccacgcgctccgttttcgcccgtttgttctg

SEQ ID NO: 111870 - DNA, 35 bp, Artificial Sequence
  Synthetic oligonucleotide
accatgccccaccatcacagagtcacttcatcttg

SEQ ID NO: 111871 - DNA, 35 bp, Artificial Sequence
  Synthetic oligonucleotide
tgcgtccacccgcctgactcccaagcagtatccct

SEQ ID NO: 111872 - DNA, 35 bp, Artificial Sequence
  Synthetic oligonucleotide
ttcgctcgccctcaatcgtaacctctttcctctct

SEQ ID NO: 111873 - DNA, 36 bp, Artificial Sequence
  Synthetic oligonucleotide
tactgccacgcccgcgcttatgttccgctcccccca

SEQ ID NO: 111874 - DNA, 36 bp, Artificial Sequence
  Synthetic oligonucleotide
agcttaggccccagctccatatctgctttccatcca

SEQ ID NO: 111875 - DNA, 35 bp, Artificial Sequence
  Synthetic oligonucleotide
ttcagcccagtgctacaccctgccagctcaccgct

SEQ ID NO: 111876 - DNA, 35 bp, Artificial Sequence
  Synthetic oligonucleotide
tctccagccactcattggcgtctctttgtccctct

SEQ ID NO: 111877 - DNA, 36 bp, Artificial Sequence
  Synthetic oligonucleotide
tccacggggggggctgaatagggaagggttgtcaga

SEQ ID NO: 111878 - DNA, 36 bp, Artificial Sequence
  Synthetic oligonucleotide
atggcacgccacatccctgtccgtcaccaccacgta

SEQ ID NO: 111879 - DNA, 35 bp, Artificial Sequence
  Synthetic oligonucleotide
taccgccgccatccaccgcttcggaggccgccctc

SEQ ID NO: 111880 - DNA, 35 bp, Artificial Sequence
  Synthetic oligonucleotide
actcccccccctgcattgctagttccgtagacgga

SEQ ID NO: 111881 - DNA, 37 bp, Artificial Sequence
  Synthetic oligonucleotide
acccccatccggtcaactgataccaaccgcccccgga

SEQ ID NO: 111882 - DNA, 35 bp, Artificial Sequence
  Synthetic oligonucleotide
atcccacctacgccccctccgacttcagaccacgt

SEQ ID NO: 111883 - DNA, 35 bp, Artificial Sequence
  Synthetic oligonucleotide
gaggccgttgccgcgctcctttcctttgtccctgt

SEQ ID NO: 111884 - DNA, 37 bp, Artificial Sequence
  Synthetic oligonucleotide
gatgtcgccgcctcttttcggtttagcccccctccga

SEQ ID NO: 111885 - DNA, 35 bp, Artificial Sequence
  Synthetic oligonucleotide
ttgcccccgcatatcagtttctcaccatccgcaac

SEQ ID NO: 111886 - DNA, 35 bp, Artificial Sequence
  Synthetic oligonucleotide
tccgcactgtacgccgttacctcaccactctgtac

SEQ ID NO: 111887 - DNA, 35 bp, Artificial Sequence
  Synthetic oligonucleotide
gtgggcctaacctatctgtcatttagcccttttcc

SEQ ID NO: 111888 - DNA, 35 bp, Artificial Sequence
  Synthetic oligonucleotide
tgagcctcacctgctcctcgttatagtcctcatgc

SEQ ID NO: 111889 - DNA, 37 bp, Artificial Sequence
  Synthetic oligonucleotide
tgcgatgggaggggggtggtgggctgggtggatagga

SEQ ID NO: 111890 - DNA, 35 bp, Artificial Sequence
  Synthetic oligonucleotide
gcgcccccgactcgtttcccgcccaccgtttgttc

SEQ ID NO: 111891 - DNA, 35 bp, Artificial Sequence
  Synthetic oligonucleotide
tccgtagaggggggcaagaggggaagtaacgtggg

SEQ ID NO: 111892 - DNA, 35 bp, Artificial Sequence
  Synthetic oligonucleotide
tctgacgcgcacctctgccatacggtccatccacc

SEQ ID NO: 111893 - DNA, 36 bp, Artificial Sequence
  Synthetic oligonucleotide
tccggtgcctcccgatcttccttcgcctgtgggcca

SEQ ID NO: 111894 - DNA, 37 bp, Artificial Sequence
  Synthetic oligonucleotide
atgggtggcggttaattggtcggggtcgacggaggga

SEQ ID NO: 111895 - DNA, 35 bp, Artificial Sequence
  Synthetic oligonucleotide
tagccactcactgctgattgttacccccccgctac

SEQ ID NO: 111896 - DNA, 34 bp, Artificial Sequence
  Synthetic oligonucleotide
aacgcacatacgccctcccgtttctccatgcacc

SEQ ID NO: 111897 - DNA, 36 bp, Artificial Sequence
  Synthetic oligonucleotide
tagtctcgccgcctgccacgttccactgtccattaa

SEQ ID NO: 111898 - DNA, 35 bp, Artificial Sequence
  Synthetic oligonucleotide
accagccaccgcttctttggtcgccatctgccccc

SEQ ID NO: 111899 - DNA, 36 bp, Artificial Sequence
  Synthetic oligonucleotide
gacccttgccccagcccgactgcctcctttgtccgc

SEQ ID NO: 111900 - DNA, 35 bp, Artificial Sequence
  Synthetic oligonucleotide
gcatggcctcttgcatctggttcccctcaccatcc

SEQ ID NO: 111901 - DNA, 35 bp, Artificial Sequence
  Synthetic oligonucleotide
aagccaagggagggccgggtggggggaaaaagccg

SEQ ID NO: 111902 - DNA, 36 bp, Artificial Sequence
  Synthetic oligonucleotide
tgaggtcgccgccgcctacgcctctcctgtagttaa

SEQ ID NO: 111903 - DNA, 38 bp, Artificial Sequence
  Synthetic oligonucleotide
gtatgtcaccgtccaatcccccttctgcgctcccatga

SEQ ID NO: 111904 - DNA, 35 bp, Artificial Sequence
  Synthetic oligonucleotide
ggaccccccgctgcaatctttcttaggacctacgc

SEQ ID NO: 111905 - DNA, 35 bp, Artificial Sequence
  Synthetic oligonucleotide
tcaccgcccctcttctagtcgtacttacatcacgc

SEQ ID NO: 111906 - DNA, 36 bp, Artificial Sequence
  Synthetic oligonucleotide
ttactccgctccgaactgtttacacccgctatccga

SEQ ID NO: 111907 - DNA, 36 bp, Artificial Sequence
  Synthetic oligonucleotide
tgccccctcgctgctctaagctctgctccaccaata

SEQ ID NO: 111908 - DNA, 35 bp, Artificial Sequence
  Synthetic oligonucleotide
tccgctctgccattcccaattgttgtctgcccctt

SEQ ID NO: 111909 - DNA, 36 bp, Artificial Sequence
  Synthetic oligonucleotide
gtgcacctctcgatcccccatggcctatacgctcca

SEQ ID NO: 111910 - DNA, 35 bp, Artificial Sequence
  Synthetic oligonucleotide
agagcccaccccgtgcacaatgccactgatttccc

SEQ ID NO: 111911 - DNA, 35 bp, Artificial Sequence
  Synthetic oligonucleotide
accaatgtcctgttcgtcgctccccggtggcctgc

SEQ ID NO: 111912 - DNA, 35 bp, Artificial Sequence
  Synthetic oligonucleotide
aacaggtcccagctccatccgttttgcccccccgg

SEQ ID NO: 111913 - DNA, 35 bp, Artificial Sequence
  Synthetic oligonucleotide
tcacagacagcttgctaccgcaccttctcttcgct

SEQ ID NO: 111914 - DNA, 35 bp, Artificial Sequence
  Synthetic oligonucleotide
gctgaccattcgcatccgttcgccctgttcttgct

SEQ ID NO: 111915 - DNA, 37 bp, Artificial Sequence
  Synthetic oligonucleotide
aagggtggagggaagggtgtcgcggggagaagactga

SEQ ID NO: 111916 - DNA, 35 bp, Artificial Sequence
  Synthetic oligonucleotide
ttcgagcgcacccctgagtttccccaagcctgttc

SEQ ID NO: 111917 - DNA, 35 bp, Artificial Sequence
  Synthetic oligonucleotide
tgggctgctgcacgcgcacagtcgccccttcctct

SEQ ID NO: 111918 - DNA, 35 bp, Artificial Sequence
  Synthetic oligonucleotide
gcctcgccccttcaggtatccctgtctcactctca

SEQ ID NO: 111919 - DNA, 36 bp, Artificial Sequence
  Synthetic oligonucleotide
gaggggtggtagtaggggtggaatgtttgccgggga

SEQ ID NO: 111920 - DNA, 35 bp, Artificial Sequence
  Synthetic oligonucleotide
tcacgtccaccccatcctgcaatacccccggcata

SEQ ID NO: 111921 - DNA, 38 bp, Artificial Sequence
  Synthetic oligonucleotide
tttgcccacaagcgtcactcctttatctgcccccttga

SEQ ID NO: 111922 - DNA, 35 bp, Artificial Sequence
  Synthetic oligonucleotide
gatggagggtggagtcatggagtaagggagcccag

SEQ ID NO: 111923 - DNA, 35 bp, Artificial Sequence
  Synthetic oligonucleotide
tgaccgccaccattgctctcctctacggaacttcg

SEQ ID NO: 111924 - DNA, 36 bp, Artificial Sequence
  Synthetic oligonucleotide
agtcatcccattgcctatcatcgcgttctccccgca

SEQ ID NO: 111925 - DNA, 35 bp, Artificial Sequence
  Synthetic oligonucleotide
atcgacggcacaactgcggtaccgtctcccccttc

SEQ ID NO: 111926 - DNA, 37 bp, Artificial Sequence
  Synthetic oligonucleotide
gcgccactccatgcctctcttttcgtgtcatcttcga

SEQ ID NO: 111927 - DNA, 36 bp, Artificial Sequence
  Synthetic oligonucleotide
atcgcaagccccctgttccgttctgtttcccatgca

SEQ ID NO: 111928 - DNA, 36 bp, Artificial Sequence
  Synthetic oligonucleotide
tcactcgcacaatagtgcaccttggcttgtacctcc

SEQ ID NO: 111929 - DNA, 35 bp, Artificial Sequence
  Synthetic oligonucleotide
tgtagcaatgcctgctgctccgccgccccacccgc

SEQ ID NO: 111930 - DNA, 35 bp, Artificial Sequence
  Synthetic oligonucleotide
aggattgcatcccatcctatatgccgcccgttacc

SEQ ID NO: 111931 - DNA, 35 bp, Artificial Sequence
  Synthetic oligonucleotide
gtcagagccaaccctgcctccgcttccccctgtcc

SEQ ID NO: 111932 - DNA, 35 bp, Artificial Sequence
  Synthetic oligonucleotide
tcgagcaccgcctcgacctgatactccaacctgtc

SEQ ID NO: 111933 - DNA, 35 bp, Artificial Sequence
  Synthetic oligonucleotide
tcaccgctcaagcgcgctgacctttgctttgccct

SEQ ID NO: 111934 - DNA, 35 bp, Artificial Sequence
  Synthetic oligonucleotide
accctgcccgaacccgctgtcgagatccgtcgccc

SEQ ID NO: 111935 - DNA, 37 bp, Artificial Sequence
  Synthetic oligonucleotide
actcgcccgtccaacgccctgatcacgcaccacctga

SEQ ID NO: 111936 - DNA, 35 bp, Artificial Sequence
  Synthetic oligonucleotide
tagcaccgccttcggactcctcaacccatcctgcc

SEQ ID NO: 111937 - DNA, 35 bp, Artificial Sequence
  Synthetic oligonucleotide
gagccccaccgccaaccctgccggaccatgtttcg

SEQ ID NO: 111938 - DNA, 35 bp, Artificial Sequence
  Synthetic oligonucleotide
tcagagcccccccacatgttgcagcagtcgctact

SEQ ID NO: 111939 - DNA, 36 bp, Artificial Sequence
  Synthetic oligonucleotide
agtaccgggcggggagggggcaaatacgcggggaaa

SEQ ID NO: 111940 - DNA, 35 bp, Artificial Sequence
  Synthetic oligonucleotide
tatgccctaccacatatgccaccctgtgtccctcc

SEQ ID NO: 111941 - DNA, 36 bp, Artificial Sequence
  Synthetic oligonucleotide
acaggggggcagaaggggaaaggctggaggggcaaa

SEQ ID NO: 111942 - DNA, 35 bp, Artificial Sequence
  Synthetic oligonucleotide
aatcatgccctcctgctctgtatccctaccgcgaa

SEQ ID NO: 111943 - DNA, 36 bp, Artificial Sequence
  Synthetic oligonucleotide
atgacccaccaactgcatgccgtaacacttccctaa

SEQ ID NO: 111944 - DNA, 35 bp, Artificial Sequence
  Synthetic oligonucleotide
tccggacggccactttgcatgcacttcaccccttc

SEQ ID NO: 111945 - DNA, 35 bp, Artificial Sequence
  Synthetic oligonucleotide
gcgaaagtgaggtggaggaggggaatgggtgtttg

SEQ ID NO: 111946 - DNA, 35 bp, Artificial Sequence
  Synthetic oligonucleotide
gtcacctccttcgccgttctatagctctccgcacg

SEQ ID NO: 111947 - DNA, 36 bp, Artificial Sequence
  Synthetic oligonucleotide
aaggggacacggaggagtgatggaagtgggagaaga

SEQ ID NO: 111948 - DNA, 38 bp, Artificial Sequence
  Synthetic oligonucleotide
gaggggcggaggaggcaaaatgagggagtgagaggtga

SEQ ID NO: 111949 - DNA, 35 bp, Artificial Sequence
  Synthetic oligonucleotide
gccccccccaccatccacgtgccagtaggcgtttc

SEQ ID NO: 111950 - DNA, 35 bp, Artificial Sequence
  Synthetic oligonucleotide
agtacgggcaaaggtgggaaatggatgggcgggaa

SEQ ID NO: 111951 - DNA, 35 bp, Artificial Sequence
  Synthetic oligonucleotide
atgcatccgttcactgaccttctctccatcccgcc

SEQ ID NO: 111952 - DNA, 35 bp, Artificial Sequence
  Synthetic oligonucleotide
tactcgcccagactgctatggtcgtctcactctcc

SEQ ID NO: 111953 - DNA, 35 bp, Artificial Sequence
  Synthetic oligonucleotide
gcggggattcaatgtggggcttatgggtgggggtt

SEQ ID NO: 111954 - DNA, 37 bp, Artificial Sequence
  Synthetic oligonucleotide
tgtgtgccccttgcatatctgactcccattccatcga

SEQ ID NO: 111955 - DNA, 35 bp, Artificial Sequence
  Synthetic oligonucleotide
acgaccaccctcatgattcctgtcttcgccgtggc

SEQ ID NO: 111956 - DNA, 35 bp, Artificial Sequence
  Synthetic oligonucleotide
gcctcatcgccgtgcccgtggatttattgcccctc

SEQ ID NO: 111957 - DNA, 35 bp, Artificial Sequence
  Synthetic oligonucleotide
taaggcggaggggagggggagaagaaattgaaggc

SEQ ID NO: 111958 - DNA, 35 bp, Artificial Sequence
  Synthetic oligonucleotide
attcttgcccgccactccgtttctaccaggccctc

SEQ ID NO: 111959 - DNA, 35 bp, Artificial Sequence
  Synthetic oligonucleotide
ttgcaagagggggttgagggagggggcgatgggcg

SEQ ID NO: 111960 - DNA, 35 bp, Artificial Sequence
  Synthetic oligonucleotide
ggtgcgaggccggggggggacaaagggcgggatga

SEQ ID NO: 111961 - DNA, 38 bp, Artificial Sequence
  Synthetic oligonucleotide
gtcacaccgcccatgcccctatagttgcctgctgttga

SEQ ID NO: 111962 - DNA, 34 bp, Artificial Sequence
  Synthetic oligonucleotide
accacctccccatctgtaccgcgttgccgattta

SEQ ID NO: 111963 - DNA, 35 bp, Artificial Sequence
  Synthetic oligonucleotide
tgcccactccgcatacacgtgtcctgtgctttcac

SEQ ID NO: 111964 - DNA, 35 bp, Artificial Sequence
  Synthetic oligonucleotide
ttccgtccccccatggcagacgctccgccctctac

SEQ ID NO: 111965 - DNA, 35 bp, Artificial Sequence
  Synthetic oligonucleotide
accacctcccctcgtatgccagcaacttacgtctg

SEQ ID NO: 111966 - DNA, 35 bp, Artificial Sequence
  Synthetic oligonucleotide
gggaagggtagaagcagggggtgggggcaggacga

SEQ ID NO: 111967 - DNA, 35 bp, Artificial Sequence
  Synthetic oligonucleotide
ttggccaacatcgccgccgcccccgtcctttaacc

SEQ ID NO: 111968 - DNA, 35 bp, Artificial Sequence
  Synthetic oligonucleotide
acctaacagacgtgccccttccgaccagtcgctct

SEQ ID NO: 111969 - DNA, 35 bp, Artificial Sequence
  Synthetic oligonucleotide
gagggagggtggagcggggtgccaacgtttgtctt

SEQ ID NO: 111970 - DNA, 36 bp, Artificial Sequence
  Synthetic oligonucleotide
acccgcaccaccgcattagggcactccctcgtaaca

SEQ ID NO: 111971 - DNA, 35 bp, Artificial Sequence
  Synthetic oligonucleotide
gacgcacccgttccctgggccattccttcctctag

SEQ ID NO: 111972 - DNA, 35 bp, Artificial Sequence
  Synthetic oligonucleotide
tatgccccctcttttgtccagcttacactttaggt

SEQ ID NO: 111973 - DNA, 35 bp, Artificial Sequence
  Synthetic oligonucleotide
tcactcaccgctgatcccccgttctttttaccgca

SEQ ID NO: 111974 - DNA, 37 bp, Artificial Sequence
  Synthetic oligonucleotide
atcagggcgggggtaaatgggcggggaaggagttcga

SEQ ID NO: 111975 - DNA, 35 bp, Artificial Sequence
  Synthetic oligonucleotide
gttccaccctcacgactggcacccttcttaccggg

SEQ ID NO: 111976 - DNA, 35 bp, Artificial Sequence
  Synthetic oligonucleotide
gtcgaccctcgcccttgccaatgcatatgaccaca

SEQ ID NO: 111977 - DNA, 37 bp, Artificial Sequence
  Synthetic oligonucleotide
gcacgccaaattgcccacccggccccccgtcccgaga

SEQ ID NO: 111978 - DNA, 38 bp, Artificial Sequence
  Synthetic oligonucleotide
tgagtccctccgttctgtcattcccccgcctttcttga

SEQ ID NO: 111979 - DNA, 35 bp, Artificial Sequence
  Synthetic oligonucleotide
tttgaactgtacgcccgacccttctccgcctggtg

SEQ ID NO: 111980 - DNA, 35 bp, Artificial Sequence
  Synthetic oligonucleotide
gcacctccatttgctttccaccgagttacttacct

SEQ ID NO: 111981 - DNA, 35 bp, Artificial Sequence
  Synthetic oligonucleotide
ttcgtcccccgacacgtgcatctatctgtgccctt

SEQ ID NO: 111982 - DNA, 36 bp, Artificial Sequence
  Synthetic oligonucleotide
gtgacctccgctctggtcgtctttcagtccttttca

SEQ ID NO: 111983 - DNA, 35 bp, Artificial Sequence
  Synthetic oligonucleotide
gtcacccatccttgcgagctcccccttcaaactgg

SEQ ID NO: 111984 - DNA, 35 bp, Artificial Sequence
  Synthetic oligonucleotide
tgtgcacctccccttctcccacggactccctgctg

SEQ ID NO: 111985 - DNA, 34 bp, Artificial Sequence
  Synthetic oligonucleotide
tatgcgttagccccttcgtccctgtgttccttcc

SEQ ID NO: 111986 - DNA, 35 bp, Artificial Sequence
  Synthetic oligonucleotide
tacaacactacgccggcttacaactccacccgccc

SEQ ID NO: 111987 - DNA, 36 bp, Artificial Sequence
  Synthetic oligonucleotide
ggagagaccagggagggaaggggctggtacacggta

SEQ ID NO: 111988 - DNA, 37 bp, Artificial Sequence
  Synthetic oligonucleotide
gatcgcgccggtatggatatgggaagggggggaggga

SEQ ID NO: 111989 - DNA, 35 bp, Artificial Sequence
  Synthetic oligonucleotide
ttgcaccctcctgcgcgggcccctaatcagtccac

SEQ ID NO: 111990 - DNA, 35 bp, Artificial Sequence
  Synthetic oligonucleotide
tttccgccggcccacccctttctatgtaggctccc

SEQ ID NO: 111991 - DNA, 36 bp, Artificial Sequence
  Synthetic oligonucleotide
tgtgcgaccgcggtccctgattacgtccttccctgc

SEQ ID NO: 111992 - DNA, 35 bp, Artificial Sequence
  Synthetic oligonucleotide
tagtccctcacttccgcctgtctggtcttgcattc

SEQ ID NO: 111993 - DNA, 35 bp, Artificial Sequence
  Synthetic oligonucleotide
accccaccctttgtgtgctgcccacggtctccatt

SEQ ID NO: 111994 - DNA, 35 bp, Artificial Sequence
  Synthetic oligonucleotide
agtcccgcccctattcaatgtcacgcccccagtcc

SEQ ID NO: 111995 - DNA, 36 bp, Artificial Sequence
  Synthetic oligonucleotide
tcctcatgagcccctgtcttgcttagccttccttta

SEQ ID NO: 111996 - DNA, 35 bp, Artificial Sequence
  Synthetic oligonucleotide
gcttgcctccttgaactgatcgctgtcctcctcgc

SEQ ID NO: 111997 - DNA, 36 bp, Artificial Sequence
  Synthetic oligonucleotide
gtcgcacactgcttatcgttctttgctactccctaa

SEQ ID NO: 111998 - DNA, 35 bp, Artificial Sequence
  Synthetic oligonucleotide
tgatgcgctgtgctctcttatgcttctgttccttt

SEQ ID NO: 111999 - DNA, 36 bp, Artificial Sequence
  Synthetic oligonucleotide
accggagggtgggagggtgtagggtccactacggga

SEQ ID NO: 112000 - DNA, 35 bp, Artificial Sequence
  Synthetic oligonucleotide
gcgctcggtacgccgttttgcactctgctcccttc

SEQ ID NO: 112001 - DNA, 34 bp, Artificial Sequence
  Synthetic oligonucleotide
ttcccacccggtccctgtaagtgcccccggtccc

SEQ ID NO: 112002 - DNA, 35 bp, Artificial Sequence
  Synthetic oligonucleotide
agctcgccccatcatccccaggctaccactctgcc

SEQ ID NO: 112003 - DNA, 35 bp, Artificial Sequence
  Synthetic oligonucleotide
gctctccgcccgtgcctacatcctcgtctatccga

SEQ ID NO: 112004 - DNA, 38 bp, Artificial Sequence
  Synthetic oligonucleotide
acgacacccattagggttatatatactcaccatcctga

SEQ ID NO: 112005 - DNA, 35 bp, Artificial Sequence
  Synthetic oligonucleotide
gcgctgggtggggaggggttcgtcgcgccgggggc

SEQ ID NO: 112006 - DNA, 35 bp, Artificial Sequence
  Synthetic oligonucleotide
agcccgagtgatgtcctccgcccgtctttctaccg

SEQ ID NO: 112007 - DNA, 35 bp, Artificial Sequence
  Synthetic oligonucleotide
tgcctcaccccgggccgtcctcgatctctcttgcg

SEQ ID NO: 112008 - DNA, 35 bp, Artificial Sequence
  Synthetic oligonucleotide
tcaggccccccccgccgccacctgattttgctact

SEQ ID NO: 112009 - DNA, 35 bp, Artificial Sequence
  Synthetic oligonucleotide
tgaccaacgccgcatttttaaccatgtccttgcca

SEQ ID NO: 112010 - DNA, 37 bp, Artificial Sequence
  Synthetic oligonucleotide
gagggcggggtcaacttggggaccgactattggggga

SEQ ID NO: 112011 - DNA, 38 bp, Artificial Sequence
  Synthetic oligonucleotide
tgcccctgccccctgttctgaactccacccggtactga

SEQ ID NO: 112012 - DNA, 35 bp, Artificial Sequence
  Synthetic oligonucleotide
tccgcccccgctccccatccgctattctcgtaata

SEQ ID NO: 112013 - DNA, 35 bp, Artificial Sequence
  Synthetic oligonucleotide
gccccctgcccgcgcgtagcttactaccattctcc

SEQ ID NO: 112014 - DNA, 35 bp, Artificial Sequence
  Synthetic oligonucleotide
ttcaccctcgccggatcgatcttctccctgcttgc

SEQ ID NO: 112015 - DNA, 35 bp, Artificial Sequence
  Synthetic oligonucleotide
tcctcatgctttcccgttcgtctgttctcgtcctc

SEQ ID NO: 112016 - DNA, 35 bp, Artificial Sequence
  Synthetic oligonucleotide
gttagccagtcgcgtaccccgcatccctttccctg

SEQ ID NO: 112017 - DNA, 35 bp, Artificial Sequence
  Synthetic oligonucleotide
gtcacccatggtctgtccgttgcttgctcactccc

SEQ ID NO: 112018 - DNA, 35 bp, Artificial Sequence
  Synthetic oligonucleotide
tcatttgttcgcagctgtctcccctggccccttcc

SEQ ID NO: 112019 - DNA, 35 bp, Artificial Sequence
  Synthetic oligonucleotide
accccacttgcccaaacacctgtctattgctacct

SEQ ID NO: 112020 - DNA, 35 bp, Artificial Sequence
  Synthetic oligonucleotide
gaccacagaacgcaacatctgcctacgtacatctt

SEQ ID NO: 112021 - DNA, 35 bp, Artificial Sequence
  Synthetic oligonucleotide
gttcgggggcagactttgggtgggagggttttagc

SEQ ID NO: 112022 - DNA, 35 bp, Artificial Sequence
  Synthetic oligonucleotide
tggaacgccccactcatgatctaaccgtccccgtc

SEQ ID NO: 112023 - DNA, 35 bp, Artificial Sequence
  Synthetic oligonucleotide
gcgccaccgcatcccccgcaccagtggccccccca

SEQ ID NO: 112024 - DNA, 37 bp, Artificial Sequence
  Synthetic oligonucleotide
tcagtgcaagggggcgaatggcgaaggagggaacgga

SEQ ID NO: 112025 - DNA, 35 bp, Artificial Sequence
  Synthetic oligonucleotide
gatatccccccctccttgatgcgtactgggtccat

SEQ ID NO: 112026 - DNA, 35 bp, Artificial Sequence
  Synthetic oligonucleotide
gccgcccacgcccgtctatgctctaccagcttttt

SEQ ID NO: 112027 - DNA, 36 bp, Artificial Sequence
  Synthetic oligonucleotide
gtcaggaggacaaagatagggaagtggcgggggaga

SEQ ID NO: 112028 - DNA, 36 bp, Artificial Sequence
  Synthetic oligonucleotide
gtgcggccgtagcccttctgttcatcccccgctcca

SEQ ID NO: 112029 - DNA, 35 bp, Artificial Sequence
  Synthetic oligonucleotide
gattcgcccccggatcgttcacaccacaacattcc

SEQ ID NO: 112030 - DNA, 36 bp, Artificial Sequence
  Synthetic oligonucleotide
gaactagacctgggaggacgaagaggagggggaaaa

SEQ ID NO: 112031 - DNA, 35 bp, Artificial Sequence
  Synthetic oligonucleotide
aaccggtccccctcacatcgttgctttctttcagc

SEQ ID NO: 112032 - DNA, 35 bp, Artificial Sequence
  Synthetic oligonucleotide
atgacccatctgtgctttatcttaacgctcctttc

SEQ ID NO: 112033 - DNA, 35 bp, Artificial Sequence
  Synthetic oligonucleotide
gtgctccaccaccctgtattggtccaacctcatag

SEQ ID NO: 112034 - DNA, 36 bp, Artificial Sequence
  Synthetic oligonucleotide
tccggacagatctctgtcctcctataacgcctccca

SEQ ID NO: 112035 - DNA, 35 bp, Artificial Sequence
  Synthetic oligonucleotide
tgtactctctcagcctccatgcgcttggcccctta

SEQ ID NO: 112036 - DNA, 35 bp, Artificial Sequence
  Synthetic oligonucleotide
ggactcgggcgaggagggggaggtggagcgggcgt

SEQ ID NO: 112037 - DNA, 35 bp, Artificial Sequence
  Synthetic oligonucleotide
gcccatcctcagtaagcacatgcccaccgcctgcc

SEQ ID NO: 112038 - DNA, 35 bp, Artificial Sequence
  Synthetic oligonucleotide
tccgcacggaactttgctaactccgcacaccccgt

SEQ ID NO: 112039 - DNA, 35 bp, Artificial Sequence
  Synthetic oligonucleotide
tcgatgacgtcatcgtccctctatagtcccctgtt

SEQ ID NO: 112040 - DNA, 35 bp, Artificial Sequence
  Synthetic oligonucleotide
gtccatcctccttgagccttgacggttttcctacc

SEQ ID NO: 112041 - DNA, 35 bp, Artificial Sequence
  Synthetic oligonucleotide
gacactgctctgctataccactgccaccgcctacg

SEQ ID NO: 112042 - DNA, 35 bp, Artificial Sequence
  Synthetic oligonucleotide
ttcgacccctctcactgcacattcacagtcgcaac

SEQ ID NO: 112043 - DNA, 35 bp, Artificial Sequence
  Synthetic oligonucleotide
ttgtgcccatacgcctcagccgttctccttttccc

SEQ ID NO: 112044 - DNA, 35 bp, Artificial Sequence
  Synthetic oligonucleotide
gttctgccccatcctgtctttgaaggaaatccccc

SEQ ID NO: 112045 - DNA, 35 bp, Artificial Sequence
  Synthetic oligonucleotide
ttcgccgcagcctcttgccaccgaccccctctctt

SEQ ID NO: 112046 - DNA, 38 bp, Artificial Sequence
  Synthetic oligonucleotide
ttacgtcacggtccctgtctcttcgcccccttcgctga

SEQ ID NO: 112047 - DNA, 35 bp, Artificial Sequence
  Synthetic oligonucleotide
tcggaccagccaccgccgctattcggaccaccgcc

SEQ ID NO: 112048 - DNA, 35 bp, Artificial Sequence
  Synthetic oligonucleotide
tcctcgcccgcaccctattccgttctgcgcaagcg

SEQ ID NO: 112049 - DNA, 35 bp, Artificial Sequence
  Synthetic oligonucleotide
cggggccatccaatctgaaacacatctgcctcgcc

SEQ ID NO: 112050 - DNA, 35 bp, Artificial Sequence
  Synthetic oligonucleotide
gatgtggtgccgaatgcgtcttatcacgttccttc

SEQ ID NO: 112051 - DNA, 37 bp, Artificial Sequence
  Synthetic oligonucleotide
gtggtaactgggaggggggggagggttcggctaagga

SEQ ID NO: 112052 - DNA, 35 bp, Artificial Sequence
  Synthetic oligonucleotide
tgccatcaccccatgggcacctttgatccttgtcc

SEQ ID NO: 112053 - DNA, 35 bp, Artificial Sequence
  Synthetic oligonucleotide
gctcactccctcgggccggtatgcacacgccccca

SEQ ID NO: 112054 - DNA, 35 bp, Artificial Sequence
  Synthetic oligonucleotide
tcccgccccgcccgtcgttcacccgttactcttgc

SEQ ID NO: 112055 - DNA, 35 bp, Artificial Sequence
  Synthetic oligonucleotide
tgcacgagcaacaggaggggtggggaagggtgtcg

SEQ ID NO: 112056 - DNA, 35 bp, Artificial Sequence
  Synthetic oligonucleotide
actgtccacatccgagcctccctttctgtcgtact

SEQ ID NO: 112057 - DNA, 36 bp, Artificial Sequence
  Synthetic oligonucleotide
tgccagaccgctctgcacctcttaactgccctatca

SEQ ID NO: 112058 - DNA, 35 bp, Artificial Sequence
  Synthetic oligonucleotide
ttcgagcccaccgcccgccaacctgttatgccctg

SEQ ID NO: 112059 - DNA, 38 bp, Artificial Sequence
  Synthetic oligonucleotide
tccatccacatgctattatacaccttggcctgccttga

SEQ ID NO: 112060 - DNA, 36 bp, Artificial Sequence
  Synthetic oligonucleotide
gccccggtaccgctctgccgcccaatccttccggta

SEQ ID NO: 112061 - DNA, 35 bp, Artificial Sequence
  Synthetic oligonucleotide
ggtccccgccctcattccctatacacgacttagcc

SEQ ID NO: 112062 - DNA, 35 bp, Artificial Sequence
  Synthetic oligonucleotide
tcacgtgcatacgtttgaattccacgccctccctg

SEQ ID NO: 112063 - DNA, 35 bp, Artificial Sequence
  Synthetic oligonucleotide
ttactgccggccagacggaccttcacactgcttcc

SEQ ID NO: 112064 - DNA, 35 bp, Artificial Sequence
  Synthetic oligonucleotide
gtagcccccgtcatagcaatattgtccttctccgt

SEQ ID NO: 112065 - DNA, 35 bp, Artificial Sequence
  Synthetic oligonucleotide
attgctccgccgctgattctttacttttgcgttcc

SEQ ID NO: 112066 - DNA, 36 bp, Artificial Sequence
  Synthetic oligonucleotide
acgtggaggaggaggggtaagtggagggtggagaaa

SEQ ID NO: 112067 - DNA, 36 bp, Artificial Sequence
  Synthetic oligonucleotide
gtgcccgttgccttctgttccccgcgatcctggtca

SEQ ID NO: 112068 - DNA, 35 bp, Artificial Sequence
  Synthetic oligonucleotide
agggggggtagacgggaaagtaggggaggcgggag

SEQ ID NO: 112069 - DNA, 37 bp, Artificial Sequence
  Synthetic oligonucleotide
atggggaagcacacaacggggaatgggctgggaggga

SEQ ID NO: 112070 - DNA, 35 bp, Artificial Sequence
  Synthetic oligonucleotide
acctacaccacgagcattgcacttatagccgcccc

SEQ ID NO: 112071 - DNA, 35 bp, Artificial Sequence
  Synthetic oligonucleotide
agccgctactacgacctggcctaccacgctcctcg

SEQ ID NO: 112072 - DNA, 38 bp, Artificial Sequence
  Synthetic oligonucleotide
acaccccgtcatcttcgcctagctgctccatccaatga

SEQ ID NO: 112073 - DNA, 37 bp, Artificial Sequence
  Synthetic oligonucleotide
gtgggagggcggggtagggtaggttatgcaattgtga

SEQ ID NO: 112074 - DNA, 38 bp, Artificial Sequence
  Synthetic oligonucleotide
tagccccgccgttcgtactcgcctggccctgaccttga

SEQ ID NO: 112075 - DNA, 35 bp, Artificial Sequence
  Synthetic oligonucleotide
tgtccctgcccttcgttgctctaaccgcaagtacc

SEQ ID NO: 112076 - DNA, 35 bp, Artificial Sequence
  Synthetic oligonucleotide
aacacctcgtaccattcgcgtatcgctagtacccc

SEQ ID NO: 112077 - DNA, 35 bp, Artificial Sequence
  Synthetic oligonucleotide
atcgcacacctgacgtccgcttcttctcgcctacg

SEQ ID NO: 112078 - DNA, 35 bp, Artificial Sequence
  Synthetic oligonucleotide
aacgaccactgcactgccccccgcccgatttagtt

SEQ ID NO: 112079 - DNA, 35 bp, Artificial Sequence
  Synthetic oligonucleotide
gatgacgtacgatcgtccttctttctatccgattc

SEQ ID NO: 112080 - DNA, 36 bp, Artificial Sequence
  Synthetic oligonucleotide
cacgtcacctctgtcgccccccgtccgcgctcccgt

SEQ ID NO: 112081 - DNA, 37 bp, Artificial Sequence
  Synthetic oligonucleotide
gccagccttcccgttattatcgcactgcccgccctga

SEQ ID NO: 112082 - DNA, 35 bp, Artificial Sequence
  Synthetic oligonucleotide
tgatatccacactcctcgctcgacccgccactggg

SEQ ID NO: 112083 - DNA, 36 bp, Artificial Sequence
  Synthetic oligonucleotide
tgtgcgaagggaacaggggggaaggtcggacgaaaa

SEQ ID NO: 112084 - DNA, 34 bp, Artificial Sequence
  Synthetic oligonucleotide
atgcacccctgacctgcggcctcactacgttacc

SEQ ID NO: 112085 - DNA, 35 bp, Artificial Sequence
  Synthetic oligonucleotide
ggggaacaacgagggtcgaaacgggtgggggacgt

SEQ ID NO: 112086 - DNA, 36 bp, Artificial Sequence
  Synthetic oligonucleotide
agacctccgcctgcctttttactcctctgctgccca

SEQ ID NO: 112087 - DNA, 34 bp, Artificial Sequence
  Synthetic oligonucleotide
tgagcccgaaccagccagtgcatccgccgccccc

SEQ ID NO: 112088 - DNA, 36 bp, Artificial Sequence
  Synthetic oligonucleotide
gatgacgtcagttgctccctccgaccctacacttca

SEQ ID NO: 112089 - DNA, 37 bp, Artificial Sequence
  Synthetic oligonucleotide
gagagggtttcgaagggcaagggaggtgagggcggga

SEQ ID NO: 112090 - DNA, 35 bp, Artificial Sequence
  Synthetic oligonucleotide
tcatggcctaccacctagttgcttgctgttccacc

SEQ ID NO: 112091 - DNA, 37 bp, Artificial Sequence
  Synthetic oligonucleotide
acatccagcctacacatcgccacgctgcctccctaga

SEQ ID NO: 112092 - DNA, 36 bp, Artificial Sequence
  Synthetic oligonucleotide
tcagcgcatgcacaagcccttccctaccgccgttga

SEQ ID NO: 112093 - DNA, 35 bp, Artificial Sequence
  Synthetic oligonucleotide
tgccaaccacctctatgtgggacaccacatccgcc

SEQ ID NO: 112094 - DNA, 35 bp, Artificial Sequence
  Synthetic oligonucleotide
ggacattccgctcgttacgctacttcaccaccacg

SEQ ID NO: 112095 - DNA, 35 bp, Artificial Sequence
  Synthetic oligonucleotide
aatccgatcaccactcccctcgcaagaacatctcg

SEQ ID NO: 112096 - DNA, 35 bp, Artificial Sequence
  Synthetic oligonucleotide
tgtgctcgcccctccctgctgaatgctctggtact

SEQ ID NO: 112097 - DNA, 35 bp, Artificial Sequence
  Synthetic oligonucleotide
gcaccaaaccgccgctactacgttatacccgtgct

SEQ ID NO: 112098 - DNA, 35 bp, Artificial Sequence
  Synthetic oligonucleotide
atgacctaccacactaggctcccggttcacgggcc

SEQ ID NO: 112099 - DNA, 35 bp, Artificial Sequence
  Synthetic oligonucleotide
atcacatccgcacccgtttcgctctcctggttctg

SEQ ID NO: 112100 - DNA, 35 bp, Artificial Sequence
  Synthetic oligonucleotide
tcagtcccgcccggtcccgcaaggcctatattcct

SEQ ID NO: 112101 - DNA, 35 bp, Artificial Sequence
  Synthetic oligonucleotide
aagtcgtcccatcgcgttttccagccccatcccta

SEQ ID NO: 112102 - DNA, 35 bp, Artificial Sequence
  Synthetic oligonucleotide
gcctcgccctcgttggactcgctcccacctgccgc

SEQ ID NO: 112103 - DNA, 35 bp, Artificial Sequence
  Synthetic oligonucleotide
atgccattctgcaccctgttttatcgctagcctgc

SEQ ID NO: 112104 - DNA, 35 bp, Artificial Sequence
  Synthetic oligonucleotide
atccacgccctattcgtttgcattatcggttaatc

SEQ ID NO: 112105 - DNA, 35 bp, Artificial Sequence
  Synthetic oligonucleotide
accctaaccgcccactagttgaccgcttgaccttt

SEQ ID NO: 112106 - DNA, 35 bp, Artificial Sequence
  Synthetic oligonucleotide
gtccctcccccgagtccccagccacttttgaggtc

SEQ ID NO: 112107 - DNA, 35 bp, Artificial Sequence
  Synthetic oligonucleotide
tatgctcgatccgagcgtaatctaccacccatacc

SEQ ID NO: 112108 - DNA, 35 bp, Artificial Sequence
  Synthetic oligonucleotide
tctccggagcgcatcctttccccctcgtcgtgccc

SEQ ID NO: 112109 - DNA, 35 bp, Artificial Sequence
  Synthetic oligonucleotide
gtctcccgcccgatcctgcacgtccatgtatcgtc

SEQ ID NO: 112110 - DNA, 37 bp, Artificial Sequence
  Synthetic oligonucleotide
gcccatcccggtgcatgtttttcgtgcccttccctga

SEQ ID NO: 112111 - DNA, 35 bp, Artificial Sequence
  Synthetic oligonucleotide
actccatccctcagaccgaccctgttgtccggccc

SEQ ID NO: 112112 - DNA, 36 bp, Artificial Sequence
  Synthetic oligonucleotide
aaaccgccgccttccgcctgtcctagccgacgctca

SEQ ID NO: 112113 - DNA, 35 bp, Artificial Sequence
  Synthetic oligonucleotide
atgatcgcgccgtcttttttcgttgccagcccctt

SEQ ID NO: 112114 - DNA, 35 bp, Artificial Sequence
  Synthetic oligonucleotide
ttccgtccacgcctgcccagctacatctcctgtgc

SEQ ID NO: 112115 - DNA, 35 bp, Artificial Sequence
  Synthetic oligonucleotide
ggggaagagtcgggggcgggtgcgaaggggcagat

SEQ ID NO: 112116 - DNA, 38 bp, Artificial Sequence
  Synthetic oligonucleotide
aagacgggggtggaggggtcgaagatgggcgtggatga

SEQ ID NO: 112117 - DNA, 35 bp, Artificial Sequence
  Synthetic oligonucleotide
tcccgcgccgggacctgctgtcactccgttcaccc

SEQ ID NO: 112118 - DNA, 35 bp, Artificial Sequence
  Synthetic oligonucleotide
tcccttctacccccgtgcctacgcctccgttgccc

SEQ ID NO: 112119 - DNA, 35 bp, Artificial Sequence
  Synthetic oligonucleotide
tcgatcgtcgccgccctctttcgtcttcagcctag

SEQ ID NO: 112120 - DNA, 35 bp, Artificial Sequence
  Synthetic oligonucleotide
taccgtccagacctccgtgccatttccgctccttg

SEQ ID NO: 112121 - DNA, 35 bp, Artificial Sequence
  Synthetic oligonucleotide
gcctacacacatgccctagactcacctgtactcga

SEQ ID NO: 112122 - DNA, 36 bp, Artificial Sequence
  Synthetic oligonucleotide
gagagcggagggggtggaatctgggtagggggaaca

SEQ ID NO: 112123 - DNA, 34 bp, Artificial Sequence
  Synthetic oligonucleotide
aacgcctccaccttgttaccatccattcgcgaga

SEQ ID NO: 112124 - DNA, 35 bp, Artificial Sequence
  Synthetic oligonucleotide
atctcagccggcccatggcttccgtccgccgcccc

SEQ ID NO: 112125 - DNA, 36 bp, Artificial Sequence
  Synthetic oligonucleotide
gtctcgtccgcaggctgttcaccccgtcgtttccca

SEQ ID NO: 112126 - DNA, 35 bp, Artificial Sequence
  Synthetic oligonucleotide
tgtaaagccgcattccgctccggggccccctcctg

SEQ ID NO: 112127 - DNA, 35 bp, Artificial Sequence
  Synthetic oligonucleotide
taccgccccccgcccttctgagccgctcctaccaa

SEQ ID NO: 112128 - DNA, 36 bp, Artificial Sequence
  Synthetic oligonucleotide
gtgcgctcaacggagggggggaaaaggggggcacga

SEQ ID NO: 112129 - DNA, 35 bp, Artificial Sequence
  Synthetic oligonucleotide
tttcgcccttgccgtaatccttatccgtgccaccc

SEQ ID NO: 112130 - DNA, 35 bp, Artificial Sequence
  Synthetic oligonucleotide
agcactcccaccgatcgttcgcactcgcttttttg

SEQ ID NO: 112131 - DNA, 36 bp, Artificial Sequence
  Synthetic oligonucleotide
acgcccccctgcccgcatgaaccatcgaattatcga

SEQ ID NO: 112132 - DNA, 37 bp, Artificial Sequence
  Synthetic oligonucleotide
taagcggcctgggaaggacaagggaggggggatagga

SEQ ID NO: 112133 - DNA, 37 bp, Artificial Sequence
  Synthetic oligonucleotide
gtagggcgggtcaaggaggtcaagggggggtggcgga

SEQ ID NO: 112134 - DNA, 35 bp, Artificial Sequence
  Synthetic oligonucleotide
gtacaggaccccccgtaccaccaaatggcgaatgc

SEQ ID NO: 112135 - DNA, 36 bp, Artificial Sequence
  Synthetic oligonucleotide
tccgcccaccgcctcccctcagactctctagtccag

SEQ ID NO: 112136 - DNA, 35 bp, Artificial Sequence
  Synthetic oligonucleotide
gtccgtgccggctagtatttatgctctcctcgcca

SEQ ID NO: 112137 - DNA, 36 bp, Artificial Sequence
  Synthetic oligonucleotide
tgacatcgccattatatctgtcccttccgtccagca

SEQ ID NO: 112138 - DNA, 35 bp, Artificial Sequence
  Synthetic oligonucleotide
acctcaccgcaatactaactccccattaggttcac

SEQ ID NO: 112139 - DNA, 35 bp, Artificial Sequence
  Synthetic oligonucleotide
gccgccgtggttcacccgccccttgacccttgccc

SEQ ID NO: 112140 - DNA, 35 bp, Artificial Sequence
  Synthetic oligonucleotide
accgtccggtcccctttgccatatcagccattttc

SEQ ID NO: 112141 - DNA, 36 bp, Artificial Sequence
  Synthetic oligonucleotide
accacgtactgcctggatcattacagcccctgccca

SEQ ID NO: 112142 - DNA, 35 bp, Artificial Sequence
  Synthetic oligonucleotide
gagggggaccgaagcatggggtagggtgtagggca

SEQ ID NO: 112143 - DNA, 36 bp, Artificial Sequence
  Synthetic oligonucleotide
tacctgcccattcctgttttagcttcacgaccacca

SEQ ID NO: 112144 - DNA, 35 bp, Artificial Sequence
  Synthetic oligonucleotide
aacacccgccccgatacactcgcgctaccaatggt

SEQ ID NO: 112145 - DNA, 36 bp, Artificial Sequence
  Synthetic oligonucleotide
tcacgcattcttctgtacacctcgttccatccgtga

SEQ ID NO: 112146 - DNA, 35 bp, Artificial Sequence
  Synthetic oligonucleotide
agtcccccagcattccccgccgcctgggtcctccc

SEQ ID NO: 112147 - DNA, 35 bp, Artificial Sequence
  Synthetic oligonucleotide
ggtgccccccacctgctccgctcgttgtcccactc

SEQ ID NO: 112148 - DNA, 35 bp, Artificial Sequence
  Synthetic oligonucleotide
gtaacgcacaagaagggtgggggggaagtgtggtg

SEQ ID NO: 112149 - DNA, 35 bp, Artificial Sequence
  Synthetic oligonucleotide
acgaccccgcacccgaccacatatctgcccggcct

SEQ ID NO: 112150 - DNA, 35 bp, Artificial Sequence
  Synthetic oligonucleotide
atcgtcatcacccccaccatctgctactgttgcac

SEQ ID NO: 112151 - DNA, 35 bp, Artificial Sequence
  Synthetic oligonucleotide
acatcctgccccccagttcgcattttcctcagggc

SEQ ID NO: 112152 - DNA, 35 bp, Artificial Sequence
  Synthetic oligonucleotide
tccccacccgccattgactgcattaacgctccttt

SEQ ID NO: 112153 - DNA, 36 bp, Artificial Sequence
  Synthetic oligonucleotide
tggagggggtggtggaggtggaggtgtactgtcaca

SEQ ID NO: 112154 - DNA, 38 bp, Artificial Sequence
  Synthetic oligonucleotide
acacgtcctccgctatatcggccaactcgccttcctga

SEQ ID NO: 112155 - DNA, 35 bp, Artificial Sequence
  Synthetic oligonucleotide
gattcgctccaacctcctgatatgcatcacacctg

SEQ ID NO: 112156 - DNA, 35 bp, Artificial Sequence
  Synthetic oligonucleotide
ttgtccgccttgctgccagctctcctctttcgcct

SEQ ID NO: 112157 - DNA, 37 bp, Artificial Sequence
  Synthetic oligonucleotide
gacacagcgaatggaggggggcatgggggcgtgggga

SEQ ID NO: 112158 - DNA, 38 bp, Artificial Sequence
  Synthetic oligonucleotide
ttaccacgcctcccatgtccacccgtactcgtttatga

SEQ ID NO: 112159 - DNA, 37 bp, Artificial Sequence
  Synthetic oligonucleotide
gccccctccctccgactgtttacctacttgcctttga

SEQ ID NO: 112160 - DNA, 35 bp, Artificial Sequence
  Synthetic oligonucleotide
taggtcggtcgctgctcccacactcccgtcttgct

SEQ ID NO: 112161 - DNA, 35 bp, Artificial Sequence
  Synthetic oligonucleotide
gcgttcccgcgctgatctctctcttcccctcctca

SEQ ID NO: 112162 - DNA, 35 bp, Artificial Sequence
  Synthetic oligonucleotide
gccccactactgcctctgctcattttatttagtcc

SEQ ID NO: 112163 - DNA, 35 bp, Artificial Sequence
  Synthetic oligonucleotide
taagccaactcacgttctgccattgttttctgtcc

SEQ ID NO: 112164 - DNA, 36 bp, Artificial Sequence
  Synthetic oligonucleotide
gatggaggttaagggggggagcgaagtgacagggta

SEQ ID NO: 112165 - DNA, 35 bp, Artificial Sequence
  Synthetic oligonucleotide
agacgggtgggtgggaacgggaaaacgtagccctc

SEQ ID NO: 112166 - DNA, 36 bp, Artificial Sequence
  Synthetic oligonucleotide
gcgccgctgcctgtcttacttcgcccttcatcttca

SEQ ID NO: 112167 - DNA, 35 bp, Artificial Sequence
  Synthetic oligonucleotide
gacccgcaacacatctcaccggccccctacctgtc

SEQ ID NO: 112168 - DNA, 37 bp, Artificial Sequence
  Synthetic oligonucleotide
gctacctgcccgtcgcgccccctgtgccctctgctga

SEQ ID NO: 112169 - DNA, 35 bp, Artificial Sequence
  Synthetic oligonucleotide
acatcacctacagggccttccacctctctattgag

SEQ ID NO: 112170 - DNA, 35 bp, Artificial Sequence
  Synthetic oligonucleotide
ggacacggagtagagggtgaggaggaggggtacgg

SEQ ID NO: 112171 - DNA, 37 bp, Artificial Sequence
  Synthetic oligonucleotide
gaatcagccccgtctctagccccccgtcccacctgga

SEQ ID NO: 112172 - DNA, 37 bp, Artificial Sequence
  Synthetic oligonucleotide
tgtactgaagggatggggtttggggtaccgatgggga

SEQ ID NO: 112173 - DNA, 36 bp, Artificial Sequence
  Synthetic oligonucleotide
taccaacgcacactcgtactccgccgccttcctgga

SEQ ID NO: 112174 - DNA, 37 bp, Artificial Sequence
  Synthetic oligonucleotide
ggtcccatcctctccatctgcctgccatcatctatga

SEQ ID NO: 112175 - DNA, 35 bp, Artificial Sequence
  Synthetic oligonucleotide
gttgtgccgtcgcctcttgttcatcgccatcgacc

SEQ ID NO: 112176 - DNA, 35 bp, Artificial Sequence
  Synthetic oligonucleotide
gttgcccaccttagcctgccttcatttggtcaccc

SEQ ID NO: 112177 - DNA, 35 bp, Artificial Sequence
  Synthetic oligonucleotide
gtacgcctgcgttaaccgtaagtcccctgctccac

SEQ ID NO: 112178 - DNA, 35 bp, Artificial Sequence
  Synthetic oligonucleotide
tttgagcacggagggggtagggaggagggcgaaat

SEQ ID NO: 112179 - DNA, 36 bp, Artificial Sequence
  Synthetic oligonucleotide
tacgcccctgccctatcgctattgctgtaatcatta

SEQ ID NO: 112180 - DNA, 35 bp, Artificial Sequence
  Synthetic oligonucleotide
tccacatgttaccgctcttgtttgtcttcaccgcc

SEQ ID NO: 112181 - DNA, 35 bp, Artificial Sequence
  Synthetic oligonucleotide
aagccacgacgctcccatccacaccgtcacttccg

SEQ ID NO: 112182 - DNA, 35 bp, Artificial Sequence
  Synthetic oligonucleotide
gatgggagcatgcggagaaaagggagggacggatg

SEQ ID NO: 112183 - DNA, 35 bp, Artificial Sequence
  Synthetic oligonucleotide
tcccttgtcatgccccatacccccgtccctcggcg

SEQ ID NO: 112184 - DNA, 35 bp, Artificial Sequence
  Synthetic oligonucleotide
ggacgccaccatgccctacggctccctccccggtt

SEQ ID NO: 112185 - DNA, 36 bp, Artificial Sequence
  Synthetic oligonucleotide
tttccacccgcgccgtccattggcccccgtacccca

SEQ ID NO: 112186 - DNA, 37 bp, Artificial Sequence
  Synthetic oligonucleotide
atgcgccgcccacttaactgtctctgcctctcttcga

SEQ ID NO: 112187 - DNA, 35 bp, Artificial Sequence
  Synthetic oligonucleotide
acacactcctgtaccccgccctactccatggtggc

SEQ ID NO: 112188 - DNA, 36 bp, Artificial Sequence
  Synthetic oligonucleotide
gtgcgcctccattatcttattgtgtcgttaccacca

SEQ ID NO: 112189 - DNA, 35 bp, Artificial Sequence
  Synthetic oligonucleotide
aaaccgcctcctcttgctcgctacaactgcctgta

SEQ ID NO: 112190 - DNA, 35 bp, Artificial Sequence
  Synthetic oligonucleotide
acgcgcccttccagttctatccccactcgcttaca

SEQ ID NO: 112191 - DNA, 36 bp, Artificial Sequence
  Synthetic oligonucleotide
ttgtcgacccccacagctgttatctgcccttaacca

SEQ ID NO: 112192 - DNA, 35 bp, Artificial Sequence
  Synthetic oligonucleotide
accctcccgcccatgctgccttgtagactggtatc

SEQ ID NO: 112193 - DNA, 37 bp, Artificial Sequence
  Synthetic oligonucleotide
gaagctgggaggcgggaggggcttgggattggcatga

SEQ ID NO: 112194 - DNA, 35 bp, Artificial Sequence
  Synthetic oligonucleotide
tagcctcggtgctccgtttctatagttcccccctc

SEQ ID NO: 112195 - DNA, 35 bp, Artificial Sequence
  Synthetic oligonucleotide
ttgatagccctccccatgctgaatcgctcacattc

SEQ ID NO: 112196 - DNA, 35 bp, Artificial Sequence
  Synthetic oligonucleotide
aaagccagcctaccccaccgcaccatgaccgccgc

SEQ ID NO: 112197 - DNA, 35 bp, Artificial Sequence
  Synthetic oligonucleotide
tccagtgcaatattcgtgatactctggctacacct

SEQ ID NO: 112198 - DNA, 36 bp, Artificial Sequence
  Synthetic oligonucleotide
acacgtgccgtctttgctttcctgctggtcccttaa

SEQ ID NO: 112199 - DNA, 35 bp, Artificial Sequence
  Synthetic oligonucleotide
gtccaccgcccgatctttaaccattaccctgcaag

SEQ ID NO: 112200 - DNA, 37 bp, Artificial Sequence
  Synthetic oligonucleotide
tccgcccgtgccgttgctcttctcttccttggcttga

SEQ ID NO: 112201 - DNA, 35 bp, Artificial Sequence
  Synthetic oligonucleotide
tcacaccttcagcaacgaactgctacccttcacac

SEQ ID NO: 112202 - DNA, 37 bp, Artificial Sequence
  Synthetic oligonucleotide
actccgccccccctcgcccagtatagagctgcatcga

SEQ ID NO: 112203 - DNA, 35 bp, Artificial Sequence
  Synthetic oligonucleotide
gacttcggcgcaggttgtccttccttccctcgctc

SEQ ID NO: 112204 - DNA, 36 bp, Artificial Sequence
  Synthetic oligonucleotide
acccatccacccgtaatggcccgagccttgcttaca

SEQ ID NO: 112205 - DNA, 35 bp, Artificial Sequence
  Synthetic oligonucleotide
tggtacgaccgtctgtcacacatgcctccctctca

SEQ ID NO: 112206 - DNA, 35 bp, Artificial Sequence
  Synthetic oligonucleotide
gtcacaccatcagtgctcggcccccttatacctcc

SEQ ID NO: 112207 - DNA, 35 bp, Artificial Sequence
  Synthetic oligonucleotide
acgacccatcttctgctcactgttaactcatgcct

SEQ ID NO: 112208 - DNA, 35 bp, Artificial Sequence
  Synthetic oligonucleotide
ttcccgccccacggccacttgccccgctttgcacc

SEQ ID NO: 112209 - DNA, 35 bp, Artificial Sequence
  Synthetic oligonucleotide
tttacgcaccccttgcatcatgtctacttccttgt

SEQ ID NO: 112210 - DNA, 35 bp, Artificial Sequence
  Synthetic oligonucleotide
gcatccccctcgcgccctaagtagtgccccggtcc

SEQ ID NO: 112211 - DNA, 36 bp, Artificial Sequence
  Synthetic oligonucleotide
gggtgcgcaagcggaaggggcggtggggggctggaa

SEQ ID NO: 112212 - DNA, 36 bp, Artificial Sequence
  Synthetic oligonucleotide
ttttgcgccacaatgttctgcccccttgtttcttca

SEQ ID NO: 112213 - DNA, 36 bp, Artificial Sequence
  Synthetic oligonucleotide
atccctgtacccgcccctcttcgtgccactgcacga

SEQ ID NO: 112214 - DNA, 35 bp, Artificial Sequence
  Synthetic oligonucleotide
acacctccacgttccgggccatgctttgcactctt

SEQ ID NO: 112215 - DNA, 35 bp, Artificial Sequence
  Synthetic oligonucleotide
tgttgcacgagcctatagccgccgcccatccccga

SEQ ID NO: 112216 - DNA, 36 bp, Artificial Sequence
  Synthetic oligonucleotide
gtgtatgccgccgtactgtccgctcttggtgccccg

SEQ ID NO: 112217 - DNA, 36 bp, Artificial Sequence
  Synthetic oligonucleotide
acacctgctccatcgtgctgtaatacccccgcgcga

SEQ ID NO: 112218 - DNA, 34 bp, Artificial Sequence
  Synthetic oligonucleotide
gcgcccattcggtgcgctttgaccaattaccttc

SEQ ID NO: 112219 - DNA, 35 bp, Artificial Sequence
  Synthetic oligonucleotide
gattagcccacatgtcccgccttcggtttcccgcg

SEQ ID NO: 112220 - DNA, 37 bp, Artificial Sequence
  Synthetic oligonucleotide
gatacgaaagggtgggacacggaggaggacaaagaga

SEQ ID NO: 112221 - DNA, 35 bp, Artificial Sequence
  Synthetic oligonucleotide
acccactcgccctccctctctaaagtcgcttagcc

SEQ ID NO: 112222 - DNA, 35 bp, Artificial Sequence
  Synthetic oligonucleotide
gtcaaaccgcccgtctcagttcatttccatcgccg

SEQ ID NO: 112223 - DNA, 36 bp, Artificial Sequence
  Synthetic oligonucleotide
taaccgccccaccgatccaggagccgcctcccttca

SEQ ID NO: 112224 - DNA, 37 bp, Artificial Sequence
  Synthetic oligonucleotide
gagcccatctgtagtgcctttacccccgcccttccga

SEQ ID NO: 112225 - DNA, 35 bp, Artificial Sequence
  Synthetic oligonucleotide
gactgcgttagaatcatggttccctctcgcattct

SEQ ID NO: 112226 - DNA, 35 bp, Artificial Sequence
  Synthetic oligonucleotide
atgctccatctctcagcttgttttgtccttccgca

SEQ ID NO: 112227 - DNA, 35 bp, Artificial Sequence
  Synthetic oligonucleotide
tccagctgccgtcaccgcactcttctgcccagccc

SEQ ID NO: 112228 - DNA, 35 bp, Artificial Sequence
  Synthetic oligonucleotide
ttgtcacctccaggcaatcagcgggcgctccctcc

SEQ ID NO: 112229 - DNA, 35 bp, Artificial Sequence
  Synthetic oligonucleotide
actcgcccctcatgctaaaattacggcccctcttt

SEQ ID NO: 112230 - DNA, 36 bp, Artificial Sequence
  Synthetic oligonucleotide
gccgcacctgccgtggccttttgatccgtactatca

SEQ ID NO: 112231 - DNA, 35 bp, Artificial Sequence
  Synthetic oligonucleotide
ataccctcgcagctcgcctcgcgtactcctctgtc

SEQ ID NO: 112232 - DNA, 35 bp, Artificial Sequence
  Synthetic oligonucleotide
tcccgtgcaccctcacgtcaagctccccgggtcct

SEQ ID NO: 112233 - DNA, 35 bp, Artificial Sequence
  Synthetic oligonucleotide
tgcgcctctccgttttcatgcctggcccatacaac

SEQ ID NO: 112234 - DNA, 35 bp, Artificial Sequence
  Synthetic oligonucleotide
gcgaccacctatgcatcacgtactacccggtcttt

SEQ ID NO: 112235 - DNA, 38 bp, Artificial Sequence
  Synthetic oligonucleotide
tgcctcgtcgctggccatagtttcgctcctccacctga

SEQ ID NO: 112236 - DNA, 36 bp, Artificial Sequence
  Synthetic oligonucleotide
tatcctgcgctgaccgtcgctgcttaccgttcccca

SEQ ID NO: 112237 - DNA, 35 bp, Artificial Sequence
  Synthetic oligonucleotide
gtttgagcgtcccccgttcctatgatcctgccgca

SEQ ID NO: 112238 - DNA, 37 bp, Artificial Sequence
  Synthetic oligonucleotide
tccccctcgctccgtcaccgctccctgtccttctgga

SEQ ID NO: 112239 - DNA, 38 bp, Artificial Sequence
  Synthetic oligonucleotide
ttcagccctgcccttgttcttgcgttgctatcctttga

SEQ ID NO: 112240 - DNA, 35 bp, Artificial Sequence
  Synthetic oligonucleotide
atgaccccaagttgctgtacccccttgttccctgc

SEQ ID NO: 112241 - DNA, 34 bp, Artificial Sequence
  Synthetic oligonucleotide
tcattgtccgccccttatttacgtgccacgaacc

SEQ ID NO: 112242 - DNA, 35 bp, Artificial Sequence
  Synthetic oligonucleotide
aacgcggcatttcctcttcgaactgttgctccacc

SEQ ID NO: 112243 - DNA, 35 bp, Artificial Sequence
  Synthetic oligonucleotide
tacgatagcatgggagggcgcggtgggaggtaacg

SEQ ID NO: 112244 - DNA, 35 bp, Artificial Sequence
  Synthetic oligonucleotide
gacccgtgcgcacctcctcgctctgtgccatttac

SEQ ID NO: 112245 - DNA, 35 bp, Artificial Sequence
  Synthetic oligonucleotide
gtcccgccagatcacctcgccccctttgttgatca

SEQ ID NO: 112246 - DNA, 35 bp, Artificial Sequence
  Synthetic oligonucleotide
acgcaaaccccctctgggaccgacccatctgcctt

SEQ ID NO: 112247 - DNA, 38 bp, Artificial Sequence
  Synthetic oligonucleotide
tccatacctcgccctgttctgttcccctagaccgttga

SEQ ID NO: 112248 - DNA, 35 bp, Artificial Sequence
  Synthetic oligonucleotide
gagcaagccccacatatcttctgtccctcatgcac

SEQ ID NO: 112249 - DNA, 35 bp, Artificial Sequence
  Synthetic oligonucleotide
attcctgcgcatgagctgccctgtccactctactc

SEQ ID NO: 112250 - DNA, 35 bp, Artificial Sequence
  Synthetic oligonucleotide
aacgccctgcccaccgttcgcccagtgatgccctg

SEQ ID NO: 112251 - DNA, 35 bp, Artificial Sequence
  Synthetic oligonucleotide
gatcaccgccttgccctaccttgagtttcctcgct

SEQ ID NO: 112252 - DNA, 35 bp, Artificial Sequence
  Synthetic oligonucleotide
gccaactgggcgcaaggggggggaacgggcggaaa

SEQ ID NO: 112253 - DNA, 35 bp, Artificial Sequence
  Synthetic oligonucleotide
ggagggtggggggggtaacacaaggtgcaatgcga

SEQ ID NO: 112254 - DNA, 37 bp, Artificial Sequence
  Synthetic oligonucleotide
gacacacagagaaagcgggagggcgcgggacgggtga

SEQ ID NO: 112255 - DNA, 35 bp, Artificial Sequence
  Synthetic oligonucleotide
tacacctgcacctttgcgtaaccatccgttgatcc

SEQ ID NO: 112256 - DNA, 35 bp, Artificial Sequence
  Synthetic oligonucleotide
gatgcaagtcacaatctgccaccccgccggaccct

SEQ ID NO: 112257 - DNA, 35 bp, Artificial Sequence
  Synthetic oligonucleotide
ttcatcacccgtcggactagtcgcgccccatccaa

SEQ ID NO: 112258 - DNA, 36 bp, Artificial Sequence
  Synthetic oligonucleotide
acaaccgaccgtcaaccgtcctaagcccctccccga

SEQ ID NO: 112259 - DNA, 35 bp, Artificial Sequence
  Synthetic oligonucleotide
acacatcctcctcagtccgtagccatgcaacaccg

SEQ ID NO: 112260 - DNA, 37 bp, Artificial Sequence
  Synthetic oligonucleotide
tcctcgtgctcattggcattgccccgccccccttgga

SEQ ID NO: 112261 - DNA, 35 bp, Artificial Sequence
  Synthetic oligonucleotide
gaccagacgctggggaaaggcgaggggggggaacg

SEQ ID NO: 112262 - DNA, 35 bp, Artificial Sequence
  Synthetic oligonucleotide
gccgccgtcgcaccgtttcttccctgtgatgctgc

SEQ ID NO: 112263 - DNA, 35 bp, Artificial Sequence
  Synthetic oligonucleotide
gccccctcaccttcgaattacgcagaccttcctca

SEQ ID NO: 112264 - DNA, 37 bp, Artificial Sequence
  Synthetic oligonucleotide
gaccactcacctcatatctcgacctgccttctccgga

SEQ ID NO: 112265 - DNA, 37 bp, Artificial Sequence
  Synthetic oligonucleotide
tcatccccccctttgctattactgcagtcaaccctga

SEQ ID NO: 112266 - DNA, 35 bp, Artificial Sequence
  Synthetic oligonucleotide
acacccactcgggccctcccaggcacctttccgta

SEQ ID NO: 112267 - DNA, 34 bp, Artificial Sequence
  Synthetic oligonucleotide
gtctggccccccgcatcctcccatttgcgcttcg

SEQ ID NO: 112268 - DNA, 32 bp, Artificial Sequence
  Synthetic oligonucleotide
tacacccgagagtactgctattcacacttcat

SEQ ID NO: 112269 - DNA, 35 bp, Artificial Sequence
  Synthetic oligonucleotide
gtccctcaccactactgttaaactgtgacctccct

SEQ ID NO: 112270 - DNA, 35 bp, Artificial Sequence
  Synthetic oligonucleotide
gatagctgcccccctcctcccgtcccgcctctgca

SEQ ID NO: 112271 - DNA, 36 bp, Artificial Sequence
  Synthetic oligonucleotide
actcccctgtccgtatctattcccgtgtttccctca

SEQ ID NO: 112272 - DNA, 36 bp, Artificial Sequence
  Synthetic oligonucleotide
gtttcgcgccccctcatccacacacccgttccacga

SEQ ID NO: 112273 - DNA, 35 bp, Artificial Sequence
  Synthetic oligonucleotide
gccgcaggcaccagtttgacgcgttcatccattcc

SEQ ID NO: 112274 - DNA, 35 bp, Artificial Sequence
  Synthetic oligonucleotide
gtcctcgcccagttcgcttttactcccgtctacgg

SEQ ID NO: 112275 - DNA, 37 bp, Artificial Sequence
  Synthetic oligonucleotide
gaggagggtaagggaggacggggacgggtgacggcga

SEQ ID NO: 112276 - DNA, 35 bp, Artificial Sequence
  Synthetic oligonucleotide
gtgacacatgtccttcctgtaactgccccaacttc

SEQ ID NO: 112277 - DNA, 37 bp, Artificial Sequence
  Synthetic oligonucleotide
gtgacatcccgccccctccgacgacctcctgaatgga

SEQ ID NO: 112278 - DNA, 35 bp, Artificial Sequence
  Synthetic oligonucleotide
tctcccgtcgccacgtgtacttccgcccttacacc

SEQ ID NO: 112279 - DNA, 35 bp, Artificial Sequence
  Synthetic oligonucleotide
tgtcacccacccggcccccttcaccgcctcaagga

SEQ ID NO: 112280 - DNA, 35 bp, Artificial Sequence
  Synthetic oligonucleotide
agtacccaccctgtctcataacgtgcggtttctcc

SEQ ID NO: 112281 - DNA, 35 bp, Artificial Sequence
  Synthetic oligonucleotide
atagccgtgcccccgaacgtgaagtttcgctctct

SEQ ID NO: 112282 - DNA, 34 bp, Artificial Sequence
  Synthetic oligonucleotide
tcctccacctcaccgtattataccttgcctcgtt

SEQ ID NO: 112283 - DNA, 33 bp, Artificial Sequence
  Synthetic oligonucleotide
gtacggaccaagggtggggtaatgagggagggg

SEQ ID NO: 112284 - DNA, 35 bp, Artificial Sequence
  Synthetic oligonucleotide
gctgcacgggcggcgctcgtgggcggggaaggcct

SEQ ID NO: 112285 - DNA, 35 bp, Artificial Sequence
  Synthetic oligonucleotide
gatgccatgtccctcagttttcctgttttggtcct

SEQ ID NO: 112286 - DNA, 35 bp, Artificial Sequence
  Synthetic oligonucleotide
atagaaccgccgttgctccctcccacggtgtaccc

SEQ ID NO: 112287 - DNA, 35 bp, Artificial Sequence
  Synthetic oligonucleotide
agccaatgcccggactcctgcatgactaccattcc

SEQ ID NO: 112288 - DNA, 35 bp, Artificial Sequence
  Synthetic oligonucleotide
gcccgctgacccctgtgatactatcctgccctgtc

SEQ ID NO: 112289 - DNA, 35 bp, Artificial Sequence
  Synthetic oligonucleotide
tatgacaccgcgcccatcttcatgcacacctttaa

SEQ ID NO: 112290 - DNA, 36 bp, Artificial Sequence
  Synthetic oligonucleotide
acatcccatcatcggtctgtctatgcctgttcctca

SEQ ID NO: 112291 - DNA, 35 bp, Artificial Sequence
  Synthetic oligonucleotide
gtggggaaagaggtgggatagaagggaaagcgtat

SEQ ID NO: 112292 - DNA, 32 bp, Artificial Sequence
  Synthetic oligonucleotide
tgcaacagacgccctcccatttgattcctgtt

SEQ ID NO: 112293 - DNA, 36 bp, Artificial Sequence
  Synthetic oligonucleotide
acctgccccccatactgtctgtcaccctgtctatga

SEQ ID NO: 112294 - DNA, 34 bp, Artificial Sequence
  Synthetic oligonucleotide
tcacgcagacctgtttttcacgcgcgttcacacc

SEQ ID NO: 112295 - DNA, 33 bp, Artificial Sequence
  Synthetic oligonucleotide
acctggcctcctggttgcgattcctgcctagcc

SEQ ID NO: 112296 - DNA, 35 bp, Artificial Sequence
  Synthetic oligonucleotide
gtacgcacctcccccatttatcgtcacgcctcggc

SEQ ID NO: 112297 - DNA, 35 bp, Artificial Sequence
  Synthetic oligonucleotide
tgcacagccccccgcgatctgcccgctccccaact

SEQ ID NO: 112298 - DNA, 35 bp, Artificial Sequence
  Synthetic oligonucleotide
ttacccgaccccgccgctgaaaaccgagaggttac

SEQ ID NO: 112299 - DNA, 35 bp, Artificial Sequence
  Synthetic oligonucleotide
tcctccacccggcaaccatttcttgcgaacccctg

SEQ ID NO: 112300 - DNA, 36 bp, Artificial Sequence
  Synthetic oligonucleotide
gatggatggggggggtgaggaaaagctggtggttaa

SEQ ID NO: 112301 - DNA, 35 bp, Artificial Sequence
  Synthetic oligonucleotide
tcaaccaccacgcaccttcttgtggctccaccaca

SEQ ID NO: 112302 - DNA, 35 bp, Artificial Sequence
  Synthetic oligonucleotide
gctccctccgcccgctttctacgatcatacttgtc

SEQ ID NO: 112303 - DNA, 37 bp, Artificial Sequence
  Synthetic oligonucleotide
agccccacacgcccgtgccttgactcccttcccctga

SEQ ID NO: 112304 - DNA, 37 bp, Artificial Sequence
  Synthetic oligonucleotide
tcgtagccatcacgttggttcctgctccacctcccga

SEQ ID NO: 112305 - DNA, 38 bp, Artificial Sequence
  Synthetic oligonucleotide
gacggaacggtgcagggagggggggggccgggaattga

SEQ ID NO: 112306 - DNA, 35 bp, Artificial Sequence
  Synthetic oligonucleotide
gccaaccgcactgttgtccccctccctcagtgcta

SEQ ID NO: 112307 - DNA, 36 bp, Artificial Sequence
  Synthetic oligonucleotide
gccagtcgtcgctccaccctcgcccttcacgctgta

SEQ ID NO: 112308 - DNA, 35 bp, Artificial Sequence
  Synthetic oligonucleotide
agatagagggtgggcgggcagatgggtcttctgtt

SEQ ID NO: 112309 - DNA, 35 bp, Artificial Sequence
  Synthetic oligonucleotide
tcctcccatccctcggttgcccctgtgacttagca

SEQ ID NO: 112310 - DNA, 36 bp, Artificial Sequence
  Synthetic oligonucleotide
tccgaccacggctcgctggttgctttgtttccctta

SEQ ID NO: 112311 - DNA, 35 bp, Artificial Sequence
  Synthetic oligonucleotide
tcttaggccccgtccaccaatgcacccccctcctc

SEQ ID NO: 112312 - DNA, 35 bp, Artificial Sequence
  Synthetic oligonucleotide
gtagtagcgggggggcgggtagagactgagggcag

SEQ ID NO: 112313 - DNA, 35 bp, Artificial Sequence
  Synthetic oligonucleotide
aagccctgcttcccacccggtttcacgttgccttt

SEQ ID NO: 112314 - DNA, 35 bp, Artificial Sequence
  Synthetic oligonucleotide
tacatgagccggccgtttctgttatcttactcttc

SEQ ID NO: 112315 - DNA, 35 bp, Artificial Sequence
  Synthetic oligonucleotide
tgccaccgcactgtctatgcgccgcccttcagtct

SEQ ID NO: 112316 - DNA, 35 bp, Artificial Sequence
  Synthetic oligonucleotide
tccgccccccctgccggttccctcgagcgcattac

SEQ ID NO: 112317 - DNA, 35 bp, Artificial Sequence
  Synthetic oligonucleotide
gcgaatcgccagagcgattaccccgcctcacttcc

SEQ ID NO: 112318 - DNA, 35 bp, Artificial Sequence
  Synthetic oligonucleotide
tgtcccccctgctcttctggtcatcagcacttatc

SEQ ID NO: 112319 - DNA, 35 bp, Artificial Sequence
  Synthetic oligonucleotide
agatgcttcccgcccgatcgcccttacccgctatg

SEQ ID NO: 112320 - DNA, 35 bp, Artificial Sequence
  Synthetic oligonucleotide
aacttcaaggaggaggggggcaagggggtggactg

SEQ ID NO: 112321 - DNA, 36 bp, Artificial Sequence
  Synthetic oligonucleotide
gtaccatcgatgacttctacaccggtcacattctca

SEQ ID NO: 112322 - DNA, 35 bp, Artificial Sequence
  Synthetic oligonucleotide
tctctgtgcaatcagcggcctttactgcatcactc

SEQ ID NO: 112323 - DNA, 35 bp, Artificial Sequence
  Synthetic oligonucleotide
ggtaccgtcggctattaaccgtcttctatcccttg

SEQ ID NO: 112324 - DNA, 35 bp, Artificial Sequence
  Synthetic oligonucleotide
actgcccttcgcctctcttatctctctgacctgct

SEQ ID NO: 112325 - DNA, 35 bp, Artificial Sequence
  Synthetic oligonucleotide
tcgcggatccttctgctgcccatatatcgccacca

SEQ ID NO: 112326 - DNA, 35 bp, Artificial Sequence
  Synthetic oligonucleotide
tactccactcccacgtcccaactgccctgtcccga

SEQ ID NO: 112327 - DNA, 35 bp, Artificial Sequence
  Synthetic oligonucleotide
gccgaccacccgaagtcttgtttttagccccgtac

SEQ ID NO: 112328 - DNA, 35 bp, Artificial Sequence
  Synthetic oligonucleotide
acctgccacctaaactagcaaccgtgctcccgttc

SEQ ID NO: 112329 - DNA, 35 bp, Artificial Sequence
  Synthetic oligonucleotide
agtggcacccgccactttcctacttttacgttgcc

SEQ ID NO: 112330 - DNA, 35 bp, Artificial Sequence
  Synthetic oligonucleotide
atccagccccatctgctgacctccctttggtattc

SEQ ID NO: 112331 - DNA, 37 bp, Artificial Sequence
  Synthetic oligonucleotide
gaccactgcgctgttccaacctgccgtcctctcttga

SEQ ID NO: 112332 - DNA, 35 bp, Artificial Sequence
  Synthetic oligonucleotide
gcctaccatccgttcgatccatggtcttacgcacc

SEQ ID NO: 112333 - DNA, 35 bp, Artificial Sequence
  Synthetic oligonucleotide
tgactccacctgattgctacccaaaagcccaccct

SEQ ID NO: 112334 - DNA, 36 bp, Artificial Sequence
  Synthetic oligonucleotide
tccccctcctcgaccaacgccgtatgcgacgcccca

SEQ ID NO: 112335 - DNA, 35 bp, Artificial Sequence
  Synthetic oligonucleotide
ggaacccagcctcgtgcccgccctcagccgcccca

SEQ ID NO: 112336 - DNA, 35 bp, Artificial Sequence
  Synthetic oligonucleotide
agggggggaggaaagtgggtagaagatgagtggag

SEQ ID NO: 112337 - DNA, 37 bp, Artificial Sequence
  Synthetic oligonucleotide
tccagtgcccctgctctactcatccacctctactgga

SEQ ID NO: 112338 - DNA, 35 bp, Artificial Sequence
  Synthetic oligonucleotide
gactcgctccgatgctttcttgtgcgcctttccac

SEQ ID NO: 112339 - DNA, 35 bp, Artificial Sequence
  Synthetic oligonucleotide
agcccccgcccagcttgtcccacaagtagaacccc

SEQ ID NO: 112340 - DNA, 35 bp, Artificial Sequence
  Synthetic oligonucleotide
acgtccgacccggcgaccctttgctccctcccttg

SEQ ID NO: 112341 - DNA, 35 bp, Artificial Sequence
  Synthetic oligonucleotide
accctccaccatgtatacatcctgctcccgagtga

SEQ ID NO: 112342 - DNA, 35 bp, Artificial Sequence
  Synthetic oligonucleotide
actgagcccttctgtaattacccctccactttcgt

SEQ ID NO: 112343 - DNA, 37 bp, Artificial Sequence
  Synthetic oligonucleotide
gagtctcaggatcgacgggcaggtggaggtgggagga

SEQ ID NO: 112344 - DNA, 35 bp, Artificial Sequence
  Synthetic oligonucleotide
ttcgacctccgccttgcccctcctcacaaatagcc

SEQ ID NO: 112345 - DNA, 35 bp, Artificial Sequence
  Synthetic oligonucleotide
tcagtccactgcgcccgccccgtatctttttctcg

SEQ ID NO: 112346 - DNA, 35 bp, Artificial Sequence
  Synthetic oligonucleotide
tccaccgcttgcgggtccatgcaatcttcctcctc

SEQ ID NO: 112347 - DNA, 35 bp, Artificial Sequence
  Synthetic oligonucleotide
gcacacttcagacctgatcaccagccgtaacttcc

SEQ ID NO: 112348 - DNA, 35 bp, Artificial Sequence
  Synthetic oligonucleotide
tgcccacgtctctctcgcgtgaccccccttcgccg

SEQ ID NO: 112349 - DNA, 35 bp, Artificial Sequence
  Synthetic oligonucleotide
tgcgacggtcacttgctcgaattcccctgtcacct

SEQ ID NO: 112350 - DNA, 36 bp, Artificial Sequence
  Synthetic oligonucleotide
ggggaacaaggggttgctcataactggggaggggaa

SEQ ID NO: 112351 - DNA, 36 bp, Artificial Sequence
  Synthetic oligonucleotide
gatgctcgtccctgatcttatgctcgcccccgttaa

SEQ ID NO: 112352 - DNA, 36 bp, Artificial Sequence
  Synthetic oligonucleotide
tgagcctccatcacactgcatcactcctacgtttca

SEQ ID NO: 112353 - DNA, 35 bp, Artificial Sequence
  Synthetic oligonucleotide
gaccagccaccctcctgatatgctcttggttcctt

SEQ ID NO: 112354 - DNA, 35 bp, Artificial Sequence
  Synthetic oligonucleotide
acacgccggccctcagctaatctgctcccgactca

SEQ ID NO: 112355 - DNA, 35 bp, Artificial Sequence
  Synthetic oligonucleotide
tcgtagcgccccatccatgtccactctgtccgcca

SEQ ID NO: 112356 - DNA, 37 bp, Artificial Sequence
  Synthetic oligonucleotide
gatgcgcccctgccgccgatgcccgtgcctcacccga

SEQ ID NO: 112357 - DNA, 36 bp, Artificial Sequence
  Synthetic oligonucleotide
tacatacgcccgctctcacctctcgtcccctaggga

SEQ ID NO: 112358 - DNA, 35 bp, Artificial Sequence
  Synthetic oligonucleotide
gtgggaccgtcgtaccgtcactactgcccccgtac

SEQ ID NO: 112359 - DNA, 35 bp, Artificial Sequence
  Synthetic oligonucleotide
aaacagcccccgaaggcgccccgtttgcttccctc

SEQ ID NO: 112360 - DNA, 35 bp, Artificial Sequence
  Synthetic oligonucleotide
acgccacttccagctctcgggcccgattccccgct

SEQ ID NO: 112361 - DNA, 34 bp, Artificial Sequence
  Synthetic oligonucleotide
ttgagcgccaagtccagctcactctctcgtcgcc

SEQ ID NO: 112362 - DNA, 35 bp, Artificial Sequence
  Synthetic oligonucleotide
gcacgaaggaggtggaggggtaagcgggcggatgg

SEQ ID NO: 112363 - DNA, 35 bp, Artificial Sequence
  Synthetic oligonucleotide
tcctgtgccgccttcccctcgtattttgattggca

SEQ ID NO: 112364 - DNA, 38 bp, Artificial Sequence
  Synthetic oligonucleotide
tcgaccaccatcttccccgtgcatgcgcatcaccctga

SEQ ID NO: 112365 - DNA, 35 bp, Artificial Sequence
  Synthetic oligonucleotide
tctcaccatcaccacctgttactctttagtgttgc

SEQ ID NO: 112366 - DNA, 37 bp, Artificial Sequence
  Synthetic oligonucleotide
gatcgccgagggggtggggctgcaggaggcggttgga

SEQ ID NO: 112367 - DNA, 35 bp, Artificial Sequence
  Synthetic oligonucleotide
actgactcgctgtcatagactacccgccccctgtc

SEQ ID NO: 112368 - DNA, 35 bp, Artificial Sequence
  Synthetic oligonucleotide
gatgcctccccctgaattgcaacatcgccgtttcg

SEQ ID NO: 112369 - DNA, 37 bp, Artificial Sequence
  Synthetic oligonucleotide
tgaggaggcggggggatggggtggtggtgcttaagga

SEQ ID NO: 112370 - DNA, 36 bp, Artificial Sequence
  Synthetic oligonucleotide
accgacggaacctcctgcacatcatcgcctcctgga

SEQ ID NO: 112371 - DNA, 35 bp, Artificial Sequence
  Synthetic oligonucleotide
acccctccgctgatccggttcacgccaacctttcg

SEQ ID NO: 112372 - DNA, 35 bp, Artificial Sequence
  Synthetic oligonucleotide
ttgcccagcatgccttctgtaccttcgtttgctcc

SEQ ID NO: 112373 - DNA, 36 bp, Artificial Sequence
  Synthetic oligonucleotide
agcacgtacgcaccgatctgccactcgcattttgca

SEQ ID NO: 112374 - DNA, 36 bp, Artificial Sequence
  Synthetic oligonucleotide
ggggaaggggcaaacgagtgggagggcggcaaagta

SEQ ID NO: 112375 - DNA, 35 bp, Artificial Sequence
  Synthetic oligonucleotide
tacccacctctcgtgccctgagataccctcgtaca

SEQ ID NO: 112376 - DNA, 35 bp, Artificial Sequence
  Synthetic oligonucleotide
atcgggggggagggggtattagatggaagggcgtg

SEQ ID NO: 112377 - DNA, 35 bp, Artificial Sequence
  Synthetic oligonucleotide
gccaccccccgtaccctcaaccccagatggaccct

SEQ ID NO: 112378 - DNA, 36 bp, Artificial Sequence
  Synthetic oligonucleotide
aacccgccgcactgttcatcatcagtttccatcgca

SEQ ID NO: 112379 - DNA, 35 bp, Artificial Sequence
  Synthetic oligonucleotide
gcctgtcggatgcacggcttccccttggtctcctc

SEQ ID NO: 112380 - DNA, 35 bp, Artificial Sequence
  Synthetic oligonucleotide
gtccccctcccgcagtgtcgttcgacgtacactat

SEQ ID NO: 112381 - DNA, 37 bp, Artificial Sequence
  Synthetic oligonucleotide
tcccacgcctccatccgcccaacccaggtcctagaga

SEQ ID NO: 112382 - DNA, 37 bp, Artificial Sequence
  Synthetic oligonucleotide
acacaactcctactggcttatagacccccccgtgcga

SEQ ID NO: 112383 - DNA, 35 bp, Artificial Sequence
  Synthetic oligonucleotide
tgacaacccccgcttgcactcaatgcactcttcca

SEQ ID NO: 112384 - DNA, 37 bp, Artificial Sequence
  Synthetic oligonucleotide
acgcgttgcctcgcgcctatacctgtcccctccacga

SEQ ID NO: 112385 - DNA, 35 bp, Artificial Sequence
  Synthetic oligonucleotide
gtggttacgccccccggtgctgcattcccctacct

SEQ ID NO: 112386 - DNA, 36 bp, Artificial Sequence
  Synthetic oligonucleotide
tatcggactccacccaccatggtctacgcacaccca

SEQ ID NO: 112387 - DNA, 36 bp, Artificial Sequence
  Synthetic oligonucleotide
aagggggaggtgggatacggtggatgggctagggta

SEQ ID NO: 112388 - DNA, 35 bp, Artificial Sequence
  Synthetic oligonucleotide
agcgccatcagtccccctcgctcctaccttcagtg

SEQ ID NO: 112389 - DNA, 37 bp, Artificial Sequence
  Synthetic oligonucleotide
gtgctacgcgcagtatgtcatcgccccttccctctga

SEQ ID NO: 112390 - DNA, 35 bp, Artificial Sequence
  Synthetic oligonucleotide
tcgcacgtagctgctctctgtcttgcgccgactcc

SEQ ID NO: 112391 - DNA, 35 bp, Artificial Sequence
  Synthetic oligonucleotide
tctcacatcagggccgccactcccccatcgctctg

SEQ ID NO: 112392 - DNA, 35 bp, Artificial Sequence
  Synthetic oligonucleotide
atggtgaggggggggcggtgaaagtatcgtggggt

SEQ ID NO: 112393 - DNA, 36 bp, Artificial Sequence
  Synthetic oligonucleotide
tgggactgaagggaggggaagaatggcaagggggaa

SEQ ID NO: 112394 - DNA, 35 bp, Artificial Sequence
  Synthetic oligonucleotide
tcgatttccacgcccgccctcaccgtagccccgtg

SEQ ID NO: 112395 - DNA, 35 bp, Artificial Sequence
  Synthetic oligonucleotide
atccatcgccctggtggcacctcgcttaacctcca

SEQ ID NO: 112396 - DNA, 35 bp, Artificial Sequence
  Synthetic oligonucleotide
gacccacccaccattgttctttgttagaccttttg

SEQ ID NO: 112397 - DNA, 35 bp, Artificial Sequence
  Synthetic oligonucleotide
gcagacgggagggagggtacggggttatcatgaat

SEQ ID NO: 112398 - DNA, 35 bp, Artificial Sequence
  Synthetic oligonucleotide
gttggtcaacgccgaccggtcctccctcttcgcat

SEQ ID NO: 112399 - DNA, 35 bp, Artificial Sequence
  Synthetic oligonucleotide
gcccacttgacggacggtcctatctacaacttctc

SEQ ID NO: 112400 - DNA, 35 bp, Artificial Sequence
  Synthetic oligonucleotide
gctacgggcgggaggggtttagggcgccgcatcct

SEQ ID NO: 112401 - DNA, 37 bp, Artificial Sequence
  Synthetic oligonucleotide
tctaccgccccatgttttagcttttggcctctcttga

SEQ ID NO: 112402 - DNA, 35 bp, Artificial Sequence
  Synthetic oligonucleotide
tgcacgacccccggccccacatccagttcgttttg

SEQ ID NO: 112403 - DNA, 35 bp, Artificial Sequence
  Synthetic oligonucleotide
ttgtcccgtcgcttgtcttatgtcgcttcaccttt

SEQ ID NO: 112404 - DNA, 36 bp, Artificial Sequence
  Synthetic oligonucleotide
gctacgcccagctccttctgccaccacgcgcctcca

SEQ ID NO: 112405 - DNA, 37 bp, Artificial Sequence
  Synthetic oligonucleotide
tctcggggaaggggtggaagggagcgagttgcagaga

SEQ ID NO: 112406 - DNA, 37 bp, Artificial Sequence
  Synthetic oligonucleotide
gcaagggtactggagggaagggggagggacatggtga

SEQ ID NO: 112407 - DNA, 35 bp, Artificial Sequence
  Synthetic oligonucleotide
tgagcgtacctgtgccgttcctatctgtggcctcc

SEQ ID NO: 112408 - DNA, 35 bp, Artificial Sequence
  Synthetic oligonucleotide
gactccgcccgatcataaccgccgcctaacgttaa

SEQ ID NO: 112409 - DNA, 37 bp, Artificial Sequence
  Synthetic oligonucleotide
accctccaccgccgctgaatttgcgttacattgccga

SEQ ID NO: 112410 - DNA, 36 bp, Artificial Sequence
  Synthetic oligonucleotide
accgcaccacacatcgccactctctccgtcttgcta

SEQ ID NO: 112411 - DNA, 35 bp, Artificial Sequence
  Synthetic oligonucleotide
gtcgccccacccgataatcaggacctgacctctca

SEQ ID NO: 112412 - DNA, 35 bp, Artificial Sequence
  Synthetic oligonucleotide
tgatcaacgcacttcatcttctaccagctccctgc

SEQ ID NO: 112413 - DNA, 37 bp, Artificial Sequence
  Synthetic oligonucleotide
atcgaagggtggtggggctagggaatgaggggctgga

SEQ ID NO: 112414 - DNA, 36 bp, Artificial Sequence
  Synthetic oligonucleotide
tcatgcccactgcctggtattctttctacgcctcta

SEQ ID NO: 112415 - DNA, 35 bp, Artificial Sequence
  Synthetic oligonucleotide
gatgcgcggagtctctggttttcgtcgttcttccc

SEQ ID NO: 112416 - DNA, 35 bp, Artificial Sequence
  Synthetic oligonucleotide
tcttctcgccgaactagtacttttgcccacctccg

SEQ ID NO: 112417 - DNA, 35 bp, Artificial Sequence
  Synthetic oligonucleotide
gagtgcgcttccaggacctatttgccgctctatct

SEQ ID NO: 112418 - DNA, 35 bp, Artificial Sequence
  Synthetic oligonucleotide
ttaccgctgtaacatggcctcccgtgcctccccca

SEQ ID NO: 112419 - DNA, 38 bp, Artificial Sequence
  Synthetic oligonucleotide
aagccaccctcgcccgctctccccctgtttgatcgtga

SEQ ID NO: 112420 - DNA, 35 bp, Artificial Sequence
  Synthetic oligonucleotide
aaacgcccaccctctgaccgcgcatgccgacctgc

SEQ ID NO: 112421 - DNA, 35 bp, Artificial Sequence
  Synthetic oligonucleotide
atgcaccgctcgcctccttatggatcatcctgctc

SEQ ID NO: 112422 - DNA, 35 bp, Artificial Sequence
  Synthetic oligonucleotide
aaggagacgtatgtaacatcgcctgccctccgccc

SEQ ID NO: 112423 - DNA, 35 bp, Artificial Sequence
  Synthetic oligonucleotide
tctgacgtcacatttggttcgcatttccgtccgcc

SEQ ID NO: 112424 - DNA, 37 bp, Artificial Sequence
  Synthetic oligonucleotide
gtaccgtccgctgcccttctaacttatcctccgctga

SEQ ID NO: 112425 - DNA, 35 bp, Artificial Sequence
  Synthetic oligonucleotide
tgacgttaccgccgatcccttcatgtgctgcctac

SEQ ID NO: 112426 - DNA, 35 bp, Artificial Sequence
  Synthetic oligonucleotide
tgttcacgcagctacctcgatttctcccccgcctg

SEQ ID NO: 112427 - DNA, 35 bp, Artificial Sequence
  Synthetic oligonucleotide
atccgacccatcgcctatcgccatcgcttttctat

SEQ ID NO: 112428 - DNA, 38 bp, Artificial Sequence
  Synthetic oligonucleotide
tgggtggggggagagatgggacggtgggtacggggtga

SEQ ID NO: 112429 - DNA, 35 bp, Artificial Sequence
  Synthetic oligonucleotide
gcacaatcgccctatcgctccatcacacaaggtac

SEQ ID NO: 112430 - DNA, 35 bp, Artificial Sequence
  Synthetic oligonucleotide
ggttcagcctgtttccttcgtgtcttgttcccttg

SEQ ID NO: 112431 - DNA, 36 bp, Artificial Sequence
  Synthetic oligonucleotide
gacccatccatgcctatgccgccaactcttgtacca

SEQ ID NO: 112432 - DNA, 35 bp, Artificial Sequence
  Synthetic oligonucleotide
gtcgcaagtcttctccgtccgttgttcctggcttc

SEQ ID NO: 112433 - DNA, 37 bp, Artificial Sequence
  Synthetic oligonucleotide
gcacgaagggtggagggtggaagggtagcaggaacga

SEQ ID NO: 112434 - DNA, 35 bp, Artificial Sequence
  Synthetic oligonucleotide
accccgtcactaaacgttctattgcgcacctccca

SEQ ID NO: 112435 - DNA, 35 bp, Artificial Sequence
  Synthetic oligonucleotide
gagccctccccgtctctgtacctagtttcaccgcc

SEQ ID NO: 112436 - DNA, 35 bp, Artificial Sequence
  Synthetic oligonucleotide
accattccatcgctgttccccttcgtgcatcttcg

SEQ ID NO: 112437 - DNA, 35 bp, Artificial Sequence
  Synthetic oligonucleotide
tgccccctatgcactgtcccccacggcctccaacc

SEQ ID NO: 112438 - DNA, 35 bp, Artificial Sequence
  Synthetic oligonucleotide
tcggggccgaccgatctcccttcatgcatactccg

SEQ ID NO: 112439 - DNA, 35 bp, Artificial Sequence
  Synthetic oligonucleotide
gccgggccggccgctactcgcctgtcttttttcac

SEQ ID NO: 112440 - DNA, 35 bp, Artificial Sequence
  Synthetic oligonucleotide
ggaccccctaccgccatgatgcccgctgtgtcccc

SEQ ID NO: 112441 - DNA, 35 bp, Artificial Sequence
  Synthetic oligonucleotide
ttgctcgccctatgtctgtgcttcctgcctcttcc

SEQ ID NO: 112442 - DNA, 35 bp, Artificial Sequence
  Synthetic oligonucleotide
atagtgctgccactagtcctgtcctctgtctgctc

SEQ ID NO: 112443 - DNA, 35 bp, Artificial Sequence
  Synthetic oligonucleotide
acctcgccttgtactccacctgccactaattttcg

SEQ ID NO: 112444 - DNA, 36 bp, Artificial Sequence
  Synthetic oligonucleotide
gccacgaacgggcacagggaagggcgggtgaaggta

SEQ ID NO: 112445 - DNA, 35 bp, Artificial Sequence
  Synthetic oligonucleotide
acccatccagttgccctgtgcctcaatctcgctac

SEQ ID NO: 112446 - DNA, 37 bp, Artificial Sequence
  Synthetic oligonucleotide
tgctccagcccgtcccatacatgtcccagcctcccga

SEQ ID NO: 112447 - DNA, 35 bp, Artificial Sequence
  Synthetic oligonucleotide
gagtatccgccccccgaccactgtggctcatgtcc

SEQ ID NO: 112448 - DNA, 35 bp, Artificial Sequence
  Synthetic oligonucleotide
aagtggtggggggggaaaacaggcgagaacgaggt

SEQ ID NO: 112449 - DNA, 36 bp, Artificial Sequence
  Synthetic oligonucleotide
gtagtccattccgcccctgtttgtgtccgccctcta

SEQ ID NO: 112450 - DNA, 35 bp, Artificial Sequence
  Synthetic oligonucleotide
tagtccgccgcaggtagtctgtctatttcttgtcc

SEQ ID NO: 112451 - DNA, 35 bp, Artificial Sequence
  Synthetic oligonucleotide
tgatgtcctgctgcccgaccttcttatgcgcgatc

SEQ ID NO: 112452 - DNA, 35 bp, Artificial Sequence
  Synthetic oligonucleotide
agtgcccgcccaccatcccgcctcgaggcagcatt

SEQ ID NO: 112453 - DNA, 35 bp, Artificial Sequence
  Synthetic oligonucleotide
gcccaccccaccgccttcactcatcgagcccttgt

SEQ ID NO: 112454 - DNA, 38 bp, Artificial Sequence
  Synthetic oligonucleotide
acacggtgggggcggggttttgcagggatggtggttga

SEQ ID NO: 112455 - DNA, 35 bp, Artificial Sequence
  Synthetic oligonucleotide
tacgacgccgccacctctgctctacgccacactgc

SEQ ID NO: 112456 - DNA, 35 bp, Artificial Sequence
  Synthetic oligonucleotide
tgcaagctcgtccccacgccagttcccccgtgctc

SEQ ID NO: 112457 - DNA, 35 bp, Artificial Sequence
  Synthetic oligonucleotide
gattgcacctgcctgtctgttacgctgtcacctct

SEQ ID NO: 112458 - DNA, 35 bp, Artificial Sequence
  Synthetic oligonucleotide
tccgcgtacatggattctcgcctgcctgacctctc

SEQ ID NO: 112459 - DNA, 36 bp, Artificial Sequence
  Synthetic oligonucleotide
gatgctccgcctgccacttgtttccatcccatcgca

SEQ ID NO: 112460 - DNA, 35 bp, Artificial Sequence
  Synthetic oligonucleotide
gttttgcgccccgccttcgcccgatcgttaccgcc

SEQ ID NO: 112461 - DNA, 35 bp, Artificial Sequence
  Synthetic oligonucleotide
gcactgcacaggcatcaacctccacctcattggcg

SEQ ID NO: 112462 - DNA, 35 bp, Artificial Sequence
  Synthetic oligonucleotide
gtgactaccgccccgcagagtcccttacctgttcc

SEQ ID NO: 112463 - DNA, 35 bp, Artificial Sequence
  Synthetic oligonucleotide
aatcacccacgctttgttaccgttctgtccacatc

SEQ ID NO: 112464 - DNA, 35 bp, Artificial Sequence
  Synthetic oligonucleotide
tttgctagcccccgtaccatctgtcataactcacg

SEQ ID NO: 112465 - DNA, 35 bp, Artificial Sequence
  Synthetic oligonucleotide
tgttgacccacatagttcgttccatgccttctcct

SEQ ID NO: 112466 - DNA, 37 bp, Artificial Sequence
  Synthetic oligonucleotide
gcacagcctcgtgtcgttcttctgcgcttcaccccga

SEQ ID NO: 112467 - DNA, 35 bp, Artificial Sequence
  Synthetic oligonucleotide
ggggtgggtgaaggggaaaatctagcgtcggggac

SEQ ID NO: 112468 - DNA, 35 bp, Artificial Sequence
  Synthetic oligonucleotide
acgccccccactgtgactatatctggtccgctcgc

SEQ ID NO: 112469 - DNA, 35 bp, Artificial Sequence
  Synthetic oligonucleotide
attgcccgcttaatcggtactctggcttctacctc

SEQ ID NO: 112470 - DNA, 34 bp, Artificial Sequence
  Synthetic oligonucleotide
atgcctactcgcccgaccttgcctatcccaattg

SEQ ID NO: 112471 - DNA, 35 bp, Artificial Sequence
  Synthetic oligonucleotide
aacgatgacagccatgttctttagtcctcctttcc

SEQ ID NO: 112472 - DNA, 35 bp, Artificial Sequence
  Synthetic oligonucleotide
gagtagcccgcgccccgtccgctcctgtactttcg

SEQ ID NO: 112473 - DNA, 35 bp, Artificial Sequence
  Synthetic oligonucleotide
gaggggggttggggggacggataaggaggagggtt

SEQ ID NO: 112474 - DNA, 35 bp, Artificial Sequence
  Synthetic oligonucleotide
tgttcgtacctgccagctgagccattcacctccca

SEQ ID NO: 112475 - DNA, 36 bp, Artificial Sequence
  Synthetic oligonucleotide
gaacgtaacatcggactcgacctcactcttccctga

SEQ ID NO: 112476 - DNA, 35 bp, Artificial Sequence
  Synthetic oligonucleotide
aacaccctctgactctgcattcctcaaccgctaac

SEQ ID NO: 112477 - DNA, 35 bp, Artificial Sequence
  Synthetic oligonucleotide
gcccaacacgtccccgtccttactaactgtgctcc

SEQ ID NO: 112478 - DNA, 35 bp, Artificial Sequence
  Synthetic oligonucleotide
gacatgtcactggccctcctttcttcctgttccgc

SEQ ID NO: 112479 - DNA, 35 bp, Artificial Sequence
  Synthetic oligonucleotide
tagctgctcgcttagtccccccgtcatttgctcgc

SEQ ID NO: 112480 - DNA, 35 bp, Artificial Sequence
  Synthetic oligonucleotide
accaactagcctgaccgaccgcgctcccgttccca

SEQ ID NO: 112481 - DNA, 35 bp, Artificial Sequence
  Synthetic oligonucleotide
attcgaagcctcactctcctgtcccgtacgcaatt

SEQ ID NO: 112482 - DNA, 35 bp, Artificial Sequence
  Synthetic oligonucleotide
gatgccccgcctactcgacttataccttctatcga

SEQ ID NO: 112483 - DNA, 35 bp, Artificial Sequence
  Synthetic oligonucleotide
gtaaccgcctgacttagcctcacccacctactgga

SEQ ID NO: 112484 - DNA, 35 bp, Artificial Sequence
  Synthetic oligonucleotide
gcgatggggtggacggggggcaagcttatggaggg

SEQ ID NO: 112485 - DNA, 35 bp, Artificial Sequence
  Synthetic oligonucleotide
aaagtggggaggcggagaagagatatcgcgcgcat

SEQ ID NO: 112486 - DNA, 35 bp, Artificial Sequence
  Synthetic oligonucleotide
acgccactcccgtcctctcgatcacctgcggcttc

SEQ ID NO: 112487 - DNA, 35 bp, Artificial Sequence
  Synthetic oligonucleotide
tcacacccccatggatcccaccagacacaacacat

SEQ ID NO: 112488 - DNA, 35 bp, Artificial Sequence
  Synthetic oligonucleotide
gttgcctgtccccgtacgcccttcaaccctgtgct

SEQ ID NO: 112489 - DNA, 35 bp, Artificial Sequence
  Synthetic oligonucleotide
aacagccaccgtacggtctccacccactccatgtt

SEQ ID NO: 112490 - DNA, 36 bp, Artificial Sequence
  Synthetic oligonucleotide
atggtggacggagagaggggggcaaagctagggtga

SEQ ID NO: 112491 - DNA, 36 bp, Artificial Sequence
  Synthetic oligonucleotide
gagggggggggtgatgatggagggaaggaataagta

SEQ ID NO: 112492 - DNA, 32 bp, Artificial Sequence
  Synthetic oligonucleotide
gcgccctacgcggcttcccctgcacacacctc

SEQ ID NO: 112493 - DNA, 36 bp, Artificial Sequence
  Synthetic oligonucleotide
tgctaccatcgcgcccacgtgctactgccttttcaa

SEQ ID NO: 112494 - DNA, 35 bp, Artificial Sequence
  Synthetic oligonucleotide
gactcgctccaccctggattttggtactctgttga

SEQ ID NO: 112495 - DNA, 37 bp, Artificial Sequence
  Synthetic oligonucleotide
ggaccagtccacttttcgtatccgccatcgcccccga

SEQ ID NO: 112496 - DNA, 35 bp, Artificial Sequence
  Synthetic oligonucleotide
tgccacacttcggcgacctaccctgccctcatacg

SEQ ID NO: 112497 - DNA, 35 bp, Artificial Sequence
  Synthetic oligonucleotide
gacattcgccacatgtcacgttcattatctctggt

SEQ ID NO: 112498 - DNA, 36 bp, Artificial Sequence
  Synthetic oligonucleotide
gccccctgcaccgatcccatggcgatgcctccctca

SEQ ID NO: 112499 - DNA, 35 bp, Artificial Sequence
  Synthetic oligonucleotide
tgcacctcattcgctgtctacttccccctacctta

SEQ ID NO: 112500 - DNA, 35 bp, Artificial Sequence
  Synthetic oligonucleotide
tccctagcccgcacatgcaatgccaccaacacgcc

SEQ ID NO: 112501 - DNA, 35 bp, Artificial Sequence
  Synthetic oligonucleotide
agccgatcgtgtacctcggttggcacttacctttc

SEQ ID NO: 112502 - DNA, 35 bp, Artificial Sequence
  Synthetic oligonucleotide
tcacccttcccgcgcctcatctgaagtcggcctac

SEQ ID NO: 112503 - DNA, 35 bp, Artificial Sequence
  Synthetic oligonucleotide
gttgcacagatccccggcctgccacacctacgccc

SEQ ID NO: 112504 - DNA, 35 bp, Artificial Sequence
  Synthetic oligonucleotide
ttgaagccgcaacactatggatccaccactcgccg

SEQ ID NO: 112505 - DNA, 35 bp, Artificial Sequence
  Synthetic oligonucleotide
tatacgtcccgctgcccccattttagcctcgcctc

SEQ ID NO: 112506 - DNA, 35 bp, Artificial Sequence
  Synthetic oligonucleotide
ttgggtaagggcgggtagggaggtaaggaatcaat

SEQ ID NO: 112507 - DNA, 36 bp, Artificial Sequence
  Synthetic oligonucleotide
acccgcccaccggtccaaacccaaaagcccccgctt

SEQ ID NO: 112508 - DNA, 37 bp, Artificial Sequence
  Synthetic oligonucleotide
ttgaggggaggaaggggcgatagagtcgggggttgaa

SEQ ID NO: 112509 - DNA, 35 bp, Artificial Sequence
  Synthetic oligonucleotide
cacccctcgccaccatctcatccggatctggaaat

SEQ ID NO: 112510 - DNA, 36 bp, Artificial Sequence
  Synthetic oligonucleotide
gtcgcacttccgccctcccatattcatcggtcgcca

SEQ ID NO: 112511 - DNA, 37 bp, Artificial Sequence
  Synthetic oligonucleotide
atgcgggtggggggggacggaagagaacatggtacga

SEQ ID NO: 112512 - DNA, 35 bp, Artificial Sequence
  Synthetic oligonucleotide
tcctcccccctactggttttcggacacttgctctg

SEQ ID NO: 112513 - DNA, 31 bp, Artificial Sequence
  Synthetic oligonucleotide
atctccgtagccgcccgcatccttgtttcta

SEQ ID NO: 112514 - DNA, 35 bp, Artificial Sequence
  Synthetic oligonucleotide
gcacgtttagccgtgctccatccaatgtcaccctt

SEQ ID NO: 112515 - DNA, 36 bp, Artificial Sequence
  Synthetic oligonucleotide
ttccccctccatcggtgataacgttgtcctttccca

SEQ ID NO: 112516 - DNA, 36 bp, Artificial Sequence
  Synthetic oligonucleotide
aaagatggaggaagaggtggtggggactgtggcgga

SEQ ID NO: 112517 - DNA, 36 bp, Artificial Sequence
  Synthetic oligonucleotide
tcacgatgggggggaggtgcgggacacgattggaga

SEQ ID NO: 112518 - DNA, 35 bp, Artificial Sequence
  Synthetic oligonucleotide
atcccgcgcgccctcaattcctcgctcatgcctga

SEQ ID NO: 112519 - DNA, 35 bp, Artificial Sequence
  Synthetic oligonucleotide
gtgaagacgatgagggaagggataggggggcgcta

SEQ ID NO: 112520 - DNA, 35 bp, Artificial Sequence
  Synthetic oligonucleotide
tacttccgactcgtgcttctcagtcttcacccctg

SEQ ID NO: 112521 - DNA, 35 bp, Artificial Sequence
  Synthetic oligonucleotide
ggacgccctccatattgcgaaagcctctgcctcac

SEQ ID NO: 112522 - DNA, 35 bp, Artificial Sequence
  Synthetic oligonucleotide
gtcgcgtgcgctcgttttccgggtccgctttcccc

SEQ ID NO: 112523 - DNA, 35 bp, Artificial Sequence
  Synthetic oligonucleotide
tgtccctcaccgacgttacagtctaactgcttctc

SEQ ID NO: 112524 - DNA, 35 bp, Artificial Sequence
  Synthetic oligonucleotide
tcccccccccgtcggtagtactcctttgattcgcg

SEQ ID NO: 112525 - DNA, 35 bp, Artificial Sequence
  Synthetic oligonucleotide
gacgtagggagcgaggtggaggaatgcagatcagg

SEQ ID NO: 112526 - DNA, 35 bp, Artificial Sequence
  Synthetic oligonucleotide
gactggctactatggcccgagccttcacctcccct

SEQ ID NO: 112527 - DNA, 38 bp, Artificial Sequence
  Synthetic oligonucleotide
tgccccgcccccgaagtaccatctcgatcagtccctga

SEQ ID NO: 112528 - DNA, 35 bp, Artificial Sequence
  Synthetic oligonucleotide
gagccacctacgctatctgtcctcttcgcctactt

SEQ ID NO: 112529 - DNA, 38 bp, Artificial Sequence
  Synthetic oligonucleotide
acatccagccgctgttgcgttgttccgtcctcctctga

SEQ ID NO: 112530 - DNA, 35 bp, Artificial Sequence
  Synthetic oligonucleotide
gcagtcccgccgctggttcccttcctagctcaccg

SEQ ID NO: 112531 - DNA, 36 bp, Artificial Sequence
  Synthetic oligonucleotide
atcgacgcgcactatcacctgtccagcccatcaaca

SEQ ID NO: 112532 - DNA, 36 bp, Artificial Sequence
  Synthetic oligonucleotide
gacccccgcgtacacccccgtcccctcgtgtgtata

SEQ ID NO: 112533 - DNA, 35 bp, Artificial Sequence
  Synthetic oligonucleotide
acccgcagtccgcctccacctccgtaccttccaag

SEQ ID NO: 112534 - DNA, 35 bp, Artificial Sequence
  Synthetic oligonucleotide
gttgtctcaccatccttctattaccgtcccccggg

SEQ ID NO: 112535 - DNA, 37 bp, Artificial Sequence
  Synthetic oligonucleotide
tgagatagagtggggtgggagaaggggcacaggacga

SEQ ID NO: 112536 - DNA, 35 bp, Artificial Sequence
  Synthetic oligonucleotide
tgaaccgtgccattttgcgtttttccccctttccc

SEQ ID NO: 112537 - DNA, 35 bp, Artificial Sequence
  Synthetic oligonucleotide
actcaccgcctccgttctgccgcgctccctgctaa

SEQ ID NO: 112538 - DNA, 35 bp, Artificial Sequence
  Synthetic oligonucleotide
atgccaacctgcccattgtcgccacttaccagccg

SEQ ID NO: 112539 - DNA, 37 bp, Artificial Sequence
  Synthetic oligonucleotide
atgaagaggggcgggcggggaaaagaacgcttaggga

SEQ ID NO: 112540 - DNA, 37 bp, Artificial Sequence
  Synthetic oligonucleotide
tgtgaggagggccaatggggagggatgaaaacgatga

SEQ ID NO: 112541 - DNA, 35 bp, Artificial Sequence
  Synthetic oligonucleotide
gacactcccccagtgcgcgatccctgcttgcctac

SEQ ID NO: 112542 - DNA, 35 bp, Artificial Sequence
  Synthetic oligonucleotide
gtcgcctcccaccatcccccgtgtcgtatggtacc

SEQ ID NO: 112543 - DNA, 35 bp, Artificial Sequence
  Synthetic oligonucleotide
gccgactccagcactctcaccccactgtctttcgc

SEQ ID NO: 112544 - DNA, 35 bp, Artificial Sequence
  Synthetic oligonucleotide
tcgttccgccttcccgatattttgtcacaccatgt

SEQ ID NO: 112545 - DNA, 36 bp, Artificial Sequence
  Synthetic oligonucleotide
acactgccgtgcagtttgtctcatacgccctcccca

SEQ ID NO: 112546 - DNA, 37 bp, Artificial Sequence
  Synthetic oligonucleotide
tagggggcgggcatgtggggatacggtaaggggtaga

SEQ ID NO: 112547 - DNA, 35 bp, Artificial Sequence
  Synthetic oligonucleotide
tgcccatgacgtccgcctggctgcctcacttgtcc

SEQ ID NO: 112548 - DNA, 35 bp, Artificial Sequence
  Synthetic oligonucleotide
agatcgagaggagggagggaatgaacagggacagc

SEQ ID NO: 112549 - DNA, 34 bp, Artificial Sequence
  Synthetic oligonucleotide
tctatgcctctcgaaccaccgcttcacctgccat

SEQ ID NO: 112550 - DNA, 35 bp, Artificial Sequence
  Synthetic oligonucleotide
ttccgcggagatgccctcgtactgccctcctgcct

SEQ ID NO: 112551 - DNA, 36 bp, Artificial Sequence
  Synthetic oligonucleotide
gagccctgccgccgccgttcgttaaccatcttagca

SEQ ID NO: 112552 - DNA, 35 bp, Artificial Sequence
  Synthetic oligonucleotide
gttaggtggcagagaatcggaggggcgggggggta

SEQ ID NO: 112553 - DNA, 34 bp, Artificial Sequence
  Synthetic oligonucleotide
gattcgcacccctcattaacgttgccctgcgccc

SEQ ID NO: 112554 - DNA, 35 bp, Artificial Sequence
  Synthetic oligonucleotide
tcctcgtccacttcgcacatgtctcgtctctgtcc

SEQ ID NO: 112555 - DNA, 35 bp, Artificial Sequence
  Synthetic oligonucleotide
ggaacaacgtggggggcgggggtgcaaaatggcgt

SEQ ID NO: 112556 - DNA, 37 bp, Artificial Sequence
  Synthetic oligonucleotide
gggacggtgatcggggaggaggagggagaattgacga

SEQ ID NO: 112557 - DNA, 37 bp, Artificial Sequence
  Synthetic oligonucleotide
gagagggatggggccgggcacgagagcggagctacga

SEQ ID NO: 112558 - DNA, 37 bp, Artificial Sequence
  Synthetic oligonucleotide
gctgggaaggggggaaaggagacggtaagcagacgga

SEQ ID NO: 112559 - DNA, 35 bp, Artificial Sequence
  Synthetic oligonucleotide
aatacgcccccgcggtttcacgcatttccatcacc

SEQ ID NO: 112560 - DNA, 38 bp, Artificial Sequence
  Synthetic oligonucleotide
agcacaaaggggcgagggggggaaaagcgggaaggtga

SEQ ID NO: 112561 - DNA, 35 bp, Artificial Sequence
  Synthetic oligonucleotide
gttgcccaatgagttctcgaaccgtactgtccctc

SEQ ID NO: 112562 - DNA, 35 bp, Artificial Sequence
  Synthetic oligonucleotide
acacccacccgccacttatcgaaagattctcattg

SEQ ID NO: 112563 - DNA, 35 bp, Artificial Sequence
  Synthetic oligonucleotide
ggcccgccctcctccgtttcagctccccctctggt

SEQ ID NO: 112564 - DNA, 35 bp, Artificial Sequence
  Synthetic oligonucleotide
accccagagcgaaggggaggcggaatggaagggga

SEQ ID NO: 112565 - DNA, 35 bp, Artificial Sequence
  Synthetic oligonucleotide
accgacccccggatgtatccatttcccacgcccac

SEQ ID NO: 112566 - DNA, 35 bp, Artificial Sequence
  Synthetic oligonucleotide
tgccacccacctccattgtcagacccatctacccg

SEQ ID NO: 112567 - DNA, 36 bp, Artificial Sequence
  Synthetic oligonucleotide
tcccttgccccccacattaggtacgttcgctctcaa

SEQ ID NO: 112568 - DNA, 36 bp, Artificial Sequence
  Synthetic oligonucleotide
gtccacccctactgctgagtactttctcccgaatca

SEQ ID NO: 112569 - DNA, 35 bp, Artificial Sequence
  Synthetic oligonucleotide
tccagtccaccagtatctgccaacacgcttttatc

SEQ ID NO: 112570 - DNA, 35 bp, Artificial Sequence
  Synthetic oligonucleotide
tccgtccgctatccgccctggtccacctagccttc

SEQ ID NO: 112571 - DNA, 35 bp, Artificial Sequence
  Synthetic oligonucleotide
gacgttcgcgtatgtgtcttgtccgcccgtccttc

SEQ ID NO: 112572 - DNA, 37 bp, Artificial Sequence
  Synthetic oligonucleotide
tccacctaccacttggctcccacttcagtccatagga

SEQ ID NO: 112573 - DNA, 35 bp, Artificial Sequence
  Synthetic oligonucleotide
tgttccaccaccttctgttccatgctgccgttgct

SEQ ID NO: 112574 - DNA, 35 bp, Artificial Sequence
  Synthetic oligonucleotide
ttcgctcccttgttcgtttatgttcctacttccac

SEQ ID NO: 112575 - DNA, 35 bp, Artificial Sequence
  Synthetic oligonucleotide
acgcgacaccgcagtctttcttttccccgtacgcc

SEQ ID NO: 112576 - DNA, 35 bp, Artificial Sequence
  Synthetic oligonucleotide
gtctgccatcctgccgaagtttagccgtctcctcc

SEQ ID NO: 112577 - DNA, 35 bp, Artificial Sequence
  Synthetic oligonucleotide
acacgcccctcgcggtctatagcccgaccctcaat

SEQ ID NO: 112578 - DNA, 36 bp, Artificial Sequence
  Synthetic oligonucleotide
tagcaactccctgctaccgacccactgccccgagta

SEQ ID NO: 112579 - DNA, 37 bp, Artificial Sequence
  Synthetic oligonucleotide
tccctcccgcccacgatccgcacgcttcccccggaga

SEQ ID NO: 112580 - DNA, 37 bp, Artificial Sequence
  Synthetic oligonucleotide
tcatgaagggggcggtgcgtgggacatcaaaggggga

SEQ ID NO: 112581 - DNA, 37 bp, Artificial Sequence
  Synthetic oligonucleotide
acattgacagtcagggaaacagggaagaaggggggga

SEQ ID NO: 112582 - DNA, 36 bp, Artificial Sequence
  Synthetic oligonucleotide
ttacccccgtcgatgtcttcctctgccacttcgaaa

SEQ ID NO: 112583 - DNA, 35 bp, Artificial Sequence
  Synthetic oligonucleotide
gtagctccgtacagttcgccgtccatctatccctc

SEQ ID NO: 112584 - DNA, 35 bp, Artificial Sequence
  Synthetic oligonucleotide
aacgccctgtagcattgtcttgggccccatacctc

SEQ ID NO: 112585 - DNA, 35 bp, Artificial Sequence
  Synthetic oligonucleotide
ttcatcgtcatgtctgcccttattgtctgtccctt

SEQ ID NO: 112586 - DNA, 35 bp, Artificial Sequence
  Synthetic oligonucleotide
tgtgtacccccgccccttgcccaccggttctggtt

SEQ ID NO: 112587 - DNA, 36 bp, Artificial Sequence
  Synthetic oligonucleotide
atctgtgccccgcctttgctgtcctacgcgcaccta

SEQ ID NO: 112588 - DNA, 35 bp, Artificial Sequence
  Synthetic oligonucleotide
tcgcccacggcgcgatatctttcaagttccaccct

SEQ ID NO: 112589 - DNA, 35 bp, Artificial Sequence
  Synthetic oligonucleotide
atctcacctccattggtatcctcatcaccccggtt

SEQ ID NO: 112590 - DNA, 35 bp, Artificial Sequence
  Synthetic oligonucleotide
gtagcccacgctgcacaattagcctcatctaccac

SEQ ID NO: 112591 - DNA, 34 bp, Artificial Sequence
  Synthetic oligonucleotide
gccgcatatagccgtccacctgatctccttcgtc

SEQ ID NO: 112592 - DNA, 35 bp, Artificial Sequence
  Synthetic oligonucleotide
gaacacgggcgggggggtcttaattagggcaagac

SEQ ID NO: 112593 - DNA, 35 bp, Artificial Sequence
  Synthetic oligonucleotide
ttagcccaccccgttccccgtattagtcaccggac

SEQ ID NO: 112594 - DNA, 35 bp, Artificial Sequence
  Synthetic oligonucleotide
ggggtggggggtgtactggattaggcgcgcggggg

SEQ ID NO: 112595 - DNA, 36 bp, Artificial Sequence
  Synthetic oligonucleotide
gccgctctcgctctgttcccgcccagtttaccgcta

SEQ ID NO: 112596 - DNA, 35 bp, Artificial Sequence
  Synthetic oligonucleotide
gccaactgccctgaaccctgccgaacgtcccagtc

SEQ ID NO: 112597 - DNA, 35 bp, Artificial Sequence
  Synthetic oligonucleotide
tcctaccgactcccgtgcacatacgtatctctcgc

SEQ ID NO: 112598 - DNA, 35 bp, Artificial Sequence
  Synthetic oligonucleotide
aatgcccgttccgcccccttctgtaccgcgccctc

SEQ ID NO: 112599 - DNA, 35 bp, Artificial Sequence
  Synthetic oligonucleotide
atcgccacctgatcctttaccggcctatttccccg

SEQ ID NO: 112600 - DNA, 36 bp, Artificial Sequence
  Synthetic oligonucleotide
gctcagccccgccccccataagccccgtatgtccca

SEQ ID NO: 112601 - DNA, 35 bp, Artificial Sequence
  Synthetic oligonucleotide
tccccgacctgtctcctgccgacttctaatcgaac

SEQ ID NO: 112602 - DNA, 35 bp, Artificial Sequence
  Synthetic oligonucleotide
gacgtcgtcgccgtaacagctcttctcctactacc

SEQ ID NO: 112603 - DNA, 37 bp, Artificial Sequence
  Synthetic oligonucleotide
gggggagtagggggggcgggatcatgcggcgttgcga

SEQ ID NO: 112604 - DNA, 37 bp, Artificial Sequence
  Synthetic oligonucleotide
agcctgtccgcacttctgtacatccctgccatcatga

SEQ ID NO: 112605 - DNA, 35 bp, Artificial Sequence
  Synthetic oligonucleotide
tcccctccgccacccactatatagccgatctttta

SEQ ID NO: 112606 - DNA, 36 bp, Artificial Sequence
  Synthetic oligonucleotide
tccaacactccctcgcctgctcctatgaatctacga

SEQ ID NO: 112607 - DNA, 30 bp, Artificial Sequence
  Synthetic oligonucleotide
gccccgaccgcgcccacacccttgtaactc

SEQ ID NO: 112608 - DNA, 35 bp, Artificial Sequence
  Synthetic oligonucleotide
tcatcactgtagttgcatagctccctagccccctt

SEQ ID NO: 112609 - DNA, 37 bp, Artificial Sequence
  Synthetic oligonucleotide
gtagtgggcgacggggggagggcaacggcaataaaga

SEQ ID NO: 112610 - DNA, 38 bp, Artificial Sequence
  Synthetic oligonucleotide
tgtggggggaggagtagagaagggtaagggggaaatga

SEQ ID NO: 112611 - DNA, 38 bp, Artificial Sequence
  Synthetic oligonucleotide
tctcgccccccctcgcatcgttatcgctgttcccctga

SEQ ID NO: 112612 - DNA, 35 bp, Artificial Sequence
  Synthetic oligonucleotide
tgggggggcgggcgggtagcacgagttggggccac

SEQ ID NO: 112613 - DNA, 35 bp, Artificial Sequence
  Synthetic oligonucleotide
gttgcagacgaaccgcccctttttctgcccttgtc

SEQ ID NO: 112614 - DNA, 35 bp, Artificial Sequence
  Synthetic oligonucleotide
gtaggccgtatcatccccagcgtcaccgactccat

SEQ ID NO: 112615 - DNA, 35 bp, Artificial Sequence
  Synthetic oligonucleotide
gcacgccgctttctatcccgccccaccctgcttgt

SEQ ID NO: 112616 - DNA, 36 bp, Artificial Sequence
  Synthetic oligonucleotide
gccaacgtccgagcgcactctactttcctcctctca

SEQ ID NO: 112617 - DNA, 35 bp, Artificial Sequence
  Synthetic oligonucleotide
acgtgcaccggtcgctacgttgccagccccttcac

SEQ ID NO: 112618 - DNA, 35 bp, Artificial Sequence
  Synthetic oligonucleotide
atgacccgtcctctttcccttccgcccgatcgatc

SEQ ID NO: 112619 - DNA, 35 bp, Artificial Sequence
  Synthetic oligonucleotide
gcaaaactggaggggaatggaggggggctggggtg

SEQ ID NO: 112620 - DNA, 35 bp, Artificial Sequence
  Synthetic oligonucleotide
tataaccgcccacgactggttccgatacccttgct

SEQ ID NO: 112621 - DNA, 35 bp, Artificial Sequence
  Synthetic oligonucleotide
tccacgcttaatttgccctatcgcgccacctcgca

SEQ ID NO: 112622 - DNA, 35 bp, Artificial Sequence
  Synthetic oligonucleotide
gatacctcaactcgccctcagctcctgccgttgct

SEQ ID NO: 112623 - DNA, 35 bp, Artificial Sequence
  Synthetic oligonucleotide
tgctcctccacctttcgtaaagtccggtctcacac

SEQ ID NO: 112624 - DNA, 35 bp, Artificial Sequence
  Synthetic oligonucleotide
accgccagtgccgcgctacacactatgcccctgtc

SEQ ID NO: 112625 - DNA, 36 bp, Artificial Sequence
  Synthetic oligonucleotide
accaggccccctaagtcacgtcgcccgcctcccgca

SEQ ID NO: 112626 - DNA, 35 bp, Artificial Sequence
  Synthetic oligonucleotide
gaaagcgcatctttgccctcgacccgctgatcctc

SEQ ID NO: 112627 - DNA, 35 bp, Artificial Sequence
  Synthetic oligonucleotide
gccaagcactgccggtcaatcgcatatcctcctcg

SEQ ID NO: 112628 - DNA, 35 bp, Artificial Sequence
  Synthetic oligonucleotide
gccactgactatcgaattttgacccatgcccttct

SEQ ID NO: 112629 - DNA, 35 bp, Artificial Sequence
  Synthetic oligonucleotide
attcacgctctccctggtacttacatacacgtccc

SEQ ID NO: 112630 - DNA, 35 bp, Artificial Sequence
  Synthetic oligonucleotide
ggggccactcttccctgtgacttttgtgccctctt

SEQ ID NO: 112631 - DNA, 35 bp, Artificial Sequence
  Synthetic oligonucleotide
acctacgtcccccccggccccgctggcttgcaccc

SEQ ID NO: 112632 - DNA, 35 bp, Artificial Sequence
  Synthetic oligonucleotide
gcatgtcgcgctgccctctctcctattaatgatcg

SEQ ID NO: 112633 - DNA, 35 bp, Artificial Sequence
  Synthetic oligonucleotide
ggatcggggcagggggggaggtggcggtgggtaga

SEQ ID NO: 112634 - DNA, 35 bp, Artificial Sequence
  Synthetic oligonucleotide
gtctgccttccccttgcttatatgatctcttaccg

SEQ ID NO: 112635 - DNA, 36 bp, Artificial Sequence
  Synthetic oligonucleotide
tgtacactccgccagcccgttattccgtcccctgca

SEQ ID NO: 112636 - DNA, 35 bp, Artificial Sequence
  Synthetic oligonucleotide
actcgcaagccgctgtcactccaccttgtcttccg

SEQ ID NO: 112637 - DNA, 35 bp, Artificial Sequence
  Synthetic oligonucleotide
agaagggggaggccgggtgtgaagggtcgggcggg

SEQ ID NO: 112638 - DNA, 35 bp, Artificial Sequence
  Synthetic oligonucleotide
accagagccctccgatttacctgctccttacctga

SEQ ID NO: 112639 - DNA, 35 bp, Artificial Sequence
  Synthetic oligonucleotide
acacgggagggggaacttggtggaatggggtgtgg

SEQ ID NO: 112640 - DNA, 35 bp, Artificial Sequence
  Synthetic oligonucleotide
gtcatatcccgtccctcgtcactgccatatcctgt

SEQ ID NO: 112641 - DNA, 35 bp, Artificial Sequence
  Synthetic oligonucleotide
tgccaccccaccatccgccccacccgatctttaag

SEQ ID NO: 112642 - DNA, 33 bp, Artificial Sequence
  Synthetic oligonucleotide
acaacccgcctaccgcactgacgaaacgcctat

SEQ ID NO: 112643 - DNA, 36 bp, Artificial Sequence
  Synthetic oligonucleotide
gcaacccaccccgcactcatgacgccacgtgccaca

SEQ ID NO: 112644 - DNA, 35 bp, Artificial Sequence
  Synthetic oligonucleotide
tgaccccgttcgctcctaccccccacatcggcgct

SEQ ID NO: 112645 - DNA, 35 bp, Artificial Sequence
  Synthetic oligonucleotide
agcgcgcccctattctgcctacctctgcccgtgct

SEQ ID NO: 112646 - DNA, 35 bp, Artificial Sequence
  Synthetic oligonucleotide
tccgcacccgcctacgacgcaaagcatctcacctt

SEQ ID NO: 112647 - DNA, 35 bp, Artificial Sequence
  Synthetic oligonucleotide
aacgtctacctccgtttgcctacgtgtcacccctt

SEQ ID NO: 112648 - DNA, 36 bp, Artificial Sequence
  Synthetic oligonucleotide
cacgcaccccctccgcatgttccccggccgctatca

SEQ ID NO: 112649 - DNA, 35 bp, Artificial Sequence
  Synthetic oligonucleotide
tgcgccacccttgcgcttatcatctcccggtttca

SEQ ID NO: 112650 - DNA, 35 bp, Artificial Sequence
  Synthetic oligonucleotide
ggtgcatcatcaccctgggctctttaccatctttg

SEQ ID NO: 112651 - DNA, 35 bp, Artificial Sequence
  Synthetic oligonucleotide
acactcattccgacgccgccatcctgcacttgcct

SEQ ID NO: 112652 - DNA, 36 bp, Artificial Sequence
  Synthetic oligonucleotide
tccgcctcccccaccgacctgtactttccacgcgaa

SEQ ID NO: 112653 - DNA, 35 bp, Artificial Sequence
  Synthetic oligonucleotide
atagaggacggtgggcggcggggacggagggggaa

SEQ ID NO: 112654 - DNA, 35 bp, Artificial Sequence
  Synthetic oligonucleotide
gcccctagttgttgccctgccccgtcgtgacccgc

SEQ ID NO: 112655 - DNA, 35 bp, Artificial Sequence
  Synthetic oligonucleotide
gtcgcctccgcagagccgtcccccgctcccaaatc

SEQ ID NO: 112656 - DNA, 37 bp, Artificial Sequence
  Synthetic oligonucleotide
tccgagtcaggtgtaatactctgctccatccccctga

SEQ ID NO: 112657 - DNA, 37 bp, Artificial Sequence
  Synthetic oligonucleotide
ggaggtggtggggtggacttatggcggtacctgttta

SEQ ID NO: 112658 - DNA, 35 bp, Artificial Sequence
  Synthetic oligonucleotide
gctgagcatcatcgttatacccttctcgcacctca

SEQ ID NO: 112659 - DNA, 36 bp, Artificial Sequence
  Synthetic oligonucleotide
gttgacgccacatagttccacctccccatatctgga

SEQ ID NO: 112660 - DNA, 37 bp, Artificial Sequence
  Synthetic oligonucleotide
tgcccccgccccaccataaccgatgcaccgcccgtga

SEQ ID NO: 112661 - DNA, 35 bp, Artificial Sequence
  Synthetic oligonucleotide
gacgtccccctccgatacttggatcccgccctgaa

SEQ ID NO: 112662 - DNA, 35 bp, Artificial Sequence
  Synthetic oligonucleotide
tcccctctcgccaccgaagtaatagctaccatcac

SEQ ID NO: 112663 - DNA, 35 bp, Artificial Sequence
  Synthetic oligonucleotide
agcaccctccgcctctacagatcggtcgccgttac

SEQ ID NO: 112664 - DNA, 35 bp, Artificial Sequence
  Synthetic oligonucleotide
actccatcccggaattgctatcgctcgaggtcccc

SEQ ID NO: 112665 - DNA, 35 bp, Artificial Sequence
  Synthetic oligonucleotide
gaccattgtgacatcagtctaagcccttccgcctc

SEQ ID NO: 112666 - DNA, 34 bp, Artificial Sequence
  Synthetic oligonucleotide
atggatgggataatcggggatagggaggggacgg

SEQ ID NO: 112667 - DNA, 36 bp, Artificial Sequence
  Synthetic oligonucleotide
ttgtccccgctccctttggaatgtacctgccgtgca

SEQ ID NO: 112668 - DNA, 35 bp, Artificial Sequence
  Synthetic oligonucleotide
gacacacacccattcatgacgtctaggaacccccc

SEQ ID NO: 112669 - DNA, 35 bp, Artificial Sequence
  Synthetic oligonucleotide
gactgcgaccacgtttctcttctccttcccttccg

SEQ ID NO: 112670 - DNA, 35 bp, Artificial Sequence
  Synthetic oligonucleotide
atcactccgcacatgccaccgaataccttcctgat

SEQ ID NO: 112671 - DNA, 36 bp, Artificial Sequence
  Synthetic oligonucleotide
accccgccccagcatatttctcactgccactcgtaa

SEQ ID NO: 112672 - DNA, 36 bp, Artificial Sequence
  Synthetic oligonucleotide
tgacgcctcctactaagtgccatcccacaccccgta

SEQ ID NO: 112673 - DNA, 35 bp, Artificial Sequence
  Synthetic oligonucleotide
ttgtcgcatcccatgtacatcacgtcttctttcac

SEQ ID NO: 112674 - DNA, 35 bp, Artificial Sequence
  Synthetic oligonucleotide
gattacgcgcctgacataacgcgccatccaccctc

SEQ ID NO: 112675 - DNA, 35 bp, Artificial Sequence
  Synthetic oligonucleotide
gcccactcgcacaatccgctgtaaccacatagctc

SEQ ID NO: 112676 - DNA, 35 bp, Artificial Sequence
  Synthetic oligonucleotide
tgccgacttcccggtctgttgtactccactccccg

SEQ ID NO: 112677 - DNA, 35 bp, Artificial Sequence
  Synthetic oligonucleotide
gtacgggtggaggagatagagggaatggagtgatg

SEQ ID NO: 112678 - DNA, 35 bp, Artificial Sequence
  Synthetic oligonucleotide
gtgacacgcccaatctagttccagccctcccgttt

SEQ ID NO: 112679 - DNA, 35 bp, Artificial Sequence
  Synthetic oligonucleotide
ggaactacccgcccaccttgttttgtcaccacccg

SEQ ID NO: 112680 - DNA, 36 bp, Artificial Sequence
  Synthetic oligonucleotide
accccccgcccatagcctttggaaccacttgtagta

SEQ ID NO: 112681 - DNA, 35 bp, Artificial Sequence
  Synthetic oligonucleotide
gtgctcgctactggtctcgttcttctgtctcgctg

SEQ ID NO: 112682 - DNA, 36 bp, Artificial Sequence
  Synthetic oligonucleotide
tactccgtgactgtgttacatctccccctccgccga

SEQ ID NO: 112683 - DNA, 35 bp, Artificial Sequence
  Synthetic oligonucleotide
tcgaccgtctgtcgtcgcactgctccacttctttt

SEQ ID NO: 112684 - DNA, 35 bp, Artificial Sequence
  Synthetic oligonucleotide
ttggccccatcgcgacctgctcctctggtttgtcc

SEQ ID NO: 112685 - DNA, 35 bp, Artificial Sequence
  Synthetic oligonucleotide
gaccccgtcccgcccaccgccaaactccctccgaa

SEQ ID NO: 112686 - DNA, 36 bp, Artificial Sequence
  Synthetic oligonucleotide
gatcaccgccggttcgctttccgtacactaacgcca

SEQ ID NO: 112687 - DNA, 36 bp, Artificial Sequence
  Synthetic oligonucleotide
ccccacatacctgcattcgtactttagcccgcctca

SEQ ID NO: 112688 - DNA, 36 bp, Artificial Sequence
  Synthetic oligonucleotide
accgcccggtccgctcccgccccatcacgccgacaa

SEQ ID NO: 112689 - DNA, 35 bp, Artificial Sequence
  Synthetic oligonucleotide
gtccctgtccgcaccatttctccgagtctcaaccg

SEQ ID NO: 112690 - DNA, 35 bp, Artificial Sequence
  Synthetic oligonucleotide
tgtgccgatcgcgcctgttatccgtttttttgcct

SEQ ID NO: 112691 - DNA, 35 bp, Artificial Sequence
  Synthetic oligonucleotide
accccatccagtttaccgtgtcacctttccatggt

SEQ ID NO: 112692 - DNA, 35 bp, Artificial Sequence
  Synthetic oligonucleotide
gaggacgtaggggggggtaaacgagggcgcgacgt

SEQ ID NO: 112693 - DNA, 35 bp, Artificial Sequence
  Synthetic oligonucleotide
gcactccgtgatacctcccggtacgtaatcccacc

SEQ ID NO: 112694 - DNA, 35 bp, Artificial Sequence
  Synthetic oligonucleotide
tttggccgctcagccgacattcttcttccctcctg

SEQ ID NO: 112695 - DNA, 36 bp, Artificial Sequence
  Synthetic oligonucleotide
gaacgaggagggggagaatggcggtcgtggcagaaa

SEQ ID NO: 112696 - DNA, 36 bp, Artificial Sequence
  Synthetic oligonucleotide
tcagccgtccaatctgccgccccatgtcaacactaa

SEQ ID NO: 112697 - DNA, 37 bp, Artificial Sequence
  Synthetic oligonucleotide
tcacgcgggccgggagggtgctggggggtggcaagga

SEQ ID NO: 112698 - DNA, 35 bp, Artificial Sequence
  Synthetic oligonucleotide
aaccccggcccacagttgaaaaactgcccctccgc

SEQ ID NO: 112699 - DNA, 37 bp, Artificial Sequence
  Synthetic oligonucleotide
ttgagggcgggggggaatgagtcaccgacgacgggga

SEQ ID NO: 112700 - DNA, 38 bp, Artificial Sequence
  Synthetic oligonucleotide
tcccgctccgtttggtacccgcccatgccccaccgtga

SEQ ID NO: 112701 - DNA, 35 bp, Artificial Sequence
  Synthetic oligonucleotide
ggggccatcttgtttccccctcccgcattatccgc

SEQ ID NO: 112702 - DNA, 36 bp, Artificial Sequence
  Synthetic oligonucleotide
tcagactcacgacgctttttctgccttgttacctca

SEQ ID NO: 112703 - DNA, 37 bp, Artificial Sequence
  Synthetic oligonucleotide
tcacccccactcctgcttaacagtcgcgcttaactga

SEQ ID NO: 112704 - DNA, 35 bp, Artificial Sequence
  Synthetic oligonucleotide
ggaggagaggagaagaatggtgaggtataggggac

SEQ ID NO: 112705 - DNA, 29 bp, Artificial Sequence
  Synthetic oligonucleotide
acccaaacttctgaccccctcgcctcccc

SEQ ID NO: 112706 - DNA, 35 bp, Artificial Sequence
  Synthetic oligonucleotide
ggatgcgccccggctcctgtcgatctgctcactcc

SEQ ID NO: 112707 - DNA, 35 bp, Artificial Sequence
  Synthetic oligonucleotide
atccatgcccctccctctctgccgacgtgcctcaa

SEQ ID NO: 112708 - DNA, 35 bp, Artificial Sequence
  Synthetic oligonucleotide
aacatccccccccgctcagacagtagtcgctgtaa

SEQ ID NO: 112709 - DNA, 36 bp, Artificial Sequence
  Synthetic oligonucleotide
ttcccgccacacattgtcctcactagcttttttgca

SEQ ID NO: 112710 - DNA, 35 bp, Artificial Sequence
  Synthetic oligonucleotide
actcgcttccctccaccgtatagccccgtattcac

SEQ ID NO: 112711 - DNA, 37 bp, Artificial Sequence
  Synthetic oligonucleotide
gtgcgtgggtggggagcaaggtaggaggagcgggcga

SEQ ID NO: 112712 - DNA, 35 bp, Artificial Sequence
  Synthetic oligonucleotide
gtcgatccgcctatcccacgctcatcagacacttc

SEQ ID NO: 112713 - DNA, 37 bp, Artificial Sequence
  Synthetic oligonucleotide
gcagggcacaccatgttcgttctcgccctccacctga

SEQ ID NO: 112714 - DNA, 35 bp, Artificial Sequence
  Synthetic oligonucleotide
gttcacgcctccctgccttccacaggtctcgaccc

SEQ ID NO: 112715 - DNA, 35 bp, Artificial Sequence
  Synthetic oligonucleotide
gccacattacatgtcactagtacctagcgcccctc

SEQ ID NO: 112716 - DNA, 35 bp, Artificial Sequence
  Synthetic oligonucleotide
tcatccgtcatctcccgtccacctcttcgatcggt

SEQ ID NO: 112717 - DNA, 35 bp, Artificial Sequence
  Synthetic oligonucleotide
gatcatgcccagcccgccccatgcccgatatctcc

SEQ ID NO: 112718 - DNA, 37 bp, Artificial Sequence
  Synthetic oligonucleotide
tcacacgtcggctaatacgccaccctgtccctgccga

SEQ ID NO: 112719 - DNA, 35 bp, Artificial Sequence
  Synthetic oligonucleotide
gacgcccccactcatgaacatcagcacgaccgccc

SEQ ID NO: 112720 - DNA, 35 bp, Artificial Sequence
  Synthetic oligonucleotide
gcacaagtagccgccttcaccgccgttttcactgc

SEQ ID NO: 112721 - DNA, 33 bp, Artificial Sequence
  Synthetic oligonucleotide
gccacaccccctcaacccgaccagctgaattag

SEQ ID NO: 112722 - DNA, 36 bp, Artificial Sequence
  Synthetic oligonucleotide
atcaccccttcacccgtgtcgagtactcacttttca

SEQ ID NO: 112723 - DNA, 38 bp, Artificial Sequence
  Synthetic oligonucleotide
tgtacgacgctgtaatgtcgtaacacctccccccttga

SEQ ID NO: 112724 - DNA, 38 bp, Artificial Sequence
  Synthetic oligonucleotide
gcacccacctcttgccttgtaacctgtcctaccgttga

SEQ ID NO: 112725 - DNA, 35 bp, Artificial Sequence
  Synthetic oligonucleotide
tgagtcgtacatgccacaccggcggtccttccccc

SEQ ID NO: 112726 - DNA, 35 bp, Artificial Sequence
  Synthetic oligonucleotide
gccagtgatcagcatctgtcctcgtcccgccccct

SEQ ID NO: 112727 - DNA, 35 bp, Artificial Sequence
  Synthetic oligonucleotide
ttcgcggttcgatatgaactgttacctgtccccct

SEQ ID NO: 112728 - DNA, 35 bp, Artificial Sequence
  Synthetic oligonucleotide
gttaccgcctccctgcttgtttccctatatcagac

SEQ ID NO: 112729 - DNA, 35 bp, Artificial Sequence
  Synthetic oligonucleotide
agctcgcctgacggttccccctcggacctcccccg

SEQ ID NO: 112730 - DNA, 35 bp, Artificial Sequence
  Synthetic oligonucleotide
agtcccacccgttctgaagtctctgctccctccgg

SEQ ID NO: 112731 - DNA, 35 bp, Artificial Sequence
  Synthetic oligonucleotide
ttgtacccgaaggttcctcatagatctgctttccc

SEQ ID NO: 112732 - DNA, 35 bp, Artificial Sequence
  Synthetic oligonucleotide
gcacgagcccccgatcgtcctcaatcatcacttcc

SEQ ID NO: 112733 - DNA, 35 bp, Artificial Sequence
  Synthetic oligonucleotide
gcacacatcctgccccgtttaaagggtatccctgc

SEQ ID NO: 112734 - DNA, 35 bp, Artificial Sequence
  Synthetic oligonucleotide
acgaccaccctgtatttaccgtccgtctttctggt

SEQ ID NO: 112735 - DNA, 35 bp, Artificial Sequence
  Synthetic oligonucleotide
gcacagggtagggggggtgtttcgggatgttgccg

SEQ ID NO: 112736 - DNA, 37 bp, Artificial Sequence
  Synthetic oligonucleotide
gcgcccggccaaatctgccaccccgcacctctcttga

SEQ ID NO: 112737 - DNA, 35 bp, Artificial Sequence
  Synthetic oligonucleotide
gatcgcacccttcctttctcgcctggtatacttcg

SEQ ID NO: 112738 - DNA, 35 bp, Artificial Sequence
  Synthetic oligonucleotide
gtgggacgggggacgagtaagggaaggggacgatg

SEQ ID NO: 112739 - DNA, 36 bp, Artificial Sequence
  Synthetic oligonucleotide
tgatacccccattgggctccgtactacccttaccta

SEQ ID NO: 112740 - DNA, 36 bp, Artificial Sequence
  Synthetic oligonucleotide
accgccacccgttactttctttagtgcccttccgta

SEQ ID NO: 112741 - DNA, 36 bp, Artificial Sequence
  Synthetic oligonucleotide
tatgacgcagcccttccgcccccgcctccactggta

SEQ ID NO: 112742 - DNA, 35 bp, Artificial Sequence
  Synthetic oligonucleotide
tgccgatcgctgaccgcccgggaaacactccccac

SEQ ID NO: 112743 - DNA, 35 bp, Artificial Sequence
  Synthetic oligonucleotide
tctgttaccggcccaggctgtaatccctgcccttc

SEQ ID NO: 112744 - DNA, 35 bp, Artificial Sequence
  Synthetic oligonucleotide
gtggggaggggcggtggagggacgctggtgatatg

SEQ ID NO: 112745 - DNA, 35 bp, Artificial Sequence
  Synthetic oligonucleotide
ttggtgcgccactgctgcctctccaacttttgcta

SEQ ID NO: 112746 - DNA, 37 bp, Artificial Sequence
  Synthetic oligonucleotide
acgtcgacgagggaaggggggtccggagggcgggaga

SEQ ID NO: 112747 - DNA, 37 bp, Artificial Sequence
  Synthetic oligonucleotide
aaggtgcgggagagagaacacgggaacgggcgggaga

SEQ ID NO: 112748 - DNA, 37 bp, Artificial Sequence
  Synthetic oligonucleotide
tccgcctcggtgctctgtcttgtcgcccttcccccga

SEQ ID NO: 112749 - DNA, 35 bp, Artificial Sequence
  Synthetic oligonucleotide
actagacaccccacttatcgtacttttgacctgtc

SEQ ID NO: 112750 - DNA, 35 bp, Artificial Sequence
  Synthetic oligonucleotide
agcatccgttatgatctgcatccgcccaccctcac

SEQ ID NO: 112751 - DNA, 35 bp, Artificial Sequence
  Synthetic oligonucleotide
gtgtcgtcgatggatcctgtttttcttgtccgtcc

SEQ ID NO: 112752 - DNA, 35 bp, Artificial Sequence
  Synthetic oligonucleotide
tacgcccacggtaaccttcttgctattcccttgtc

SEQ ID NO: 112753 - DNA, 35 bp, Artificial Sequence
  Synthetic oligonucleotide
tagaggacgggtggggggatgacgggtatgggggg

SEQ ID NO: 112754 - DNA, 36 bp, Artificial Sequence
  Synthetic oligonucleotide
gtagggcgggggataaggcatttgggtggggttaca

SEQ ID NO: 112755 - DNA, 35 bp, Artificial Sequence
  Synthetic oligonucleotide
tccgacggtgacggccatcgctactacattctccc

SEQ ID NO: 112756 - DNA, 35 bp, Artificial Sequence
  Synthetic oligonucleotide
atcatcgcgcacctctattctccgcaagttgcctc

SEQ ID NO: 112757 - DNA, 35 bp, Artificial Sequence
  Synthetic oligonucleotide
tgcgggtgctcctccgttgcccacctgatcccttt

SEQ ID NO: 112758 - DNA, 35 bp, Artificial Sequence
  Synthetic oligonucleotide
tgcgacgtaagtcctattcgtgcacctcccacgcc

SEQ ID NO: 112759 - DNA, 35 bp, Artificial Sequence
  Synthetic oligonucleotide
acgatcgaatcctgcctattccgccactgcccgcc

SEQ ID NO: 112760 - DNA, 37 bp, Artificial Sequence
  Synthetic oligonucleotide
tagacgggagggtggaaggagagaagggtgtataaga

SEQ ID NO: 112761 - DNA, 36 bp, Artificial Sequence
  Synthetic oligonucleotide
acacccgcctggctggccgacccgaccccttcacga

SEQ ID NO: 112762 - DNA, 35 bp, Artificial Sequence
  Synthetic oligonucleotide
tacgttcgccatgtgccagcccaccgtaactcctc

SEQ ID NO: 112763 - DNA, 35 bp, Artificial Sequence
  Synthetic oligonucleotide
acgaagtgccgccagctcgactatcgcccggcccc

SEQ ID NO: 112764 - DNA, 35 bp, Artificial Sequence
  Synthetic oligonucleotide
ttgacagtcaacatgtaagacctccctgccccccc

SEQ ID NO: 112765 - DNA, 36 bp, Artificial Sequence
  Synthetic oligonucleotide
acgctctgcaccttccgtctttcacgctcctggttc

SEQ ID NO: 112766 - DNA, 35 bp, Artificial Sequence
  Synthetic oligonucleotide
gcctgtgccctgctgaatttgtcaatgggtccccc

SEQ ID NO: 112767 - DNA, 35 bp, Artificial Sequence
  Synthetic oligonucleotide
tgtggcacgccctccgacccatcacagtgctgtcc

SEQ ID NO: 112768 - DNA, 36 bp, Artificial Sequence
  Synthetic oligonucleotide
gagagaggcgggtggtggtggtagtagacgtagcga

SEQ ID NO: 112769 - DNA, 37 bp, Artificial Sequence
  Synthetic oligonucleotide
tagtaacgagaggagggggggggcggtactgaacgga

SEQ ID NO: 112770 - DNA, 37 bp, Artificial Sequence
  Synthetic oligonucleotide
agtggcaagttcaaggaggaggggaggggtggtcgga

SEQ ID NO: 112771 - DNA, 35 bp, Artificial Sequence
  Synthetic oligonucleotide
atgccccggaggctccccccccttccgataccgct

SEQ ID NO: 112772 - DNA, 35 bp, Artificial Sequence
  Synthetic oligonucleotide
taccaccgccccctgcgttttactacgaccgcggt

SEQ ID NO: 112773 - DNA, 36 bp, Artificial Sequence
  Synthetic oligonucleotide
gcaaggccctccctgtactctatgaccgctcgccca

SEQ ID NO: 112774 - DNA, 35 bp, Artificial Sequence
  Synthetic oligonucleotide
atcctgaccgtactgtcttctctgctacagcctac

SEQ ID NO: 112775 - DNA, 35 bp, Artificial Sequence
  Synthetic oligonucleotide
gacccccgctccatcctggccaattgcctgtactc

SEQ ID NO: 112776 - DNA, 35 bp, Artificial Sequence
  Synthetic oligonucleotide
gatgtacgtcgatcccagtcctattgccacctttt

SEQ ID NO: 112777 - DNA, 35 bp, Artificial Sequence
  Synthetic oligonucleotide
atagccaccgtattctatctgccctgtggttttcc

SEQ ID NO: 112778 - DNA, 35 bp, Artificial Sequence
  Synthetic oligonucleotide
tgcgacgagaacgggaagggggaggagagtgctag

SEQ ID NO: 112779 - DNA, 35 bp, Artificial Sequence
  Synthetic oligonucleotide
tcattctgtcctcctgccgtagtagccacccgcgc

SEQ ID NO: 112780 - DNA, 35 bp, Artificial Sequence
  Synthetic oligonucleotide
gacggagccaggtactgcttcccttacctccccaa

SEQ ID NO: 112781 - DNA, 36 bp, Artificial Sequence
  Synthetic oligonucleotide
gggacggacgaaaaccaacgagggaggggggggaga

SEQ ID NO: 112782 - DNA, 36 bp, Artificial Sequence
  Synthetic oligonucleotide
acacgccggtgttcttctcagccgatctccctccta

SEQ ID NO: 112783 - DNA, 36 bp, Artificial Sequence
  Synthetic oligonucleotide
ggggaggggctgaaggggggggttgacaaagacgta

SEQ ID NO: 112784 - DNA, 35 bp, Artificial Sequence
  Synthetic oligonucleotide
ttgactcctcactcgttatcccacggtacccgccc

SEQ ID NO: 112785 - DNA, 35 bp, Artificial Sequence
  Synthetic oligonucleotide
tcccagacgtggctctggctttcactcctcttacg

SEQ ID NO: 112786 - DNA, 35 bp, Artificial Sequence
  Synthetic oligonucleotide
tccctacgcttggcctgctttgccgactattccca

SEQ ID NO: 112787 - DNA, 37 bp, Artificial Sequence
  Synthetic oligonucleotide
ccatgccgccctgcctgttagcgcacctcccttacga

SEQ ID NO: 112788 - DNA, 35 bp, Artificial Sequence
  Synthetic oligonucleotide
tccgcccttccaatgcccctttattgtatagtccc

SEQ ID NO: 112789 - DNA, 35 bp, Artificial Sequence
  Synthetic oligonucleotide
gtccgaaccatcaagtggagttcttccccctcgcc

SEQ ID NO: 112790 - DNA, 35 bp, Artificial Sequence
  Synthetic oligonucleotide
gccgagccccgccgccgtttatttggctttgtgcc

SEQ ID NO: 112791 - DNA, 35 bp, Artificial Sequence
  Synthetic oligonucleotide
tcccgactctgcaccttcgctgtacatcgaccctt

SEQ ID NO: 112792 - DNA, 37 bp, Artificial Sequence
  Synthetic oligonucleotide
gcacctcttgcccctctaagaccctctcgttgcccga

SEQ ID NO: 112793 - DNA, 35 bp, Artificial Sequence
  Synthetic oligonucleotide
ggggcgggttagaatggggctgctggttttggggc

SEQ ID NO: 112794 - DNA, 35 bp, Artificial Sequence
  Synthetic oligonucleotide
acgatgtggagggcgggctaaggggcggatgatgg

SEQ ID NO: 112795 - DNA, 35 bp, Artificial Sequence
  Synthetic oligonucleotide
gacgtgtgacgcgtgtgggcgggaaggggtggggt

SEQ ID NO: 112796 - DNA, 37 bp, Artificial Sequence
  Synthetic oligonucleotide
tcacattcggtcagcgagttcctccgccatcctctga

SEQ ID NO: 112797 - DNA, 35 bp, Artificial Sequence
  Synthetic oligonucleotide
gcacaacccgtcgccttggtttagccagccctgcc

SEQ ID NO: 112798 - DNA, 35 bp, Artificial Sequence
  Synthetic oligonucleotide
tcgatgagcccctcagtgtcccgtttcacctgtcg

SEQ ID NO: 112799 - DNA, 36 bp, Artificial Sequence
  Synthetic oligonucleotide
agcgggggagggctgggggctaggagaagggtccaa

SEQ ID NO: 112800 - DNA, 37 bp, Artificial Sequence
  Synthetic oligonucleotide
tgatcaatctgcacgtgcacctcgcctcatctttcga

SEQ ID NO: 112801 - DNA, 35 bp, Artificial Sequence
  Synthetic oligonucleotide
gcccgccagtctcgcaatgctttgtcgcctccacc

SEQ ID NO: 112802 - DNA, 37 bp, Artificial Sequence
  Synthetic oligonucleotide
ggagacaggcgaggcaggggaaaagggaaataaagga

SEQ ID NO: 112803 - DNA, 35 bp, Artificial Sequence
  Synthetic oligonucleotide
gatcaagcctcgctcgccctgttccctcctgatat

SEQ ID NO: 112804 - DNA, 35 bp, Artificial Sequence
  Synthetic oligonucleotide
tacagctcgcatctccgctcccttccttgggtcct

SEQ ID NO: 112805 - DNA, 35 bp, Artificial Sequence
  Synthetic oligonucleotide
gcacgcacccggccacttatttgcctccgaactct

SEQ ID NO: 112806 - DNA, 38 bp, Artificial Sequence
  Synthetic oligonucleotide
gcgctcgccacacctgcccgccttgaccgccgccctga

SEQ ID NO: 112807 - DNA, 35 bp, Artificial Sequence
  Synthetic oligonucleotide
tcgtggcacacatagtttagccgccaccattcatc

SEQ ID NO: 112808 - DNA, 35 bp, Artificial Sequence
  Synthetic oligonucleotide
gacgcccaagctgctcctccgttgccacactcgat

SEQ ID NO: 112809 - DNA, 35 bp, Artificial Sequence
  Synthetic oligonucleotide
atgacaccacccctgttctccttagcctaggcaca

SEQ ID NO: 112810 - DNA, 37 bp, Artificial Sequence
  Synthetic oligonucleotide
tgcccgccatcttccgcctcgtatgtcacatcctcga

SEQ ID NO: 112811 - DNA, 35 bp, Artificial Sequence
  Synthetic oligonucleotide
tagaccctcccgtgcgttttcttgttcgcgttcac

SEQ ID NO: 112812 - DNA, 35 bp, Artificial Sequence
  Synthetic oligonucleotide
tccccgacactctgaatttcaatgccccgcccgcc

SEQ ID NO: 112813 - DNA, 35 bp, Artificial Sequence
  Synthetic oligonucleotide
ttggccacgcgttctttcgtccttcatactgcgcc

SEQ ID NO: 112814 - DNA, 36 bp, Artificial Sequence
  Synthetic oligonucleotide
ccatcacagttcctgcgtctctgctccttccctaga

SEQ ID NO: 112815 - DNA, 36 bp, Artificial Sequence
  Synthetic oligonucleotide
gggtgggtgtagggagggaaatcgagagacgtagca

SEQ ID NO: 112816 - DNA, 36 bp, Artificial Sequence
  Synthetic oligonucleotide
tcatccgcctggacctgtaccttttcttcaccccga

SEQ ID NO: 112817 - DNA, 37 bp, Artificial Sequence
  Synthetic oligonucleotide
gtcacgccccccccatttatccggccccagtcatgga

SEQ ID NO: 112818 - DNA, 35 bp, Artificial Sequence
  Synthetic oligonucleotide
tcccacgtgtgactgcctcttgaccccactaccac

SEQ ID NO: 112819 - DNA, 35 bp, Artificial Sequence
  Synthetic oligonucleotide
atacgccccagcactttttaagcccctgacctatc

SEQ ID NO: 112820 - DNA, 36 bp, Artificial Sequence
  Synthetic oligonucleotide
tcaggtggggcggaggggggaaggtttcggcattaa

SEQ ID NO: 112821 - DNA, 35 bp, Artificial Sequence
  Synthetic oligonucleotide
tttggaccctccgtatgcatgcaagtgccccaccc

SEQ ID NO: 112822 - DNA, 35 bp, Artificial Sequence
  Synthetic oligonucleotide
gccgttcacgctctctctatgtctcattgtctggc

SEQ ID NO: 112823 - DNA, 35 bp, Artificial Sequence
  Synthetic oligonucleotide
tgccagcatcagccccaccttcgctctccgcccgt

SEQ ID NO: 112824 - DNA, 36 bp, Artificial Sequence
  Synthetic oligonucleotide
ttcgacacccgccacgactcaccctgcgatttccaa

SEQ ID NO: 112825 - DNA, 35 bp, Artificial Sequence
  Synthetic oligonucleotide
gcacgatcccctgcagtgccgcactccgcccccgg

SEQ ID NO: 112826 - DNA, 35 bp, Artificial Sequence
  Synthetic oligonucleotide
tcacatcccggtcgtacttacctcttgcacactct

SEQ ID NO: 112827 - DNA, 36 bp, Artificial Sequence
  Synthetic oligonucleotide
tgagggagggggggattggagcaggcgagagtggaa

SEQ ID NO: 112828 - DNA, 36 bp, Artificial Sequence
  Synthetic oligonucleotide
gtcacttgcccccgctgtcgcatcagcccccctcca

SEQ ID NO: 112829 - DNA, 37 bp, Artificial Sequence
  Synthetic oligonucleotide
tgaagctcctgcctgcaccctgtccttgttacgccga

SEQ ID NO: 112830 - DNA, 37 bp, Artificial Sequence
  Synthetic oligonucleotide
gtgcctccacacagattgacatccgccatcccctcga

SEQ ID NO: 112831 - DNA, 37 bp, Artificial Sequence
  Synthetic oligonucleotide
aagggcgggggtggagctacaacaagggctgggagga

SEQ ID NO: 112832 - DNA, 37 bp, Artificial Sequence
  Synthetic oligonucleotide
ggggcgggttgatagactggggcatatatacggggga

SEQ ID NO: 112833 - DNA, 36 bp, Artificial Sequence
  Synthetic oligonucleotide
tcagccgtccggccgtcgtgtactcgccccctgcta

SEQ ID NO: 112834 - DNA, 36 bp, Artificial Sequence
  Synthetic oligonucleotide
ggacgagggagggcgggaagggacgttcacgaatta

SEQ ID NO: 112835 - DNA, 34 bp, Artificial Sequence
  Synthetic oligonucleotide
tgaagcccccgctgccctctcactccatcagtcc

SEQ ID NO: 112836 - DNA, 35 bp, Artificial Sequence
  Synthetic oligonucleotide
tatcccatcccgccttatatagcttctggcctgtc

SEQ ID NO: 112837 - DNA, 36 bp, Artificial Sequence
  Synthetic oligonucleotide
ttcaacccatcacgttctgctataccgctttccaca

SEQ ID NO: 112838 - DNA, 35 bp, Artificial Sequence
  Synthetic oligonucleotide
gccctctgcatattatccctgttgcctgttcgtac

SEQ ID NO: 112839 - DNA, 35 bp, Artificial Sequence
  Synthetic oligonucleotide
attgccgcccacacgaacgtgatcgccctttctgc

SEQ ID NO: 112840 - DNA, 35 bp, Artificial Sequence
  Synthetic oligonucleotide
gtacccccatgtcagccgtgtcattttcgtcttcc

SEQ ID NO: 112841 - DNA, 35 bp, Artificial Sequence
  Synthetic oligonucleotide
tctctgccgccaagtcttacctaccacccccgcgt

SEQ ID NO: 112842 - DNA, 37 bp, Artificial Sequence
  Synthetic oligonucleotide
tccaagcgggaacgggaaaccaaggggaggcaaaaga

SEQ ID NO: 112843 - DNA, 35 bp, Artificial Sequence
  Synthetic oligonucleotide
tccgcaccatcctttcacttaaggcaccacacgct

SEQ ID NO: 112844 - DNA, 35 bp, Artificial Sequence
  Synthetic oligonucleotide
ggtctaccgccgcgcctcgttttcgcctgccttga

SEQ ID NO: 112845 - DNA, 36 bp, Artificial Sequence
  Synthetic oligonucleotide
acccccttcgcccgcacattccttagacgacgttaa

SEQ ID NO: 112846 - DNA, 38 bp, Artificial Sequence
  Synthetic oligonucleotide
gatgcccttgatcgtcctactacgcccccacttcgtga

SEQ ID NO: 112847 - DNA, 35 bp, Artificial Sequence
  Synthetic oligonucleotide
gaaccgcaccgtcttctttgtcgcgctcctaccac

SEQ ID NO: 112848 - DNA, 35 bp, Artificial Sequence
  Synthetic oligonucleotide
actcacaccaccgactggcactcatccgctatcat

SEQ ID NO: 112849 - DNA, 35 bp, Artificial Sequence
  Synthetic oligonucleotide
aacgacagatatagggcgggaacgggaaggggtct

SEQ ID NO: 112850 - DNA, 35 bp, Artificial Sequence
  Synthetic oligonucleotide
ggtctcgccgcatcgctttgtgcactccctctcga

SEQ ID NO: 112851 - DNA, 35 bp, Artificial Sequence
  Synthetic oligonucleotide
gttgcaccatcccgcgcgaggctcctcctcagtct

SEQ ID NO: 112852 - DNA, 35 bp, Artificial Sequence
  Synthetic oligonucleotide
gggacggggtggtagggggaggattcgacatggcc

SEQ ID NO: 112853 - DNA, 36 bp, Artificial Sequence
  Synthetic oligonucleotide
atgtcgccctgtggtgctgccgacacccaccctgcc

SEQ ID NO: 112854 - DNA, 35 bp, Artificial Sequence
  Synthetic oligonucleotide
gcgctccgccgcccttatgcgacatcaaggcctcc

SEQ ID NO: 112855 - DNA, 35 bp, Artificial Sequence
  Synthetic oligonucleotide
gatcctgcctgacctcgccctcactgtctctcgtt

SEQ ID NO: 112856 - DNA, 37 bp, Artificial Sequence
  Synthetic oligonucleotide
accgggccgaagttgatgggcgggactagctagggga

SEQ ID NO: 112857 - DNA, 38 bp, Artificial Sequence
  Synthetic oligonucleotide
tccgcatgcaagccgccgtaatgctttcacctccctga

SEQ ID NO: 112858 - DNA, 35 bp, Artificial Sequence
  Synthetic oligonucleotide
acgatagccctcatcttgttcacacctggtcccat

SEQ ID NO: 112859 - DNA, 35 bp, Artificial Sequence
  Synthetic oligonucleotide
tagcctcctgttctgcctacccgtgactatcctat

SEQ ID NO: 112860 - DNA, 35 bp, Artificial Sequence
  Synthetic oligonucleotide
cccgcccccgccgcatcgataccgctccagtaccc

SEQ ID NO: 112861 - DNA, 35 bp, Artificial Sequence
  Synthetic oligonucleotide
acacgccggcccgtgattctgtaccccaccccgcc

SEQ ID NO: 112862 - DNA, 36 bp, Artificial Sequence
  Synthetic oligonucleotide
tccagtacctcgcatgttgcctaacgctcctccgca

SEQ ID NO: 112863 - DNA, 36 bp, Artificial Sequence
  Synthetic oligonucleotide
gttcgcgcgccgtttgcacaccatcatcccccggca

SEQ ID NO: 112864 - DNA, 35 bp, Artificial Sequence
  Synthetic oligonucleotide
tcacacccgtcatctcccctgtcgctacattgcgc

SEQ ID NO: 112865 - DNA, 35 bp, Artificial Sequence
  Synthetic oligonucleotide
tatcagccacacataacatcgccggccatgcactc

SEQ ID NO: 112866 - DNA, 35 bp, Artificial Sequence
  Synthetic oligonucleotide
gttccccctgccgttatcccagcactgaggttccc

SEQ ID NO: 112867 - DNA, 35 bp, Artificial Sequence
  Synthetic oligonucleotide
acgctcgatgtagttgtcactggagggggggaggg

SEQ ID NO: 112868 - DNA, 37 bp, Artificial Sequence
  Synthetic oligonucleotide
gcctgccgccgccgttgccaccatgttaccagcctga

SEQ ID NO: 112869 - DNA, 37 bp, Artificial Sequence
  Synthetic oligonucleotide
gctgcccgctttgtcctccccgtgagcccctccatga

SEQ ID NO: 112870 - DNA, 35 bp, Artificial Sequence
  Synthetic oligonucleotide
ttgtcctcccgcacaattcattgacgacttctacc

SEQ ID NO: 112871 - DNA, 35 bp, Artificial Sequence
  Synthetic oligonucleotide
aaccacccactttgtcttcctcgataacaggttct

SEQ ID NO: 112872 - DNA, 36 bp, Artificial Sequence
  Synthetic oligonucleotide
acacccctcatccgtgctcaccccgactcacccgga

SEQ ID NO: 112873 - DNA, 35 bp, Artificial Sequence
  Synthetic oligonucleotide
tccaccacgcccttatagaactactgaccaccgct

SEQ ID NO: 112874 - DNA, 35 bp, Artificial Sequence
  Synthetic oligonucleotide
tccatgccgccacccgcccttttaaggctctatca

SEQ ID NO: 112875 - DNA, 38 bp, Artificial Sequence
  Synthetic oligonucleotide
gacctgctcactgtcttccgtactgcccctcacagtga

SEQ ID NO: 112876 - DNA, 35 bp, Artificial Sequence
  Synthetic oligonucleotide
actctcccgcccgaagttagccacgttccgtcccc

SEQ ID NO: 112877 - DNA, 35 bp, Artificial Sequence
  Synthetic oligonucleotide
gccgaccctaggctcttgtcccatcccgccccgct

SEQ ID NO: 112878 - DNA, 35 bp, Artificial Sequence
  Synthetic oligonucleotide
atcaccttccgcccgtcccgactttctggtttaca

SEQ ID NO: 112879 - DNA, 35 bp, Artificial Sequence
  Synthetic oligonucleotide
acacaccacgcggtccactcgctgttcgccctcca

SEQ ID NO: 112880 - DNA, 36 bp, Artificial Sequence
  Synthetic oligonucleotide
gcccgctccgaccctggttcatccccgcttctacga

SEQ ID NO: 112881 - DNA, 34 bp, Artificial Sequence
  Synthetic oligonucleotide
tttaccccggctggccattgcccttaaccctgcc

SEQ ID NO: 112882 - DNA, 35 bp, Artificial Sequence
  Synthetic oligonucleotide
tcaccgctcacgtgctcgtccttctctttatctgc

SEQ ID NO: 112883 - DNA, 36 bp, Artificial Sequence
  Synthetic oligonucleotide
gtcacccggcaagccttgcacatcttgaacctccca

SEQ ID NO: 112884 - DNA, 36 bp, Artificial Sequence
  Synthetic oligonucleotide
tgtccgacttaggacgtatcatccctgggccttcca

SEQ ID NO: 112885 - DNA, 37 bp, Artificial Sequence
  Synthetic oligonucleotide
acccgcatgcccctgtagcgccgcccccacaactcga

SEQ ID NO: 112886 - DNA, 35 bp, Artificial Sequence
  Synthetic oligonucleotide
tgacggcgatccaacttgtccatgtccttcctctg

SEQ ID NO: 112887 - DNA, 35 bp, Artificial Sequence
  Synthetic oligonucleotide
tccgaagcccccgccctctgctctcaattgtgcaa

SEQ ID NO: 112888 - DNA, 36 bp, Artificial Sequence
  Synthetic oligonucleotide
gtccatgccctggtccacacgtgtctccgccgcaca

SEQ ID NO: 112889 - DNA, 35 bp, Artificial Sequence
  Synthetic oligonucleotide
gtccccttccgactcgtgggctctccaaccgtact

SEQ ID NO: 112890 - DNA, 35 bp, Artificial Sequence
  Synthetic oligonucleotide
gactcctcaccctgatacgcacctgccccccgcgt

SEQ ID NO: 112891 - DNA, 36 bp, Artificial Sequence
  Synthetic oligonucleotide
taccgccccatgctaacgaatacctgctcctcttta

SEQ ID NO: 112892 - DNA, 35 bp, Artificial Sequence
  Synthetic oligonucleotide
acacgtggccccccgttgccatcattgccgccctc

SEQ ID NO: 112893 - DNA, 35 bp, Artificial Sequence
  Synthetic oligonucleotide
tgtcaccgcccgtcccttgacctcccattgctcat

SEQ ID NO: 112894 - DNA, 36 bp, Artificial Sequence
  Synthetic oligonucleotide
gtggcctccttccctgcgatatgaatgctctcccga

SEQ ID NO: 112895 - DNA, 37 bp, Artificial Sequence
  Synthetic oligonucleotide
tgccgttcagctccgttttgccgcctccatacccgta

SEQ ID NO: 112896 - DNA, 35 bp, Artificial Sequence
  Synthetic oligonucleotide
tcctcaccctctcgaccggtctaatggtgacatta

SEQ ID NO: 112897 - DNA, 35 bp, Artificial Sequence
  Synthetic oligonucleotide
ttgcaccatctcccaccgatcatatgacacgcccc

SEQ ID NO: 112898 - DNA, 35 bp, Artificial Sequence
  Synthetic oligonucleotide
actgcaccctcaaggacctccacctcccgcctagc

SEQ ID NO: 112899 - DNA, 35 bp, Artificial Sequence
  Synthetic oligonucleotide
ttggtgctcctcgtttggcgttccgtacctgcctc

SEQ ID NO: 112900 - DNA, 35 bp, Artificial Sequence
  Synthetic oligonucleotide
gttccgccccattcgacatttatcagtcctcctcg

SEQ ID NO: 112901 - DNA, 35 bp, Artificial Sequence
  Synthetic oligonucleotide
tgaccatattccacgctctctgtgcctacctctcg

SEQ ID NO: 112902 - DNA, 35 bp, Artificial Sequence
  Synthetic oligonucleotide
aatacggaggggggggagcggggacggtcatgagg

SEQ ID NO: 112903 - DNA, 38 bp, Artificial Sequence
  Synthetic oligonucleotide
gcctggcccctgttttccgcgagctgccccactcctga

SEQ ID NO: 112904 - DNA, 33 bp, Artificial Sequence
  Synthetic oligonucleotide
taccacactaccaccctaccgtcaccgtactcg

SEQ ID NO: 112905 - DNA, 36 bp, Artificial Sequence
  Synthetic oligonucleotide
accgtcgccacatatctacttcgccggaccacttca

SEQ ID NO: 112906 - DNA, 36 bp, Artificial Sequence
  Synthetic oligonucleotide
atccccgcccggaccttgcagtcaagtaatcttgta

SEQ ID NO: 112907 - DNA, 35 bp, Artificial Sequence
  Synthetic oligonucleotide
tccgagcccaaggttccaccccctcgttcccgctc

SEQ ID NO: 112908 - DNA, 37 bp, Artificial Sequence
  Synthetic oligonucleotide
agagacgaaggactgagcaatagaggagggggggcga

SEQ ID NO: 112909 - DNA, 35 bp, Artificial Sequence
  Synthetic oligonucleotide
taaacacgtggggggggggaacaaaggacaaggga

SEQ ID NO: 112910 - DNA, 35 bp, Artificial Sequence
  Synthetic oligonucleotide
tacgccgtcaacactctcgcagtcgttctttgccc

SEQ ID NO: 112911 - DNA, 35 bp, Artificial Sequence
  Synthetic oligonucleotide
acgctccccatgatcagcaattatagccctctgtc

SEQ ID NO: 112912 - DNA, 35 bp, Artificial Sequence
  Synthetic oligonucleotide
acacgccccgtctctctcccctacctgtctttgcg

SEQ ID NO: 112913 - DNA, 35 bp, Artificial Sequence
  Synthetic oligonucleotide
gcccctgacactgtgcctcttatgctgctcgctca

SEQ ID NO: 112914 - DNA, 37 bp, Artificial Sequence
  Synthetic oligonucleotide
taccgacccgagatctgcccccctcgacacaagtcga

SEQ ID NO: 112915 - DNA, 37 bp, Artificial Sequence
  Synthetic oligonucleotide
atccgaggggtggcagttgggggaggaaacggaggga

SEQ ID NO: 112916 - DNA, 37 bp, Artificial Sequence
  Synthetic oligonucleotide
gtgtactcaggggaggatggaggggggaatgcaatga

SEQ ID NO: 112917 - DNA, 36 bp, Artificial Sequence
  Synthetic oligonucleotide
gatccatcgtatgttctgattgcgcctacacctcca

SEQ ID NO: 112918 - DNA, 36 bp, Artificial Sequence
  Synthetic oligonucleotide
acccgcgccgcaagctccgactccaccataggccta

SEQ ID NO: 112919 - DNA, 35 bp, Artificial Sequence
  Synthetic oligonucleotide
tcgaaacgttcaccttgtcgctgtctcgttcctta

SEQ ID NO: 112920 - DNA, 35 bp, Artificial Sequence
  Synthetic oligonucleotide
gccccttgccttgctgtatatccgaattccgccgc

SEQ ID NO: 112921 - DNA, 35 bp, Artificial Sequence
  Synthetic oligonucleotide
tgttgctcctgactctatagccgtttctgcacccc

SEQ ID NO: 112922 - DNA, 35 bp, Artificial Sequence
  Synthetic oligonucleotide
gttggatgtgccgccgcccgtcccctatgttgctt

SEQ ID NO: 112923 - DNA, 35 bp, Artificial Sequence
  Synthetic oligonucleotide
actgccccagtgacccgtgcgccgtacgcccctcc

SEQ ID NO: 112924 - DNA, 35 bp, Artificial Sequence
  Synthetic oligonucleotide
actatccgacccaccccgcgccctgccacactgtc

SEQ ID NO: 112925 - DNA, 35 bp, Artificial Sequence
  Synthetic oligonucleotide
gcgaacaaccgatctggtcagcctgccctccctgt

SEQ ID NO: 112926 - DNA, 35 bp, Artificial Sequence
  Synthetic oligonucleotide
accacctcccatagcgctcgcacccgcgcttctca

SEQ ID NO: 112927 - DNA, 35 bp, Artificial Sequence
  Synthetic oligonucleotide
tctaacgtcctggctccacgaaaccggtccacccc

SEQ ID NO: 112928 - DNA, 35 bp, Artificial Sequence
  Synthetic oligonucleotide
ttcagttgctcctcttgcgccttaagttccctcgc

SEQ ID NO: 112929 - DNA, 37 bp, Artificial Sequence
  Synthetic oligonucleotide
acacaacgggagggcactggggagggagttgattaga

SEQ ID NO: 112930 - DNA, 38 bp, Artificial Sequence
  Synthetic oligonucleotide
gtctggccgggggggtatggggcggaggtacacgttga

SEQ ID NO: 112931 - DNA, 35 bp, Artificial Sequence
  Synthetic oligonucleotide
atcatgtccgacttcacgcctggcttaccattgta

SEQ ID NO: 112932 - DNA, 35 bp, Artificial Sequence
  Synthetic oligonucleotide
gtgtgacctctgtcgcccgttttatgcccctaccc

SEQ ID NO: 112933 - DNA, 35 bp, Artificial Sequence
  Synthetic oligonucleotide
gcgattgctcggcacacgtctttcaaccgcacctc

SEQ ID NO: 112934 - DNA, 36 bp, Artificial Sequence
  Synthetic oligonucleotide
agggacggggagatcgagaggggaggggcacgcgaa

SEQ ID NO: 112935 - DNA, 38 bp, Artificial Sequence
  Synthetic oligonucleotide
tgcacctcaactgctgctctacatgtttcttcccttga

SEQ ID NO: 112936 - DNA, 35 bp, Artificial Sequence
  Synthetic oligonucleotide
acccccatctgttcgtggtaccctagccatactac

SEQ ID NO: 112937 - DNA, 35 bp, Artificial Sequence
  Synthetic oligonucleotide
gtgactacgctccctttctgcacgtccctcctggc

SEQ ID NO: 112938 - DNA, 35 bp, Artificial Sequence
  Synthetic oligonucleotide
gtgccgacccaattcccttggagcccgtttccttc

SEQ ID NO: 112939 - DNA, 35 bp, Artificial Sequence
  Synthetic oligonucleotide
agccccatccccccctccgatcaagattagcggag

SEQ ID NO: 112940 - DNA, 35 bp, Artificial Sequence
  Synthetic oligonucleotide
tgactccccccatgttttaatccctcggtcggtct

SEQ ID NO: 112941 - DNA, 37 bp, Artificial Sequence
  Synthetic oligonucleotide
gtcacccccatctagtcttatgcacctcttctcccga

SEQ ID NO: 112942 - DNA, 37 bp, Artificial Sequence
  Synthetic oligonucleotide
gctggagggtaattcggtggggcggctgtggatccga

SEQ ID NO: 112943 - DNA, 37 bp, Artificial Sequence
  Synthetic oligonucleotide
agtcgatcgcccctttcggttctaagcccctccctga

SEQ ID NO: 112944 - DNA, 36 bp, Artificial Sequence
  Synthetic oligonucleotide
tacagacagggggattgtgggacgggaggaaggggg

SEQ ID NO: 112945 - DNA, 35 bp, Artificial Sequence
  Synthetic oligonucleotide
aacatcctcggctccgtgacacactgcccgctcca

SEQ ID NO: 112946 - DNA, 37 bp, Artificial Sequence
  Synthetic oligonucleotide
tcaccccgccctttctccccagtcccgctaaggtcga

SEQ ID NO: 112947 - DNA, 37 bp, Artificial Sequence
  Synthetic oligonucleotide
atggggaccaggaaaaggggaaaagggctgaatggga

SEQ ID NO: 112948 - DNA, 37 bp, Artificial Sequence
  Synthetic oligonucleotide
atgtgaggggccgaagtggagggagtgggtggtatga

SEQ ID NO: 112949 - DNA, 38 bp, Artificial Sequence
  Synthetic oligonucleotide
ttccgcctcactgtcccatatttcctgtccgtttctga

SEQ ID NO: 112950 - DNA, 35 bp, Artificial Sequence
  Synthetic oligonucleotide
agacgccactgccacgagatccactgtctaccccc

SEQ ID NO: 112951 - DNA, 35 bp, Artificial Sequence
  Synthetic oligonucleotide
atgcccgcccgccgtcttttcacttccacatcgca

SEQ ID NO: 112952 - DNA, 35 bp, Artificial Sequence
  Synthetic oligonucleotide
tcagccactgcccccctggttggttttttttttcc

SEQ ID NO: 112953 - DNA, 35 bp, Artificial Sequence
  Synthetic oligonucleotide
gtccctctccgccgcttggtttattttcgtagcca

SEQ ID NO: 112954 - DNA, 35 bp, Artificial Sequence
  Synthetic oligonucleotide
tccgggctcgaccatcttccccgctctaccgtggt

SEQ ID NO: 112955 - DNA, 37 bp, Artificial Sequence
  Synthetic oligonucleotide
agtacgcccacttgcccagcccgatccgcctcttcga

SEQ ID NO: 112956 - DNA, 37 bp, Artificial Sequence
  Synthetic oligonucleotide
agggacgagggaaggggcaggggagagattgcacgga

SEQ ID NO: 112957 - DNA, 35 bp, Artificial Sequence
  Synthetic oligonucleotide
accttgccctcaaccctcgccttccgatgccattg

SEQ ID NO: 112958 - DNA, 35 bp, Artificial Sequence
  Synthetic oligonucleotide
gagcggtcgtggagctgtaccctctgctgccttcc

SEQ ID NO: 112959 - DNA, 35 bp, Artificial Sequence
  Synthetic oligonucleotide
gccacacagaccggtcctgactccctttcttatcg

SEQ ID NO: 112960 - DNA, 35 bp, Artificial Sequence
  Synthetic oligonucleotide
accgcccgctgattctgcttcaacctaccgtacgt

SEQ ID NO: 112961 - DNA, 36 bp, Artificial Sequence
  Synthetic oligonucleotide
tctctgggagggaaggggaaacggggggaggactca

SEQ ID NO: 112962 - DNA, 37 bp, Artificial Sequence
  Synthetic oligonucleotide
tatgggggcctaaggggcggggctgtccttcagggga

SEQ ID NO: 112963 - DNA, 38 bp, Artificial Sequence
  Synthetic oligonucleotide
tcccgatccatcaccgtttaagctctcgtccggcctga

SEQ ID NO: 112964 - DNA, 35 bp, Artificial Sequence
  Synthetic oligonucleotide
gtgagccgcccgagctctagtaataacccctctgc

SEQ ID NO: 112965 - DNA, 37 bp, Artificial Sequence
  Synthetic oligonucleotide
tgaggagtgggaggggaagggaggccctagacaacga

SEQ ID NO: 112966 - DNA, 37 bp, Artificial Sequence
  Synthetic oligonucleotide
gttgcatcatgagctccccacccgccactctctcgga

SEQ ID NO: 112967 - DNA, 36 bp, Artificial Sequence
  Synthetic oligonucleotide
tcctggccccactcgatcccgccttccatgcgattc

SEQ ID NO: 112968 - DNA, 35 bp, Artificial Sequence
  Synthetic oligonucleotide
tcctcggtgacgtcactctacgcccgcccctctcg

SEQ ID NO: 112969 - DNA, 35 bp, Artificial Sequence
  Synthetic oligonucleotide
gcaaggaggtgggcgtaggaaaagggcggtgggaa

SEQ ID NO: 112970 - DNA, 35 bp, Artificial Sequence
  Synthetic oligonucleotide
gctcccacacatgctctgttactgattcctccgca

SEQ ID NO: 112971 - DNA, 37 bp, Artificial Sequence
  Synthetic oligonucleotide
gatgtaggggaggatgggacgagtggtggggcgtgga

SEQ ID NO: 112972 - DNA, 36 bp, Artificial Sequence
  Synthetic oligonucleotide
gtgagtgagagcgggggagggaaccagggaggatga

SEQ ID NO: 112973 - DNA, 36 bp, Artificial Sequence
  Synthetic oligonucleotide
gcccacgcatcttgcgtgttattcactcatctccta

SEQ ID NO: 112974 - DNA, 35 bp, Artificial Sequence
  Synthetic oligonucleotide
gttcacgccccacctttcggacaacacagctcctc

SEQ ID NO: 112975 - DNA, 36 bp, Artificial Sequence
  Synthetic oligonucleotide
gtcacattcaacgatcctggcccctgttctccgctc

SEQ ID NO: 112976 - DNA, 34 bp, Artificial Sequence
  Synthetic oligonucleotide
tcaccccgccccggatagttcaacaaccgtacat

SEQ ID NO: 112977 - DNA, 35 bp, Artificial Sequence
  Synthetic oligonucleotide
cgacatccaccccctaattgtccgactgcttacac

SEQ ID NO: 112978 - DNA, 34 bp, Artificial Sequence
  Synthetic oligonucleotide
gctacccacgccattgtctgctcccttcgctaat

SEQ ID NO: 112979 - DNA, 35 bp, Artificial Sequence
  Synthetic oligonucleotide
acaccatccttgccgctcgatatcgttcacttgcc

SEQ ID NO: 112980 - DNA, 35 bp, Artificial Sequence
  Synthetic oligonucleotide
aacattgccctcgccctgtaagagtgcacaccacc

SEQ ID NO: 112981 - DNA, 35 bp, Artificial Sequence
  Synthetic oligonucleotide
tccaaccgccgctgttcccgtgcctattagttttt

SEQ ID NO: 112982 - DNA, 35 bp, Artificial Sequence
  Synthetic oligonucleotide
gcacagatccgcccgttcgaccgaagcccgtcccc

SEQ ID NO: 112983 - DNA, 35 bp, Artificial Sequence
  Synthetic oligonucleotide
gagggatagggggagggcggaaacgggcgtgataa

SEQ ID NO: 112984 - DNA, 37 bp, Artificial Sequence
  Synthetic oligonucleotide
gcacttgggtggagggggcggtgggcggaaaggagga

SEQ ID NO: 112985 - DNA, 37 bp, Artificial Sequence
  Synthetic oligonucleotide
aggacaacccgatcggcatactgctcccttctcccga

SEQ ID NO: 112986 - DNA, 38 bp, Artificial Sequence
  Synthetic oligonucleotide
gaggggggggaggtggtgctggggccatgagaaggtga

SEQ ID NO: 112987 - DNA, 35 bp, Artificial Sequence
  Synthetic oligonucleotide
gacttgtcccctgtagcacgtacaccctctcttgc

SEQ ID NO: 112988 - DNA, 37 bp, Artificial Sequence
  Synthetic oligonucleotide
gccgcggcgcaagggtgggtggtgggcggcgggggga

SEQ ID NO: 112989 - DNA, 35 bp, Artificial Sequence
  Synthetic oligonucleotide
tccatgcgcagtgccatgtcatccttcgtcttatc

SEQ ID NO: 112990 - DNA, 28 bp, Artificial Sequence
  Synthetic oligonucleotide
atctcaccacattggaacctgtcaccat

SEQ ID NO: 112991 - DNA, 37 bp, Artificial Sequence
  Synthetic oligonucleotide
attgggcgggaggagggggtgtggggggccgaaatga

SEQ ID NO: 112992 - DNA, 38 bp, Artificial Sequence
  Synthetic oligonucleotide
gtggcccctccctttgaatgcgctatcctccccggtga

SEQ ID NO: 112993 - DNA, 35 bp, Artificial Sequence
  Synthetic oligonucleotide
aaccccccctctacccgcctgttgacaggggtgcc

SEQ ID NO: 112994 - DNA, 35 bp, Artificial Sequence
  Synthetic oligonucleotide
ttatccatcatcgcgctgtgtatgttctccaccgt

SEQ ID NO: 112995 - DNA, 36 bp, Artificial Sequence
  Synthetic oligonucleotide
tcccttcgcgcccacatcttccacgcacttcccgta

SEQ ID NO: 112996 - DNA, 35 bp, Artificial Sequence
  Synthetic oligonucleotide
gttcgccgttccatctatgccagccagccacgtta

SEQ ID NO: 112997 - DNA, 35 bp, Artificial Sequence
  Synthetic oligonucleotide
gtgtcccgcctccgaccttgcacggccccaccctt

SEQ ID NO: 112998 - DNA, 36 bp, Artificial Sequence
  Synthetic oligonucleotide
atacacaccatcttgtcccgctcaccaggcccttga

SEQ ID NO: 112999 - DNA, 35 bp, Artificial Sequence
  Synthetic oligonucleotide
tacgcccttcctgcattgacgcctcactggtttga

SEQ ID NO: 113000 - DNA, 35 bp, Artificial Sequence
  Synthetic oligonucleotide
gactggacatcagttgcagctcgtttctcttcgcc

SEQ ID NO: 113001 - DNA, 35 bp, Artificial Sequence
  Synthetic oligonucleotide
acctgcccgcctgcccttcgtcattctgtcgcaat

SEQ ID NO: 113002 - DNA, 35 bp, Artificial Sequence
  Synthetic oligonucleotide
gtgttccctcatgtatgccattctaagtccgccct

SEQ ID NO: 113003 - DNA, 38 bp, Artificial Sequence
  Synthetic oligonucleotide
gatgacgctcatgtcgttgatacctccccgtgccttga

SEQ ID NO: 113004 - DNA, 35 bp, Artificial Sequence
  Synthetic oligonucleotide
gctcacccgggcagtgtttatcgcctaccctgcac

SEQ ID NO: 113005 - DNA, 35 bp, Artificial Sequence
  Synthetic oligonucleotide
tcaagcggatccacccgccgcctgttttatctcgc

SEQ ID NO: 113006 - DNA, 35 bp, Artificial Sequence
  Synthetic oligonucleotide
gcaagcccgccccttcctattgagtgatttgcctc

SEQ ID NO: 113007 - DNA, 35 bp, Artificial Sequence
  Synthetic oligonucleotide
tgccccgttgtcctggcctcatcacatgcactctc

SEQ ID NO: 113008 - DNA, 35 bp, Artificial Sequence
  Synthetic oligonucleotide
gtgttcgcccccgatctaaatcgtgtctcttctca

SEQ ID NO: 113009 - DNA, 35 bp, Artificial Sequence
  Synthetic oligonucleotide
ttcggaacggcaatccacggcccatccacacttcc

SEQ ID NO: 113010 - DNA, 37 bp, Artificial Sequence
  Synthetic oligonucleotide
gagtgggagggggtgttagaacacgggcaatagggga

SEQ ID NO: 113011 - DNA, 35 bp, Artificial Sequence
  Synthetic oligonucleotide
tgcatgggtccggccgtcgcgcccgttttgccccc

SEQ ID NO: 113012 - DNA, 37 bp, Artificial Sequence
  Synthetic oligonucleotide
tgatcttactgactgtagcctccaccttccccccgga

SEQ ID NO: 113013 - DNA, 35 bp, Artificial Sequence
  Synthetic oligonucleotide
gtgcactgcgcagtcatttatcatctcgttccttc

SEQ ID NO: 113014 - DNA, 35 bp, Artificial Sequence
  Synthetic oligonucleotide
ttagcggcatcctcccttttagtgcctcgttctat

SEQ ID NO: 113015 - DNA, 35 bp, Artificial Sequence
  Synthetic oligonucleotide
gtctcccgcctgctgcccatggcgatactccccaa

SEQ ID NO: 113016 - DNA, 36 bp, Artificial Sequence
  Synthetic oligonucleotide
atccgcccgcccacttctgatatcgctcttagaaca

SEQ ID NO: 113017 - DNA, 35 bp, Artificial Sequence
  Synthetic oligonucleotide
gccgctcattgtttcgttacttcccccccgttgtg

SEQ ID NO: 113018 - DNA, 36 bp, Artificial Sequence
  Synthetic oligonucleotide
gccaaaccagctggtttcgaaccccaccatctccca

SEQ ID NO: 113019 - DNA, 36 bp, Artificial Sequence
  Synthetic oligonucleotide
gtactcccggcccccactcgatccgcccgttccgta

SEQ ID NO: 113020 - DNA, 35 bp, Artificial Sequence
  Synthetic oligonucleotide
gataccctgcccgcatgacgctacgacctcactat

SEQ ID NO: 113021 - DNA, 35 bp, Artificial Sequence
  Synthetic oligonucleotide
tcgacccgccccgttctccccatttgaaggccatt

SEQ ID NO: 113022 - DNA, 37 bp, Artificial Sequence
  Synthetic oligonucleotide
gtgtggggagggcgggaacggggcgtgctgaatcgga

SEQ ID NO: 113023 - DNA, 35 bp, Artificial Sequence
  Synthetic oligonucleotide
agaacggacggagggggaatggtcaggaacggcat

SEQ ID NO: 113024 - DNA, 35 bp, Artificial Sequence
  Synthetic oligonucleotide
accccacggggccttttcgtacattgtcctatcct

SEQ ID NO: 113025 - DNA, 36 bp, Artificial Sequence
  Synthetic oligonucleotide
gtgtcgcacccgcgtgtttttatcccgttttttgaa

SEQ ID NO: 113026 - DNA, 36 bp, Artificial Sequence
  Synthetic oligonucleotide
actccaccccacgtcagttcgtcaaacccggcctca

SEQ ID NO: 113027 - DNA, 37 bp, Artificial Sequence
  Synthetic oligonucleotide
tcaccgccctccactgtagttctcggctttagcacga

SEQ ID NO: 113028 - DNA, 35 bp, Artificial Sequence
  Synthetic oligonucleotide
tattgcccgcctctcaacacatgtacacctcctgt

SEQ ID NO: 113029 - DNA, 36 bp, Artificial Sequence
  Synthetic oligonucleotide
ttatgcacgtcaatcctgggccgccaccccgctcca

SEQ ID NO: 113030 - DNA, 35 bp, Artificial Sequence
  Synthetic oligonucleotide
tcaaacccgccgcacgccatgcaacctcacttcat

SEQ ID NO: 113031 - DNA, 36 bp, Artificial Sequence
  Synthetic oligonucleotide
tgccaatgcctgtcaatggtccttctcctcactgca

SEQ ID NO: 113032 - DNA, 36 bp, Artificial Sequence
  Synthetic oligonucleotide
accccagccgattgaactgctgcccccaccctatga

SEQ ID NO: 113033 - DNA, 35 bp, Artificial Sequence
  Synthetic oligonucleotide
atgctaccgccgatactttcgtgaaccgcttttcc

SEQ ID NO: 113034 - DNA, 35 bp, Artificial Sequence
  Synthetic oligonucleotide
gagcaccttccttgtcgagccttgcccatatctct

SEQ ID NO: 113035 - DNA, 35 bp, Artificial Sequence
  Synthetic oligonucleotide
gccccaccccttccgctgccgagtacttgacagga

SEQ ID NO: 113036 - DNA, 36 bp, Artificial Sequence
  Synthetic oligonucleotide
atgtccctcgccacattactgagagtccccctccta

SEQ ID NO: 113037 - DNA, 35 bp, Artificial Sequence
  Synthetic oligonucleotide
tctcaacgcggtgttccaacgcccctcgactttcc

SEQ ID NO: 113038 - DNA, 35 bp, Artificial Sequence
  Synthetic oligonucleotide
gccgcgtgccgccgctacgtatcatggcctacctc

SEQ ID NO: 113039 - DNA, 35 bp, Artificial Sequence
  Synthetic oligonucleotide
acccctgcctttaactgctctgccccgagatctct

SEQ ID NO: 113040 - DNA, 35 bp, Artificial Sequence
  Synthetic oligonucleotide
agcccccccctggcctgctcgacgctacgttaccc

SEQ ID NO: 113041 - DNA, 35 bp, Artificial Sequence
  Synthetic oligonucleotide
tgatcgccctgcctcttgattcctttactcgattc

SEQ ID NO: 113042 - DNA, 35 bp, Artificial Sequence
  Synthetic oligonucleotide
gtcgactttccctattgtgcattcgcctcgccccc

SEQ ID NO: 113043 - DNA, 35 bp, Artificial Sequence
  Synthetic oligonucleotide
tactaacggcacctcgcgcgtccaacccgttcctt

SEQ ID NO: 113044 - DNA, 36 bp, Artificial Sequence
  Synthetic oligonucleotide
acgaactaggaggtaaaggcggggggggcggaggga

SEQ ID NO: 113045 - DNA, 35 bp, Artificial Sequence
  Synthetic oligonucleotide
atccctccatcccaggccttgaacaggacaacgta

SEQ ID NO: 113046 - DNA, 35 bp, Artificial Sequence
  Synthetic oligonucleotide
tcttacctagccccggcactgattctgttcatcac

SEQ ID NO: 113047 - DNA, 35 bp, Artificial Sequence
  Synthetic oligonucleotide
tgcatctctggtccttttcaccggcgctcgctctc

SEQ ID NO: 113048 - DNA, 35 bp, Artificial Sequence
  Synthetic oligonucleotide
tacgtccacgctcctggcccttctatcgtatctcg

SEQ ID NO: 113049 - DNA, 35 bp, Artificial Sequence
  Synthetic oligonucleotide
tttgcactcgcccgccatcgcccgtatccaactat

SEQ ID NO: 113050 - DNA, 35 bp, Artificial Sequence
  Synthetic oligonucleotide
tctcgtacgccccacgcattggtactgccttaact

SEQ ID NO: 113051 - DNA, 35 bp, Artificial Sequence
  Synthetic oligonucleotide
cccgtcacagccactgtcctgtctgccttccactg

SEQ ID NO: 113052 - DNA, 37 bp, Artificial Sequence
  Synthetic oligonucleotide
atgggagggcaggggggggattaggtgacgtgggtga

SEQ ID NO: 113053 - DNA, 38 bp, Artificial Sequence
  Synthetic oligonucleotide
acgtccaacgccccttgatctgttccctccacttgtga

SEQ ID NO: 113054 - DNA, 36 bp, Artificial Sequence
  Synthetic oligonucleotide
gacatcctgctattgtttagtacctccgcttcctta

SEQ ID NO: 113055 - DNA, 35 bp, Artificial Sequence
  Synthetic oligonucleotide
tcgcacggtgccacggttcaaatcatgctgccccc

SEQ ID NO: 113056 - DNA, 36 bp, Artificial Sequence
  Synthetic oligonucleotide
aatcccgtgtccctgtggttgccctcccctcgccga

SEQ ID NO: 113057 - DNA, 38 bp, Artificial Sequence
  Synthetic oligonucleotide
gtcaccgcacggtgcttagtgtttcgtttccctgctga

SEQ ID NO: 113058 - DNA, 36 bp, Artificial Sequence
  Synthetic oligonucleotide
gccaccttagcctacggaccaactgctttgctttgc

SEQ ID NO: 113059 - DNA, 35 bp, Artificial Sequence
  Synthetic oligonucleotide
gtagcacacatgagctctacaaccgacctcctcct

SEQ ID NO: 113060 - DNA, 35 bp, Artificial Sequence
  Synthetic oligonucleotide
tccactcatcgatccctattggtgcatgcttcctc

SEQ ID NO: 113061 - DNA, 37 bp, Artificial Sequence
  Synthetic oligonucleotide
gtgccggaagggcgtattctaacgggcgggagggaga

SEQ ID NO: 113062 - DNA, 35 bp, Artificial Sequence
  Synthetic oligonucleotide
tccccgcgcgcctcccacagcttaatgtcatccac

SEQ ID NO: 113063 - DNA, 37 bp, Artificial Sequence
  Synthetic oligonucleotide
acgtagacaaggaaggtggaggaggggatcaaaggga

SEQ ID NO: 113064 - DNA, 35 bp, Artificial Sequence
  Synthetic oligonucleotide
aggacaccgccttgttttgtcctccgcccccaata

SEQ ID NO: 113065 - DNA, 35 bp, Artificial Sequence
  Synthetic oligonucleotide
accccccggccttgtactgtaatctgcattccaac

SEQ ID NO: 113066 - DNA, 37 bp, Artificial Sequence
  Synthetic oligonucleotide
gcgagagccggcaggggaggggttgggggtggaagga

SEQ ID NO: 113067 - DNA, 36 bp, Artificial Sequence
  Synthetic oligonucleotide
gccccgccggttatcgataccctggtccgccaccta

SEQ ID NO: 113068 - DNA, 37 bp, Artificial Sequence
  Synthetic oligonucleotide
gtcgccccgcccttcctccttttgcccagcatgttga

SEQ ID NO: 113069 - DNA, 35 bp, Artificial Sequence
  Synthetic oligonucleotide
tgtctcaatcccaggctgatccgtcctcttcactg

SEQ ID NO: 113070 - DNA, 35 bp, Artificial Sequence
  Synthetic oligonucleotide
tccctcgccgcgctgacccatgcgttcttcactca

SEQ ID NO: 113071 - DNA, 36 bp, Artificial Sequence
  Synthetic oligonucleotide
gtacatcggcacatcccgctttccctgccagtctca

SEQ ID NO: 113072 - DNA, 36 bp, Artificial Sequence
  Synthetic oligonucleotide
ggacactcacccttgcgttaggacccttctctccaa

SEQ ID NO: 113073 - DNA, 37 bp, Artificial Sequence
  Synthetic oligonucleotide
tgagagggaaaagggcggtaaagcgcgaacgggagga

SEQ ID NO: 113074 - DNA, 35 bp, Artificial Sequence
  Synthetic oligonucleotide
ttcatagggggggccaaggggggacgggagacgga

SEQ ID NO: 113075 - DNA, 35 bp, Artificial Sequence
  Synthetic oligonucleotide
taccccccgcccttatcgcacgcctagcctggtcg

SEQ ID NO: 113076 - DNA, 35 bp, Artificial Sequence
  Synthetic oligonucleotide
tccacctcgacccagaccgtgttactcctttcgtg

SEQ ID NO: 113077 - DNA, 35 bp, Artificial Sequence
  Synthetic oligonucleotide
gtcgccctctctgttcatggtcgttctcccttatt

SEQ ID NO: 113078 - DNA, 36 bp, Artificial Sequence
  Synthetic oligonucleotide
gtgccgggggaagagggtcagaaggatcggaaagaa

SEQ ID NO: 113079 - DNA, 37 bp, Artificial Sequence
  Synthetic oligonucleotide
aatgaacaggggcgggggggagttagggcgttgccga

SEQ ID NO: 113080 - DNA, 38 bp, Artificial Sequence
  Synthetic oligonucleotide
tgtggacggggaggggataaaacgaggggggaaattga

SEQ ID NO: 113081 - DNA, 35 bp, Artificial Sequence
  Synthetic oligonucleotide
tcgccccgcccccaggcccctgtgcttccctttga

SEQ ID NO: 113082 - DNA, 35 bp, Artificial Sequence
  Synthetic oligonucleotide
agtcaccttccagccttccctgccgtatcgtacac

SEQ ID NO: 113083 - DNA, 35 bp, Artificial Sequence
  Synthetic oligonucleotide
tctccgcaccaatgtaccagccatgtctttccccc

SEQ ID NO: 113084 - DNA, 35 bp, Artificial Sequence
  Synthetic oligonucleotide
tacgcacatgtagtctcccagcccctgtacttctc

SEQ ID NO: 113085 - DNA, 36 bp, Artificial Sequence
  Synthetic oligonucleotide
tgctcctcccatggctatcgctcgctcccccctcca

SEQ ID NO: 113086 - DNA, 37 bp, Artificial Sequence
  Synthetic oligonucleotide
gaagaggggatgatagggcagggaggggcacaaccga

SEQ ID NO: 113087 - DNA, 37 bp, Artificial Sequence
  Synthetic oligonucleotide
aggtcacactccctatagttgcctcgcctctgcccga

SEQ ID NO: 113088 - DNA, 36 bp, Artificial Sequence
  Synthetic oligonucleotide
acgcacttcccgcctcggtttttcgatccatcgcca

SEQ ID NO: 113089 - DNA, 35 bp, Artificial Sequence
  Synthetic oligonucleotide
taaccgcagatcgttgctttccgctcccctaccgt

SEQ ID NO: 113090 - DNA, 36 bp, Artificial Sequence
  Synthetic oligonucleotide
tcacatgatcgcatgtgagttagcccttccctgcca

SEQ ID NO: 113091 - DNA, 25 bp, Artificial Sequence
  Synthetic oligonucleotide
accccccctgccgtttacgcaacga

SEQ ID NO: 113092 - DNA, 36 bp, Artificial Sequence
  Synthetic oligonucleotide
gataccaccacatgtgcacgcatcctctcctgaata

SEQ ID NO: 113093 - DNA, 35 bp, Artificial Sequence
  Synthetic oligonucleotide
gattgccccacctgcctgttatctggtatcagctc

SEQ ID NO: 113094 - DNA, 35 bp, Artificial Sequence
  Synthetic oligonucleotide
tgcgcaacctccctctgcttacgtcgccatgaccg

SEQ ID NO: 113095 - DNA, 35 bp, Artificial Sequence
  Synthetic oligonucleotide
tccttcgcggcaattcgtccaccgtccgccatcca

SEQ ID NO: 113096 - DNA, 36 bp, Artificial Sequence
  Synthetic oligonucleotide
agctgcccccgcgtgcctccgttccccacggttcca

SEQ ID NO: 113097 - DNA, 36 bp, Artificial Sequence
  Synthetic oligonucleotide
tgatccgccctctctggcttgcccctgtttcacata

SEQ ID NO: 113098 - DNA, 35 bp, Artificial Sequence
  Synthetic oligonucleotide
acgcccatccagttttcatcatacaccatgcacat

SEQ ID NO: 113099 - DNA, 35 bp, Artificial Sequence
  Synthetic oligonucleotide
ttccgcgccatcgcccagcctatttgcactttctt

SEQ ID NO: 113100 - DNA, 36 bp, Artificial Sequence
  Synthetic oligonucleotide
tccagctcagctctttcatcatcacgctttctgcca

SEQ ID NO: 113101 - DNA, 37 bp, Artificial Sequence
  Synthetic oligonucleotide
ttagcgcccctgaacctgctgacctccctgctatcga

SEQ ID NO: 113102 - DNA, 35 bp, Artificial Sequence
  Synthetic oligonucleotide
tccggatgacgcactttttctgtatcctctctgtc

SEQ ID NO: 113103 - DNA, 35 bp, Artificial Sequence
  Synthetic oligonucleotide
gtcccatcgagcgttgtggtcctgttctcgcttct

SEQ ID NO: 113104 - DNA, 35 bp, Artificial Sequence
  Synthetic oligonucleotide
tacaccgccgtatagttccaacgcccccacccgtt

SEQ ID NO: 113105 - DNA, 36 bp, Artificial Sequence
  Synthetic oligonucleotide
ttgcgcacccctccggcattcaagcccctctcctga

SEQ ID NO: 113106 - DNA, 35 bp, Artificial Sequence
  Synthetic oligonucleotide
aacgcccgatccgcctctcgaatgtcccctgctat

SEQ ID NO: 113107 - DNA, 35 bp, Artificial Sequence
  Synthetic oligonucleotide
tacgtagcccgccattccacacgtccacatcccgt

SEQ ID NO: 113108 - DNA, 38 bp, Artificial Sequence
  Synthetic oligonucleotide
tagcccaccacctatgcactcggtcgcctgattcatga

SEQ ID NO: 113109 - DNA, 35 bp, Artificial Sequence
  Synthetic oligonucleotide
atcggacacccttcaatcgcgctttgtcccccaac

SEQ ID NO: 113110 - DNA, 35 bp, Artificial Sequence
  Synthetic oligonucleotide
gacgcctcgtcctatactctatagtccaccatccg

SEQ ID NO: 113111 - DNA, 35 bp, Artificial Sequence
  Synthetic oligonucleotide
tgtgtgcagtcaactcgtcttcttgccctacctgt

SEQ ID NO: 113112 - DNA, 36 bp, Artificial Sequence
  Synthetic oligonucleotide
gcgccttcccactggtcctccccgctcccgctggca

SEQ ID NO: 113113 - DNA, 36 bp, Artificial Sequence
  Synthetic oligonucleotide
tctaccccgtctgcatgcctcattcctcgcccttca

SEQ ID NO: 113114 - DNA, 36 bp, Artificial Sequence
  Synthetic oligonucleotide
tccctgtcctcctcttgcttacgctgccatcactga

SEQ ID NO: 113115 - DNA, 37 bp, Artificial Sequence
  Synthetic oligonucleotide
gcgatggggagcttgctaagggaggggaaggggttga

SEQ ID NO: 113116 - DNA, 36 bp, Artificial Sequence
  Synthetic oligonucleotide
gcacccgccccgttatttctggagtcctatcaccta

SEQ ID NO: 113117 - DNA, 35 bp, Artificial Sequence
  Synthetic oligonucleotide
ttggatcccgccccaagccatacgttcatcccctc

SEQ ID NO: 113118 - DNA, 35 bp, Artificial Sequence
  Synthetic oligonucleotide
gagatacgcccccctggtttttcagccctgccact

SEQ ID NO: 113119 - DNA, 37 bp, Artificial Sequence
  Synthetic oligonucleotide
gttacgggtgggtggggataattcacgactcagggga

SEQ ID NO: 113120 - DNA, 35 bp, Artificial Sequence
  Synthetic oligonucleotide
gccaacatcccgacatacaaactaccacgctccgc

SEQ ID NO: 113121 - DNA, 35 bp, Artificial Sequence
  Synthetic oligonucleotide
gtccatccatccttgcgttacgcacacgtgtacca

SEQ ID NO: 113122 - DNA, 36 bp, Artificial Sequence
  Synthetic oligonucleotide
atccactcgtcattcgttgcgctcccccgtggtcca

SEQ ID NO: 113123 - DNA, 36 bp, Artificial Sequence
  Synthetic oligonucleotide
tcctgtcacccaccagctgcccaccaccgctccata

SEQ ID NO: 113124 - DNA, 35 bp, Artificial Sequence
  Synthetic oligonucleotide
tccccctcgcttaggcgatttccgagccccctacc

SEQ ID NO: 113125 - DNA, 38 bp, Artificial Sequence
  Synthetic oligonucleotide
atgggggggacgggagggtgctaggacaggacccatga

SEQ ID NO: 113126 - DNA, 35 bp, Artificial Sequence
  Synthetic oligonucleotide
gcgtgcctcgccgttgccccgttactttatggttc

SEQ ID NO: 113127 - DNA, 37 bp, Artificial Sequence
  Synthetic oligonucleotide
gactggagagggagcggggctaaaggaggcaaaggga

SEQ ID NO: 113128 - DNA, 36 bp, Artificial Sequence
  Synthetic oligonucleotide
gctcaggcctacgtttgcctacgatccaccccctga

SEQ ID NO: 113129 - DNA, 35 bp, Artificial Sequence
  Synthetic oligonucleotide
gccccgcacctctcttcacgtcgtttaactttcta

SEQ ID NO: 113130 - DNA, 35 bp, Artificial Sequence
  Synthetic oligonucleotide
tagccccccccgatgtgcagcgtgcggttcaccat

SEQ ID NO: 113131 - DNA, 35 bp, Artificial Sequence
  Synthetic oligonucleotide
aacgggggggtcgggcaacgggggcataggaaagt

SEQ ID NO: 113132 - DNA, 35 bp, Artificial Sequence
  Synthetic oligonucleotide
tgccatcctcccccctctactgtactgcataggac

SEQ ID NO: 113133 - DNA, 35 bp, Artificial Sequence
  Synthetic oligonucleotide
agttcaggtccatcctggtctcatctacctcctac

SEQ ID NO: 113134 - DNA, 35 bp, Artificial Sequence
  Synthetic oligonucleotide
agagggagtgcggcaatagagaggggggggtggct

SEQ ID NO: 113135 - DNA, 35 bp, Artificial Sequence
  Synthetic oligonucleotide
gactcacccttgtactcgcgtattgccctcgcctt

SEQ ID NO: 113136 - DNA, 35 bp, Artificial Sequence
  Synthetic oligonucleotide
gacacacgcgcgactcctgcctgctcacccgatac

SEQ ID NO: 113137 - DNA, 35 bp, Artificial Sequence
  Synthetic oligonucleotide
gacgcggtcagttcccgcccctctgtctggtttcc

SEQ ID NO: 113138 - DNA, 35 bp, Artificial Sequence
  Synthetic oligonucleotide
tgcgctagcctcgccgtccgttaacctcgattttc

SEQ ID NO: 113139 - DNA, 35 bp, Artificial Sequence
  Synthetic oligonucleotide
acacgccctccatgccattctttatctgtgcccgc

SEQ ID NO: 113140 - DNA, 37 bp, Artificial Sequence
  Synthetic oligonucleotide
gagtgcgtgcatgggtgggggggcactgggacatcga

SEQ ID NO: 113141 - DNA, 35 bp, Artificial Sequence
  Synthetic oligonucleotide
tccgcccccaggcggtccccgatgactccgcatta

SEQ ID NO: 113142 - DNA, 36 bp, Artificial Sequence
  Synthetic oligonucleotide
gcacccccaccccgtcccagcgtaactattacacgt

SEQ ID NO: 113143 - DNA, 35 bp, Artificial Sequence
  Synthetic oligonucleotide
gtccacgttcccacgctgtctcatttcctgttaaa

SEQ ID NO: 113144 - DNA, 35 bp, Artificial Sequence
  Synthetic oligonucleotide
actcccaccgtggccccgttttatacagtctatac

SEQ ID NO: 113145 - DNA, 35 bp, Artificial Sequence
  Synthetic oligonucleotide
tcgggacgcacccatttactgcctggcaacccccc

SEQ ID NO: 113146 - DNA, 35 bp, Artificial Sequence
  Synthetic oligonucleotide
tcaccaccttcgcgttcaatatcggcctgtaccct

SEQ ID NO: 113147 - DNA, 36 bp, Artificial Sequence
  Synthetic oligonucleotide
gcacagagttcagtcgctcatcgtacgctccaccca

SEQ ID NO: 113148 - DNA, 38 bp, Artificial Sequence
  Synthetic oligonucleotide
gtgcgccatcagatacccttgctcgccctacgccctga

SEQ ID NO: 113149 - DNA, 35 bp, Artificial Sequence
  Synthetic oligonucleotide
tctcgccccctctattatttaacggtggacacttc

SEQ ID NO: 113150 - DNA, 36 bp, Artificial Sequence
  Synthetic oligonucleotide
accaccatccgtttcttcattgacccttgctaggca

SEQ ID NO: 113151 - DNA, 36 bp, Artificial Sequence
  Synthetic oligonucleotide
gtccatccaccgtttattatgtccactctctattga

SEQ ID NO: 113152 - DNA, 35 bp, Artificial Sequence
  Synthetic oligonucleotide
gatctccgcctgcctgctatatcgaaccctgtgag

SEQ ID NO: 113153 - DNA, 38 bp, Artificial Sequence
  Synthetic oligonucleotide
tgagagccagggggaggggcggagaagggagccgttga

SEQ ID NO: 113154 - DNA, 35 bp, Artificial Sequence
  Synthetic oligonucleotide
ttccattgccgcacttggtgccgaatcgcccctcc

SEQ ID NO: 113155 - DNA, 35 bp, Artificial Sequence
  Synthetic oligonucleotide
tcgaacccctttatggcacctacaccgctcgccgc

SEQ ID NO: 113156 - DNA, 36 bp, Artificial Sequence
  Synthetic oligonucleotide
tctccgccgccgcccaatagttgcccccctcatcca

SEQ ID NO: 113157 - DNA, 36 bp, Artificial Sequence
  Synthetic oligonucleotide
aacaaggccagggtggggtacgtggggggtgcggca

SEQ ID NO: 113158 - DNA, 38 bp, Artificial Sequence
  Synthetic oligonucleotide
tacgatgcatccattgtccttatgcctactccccttga

SEQ ID NO: 113159 - DNA, 35 bp, Artificial Sequence
  Synthetic oligonucleotide
tccatccgctacaggcactattggcccttctttta

SEQ ID NO: 113160 - DNA, 38 bp, Artificial Sequence
  Synthetic oligonucleotide
tccgccctctgcccactatgttcgactccgcttcttga

SEQ ID NO: 113161 - DNA, 35 bp, Artificial Sequence
  Synthetic oligonucleotide
ttgcgaggaggaaacggggacaaggaggacgacta

SEQ ID NO: 113162 - DNA, 35 bp, Artificial Sequence
  Synthetic oligonucleotide
tgcgcgctctttcctgtccctgcgttgcccatacc

SEQ ID NO: 113163 - DNA, 35 bp, Artificial Sequence
  Synthetic oligonucleotide
agtgctaccccacacgcgattggtcatgctctacc

SEQ ID NO: 113164 - DNA, 35 bp, Artificial Sequence
  Synthetic oligonucleotide
tcgaccccgctgcacctgtaaccagccccacacat

SEQ ID NO: 113165 - DNA, 35 bp, Artificial Sequence
  Synthetic oligonucleotide
tagggagcatggggggcgggggagtagtggatgaa

SEQ ID NO: 113166 - DNA, 36 bp, Artificial Sequence
  Synthetic oligonucleotide
gcaccgccgtgatacctagtacctccgcctttccta

SEQ ID NO: 113167 - DNA, 35 bp, Artificial Sequence
  Synthetic oligonucleotide
taggaatgggttggggtggggagggtgtcattgac

SEQ ID NO: 113168 - DNA, 35 bp, Artificial Sequence
  Synthetic oligonucleotide
agagggaaaacgggcggggggatccgatcggggcg

SEQ ID NO: 113169 - DNA, 35 bp, Artificial Sequence
  Synthetic oligonucleotide
tccgccttagccgcaccgctgaacctcccatttgt

SEQ ID NO: 113170 - DNA, 35 bp, Artificial Sequence
  Synthetic oligonucleotide
gacggacgaggagagggtgggactagggatcaaaa

SEQ ID NO: 113171 - DNA, 35 bp, Artificial Sequence
  Synthetic oligonucleotide
tgcctgatcgccctgcctgacctgcgctttcacca

SEQ ID NO: 113172 - DNA, 36 bp, Artificial Sequence
  Synthetic oligonucleotide
actggtggctgggggggcggaatagcacaggacgga

SEQ ID NO: 113173 - DNA, 36 bp, Artificial Sequence
  Synthetic oligonucleotide
ttgtcacttccgcctgaatcttggccccacatccta

SEQ ID NO: 113174 - DNA, 35 bp, Artificial Sequence
  Synthetic oligonucleotide
gtcccgccatcccgcggttaccttactattggttc

SEQ ID NO: 113175 - DNA, 35 bp, Artificial Sequence
  Synthetic oligonucleotide
tcaacacgatcttgtctcttgcgcccggctccatc

SEQ ID NO: 113176 - DNA, 35 bp, Artificial Sequence
  Synthetic oligonucleotide
atcgccgacgcctactaagcgcgtattactcctct

SEQ ID NO: 113177 - DNA, 38 bp, Artificial Sequence
  Synthetic oligonucleotide
gggtaggtggatgggctctgggggagggcaccgtgtga

SEQ ID NO: 113178 - DNA, 35 bp, Artificial Sequence
  Synthetic oligonucleotide
tcaccgcccctccgcgactcctagtcttttagttt

SEQ ID NO: 113179 - DNA, 35 bp, Artificial Sequence
  Synthetic oligonucleotide
actcgcccccccttgtttgtcgtaccttttcaaac

SEQ ID NO: 113180 - DNA, 35 bp, Artificial Sequence
  Synthetic oligonucleotide
ttggagcacatgactgttcactcgtcgccttatcc

SEQ ID NO: 113181 - DNA, 35 bp, Artificial Sequence
  Synthetic oligonucleotide
gatacccacctcaatacttcgaccaccgatcctgc

SEQ ID NO: 113182 - DNA, 35 bp, Artificial Sequence
  Synthetic oligonucleotide
gacgcccctcatttctgtcctgccctccctgtacg

SEQ ID NO: 113183 - DNA, 35 bp, Artificial Sequence
  Synthetic oligonucleotide
attcgaccccgttccattgccttcccgcatagcct

SEQ ID NO: 113184 - DNA, 35 bp, Artificial Sequence
  Synthetic oligonucleotide
accaccgtgctgaatgccgctcgcttaacgccctt

SEQ ID NO: 113185 - DNA, 35 bp, Artificial Sequence
  Synthetic oligonucleotide
gttgggcccccgattggaaccgctcgcctttctcc

SEQ ID NO: 113186 - DNA, 35 bp, Artificial Sequence
  Synthetic oligonucleotide
aatcacccccccacgaattgtagtgccttgaacct

SEQ ID NO: 113187 - DNA, 35 bp, Artificial Sequence
  Synthetic oligonucleotide
tccccccgctgttcttcgtattctgccaatcaatt

SEQ ID NO: 113188 - DNA, 35 bp, Artificial Sequence
  Synthetic oligonucleotide
acttcccccagccccttaaccgtgtgctccatcca

SEQ ID NO: 113189 - DNA, 35 bp, Artificial Sequence
  Synthetic oligonucleotide
gcctcacctctgatgcgggccccatttcctctttg

SEQ ID NO: 113190 - DNA, 37 bp, Artificial Sequence
  Synthetic oligonucleotide
gcccgggcggggtgtcctaggggctcgtattagggga

SEQ ID NO: 113191 - DNA, 35 bp, Artificial Sequence
  Synthetic oligonucleotide
tgagcgcccgctagtctcatcgctgttatcgctcc

SEQ ID NO: 113192 - DNA, 35 bp, Artificial Sequence
  Synthetic oligonucleotide
tgtaccatcccactacatgcacggttcttcctgac

SEQ ID NO: 113193 - DNA, 35 bp, Artificial Sequence
  Synthetic oligonucleotide
gcaccgcccattattttatctggtccacttcatcc

SEQ ID NO: 113194 - DNA, 35 bp, Artificial Sequence
  Synthetic oligonucleotide
tccattcccgggccctcctttcctacaatgagact

SEQ ID NO: 113195 - DNA, 36 bp, Artificial Sequence
  Synthetic oligonucleotide
cccatccccgctcccgacgctgtcatcactgttcaa

SEQ ID NO: 113196 - DNA, 37 bp, Artificial Sequence
  Synthetic oligonucleotide
tcagccttccacatcgtgttctatcgctccctaccga

SEQ ID NO: 113197 - DNA, 35 bp, Artificial Sequence
  Synthetic oligonucleotide
ttgccccaccgcccactctgacctttctattgttg

SEQ ID NO: 113198 - DNA, 35 bp, Artificial Sequence
  Synthetic oligonucleotide
gagggggcaagggtggaggaggcgcaccgaaaaaa

SEQ ID NO: 113199 - DNA, 37 bp, Artificial Sequence
  Synthetic oligonucleotide
tcaccctgggttaacctgccactttgccactcctgga

SEQ ID NO: 113200 - DNA, 38 bp, Artificial Sequence
  Synthetic oligonucleotide
tggtaacgaggagggacgagggagggtgacggtgatga

SEQ ID NO: 113201 - DNA, 38 bp, Artificial Sequence
  Synthetic oligonucleotide
gcctcccttcccacgtgtatcctgcccgtcccgcttga

SEQ ID NO: 113202 - DNA, 35 bp, Artificial Sequence
  Synthetic oligonucleotide
tatgtcccagcctgccctgcttagttcagcttacc

SEQ ID NO: 113203 - DNA, 35 bp, Artificial Sequence
  Synthetic oligonucleotide
accacgacagccactgcttccactcccgctcctgc

SEQ ID NO: 113204 - DNA, 35 bp, Artificial Sequence
  Synthetic oligonucleotide
tgtaaaccgctctgtacctgccactctacgaaccg

SEQ ID NO: 113205 - DNA, 34 bp, Artificial Sequence
  Synthetic oligonucleotide
atgcctgccgtccattattccccactcctgcgaa

SEQ ID NO: 113206 - DNA, 37 bp, Artificial Sequence
  Synthetic oligonucleotide
gcagtcgcagcccttgatcctgccgctattccgccga

SEQ ID NO: 113207 - DNA, 35 bp, Artificial Sequence
  Synthetic oligonucleotide
gatggtagtgcaagggggggtgggacgatggtgga

SEQ ID NO: 113208 - DNA, 35 bp, Artificial Sequence
  Synthetic oligonucleotide
ttggcggacgcactttgctacctacccctgcccat

SEQ ID NO: 113209 - DNA, 36 bp, Artificial Sequence
  Synthetic oligonucleotide
gctccacctcgtcctactgcccgcctaatgccctga

SEQ ID NO: 113210 - DNA, 38 bp, Artificial Sequence
  Synthetic oligonucleotide
gactacactgctgtaatccgtgagcctcccttccttga

SEQ ID NO: 113211 - DNA, 35 bp, Artificial Sequence
  Synthetic oligonucleotide
gcttacctcccatggctgtttctttgtcactccta

SEQ ID NO: 113212 - DNA, 34 bp, Artificial Sequence
  Synthetic oligonucleotide
gtgtctgccccccgccgttatctctgcttgattt

SEQ ID NO: 113213 - DNA, 35 bp, Artificial Sequence
  Synthetic oligonucleotide
atcccccctgctagcccgcgtccgtactatcgcca

SEQ ID NO: 113214 - DNA, 36 bp, Artificial Sequence
  Synthetic oligonucleotide
tgcggccctccaatctgtctcatcttgttcgtttca

SEQ ID NO: 113215 - DNA, 37 bp, Artificial Sequence
  Synthetic oligonucleotide
ggagggggagactggaggcaggaaggtcggtcagaga

SEQ ID NO: 113216 - DNA, 35 bp, Artificial Sequence
  Synthetic oligonucleotide
tagagcaggcctgtctccgcttcatacctccgccg

SEQ ID NO: 113217 - DNA, 35 bp, Artificial Sequence
  Synthetic oligonucleotide
acaccctacagcctgtcactactcactacctctgg

SEQ ID NO: 113218 - DNA, 33 bp, Artificial Sequence
  Synthetic oligonucleotide
tgcacttcccgttgttttgcttctactgccact

SEQ ID NO: 113219 - DNA, 37 bp, Artificial Sequence
  Synthetic oligonucleotide
gttcgcatcccgacgccagatcccgccccatcctcga

SEQ ID NO: 113220 - DNA, 35 bp, Artificial Sequence
  Synthetic oligonucleotide
atcgtaaacgtccggcactgatatcactacctccg

SEQ ID NO: 113221 - DNA, 36 bp, Artificial Sequence
  Synthetic oligonucleotide
gtccaccccgatgctcgctttgccacattatttgaa

SEQ ID NO: 113222 - DNA, 37 bp, Artificial Sequence
  Synthetic oligonucleotide
tgtcgccatcaccagtggccccgtctccttcgctcga

SEQ ID NO: 113223 - DNA, 37 bp, Artificial Sequence
  Synthetic oligonucleotide
aaggggtgtggggtgggtaagtgccggggatatatga

SEQ ID NO: 113224 - DNA, 35 bp, Artificial Sequence
  Synthetic oligonucleotide
tccacctcccatgtttctgcaccagcccggggtga

SEQ ID NO: 113225 - DNA, 35 bp, Artificial Sequence
  Synthetic oligonucleotide
tatcgcctgcctgtgactccctttaccgtgctacc

SEQ ID NO: 113226 - DNA, 35 bp, Artificial Sequence
  Synthetic oligonucleotide
gccagacgtacactatcacgcgcttcttaatcctg

SEQ ID NO: 113227 - DNA, 36 bp, Artificial Sequence
  Synthetic oligonucleotide
acaccccaccctcgtattgtttagattcgcgtaaca

SEQ ID NO: 113228 - DNA, 38 bp, Artificial Sequence
  Synthetic oligonucleotide
tccgggcgtgacactgggcgggtgtgaatacggggtga

SEQ ID NO: 113229 - DNA, 35 bp, Artificial Sequence
  Synthetic oligonucleotide
gaagagaaggaggggatagtatgatgggggcgagt

SEQ ID NO: 113230 - DNA, 35 bp, Artificial Sequence
  Synthetic oligonucleotide
tctgtgtatcccggcctgccctccttaattccggt

SEQ ID NO: 113231 - DNA, 36 bp, Artificial Sequence
  Synthetic oligonucleotide
gatccgggatgggtgggtagggttgggctgtcgaca

SEQ ID NO: 113232 - DNA, 36 bp, Artificial Sequence
  Synthetic oligonucleotide
agcccacaccaccaatgcgtcagccactatcctaga

SEQ ID NO: 113233 - DNA, 37 bp, Artificial Sequence
  Synthetic oligonucleotide
gaagggggacgcgtgataggagggggaagggagtaga

SEQ ID NO: 113234 - DNA, 37 bp, Artificial Sequence
  Synthetic oligonucleotide
atgcccccgcccttgatcatcagcactcctttgtcga

SEQ ID NO: 113235 - DNA, 35 bp, Artificial Sequence
  Synthetic oligonucleotide
tacgaaccgccttcacatccgagcgtgcctttaac

SEQ ID NO: 113236 - DNA, 35 bp, Artificial Sequence
  Synthetic oligonucleotide
acaccccgttacggtacactagcccctccgcacat

SEQ ID NO: 113237 - DNA, 35 bp, Artificial Sequence
  Synthetic oligonucleotide
tgggaccactatcgtacatctgcccgccctttcgt

SEQ ID NO: 113238 - DNA, 38 bp, Artificial Sequence
  Synthetic oligonucleotide
tacgacaaaaggcagtggaaatgggggggcgggtgtga

SEQ ID NO: 113239 - DNA, 37 bp, Artificial Sequence
  Synthetic oligonucleotide
acacgacaggtgtatcacccgctgctccctttaccga

SEQ ID NO: 113240 - DNA, 37 bp, Artificial Sequence
  Synthetic oligonucleotide
tggggagtggcgttttccatcctagggcggtggggga

SEQ ID NO: 113241 - DNA, 36 bp, Artificial Sequence
  Synthetic oligonucleotide
tgactcctgtcaatccccgtgccctagctcctccta

SEQ ID NO: 113242 - DNA, 35 bp, Artificial Sequence
  Synthetic oligonucleotide
atacccctcgtacattgagtcactacctgcctgcc

SEQ ID NO: 113243 - DNA, 36 bp, Artificial Sequence
  Synthetic oligonucleotide
gcccatccccgccacatgcaccttacatgtagacaa

SEQ ID NO: 113244 - DNA, 37 bp, Artificial Sequence
  Synthetic oligonucleotide
tacggggcgaggggggggaggggaacttgatagttga

SEQ ID NO: 113245 - DNA, 35 bp, Artificial Sequence
  Synthetic oligonucleotide
atccgccccatctggttccgcatgaagcatagctc

SEQ ID NO: 113246 - DNA, 35 bp, Artificial Sequence
  Synthetic oligonucleotide
tcatcgtcgaaccgtcacccagctcccctgctttc

SEQ ID NO: 113247 - DNA, 35 bp, Artificial Sequence
  Synthetic oligonucleotide
gacctcgcgagtcgatgcgtcctcccctgttcctg

SEQ ID NO: 113248 - DNA, 38 bp, Artificial Sequence
  Synthetic oligonucleotide
accatcaccttctgccactctgcgttctccgccgctga

SEQ ID NO: 113249 - DNA, 35 bp, Artificial Sequence
  Synthetic oligonucleotide
gacgtccacttctccattgttcacctgtccactac

SEQ ID NO: 113250 - DNA, 35 bp, Artificial Sequence
  Synthetic oligonucleotide
tccgccgatgccacctgcgcactccccttgtgaca

SEQ ID NO: 113251 - DNA, 34 bp, Artificial Sequence
  Synthetic oligonucleotide
acattacccgactattccgccacacgcacattgc

SEQ ID NO: 113252 - DNA, 35 bp, Artificial Sequence
  Synthetic oligonucleotide
agcggggcgcaatctgtcatacctatccaccactc

SEQ ID NO: 113253 - DNA, 35 bp, Artificial Sequence
  Synthetic oligonucleotide
atccgccccactttccgaactgtttataccccccg

SEQ ID NO: 113254 - DNA, 38 bp, Artificial Sequence
  Synthetic oligonucleotide
tgccccgttcccccgctgcctaacctcccgcaccgtga

SEQ ID NO: 113255 - DNA, 35 bp, Artificial Sequence
  Synthetic oligonucleotide
tgcacccgtgtggtttaaccgcctcctcccttgcc

SEQ ID NO: 113256 - DNA, 38 bp, Artificial Sequence
  Synthetic oligonucleotide
tccctcgccccagggtaccaccacttccactctattga

SEQ ID NO: 113257 - DNA, 36 bp, Artificial Sequence
  Synthetic oligonucleotide
atccacgcccatgctcgagtctacgatcttccctta

SEQ ID NO: 113258 - DNA, 35 bp, Artificial Sequence
  Synthetic oligonucleotide
gtcccgccgtcggtcgcttgattcgtgtcgcctgc

SEQ ID NO: 113259 - DNA, 35 bp, Artificial Sequence
  Synthetic oligonucleotide
gacccacaccgcatgagtcgcccctttaccttccc

SEQ ID NO: 113260 - DNA, 35 bp, Artificial Sequence
  Synthetic oligonucleotide
tgcgcccatcgttccctacgtcctactgcggttcc

SEQ ID NO: 113261 - DNA, 35 bp, Artificial Sequence
  Synthetic oligonucleotide
tgcctccacctccagcctctaccctgtcatccagt

SEQ ID NO: 113262 - DNA, 37 bp, Artificial Sequence
  Synthetic oligonucleotide
ttgacgcaagagggtgggaaatgaaagggggaggcga

SEQ ID NO: 113263 - DNA, 35 bp, Artificial Sequence
  Synthetic oligonucleotide
gcaggtcgccgcgttcgacctccctcctcttctta

SEQ ID NO: 113264 - DNA, 35 bp, Artificial Sequence
  Synthetic oligonucleotide
gtccgtgaacgcctctaatatatatgctgtccgcc

SEQ ID NO: 113265 - DNA, 35 bp, Artificial Sequence
  Synthetic oligonucleotide
ggtgccgccttcacccctgtccccttggttcgcac

SEQ ID NO: 113266 - DNA, 35 bp, Artificial Sequence
  Synthetic oligonucleotide
tcgcctctcggctgtctcctaggctctcgttctcc

SEQ ID NO: 113267 - DNA, 35 bp, Artificial Sequence
  Synthetic oligonucleotide
aacatcctgcccttatgtctcgttttctagtgtcc

SEQ ID NO: 113268 - DNA, 35 bp, Artificial Sequence
  Synthetic oligonucleotide
ggagcggtcacccctcccgtattggttgctcccct

SEQ ID NO: 113269 - DNA, 35 bp, Artificial Sequence
  Synthetic oligonucleotide
ttacctcaccatctttctacagaccagatctcagt

SEQ ID NO: 113270 - DNA, 36 bp, Artificial Sequence
  Synthetic oligonucleotide
gttctcgccctgtgccgctctttggaacctcctcca

SEQ ID NO: 113271 - DNA, 35 bp, Artificial Sequence
  Synthetic oligonucleotide
ggacgcccaacggatcgcgcctgctcctcccttac

SEQ ID NO: 113272 - DNA, 35 bp, Artificial Sequence
  Synthetic oligonucleotide
gatgctgcagatacccgcttttccgtcaccctgcc

SEQ ID NO: 113273 - DNA, 37 bp, Artificial Sequence
  Synthetic oligonucleotide
agtacggggaggggttcatggagaaggggggggcaga

SEQ ID NO: 113274 - DNA, 37 bp, Artificial Sequence
  Synthetic oligonucleotide
tcacaactccgcctagcctacgtgccctgctcttcga

SEQ ID NO: 113275 - DNA, 36 bp, Artificial Sequence
  Synthetic oligonucleotide
attcgctcgcctgctcccctgcgtaatcctttcgta

SEQ ID NO: 113276 - DNA, 35 bp, Artificial Sequence
  Synthetic oligonucleotide
ttggggggcggtcgggtagcacgagttggggccac

SEQ ID NO: 113277 - DNA, 34 bp, Artificial Sequence
  Synthetic oligonucleotide
taccccttcacccgtcccccgttcattgtccacc

SEQ ID NO: 113278 - DNA, 35 bp, Artificial Sequence
  Synthetic oligonucleotide
atcatcaaccgcgccggctcgcccatcttgcttcc

SEQ ID NO: 113279 - DNA, 38 bp, Artificial Sequence
  Synthetic oligonucleotide
gtgggtaggggggcatgaaagggaaaaaggacagatga

SEQ ID NO: 113280 - DNA, 35 bp, Artificial Sequence
  Synthetic oligonucleotide
tcaccatccaccatgttctcatatgcgagcctaca

SEQ ID NO: 113281 - DNA, 37 bp, Artificial Sequence
  Synthetic oligonucleotide
acctgatgtcgtcagggaggaagggggggagggccga

SEQ ID NO: 113282 - DNA, 35 bp, Artificial Sequence
  Synthetic oligonucleotide
gttccatccctgtggtgtgcttccgtggccccgca

SEQ ID NO: 113283 - DNA, 35 bp, Artificial Sequence
  Synthetic oligonucleotide
tgttgcctccccatctagagtcgtccgcgaaccgc

SEQ ID NO: 113284 - DNA, 35 bp, Artificial Sequence
  Synthetic oligonucleotide
ttccgcccgcgctctacccgctcaccgctcaaccg

SEQ ID NO: 113285 - DNA, 35 bp, Artificial Sequence
  Synthetic oligonucleotide
gcgacgcgccattgtctacgccttctgttctccct

SEQ ID NO: 113286 - DNA, 36 bp, Artificial Sequence
  Synthetic oligonucleotide
acacacgggggacaaggagaatgggagtgtgtgtaa

SEQ ID NO: 113287 - DNA, 34 bp, Artificial Sequence
  Synthetic oligonucleotide
tccacatctctcagccgcacgccactactagcca

SEQ ID NO: 113288 - DNA, 36 bp, Artificial Sequence
  Synthetic oligonucleotide
ggacactgcgctgctggctcttctcaacgttctcca

SEQ ID NO: 113289 - DNA, 34 bp, Artificial Sequence
  Synthetic oligonucleotide
tccaccccgtatcggtccggacgtattgccatcc

SEQ ID NO: 113290 - DNA, 37 bp, Artificial Sequence
  Synthetic oligonucleotide
agatcccctcacccctgtaaatgtccgcatacctcga

SEQ ID NO: 113291 - DNA, 35 bp, Artificial Sequence
  Synthetic oligonucleotide
atcgctccaggtcttgctcttcaccacttgtgccc

SEQ ID NO: 113292 - DNA, 35 bp, Artificial Sequence
  Synthetic oligonucleotide
tgacacctcctccgccaaacgctaccctgcccttg

SEQ ID NO: 113293 - DNA, 36 bp, Artificial Sequence
  Synthetic oligonucleotide
acccctaccacctgtatgtctcttgtctgggcctta

SEQ ID NO: 113294 - DNA, 35 bp, Artificial Sequence
  Synthetic oligonucleotide
gtgtaggcacgaactggtcgccgccccttttagcc

SEQ ID NO: 113295 - DNA, 35 bp, Artificial Sequence
  Synthetic oligonucleotide
gatcccgctgcccctatattccaccgagtgccgat

SEQ ID NO: 113296 - DNA, 35 bp, Artificial Sequence
  Synthetic oligonucleotide
gacacgcagttcctgtcccgttttatcttcgcagt

SEQ ID NO: 113297 - DNA, 36 bp, Artificial Sequence
  Synthetic oligonucleotide
gtgtaaaacgagagggatggagggatggggcagaaa

SEQ ID NO: 113298 - DNA, 35 bp, Artificial Sequence
  Synthetic oligonucleotide
acccgtcgccgctacaacgtacgactgtaccttcc

SEQ ID NO: 113299 - DNA, 35 bp, Artificial Sequence
  Synthetic oligonucleotide
actgggggatggtggaagggcgaagggaaaataag

SEQ ID NO: 113300 - DNA, 35 bp, Artificial Sequence
  Synthetic oligonucleotide
atcgtgtcgcagcaccgagccccttcttccccatg

SEQ ID NO: 113301 - DNA, 35 bp, Artificial Sequence
  Synthetic oligonucleotide
acatgcacggtaacggtctactttggcccccccct

SEQ ID NO: 113302 - DNA, 37 bp, Artificial Sequence
  Synthetic oligonucleotide
gcgctcggcgcgctgctctatttcactgccctcccga

SEQ ID NO: 113303 - DNA, 35 bp, Artificial Sequence
  Synthetic oligonucleotide
agtgctagccgtgcctgcctcccacctactccctg

SEQ ID NO: 113304 - DNA, 35 bp, Artificial Sequence
  Synthetic oligonucleotide
gtcccgccccccgccacggttctcctacgaagtga

SEQ ID NO: 113305 - DNA, 35 bp, Artificial Sequence
  Synthetic oligonucleotide
acctatcctccccagtatgcccgtcctgcccactg

SEQ ID NO: 113306 - DNA, 35 bp, Artificial Sequence
  Synthetic oligonucleotide
gctggcctccagctttatgacgttcccctcctctt

SEQ ID NO: 113307 - DNA, 35 bp, Artificial Sequence
  Synthetic oligonucleotide
acctcagcctctcgccgttacgactccgtctcttt

SEQ ID NO: 113308 - DNA, 35 bp, Artificial Sequence
  Synthetic oligonucleotide
acccacgccgctttttcgttgcgtttctctctttt

SEQ ID NO: 113309 - DNA, 36 bp, Artificial Sequence
  Synthetic oligonucleotide
aaaaggcgggaggcaaagggggaaggcgtgtgggaa

SEQ ID NO: 113310 - DNA, 35 bp, Artificial Sequence
  Synthetic oligonucleotide
tgctaacctcctcttgccagttccgcgctcctcca

SEQ ID NO: 113311 - DNA, 35 bp, Artificial Sequence
  Synthetic oligonucleotide
gccccctcccataacagatgatgtcacttgccccc

SEQ ID NO: 113312 - DNA, 35 bp, Artificial Sequence
  Synthetic oligonucleotide
accgggagaggagaggggggtaacaacaaggatgc

SEQ ID NO: 113313 - DNA, 35 bp, Artificial Sequence
  Synthetic oligonucleotide
gactcgccaatggccccagcttaacccctgctttc

SEQ ID NO: 113314 - DNA, 35 bp, Artificial Sequence
  Synthetic oligonucleotide
ggacgggtacatagggtgggagggggagatccctt

SEQ ID NO: 113315 - DNA, 35 bp, Artificial Sequence
  Synthetic oligonucleotide
gaaggtaaagggggggtagggaccgggggtattcg

SEQ ID NO: 113316 - DNA, 35 bp, Artificial Sequence
  Synthetic oligonucleotide
tagtcgcctcctgtttcaacgctctatcccgttct

SEQ ID NO: 113317 - DNA, 36 bp, Artificial Sequence
  Synthetic oligonucleotide
gccccccctgcactcaacgccctagtccttcggaca

SEQ ID NO: 113318 - DNA, 38 bp, Artificial Sequence
  Synthetic oligonucleotide
acagggaacgggtggccggggggggaacgggtcggtga

SEQ ID NO: 113319 - DNA, 35 bp, Artificial Sequence
  Synthetic oligonucleotide
gtccctgccctcatcgtggggccacatcccacacc

SEQ ID NO: 113320 - DNA, 35 bp, Artificial Sequence
  Synthetic oligonucleotide
gttacgcccagtattttatactgtctttgctcctc

SEQ ID NO: 113321 - DNA, 35 bp, Artificial Sequence
  Synthetic oligonucleotide
acccgccctctctacggtggcatgatccatcccca

SEQ ID NO: 113322 - DNA, 36 bp, Artificial Sequence
  Synthetic oligonucleotide
ggtggaggggcggggtgggagttgttcaagggcaga

SEQ ID NO: 113323 - DNA, 35 bp, Artificial Sequence
  Synthetic oligonucleotide
gctgtgttgaagtccggttcctgttcgccccccgc

SEQ ID NO: 113324 - DNA, 36 bp, Artificial Sequence
  Synthetic oligonucleotide
accgtcccctcgatcgtctatacttacgcccaccta

SEQ ID NO: 113325 - DNA, 35 bp, Artificial Sequence
  Synthetic oligonucleotide
tcaggtccacgtcgccctgtccatgatatccaccc

SEQ ID NO: 113326 - DNA, 35 bp, Artificial Sequence
  Synthetic oligonucleotide
tgcaatcgaagcccctgtcgttatccagttccgcc

SEQ ID NO: 113327 - DNA, 35 bp, Artificial Sequence
  Synthetic oligonucleotide
aaacgggggtaatcgggtggggcagggggacttgg

SEQ ID NO: 113328 - DNA, 35 bp, Artificial Sequence
  Synthetic oligonucleotide
tcagaggccgggctacgggagggtggggggaaggt

SEQ ID NO: 113329 - DNA, 31 bp, Artificial Sequence
  Synthetic oligonucleotide
gccgctcctggctcgacgaaacccccccgca

SEQ ID NO: 113330 - DNA, 35 bp, Artificial Sequence
  Synthetic oligonucleotide
acacaccactacgagcttttaggtcgcccccctgc

SEQ ID NO: 113331 - DNA, 36 bp, Artificial Sequence
  Synthetic oligonucleotide
taatgccgacgcccgtggctgtttcccctgtcctta

SEQ ID NO: 113332 - DNA, 35 bp, Artificial Sequence
  Synthetic oligonucleotide
tgctgcccctcggacatgccacagctcctcccttc

SEQ ID NO: 113333 - DNA, 35 bp, Artificial Sequence
  Synthetic oligonucleotide
gcacctccctgtagctccccttattcattcgcgga

SEQ ID NO: 113334 - DNA, 38 bp, Artificial Sequence
  Synthetic oligonucleotide
gtggaggaggggcgggcggtgggaggaagcagagatga

SEQ ID NO: 113335 - DNA, 37 bp, Artificial Sequence
  Synthetic oligonucleotide
tccgtgctgctctacccgtgcccgcccccccgagtga

SEQ ID NO: 113336 - DNA, 35 bp, Artificial Sequence
  Synthetic oligonucleotide
actgccccacagcctacgcctcccgttggaccgcc

SEQ ID NO: 113337 - DNA, 37 bp, Artificial Sequence
  Synthetic oligonucleotide
aagcatgccacccgcccgtttattgtctcccctgcga

SEQ ID NO: 113338 - DNA, 35 bp, Artificial Sequence
  Synthetic oligonucleotide
gcctgaccacagtccgcttgtccacctaacccgcc

SEQ ID NO: 113339 - DNA, 35 bp, Artificial Sequence
  Synthetic oligonucleotide
aaaccgccacctacattgtctgctactgccctcgt

SEQ ID NO: 113340 - DNA, 35 bp, Artificial Sequence
  Synthetic oligonucleotide
gtgggagggaggtgttgggttaatggtgtaggggg

SEQ ID NO: 113341 - DNA, 35 bp, Artificial Sequence
  Synthetic oligonucleotide
tttgccaagcgttcgtcctgccctatcttcttgct

SEQ ID NO: 113342 - DNA, 35 bp, Artificial Sequence
  Synthetic oligonucleotide
ggacctcccccatctgctcctgcggacacggatcc

SEQ ID NO: 113343 - DNA, 35 bp, Artificial Sequence
  Synthetic oligonucleotide
agcatgcgccctgtctgctggctctttcgtttccg

SEQ ID NO: 113344 - DNA, 37 bp, Artificial Sequence
  Synthetic oligonucleotide
tcatccgcccctcctgcagcacgccgttattacgcga

SEQ ID NO: 113345 - DNA, 36 bp, Artificial Sequence
  Synthetic oligonucleotide
ttgccccccttctaatgcatacaactgccctttcga

SEQ ID NO: 113346 - DNA, 35 bp, Artificial Sequence
  Synthetic oligonucleotide
gcccatcctcgtcatcactgctatcatcttttgtc

SEQ ID NO: 113347 - DNA, 36 bp, Artificial Sequence
  Synthetic oligonucleotide
gccccgccggtgtgctgccccttccaccactcccaa

SEQ ID NO: 113348 - DNA, 35 bp, Artificial Sequence
  Synthetic oligonucleotide
gaggatagggggcggaaagaacgagcgagaggaca

SEQ ID NO: 113349 - DNA, 36 bp, Artificial Sequence
  Synthetic oligonucleotide
gatccatccggatgcgcctcctgcctgtacctccca

SEQ ID NO: 113350 - DNA, 37 bp, Artificial Sequence
  Synthetic oligonucleotide
gagcggggggaaggtggaaaatccgggggagggcaga

SEQ ID NO: 113351 - DNA, 36 bp, Artificial Sequence
  Synthetic oligonucleotide
ggggctatccggggcatggtagtagggaggggaata

SEQ ID NO: 113352 - DNA, 36 bp, Artificial Sequence
  Synthetic oligonucleotide
atactgccacccattgccttgctgaccccgtgccaa

SEQ ID NO: 113353 - DNA, 36 bp, Artificial Sequence
  Synthetic oligonucleotide
acaccgcactgcataactccctgtagccccttgtta

SEQ ID NO: 113354 - DNA, 35 bp, Artificial Sequence
  Synthetic oligonucleotide
ttaacccccgtgctcgagctcccttgcctggcccc

SEQ ID NO: 113355 - DNA, 35 bp, Artificial Sequence
  Synthetic oligonucleotide
gccaatggccaccccttccgctccgactacccggt

SEQ ID NO: 113356 - DNA, 35 bp, Artificial Sequence
  Synthetic oligonucleotide
tgtacccagatcgacgaactttcccgcccgctgcc

SEQ ID NO: 113357 - DNA, 35 bp, Artificial Sequence
  Synthetic oligonucleotide
tcctgcactccttcgcgttcccacaccctcccgcg

SEQ ID NO: 113358 - DNA, 36 bp, Artificial Sequence
  Synthetic oligonucleotide
tacaccctcgcccccgtaaaactcagtctcgagaga

SEQ ID NO: 113359 - DNA, 37 bp, Artificial Sequence
  Synthetic oligonucleotide
agggccgggtcggacgggggatggctagcggagggga

SEQ ID NO: 113360 - DNA, 38 bp, Artificial Sequence
  Synthetic oligonucleotide
ttgtcgccccattggtttgccgtttcatcccgccttga

SEQ ID NO: 113361 - DNA, 36 bp, Artificial Sequence
  Synthetic oligonucleotide
gtcccctgcccatctgctcttcagttatccgcaata

SEQ ID NO: 113362 - DNA, 35 bp, Artificial Sequence
  Synthetic oligonucleotide
gaaagtccgtcgcttgcacccctgtcctgtccttc

SEQ ID NO: 113363 - DNA, 37 bp, Artificial Sequence
  Synthetic oligonucleotide
ttcgacgtcactgccttctttggattcgatcccccga

SEQ ID NO: 113364 - DNA, 35 bp, Artificial Sequence
  Synthetic oligonucleotide
aaccctaccggccattgactccttacggctccacc

SEQ ID NO: 113365 - DNA, 35 bp, Artificial Sequence
  Synthetic oligonucleotide
acaccacctcaccatctgtgcttcttacccttgcc

SEQ ID NO: 113366 - DNA, 35 bp, Artificial Sequence
  Synthetic oligonucleotide
tcctgcccacaccctttcccctccgttggatcctg

SEQ ID NO: 113367 - DNA, 35 bp, Artificial Sequence
  Synthetic oligonucleotide
tcacaccacccgctttgcatagttccattcgggat

SEQ ID NO: 113368 - DNA, 35 bp, Artificial Sequence
  Synthetic oligonucleotide
gaaggggccgggagaaagggagggacggtcttctt

SEQ ID NO: 113369 - DNA, 37 bp, Artificial Sequence
  Synthetic oligonucleotide
ttgggaggaacaaggaaggagagggggttggggtgga

SEQ ID NO: 113370 - DNA, 36 bp, Artificial Sequence
  Synthetic oligonucleotide
ttcatccaccttggctgttagacccgcctttcaata

SEQ ID NO: 113371 - DNA, 35 bp, Artificial Sequence
  Synthetic oligonucleotide
gtacgccgtccgctgccccatttctcacctgtcta

SEQ ID NO: 113372 - DNA, 35 bp, Artificial Sequence
  Synthetic oligonucleotide
acctctgcccatgtacctcaacccccagctttggc

SEQ ID NO: 113373 - DNA, 35 bp, Artificial Sequence
  Synthetic oligonucleotide
gtgctccgttcacccgtcccttgttgctcacattg

SEQ ID NO: 113374 - DNA, 35 bp, Artificial Sequence
  Synthetic oligonucleotide
gggtggtgggggggtaggggtaggtgcactggctt

SEQ ID NO: 113375 - DNA, 30 bp, Artificial Sequence
  Synthetic oligonucleotide
tacatcccccctgactgcccgtatctagca

SEQ ID NO: 113376 - DNA, 37 bp, Artificial Sequence
  Synthetic oligonucleotide
ttccaccacgcctatgccccttgatacgccaccatga

SEQ ID NO: 113377 - DNA, 36 bp, Artificial Sequence
  Synthetic oligonucleotide
gctgggtgggagggaaagggaagtggttttccgcta

SEQ ID NO: 113378 - DNA, 34 bp, Artificial Sequence
  Synthetic oligonucleotide
taggtgccctcccccccgatatgttcactgaacg

SEQ ID NO: 113379 - DNA, 35 bp, Artificial Sequence
  Synthetic oligonucleotide
ttgtccgacgccaccatagtttctcgctcctgtac

SEQ ID NO: 113380 - DNA, 35 bp, Artificial Sequence
  Synthetic oligonucleotide
tcccagctcaccttattatcccacgccggtcaccc

SEQ ID NO: 113381 - DNA, 35 bp, Artificial Sequence
  Synthetic oligonucleotide
gccgtgcactctagtgccatccctgtccccctagc

SEQ ID NO: 113382 - DNA, 35 bp, Artificial Sequence
  Synthetic oligonucleotide
ttggctgtccccgccacttgctcttcgtacgcttt

SEQ ID NO: 113383 - DNA, 37 bp, Artificial Sequence
  Synthetic oligonucleotide
ggtcgggtagaggaaactgggaaggggggtggaggga

SEQ ID NO: 113384 - DNA, 37 bp, Artificial Sequence
  Synthetic oligonucleotide
tccccagttgccgacctgccaattctgccatccttga

SEQ ID NO: 113385 - DNA, 35 bp, Artificial Sequence
  Synthetic oligonucleotide
gcaccccaccgactctgaccacccccgaagtttgc

SEQ ID NO: 113386 - DNA, 35 bp, Artificial Sequence
  Synthetic oligonucleotide
gtaccactccctcccctgctctataagccttatgg

SEQ ID NO: 113387 - DNA, 35 bp, Artificial Sequence
  Synthetic oligonucleotide
gccgtgcctctatcctcccttccgagaccacgttt

SEQ ID NO: 113388 - DNA, 36 bp, Artificial Sequence
  Synthetic oligonucleotide
tcaccaccgccgcctcgacccctatcctggtgtaaa

SEQ ID NO: 113389 - DNA, 35 bp, Artificial Sequence
  Synthetic oligonucleotide
aacgacacgcaagccttttctatctccacctgctc

SEQ ID NO: 113390 - DNA, 35 bp, Artificial Sequence
  Synthetic oligonucleotide
gggtgccgggggtggttgggggaggagaaggacat

SEQ ID NO: 113391 - DNA, 35 bp, Artificial Sequence
  Synthetic oligonucleotide
tcactccgcctgtcctcgctgctttttagtctcat

SEQ ID NO: 113392 - DNA, 35 bp, Artificial Sequence
  Synthetic oligonucleotide
atatgcaagctgtcaccattatgctcgttccatct

SEQ ID NO: 113393 - DNA, 36 bp, Artificial Sequence
  Synthetic oligonucleotide
ttcgcccccccctgtgactatcacgcggccaatcca

SEQ ID NO: 113394 - DNA, 38 bp, Artificial Sequence
  Synthetic oligonucleotide
acgatccgccgcccacccctgttagtcttgtccattga

SEQ ID NO: 113395 - DNA, 35 bp, Artificial Sequence
  Synthetic oligonucleotide
gtcgacgttcccgtccatccattttgttgcttgcc

SEQ ID NO: 113396 - DNA, 35 bp, Artificial Sequence
  Synthetic oligonucleotide
accacccggtgggtgaccgtttatttaccatcctt

SEQ ID NO: 113397 - DNA, 36 bp, Artificial Sequence
  Synthetic oligonucleotide
tcactgcccctgcctaagtttttgaccaccttgaca

SEQ ID NO: 113398 - DNA, 36 bp, Artificial Sequence
  Synthetic oligonucleotide
tcccccccgcaccgagtgccatattgctcccacgta

SEQ ID NO: 113399 - DNA, 35 bp, Artificial Sequence
  Synthetic oligonucleotide
tgacccgtcttgttttacgtctctgctccttggtc

SEQ ID NO: 113400 - DNA, 35 bp, Artificial Sequence
  Synthetic oligonucleotide
gttccgccctttgattacttgtgaccccactgcac

SEQ ID NO: 113401 - DNA, 35 bp, Artificial Sequence
  Synthetic oligonucleotide
ggtccatcgacccgcatatgtcactacgccctccc

SEQ ID NO: 113402 - DNA, 35 bp, Artificial Sequence
  Synthetic oligonucleotide
atcgacctcagctcacgcgccttactttgcctgcc

SEQ ID NO: 113403 - DNA, 35 bp, Artificial Sequence
  Synthetic oligonucleotide
attcacctcccaatctcccccatgccctgtgtgcc

SEQ ID NO: 113404 - DNA, 35 bp, Artificial Sequence
  Synthetic oligonucleotide
acccgtcaggccctaagcttgcaccctctcttccg

SEQ ID NO: 113405 - DNA, 35 bp, Artificial Sequence
  Synthetic oligonucleotide
tcaacactcctgtccagcctaccgcccatatggct

SEQ ID NO: 113406 - DNA, 37 bp, Artificial Sequence
  Synthetic oligonucleotide
ccgcgcgaagggaggggaggaaggggtgatggagcga

SEQ ID NO: 113407 - DNA, 36 bp, Artificial Sequence
  Synthetic oligonucleotide
gtcaccctccgaccttgtctcagctccacttttgta

SEQ ID NO: 113408 - DNA, 35 bp, Artificial Sequence
  Synthetic oligonucleotide
ttcgtcggggggaggaggggcgcggtggtaggaaa

SEQ ID NO: 113409 - DNA, 35 bp, Artificial Sequence
  Synthetic oligonucleotide
ggagccgccatctttccatccgtagctctcctgcc

SEQ ID NO: 113410 - DNA, 35 bp, Artificial Sequence
  Synthetic oligonucleotide
ttgcccgcccacatttcagtcattgtccccgatcc

SEQ ID NO: 113411 - DNA, 35 bp, Artificial Sequence
  Synthetic oligonucleotide
cacatcgcatatctgcttctcgtgcctgtttcatc

SEQ ID NO: 113412 - DNA, 35 bp, Artificial Sequence
  Synthetic oligonucleotide
tcatacccgtccgcccccatcctacttatctctcg

SEQ ID NO: 113413 - DNA, 35 bp, Artificial Sequence
  Synthetic oligonucleotide
tcctgaacagccgccctgcctgaatttacccttcg

SEQ ID NO: 113414 - DNA, 35 bp, Artificial Sequence
  Synthetic oligonucleotide
gcccatcgtgcacctgcttctgacatctccttctg

SEQ ID NO: 113415 - DNA, 35 bp, Artificial Sequence
  Synthetic oligonucleotide
gtggccgtacggcgacacgtcttgcactaccactc

SEQ ID NO: 113416 - DNA, 36 bp, Artificial Sequence
  Synthetic oligonucleotide
tccccctcacatcgcgcgctgctactctcctgccaa

SEQ ID NO: 113417 - DNA, 37 bp, Artificial Sequence
  Synthetic oligonucleotide
tgccatgttcccttgtccctgcgccactgtccttaga

SEQ ID NO: 113418 - DNA, 35 bp, Artificial Sequence
  Synthetic oligonucleotide
tttcccccccctgtacaacgcgcataacggtcacc

SEQ ID NO: 113419 - DNA, 37 bp, Artificial Sequence
  Synthetic oligonucleotide
ttagccatcgcctgcgttcttcatcgtccttcttcga

SEQ ID NO: 113420 - DNA, 38 bp, Artificial Sequence
  Synthetic oligonucleotide
acaacgttgcaacgtacctgctttgtgctccccggtga

SEQ ID NO: 113421 - DNA, 35 bp, Artificial Sequence
  Synthetic oligonucleotide
gtgaacgggttgggagggagctaacgggcaggtcc

SEQ ID NO: 113422 - DNA, 37 bp, Artificial Sequence
  Synthetic oligonucleotide
gggggagaccacgggtgggcggtgaaggggagaggga

SEQ ID NO: 113423 - DNA, 35 bp, Artificial Sequence
  Synthetic oligonucleotide
tgctcccccgcgaacctccgtagtaattgcacctc

SEQ ID NO: 113424 - DNA, 38 bp, Artificial Sequence
  Synthetic oligonucleotide
atctgcaccgggtagggagggcaagggacgttttatga

SEQ ID NO: 113425 - DNA, 35 bp, Artificial Sequence
  Synthetic oligonucleotide
ttctccccgcaatgtgccctcgttttcttgccgac

SEQ ID NO: 113426 - DNA, 35 bp, Artificial Sequence
  Synthetic oligonucleotide
gctctgtccagcgcgtacttctccgttccattatc

SEQ ID NO: 113427 - DNA, 35 bp, Artificial Sequence
  Synthetic oligonucleotide
tcacagataccatccctgtactcgccctatgcctc

SEQ ID NO: 113428 - DNA, 35 bp, Artificial Sequence
  Synthetic oligonucleotide
gttcactagccctgaacactgtatcctgtcctcct

SEQ ID NO: 113429 - DNA, 35 bp, Artificial Sequence
  Synthetic oligonucleotide
gcactcgtcgaaagggggggtgggaatgaggaggg

SEQ ID NO: 113430 - DNA, 35 bp, Artificial Sequence
  Synthetic oligonucleotide
ggaccgcagccgccctcttgtctttttaacctctg

SEQ ID NO: 113431 - DNA, 35 bp, Artificial Sequence
  Synthetic oligonucleotide
tacacctctaacgtgctgttctcatccggttctca

SEQ ID NO: 113432 - DNA, 37 bp, Artificial Sequence
  Synthetic oligonucleotide
ggatacaggggggtgaaggcggataatggagtgcgga

SEQ ID NO: 113433 - DNA, 36 bp, Artificial Sequence
  Synthetic oligonucleotide
tatgacaccacctgcccctgtagtttcgcggactta

SEQ ID NO: 113434 - DNA, 35 bp, Artificial Sequence
  Synthetic oligonucleotide
gcgctggagtggggtggtgggcggggggggcacgg

SEQ ID NO: 113435 - DNA, 35 bp, Artificial Sequence
  Synthetic oligonucleotide
gcgtgcaccatatgtctctctgcgctactccacct

SEQ ID NO: 113436 - DNA, 35 bp, Artificial Sequence
  Synthetic oligonucleotide
ttatgcaaagtggcgagcgggcgggcgggttagct

SEQ ID NO: 113437 - DNA, 37 bp, Artificial Sequence
  Synthetic oligonucleotide
gaggacgtagggagggcaaggagggggtcagttgaga

SEQ ID NO: 113438 - DNA, 35 bp, Artificial Sequence
  Synthetic oligonucleotide
gtttgaccccccgatgattaatgtcgctcaccact

SEQ ID NO: 113439 - DNA, 35 bp, Artificial Sequence
  Synthetic oligonucleotide
gtaccaaccccgctttgcttctcgccgatttgcct

SEQ ID NO: 113440 - DNA, 36 bp, Artificial Sequence
  Synthetic oligonucleotide
tcactcgcggcccatgcctaccacgctacatccata

SEQ ID NO: 113441 - DNA, 35 bp, Artificial Sequence
  Synthetic oligonucleotide
tcgatcttgtcgccacccatcatgtcttatcctcc

SEQ ID NO: 113442 - DNA, 35 bp, Artificial Sequence
  Synthetic oligonucleotide
tccgcctcccatacgaagtttctgctggtccctcg

SEQ ID NO: 113443 - DNA, 35 bp, Artificial Sequence
  Synthetic oligonucleotide
acaccgccgctgtaaccgcttccctaagtccccct

SEQ ID NO: 113444 - DNA, 38 bp, Artificial Sequence
  Synthetic oligonucleotide
gacgaaagggcgagggggaggaaggcaagatgaaatga

SEQ ID NO: 113445 - DNA, 37 bp, Artificial Sequence
  Synthetic oligonucleotide
accgtgcgatcgtccgctctgcccaccgcctgcctga

SEQ ID NO: 113446 - DNA, 35 bp, Artificial Sequence
  Synthetic oligonucleotide
agccacgctttcgaggaccgccacaccttccttcc

SEQ ID NO: 113447 - DNA, 35 bp, Artificial Sequence
  Synthetic oligonucleotide
gcccatcacgacttcccctgctccattggttgatc

SEQ ID NO: 113448 - DNA, 35 bp, Artificial Sequence
  Synthetic oligonucleotide
gtgcctgccctttcgtgatcggtgcccccgctctc

SEQ ID NO: 113449 - DNA, 35 bp, Artificial Sequence
  Synthetic oligonucleotide
aaagcgagccgtggcccccatacccgcccttcgtc

SEQ ID NO: 113450 - DNA, 35 bp, Artificial Sequence
  Synthetic oligonucleotide
gatgtgcatgcccagcccccactaatcgcctctgt

SEQ ID NO: 113451 - DNA, 35 bp, Artificial Sequence
  Synthetic oligonucleotide
gccccacacctactgtacatgtacacctccaccca

SEQ ID NO: 113452 - DNA, 37 bp, Artificial Sequence
  Synthetic oligonucleotide
ggaccgtgtaacggatgggggaggagggaggagagga

SEQ ID NO: 113453 - DNA, 37 bp, Artificial Sequence
  Synthetic oligonucleotide
gaggtgaaatacagggggggcggaaggggtcagggga

SEQ ID NO: 113454 - DNA, 35 bp, Artificial Sequence
  Synthetic oligonucleotide
gtactgttcgccgcctttcatctataatgtcatcc

SEQ ID NO: 113455 - DNA, 36 bp, Artificial Sequence
  Synthetic oligonucleotide
actcgcctcttctgtccctcgcgctcgtccgccgaa

SEQ ID NO: 113456 - DNA, 35 bp, Artificial Sequence
  Synthetic oligonucleotide
gccgaggcccgctccgaagcacccaccttcccccc

SEQ ID NO: 113457 - DNA, 35 bp, Artificial Sequence
  Synthetic oligonucleotide
taccaccttactcgcttacggatccgtgtctcttc

SEQ ID NO: 113458 - DNA, 35 bp, Artificial Sequence
  Synthetic oligonucleotide
tcaaccactccgtgtcaagcctccagttctccccg

SEQ ID NO: 113459 - DNA, 35 bp, Artificial Sequence
  Synthetic oligonucleotide
taaacggggaagccaagggggaggaagagggaagg

SEQ ID NO: 113460 - DNA, 36 bp, Artificial Sequence
  Synthetic oligonucleotide
tatgacttgggcctcatcgcgtacgccccctcccca

SEQ ID NO: 113461 - DNA, 36 bp, Artificial Sequence
  Synthetic oligonucleotide
gtcacgtggagaaaaagcaggaagggggatagggca

SEQ ID NO: 113462 - DNA, 35 bp, Artificial Sequence
  Synthetic oligonucleotide
gtatcgtcactccgccctgcaagcacctgtttcat

SEQ ID NO: 113463 - DNA, 35 bp, Artificial Sequence
  Synthetic oligonucleotide
gagagacgcggctggggaggggggtgcgggctaac

SEQ ID NO: 113464 - DNA, 32 bp, Artificial Sequence
  Synthetic oligonucleotide
atcgcgtgcgcaatacgccgacctccccttgt

SEQ ID NO: 113465 - DNA, 35 bp, Artificial Sequence
  Synthetic oligonucleotide
gctgtgccccgctgacctgcccctaggaatatatc

SEQ ID NO: 113466 - DNA, 35 bp, Artificial Sequence
  Synthetic oligonucleotide
gagtcccgtgaggggataggaaggtggagaggggt

SEQ ID NO: 113467 - DNA, 37 bp, Artificial Sequence
  Synthetic oligonucleotide
actcgcccccatgcacttcccccacctctgtcgtgga

SEQ ID NO: 113468 - DNA, 36 bp, Artificial Sequence
  Synthetic oligonucleotide
ttacgcgccttcccctgatcctgctatcgtgcacta

SEQ ID NO: 113469 - DNA, 35 bp, Artificial Sequence
  Synthetic oligonucleotide
tgagtccgtcctgctgtcactaccctctggccccc

SEQ ID NO: 113470 - DNA, 35 bp, Artificial Sequence
  Synthetic oligonucleotide
tgcccacttcctcgatcaatcccgtccattcggtc

SEQ ID NO: 113471 - DNA, 35 bp, Artificial Sequence
  Synthetic oligonucleotide
ttttgcacccctatgcgcacacgactacctctttc

SEQ ID NO: 113472 - DNA, 35 bp, Artificial Sequence
  Synthetic oligonucleotide
ggtatcgccatggtgtccgctcccgtctgtctttc

SEQ ID NO: 113473 - DNA, 35 bp, Artificial Sequence
  Synthetic oligonucleotide
acatcccccgcaacccccgatggtggttactcctt

SEQ ID NO: 113474 - DNA, 37 bp, Artificial Sequence
  Synthetic oligonucleotide
tctgagggggacgggaggctacaggcaagggggagga

SEQ ID NO: 113475 - DNA, 35 bp, Artificial Sequence
  Synthetic oligonucleotide
gtgccttatgcacagccgttcctcgcctctgtccc

SEQ ID NO: 113476 - DNA, 35 bp, Artificial Sequence
  Synthetic oligonucleotide
gttgcccgaatacatgcacagcgcccttccccgcc

SEQ ID NO: 113477 - DNA, 35 bp, Artificial Sequence
  Synthetic oligonucleotide
tacgcgtggccgctcttcacccctcccttagtgtc

SEQ ID NO: 113478 - DNA, 35 bp, Artificial Sequence
  Synthetic oligonucleotide
tgttgtcgattgactgctgcccgtttcaccccacc

SEQ ID NO: 113479 - DNA, 35 bp, Artificial Sequence
  Synthetic oligonucleotide
atgccaccatcaatcccggttccatattgttcgcc

SEQ ID NO: 113480 - DNA, 35 bp, Artificial Sequence
  Synthetic oligonucleotide
ggatcgggcgggagggaagggaacaactaagggcc

SEQ ID NO: 113481 - DNA, 35 bp, Artificial Sequence
  Synthetic oligonucleotide
gccactctcctgggatcccgactcatcttttctgc

SEQ ID NO: 113482 - DNA, 35 bp, Artificial Sequence
  Synthetic oligonucleotide
atctgcccgcccctgtaatacctactctccgcaca

SEQ ID NO: 113483 - DNA, 38 bp, Artificial Sequence
  Synthetic oligonucleotide
gccctcaacgtatgtgcccactccccgctccctcgtga

SEQ ID NO: 113484 - DNA, 35 bp, Artificial Sequence
  Synthetic oligonucleotide
acgacgtgccaccgccgccctacgccctccttgtc

SEQ ID NO: 113485 - DNA, 35 bp, Artificial Sequence
  Synthetic oligonucleotide
agagcccaccgcctgctgcaagccaaaacgctttc

SEQ ID NO: 113486 - DNA, 35 bp, Artificial Sequence
  Synthetic oligonucleotide
tcccctcccgtcttgctcgtttcaagtttattcct

SEQ ID NO: 113487 - DNA, 35 bp, Artificial Sequence
  Synthetic oligonucleotide
gttaccacgcgcctcctctcgatttgccgccgtcc

SEQ ID NO: 113488 - DNA, 35 bp, Artificial Sequence
  Synthetic oligonucleotide
gacgatctcattgccctgtccctgtatcctcgttc

SEQ ID NO: 113489 - DNA, 37 bp, Artificial Sequence
  Synthetic oligonucleotide
gatgagaccctcagccggttatatccccatctattga

SEQ ID NO: 113490 - DNA, 36 bp, Artificial Sequence
  Synthetic oligonucleotide
acgcaagttagtgcagggtaaggggggggtgggata

SEQ ID NO: 113491 - DNA, 35 bp, Artificial Sequence
  Synthetic oligonucleotide
gccacccgtgcctgcttactccgagtccttctaac

SEQ ID NO: 113492 - DNA, 35 bp, Artificial Sequence
  Synthetic oligonucleotide
tactgccccgacccatctcttgatagcagcaaacc

SEQ ID NO: 113493 - DNA, 35 bp, Artificial Sequence
  Synthetic oligonucleotide
actgaacacgtaacagttgcgtcctccccggcccc

SEQ ID NO: 113494 - DNA, 35 bp, Artificial Sequence
  Synthetic oligonucleotide
gcatccgatcggtctggcctcccccctgtagtaca

SEQ ID NO: 113495 - DNA, 35 bp, Artificial Sequence
  Synthetic oligonucleotide
tccaacggctgttcattaccttgcagtaccctctc

SEQ ID NO: 113496 - DNA, 35 bp, Artificial Sequence
  Synthetic oligonucleotide
gggaaggaggaggaagggacaagaatgtggcgtct

SEQ ID NO: 113497 - DNA, 35 bp, Artificial Sequence
  Synthetic oligonucleotide
tccgtcttccgccactctgaacccctaccagcgtt

SEQ ID NO: 113498 - DNA, 38 bp, Artificial Sequence
  Synthetic oligonucleotide
tcagtgctcagcattcttatgcccgaccctctccttga

SEQ ID NO: 113499 - DNA, 35 bp, Artificial Sequence
  Synthetic oligonucleotide
gactcgtcgtggtctatgttctcccccctccggct

SEQ ID NO: 113500 - DNA, 36 bp, Artificial Sequence
  Synthetic oligonucleotide
gatgcaagggaggagaggggagaactctgcggggga

SEQ ID NO: 113501 - DNA, 38 bp, Artificial Sequence
  Synthetic oligonucleotide
gcgatcgccacagagcgatgctaatccttcacctttga

SEQ ID NO: 113502 - DNA, 35 bp, Artificial Sequence
  Synthetic oligonucleotide
ttgccggccataacgtcgcgttcctcctgtcttcc

SEQ ID NO: 113503 - DNA, 35 bp, Artificial Sequence
  Synthetic oligonucleotide
tacgctcgccccatcgcgcctccctgaaatgattc

SEQ ID NO: 113504 - DNA, 35 bp, Artificial Sequence
  Synthetic oligonucleotide
ttaccgctaccgcctgacgtccgccccctctaaac

SEQ ID NO: 113505 - DNA, 35 bp, Artificial Sequence
  Synthetic oligonucleotide
tgtagccgccccatctatcgttaccatcgctctgg

SEQ ID NO: 113506 - DNA, 35 bp, Artificial Sequence
  Synthetic oligonucleotide
ttgaccacgcggtaactgatccccccccgccctta

SEQ ID NO: 113507 - DNA, 35 bp, Artificial Sequence
  Synthetic oligonucleotide
aatcgacgcatcatggccgccactccctgtcttta

SEQ ID NO: 113508 - DNA, 35 bp, Artificial Sequence
  Synthetic oligonucleotide
tcgagcctgacactgcgcacgtaggccctccttcc

SEQ ID NO: 113509 - DNA, 34 bp, Artificial Sequence
  Synthetic oligonucleotide
gcccttccctgctttgtctcgcggcgacctacgc

SEQ ID NO: 113510 - DNA, 35 bp, Artificial Sequence
  Synthetic oligonucleotide
gcatcccagtcgctatcacctgggcaccttacttc

SEQ ID NO: 113511 - DNA, 35 bp, Artificial Sequence
  Synthetic oligonucleotide
tgccgccctccgccgcccactgtcaggcataattc

SEQ ID NO: 113512 - DNA, 35 bp, Artificial Sequence
  Synthetic oligonucleotide
gcccgatccatcgctgccatcccacttttatctag

SEQ ID NO: 113513 - DNA, 35 bp, Artificial Sequence
  Synthetic oligonucleotide
gacaccatcgccgccgccgactcatgcctctttct

SEQ ID NO: 113514 - DNA, 38 bp, Artificial Sequence
  Synthetic oligonucleotide
taccacccacagagccctcgccacgcatcttcccatga

SEQ ID NO: 113515 - DNA, 38 bp, Artificial Sequence
  Synthetic oligonucleotide
atgggggaacggaaacggggggatagaacaagggttga

SEQ ID NO: 113516 - DNA, 35 bp, Artificial Sequence
  Synthetic oligonucleotide
gttgtcgagcggtcaatctgcacctttctgctcac

SEQ ID NO: 113517 - DNA, 38 bp, Artificial Sequence
  Synthetic oligonucleotide
gtgcatcggggagggcggaaaatggggggcatgattga

SEQ ID NO: 113518 - DNA, 35 bp, Artificial Sequence
  Synthetic oligonucleotide
tctaccgccctccctcggcccatcaaccccgtgct

SEQ ID NO: 113519 - DNA, 36 bp, Artificial Sequence
  Synthetic oligonucleotide
taatcacccgctttggtacacgagcccttccctacc

SEQ ID NO: 113520 - DNA, 35 bp, Artificial Sequence
  Synthetic oligonucleotide
ggatctgccgccgcaagtgctcgcgcctccccgcc

SEQ ID NO: 113521 - DNA, 35 bp, Artificial Sequence
  Synthetic oligonucleotide
gacaggagggggaggggagtagaataataaggtca

SEQ ID NO: 113522 - DNA, 37 bp, Artificial Sequence
  Synthetic oligonucleotide
atgacccaccgaatgccatagcccatccctctcggga

SEQ ID NO: 113523 - DNA, 37 bp, Artificial Sequence
  Synthetic oligonucleotide
tcagtctgcccacttccccccgcccagcaccgcgtga

SEQ ID NO: 113524 - DNA, 38 bp, Artificial Sequence
  Synthetic oligonucleotide
aagggtgggtcaagggaagggtgggatggaacgggtga

SEQ ID NO: 113525 - DNA, 35 bp, Artificial Sequence
  Synthetic oligonucleotide
atacgctgcccctccctacgttggcttgaacttcc

SEQ ID NO: 113526 - DNA, 35 bp, Artificial Sequence
  Synthetic oligonucleotide
tacgatcgcccttcttgcctgttccacacacgtgg

SEQ ID NO: 113527 - DNA, 35 bp, Artificial Sequence
  Synthetic oligonucleotide
ggcccaacccccccctcgtattatggctccacctg

SEQ ID NO: 113528 - DNA, 35 bp, Artificial Sequence
  Synthetic oligonucleotide
tccaccgagcagggtgcagctccattctctctctt

SEQ ID NO: 113529 - DNA, 36 bp, Artificial Sequence
  Synthetic oligonucleotide
gtgtgagaccgaggaagtacgagggggaggaatgga

SEQ ID NO: 113530 - DNA, 35 bp, Artificial Sequence
  Synthetic oligonucleotide
gacgccaaaggcgtttccccctgtctctttacgac

SEQ ID NO: 113531 - DNA, 35 bp, Artificial Sequence
  Synthetic oligonucleotide
gcacgctcgccgacatctatattcctgggccttct

SEQ ID NO: 113532 - DNA, 35 bp, Artificial Sequence
  Synthetic oligonucleotide
agcaccctccgctccgcacattagaacacgtgccc

SEQ ID NO: 113533 - DNA, 35 bp, Artificial Sequence
  Synthetic oligonucleotide
ttgtgcgccatcacactgccgccataatatttcct

SEQ ID NO: 113534 - DNA, 35 bp, Artificial Sequence
  Synthetic oligonucleotide
tccacgcatatatcccttggccggtcctttcatcc

SEQ ID NO: 113535 - DNA, 35 bp, Artificial Sequence
  Synthetic oligonucleotide
taccccacctccctgttgtttcaatgtgggccttc

SEQ ID NO: 113536 - DNA, 35 bp, Artificial Sequence
  Synthetic oligonucleotide
atcgccagggcccataccgccgcttcccatttccg

SEQ ID NO: 113537 - DNA, 35 bp, Artificial Sequence
  Synthetic oligonucleotide
ggatcgcccccgcgccaccccccaccgtttgtaaa

SEQ ID NO: 113538 - DNA, 35 bp, Artificial Sequence
  Synthetic oligonucleotide
gttcacccacttgatcctgtaggttggtctactcc

SEQ ID NO: 113539 - DNA, 35 bp, Artificial Sequence
  Synthetic oligonucleotide
tcacaccctgcgcaagttcgtcagccttctgccgc

SEQ ID NO: 113540 - DNA, 35 bp, Artificial Sequence
  Synthetic oligonucleotide
gatctgcctactctgcgcatgacgacttgtccctc

SEQ ID NO: 113541 - DNA, 35 bp, Artificial Sequence
  Synthetic oligonucleotide
gtacccgttcacgatcccgtcttctcgcttgcccg

SEQ ID NO: 113542 - DNA, 36 bp, Artificial Sequence
  Synthetic oligonucleotide
tcctccctccgtcttttttcgtaaacgcaccccaca

SEQ ID NO: 113543 - DNA, 35 bp, Artificial Sequence
  Synthetic oligonucleotide
tccactccacggaccataagcactctcccgctcgc

SEQ ID NO: 113544 - DNA, 35 bp, Artificial Sequence
  Synthetic oligonucleotide
gcgaaaggataaccggaaggggagtgcggaaggaa

SEQ ID NO: 113545 - DNA, 38 bp, Artificial Sequence
  Synthetic oligonucleotide
agtggtgcctcccatgtctgttcttcccctccacttga

SEQ ID NO: 113546 - DNA, 35 bp, Artificial Sequence
  Synthetic oligonucleotide
ttcccacgccctcacactctacgctactgcaggaa

SEQ ID NO: 113547 - DNA, 36 bp, Artificial Sequence
  Synthetic oligonucleotide
tcacataccgtccgtagtcctgtctcatcaccccca

SEQ ID NO: 113548 - DNA, 36 bp, Artificial Sequence
  Synthetic oligonucleotide
gcctccgctcccaccgctttgctacttggcctcata

SEQ ID NO: 113549 - DNA, 35 bp, Artificial Sequence
  Synthetic oligonucleotide
ggtcacgagccacccgtgcgaaccacccttgctac

SEQ ID NO: 113550 - DNA, 35 bp, Artificial Sequence
  Synthetic oligonucleotide
aatgagctctgcacgcgtggccccccgtttccccc

SEQ ID NO: 113551 - DNA, 35 bp, Artificial Sequence
  Synthetic oligonucleotide
tagccggtggctggcctgtccgctttcttgtcttc

SEQ ID NO: 113552 - DNA, 36 bp, Artificial Sequence
  Synthetic oligonucleotide
gtccccctccctgctctggcctcgtacaaccgcaca

SEQ ID NO: 113553 - DNA, 37 bp, Artificial Sequence
  Synthetic oligonucleotide
gacccacgtacgttgactccgatcccgaccttgccga

SEQ ID NO: 113554 - DNA, 37 bp, Artificial Sequence
  Synthetic oligonucleotide
gtagggggaaagactggacagggagggacgagaggga

SEQ ID NO: 113555 - DNA, 35 bp, Artificial Sequence
  Synthetic oligonucleotide
gtactacgcattgttatcgaacctgtcttttcctc

SEQ ID NO: 113556 - DNA, 35 bp, Artificial Sequence
  Synthetic oligonucleotide
acctccaggcgagagggcgggagggtaccagtgtg

SEQ ID NO: 113557 - DNA, 34 bp, Artificial Sequence
  Synthetic oligonucleotide
gtcgatccgccatctgatcttctgttccatctac

SEQ ID NO: 113558 - DNA, 35 bp, Artificial Sequence
  Synthetic oligonucleotide
gccttgtccatctgtcatagccaatcgcctactcc

SEQ ID NO: 113559 - DNA, 35 bp, Artificial Sequence
  Synthetic oligonucleotide
gtgcaggctcatgagagtacaccccccgcccgctc

SEQ ID NO: 113560 - DNA, 35 bp, Artificial Sequence
  Synthetic oligonucleotide
ttggtaggcggggggggaggtggttttgcgggatg

SEQ ID NO: 113561 - DNA, 35 bp, Artificial Sequence
  Synthetic oligonucleotide
gactcctgccccgttttgccacctagatctccggt

SEQ ID NO: 113562 - DNA, 36 bp, Artificial Sequence
  Synthetic oligonucleotide
tgcatcccgtgcttctctgcttcactcctcgttcga

SEQ ID NO: 113563 - DNA, 35 bp, Artificial Sequence
  Synthetic oligonucleotide
atctcgccctcggttctctaccatgagctgttcct

SEQ ID NO: 113564 - DNA, 35 bp, Artificial Sequence
  Synthetic oligonucleotide
agtaaacatggggggaggggtgcaagaggggtggt

SEQ ID NO: 113565 - DNA, 35 bp, Artificial Sequence
  Synthetic oligonucleotide
gaccctgttccgccctgacgcgagtcgcccccgta

SEQ ID NO: 113566 - DNA, 35 bp, Artificial Sequence
  Synthetic oligonucleotide
aactggaggggggggacagggagggtgggtctgac

SEQ ID NO: 113567 - DNA, 35 bp, Artificial Sequence
  Synthetic oligonucleotide
gagctgtccgcccgactgcgatatcccatccgtac

SEQ ID NO: 113568 - DNA, 35 bp, Artificial Sequence
  Synthetic oligonucleotide
tgccacgccaccctcgtcgacgccagttacctacc

SEQ ID NO: 113569 - DNA, 34 bp, Artificial Sequence
  Synthetic oligonucleotide
gaatacctgccacgtgctccgctctttccgccgc

SEQ ID NO: 113570 - DNA, 35 bp, Artificial Sequence
  Synthetic oligonucleotide
gcacacccactaacgtcatcaccaccacctcgtag

SEQ ID NO: 113571 - DNA, 35 bp, Artificial Sequence
  Synthetic oligonucleotide
gtgagcgccccctctttagctattccgcccagcct

SEQ ID NO: 113572 - DNA, 36 bp, Artificial Sequence
  Synthetic oligonucleotide
ttcacctgtcagccccgctccacttgtccctgctca

SEQ ID NO: 113573 - DNA, 35 bp, Artificial Sequence
  Synthetic oligonucleotide
gaccaggctcacactctatctacacctcttgtcgc

SEQ ID NO: 113574 - DNA, 35 bp, Artificial Sequence
  Synthetic oligonucleotide
tctccccgaaccgatcttgcagcacgcccgcgctc

SEQ ID NO: 113575 - DNA, 35 bp, Artificial Sequence
  Synthetic oligonucleotide
tgccccgacaccatccgtctgccttcggttacctg

SEQ ID NO: 113576 - DNA, 35 bp, Artificial Sequence
  Synthetic oligonucleotide
atgctgacctcacttgccgacacacgtagtcctat

SEQ ID NO: 113577 - DNA, 36 bp, Artificial Sequence
  Synthetic oligonucleotide
tgaccatcccccctgtttgcgctgtgacgccgagta

SEQ ID NO: 113578 - DNA, 35 bp, Artificial Sequence
  Synthetic oligonucleotide
ttcattatgggaaagggaaggggaggaaggaggaa

SEQ ID NO: 113579 - DNA, 35 bp, Artificial Sequence
  Synthetic oligonucleotide
accccattcgcatttgatccgtaacctttatgtcc

SEQ ID NO: 113580 - DNA, 35 bp, Artificial Sequence
  Synthetic oligonucleotide
ttcgctctaccctctcctgatttgagccctccctc

SEQ ID NO: 113581 - DNA, 35 bp, Artificial Sequence
  Synthetic oligonucleotide
gacgccgtcgctcgtcaccacccagcccaacacca

SEQ ID NO: 113582 - DNA, 38 bp, Artificial Sequence
  Synthetic oligonucleotide
agccacccgccattccgttcatttcagtatctccctga

SEQ ID NO: 113583 - DNA, 35 bp, Artificial Sequence
  Synthetic oligonucleotide
atcacccccgctaagtttcgctcactccgggcctc

SEQ ID NO: 113584 - DNA, 36 bp, Artificial Sequence
  Synthetic oligonucleotide
gtccctcaccatcagcccatgctttctgcgctgcca

SEQ ID NO: 113585 - DNA, 37 bp, Artificial Sequence
  Synthetic oligonucleotide
ttcgccgtgccaccctgcccttgttatccccgcatga

SEQ ID NO: 113586 - DNA, 35 bp, Artificial Sequence
  Synthetic oligonucleotide
accgtccactctgcattacccgtttgaccacagcc

SEQ ID NO: 113587 - DNA, 35 bp, Artificial Sequence
  Synthetic oligonucleotide
gactccgccggccgatacactcccgccgtttctcc

SEQ ID NO: 113588 - DNA, 36 bp, Artificial Sequence
  Synthetic oligonucleotide
actgccgagggcgaggggagagggaagggtgaagaa

SEQ ID NO: 113589 - DNA, 36 bp, Artificial Sequence
  Synthetic oligonucleotide
gcctacgtcgcccgccgcctcccttcgcgtgtgcca

SEQ ID NO: 113590 - DNA, 35 bp, Artificial Sequence
  Synthetic oligonucleotide
agtagccccacaatcgtatacgttaatccccgtcc

SEQ ID NO: 113591 - DNA, 37 bp, Artificial Sequence
  Synthetic oligonucleotide
gacggaaatgggtggggaatgggggcataaccgggga

SEQ ID NO: 113592 - DNA, 35 bp, Artificial Sequence
  Synthetic oligonucleotide
acgcaccgactcatgcttctgtcctctggttatcc

SEQ ID NO: 113593 - DNA, 35 bp, Artificial Sequence
  Synthetic oligonucleotide
gcgcactgtccccccttattcatgtcgcacccttc

SEQ ID NO: 113594 - DNA, 35 bp, Artificial Sequence
  Synthetic oligonucleotide
gccgcgccttcccctgtgcgttttaggcctccctt

SEQ ID NO: 113595 - DNA, 38 bp, Artificial Sequence
  Synthetic oligonucleotide
gtcccatcctccagtgcgttgttctgctctactcctga

SEQ ID NO: 113596 - DNA, 35 bp, Artificial Sequence
  Synthetic oligonucleotide
tcgtgcctccacccgcaccatgtctcatgtccgtc

SEQ ID NO: 113597 - DNA, 35 bp, Artificial Sequence
  Synthetic oligonucleotide
ggggatagccccccattgttttgtcccttcctgct

SEQ ID NO: 113598 - DNA, 36 bp, Artificial Sequence
  Synthetic oligonucleotide
gctgcccctgcctctgttctgcgaatctttctgtca

SEQ ID NO: 113599 - DNA, 38 bp, Artificial Sequence
  Synthetic oligonucleotide
gccgcgggtgcagggcggaagggaggtggggggggtga

SEQ ID NO: 113600 - DNA, 35 bp, Artificial Sequence
  Synthetic oligonucleotide
gacgtccagatccgtcctcctggtgcccccacgta

SEQ ID NO: 113601 - DNA, 35 bp, Artificial Sequence
  Synthetic oligonucleotide
gccattgccacggtaaatgacattcttgccttccc

SEQ ID NO: 113602 - DNA, 35 bp, Artificial Sequence
  Synthetic oligonucleotide
tccacccacacgctgtatttttcagctgaaactcc

SEQ ID NO: 113603 - DNA, 35 bp, Artificial Sequence
  Synthetic oligonucleotide
acacacacgcggattgttctgttccatccatttag

SEQ ID NO: 113604 - DNA, 35 bp, Artificial Sequence
  Synthetic oligonucleotide
agttgcgctacatcttgctcaccatcccgcctccg

SEQ ID NO: 113605 - DNA, 36 bp, Artificial Sequence
  Synthetic oligonucleotide
accacctccggttgccttccaccttgccacaaacta

SEQ ID NO: 113606 - DNA, 35 bp, Artificial Sequence
  Synthetic oligonucleotide
tcccaccgccccatctttgcatattccctgccacg

SEQ ID NO: 113607 - DNA, 35 bp, Artificial Sequence
  Synthetic oligonucleotide
tgtagcgcctgcacctgacgtcccccgcccttcaa

SEQ ID NO: 113608 - DNA, 36 bp, Artificial Sequence
  Synthetic oligonucleotide
ggagaggaaggtgggaaggaggcctggatgagaaga

SEQ ID NO: 113609 - DNA, 37 bp, Artificial Sequence
  Synthetic oligonucleotide
tgactggaccgtagtggagcgggagggagtggaggga

SEQ ID NO: 113610 - DNA, 37 bp, Artificial Sequence
  Synthetic oligonucleotide
atgttggggcagggagtagggggccacgggaagggga

SEQ ID NO: 113611 - DNA, 35 bp, Artificial Sequence
  Synthetic oligonucleotide
tttgccatgccctctgccatggtcacactctttcc

SEQ ID NO: 113612 - DNA, 35 bp, Artificial Sequence
  Synthetic oligonucleotide
tcagcctagccctcccacattgttaatgccgccct

SEQ ID NO: 113613 - DNA, 35 bp, Artificial Sequence
  Synthetic oligonucleotide
acaccgctattgctgccgaactgagccccccccca

SEQ ID NO: 113614 - DNA, 32 bp, Artificial Sequence
  Synthetic oligonucleotide
gctacgatactccgctcccagccgcccccgca

SEQ ID NO: 113615 - DNA, 38 bp, Artificial Sequence
  Synthetic oligonucleotide
tacgccactactgaagtgctatcgtattcccccgctga

SEQ ID NO: 113616 - DNA, 35 bp, Artificial Sequence
  Synthetic oligonucleotide
acccaccaacatatgcattaggctctttccgtaac

SEQ ID NO: 113617 - DNA, 35 bp, Artificial Sequence
  Synthetic oligonucleotide
acgcctccctcgcaacacacttcacggctctgccc

SEQ ID NO: 113618 - DNA, 35 bp, Artificial Sequence
  Synthetic oligonucleotide
gctgggggtcgggagggggaaatctgatctgggtg

SEQ ID NO: 113619 - DNA, 37 bp, Artificial Sequence
  Synthetic oligonucleotide
gtgctcagtcgagaagggtgtggggggcgggatgaga

SEQ ID NO: 113620 - DNA, 37 bp, Artificial Sequence
  Synthetic oligonucleotide
ttgctatgcagccgctcaccagctcaccctctctcga

SEQ ID NO: 113621 - DNA, 35 bp, Artificial Sequence
  Synthetic oligonucleotide
actcaccacacatcacctagctaccgcccacggcc

SEQ ID NO: 113622 - DNA, 35 bp, Artificial Sequence
  Synthetic oligonucleotide
tccagccctcctccctctgccagctcggctttttg

SEQ ID NO: 113623 - DNA, 37 bp, Artificial Sequence
  Synthetic oligonucleotide
tgccaaccccaccatcctctgagacggagccccctga

SEQ ID NO: 113624 - DNA, 36 bp, Artificial Sequence
  Synthetic oligonucleotide
actcccccccggcgcataatggtcaccttttccact

SEQ ID NO: 113625 - DNA, 35 bp, Artificial Sequence
  Synthetic oligonucleotide
ttcccacgccggaccccgcacatctgcatctcgtt

SEQ ID NO: 113626 - DNA, 38 bp, Artificial Sequence
  Synthetic oligonucleotide
tctgacacgccgcccccgatatatctgcctccgtttga

SEQ ID NO: 113627 - DNA, 35 bp, Artificial Sequence
  Synthetic oligonucleotide
gtcccatcctcctaaatgcccgcttgtcccaaagt

SEQ ID NO: 113628 - DNA, 37 bp, Artificial Sequence
  Synthetic oligonucleotide
gtcctcaccactccccgatgccgtttagtcgtatcga

SEQ ID NO: 113629 - DNA, 35 bp, Artificial Sequence
  Synthetic oligonucleotide
tcctccacgttctggtgcattccctccatcctacc

SEQ ID NO: 113630 - DNA, 35 bp, Artificial Sequence
  Synthetic oligonucleotide
gttgccatgtcgttcttggtccgtctcctatcccc

SEQ ID NO: 113631 - DNA, 35 bp, Artificial Sequence
  Synthetic oligonucleotide
atcgttgtcgcccctgctcctgttatcttttggtt

SEQ ID NO: 113632 - DNA, 35 bp, Artificial Sequence
  Synthetic oligonucleotide
tacaccacctctctaccgacttctgcccttgcgcg

SEQ ID NO: 113633 - DNA, 35 bp, Artificial Sequence
  Synthetic oligonucleotide
tcactcggctactcccacatgtcttagcttccctt

SEQ ID NO: 113634 - DNA, 37 bp, Artificial Sequence
  Synthetic oligonucleotide
acgagagggtagacggagggggggggacgcaattcga

SEQ ID NO: 113635 - DNA, 36 bp, Artificial Sequence
  Synthetic oligonucleotide
acaccccaccctcccgcgtgccagtgctcactgtaa

SEQ ID NO: 113636 - DNA, 37 bp, Artificial Sequence
  Synthetic oligonucleotide
gtgggagagacatgggaggggcggatgaagagcgaga

SEQ ID NO: 113637 - DNA, 35 bp, Artificial Sequence
  Synthetic oligonucleotide
gtgtaggggggagggtggaataattagcgggccag

SEQ ID NO: 113638 - DNA, 38 bp, Artificial Sequence
  Synthetic oligonucleotide
tgttgccccttacccgttgtcttcattgaacttgctga

SEQ ID NO: 113639 - DNA, 35 bp, Artificial Sequence
  Synthetic oligonucleotide
gttgtcgtagtacccctcccgcccgcctttacagc

SEQ ID NO: 113640 - DNA, 35 bp, Artificial Sequence
  Synthetic oligonucleotide
atgttctcgccgcctctaccgttaccgtttggctc

SEQ ID NO: 113641 - DNA, 32 bp, Artificial Sequence
  Synthetic oligonucleotide
aacccccaacctgtcaccattggcatattcca

SEQ ID NO: 113642 - DNA, 37 bp, Artificial Sequence
  Synthetic oligonucleotide
gacaagtttgcagggggtggaggggtggtaggttgga

SEQ ID NO: 113643 - DNA, 35 bp, Artificial Sequence
  Synthetic oligonucleotide
atgtggcctcgcccgacctgccttgctatgaatat

SEQ ID NO: 113644 - DNA, 36 bp, Artificial Sequence
  Synthetic oligonucleotide
gcctcgcgcctggtccgtcacactctcattggctca

SEQ ID NO: 113645 - DNA, 35 bp, Artificial Sequence
  Synthetic oligonucleotide
tgccttcacctgctacatcgtttcctgctcttccg

SEQ ID NO: 113646 - DNA, 37 bp, Artificial Sequence
  Synthetic oligonucleotide
gagtacgtcagctccatcccccccgccccgcactcga

SEQ ID NO: 113647 - DNA, 37 bp, Artificial Sequence
  Synthetic oligonucleotide
atccgcccctgtacaaccccatcctcaactacgatga

SEQ ID NO: 113648 - DNA, 36 bp, Artificial Sequence
  Synthetic oligonucleotide
gcaccttccgaactattatacacacgccgcccttga

SEQ ID NO: 113649 - DNA, 35 bp, Artificial Sequence
  Synthetic oligonucleotide
acgcgatggccacacagcgcccccccccgctcccg

SEQ ID NO: 113650 - DNA, 36 bp, Artificial Sequence
  Synthetic oligonucleotide
gacaccacgtccgctgatttcccgccgtaccaccca

SEQ ID NO: 113651 - DNA, 37 bp, Artificial Sequence
  Synthetic oligonucleotide
ggggggccggtagggattggggaaggaatgggggcga

SEQ ID NO: 113652 - DNA, 36 bp, Artificial Sequence
  Synthetic oligonucleotide
gggtggggacctcatctggggataagtagtagggga

SEQ ID NO: 113653 - DNA, 35 bp, Artificial Sequence
  Synthetic oligonucleotide
ttcccctctgacctgtaaaggcgcctgttccactc

SEQ ID NO: 113654 - DNA, 35 bp, Artificial Sequence
  Synthetic oligonucleotide
gtttgcgcacctccatcatgatcaccggcaatctc

SEQ ID NO: 113655 - DNA, 35 bp, Artificial Sequence
  Synthetic oligonucleotide
gaaaacttgctcccgtgcaccccacgtacctctat

SEQ ID NO: 113656 - DNA, 35 bp, Artificial Sequence
  Synthetic oligonucleotide
atggtctgcccgcccttaagttcctggcccccgct

SEQ ID NO: 113657 - DNA, 35 bp, Artificial Sequence
  Synthetic oligonucleotide
tcacgccgatccagccgttctcttgctccgtcgtc

SEQ ID NO: 113658 - DNA, 35 bp, Artificial Sequence
  Synthetic oligonucleotide
gatagcgtgccgcccgctttgtgctccctcttccg

SEQ ID NO: 113659 - DNA, 35 bp, Artificial Sequence
  Synthetic oligonucleotide
aatgcgagagaaggggcgggcgcgaacgggggaat

SEQ ID NO: 113660 - DNA, 35 bp, Artificial Sequence
  Synthetic oligonucleotide
gccacgccgcttccggttcaccccgtcgcccttat

SEQ ID NO: 113661 - DNA, 35 bp, Artificial Sequence
  Synthetic oligonucleotide
attcgcgtggccctcacgccatgtttttgctctct

SEQ ID NO: 113662 - DNA, 35 bp, Artificial Sequence
  Synthetic oligonucleotide
gactctggcgggaaacgggaggaaggggcaaggaa

SEQ ID NO: 113663 - DNA, 35 bp, Artificial Sequence
  Synthetic oligonucleotide
atccacaccttatcaatggcgatttaaccgtgccc

SEQ ID NO: 113664 - DNA, 35 bp, Artificial Sequence
  Synthetic oligonucleotide
tacggtcgccccgcccctccgatccctgcattatg

SEQ ID NO: 113665 - DNA, 36 bp, Artificial Sequence
  Synthetic oligonucleotide
ttggctctccacctgatcccgccgtttcaaccgcca

SEQ ID NO: 113666 - DNA, 37 bp, Artificial Sequence
  Synthetic oligonucleotide
tgaggagagggtggggaaggtggttgaatagttgaga

SEQ ID NO: 113667 - DNA, 36 bp, Artificial Sequence
  Synthetic oligonucleotide
gagaggtgagggggctgaaacgggaggtgactggga

SEQ ID NO: 113668 - DNA, 35 bp, Artificial Sequence
  Synthetic oligonucleotide
atacccaccctcacatgctacagcactaggcaaac

SEQ ID NO: 113669 - DNA, 35 bp, Artificial Sequence
  Synthetic oligonucleotide
ggggcagtagccacctcgtactgtcgcccttgtcc

SEQ ID NO: 113670 - DNA, 35 bp, Artificial Sequence
  Synthetic oligonucleotide
gcaagtagatgtcgcatcacttcccgtcctctctc

SEQ ID NO: 113671 - DNA, 35 bp, Artificial Sequence
  Synthetic oligonucleotide
ggacgtggggcgggggaggatagcgggaggtgttt

SEQ ID NO: 113672 - DNA, 35 bp, Artificial Sequence
  Synthetic oligonucleotide
tcccgtatcgcctccgtattgtccgcgtgttcacc

SEQ ID NO: 113673 - DNA, 35 bp, Artificial Sequence
  Synthetic oligonucleotide
gtactccccgcttcgacctagcctgccccgacggc

SEQ ID NO: 113674 - DNA, 35 bp, Artificial Sequence
  Synthetic oligonucleotide
tgagcgtgcttggctagccccttccactaccacct

SEQ ID NO: 113675 - DNA, 38 bp, Artificial Sequence
  Synthetic oligonucleotide
tacgcctcccagccctatgctcacgacttccaccatga

SEQ ID NO: 113676 - DNA, 38 bp, Artificial Sequence
  Synthetic oligonucleotide
gtcccaccatccatgtacaccactcccattgggcctga

SEQ ID NO: 113677 - DNA, 35 bp, Artificial Sequence
  Synthetic oligonucleotide
atcgccgcccgcctgtttttttctgctatctgtgc

SEQ ID NO: 113678 - DNA, 35 bp, Artificial Sequence
  Synthetic oligonucleotide
gtttgcctccccacctcgcgtgccccattcgagtc

SEQ ID NO: 113679 - DNA, 37 bp, Artificial Sequence
  Synthetic oligonucleotide
gcgagggaaggggggacgaaaacagggatcaggacga

SEQ ID NO: 113680 - DNA, 37 bp, Artificial Sequence
  Synthetic oligonucleotide
gtcagggaaggaggagaatgggggggagcagtgccga

SEQ ID NO: 113681 - DNA, 35 bp, Artificial Sequence
  Synthetic oligonucleotide
gaagctgctggtgtatcacatccgtccgccccacc

SEQ ID NO: 113682 - DNA, 37 bp, Artificial Sequence
  Synthetic oligonucleotide
tgtgacgatcacagggagggaggggtggaggagaaga

SEQ ID NO: 113683 - DNA, 37 bp, Artificial Sequence
  Synthetic oligonucleotide
accagcacggctctggtcatcctgcgcttcctctcga

SEQ ID NO: 113684 - DNA, 35 bp, Artificial Sequence
  Synthetic oligonucleotide
actgaccaacggcacactccacactcgacctcgtc

SEQ ID NO: 113685 - DNA, 35 bp, Artificial Sequence
  Synthetic oligonucleotide
actaccctgccacttgcttgttctccgattacggt

SEQ ID NO: 113686 - DNA, 37 bp, Artificial Sequence
  Synthetic oligonucleotide
gaagaggggtgaaggtggacacaggacaggggaggga

SEQ ID NO: 113687 - DNA, 35 bp, Artificial Sequence
  Synthetic oligonucleotide
ttgctaccaccggccccgaccgtccacccatgcac

SEQ ID NO: 113688 - DNA, 36 bp, Artificial Sequence
  Synthetic oligonucleotide
tcacctcgctgaagtatctgatctgcccctctccga

SEQ ID NO: 113689 - DNA, 35 bp, Artificial Sequence
  Synthetic oligonucleotide
actcgctccacctggcctatgcgcattgtacgttt

SEQ ID NO: 113690 - DNA, 35 bp, Artificial Sequence
  Synthetic oligonucleotide
tctatcgctcgctccaggccttaacacctcacttg

SEQ ID NO: 113691 - DNA, 35 bp, Artificial Sequence
  Synthetic oligonucleotide
gccctgcaggcctcgaattgccgttttatccatct

SEQ ID NO: 113692 - DNA, 36 bp, Artificial Sequence
  Synthetic oligonucleotide
tgccacggttcacgccatgctcccttgccctttgca

SEQ ID NO: 113693 - DNA, 38 bp, Artificial Sequence
  Synthetic oligonucleotide
ggagccagtggggggagggaggagatagacgatgggga

SEQ ID NO: 113694 - DNA, 35 bp, Artificial Sequence
  Synthetic oligonucleotide
atgacccgaagaaattactcggtccttgtcctacc

SEQ ID NO: 113695 - DNA, 35 bp, Artificial Sequence
  Synthetic oligonucleotide
gcactccccgctggttagccgtctttcgttcgtct

SEQ ID NO: 113696 - DNA, 37 bp, Artificial Sequence
  Synthetic oligonucleotide
gaactgacggtgggagctggggaacggggctgggaga

SEQ ID NO: 113697 - DNA, 35 bp, Artificial Sequence
  Synthetic oligonucleotide
tcccgcgtgcaccgctgctgactcctccctcatcc

SEQ ID NO: 113698 - DNA, 36 bp, Artificial Sequence
  Synthetic oligonucleotide
gtgcccgtgcctcagacctgatcgaacccgccacca

SEQ ID NO: 113699 - DNA, 35 bp, Artificial Sequence
  Synthetic oligonucleotide
gccctccaccctctcgcatctgtacatttccccaa

SEQ ID NO: 113700 - DNA, 37 bp, Artificial Sequence
  Synthetic oligonucleotide
gcatcaccctttagctgcttctatgccccgccaccga

SEQ ID NO: 113701 - DNA, 35 bp, Artificial Sequence
  Synthetic oligonucleotide
acccgtacgccgctccccgcttatgccgcccccga

SEQ ID NO: 113702 - DNA, 35 bp, Artificial Sequence
  Synthetic oligonucleotide
gccaatcctccgactcgtattccgcttatttcaac

SEQ ID NO: 113703 - DNA, 35 bp, Artificial Sequence
  Synthetic oligonucleotide
atcaggctcccctccagctttgccttcctatcctg

SEQ ID NO: 113704 - DNA, 38 bp, Artificial Sequence
  Synthetic oligonucleotide
ttcgaccgggtccgggtgggagggaaacgctttggtga

SEQ ID NO: 113705 - DNA, 35 bp, Artificial Sequence
  Synthetic oligonucleotide
tcccccgagctagattcgcatttagccccctgtcc

SEQ ID NO: 113706 - DNA, 35 bp, Artificial Sequence
  Synthetic oligonucleotide
gaccccactgttgcataggtcgtcgcccttaccgc

SEQ ID NO: 113707 - DNA, 35 bp, Artificial Sequence
  Synthetic oligonucleotide
gcaaggagaaaagtgggaaaggcagggaggtgggt

SEQ ID NO: 113708 - DNA, 35 bp, Artificial Sequence
  Synthetic oligonucleotide
gacaccacctctgtctattctgtccccgtccggaa

SEQ ID NO: 113709 - DNA, 35 bp, Artificial Sequence
  Synthetic oligonucleotide
gtcgtaaccgatccgtgccctatggtgcccctttc

SEQ ID NO: 113710 - DNA, 36 bp, Artificial Sequence
  Synthetic oligonucleotide
gactcccccttgccgctggttggctcacacacatca

SEQ ID NO: 113711 - DNA, 35 bp, Artificial Sequence
  Synthetic oligonucleotide
acacccagtcacatgcttgcatcgaccaccacacc

SEQ ID NO: 113712 - DNA, 35 bp, Artificial Sequence
  Synthetic oligonucleotide
accgcctcgaccatcgccttaagccgaactttccc

SEQ ID NO: 113713 - DNA, 35 bp, Artificial Sequence
  Synthetic oligonucleotide
gtgcccctacatcgatcgctgctttctatactgcc

SEQ ID NO: 113714 - DNA, 35 bp, Artificial Sequence
  Synthetic oligonucleotide
tgcgacgagtgggggggacggggtggggagtaggt

SEQ ID NO: 113715 - DNA, 36 bp, Artificial Sequence
  Synthetic oligonucleotide
actccaccgctaaaatgtcccctttgcgccctctca

SEQ ID NO: 113716 - DNA, 37 bp, Artificial Sequence
  Synthetic oligonucleotide
ggtaggggtgagggaggcaaggatagaatgcggagga

SEQ ID NO: 113717 - DNA, 37 bp, Artificial Sequence
  Synthetic oligonucleotide
atacctgggggcggagggggtttggacgggtgggtga

SEQ ID NO: 113718 - DNA, 35 bp, Artificial Sequence
  Synthetic oligonucleotide
gaaaggggtggagagaagcgagtaggtagggcgtc

SEQ ID NO: 113719 - DNA, 35 bp, Artificial Sequence
  Synthetic oligonucleotide
tccgccacccttctagttatacccatggccttccg

SEQ ID NO: 113720 - DNA, 35 bp, Artificial Sequence
  Synthetic oligonucleotide
tcgatttccctcctcatgctgttgctcccgcccat

SEQ ID NO: 113721 - DNA, 35 bp, Artificial Sequence
  Synthetic oligonucleotide
tccatcctcgccttcttcctagtgagttccctcac

SEQ ID NO: 113722 - DNA, 35 bp, Artificial Sequence
  Synthetic oligonucleotide
caaccgccctctgactaccatcgtacctgctttac

SEQ ID NO: 113723 - DNA, 35 bp, Artificial Sequence
  Synthetic oligonucleotide
tcagcacgtacttcttcttccttaacgtgccgccc

SEQ ID NO: 113724 - DNA, 35 bp, Artificial Sequence
  Synthetic oligonucleotide
acgcggcccacgtgacccaccgccgcccgccctgc

SEQ ID NO: 113725 - DNA, 38 bp, Artificial Sequence
  Synthetic oligonucleotide
gcaacccacgttgtcacaccctaccatcctccgcatga

SEQ ID NO: 113726 - DNA, 35 bp, Artificial Sequence
  Synthetic oligonucleotide
catcaagcccgccatgttcacccccgcccttcgcc

SEQ ID NO: 113727 - DNA, 35 bp, Artificial Sequence
  Synthetic oligonucleotide
atcacgccactaacgcgtatacacttttcctggtc

SEQ ID NO: 113728 - DNA, 35 bp, Artificial Sequence
  Synthetic oligonucleotide
ttccgtgcccagttcctcctcccgcgatgcggttc

SEQ ID NO: 113729 - DNA, 35 bp, Artificial Sequence
  Synthetic oligonucleotide
ttgatccgccgcttccttaacgtttccccccgagg

SEQ ID NO: 113730 - DNA, 37 bp, Artificial Sequence
  Synthetic oligonucleotide
tagcgatggggggaggggaagaagggccacgcatcga

SEQ ID NO: 113731 - DNA, 38 bp, Artificial Sequence
  Synthetic oligonucleotide
gcacggtcccctgcctttgtacgccacggcctccctga

SEQ ID NO: 113732 - DNA, 35 bp, Artificial Sequence
  Synthetic oligonucleotide
tcatcacgcctgcagacgccgagcgacccccccgc

SEQ ID NO: 113733 - DNA, 35 bp, Artificial Sequence
  Synthetic oligonucleotide
aagtacgcctccagctcgctaccgcttcccttggc

SEQ ID NO: 113734 - DNA, 35 bp, Artificial Sequence
  Synthetic oligonucleotide
ataactgcgcgatcactgtccctttccccgcggtc

SEQ ID NO: 113735 - DNA, 35 bp, Artificial Sequence
  Synthetic oligonucleotide
gcccatccttcctgtctccatctatactgacgttc

SEQ ID NO: 113736 - DNA, 35 bp, Artificial Sequence
  Synthetic oligonucleotide
ggtgcaccctaggtcttatctttcgctcgcccacg

SEQ ID NO: 113737 - DNA, 37 bp, Artificial Sequence
  Synthetic oligonucleotide
gcacagttggggagggggggtgaagggctagttccga

SEQ ID NO: 113738 - DNA, 35 bp, Artificial Sequence
  Synthetic oligonucleotide
gcgcatggcacgaattcgtcacctgcctcccgtac

SEQ ID NO: 113739 - DNA, 37 bp, Artificial Sequence
  Synthetic oligonucleotide
gagagacggagggggggtgggaacgtaggatgggaga

SEQ ID NO: 113740 - DNA, 35 bp, Artificial Sequence
  Synthetic oligonucleotide
acaccaccatttgctttcgttactccggctatacc

SEQ ID NO: 113741 - DNA, 35 bp, Artificial Sequence
  Synthetic oligonucleotide
gacccgatctacaagttttttcagccgcccgcccc

SEQ ID NO: 113742 - DNA, 28 bp, Artificial Sequence
  Synthetic oligonucleotide
tctccttacgcccccacaccctgcttct

SEQ ID NO: 113743 - DNA, 37 bp, Artificial Sequence
  Synthetic oligonucleotide
tgagggtgaaggaaatgacaaggggaggggaggtaga

SEQ ID NO: 113744 - DNA, 35 bp, Artificial Sequence
  Synthetic oligonucleotide
gtgtacggcacttttgtccgaaaccgcttcccacc

SEQ ID NO: 113745 - DNA, 35 bp, Artificial Sequence
  Synthetic oligonucleotide
agcccatgcctccattattctcgtttacctgcctc

SEQ ID NO: 113746 - DNA, 35 bp, Artificial Sequence
  Synthetic oligonucleotide
ttgcgacccgccaccccccgtcacatgcactacgg

SEQ ID NO: 113747 - DNA, 35 bp, Artificial Sequence
  Synthetic oligonucleotide
gacgcctccggattagcattctcctcctcttgtgg

SEQ ID NO: 113748 - DNA, 38 bp, Artificial Sequence
  Synthetic oligonucleotide
tccgatccccacgcctgtccgtccttaatgcaccctga

SEQ ID NO: 113749 - DNA, 36 bp, Artificial Sequence
  Synthetic oligonucleotide
gccacacgtccgtcccgcccccctcgaccagtgaaa

SEQ ID NO: 113750 - DNA, 35 bp, Artificial Sequence
  Synthetic oligonucleotide
agtgaccgtccggcagcctccgctccttccccccc

SEQ ID NO: 113751 - DNA, 35 bp, Artificial Sequence
  Synthetic oligonucleotide
ttgctacacacgactttgcctactcgcctctccgc

SEQ ID NO: 113752 - DNA, 35 bp, Artificial Sequence
  Synthetic oligonucleotide
tgtcctcacaggccttattcaaccgccgcctttgc

SEQ ID NO: 113753 - DNA, 35 bp, Artificial Sequence
  Synthetic oligonucleotide
ggaggacaggaggggggagcattgaacctaagcgg

SEQ ID NO: 113754 - DNA, 38 bp, Artificial Sequence
  Synthetic oligonucleotide
acagggaaggggacggggggtaggtatggcaagggtga

SEQ ID NO: 113755 - DNA, 36 bp, Artificial Sequence
  Synthetic oligonucleotide
aaaggtgaggggcggaggatggggagctgtggttga

SEQ ID NO: 113756 - DNA, 35 bp, Artificial Sequence
  Synthetic oligonucleotide
ttgggcctgccctttcgtcgacttcttgatccatc

SEQ ID NO: 113757 - DNA, 36 bp, Artificial Sequence
  Synthetic oligonucleotide
tttcgacccgccgtaccaccctttgtgcctagccca

SEQ ID NO: 113758 - DNA, 35 bp, Artificial Sequence
  Synthetic oligonucleotide
gtaccccccatatgtatggcctccccacgtgtgca

SEQ ID NO: 113759 - DNA, 37 bp, Artificial Sequence
  Synthetic oligonucleotide
gccactgcctcacccgtaactgttcactctgccctga

SEQ ID NO: 113760 - DNA, 35 bp, Artificial Sequence
  Synthetic oligonucleotide
caacccaccgcccgatcactatgtctacgcccccc

SEQ ID NO: 113761 - DNA, 35 bp, Artificial Sequence
  Synthetic oligonucleotide
tcccatgactgtaccccccgaccggacccgcgacc

SEQ ID NO: 113762 - DNA, 35 bp, Artificial Sequence
  Synthetic oligonucleotide
tctcacgttcccgtgccccggtcctgactcatcgc

SEQ ID NO: 113763 - DNA, 35 bp, Artificial Sequence
  Synthetic oligonucleotide
tccatacccgcctgccgcttctactagtcacaatc

SEQ ID NO: 113764 - DNA, 35 bp, Artificial Sequence
  Synthetic oligonucleotide
tgttccttcgcccccctgtgatatctgttccctga

SEQ ID NO: 113765 - DNA, 35 bp, Artificial Sequence
  Synthetic oligonucleotide
gacgctcctccccgttcgtgaagcttgcactcctt

SEQ ID NO: 113766 - DNA, 36 bp, Artificial Sequence
  Synthetic oligonucleotide
actcaccccacacccccccagaccagtcgctgtcga

SEQ ID NO: 113767 - DNA, 35 bp, Artificial Sequence
  Synthetic oligonucleotide
acagagggggaatggcagggaggttgcgcggtcta

SEQ ID NO: 113768 - DNA, 35 bp, Artificial Sequence
  Synthetic oligonucleotide
tatgcaccgccgaccccccccaagcacggcccaac

SEQ ID NO: 113769 - DNA, 35 bp, Artificial Sequence
  Synthetic oligonucleotide
aaccccgtcacgcttatccgttactccttccaccg

SEQ ID NO: 113770 - DNA, 37 bp, Artificial Sequence
  Synthetic oligonucleotide
gttgtcccacgccacttgtcgatttcatatttcctga

SEQ ID NO: 113771 - DNA, 35 bp, Artificial Sequence
  Synthetic oligonucleotide
atcccaccgcttggtctcaaggtcgtacctccgcc

SEQ ID NO: 113772 - DNA, 35 bp, Artificial Sequence
  Synthetic oligonucleotide
tacgatgaacgaccacatgtcctgcacctccgctc

SEQ ID NO: 113773 - DNA, 35 bp, Artificial Sequence
  Synthetic oligonucleotide
gttcaacacgcaggacctgcacctcgctttctacc

SEQ ID NO: 113774 - DNA, 35 bp, Artificial Sequence
  Synthetic oligonucleotide
tcactgtgcgccacttcaccttctgccttactttg

SEQ ID NO: 113775 - DNA, 35 bp, Artificial Sequence
  Synthetic oligonucleotide
tgcccacgcgccgcctggccttgtctcctcctact

SEQ ID NO: 113776 - DNA, 35 bp, Artificial Sequence
  Synthetic oligonucleotide
tgaggccaggctagtctgtcctactaccgtcccct

SEQ ID NO: 113777 - DNA, 37 bp, Artificial Sequence
  Synthetic oligonucleotide
tccgcaccgcacttttttgaacacgctccacctgtga

SEQ ID NO: 113778 - DNA, 35 bp, Artificial Sequence
  Synthetic oligonucleotide
tgtccgtgccttctagttttgtccgcctactcctt

SEQ ID NO: 113779 - DNA, 37 bp, Artificial Sequence
  Synthetic oligonucleotide
gcaccatcacatgcccttctgtccgtctccccagtga

SEQ ID NO: 113780 - DNA, 35 bp, Artificial Sequence
  Synthetic oligonucleotide
accacgcacagctcccgtcccccctgcgtgcttta

SEQ ID NO: 113781 - DNA, 35 bp, Artificial Sequence
  Synthetic oligonucleotide
tctggccactgcgtgtaacttccgccgctccctac

SEQ ID NO: 113782 - DNA, 35 bp, Artificial Sequence
  Synthetic oligonucleotide
gaccactcacattttggggctgcctgatcacccac

SEQ ID NO: 113783 - DNA, 35 bp, Artificial Sequence
  Synthetic oligonucleotide
tccgcctccccgtaatgcccgttcacctcccgagc

SEQ ID NO: 113784 - DNA, 35 bp, Artificial Sequence
  Synthetic oligonucleotide
gcactgcccgctcccatgtcgttgcgccccgtatc

SEQ ID NO: 113785 - DNA, 35 bp, Artificial Sequence
  Synthetic oligonucleotide
aacccatgagaacctgcctgcccgtccctgccctg

SEQ ID NO: 113786 - DNA, 36 bp, Artificial Sequence
  Synthetic oligonucleotide
atgccacctcccatggcctgtaactcccgttgatca

SEQ ID NO: 113787 - DNA, 35 bp, Artificial Sequence
  Synthetic oligonucleotide
accatccactttcgctgtatttagccttttaccaa

SEQ ID NO: 113788 - DNA, 36 bp, Artificial Sequence
  Synthetic oligonucleotide
gtcccgcccgcccctgcatgtaacgcaacctatgca

SEQ ID NO: 113789 - DNA, 35 bp, Artificial Sequence
  Synthetic oligonucleotide
gtgggcactcggtccgcccttgtaaagccccccta

SEQ ID NO: 113790 - DNA, 35 bp, Artificial Sequence
  Synthetic oligonucleotide
actgggaggggagggtagttgtatcgggactaaac

SEQ ID NO: 113791 - DNA, 35 bp, Artificial Sequence
  Synthetic oligonucleotide
ttgaagccacatcctgtcctttagcctctgcaccc

SEQ ID NO: 113792 - DNA, 35 bp, Artificial Sequence
  Synthetic oligonucleotide
gccactcataaccgcatttacgccggcgccttgcc

SEQ ID NO: 113793 - DNA, 35 bp, Artificial Sequence
  Synthetic oligonucleotide
gaaacgccctcgcccccaccagacagtacgccatc

SEQ ID NO: 113794 - DNA, 35 bp, Artificial Sequence
  Synthetic oligonucleotide
gagaggcggatacgaacatgggggggaggaaagca

SEQ ID NO: 113795 - DNA, 32 bp, Artificial Sequence
  Synthetic oligonucleotide
tctacccttccgagcgtggctatccccctgca

SEQ ID NO: 113796 - DNA, 36 bp, Artificial Sequence
  Synthetic oligonucleotide
gccgcccctcgtaatgctagtacccctgccttttca

SEQ ID NO: 113797 - DNA, 36 bp, Artificial Sequence
  Synthetic oligonucleotide
aacgaagtgcgtagggcgggtgggtataatgggcta

SEQ ID NO: 113798 - DNA, 35 bp, Artificial Sequence
  Synthetic oligonucleotide
aacgcccatccacgcgtgtccaactaccgctcgcc

SEQ ID NO: 113799 - DNA, 35 bp, Artificial Sequence
  Synthetic oligonucleotide
ggtcacccgcatttggtgttgtccccgaaccctcc

SEQ ID NO: 113800 - DNA, 35 bp, Artificial Sequence
  Synthetic oligonucleotide
ggcccctcacgccccctgtcgtacctcctgctcgc

SEQ ID NO: 113801 - DNA, 37 bp, Artificial Sequence
  Synthetic oligonucleotide
accgcccacaactggcgtaatatcacttcctctttga

SEQ ID NO: 113802 - DNA, 35 bp, Artificial Sequence
  Synthetic oligonucleotide
gttgcgcagaccttccggcgtccatcccatgtcac

SEQ ID NO: 113803 - DNA, 35 bp, Artificial Sequence
  Synthetic oligonucleotide
atgaccgctgcacttcctcctcgtagtccacatgc

SEQ ID NO: 113804 - DNA, 35 bp, Artificial Sequence
  Synthetic oligonucleotide
tgataccgcgccccactatctatggttgcccgttc

SEQ ID NO: 113805 - DNA, 35 bp, Artificial Sequence
  Synthetic oligonucleotide
acgttcccaaccctctacatgtccttatccgtagc

SEQ ID NO: 113806 - DNA, 35 bp, Artificial Sequence
  Synthetic oligonucleotide
aaccactccattgtttgcctccagtaggcccctgc

SEQ ID NO: 113807 - DNA, 35 bp, Artificial Sequence
  Synthetic oligonucleotide
attgtcgcgaatgtccttaccgcctgtaccatctc

SEQ ID NO: 113808 - DNA, 35 bp, Artificial Sequence
  Synthetic oligonucleotide
tttcaaccgccgtatcgataatgttccgcccgttc

SEQ ID NO: 113809 - DNA, 35 bp, Artificial Sequence
  Synthetic oligonucleotide
gtaacctccctcattgcgcttaatccagcccaccc

SEQ ID NO: 113810 - DNA, 35 bp, Artificial Sequence
  Synthetic oligonucleotide
actcgtagcccccacgtccttcaccacccaggcgc

SEQ ID NO: 113811 - DNA, 35 bp, Artificial Sequence
  Synthetic oligonucleotide
gatgctgccccacttagccaccccgccataccccg

SEQ ID NO: 113812 - DNA, 38 bp, Artificial Sequence
  Synthetic oligonucleotide
acccgcccgcctgccgtacttaacgcctcatctagtga

SEQ ID NO: 113813 - DNA, 38 bp, Artificial Sequence
  Synthetic oligonucleotide
attgcccgtctccgttatcgcctctccatcctgtgtga

SEQ ID NO: 113814 - DNA, 35 bp, Artificial Sequence
  Synthetic oligonucleotide
tctaactcccaccgtgcactacactcgcctgttac

SEQ ID NO: 113815 - DNA, 35 bp, Artificial Sequence
  Synthetic oligonucleotide
tattcaccccagcgccgctccgtcctttgattctc

SEQ ID NO: 113816 - DNA, 35 bp, Artificial Sequence
  Synthetic oligonucleotide
tagaaaaagggagaagggtgggccacggtgggaga

SEQ ID NO: 113817 - DNA, 35 bp, Artificial Sequence
  Synthetic oligonucleotide
atcgcattgtgcccctctgctgcctaccttgattc

SEQ ID NO: 113818 - DNA, 35 bp, Artificial Sequence
  Synthetic oligonucleotide
gaccacctcggcgtgaggcggtccattcccctgtt

SEQ ID NO: 113819 - DNA, 35 bp, Artificial Sequence
  Synthetic oligonucleotide
taccgcactcccgctaagtcccgatgcccccgccc

SEQ ID NO: 113820 - DNA, 35 bp, Artificial Sequence
  Synthetic oligonucleotide
tcgcacgtggcgctcgctcaaagtcttccccctcg

SEQ ID NO: 113821 - DNA, 35 bp, Artificial Sequence
  Synthetic oligonucleotide
agctgcatccggtagtctctttgtctccatccctc

SEQ ID NO: 113822 - DNA, 36 bp, Artificial Sequence
  Synthetic oligonucleotide
tttgccgcctgctctcgttcgtcctgagccccatac

SEQ ID NO: 113823 - DNA, 35 bp, Artificial Sequence
  Synthetic oligonucleotide
ttccgcccctcgttgtatcgctccgtatcgggtac

SEQ ID NO: 113824 - DNA, 35 bp, Artificial Sequence
  Synthetic oligonucleotide
tcacatgtacgtgtctgtcccaccccttgttctcg

SEQ ID NO: 113825 - DNA, 35 bp, Artificial Sequence
  Synthetic oligonucleotide
gtgctacgacatacccagtgccccctcccaccgtg

SEQ ID NO: 113826 - DNA, 35 bp, Artificial Sequence
  Synthetic oligonucleotide
tgaactgcgccctgtcccgtcacttgaacgccact

SEQ ID NO: 113827 - DNA, 36 bp, Artificial Sequence
  Synthetic oligonucleotide
ttgatgcatccggctgtctcccctcccccccgggca

SEQ ID NO: 113828 - DNA, 35 bp, Artificial Sequence
  Synthetic oligonucleotide
aacacgcccccccatccccccgcttctggtggacg

SEQ ID NO: 113829 - DNA, 35 bp, Artificial Sequence
  Synthetic oligonucleotide
tctcggcccactctcattgttactgtcccaccccc

SEQ ID NO: 113830 - DNA, 35 bp, Artificial Sequence
  Synthetic oligonucleotide
aacccgcaatgagcggtaccgttcccctcctctgc

SEQ ID NO: 113831 - DNA, 36 bp, Artificial Sequence
  Synthetic oligonucleotide
acgccggggcccatccacgtttcactgccactctca

SEQ ID NO: 113832 - DNA, 37 bp, Artificial Sequence
  Synthetic oligonucleotide
tcagcctcgctcgcccgttccctcagcacgcttttga

SEQ ID NO: 113833 - DNA, 35 bp, Artificial Sequence
  Synthetic oligonucleotide
gtgacccctgcgccctgctttcaatcaacgtcccc

SEQ ID NO: 113834 - DNA, 35 bp, Artificial Sequence
  Synthetic oligonucleotide
tcagattcccagttgtacatgccctcccgacccag

SEQ ID NO: 113835 - DNA, 35 bp, Artificial Sequence
  Synthetic oligonucleotide
attgcactgccccaggttctgctcctctttaactg

SEQ ID NO: 113836 - DNA, 35 bp, Artificial Sequence
  Synthetic oligonucleotide
atcacccgcgccaccctactaggtcttcgtttaca

SEQ ID NO: 113837 - DNA, 36 bp, Artificial Sequence
  Synthetic oligonucleotide
accgccgtatccgttaaatcgttgcccatccgccca

SEQ ID NO: 113838 - DNA, 36 bp, Artificial Sequence
  Synthetic oligonucleotide
gcaacccccctctgcttattgatccggctcaacgca

SEQ ID NO: 113839 - DNA, 36 bp, Artificial Sequence
  Synthetic oligonucleotide
tcgcaattccgcccgccgtaataacccttgccttca

SEQ ID NO: 113840 - DNA, 35 bp, Artificial Sequence
  Synthetic oligonucleotide
gagttccgacccctgccccagttcctcctactgac

SEQ ID NO: 113841 - DNA, 35 bp, Artificial Sequence
  Synthetic oligonucleotide
taaccagcccgccccatcccctagtgtcatccggc

SEQ ID NO: 113842 - DNA, 35 bp, Artificial Sequence
  Synthetic oligonucleotide
tgccctcccgttggctcttctccagatctgctttt

SEQ ID NO: 113843 - DNA, 35 bp, Artificial Sequence
  Synthetic oligonucleotide
tgtgtccagtccgtgcgccgccctccttgccatcg

SEQ ID NO: 113844 - DNA, 35 bp, Artificial Sequence
  Synthetic oligonucleotide
tgtcaccaacgccacgacccgctccccagcctctt

SEQ ID NO: 113845 - DNA, 36 bp, Artificial Sequence
  Synthetic oligonucleotide
gccccgcctactgcacaaaccaacgcccttgccgaa

SEQ ID NO: 113846 - DNA, 36 bp, Artificial Sequence
  Synthetic oligonucleotide
agaaccgcccacctgttttaccccgttttttcgtaa

SEQ ID NO: 113847 - DNA, 35 bp, Artificial Sequence
  Synthetic oligonucleotide
tccgttcaccatctctcactttgcatctgccacaa

SEQ ID NO: 113848 - DNA, 35 bp, Artificial Sequence
  Synthetic oligonucleotide
atcaccccgtctcgcttctgttaaatcgttgccac

SEQ ID NO: 113849 - DNA, 35 bp, Artificial Sequence
  Synthetic oligonucleotide
atgaacctcgccgtatccaccacccttgctacaag

SEQ ID NO: 113850 - DNA, 35 bp, Artificial Sequence
  Synthetic oligonucleotide
aggagagaaggggagtcggagagggtgcggggtgt

SEQ ID NO: 113851 - DNA, 36 bp, Artificial Sequence
  Synthetic oligonucleotide
gcaccccccattgcctcatagaaaaagcgattctca

SEQ ID NO: 113852 - DNA, 37 bp, Artificial Sequence
  Synthetic oligonucleotide
tcaacgggcggagggagggaatcatgagggaggacga

SEQ ID NO: 113853 - DNA, 37 bp, Artificial Sequence
  Synthetic oligonucleotide
atggataggggatggggaggggctgggcgaaacgcga

SEQ ID NO: 113854 - DNA, 37 bp, Artificial Sequence
  Synthetic oligonucleotide
gggatgggaaggtggatactttggaaagggtgtagga

SEQ ID NO: 113855 - DNA, 37 bp, Artificial Sequence
  Synthetic oligonucleotide
tgaagggaggagagaggggtaagggcatgtgtttgga

SEQ ID NO: 113856 - DNA, 35 bp, Artificial Sequence
  Synthetic oligonucleotide
aaacgagcttgaccgccgtgcctccgcccccgttc

SEQ ID NO: 113857 - DNA, 35 bp, Artificial Sequence
  Synthetic oligonucleotide
gatgcagggaggcagggtgggtgggcaggggagcg

SEQ ID NO: 113858 - DNA, 35 bp, Artificial Sequence
  Synthetic oligonucleotide
tgtcaccctacggcatgctgacccttgttaacaat

SEQ ID NO: 113859 - DNA, 37 bp, Artificial Sequence
  Synthetic oligonucleotide
tgaaccggtgaagggtggggcgggggcagtaagaaga

SEQ ID NO: 113860 - DNA, 35 bp, Artificial Sequence
  Synthetic oligonucleotide
tccgaaccctgcctctctaattgtacttacacgac

SEQ ID NO: 113861 - DNA, 35 bp, Artificial Sequence
  Synthetic oligonucleotide
ttgacctcagcctcgtctcaattatgccgccgccc

SEQ ID NO: 113862 - DNA, 35 bp, Artificial Sequence
  Synthetic oligonucleotide
tctccccactccacctcgatgccgtgctcccgtcc

SEQ ID NO: 113863 - DNA, 35 bp, Artificial Sequence
  Synthetic oligonucleotide
tccacgcctacgcctaccctcaagagcctcccttg

SEQ ID NO: 113864 - DNA, 35 bp, Artificial Sequence
  Synthetic oligonucleotide
tgagcgccctgccgaggatccctgcccttccgctt

SEQ ID NO: 113865 - DNA, 35 bp, Artificial Sequence
  Synthetic oligonucleotide
gtgcccccccaacggctggccgattctcgtttctc

SEQ ID NO: 113866 - DNA, 35 bp, Artificial Sequence
  Synthetic oligonucleotide
ggtcgtccagcccccgttccttcccgatcgttgct

SEQ ID NO: 113867 - DNA, 36 bp, Artificial Sequence
  Synthetic oligonucleotide
ggaaaggggtgcatggggatcaagggggaatggaca

SEQ ID NO: 113868 - DNA, 35 bp, Artificial Sequence
  Synthetic oligonucleotide
taagcgaccgcacctgctctgtgctagccttcccc

SEQ ID NO: 113869 - DNA, 35 bp, Artificial Sequence
  Synthetic oligonucleotide
ggatcttccgcctatgctccctggcctcccaagcc

SEQ ID NO: 113870 - DNA, 35 bp, Artificial Sequence
  Synthetic oligonucleotide
gtacgcagccctggcccttccgcgccccgcatcac

SEQ ID NO: 113871 - DNA, 35 bp, Artificial Sequence
  Synthetic oligonucleotide
gccgccccttaatgtgctgctacccacggtccccc

SEQ ID NO: 113872 - DNA, 35 bp, Artificial Sequence
  Synthetic oligonucleotide
acacagctcagatcgtctctctcgaacccccgcgc

SEQ ID NO: 113873 - DNA, 36 bp, Artificial Sequence
  Synthetic oligonucleotide
atcgccaccctcatcatgtctccttcgttgtcggaa

SEQ ID NO: 113874 - DNA, 35 bp, Artificial Sequence
  Synthetic oligonucleotide
gtagccctccccaagtaaatatcggtcactgcctc

SEQ ID NO: 113875 - DNA, 35 bp, Artificial Sequence
  Synthetic oligonucleotide
tcacgtgccctgttttggctaccatcccccctgag

SEQ ID NO: 113876 - DNA, 35 bp, Artificial Sequence
  Synthetic oligonucleotide
accaggccctctttgtctttcctccctgtcctact

SEQ ID NO: 113877 - DNA, 35 bp, Artificial Sequence
  Synthetic oligonucleotide
ttcgaccccgcccttctcgacgtgcaccggcgact

SEQ ID NO: 113878 - DNA, 35 bp, Artificial Sequence
  Synthetic oligonucleotide
atgatgggtcattccccccggctccgcccgccgcc

SEQ ID NO: 113879 - DNA, 35 bp, Artificial Sequence
  Synthetic oligonucleotide
gcaccatccattgccttgattcgcagtccacgcgc

SEQ ID NO: 113880 - DNA, 35 bp, Artificial Sequence
  Synthetic oligonucleotide
atcaccgccattcatctacgccctggactataggc

SEQ ID NO: 113881 - DNA, 37 bp, Artificial Sequence
  Synthetic oligonucleotide
gtcacctcgtgcttattctaccgtcttccctgcgcga

SEQ ID NO: 113882 - DNA, 37 bp, Artificial Sequence
  Synthetic oligonucleotide
tgtccaccgctaatgttccccatcgccttcctcagga

SEQ ID NO: 113883 - DNA, 35 bp, Artificial Sequence
  Synthetic oligonucleotide
gaccaactcggctttgattattctctcttccctgt

SEQ ID NO: 113884 - DNA, 35 bp, Artificial Sequence
  Synthetic oligonucleotide
acatggcgcaacgctgacttccgcatcccccctgc

SEQ ID NO: 113885 - DNA, 35 bp, Artificial Sequence
  Synthetic oligonucleotide
accgagacgggagggttttggggggggcggcttgc

SEQ ID NO: 113886 - DNA, 35 bp, Artificial Sequence
  Synthetic oligonucleotide
gacccccccatgcccagtgcgtacttcaactgccg

SEQ ID NO: 113887 - DNA, 35 bp, Artificial Sequence
  Synthetic oligonucleotide
gacactcgcccgtagcccaggtaatgccttcccca

SEQ ID NO: 113888 - DNA, 35 bp, Artificial Sequence
  Synthetic oligonucleotide
aacccagcccgtttgccagtcatcgaaaccgccct

SEQ ID NO: 113889 - DNA, 35 bp, Artificial Sequence
  Synthetic oligonucleotide
tcgcacgcccttgctggctatcacattacatcacc

SEQ ID NO: 113890 - DNA, 35 bp, Artificial Sequence
  Synthetic oligonucleotide
tatttcaagcgcacccttgtcctttgtcactccct

SEQ ID NO: 113891 - DNA, 35 bp, Artificial Sequence
  Synthetic oligonucleotide
acgccctaccgcccggattcctttacaccgccctt

SEQ ID NO: 113892 - DNA, 35 bp, Artificial Sequence
  Synthetic oligonucleotide
tcgcccggattcactgtctctcgtaccgccttgcc

SEQ ID NO: 113893 - DNA, 35 bp, Artificial Sequence
  Synthetic oligonucleotide
gacacccgcgccactctccggttatccacctcgct

SEQ ID NO: 113894 - DNA, 35 bp, Artificial Sequence
  Synthetic oligonucleotide
ttgacccacacccgctcgagccccctgccccgatt

SEQ ID NO: 113895 - DNA, 35 bp, Artificial Sequence
  Synthetic oligonucleotide
tacaccctgctcgtctccatgaacgatgttcattt

SEQ ID NO: 113896 - DNA, 38 bp, Artificial Sequence
  Synthetic oligonucleotide
acagggcggggcgttctggggaacagccagggggatga

SEQ ID NO: 113897 - DNA, 35 bp, Artificial Sequence
  Synthetic oligonucleotide
gatgcccccttgtaaagatcgtgcccccgtaccac

SEQ ID NO: 113898 - DNA, 35 bp, Artificial Sequence
  Synthetic oligonucleotide
atggaggggagggaagctgggtgggatgggtaccc

SEQ ID NO: 113899 - DNA, 35 bp, Artificial Sequence
  Synthetic oligonucleotide
atccttgccgtcctgtcatccaccctgcctttggc

SEQ ID NO: 113900 - DNA, 35 bp, Artificial Sequence
  Synthetic oligonucleotide
gacacatctcgcccgctatgaagccttcccttatt

SEQ ID NO: 113901 - DNA, 35 bp, Artificial Sequence
  Synthetic oligonucleotide
cccacaccccgccgccgttacatactggttgcctt

SEQ ID NO: 113902 - DNA, 36 bp, Artificial Sequence
  Synthetic oligonucleotide
gactcccctccgactacctcgggacagaccttccaa

SEQ ID NO: 113903 - DNA, 35 bp, Artificial Sequence
  Synthetic oligonucleotide
attgtcaccataacatgcgtctcgctgccgctccc

SEQ ID NO: 113904 - DNA, 37 bp, Artificial Sequence
  Synthetic oligonucleotide
atgggacgagcatacgggagggagacaatatgggcga

SEQ ID NO: 113905 - DNA, 37 bp, Artificial Sequence
  Synthetic oligonucleotide
ttacagcccaactgccctgtccacgcttcctgttcga

SEQ ID NO: 113906 - DNA, 35 bp, Artificial Sequence
  Synthetic oligonucleotide
gatgttggggcgtatacgggtggggggcacgggga

SEQ ID NO: 113907 - DNA, 35 bp, Artificial Sequence
  Synthetic oligonucleotide
gaggggggtaggtggagggataggctataggggac

SEQ ID NO: 113908 - DNA, 35 bp, Artificial Sequence
  Synthetic oligonucleotide
ttcacagtgcacctcgctcatccgcctctcgatac

SEQ ID NO: 113909 - DNA, 35 bp, Artificial Sequence
  Synthetic oligonucleotide
ttagcccggccccacacgcaatgctccgtttaacc

SEQ ID NO: 113910 - DNA, 36 bp, Artificial Sequence
  Synthetic oligonucleotide
tccacctcccatcgttcatttgacgcagtcacaaca

SEQ ID NO: 113911 - DNA, 36 bp, Artificial Sequence
  Synthetic oligonucleotide
tgcccggcaaccgccatcaccgtcgcccgcctccca

SEQ ID NO: 113912 - DNA, 35 bp, Artificial Sequence
  Synthetic oligonucleotide
gacaccgatccgttccatcatcccgtcctagtggc

SEQ ID NO: 113913 - DNA, 37 bp, Artificial Sequence
  Synthetic oligonucleotide
ttgaatgacgacgggtggcggggggagggctaaagga

SEQ ID NO: 113914 - DNA, 35 bp, Artificial Sequence
  Synthetic oligonucleotide
tccgccccagtcccaccgatattagctcgcggaac

SEQ ID NO: 113915 - DNA, 35 bp, Artificial Sequence
  Synthetic oligonucleotide
tacccagcctcccgactcttccgtgttcgtctctc

SEQ ID NO: 113916 - DNA, 35 bp, Artificial Sequence
  Synthetic oligonucleotide
gcatgcccattgtctgttcctgggtctcgtttttc

SEQ ID NO: 113917 - DNA, 35 bp, Artificial Sequence
  Synthetic oligonucleotide
gttcccccccgcgatcatggtatcgtgcgctttac

SEQ ID NO: 113918 - DNA, 35 bp, Artificial Sequence
  Synthetic oligonucleotide
cacaccccctcgttagcacacactgactccttagc

SEQ ID NO: 113919 - DNA, 35 bp, Artificial Sequence
  Synthetic oligonucleotide
tactctcgcacctgtggtttaccgctgttacacct

SEQ ID NO: 113920 - DNA, 36 bp, Artificial Sequence
  Synthetic oligonucleotide
gcctggctagcccacccattgttcgcgccacctcga

SEQ ID NO: 113921 - DNA, 37 bp, Artificial Sequence
  Synthetic oligonucleotide
taggggacgaaggggggcacggaagaaaggcatcgga

SEQ ID NO: 113922 - DNA, 38 bp, Artificial Sequence
  Synthetic oligonucleotide
gtgcgaggtggtggacggggcacgagaggaagggatga

SEQ ID NO: 113923 - DNA, 35 bp, Artificial Sequence
  Synthetic oligonucleotide
tccccccgtccccacaagattctcgcataccgccg

SEQ ID NO: 113924 - DNA, 35 bp, Artificial Sequence
  Synthetic oligonucleotide
atgaacgcatcgggagggcgcgggtgacggggtat

SEQ ID NO: 113925 - DNA, 37 bp, Artificial Sequence
  Synthetic oligonucleotide
gcaccccccgccacacgcgccgcaaccctcagcttga

SEQ ID NO: 113926 - DNA, 35 bp, Artificial Sequence
  Synthetic oligonucleotide
acttgcactacctcgattcccttacgctcgactcc

SEQ ID NO: 113927 - DNA, 35 bp, Artificial Sequence
  Synthetic oligonucleotide
gacccctcatcgggagcgcattctgctatcgcccc

SEQ ID NO: 113928 - DNA, 36 bp, Artificial Sequence
  Synthetic oligonucleotide
gcccgcctaccgcatcactcgccgctcaacccgcca

SEQ ID NO: 113929 - DNA, 36 bp, Artificial Sequence
  Synthetic oligonucleotide
tcctcactcgccttgtcactcgatcctggtcattca

SEQ ID NO: 113930 - DNA, 38 bp, Artificial Sequence
  Synthetic oligonucleotide
tggtcggtaggatgaggtggaggggcatgtggtggtga

SEQ ID NO: 113931 - DNA, 35 bp, Artificial Sequence
  Synthetic oligonucleotide
gcccaccaccgccttgtccttccgcctggatcgta

SEQ ID NO: 113932 - DNA, 35 bp, Artificial Sequence
  Synthetic oligonucleotide
gtgcacgcccttccccgaccctgccgctcgttagc

SEQ ID NO: 113933 - DNA, 35 bp, Artificial Sequence
  Synthetic oligonucleotide
tcccgttgccatgcgctttatccccgcccttttaa

SEQ ID NO: 113934 - DNA, 36 bp, Artificial Sequence
  Synthetic oligonucleotide
gtcccgcccccatcatgactcaactgttcaccgcga

SEQ ID NO: 113935 - DNA, 35 bp, Artificial Sequence
  Synthetic oligonucleotide
tacgcgacttccgccgtgactctaatttgtcttgt

SEQ ID NO: 113936 - DNA, 35 bp, Artificial Sequence
  Synthetic oligonucleotide
gctcaccagtcacacgccttggcccggccctcccc

SEQ ID NO: 113937 - DNA, 35 bp, Artificial Sequence
  Synthetic oligonucleotide
gacgactcctttgttttctcgtggacctaccgccc

SEQ ID NO: 113938 - DNA, 35 bp, Artificial Sequence
  Synthetic oligonucleotide
gagacgggtgggtcggagagagggaaaggtctgcg

SEQ ID NO: 113939 - DNA, 36 bp, Artificial Sequence
  Synthetic oligonucleotide
atcagccctgctctcctttggaccccgctcccagca

SEQ ID NO: 113940 - DNA, 35 bp, Artificial Sequence
  Synthetic oligonucleotide
ttcacctctccgccccaatttatgatctgcttatg

SEQ ID NO: 113941 - DNA, 35 bp, Artificial Sequence
  Synthetic oligonucleotide
gaccgagtcacctccccgccacatgctacgcgctt

SEQ ID NO: 113942 - DNA, 36 bp, Artificial Sequence
  Synthetic oligonucleotide
gagtgcaggggggtcggagtaggggggaagcatcga

SEQ ID NO: 113943 - DNA, 37 bp, Artificial Sequence
  Synthetic oligonucleotide
gagctgttcctcgccatccctatttgagcgcccttga

SEQ ID NO: 113944 - DNA, 36 bp, Artificial Sequence
  Synthetic oligonucleotide
gcacacctcgcccttgaccccgctgtaaacatgtta

SEQ ID NO: 113945 - DNA, 35 bp, Artificial Sequence
  Synthetic oligonucleotide
tacagcggcacaacattgtctatttgcccttcgcc

SEQ ID NO: 113946 - DNA, 34 bp, Artificial Sequence
  Synthetic oligonucleotide
acgaccttcttcacaactgtcaagtacaccctcc

SEQ ID NO: 113947 - DNA, 35 bp, Artificial Sequence
  Synthetic oligonucleotide
gcaccgttgccgcttcttatctcgctcttcaaccg

SEQ ID NO: 113948 - DNA, 36 bp, Artificial Sequence
  Synthetic oligonucleotide
ggggcggaaaagggagcaatagggggaagagagcaa

SEQ ID NO: 113949 - DNA, 36 bp, Artificial Sequence
  Synthetic oligonucleotide
aacgcgggtgggagggattaaagtgggaagaagtaa

SEQ ID NO: 113950 - DNA, 35 bp, Artificial Sequence
  Synthetic oligonucleotide
gaatccgcctcatggttacgctaacccccgtttca

SEQ ID NO: 113951 - DNA, 36 bp, Artificial Sequence
  Synthetic oligonucleotide
gcactcactgctgttctcttctcaccacccccacga

SEQ ID NO: 113952 - DNA, 37 bp, Artificial Sequence
  Synthetic oligonucleotide
gaggtgagtggggggggacgaggggatatggaggcga

SEQ ID NO: 113953 - DNA, 38 bp, Artificial Sequence
  Synthetic oligonucleotide
atccaatcgcactgctgctttactacgatcctccatga

SEQ ID NO: 113954 - DNA, 35 bp, Artificial Sequence
  Synthetic oligonucleotide
gaccgcagacccaccatgcaccacccccttctaat

SEQ ID NO: 113955 - DNA, 35 bp, Artificial Sequence
  Synthetic oligonucleotide
acgacccacggcatttacaccgcgctttctcccgt

SEQ ID NO: 113956 - DNA, 35 bp, Artificial Sequence
  Synthetic oligonucleotide
acagctcccgactgtccttctgctgcctaacctgt

SEQ ID NO: 113957 - DNA, 35 bp, Artificial Sequence
  Synthetic oligonucleotide
ttgacgagcactctgcaccactgctttcctgcacc

SEQ ID NO: 113958 - DNA, 35 bp, Artificial Sequence
  Synthetic oligonucleotide
tggggcaccctctgtctccctgtccgttggtccgc

SEQ ID NO: 113959 - DNA, 35 bp, Artificial Sequence
  Synthetic oligonucleotide
gctgcgcgatccttgtcttaccgccactcatcgtc

SEQ ID NO: 113960 - DNA, 35 bp, Artificial Sequence
  Synthetic oligonucleotide
gtcgtgttaccgcgcttaatgcccacttcctgttc

SEQ ID NO: 113961 - DNA, 37 bp, Artificial Sequence
  Synthetic oligonucleotide
gataggtaccgggtgaggcatggggagggtggtggga

SEQ ID NO: 113962 - DNA, 38 bp, Artificial Sequence
  Synthetic oligonucleotide
tagcggtgcctgtagggtggtgaagggggagggaatga

SEQ ID NO: 113963 - DNA, 35 bp, Artificial Sequence
  Synthetic oligonucleotide
atgcatccccgaccgcaaatacagaccccgttccc

SEQ ID NO: 113964 - DNA, 36 bp, Artificial Sequence
  Synthetic oligonucleotide
ttcgcatccccccgctcaccatattttgtctgctca

SEQ ID NO: 113965 - DNA, 35 bp, Artificial Sequence
  Synthetic oligonucleotide
gtcagtcccgcctttcgtacgcaacgacctgttca

SEQ ID NO: 113966 - DNA, 35 bp, Artificial Sequence
  Synthetic oligonucleotide
acgcaccccactgtctcgcctacagacccgccgcc

SEQ ID NO: 113967 - DNA, 37 bp, Artificial Sequence
  Synthetic oligonucleotide
ttcccactgcccttctgctcacgtccgcgtacgtgga

SEQ ID NO: 113968 - DNA, 35 bp, Artificial Sequence
  Synthetic oligonucleotide
tgctacgcgtacaagtcgcctctttacctgcctcc

SEQ ID NO: 113969 - DNA, 35 bp, Artificial Sequence
  Synthetic oligonucleotide
acctgcctaccgcttcgtctttatctacctgttcc

SEQ ID NO: 113970 - DNA, 35 bp, Artificial Sequence
  Synthetic oligonucleotide
tccccgccacctctttataccatggtccagcttcg

SEQ ID NO: 113971 - DNA, 37 bp, Artificial Sequence
  Synthetic oligonucleotide
tgacaagaggaaagggaagtagggaaagcgatggcga

SEQ ID NO: 113972 - DNA, 35 bp, Artificial Sequence
  Synthetic oligonucleotide
gcccctccttgacccatgtccccgcacccatgacc

SEQ ID NO: 113973 - DNA, 36 bp, Artificial Sequence
  Synthetic oligonucleotide
tccggagccagacgcctccctgtacgtaccaccata

SEQ ID NO: 113974 - DNA, 35 bp, Artificial Sequence
  Synthetic oligonucleotide
actctccgaaatgtccctgtactggtcctccgtcc

SEQ ID NO: 113975 - DNA, 35 bp, Artificial Sequence
  Synthetic oligonucleotide
gacaacctcgccgtgatcgttctggtcctttaccg

SEQ ID NO: 113976 - DNA, 35 bp, Artificial Sequence
  Synthetic oligonucleotide
atcgcacctctcacagggtctcgtactctcccttg

SEQ ID NO: 113977 - DNA, 36 bp, Artificial Sequence
  Synthetic oligonucleotide
gccatcctcctgcatcactatccgggccacccacaa

SEQ ID NO: 113978 - DNA, 35 bp, Artificial Sequence
  Synthetic oligonucleotide
gtcccacgccaccagtacccatcctgttaaaccca

SEQ ID NO: 113979 - DNA, 35 bp, Artificial Sequence
  Synthetic oligonucleotide
aacgagcgctcacatctccgcctctcgcttacttg

SEQ ID NO: 113980 - DNA, 35 bp, Artificial Sequence
  Synthetic oligonucleotide
tggagccaatgcctcccacgtgcctgcactctctc

SEQ ID NO: 113981 - DNA, 37 bp, Artificial Sequence
  Synthetic oligonucleotide
acgccacactcctcatcatgatcatctgcacccttga

SEQ ID NO: 113982 - DNA, 35 bp, Artificial Sequence
  Synthetic oligonucleotide
gaagagcggtatcgagggggtaggaggcgggggag

SEQ ID NO: 113983 - DNA, 36 bp, Artificial Sequence
  Synthetic oligonucleotide
gctcccccgccccttgattgcatttcctggtctgca

SEQ ID NO: 113984 - DNA, 34 bp, Artificial Sequence
  Synthetic oligonucleotide
aacagccaccaatctgctctgggcactcattccc

SEQ ID NO: 113985 - DNA, 35 bp, Artificial Sequence
  Synthetic oligonucleotide
aaaccctgccgctctattttcctcatgctgcccgc

SEQ ID NO: 113986 - DNA, 35 bp, Artificial Sequence
  Synthetic oligonucleotide
tgcggacccgctcagatcaccgccacacctcttgt

SEQ ID NO: 113987 - DNA, 37 bp, Artificial Sequence
  Synthetic oligonucleotide
gagacaggtatggggagtcgggggtacaggagtggga

SEQ ID NO: 113988 - DNA, 35 bp, Artificial Sequence
  Synthetic oligonucleotide
tcccgaactgccatccatttgatccctcacgacta

SEQ ID NO: 113989 - DNA, 36 bp, Artificial Sequence
  Synthetic oligonucleotide
gacaacccagagtcttcaccacctcatgcccgcgca

SEQ ID NO: 113990 - DNA, 35 bp, Artificial Sequence
  Synthetic oligonucleotide
agtctgagaggaaggggtggggagctgagagggag

SEQ ID NO: 113991 - DNA, 35 bp, Artificial Sequence
  Synthetic oligonucleotide
gaccgccgccggagtgtcagtgcatatttaccctg

SEQ ID NO: 113992 - DNA, 36 bp, Artificial Sequence
  Synthetic oligonucleotide
ttcctcccaccgccccgcctccttcaagattgacga

SEQ ID NO: 113993 - DNA, 38 bp, Artificial Sequence
  Synthetic oligonucleotide
aagagaggagagggagggtgcatgcagggaaagaatga

SEQ ID NO: 113994 - DNA, 35 bp, Artificial Sequence
  Synthetic oligonucleotide
attgtgccccccggtcctttagttgatatcccgcc

SEQ ID NO: 113995 - DNA, 35 bp, Artificial Sequence
  Synthetic oligonucleotide
gccagtgcccggtattctcgtgtcgctccttggcc

SEQ ID NO: 113996 - DNA, 35 bp, Artificial Sequence
  Synthetic oligonucleotide
ttgtccacctgccccagatcctgcccacactgcag

SEQ ID NO: 113997 - DNA, 35 bp, Artificial Sequence
  Synthetic oligonucleotide
aaagcgctccccctcgtcctatgcccgaccgcgct

SEQ ID NO: 113998 - DNA, 34 bp, Artificial Sequence
  Synthetic oligonucleotide
tcccaccccgcttttttccctagtacagccatct

SEQ ID NO: 113999 - DNA, 35 bp, Artificial Sequence
  Synthetic oligonucleotide
actgctccctcctcagacgcttactccttgccaac

SEQ ID NO: 114000 - DNA, 34 bp, Artificial Sequence
  Synthetic oligonucleotide
aaacaccccattgtatgtcccccccggtttacac

SEQ ID NO: 114001 - DNA, 35 bp, Artificial Sequence
  Synthetic oligonucleotide
tgcctggtcgccctcacgctgaacgttatgcctct

SEQ ID NO: 114002 - DNA, 36 bp, Artificial Sequence
  Synthetic oligonucleotide
tgccccagccctcccatgccctaatttgagtcttca

SEQ ID NO: 114003 - DNA, 38 bp, Artificial Sequence
  Synthetic oligonucleotide
gaactagggaacaagggaggggggacgggaggacttga

SEQ ID NO: 114004 - DNA, 35 bp, Artificial Sequence
  Synthetic oligonucleotide
gcaccacgcttgctttcctacacagtaccccttac

SEQ ID NO: 114005 - DNA, 35 bp, Artificial Sequence
  Synthetic oligonucleotide
gacctgccccgatgccccgcttatctcttcattgg

SEQ ID NO: 114006 - DNA, 35 bp, Artificial Sequence
  Synthetic oligonucleotide
atccacctcacttgtctctggccacttttgaaact

SEQ ID NO: 114007 - DNA, 35 bp, Artificial Sequence
  Synthetic oligonucleotide
gactccgaacatttgcatttgtacaatcctccctt

SEQ ID NO: 114008 - DNA, 38 bp, Artificial Sequence
  Synthetic oligonucleotide
gcgaacgcttgcttgccatctgccacatccccctttga

SEQ ID NO: 114009 - DNA, 35 bp, Artificial Sequence
  Synthetic oligonucleotide
aacacataccggccatgcacctgcctcctcgttcc

SEQ ID NO: 114010 - DNA, 37 bp, Artificial Sequence
  Synthetic oligonucleotide
ttggtgccccctcaggttctgcgtttttcctgcccga

SEQ ID NO: 114011 - DNA, 36 bp, Artificial Sequence
  Synthetic oligonucleotide
attgccccacccgctatacccgcaacccacattgga

SEQ ID NO: 114012 - DNA, 38 bp, Artificial Sequence
  Synthetic oligonucleotide
tctcgcgcttcccatctcgtttcatgctaccatcctga

SEQ ID NO: 114013 - DNA, 36 bp, Artificial Sequence
  Synthetic oligonucleotide
acagggacgtaggagggcgggtagggctgtggggta

SEQ ID NO: 114014 - DNA, 35 bp, Artificial Sequence
  Synthetic oligonucleotide
tccgatctcccacttattgttctaacgtggcctcc

SEQ ID NO: 114015 - DNA, 35 bp, Artificial Sequence
  Synthetic oligonucleotide
attgcctctgcctgtctccttccccttgtacactt

SEQ ID NO: 114016 - DNA, 35 bp, Artificial Sequence
  Synthetic oligonucleotide
ttgtctccccagcccaccgccttacgttctgtttt

SEQ ID NO: 114017 - DNA, 36 bp, Artificial Sequence
  Synthetic oligonucleotide
ggtcactgctccactcgcgtactttgcccgttaaca

SEQ ID NO: 114018 - DNA, 36 bp, Artificial Sequence
  Synthetic oligonucleotide
actactccgctacttgaaccgtgttccgccttacaa

SEQ ID NO: 114019 - DNA, 36 bp, Artificial Sequence
  Synthetic oligonucleotide
gtcgatcacgccctgttgctttcgctttatccctca

SEQ ID NO: 114020 - DNA, 37 bp, Artificial Sequence
  Synthetic oligonucleotide
tacgccaacgatcatagggaaggggagggggggtaga

SEQ ID NO: 114021 - DNA, 37 bp, Artificial Sequence
  Synthetic oligonucleotide
acctggacagctcgcatttccgcgctacacctccgga

SEQ ID NO: 114022 - DNA, 37 bp, Artificial Sequence
  Synthetic oligonucleotide
ggggaggggagcaggaaggcgacggatagaagggtga

SEQ ID NO: 114023 - DNA, 35 bp, Artificial Sequence
  Synthetic oligonucleotide
gcccagtggttctcctgtctcgttcaagctcgttc

SEQ ID NO: 114024 - DNA, 35 bp, Artificial Sequence
  Synthetic oligonucleotide
taggcctgcctacgttcccctgtcctaactatctg

SEQ ID NO: 114025 - DNA, 35 bp, Artificial Sequence
  Synthetic oligonucleotide
tgttgtgcgctgctttgttccattctcgctctctc

SEQ ID NO: 114026 - DNA, 35 bp, Artificial Sequence
  Synthetic oligonucleotide
gttagcccgtctatatcctgcctttccacccaccg

SEQ ID NO: 114027 - DNA, 35 bp, Artificial Sequence
  Synthetic oligonucleotide
gtacctgccgtataactgttcctagcccccttccg

SEQ ID NO: 114028 - DNA, 35 bp, Artificial Sequence
  Synthetic oligonucleotide
aagaatgcaggggagtggcaggaggggtggtggtg

SEQ ID NO: 114029 - DNA, 35 bp, Artificial Sequence
  Synthetic oligonucleotide
gacaggccacacctcgccgttcctaccacctttga

SEQ ID NO: 114030 - DNA, 35 bp, Artificial Sequence
  Synthetic oligonucleotide
taccccacgttcctgcgcggtcttatccttctgcc

SEQ ID NO: 114031 - DNA, 35 bp, Artificial Sequence
  Synthetic oligonucleotide
gagcgcccgcccatagcccccgttgccctatagcc

SEQ ID NO: 114032 - DNA, 35 bp, Artificial Sequence
  Synthetic oligonucleotide
tagccaggcctgtttcagctcatttcgtcgcccct

SEQ ID NO: 114033 - DNA, 35 bp, Artificial Sequence
  Synthetic oligonucleotide
gtcctttcctgccctcatgcaacatgctgcatttt

SEQ ID NO: 114034 - DNA, 36 bp, Artificial Sequence
  Synthetic oligonucleotide
gacgatggtagggcgggcatgggagggggcagagga

SEQ ID NO: 114035 - DNA, 35 bp, Artificial Sequence
  Synthetic oligonucleotide
atggagtggggggtggaacggtgcgagacatgggc

SEQ ID NO: 114036 - DNA, 35 bp, Artificial Sequence
  Synthetic oligonucleotide
tacgaccacaccgccttgaccaccgccacgaaata

SEQ ID NO: 114037 - DNA, 35 bp, Artificial Sequence
  Synthetic oligonucleotide
gtacacctcagccaatccccgcccccagcgagacc

SEQ ID NO: 114038 - DNA, 35 bp, Artificial Sequence
  Synthetic oligonucleotide
ttgcccgtttcgtcctgcctgggttccatcttatt

SEQ ID NO: 114039 - DNA, 35 bp, Artificial Sequence
  Synthetic oligonucleotide
gatccgactgctgagctccacacactcttcactgc

SEQ ID NO: 114040 - DNA, 35 bp, Artificial Sequence
  Synthetic oligonucleotide
agaagaagcactccaccgtgagcccctcccgcctc

SEQ ID NO: 114041 - DNA, 35 bp, Artificial Sequence
  Synthetic oligonucleotide
attgtcgagcgcgaatctcccgtccatgtcttgtc

SEQ ID NO: 114042 - DNA, 35 bp, Artificial Sequence
  Synthetic oligonucleotide
acacgcatttccgtacgcgtattcttcatgcccct

SEQ ID NO: 114043 - DNA, 35 bp, Artificial Sequence
  Synthetic oligonucleotide
tgcgaatgccttccgctccccgtttggtatacctt

SEQ ID NO: 114044 - DNA, 36 bp, Artificial Sequence
  Synthetic oligonucleotide
gcaggggacggggagctgagggaatgcggaggtgga

SEQ ID NO: 114045 - DNA, 38 bp, Artificial Sequence
  Synthetic oligonucleotide
acacctgcctcaacctgcttttgccaccggaatcctga

SEQ ID NO: 114046 - DNA, 36 bp, Artificial Sequence
  Synthetic oligonucleotide
gtggtaagggagggtgggaaaacgggtatgaagtta

SEQ ID NO: 114047 - DNA, 35 bp, Artificial Sequence
  Synthetic oligonucleotide
tccatggccttccttgcattgtatcctgccctatc

SEQ ID NO: 114048 - DNA, 35 bp, Artificial Sequence
  Synthetic oligonucleotide
ggagacatcccggctgcccagtctcatcacctgtc

SEQ ID NO: 114049 - DNA, 31 bp, Artificial Sequence
  Synthetic oligonucleotide
ggtcgacagcagccccccgtcctcaacctct

SEQ ID NO: 114050 - DNA, 37 bp, Artificial Sequence
  Synthetic oligonucleotide
tgtccgccggggtgggagaagggagggcacggaatga

SEQ ID NO: 114051 - DNA, 35 bp, Artificial Sequence
  Synthetic oligonucleotide
atgtgcggagctgttctttccgttatcgtctcctc

SEQ ID NO: 114052 - DNA, 35 bp, Artificial Sequence
  Synthetic oligonucleotide
tcctcctgcgcgcaagtcttatcatccccaccctg

SEQ ID NO: 114053 - DNA, 35 bp, Artificial Sequence
  Synthetic oligonucleotide
gcaccatccgccttcatttgtacgtacaatcgttg

SEQ ID NO: 114054 - DNA, 36 bp, Artificial Sequence
  Synthetic oligonucleotide
gttgccacccgcacttgcgcctcccttgccgcccca

SEQ ID NO: 114055 - DNA, 36 bp, Artificial Sequence
  Synthetic oligonucleotide
agaccgccttcccgtgttggattcccccgtctctca

SEQ ID NO: 114056 - DNA, 35 bp, Artificial Sequence
  Synthetic oligonucleotide
tgccagcctatagaccgtttttcctcttgtgcctc

SEQ ID NO: 114057 - DNA, 35 bp, Artificial Sequence
  Synthetic oligonucleotide
tacgcattcagtgccccccgtcccagcgacttctc

SEQ ID NO: 114058 - DNA, 35 bp, Artificial Sequence
  Synthetic oligonucleotide
aacccatcggccattttgctacttgtcttctcgct

SEQ ID NO: 114059 - DNA, 35 bp, Artificial Sequence
  Synthetic oligonucleotide
tttccgcccagttagacgctacccccttgctcctc

SEQ ID NO: 114060 - DNA, 35 bp, Artificial Sequence
  Synthetic oligonucleotide
tcaccaccacccgctcatgctcagacacctccagt

SEQ ID NO: 114061 - DNA, 36 bp, Artificial Sequence
  Synthetic oligonucleotide
gcgccctcggctgcacgtgaaacccatcacacccca

SEQ ID NO: 114062 - DNA, 37 bp, Artificial Sequence
  Synthetic oligonucleotide
taaggagagggagggtgggtggcgccgtgagggggga

SEQ ID NO: 114063 - DNA, 35 bp, Artificial Sequence
  Synthetic oligonucleotide
acttacccctcgcgacccgttattatggctccacc

SEQ ID NO: 114064 - DNA, 38 bp, Artificial Sequence
  Synthetic oligonucleotide
tactccgtcgcagtaatcccgcccacttcttcccttga

SEQ ID NO: 114065 - DNA, 36 bp, Artificial Sequence
  Synthetic oligonucleotide
gatgcccccctgtacgcacgcgttaccttcgcttaa

SEQ ID NO: 114066 - DNA, 35 bp, Artificial Sequence
  Synthetic oligonucleotide
tccatccacacattgtactgaagtatcacatttcc

SEQ ID NO: 114067 - DNA, 35 bp, Artificial Sequence
  Synthetic oligonucleotide
tcccccctccaggcgtggctacactaccgcactat

SEQ ID NO: 114068 - DNA, 35 bp, Artificial Sequence
  Synthetic oligonucleotide
gccactccttcgttcaaccgctctgtgccttgcaa

SEQ ID NO: 114069 - DNA, 37 bp, Artificial Sequence
  Synthetic oligonucleotide
gaggtcggagatcgacaagggagacggggggggcgga

SEQ ID NO: 114070 - DNA, 36 bp, Artificial Sequence
  Synthetic oligonucleotide
tgcctgcccaaccctgtcactgtcttccctcggtta

SEQ ID NO: 114071 - DNA, 35 bp, Artificial Sequence
  Synthetic oligonucleotide
aagcccccgtctcaccatagtagttccaccgccac

SEQ ID NO: 114072 - DNA, 35 bp, Artificial Sequence
  Synthetic oligonucleotide
tgatgcgatccccgtcgtaatcgttgtcatccttt

SEQ ID NO: 114073 - DNA, 35 bp, Artificial Sequence
  Synthetic oligonucleotide
tacgcccagttccctcctcgccatccatgccggag

SEQ ID NO: 114074 - DNA, 35 bp, Artificial Sequence
  Synthetic oligonucleotide
tccatgccccttattccatgtacaattgccctttt

SEQ ID NO: 114075 - DNA, 35 bp, Artificial Sequence
  Synthetic oligonucleotide
atcacaccccgccgtgctggccacttcatccgtgc

SEQ ID NO: 114076 - DNA, 37 bp, Artificial Sequence
  Synthetic oligonucleotide
ggtccaccatcccgttacagattgcacccctttcctg

SEQ ID NO: 114077 - DNA, 36 bp, Artificial Sequence
  Synthetic oligonucleotide
gacgccgactttagttttactcacctgctctaccga

SEQ ID NO: 114078 - DNA, 35 bp, Artificial Sequence
  Synthetic oligonucleotide
tcgccatcacctccgcccggctcgccccccggtct

SEQ ID NO: 114079 - DNA, 35 bp, Artificial Sequence
  Synthetic oligonucleotide
tagcgccccgcctcattagttttactggtccattt

SEQ ID NO: 114080 - DNA, 37 bp, Artificial Sequence
  Synthetic oligonucleotide
tgctcgccatccgccgttatatcaacctttcacctga

SEQ ID NO: 114081 - DNA, 37 bp, Artificial Sequence
  Synthetic oligonucleotide
attgccgccaccgcctttctgttgccttcttcgcgta

SEQ ID NO: 114082 - DNA, 35 bp, Artificial Sequence
  Synthetic oligonucleotide
gtgtacccccgtgcctcccgccccccttgcccggc

SEQ ID NO: 114083 - DNA, 35 bp, Artificial Sequence
  Synthetic oligonucleotide
tgccacacctctcacgggttccattcgccatttcg

SEQ ID NO: 114084 - DNA, 34 bp, Artificial Sequence
  Synthetic oligonucleotide
tcatcggagggagggtgggacgggctcttttggg

SEQ ID NO: 114085 - DNA, 35 bp, Artificial Sequence
  Synthetic oligonucleotide
accatccgccgtatctactattccctgacgtgctt

SEQ ID NO: 114086 - DNA, 36 bp, Artificial Sequence
  Synthetic oligonucleotide
atcctcccccctgctgtggtttttattctccttcga

SEQ ID NO: 114087 - DNA, 35 bp, Artificial Sequence
  Synthetic oligonucleotide
acccctccacgccgccgcatatttttgctgactat

SEQ ID NO: 114088 - DNA, 36 bp, Artificial Sequence
  Synthetic oligonucleotide
gatacctcgcccttccagagcactcgatcctcacaa

SEQ ID NO: 114089 - DNA, 37 bp, Artificial Sequence
  Synthetic oligonucleotide
gaagtcgtgagggagcgagcgggataggggaagggga

SEQ ID NO: 114090 - DNA, 35 bp, Artificial Sequence
  Synthetic oligonucleotide
gtagtccccccgcctcgttccccatggttaacatt

SEQ ID NO: 114091 - DNA, 36 bp, Artificial Sequence
  Synthetic oligonucleotide
gcccaaccctgaccccccgctgaccggtcctttgca

SEQ ID NO: 114092 - DNA, 35 bp, Artificial Sequence
  Synthetic oligonucleotide
ggtcacctgtcccgcttacgtctcctccgccctta

SEQ ID NO: 114093 - DNA, 35 bp, Artificial Sequence
  Synthetic oligonucleotide
tccagttccgccctctctgctcaggcgttccttac

SEQ ID NO: 114094 - DNA, 35 bp, Artificial Sequence
  Synthetic oligonucleotide
gggacgagcgcgttctgttcccccttctttgccct

SEQ ID NO: 114095 - DNA, 36 bp, Artificial Sequence
  Synthetic oligonucleotide
gttggcatcccgccgaattgctaatccttctctcca

SEQ ID NO: 114096 - DNA, 38 bp, Artificial Sequence
  Synthetic oligonucleotide
gagagcgagaggagaggagggcggggcatgcgatctga

SEQ ID NO: 114097 - DNA, 35 bp, Artificial Sequence
  Synthetic oligonucleotide
tgcacactcttcttgtacgaaccaccctttatgtc

SEQ ID NO: 114098 - DNA, 37 bp, Artificial Sequence
  Synthetic oligonucleotide
gatgcgagattaggggcgagagggtgaggagggggga

SEQ ID NO: 114099 - DNA, 35 bp, Artificial Sequence
  Synthetic oligonucleotide
tgtcccgcctccctttagcttatcggtccttagtc

SEQ ID NO: 114100 - DNA, 35 bp, Artificial Sequence
  Synthetic oligonucleotide
atcgccccagaattggtcttttccttgcccttcct

SEQ ID NO: 114101 - DNA, 35 bp, Artificial Sequence
  Synthetic oligonucleotide
actactcacatgcactgccgacttgcctccccgga

SEQ ID NO: 114102 - DNA, 37 bp, Artificial Sequence
  Synthetic oligonucleotide
gagcgcacacccgcctgcccctcacatctcttgtgga

SEQ ID NO: 114103 - DNA, 35 bp, Artificial Sequence
  Synthetic oligonucleotide
agcaccccactgcaaccccgcccttgccagttctc

SEQ ID NO: 114104 - DNA, 37 bp, Artificial Sequence
  Synthetic oligonucleotide
gcaccccccgcatgattaaggtttccctccgctacga

SEQ ID NO: 114105 - DNA, 35 bp, Artificial Sequence
  Synthetic oligonucleotide
gatcctcctcctgtcgatttaaccagtgcccttac

SEQ ID NO: 114106 - DNA, 35 bp, Artificial Sequence
  Synthetic oligonucleotide
tctagcccccccgacaccggtctacacttggtccc

SEQ ID NO: 114107 - DNA, 35 bp, Artificial Sequence
  Synthetic oligonucleotide
acttccggtcgaggcccggggaggagggaggagcc

SEQ ID NO: 114108 - DNA, 35 bp, Artificial Sequence
  Synthetic oligonucleotide
taatccaacggtcagcctttctatcgctccctact

SEQ ID NO: 114109 - DNA, 35 bp, Artificial Sequence
  Synthetic oligonucleotide
gtccacagagatacccccccgttccccgtccctga

SEQ ID NO: 114110 - DNA, 35 bp, Artificial Sequence
  Synthetic oligonucleotide
atggtcatccgccccgtgccgttgtaggccaacct

SEQ ID NO: 114111 - DNA, 35 bp, Artificial Sequence
  Synthetic oligonucleotide
gagccgctcggcgcctctgttgtctctctcgtcct

SEQ ID NO: 114112 - DNA, 35 bp, Artificial Sequence
  Synthetic oligonucleotide
gaccacgttatgcttagtctccagcccgtttctct

SEQ ID NO: 114113 - DNA, 36 bp, Artificial Sequence
  Synthetic oligonucleotide
aggagagggcgggtcaagggggaggggggcagaaca

SEQ ID NO: 114114 - DNA, 37 bp, Artificial Sequence
  Synthetic oligonucleotide
accacaccccctgcgcccgcggtcccgtcccttagga

SEQ ID NO: 114115 - DNA, 35 bp, Artificial Sequence
  Synthetic oligonucleotide
taccgctgcccgcttacgtctctctctactgctga

SEQ ID NO: 114116 - DNA, 35 bp, Artificial Sequence
  Synthetic oligonucleotide
atgactcgtgtcatggcaaaggggggtcgggaggg

SEQ ID NO: 114117 - DNA, 37 bp, Artificial Sequence
  Synthetic oligonucleotide
gcacaagagtggggagtggtagagggaagggagtcga

SEQ ID NO: 114118 - DNA, 35 bp, Artificial Sequence
  Synthetic oligonucleotide
tttgcccctcagtctcaacccgcccaccttgagga

SEQ ID NO: 114119 - DNA, 35 bp, Artificial Sequence
  Synthetic oligonucleotide
tcccgcccgttgcctacctatatatgcaccgtccc

SEQ ID NO: 114120 - DNA, 35 bp, Artificial Sequence
  Synthetic oligonucleotide
ttcgtccctgcgcctttagacccaccccctttccc

SEQ ID NO: 114121 - DNA, 35 bp, Artificial Sequence
  Synthetic oligonucleotide
ttgcgcaaccccttttgccctatgacctcagccct

SEQ ID NO: 114122 - DNA, 36 bp, Artificial Sequence
  Synthetic oligonucleotide
tccgtagccccgtgaggatttgcccgccccacccaa

SEQ ID NO: 114123 - DNA, 37 bp, Artificial Sequence
  Synthetic oligonucleotide
gacagggccgggcatgggagggtagggggataaggga

SEQ ID NO: 114124 - DNA, 37 bp, Artificial Sequence
  Synthetic oligonucleotide
ggtacacgagagaggggggaggcgggtatggtaatga

SEQ ID NO: 114125 - DNA, 35 bp, Artificial Sequence
  Synthetic oligonucleotide
atgagcacgtcgagcctctcgtcttcccgccctta

SEQ ID NO: 114126 - DNA, 35 bp, Artificial Sequence
  Synthetic oligonucleotide
agccactccgcctcgtcccgaattcgccagaacac

SEQ ID NO: 114127 - DNA, 35 bp, Artificial Sequence
  Synthetic oligonucleotide
tgccattacccccgcagacgctatgcactaccttc

SEQ ID NO: 114128 - DNA, 35 bp, Artificial Sequence
  Synthetic oligonucleotide
tacgtgcgtgagggaagtagggagggcgggagtaa

SEQ ID NO: 114129 - DNA, 35 bp, Artificial Sequence
  Synthetic oligonucleotide
acaccacccctagagtcgttttcgattttacccca

SEQ ID NO: 114130 - DNA, 36 bp, Artificial Sequence
  Synthetic oligonucleotide
gcacccgcgcccgacgctccatctattcctatgtca

SEQ ID NO: 114131 - DNA, 38 bp, Artificial Sequence
  Synthetic oligonucleotide
aacgggaggagcatcggaggggagggaggggcgaatga

SEQ ID NO: 114132 - DNA, 38 bp, Artificial Sequence
  Synthetic oligonucleotide
tgtcctgcccctgctgccaagcctgcctgcccttgtga

SEQ ID NO: 114133 - DNA, 35 bp, Artificial Sequence
  Synthetic oligonucleotide
aattggccacgcctcatgcccactagctcccacgc

SEQ ID NO: 114134 - DNA, 35 bp, Artificial Sequence
  Synthetic oligonucleotide
tccacctgtccatttggacgttatgacttccccat

SEQ ID NO: 114135 - DNA, 36 bp, Artificial Sequence
  Synthetic oligonucleotide
atcaccgtcagctatgcccccccgcttgtccgatca

SEQ ID NO: 114136 - DNA, 36 bp, Artificial Sequence
  Synthetic oligonucleotide
gaagcgtgaagagagggcgatgaaggggcggggtga

SEQ ID NO: 114137 - DNA, 35 bp, Artificial Sequence
  Synthetic oligonucleotide
gtccgacaccctccgcctcttatccaacctggcac

SEQ ID NO: 114138 - DNA, 32 bp, Artificial Sequence
  Synthetic oligonucleotide
ttggtcaccttcttacgcgccataacatctcc

SEQ ID NO: 114139 - DNA, 35 bp, Artificial Sequence
  Synthetic oligonucleotide
gtgctgacgaatgcgctacatatgctccaccttgc

SEQ ID NO: 114140 - DNA, 28 bp, Artificial Sequence
  Synthetic oligonucleotide
actttacggtcgccgctccgccccttct

SEQ ID NO: 114141 - DNA, 35 bp, Artificial Sequence
  Synthetic oligonucleotide
gagaccccccccactggtgcactcgccccttaagc

SEQ ID NO: 114142 - DNA, 35 bp, Artificial Sequence
  Synthetic oligonucleotide
ttcaccaccccgcgattggactaacgctacctgaa

SEQ ID NO: 114143 - DNA, 36 bp, Artificial Sequence
  Synthetic oligonucleotide
tccttgcactgccccttccatcgtcttcagaccgca

SEQ ID NO: 114144 - DNA, 35 bp, Artificial Sequence
  Synthetic oligonucleotide
acgcaacccgtagagcctcttctttctgtcctccg

SEQ ID NO: 114145 - DNA, 35 bp, Artificial Sequence
  Synthetic oligonucleotide
acacccggtagtggtgtagcctggcccactctcca

SEQ ID NO: 114146 - DNA, 37 bp, Artificial Sequence
  Synthetic oligonucleotide
atcaagagcaattggtgggagttggggacgggaggga

SEQ ID NO: 114147 - DNA, 36 bp, Artificial Sequence
  Synthetic oligonucleotide
gaaggggaggatatcttggatgggggataggggtta

SEQ ID NO: 114148 - DNA, 35 bp, Artificial Sequence
  Synthetic oligonucleotide
atctcctgccgcctccagcacaacacgttttccac

SEQ ID NO: 114149 - DNA, 34 bp, Artificial Sequence
  Synthetic oligonucleotide
ggagtcgatcgccgtagtttttgtccattccccg

SEQ ID NO: 114150 - DNA, 35 bp, Artificial Sequence
  Synthetic oligonucleotide
tcatgcaccgcccgttcaaatagttgttctctccg

SEQ ID NO: 114151 - DNA, 37 bp, Artificial Sequence
  Synthetic oligonucleotide
gtgaacgacggtgggggggggcgtttgggaggacgga

SEQ ID NO: 114152 - DNA, 37 bp, Artificial Sequence
  Synthetic oligonucleotide
ttctccccgcctctgcccatccatccctcccatggga

SEQ ID NO: 114153 - DNA, 35 bp, Artificial Sequence
  Synthetic oligonucleotide
ttggccctcccgcctcgttgttcccgtgaacctga

SEQ ID NO: 114154 - DNA, 35 bp, Artificial Sequence
  Synthetic oligonucleotide
ataccgcgcccaactgcccactgccactctcttta

SEQ ID NO: 114155 - DNA, 35 bp, Artificial Sequence
  Synthetic oligonucleotide
gtacctgccccatccgtttcgttagccacttttag

SEQ ID NO: 114156 - DNA, 35 bp, Artificial Sequence
  Synthetic oligonucleotide
gcctccaccagatctccgttgcgacctctatccgc

SEQ ID NO: 114157 - DNA, 35 bp, Artificial Sequence
  Synthetic oligonucleotide
gtcccatccacactccgcacatggtagttctgctc

SEQ ID NO: 114158 - DNA, 35 bp, Artificial Sequence
  Synthetic oligonucleotide
ttagccccctctagtgatcgttccttttctttctg

SEQ ID NO: 114159 - DNA, 36 bp, Artificial Sequence
  Synthetic oligonucleotide
atgggggatcgtaagggaggggttcgttcatgggga

SEQ ID NO: 114160 - DNA, 35 bp, Artificial Sequence
  Synthetic oligonucleotide
gcatcctcctgctgctccacgtttattgcttgcta

SEQ ID NO: 114161 - DNA, 35 bp, Artificial Sequence
  Synthetic oligonucleotide
gcgcccgagtcctcgtttcttttggcgcatccctc

SEQ ID NO: 114162 - DNA, 35 bp, Artificial Sequence
  Synthetic oligonucleotide
gtgccccatgtgtatccccggccatattgcttctc

SEQ ID NO: 114163 - DNA, 34 bp, Artificial Sequence
  Synthetic oligonucleotide
tcctcgcacgccgccgccccgttcccttgacctg

SEQ ID NO: 114164 - DNA, 35 bp, Artificial Sequence
  Synthetic oligonucleotide
ccccctgcctcacatcccccccgtcctagcacgtg

SEQ ID NO: 114165 - DNA, 35 bp, Artificial Sequence
  Synthetic oligonucleotide
gtacctctccgccattcatcttagtgcgccctggc

SEQ ID NO: 114166 - DNA, 35 bp, Artificial Sequence
  Synthetic oligonucleotide
tgcctccggcgcacgacctccgaccatcccctctg

SEQ ID NO: 114167 - DNA, 36 bp, Artificial Sequence
  Synthetic oligonucleotide
gggatggagggagtagagggggaatgggcaataaga

SEQ ID NO: 114168 - DNA, 37 bp, Artificial Sequence
  Synthetic oligonucleotide
tcccctcatccgcctgactttttgccctatgagacga

SEQ ID NO: 114169 - DNA, 37 bp, Artificial Sequence
  Synthetic oligonucleotide
acgggtgggggctgaagaggggcgagtacggggttga

SEQ ID NO: 114170 - DNA, 35 bp, Artificial Sequence
  Synthetic oligonucleotide
gtactcgacctcctgccctccgccccacgctcgac

SEQ ID NO: 114171 - DNA, 35 bp, Artificial Sequence
  Synthetic oligonucleotide
tctgacgggtgcgggggggacaagtaggggtcgcg

SEQ ID NO: 114172 - DNA, 35 bp, Artificial Sequence
  Synthetic oligonucleotide
gcaacggactgcctcgcggtttttattacgccctt

SEQ ID NO: 114173 - DNA, 37 bp, Artificial Sequence
  Synthetic oligonucleotide
ggttgggtaagggaggaaaagggggcgaagaatgaga

SEQ ID NO: 114174 - DNA, 35 bp, Artificial Sequence
  Synthetic oligonucleotide
gccgttcagccggctgcccatctgtccattcacac

SEQ ID NO: 114175 - DNA, 35 bp, Artificial Sequence
  Synthetic oligonucleotide
gtccgtctcctgcccgctccctactgctcgcactc

SEQ ID NO: 114176 - DNA, 35 bp, Artificial Sequence
  Synthetic oligonucleotide
atgcctggttcccatgccgtaacccatccatcacc

SEQ ID NO: 114177 - DNA, 35 bp, Artificial Sequence
  Synthetic oligonucleotide
tcgaggctcgccccccgtttccaccagttatccct

SEQ ID NO: 114178 - DNA, 35 bp, Artificial Sequence
  Synthetic oligonucleotide
accttcccgacaggtcgaacttagcaccccccccg

SEQ ID NO: 114179 - DNA, 35 bp, Artificial Sequence
  Synthetic oligonucleotide
acccgcaccttatatgtgctcccactcttcctgtt

SEQ ID NO: 114180 - DNA, 36 bp, Artificial Sequence
  Synthetic oligonucleotide
gagcgcccccagcctcccgtgcatccttgtctccaa

SEQ ID NO: 114181 - DNA, 35 bp, Artificial Sequence
  Synthetic oligonucleotide
cccaacaccctgcctcatggttcccacacgcacca

SEQ ID NO: 114182 - DNA, 35 bp, Artificial Sequence
  Synthetic oligonucleotide
gacacgtatgtcggcgcttttccaccgctttgccc

SEQ ID NO: 114183 - DNA, 36 bp, Artificial Sequence
  Synthetic oligonucleotide
aagtgccgggggaagggagaaggagggaagtacaca

SEQ ID NO: 114184 - DNA, 36 bp, Artificial Sequence
  Synthetic oligonucleotide
gtggaccacgccacttgtatccttctatcccttgca

SEQ ID NO: 114185 - DNA, 36 bp, Artificial Sequence
  Synthetic oligonucleotide
agctgggccgcctgctacgatccctacacccctgta

SEQ ID NO: 114186 - DNA, 35 bp, Artificial Sequence
  Synthetic oligonucleotide
ttagccgcccaagcgaatcgcccacaccctccgtc

SEQ ID NO: 114187 - DNA, 35 bp, Artificial Sequence
  Synthetic oligonucleotide
gactgaagcggagggagggaatggaggagaagcaa

SEQ ID NO: 114188 - DNA, 35 bp, Artificial Sequence
  Synthetic oligonucleotide
gcagctgatccagctctgtcctgcccctgttgccc

SEQ ID NO: 114189 - DNA, 35 bp, Artificial Sequence
  Synthetic oligonucleotide
gttaggggggggaggagggaatatgaactggcgtg

SEQ ID NO: 114190 - DNA, 38 bp, Artificial Sequence
  Synthetic oligonucleotide
gacattgccatccttcgtgtggcgctcctctctcttga

SEQ ID NO: 114191 - DNA, 35 bp, Artificial Sequence
  Synthetic oligonucleotide
atacctcactgcccccgttgcatttatacccgtac

SEQ ID NO: 114192 - DNA, 35 bp, Artificial Sequence
  Synthetic oligonucleotide
agtccgccgccctcgcttctacttgactctggccc

SEQ ID NO: 114193 - DNA, 35 bp, Artificial Sequence
  Synthetic oligonucleotide
gtccaacgtctctgtcctctgaatgccaccctccg

SEQ ID NO: 114194 - DNA, 35 bp, Artificial Sequence
  Synthetic oligonucleotide
tccataccctgtctgcttggccttgcctactctct

SEQ ID NO: 114195 - DNA, 35 bp, Artificial Sequence
  Synthetic oligonucleotide
tagccactccaccgcacatcgcagactggtttcca

SEQ ID NO: 114196 - DNA, 37 bp, Artificial Sequence
  Synthetic oligonucleotide
gacacaggggagggtgtgggtgtcgggggactggaga

SEQ ID NO: 114197 - DNA, 37 bp, Artificial Sequence
  Synthetic oligonucleotide
tgagagagggggcaggggacggaaggaaaaggatgga

SEQ ID NO: 114198 - DNA, 36 bp, Artificial Sequence
  Synthetic oligonucleotide
gacctcgtagctgtctcccacgttcgctctcagcca

SEQ ID NO: 114199 - DNA, 35 bp, Artificial Sequence
  Synthetic oligonucleotide
ggaaggcggggggggatattgggagtggaggggca

SEQ ID NO: 114200 - DNA, 35 bp, Artificial Sequence
  Synthetic oligonucleotide
acaccgtacgctcccgctctatctagtacacctga

SEQ ID NO: 114201 - DNA, 35 bp, Artificial Sequence
  Synthetic oligonucleotide
gcccctctgccatgtagacccttgtcacgccttac

SEQ ID NO: 114202 - DNA, 35 bp, Artificial Sequence
  Synthetic oligonucleotide
tctgcgccctccatcattcgtgctcaaccggcttc

SEQ ID NO: 114203 - DNA, 35 bp, Artificial Sequence
  Synthetic oligonucleotide
gacccgcctccacgctacctgttccttgagaccct

SEQ ID NO: 114204 - DNA, 35 bp, Artificial Sequence
  Synthetic oligonucleotide
tgcatccgccctttccataggacccaccatcctca

SEQ ID NO: 114205 - DNA, 36 bp, Artificial Sequence
  Synthetic oligonucleotide
tctcacccccaccgctgggccgttttgccagtttta

SEQ ID NO: 114206 - DNA, 35 bp, Artificial Sequence
  Synthetic oligonucleotide
tctccactgtggtttcgatcggtacatgcccctcc

SEQ ID NO: 114207 - DNA, 35 bp, Artificial Sequence
  Synthetic oligonucleotide
ttgacaccggcccgcctccccatcgctgcccagct

SEQ ID NO: 114208 - DNA, 35 bp, Artificial Sequence
  Synthetic oligonucleotide
accacggcccacgtgatttactgtcccggccctct

SEQ ID NO: 114209 - DNA, 36 bp, Artificial Sequence
  Synthetic oligonucleotide
tgcatccgccgccgaattcagaaactcacctctcga

SEQ ID NO: 114210 - DNA, 35 bp, Artificial Sequence
  Synthetic oligonucleotide
tgcacgcctgttgccggttccccatgtctgaatta

SEQ ID NO: 114211 - DNA, 35 bp, Artificial Sequence
  Synthetic oligonucleotide
attacccccgtgtgcctcctcttctttttgtctcc

SEQ ID NO: 114212 - DNA, 35 bp, Artificial Sequence
  Synthetic oligonucleotide
acaccgctccccgtagttctgggctccctaccact

SEQ ID NO: 114213 - DNA, 35 bp, Artificial Sequence
  Synthetic oligonucleotide
gccaacagtcagcctgctctctccccttccatgct

SEQ ID NO: 114214 - DNA, 36 bp, Artificial Sequence
  Synthetic oligonucleotide
tactacgcccttcatcgcttatagccactgtctcta

SEQ ID NO: 114215 - DNA, 35 bp, Artificial Sequence
  Synthetic oligonucleotide
gtcacgcaccccattgcaagtcccctttctccggt

SEQ ID NO: 114216 - DNA, 35 bp, Artificial Sequence
  Synthetic oligonucleotide
aacgccgctgacgaattctgttcacgccactcctt

SEQ ID NO: 114217 - DNA, 36 bp, Artificial Sequence
  Synthetic oligonucleotide
ttcacccatcccagctgccgagtcctaacttgcgaa

SEQ ID NO: 114218 - DNA, 36 bp, Artificial Sequence
  Synthetic oligonucleotide
gtcgaccctcttcccccgttatccgtctgtcaaaga

SEQ ID NO: 114219 - DNA, 37 bp, Artificial Sequence
  Synthetic oligonucleotide
gagcaggtggcgggcggggtaggtaccggagcgggga

SEQ ID NO: 114220 - DNA, 35 bp, Artificial Sequence
  Synthetic oligonucleotide
ttcgacagccctactgactgtttctctgcttctcc

SEQ ID NO: 114221 - DNA, 35 bp, Artificial Sequence
  Synthetic oligonucleotide
tgtacatccccagcgctcgctcccatccgggttcc

SEQ ID NO: 114222 - DNA, 35 bp, Artificial Sequence
  Synthetic oligonucleotide
gtgaggaaggggagcaaatgagggttggagtaggg

SEQ ID NO: 114223 - DNA, 35 bp, Artificial Sequence
  Synthetic oligonucleotide
gcggtgcccccgcgtgccccatctgtctaccttct

SEQ ID NO: 114224 - DNA, 35 bp, Artificial Sequence
  Synthetic oligonucleotide
gacacccgccctatttgcctcgctccctctctgga

SEQ ID NO: 114225 - DNA, 35 bp, Artificial Sequence
  Synthetic oligonucleotide
tggacactcgcacttgttaccgccactatctccag

SEQ ID NO: 114226 - DNA, 35 bp, Artificial Sequence
  Synthetic oligonucleotide
gaccctccatccgcgcgaacctagcatttatcctg

SEQ ID NO: 114227 - DNA, 36 bp, Artificial Sequence
  Synthetic oligonucleotide
tcctcacccggtcaccttctagttcatacgcacgaa

SEQ ID NO: 114228 - DNA, 36 bp, Artificial Sequence
  Synthetic oligonucleotide
tgagacctcctgttatttttcgccgatcctgctcca

SEQ ID NO: 114229 - DNA, 34 bp, Artificial Sequence
  Synthetic oligonucleotide
gttcccgcgccaggcacgcacgccatccccctca

SEQ ID NO: 114230 - DNA, 35 bp, Artificial Sequence
  Synthetic oligonucleotide
gacccacaccgcacccgccccaatagcccacgtcc

SEQ ID NO: 114231 - DNA, 35 bp, Artificial Sequence
  Synthetic oligonucleotide
gtgcgctcagctctccactcggccctcctgctagt

SEQ ID NO: 114232 - DNA, 35 bp, Artificial Sequence
  Synthetic oligonucleotide
accccgtgagagctgtcaaccccgccctgctacca

SEQ ID NO: 114233 - DNA, 36 bp, Artificial Sequence
  Synthetic oligonucleotide
tctatgccgcgccaggctgccagtccacccccccca

SEQ ID NO: 114234 - DNA, 36 bp, Artificial Sequence
  Synthetic oligonucleotide
ttgcctggttcttctcgcgctcgaccactgtttcca

SEQ ID NO: 114235 - DNA, 35 bp, Artificial Sequence
  Synthetic oligonucleotide
aacccgccacccgactcccagatgcggctcactca

SEQ ID NO: 114236 - DNA, 35 bp, Artificial Sequence
  Synthetic oligonucleotide
gtttcgctcaatccgctttatcgccctgtcgttcc

SEQ ID NO: 114237 - DNA, 35 bp, Artificial Sequence
  Synthetic oligonucleotide
actggccccccctgtcgatctatcgtgcccatcaa

SEQ ID NO: 114238 - DNA, 36 bp, Artificial Sequence
  Synthetic oligonucleotide
atagggccagggggggtatggtgggcatgaagggga

SEQ ID NO: 114239 - DNA, 35 bp, Artificial Sequence
  Synthetic oligonucleotide
gcctgctcatcggtttctgtgctcctccctcgccc

SEQ ID NO: 114240 - DNA, 35 bp, Artificial Sequence
  Synthetic oligonucleotide
gcacacccgctacacacctcttgcaagagcttatc

SEQ ID NO: 114241 - DNA, 35 bp, Artificial Sequence
  Synthetic oligonucleotide
gcgacgagccgatgtaacgcccgcccctccaaccg

SEQ ID NO: 114242 - DNA, 35 bp, Artificial Sequence
  Synthetic oligonucleotide
gcatcaccccgcctcgctttccccgtagtgcacat

SEQ ID NO: 114243 - DNA, 35 bp, Artificial Sequence
  Synthetic oligonucleotide
aacctcaccctgcaccgtccacccccacgtgccgt

SEQ ID NO: 114244 - DNA, 36 bp, Artificial Sequence
  Synthetic oligonucleotide
gactgtccctgggtgtttcccgcgcccctccaccca

SEQ ID NO: 114245 - DNA, 37 bp, Artificial Sequence
  Synthetic oligonucleotide
tcccgcctcgccgctccaacccctgctgtttgttcga

SEQ ID NO: 114246 - DNA, 37 bp, Artificial Sequence
  Synthetic oligonucleotide
gtggggggagtcggggtattggatggagggtagggga

SEQ ID NO: 114247 - DNA, 36 bp, Artificial Sequence
  Synthetic oligonucleotide
atgtctccgcaactacgcaccctgttcacatacgta

SEQ ID NO: 114248 - DNA, 35 bp, Artificial Sequence
  Synthetic oligonucleotide
ttgactcgccgctgccccctaacgcaacatttgac

SEQ ID NO: 114249 - DNA, 35 bp, Artificial Sequence
  Synthetic oligonucleotide
gattggggaggggaagagggaagaggtggatacag

SEQ ID NO: 114250 - DNA, 35 bp, Artificial Sequence
  Synthetic oligonucleotide
gcctggctaccaccatgtctacttactctcattct

SEQ ID NO: 114251 - DNA, 36 bp, Artificial Sequence
  Synthetic oligonucleotide
gaccacgtccgttactgcatccaccgcattcttaca

SEQ ID NO: 114252 - DNA, 35 bp, Artificial Sequence
  Synthetic oligonucleotide
actccactcatcctcgtttggccgtgttgttctac

SEQ ID NO: 114253 - DNA, 35 bp, Artificial Sequence
  Synthetic oligonucleotide
ttcttgcaccccccgcccttatgatatctttggcc

SEQ ID NO: 114254 - DNA, 35 bp, Artificial Sequence
  Synthetic oligonucleotide
ttgagcgcaagcgtattacctctctcttcttttcg

SEQ ID NO: 114255 - DNA, 35 bp, Artificial Sequence
  Synthetic oligonucleotide
acacagctcccacgctgttcacgattgcccactct

SEQ ID NO: 114256 - DNA, 36 bp, Artificial Sequence
  Synthetic oligonucleotide
agtccgtgcggcacatagcattccttcaccttccca

SEQ ID NO: 114257 - DNA, 35 bp, Artificial Sequence
  Synthetic oligonucleotide
atgagggggggtgagaagggcatgaaaagagggca

SEQ ID NO: 114258 - DNA, 37 bp, Artificial Sequence
  Synthetic oligonucleotide
gagaagagacagaggaccagtatgaggagagggatga

SEQ ID NO: 114259 - DNA, 38 bp, Artificial Sequence
  Synthetic oligonucleotide
gtcacctccacagcgtattctcctcaccacggccttga

SEQ ID NO: 114260 - DNA, 38 bp, Artificial Sequence
  Synthetic oligonucleotide
gcgatggatcgggggggtagggagggatcaggtcttga

SEQ ID NO: 114261 - DNA, 35 bp, Artificial Sequence
  Synthetic oligonucleotide
tgctgcggccgttttgccctaccccaccgttctgc

SEQ ID NO: 114262 - DNA, 35 bp, Artificial Sequence
  Synthetic oligonucleotide
tgagccgcctgcatcggcctccaccaggttcccct

SEQ ID NO: 114263 - DNA, 37 bp, Artificial Sequence
  Synthetic oligonucleotide
acagggagggagggccatgtaggtccaatgagaggga

SEQ ID NO: 114264 - DNA, 35 bp, Artificial Sequence
  Synthetic oligonucleotide
agccccccgcacccaagacgcccctctctgacgta

SEQ ID NO: 114265 - DNA, 35 bp, Artificial Sequence
  Synthetic oligonucleotide
gccggtgtctagcgccttcctgccccatgtctcct

SEQ ID NO: 114266 - DNA, 35 bp, Artificial Sequence
  Synthetic oligonucleotide
tggtaccctcagctactaccctgccttcacttagt

SEQ ID NO: 114267 - DNA, 36 bp, Artificial Sequence
  Synthetic oligonucleotide
ttaccacccggggatgttctttgccctcgtccacca

SEQ ID NO: 114268 - DNA, 35 bp, Artificial Sequence
  Synthetic oligonucleotide
ttgggacagagcgcatcccgcccgcccgccaactt

SEQ ID NO: 114269 - DNA, 35 bp, Artificial Sequence
  Synthetic oligonucleotide
ttcatccagacgccgcatgcacctttagcgccctt

SEQ ID NO: 114270 - DNA, 37 bp, Artificial Sequence
  Synthetic oligonucleotide
tccaggattggcaagggtgggtagggaagggtacgga

SEQ ID NO: 114271 - DNA, 35 bp, Artificial Sequence
  Synthetic oligonucleotide
tctgtgtctgctcctgtgctcctatcaccttctcg

SEQ ID NO: 114272 - DNA, 35 bp, Artificial Sequence
  Synthetic oligonucleotide
ttgctcgtcagacacgcctcccccccctacatgca

SEQ ID NO: 114273 - DNA, 35 bp, Artificial Sequence
  Synthetic oligonucleotide
gttggggggatcgggtgggggaacatcatggggga

SEQ ID NO: 114274 - DNA, 36 bp, Artificial Sequence
  Synthetic oligonucleotide
gacctcgcgccatacgcgcatatagcccccccctga

SEQ ID NO: 114275 - DNA, 38 bp, Artificial Sequence
  Synthetic oligonucleotide
atcgccggtggggggagggggagggcattaggaggtga

SEQ ID NO: 114276 - DNA, 35 bp, Artificial Sequence
  Synthetic oligonucleotide
agcacaaccggctatgcgatcctgcctgtttttcc

SEQ ID NO: 114277 - DNA, 35 bp, Artificial Sequence
  Synthetic oligonucleotide
ttgttcctcctcccatggtctttttggaccgccgc

SEQ ID NO: 114278 - DNA, 35 bp, Artificial Sequence
  Synthetic oligonucleotide
accaagcctatgtagcgctcgttaacacctcctgc

SEQ ID NO: 114279 - DNA, 35 bp, Artificial Sequence
  Synthetic oligonucleotide
gatcaccactcctgccgaccacattccaccctcgg

SEQ ID NO: 114280 - DNA, 35 bp, Artificial Sequence
  Synthetic oligonucleotide
tgcacatgcagcattttgtctacttcgcccctcca

SEQ ID NO: 114281 - DNA, 36 bp, Artificial Sequence
  Synthetic oligonucleotide
acccgtctcccatgtaacacccgtccaccacgctca

SEQ ID NO: 114282 - DNA, 35 bp, Artificial Sequence
  Synthetic oligonucleotide
acccccgcccggctgcttagtccctctcctgccta

SEQ ID NO: 114283 - DNA, 35 bp, Artificial Sequence
  Synthetic oligonucleotide
aaccaccgctattgaggcctgtcccgcctattcta

SEQ ID NO: 114284 - DNA, 35 bp, Artificial Sequence
  Synthetic oligonucleotide
gccagacgccatatttatgccctcgaacccttctt

SEQ ID NO: 114285 - DNA, 35 bp, Artificial Sequence
  Synthetic oligonucleotide
aacgatacgcgggagaggcgggaggggggtccaga

SEQ ID NO: 114286 - DNA, 37 bp, Artificial Sequence
  Synthetic oligonucleotide
ggggagggtgtacgctggggtcctaattttgtgggga

SEQ ID NO: 114287 - DNA, 37 bp, Artificial Sequence
  Synthetic oligonucleotide
gtgagccctgcccctccgttgcctgtcagtatactga

SEQ ID NO: 114288 - DNA, 35 bp, Artificial Sequence
  Synthetic oligonucleotide
gtccccaccccgctgtatggcgaatattgttacac

SEQ ID NO: 114289 - DNA, 35 bp, Artificial Sequence
  Synthetic oligonucleotide
gtgcatccgccccccgtcacaacgaactgcaaagc

SEQ ID NO: 114290 - DNA, 35 bp, Artificial Sequence
  Synthetic oligonucleotide
tgataagccctatccggttcgttgtctcgttactc

SEQ ID NO: 114291 - DNA, 35 bp, Artificial Sequence
  Synthetic oligonucleotide
ggatcctgcctcccgattccacacacctagccgcg

SEQ ID NO: 114292 - DNA, 35 bp, Artificial Sequence
  Synthetic oligonucleotide
gtttacgaagtccccgccccgtccaccctctaatg

SEQ ID NO: 114293 - DNA, 36 bp, Artificial Sequence
  Synthetic oligonucleotide
tcaacagtggggggggaggagaggggccgggggata

SEQ ID NO: 114294 - DNA, 35 bp, Artificial Sequence
  Synthetic oligonucleotide
acgaacgccccgctgcctcccttcagtcatagccg

SEQ ID NO: 114295 - DNA, 35 bp, Artificial Sequence
  Synthetic oligonucleotide
gaaggaagtcgcggaggaagaaggcacggggcagg

SEQ ID NO: 114296 - DNA, 35 bp, Artificial Sequence
  Synthetic oligonucleotide
gagagagagtgcggaagggtcaaagggcggctcaa

SEQ ID NO: 114297 - DNA, 37 bp, Artificial Sequence
  Synthetic oligonucleotide
tgtacccctctgtgtttccccgaccctgcttcatcga

SEQ ID NO: 114298 - DNA, 35 bp, Artificial Sequence
  Synthetic oligonucleotide
acccgcctgtgcggttctctagccaacttactcac

SEQ ID NO: 114299 - DNA, 35 bp, Artificial Sequence
  Synthetic oligonucleotide
tgttagcgcatcccccgtctagttcgcgcccttac

SEQ ID NO: 114300 - DNA, 35 bp, Artificial Sequence
  Synthetic oligonucleotide
gtcctcactcccgaagggttatatgcccccttctc

SEQ ID NO: 114301 - DNA, 35 bp, Artificial Sequence
  Synthetic oligonucleotide
tcgatcacagctcccgacgttcccattttcgtgtc

SEQ ID NO: 114302 - DNA, 35 bp, Artificial Sequence
  Synthetic oligonucleotide
ttgcactcaccacggcacactgaaccacctctctt

SEQ ID NO: 114303 - DNA, 36 bp, Artificial Sequence
  Synthetic oligonucleotide
tcagcaccctccttactgtctgtgattccgcctcca

SEQ ID NO: 114304 - DNA, 37 bp, Artificial Sequence
  Synthetic oligonucleotide
gtttgccccccctgttattctgtacgtcgacagctga

SEQ ID NO: 114305 - DNA, 35 bp, Artificial Sequence
  Synthetic oligonucleotide
aacatcgctgtggcgcatatcggcccctttctacc

SEQ ID NO: 114306 - DNA, 35 bp, Artificial Sequence
  Synthetic oligonucleotide
tgaagcagtagggccgggagggaagggatctcgcc

SEQ ID NO: 114307 - DNA, 35 bp, Artificial Sequence
  Synthetic oligonucleotide
atcgcggtggtcgacgttcgccccccttttgctct

SEQ ID NO: 114308 - DNA, 35 bp, Artificial Sequence
  Synthetic oligonucleotide
tcatcaatcacgggaggaggggtggggtggacggt

SEQ ID NO: 114309 - DNA, 35 bp, Artificial Sequence
  Synthetic oligonucleotide
tccgccacacacacgcctacgcatcccccggactg

SEQ ID NO: 114310 - DNA, 37 bp, Artificial Sequence
  Synthetic oligonucleotide
agcccgcccttcgtatccccgcagccactctacacga

SEQ ID NO: 114311 - DNA, 35 bp, Artificial Sequence
  Synthetic oligonucleotide
acacccgtcgcccgtccccgcttatactacggcta

SEQ ID NO: 114312 - DNA, 36 bp, Artificial Sequence
  Synthetic oligonucleotide
gccaccacccttccgcctcaatcgtagtggacctcc

SEQ ID NO: 114313 - DNA, 35 bp, Artificial Sequence
  Synthetic oligonucleotide
aatgcgccttaccgccccccctgcccacttgccag

SEQ ID NO: 114314 - DNA, 35 bp, Artificial Sequence
  Synthetic oligonucleotide
gacggaactccgtacagccttgtcccatccttgcg

SEQ ID NO: 114315 - DNA, 35 bp, Artificial Sequence
  Synthetic oligonucleotide
gtattgtcgccgccttcctgtttgagtctcctcgt

SEQ ID NO: 114316 - DNA, 35 bp, Artificial Sequence
  Synthetic oligonucleotide
gggggaaatggtggtagaagggggggaagaatgga

SEQ ID NO: 114317 - DNA, 35 bp, Artificial Sequence
  Synthetic oligonucleotide
ttggctcagcataccgtgtgaccgctccctctctc

SEQ ID NO: 114318 - DNA, 35 bp, Artificial Sequence
  Synthetic oligonucleotide
atgggacccgcacatttctaccactcacatccttg

SEQ ID NO: 114319 - DNA, 35 bp, Artificial Sequence
  Synthetic oligonucleotide
gtccccctcatcgttcgcatcctagcctcggtgct

SEQ ID NO: 114320 - DNA, 35 bp, Artificial Sequence
  Synthetic oligonucleotide
gcgcccccttcgctgttcgttctcgcctgtatcgt

SEQ ID NO: 114321 - DNA, 37 bp, Artificial Sequence
  Synthetic oligonucleotide
gtgggggaaggagagttggggcctaaggggtggtgga

SEQ ID NO: 114322 - DNA, 35 bp, Artificial Sequence
  Synthetic oligonucleotide
tcaccttcaccaatcgcgccacaccacccttgcgc

SEQ ID NO: 114323 - DNA, 35 bp, Artificial Sequence
  Synthetic oligonucleotide
acacgaagaagaaggtgcaggggaacgggatggat

SEQ ID NO: 114324 - DNA, 35 bp, Artificial Sequence
  Synthetic oligonucleotide
gccgccgtgcccatgcacctctctacttcccatga

SEQ ID NO: 114325 - DNA, 35 bp, Artificial Sequence
  Synthetic oligonucleotide
ggacgggcaccccctaatacacctcggcttctacc

SEQ ID NO: 114326 - DNA, 35 bp, Artificial Sequence
  Synthetic oligonucleotide
ggaagccctcggttgcacatccccgttcctctccg

SEQ ID NO: 114327 - DNA, 37 bp, Artificial Sequence
  Synthetic oligonucleotide
tcaacattgacccatctggtaagacctccccctgtga

SEQ ID NO: 114328 - DNA, 37 bp, Artificial Sequence
  Synthetic oligonucleotide
tctacccccgccccccgtgcccccttttaaggaccga

SEQ ID NO: 114329 - DNA, 36 bp, Artificial Sequence
  Synthetic oligonucleotide
gcacatcgcggtagctgcgcttgcacccctcttgta

SEQ ID NO: 114330 - DNA, 35 bp, Artificial Sequence
  Synthetic oligonucleotide
gtttcgccccgtatgacttacgctgacccctatac

SEQ ID NO: 114331 - DNA, 35 bp, Artificial Sequence
  Synthetic oligonucleotide
gtacgaaggggggagtagggtcggaattccgggag

SEQ ID NO: 114332 - DNA, 35 bp, Artificial Sequence
  Synthetic oligonucleotide
attaacatgcggggaggggagggtcgggcaatagg

SEQ ID NO: 114333 - DNA, 36 bp, Artificial Sequence
  Synthetic oligonucleotide
tcacatccgcacgattagctggttgcctcccctcca

SEQ ID NO: 114334 - DNA, 37 bp, Artificial Sequence
  Synthetic oligonucleotide
atagagacggaatagggtaaggagggcgggatgggga

SEQ ID NO: 114335 - DNA, 38 bp, Artificial Sequence
  Synthetic oligonucleotide
gttcggggagggcacccggggaaataaggggactatga

SEQ ID NO: 114336 - DNA, 34 bp, Artificial Sequence
  Synthetic oligonucleotide
gccctaagtgcatcatctctgtacctccattgtc

SEQ ID NO: 114337 - DNA, 35 bp, Artificial Sequence
  Synthetic oligonucleotide
taggggtgttgggggtgaacagggaggagaggtgg

SEQ ID NO: 114338 - DNA, 37 bp, Artificial Sequence
  Synthetic oligonucleotide
acgactaggtcagcagcttttctggccccctccccga

SEQ ID NO: 114339 - DNA, 36 bp, Artificial Sequence
  Synthetic oligonucleotide
ccaaaacccttgtctcacgaactgcccacccccgga

SEQ ID NO: 114340 - DNA, 35 bp, Artificial Sequence
  Synthetic oligonucleotide
ttgccgacaccgcctctgacctgggtcccgttttc

SEQ ID NO: 114341 - DNA, 35 bp, Artificial Sequence
  Synthetic oligonucleotide
agggacgaacaagagggcaagggaatgggaggcag

SEQ ID NO: 114342 - DNA, 35 bp, Artificial Sequence
  Synthetic oligonucleotide
gattcgctccgtgcacgtttttaccgcgcttccct

SEQ ID NO: 114343 - DNA, 36 bp, Artificial Sequence
  Synthetic oligonucleotide
ggacaggcgtgcacttgtcttccctgcggtcctcca

SEQ ID NO: 114344 - DNA, 36 bp, Artificial Sequence
  Synthetic oligonucleotide
gtctgacgtccgtctcgcttggccttctctttcgca

SEQ ID NO: 114345 - DNA, 37 bp, Artificial Sequence
  Synthetic oligonucleotide
acttgccctcattatgcctttgttctgtccgccatta

SEQ ID NO: 114346 - DNA, 38 bp, Artificial Sequence
  Synthetic oligonucleotide
tcctccccgactcctgtgcgttttagcctcacttctga

SEQ ID NO: 114347 - DNA, 35 bp, Artificial Sequence
  Synthetic oligonucleotide
tcatgtgtacacagtcccgctccacccttatgcca

SEQ ID NO: 114348 - DNA, 38 bp, Artificial Sequence
  Synthetic oligonucleotide
atgaccggcctttcctgttccgttcgcctgtactttga

SEQ ID NO: 114349 - DNA, 36 bp, Artificial Sequence
  Synthetic oligonucleotide
gcatcccaccccccagttgagtcttacaccatcgta

SEQ ID NO: 114350 - DNA, 35 bp, Artificial Sequence
  Synthetic oligonucleotide
gccacactcctggatttaaccgacgctcacctgac

SEQ ID NO: 114351 - DNA, 37 bp, Artificial Sequence
  Synthetic oligonucleotide
gtgccctccttcgtcgtccaagatcccggccttaccc

SEQ ID NO: 114352 - DNA, 35 bp, Artificial Sequence
  Synthetic oligonucleotide
gagggcgcctctgctctggccactctacaacctcc

SEQ ID NO: 114353 - DNA, 34 bp, Artificial Sequence
  Synthetic oligonucleotide
acatctaccgccagaccggaccatccacctcgac

SEQ ID NO: 114354 - DNA, 34 bp, Artificial Sequence
  Synthetic oligonucleotide
gacccatccgctacccccacacccccgctgactg

SEQ ID NO: 114355 - DNA, 35 bp, Artificial Sequence
  Synthetic oligonucleotide
tgttgcccgtcacccgccccccacacactcctctt

SEQ ID NO: 114356 - DNA, 35 bp, Artificial Sequence
  Synthetic oligonucleotide
tctactgcctcgtcccgacctccccatcccgagtg

SEQ ID NO: 114357 - DNA, 35 bp, Artificial Sequence
  Synthetic oligonucleotide
tactggcacccgttcgaccacccatagctccatct

SEQ ID NO: 114358 - DNA, 36 bp, Artificial Sequence
  Synthetic oligonucleotide
gagccacgagctgcccctccgcctcacttacctgaa

SEQ ID NO: 114359 - DNA, 37 bp, Artificial Sequence
  Synthetic oligonucleotide
gaaatgcgggggtagggtagggcgggcagctcgagga

SEQ ID NO: 114360 - DNA, 38 bp, Artificial Sequence
  Synthetic oligonucleotide
gattgacgggtggagggggagggtggagatagtcgtga

SEQ ID NO: 114361 - DNA, 35 bp, Artificial Sequence
  Synthetic oligonucleotide
ttccatcctccatgctctatagcgactcgtctact

SEQ ID NO: 114362 - DNA, 37 bp, Artificial Sequence
  Synthetic oligonucleotide
accccgctcaccatggccccacgcactatcttaatga

SEQ ID NO: 114363 - DNA, 35 bp, Artificial Sequence
  Synthetic oligonucleotide
acgtacgcctaatgcgagtagcatacatcccgccc

SEQ ID NO: 114364 - DNA, 35 bp, Artificial Sequence
  Synthetic oligonucleotide
tatgaaaggggcaaggtggcacgggggaaaggccg

SEQ ID NO: 114365 - DNA, 35 bp, Artificial Sequence
  Synthetic oligonucleotide
gacgaggccgtggagggaagaaaaacggacgggtg

SEQ ID NO: 114366 - DNA, 35 bp, Artificial Sequence
  Synthetic oligonucleotide
tgccaccgaccgagttaaatcggccactcactcct

SEQ ID NO: 114367 - DNA, 35 bp, Artificial Sequence
  Synthetic oligonucleotide
acagtcacccgactgtcggtacctggtctatcctt

SEQ ID NO: 114368 - DNA, 38 bp, Artificial Sequence
  Synthetic oligonucleotide
atacatcactccgaatgccagacccgcctcacctttga

SEQ ID NO: 114369 - DNA, 35 bp, Artificial Sequence
  Synthetic oligonucleotide
gtcacttcacatcgccctgcccctatctggaattc

SEQ ID NO: 114370 - DNA, 35 bp, Artificial Sequence
  Synthetic oligonucleotide
tcccaccgccccatcttttcatatgccctgccacg

SEQ ID NO: 114371 - DNA, 35 bp, Artificial Sequence
  Synthetic oligonucleotide
gccgtgtcgtgtgcttcccctccgtccgctttcac

SEQ ID NO: 114372 - DNA, 35 bp, Artificial Sequence
  Synthetic oligonucleotide
atacgcccccgtaagctctgctaaccactcaccga

SEQ ID NO: 114373 - DNA, 35 bp, Artificial Sequence
  Synthetic oligonucleotide
tatggccgtctggctttaccgtgtcttaccccccc

SEQ ID NO: 114374 - DNA, 35 bp, Artificial Sequence
  Synthetic oligonucleotide
gctcagccccaatctgtcatccttacttttacggt

SEQ ID NO: 114375 - DNA, 37 bp, Artificial Sequence
  Synthetic oligonucleotide
ggaaggggaggggggcctacggggagaagatggtgga

SEQ ID NO: 114376 - DNA, 38 bp, Artificial Sequence
  Synthetic oligonucleotide
tccgtaccatcactttatgcctgcctgctcacccctga

SEQ ID NO: 114377 - DNA, 35 bp, Artificial Sequence
  Synthetic oligonucleotide
gcaagtcagccgcgcgctactatccttctcacctg

SEQ ID NO: 114378 - DNA, 36 bp, Artificial Sequence
  Synthetic oligonucleotide
gccaccccagctgccttgtacaaaatccttctccaa

SEQ ID NO: 114379 - DNA, 38 bp, Artificial Sequence
  Synthetic oligonucleotide
atagtgagggaggaaggcgaaaaggaaggaaggtgtga

SEQ ID NO: 114380 - DNA, 35 bp, Artificial Sequence
  Synthetic oligonucleotide
tgacactgtaccgccaggcgcctcactactgtccc

SEQ ID NO: 114381 - DNA, 35 bp, Artificial Sequence
  Synthetic oligonucleotide
tactgtcaagccgccccagctcgtccctatccgtc

SEQ ID NO: 114382 - DNA, 35 bp, Artificial Sequence
  Synthetic oligonucleotide
tgccacagtgccccccgtacttcttaagcccgccg

SEQ ID NO: 114383 - DNA, 34 bp, Artificial Sequence
  Synthetic oligonucleotide
atccgcccctccccctgaagtcctcaatgcaaga

SEQ ID NO: 114384 - DNA, 35 bp, Artificial Sequence
  Synthetic oligonucleotide
agaccgtggggagggagttagggggagggacacca

SEQ ID NO: 114385 - DNA, 38 bp, Artificial Sequence
  Synthetic oligonucleotide
atcagcgcacacggcgttccccccctctagtttcttga

SEQ ID NO: 114386 - DNA, 35 bp, Artificial Sequence
  Synthetic oligonucleotide
gacgaccgccatcgcactctgttgcttactacgcc

SEQ ID NO: 114387 - DNA, 34 bp, Artificial Sequence
  Synthetic oligonucleotide
gtagcctcatgccttctttgctcactggtttctt

SEQ ID NO: 114388 - DNA, 35 bp, Artificial Sequence
  Synthetic oligonucleotide
tcgcaaactgcctcgctgtatccacctttcgccac

SEQ ID NO: 114389 - DNA, 35 bp, Artificial Sequence
  Synthetic oligonucleotide
ttcatcagccacgtctgcctccgtcatgtcgcctc

SEQ ID NO: 114390 - DNA, 35 bp, Artificial Sequence
  Synthetic oligonucleotide
gatccgccccccagtgtcacatagaacccgctttt

SEQ ID NO: 114391 - DNA, 37 bp, Artificial Sequence
  Synthetic oligonucleotide
taaggcgggaagaagggcggggcaaacggatggggga

SEQ ID NO: 114392 - DNA, 38 bp, Artificial Sequence
  Synthetic oligonucleotide
tactgcccctcactgcgtgtccctcgtgcaatccttga

SEQ ID NO: 114393 - DNA, 36 bp, Artificial Sequence
  Synthetic oligonucleotide
tcccagctctgtcttcctctgtccactcctctcgta

SEQ ID NO: 114394 - DNA, 35 bp, Artificial Sequence
  Synthetic oligonucleotide
accatgccctcactgtactaacttcctaacgcgtg

SEQ ID NO: 114395 - DNA, 35 bp, Artificial Sequence
  Synthetic oligonucleotide
tgtgcacgatccctgctttgaccttttcacctttg

SEQ ID NO: 114396 - DNA, 35 bp, Artificial Sequence
  Synthetic oligonucleotide
agcacgcacctggcccgtgcccactatgcctccct

SEQ ID NO: 114397 - DNA, 35 bp, Artificial Sequence
  Synthetic oligonucleotide
acccaaccatcaggcgcgttccggccattttcttt

SEQ ID NO: 114398 - DNA, 36 bp, Artificial Sequence
  Synthetic oligonucleotide
gccatcgcctttcgtttttgctactatcaccgccca

SEQ ID NO: 114399 - DNA, 36 bp, Artificial Sequence
  Synthetic oligonucleotide
gaccactctgcatctttagtacctcgctctatttca

SEQ ID NO: 114400 - DNA, 38 bp, Artificial Sequence
  Synthetic oligonucleotide
tacacaaacgcgggagggagggaatgggcctggggtga

SEQ ID NO: 114401 - DNA, 38 bp, Artificial Sequence
  Synthetic oligonucleotide
gatgcgcccaacgcaatctgcctgtcccatctcattga

SEQ ID NO: 114402 - DNA, 35 bp, Artificial Sequence
  Synthetic oligonucleotide
gtggcacatgccaaatctgttcgtttgcttctcct

SEQ ID NO: 114403 - DNA, 35 bp, Artificial Sequence
  Synthetic oligonucleotide
ggtgccccccgctttttctaggacttcctgttgca

SEQ ID NO: 114404 - DNA, 36 bp, Artificial Sequence
  Synthetic oligonucleotide
tagacggggcatggaagggggttgaggctgggcgta

SEQ ID NO: 114405 - DNA, 35 bp, Artificial Sequence
  Synthetic oligonucleotide
ttgcgtcccccgctgtcgccttttttgtcattcac

SEQ ID NO: 114406 - DNA, 35 bp, Artificial Sequence
  Synthetic oligonucleotide
accgtcccgcatcacctccgctgccccgcacgcat

SEQ ID NO: 114407 - DNA, 35 bp, Artificial Sequence
  Synthetic oligonucleotide
gaagatagcgggcggagaggttgagggacggcgct

SEQ ID NO: 114408 - DNA, 37 bp, Artificial Sequence
  Synthetic oligonucleotide
ggagggtcgggacggaggggggaacaggtgggagcga

SEQ ID NO: 114409 - DNA, 35 bp, Artificial Sequence
  Synthetic oligonucleotide
accccctccgtttgggcatatgtatttcccccccc

SEQ ID NO: 114410 - DNA, 35 bp, Artificial Sequence
  Synthetic oligonucleotide
gttatcatctgccccctgttattcgttgtctgctc

SEQ ID NO: 114411 - DNA, 35 bp, Artificial Sequence
  Synthetic oligonucleotide
ggaacgactaagtcgtctcaccaaccaccccctgt

SEQ ID NO: 114412 - DNA, 36 bp, Artificial Sequence
  Synthetic oligonucleotide
tacccgtcgcaggcttgtacgtcctgtccttctcca

SEQ ID NO: 114413 - DNA, 36 bp, Artificial Sequence
  Synthetic oligonucleotide
gcatcgctagcgcctcatccgttttgttccgtctca

SEQ ID NO: 114414 - DNA, 36 bp, Artificial Sequence
  Synthetic oligonucleotide
tacacccccgacactgttcacacctgtttcactgta

SEQ ID NO: 114415 - DNA, 35 bp, Artificial Sequence
  Synthetic oligonucleotide
attcacacatccgcctgcttttgctcgttcgtctc

SEQ ID NO: 114416 - DNA, 35 bp, Artificial Sequence
  Synthetic oligonucleotide
ttgcccacgtcgttcgtccgcgttgtcatttcttc

SEQ ID NO: 114417 - DNA, 35 bp, Artificial Sequence
  Synthetic oligonucleotide
gtggtcgccgcttaccttgccgttttgatccatcg

SEQ ID NO: 114418 - DNA, 36 bp, Artificial Sequence
  Synthetic oligonucleotide
tggaggggaggaaggtaggagagtaagggaataaga

SEQ ID NO: 114419 - DNA, 35 bp, Artificial Sequence
  Synthetic oligonucleotide
tgctccacgcgtaactgttccatcccgactatcac

SEQ ID NO: 114420 - DNA, 35 bp, Artificial Sequence
  Synthetic oligonucleotide
gcaaaccgtctgcgcgaccgccttgtttttgcctc

SEQ ID NO: 114421 - DNA, 35 bp, Artificial Sequence
  Synthetic oligonucleotide
gcaggaccatctgctctactgtctcccacttcgcg

SEQ ID NO: 114422 - DNA, 35 bp, Artificial Sequence
  Synthetic oligonucleotide
gtctccttccgccatctttcaactcgccatctgcg

SEQ ID NO: 114423 - DNA, 35 bp, Artificial Sequence
  Synthetic oligonucleotide
atttccccggcggtgtgttttgccctgtgccttcg

SEQ ID NO: 114424 - DNA, 37 bp, Artificial Sequence
  Synthetic oligonucleotide
gcctaccccacttgttccctaaagcctggcttctcga

SEQ ID NO: 114425 - DNA, 38 bp, Artificial Sequence
  Synthetic oligonucleotide
tgcatccgcccccgctgctacgccccttccgagcctga

SEQ ID NO: 114426 - DNA, 35 bp, Artificial Sequence
  Synthetic oligonucleotide
tcccgacctcacgtggctacactttctcttccgtt

SEQ ID NO: 114427 - DNA, 36 bp, Artificial Sequence
  Synthetic oligonucleotide
tccactcgccactctatgcaccattatgaccgcaca

SEQ ID NO: 114428 - DNA, 35 bp, Artificial Sequence
  Synthetic oligonucleotide
actccctccgcttagattcactccatccgctggta

SEQ ID NO: 114429 - DNA, 35 bp, Artificial Sequence
  Synthetic oligonucleotide
gcactagccccttgtactgccttattggtcgctct

SEQ ID NO: 114430 - DNA, 36 bp, Artificial Sequence
  Synthetic oligonucleotide
gccacgccggaacctcgccagctgaccccgccccca

SEQ ID NO: 114431 - DNA, 37 bp, Artificial Sequence
  Synthetic oligonucleotide
ggggggggagtaactgggtggaggaacgggtgtatga

SEQ ID NO: 114432 - DNA, 35 bp, Artificial Sequence
  Synthetic oligonucleotide
tactgccagcggccacgcggttctgctacctttcc

SEQ ID NO: 114433 - DNA, 34 bp, Artificial Sequence
  Synthetic oligonucleotide
tacgcacaatcgttccgcctcagctccacactct

SEQ ID NO: 114434 - DNA, 35 bp, Artificial Sequence
  Synthetic oligonucleotide
tgatggggagacagggtggggagggcagtcatcgt

SEQ ID NO: 114435 - DNA, 37 bp, Artificial Sequence
  Synthetic oligonucleotide
gagatggtggggggtggtggtctaggggaacaggcga

SEQ ID NO: 114436 - DNA, 35 bp, Artificial Sequence
  Synthetic oligonucleotide
aatacagcctgccctcaccgctcgtgcacacactc

SEQ ID NO: 114437 - DNA, 35 bp, Artificial Sequence
  Synthetic oligonucleotide
tgcgtcatcagttgctcccggtagcccgcctccct

SEQ ID NO: 114438 - DNA, 36 bp, Artificial Sequence
  Synthetic oligonucleotide
gtcacctcatgttattacgccatccttcccgctcaa

SEQ ID NO: 114439 - DNA, 34 bp, Artificial Sequence
  Synthetic oligonucleotide
tcctgacccccacttagtgatccgacccgccaca

SEQ ID NO: 114440 - DNA, 35 bp, Artificial Sequence
  Synthetic oligonucleotide
tgctcaactgcctgcctttcgtcccaagccacgta

SEQ ID NO: 114441 - DNA, 35 bp, Artificial Sequence
  Synthetic oligonucleotide
gttgcaggtacgccccccgtcgttttaaccagccc

SEQ ID NO: 114442 - DNA, 35 bp, Artificial Sequence
  Synthetic oligonucleotide
tacgtccgacaacagttcgatccccctgctttccc

SEQ ID NO: 114443 - DNA, 35 bp, Artificial Sequence
  Synthetic oligonucleotide
gcgataccatctacgcgtgtcctacctatgccctc

SEQ ID NO: 114444 - DNA, 37 bp, Artificial Sequence
  Synthetic oligonucleotide
gtgaagagaatggaccggggcaagagagagagtggga

SEQ ID NO: 114445 - DNA, 35 bp, Artificial Sequence
  Synthetic oligonucleotide
atgcgcacttcctcctgcagctcctggtactagcc

SEQ ID NO: 114446 - DNA, 35 bp, Artificial Sequence
  Synthetic oligonucleotide
ggtgccaccatgtcacttccgtcatcctgatccgc

SEQ ID NO: 114447 - DNA, 35 bp, Artificial Sequence
  Synthetic oligonucleotide
acatcccgtcgccccgcttgtcctatcataacgtg

SEQ ID NO: 114448 - DNA, 35 bp, Artificial Sequence
  Synthetic oligonucleotide
tcaccgatacctccgccctatagagctccgccact

SEQ ID NO: 114449 - DNA, 36 bp, Artificial Sequence
  Synthetic oligonucleotide
gtggggaagtggtggcggggtaatagggctgggcaa

SEQ ID NO: 114450 - DNA, 36 bp, Artificial Sequence
  Synthetic oligonucleotide
gttgccggccagacatttacattgcccgcccccaca

SEQ ID NO: 114451 - DNA, 36 bp, Artificial Sequence
  Synthetic oligonucleotide
tccgcaccccctgctccttctcttcgtgaccagaga

SEQ ID NO: 114452 - DNA, 35 bp, Artificial Sequence
  Synthetic oligonucleotide
atcgcaacccattcgttgctttttagcctcccgcc

SEQ ID NO: 114453 - DNA, 35 bp, Artificial Sequence
  Synthetic oligonucleotide
tcacggcctacacattagacttgctgccttcctcc

SEQ ID NO: 114454 - DNA, 35 bp, Artificial Sequence
  Synthetic oligonucleotide
tttgccccccgctcgttcgcacatcattctagatc

SEQ ID NO: 114455 - DNA, 35 bp, Artificial Sequence
  Synthetic oligonucleotide
tccccaccgaccattctttctttgccacagggacg

SEQ ID NO: 114456 - DNA, 35 bp, Artificial Sequence
  Synthetic oligonucleotide
gctgctccctccacctccacctcacttgcggcatg

SEQ ID NO: 114457 - DNA, 36 bp, Artificial Sequence
  Synthetic oligonucleotide
acccccggtctgtaattcgccacatgcctctaccca

SEQ ID NO: 114458 - DNA, 35 bp, Artificial Sequence
  Synthetic oligonucleotide
tttcccccactcccgccgatacgcaagtccaggcc

SEQ ID NO: 114459 - DNA, 35 bp, Artificial Sequence
  Synthetic oligonucleotide
gaatcatctcgagccccccccgccgccggaactgc

SEQ ID NO: 114460 - DNA, 34 bp, Artificial Sequence
  Synthetic oligonucleotide
aacgtcgcccggcatatcaccctggtcccccatc

SEQ ID NO: 114461 - DNA, 35 bp, Artificial Sequence
  Synthetic oligonucleotide
cccttccccgcgaccgacgcccgagtttaccgttc

SEQ ID NO: 114462 - DNA, 35 bp, Artificial Sequence
  Synthetic oligonucleotide
tgttccgtcacatttccacttcacgctcccttcct

SEQ ID NO: 114463 - DNA, 36 bp, Artificial Sequence
  Synthetic oligonucleotide
tccatcacaacgtgttcgtcgcgcattccaccgcca

SEQ ID NO: 114464 - DNA, 36 bp, Artificial Sequence
  Synthetic oligonucleotide
atcctgcacctcctccgacacacctgcctttagcga

SEQ ID NO: 114465 - DNA, 36 bp, Artificial Sequence
  Synthetic oligonucleotide
atctgcgcatcagtccctttgtctcacctcgtccta

SEQ ID NO: 114466 - DNA, 35 bp, Artificial Sequence
  Synthetic oligonucleotide
gcgccgcgtggggggggaagcgtagcacggtggtt

SEQ ID NO: 114467 - DNA, 36 bp, Artificial Sequence
  Synthetic oligonucleotide
tactaacctctgatcgcctaaagccactccacgcca

SEQ ID NO: 114468 - DNA, 36 bp, Artificial Sequence
  Synthetic oligonucleotide
tccggacggtcccgttttctgttatcctgttcttca

SEQ ID NO: 114469 - DNA, 35 bp, Artificial Sequence
  Synthetic oligonucleotide
gtcacccgcatccgacctccgttcactcctgttca

SEQ ID NO: 114470 - DNA, 38 bp, Artificial Sequence
  Synthetic oligonucleotide
gggacaccctctgtttctgcttagcctcccctctatga

SEQ ID NO: 114471 - DNA, 38 bp, Artificial Sequence
  Synthetic oligonucleotide
gttgcctcgcccgctttgttcttacgtaccctctgtga

SEQ ID NO: 114472 - DNA, 36 bp, Artificial Sequence
  Synthetic oligonucleotide
atcccgtcacacccctccagttcgccccccacgtta

SEQ ID NO: 114473 - DNA, 35 bp, Artificial Sequence
  Synthetic oligonucleotide
gatgggggaggggcggtggtggatggatgccatcc

SEQ ID NO: 114474 - DNA, 37 bp, Artificial Sequence
  Synthetic oligonucleotide
tgcacctcacacattgctaattagcgcccctgttcga

SEQ ID NO: 114475 - DNA, 38 bp, Artificial Sequence
  Synthetic oligonucleotide
tcagccgcctagaccctattcgctcccgtgcctcctga

SEQ ID NO: 114476 - DNA, 35 bp, Artificial Sequence
  Synthetic oligonucleotide
acacccccgccccccgagtgtcctcaacttaccac

SEQ ID NO: 114477 - DNA, 35 bp, Artificial Sequence
  Synthetic oligonucleotide
acttaacgccctgtccccttccgccctgctaggcc

SEQ ID NO: 114478 - DNA, 35 bp, Artificial Sequence
  Synthetic oligonucleotide
tcaccgcggccacacatcagcgcctcctgcagtcc

SEQ ID NO: 114479 - DNA, 35 bp, Artificial Sequence
  Synthetic oligonucleotide
gttgccccattccgaattttgcaccactttactgc

SEQ ID NO: 114480 - DNA, 35 bp, Artificial Sequence
  Synthetic oligonucleotide
ggtggggagtagcggaaagggaagggtcgtcacgg

SEQ ID NO: 114481 - DNA, 34 bp, Artificial Sequence
  Synthetic oligonucleotide
acatccccctcggtacacagaatcacacatggtt

SEQ ID NO: 114482 - DNA, 37 bp, Artificial Sequence
  Synthetic oligonucleotide
atggggagaaggggggaggctcggaaacaggagggga

SEQ ID NO: 114483 - DNA, 36 bp, Artificial Sequence
  Synthetic oligonucleotide
gctgcgatgcgcctgcccttcgtatcactacctcta

SEQ ID NO: 114484 - DNA, 35 bp, Artificial Sequence
  Synthetic oligonucleotide
accacctccccgcttgggataccactcacttcaca

SEQ ID NO: 114485 - DNA, 35 bp, Artificial Sequence
  Synthetic oligonucleotide
gaggtgggatgggaagctagaggaatggggagggt

SEQ ID NO: 114486 - DNA, 35 bp, Artificial Sequence
  Synthetic oligonucleotide
atcccacctgccaccgaggggcgccccaagacctc

SEQ ID NO: 114487 - DNA, 35 bp, Artificial Sequence
  Synthetic oligonucleotide
gtcgccccccttgtgcactctccccggtatttttt

SEQ ID NO: 114488 - DNA, 37 bp, Artificial Sequence
  Synthetic oligonucleotide
aacgacgggggggggcaaaggcggtgagaggagtaga

SEQ ID NO: 114489 - DNA, 36 bp, Artificial Sequence
  Synthetic oligonucleotide
tccaaccgcctcgcccatctaaccttacagtgccta

SEQ ID NO: 114490 - DNA, 35 bp, Artificial Sequence
  Synthetic oligonucleotide
atctcccaacgccctgaaccgcgcccaattatgcc

SEQ ID NO: 114491 - DNA, 35 bp, Artificial Sequence
  Synthetic oligonucleotide
tcccatcaccgacctgccgcccgtattggctccat

SEQ ID NO: 114492 - DNA, 35 bp, Artificial Sequence
  Synthetic oligonucleotide
tcctgcgcatctgttcgctctcctgccacttgcta

SEQ ID NO: 114493 - DNA, 35 bp, Artificial Sequence
  Synthetic oligonucleotide
gtggacgccgctcgatccacggtccctcttactta

SEQ ID NO: 114494 - DNA, 35 bp, Artificial Sequence
  Synthetic oligonucleotide
actgactccccccgttagccgcccttccacagccg

SEQ ID NO: 114495 - DNA, 35 bp, Artificial Sequence
  Synthetic oligonucleotide
actgccgtctcctggatgccgttgctgccccccct

SEQ ID NO: 114496 - DNA, 35 bp, Artificial Sequence
  Synthetic oligonucleotide
gtgcattgcagagctgactcatcctccgccatcct

SEQ ID NO: 114497 - DNA, 35 bp, Artificial Sequence
  Synthetic oligonucleotide
gacccaacgtatcgagctgtctccatccatccttt

SEQ ID NO: 114498 - DNA, 36 bp, Artificial Sequence
  Synthetic oligonucleotide
gtgactacgggaaaggggcgagggagaatcggggta

SEQ ID NO: 114499 - DNA, 35 bp, Artificial Sequence
  Synthetic oligonucleotide
tacggacacctcccccgccgcaaccaggtaacctc

SEQ ID NO: 114500 - DNA, 35 bp, Artificial Sequence
  Synthetic oligonucleotide
gcccacaccctgctctaagctttggtttccaaacc

SEQ ID NO: 114501 - DNA, 35 bp, Artificial Sequence
  Synthetic oligonucleotide
gacgccaccagcgtgtgattccatcgggccctcct

SEQ ID NO: 114502 - DNA, 35 bp, Artificial Sequence
  Synthetic oligonucleotide
tcccctgtcgagctgtctattccgcggctacctct

SEQ ID NO: 114503 - DNA, 34 bp, Artificial Sequence
  Synthetic oligonucleotide
gtggatgttcggggaaggttaggtggaggggaga

SEQ ID NO: 114504 - DNA, 38 bp, Artificial Sequence
  Synthetic oligonucleotide
tccacccgctccttctcactaagtgtcaccgcttttga

SEQ ID NO: 114505 - DNA, 35 bp, Artificial Sequence
  Synthetic oligonucleotide
gatttccacccacacgttcctgcgaggcttcgcta

SEQ ID NO: 114506 - DNA, 35 bp, Artificial Sequence
  Synthetic oligonucleotide
atcctcactcccttgctttgtcgtttgcaccgcca

SEQ ID NO: 114507 - DNA, 35 bp, Artificial Sequence
  Synthetic oligonucleotide
atggtggtgccccctgttgtcgccgttcttgctct

SEQ ID NO: 114508 - DNA, 35 bp, Artificial Sequence
  Synthetic oligonucleotide
atcgccatctgccgactcttcatttagttacttct

SEQ ID NO: 114509 - DNA, 37 bp, Artificial Sequence
  Synthetic oligonucleotide
aaatggggggcggacggcgacgggggaacggtcagga

SEQ ID NO: 114510 - DNA, 38 bp, Artificial Sequence
  Synthetic oligonucleotide
taagccacgcactcatctgtcatccgaccgagccctga

SEQ ID NO: 114511 - DNA, 37 bp, Artificial Sequence
  Synthetic oligonucleotide
ttggtacgagggtgggcaagggggtagaagggagtga

SEQ ID NO: 114512 - DNA, 37 bp, Artificial Sequence
  Synthetic oligonucleotide
gagaccgggggtaggaaggagggagggggatgtgaga

SEQ ID NO: 114513 - DNA, 35 bp, Artificial Sequence
  Synthetic oligonucleotide
taactcgcctcggtgctcaccctaaccgctgcccc

SEQ ID NO: 114514 - DNA, 34 bp, Artificial Sequence
  Synthetic oligonucleotide
tgatccaccctgataaacgcctctccgctccctg

SEQ ID NO: 114515 - DNA, 36 bp, Artificial Sequence
  Synthetic oligonucleotide
tgcaagacggctgggtggagggggagggcgcgttca

SEQ ID NO: 114516 - DNA, 35 bp, Artificial Sequence
  Synthetic oligonucleotide
gtctgccccgccctgctataacacctaagctccga

SEQ ID NO: 114517 - DNA, 35 bp, Artificial Sequence
  Synthetic oligonucleotide
tgtccgatcgctgcctacactttgcccctgcctta

SEQ ID NO: 114518 - DNA, 35 bp, Artificial Sequence
  Synthetic oligonucleotide
atcaacactcgcctccgtggtccgtagggaccgcc

SEQ ID NO: 114519 - DNA, 35 bp, Artificial Sequence
  Synthetic oligonucleotide
tacccccgccggtttactttcacacatctcgattg

SEQ ID NO: 114520 - DNA, 35 bp, Artificial Sequence
  Synthetic oligonucleotide
gcgagggtgggggacaaggagagggcgattcgcgt

SEQ ID NO: 114521 - DNA, 37 bp, Artificial Sequence
  Synthetic oligonucleotide
atgccctcttcacatgccgaaccctcacctcccagga

SEQ ID NO: 114522 - DNA, 35 bp, Artificial Sequence
  Synthetic oligonucleotide
aagccgtgcctatagttttgatcctcttgcccgcc

SEQ ID NO: 114523 - DNA, 35 bp, Artificial Sequence
  Synthetic oligonucleotide
accaggtcacccgctatgctgcctcctgtaccctg

SEQ ID NO: 114524 - DNA, 35 bp, Artificial Sequence
  Synthetic oligonucleotide
atcccgaggtgtcccgtctcccgtcccttcccgtg

SEQ ID NO: 114525 - DNA, 35 bp, Artificial Sequence
  Synthetic oligonucleotide
accgggaccccgcccttgcctgactctggtacacc

SEQ ID NO: 114526 - DNA, 35 bp, Artificial Sequence
  Synthetic oligonucleotide
tcacatcgggacgtcctgcgcctggtcccctaccc

SEQ ID NO: 114527 - DNA, 37 bp, Artificial Sequence
  Synthetic oligonucleotide
gagtggaataacgggaagggaagggtgggtagaggga

SEQ ID NO: 114528 - DNA, 38 bp, Artificial Sequence
  Synthetic oligonucleotide
tcctccaccgcaagagctcatgctccactcccctttga

SEQ ID NO: 114529 - DNA, 35 bp, Artificial Sequence
  Synthetic oligonucleotide
ttgtcctccatccgctgattcttggcttgcattgc

SEQ ID NO: 114530 - DNA, 35 bp, Artificial Sequence
  Synthetic oligonucleotide
gttccccatccggtgtcgcccgacctaccttcttc

SEQ ID NO: 114531 - DNA, 35 bp, Artificial Sequence
  Synthetic oligonucleotide
agccacctccggcctatcactgagtctttccacac

SEQ ID NO: 114532 - DNA, 35 bp, Artificial Sequence
  Synthetic oligonucleotide
aacgacgggtggtagaggaacgggatggcatgatg

SEQ ID NO: 114533 - DNA, 36 bp, Artificial Sequence
  Synthetic oligonucleotide
gtcgcctactatgtttccctgccgccgtggtacgca

SEQ ID NO: 114534 - DNA, 35 bp, Artificial Sequence
  Synthetic oligonucleotide
ggtcactcccgtggctacagtccccaccatcctgc

SEQ ID NO: 114535 - DNA, 36 bp, Artificial Sequence
  Synthetic oligonucleotide
gaaccgtctcagcgccccgtccgcccacgtgtccaa

SEQ ID NO: 114536 - DNA, 36 bp, Artificial Sequence
  Synthetic oligonucleotide
acatgacagggcaagggggggaacacgggtgggtca

SEQ ID NO: 114537 - DNA, 35 bp, Artificial Sequence
  Synthetic oligonucleotide
tcacaatgctgggctttgtcctccgttcctgcccc

SEQ ID NO: 114538 - DNA, 35 bp, Artificial Sequence
  Synthetic oligonucleotide
tcatccgtggtctcatgtcctgtctcccttattgt

SEQ ID NO: 114539 - DNA, 37 bp, Artificial Sequence
  Synthetic oligonucleotide
attggcgggtgaaacaggggcggaggtaagggaggga

SEQ ID NO: 114540 - DNA, 35 bp, Artificial Sequence
  Synthetic oligonucleotide
atctcccgccattcctgcctccagaaaccagctcg

SEQ ID NO: 114541 - DNA, 35 bp, Artificial Sequence
  Synthetic oligonucleotide
gtggtccacattcgctactagacgccttccatcgc

SEQ ID NO: 114542 - DNA, 35 bp, Artificial Sequence
  Synthetic oligonucleotide
agtgtatgggcggaggagggcggagcagggaaggc

SEQ ID NO: 114543 - DNA, 35 bp, Artificial Sequence
  Synthetic oligonucleotide
acgcgagtgccccgcccctcaccgatcactgtttt

SEQ ID NO: 114544 - DNA, 36 bp, Artificial Sequence
  Synthetic oligonucleotide
ggggcgggagattgggggatggggtaccaacttgca

SEQ ID NO: 114545 - DNA, 37 bp, Artificial Sequence
  Synthetic oligonucleotide
gcccactcgccatcctggtttcacgggcctcccgtga

SEQ ID NO: 114546 - DNA, 37 bp, Artificial Sequence
  Synthetic oligonucleotide
gacaattccgcctcgcatcgtgctccctccatcttga

SEQ ID NO: 114547 - DNA, 35 bp, Artificial Sequence
  Synthetic oligonucleotide
tcccagccggttcgttcttaagccccactcaatcc

SEQ ID NO: 114548 - DNA, 34 bp, Artificial Sequence
  Synthetic oligonucleotide
tgcgagacgtcctcggcctctcactgtacgccct

SEQ ID NO: 114549 - DNA, 35 bp, Artificial Sequence
  Synthetic oligonucleotide
taacaccgccctcctgtccaggtgcattctttgca

SEQ ID NO: 114550 - DNA, 37 bp, Artificial Sequence
  Synthetic oligonucleotide
tagtgatccctgttctgttttgcccgcctctacccga

SEQ ID NO: 114551 - DNA, 35 bp, Artificial Sequence
  Synthetic oligonucleotide
tccgtcaactgcccatccccgctctacttctggcc

SEQ ID NO: 114552 - DNA, 36 bp, Artificial Sequence
  Synthetic oligonucleotide
actaacagccccgatcgctaccgttctgcccttcta

SEQ ID NO: 114553 - DNA, 35 bp, Artificial Sequence
  Synthetic oligonucleotide
agccccaccccggaattcgcttacctactgctccc

SEQ ID NO: 114554 - DNA, 35 bp, Artificial Sequence
  Synthetic oligonucleotide
acacctctcgtacgttctggttatggcttaccttc

SEQ ID NO: 114555 - DNA, 35 bp, Artificial Sequence
  Synthetic oligonucleotide
tgttgcacctcattcttgtttcttcgcttcctggg

SEQ ID NO: 114556 - DNA, 35 bp, Artificial Sequence
  Synthetic oligonucleotide
gattgctagcccccgaattacctcaccgtcgcgat

SEQ ID NO: 114557 - DNA, 37 bp, Artificial Sequence
  Synthetic oligonucleotide
gggggggaggaggagaataggacgaaggggtactgga

SEQ ID NO: 114558 - DNA, 35 bp, Artificial Sequence
  Synthetic oligonucleotide
gacacggtaccgcgcccatcgcttcctccttgccg

SEQ ID NO: 114559 - DNA, 35 bp, Artificial Sequence
  Synthetic oligonucleotide
tcactgccctagtatccggcccccatcgccccgtg

SEQ ID NO: 114560 - DNA, 35 bp, Artificial Sequence
  Synthetic oligonucleotide
gacgtgagacagaggataagaaggcgggggtggat

SEQ ID NO: 114561 - DNA, 35 bp, Artificial Sequence
  Synthetic oligonucleotide
tgcacatcctcgattttctgccgcttacctgctac

SEQ ID NO: 114562 - DNA, 35 bp, Artificial Sequence
  Synthetic oligonucleotide
gcgaggcacagtttctatgcgttctatcacctcca

SEQ ID NO: 114563 - DNA, 37 bp, Artificial Sequence
  Synthetic oligonucleotide
gatcgcggcataggggagggaggggtacgggggtcga

SEQ ID NO: 114564 - DNA, 37 bp, Artificial Sequence
  Synthetic oligonucleotide
ttcgccttaccacctgcacctacccgacagtcattga

SEQ ID NO: 114565 - DNA, 35 bp, Artificial Sequence
  Synthetic oligonucleotide
acgctgcacccattgcgctcatcgaatcttccgcc

SEQ ID NO: 114566 - DNA, 38 bp, Artificial Sequence
  Synthetic oligonucleotide
tccgttgtcgcaccatctgtcttctcgggtacctttgc

SEQ ID NO: 114567 - DNA, 33 bp, Artificial Sequence
  Synthetic oligonucleotide
acttgtcacctcccaccgccgcttcatcgcaat

SEQ ID NO: 114568 - DNA, 36 bp, Artificial Sequence
  Synthetic oligonucleotide
agatgtgcagggtggaaaggaacgagaggggtggaa

SEQ ID NO: 114569 - DNA, 35 bp, Artificial Sequence
  Synthetic oligonucleotide
gtggagtccttccgctgttgccctacactcatctc

SEQ ID NO: 114570 - DNA, 35 bp, Artificial Sequence
  Synthetic oligonucleotide
tgttcaccacctctccatagccggcccaccttgct

SEQ ID NO: 114571 - DNA, 35 bp, Artificial Sequence
  Synthetic oligonucleotide
gctgcccatccctagtcacgcgagctgccctttct

SEQ ID NO: 114572 - DNA, 35 bp, Artificial Sequence
  Synthetic oligonucleotide
ttgagtagtgcgtccgtctccccccttgcccggtt

SEQ ID NO: 114573 - DNA, 35 bp, Artificial Sequence
  Synthetic oligonucleotide
gccgtacagcccccctccctgctaagctcacggaa

SEQ ID NO: 114574 - DNA, 37 bp, Artificial Sequence
  Synthetic oligonucleotide
gggagtgggggcacacggggaggggcaaaatcaaaga

SEQ ID NO: 114575 - DNA, 37 bp, Artificial Sequence
  Synthetic oligonucleotide
gccccctccacctcgtaatgcccagcctcgctgtaga

SEQ ID NO: 114576 - DNA, 38 bp, Artificial Sequence
  Synthetic oligonucleotide
tgtctccccgtcatccttcctgccctgttcctctgtga

SEQ ID NO: 114577 - DNA, 35 bp, Artificial Sequence
  Synthetic oligonucleotide
gtcacatcagcggcctgctccaccgatttccagct

SEQ ID NO: 114578 - DNA, 37 bp, Artificial Sequence
  Synthetic oligonucleotide
tgcaccccgcctctttcctatacagacctcagtccga

SEQ ID NO: 114579 - DNA, 37 bp, Artificial Sequence
  Synthetic oligonucleotide
gaaggggagtgggggaagggaaggtagtgagtcgtga

SEQ ID NO: 114580 - DNA, 35 bp, Artificial Sequence
  Synthetic oligonucleotide
gtgtgtgcctcagcccccctccaccttccttgctc

SEQ ID NO: 114581 - DNA, 35 bp, Artificial Sequence
  Synthetic oligonucleotide
gccttcatccgcccgcctggctgactcaccgccct

SEQ ID NO: 114582 - DNA, 35 bp, Artificial Sequence
  Synthetic oligonucleotide
gtacttcccacgcagccctcctttgccctcggctt

SEQ ID NO: 114583 - DNA, 37 bp, Artificial Sequence
  Synthetic oligonucleotide
gctacgggagggacggggaatacgtagagggagggga

SEQ ID NO: 114584 - DNA, 36 bp, Artificial Sequence
  Synthetic oligonucleotide
actgggggggaagggatgggatgaggttttggtgga

SEQ ID NO: 114585 - DNA, 35 bp, Artificial Sequence
  Synthetic oligonucleotide
gcgaaactgtacctgctctatcgactccgtggccc

SEQ ID NO: 114586 - DNA, 36 bp, Artificial Sequence
  Synthetic oligonucleotide
tccgacggtgtctagacccgccgctgtttccaccca

SEQ ID NO: 114587 - DNA, 36 bp, Artificial Sequence
  Synthetic oligonucleotide
agcaccccctctgcacggcgttcgcttctccgccca

SEQ ID NO: 114588 - DNA, 37 bp, Artificial Sequence
  Synthetic oligonucleotide
tgcacattcaaagccaacattatgcctctctcctgga

SEQ ID NO: 114589 - DNA, 35 bp, Artificial Sequence
  Synthetic oligonucleotide
gcccgtagaggcatcccttccgccacttgcactgc

SEQ ID NO: 114590 - DNA, 35 bp, Artificial Sequence
  Synthetic oligonucleotide
ggaggggaggaaagaggcaatgggaaacaggccag

SEQ ID NO: 114591 - DNA, 36 bp, Artificial Sequence
  Synthetic oligonucleotide
gccacccgccgttctctctctcctcaccgcaagaca

SEQ ID NO: 114592 - DNA, 36 bp, Artificial Sequence
  Synthetic oligonucleotide
attgctcccttttgcctcgtatttgtgtcgcatcca

SEQ ID NO: 114593 - DNA, 36 bp, Artificial Sequence
  Synthetic oligonucleotide
atcgtcccaccatcactcactgtctttttgccgcca

SEQ ID NO: 114594 - DNA, 35 bp, Artificial Sequence
  Synthetic oligonucleotide
aatacccgccgcccccccaccgtgacccagccata

SEQ ID NO: 114595 - DNA, 35 bp, Artificial Sequence
  Synthetic oligonucleotide
acgtacgcatgtgcgcactgctccgggccttccct

SEQ ID NO: 114596 - DNA, 36 bp, Artificial Sequence
  Synthetic oligonucleotide
gccactcccgccccagacctttgtcgactgtctaca

SEQ ID NO: 114597 - DNA, 36 bp, Artificial Sequence
  Synthetic oligonucleotide
cacctccgtcctgtatggtctgttactcccaccgca

SEQ ID NO: 114598 - DNA, 37 bp, Artificial Sequence
  Synthetic oligonucleotide
ggatgggaagaggaggatggcgaggagaggggtagga

SEQ ID NO: 114599 - DNA, 26 bp, Artificial Sequence
  Synthetic oligonucleotide
gacgccgccccctatccccggccacc

SEQ ID NO: 114600 - DNA, 35 bp, Artificial Sequence
  Synthetic oligonucleotide
gaccacctctgcaatcccgccgcatctcatgggct

SEQ ID NO: 114601 - DNA, 35 bp, Artificial Sequence
  Synthetic oligonucleotide
gtaacaggcccactgtgcccttatggtccacctct

SEQ ID NO: 114602 - DNA, 35 bp, Artificial Sequence
  Synthetic oligonucleotide
gccatcctgtccatcactgtcaccttgaaacgtac

SEQ ID NO: 114603 - DNA, 35 bp, Artificial Sequence
  Synthetic oligonucleotide
attgcacgtgctacattagttcttatcgctccacc

SEQ ID NO: 114604 - DNA, 35 bp, Artificial Sequence
  Synthetic oligonucleotide
ttgggcccgctgcttgcttctgagcaccatccccc

SEQ ID NO: 114605 - DNA, 37 bp, Artificial Sequence
  Synthetic oligonucleotide
tgcgctatcctgttgccttccaagtgcccccctgtgc

SEQ ID NO: 114606 - DNA, 35 bp, Artificial Sequence
  Synthetic oligonucleotide
tgactataaccgccgtttcgtggcccccccgtgcc

SEQ ID NO: 114607 - DNA, 35 bp, Artificial Sequence
  Synthetic oligonucleotide
aaagggttcggggggagggtggtaagggaggggtg

SEQ ID NO: 114608 - DNA, 35 bp, Artificial Sequence
  Synthetic oligonucleotide
gtccttgtccgtccccccactcccccctgttgttg

SEQ ID NO: 114609 - DNA, 35 bp, Artificial Sequence
  Synthetic oligonucleotide
tcagccgccactcccaccctcccatatacagtgtt

SEQ ID NO: 114610 - DNA, 35 bp, Artificial Sequence
  Synthetic oligonucleotide
acactccgtgcattcatgtcctatccatccatcaa

SEQ ID NO: 114611 - DNA, 36 bp, Artificial Sequence
  Synthetic oligonucleotide
taagggcgtagagagggggggtacggggtaggggca

SEQ ID NO: 114612 - DNA, 37 bp, Artificial Sequence
  Synthetic oligonucleotide
tcgaggggagggtgggaaggctgcagggcgcgaaaga

SEQ ID NO: 114613 - DNA, 35 bp, Artificial Sequence
  Synthetic oligonucleotide
gttcccgtccggtcctccgatactcggttctctcc

SEQ ID NO: 114614 - DNA, 35 bp, Artificial Sequence
  Synthetic oligonucleotide
gtcacgtacctcgttatcacctccgttaccctgtc

SEQ ID NO: 114615 - DNA, 35 bp, Artificial Sequence
  Synthetic oligonucleotide
tccgccccttaaagtacactctctgttccaccctg

SEQ ID NO: 114616 - DNA, 35 bp, Artificial Sequence
  Synthetic oligonucleotide
gtggccacctcccgccatgcgcgacacacacacaa

SEQ ID NO: 114617 - DNA, 35 bp, Artificial Sequence
  Synthetic oligonucleotide
gccactcatccgcctctgccttaggcacgtgaacc

SEQ ID NO: 114618 - DNA, 35 bp, Artificial Sequence
  Synthetic oligonucleotide
tcgccctgcttggggtttatctgccttcatccctc

SEQ ID NO: 114619 - DNA, 36 bp, Artificial Sequence
  Synthetic oligonucleotide
gactgggtgggtgtcgggtgggatgaagggttcaga

SEQ ID NO: 114620 - DNA, 35 bp, Artificial Sequence
  Synthetic oligonucleotide
aaccgatcaccgccaccaacacgatacggtccctc

SEQ ID NO: 114621 - DNA, 35 bp, Artificial Sequence
  Synthetic oligonucleotide
tttgcacacatgtgcacactcttagcccctttccg

SEQ ID NO: 114622 - DNA, 32 bp, Artificial Sequence
  Synthetic oligonucleotide
gatgtccgctttcgttctgtgcgcccaccctg

SEQ ID NO: 114623 - DNA, 35 bp, Artificial Sequence
  Synthetic oligonucleotide
acgcgtagatccgtcctgtcttcttccttagctct

SEQ ID NO: 114624 - DNA, 37 bp, Artificial Sequence
  Synthetic oligonucleotide
tagtcaccccgcacatctgtttcgctactcggtccga

SEQ ID NO: 114625 - DNA, 36 bp, Artificial Sequence
  Synthetic oligonucleotide
attaagggcggggcaatacaacatgggaggggagta

SEQ ID NO: 114626 - DNA, 35 bp, Artificial Sequence
  Synthetic oligonucleotide
gccatctcgagctgatttgatccctgctgtacctc

SEQ ID NO: 114627 - DNA, 35 bp, Artificial Sequence
  Synthetic oligonucleotide
gacgcacatttcgccctatttccgctgctaacgcc

SEQ ID NO: 114628 - DNA, 35 bp, Artificial Sequence
  Synthetic oligonucleotide
agttgcctcatacaccgctgcccgttttccatgcc

SEQ ID NO: 114629 - DNA, 35 bp, Artificial Sequence
  Synthetic oligonucleotide
tgaccacctctgtccttattctccaaaccggctcc

SEQ ID NO: 114630 - DNA, 35 bp, Artificial Sequence
  Synthetic oligonucleotide
gaggccgtagcatgcgtgcccttcctacccttcct

SEQ ID NO: 114631 - DNA, 37 bp, Artificial Sequence
  Synthetic oligonucleotide
taggagggagggagggggttcggggtctggacctaga

SEQ ID NO: 114632 - DNA, 36 bp, Artificial Sequence
  Synthetic oligonucleotide
gccaccacccacttctcctgacctcgcttcctgtga

SEQ ID NO: 114633 - DNA, 35 bp, Artificial Sequence
  Synthetic oligonucleotide
accgccaccttccacagctcttactcttgacgcct

SEQ ID NO: 114634 - DNA, 36 bp, Artificial Sequence
  Synthetic oligonucleotide
atgcggggcgggagggaggacgtagcgtagggtgaa

SEQ ID NO: 114635 - DNA, 35 bp, Artificial Sequence
  Synthetic oligonucleotide
tactagccgacggacgaccacccgccactgctcca

SEQ ID NO: 114636 - DNA, 37 bp, Artificial Sequence
  Synthetic oligonucleotide
gccccacacctgcactacatgtccgtttcgctacgga

SEQ ID NO: 114637 - DNA, 35 bp, Artificial Sequence
  Synthetic oligonucleotide
ggggtccgccattcgtctcgttactgctaccaatc

SEQ ID NO: 114638 - DNA, 35 bp, Artificial Sequence
  Synthetic oligonucleotide
tgtaacccagcccatttattcgctttacgtacctc

SEQ ID NO: 114639 - DNA, 35 bp, Artificial Sequence
  Synthetic oligonucleotide
gcacctgcctatagttccattgaccatcgcccccg

SEQ ID NO: 114640 - DNA, 35 bp, Artificial Sequence
  Synthetic oligonucleotide
atctgcctccgcccgcaccagttcacttcccactt

SEQ ID NO: 114641 - DNA, 37 bp, Artificial Sequence
  Synthetic oligonucleotide
tgttcacctcacctgcctgtgttcacgctatctccga

SEQ ID NO: 114642 - DNA, 37 bp, Artificial Sequence
  Synthetic oligonucleotide
agcacccctccactgctatttacccggttcacatgga

SEQ ID NO: 114643 - DNA, 35 bp, Artificial Sequence
  Synthetic oligonucleotide
ccaagcacacgcccgttgtcctgctgtctccgctc

SEQ ID NO: 114644 - DNA, 34 bp, Artificial Sequence
  Synthetic oligonucleotide
gacacgccgcactcctcgtcccctgccataaact

SEQ ID NO: 114645 - DNA, 37 bp, Artificial Sequence
  Synthetic oligonucleotide
ggacagccgccgcgttcgtcctcctggttccgttcta

SEQ ID NO: 114646 - DNA, 32 bp, Artificial Sequence
  Synthetic oligonucleotide
agccacatccggcgtaagtccacctactatcc

SEQ ID NO: 114647 - DNA, 35 bp, Artificial Sequence
  Synthetic oligonucleotide
tgcctgctaccattgtgccaccatcttgttcccgc

SEQ ID NO: 114648 - DNA, 36 bp, Artificial Sequence
  Synthetic oligonucleotide
gagactgcgaatggagggggataggcaatggggcaa

SEQ ID NO: 114649 - DNA, 35 bp, Artificial Sequence
  Synthetic oligonucleotide
gatgagccgcctaccacgttcctcattagccatcc

SEQ ID NO: 114650 - DNA, 35 bp, Artificial Sequence
  Synthetic oligonucleotide
gcccaccccattcttaattaggcagacctccccca

SEQ ID NO: 114651 - DNA, 36 bp, Artificial Sequence
  Synthetic oligonucleotide
tctgtcccgcagtgccaatgcccgtccgtcgtccca

SEQ ID NO: 114652 - DNA, 37 bp, Artificial Sequence
  Synthetic oligonucleotide
gacgacacagaatgaggagcgggcgggggagggcaga

SEQ ID NO: 114653 - DNA, 38 bp, Artificial Sequence
  Synthetic oligonucleotide
tcgaactcccgctgtaatctgtctttgcccacccctga

SEQ ID NO: 114654 - DNA, 35 bp, Artificial Sequence
  Synthetic oligonucleotide
agtcactccgcccaccatgtatctctctcatatcc

SEQ ID NO: 114655 - DNA, 35 bp, Artificial Sequence
  Synthetic oligonucleotide
ggggccatcgtcaagtcgttttatccccccgttcc

SEQ ID NO: 114656 - DNA, 35 bp, Artificial Sequence
  Synthetic oligonucleotide
tgtgcctcatcccagggctctatgacgttccctct

SEQ ID NO: 114657 - DNA, 36 bp, Artificial Sequence
  Synthetic oligonucleotide
gcccacccgctcagtggtcctgcacctccctatgaa

SEQ ID NO: 114658 - DNA, 37 bp, Artificial Sequence
  Synthetic oligonucleotide
ggtgagggaacggtgcgaaggggggcggcattaaaga

SEQ ID NO: 114659 - DNA, 36 bp, Artificial Sequence
  Synthetic oligonucleotide
gaagtgggtagcagggaggaggaggcgaattgagga

SEQ ID NO: 114660 - DNA, 38 bp, Artificial Sequence
  Synthetic oligonucleotide
tttggcgtagcggggggggaggaggtggtccccattga

SEQ ID NO: 114661 - DNA, 37 bp, Artificial Sequence
  Synthetic oligonucleotide
gacgccgtgatggcctaccgttccttgctccctttga

SEQ ID NO: 114662 - DNA, 35 bp, Artificial Sequence
  Synthetic oligonucleotide
aacctgcgcccgggtaccaatcctgcctcaccttc

SEQ ID NO: 114663 - DNA, 35 bp, Artificial Sequence
  Synthetic oligonucleotide
atcctcgcccggtcctcaatttcatccctcatggt

SEQ ID NO: 114664 - DNA, 36 bp, Artificial Sequence
  Synthetic oligonucleotide
acccctgccacaccgcatcctcggcctgttatcaca

SEQ ID NO: 114665 - DNA, 35 bp, Artificial Sequence
  Synthetic oligonucleotide
gatcaccatcgatggaatgccatccctatccaccc

SEQ ID NO: 114666 - DNA, 35 bp, Artificial Sequence
  Synthetic oligonucleotide
tagcacctagtgcttctcctcttgcctcctgccgc

SEQ ID NO: 114667 - DNA, 35 bp, Artificial Sequence
  Synthetic oligonucleotide
gttcacccactcgaccgttattaccgtttctctca

SEQ ID NO: 114668 - DNA, 37 bp, Artificial Sequence
  Synthetic oligonucleotide
gtcacctgcacatctcccctacgccctttactcggga

SEQ ID NO: 114669 - DNA, 35 bp, Artificial Sequence
  Synthetic oligonucleotide
cgagacacccccgtaatttatgtagggaccccgcc

SEQ ID NO: 114670 - DNA, 35 bp, Artificial Sequence
  Synthetic oligonucleotide
atagccgccagattagtcttacacccgtcccccgc

SEQ ID NO: 114671 - DNA, 35 bp, Artificial Sequence
  Synthetic oligonucleotide
tacgtcccacccgtctatcctgcaactcaccttaa

SEQ ID NO: 114672 - DNA, 35 bp, Artificial Sequence
  Synthetic oligonucleotide
taacacgccacctacatctccgcccttccttcagt

SEQ ID NO: 114673 - DNA, 35 bp, Artificial Sequence
  Synthetic oligonucleotide
tccctactccgtttgtgcctggtctttttcgttca

SEQ ID NO: 114674 - DNA, 35 bp, Artificial Sequence
  Synthetic oligonucleotide
atcggggcagtagtaggggagggggcggggatgta

SEQ ID NO: 114675 - DNA, 35 bp, Artificial Sequence
  Synthetic oligonucleotide
tacgactctctcggatcctatactcacccgcaccc

SEQ ID NO: 114676 - DNA, 35 bp, Artificial Sequence
  Synthetic oligonucleotide
tccgttgcccaatagtccgtagctcgaccttccgc

SEQ ID NO: 114677 - DNA, 38 bp, Artificial Sequence
  Synthetic oligonucleotide
agacatggggaagggcagggaaacggggacgtggctga

SEQ ID NO: 114678 - DNA, 35 bp, Artificial Sequence
  Synthetic oligonucleotide
acccgtcattcccatccgttgcttcgcctccctgc

SEQ ID NO: 114679 - DNA, 35 bp, Artificial Sequence
  Synthetic oligonucleotide
gggagatcgtccgccctgcatgtcgcccgctcatc

SEQ ID NO: 114680 - DNA, 36 bp, Artificial Sequence
  Synthetic oligonucleotide
gtcatggccaggtgtgcccccacttacaccacgcca

SEQ ID NO: 114681 - DNA, 37 bp, Artificial Sequence
  Synthetic oligonucleotide
accccgttggcccctccgctgcttatacctcgtacga

SEQ ID NO: 114682 - DNA, 35 bp, Artificial Sequence
  Synthetic oligonucleotide
ttgtcctacactgatgtcccgccgattccccccga

SEQ ID NO: 114683 - DNA, 38 bp, Artificial Sequence
  Synthetic oligonucleotide
gggagggagggtgccgggaggatcgggaactgaaatga

SEQ ID NO: 114684 - DNA, 35 bp, Artificial Sequence
  Synthetic oligonucleotide
gcagggtggggtgacggttgggtgttgggacaacc

SEQ ID NO: 114685 - DNA, 35 bp, Artificial Sequence
  Synthetic oligonucleotide
tcctcccgctcggacgccctccaccctgattaacc

SEQ ID NO: 114686 - DNA, 35 bp, Artificial Sequence
  Synthetic oligonucleotide
tgttactctgtctgtactcgaccctgccacccacc

SEQ ID NO: 114687 - DNA, 28 bp, Artificial Sequence
  Synthetic oligonucleotide
gacctccgtgtgactaccacgattctcc

SEQ ID NO: 114688 - DNA, 35 bp, Artificial Sequence
  Synthetic oligonucleotide
gatctcatacgcacatgccagctttcgcactgcct

SEQ ID NO: 114689 - DNA, 35 bp, Artificial Sequence
  Synthetic oligonucleotide
tctttcccgccctcatgcacctcgcctcgcgatct

SEQ ID NO: 114690 - DNA, 36 bp, Artificial Sequence
  Synthetic oligonucleotide
gacgcacgagtcccgctactgtactttttgccctta

SEQ ID NO: 114691 - DNA, 35 bp, Artificial Sequence
  Synthetic oligonucleotide
gtcgcctcccccaatgtcgccccctgtactctatc

SEQ ID NO: 114692 - DNA, 37 bp, Artificial Sequence
  Synthetic oligonucleotide
gccggggggggacggggaataccgagggccggccgga

SEQ ID NO: 114693 - DNA, 35 bp, Artificial Sequence
  Synthetic oligonucleotide
tagcacccccattcgcccgccgtcccatcgtagta

SEQ ID NO: 114694 - DNA, 35 bp, Artificial Sequence
  Synthetic oligonucleotide
gagcccgatcccctgctcgacatcccctgtcgccc

SEQ ID NO: 114695 - DNA, 35 bp, Artificial Sequence
  Synthetic oligonucleotide
gcactatcgcccgccctggtaccatcaaacgacat

SEQ ID NO: 114696 - DNA, 34 bp, Artificial Sequence
  Synthetic oligonucleotide
atacctgcaccaacatctggtcctctgcttcctt

SEQ ID NO: 114697 - DNA, 35 bp, Artificial Sequence
  Synthetic oligonucleotide
tacgtgccgaacatatctggccttgtacattttcc

SEQ ID NO: 114698 - DNA, 35 bp, Artificial Sequence
  Synthetic oligonucleotide
tccaccaactgatcatcttacagacacctgaccgc

SEQ ID NO: 114699 - DNA, 36 bp, Artificial Sequence
  Synthetic oligonucleotide
accaacggtcgcagtgtcgtagtccgcaccctccaa

SEQ ID NO: 114700 - DNA, 36 bp, Artificial Sequence
  Synthetic oligonucleotide
accgttccgcgcccttcttccctgctccacatgcga

SEQ ID NO: 114701 - DNA, 35 bp, Artificial Sequence
  Synthetic oligonucleotide
tctcactcatccagtcacacgtatgtcaatcctgc

SEQ ID NO: 114702 - DNA, 35 bp, Artificial Sequence
  Synthetic oligonucleotide
gtccatgtaccatcagtctttattgcgccttccag

SEQ ID NO: 114703 - DNA, 35 bp, Artificial Sequence
  Synthetic oligonucleotide
atgcttacccgtccctggcttgcacataccacccg

SEQ ID NO: 114704 - DNA, 35 bp, Artificial Sequence
  Synthetic oligonucleotide
agatcaccatccttgccatgtacacctcactcccg

SEQ ID NO: 114705 - DNA, 37 bp, Artificial Sequence
  Synthetic oligonucleotide
tatccccgccatctggctttgcattccacttccctga

SEQ ID NO: 114706 - DNA, 36 bp, Artificial Sequence
  Synthetic oligonucleotide
gacgcaccgtgctcgttcctgttcaccttcttttga

SEQ ID NO: 114707 - DNA, 35 bp, Artificial Sequence
  Synthetic oligonucleotide
aacctgccctcggaaacccgccactgaactgcctc

SEQ ID NO: 114708 - DNA, 35 bp, Artificial Sequence
  Synthetic oligonucleotide
gaaccgcgttgcccctgtttgttcctccgctcgtg

SEQ ID NO: 114709 - DNA, 36 bp, Artificial Sequence
  Synthetic oligonucleotide
tgctcgctcacccacgcgtcgtcacgcctctctcga

SEQ ID NO: 114710 - DNA, 37 bp, Artificial Sequence
  Synthetic oligonucleotide
tgaatggacggataggggtagggggtgcgggtgagga

SEQ ID NO: 114711 - DNA, 36 bp, Artificial Sequence
  Synthetic oligonucleotide
atcaaccgccccaatgacctattgatctgtaccgta

SEQ ID NO: 114712 - DNA, 36 bp, Artificial Sequence
  Synthetic oligonucleotide
gagtccaccgcccaatcatagcagccatcgcctaca

SEQ ID NO: 114713 - DNA, 35 bp, Artificial Sequence
  Synthetic oligonucleotide
aacccccgctacacccgtatcatcacgaacagtcc

SEQ ID NO: 114714 - DNA, 35 bp, Artificial Sequence
  Synthetic oligonucleotide
tgcaaccccacatcttcgttcaagcgtaactttcc

SEQ ID NO: 114715 - DNA, 35 bp, Artificial Sequence
  Synthetic oligonucleotide
tccgctgctgcccatgttcactcctctgtatcttc

SEQ ID NO: 114716 - DNA, 35 bp, Artificial Sequence
  Synthetic oligonucleotide
gcgcaaccgcgctcatctacttctaatgcacctct

SEQ ID NO: 114717 - DNA, 38 bp, Artificial Sequence
  Synthetic oligonucleotide
gcgcgggggacgggaagggtgatagggcgggaacgtga

SEQ ID NO: 114718 - DNA, 35 bp, Artificial Sequence
  Synthetic oligonucleotide
acctctgcgccgaacggccccatcatcttacgccc

SEQ ID NO: 114719 - DNA, 35 bp, Artificial Sequence
  Synthetic oligonucleotide
attgccgccatccgccctgttacctctccagtcct

SEQ ID NO: 114720 - DNA, 38 bp, Artificial Sequence
  Synthetic oligonucleotide
gccgacacttgtcgtccttcctcgcttcccttggttga

SEQ ID NO: 114721 - DNA, 36 bp, Artificial Sequence
  Synthetic oligonucleotide
taggtgcccactgtcctcgtcctattttgcttccta

SEQ ID NO: 114722 - DNA, 36 bp, Artificial Sequence
  Synthetic oligonucleotide
ttcggaccctacctcagctacctccgcctgactcag

SEQ ID NO: 114723 - DNA, 35 bp, Artificial Sequence
  Synthetic oligonucleotide
gccactcgtgcagttcgctttttttccgccccatg

SEQ ID NO: 114724 - DNA, 35 bp, Artificial Sequence
  Synthetic oligonucleotide
agatcaccgcctcgccgtactccctcactgccggt

SEQ ID NO: 114725 - DNA, 36 bp, Artificial Sequence
  Synthetic oligonucleotide
acctcaccccagtacttgctttagccctagctcaca

SEQ ID NO: 114726 - DNA, 35 bp, Artificial Sequence
  Synthetic oligonucleotide
gctgatctccgtccgtccttagtgctctcggctca

SEQ ID NO: 114727 - DNA, 38 bp, Artificial Sequence
  Synthetic oligonucleotide
atcgcgcaccactgtccctaaaagcccatccattttga

SEQ ID NO: 114728 - DNA, 35 bp, Artificial Sequence
  Synthetic oligonucleotide
ggttagccacgcagcccttccactccgtcttcgcc

SEQ ID NO: 114729 - DNA, 35 bp, Artificial Sequence
  Synthetic oligonucleotide
gcacggcgggggttgggagcaggaggagaaaaggg

SEQ ID NO: 114730 - DNA, 35 bp, Artificial Sequence
  Synthetic oligonucleotide
ttggagagtgggtgggagggttctggcaccaatgg

SEQ ID NO: 114731 - DNA, 37 bp, Artificial Sequence
  Synthetic oligonucleotide
gccaacctcccttggccgatctggactggctcccgga

SEQ ID NO: 114732 - DNA, 35 bp, Artificial Sequence
  Synthetic oligonucleotide
tacgcctatggcctctgaacgtacttttccaccca

SEQ ID NO: 114733 - DNA, 35 bp, Artificial Sequence
  Synthetic oligonucleotide
acgccgccctctcatctcctgactcccgctgccga

SEQ ID NO: 114734 - DNA, 35 bp, Artificial Sequence
  Synthetic oligonucleotide
ggtacgcccgctcctaatagccacatcgccccctc

SEQ ID NO: 114735 - DNA, 35 bp, Artificial Sequence
  Synthetic oligonucleotide
gtgtaggttcggggtggcggaggagggggaatgat

SEQ ID NO: 114736 - DNA, 35 bp, Artificial Sequence
  Synthetic oligonucleotide
tttcagccgctgtccgttcccctcacccctctgat

SEQ ID NO: 114737 - DNA, 35 bp, Artificial Sequence
  Synthetic oligonucleotide
gcgtgcacctcccgcgcctttcgttccgctttcct

SEQ ID NO: 114738 - DNA, 37 bp, Artificial Sequence
  Synthetic oligonucleotide
aagggggagcgggaggggacatgggtaatcggctgga

SEQ ID NO: 114739 - DNA, 35 bp, Artificial Sequence
  Synthetic oligonucleotide
aaccaccgtcaggctccacgtttagcccgcccccc

SEQ ID NO: 114740 - DNA, 35 bp, Artificial Sequence
  Synthetic oligonucleotide
gtcgaggcgaacagcagagaccaccacccgccccc

SEQ ID NO: 114741 - DNA, 35 bp, Artificial Sequence
  Synthetic oligonucleotide
tcctccacgacacccatgccctgagaaaccctcgc

SEQ ID NO: 114742 - DNA, 35 bp, Artificial Sequence
  Synthetic oligonucleotide
tgacgccacaccgccctctctgcttgggtttccct

SEQ ID NO: 114743 - DNA, 35 bp, Artificial Sequence
  Synthetic oligonucleotide
agatgcatgccctcccttaccctcggaccttgcct

SEQ ID NO: 114744 - DNA, 35 bp, Artificial Sequence
  Synthetic oligonucleotide
actccgaccctccgctcccggctatccaggtaaac

SEQ ID NO: 114745 - DNA, 37 bp, Artificial Sequence
  Synthetic oligonucleotide
tctccgccccaccatgctcttgttagtcaacccagga

SEQ ID NO: 114746 - DNA, 35 bp, Artificial Sequence
  Synthetic oligonucleotide
tgtgcgagaagaccagccccctactttgcccgctc

SEQ ID NO: 114747 - DNA, 38 bp, Artificial Sequence
  Synthetic oligonucleotide
gggtgggtgagggaggtgggacgggctggtggagttga

SEQ ID NO: 114748 - DNA, 35 bp, Artificial Sequence
  Synthetic oligonucleotide
gccaattcacctagcgtcattccgtcccattccac

SEQ ID NO: 114749 - DNA, 35 bp, Artificial Sequence
  Synthetic oligonucleotide
tatcgcctccctcctgttttgatacctccgggacc

SEQ ID NO: 114750 - DNA, 36 bp, Artificial Sequence
  Synthetic oligonucleotide
tagcccgaatgtgccgccccatcccctcagtctcgc

SEQ ID NO: 114751 - DNA, 35 bp, Artificial Sequence
  Synthetic oligonucleotide
gtacagccttagacacataacgtgttccacccccg

SEQ ID NO: 114752 - DNA, 35 bp, Artificial Sequence
  Synthetic oligonucleotide
ggccacctactctcctggcccccccgactcccgtg

SEQ ID NO: 114753 - DNA, 35 bp, Artificial Sequence
  Synthetic oligonucleotide
gtggcgtgccccgtacattttgcttatcgccgcct

SEQ ID NO: 114754 - DNA, 35 bp, Artificial Sequence
  Synthetic oligonucleotide
tgaatcgcccactccgccgccctggtgagaccgcc

SEQ ID NO: 114755 - DNA, 35 bp, Artificial Sequence
  Synthetic oligonucleotide
gaagtcgcacctcatctctagccaatgctcccgcc

SEQ ID NO: 114756 - DNA, 35 bp, Artificial Sequence
  Synthetic oligonucleotide
aaacagacgccaccttcgcctcgtttgctgtttct

SEQ ID NO: 114757 - DNA, 36 bp, Artificial Sequence
  Synthetic oligonucleotide
tgcaccacacctcaccctgtaaatgccgcatgtcca

SEQ ID NO: 114758 - DNA, 35 bp, Artificial Sequence
  Synthetic oligonucleotide
gatgccctgtccttcttccgtagcctttccatcgc

SEQ ID NO: 114759 - DNA, 35 bp, Artificial Sequence
  Synthetic oligonucleotide
atgccccctctcgcctgttctgttgacttgattgc

SEQ ID NO: 114760 - DNA, 35 bp, Artificial Sequence
  Synthetic oligonucleotide
tacgcgagtgacacatggttcagtcccctctcctc

SEQ ID NO: 114761 - DNA, 35 bp, Artificial Sequence
  Synthetic oligonucleotide
gcagtcagtccggtccgtcttgttttcccctcttc

SEQ ID NO: 114762 - DNA, 37 bp, Artificial Sequence
  Synthetic oligonucleotide
taacgctgcactgtcacctgcctcgcctcaccttgga

SEQ ID NO: 114763 - DNA, 35 bp, Artificial Sequence
  Synthetic oligonucleotide
ttaccatcccctcggctctgagactactgttacac

SEQ ID NO: 114764 - DNA, 35 bp, Artificial Sequence
  Synthetic oligonucleotide
tgcctgttccagtatggtccgctccacgtcttccc

SEQ ID NO: 114765 - DNA, 35 bp, Artificial Sequence
  Synthetic oligonucleotide
gaccatagcgcaatcgtctttccacctcacccatg

SEQ ID NO: 114766 - DNA, 35 bp, Artificial Sequence
  Synthetic oligonucleotide
tccacctctctgtcactatcgttgctgggctaact

SEQ ID NO: 114767 - DNA, 35 bp, Artificial Sequence
  Synthetic oligonucleotide
ggacgacacaatgatgccgcagccccttcccccct

SEQ ID NO: 114768 - DNA, 35 bp, Artificial Sequence
  Synthetic oligonucleotide
acgagtcagcctcccccctgcgtacttgaatcatt

SEQ ID NO: 114769 - DNA, 35 bp, Artificial Sequence
  Synthetic oligonucleotide
gtgccactgcgataccggtgctcttcccccccttt

SEQ ID NO: 114770 - DNA, 35 bp, Artificial Sequence
  Synthetic oligonucleotide
ttgtagcctccctccgttgcgtcgcctaatgctca

SEQ ID NO: 114771 - DNA, 36 bp, Artificial Sequence
  Synthetic oligonucleotide
gttcccagtcctccgcagattatggcctccttctca

SEQ ID NO: 114772 - DNA, 37 bp, Artificial Sequence
  Synthetic oligonucleotide
agccatccccactttgtaggtcgcactcttaccctga

SEQ ID NO: 114773 - DNA, 36 bp, Artificial Sequence
  Synthetic oligonucleotide
tgtcggcaaaagggaggggagggaagcaaaagggta

SEQ ID NO: 114774 - DNA, 36 bp, Artificial Sequence
  Synthetic oligonucleotide
ggggtgggctcatgccataatatagtgaaagaggga

SEQ ID NO: 114775 - DNA, 35 bp, Artificial Sequence
  Synthetic oligonucleotide
ggtcccaccctctgccttccttatggcaacacctt

SEQ ID NO: 114776 - DNA, 36 bp, Artificial Sequence
  Synthetic oligonucleotide
actgcttccctgcccgctctgtattttctgccttca

SEQ ID NO: 114777 - DNA, 37 bp, Artificial Sequence
  Synthetic oligonucleotide
gaggagacatgtgggggtagggcgggcgataaaagga

SEQ ID NO: 114778 - DNA, 34 bp, Artificial Sequence
  Synthetic oligonucleotide
tacgatgctgataactgccacgctctgcctcccc

SEQ ID NO: 114779 - DNA, 35 bp, Artificial Sequence
  Synthetic oligonucleotide
gtactgctgcctttcgtgataccgtgccctcgctc

SEQ ID NO: 114780 - DNA, 33 bp, Artificial Sequence
  Synthetic oligonucleotide
tgccgtatcaccgccgttctctatgacgttctc

SEQ ID NO: 114781 - DNA, 35 bp, Artificial Sequence
  Synthetic oligonucleotide
gactgttgccagttagcccggtccaccctgttctc

SEQ ID NO: 114782 - DNA, 35 bp, Artificial Sequence
  Synthetic oligonucleotide
gcgccgttagccgcctctatagtccgttaccttca

SEQ ID NO: 114783 - DNA, 35 bp, Artificial Sequence
  Synthetic oligonucleotide
ttggtacagtcccttctgctccccaggttcgctcc

SEQ ID NO: 114784 - DNA, 35 bp, Artificial Sequence
  Synthetic oligonucleotide
acatgtgcgtctgcgtttacttcatccggccttcc

SEQ ID NO: 114785 - DNA, 35 bp, Artificial Sequence
  Synthetic oligonucleotide
gcatgccacgcaaccctcgagctctcctctccagc

SEQ ID NO: 114786 - DNA, 35 bp, Artificial Sequence
  Synthetic oligonucleotide
tcccaaccagccgtcatccatcacaccgggtcctc

SEQ ID NO: 114787 - DNA, 35 bp, Artificial Sequence
  Synthetic oligonucleotide
gcgcccccccctcgcactgcgcatatctcgtaaca

SEQ ID NO: 114788 - DNA, 36 bp, Artificial Sequence
  Synthetic oligonucleotide
agaatgggagggggtggacggtgatacgggtgcaaa

SEQ ID NO: 114789 - DNA, 35 bp, Artificial Sequence
  Synthetic oligonucleotide
tccgacgtgatggagggtgggggggaggtatatta

SEQ ID NO: 114790 - DNA, 35 bp, Artificial Sequence
  Synthetic oligonucleotide
agcaaggtcctcatctgccagttgcttgttcctcc

SEQ ID NO: 114791 - DNA, 35 bp, Artificial Sequence
  Synthetic oligonucleotide
tatgttgaggggtgggagggtatactggggtttcc

SEQ ID NO: 114792 - DNA, 35 bp, Artificial Sequence
  Synthetic oligonucleotide
gacgcccacgcctacaatatacccgcctagcctct

SEQ ID NO: 114793 - DNA, 35 bp, Artificial Sequence
  Synthetic oligonucleotide
atacgccacctccccacctggtagtatgtttcttt

SEQ ID NO: 114794 - DNA, 35 bp, Artificial Sequence
  Synthetic oligonucleotide
gggtgtgggtgagggggagtggaggaacggaaaca

SEQ ID NO: 114795 - DNA, 35 bp, Artificial Sequence
  Synthetic oligonucleotide
acgcgtgcgatcgcattgcgtttcatccaccgctc

SEQ ID NO: 114796 - DNA, 35 bp, Artificial Sequence
  Synthetic oligonucleotide
gtgccacacctcccggttctttcccccgccccagg

SEQ ID NO: 114797 - DNA, 35 bp, Artificial Sequence
  Synthetic oligonucleotide
tcgtgaacgtctggtcaccggtctcctgccccctt

SEQ ID NO: 114798 - DNA, 36 bp, Artificial Sequence
  Synthetic oligonucleotide
tgtccctccgccgtattgctagcgcctgtcatctaa

SEQ ID NO: 114799 - DNA, 37 bp, Artificial Sequence
  Synthetic oligonucleotide
ttggggaagcgctatggggcgggcgaccaatggggga

SEQ ID NO: 114800 - DNA, 36 bp, Artificial Sequence
  Synthetic oligonucleotide
gtatggccggggtagggggggatggggcgcacgtga

SEQ ID NO: 114801 - DNA, 35 bp, Artificial Sequence
  Synthetic oligonucleotide
tcacttggctcagtgttaccttgcccgccacgccc

SEQ ID NO: 114802 - DNA, 35 bp, Artificial Sequence
  Synthetic oligonucleotide
attacccatcctcagtgttgacctgttcgcccctc

SEQ ID NO: 114803 - DNA, 35 bp, Artificial Sequence
  Synthetic oligonucleotide
tttgccccatgcctgtacttcactgcctcctaggt

SEQ ID NO: 114804 - DNA, 35 bp, Artificial Sequence
  Synthetic oligonucleotide
ccacgtcaccccttgaattgttgtgcttagccctt

SEQ ID NO: 114805 - DNA, 37 bp, Artificial Sequence
  Synthetic oligonucleotide
gagccccacgcccgcctttcgattcagtccgcccaga

SEQ ID NO: 114806 - DNA, 38 bp, Artificial Sequence
  Synthetic oligonucleotide
tgtgtgcatgggaatgggggggagggacttacccttga

SEQ ID NO: 114807 - DNA, 35 bp, Artificial Sequence
  Synthetic oligonucleotide
tgacgctgctcacccactgtcttcttgccctacgc

SEQ ID NO: 114808 - DNA, 35 bp, Artificial Sequence
  Synthetic oligonucleotide
tcgaggggagtggtcgggaggcgaaagggtggcgg

SEQ ID NO: 114809 - DNA, 37 bp, Artificial Sequence
  Synthetic oligonucleotide
tatgccatccgcccgccctcgaaccagacgctttaga

SEQ ID NO: 114810 - DNA, 37 bp, Artificial Sequence
  Synthetic oligonucleotide
agccgcccccattgtacctattgcctccgctagccga

SEQ ID NO: 114811 - DNA, 38 bp, Artificial Sequence
  Synthetic oligonucleotide
gaacgagacaccggacgggaatggggggactgggatga

SEQ ID NO: 114812 - DNA, 37 bp, Artificial Sequence
  Synthetic oligonucleotide
ttcacatccgcaactgtagcaacctctccatccgtga

SEQ ID NO: 114813 - DNA, 37 bp, Artificial Sequence
  Synthetic oligonucleotide
tccaggatgggaagggatgggggggaggttacggtga

SEQ ID NO: 114814 - DNA, 36 bp, Artificial Sequence
  Synthetic oligonucleotide
gtgattgcaaagaaccgctcgtcctgcctcctccta

SEQ ID NO: 114815 - DNA, 35 bp, Artificial Sequence
  Synthetic oligonucleotide
ttcaacaccgctcacctgacaaaggcgtacctccc

SEQ ID NO: 114816 - DNA, 36 bp, Artificial Sequence
  Synthetic oligonucleotide
gcgctgcccagcccatcactccgctcgtttgccgca

SEQ ID NO: 114817 - DNA, 37 bp, Artificial Sequence
  Synthetic oligonucleotide
tcagcattgctctgctttcctatcgttacgtgtttga

SEQ ID NO: 114818 - DNA, 35 bp, Artificial Sequence
  Synthetic oligonucleotide
acccccccggtcgtgtgaacctagcatcctcccta

SEQ ID NO: 114819 - DNA, 35 bp, Artificial Sequence
  Synthetic oligonucleotide
atccgcctcgcccgagcatcactccttaatggccc

SEQ ID NO: 114820 - DNA, 34 bp, Artificial Sequence
  Synthetic oligonucleotide
gcccccccccatctgtcctttggaatggttagcc

SEQ ID NO: 114821 - DNA, 35 bp, Artificial Sequence
  Synthetic oligonucleotide
accacgcaggccaagttcacacgcgacgccccatc

SEQ ID NO: 114822 - DNA, 35 bp, Artificial Sequence
  Synthetic oligonucleotide
gaatccacctccatgatctgtcacccactccaatg

SEQ ID NO: 114823 - DNA, 35 bp, Artificial Sequence
  Synthetic oligonucleotide
gtgttgctcccggccctatcagtcctggctcccct

SEQ ID NO: 114824 - DNA, 35 bp, Artificial Sequence
  Synthetic oligonucleotide
acaccacacgcagcacccctccgaccatgcgctta

SEQ ID NO: 114825 - DNA, 35 bp, Artificial Sequence
  Synthetic oligonucleotide
gggtcggtccgcagaatctctacgtgcgctccctc

SEQ ID NO: 114826 - DNA, 35 bp, Artificial Sequence
  Synthetic oligonucleotide
gcccccccgttgctctcccgtcatgtttaccgttc

SEQ ID NO: 114827 - DNA, 36 bp, Artificial Sequence
  Synthetic oligonucleotide
ttacgggtggggaagggaggggtgagattagagcaa

SEQ ID NO: 114828 - DNA, 37 bp, Artificial Sequence
  Synthetic oligonucleotide
gggcgaggggaaggcgaaaataagggtgggggatgga

SEQ ID NO: 114829 - DNA, 35 bp, Artificial Sequence
  Synthetic oligonucleotide
tactcgtccccacgccattctccggtccttttgtc

SEQ ID NO: 114830 - DNA, 35 bp, Artificial Sequence
  Synthetic oligonucleotide
gacgccttctgtaaatccgccttgacctgtgccct

SEQ ID NO: 114831 - DNA, 34 bp, Artificial Sequence
  Synthetic oligonucleotide
tttcgccctctcgaccggtcctatagccaccgct

SEQ ID NO: 114832 - DNA, 35 bp, Artificial Sequence
  Synthetic oligonucleotide
atcgccccgctctctagtttgccatcaagtcccgt

SEQ ID NO: 114833 - DNA, 35 bp, Artificial Sequence
  Synthetic oligonucleotide
tactcgccgccccttctcggtcttcgcacacaaat

SEQ ID NO: 114834 - DNA, 35 bp, Artificial Sequence
  Synthetic oligonucleotide
ggtagggggcggaattggggtggggaaacgggctt

SEQ ID NO: 114835 - DNA, 36 bp, Artificial Sequence
  Synthetic oligonucleotide
cagagggagggacacgggtgcgaatgtggggggaaa

SEQ ID NO: 114836 - DNA, 36 bp, Artificial Sequence
  Synthetic oligonucleotide
gatgcacggacattcgttattcacctcctttcccca

SEQ ID NO: 114837 - DNA, 35 bp, Artificial Sequence
  Synthetic oligonucleotide
tgcacgaacgccgcctgtttctgacttccacaccc

SEQ ID NO: 114838 - DNA, 35 bp, Artificial Sequence
  Synthetic oligonucleotide
tgaccctcacactgttaatcccccctcatgaaagg

SEQ ID NO: 114839 - DNA, 35 bp, Artificial Sequence
  Synthetic oligonucleotide
attgggccaatgggggggaggtatgggaggaaggg

SEQ ID NO: 114840 - DNA, 35 bp, Artificial Sequence
  Synthetic oligonucleotide
accactccggtctacctattccgccccccgctctg

SEQ ID NO: 114841 - DNA, 35 bp, Artificial Sequence
  Synthetic oligonucleotide
acaatcggccagtcacctgaacgcatcctccccgt

SEQ ID NO: 114842 - DNA, 36 bp, Artificial Sequence
  Synthetic oligonucleotide
agccacgccattacgtccctccaccatgttcgtaca

SEQ ID NO: 114843 - DNA, 37 bp, Artificial Sequence
  Synthetic oligonucleotide
gcgaggatagggggtacaggcggaggggggtagtgga

SEQ ID NO: 114844 - DNA, 35 bp, Artificial Sequence
  Synthetic oligonucleotide
tacgggagggaggggtgggtccaatcgtattcgta

SEQ ID NO: 114845 - DNA, 35 bp, Artificial Sequence
  Synthetic oligonucleotide
tctcgcccgatcgccccactgtccaccgcacaccc

SEQ ID NO: 114846 - DNA, 36 bp, Artificial Sequence
  Synthetic oligonucleotide
gcctcctcaccatcgccatacgagaactaactgtcc

SEQ ID NO: 114847 - DNA, 35 bp, Artificial Sequence
  Synthetic oligonucleotide
ggtgaatgcaccgtcctgttctgctcgccatttgt

SEQ ID NO: 114848 - DNA, 36 bp, Artificial Sequence
  Synthetic oligonucleotide
gcctgccacttgacgtttatcatccccacgtcgcca

SEQ ID NO: 114849 - DNA, 36 bp, Artificial Sequence
  Synthetic oligonucleotide
acagtacgaggccgtttgggaagggatgggggggta

SEQ ID NO: 114850 - DNA, 35 bp, Artificial Sequence
  Synthetic oligonucleotide
tcttcacacctccctggtaattatggttgttccac

SEQ ID NO: 114851 - DNA, 34 bp, Artificial Sequence
  Synthetic oligonucleotide
gatagcagggcggggggggatgggccatacttgc

SEQ ID NO: 114852 - DNA, 36 bp, Artificial Sequence
  Synthetic oligonucleotide
gatcacctcctcgttttggccttaaagtccgccaca

SEQ ID NO: 114853 - DNA, 37 bp, Artificial Sequence
  Synthetic oligonucleotide
acgaccaggggccggagggtgacgggcaaggaggcga

SEQ ID NO: 114854 - DNA, 35 bp, Artificial Sequence
  Synthetic oligonucleotide
tccaccggccggtctcagtcctccggtcctgtccc

SEQ ID NO: 114855 - DNA, 35 bp, Artificial Sequence
  Synthetic oligonucleotide
ttccttccgtcccagctactcgtttcttggttgcc

SEQ ID NO: 114856 - DNA, 35 bp, Artificial Sequence
  Synthetic oligonucleotide
gttcctcacccccccgctgttccttcttgtaaggc

SEQ ID NO: 114857 - DNA, 35 bp, Artificial Sequence
  Synthetic oligonucleotide
gcacaccggaagtttccccccctgccacccatgcg

SEQ ID NO: 114858 - DNA, 35 bp, Artificial Sequence
  Synthetic oligonucleotide
accatcacgccccaccacgcctgtatattactttt

SEQ ID NO: 114859 - DNA, 35 bp, Artificial Sequence
  Synthetic oligonucleotide
gtgctgttctcccccctttcgtgactgttgttctc

SEQ ID NO: 114860 - DNA, 35 bp, Artificial Sequence
  Synthetic oligonucleotide
tagccccgcctttgggccatcattcatcaatccct

SEQ ID NO: 114861 - DNA, 35 bp, Artificial Sequence
  Synthetic oligonucleotide
gttcacctcattaaacgctcccgacctgtctcgct

SEQ ID NO: 114862 - DNA, 35 bp, Artificial Sequence
  Synthetic oligonucleotide
ttcgtaatccctccgccactgtcccatttgatgct

SEQ ID NO: 114863 - DNA, 37 bp, Artificial Sequence
  Synthetic oligonucleotide
gtgtgccgcccttcccgcagcctgctatttgactcga

SEQ ID NO: 114864 - DNA, 35 bp, Artificial Sequence
  Synthetic oligonucleotide
tgattgccccttcgttatgcgaccgaccacacccc

SEQ ID NO: 114865 - DNA, 34 bp, Artificial Sequence
  Synthetic oligonucleotide
gcgcacagggtcctttttgtcgcacaccgtcccc

SEQ ID NO: 114866 - DNA, 35 bp, Artificial Sequence
  Synthetic oligonucleotide
aagcacaacatccatcgcgtattccttacttgccc

SEQ ID NO: 114867 - DNA, 35 bp, Artificial Sequence
  Synthetic oligonucleotide
gaacgcccctcctaggttcccgcattacaccttgc

SEQ ID NO: 114868 - DNA, 35 bp, Artificial Sequence
  Synthetic oligonucleotide
tagctgctcagaccctgctgcacctccactccctg

SEQ ID NO: 114869 - DNA, 35 bp, Artificial Sequence
  Synthetic oligonucleotide
acaccgccgttcgccgtatccgttacacctaaatt

SEQ ID NO: 114870 - DNA, 37 bp, Artificial Sequence
  Synthetic oligonucleotide
tgatgggtccgagtgggagggcgggcgattttctcga

SEQ ID NO: 114871 - DNA, 35 bp, Artificial Sequence
  Synthetic oligonucleotide
tcagggctcagtcgcgtactgcctacttgctctcc

SEQ ID NO: 114872 - DNA, 35 bp, Artificial Sequence
  Synthetic oligonucleotide
tgcccagctttgcttcttcataccttcgccctcgc

SEQ ID NO: 114873 - DNA, 35 bp, Artificial Sequence
  Synthetic oligonucleotide
taccgcgtgcgccgttcctgttctcgtacgtactc

SEQ ID NO: 114874 - DNA, 35 bp, Artificial Sequence
  Synthetic oligonucleotide
gacaaccctgttgattgatctttcaccgccccctc

SEQ ID NO: 114875 - DNA, 38 bp, Artificial Sequence
  Synthetic oligonucleotide
gatgcacaacgccgaattgcctcaccctccatccgtga

SEQ ID NO: 114876 - DNA, 35 bp, Artificial Sequence
  Synthetic oligonucleotide
agtcgacgccctcttgttgatctaccctgctggcc

SEQ ID NO: 114877 - DNA, 35 bp, Artificial Sequence
  Synthetic oligonucleotide
tgtaccaccctgctgtcgtttgaaaagtccttccg

SEQ ID NO: 114878 - DNA, 35 bp, Artificial Sequence
  Synthetic oligonucleotide
acacccatccgggaatataagacccaccttaccat

SEQ ID NO: 114879 - DNA, 35 bp, Artificial Sequence
  Synthetic oligonucleotide
atgccattcgccccatcgtccattcgtcccgtatt

SEQ ID NO: 114880 - DNA, 36 bp, Artificial Sequence
  Synthetic oligonucleotide
accacctctgtcctgacactgatccgcctcctgaca

SEQ ID NO: 114881 - DNA, 35 bp, Artificial Sequence
  Synthetic oligonucleotide
atcatggcacatactgtctgcgctcccgcctcatc

SEQ ID NO: 114882 - DNA, 35 bp, Artificial Sequence
  Synthetic oligonucleotide
gaacgatacgcagcctgtcactcccaccattcccg

SEQ ID NO: 114883 - DNA, 35 bp, Artificial Sequence
  Synthetic oligonucleotide
tcacctcctcagcctgctaagcggacccagtctct

SEQ ID NO: 114884 - DNA, 35 bp, Artificial Sequence
  Synthetic oligonucleotide
acttccgtacgacagcgatcctccatcttcgtgcc

SEQ ID NO: 114885 - DNA, 35 bp, Artificial Sequence
  Synthetic oligonucleotide
gtcaatgtcacacgtcctccccacccgtaacgctg

SEQ ID NO: 114886 - DNA, 35 bp, Artificial Sequence
  Synthetic oligonucleotide
ttcgccgtgcccccagtcagtcacccgtcctctta

SEQ ID NO: 114887 - DNA, 35 bp, Artificial Sequence
  Synthetic oligonucleotide
gaccacacctccacgctcccccggtttaacccccg

SEQ ID NO: 114888 - DNA, 35 bp, Artificial Sequence
  Synthetic oligonucleotide
tttgccccttttgatccgtccaaccgaccttgctt

SEQ ID NO: 114889 - DNA, 36 bp, Artificial Sequence
  Synthetic oligonucleotide
gtctggaacggggtggggagcggaggggccattgaa

SEQ ID NO: 114890 - DNA, 38 bp, Artificial Sequence
  Synthetic oligonucleotide
tcagccacgcgcccacgccccgctatcctccgccctga

SEQ ID NO: 114891 - DNA, 35 bp, Artificial Sequence
  Synthetic oligonucleotide
taacgcccccctcctcgcgaccgtctccacggaat

SEQ ID NO: 114892 - DNA, 35 bp, Artificial Sequence
  Synthetic oligonucleotide
ttggtggagcctctatatgcccttgcctgtaccat

SEQ ID NO: 114893 - DNA, 36 bp, Artificial Sequence
  Synthetic oligonucleotide
tccatgcccctttcttgttacaccgcgcggatctca

SEQ ID NO: 114894 - DNA, 38 bp, Artificial Sequence
  Synthetic oligonucleotide
acgtgacgtcgctacctgcctgttccctctcgctgtga

SEQ ID NO: 114895 - DNA, 36 bp, Artificial Sequence
  Synthetic oligonucleotide
ggtggtgggggaggggcctaaagggaaacggcatta

SEQ ID NO: 114896 - DNA, 35 bp, Artificial Sequence
  Synthetic oligonucleotide
accacgccccgcctgcactccaggtcatcttaccc

SEQ ID NO: 114897 - DNA, 35 bp, Artificial Sequence
  Synthetic oligonucleotide
ttgactacagccgccgttccctcacgattctcgtc

SEQ ID NO: 114898 - DNA, 35 bp, Artificial Sequence
  Synthetic oligonucleotide
gtgctgtggtactcttgcgctcctgtcctgctccg

SEQ ID NO: 114899 - DNA, 35 bp, Artificial Sequence
  Synthetic oligonucleotide
atccttgccggtcccttgtttgctgcccgtgccct

SEQ ID NO: 114900 - DNA, 38 bp, Artificial Sequence
  Synthetic oligonucleotide
tactgccctcggcgcgttgtgttatcccccctccgtga

SEQ ID NO: 114901 - DNA, 36 bp, Artificial Sequence
  Synthetic oligonucleotide
agccttaccgctcctgttcctgtttttagccccata

SEQ ID NO: 114902 - DNA, 35 bp, Artificial Sequence
  Synthetic oligonucleotide
tgcgatccgtccgccctgcgatttttaccatccac

SEQ ID NO: 114903 - DNA, 35 bp, Artificial Sequence
  Synthetic oligonucleotide
ttgttcacctgccgctggtctcgtcgctcccatac

SEQ ID NO: 114904 - DNA, 34 bp, Artificial Sequence
  Synthetic oligonucleotide
ttacagatccggtggtccatcgctgtcctgctcc

SEQ ID NO: 114905 - DNA, 35 bp, Artificial Sequence
  Synthetic oligonucleotide
gtggcccggcctcctttgttacctacgctctctcc

SEQ ID NO: 114906 - DNA, 35 bp, Artificial Sequence
  Synthetic oligonucleotide
gcctccccgtcaaaggccggcctgccatcccttcc

SEQ ID NO: 114907 - DNA, 35 bp, Artificial Sequence
  Synthetic oligonucleotide
tgccatcgatccaccctgtaggccccacatcctct

SEQ ID NO: 114908 - DNA, 36 bp, Artificial Sequence
  Synthetic oligonucleotide
tgcgtgccatccaacgtttcctgctaggtcctgcca

SEQ ID NO: 114909 - DNA, 37 bp, Artificial Sequence
  Synthetic oligonucleotide
tccgctctccgcagacataccgacctcacccccgcga

SEQ ID NO: 114910 - DNA, 37 bp, Artificial Sequence
  Synthetic oligonucleotide
gatccatccacagttgtttcgaatcttccccccgtga

SEQ ID NO: 114911 - DNA, 37 bp, Artificial Sequence
  Synthetic oligonucleotide
gcgaacccctccccatacgcccccatgagctcgttga

SEQ ID NO: 114912 - DNA, 36 bp, Artificial Sequence
  Synthetic oligonucleotide
atctccaccgactgagagttaacctctcgcccccta

SEQ ID NO: 114913 - DNA, 35 bp, Artificial Sequence
  Synthetic oligonucleotide
gatgtctgcatacgtatctttcccttgcaccagcc

SEQ ID NO: 114914 - DNA, 36 bp, Artificial Sequence
  Synthetic oligonucleotide
gcaccccccctctatgttatcgtgccccggatgtta

SEQ ID NO: 114915 - DNA, 35 bp, Artificial Sequence
  Synthetic oligonucleotide
ggggacggcggagtggaatgggtggtcggaggtcg

SEQ ID NO: 114916 - DNA, 37 bp, Artificial Sequence
  Synthetic oligonucleotide
gtcgccctttagttacgtcgccagcacccccatccga

SEQ ID NO: 114917 - DNA, 35 bp, Artificial Sequence
  Synthetic oligonucleotide
tctacatgccgcattacacctcacacgccgtacgc

SEQ ID NO: 114918 - DNA, 35 bp, Artificial Sequence
  Synthetic oligonucleotide
aagccgtaaatgcccctcccgtgtcaccgccgttc

SEQ ID NO: 114919 - DNA, 35 bp, Artificial Sequence
  Synthetic oligonucleotide
gttggccatgtgaagtgggcagggatgggggggag

SEQ ID NO: 114920 - DNA, 35 bp, Artificial Sequence
  Synthetic oligonucleotide
gtccgctcgatgtcgccgtacatactccctgtcct

SEQ ID NO: 114921 - DNA, 35 bp, Artificial Sequence
  Synthetic oligonucleotide
tcccctcccactgttctcaggcaaaactcctcgtt

SEQ ID NO: 114922 - DNA, 35 bp, Artificial Sequence
  Synthetic oligonucleotide
ggatccccgccacctgcgaattcgacaatcctttt

SEQ ID NO: 114923 - DNA, 36 bp, Artificial Sequence
  Synthetic oligonucleotide
atagggtggaggaggtgaagggggacaagagtataa

SEQ ID NO: 114924 - DNA, 36 bp, Artificial Sequence
  Synthetic oligonucleotide
tcttacccatccgcccgatcaccccctgcctccgga

SEQ ID NO: 114925 - DNA, 38 bp, Artificial Sequence
  Synthetic oligonucleotide
tctatcaccgccccgcacctgtacttacctgccattga

SEQ ID NO: 114926 - DNA, 35 bp, Artificial Sequence
  Synthetic oligonucleotide
gttgggccaagcactatcgggggggagggacttgc

SEQ ID NO: 114927 - DNA, 35 bp, Artificial Sequence
  Synthetic oligonucleotide
gctcacccccccgcgtacctagtcacacacaagtc

SEQ ID NO: 114928 - DNA, 38 bp, Artificial Sequence
  Synthetic oligonucleotide
gacgggtgggagccgctgtgagggggaacgggggatga

SEQ ID NO: 114929 - DNA, 38 bp, Artificial Sequence
  Synthetic oligonucleotide
gtgtcatgcgggggaggtcggggttggtggtggtttga

SEQ ID NO: 114930 - DNA, 35 bp, Artificial Sequence
  Synthetic oligonucleotide
gtgcgagccgccccatgctcccctatacgggtacc

SEQ ID NO: 114931 - DNA, 35 bp, Artificial Sequence
  Synthetic oligonucleotide
tcccgtgcccggtctccatagctgtccttcttcgt

SEQ ID NO: 114932 - DNA, 35 bp, Artificial Sequence
  Synthetic oligonucleotide
tgccatcctcgcctctttttgatggtgaccctgcc

SEQ ID NO: 114933 - DNA, 35 bp, Artificial Sequence
  Synthetic oligonucleotide
tactgcactaccccctatcgttatacggctacctc

SEQ ID NO: 114934 - DNA, 35 bp, Artificial Sequence
  Synthetic oligonucleotide
tgttcccgcccatgctgctttatcattacggccat

SEQ ID NO: 114935 - DNA, 35 bp, Artificial Sequence
  Synthetic oligonucleotide
gcaagcacaaagcgcgctatgtccatcctgtccct

SEQ ID NO: 114936 - DNA, 35 bp, Artificial Sequence
  Synthetic oligonucleotide
ttccgctccacccggggtctagtccaccactctca

SEQ ID NO: 114937 - DNA, 35 bp, Artificial Sequence
  Synthetic oligonucleotide
ttcaccgctactgcaatgcgctctctagcccaccc

SEQ ID NO: 114938 - DNA, 35 bp, Artificial Sequence
  Synthetic oligonucleotide
gtttgaccaccctctgttgagcgtttccgactctc

SEQ ID NO: 114939 - DNA, 36 bp, Artificial Sequence
  Synthetic oligonucleotide
atgtccgccctctggtatcaacccactaggcactta

SEQ ID NO: 114940 - DNA, 35 bp, Artificial Sequence
  Synthetic oligonucleotide
ttgtggcgtagaccgtctcaagccgttaccccctc

SEQ ID NO: 114941 - DNA, 35 bp, Artificial Sequence
  Synthetic oligonucleotide
gtccacgccactgccctttaacttgcctttgttgg

SEQ ID NO: 114942 - DNA, 35 bp, Artificial Sequence
  Synthetic oligonucleotide
acataaccagcatccggcttcacccccgtcgcatt

SEQ ID NO: 114943 - DNA, 35 bp, Artificial Sequence
  Synthetic oligonucleotide
gtgccacgcccaattggaaattttctcacgctctc

SEQ ID NO: 114944 - DNA, 35 bp, Artificial Sequence
  Synthetic oligonucleotide
tcctgctcacatctgcccccttttgttgcaacttt

SEQ ID NO: 114945 - DNA, 37 bp, Artificial Sequence
  Synthetic oligonucleotide
tccccacacctcgtcctctatatcccgtccttccaga

SEQ ID NO: 114946 - DNA, 37 bp, Artificial Sequence
  Synthetic oligonucleotide
atgcacgagccacgggggggtagaggggaagtatgga

SEQ ID NO: 114947 - DNA, 38 bp, Artificial Sequence
  Synthetic oligonucleotide
ggtgtagcatccgccgtgccagccgcctgctcccctga

SEQ ID NO: 114948 - DNA, 35 bp, Artificial Sequence
  Synthetic oligonucleotide
agtgcgtgccactgctcaaatcctccgccacttta

SEQ ID NO: 114949 - DNA, 35 bp, Artificial Sequence
  Synthetic oligonucleotide
acccgcgcctcctgtcactccccctgttgcgccgg

SEQ ID NO: 114950 - DNA, 37 bp, Artificial Sequence
  Synthetic oligonucleotide
agagtaggggggaggggagagaagacgacaatcggga

SEQ ID NO: 114951 - DNA, 37 bp, Artificial Sequence
  Synthetic oligonucleotide
tcgaataaggggagggtgatggagagcggagggaaga

SEQ ID NO: 114952 - DNA, 37 bp, Artificial Sequence
  Synthetic oligonucleotide
acccccgacacatccctcccgacatctattggcccga

SEQ ID NO: 114953 - DNA, 35 bp, Artificial Sequence
  Synthetic oligonucleotide
accccccgacggaggcaatcccatccccgcctatc

SEQ ID NO: 114954 - DNA, 35 bp, Artificial Sequence
  Synthetic oligonucleotide
tcgcaccacagcccgctgcgccttctcacccgctc

SEQ ID NO: 114955 - DNA, 35 bp, Artificial Sequence
  Synthetic oligonucleotide
gagtgtcggggggggaccaaaggcggtaagtaggg

SEQ ID NO: 114956 - DNA, 35 bp, Artificial Sequence
  Synthetic oligonucleotide
tacgactccgctcccagccaccccccggtacaaca

SEQ ID NO: 114957 - DNA, 35 bp, Artificial Sequence
  Synthetic oligonucleotide
tcacgcccgtagcccgtgaggtacctgccattgcc

SEQ ID NO: 114958 - DNA, 37 bp, Artificial Sequence
  Synthetic oligonucleotide
atgagagggggaatggaacagaggggggaatcggtga

SEQ ID NO: 114959 - DNA, 36 bp, Artificial Sequence
  Synthetic oligonucleotide
gtcccgccagcctcacttgcttctgctcgccctcta

SEQ ID NO: 114960 - DNA, 35 bp, Artificial Sequence
  Synthetic oligonucleotide
tgcacctccgccctgaccctgcgagttacacttcc

SEQ ID NO: 114961 - DNA, 35 bp, Artificial Sequence
  Synthetic oligonucleotide
accgcggacacgcttgcctctatacctgttgttcc

SEQ ID NO: 114962 - DNA, 34 bp, Artificial Sequence
  Synthetic oligonucleotide
taccgactgtccccctggccctcccatagagtca

SEQ ID NO: 114963 - DNA, 35 bp, Artificial Sequence
  Synthetic oligonucleotide
gccacaccacaagtgccgcatatggattctccctc

SEQ ID NO: 114964 - DNA, 35 bp, Artificial Sequence
  Synthetic oligonucleotide
gagggtcagggagagcaggacggtcgaggggggag

SEQ ID NO: 114965 - DNA, 37 bp, Artificial Sequence
  Synthetic oligonucleotide
gtccccgccctgctttggtgccatcgatttccctgga

SEQ ID NO: 114966 - DNA, 37 bp, Artificial Sequence
  Synthetic oligonucleotide
gtcctgctccacatcgccgcctatactacctcttgga

SEQ ID NO: 114967 - DNA, 35 bp, Artificial Sequence
  Synthetic oligonucleotide
gtgactcggatgtcacccccccccattgcctgtac

SEQ ID NO: 114968 - DNA, 35 bp, Artificial Sequence
  Synthetic oligonucleotide
tatgccattgtcaggtttactcccgctgtccccgt

SEQ ID NO: 114969 - DNA, 36 bp, Artificial Sequence
  Synthetic oligonucleotide
ttcgccgccctactgcctcttctatctcagacacca

SEQ ID NO: 114970 - DNA, 36 bp, Artificial Sequence
  Synthetic oligonucleotide
gcccatccatccatcggtataccaatcctttagtta

SEQ ID NO: 114971 - DNA, 35 bp, Artificial Sequence
  Synthetic oligonucleotide
acttctccgccccctgtcaccttcccttaagggac

SEQ ID NO: 114972 - DNA, 36 bp, Artificial Sequence
  Synthetic oligonucleotide
agctggaggggaccgaggggggggtaaaaggtggaa

SEQ ID NO: 114973 - DNA, 38 bp, Artificial Sequence
  Synthetic oligonucleotide
tgcctgctccatccgtccgtgtccgccactcaatttga

SEQ ID NO: 114974 - DNA, 37 bp, Artificial Sequence
  Synthetic oligonucleotide
gcacgcatgtgttcctcgctccatcgtaaccacctga

SEQ ID NO: 114975 - DNA, 35 bp, Artificial Sequence
  Synthetic oligonucleotide
gcctgatctcgcttagtactcattggccttccacc

SEQ ID NO: 114976 - DNA, 35 bp, Artificial Sequence
  Synthetic oligonucleotide
cctacccccgcctacatgtcacggtctcttcttgc

SEQ ID NO: 114977 - DNA, 35 bp, Artificial Sequence
  Synthetic oligonucleotide
acagcctctccacccatttaagccactgtcacatc

SEQ ID NO: 114978 - DNA, 35 bp, Artificial Sequence
  Synthetic oligonucleotide
gtttgcccccgccattcttccgtctcgtttcctgg

SEQ ID NO: 114979 - DNA, 36 bp, Artificial Sequence
  Synthetic oligonucleotide
acgccctcgcctcgaccccttgccacacaggttaaa

SEQ ID NO: 114980 - DNA, 38 bp, Artificial Sequence
  Synthetic oligonucleotide
gtggtcgccctaccacccgtgtttcctgatccctctga

SEQ ID NO: 114981 - DNA, 35 bp, Artificial Sequence
  Synthetic oligonucleotide
tgccgagctctaagtactgctttcgccacgcccac

SEQ ID NO: 114982 - DNA, 35 bp, Artificial Sequence
  Synthetic oligonucleotide
gtgctcgcctatccgtactttgctctctaaccgtc

SEQ ID NO: 114983 - DNA, 35 bp, Artificial Sequence
  Synthetic oligonucleotide
gtaccaccgccacacttgcttatgcccggattttc

SEQ ID NO: 114984 - DNA, 35 bp, Artificial Sequence
  Synthetic oligonucleotide
tcacgcgctccgactcgcaccgaacccccgccgaa

SEQ ID NO: 114985 - DNA, 35 bp, Artificial Sequence
  Synthetic oligonucleotide
tccacactgtgcccttcccgttgatactcgtccct

SEQ ID NO: 114986 - DNA, 37 bp, Artificial Sequence
  Synthetic oligonucleotide
ggtgacacaggaggaggaaaggcaagcgaggggccga

SEQ ID NO: 114987 - DNA, 37 bp, Artificial Sequence
  Synthetic oligonucleotide
aataaggggtagggaccgggaagaagggacgggcgga

SEQ ID NO: 114988 - DNA, 36 bp, Artificial Sequence
  Synthetic oligonucleotide
gagaggtggccgggggcacagggggacggggagtga

SEQ ID NO: 114989 - DNA, 36 bp, Artificial Sequence
  Synthetic oligonucleotide
gttaccctctgactgccgcccctccagccgttttta

SEQ ID NO: 114990 - DNA, 35 bp, Artificial Sequence
  Synthetic oligonucleotide
tatgccctcacctccatcaccgtgccgacgctgcc

SEQ ID NO: 114991 - DNA, 35 bp, Artificial Sequence
  Synthetic oligonucleotide
agcacgaccgtcttcttcctccaggccccttccgt

SEQ ID NO: 114992 - DNA, 35 bp, Artificial Sequence
  Synthetic oligonucleotide
gccagtacatcacctgcccttagtctccacctggt

SEQ ID NO: 114993 - DNA, 35 bp, Artificial Sequence
  Synthetic oligonucleotide
attgcccggtcctggcccctccgttgaatttatcg

SEQ ID NO: 114994 - DNA, 35 bp, Artificial Sequence
  Synthetic oligonucleotide
gaggggccgcgggtgggggaagtagggaggaggta

SEQ ID NO: 114995 - DNA, 35 bp, Artificial Sequence
  Synthetic oligonucleotide
aagcccccgcccgcctaattcttgcctgtgactta

SEQ ID NO: 114996 - DNA, 35 bp, Artificial Sequence
  Synthetic oligonucleotide
aacacgactcgcttgtctgccgccttcgctttgcc

SEQ ID NO: 114997 - DNA, 38 bp, Artificial Sequence
  Synthetic oligonucleotide
tccgcccccgccgtagccacacaccgtgaccctcttga

SEQ ID NO: 114998 - DNA, 35 bp, Artificial Sequence
  Synthetic oligonucleotide
gccccatcaactcggttatatttctgccatctcac

SEQ ID NO: 114999 - DNA, 35 bp, Artificial Sequence
  Synthetic oligonucleotide
acccgacccgactcttatgagtcacaccgctctac

SEQ ID NO: 115000 - DNA, 35 bp, Artificial Sequence
  Synthetic oligonucleotide
gcacccacacgccggctgctctacccttgcacggc

SEQ ID NO: 115001 - DNA, 35 bp, Artificial Sequence
  Synthetic oligonucleotide
tacccgacctagattacgttatgctgtctccctct

SEQ ID NO: 115002 - DNA, 35 bp, Artificial Sequence
  Synthetic oligonucleotide
gccacgttcggatgaagttcccgcctgtccgctct

SEQ ID NO: 115003 - DNA, 35 bp, Artificial Sequence
  Synthetic oligonucleotide
acccgccctccgccatccgtcttttgtcgggttac

SEQ ID NO: 115004 - DNA, 35 bp, Artificial Sequence
  Synthetic oligonucleotide
gaagggttgcggggagcagggggtaaggtggaaaa

SEQ ID NO: 115005 - DNA, 36 bp, Artificial Sequence
  Synthetic oligonucleotide
ttcatccgcactgttccctattttccttcccttgga

SEQ ID NO: 115006 - DNA, 35 bp, Artificial Sequence
  Synthetic oligonucleotide
ggaaccgcccccaaaggatttgccgccgctccgcc

SEQ ID NO: 115007 - DNA, 35 bp, Artificial Sequence
  Synthetic oligonucleotide
acgaccggttcggtgcgcgcccctctcactcctga

SEQ ID NO: 115008 - DNA, 35 bp, Artificial Sequence
  Synthetic oligonucleotide
tcccagcctacgtatgcatcatctttagcccctcg

SEQ ID NO: 115009 - DNA, 35 bp, Artificial Sequence
  Synthetic oligonucleotide
gcccatacatcctgccgtcctctcatagccgttct

SEQ ID NO: 115010 - DNA, 35 bp, Artificial Sequence
  Synthetic oligonucleotide
gaaacagtgtgtcccggtccgtgttgctcctcctt

SEQ ID NO: 115011 - DNA, 38 bp, Artificial Sequence
  Synthetic oligonucleotide
tgtgttcaccgccccctttgacttgtcgcagtcattga

SEQ ID NO: 115012 - DNA, 35 bp, Artificial Sequence
  Synthetic oligonucleotide
ccagatgcgcctcgatctgcttctcgtgctacccc

SEQ ID NO: 115013 - DNA, 36 bp, Artificial Sequence
  Synthetic oligonucleotide
tccacccccgctctacccccacggtgtatttgagaa

SEQ ID NO: 115014 - DNA, 35 bp, Artificial Sequence
  Synthetic oligonucleotide
ttaccacgccatccgtccatcttcccacgggagca

SEQ ID NO: 115015 - DNA, 36 bp, Artificial Sequence
  Synthetic oligonucleotide
gcacgccacgtcttcccacccttgtcccccgtcaga

SEQ ID NO: 115016 - DNA, 36 bp, Artificial Sequence
  Synthetic oligonucleotide
gcctacgtggtccctcctacgctcactgtctgttga

SEQ ID NO: 115017 - DNA, 36 bp, Artificial Sequence
  Synthetic oligonucleotide
gtgcccctctcaccgttgttgtcgttctatcctgca

SEQ ID NO: 115018 - DNA, 37 bp, Artificial Sequence
  Synthetic oligonucleotide
gaaagagggaaagatagagcgagtgggggggggacga

SEQ ID NO: 115019 - DNA, 37 bp, Artificial Sequence
  Synthetic oligonucleotide
ggggtgaagagtggaaaggggtacggggcagggcgga

SEQ ID NO: 115020 - DNA, 35 bp, Artificial Sequence
  Synthetic oligonucleotide
gacacccgccctctattacttccctccgggcctgc

SEQ ID NO: 115021 - DNA, 35 bp, Artificial Sequence
  Synthetic oligonucleotide
atgcgcaccatcccctctcgtaagcacgattcctc

SEQ ID NO: 115022 - DNA, 35 bp, Artificial Sequence
  Synthetic oligonucleotide
aaccgcctcccgacccgtcaactctagttcatccg

SEQ ID NO: 115023 - DNA, 36 bp, Artificial Sequence
  Synthetic oligonucleotide
tgtacgcccgccaacactgtcctgtgccttctcaaa

SEQ ID NO: 115024 - DNA, 38 bp, Artificial Sequence
  Synthetic oligonucleotide
gacggggtgggacgggagggcaatgtaaggattcggga

SEQ ID NO: 115025 - DNA, 36 bp, Artificial Sequence
  Synthetic oligonucleotide
tccgaacgttccctgtactatgccctttccacctta

SEQ ID NO: 115026 - DNA, 35 bp, Artificial Sequence
  Synthetic oligonucleotide
tttagcatccgttctgctctccctcctcccgtgtc

SEQ ID NO: 115027 - DNA, 35 bp, Artificial Sequence
  Synthetic oligonucleotide
gcagacaactgccgtatcatcgtcaccagtccttc

SEQ ID NO: 115028 - DNA, 35 bp, Artificial Sequence
  Synthetic oligonucleotide
acgctccacctgcagacatttttagtttccaccgg

SEQ ID NO: 115029 - DNA, 36 bp, Artificial Sequence
  Synthetic oligonucleotide
tcgagcgggtggggcgggaggtaggggggcgaggaa

SEQ ID NO: 115030 - DNA, 38 bp, Artificial Sequence
  Synthetic oligonucleotide
actcagccccaacttgccatacgcgcctctcctaatga

SEQ ID NO: 115031 - DNA, 34 bp, Artificial Sequence
  Synthetic oligonucleotide
actggcccatcctgccgccccccagagctagcta

SEQ ID NO: 115032 - DNA, 35 bp, Artificial Sequence
  Synthetic oligonucleotide
ggaccttcccgacgtatctctctgctgaccctggc

SEQ ID NO: 115033 - DNA, 35 bp, Artificial Sequence
  Synthetic oligonucleotide
tcgacaccccgtttgtttaatcaccccccctagcg

SEQ ID NO: 115034 - DNA, 35 bp, Artificial Sequence
  Synthetic oligonucleotide
gcccggtctcgcctgcgtgtccccttctctccgtt

SEQ ID NO: 115035 - DNA, 36 bp, Artificial Sequence
  Synthetic oligonucleotide
ggatgagggcggggaaaaatgagggaaaggtgaaga

SEQ ID NO: 115036 - DNA, 37 bp, Artificial Sequence
  Synthetic oligonucleotide
ttcagccacactattccactctccgctaccacccgga

SEQ ID NO: 115037 - DNA, 38 bp, Artificial Sequence
  Synthetic oligonucleotide
ggacgccgttcgagcgttctttgctccctcctccttga

SEQ ID NO: 115038 - DNA, 35 bp, Artificial Sequence
  Synthetic oligonucleotide
gcctgtccatcggcgattagcaccctctttagctc

SEQ ID NO: 115039 - DNA, 35 bp, Artificial Sequence
  Synthetic oligonucleotide
gccaaaccccgctgaccgagatactgccaccgctc

SEQ ID NO: 115040 - DNA, 35 bp, Artificial Sequence
  Synthetic oligonucleotide
tcataccgttaggtttaatatctgtcctctacccg

SEQ ID NO: 115041 - DNA, 36 bp, Artificial Sequence
  Synthetic oligonucleotide
tccattccgccgcctcacacgtacagccacctacaa

SEQ ID NO: 115042 - DNA, 36 bp, Artificial Sequence
  Synthetic oligonucleotide
tgacttctccattgtcaccacactcgcccctttcga

SEQ ID NO: 115043 - DNA, 37 bp, Artificial Sequence
  Synthetic oligonucleotide
gattgcccggggtgtggggcgggtacagtgcggggga

SEQ ID NO: 115044 - DNA, 37 bp, Artificial Sequence
  Synthetic oligonucleotide
ggagggacctcggatgggggcgggctgcacgggggga

SEQ ID NO: 115045 - DNA, 35 bp, Artificial Sequence
  Synthetic oligonucleotide
tgcgactccgtcccttttttggtttcacacgccct

SEQ ID NO: 115046 - DNA, 35 bp, Artificial Sequence
  Synthetic oligonucleotide
accatgcctgccgctttcccccgcgtcctcggtct

SEQ ID NO: 115047 - DNA, 36 bp, Artificial Sequence
  Synthetic oligonucleotide
acgttgcccagctgatccacttctatgccttcgcca

SEQ ID NO: 115048 - DNA, 35 bp, Artificial Sequence
  Synthetic oligonucleotide
agtaccctccccggtgttggatcctgccatgtccc

SEQ ID NO: 115049 - DNA, 35 bp, Artificial Sequence
  Synthetic oligonucleotide
tgtcgcaaccggtctattcgctctatctctactcc

SEQ ID NO: 115050 - DNA, 35 bp, Artificial Sequence
  Synthetic oligonucleotide
aacggggaggggcggtaatgaggatcggggtgcag

SEQ ID NO: 115051 - DNA, 35 bp, Artificial Sequence
  Synthetic oligonucleotide
ttccgccatgtgttccgctttcccgctcgcctccg

SEQ ID NO: 115052 - DNA, 36 bp, Artificial Sequence
  Synthetic oligonucleotide
tccgacaccacatgatatttctctccgccgcttgga

SEQ ID NO: 115053 - DNA, 35 bp, Artificial Sequence
  Synthetic oligonucleotide
gcctccgcctgtttccctcaatactcgttcgcact

SEQ ID NO: 115054 - DNA, 35 bp, Artificial Sequence
  Synthetic oligonucleotide
accttgcccaaactgtccacctagtgtcctcacac

SEQ ID NO: 115055 - DNA, 35 bp, Artificial Sequence
  Synthetic oligonucleotide
tctgatgacatcgactgttccgctcaccgctccct

SEQ ID NO: 115056 - DNA, 35 bp, Artificial Sequence
  Synthetic oligonucleotide
ggtgggagggccggggaggagggggtcgtagtggg

SEQ ID NO: 115057 - DNA, 35 bp, Artificial Sequence
  Synthetic oligonucleotide
ggagagagggcggggggggtatgtaattccatgtg

SEQ ID NO: 115058 - DNA, 35 bp, Artificial Sequence
  Synthetic oligonucleotide
accgctcgcggatgttccagctcaccctcccgtac

SEQ ID NO: 115059 - DNA, 35 bp, Artificial Sequence
  Synthetic oligonucleotide
tagcctcgcgtgctctgctgccaatttcccctcct

SEQ ID NO: 115060 - DNA, 36 bp, Artificial Sequence
  Synthetic oligonucleotide
aaccgaaggcgcggaagaggaaaagggggggcggaa

SEQ ID NO: 115061 - DNA, 37 bp, Artificial Sequence
  Synthetic oligonucleotide
tcccatcccactgcctggtttcccatagtcacctaga

SEQ ID NO: 115062 - DNA, 35 bp, Artificial Sequence
  Synthetic oligonucleotide
actgagcgccataagtctccctactcccgccccct

SEQ ID NO: 115063 - DNA, 36 bp, Artificial Sequence
  Synthetic oligonucleotide
gacgctaggtcaccactgctttgactctccattata

SEQ ID NO: 115064 - DNA, 35 bp, Artificial Sequence
  Synthetic oligonucleotide
agtcctcgccgcacctgcctattattctgtagccc

SEQ ID NO: 115065 - DNA, 35 bp, Artificial Sequence
  Synthetic oligonucleotide
gtatgccaccatccctccaaggtccgttctgctcg

SEQ ID NO: 115066 - DNA, 36 bp, Artificial Sequence
  Synthetic oligonucleotide
atgcgacagtcctccgtgccttctctccaccagcca

SEQ ID NO: 115067 - DNA, 37 bp, Artificial Sequence
  Synthetic oligonucleotide
ggaacatgggatagaggggtggagagcagggcgcaga

SEQ ID NO: 115068 - DNA, 37 bp, Artificial Sequence
  Synthetic oligonucleotide
gccactgtcctgtttcctcttgcccccacttcgtcga

SEQ ID NO: 115069 - DNA, 35 bp, Artificial Sequence
  Synthetic oligonucleotide
gttgactccacctacgtgccctagccccaattgcc

SEQ ID NO: 115070 - DNA, 34 bp, Artificial Sequence
  Synthetic oligonucleotide
aagaccctcgccaaccaggtgcatgccgccttcc

SEQ ID NO: 115071 - DNA, 35 bp, Artificial Sequence
  Synthetic oligonucleotide
tccatgcacgccatattacaaccatctctccgtcg

SEQ ID NO: 115072 - DNA, 35 bp, Artificial Sequence
  Synthetic oligonucleotide
ttcgcccgccccggtctgccacattttaatctgct

SEQ ID NO: 115073 - DNA, 36 bp, Artificial Sequence
  Synthetic oligonucleotide
gactggcctcattgcttattggtcttccctccaaca

SEQ ID NO: 115074 - DNA, 36 bp, Artificial Sequence
  Synthetic oligonucleotide
gtggccaagcagcctggtcgcgcatcctcttcttca

SEQ ID NO: 115075 - DNA, 35 bp, Artificial Sequence
  Synthetic oligonucleotide
atacctcctccgtgcctgtacagctgtagccatcc

SEQ ID NO: 115076 - DNA, 35 bp, Artificial Sequence
  Synthetic oligonucleotide
accccatgcgtctcgctcgcgcccctgttgccgct

SEQ ID NO: 115077 - DNA, 36 bp, Artificial Sequence
  Synthetic oligonucleotide
acgcgccgcctcgtggttccgcccccagccccctaa

SEQ ID NO: 115078 - DNA, 37 bp, Artificial Sequence
  Synthetic oligonucleotide
aacgccaggtagggaagaacgggtgtgggtggtggga

SEQ ID NO: 115079 - DNA, 35 bp, Artificial Sequence
  Synthetic oligonucleotide
gagctcgtcccgctgcctaccaccgtgcgccttac

SEQ ID NO: 115080 - DNA, 35 bp, Artificial Sequence
  Synthetic oligonucleotide
attgcgcctgtccgccctgactctttaggtaccct

SEQ ID NO: 115081 - DNA, 35 bp, Artificial Sequence
  Synthetic oligonucleotide
ttccaccccccggcggctcaccctatcgaccgcta

SEQ ID NO: 115082 - DNA, 35 bp, Artificial Sequence
  Synthetic oligonucleotide
gagcccgcccttccgtggttaccgaccccgcttat

SEQ ID NO: 115083 - DNA, 35 bp, Artificial Sequence
  Synthetic oligonucleotide
gtgtcaccacgtcactccacgccacactgtctctt

SEQ ID NO: 115084 - DNA, 36 bp, Artificial Sequence
  Synthetic oligonucleotide
tcctaccacccttgccccaggagactgcctacgcca

SEQ ID NO: 115085 - DNA, 35 bp, Artificial Sequence
  Synthetic oligonucleotide
tagtgctcccacacccattgtcattgtctacaccc

SEQ ID NO: 115086 - DNA, 35 bp, Artificial Sequence
  Synthetic oligonucleotide
gccgaaaccgttcgcccttgcaatttgcaaccccg

SEQ ID NO: 115087 - DNA, 35 bp, Artificial Sequence
  Synthetic oligonucleotide
tcagagggtcagcctctatcacctccccggcccat

SEQ ID NO: 115088 - DNA, 38 bp, Artificial Sequence
  Synthetic oligonucleotide
gtgaagggcgggtagggatagaaagaagggggacgtga

SEQ ID NO: 115089 - DNA, 35 bp, Artificial Sequence
  Synthetic oligonucleotide
ttgcccccgcactcatgggctccaccgatttttcg

SEQ ID NO: 115090 - DNA, 35 bp, Artificial Sequence
  Synthetic oligonucleotide
gatgcggccccctctcatgttgaaatcccccttgg

SEQ ID NO: 115091 - DNA, 35 bp, Artificial Sequence
  Synthetic oligonucleotide
tcactgcccacttacatggtatctgtcacctccgc

SEQ ID NO: 115092 - DNA, 35 bp, Artificial Sequence
  Synthetic oligonucleotide
gtcgcatctgtccactgccaccgccgattctccct

SEQ ID NO: 115093 - DNA, 36 bp, Artificial Sequence
  Synthetic oligonucleotide
atgtccctccgtccttctgtaccgtctttacccgca

SEQ ID NO: 115094 - DNA, 37 bp, Artificial Sequence
  Synthetic oligonucleotide
tgcgagggaggtgtcggggggcagggaggggatgcga

SEQ ID NO: 115095 - DNA, 36 bp, Artificial Sequence
  Synthetic oligonucleotide
tcagcacacgcctccccttgttcaccccggtacgta

SEQ ID NO: 115096 - DNA, 35 bp, Artificial Sequence
  Synthetic oligonucleotide
tcacactctcagggtaacctcgcgcaccatcccgc

SEQ ID NO: 115097 - DNA, 36 bp, Artificial Sequence
  Synthetic oligonucleotide
ttaccgctcccgccccgcatttcgcattgttcccga

SEQ ID NO: 115098 - DNA, 37 bp, Artificial Sequence
  Synthetic oligonucleotide
agagagggcgtgaatagggaagggggaagggcatcga

SEQ ID NO: 115099 - DNA, 35 bp, Artificial Sequence
  Synthetic oligonucleotide
cccgaaccgccttgagctatgtcaccacctcgttc

SEQ ID NO: 115100 - DNA, 35 bp, Artificial Sequence
  Synthetic oligonucleotide
tgatgaggaaggtggtacgtagtggagggaaattg

SEQ ID NO: 115101 - DNA, 35 bp, Artificial Sequence
  Synthetic oligonucleotide
gccacgccgcccgttgaccactgaattctatctat

SEQ ID NO: 115102 - DNA, 35 bp, Artificial Sequence
  Synthetic oligonucleotide
tgctgatcccacatactgttacgtgccctccatgt

SEQ ID NO: 115103 - DNA, 35 bp, Artificial Sequence
  Synthetic oligonucleotide
gaccctgcccaaatgccaagatcgtccctctctgt

SEQ ID NO: 115104 - DNA, 36 bp, Artificial Sequence
  Synthetic oligonucleotide
gttccaccctacgtcctaagcaccacgcgtaccgta

SEQ ID NO: 115105 - DNA, 35 bp, Artificial Sequence
  Synthetic oligonucleotide
gtaggcacaggccgccgccgtttccacccttagcc

SEQ ID NO: 115106 - DNA, 35 bp, Artificial Sequence
  Synthetic oligonucleotide
tcacgacacatggtttcgccctttcttcccgtctc

SEQ ID NO: 115107 - DNA, 36 bp, Artificial Sequence
  Synthetic oligonucleotide
atgcctgccgccactttagtcgctaacacaccttca

SEQ ID NO: 115108 - DNA, 37 bp, Artificial Sequence
  Synthetic oligonucleotide
gcacgaaccgccgccccgccaccacgacgcaccctga

SEQ ID NO: 115109 - DNA, 36 bp, Artificial Sequence
  Synthetic oligonucleotide
atccacactccactcatgtcttacgcagtagacata

SEQ ID NO: 115110 - DNA, 35 bp, Artificial Sequence
  Synthetic oligonucleotide
aatccgccacccccgtcgaacaccccctgtcgctc

SEQ ID NO: 115111 - DNA, 35 bp, Artificial Sequence
  Synthetic oligonucleotide
ggaacctctccacggacttaattgctcgcctcgct

SEQ ID NO: 115112 - DNA, 36 bp, Artificial Sequence
  Synthetic oligonucleotide
gcatacctcaagtctgtcaattgcccactgccccca

SEQ ID NO: 115113 - DNA, 35 bp, Artificial Sequence
  Synthetic oligonucleotide
ggggcctccctccatgccgtccactcgctgttgca

SEQ ID NO: 115114 - DNA, 35 bp, Artificial Sequence
  Synthetic oligonucleotide
tgtagcccgtgtgccctatcctgtccgccgctcgc

SEQ ID NO: 115115 - DNA, 35 bp, Artificial Sequence
  Synthetic oligonucleotide
aattggaacaggggactgaaggggggtggagagag

SEQ ID NO: 115116 - DNA, 35 bp, Artificial Sequence
  Synthetic oligonucleotide
ttccaccatcgatactagtccggctttccttgctc

SEQ ID NO: 115117 - DNA, 35 bp, Artificial Sequence
  Synthetic oligonucleotide
atgcgcccattggcagttacttttacaccttcctg

SEQ ID NO: 115118 - DNA, 35 bp, Artificial Sequence
  Synthetic oligonucleotide
gtgcgccccagaggctactcaagtcttctccgctc

SEQ ID NO: 115119 - DNA, 35 bp, Artificial Sequence
  Synthetic oligonucleotide
tatcggaacccctgcatacagccacacgcaccttc

SEQ ID NO: 115120 - DNA, 35 bp, Artificial Sequence
  Synthetic oligonucleotide
gtgcattccactcgctgccctctcacccttgcgcg

SEQ ID NO: 115121 - DNA, 37 bp, Artificial Sequence
  Synthetic oligonucleotide
gtggggccgtgaaggggtggagagggacgcaagcaga

SEQ ID NO: 115122 - DNA, 34 bp, Artificial Sequence
  Synthetic oligonucleotide
tctccgcctccttctgtctgtccagccacaccgc

SEQ ID NO: 115123 - DNA, 35 bp, Artificial Sequence
  Synthetic oligonucleotide
gtatacccgcttgcctgcccgttacgtaacacttc

SEQ ID NO: 115124 - DNA, 35 bp, Artificial Sequence
  Synthetic oligonucleotide
ttcgatttgccccattggttcctgtatgctccccg

SEQ ID NO: 115125 - DNA, 35 bp, Artificial Sequence
  Synthetic oligonucleotide
gtgggcccttcctcttgccgttcgtcgttttccca

SEQ ID NO: 115126 - DNA, 36 bp, Artificial Sequence
  Synthetic oligonucleotide
gtgcaaggtcaggtccaaacgttctgccgcccgcca

SEQ ID NO: 115127 - DNA, 35 bp, Artificial Sequence
  Synthetic oligonucleotide
gcccccactccggatgctagtcgcactaccactgc

SEQ ID NO: 115128 - DNA, 35 bp, Artificial Sequence
  Synthetic oligonucleotide
gccctcgccggtcggagcgtgctcgtttttccctc

SEQ ID NO: 115129 - DNA, 35 bp, Artificial Sequence
  Synthetic oligonucleotide
gttgcgtggccccccctccgtcattccctcatctg

SEQ ID NO: 115130 - DNA, 35 bp, Artificial Sequence
  Synthetic oligonucleotide
acctccaccgctataccagacctcgattcccacct

SEQ ID NO: 115131 - DNA, 37 bp, Artificial Sequence
  Synthetic oligonucleotide
tgtccggtggacgggggataggagggaggagtgacga

SEQ ID NO: 115132 - DNA, 35 bp, Artificial Sequence
  Synthetic oligonucleotide
gtgggaagaaggggggcagaaggcgcggaaggtac

SEQ ID NO: 115133 - DNA, 35 bp, Artificial Sequence
  Synthetic oligonucleotide
atgtccctatcgctgccacgctcccacgaatgtcc

SEQ ID NO: 115134 - DNA, 36 bp, Artificial Sequence
  Synthetic oligonucleotide
gaaccaccccactttccagatcgtaattgcctctca

SEQ ID NO: 115135 - DNA, 35 bp, Artificial Sequence
  Synthetic oligonucleotide
aagcctgacgcagtcctcgttaaacatactccgcc

SEQ ID NO: 115136 - DNA, 35 bp, Artificial Sequence
  Synthetic oligonucleotide
accgtgaggtcgtccgtcacgcacaccccccccgc

SEQ ID NO: 115137 - DNA, 35 bp, Artificial Sequence
  Synthetic oligonucleotide
gtcctgtacgcgtgacgtcctgcccactcctgctc

SEQ ID NO: 115138 - DNA, 35 bp, Artificial Sequence
  Synthetic oligonucleotide
accctgcacctgtcaccgccttactccgacacacc

SEQ ID NO: 115139 - DNA, 35 bp, Artificial Sequence
  Synthetic oligonucleotide
acccgaccccccgtcctccccgatcgagcggtttc

SEQ ID NO: 115140 - DNA, 35 bp, Artificial Sequence
  Synthetic oligonucleotide
gccctaacgaacccatgagtctcaccacccccccg

SEQ ID NO: 115141 - DNA, 36 bp, Artificial Sequence
  Synthetic oligonucleotide
tcctgctccgcatccgacgtcaactccgccgcccga

SEQ ID NO: 115142 - DNA, 35 bp, Artificial Sequence
  Synthetic oligonucleotide
tctgcctcctgcttcttactctagtgtccgcccga

SEQ ID NO: 115143 - DNA, 36 bp, Artificial Sequence
  Synthetic oligonucleotide
gtcgccatccccgttctcacgctcccgcactgctga

SEQ ID NO: 115144 - DNA, 34 bp, Artificial Sequence
  Synthetic oligonucleotide
gcgctcagtgctccccgatatcgttttcctgttc

SEQ ID NO: 115145 - DNA, 35 bp, Artificial Sequence
  Synthetic oligonucleotide
tccatccgatcctgtttttatgacctccgatcttc

SEQ ID NO: 115146 - DNA, 35 bp, Artificial Sequence
  Synthetic oligonucleotide
gaaatgaggagttggaatgagaagggcggaagggg

SEQ ID NO: 115147 - DNA, 35 bp, Artificial Sequence
  Synthetic oligonucleotide
acacaccacctaacatgttcgcagttccgctcttg

SEQ ID NO: 115148 - DNA, 35 bp, Artificial Sequence
  Synthetic oligonucleotide
gccacccagtcatccctgccgctttttcgcaccct

SEQ ID NO: 115149 - DNA, 37 bp, Artificial Sequence
  Synthetic oligonucleotide
gccggggaaaggatggcgtcaaggggaagggctggga

SEQ ID NO: 115150 - DNA, 38 bp, Artificial Sequence
  Synthetic oligonucleotide
gccaccaccgccgacctccacactgaactgtcacgtga

SEQ ID NO: 115151 - DNA, 36 bp, Artificial Sequence
  Synthetic oligonucleotide
tgccaccactgaaggggtttccagcgcacattacta

SEQ ID NO: 115152 - DNA, 37 bp, Artificial Sequence
  Synthetic oligonucleotide
gacccgctctcacgcgtccaattccattcctgcctga

SEQ ID NO: 115153 - DNA, 38 bp, Artificial Sequence
  Synthetic oligonucleotide
gggaacgaggaggggggggcggagtatgggccgggtga

SEQ ID NO: 115154 - DNA, 35 bp, Artificial Sequence
  Synthetic oligonucleotide
ttttacgcacccacaatacaggctgttacgcctcc

SEQ ID NO: 115155 - DNA, 35 bp, Artificial Sequence
  Synthetic oligonucleotide
aacccccgatccgacgctattttcatggccacatc

SEQ ID NO: 115156 - DNA, 35 bp, Artificial Sequence
  Synthetic oligonucleotide
gcaccccacctccctttcgttattgcacgttcgtg

SEQ ID NO: 115157 - DNA, 36 bp, Artificial Sequence
  Synthetic oligonucleotide
gtcaggggagggagagcggggagcggggggcataca

SEQ ID NO: 115158 - DNA, 37 bp, Artificial Sequence
  Synthetic oligonucleotide
atgtcccctcttccgcccgttctcgtgacagccatga

SEQ ID NO: 115159 - DNA, 35 bp, Artificial Sequence
  Synthetic oligonucleotide
tttcaccccccatcagccttggttcccgggaccac

SEQ ID NO: 115160 - DNA, 35 bp, Artificial Sequence
  Synthetic oligonucleotide
gacccccccgtcttactctccacccttggagggtc

SEQ ID NO: 115161 - DNA, 38 bp, Artificial Sequence
  Synthetic oligonucleotide
gtcacccgctcctgttgtgctctgccccctctcggtga

SEQ ID NO: 115162 - DNA, 35 bp, Artificial Sequence
  Synthetic oligonucleotide
tgcacccccaggtcgacccatccatatcccccggg

SEQ ID NO: 115163 - DNA, 35 bp, Artificial Sequence
  Synthetic oligonucleotide
aacagccgaccgcctaccgtactcccagctatcct

SEQ ID NO: 115164 - DNA, 35 bp, Artificial Sequence
  Synthetic oligonucleotide
ataggacggacgtagggggcggggggaaaacgggt

SEQ ID NO: 115165 - DNA, 37 bp, Artificial Sequence
  Synthetic oligonucleotide
ttgggcggggtagtttctccagggggagcgtggggga

SEQ ID NO: 115166 - DNA, 35 bp, Artificial Sequence
  Synthetic oligonucleotide
gtagtttgcgcacatggtccagatgccccatcccc

SEQ ID NO: 115167 - DNA, 35 bp, Artificial Sequence
  Synthetic oligonucleotide
tagttaacgcacatccctccctgtacccgccccgc

SEQ ID NO: 115168 - DNA, 36 bp, Artificial Sequence
  Synthetic oligonucleotide
gtaccgcgatcagcagcacgtcgcccccttctgtca

SEQ ID NO: 115169 - DNA, 37 bp, Artificial Sequence
  Synthetic oligonucleotide
ggggggggaaggcaaggtgaagctaaggcggaacgga

SEQ ID NO: 115170 - DNA, 37 bp, Artificial Sequence
  Synthetic oligonucleotide
agtgggtacggaggggggggaaaaaaacggctggtga

SEQ ID NO: 115171 - DNA, 35 bp, Artificial Sequence
  Synthetic oligonucleotide
ttcaccccgcatagaacgtcgttaattcaccatct

SEQ ID NO: 115172 - DNA, 35 bp, Artificial Sequence
  Synthetic oligonucleotide
gccatgcaccaccccggaacacagtctcccaacac

SEQ ID NO: 115173 - DNA, 35 bp, Artificial Sequence
  Synthetic oligonucleotide
tacacgctgccctgaattggttgtcttcccttccc

SEQ ID NO: 115174 - DNA, 35 bp, Artificial Sequence
  Synthetic oligonucleotide
tacacctcctctcgccattggtcttacagtcccct

SEQ ID NO: 115175 - DNA, 35 bp, Artificial Sequence
  Synthetic oligonucleotide
tgtaccccacgcccctcagctctgccgcctagcaa

SEQ ID NO: 115176 - DNA, 35 bp, Artificial Sequence
  Synthetic oligonucleotide
atcccacccccaccgacgtggaatggaacactaca

SEQ ID NO: 115177 - DNA, 37 bp, Artificial Sequence
  Synthetic oligonucleotide
agcccccgccccggatcttcgtaatgcacctcttgga

SEQ ID NO: 115178 - DNA, 35 bp, Artificial Sequence
  Synthetic oligonucleotide
ggaaacccagtgtgaagccccattcccccgccgct

SEQ ID NO: 115179 - DNA, 35 bp, Artificial Sequence
  Synthetic oligonucleotide
gtgtcactcctttgtcccatcgtccatacgccgta

SEQ ID NO: 115180 - DNA, 35 bp, Artificial Sequence
  Synthetic oligonucleotide
gccccgaagttgcacccccacagcgcgcccttccc

SEQ ID NO: 115181 - DNA, 37 bp, Artificial Sequence
  Synthetic oligonucleotide
gagagggcgggacgagactggaggctggggagtaaga

SEQ ID NO: 115182 - DNA, 38 bp, Artificial Sequence
  Synthetic oligonucleotide
agccacccacctttcgtaccagcctccgttttcactga

SEQ ID NO: 115183 - DNA, 35 bp, Artificial Sequence
  Synthetic oligonucleotide
tacgacgccagcctccttcatccctcacgttaccg

SEQ ID NO: 115184 - DNA, 35 bp, Artificial Sequence
  Synthetic oligonucleotide
tgtaccaatccctctgccctccgtctagtcccgcg

SEQ ID NO: 115185 - DNA, 35 bp, Artificial Sequence
  Synthetic oligonucleotide
acgccggtgtctatcgcccgcccttactatatcga

SEQ ID NO: 115186 - DNA, 38 bp, Artificial Sequence
  Synthetic oligonucleotide
gtcgacgaagtgggagaagggggcgggactaaatgtga

SEQ ID NO: 115187 - DNA, 35 bp, Artificial Sequence
  Synthetic oligonucleotide
gtgtaagaaacaaggtgtgagggggggctgggttg

SEQ ID NO: 115188 - DNA, 37 bp, Artificial Sequence
  Synthetic oligonucleotide
tgggtagagaggagggggaatagaaaacacacgggga

SEQ ID NO: 115189 - DNA, 36 bp, Artificial Sequence
  Synthetic oligonucleotide
ttcaacatcgctgctatgttccatctcactcccgta

SEQ ID NO: 115190 - DNA, 35 bp, Artificial Sequence
  Synthetic oligonucleotide
tccgggccctcgccgccctgtctctgactgctcct

SEQ ID NO: 115191 - DNA, 37 bp, Artificial Sequence
  Synthetic oligonucleotide
agagcgacaaggggtggaggaagggaacggagagaga

SEQ ID NO: 115192 - DNA, 36 bp, Artificial Sequence
  Synthetic oligonucleotide
tccgccccctagtcagttctcttcccgttttgccta

SEQ ID NO: 115193 - DNA, 35 bp, Artificial Sequence
  Synthetic oligonucleotide
gattcccctgcttgctctgctcgatcccgtttcac

SEQ ID NO: 115194 - DNA, 35 bp, Artificial Sequence
  Synthetic oligonucleotide
ttgtcatcgctgttgggcgatggatccacccctcc

SEQ ID NO: 115195 - DNA, 35 bp, Artificial Sequence
  Synthetic oligonucleotide
gtgctaacggtactgcccctgccccagccacttgt

SEQ ID NO: 115196 - DNA, 35 bp, Artificial Sequence
  Synthetic oligonucleotide
ggagaagggctggtggcagggaggggactgggctt

SEQ ID NO: 115197 - DNA, 36 bp, Artificial Sequence
  Synthetic oligonucleotide
tcgatctccgcccctctgattcaacgttccggtcca

SEQ ID NO: 115198 - DNA, 38 bp, Artificial Sequence
  Synthetic oligonucleotide
acctccgcccacgccccacagccagcccgtattgctga

SEQ ID NO: 115199 - DNA, 35 bp, Artificial Sequence
  Synthetic oligonucleotide
gagcatgaggcaaggttgaaggggggaggcggctg

SEQ ID NO: 115200 - DNA, 36 bp, Artificial Sequence
  Synthetic oligonucleotide
tgtggggaaggggcgggagggccataatttcggaaa

SEQ ID NO: 115201 - DNA, 36 bp, Artificial Sequence
  Synthetic oligonucleotide
ggacgctcccgagtgtccctccccctgccttattca

SEQ ID NO: 115202 - DNA, 36 bp, Artificial Sequence
  Synthetic oligonucleotide
tgcactcctgcccccgtgcccctagttgcccaccga

SEQ ID NO: 115203 - DNA, 35 bp, Artificial Sequence
  Synthetic oligonucleotide
atagcctcgtgcaactgtccctcattccggtttcc

SEQ ID NO: 115204 - DNA, 35 bp, Artificial Sequence
  Synthetic oligonucleotide
agtccccatcactctgtcaacctctgcactacacg

SEQ ID NO: 115205 - DNA, 36 bp, Artificial Sequence
  Synthetic oligonucleotide
atgcgatcaggccctctccgcgcccgccgtttttcg

SEQ ID NO: 115206 - DNA, 35 bp, Artificial Sequence
  Synthetic oligonucleotide
tcaaccccttcacacaccgctcgctttcagcactg

SEQ ID NO: 115207 - DNA, 35 bp, Artificial Sequence
  Synthetic oligonucleotide
gcccgagcgctgtctgttatcggtccttctcgcca

SEQ ID NO: 115208 - DNA, 37 bp, Artificial Sequence
  Synthetic oligonucleotide
aagagggaagtaaggggatgagggggaggaggtgcga

SEQ ID NO: 115209 - DNA, 35 bp, Artificial Sequence
  Synthetic oligonucleotide
tctacacgcccatgctatgtctacctgccatcact

SEQ ID NO: 115210 - DNA, 34 bp, Artificial Sequence
  Synthetic oligonucleotide
acccccccccggcatctgcccttggcccgccgct

SEQ ID NO: 115211 - DNA, 35 bp, Artificial Sequence
  Synthetic oligonucleotide
aattgcagcacttcgccgtcttcgagtctccctct

SEQ ID NO: 115212 - DNA, 37 bp, Artificial Sequence
  Synthetic oligonucleotide
tccgtcgcctccctatcgcccgttgtcatcctgatga

SEQ ID NO: 115213 - DNA, 37 bp, Artificial Sequence
  Synthetic oligonucleotide
ccgacccaccctgcctgttattttgcccgctatttga

SEQ ID NO: 115214 - DNA, 35 bp, Artificial Sequence
  Synthetic oligonucleotide
agcgtgctcagagtgccctgctgtccgctcgcctc

SEQ ID NO: 115215 - DNA, 35 bp, Artificial Sequence
  Synthetic oligonucleotide
aaccgccacacttgcctactcgaacaatttcatct

SEQ ID NO: 115216 - DNA, 36 bp, Artificial Sequence
  Synthetic oligonucleotide
gcaacaccgcaacaacgaacggtcgcccccccgcca

SEQ ID NO: 115217 - DNA, 36 bp, Artificial Sequence
  Synthetic oligonucleotide
gcacgaggtgggaagggaaagacggacggacggaga

SEQ ID NO: 115218 - DNA, 35 bp, Artificial Sequence
  Synthetic oligonucleotide
tgcctacccgccgtggctcgcgcctcactcttggc

SEQ ID NO: 115219 - DNA, 35 bp, Artificial Sequence
  Synthetic oligonucleotide
gtcacttcctcctatctcggtaacgagctgttctc

SEQ ID NO: 115220 - DNA, 35 bp, Artificial Sequence
  Synthetic oligonucleotide
taggtgagaggagggcaaggaggacgggacaatag

SEQ ID NO: 115221 - DNA, 35 bp, Artificial Sequence
  Synthetic oligonucleotide
gaatctgccctccatggaaccgccgcctgcaccct

SEQ ID NO: 115222 - DNA, 37 bp, Artificial Sequence
  Synthetic oligonucleotide
tcccacacccgtcacttcctgcaacacgtactgtcga

SEQ ID NO: 115223 - DNA, 37 bp, Artificial Sequence
  Synthetic oligonucleotide
gaggggtggaggaaggttctaggatcggaaggcggga

SEQ ID NO: 115224 - DNA, 35 bp, Artificial Sequence
  Synthetic oligonucleotide
tacgacgttgtcttggtctcgcttttctgcccttc

SEQ ID NO: 115225 - DNA, 35 bp, Artificial Sequence
  Synthetic oligonucleotide
cctaccactgttcgctgtttcttgttccttggcct

SEQ ID NO: 115226 - DNA, 37 bp, Artificial Sequence
  Synthetic oligonucleotide
accgcacagccctcagactgtcgcccccatttctcca

SEQ ID NO: 115227 - DNA, 36 bp, Artificial Sequence
  Synthetic oligonucleotide
acgaatctgggacggagggtacgggaggagggggca

SEQ ID NO: 115228 - DNA, 34 bp, Artificial Sequence
  Synthetic oligonucleotide
tagcaacctgtggccccccccccgctccactagc

SEQ ID NO: 115229 - DNA, 35 bp, Artificial Sequence
  Synthetic oligonucleotide
ggacactcactccgccggtttccgtaccacctgtc

SEQ ID NO: 115230 - DNA, 38 bp, Artificial Sequence
  Synthetic oligonucleotide
atggtggggctggatgtcggtgttaaatggcggggtga

SEQ ID NO: 115231 - DNA, 36 bp, Artificial Sequence
  Synthetic oligonucleotide
acgatcccgttccacatgccgcacttctctgtttga

SEQ ID NO: 115232 - DNA, 35 bp, Artificial Sequence
  Synthetic oligonucleotide
gttcgcccatgtacacttgagttatcattccttcc

SEQ ID NO: 115233 - DNA, 35 bp, Artificial Sequence
  Synthetic oligonucleotide
acagcccgcacacggtatctcccagccctccgcat

SEQ ID NO: 115234 - DNA, 35 bp, Artificial Sequence
  Synthetic oligonucleotide
agcaaaggaataggggcgggggggataagggaaaa

SEQ ID NO: 115235 - DNA, 36 bp, Artificial Sequence
  Synthetic oligonucleotide
tccctgttcccatatgcctcactcgtatccgttcca

SEQ ID NO: 115236 - DNA, 37 bp, Artificial Sequence
  Synthetic oligonucleotide
ttcgcgactggccccgattttgtaccctgccttccga

SEQ ID NO: 115237 - DNA, 35 bp, Artificial Sequence
  Synthetic oligonucleotide
gtcgccaactgttctatcactgctattacccccgc

SEQ ID NO: 115238 - DNA, 35 bp, Artificial Sequence
  Synthetic oligonucleotide
agcctacacgcctgccatacattcagtccttcgct

SEQ ID NO: 115239 - DNA, 35 bp, Artificial Sequence
  Synthetic oligonucleotide
ttgtcctgcctgctccgtctgttcccgccacctgt

SEQ ID NO: 115240 - DNA, 37 bp, Artificial Sequence
  Synthetic oligonucleotide
ggttgggaggaaaggggaagatttggcggtggacgga

SEQ ID NO: 115241 - DNA, 37 bp, Artificial Sequence
  Synthetic oligonucleotide
atggtgcgctacacggtggtggggggggaaggaggga

SEQ ID NO: 115242 - DNA, 38 bp, Artificial Sequence
  Synthetic oligonucleotide
gccccatccgctcctgtctcatctctcctggcacatga

SEQ ID NO: 115243 - DNA, 38 bp, Artificial Sequence
  Synthetic oligonucleotide
gagtagggagaagacggtgggatgaacgacgggggtga

SEQ ID NO: 115244 - DNA, 35 bp, Artificial Sequence
  Synthetic oligonucleotide
atgataagccgccctgtgcgtcccgagccctttcc

SEQ ID NO: 115245 - DNA, 35 bp, Artificial Sequence
  Synthetic oligonucleotide
atcgcagtgcccattgccttggttctgtttttctc

SEQ ID NO: 115246 - DNA, 35 bp, Artificial Sequence
  Synthetic oligonucleotide
tccacgcataactgtttcgctccccctgctctttg

SEQ ID NO: 115247 - DNA, 36 bp, Artificial Sequence
  Synthetic oligonucleotide
gagagccccaacctgatctctctcgtttacagtgaa

SEQ ID NO: 115248 - DNA, 35 bp, Artificial Sequence
  Synthetic oligonucleotide
gtttcagtcccctcaatcgtcactactgcctgccc

SEQ ID NO: 115249 - DNA, 35 bp, Artificial Sequence
  Synthetic oligonucleotide
gtggtcccatcttcgtgttcgatcacacacacctc

SEQ ID NO: 115250 - DNA, 35 bp, Artificial Sequence
  Synthetic oligonucleotide
acgctccaccactacggccgacccatgcctttatg

SEQ ID NO: 115251 - DNA, 35 bp, Artificial Sequence
  Synthetic oligonucleotide
acccccccagagtgtctcgcctgaaatcatttgcc

SEQ ID NO: 115252 - DNA, 35 bp, Artificial Sequence
  Synthetic oligonucleotide
gacaggccatactgctctcgtgacttgctgctctc

SEQ ID NO: 115253 - DNA, 35 bp, Artificial Sequence
  Synthetic oligonucleotide
agtgcactccgcctcactaactccgtcctgcttgt

SEQ ID NO: 115254 - DNA, 36 bp, Artificial Sequence
  Synthetic oligonucleotide
actcctcctccgcagtgacttgctgtcacctctcca

SEQ ID NO: 115255 - DNA, 35 bp, Artificial Sequence
  Synthetic oligonucleotide
ccgcactgccaatcatttagtccccagtaaccctc

SEQ ID NO: 115256 - DNA, 35 bp, Artificial Sequence
  Synthetic oligonucleotide
ttgctgttgcgtgttcttctccggccctgttgctc

SEQ ID NO: 115257 - DNA, 35 bp, Artificial Sequence
  Synthetic oligonucleotide
agaccaacccttccgcctgtatccttaaatgcccg

SEQ ID NO: 115258 - DNA, 35 bp, Artificial Sequence
  Synthetic oligonucleotide
tcagtccggactgaacgtctcccttcccatatctg

SEQ ID NO: 115259 - DNA, 37 bp, Artificial Sequence
  Synthetic oligonucleotide
tcagatgcaccgggaaggggggggattgaggggacga

SEQ ID NO: 115260 - DNA, 35 bp, Artificial Sequence
  Synthetic oligonucleotide
gtccacattgcagctcgtcccatcctatatcccgc

SEQ ID NO: 115261 - DNA, 35 bp, Artificial Sequence
  Synthetic oligonucleotide
acagttagcaccgcccttgacatgtcactcccctc

SEQ ID NO: 115262 - DNA, 35 bp, Artificial Sequence
  Synthetic oligonucleotide
atggagcatccgttcgccatccccgcaatcctctc

SEQ ID NO: 115263 - DNA, 35 bp, Artificial Sequence
  Synthetic oligonucleotide
ccctgcctcaacgctctcttccacggcctcgattc

SEQ ID NO: 115264 - DNA, 35 bp, Artificial Sequence
  Synthetic oligonucleotide
tcgctcaacccgctcctggtgctacttttgtcttt

SEQ ID NO: 115265 - DNA, 37 bp, Artificial Sequence
  Synthetic oligonucleotide
atgtcacgtcgatattcctccgcgcctcgtccacaga

SEQ ID NO: 115266 - DNA, 35 bp, Artificial Sequence
  Synthetic oligonucleotide
tagcgcacacccctgtcactctaggatcccgtccc

SEQ ID NO: 115267 - DNA, 34 bp, Artificial Sequence
  Synthetic oligonucleotide
ggtggtacacaggagggaagagagtggtgggagg

SEQ ID NO: 115268 - DNA, 35 bp, Artificial Sequence
  Synthetic oligonucleotide
agaggccaccgctcgcttccatatccgtactctct

SEQ ID NO: 115269 - DNA, 35 bp, Artificial Sequence
  Synthetic oligonucleotide
gtgaagataggggtggtagggcgggtaattgggaa

SEQ ID NO: 115270 - DNA, 36 bp, Artificial Sequence
  Synthetic oligonucleotide
tgtcactcgcccggcaataattcgtaccctgctcca

SEQ ID NO: 115271 - DNA, 35 bp, Artificial Sequence
  Synthetic oligonucleotide
gacccgccggaacatcatcctgtcctatttgctca

SEQ ID NO: 115272 - DNA, 35 bp, Artificial Sequence
  Synthetic oligonucleotide
ttcgaccgtcacttccgtcctcttgaatcctgcat

SEQ ID NO: 115273 - DNA, 35 bp, Artificial Sequence
  Synthetic oligonucleotide
gcccgcacgtactttgtgtgatccttctttaccgt

SEQ ID NO: 115274 - DNA, 37 bp, Artificial Sequence
  Synthetic oligonucleotide
accggagaggggggttggaacgggatggagaagggga

SEQ ID NO: 115275 - DNA, 36 bp, Artificial Sequence
  Synthetic oligonucleotide
gtcccaccgtatccaacgtgctatcctgcccctgga

SEQ ID NO: 115276 - DNA, 35 bp, Artificial Sequence
  Synthetic oligonucleotide
accactcacaccgaatcacttagcactgaccttgc

SEQ ID NO: 115277 - DNA, 35 bp, Artificial Sequence
  Synthetic oligonucleotide
acttcgcccctgcgccgcccttctccacgttggct

SEQ ID NO: 115278 - DNA, 35 bp, Artificial Sequence
  Synthetic oligonucleotide
tcgccctccactttttgcgcttcccgtgttcaccg

SEQ ID NO: 115279 - DNA, 35 bp, Artificial Sequence
  Synthetic oligonucleotide
tgcgagtctcacattttgtcacctgtcccatgtcg

SEQ ID NO: 115280 - DNA, 36 bp, Artificial Sequence
  Synthetic oligonucleotide
gatgtgctgtccagggagggatgagggtgggtgaca

SEQ ID NO: 115281 - DNA, 35 bp, Artificial Sequence
  Synthetic oligonucleotide
tctccctgccgttacgttttctgccctctcgtgcg

SEQ ID NO: 115282 - DNA, 36 bp, Artificial Sequence
  Synthetic oligonucleotide
gtgtcgaagccgtttgacacacttactcccctggaa

SEQ ID NO: 115283 - DNA, 35 bp, Artificial Sequence
  Synthetic oligonucleotide
tgccctccggctgtcataacactttgctccccttc

SEQ ID NO: 115284 - DNA, 35 bp, Artificial Sequence
  Synthetic oligonucleotide
tccataacgcggccggcctgttcgcccttcacccc

SEQ ID NO: 115285 - DNA, 36 bp, Artificial Sequence
  Synthetic oligonucleotide
gtgttgccctcctgcctttgtttttatgcgtatgca

SEQ ID NO: 115286 - DNA, 35 bp, Artificial Sequence
  Synthetic oligonucleotide
gtcactgccgacacaattctacttacgctctccgc

SEQ ID NO: 115287 - DNA, 35 bp, Artificial Sequence
  Synthetic oligonucleotide
tcgcggcggtggtggggctggtatggctggtaacg

SEQ ID NO: 115288 - DNA, 34 bp, Artificial Sequence
  Synthetic oligonucleotide
tattgtgcccgcacaccgagcccctcccccctga

SEQ ID NO: 115289 - DNA, 38 bp, Artificial Sequence
  Synthetic oligonucleotide
gttagcctcattgccgccgttatgccactcttgtttga

SEQ ID NO: 115290 - DNA, 35 bp, Artificial Sequence
  Synthetic oligonucleotide
actctccccgcctgagcgttgtcgcttccgccatc

SEQ ID NO: 115291 - DNA, 35 bp, Artificial Sequence
  Synthetic oligonucleotide
tcgcaccgccaccgtacccccgaccgcacgcccct

SEQ ID NO: 115292 - DNA, 35 bp, Artificial Sequence
  Synthetic oligonucleotide
gatggccgacgcccgagcactcccccctgtcgtac

SEQ ID NO: 115293 - DNA, 35 bp, Artificial Sequence
  Synthetic oligonucleotide
ttacaccgccaacccgttctatgccagccattgtc

SEQ ID NO: 115294 - DNA, 35 bp, Artificial Sequence
  Synthetic oligonucleotide
gcacatctgtgcgacatatccgactcgcccctccg

SEQ ID NO: 115295 - DNA, 35 bp, Artificial Sequence
  Synthetic oligonucleotide
acgccaccatcaataccccgcgtcctctggtccct

SEQ ID NO: 115296 - DNA, 35 bp, Artificial Sequence
  Synthetic oligonucleotide
atcacgcatcgttgctctcaccgcgcctccgtcct

SEQ ID NO: 115297 - DNA, 35 bp, Artificial Sequence
  Synthetic oligonucleotide
ttccatcctcgcctcggtttcctgaatgctttcct

SEQ ID NO: 115298 - DNA, 35 bp, Artificial Sequence
  Synthetic oligonucleotide
tcactccccctgggcctgtttaacggtacccatct

SEQ ID NO: 115299 - DNA, 35 bp, Artificial Sequence
  Synthetic oligonucleotide
tccaagggaggggtgagtgagttgggtgggcttga

SEQ ID NO: 115300 - DNA, 36 bp, Artificial Sequence
  Synthetic oligonucleotide
aaattgtgggggggctggaggggcttgaggatggta

SEQ ID NO: 115301 - DNA, 35 bp, Artificial Sequence
  Synthetic oligonucleotide
tgacgggccccactcgtgcctccgtctttaccacc

SEQ ID NO: 115302 - DNA, 35 bp, Artificial Sequence
  Synthetic oligonucleotide
agcaacatcctcggcggctcctactgtccccccgc

SEQ ID NO: 115303 - DNA, 35 bp, Artificial Sequence
  Synthetic oligonucleotide
tcatccccgccacctgtctgttctccgtttctacg

SEQ ID NO: 115304 - DNA, 35 bp, Artificial Sequence
  Synthetic oligonucleotide
gcacgtcaatcgctctcaacgttccctggctctcg

SEQ ID NO: 115305 - DNA, 35 bp, Artificial Sequence
  Synthetic oligonucleotide
tgaccgtcgattagtgacctctcctgccttccctt

SEQ ID NO: 115306 - DNA, 36 bp, Artificial Sequence
  Synthetic oligonucleotide
tccaccccacgagttaaataatcacaccccctcgca

SEQ ID NO: 115307 - DNA, 37 bp, Artificial Sequence
  Synthetic oligonucleotide
gcagagggcgggggggacaggagaagatcgagtgcga

SEQ ID NO: 115308 - DNA, 38 bp, Artificial Sequence
  Synthetic oligonucleotide
gtgtgggagggttgcggaggggggaagggggcaggtga

SEQ ID NO: 115309 - DNA, 38 bp, Artificial Sequence
  Synthetic oligonucleotide
tacgattcgctccccgcctaagccctgatcccttgtga

SEQ ID NO: 115310 - DNA, 34 bp, Artificial Sequence
  Synthetic oligonucleotide
tttgaccccttgccctgttagtaccgtgatggta

SEQ ID NO: 115311 - DNA, 35 bp, Artificial Sequence
  Synthetic oligonucleotide
accgttccccatcgtgactaacgccctgtgttcac

SEQ ID NO: 115312 - DNA, 35 bp, Artificial Sequence
  Synthetic oligonucleotide
gttcatgcgttagcgtccatccctcgttcctctgg

SEQ ID NO: 115313 - DNA, 37 bp, Artificial Sequence
  Synthetic oligonucleotide
agcacgcacatccgccgccccgagtttcttctctcga

SEQ ID NO: 115314 - DNA, 37 bp, Artificial Sequence
  Synthetic oligonucleotide
gccaggctgaggggcggagaggggtgggaggcacgga

SEQ ID NO: 115315 - DNA, 35 bp, Artificial Sequence
  Synthetic oligonucleotide
tgaccccattcacttgcctccgttttgagtttgct

SEQ ID NO: 115316 - DNA, 38 bp, Artificial Sequence
  Synthetic oligonucleotide
ttggactgcccccattgtatttccggcctctcacctga

SEQ ID NO: 115317 - DNA, 36 bp, Artificial Sequence
  Synthetic oligonucleotide
tcagtactcctccacgccacatgctcacctctctga

SEQ ID NO: 115318 - DNA, 35 bp, Artificial Sequence
  Synthetic oligonucleotide
agacccgcccttggtttggtgcgcttcctcctcgc

SEQ ID NO: 115319 - DNA, 35 bp, Artificial Sequence
  Synthetic oligonucleotide
gttcaccctaatcatgtgctccgcctcctcccggc

SEQ ID NO: 115320 - DNA, 35 bp, Artificial Sequence
  Synthetic oligonucleotide
tccgagggtaggcgttttctccccgtcctcctgtc

SEQ ID NO: 115321 - DNA, 35 bp, Artificial Sequence
  Synthetic oligonucleotide
tgtatcctcggcgtgcttacctcctatctacctcg

SEQ ID NO: 115322 - DNA, 35 bp, Artificial Sequence
  Synthetic oligonucleotide
aatcacaggaggagaggggggggatcagggtgcgg

SEQ ID NO: 115323 - DNA, 35 bp, Artificial Sequence
  Synthetic oligonucleotide
tgaccacgtatactgtcaacttgctctgttcctct

SEQ ID NO: 115324 - DNA, 36 bp, Artificial Sequence
  Synthetic oligonucleotide
acacatgggacagtgacgtgcgggggggggaggaaa

SEQ ID NO: 115325 - DNA, 36 bp, Artificial Sequence
  Synthetic oligonucleotide
gtctcgggcgggtgggattcaagcaggttggggcca

SEQ ID NO: 115326 - DNA, 36 bp, Artificial Sequence
  Synthetic oligonucleotide
gttccacccgtccggcccctcttttcgttcgcgtca

SEQ ID NO: 115327 - DNA, 37 bp, Artificial Sequence
  Synthetic oligonucleotide
gatcgagtggggggggtaggaacgcgggggagaccga

SEQ ID NO: 115328 - DNA, 35 bp, Artificial Sequence
  Synthetic oligonucleotide
tgaacgccccatcatgactcacgcagtgtcactcc

SEQ ID NO: 115329 - DNA, 37 bp, Artificial Sequence
  Synthetic oligonucleotide
atcatccgccctcgctatgcgcatccacccctccaga

SEQ ID NO: 115330 - DNA, 37 bp, Artificial Sequence
  Synthetic oligonucleotide
gtcggaacgccaagaggggcgggggggaagggatgga

SEQ ID NO: 115331 - DNA, 36 bp, Artificial Sequence
  Synthetic oligonucleotide
gagccgaccagtgcttcttttcgtctcgctctccta

SEQ ID NO: 115332 - DNA, 36 bp, Artificial Sequence
  Synthetic oligonucleotide
tacgccaccctgcctttcgtcattccagcccgtcta

SEQ ID NO: 115333 - DNA, 34 bp, Artificial Sequence
  Synthetic oligonucleotide
gactacacctctatgtactttttgattccatggc

SEQ ID NO: 115334 - DNA, 35 bp, Artificial Sequence
  Synthetic oligonucleotide
ttccaccctcccagtcatcaccaatgcccctggca

SEQ ID NO: 115335 - DNA, 35 bp, Artificial Sequence
  Synthetic oligonucleotide
gagacgggtttggaacgagggaacgggcggactag

SEQ ID NO: 115336 - DNA, 36 bp, Artificial Sequence
  Synthetic oligonucleotide
atgtacccgccccccgttgtcattggccttagacca

SEQ ID NO: 115337 - DNA, 35 bp, Artificial Sequence
  Synthetic oligonucleotide
acccattcaccgcatagttgtacttactgtccacc

SEQ ID NO: 115338 - DNA, 35 bp, Artificial Sequence
  Synthetic oligonucleotide
taatgtcaaacgccgccacccgccccatcccgttg

SEQ ID NO: 115339 - DNA, 35 bp, Artificial Sequence
  Synthetic oligonucleotide
gacatcccccactcgctgggttggaaacactccct

SEQ ID NO: 115340 - DNA, 35 bp, Artificial Sequence
  Synthetic oligonucleotide
agatccgctccacctcagtcagcaaggcccttctt

SEQ ID NO: 115341 - DNA, 35 bp, Artificial Sequence
  Synthetic oligonucleotide
accctccatcccatcttgtcctagtgtcgcttata

SEQ ID NO: 115342 - DNA, 35 bp, Artificial Sequence
  Synthetic oligonucleotide
gttgccacattgctttgtcttgtcactgcctttgc

SEQ ID NO: 115343 - DNA, 35 bp, Artificial Sequence
  Synthetic oligonucleotide
gccgaatcgatgtcacctcaaccgtgcgtcccctc

SEQ ID NO: 115344 - DNA, 35 bp, Artificial Sequence
  Synthetic oligonucleotide
ggtacggggagggaggggaggggctgagtgtgagg

SEQ ID NO: 115345 - DNA, 35 bp, Artificial Sequence
  Synthetic oligonucleotide
aacaacgccccacgcttacatcgtccttgcccctt

SEQ ID NO: 115346 - DNA, 35 bp, Artificial Sequence
  Synthetic oligonucleotide
gcatccattccagctgactgtttcatgttcccttt

SEQ ID NO: 115347 - DNA, 36 bp, Artificial Sequence
  Synthetic oligonucleotide
agccaatccccgcagtgtaaaccggccctctctgaa

SEQ ID NO: 115348 - DNA, 35 bp, Artificial Sequence
  Synthetic oligonucleotide
agtacccctaccgaactgaatttggccacatcccc

SEQ ID NO: 115349 - DNA, 35 bp, Artificial Sequence
  Synthetic oligonucleotide
tcatcccgtttcgttgttatgccaactgtcctcct

SEQ ID NO: 115350 - DNA, 37 bp, Artificial Sequence
  Synthetic oligonucleotide
ggggggatgttcaggggtggggaaccgcaaatgggga

SEQ ID NO: 115351 - DNA, 37 bp, Artificial Sequence
  Synthetic oligonucleotide
gccccgccgtctacccccccagccgtccatcccctga

SEQ ID NO: 115352 - DNA, 34 bp, Artificial Sequence
  Synthetic oligonucleotide
gtcccaccgcctgtctttaaaccagctttcctga

SEQ ID NO: 115353 - DNA, 38 bp, Artificial Sequence
  Synthetic oligonucleotide
ttcgtggtggtaggggtccagtggtagtcctggggtga

SEQ ID NO: 115354 - DNA, 35 bp, Artificial Sequence
  Synthetic oligonucleotide
gcaacagccccacactccattgtcgattctcctgg

SEQ ID NO: 115355 - DNA, 35 bp, Artificial Sequence
  Synthetic oligonucleotide
acataccaccgcactttcactgtcccaccactgtt

SEQ ID NO: 115356 - DNA, 35 bp, Artificial Sequence
  Synthetic oligonucleotide
ggactacgccctccgccctcgaccccgtgcccgga

SEQ ID NO: 115357 - DNA, 37 bp, Artificial Sequence
  Synthetic oligonucleotide
ttcagtcccacctccgaatgcgctctatccctttgga

SEQ ID NO: 115358 - DNA, 35 bp, Artificial Sequence
  Synthetic oligonucleotide
ttgtgcgttccaggccgcgctctccccatcctttc

SEQ ID NO: 115359 - DNA, 35 bp, Artificial Sequence
  Synthetic oligonucleotide
gccaggcctcactcccccatcgcggacgctctttc

SEQ ID NO: 115360 - DNA, 35 bp, Artificial Sequence
  Synthetic oligonucleotide
acatcccgaccgtcgctctccaagtgccgcctctt

SEQ ID NO: 115361 - DNA, 35 bp, Artificial Sequence
  Synthetic oligonucleotide
gatgtcgctccaccgggtcccttggttcttcattc

SEQ ID NO: 115362 - DNA, 37 bp, Artificial Sequence
  Synthetic oligonucleotide
gcacccctccgctgacgggtctcgcccctcccctaga

SEQ ID NO: 115363 - DNA, 35 bp, Artificial Sequence
  Synthetic oligonucleotide
gtatgccgccctcgaccttctaccacagttatgac

SEQ ID NO: 115364 - DNA, 37 bp, Artificial Sequence
  Synthetic oligonucleotide
tgttcgtcgtcgccacatccgttatcccctgcctcga

SEQ ID NO: 115365 - DNA, 35 bp, Artificial Sequence
  Synthetic oligonucleotide
tccaaccttcagccgtctgtccttatccacgcgtc

SEQ ID NO: 115366 - DNA, 35 bp, Artificial Sequence
  Synthetic oligonucleotide
gacgcatccgaccctgcttcttacccgtaggctct

SEQ ID NO: 115367 - DNA, 36 bp, Artificial Sequence
  Synthetic oligonucleotide
atcagccccgcccgcatagtcgtctcgctccccgga

SEQ ID NO: 115368 - DNA, 38 bp, Artificial Sequence
  Synthetic oligonucleotide
acccgggtaaggtgggtggggggacgtggagggaatga

SEQ ID NO: 115369 - DNA, 36 bp, Artificial Sequence
  Synthetic oligonucleotide
tacgtacctcctgctggtctctcatcttcgaccgta

SEQ ID NO: 115370 - DNA, 35 bp, Artificial Sequence
  Synthetic oligonucleotide
acccgacacccagccccgcctcatgcccccttttt

SEQ ID NO: 115371 - DNA, 36 bp, Artificial Sequence
  Synthetic oligonucleotide
tgtgggtggggccggggaggaggatatacgtcggga

SEQ ID NO: 115372 - DNA, 35 bp, Artificial Sequence
  Synthetic oligonucleotide
ggattacgccattgcttccatcaccccccactttg

SEQ ID NO: 115373 - DNA, 35 bp, Artificial Sequence
  Synthetic oligonucleotide
acccatgccgtcagtgcgcaccccccccgccctct

SEQ ID NO: 115374 - DNA, 35 bp, Artificial Sequence
  Synthetic oligonucleotide
atcaccccatgtcgactgtcagaccccacgcccca

SEQ ID NO: 115375 - DNA, 35 bp, Artificial Sequence
  Synthetic oligonucleotide
gcccacttcgctgcctttcccacaggagacgtacc

SEQ ID NO: 115376 - DNA, 35 bp, Artificial Sequence
  Synthetic oligonucleotide
gcgaccgctcgccgacactgttttactctcaccct

SEQ ID NO: 115377 - DNA, 35 bp, Artificial Sequence
  Synthetic oligonucleotide
gacaccccaccatcacctagagcttgtagcctcct

SEQ ID NO: 115378 - DNA, 35 bp, Artificial Sequence
  Synthetic oligonucleotide
tccgcccaggtcttctgcgccatatctaactctct

SEQ ID NO: 115379 - DNA, 36 bp, Artificial Sequence
  Synthetic oligonucleotide
aaccaggagcaaaagggcacggggaggtgggaacaa

SEQ ID NO: 115380 - DNA, 36 bp, Artificial Sequence
  Synthetic oligonucleotide
acctcccactcgaccactatgcttgatttgcctaca

SEQ ID NO: 115381 - DNA, 35 bp, Artificial Sequence
  Synthetic oligonucleotide
ttttgccctgtcctgccgccgtaccagttggccta

SEQ ID NO: 115382 - DNA, 35 bp, Artificial Sequence
  Synthetic oligonucleotide
gacgggggggaaagggggcagtgagcctagttaag

SEQ ID NO: 115383 - DNA, 35 bp, Artificial Sequence
  Synthetic oligonucleotide
aacccttccgccgcatagctaacatcgcattcccg

SEQ ID NO: 115384 - DNA, 37 bp, Artificial Sequence
  Synthetic oligonucleotide
gatagtgacgggaggggaggcaaaagggtgggtaaga

SEQ ID NO: 115385 - DNA, 36 bp, Artificial Sequence
  Synthetic oligonucleotide
tgcaaaccctctcttgctgccaccgctaaggcccta

SEQ ID NO: 115386 - DNA, 35 bp, Artificial Sequence
  Synthetic oligonucleotide
ttgggcaaccctgtcgcttttgccatccgttctcc

SEQ ID NO: 115387 - DNA, 36 bp, Artificial Sequence
  Synthetic oligonucleotide
tgcgtgcgcactacatctattcctgtcctttccgca

SEQ ID NO: 115388 - DNA, 36 bp, Artificial Sequence
  Synthetic oligonucleotide
tcacccctcctcactggtattgttaccaatatttca

SEQ ID NO: 115389 - DNA, 36 bp, Artificial Sequence
  Synthetic oligonucleotide
gacacgtcccctgttcccttgtccgccccgacgcta

SEQ ID NO: 115390 - DNA, 35 bp, Artificial Sequence
  Synthetic oligonucleotide
tatccactcactcaccctggctttcgggaccaaac

SEQ ID NO: 115391 - DNA, 35 bp, Artificial Sequence
  Synthetic oligonucleotide
gagagagctgcccattgccccatctagaaccttac

SEQ ID NO: 115392 - DNA, 36 bp, Artificial Sequence
  Synthetic oligonucleotide
tgctccaccctctccggctagcctcctgtcctttgt

SEQ ID NO: 115393 - DNA, 36 bp, Artificial Sequence
  Synthetic oligonucleotide
tcactccgccgattgccacccgttacccagatatga

SEQ ID NO: 115394 - DNA, 35 bp, Artificial Sequence
  Synthetic oligonucleotide
tgcgcagtgattccgctcctgtccgctgcctttcc

SEQ ID NO: 115395 - DNA, 36 bp, Artificial Sequence
  Synthetic oligonucleotide
acccgccacccttatataatgtctcgtcccaaggca

SEQ ID NO: 115396 - DNA, 35 bp, Artificial Sequence
  Synthetic oligonucleotide
ttcgaccaccgacccatctagtttgcgcccttgcc

SEQ ID NO: 115397 - DNA, 34 bp, Artificial Sequence
  Synthetic oligonucleotide
tcacgtgcgaccgacattgacctctacctctgca

SEQ ID NO: 115398 - DNA, 37 bp, Artificial Sequence
  Synthetic oligonucleotide
gtccaggctagcacagtgttcctccgccctccgccga

SEQ ID NO: 115399 - DNA, 35 bp, Artificial Sequence
  Synthetic oligonucleotide
accatccggaaccccgcccacatgaattattgtcc

SEQ ID NO: 115400 - DNA, 35 bp, Artificial Sequence
  Synthetic oligonucleotide
acccccctgctccgatccccgcacctggagcattc

SEQ ID NO: 115401 - DNA, 35 bp, Artificial Sequence
  Synthetic oligonucleotide
ggagtggccgcatccccctccttattttgtctctg

SEQ ID NO: 115402 - DNA, 35 bp, Artificial Sequence
  Synthetic oligonucleotide
tagagccgccctcctaccttcctcctgtgccacat

SEQ ID NO: 115403 - DNA, 35 bp, Artificial Sequence
  Synthetic oligonucleotide
ttgcgcagcccctgttactggcgccgctttctcct

SEQ ID NO: 115404 - DNA, 36 bp, Artificial Sequence
  Synthetic oligonucleotide
gtctgccctccattgtgtatcctgcttccgtcccca

SEQ ID NO: 115405 - DNA, 37 bp, Artificial Sequence
  Synthetic oligonucleotide
gacgcccccccacccaccgaccagagagagccatcga

SEQ ID NO: 115406 - DNA, 35 bp, Artificial Sequence
  Synthetic oligonucleotide
gatgggtaggggaggggtgtgcctaagggcaagta

SEQ ID NO: 115407 - DNA, 35 bp, Artificial Sequence
  Synthetic oligonucleotide
acgcgctctcctcttgctgatcttcgtgtctcgta

SEQ ID NO: 115408 - DNA, 35 bp, Artificial Sequence
  Synthetic oligonucleotide
tgcgcgccaattgactctcgcccgcccttctccct

SEQ ID NO: 115409 - DNA, 35 bp, Artificial Sequence
  Synthetic oligonucleotide
tccacggagccccctcttggctgtctatatttcct

SEQ ID NO: 115410 - DNA, 36 bp, Artificial Sequence
  Synthetic oligonucleotide
gtctccaccccactgagtatctattacccccccgga

SEQ ID NO: 115411 - DNA, 34 bp, Artificial Sequence
  Synthetic oligonucleotide
tacatgcccgcttcccttctttctccggcctgga

SEQ ID NO: 115412 - DNA, 37 bp, Artificial Sequence
  Synthetic oligonucleotide
accaccctcacccgcccttgcagcgtttcccacttga

SEQ ID NO: 115413 - DNA, 38 bp, Artificial Sequence
  Synthetic oligonucleotide
aacaccacgcgcccatctcgtacatgacccacctttga

SEQ ID NO: 115414 - DNA, 36 bp, Artificial Sequence
  Synthetic oligonucleotide
tgaccacgcgcttcctctcgtctattgcccgcgcta

SEQ ID NO: 115415 - DNA, 35 bp, Artificial Sequence
  Synthetic oligonucleotide
tcttacgccgaactctacaccctcctgtcctgggg

SEQ ID NO: 115416 - DNA, 37 bp, Artificial Sequence
  Synthetic oligonucleotide
acgaaaggggagggatgggcatggggtggacatcaga

SEQ ID NO: 115417 - DNA, 36 bp, Artificial Sequence
  Synthetic oligonucleotide
agacccccctccatagtatcagcattgcacccctga

SEQ ID NO: 115418 - DNA, 36 bp, Artificial Sequence
  Synthetic oligonucleotide
ggaccgtgccacaagccttgcccaccgccccattga

SEQ ID NO: 115419 - DNA, 35 bp, Artificial Sequence
  Synthetic oligonucleotide
ttcacgcaccgccgcaccactttaccgacctcata

SEQ ID NO: 115420 - DNA, 35 bp, Artificial Sequence
  Synthetic oligonucleotide
ttgggcgctcaccagcctctgatcacacctccacc

SEQ ID NO: 115421 - DNA, 35 bp, Artificial Sequence
  Synthetic oligonucleotide
gtacttcgcccctaatgctaaccgggtccctgttc

SEQ ID NO: 115422 - DNA, 35 bp, Artificial Sequence
  Synthetic oligonucleotide
gaagggtaaggggagggaggtgtgtgatggcgtgg

SEQ ID NO: 115423 - DNA, 35 bp, Artificial Sequence
  Synthetic oligonucleotide
tcagtcacccagctgctgtccactacctgtactat

SEQ ID NO: 115424 - DNA, 36 bp, Artificial Sequence
  Synthetic oligonucleotide
agcaaccgcgaactgcttatccctgtcactcgatca

SEQ ID NO: 115425 - DNA, 36 bp, Artificial Sequence
  Synthetic oligonucleotide
gatcagcccccgccgctttaccgccacctgcgacga

SEQ ID NO: 115426 - DNA, 36 bp, Artificial Sequence
  Synthetic oligonucleotide
acaccacccgtcccgctgctttccggcctagcttga

SEQ ID NO: 115427 - DNA, 36 bp, Artificial Sequence
  Synthetic oligonucleotide
gacctcccaccgatctgctctgctttgttctaccta

SEQ ID NO: 115428 - DNA, 36 bp, Artificial Sequence
  Synthetic oligonucleotide
tcgcaaggtcgccgtttctcacccgccgccttttta

SEQ ID NO: 115429 - DNA, 35 bp, Artificial Sequence
  Synthetic oligonucleotide
gcccacttcatccgcggttgttaacatgctccacc

SEQ ID NO: 115430 - DNA, 35 bp, Artificial Sequence
  Synthetic oligonucleotide
atcgcctccccggaatctcgcagactgatccacct

SEQ ID NO: 115431 - DNA, 37 bp, Artificial Sequence
  Synthetic oligonucleotide
tctagcgcatcatctgcttagtgccccccgttttcga

SEQ ID NO: 115432 - DNA, 37 bp, Artificial Sequence
  Synthetic oligonucleotide
gtgcacgtccatctgactccgcgctgcttcccattga

SEQ ID NO: 115433 - DNA, 35 bp, Artificial Sequence
  Synthetic oligonucleotide
acgaccatggccatatagctacactcttccctccg

SEQ ID NO: 115434 - DNA, 34 bp, Artificial Sequence
  Synthetic oligonucleotide
ttgagcctccaactgcccccctactgttttacga

SEQ ID NO: 115435 - DNA, 36 bp, Artificial Sequence
  Synthetic oligonucleotide
acacccgccgtttctggtccacacttatgcacacta

SEQ ID NO: 115436 - DNA, 36 bp, Artificial Sequence
  Synthetic oligonucleotide
ggagtaggaggaagggcaggggagggtacagcacta

SEQ ID NO: 115437 - DNA, 35 bp, Artificial Sequence
  Synthetic oligonucleotide
tcagccgaaagtccggagggggtggaggaggggcg

SEQ ID NO: 115438 - DNA, 35 bp, Artificial Sequence
  Synthetic oligonucleotide
gaggcgccgtccatggttcttccccctttgcgcct

SEQ ID NO: 115439 - DNA, 35 bp, Artificial Sequence
  Synthetic oligonucleotide
acgcccccccggttctattggccctcgacgtagct

SEQ ID NO: 115440 - DNA, 35 bp, Artificial Sequence
  Synthetic oligonucleotide
atagccacctcgttctgtggcacctgttcactctt

SEQ ID NO: 115441 - DNA, 37 bp, Artificial Sequence
  Synthetic oligonucleotide
agtaagagaaggagtggggggggcggaatgagaggga

SEQ ID NO: 115442 - DNA, 37 bp, Artificial Sequence
  Synthetic oligonucleotide
tagtcgccccctctctggccctgtaccatgtctttga

SEQ ID NO: 115443 - DNA, 35 bp, Artificial Sequence
  Synthetic oligonucleotide
tgatctgcccgctcctttggcccctgataaccctg

SEQ ID NO: 115444 - DNA, 35 bp, Artificial Sequence
  Synthetic oligonucleotide
atagccacagtcaacgacccctctcgctccgccct

SEQ ID NO: 115445 - DNA, 36 bp, Artificial Sequence
  Synthetic oligonucleotide
tgcccgaccctgcgtaatactgcctctcgtaaccaa

SEQ ID NO: 115446 - DNA, 36 bp, Artificial Sequence
  Synthetic oligonucleotide
gtgcccactgggcattatcacactttcctcaccgaa

SEQ ID NO: 115447 - DNA, 37 bp, Artificial Sequence
  Synthetic oligonucleotide
gcatacgagggagaaggagaggaggcggggctaatga

SEQ ID NO: 115448 - DNA, 34 bp, Artificial Sequence
  Synthetic oligonucleotide
gctgtgaatcggagattccgcccatcgcccctcc

SEQ ID NO: 115449 - DNA, 35 bp, Artificial Sequence
  Synthetic oligonucleotide
gcatcgatcacaatcgtactctgctttccatctgc

SEQ ID NO: 115450 - DNA, 35 bp, Artificial Sequence
  Synthetic oligonucleotide
gtcaaccagcccctgtcccgaactcagtgctcccg

SEQ ID NO: 115451 - DNA, 36 bp, Artificial Sequence
  Synthetic oligonucleotide
tgagcgcggacagcccttcctcttcgccttgttcca

SEQ ID NO: 115452 - DNA, 37 bp, Artificial Sequence
  Synthetic oligonucleotide
gtccgcctttccgctctggtatatcttccccccgtga

SEQ ID NO: 115453 - DNA, 36 bp, Artificial Sequence
  Synthetic oligonucleotide
acaggagcgccaagccgcctttgatcatgcccccca

SEQ ID NO: 115454 - DNA, 38 bp, Artificial Sequence
  Synthetic oligonucleotide
acgagcggagggagggcggtggggcggtatacgtatga

SEQ ID NO: 115455 - DNA, 37 bp, Artificial Sequence
  Synthetic oligonucleotide
tgaccgtagttcgatctttgcgccacccctgtcttga

SEQ ID NO: 115456 - DNA, 36 bp, Artificial Sequence
  Synthetic oligonucleotide
gccgggccgccacgcaccccctgtcactaccctgta

SEQ ID NO: 115457 - DNA, 35 bp, Artificial Sequence
  Synthetic oligonucleotide
gcaggacctcctttgccccccgcgtgcctgtcttc

SEQ ID NO: 115458 - DNA, 35 bp, Artificial Sequence
  Synthetic oligonucleotide
tccaccctcgcctgagccaggaggtaacctcctct

SEQ ID NO: 115459 - DNA, 35 bp, Artificial Sequence
  Synthetic oligonucleotide
ctcgaacgccggatcatactcgcgctttattccca

SEQ ID NO: 115460 - DNA, 37 bp, Artificial Sequence
  Synthetic oligonucleotide
ttgccaccccaatattcttcacctgccgcctaatcga

SEQ ID NO: 115461 - DNA, 35 bp, Artificial Sequence
  Synthetic oligonucleotide
gactcctcataaagtgcgcgtgccccgtacccccc

SEQ ID NO: 115462 - DNA, 35 bp, Artificial Sequence
  Synthetic oligonucleotide
aagcagtccgccacatcgtcctagctacttatcct

SEQ ID NO: 115463 - DNA, 37 bp, Artificial Sequence
  Synthetic oligonucleotide
ttcgcgtaacgcctccgatccagctccccgtgcccga

SEQ ID NO: 115464 - DNA, 35 bp, Artificial Sequence
  Synthetic oligonucleotide
gcatccccacgaccccggcacattccctttctctg

SEQ ID NO: 115465 - DNA, 35 bp, Artificial Sequence
  Synthetic oligonucleotide
tgccgcagttgtccccgtccccgccgcatgctgac

SEQ ID NO: 115466 - DNA, 35 bp, Artificial Sequence
  Synthetic oligonucleotide
tacacgcccccagccagccgactgctatatccccc

SEQ ID NO: 115467 - DNA, 35 bp, Artificial Sequence
  Synthetic oligonucleotide
ggacagacccccatgataccgatccacgccccagt

SEQ ID NO: 115468 - DNA, 35 bp, Artificial Sequence
  Synthetic oligonucleotide
accacttccctcgcatggttacgcattgcaattcc

SEQ ID NO: 115469 - DNA, 35 bp, Artificial Sequence
  Synthetic oligonucleotide
tcgcacaccgacgaacgctcctgtcacgctacgcc

SEQ ID NO: 115470 - DNA, 35 bp, Artificial Sequence
  Synthetic oligonucleotide
ttcgcaacatcatgcctcgtccctcgaaaccccat

SEQ ID NO: 115471 - DNA, 36 bp, Artificial Sequence
  Synthetic oligonucleotide
gccgcatgcctgtttaccgcccacctatgttcgcct

SEQ ID NO: 115472 - DNA, 35 bp, Artificial Sequence
  Synthetic oligonucleotide
gatggggaacgaccgggggaaagggtgtgaggcca

SEQ ID NO: 115473 - DNA, 37 bp, Artificial Sequence
  Synthetic oligonucleotide
tgccgacggtcttccatgtttcgttcttccgctccga

SEQ ID NO: 115474 - DNA, 38 bp, Artificial Sequence
  Synthetic oligonucleotide
tgacggtgaccggggcggggataaaaggggggaagtga

SEQ ID NO: 115475 - DNA, 37 bp, Artificial Sequence
  Synthetic oligonucleotide
acgagagagggggggggttagaagccggtgaggttga

SEQ ID NO: 115476 - DNA, 35 bp, Artificial Sequence
  Synthetic oligonucleotide
tcccatccaagactttagtagtggccccgctcctc

SEQ ID NO: 115477 - DNA, 36 bp, Artificial Sequence
  Synthetic oligonucleotide
tcatcccatctcgtcgcatattttggtgtcgctcca

SEQ ID NO: 115478 - DNA, 35 bp, Artificial Sequence
  Synthetic oligonucleotide
acacgatcaccttcacatgcacgaagccacttctc

SEQ ID NO: 115479 - DNA, 35 bp, Artificial Sequence
  Synthetic oligonucleotide
ggtctacctccactcgtgattcgtttgcctcgttc

SEQ ID NO: 115480 - DNA, 36 bp, Artificial Sequence
  Synthetic oligonucleotide
gcccactacacgtgccaacggtcattctctctccga

SEQ ID NO: 115481 - DNA, 35 bp, Artificial Sequence
  Synthetic oligonucleotide
gcgctactgccctgcccacatggtcgttactgccc

SEQ ID NO: 115482 - DNA, 35 bp, Artificial Sequence
  Synthetic oligonucleotide
gtcaccctcttttgccgtactaaccgatcaacctg

SEQ ID NO: 115483 - DNA, 35 bp, Artificial Sequence
  Synthetic oligonucleotide
gctccaaccgctgcatggcctcccgtcccgcgatt

SEQ ID NO: 115484 - DNA, 35 bp, Artificial Sequence
  Synthetic oligonucleotide
gactccaccgtcgcacgccctctattgttgtccac

SEQ ID NO: 115485 - DNA, 36 bp, Artificial Sequence
  Synthetic oligonucleotide
tccaccgctcaaaagtcgccgcgccccccctttgta

SEQ ID NO: 115486 - DNA, 35 bp, Artificial Sequence
  Synthetic oligonucleotide
gacgaccgccatcgcgtaaattctagccgtttttc

SEQ ID NO: 115487 - DNA, 35 bp, Artificial Sequence
  Synthetic oligonucleotide
ttgagtggaccacagggagaatcggagggaggggg

SEQ ID NO: 115488 - DNA, 37 bp, Artificial Sequence
  Synthetic oligonucleotide
aagaggggaactaatggcgcctggggagggttgggga

SEQ ID NO: 115489 - DNA, 37 bp, Artificial Sequence
  Synthetic oligonucleotide
gataggacaagagaggacaaaggggtgggcgacacga

SEQ ID NO: 115490 - DNA, 37 bp, Artificial Sequence
  Synthetic oligonucleotide
agagaagcagaaggggaagggagttgctggaagggga

SEQ ID NO: 115491 - DNA, 35 bp, Artificial Sequence
  Synthetic oligonucleotide
tccatcgcacccactcctccaggctgccacaacgc

SEQ ID NO: 115492 - DNA, 35 bp, Artificial Sequence
  Synthetic oligonucleotide
gcctacatcctcggttaaagctgcctttttcctgc

SEQ ID NO: 115493 - DNA, 34 bp, Artificial Sequence
  Synthetic oligonucleotide
gacttccccacgcctctcgcgatgcactacaccg

SEQ ID NO: 115494 - DNA, 35 bp, Artificial Sequence
  Synthetic oligonucleotide
ttccccgccagataccgcacgccaccttacaccat

SEQ ID NO: 115495 - DNA, 37 bp, Artificial Sequence
  Synthetic oligonucleotide
aacgccagagaagagggggggtaggcatgaggcggga

SEQ ID NO: 115496 - DNA, 38 bp, Artificial Sequence
  Synthetic oligonucleotide
acgccaccttctcctttgtactttgcccatccctctga

SEQ ID NO: 115497 - DNA, 35 bp, Artificial Sequence
  Synthetic oligonucleotide
ggggagtacgggcgggtgggaggtgcacgtaggta

SEQ ID NO: 115498 - DNA, 35 bp, Artificial Sequence
  Synthetic oligonucleotide
gctgcacggaacgccggaaggcccctcccatcctc

SEQ ID NO: 115499 - DNA, 35 bp, Artificial Sequence
  Synthetic oligonucleotide
ttcccgggccatctggtctatcatcctgcttcccg

SEQ ID NO: 115500 - DNA, 35 bp, Artificial Sequence
  Synthetic oligonucleotide
accaacaggtcggcttctcctgcaatcgttgccct

SEQ ID NO: 115501 - DNA, 36 bp, Artificial Sequence
  Synthetic oligonucleotide
aacgcacctctttggtagtactcctcgtccccctca

SEQ ID NO: 115502 - DNA, 35 bp, Artificial Sequence
  Synthetic oligonucleotide
tgtggaccaccactgtactcatacctaccgtttca

SEQ ID NO: 115503 - DNA, 37 bp, Artificial Sequence
  Synthetic oligonucleotide
aaggggcgaacgctggggtgggtgccgagaccgggga

SEQ ID NO: 115504 - DNA, 35 bp, Artificial Sequence
  Synthetic oligonucleotide
taccatgctccacgcgtccgccacctccgaccgcc

SEQ ID NO: 115505 - DNA, 35 bp, Artificial Sequence
  Synthetic oligonucleotide
tgatcggtgcctgtccgactaaagcccttccctgc

SEQ ID NO: 115506 - DNA, 36 bp, Artificial Sequence
  Synthetic oligonucleotide
agtggcgaacgggagggggtagttgggcgtggagga

SEQ ID NO: 115507 - DNA, 35 bp, Artificial Sequence
  Synthetic oligonucleotide
gacccattccagatgttacacccgttccgttgcac

SEQ ID NO: 115508 - DNA, 35 bp, Artificial Sequence
  Synthetic oligonucleotide
gtagtacccgagtcatccctcccgcttgcgtttcc

SEQ ID NO: 115509 - DNA, 35 bp, Artificial Sequence
  Synthetic oligonucleotide
tgtcactccgcagtcctcccccctccgatggcatg

SEQ ID NO: 115510 - DNA, 35 bp, Artificial Sequence
  Synthetic oligonucleotide
gacccacaccttcgcttgaatcacacccttagggt

SEQ ID NO: 115511 - DNA, 35 bp, Artificial Sequence
  Synthetic oligonucleotide
gaggggggaaggggagtgacggaaattcagcgggt

SEQ ID NO: 115512 - DNA, 36 bp, Artificial Sequence
  Synthetic oligonucleotide
atagacagggagagacacaggaaagagaggtgggaa

SEQ ID NO: 115513 - DNA, 35 bp, Artificial Sequence
  Synthetic oligonucleotide
atcgattccccacccgcctgttgttcacacctata

SEQ ID NO: 115514 - DNA, 35 bp, Artificial Sequence
  Synthetic oligonucleotide
accccgccccttttgaccgtcgtactccatctgtt

SEQ ID NO: 115515 - DNA, 36 bp, Artificial Sequence
  Synthetic oligonucleotide
tgtccgtcactattcctatctgcccctgtttaccaa

SEQ ID NO: 115516 - DNA, 35 bp, Artificial Sequence
  Synthetic oligonucleotide
aaccatcgcccacttttttcacagcattatcccta

SEQ ID NO: 115517 - DNA, 35 bp, Artificial Sequence
  Synthetic oligonucleotide
ggactaccgcctcctcccgcgcgcctctcacatgc

SEQ ID NO: 115518 - DNA, 35 bp, Artificial Sequence
  Synthetic oligonucleotide
gagacccgggatgggggagggaggggcacattcag

SEQ ID NO: 115519 - DNA, 35 bp, Artificial Sequence
  Synthetic oligonucleotide
tgcactcgtcgcccttggctgtccatcccgtttcg

SEQ ID NO: 115520 - DNA, 35 bp, Artificial Sequence
  Synthetic oligonucleotide
cctgacgccactgccctgatccaccgaacgcctct

SEQ ID NO: 115521 - DNA, 35 bp, Artificial Sequence
  Synthetic oligonucleotide
gcaacatctatgtcgcatcggcctcctacccccgc

SEQ ID NO: 115522 - DNA, 35 bp, Artificial Sequence
  Synthetic oligonucleotide
tccgcctgcacctgttctcactttgcctgtctcgc

SEQ ID NO: 115523 - DNA, 35 bp, Artificial Sequence
  Synthetic oligonucleotide
atgttctgtccgcactctcaagtcactgcccctcg

SEQ ID NO: 115524 - DNA, 35 bp, Artificial Sequence
  Synthetic oligonucleotide
tcactcacctccaatgattatcctgctcgtacgct

SEQ ID NO: 115525 - DNA, 35 bp, Artificial Sequence
  Synthetic oligonucleotide
gtcacccccctactcggttagccctttctctcggt

SEQ ID NO: 115526 - DNA, 34 bp, Artificial Sequence
  Synthetic oligonucleotide
tcctctaccgccgcccctgcatccgcactattaa

SEQ ID NO: 115527 - DNA, 37 bp, Artificial Sequence
  Synthetic oligonucleotide
ttagggcacatccatctggttccagcatcccccccga

SEQ ID NO: 115528 - DNA, 37 bp, Artificial Sequence
  Synthetic oligonucleotide
tccgcccccccagcgagaattcaggccttgtccctga

SEQ ID NO: 115529 - DNA, 36 bp, Artificial Sequence
  Synthetic oligonucleotide
atcgccggccccaacaccatgttatcgccatccata

SEQ ID NO: 115530 - DNA, 34 bp, Artificial Sequence
  Synthetic oligonucleotide
ttcgactcccacacccctgttggctggctcactc

SEQ ID NO: 115531 - DNA, 35 bp, Artificial Sequence
  Synthetic oligonucleotide
gccccagcccatatctcactcgtttacctggccca

SEQ ID NO: 115532 - DNA, 35 bp, Artificial Sequence
  Synthetic oligonucleotide
tgtaacctccctggcataggcacccttacctcgcc

SEQ ID NO: 115533 - DNA, 35 bp, Artificial Sequence
  Synthetic oligonucleotide
gttcacgtccgcgctcgacccccccgtcactttgg

SEQ ID NO: 115534 - DNA, 36 bp, Artificial Sequence
  Synthetic oligonucleotide
tcgcaatcccacccgtcctccatgtgtaccgcccca

SEQ ID NO: 115535 - DNA, 35 bp, Artificial Sequence
  Synthetic oligonucleotide
gatcccccgctacatggtgcacattcccacatcca

SEQ ID NO: 115536 - DNA, 38 bp, Artificial Sequence
  Synthetic oligonucleotide
gagagggaggaggggaataggacagccggggatcgtga

SEQ ID NO: 115537 - DNA, 35 bp, Artificial Sequence
  Synthetic oligonucleotide
tatccacacccagtctattactcactgtttgcacc

SEQ ID NO: 115538 - DNA, 35 bp, Artificial Sequence
  Synthetic oligonucleotide
ttcgtagccccgcacactatctacaccgccgtgcc

SEQ ID NO: 115539 - DNA, 35 bp, Artificial Sequence
  Synthetic oligonucleotide
aaccccagccccaggtcactcgtaaacccccgttc

SEQ ID NO: 115540 - DNA, 35 bp, Artificial Sequence
  Synthetic oligonucleotide
gttgtgccccatgccgcccattaggtgccccatct

SEQ ID NO: 115541 - DNA, 35 bp, Artificial Sequence
  Synthetic oligonucleotide
gcgctcccacctgctcgtctccccagggatgaacc

SEQ ID NO: 115542 - DNA, 36 bp, Artificial Sequence
  Synthetic oligonucleotide
atcgcacgtgatttaatttctgtcgccccgtttcca

SEQ ID NO: 115543 - DNA, 37 bp, Artificial Sequence
  Synthetic oligonucleotide
tcccgcccgctgttactccctcgtcctggccacccga

SEQ ID NO: 115544 - DNA, 35 bp, Artificial Sequence
  Synthetic oligonucleotide
tccatcccagttgcgcactttctcctctcattaac

SEQ ID NO: 115545 - DNA, 36 bp, Artificial Sequence
  Synthetic oligonucleotide
agtggggaggcgaggaggggtggtgggtctccggca

SEQ ID NO: 115546 - DNA, 36 bp, Artificial Sequence
  Synthetic oligonucleotide
ggaacaagaggaggggggacataagggagtaaaacg

SEQ ID NO: 115547 - DNA, 35 bp, Artificial Sequence
  Synthetic oligonucleotide
acagccggtaccgccttgttgctactccttccgct

SEQ ID NO: 115548 - DNA, 36 bp, Artificial Sequence
  Synthetic oligonucleotide
tcctgcccgcctcgacgtatcagctatactacccca

SEQ ID NO: 115549 - DNA, 37 bp, Artificial Sequence
  Synthetic oligonucleotide
tcacagccacacccatccctgttcgcgttatcaccga

SEQ ID NO: 115550 - DNA, 36 bp, Artificial Sequence
  Synthetic oligonucleotide
agcagagaaggagggaggaggagggggaatcgtgga

SEQ ID NO: 115551 - DNA, 35 bp, Artificial Sequence
  Synthetic oligonucleotide
ttttgcccgcctcctgtctctgcaacatttctctc

SEQ ID NO: 115552 - DNA, 35 bp, Artificial Sequence
  Synthetic oligonucleotide
tcagcggtacagtctcggtcttgcttctctccttc

SEQ ID NO: 115553 - DNA, 35 bp, Artificial Sequence
  Synthetic oligonucleotide
ttcaaacccgccctacccgtatgtctatggttcca

SEQ ID NO: 115554 - DNA, 35 bp, Artificial Sequence
  Synthetic oligonucleotide
acaatgggggggagggggggctggataggtggaac

SEQ ID NO: 115555 - DNA, 35 bp, Artificial Sequence
  Synthetic oligonucleotide
ttgatcgcggctgagcctttgctacactcctccgt

SEQ ID NO: 115556 - DNA, 37 bp, Artificial Sequence
  Synthetic oligonucleotide
tcccgcattcgcccgctgccgctatatatccttttga

SEQ ID NO: 115557 - DNA, 35 bp, Artificial Sequence
  Synthetic oligonucleotide
tcaccagtcgacctgctcctttaaccattccttcc

SEQ ID NO: 115558 - DNA, 35 bp, Artificial Sequence
  Synthetic oligonucleotide
gtcccgccgcaccctctttcaactccatgggcctc

SEQ ID NO: 115559 - DNA, 35 bp, Artificial Sequence
  Synthetic oligonucleotide
gtgagatgtgtcactcgttgttcccttagtccgtc

SEQ ID NO: 115560 - DNA, 35 bp, Artificial Sequence
  Synthetic oligonucleotide
gtacgccccaaggggtaactgctaccatccttcca

SEQ ID NO: 115561 - DNA, 35 bp, Artificial Sequence
  Synthetic oligonucleotide
tgcacaatcagtccgtacccttcgtgtccacccac

SEQ ID NO: 115562 - DNA, 35 bp, Artificial Sequence
  Synthetic oligonucleotide
gccattgccgactcccagacttcctgaccgctgcc

SEQ ID NO: 115563 - DNA, 35 bp, Artificial Sequence
  Synthetic oligonucleotide
atctaccgggcctttctgttcgatcaccctcctgc

SEQ ID NO: 115564 - DNA, 35 bp, Artificial Sequence
  Synthetic oligonucleotide
tgacccatctgcccagtgccgtcttcaccgctatc

SEQ ID NO: 115565 - DNA, 35 bp, Artificial Sequence
  Synthetic oligonucleotide
aatgtaccgcgcgttgtctgcccttctccaccctg

SEQ ID NO: 115566 - DNA, 37 bp, Artificial Sequence
  Synthetic oligonucleotide
actgtccgcccggaacgttttcccactccccctcgga

SEQ ID NO: 115567 - DNA, 35 bp, Artificial Sequence
  Synthetic oligonucleotide
acaggctcgccctctgaccgtcgctacacctctcg

SEQ ID NO: 115568 - DNA, 35 bp, Artificial Sequence
  Synthetic oligonucleotide
tcccacgcgttcacgcgcgtatgatccccctcctg

SEQ ID NO: 115569 - DNA, 35 bp, Artificial Sequence
  Synthetic oligonucleotide
gccaagccgactttgccgcaccatccgaccctcgt

SEQ ID NO: 115570 - DNA, 37 bp, Artificial Sequence
  Synthetic oligonucleotide
ttcatgcagccgaccttgtaacgccccccgcctttga

SEQ ID NO: 115571 - DNA, 37 bp, Artificial Sequence
  Synthetic oligonucleotide
atcgcaccactcatcttttcatcgcacacctcgtaga

SEQ ID NO: 115572 - DNA, 36 bp, Artificial Sequence
  Synthetic oligonucleotide
atcgaccgccctttctccgtaacgaagccctcccga

SEQ ID NO: 115573 - DNA, 36 bp, Artificial Sequence
  Synthetic oligonucleotide
gatcccctcctatgaacgcccagtcccatgacccga

SEQ ID NO: 115574 - DNA, 35 bp, Artificial Sequence
  Synthetic oligonucleotide
tgctgtccctcatttgcttctgttcgtcgcatcta

SEQ ID NO: 115575 - DNA, 35 bp, Artificial Sequence
  Synthetic oligonucleotide
gcgatcgctcccattgcggtccagttccttcctta

SEQ ID NO: 115576 - DNA, 35 bp, Artificial Sequence
  Synthetic oligonucleotide
tgctacctcatagccgccgataccattccgtacct

SEQ ID NO: 115577 - DNA, 35 bp, Artificial Sequence
  Synthetic oligonucleotide
gaacagctccatgccccccccgcatccggccactt

SEQ ID NO: 115578 - DNA, 35 bp, Artificial Sequence
  Synthetic oligonucleotide
gtttgcgtccgtctccctacccgcccgttatgcca

SEQ ID NO: 115579 - DNA, 36 bp, Artificial Sequence
  Synthetic oligonucleotide
taggtgcgggggagggggggggaactaagggcagca

SEQ ID NO: 115580 - DNA, 35 bp, Artificial Sequence
  Synthetic oligonucleotide
gcttgctgtgggggcggggaggggacgagggagga

SEQ ID NO: 115581 - DNA, 35 bp, Artificial Sequence
  Synthetic oligonucleotide
gtgagccgtcattggctccagatccaccaactgcc

SEQ ID NO: 115582 - DNA, 35 bp, Artificial Sequence
  Synthetic oligonucleotide
gtccccagacgtgcttccccctgagtataccttcc

SEQ ID NO: 115583 - DNA, 35 bp, Artificial Sequence
  Synthetic oligonucleotide
tgatgtgtaggccgctgcgttgcgcctgtccccct

SEQ ID NO: 115584 - DNA, 35 bp, Artificial Sequence
  Synthetic oligonucleotide
actggagcctgcctgccccccccatcccgccggtt

SEQ ID NO: 115585 - DNA, 36 bp, Artificial Sequence
  Synthetic oligonucleotide
taaccgagtaggcggaggggggggtaggggcactaa

SEQ ID NO: 115586 - DNA, 37 bp, Artificial Sequence
  Synthetic oligonucleotide
gactggtgtgagggaacggagtggagggacgggggga

SEQ ID NO: 115587 - DNA, 35 bp, Artificial Sequence
  Synthetic oligonucleotide
gtgtcccgcctccaccttcacttgttactatatcg

SEQ ID NO: 115588 - DNA, 37 bp, Artificial Sequence
  Synthetic oligonucleotide
ttgtcgggcgggaagtgtgtgtactatttgggaggga

SEQ ID NO: 115589 - DNA, 35 bp, Artificial Sequence
  Synthetic oligonucleotide
gcacgcacccggccacacgtaactgccttcccgcc

SEQ ID NO: 115590 - DNA, 35 bp, Artificial Sequence
  Synthetic oligonucleotide
gccacctgcccctccttccatcgacccatggtatc

SEQ ID NO: 115591 - DNA, 35 bp, Artificial Sequence
  Synthetic oligonucleotide
ccccgctctctccgtgcatccaccgcctcactcaa

SEQ ID NO: 115592 - DNA, 36 bp, Artificial Sequence
  Synthetic oligonucleotide
ggagacagtggggcatggggagcgaggggaatcata

SEQ ID NO: 115593 - DNA, 35 bp, Artificial Sequence
  Synthetic oligonucleotide
gttccacctccatgcttggccggcactttaatgcc

SEQ ID NO: 115594 - DNA, 35 bp, Artificial Sequence
  Synthetic oligonucleotide
tcacacactctgtcgccgtcccaatccagccccgc

SEQ ID NO: 115595 - DNA, 35 bp, Artificial Sequence
  Synthetic oligonucleotide
tcccctgcacccagccgctgtcctgctacgcacat

SEQ ID NO: 115596 - DNA, 35 bp, Artificial Sequence
  Synthetic oligonucleotide
tgccaccccaatttcgacctgctgttactcatgtt

SEQ ID NO: 115597 - DNA, 35 bp, Artificial Sequence
  Synthetic oligonucleotide
agagcctgcccccatgtctagcacccactatgtcc

SEQ ID NO: 115598 - DNA, 35 bp, Artificial Sequence
  Synthetic oligonucleotide
tcccgcccccatcgtcgtgaaagttttcccttcag

SEQ ID NO: 115599 - DNA, 36 bp, Artificial Sequence
  Synthetic oligonucleotide
ttggtcttgttacgtgcatcccctgtacccatccta

SEQ ID NO: 115600 - DNA, 35 bp, Artificial Sequence
  Synthetic oligonucleotide
tttgtccacgcgcagtgttgcacttattcgcccct

SEQ ID NO: 115601 - DNA, 36 bp, Artificial Sequence
  Synthetic oligonucleotide
gcgaccctgacaggagaggggggggaagggggctaa

SEQ ID NO: 115602 - DNA, 36 bp, Artificial Sequence
  Synthetic oligonucleotide
agatcgctccactgccctgttagttgctacacctca

SEQ ID NO: 115603 - DNA, 38 bp, Artificial Sequence
  Synthetic oligonucleotide
acccctctcgcccatgcagtatgctgccttcctcgtga

SEQ ID NO: 115604 - DNA, 35 bp, Artificial Sequence
  Synthetic oligonucleotide
tctcacaccatctggcatagactaggcccccatcc

SEQ ID NO: 115605 - DNA, 31 bp, Artificial Sequence
  Synthetic oligonucleotide
agccccctgctccctacgtctcctttcatga

SEQ ID NO: 115606 - DNA, 38 bp, Artificial Sequence
  Synthetic oligonucleotide
tcagactcccacatgttcgtttatctgcccctctgtga

SEQ ID NO: 115607 - DNA, 35 bp, Artificial Sequence
  Synthetic oligonucleotide
atccgcctccaatgtccttggaccacaaccctaac

SEQ ID NO: 115608 - DNA, 36 bp, Artificial Sequence
  Synthetic oligonucleotide
tgttgcccctcagtatgtcgacctcgccccccccca

SEQ ID NO: 115609 - DNA, 36 bp, Artificial Sequence
  Synthetic oligonucleotide
gccatatgcttagctgcccgttacgtccactctcca

SEQ ID NO: 115610 - DNA, 35 bp, Artificial Sequence
  Synthetic oligonucleotide
gtgtgcgtagagttcgttcctcgccgacctgttcc

SEQ ID NO: 115611 - DNA, 35 bp, Artificial Sequence
  Synthetic oligonucleotide
atgggaagggagcacggggagggtggagccagaag

SEQ ID NO: 115612 - DNA, 35 bp, Artificial Sequence
  Synthetic oligonucleotide
aagcccacattacgtgccatcccatctcttgcgcg

SEQ ID NO: 115613 - DNA, 36 bp, Artificial Sequence
  Synthetic oligonucleotide
tacccacgacccccgccttgtctgaagtgcgccctt

SEQ ID NO: 115614 - DNA, 35 bp, Artificial Sequence
  Synthetic oligonucleotide
gtccgttgctccgtgcgcttttgccgtttcacttt

SEQ ID NO: 115615 - DNA, 36 bp, Artificial Sequence
  Synthetic oligonucleotide
actgcagacaaaataggggtagcacgggcgggggaa

SEQ ID NO: 115616 - DNA, 36 bp, Artificial Sequence
  Synthetic oligonucleotide
aatggggggaggtgggaagtgagacagggggcgaga

SEQ ID NO: 115617 - DNA, 36 bp, Artificial Sequence
  Synthetic oligonucleotide
taggtcgcgcgctccttcattggccatgttccccta

SEQ ID NO: 115618 - DNA, 35 bp, Artificial Sequence
  Synthetic oligonucleotide
gaggaggcctagggggtgtcgacggaggggggtcg

SEQ ID NO: 115619 - DNA, 35 bp, Artificial Sequence
  Synthetic oligonucleotide
tgtgggtcaacgccctttcacactgcccctgcctt

SEQ ID NO: 115620 - DNA, 35 bp, Artificial Sequence
  Synthetic oligonucleotide
tcgcccggtccctctatgagcttttttgtcacgtc

SEQ ID NO: 115621 - DNA, 35 bp, Artificial Sequence
  Synthetic oligonucleotide
tcacacccttcttacgttctttacacggtcacttc

SEQ ID NO: 115622 - DNA, 36 bp, Artificial Sequence
  Synthetic oligonucleotide
gtgaagggaaagggggtgcaagaaaaataggaaaaa

SEQ ID NO: 115623 - DNA, 35 bp, Artificial Sequence
  Synthetic oligonucleotide
gccaccgccggcgtagttttcttgttcgttttcgc

SEQ ID NO: 115624 - DNA, 35 bp, Artificial Sequence
  Synthetic oligonucleotide
acccccctcgcagtctacgcagcattaccccgtgc

SEQ ID NO: 115625 - DNA, 35 bp, Artificial Sequence
  Synthetic oligonucleotide
ttcgtcggagctgccccaactgccaccgttacctc

SEQ ID NO: 115626 - DNA, 35 bp, Artificial Sequence
  Synthetic oligonucleotide
gacacccgtcgtctccctcgaccctctactgttcg

SEQ ID NO: 115627 - DNA, 35 bp, Artificial Sequence
  Synthetic oligonucleotide
tgtgctacccgtcccctccccatcggtttaccctg

SEQ ID NO: 115628 - DNA, 32 bp, Artificial Sequence
  Synthetic oligonucleotide
tcccatgtgttcccagtgctgtcccttctcca

SEQ ID NO: 115629 - DNA, 38 bp, Artificial Sequence
  Synthetic oligonucleotide
acccttcgccgcctggctcgtaagccaatccaccctga

SEQ ID NO: 115630 - DNA, 35 bp, Artificial Sequence
  Synthetic oligonucleotide
acccgcccgtccacactctggcgcttaaagtttcc

SEQ ID NO: 115631 - DNA, 35 bp, Artificial Sequence
  Synthetic oligonucleotide
gccccatcgaccgtagatcactgtaacgtttcttc

SEQ ID NO: 115632 - DNA, 35 bp, Artificial Sequence
  Synthetic oligonucleotide
tgaatcatccgacccgaccgttccctagcctcgcg

SEQ ID NO: 115633 - DNA, 35 bp, Artificial Sequence
  Synthetic oligonucleotide
tgtgtactccgcccccatgataagctctgcctctg

SEQ ID NO: 115634 - DNA, 35 bp, Artificial Sequence
  Synthetic oligonucleotide
tgcccttcggctcataacctcctgcctaccccgtg

SEQ ID NO: 115635 - DNA, 35 bp, Artificial Sequence
  Synthetic oligonucleotide
ttgcccaagcccacatgcccctcgctttcttgact

SEQ ID NO: 115636 - DNA, 35 bp, Artificial Sequence
  Synthetic oligonucleotide
acgcccccacagtttctccctgcacgtgtgctact

SEQ ID NO: 115637 - DNA, 37 bp, Artificial Sequence
  Synthetic oligonucleotide
tccaccccccatggccccaatcatgcctgtgatgaga

SEQ ID NO: 115638 - DNA, 35 bp, Artificial Sequence
  Synthetic oligonucleotide
gccccgtcatatgatcacttgcatccgcccccgcc

SEQ ID NO: 115639 - DNA, 35 bp, Artificial Sequence
  Synthetic oligonucleotide
gagccgccccatgtccttgtacccgtgccactgcc

SEQ ID NO: 115640 - DNA, 35 bp, Artificial Sequence
  Synthetic oligonucleotide
tacgcacgcttgcctctcttgtatgtcctttgttc

SEQ ID NO: 115641 - DNA, 35 bp, Artificial Sequence
  Synthetic oligonucleotide
atggcctccccatccttgtgcgcgcttgtttccct

SEQ ID NO: 115642 - DNA, 35 bp, Artificial Sequence
  Synthetic oligonucleotide
accaccatcccgtctatgcgggccgttaccattct

SEQ ID NO: 115643 - DNA, 36 bp, Artificial Sequence
  Synthetic oligonucleotide
tgagcacctcccatcgcatcatttacccgccatcga

SEQ ID NO: 115644 - DNA, 35 bp, Artificial Sequence
  Synthetic oligonucleotide
ggaccccagcctcgttcttctcgtctatgttacac

SEQ ID NO: 115645 - DNA, 35 bp, Artificial Sequence
  Synthetic oligonucleotide
gcaaccccgataatgcccccgcctacatacgatcc

SEQ ID NO: 115646 - DNA, 35 bp, Artificial Sequence
  Synthetic oligonucleotide
atcgacgggcgggaggggttttcgcccatccattg

SEQ ID NO: 115647 - DNA, 36 bp, Artificial Sequence
  Synthetic oligonucleotide
gttccgccgccaccctgattgatggtcgctactcca

SEQ ID NO: 115648 - DNA, 35 bp, Artificial Sequence
  Synthetic oligonucleotide
atgaatgtgccccgcccccgtgcccgctaaaagcc

SEQ ID NO: 115649 - DNA, 35 bp, Artificial Sequence
  Synthetic oligonucleotide
acccacgttgtgtcgtcccgggcccccatttctcc

SEQ ID NO: 115650 - DNA, 37 bp, Artificial Sequence
  Synthetic oligonucleotide
gacgccccgccacgcagttaaaatccccacaccatgc

SEQ ID NO: 115651 - DNA, 35 bp, Artificial Sequence
  Synthetic oligonucleotide
acatctcaaccgccattatattatcgaccaccctt

SEQ ID NO: 115652 - DNA, 37 bp, Artificial Sequence
  Synthetic oligonucleotide
gaacatgggaaagataagaggagggagggcgggagga

SEQ ID NO: 115653 - DNA, 38 bp, Artificial Sequence
  Synthetic oligonucleotide
gtcaccccgttgccgaacttgcgcctgccccccgctga

SEQ ID NO: 115654 - DNA, 35 bp, Artificial Sequence
  Synthetic oligonucleotide
ttagcgtgtgcctcccggatgtagcgttctccccc

SEQ ID NO: 115655 - DNA, 35 bp, Artificial Sequence
  Synthetic oligonucleotide
accgcacccgcagttccccgttgcttccatgtagc

SEQ ID NO: 115656 - DNA, 35 bp, Artificial Sequence
  Synthetic oligonucleotide
tcccaccgctgtcgacggtttcgaattcgcccctg

SEQ ID NO: 115657 - DNA, 35 bp, Artificial Sequence
  Synthetic oligonucleotide
ttgatccacctctcatcgtagccattaacaccaca

SEQ ID NO: 115658 - DNA, 38 bp, Artificial Sequence
  Synthetic oligonucleotide
gaggggactaaggagcaacggaacgggggaggatatga

SEQ ID NO: 115659 - DNA, 35 bp, Artificial Sequence
  Synthetic oligonucleotide
gttgtaaggggcggagagggagggcaggatactga

SEQ ID NO: 115660 - DNA, 35 bp, Artificial Sequence
  Synthetic oligonucleotide
tccagcagtcacggtgcatccgcttttccatcgcc

SEQ ID NO: 115661 - DNA, 35 bp, Artificial Sequence
  Synthetic oligonucleotide
acgccctgccctatttacctagttgtccccccgcg

SEQ ID NO: 115662 - DNA, 36 bp, Artificial Sequence
  Synthetic oligonucleotide
taggtagaagggggggggcaagggaaagagaataca

SEQ ID NO: 115663 - DNA, 35 bp, Artificial Sequence
  Synthetic oligonucleotide
accgcacatactaggctgtttacgcatacctcccc

SEQ ID NO: 115664 - DNA, 35 bp, Artificial Sequence
  Synthetic oligonucleotide
gagaggggcgaccggggagggtagagtagggggcc

SEQ ID NO: 115665 - DNA, 35 bp, Artificial Sequence
  Synthetic oligonucleotide
ttgttcctcacatgtagcgtggcgccacatcttcc

SEQ ID NO: 115666 - DNA, 35 bp, Artificial Sequence
  Synthetic oligonucleotide
gttaacccttcgccgctgttctaacagtcccatct

SEQ ID NO: 115667 - DNA, 36 bp, Artificial Sequence
  Synthetic oligonucleotide
accgttaacccgccttcatgtaatttacctgctcca

SEQ ID NO: 115668 - DNA, 37 bp, Artificial Sequence
  Synthetic oligonucleotide
aggggacggggcagaaggagaaagggaggagctcaga

SEQ ID NO: 115669 - DNA, 35 bp, Artificial Sequence
  Synthetic oligonucleotide
gcctcccctgccctctagtccgttcctcgttaagg

SEQ ID NO: 115670 - DNA, 35 bp, Artificial Sequence
  Synthetic oligonucleotide
acgccaactcttgttttgttatcccccccgtgttg

SEQ ID NO: 115671 - DNA, 36 bp, Artificial Sequence
  Synthetic oligonucleotide
gagggggtgccggggggaaaggatggtcaggggcaa

SEQ ID NO: 115672 - DNA, 35 bp, Artificial Sequence
  Synthetic oligonucleotide
gccacctgcttgtgcaccacctaactccggttcca

SEQ ID NO: 115673 - DNA, 35 bp, Artificial Sequence
  Synthetic oligonucleotide
atcctccgtcgtaccgttccgccccgccattcgca

SEQ ID NO: 115674 - DNA, 38 bp, Artificial Sequence
  Synthetic oligonucleotide
gagagaggaagggcgggaaagagttcaaaaaggagtga

SEQ ID NO: 115675 - DNA, 35 bp, Artificial Sequence
  Synthetic oligonucleotide
acataactccgattctattacctgccgcccctgcc

SEQ ID NO: 115676 - DNA, 35 bp, Artificial Sequence
  Synthetic oligonucleotide
tcaccctcccatgctctcatagtctgccccttgcc

SEQ ID NO: 115677 - DNA, 35 bp, Artificial Sequence
  Synthetic oligonucleotide
tccaacggatgtgctccatcgtagccgtactccct

SEQ ID NO: 115678 - DNA, 37 bp, Artificial Sequence
  Synthetic oligonucleotide
ccactccaccgtccggaaggtagtacgatccccgtga

SEQ ID NO: 115679 - DNA, 35 bp, Artificial Sequence
  Synthetic oligonucleotide
gagccgggccgagtttgcgcaatatccaccttacc

SEQ ID NO: 115680 - DNA, 35 bp, Artificial Sequence
  Synthetic oligonucleotide
tgcggatcaacacctgccgtctgtctctcaccatc

SEQ ID NO: 115681 - DNA, 35 bp, Artificial Sequence
  Synthetic oligonucleotide
acacccatgtgtacgctaaacaccttcttgcctgt

SEQ ID NO: 115682 - DNA, 35 bp, Artificial Sequence
  Synthetic oligonucleotide
gataccaccgtggtagcgcctcacctacctcctgt

SEQ ID NO: 115683 - DNA, 35 bp, Artificial Sequence
  Synthetic oligonucleotide
ttgctcaccaccacctgctgtatctcacgacggcc

SEQ ID NO: 115684 - DNA, 35 bp, Artificial Sequence
  Synthetic oligonucleotide
acctccgctctctgcaatgatcctttacgccactc

SEQ ID NO: 115685 - DNA, 35 bp, Artificial Sequence
  Synthetic oligonucleotide
tcccaaccgcttaaatgctctctcgcttattgttc

SEQ ID NO: 115686 - DNA, 35 bp, Artificial Sequence
  Synthetic oligonucleotide
ggattgggaaggaaggaagaaatcgggaggaagaa

SEQ ID NO: 115687 - DNA, 35 bp, Artificial Sequence
  Synthetic oligonucleotide
gtttccctccgtgtcccgcctgccccgttcagccc

SEQ ID NO: 115688 - DNA, 35 bp, Artificial Sequence
  Synthetic oligonucleotide
gcccaccgccaccccgaaatgcccccccgttaggg

SEQ ID NO: 115689 - DNA, 35 bp, Artificial Sequence
  Synthetic oligonucleotide
agctcgcacacgccctcatgcctgaccgccccgct

SEQ ID NO: 115690 - DNA, 36 bp, Artificial Sequence
  Synthetic oligonucleotide
ttcgcccccgttcggctctttgcttttggttcacta

SEQ ID NO: 115691 - DNA, 35 bp, Artificial Sequence
  Synthetic oligonucleotide
gcaatccgccgttacgcccgccagtccctcgtcta

SEQ ID NO: 115692 - DNA, 35 bp, Artificial Sequence
  Synthetic oligonucleotide
gcgattgcaccatcctggctccagtacccctctta

SEQ ID NO: 115693 - DNA, 35 bp, Artificial Sequence
  Synthetic oligonucleotide
ttaccgcccccccctcgttccgacgtccgccgccc

SEQ ID NO: 115694 - DNA, 35 bp, Artificial Sequence
  Synthetic oligonucleotide
gactcgaccctttcacgcatgccccccacgcggcc

SEQ ID NO: 115695 - DNA, 35 bp, Artificial Sequence
  Synthetic oligonucleotide
tgcactaccgctttgtcccccgttacgaattctgc

SEQ ID NO: 115696 - DNA, 36 bp, Artificial Sequence
  Synthetic oligonucleotide
gtttaccacccgcactgtatactgtcccaactgcca

SEQ ID NO: 115697 - DNA, 36 bp, Artificial Sequence
  Synthetic oligonucleotide
tatccgcccttgatcccgttttgctctgtcatacta

SEQ ID NO: 115698 - DNA, 35 bp, Artificial Sequence
  Synthetic oligonucleotide
gcccctggtacagcgtactatttagcccctcttcc

SEQ ID NO: 115699 - DNA, 35 bp, Artificial Sequence
  Synthetic oligonucleotide
gcacccccaacactcgcccactgtccatagccgca

SEQ ID NO: 115700 - DNA, 36 bp, Artificial Sequence
  Synthetic oligonucleotide
tgcatactccgcgtcactacccccatcctgccgtga

SEQ ID NO: 115701 - DNA, 36 bp, Artificial Sequence
  Synthetic oligonucleotide
gtgtggtgaagtggaacgggggagagagggcgggta

SEQ ID NO: 115702 - DNA, 36 bp, Artificial Sequence
  Synthetic oligonucleotide
accgaccttaccgccgtgctcttcgccattcactta

SEQ ID NO: 115703 - DNA, 35 bp, Artificial Sequence
  Synthetic oligonucleotide
actgtgtgccgtcgcactcgtccccttctgctgac

SEQ ID NO: 115704 - DNA, 35 bp, Artificial Sequence
  Synthetic oligonucleotide
ttcacctgcagtccgtagactcacaagcctccccc

SEQ ID NO: 115705 - DNA, 35 bp, Artificial Sequence
  Synthetic oligonucleotide
gcgctcagcacactggtgtcctcttgcattccccc

SEQ ID NO: 115706 - DNA, 35 bp, Artificial Sequence
  Synthetic oligonucleotide
tcctatgcccacgatattactgcttgccccgtccc

SEQ ID NO: 115707 - DNA, 35 bp, Artificial Sequence
  Synthetic oligonucleotide
gcatgccgcatgccgcttttggatcgaaaccccct

SEQ ID NO: 115708 - DNA, 35 bp, Artificial Sequence
  Synthetic oligonucleotide
gtgcttcgtccaactccccttccgaagccgtaccc

SEQ ID NO: 115709 - DNA, 35 bp, Artificial Sequence
  Synthetic oligonucleotide
gtttagcccctgacttcgtttccctcgcggacttc

SEQ ID NO: 115710 - DNA, 35 bp, Artificial Sequence
  Synthetic oligonucleotide
atggtcagccacctctgcgtaaactcctcggtcct

SEQ ID NO: 115711 - DNA, 37 bp, Artificial Sequence
  Synthetic oligonucleotide
tgagcccctcccaatgcgcctgtccatcccgttttga

SEQ ID NO: 115712 - DNA, 35 bp, Artificial Sequence
  Synthetic oligonucleotide
ttcccatcccccgctccgtgttacctccctgacac

SEQ ID NO: 115713 - DNA, 35 bp, Artificial Sequence
  Synthetic oligonucleotide
tccacgaactgtcgtgaatccgaactctcccttcg

SEQ ID NO: 115714 - DNA, 36 bp, Artificial Sequence
  Synthetic oligonucleotide
ggggaggtgaggcatggttaggaggggccaggtcaa

SEQ ID NO: 115715 - DNA, 35 bp, Artificial Sequence
  Synthetic oligonucleotide
tctcactgcccccgttcccatgcttattgcattta

SEQ ID NO: 115716 - DNA, 35 bp, Artificial Sequence
  Synthetic oligonucleotide
tcccaatgctcctcccccgtgctgacgttaacacc

SEQ ID NO: 115717 - DNA, 35 bp, Artificial Sequence
  Synthetic oligonucleotide
agcagagggcgggtggagggtggatcggcggtccg

SEQ ID NO: 115718 - DNA, 34 bp, Artificial Sequence
  Synthetic oligonucleotide
aacgcctccccgccgcctgcctcaactcgaccct

SEQ ID NO: 115719 - DNA, 35 bp, Artificial Sequence
  Synthetic oligonucleotide
acgccagtacgtgcgcttcgtcctcccttttccga

SEQ ID NO: 115720 - DNA, 37 bp, Artificial Sequence
  Synthetic oligonucleotide
aagtctcgcgggggggaggggagggcacaatctggga

SEQ ID NO: 115721 - DNA, 35 bp, Artificial Sequence
  Synthetic oligonucleotide
tagcctgcgcctggcccggcttacccctctcgctc

SEQ ID NO: 115722 - DNA, 34 bp, Artificial Sequence
  Synthetic oligonucleotide
tatccgttccaccaatatgagtccctccgctgtc

SEQ ID NO: 115723 - DNA, 35 bp, Artificial Sequence
  Synthetic oligonucleotide
ggacaagggcgggaggacggggggaatgaagatgg

SEQ ID NO: 115724 - DNA, 35 bp, Artificial Sequence
  Synthetic oligonucleotide
aaagaggcggaggtggtctggggggagggatctgg

SEQ ID NO: 115725 - DNA, 35 bp, Artificial Sequence
  Synthetic oligonucleotide
ttcgctgctggttccatcctgtccgtctcacatct

SEQ ID NO: 115726 - DNA, 35 bp, Artificial Sequence
  Synthetic oligonucleotide
tcccgtgacccatggcttttcttttacgcacactc

SEQ ID NO: 115727 - DNA, 35 bp, Artificial Sequence
  Synthetic oligonucleotide
ggtcactcggtggccatcgcacaactgccttcttc

SEQ ID NO: 115728 - DNA, 35 bp, Artificial Sequence
  Synthetic oligonucleotide
tctgcccgtcaccccctttatacactcgcccccag

SEQ ID NO: 115729 - DNA, 32 bp, Artificial Sequence
  Synthetic oligonucleotide
gcatttcagcccgtaacgtcatccgcttcctt

SEQ ID NO: 115730 - DNA, 35 bp, Artificial Sequence
  Synthetic oligonucleotide
tagagcaaggaggaggtggacgggaagggcaggca

SEQ ID NO: 115731 - DNA, 37 bp, Artificial Sequence
  Synthetic oligonucleotide
gtggagaagggagggtacgaggaagggtagatgggga

SEQ ID NO: 115732 - DNA, 36 bp, Artificial Sequence
  Synthetic oligonucleotide
agcactcccagcaagtactacaaccccccgtcccta

SEQ ID NO: 115733 - DNA, 36 bp, Artificial Sequence
  Synthetic oligonucleotide
gaagcgaagggggaactgggcatggagggatagcta

SEQ ID NO: 115734 - DNA, 35 bp, Artificial Sequence
  Synthetic oligonucleotide
gggaccccaccccttgctgttttctccgaccacac

SEQ ID NO: 115735 - DNA, 35 bp, Artificial Sequence
  Synthetic oligonucleotide
tagtggcgggggggggcggtacttaaggggcttgg

SEQ ID NO: 115736 - DNA, 35 bp, Artificial Sequence
  Synthetic oligonucleotide
ttcgttccccgcccaatctcctcattgcccgtgac

SEQ ID NO: 115737 - DNA, 35 bp, Artificial Sequence
  Synthetic oligonucleotide
tgagccactacgtatacggttcacgctattcctcc

SEQ ID NO: 115738 - DNA, 35 bp, Artificial Sequence
  Synthetic oligonucleotide
gcacagcacggccgcccctgcttcgtccttactgg

SEQ ID NO: 115739 - DNA, 35 bp, Artificial Sequence
  Synthetic oligonucleotide
tcgatccgcattaccttccccttccgtcgcctgct

SEQ ID NO: 115740 - DNA, 35 bp, Artificial Sequence
  Synthetic oligonucleotide
tgtgcacccctcctgttccctgatagttcacgttt

SEQ ID NO: 115741 - DNA, 35 bp, Artificial Sequence
  Synthetic oligonucleotide
atcccacgcgattgcacgcccccccgtttttccaa

SEQ ID NO: 115742 - DNA, 35 bp, Artificial Sequence
  Synthetic oligonucleotide
acccgccaccaggtaaccctatgcccctcgctacc

SEQ ID NO: 115743 - DNA, 35 bp, Artificial Sequence
  Synthetic oligonucleotide
ttttgccgcccgattcttccctcaactgttcacgc

SEQ ID NO: 115744 - DNA, 35 bp, Artificial Sequence
  Synthetic oligonucleotide
gttcacactcagtccgagttgttacttcctccttc

SEQ ID NO: 115745 - DNA, 35 bp, Artificial Sequence
  Synthetic oligonucleotide
tcatgtcacctttgtctcggtcggctcccttctcc

SEQ ID NO: 115746 - DNA, 35 bp, Artificial Sequence
  Synthetic oligonucleotide
gagcaacctcatcgacccagctccaactcttgtcc

SEQ ID NO: 115747 - DNA, 35 bp, Artificial Sequence
  Synthetic oligonucleotide
agcccgccgactctatctgccctttcttggcctgc

SEQ ID NO: 115748 - DNA, 35 bp, Artificial Sequence
  Synthetic oligonucleotide
gactccgctcatctctggtactccctatgtccttc

SEQ ID NO: 115749 - DNA, 35 bp, Artificial Sequence
  Synthetic oligonucleotide
tacaccacccgcagccccggccagttactacttcg

SEQ ID NO: 115750 - DNA, 35 bp, Artificial Sequence
  Synthetic oligonucleotide
aggggagggaggggcgggtacgaggcagggggcat

SEQ ID NO: 115751 - DNA, 35 bp, Artificial Sequence
  Synthetic oligonucleotide
gacttgggggggaaggggtaggagtttggggagaa

SEQ ID NO: 115752 - DNA, 35 bp, Artificial Sequence
  Synthetic oligonucleotide
tctgtcccatccctcggtcccatgagcatacctta

SEQ ID NO: 115753 - DNA, 35 bp, Artificial Sequence
  Synthetic oligonucleotide
ggcaatgggagggagggggggaggcgccgacactt

SEQ ID NO: 115754 - DNA, 36 bp, Artificial Sequence
  Synthetic oligonucleotide
ttaccgtgcacaccgccgctaattcctccctccgga

SEQ ID NO: 115755 - DNA, 35 bp, Artificial Sequence
  Synthetic oligonucleotide
tcgatcgacaacgcaattaatggctgccttccacc

SEQ ID NO: 115756 - DNA, 33 bp, Artificial Sequence
  Synthetic oligonucleotide
tgcgacgcacctgccaccgccccctgtccccgc

SEQ ID NO: 115757 - DNA, 35 bp, Artificial Sequence
  Synthetic oligonucleotide
atcttcacccacacgtgctttgcggtcctttcctc

SEQ ID NO: 115758 - DNA, 35 bp, Artificial Sequence
  Synthetic oligonucleotide
gacacccagtcctcgattcttcaccctatgctgtc

SEQ ID NO: 115759 - DNA, 35 bp, Artificial Sequence
  Synthetic oligonucleotide
gttgacggtggaggaggtagaatgtggggttgggg

SEQ ID NO: 115760 - DNA, 35 bp, Artificial Sequence
  Synthetic oligonucleotide
cgtgctgcaacactctccgccgctggttacctggt

SEQ ID NO: 115761 - DNA, 36 bp, Artificial Sequence
  Synthetic oligonucleotide
aacgccccctgccccacttgggaatgaccccgtgaa

SEQ ID NO: 115762 - DNA, 36 bp, Artificial Sequence
  Synthetic oligonucleotide
gacgacgggggagaaacggaatgggtcgtccggtaa

SEQ ID NO: 115763 - DNA, 35 bp, Artificial Sequence
  Synthetic oligonucleotide
acgttgcagggcccgcgttgctccaatactctctc

SEQ ID NO: 115764 - DNA, 35 bp, Artificial Sequence
  Synthetic oligonucleotide
atgccaggcccgatcctggcttgtgtaccaccact

SEQ ID NO: 115765 - DNA, 35 bp, Artificial Sequence
  Synthetic oligonucleotide
gagctcgtcactatggctttgctccttcgccccct

SEQ ID NO: 115766 - DNA, 35 bp, Artificial Sequence
  Synthetic oligonucleotide
tccgccaccgcgccactggctacatttccgggttt

SEQ ID NO: 115767 - DNA, 35 bp, Artificial Sequence
  Synthetic oligonucleotide
ggaccaccacccatttattgtatttccttgccccc

SEQ ID NO: 115768 - DNA, 33 bp, Artificial Sequence
  Synthetic oligonucleotide
atgtagccattgtttagccccccttccgccttc

SEQ ID NO: 115769 - DNA, 35 bp, Artificial Sequence
  Synthetic oligonucleotide
aacatcataagctgccctgtctcctgtcctcgcca

SEQ ID NO: 115770 - DNA, 35 bp, Artificial Sequence
  Synthetic oligonucleotide
tcgatccgccacatctctttaatttaacctctcga

SEQ ID NO: 115771 - DNA, 35 bp, Artificial Sequence
  Synthetic oligonucleotide
agaccattccccagccattataggcacgcacccac

SEQ ID NO: 115772 - DNA, 35 bp, Artificial Sequence
  Synthetic oligonucleotide
atcgacacatgcgcgatcacctgttggttccccct

SEQ ID NO: 115773 - DNA, 35 bp, Artificial Sequence
  Synthetic oligonucleotide
ttccggtccacccttcgatccgcatattattgcct

SEQ ID NO: 115774 - DNA, 35 bp, Artificial Sequence
  Synthetic oligonucleotide
gcgagcatcaccggccttccctcaccgctgcacaa

SEQ ID NO: 115775 - DNA, 36 bp, Artificial Sequence
  Synthetic oligonucleotide
aacgacatgcgctgtcgttctcccgttgttttctca

SEQ ID NO: 115776 - DNA, 35 bp, Artificial Sequence
  Synthetic oligonucleotide
ttgctcgcactcttggtcccctcgcctacgcccga

SEQ ID NO: 115777 - DNA, 38 bp, Artificial Sequence
  Synthetic oligonucleotide
gcaagggggacggagtggcgggtacggggggtctgtga

SEQ ID NO: 115778 - DNA, 35 bp, Artificial Sequence
  Synthetic oligonucleotide
gacccgcgctcttcgcgtaatctctcctcgttgtc

SEQ ID NO: 115779 - DNA, 35 bp, Artificial Sequence
  Synthetic oligonucleotide
acaccttcctcgcctgacttgttagccctcgtaat

SEQ ID NO: 115780 - DNA, 35 bp, Artificial Sequence
  Synthetic oligonucleotide
tcgccccgcaccacccagcccccgtgagtcctact

SEQ ID NO: 115781 - DNA, 35 bp, Artificial Sequence
  Synthetic oligonucleotide
gagggcgctcgccacccaggttttttagtcctcct

SEQ ID NO: 115782 - DNA, 36 bp, Artificial Sequence
  Synthetic oligonucleotide
tcctgccgtgccgaagttccattttgctgcctatca

SEQ ID NO: 115783 - DNA, 35 bp, Artificial Sequence
  Synthetic oligonucleotide
ggggtggaaaggggcgggtaagagaaacacacgga

SEQ ID NO: 115784 - DNA, 35 bp, Artificial Sequence
  Synthetic oligonucleotide
tatgtggcgccttttgcctagcccgttgccccgac

SEQ ID NO: 115785 - DNA, 35 bp, Artificial Sequence
  Synthetic oligonucleotide
gccaccagtcggtactgccacacgctatgacctcc

SEQ ID NO: 115786 - DNA, 35 bp, Artificial Sequence
  Synthetic oligonucleotide
gtcagccctcaccccccgtttattgcgcttggttc

SEQ ID NO: 115787 - DNA, 35 bp, Artificial Sequence
  Synthetic oligonucleotide
tcagaaaagtgggaaggggcacgggtggggggtat

SEQ ID NO: 115788 - DNA, 35 bp, Artificial Sequence
  Synthetic oligonucleotide
tcacgcccccgcacggacagatctcttaacgccct

SEQ ID NO: 115789 - DNA, 35 bp, Artificial Sequence
  Synthetic oligonucleotide
atcgcccgcctgcccctggtccttgtccacttcac

SEQ ID NO: 115790 - DNA, 35 bp, Artificial Sequence
  Synthetic oligonucleotide
tgcaaagcaacggccctctcctctccgtttatgtc

SEQ ID NO: 115791 - DNA, 35 bp, Artificial Sequence
  Synthetic oligonucleotide
gacccctgacactgctttaacgaaacacctttcat

SEQ ID NO: 115792 - DNA, 35 bp, Artificial Sequence
  Synthetic oligonucleotide
atcagagacgggggggcgggaagtagggtaatgtt

SEQ ID NO: 115793 - DNA, 35 bp, Artificial Sequence
  Synthetic oligonucleotide
agctcgcccctagacccgattctcaccgctgcctg

SEQ ID NO: 115794 - DNA, 35 bp, Artificial Sequence
  Synthetic oligonucleotide
tctacggatcgcctctgtgctttgccttcccttct

SEQ ID NO: 115795 - DNA, 35 bp, Artificial Sequence
  Synthetic oligonucleotide
agaccatccgctgccccccgcttcttcatctgcac

SEQ ID NO: 115796 - DNA, 37 bp, Artificial Sequence
  Synthetic oligonucleotide
aatgccgtcaaactgctctgcgcctccttcccgtcga

SEQ ID NO: 115797 - DNA, 35 bp, Artificial Sequence
  Synthetic oligonucleotide
tgaaactcgatccttatatggtccgccctaccttc

SEQ ID NO: 115798 - DNA, 35 bp, Artificial Sequence
  Synthetic oligonucleotide
agtggggagggatcatacggggagtagggcacgcg

SEQ ID NO: 115799 - DNA, 35 bp, Artificial Sequence
  Synthetic oligonucleotide
tctcaccctcgcgacgttttacccccatactatgt

SEQ ID NO: 115800 - DNA, 37 bp, Artificial Sequence
  Synthetic oligonucleotide
gactccgtccattctccatgagcacctcctcgttcga

SEQ ID NO: 115801 - DNA, 37 bp, Artificial Sequence
  Synthetic oligonucleotide
tgccgcacctccgcttctactatcgtgcactctggga

SEQ ID NO: 115802 - DNA, 38 bp, Artificial Sequence
  Synthetic oligonucleotide
gtctgcccctccattgtccccgtgcattccgtccctga

SEQ ID NO: 115803 - DNA, 38 bp, Artificial Sequence
  Synthetic oligonucleotide
gcaccccttcacctggcacccttgaccgacctgcttga

SEQ ID NO: 115804 - DNA, 35 bp, Artificial Sequence
  Synthetic oligonucleotide
gcctccgcaccgtccacccgtctttcggcacacct

SEQ ID NO: 115805 - DNA, 36 bp, Artificial Sequence
  Synthetic oligonucleotide
gcctccccgcccgcttaggtctattccgccccgcga

SEQ ID NO: 115806 - DNA, 37 bp, Artificial Sequence
  Synthetic oligonucleotide
ttcctcgcaggcaactccctctccgctgccacccgga

SEQ ID NO: 115807 - DNA, 35 bp, Artificial Sequence
  Synthetic oligonucleotide
gccctcgcctccccgtgctgccttaatatctacac

SEQ ID NO: 115808 - DNA, 35 bp, Artificial Sequence
  Synthetic oligonucleotide
ttgccccaccgccgaagacaatcattggcccactc

SEQ ID NO: 115809 - DNA, 28 bp, Artificial Sequence
  Synthetic oligonucleotide
gatcgccaccattgttcgaccccccgta

SEQ ID NO: 115810 - DNA, 35 bp, Artificial Sequence
  Synthetic oligonucleotide
tcccgtgtcccagtcggccgtatgacccgcctccc

SEQ ID NO: 115811 - DNA, 35 bp, Artificial Sequence
  Synthetic oligonucleotide
tatggcaccccggaaacctattgtccagcccctct

SEQ ID NO: 115812 - DNA, 36 bp, Artificial Sequence
  Synthetic oligonucleotide
gtccgcaccacacccctgctgtttccgttcacatga

SEQ ID NO: 115813 - DNA, 35 bp, Artificial Sequence
  Synthetic oligonucleotide
tcctatctctgacgggcgctgcaccaccccacttc

SEQ ID NO: 115814 - DNA, 35 bp, Artificial Sequence
  Synthetic oligonucleotide
accaccctcgactcgttcgccgacctagatatttt

SEQ ID NO: 115815 - DNA, 35 bp, Artificial Sequence
  Synthetic oligonucleotide
tttatgcccattgagttctgtgccctgttcctttt

SEQ ID NO: 115816 - DNA, 35 bp, Artificial Sequence
  Synthetic oligonucleotide
gcctgccctcatcgcctcacttccgtttccatgaa

SEQ ID NO: 115817 - DNA, 35 bp, Artificial Sequence
  Synthetic oligonucleotide
gccatgagcccctgtgccgctctacccacatcttt

SEQ ID NO: 115818 - DNA, 35 bp, Artificial Sequence
  Synthetic oligonucleotide
gttacgcgcctaggtttttttccgtcgcctcccaa

SEQ ID NO: 115819 - DNA, 37 bp, Artificial Sequence
  Synthetic oligonucleotide
tcccgacgcatcctgctcactcgttgccccttactga

SEQ ID NO: 115820 - DNA, 35 bp, Artificial Sequence
  Synthetic oligonucleotide
tccccactgacacctatcgctacgacgttgtaccc

SEQ ID NO: 115821 - DNA, 35 bp, Artificial Sequence
  Synthetic oligonucleotide
gtacccgcccgaccatattcgttttttttagcctg

SEQ ID NO: 115822 - DNA, 35 bp, Artificial Sequence
  Synthetic oligonucleotide
gaaatgccgccgcaccatctacactcccttccgta

SEQ ID NO: 115823 - DNA, 35 bp, Artificial Sequence
  Synthetic oligonucleotide
gtgcaccaatgacgatatcaaccctgtccgttccc

SEQ ID NO: 115824 - DNA, 35 bp, Artificial Sequence
  Synthetic oligonucleotide
tcttcgcccctcgagcgttttacttcgactcccgc

SEQ ID NO: 115825 - DNA, 35 bp, Artificial Sequence
  Synthetic oligonucleotide
atcagccagcagccgcgtgatccctgcataccctc

SEQ ID NO: 115826 - DNA, 35 bp, Artificial Sequence
  Synthetic oligonucleotide
gtcccagcctcgtcctcataggtttcaatggccct

SEQ ID NO: 115827 - DNA, 36 bp, Artificial Sequence
  Synthetic oligonucleotide
acaccccgccgtttgttgcaaccaatgccgctacca

SEQ ID NO: 115828 - DNA, 36 bp, Artificial Sequence
  Synthetic oligonucleotide
tcccagctcccctcgcgctccagagccaaccccgca

SEQ ID NO: 115829 - DNA, 34 bp, Artificial Sequence
  Synthetic oligonucleotide
agacccccgcatgcagtatgccccccccgctagc

SEQ ID NO: 115830 - DNA, 35 bp, Artificial Sequence
  Synthetic oligonucleotide
tccccgcgccccgttttcgttgccacccgcgccgg

SEQ ID NO: 115831 - DNA, 35 bp, Artificial Sequence
  Synthetic oligonucleotide
gcacccccgcccggtttaagcgtgctgtccttctg

SEQ ID NO: 115832 - DNA, 36 bp, Artificial Sequence
  Synthetic oligonucleotide
tccgttgcccacttagttcctgttactcgctctcaa

SEQ ID NO: 115833 - DNA, 36 bp, Artificial Sequence
  Synthetic oligonucleotide
aaactgcccgcctgccattactaaccgacttttaca

SEQ ID NO: 115834 - DNA, 38 bp, Artificial Sequence
  Synthetic oligonucleotide
aagacatcgggaggggggtcgggaggcggtatgggtga

SEQ ID NO: 115835 - DNA, 35 bp, Artificial Sequence
  Synthetic oligonucleotide
gccactgcctggacctattgtttatctccccctgc

SEQ ID NO: 115836 - DNA, 35 bp, Artificial Sequence
  Synthetic oligonucleotide
gtggtatgccatcgcccgatttagccggcctctct

SEQ ID NO: 115837 - DNA, 35 bp, Artificial Sequence
  Synthetic oligonucleotide
tccaagccccgcgctatctaaccgtccctcgttct

SEQ ID NO: 115838 - DNA, 38 bp, Artificial Sequence
  Synthetic oligonucleotide
tcacgccacgcacttactcccgccccccctgcccgtga

SEQ ID NO: 115839 - DNA, 35 bp, Artificial Sequence
  Synthetic oligonucleotide
tacctacactcccctgattatggcccggcccttgc

SEQ ID NO: 115840 - DNA, 35 bp, Artificial Sequence
  Synthetic oligonucleotide
tctacccgccactgttttcatgcacgcctacggtt

SEQ ID NO: 115841 - DNA, 36 bp, Artificial Sequence
  Synthetic oligonucleotide
tgccactatccgcatgcaactcccgcttttgttcga

SEQ ID NO: 115842 - DNA, 38 bp, Artificial Sequence
  Synthetic oligonucleotide
ggagaggaacgggaaggggataaagtgaaggagcgtga

SEQ ID NO: 115843 - DNA, 35 bp, Artificial Sequence
  Synthetic oligonucleotide
gaccaggggggagggggggagggaaggacaagtta

SEQ ID NO: 115844 - DNA, 35 bp, Artificial Sequence
  Synthetic oligonucleotide
gctacatccactgctgcatgacctcgtacttgttc

SEQ ID NO: 115845 - DNA, 35 bp, Artificial Sequence
  Synthetic oligonucleotide
gcccatcctccgcacttcataatagtcctttcggg

SEQ ID NO: 115846 - DNA, 35 bp, Artificial Sequence
  Synthetic oligonucleotide
gcactgcccactgcgtatccgcttaccgtaccatt

SEQ ID NO: 115847 - DNA, 36 bp, Artificial Sequence
  Synthetic oligonucleotide
gaccgacgtgttgggtacgcatggggggggagggaa

SEQ ID NO: 115848 - DNA, 35 bp, Artificial Sequence
  Synthetic oligonucleotide
gccctagcccgtactgcgccaaaatcgcctccccc

SEQ ID NO: 115849 - DNA, 35 bp, Artificial Sequence
  Synthetic oligonucleotide
tgtccccacctattcgactacgccaccccgtgccc

SEQ ID NO: 115850 - DNA, 35 bp, Artificial Sequence
  Synthetic oligonucleotide
tccatcaacctcagctttcagttacctccgcccga

SEQ ID NO: 115851 - DNA, 35 bp, Artificial Sequence
  Synthetic oligonucleotide
gtcccttcagcccctcaatttgcttattcgctgtc

SEQ ID NO: 115852 - DNA, 35 bp, Artificial Sequence
  Synthetic oligonucleotide
tgaggggggggtggaggtgagtcagaaccgggagg

SEQ ID NO: 115853 - DNA, 36 bp, Artificial Sequence
  Synthetic oligonucleotide
ttcctccgccggtggatcctcgttgctattccatca

SEQ ID NO: 115854 - DNA, 35 bp, Artificial Sequence
  Synthetic oligonucleotide
tgtgtcgccatccgttgtaaccctctctttgttca

SEQ ID NO: 115855 - DNA, 37 bp, Artificial Sequence
  Synthetic oligonucleotide
gagggacgggcgggagatagggattgcatcgtcttga

SEQ ID NO: 115856 - DNA, 35 bp, Artificial Sequence
  Synthetic oligonucleotide
ggacctgccctgctccatgttttctcgctaactta

SEQ ID NO: 115857 - DNA, 35 bp, Artificial Sequence
  Synthetic oligonucleotide
taacacccatcatgcctcctacgtgcatagcccgc

SEQ ID NO: 115858 - DNA, 35 bp, Artificial Sequence
  Synthetic oligonucleotide
tgcaacctcctcgcgggcctctcactccactggtg

SEQ ID NO: 115859 - DNA, 35 bp, Artificial Sequence
  Synthetic oligonucleotide
tcaaccccgacaacattgactatgttgctacacct

SEQ ID NO: 115860 - DNA, 36 bp, Artificial Sequence
  Synthetic oligonucleotide
atccctgtcctctgcctcgtatccgcgttacttaaa

SEQ ID NO: 115861 - DNA, 36 bp, Artificial Sequence
  Synthetic oligonucleotide
cacattccaggtcccgaacggttctcactgtcttca

SEQ ID NO: 115862 - DNA, 35 bp, Artificial Sequence
  Synthetic oligonucleotide
tacaccctctgctctcgcttgtgccatctcaagga

SEQ ID NO: 115863 - DNA, 38 bp, Artificial Sequence
  Synthetic oligonucleotide
tccctgcctccgaggcttaaccacccgtaccttcatga

SEQ ID NO: 115864 - DNA, 36 bp, Artificial Sequence
  Synthetic oligonucleotide
accatgggctccctctgcttaccgctccttctcgta

SEQ ID NO: 115865 - DNA, 35 bp, Artificial Sequence
  Synthetic oligonucleotide
tgccctaccactgatcgacgacctttctttcactc

SEQ ID NO: 115866 - DNA, 37 bp, Artificial Sequence
  Synthetic oligonucleotide
tgcacgaatcggggggggaaatacagggatggcggga

SEQ ID NO: 115867 - DNA, 35 bp, Artificial Sequence
  Synthetic oligonucleotide
atatgacgagggggagaatggaaggggtgcagggc

SEQ ID NO: 115868 - DNA, 35 bp, Artificial Sequence
  Synthetic oligonucleotide
gacgtgccgtttggaagtgtcattcttctccctgc

SEQ ID NO: 115869 - DNA, 35 bp, Artificial Sequence
  Synthetic oligonucleotide
gaaggggggacatagcgatggggagtagcgcaaag

SEQ ID NO: 115870 - DNA, 35 bp, Artificial Sequence
  Synthetic oligonucleotide
ttgaccccctcccctagtaccaacagcgttgaacg

SEQ ID NO: 115871 - DNA, 36 bp, Artificial Sequence
  Synthetic oligonucleotide
ttgagcgtgccgtccgcgttcctagccccctcatca

SEQ ID NO: 115872 - DNA, 37 bp, Artificial Sequence
  Synthetic oligonucleotide
gatcggagtgcagtaagggtggaaggggatgagggga

SEQ ID NO: 115873 - DNA, 36 bp, Artificial Sequence
  Synthetic oligonucleotide
ggacgatccgtcccttgtttctcgcccccacattga

SEQ ID NO: 115874 - DNA, 35 bp, Artificial Sequence
  Synthetic oligonucleotide
ataccgccccacggagttaaatgtctctctcccgc

SEQ ID NO: 115875 - DNA, 36 bp, Artificial Sequence
  Synthetic oligonucleotide
tcattccgccccccacagaccccgccgtgaacgcta

SEQ ID NO: 115876 - DNA, 37 bp, Artificial Sequence
  Synthetic oligonucleotide
agatcatgggtgggagggggacggggcagcacaaaga

SEQ ID NO: 115877 - DNA, 37 bp, Artificial Sequence
  Synthetic oligonucleotide
acaaaaggggggacggtgaggcaaggtacgagaggga

SEQ ID NO: 115878 - DNA, 35 bp, Artificial Sequence
  Synthetic oligonucleotide
ttcccatcccccgacttgaactgaaatggacattt

SEQ ID NO: 115879 - DNA, 35 bp, Artificial Sequence
  Synthetic oligonucleotide
actcttacgccacctgttcgttcgccgcctggttt

SEQ ID NO: 115880 - DNA, 35 bp, Artificial Sequence
  Synthetic oligonucleotide
gccaactgggaccggggaaggagcgggggtggaga

SEQ ID NO: 115881 - DNA, 35 bp, Artificial Sequence
  Synthetic oligonucleotide
agacgggaaggcgggaaacgggggctgccggtgga

SEQ ID NO: 115882 - DNA, 35 bp, Artificial Sequence
  Synthetic oligonucleotide
ttaccggtgcctcacgctcttgaatcctcccttcg

SEQ ID NO: 115883 - DNA, 35 bp, Artificial Sequence
  Synthetic oligonucleotide
gcccgcacgtgttcccctgccctttactctgcctg

SEQ ID NO: 115884 - DNA, 35 bp, Artificial Sequence
  Synthetic oligonucleotide
gctcaccatcccgacgccccgtgccatctatcgtt

SEQ ID NO: 115885 - DNA, 35 bp, Artificial Sequence
  Synthetic oligonucleotide
atgacctgccatctactccccccgttctatagaca

SEQ ID NO: 115886 - DNA, 37 bp, Artificial Sequence
  Synthetic oligonucleotide
ggacgaggtaggaggagcagggggttgaggcgagaga

SEQ ID NO: 115887 - DNA, 35 bp, Artificial Sequence
  Synthetic oligonucleotide
gacaacgcgacccatcgtctctatccgggtacctt

SEQ ID NO: 115888 - DNA, 37 bp, Artificial Sequence
  Synthetic oligonucleotide
gaagggggggtgaaaggtgaggacaggcgacagtaga

SEQ ID NO: 115889 - DNA, 37 bp, Artificial Sequence
  Synthetic oligonucleotide
gagcagggggagggtggtactacaaggggattgggga

SEQ ID NO: 115890 - DNA, 36 bp, Artificial Sequence
  Synthetic oligonucleotide
gctgttccccgctgtgcctccgctttaccccctgga

SEQ ID NO: 115891 - DNA, 35 bp, Artificial Sequence
  Synthetic oligonucleotide
gcctcccgctccacctcgactatttgaaggcaata

SEQ ID NO: 115892 - DNA, 35 bp, Artificial Sequence
  Synthetic oligonucleotide
tcacgtactgtatgtcccccgtccctttcgagttt

SEQ ID NO: 115893 - DNA, 36 bp, Artificial Sequence
  Synthetic oligonucleotide
ttgccatcgcctgtcttcgcctctggtctcctctca

SEQ ID NO: 115894 - DNA, 36 bp, Artificial Sequence
  Synthetic oligonucleotide
gaatcgggtaacgggggggaaaagggagagctctga

SEQ ID NO: 115895 - DNA, 35 bp, Artificial Sequence
  Synthetic oligonucleotide
ttcgcccgccttccatggacgagctcatttctccc

SEQ ID NO: 115896 - DNA, 35 bp, Artificial Sequence
  Synthetic oligonucleotide
gcaacaccgactttctcgcttacgttacaccatgc

SEQ ID NO: 115897 - DNA, 35 bp, Artificial Sequence
  Synthetic oligonucleotide
gcggacatccgccccattaactatcaagtgaactc

SEQ ID NO: 115898 - DNA, 35 bp, Artificial Sequence
  Synthetic oligonucleotide
gctatgcggtctcgttttatccctgtccctggttc

SEQ ID NO: 115899 - DNA, 36 bp, Artificial Sequence
  Synthetic oligonucleotide
tccctatctcgcctacgatctgttctcacccctgga

SEQ ID NO: 115900 - DNA, 35 bp, Artificial Sequence
  Synthetic oligonucleotide
acttccccgctcctacacctattacagtgcgttgc

SEQ ID NO: 115901 - DNA, 36 bp, Artificial Sequence
  Synthetic oligonucleotide
gggggatggtcactggggagggaagggtgagggtaa

SEQ ID NO: 115902 - DNA, 38 bp, Artificial Sequence
  Synthetic oligonucleotide
gaggtcaaaagggagggggagggcgtagcagccgttga

SEQ ID NO: 115903 - DNA, 35 bp, Artificial Sequence
  Synthetic oligonucleotide
ataccaccgccgccctgtatacaacaacgtccccc

SEQ ID NO: 115904 - DNA, 35 bp, Artificial Sequence
  Synthetic oligonucleotide
accccgaccgccttcgttttcactgctttatgtag

SEQ ID NO: 115905 - DNA, 37 bp, Artificial Sequence
  Synthetic oligonucleotide
atagcgcgcactcctggtaatcgcctctccgccccga

SEQ ID NO: 115906 - DNA, 35 bp, Artificial Sequence
  Synthetic oligonucleotide
gccccccatctgaacatgagagtgtgccctttcct

SEQ ID NO: 115907 - DNA, 35 bp, Artificial Sequence
  Synthetic oligonucleotide
tgcctccgtccctgcgcacctacttaacttggctt

SEQ ID NO: 115908 - DNA, 35 bp, Artificial Sequence
  Synthetic oligonucleotide
atcccccgccccattggtatgacccgggtagacca

SEQ ID NO: 115909 - DNA, 36 bp, Artificial Sequence
  Synthetic oligonucleotide
tgtacggtcacttgttgcattatattcctgccccca

SEQ ID NO: 115910 - DNA, 36 bp, Artificial Sequence
  Synthetic oligonucleotide
ttcgcgctagctcacccgtcccctttaccgcaccta

SEQ ID NO: 115911 - DNA, 35 bp, Artificial Sequence
  Synthetic oligonucleotide
tcccccgcacgaattagcctgtccgtctacgcctg

SEQ ID NO: 115912 - DNA, 35 bp, Artificial Sequence
  Synthetic oligonucleotide
atccccagctcgccctttgtcgctctcacggttat

SEQ ID NO: 115913 - DNA, 35 bp, Artificial Sequence
  Synthetic oligonucleotide
ttcgcccccttcgtgtccatcggcgccatccccac

SEQ ID NO: 115914 - DNA, 35 bp, Artificial Sequence
  Synthetic oligonucleotide
aacgagccactcacactgtcgccgaattcctacgc

SEQ ID NO: 115915 - DNA, 37 bp, Artificial Sequence
  Synthetic oligonucleotide
acacctaccaccttctatcgtttaccagtcgccacga

SEQ ID NO: 115916 - DNA, 37 bp, Artificial Sequence
  Synthetic oligonucleotide
tacgcaccgccgcctgtttaacgcaaatccgccctga

SEQ ID NO: 115917 - DNA, 37 bp, Artificial Sequence
  Synthetic oligonucleotide
gacgtccgcttaccacgtgccccctctccgtttctga

SEQ ID NO: 115918 - DNA, 35 bp, Artificial Sequence
  Synthetic oligonucleotide
agtcacacacagctctctttctgttcacgtttccc

SEQ ID NO: 115919 - DNA, 35 bp, Artificial Sequence
  Synthetic oligonucleotide
tcccactcgctattcgtacaaccatgattcgttcc

SEQ ID NO: 115920 - DNA, 35 bp, Artificial Sequence
  Synthetic oligonucleotide
acgcctcagcccgtctcgtctctatccgtctcctg

SEQ ID NO: 115921 - DNA, 35 bp, Artificial Sequence
  Synthetic oligonucleotide
tccccccgtcgcttccataatcgcctcttgtcaca

SEQ ID NO: 115922 - DNA, 35 bp, Artificial Sequence
  Synthetic oligonucleotide
ggagaccggggaggggggtgatgcatctaggggtc

SEQ ID NO: 115923 - DNA, 35 bp, Artificial Sequence
  Synthetic oligonucleotide
tgtgtacacacccccgctcccttgcaccatttgcg

SEQ ID NO: 115924 - DNA, 35 bp, Artificial Sequence
  Synthetic oligonucleotide
tccgctgccgaacataccttaggcccctcttcctg

SEQ ID NO: 115925 - DNA, 38 bp, Artificial Sequence
  Synthetic oligonucleotide
tgtatccgccacacaccacccgcgcctgccaaccttga

SEQ ID NO: 115926 - DNA, 35 bp, Artificial Sequence
  Synthetic oligonucleotide
gttcactcgatcgccgttcgtcctgcctgaccgcc

SEQ ID NO: 115927 - DNA, 35 bp, Artificial Sequence
  Synthetic oligonucleotide
ggacggcctctaggtcgtccgtcttgttccatcca

SEQ ID NO: 115928 - DNA, 37 bp, Artificial Sequence
  Synthetic oligonucleotide
tatgccactcgcattttgcgtttagtcccccctccga

SEQ ID NO: 115929 - DNA, 37 bp, Artificial Sequence
  Synthetic oligonucleotide
acacccgcccctccgatacctgcctccccgacattga

SEQ ID NO: 115930 - DNA, 35 bp, Artificial Sequence
  Synthetic oligonucleotide
tccccgtggcccactgctcccttgacccagtttcc

SEQ ID NO: 115931 - DNA, 35 bp, Artificial Sequence
  Synthetic oligonucleotide
gcctgcctcgccctcttccacagttccagttatgc

SEQ ID NO: 115932 - DNA, 35 bp, Artificial Sequence
  Synthetic oligonucleotide
gggaacctcatcatgcgtgaccaccctccatcctg

SEQ ID NO: 115933 - DNA, 35 bp, Artificial Sequence
  Synthetic oligonucleotide
atgcctgacccatgctgctttcctctctcgcgttg

SEQ ID NO: 115934 - DNA, 37 bp, Artificial Sequence
  Synthetic oligonucleotide
tgcttccgcgcactgcagttttcgccatccaccctga

SEQ ID NO: 115935 - DNA, 35 bp, Artificial Sequence
  Synthetic oligonucleotide
tgtcctccgctcctctcttttcggtttcagccacg

SEQ ID NO: 115936 - DNA, 33 bp, Artificial Sequence
  Synthetic oligonucleotide
tatttgcccgtaccgtactgcccctctggtaca

SEQ ID NO: 115937 - DNA, 36 bp, Artificial Sequence
  Synthetic oligonucleotide
ttcgttggtcgccgcctgtcccctctcatgaagtca

SEQ ID NO: 115938 - DNA, 37 bp, Artificial Sequence
  Synthetic oligonucleotide
gtgggaggggccagtagggaataagggcgctaccaga

SEQ ID NO: 115939 - DNA, 37 bp, Artificial Sequence
  Synthetic oligonucleotide
atggtgccgaggtggtggtagcaagggaagggggcga

SEQ ID NO: 115940 - DNA, 37 bp, Artificial Sequence
  Synthetic oligonucleotide
tacgcagggggagggtgcggggttacccagggggcga

SEQ ID NO: 115941 - DNA, 37 bp, Artificial Sequence
  Synthetic oligonucleotide
atcgtaccgccagccttatcttcgcgatccccctcga

SEQ ID NO: 115942 - DNA, 38 bp, Artificial Sequence
  Synthetic oligonucleotide
tctaccgcctcaccaacgttacttcggactgaacctga

SEQ ID NO: 115943 - DNA, 35 bp, Artificial Sequence
  Synthetic oligonucleotide
gacgggactgggagggacatgggaatgccggagcg

SEQ ID NO: 115944 - DNA, 35 bp, Artificial Sequence
  Synthetic oligonucleotide
gtcccgaccgccctttacgttctatagcccctagt

SEQ ID NO: 115945 - DNA, 37 bp, Artificial Sequence
  Synthetic oligonucleotide
tatcgagacggtggattctggggaaggggcggaggga

SEQ ID NO: 115946 - DNA, 35 bp, Artificial Sequence
  Synthetic oligonucleotide
tatccgccatcctagttcctgccagaccccgtttt

SEQ ID NO: 115947 - DNA, 36 bp, Artificial Sequence
  Synthetic oligonucleotide
gcccaccgtccgtttgcctatatgctcctgtccgta

SEQ ID NO: 115948 - DNA, 35 bp, Artificial Sequence
  Synthetic oligonucleotide
taaaactcgcagccgttcgccatccccaattttcg

SEQ ID NO: 115949 - DNA, 35 bp, Artificial Sequence
  Synthetic oligonucleotide
gtcgactccaccgtccccctcttcatcggctactg

SEQ ID NO: 115950 - DNA, 36 bp, Artificial Sequence
  Synthetic oligonucleotide
cacgttcgccctctcgtccgcgctgttcaccaccaa

SEQ ID NO: 115951 - DNA, 36 bp, Artificial Sequence
  Synthetic oligonucleotide
actgcctggtcctggcccgcttccctccttctgcta

SEQ ID NO: 115952 - DNA, 35 bp, Artificial Sequence
  Synthetic oligonucleotide
gccgtactacgacgtctataactgctccctcttta

SEQ ID NO: 115953 - DNA, 35 bp, Artificial Sequence
  Synthetic oligonucleotide
accccaccgggtccttctgcttactatattgtacc

SEQ ID NO: 115954 - DNA, 35 bp, Artificial Sequence
  Synthetic oligonucleotide
ataccgtgccccaacgctgaccccctccgtttgcc

SEQ ID NO: 115955 - DNA, 35 bp, Artificial Sequence
  Synthetic oligonucleotide
tcatcccggttaacctctcgcacacgcgctcccgc

SEQ ID NO: 115956 - DNA, 35 bp, Artificial Sequence
  Synthetic oligonucleotide
acctgcctgggccccttcctgctcctaatcgtgct

SEQ ID NO: 115957 - DNA, 35 bp, Artificial Sequence
  Synthetic oligonucleotide
gcacaatcccggcgacgtctgctccttcctgtcca

SEQ ID NO: 115958 - DNA, 36 bp, Artificial Sequence
  Synthetic oligonucleotide
gaactgccgccatgagcgttcacgaacacctcctca

SEQ ID NO: 115959 - DNA, 38 bp, Artificial Sequence
  Synthetic oligonucleotide
ataatgggtgggaggggaacatcgacgtcaaggggtga

SEQ ID NO: 115960 - DNA, 33 bp, Artificial Sequence
  Synthetic oligonucleotide
agtggtgggagagggtagagcggggggataacg

SEQ ID NO: 115961 - DNA, 35 bp, Artificial Sequence
  Synthetic oligonucleotide
ggagggggcacaggaggagagggtgctgtggaagg

SEQ ID NO: 115962 - DNA, 35 bp, Artificial Sequence
  Synthetic oligonucleotide
atcaacgccccgacactctcttgccacacctagtg

SEQ ID NO: 115963 - DNA, 35 bp, Artificial Sequence
  Synthetic oligonucleotide
taccgtacccggtggtccgccctcatcaccttgct

SEQ ID NO: 115964 - DNA, 35 bp, Artificial Sequence
  Synthetic oligonucleotide
tgccatcctccgagctccaccatgaaaattgttca

SEQ ID NO: 115965 - DNA, 35 bp, Artificial Sequence
  Synthetic oligonucleotide
gttgcctctctcgctttaatgacctcccctgcgta

SEQ ID NO: 115966 - DNA, 35 bp, Artificial Sequence
  Synthetic oligonucleotide
atgtttagcggcaaagtcacagtcccgcccctccc

SEQ ID NO: 115967 - DNA, 34 bp, Artificial Sequence
  Synthetic oligonucleotide
tcccgccttgcctgtcctccttttattgtttgtc

SEQ ID NO: 115968 - DNA, 35 bp, Artificial Sequence
  Synthetic oligonucleotide
ttcgccatccctcgaatttttctgtaccactaccg

SEQ ID NO: 115969 - DNA, 35 bp, Artificial Sequence
  Synthetic oligonucleotide
tctagtcctgcgccccctgactattgttacccctt

SEQ ID NO: 115970 - DNA, 35 bp, Artificial Sequence
  Synthetic oligonucleotide
taacgcctcacgtcccccttcgaccgcacttcctt

SEQ ID NO: 115971 - DNA, 35 bp, Artificial Sequence
  Synthetic oligonucleotide
ttcacaacggcccttgcgattgacacctcccgcta

SEQ ID NO: 115972 - DNA, 35 bp, Artificial Sequence
  Synthetic oligonucleotide
gcaccccgttccatcgggcattcatcccatgcacc

SEQ ID NO: 115973 - DNA, 35 bp, Artificial Sequence
  Synthetic oligonucleotide
tccgactcggctccctcctcggtggctccgtttcc

SEQ ID NO: 115974 - DNA, 35 bp, Artificial Sequence
  Synthetic oligonucleotide
gatgttccgctggtgcctctgtaatgcctttgcct

SEQ ID NO: 115975 - DNA, 35 bp, Artificial Sequence
  Synthetic oligonucleotide
tgcacggtcggaaccccaagctgtcactcgcccgt

SEQ ID NO: 115976 - DNA, 36 bp, Artificial Sequence
  Synthetic oligonucleotide
acccgctctgcatcccttccccatgcgtgccactca

SEQ ID NO: 115977 - DNA, 35 bp, Artificial Sequence
  Synthetic oligonucleotide
acccgcacgcgacccgacgctatgccccctgcccc

SEQ ID NO: 115978 - DNA, 35 bp, Artificial Sequence
  Synthetic oligonucleotide
ggtctggagggcggagagggggtggggagtagagc

SEQ ID NO: 115979 - DNA, 35 bp, Artificial Sequence
  Synthetic oligonucleotide
tgtgagagaggaggagattggagaagggtgcggtg

SEQ ID NO: 115980 - DNA, 37 bp, Artificial Sequence
  Synthetic oligonucleotide
gtttcgggaggttggtggggtggaagggggacccaga

SEQ ID NO: 115981 - DNA, 37 bp, Artificial Sequence
  Synthetic oligonucleotide
ggtgggggggtagttccgttgggggagggacaatgga

SEQ ID NO: 115982 - DNA, 35 bp, Artificial Sequence
  Synthetic oligonucleotide
tgtgtcgccccatgcggaccttctacctcgtacac

SEQ ID NO: 115983 - DNA, 35 bp, Artificial Sequence
  Synthetic oligonucleotide
atcgcccccaaagtcatagcgccctcccgttcgcc

SEQ ID NO: 115984 - DNA, 35 bp, Artificial Sequence
  Synthetic oligonucleotide
atgtgccccatgtcgatatcggatctccctctcgt

SEQ ID NO: 115985 - DNA, 35 bp, Artificial Sequence
  Synthetic oligonucleotide
gatccacgccccgctcttaaacgctactgatcatt

SEQ ID NO: 115986 - DNA, 36 bp, Artificial Sequence
  Synthetic oligonucleotide
aacttccaccgcctgcaatgtagtccgtcctggcca

SEQ ID NO: 115987 - DNA, 36 bp, Artificial Sequence
  Synthetic oligonucleotide
tgcgccctcccgtccttcttgcttttttggtcgcta

SEQ ID NO: 115988 - DNA, 35 bp, Artificial Sequence
  Synthetic oligonucleotide
aacaagggaactgggacgggggacgggctataggg

SEQ ID NO: 115989 - DNA, 35 bp, Artificial Sequence
  Synthetic oligonucleotide
gaccggatctcctgttattgttccaccgtcgccca

SEQ ID NO: 115990 - DNA, 36 bp, Artificial Sequence
  Synthetic oligonucleotide
ggggtgggcgcatgccataatatagttaaagaggga

SEQ ID NO: 115991 - DNA, 37 bp, Artificial Sequence
  Synthetic oligonucleotide
tgcatccgccctgtttactacctccattatgcttgga

SEQ ID NO: 115992 - DNA, 38 bp, Artificial Sequence
  Synthetic oligonucleotide
ggtagaaagggaggggttacaaagggatggggcggtga

SEQ ID NO: 115993 - DNA, 35 bp, Artificial Sequence
  Synthetic oligonucleotide
tctccaccctgctcatgtttcctagcatgtaacac

SEQ ID NO: 115994 - DNA, 35 bp, Artificial Sequence
  Synthetic oligonucleotide
tcaccactacaatgtcacaccttctcaccttacgc

SEQ ID NO: 115995 - DNA, 35 bp, Artificial Sequence
  Synthetic oligonucleotide
tgaggaagggaggacgggatgaacgctgggagggc

SEQ ID NO: 115996 - DNA, 35 bp, Artificial Sequence
  Synthetic oligonucleotide
gtcgatggaagggagggggtagaaagaagacaacg

SEQ ID NO: 115997 - DNA, 35 bp, Artificial Sequence
  Synthetic oligonucleotide
gcacccctccgtgatctcccattaacgcccttggt

SEQ ID NO: 115998 - DNA, 34 bp, Artificial Sequence
  Synthetic oligonucleotide
ttcaactgcctgtagtgctaaacgctttctttcc

SEQ ID NO: 115999 - DNA, 36 bp, Artificial Sequence
  Synthetic oligonucleotide
tatccactcgctcgctgtcgttcgttcccccgccaa

SEQ ID NO: 116000 - DNA, 35 bp, Artificial Sequence
  Synthetic oligonucleotide
acgtgtgccccgtttctggatttccctcctcgcta

SEQ ID NO: 116001 - DNA, 37 bp, Artificial Sequence
  Synthetic oligonucleotide
acgtagcaaacgggtaggggtgggcgggcgaaacgta

SEQ ID NO: 116002 - DNA, 34 bp, Artificial Sequence
  Synthetic oligonucleotide
tataccctgcttgcccctccgttgtattaccgcc

SEQ ID NO: 116003 - DNA, 35 bp, Artificial Sequence
  Synthetic oligonucleotide
tccgtcgaccgcctaggcctgcttgttgtcttctc

SEQ ID NO: 116004 - DNA, 35 bp, Artificial Sequence
  Synthetic oligonucleotide
acaccgtaccccctcgacgtatcacacctgtctcg

SEQ ID NO: 116005 - DNA, 35 bp, Artificial Sequence
  Synthetic oligonucleotide
ttcccccgccccttctgttcaagccccgtggccca

SEQ ID NO: 116006 - DNA, 35 bp, Artificial Sequence
  Synthetic oligonucleotide
ggtagtgagggggcgtgacggggtggagggtggga

SEQ ID NO: 116007 - DNA, 38 bp, Artificial Sequence
  Synthetic oligonucleotide
tccgcacggaccaaggtagggggggagggaggcgatga

SEQ ID NO: 116008 - DNA, 37 bp, Artificial Sequence
  Synthetic oligonucleotide
gacgacgctggtgggggataggggtggagggggtgga

SEQ ID NO: 116009 - DNA, 35 bp, Artificial Sequence
  Synthetic oligonucleotide
gccgatcacccccccgtccggtcaccagttattac

SEQ ID NO: 116010 - DNA, 35 bp, Artificial Sequence
  Synthetic oligonucleotide
attgtccaccgtactttgttctcgacccccctacc

SEQ ID NO: 116011 - DNA, 35 bp, Artificial Sequence
  Synthetic oligonucleotide
attgacgtcccgtgccgctatcttccatgtctacc

SEQ ID NO: 116012 - DNA, 35 bp, Artificial Sequence
  Synthetic oligonucleotide
gtcaatgcacttggcgccccttcatcctttctgtc

SEQ ID NO: 116013 - DNA, 35 bp, Artificial Sequence
  Synthetic oligonucleotide
gccaatgtggtctgtatacgctcccaccgcccttc

SEQ ID NO: 116014 - DNA, 35 bp, Artificial Sequence
  Synthetic oligonucleotide
tcccacctccccatctttgcatatgccctgccacg

SEQ ID NO: 116015 - DNA, 35 bp, Artificial Sequence
  Synthetic oligonucleotide
ccccactgcccatccgccctcgatttaccgtttcg

SEQ ID NO: 116016 - DNA, 35 bp, Artificial Sequence
  Synthetic oligonucleotide
tgtcaccactcattgcctacggaccacctgacaca

SEQ ID NO: 116017 - DNA, 36 bp, Artificial Sequence
  Synthetic oligonucleotide
tccctcgctcccggtcttcctagtgagtccccttta

SEQ ID NO: 116018 - DNA, 35 bp, Artificial Sequence
  Synthetic oligonucleotide
gcctcagtctggcctaatcgaccaacgcgcccccc

SEQ ID NO: 116019 - DNA, 35 bp, Artificial Sequence
  Synthetic oligonucleotide
tcagctgattacccgccttcacttggcccgctcgc

SEQ ID NO: 116020 - DNA, 35 bp, Artificial Sequence
  Synthetic oligonucleotide
tcgcaaccatctgccgtgaatcggcttcgcccttc

SEQ ID NO: 116021 - DNA, 36 bp, Artificial Sequence
  Synthetic oligonucleotide
gcaccgcaaagcaccacgctaccacccctcttgcca

SEQ ID NO: 116022 - DNA, 37 bp, Artificial Sequence
  Synthetic oligonucleotide
tgccgtcccacgccatttgcttcaggctccccctcga

SEQ ID NO: 116023 - DNA, 37 bp, Artificial Sequence
  Synthetic oligonucleotide
caccaaccgctccccttttgcatcagcaccccttcga

SEQ ID NO: 116024 - DNA, 38 bp, Artificial Sequence
  Synthetic oligonucleotide
tacgcatccgccccttccgcccacacgagcccatgtga

SEQ ID NO: 116025 - DNA, 37 bp, Artificial Sequence
  Synthetic oligonucleotide
acacgcaccgtttgcgttgtgccccccccgcccttga

SEQ ID NO: 116026 - DNA, 35 bp, Artificial Sequence
  Synthetic oligonucleotide
gcactactgcccctcgcctctcttgttgtttcgta

SEQ ID NO: 116027 - DNA, 35 bp, Artificial Sequence
  Synthetic oligonucleotide
gccgggcctctctgcttccgaactggttcgcctac

SEQ ID NO: 116028 - DNA, 35 bp, Artificial Sequence
  Synthetic oligonucleotide
gtgaaccctgcccaattatggcgtcaggactcctc

SEQ ID NO: 116029 - DNA, 35 bp, Artificial Sequence
  Synthetic oligonucleotide
tgttcgccttagatctctactccccggcctgtctc

SEQ ID NO: 116030 - DNA, 35 bp, Artificial Sequence
  Synthetic oligonucleotide
gccggtagcccggaagccccccctgtccacctacg

SEQ ID NO: 116031 - DNA, 35 bp, Artificial Sequence
  Synthetic oligonucleotide
tgccgcccccattagccattcgattcagtctcccg

SEQ ID NO: 116032 - DNA, 35 bp, Artificial Sequence
  Synthetic oligonucleotide
tgtactcatgcctcactaattgctttggtcgccct

SEQ ID NO: 116033 - DNA, 38 bp, Artificial Sequence
  Synthetic oligonucleotide
tctatcaccgcacccatccgtagttcacctgtttctga

SEQ ID NO: 116034 - DNA, 36 bp, Artificial Sequence
  Synthetic oligonucleotide
tccccccgcccccgtttactgtttctccgagcgata

SEQ ID NO: 116035 - DNA, 35 bp, Artificial Sequence
  Synthetic oligonucleotide
tcctacgcgatctacctatcttggtcgtcctaccc

SEQ ID NO: 116036 - DNA, 35 bp, Artificial Sequence
  Synthetic oligonucleotide
gcgtgtccgttagttatcccgcccgttccaccctc

SEQ ID NO: 116037 - DNA, 35 bp, Artificial Sequence
  Synthetic oligonucleotide
acaccgctcggcaggctcctgccttaactccccga

SEQ ID NO: 116038 - DNA, 36 bp, Artificial Sequence
  Synthetic oligonucleotide
gcacctctctcgcttaccgcctggttctcccagtac

SEQ ID NO: 116039 - DNA, 35 bp, Artificial Sequence
  Synthetic oligonucleotide
gccgcccacactggagctcaccgccctcacattca

SEQ ID NO: 116040 - DNA, 36 bp, Artificial Sequence
  Synthetic oligonucleotide
gtcagagccacccgccgcctttaatacagtgcctta

SEQ ID NO: 116041 - DNA, 35 bp, Artificial Sequence
  Synthetic oligonucleotide
atgacgcgcctcaagtcccatccactttgtcgtac

SEQ ID NO: 116042 - DNA, 35 bp, Artificial Sequence
  Synthetic oligonucleotide
gcatgctgccgaaacgttgaggcgtcattccaccc

SEQ ID NO: 116043 - DNA, 35 bp, Artificial Sequence
  Synthetic oligonucleotide
gccacgcgcctgtcagttccgttcgccccggcctc

SEQ ID NO: 116044 - DNA, 35 bp, Artificial Sequence
  Synthetic oligonucleotide
gctcagctctgttcgcgttgtctcccccctttttc

SEQ ID NO: 116045 - DNA, 35 bp, Artificial Sequence
  Synthetic oligonucleotide
tccagccacatccgctcacaccttgttcttgttgg

SEQ ID NO: 116046 - DNA, 35 bp, Artificial Sequence
  Synthetic oligonucleotide
gtggggggaggagaaatgggaggttcggtgcggga

SEQ ID NO: 116047 - DNA, 35 bp, Artificial Sequence
  Synthetic oligonucleotide
atcgcgcggtcatttctcatcctggtcattcgccc

SEQ ID NO: 116048 - DNA, 35 bp, Artificial Sequence
  Synthetic oligonucleotide
tcgccccctccgccccttagccgtatgtacctgcg

SEQ ID NO: 116049 - DNA, 35 bp, Artificial Sequence
  Synthetic oligonucleotide
atcagccacacctcagcttccttgtctcactctca

SEQ ID NO: 116050 - DNA, 37 bp, Artificial Sequence
  Synthetic oligonucleotide
ggaaatcaacggggggggtggggaggaacgggcgaga

SEQ ID NO: 116051 - DNA, 36 bp, Artificial Sequence
  Synthetic oligonucleotide
atggaacgaaatcatgggtgatacgggcggggggga

SEQ ID NO: 116052 - DNA, 38 bp, Artificial Sequence
  Synthetic oligonucleotide
ttgggagggcgtatgtgagggggggcgggtggtattga

SEQ ID NO: 116053 - DNA, 36 bp, Artificial Sequence
  Synthetic oligonucleotide
gccgccaccgccctccaacgccccatgtctatggta

SEQ ID NO: 116054 - DNA, 35 bp, Artificial Sequence
  Synthetic oligonucleotide
acctgccgcctgcccactgtactctcgacaccgcg

SEQ ID NO: 116055 - DNA, 35 bp, Artificial Sequence
  Synthetic oligonucleotide
tacatgggggggacggagggtgactacggggtgcg

SEQ ID NO: 116056 - DNA, 33 bp, Artificial Sequence
  Synthetic oligonucleotide
cccgatgacccgcttgttcccgtaccaccttcg

SEQ ID NO: 116057 - DNA, 35 bp, Artificial Sequence
  Synthetic oligonucleotide
accccccccagatgtccggctactcctggtcaatt

SEQ ID NO: 116058 - DNA, 33 bp, Artificial Sequence
  Synthetic oligonucleotide
gcacccttccgcatgacgacccaccccacaaga

SEQ ID NO: 116059 - DNA, 35 bp, Artificial Sequence
  Synthetic oligonucleotide
ttcccaccgccgtcccgctactcgtgtgctcccga

SEQ ID NO: 116060 - DNA, 35 bp, Artificial Sequence
  Synthetic oligonucleotide
tgcctaccgcaccccctctcgctgtctacaagaca

SEQ ID NO: 116061 - DNA, 35 bp, Artificial Sequence
  Synthetic oligonucleotide
tacggggagggagggaagggggattggagacagca

SEQ ID NO: 116062 - DNA, 36 bp, Artificial Sequence
  Synthetic oligonucleotide
tcatcacaggagggaatacgggcgggggggcctgca

SEQ ID NO: 116063 - DNA, 37 bp, Artificial Sequence
  Synthetic oligonucleotide
agtaggacgggttctgcggtggaggagggtgggtgga

SEQ ID NO: 116064 - DNA, 35 bp, Artificial Sequence
  Synthetic oligonucleotide
gcacgcctctttgagttccctgctcttgccacacc

SEQ ID NO: 116065 - DNA, 35 bp, Artificial Sequence
  Synthetic oligonucleotide
tatcgccatgcccagttgcgaacgcttgtcccccc

SEQ ID NO: 116066 - DNA, 35 bp, Artificial Sequence
  Synthetic oligonucleotide
gaacaccccctcgagcttattccatccttgcttgc

SEQ ID NO: 116067 - DNA, 36 bp, Artificial Sequence
  Synthetic oligonucleotide
tagaccccgccgcattagtatttcatgcccctcgaa

SEQ ID NO: 116068 - DNA, 36 bp, Artificial Sequence
  Synthetic oligonucleotide
aagatggggggggggatggacggaagggcaacagca

SEQ ID NO: 116069 - DNA, 37 bp, Artificial Sequence
  Synthetic oligonucleotide
gacgcccgaccactggaatcaacccgcccatctacga

SEQ ID NO: 116070 - DNA, 35 bp, Artificial Sequence
  Synthetic oligonucleotide
gcacacctcctctcgagccctgaccctgctgtgcg

SEQ ID NO: 116071 - DNA, 35 bp, Artificial Sequence
  Synthetic oligonucleotide
gcgttaggccccttatgttacacccccatcgcttg

SEQ ID NO: 116072 - DNA, 35 bp, Artificial Sequence
  Synthetic oligonucleotide
gctctgttctgcctgctttgtcaccgcgcctccct

SEQ ID NO: 116073 - DNA, 36 bp, Artificial Sequence
  Synthetic oligonucleotide
tgccacccccgttgtgcctctcctttgccagtttca

SEQ ID NO: 116074 - DNA, 35 bp, Artificial Sequence
  Synthetic oligonucleotide
tgcggggtaggaaggcaaggggaggctagggtata

SEQ ID NO: 116075 - DNA, 35 bp, Artificial Sequence
  Synthetic oligonucleotide
gagtcaggggagtggtcgggaggggggtggaagta

SEQ ID NO: 116076 - DNA, 35 bp, Artificial Sequence
  Synthetic oligonucleotide
atgcacccgtttctcagttctgctagctcatgccc

SEQ ID NO: 116077 - DNA, 35 bp, Artificial Sequence
  Synthetic oligonucleotide
gcacaacccttcttcaccactcgccgccagttttg

SEQ ID NO: 116078 - DNA, 38 bp, Artificial Sequence
  Synthetic oligonucleotide
tgaccccgtccccgcacgcactggccatcaccacctga

SEQ ID NO: 116079 - DNA, 36 bp, Artificial Sequence
  Synthetic oligonucleotide
ggatgcatgaagggggtaggaaaagggaatgcgata

SEQ ID NO: 116080 - DNA, 35 bp, Artificial Sequence
  Synthetic oligonucleotide
tcatccagtgccaatctctcaagcaacccctgccc

SEQ ID NO: 116081 - DNA, 35 bp, Artificial Sequence
  Synthetic oligonucleotide
aagaccacggccctggtcctgccgactcgcctccc

SEQ ID NO: 116082 - DNA, 36 bp, Artificial Sequence
  Synthetic oligonucleotide
acccgcctcgcctcgagtgtcgtcgtaacccactcc

SEQ ID NO: 116083 - DNA, 35 bp, Artificial Sequence
  Synthetic oligonucleotide
tggaggcaccgccccctaatgattctcgcaccctg

SEQ ID NO: 116084 - DNA, 35 bp, Artificial Sequence
  Synthetic oligonucleotide
gggggttaacggtggaggggtgggaacggaatgaa

SEQ ID NO: 116085 - DNA, 35 bp, Artificial Sequence
  Synthetic oligonucleotide
gcctcctctgaccatctttccgctcgtttatagcg

SEQ ID NO: 116086 - DNA, 35 bp, Artificial Sequence
  Synthetic oligonucleotide
accctcctgccactgcccagagaacagtctgtact

SEQ ID NO: 116087 - DNA, 36 bp, Artificial Sequence
  Synthetic oligonucleotide
accccaattgctctgcgccccgccgtgtctccccca

SEQ ID NO: 116088 - DNA, 36 bp, Artificial Sequence
  Synthetic oligonucleotide
gccaggccctatccgctcgacccgctctcactttga

SEQ ID NO: 116089 - DNA, 35 bp, Artificial Sequence
  Synthetic oligonucleotide
gatggtggaggaggggtggctatcggtggtacacc

SEQ ID NO: 116090 - DNA, 35 bp, Artificial Sequence
  Synthetic oligonucleotide
tgctatcgtcagtcgctccaccctccacacaaggc

SEQ ID NO: 116091 - DNA, 36 bp, Artificial Sequence
  Synthetic oligonucleotide
accacccccaccagtgccctaattagtagtctcttg

SEQ ID NO: 116092 - DNA, 36 bp, Artificial Sequence
  Synthetic oligonucleotide
gccaagggttacaaaagggaggggagctgggggaaa

SEQ ID NO: 116093 - DNA, 35 bp, Artificial Sequence
  Synthetic oligonucleotide
atctgcgaccgtctgcattctacctcgttcttcgc

SEQ ID NO: 116094 - DNA, 35 bp, Artificial Sequence
  Synthetic oligonucleotide
tctctgcgccatccaccgtaacctcgctcctgttc

SEQ ID NO: 116095 - DNA, 37 bp, Artificial Sequence
  Synthetic oligonucleotide
tgccaggcgtggtgcggaaggggcggaggggctagga

SEQ ID NO: 116096 - DNA, 35 bp, Artificial Sequence
  Synthetic oligonucleotide
ttcctgccctcgttcctgccattcacctagcccta

SEQ ID NO: 116097 - DNA, 35 bp, Artificial Sequence
  Synthetic oligonucleotide
gccgatgcggtgtgttgtccgccttgttccccatc

SEQ ID NO: 116098 - DNA, 35 bp, Artificial Sequence
  Synthetic oligonucleotide
ttaccaccccggactgcattatactcaccatcgcg

SEQ ID NO: 116099 - DNA, 35 bp, Artificial Sequence
  Synthetic oligonucleotide
ttgtgcacacacgtttcattgacctccatctcgct

SEQ ID NO: 116100 - DNA, 36 bp, Artificial Sequence
  Synthetic oligonucleotide
tagggggggggtgcggaaggggcaaggcggaagaga

SEQ ID NO: 116101 - DNA, 37 bp, Artificial Sequence
  Synthetic oligonucleotide
gccacccaatggtccatttacgcctccccaccctgga

SEQ ID NO: 116102 - DNA, 38 bp, Artificial Sequence
  Synthetic oligonucleotide
ggtgggggtgggacgtggtgggcggttcaggaccctga

SEQ ID NO: 116103 - DNA, 35 bp, Artificial Sequence
  Synthetic oligonucleotide
ttctcaccgctctgctcggaccgctccttctgctc

SEQ ID NO: 116104 - DNA, 35 bp, Artificial Sequence
  Synthetic oligonucleotide
ttcacgacccctctcgactttgccccgcatcaatg

SEQ ID NO: 116105 - DNA, 35 bp, Artificial Sequence
  Synthetic oligonucleotide
gcactgctccaagtgcggcccctttcctcggttct

SEQ ID NO: 116106 - DNA, 38 bp, Artificial Sequence
  Synthetic oligonucleotide
tgcacctatccatgcagacctccgccccgtgcccttga

SEQ ID NO: 116107 - DNA, 36 bp, Artificial Sequence
  Synthetic oligonucleotide
tccgaccacggtaatcggttttctctcctccttcga

SEQ ID NO: 116108 - DNA, 37 bp, Artificial Sequence
  Synthetic oligonucleotide
ttgactcccctccattgcttgtaacgattccctagga

SEQ ID NO: 116109 - DNA, 35 bp, Artificial Sequence
  Synthetic oligonucleotide
atggactcgcgccacattttacacctctcgtacta

SEQ ID NO: 116110 - DNA, 35 bp, Artificial Sequence
  Synthetic oligonucleotide
agcaactcgcgcagcattcgccttttagccccccc

SEQ ID NO: 116111 - DNA, 35 bp, Artificial Sequence
  Synthetic oligonucleotide
gccataccttagcggcccccttcccttcgccactg

SEQ ID NO: 116112 - DNA, 35 bp, Artificial Sequence
  Synthetic oligonucleotide
aagcgcaccagcccttccctatcccgtctttagct

SEQ ID NO: 116113 - DNA, 35 bp, Artificial Sequence
  Synthetic oligonucleotide
gccatctccatgcccgttactcaacatcagtctca

SEQ ID NO: 116114 - DNA, 36 bp, Artificial Sequence
  Synthetic oligonucleotide
acctgcccatccctccccttacacgccacattggga

SEQ ID NO: 116115 - DNA, 35 bp, Artificial Sequence
  Synthetic oligonucleotide
gaccactcactcccccctgatccgcgctttgagcc

SEQ ID NO: 116116 - DNA, 35 bp, Artificial Sequence
  Synthetic oligonucleotide
agtgaccctgtgccgtttttggcgtactgttcctc

SEQ ID NO: 116117 - DNA, 35 bp, Artificial Sequence
  Synthetic oligonucleotide
ggggtcgcgggggggggtaaggggaggaatgacat

SEQ ID NO: 116118 - DNA, 35 bp, Artificial Sequence
  Synthetic oligonucleotide
aatgctaccgcctcaggccgtctcgcccctctcat

SEQ ID NO: 116119 - DNA, 36 bp, Artificial Sequence
  Synthetic oligonucleotide
gaagggggggccatgggtgacgggtgagagtacgga

SEQ ID NO: 116120 - DNA, 37 bp, Artificial Sequence
  Synthetic oligonucleotide
tccgacaccacgtcactggactctacccccccgctga

SEQ ID NO: 116121 - DNA, 35 bp, Artificial Sequence
  Synthetic oligonucleotide
tcgagacctcacttcctctacgcgcctgctcccgc

SEQ ID NO: 116122 - DNA, 35 bp, Artificial Sequence
  Synthetic oligonucleotide
gcaccgcccccttatgtaccaactcccgtccgtgt

SEQ ID NO: 116123 - DNA, 37 bp, Artificial Sequence
  Synthetic oligonucleotide
gaccacccccgccggttcagtcccgcgcttcatggga

SEQ ID NO: 116124 - DNA, 36 bp, Artificial Sequence
  Synthetic oligonucleotide
gcctccgctcaattcgcttacgtctatccgccctga

SEQ ID NO: 116125 - DNA, 36 bp, Artificial Sequence
  Synthetic oligonucleotide
gcgcaacgttcacgtttcgactccctccctgccgta

SEQ ID NO: 116126 - DNA, 35 bp, Artificial Sequence
  Synthetic oligonucleotide
acaaccacctgctgaacttttcgtttggactccac

SEQ ID NO: 116127 - DNA, 35 bp, Artificial Sequence
  Synthetic oligonucleotide
tctacccacatgcattaagtcctcaccgcatcgcc

SEQ ID NO: 116128 - DNA, 37 bp, Artificial Sequence
  Synthetic oligonucleotide
gaggggtgtccggggctggggtcctatgatatgggga

SEQ ID NO: 116129 - DNA, 38 bp, Artificial Sequence
  Synthetic oligonucleotide
agccacactccatcgccgcctattgcacaagcccttga

SEQ ID NO: 116130 - DNA, 36 bp, Artificial Sequence
  Synthetic oligonucleotide
ccacactccctcctgtcgtgcacgaactttcttcca

SEQ ID NO: 116131 - DNA, 37 bp, Artificial Sequence
  Synthetic oligonucleotide
tgaaagggggtagggaccaaagagggagggtgaagga

SEQ ID NO: 116132 - DNA, 37 bp, Artificial Sequence
  Synthetic oligonucleotide
gcggagcacgaccaggaaaaggggtggaggggtagga

SEQ ID NO: 116133 - DNA, 35 bp, Artificial Sequence
  Synthetic oligonucleotide
acatctcgcaactactgtaggtcgacccttaccac

SEQ ID NO: 116134 - DNA, 35 bp, Artificial Sequence
  Synthetic oligonucleotide
tgcacccatcatccagtcgttttccactttttggc

SEQ ID NO: 116135 - DNA, 35 bp, Artificial Sequence
  Synthetic oligonucleotide
ttcagacaccgccgccttccacctcctaggtattc

SEQ ID NO: 116136 - DNA, 35 bp, Artificial Sequence
  Synthetic oligonucleotide
aacgacacatgcgtttacctcgttttgttgccctt

SEQ ID NO: 116137 - DNA, 35 bp, Artificial Sequence
  Synthetic oligonucleotide
ggtgccctcctcttgtatcccgctcacatcacgtt

SEQ ID NO: 116138 - DNA, 35 bp, Artificial Sequence
  Synthetic oligonucleotide
taccactgtccatcaggctgctttttccctgttac

SEQ ID NO: 116139 - DNA, 35 bp, Artificial Sequence
  Synthetic oligonucleotide
gatgcgttatcaccctttcgcactgtgctccccta

SEQ ID NO: 116140 - DNA, 36 bp, Artificial Sequence
  Synthetic oligonucleotide
tcctgttccaccgcgttcatcgccgcatcctcagta

SEQ ID NO: 116141 - DNA, 35 bp, Artificial Sequence
  Synthetic oligonucleotide
ttccccccctgcccctgcatcacccattgtgcgac

SEQ ID NO: 116142 - DNA, 35 bp, Artificial Sequence
  Synthetic oligonucleotide
tgagcctcacacactctacgtgcgcctcgcctatc

SEQ ID NO: 116143 - DNA, 35 bp, Artificial Sequence
  Synthetic oligonucleotide
tacgttaccgacctgctgtttttatacctcatgct

SEQ ID NO: 116144 - DNA, 36 bp, Artificial Sequence
  Synthetic oligonucleotide
gatggcaaacgtcacatcacccgtcctctcgttcca

SEQ ID NO: 116145 - DNA, 38 bp, Artificial Sequence
  Synthetic oligonucleotide
tgcaccgaatcctcctaccgccaccttcaccctgctga

SEQ ID NO: 116146 - DNA, 35 bp, Artificial Sequence
  Synthetic oligonucleotide
aacgcaagccctccgccatgttccttggtgtgccc

SEQ ID NO: 116147 - DNA, 35 bp, Artificial Sequence
  Synthetic oligonucleotide
tgcggggggagggtgggcagtagaacggtcattgg

SEQ ID NO: 116148 - DNA, 35 bp, Artificial Sequence
  Synthetic oligonucleotide
gactgggtggggcgggtcgcaggaagaaagggtgt

SEQ ID NO: 116149 - DNA, 38 bp, Artificial Sequence
  Synthetic oligonucleotide
gtaggtcacggggggggcggatggagggaagatggtga

SEQ ID NO: 116150 - DNA, 35 bp, Artificial Sequence
  Synthetic oligonucleotide
tgccaagaccgacgtacgctcgcctctacccccct

SEQ ID NO: 116151 - DNA, 38 bp, Artificial Sequence
  Synthetic oligonucleotide
ttgcgtacgcagcagcccatccacccgttttgcactga

SEQ ID NO: 116152 - DNA, 35 bp, Artificial Sequence
  Synthetic oligonucleotide
taggagcgtgcagcctgtctttcgctgtaccgccc

SEQ ID NO: 116153 - DNA, 35 bp, Artificial Sequence
  Synthetic oligonucleotide
gccttcaccacatcgttgtccgggttgccccttgc

SEQ ID NO: 116154 - DNA, 35 bp, Artificial Sequence
  Synthetic oligonucleotide
ttgtctcctcaccctcgttcccgttgtcgacctct

SEQ ID NO: 116155 - DNA, 36 bp, Artificial Sequence
  Synthetic oligonucleotide
gggtcggcgaggtggaggggcgttgggaaggcataa

SEQ ID NO: 116156 - DNA, 35 bp, Artificial Sequence
  Synthetic oligonucleotide
ttcccccgtcgcgtcttttggcctttccgtcccac

SEQ ID NO: 116157 - DNA, 35 bp, Artificial Sequence
  Synthetic oligonucleotide
tgcgagtcgcatgtttgtcctgttgttttcctgcc

SEQ ID NO: 116158 - DNA, 35 bp, Artificial Sequence
  Synthetic oligonucleotide
gtgtcaccccagtccttctcgattagcccgtgatc

SEQ ID NO: 116159 - DNA, 35 bp, Artificial Sequence
  Synthetic oligonucleotide
acccctcgctctcgaatctgtctgcaaccttccat

SEQ ID NO: 116160 - DNA, 35 bp, Artificial Sequence
  Synthetic oligonucleotide
acgtgtccccccgccggccggtaaattttcaccct

SEQ ID NO: 116161 - DNA, 36 bp, Artificial Sequence
  Synthetic oligonucleotide
attccggcggaggaagggggcggtctcggtggaaaa

SEQ ID NO: 116162 - DNA, 35 bp, Artificial Sequence
  Synthetic oligonucleotide
tgtgcctgactgctacgccccttcctcccttagga

SEQ ID NO: 116163 - DNA, 36 bp, Artificial Sequence
  Synthetic oligonucleotide
tcaacggtccatttgccaccaccacactgtgtctca

SEQ ID NO: 116164 - DNA, 35 bp, Artificial Sequence
  Synthetic oligonucleotide
tgggaagggggacggtaggagagaagttacgccag

SEQ ID NO: 116165 - DNA, 35 bp, Artificial Sequence
  Synthetic oligonucleotide
tcccgccctcactcccaaagtgcatacattttatg

SEQ ID NO: 116166 - DNA, 35 bp, Artificial Sequence
  Synthetic oligonucleotide
acactcctcgcaccgatatataaactggtccttct

SEQ ID NO: 116167 - DNA, 37 bp, Artificial Sequence
  Synthetic oligonucleotide
gcgaatgggcacagtagagggggcgggctgggacgga

SEQ ID NO: 116168 - DNA, 36 bp, Artificial Sequence
  Synthetic oligonucleotide
tctctccaccgcactttgtttgactcattctccata

SEQ ID NO: 116169 - DNA, 35 bp, Artificial Sequence
  Synthetic oligonucleotide
ggtgggggaggggtccagatacggtggatggaacc

SEQ ID NO: 116170 - DNA, 35 bp, Artificial Sequence
  Synthetic oligonucleotide
ttgagccaccgttatccgccgttttctcaggtctt

SEQ ID NO: 116171 - DNA, 37 bp, Artificial Sequence
  Synthetic oligonucleotide
gacggggtaaagaaaagggaaggggacgagtcaggga

SEQ ID NO: 116172 - DNA, 35 bp, Artificial Sequence
  Synthetic oligonucleotide
tacatccagccgctgcggggccaacttcccttacc

SEQ ID NO: 116173 - DNA, 35 bp, Artificial Sequence
  Synthetic oligonucleotide
gtgcgcccggcctagctgcctttcaaatgaccctc

SEQ ID NO: 116174 - DNA, 35 bp, Artificial Sequence
  Synthetic oligonucleotide
tgacttgatcgctgctgcttatcacactccatctt

SEQ ID NO: 116175 - DNA, 36 bp, Artificial Sequence
  Synthetic oligonucleotide
tgtacgatccctacccccgtgccttccagtccttga

SEQ ID NO: 116176 - DNA, 35 bp, Artificial Sequence
  Synthetic oligonucleotide
tccctcgccgtatacgcccgtgacctcccctttgg

SEQ ID NO: 116177 - DNA, 35 bp, Artificial Sequence
  Synthetic oligonucleotide
gaaccccaccgcagcatagcatctgaaccctgcct

SEQ ID NO: 116178 - DNA, 35 bp, Artificial Sequence
  Synthetic oligonucleotide
tactatgccgcccgccgtctccgtcttcgcgcttt

SEQ ID NO: 116179 - DNA, 35 bp, Artificial Sequence
  Synthetic oligonucleotide
tccggaccactgtcccctgtatcatgtgcgctccc

SEQ ID NO: 116180 - DNA, 35 bp, Artificial Sequence
  Synthetic oligonucleotide
actgtacgtcggaggatggacggggtgggcggagg

SEQ ID NO: 116181 - DNA, 35 bp, Artificial Sequence
  Synthetic oligonucleotide
tcacccgctgccctggcccctgccttttacctcct

SEQ ID NO: 116182 - DNA, 35 bp, Artificial Sequence
  Synthetic oligonucleotide
gcctcctgcctggcacctcattcttccctggcgct

SEQ ID NO: 116183 - DNA, 36 bp, Artificial Sequence
  Synthetic oligonucleotide
gccaccgccgcttaccgatatatcgttccgtcccta

SEQ ID NO: 116184 - DNA, 35 bp, Artificial Sequence
  Synthetic oligonucleotide
gccactcctcctgttcccgatggatacgtctcgcc

SEQ ID NO: 116185 - DNA, 35 bp, Artificial Sequence
  Synthetic oligonucleotide
tgagcgtggaggggagggccggggcggggagtctg

SEQ ID NO: 116186 - DNA, 35 bp, Artificial Sequence
  Synthetic oligonucleotide
tgaagccagtggcgatctagcctaccaccccccgt

SEQ ID NO: 116187 - DNA, 35 bp, Artificial Sequence
  Synthetic oligonucleotide
acgcgtagccctgcctcccctcttgtcgtccttaa

SEQ ID NO: 116188 - DNA, 38 bp, Artificial Sequence
  Synthetic oligonucleotide
gcgagtgggggagggacgggcgaaagaccggggagtga

SEQ ID NO: 116189 - DNA, 34 bp, Artificial Sequence
  Synthetic oligonucleotide
gctttgaccccgtcctgctgactctatgccctgc

SEQ ID NO: 116190 - DNA, 35 bp, Artificial Sequence
  Synthetic oligonucleotide
tcatccatccgttctggtcgttgtcccaaccaatc

SEQ ID NO: 116191 - DNA, 35 bp, Artificial Sequence
  Synthetic oligonucleotide
tgtacgccctgccgctcccgttgtcttacacgctc

SEQ ID NO: 116192 - DNA, 35 bp, Artificial Sequence
  Synthetic oligonucleotide
tcgcatcccatcaatctgtcgacacctaatgctac

SEQ ID NO: 116193 - DNA, 35 bp, Artificial Sequence
  Synthetic oligonucleotide
tacccgtaccgacgattatcttgcgttgccccacc

SEQ ID NO: 116194 - DNA, 35 bp, Artificial Sequence
  Synthetic oligonucleotide
gcgactgctgccctttggacccctccctgccctcc

SEQ ID NO: 116195 - DNA, 35 bp, Artificial Sequence
  Synthetic oligonucleotide
ggtactgcctacccgtttgtcccccatgaccgcct

SEQ ID NO: 116196 - DNA, 35 bp, Artificial Sequence
  Synthetic oligonucleotide
gtccctccagacgcacgtcgctctctctctccatc

SEQ ID NO: 116197 - DNA, 33 bp, Artificial Sequence
  Synthetic oligonucleotide
atccaccatcgcgtgagccccgacattggccct

SEQ ID NO: 116198 - DNA, 37 bp, Artificial Sequence
  Synthetic oligonucleotide
gtcacccccaacctgcctttgcatcagccgtcccgga

SEQ ID NO: 116199 - DNA, 35 bp, Artificial Sequence
  Synthetic oligonucleotide
attcgccgccacacttcaacagtagatcgctgccc

SEQ ID NO: 116200 - DNA, 35 bp, Artificial Sequence
  Synthetic oligonucleotide
tatccccgtgctgctgcgattttcacctacccccg

SEQ ID NO: 116201 - DNA, 35 bp, Artificial Sequence
  Synthetic oligonucleotide
ttaaggccggggggagggttgaggggaggggtggt

SEQ ID NO: 116202 - DNA, 37 bp, Artificial Sequence
  Synthetic oligonucleotide
tgcacaccttcacattgtcctccgtcagcttacccga

SEQ ID NO: 116203 - DNA, 36 bp, Artificial Sequence
  Synthetic oligonucleotide
tctcaccccccttctgccttcgcgtgtacccgccga

SEQ ID NO: 116204 - DNA, 35 bp, Artificial Sequence
  Synthetic oligonucleotide
tccatatcgcgtggtccagtcgctctacttctccg

SEQ ID NO: 116205 - DNA, 35 bp, Artificial Sequence
  Synthetic oligonucleotide
gtaagacgaaggtgcggggacggcgaggaggggtg

SEQ ID NO: 116206 - DNA, 35 bp, Artificial Sequence
  Synthetic oligonucleotide
ttaagcgcgacaactccctgtctcatcatgccatc

SEQ ID NO: 116207 - DNA, 35 bp, Artificial Sequence
  Synthetic oligonucleotide
tgcccccccgtgctcattttccttgttgtcccagg

SEQ ID NO: 116208 - DNA, 37 bp, Artificial Sequence
  Synthetic oligonucleotide
actgagcaggatgacagcggggagggaagggggtgga

SEQ ID NO: 116209 - DNA, 35 bp, Artificial Sequence
  Synthetic oligonucleotide
ttcgctcgacgtgtccacttcctccgggccgttcc

SEQ ID NO: 116210 - DNA, 35 bp, Artificial Sequence
  Synthetic oligonucleotide
tcccagcccttctggctcattgacgcactatcctc

SEQ ID NO: 116211 - DNA, 35 bp, Artificial Sequence
  Synthetic oligonucleotide
attgccgggagggtggggtagggggccacaagtcg

SEQ ID NO: 116212 - DNA, 34 bp, Artificial Sequence
  Synthetic oligonucleotide
aacgcgactccattgttaccccctctacctcctg

SEQ ID NO: 116213 - DNA, 36 bp, Artificial Sequence
  Synthetic oligonucleotide
gctgacagtggaggaagggcggaacatggagaacaa

SEQ ID NO: 116214 - DNA, 36 bp, Artificial Sequence
  Synthetic oligonucleotide
gtgtcatcccgcaccctgttcagcgcccactgccga

SEQ ID NO: 116215 - DNA, 37 bp, Artificial Sequence
  Synthetic oligonucleotide
gcgagaaaagagtagggcatgggaagggcggaaggga

SEQ ID NO: 116216 - DNA, 35 bp, Artificial Sequence
  Synthetic oligonucleotide
tagccctggcctcacgtgagctcttctccatctta

SEQ ID NO: 116217 - DNA, 35 bp, Artificial Sequence
  Synthetic oligonucleotide
tcagaccaccccgtcgccctttggggccacccctg

SEQ ID NO: 116218 - DNA, 35 bp, Artificial Sequence
  Synthetic oligonucleotide
gcgcccgtccaattctgcgccgtcgaccccacttg

SEQ ID NO: 116219 - DNA, 35 bp, Artificial Sequence
  Synthetic oligonucleotide
tccaaacagtagcgcttatgctcatgccgatccct

SEQ ID NO: 116220 - DNA, 35 bp, Artificial Sequence
  Synthetic oligonucleotide
ttggccccaccgcccttagtgccctcgattcccgt

SEQ ID NO: 116221 - DNA, 35 bp, Artificial Sequence
  Synthetic oligonucleotide
tcacatgtcttgccgtttgtcgtccattccttcca

SEQ ID NO: 116222 - DNA, 35 bp, Artificial Sequence
  Synthetic oligonucleotide
tgccccgtctcgtctccctttcagtgttgtctcgc

SEQ ID NO: 116223 - DNA, 35 bp, Artificial Sequence
  Synthetic oligonucleotide
atacactcgctcgatctccctgccgcaatttacgt

SEQ ID NO: 116224 - DNA, 36 bp, Artificial Sequence
  Synthetic oligonucleotide
taccgacaaactgcaccgttgcgccttccatcccca

SEQ ID NO: 116225 - DNA, 35 bp, Artificial Sequence
  Synthetic oligonucleotide
aacgcccagcccctgctcccttgaatataccaggc

SEQ ID NO: 116226 - DNA, 35 bp, Artificial Sequence
  Synthetic oligonucleotide
ttgaccccacactgcccaccctcgtatgccccgag

SEQ ID NO: 116227 - DNA, 36 bp, Artificial Sequence
  Synthetic oligonucleotide
atgaacggacggatgcagtaggggggggcaatggta

SEQ ID NO: 116228 - DNA, 35 bp, Artificial Sequence
  Synthetic oligonucleotide
gaccagtggggggtggggggtgaggggtaacggac

SEQ ID NO: 116229 - DNA, 35 bp, Artificial Sequence
  Synthetic oligonucleotide
tgcacgtagggcgttcctcgttccgtccacacctc

SEQ ID NO: 116230 - DNA, 35 bp, Artificial Sequence
  Synthetic oligonucleotide
gtcacagccctcgttcgaatcatatgcccttattc

SEQ ID NO: 116231 - DNA, 35 bp, Artificial Sequence
  Synthetic oligonucleotide
tttcacctgcacatccgtggctctctgtcccgttc

SEQ ID NO: 116232 - DNA, 35 bp, Artificial Sequence
  Synthetic oligonucleotide
actgacgcagtcaattattgtctcgtctccctttc

SEQ ID NO: 116233 - DNA, 35 bp, Artificial Sequence
  Synthetic oligonucleotide
tgtatcctcctcgccccatccagttttcgtgacgg

SEQ ID NO: 116234 - DNA, 35 bp, Artificial Sequence
  Synthetic oligonucleotide
atgttcgcccgccctggaacgtcccggttatccac

SEQ ID NO: 116235 - DNA, 35 bp, Artificial Sequence
  Synthetic oligonucleotide
ggactggttccacatcgtttctcttcccgcttgac

SEQ ID NO: 116236 - DNA, 35 bp, Artificial Sequence
  Synthetic oligonucleotide
gccccaactagatgcgtcccacttcggtttcgccc

SEQ ID NO: 116237 - DNA, 35 bp, Artificial Sequence
  Synthetic oligonucleotide
tcctatctgccctcacaagccctattcaaggtccc

SEQ ID NO: 116238 - DNA, 35 bp, Artificial Sequence
  Synthetic oligonucleotide
gatcacctcccacctcatgtctaacgcaaacagcc

SEQ ID NO: 116239 - DNA, 35 bp, Artificial Sequence
  Synthetic oligonucleotide
tctgttcgtcgctgtaccgccttatccccccttcg

SEQ ID NO: 116240 - DNA, 35 bp, Artificial Sequence
  Synthetic oligonucleotide
tatcccaccgcccgctcaccacgcccgccgcagat

SEQ ID NO: 116241 - DNA, 35 bp, Artificial Sequence
  Synthetic oligonucleotide
atacgccaccacgccttcacacgacccacgactct

SEQ ID NO: 116242 - DNA, 36 bp, Artificial Sequence
  Synthetic oligonucleotide
gctcaacgctccctgtccatgcaactgacctacaca

SEQ ID NO: 116243 - DNA, 37 bp, Artificial Sequence
  Synthetic oligonucleotide
ggtcacccgcttatgatatcctcccgcacaccgccga

SEQ ID NO: 116244 - DNA, 35 bp, Artificial Sequence
  Synthetic oligonucleotide
aactccgccccgacacccctccgcgaccgccgcgg

SEQ ID NO: 116245 - DNA, 36 bp, Artificial Sequence
  Synthetic oligonucleotide
tgaggtggaggagtaaatgggggatgtggtggtgga

SEQ ID NO: 116246 - DNA, 35 bp, Artificial Sequence
  Synthetic oligonucleotide
cacttgcctccatccgtgctatcaagtgtttccac

SEQ ID NO: 116247 - DNA, 35 bp, Artificial Sequence
  Synthetic oligonucleotide
gcccgccgacgcccgacctgttgctacatacgccc

SEQ ID NO: 116248 - DNA, 35 bp, Artificial Sequence
  Synthetic oligonucleotide
accagctcacggacagcgatccttccactacctcc

SEQ ID NO: 116249 - DNA, 35 bp, Artificial Sequence
  Synthetic oligonucleotide
gctcctgcacctgttcgtgaactttcgtaatttcc

SEQ ID NO: 116250 - DNA, 35 bp, Artificial Sequence
  Synthetic oligonucleotide
tgcaacccggaagtccgtttttaccgtcgcacctc

SEQ ID NO: 116251 - DNA, 35 bp, Artificial Sequence
  Synthetic oligonucleotide
tccaccccccccgtttgagcagcattcacaaatca

SEQ ID NO: 116252 - DNA, 35 bp, Artificial Sequence
  Synthetic oligonucleotide
gacgactaccgacccagtatgacgctacctccccc

SEQ ID NO: 116253 - DNA, 35 bp, Artificial Sequence
  Synthetic oligonucleotide
tgcccactcctcccgaagtcgcccgtatcatccgc

SEQ ID NO: 116254 - DNA, 35 bp, Artificial Sequence
  Synthetic oligonucleotide
ccgaggccacatgtgcacgcccccactcccccttg

SEQ ID NO: 116255 - DNA, 35 bp, Artificial Sequence
  Synthetic oligonucleotide
acacctccgctcctgtgcagccagactcatgcgca

SEQ ID NO: 116256 - DNA, 38 bp, Artificial Sequence
  Synthetic oligonucleotide
acacctccttgccctgtacttagccgacaccccgttga

SEQ ID NO: 116257 - DNA, 35 bp, Artificial Sequence
  Synthetic oligonucleotide
gcgccccggctccatcagtctcacagccaccatct

SEQ ID NO: 116258 - DNA, 36 bp, Artificial Sequence
  Synthetic oligonucleotide
gtaagcccagtccatatcgtccatcgcggctcccca

SEQ ID NO: 116259 - DNA, 35 bp, Artificial Sequence
  Synthetic oligonucleotide
tgaccactggaacatctgcctccgttagcctttca

SEQ ID NO: 116260 - DNA, 35 bp, Artificial Sequence
  Synthetic oligonucleotide
acatccccctcattgatgacctatcgtttacaacc

SEQ ID NO: 116261 - DNA, 35 bp, Artificial Sequence
  Synthetic oligonucleotide
tgtatgcaccgccatgtcccttagtccacgctctt

SEQ ID NO: 116262 - DNA, 38 bp, Artificial Sequence
  Synthetic oligonucleotide
acgcacacaggaaagggttgggagggttagggaagtga

SEQ ID NO: 116263 - DNA, 37 bp, Artificial Sequence
  Synthetic oligonucleotide
tctaccatccgccttcctgtactttagttccctgtga

SEQ ID NO: 116264 - DNA, 35 bp, Artificial Sequence
  Synthetic oligonucleotide
gaccgctacgtcgggcctctacgtacactttccct

SEQ ID NO: 116265 - DNA, 35 bp, Artificial Sequence
  Synthetic oligonucleotide
ttgtcgccccctatttccaagggaccgctccctct

SEQ ID NO: 116266 - DNA, 37 bp, Artificial Sequence
  Synthetic oligonucleotide
gagtagggtgggacgtgggaggtgaacagggagggga

SEQ ID NO: 116267 - DNA, 37 bp, Artificial Sequence
  Synthetic oligonucleotide
acgggaggggagcacatttgtaggggcacggcgggga

SEQ ID NO: 116268 - DNA, 35 bp, Artificial Sequence
  Synthetic oligonucleotide
acaaccgccggatgagccagcaacaccctcgcccc

SEQ ID NO: 116269 - DNA, 36 bp, Artificial Sequence
  Synthetic oligonucleotide
acacaccccccatcactgcgcagctcctggctcttg

SEQ ID NO: 116270 - DNA, 35 bp, Artificial Sequence
  Synthetic oligonucleotide
gcccgccgccgcagtttgcgcttttggccatccat

SEQ ID NO: 116271 - DNA, 36 bp, Artificial Sequence
  Synthetic oligonucleotide
gacaagcccacttttacactggcacctccgcttcca

SEQ ID NO: 116272 - DNA, 37 bp, Artificial Sequence
  Synthetic oligonucleotide
gccccacccgcctatgtctcctctcttctatgttgga

SEQ ID NO: 116273 - DNA, 37 bp, Artificial Sequence
  Synthetic oligonucleotide
atggccgccatcacctgtctccctagccctgccctga

SEQ ID NO: 116274 - DNA, 35 bp, Artificial Sequence
  Synthetic oligonucleotide
tttgacaccgttgcattccgccgcctgtcaccacc

SEQ ID NO: 116275 - DNA, 35 bp, Artificial Sequence
  Synthetic oligonucleotide
actccgtcgtaccgctttggcctcttatgtacccc

SEQ ID NO: 116276 - DNA, 35 bp, Artificial Sequence
  Synthetic oligonucleotide
gccattcgcagccttccattcccttctcgccatag

SEQ ID NO: 116277 - DNA, 34 bp, Artificial Sequence
  Synthetic oligonucleotide
tcgccatacccggcttatattacctcccctccgg

SEQ ID NO: 116278 - DNA, 37 bp, Artificial Sequence
  Synthetic oligonucleotide
gaagggtagggtggacggtaggtggtgaggggtcgga

SEQ ID NO: 116279 - DNA, 35 bp, Artificial Sequence
  Synthetic oligonucleotide
gatgtaccgcagagcactccacgcccttttgttcc

SEQ ID NO: 116280 - DNA, 35 bp, Artificial Sequence
  Synthetic oligonucleotide
gaacaccggcccatccttgtctttgcctccgcccg

SEQ ID NO: 116281 - DNA, 34 bp, Artificial Sequence
  Synthetic oligonucleotide
acacgagaatggtgtggggggacggagggagagg

SEQ ID NO: 116282 - DNA, 35 bp, Artificial Sequence
  Synthetic oligonucleotide
acgctccctcgacacttgcaccttcccagcgcact

SEQ ID NO: 116283 - DNA, 31 bp, Artificial Sequence
  Synthetic oligonucleotide
ttgtcacccgcgctaatcgtctttactgctt

SEQ ID NO: 116284 - DNA, 36 bp, Artificial Sequence
  Synthetic oligonucleotide
taccagccacagcattagcactcctcgccctcccca

SEQ ID NO: 116285 - DNA, 36 bp, Artificial Sequence
  Synthetic oligonucleotide
gccccctcgtccaccacggcgaccgtgcccatccca

SEQ ID NO: 116286 - DNA, 38 bp, Artificial Sequence
  Synthetic oligonucleotide
acacgtcgccgccctgacctcatcgcttcatcacatga

SEQ ID NO: 116287 - DNA, 35 bp, Artificial Sequence
  Synthetic oligonucleotide
gcgccactgcacggttcccatcgccttcctgtcta

SEQ ID NO: 116288 - DNA, 35 bp, Artificial Sequence
  Synthetic oligonucleotide
tccacaacgccccgtttccccatgccaacgcgccc

SEQ ID NO: 116289 - DNA, 35 bp, Artificial Sequence
  Synthetic oligonucleotide
tattcaacgtcgcacgcctcggccctccttccgcc

SEQ ID NO: 116290 - DNA, 35 bp, Artificial Sequence
  Synthetic oligonucleotide
aaccccctcgatgcctctccagtacccaggtactc

SEQ ID NO: 116291 - DNA, 35 bp, Artificial Sequence
  Synthetic oligonucleotide
gtgccgcccgcttacttcctatctctgcgtctacg

SEQ ID NO: 116292 - DNA, 35 bp, Artificial Sequence
  Synthetic oligonucleotide
tgtgtcgcggccccgccgtggctattcctccctct

SEQ ID NO: 116293 - DNA, 35 bp, Artificial Sequence
  Synthetic oligonucleotide
accaacgcccaatgtctccatgttgtcttccgttt

SEQ ID NO: 116294 - DNA, 38 bp, Artificial Sequence
  Synthetic oligonucleotide
tacctacgccctccacttcgtatcgtcgctgtccttga

SEQ ID NO: 116295 - DNA, 35 bp, Artificial Sequence
  Synthetic oligonucleotide
gacccccagccccggatcgatccatcccctgtccc

SEQ ID NO: 116296 - DNA, 35 bp, Artificial Sequence
  Synthetic oligonucleotide
gaccaccttaccgatctgactgcgaacctttgctc

SEQ ID NO: 116297 - DNA, 35 bp, Artificial Sequence
  Synthetic oligonucleotide
aacatgtccatggtactgttctatccaactttctc

SEQ ID NO: 116298 - DNA, 37 bp, Artificial Sequence
  Synthetic oligonucleotide
gttcggggggtaggaaaaggggagcggggacgcagga

SEQ ID NO: 116299 - DNA, 35 bp, Artificial Sequence
  Synthetic oligonucleotide
gtaaccctcccatgagtcccacgagcccgagccac

SEQ ID NO: 116300 - DNA, 35 bp, Artificial Sequence
  Synthetic oligonucleotide
gaccacatccgctccgagtaacacaacacctcacc

SEQ ID NO: 116301 - DNA, 35 bp, Artificial Sequence
  Synthetic oligonucleotide
tcctcatccctgccctgcgtttttcacgggaattc

SEQ ID NO: 116302 - DNA, 35 bp, Artificial Sequence
  Synthetic oligonucleotide
gcccctccagtatgaactatcgcctgtattctttc

SEQ ID NO: 116303 - DNA, 35 bp, Artificial Sequence
  Synthetic oligonucleotide
attgccacaccgagcttattagtgccctctgtctt

SEQ ID NO: 116304 - DNA, 36 bp, Artificial Sequence
  Synthetic oligonucleotide
tcccctccgtatcacgtttctgttttatccactcca

SEQ ID NO: 116305 - DNA, 35 bp, Artificial Sequence
  Synthetic oligonucleotide
tcaagacggtccgactcacctgttcctcctcttca

SEQ ID NO: 116306 - DNA, 37 bp, Artificial Sequence
  Synthetic oligonucleotide
gcaccacctcccatgattactcgccccaatgccggga

SEQ ID NO: 116307 - DNA, 35 bp, Artificial Sequence
  Synthetic oligonucleotide
actgtcagtacagtgtacgcgtcacctacccctcc

SEQ ID NO: 116308 - DNA, 35 bp, Artificial Sequence
  Synthetic oligonucleotide
tcagccccatactgcaatcggtttctgctaccatc

SEQ ID NO: 116309 - DNA, 37 bp, Artificial Sequence
  Synthetic oligonucleotide
ggggccgtagttggggcggggctggatcactggggga

SEQ ID NO: 116310 - DNA, 35 bp, Artificial Sequence
  Synthetic oligonucleotide
tgtccactccctcgcttctattcgcttggtcaatc

SEQ ID NO: 116311 - DNA, 35 bp, Artificial Sequence
  Synthetic oligonucleotide
tacgcgacccactagctgccttccccatcgccgtc

SEQ ID NO: 116312 - DNA, 35 bp, Artificial Sequence
  Synthetic oligonucleotide
aacaagcgcatcgcatagtacttgctccccgcttc

SEQ ID NO: 116313 - DNA, 37 bp, Artificial Sequence
  Synthetic oligonucleotide
accttccccaggctccattcgttattgccacgcttga

SEQ ID NO: 116314 - DNA, 35 bp, Artificial Sequence
  Synthetic oligonucleotide
tcatctccgcccccttgtgtttcgcaagcacggac

SEQ ID NO: 116315 - DNA, 35 bp, Artificial Sequence
  Synthetic oligonucleotide
gcctgtccgctatgtgttgtctcatgccccccgtc

SEQ ID NO: 116316 - DNA, 36 bp, Artificial Sequence
  Synthetic oligonucleotide
gtggacattgggggagcgggggacaagagggagcaa

SEQ ID NO: 116317 - DNA, 36 bp, Artificial Sequence
  Synthetic oligonucleotide
tgcgcccccccacctgctttgttataccattgtcga

SEQ ID NO: 116318 - DNA, 37 bp, Artificial Sequence
  Synthetic oligonucleotide
atgacccgcatctgccctcccgccttctgtccgctga

SEQ ID NO: 116319 - DNA, 35 bp, Artificial Sequence
  Synthetic oligonucleotide
aagcgggcggagagggggggacggctggtggctac

SEQ ID NO: 116320 - DNA, 34 bp, Artificial Sequence
  Synthetic oligonucleotide
acctcctcaccctcatcggatggtcgttccattc

SEQ ID NO: 116321 - DNA, 35 bp, Artificial Sequence
  Synthetic oligonucleotide
gaccatctgttgttcccctgcgtacaccgcctttc

SEQ ID NO: 116322 - DNA, 36 bp, Artificial Sequence
  Synthetic oligonucleotide
gttccatccgcaggcttaggctcgcccccattttca

SEQ ID NO: 116323 - DNA, 38 bp, Artificial Sequence
  Synthetic oligonucleotide
tgaagcagggtggacaaggggtggaaggaaaagggtga

SEQ ID NO: 116324 - DNA, 35 bp, Artificial Sequence
  Synthetic oligonucleotide
tgttagccctgacgctgtagtcccattccgcctcc

SEQ ID NO: 116325 - DNA, 35 bp, Artificial Sequence
  Synthetic oligonucleotide
gatgtcgccggttttaggctcctgttccacccgtg

SEQ ID NO: 116326 - DNA, 35 bp, Artificial Sequence
  Synthetic oligonucleotide
ggagcccgggaggaaggatgggcggtggtggtact

SEQ ID NO: 116327 - DNA, 36 bp, Artificial Sequence
  Synthetic oligonucleotide
tgaatcgtcagggggcggcggaaaaagggaggggca

SEQ ID NO: 116328 - DNA, 37 bp, Artificial Sequence
  Synthetic oligonucleotide
gctagacagtagttggaggcaagaaggggggggcgga

SEQ ID NO: 116329 - DNA, 35 bp, Artificial Sequence
  Synthetic oligonucleotide
tgttaccacgcccctccctgacgcgtataccttga

SEQ ID NO: 116330 - DNA, 35 bp, Artificial Sequence
  Synthetic oligonucleotide
gggtcactcaccgttgcgcccctcccccgttcttg

SEQ ID NO: 116331 - DNA, 35 bp, Artificial Sequence
  Synthetic oligonucleotide
tatcggcccactcaattcgtttccgcactctcgct

SEQ ID NO: 116332 - DNA, 35 bp, Artificial Sequence
  Synthetic oligonucleotide
ttccacccgcctatatgaatatcggcatcacccca

SEQ ID NO: 116333 - DNA, 37 bp, Artificial Sequence
  Synthetic oligonucleotide
agctacacccgcatgccgctccctctgatccatctga

SEQ ID NO: 116334 - DNA, 36 bp, Artificial Sequence
  Synthetic oligonucleotide
ttcgtgtccgctgataacttgtccgtccctgctttc

SEQ ID NO: 116335 - DNA, 36 bp, Artificial Sequence
  Synthetic oligonucleotide
acagagagagaggaagggaggttattacgggcggga

SEQ ID NO: 116336 - DNA, 35 bp, Artificial Sequence
  Synthetic oligonucleotide
tgtgtcaccccgttgtctcctagccttgccgcgct

SEQ ID NO: 116337 - DNA, 34 bp, Artificial Sequence
  Synthetic oligonucleotide
gcctgcccgcctgtcggagttcgtcgccccccgc

SEQ ID NO: 116338 - DNA, 36 bp, Artificial Sequence
  Synthetic oligonucleotide
tagacctccccgccatgttcacggaaaactgcccca

SEQ ID NO: 116339 - DNA, 37 bp, Artificial Sequence
  Synthetic oligonucleotide
ggaagagggtcgggggaagaaagcggaggtggggtga

SEQ ID NO: 116340 - DNA, 37 bp, Artificial Sequence
  Synthetic oligonucleotide
tcaccccccataatgtattgcttcccaccggtcccga

SEQ ID NO: 116341 - DNA, 35 bp, Artificial Sequence
  Synthetic oligonucleotide
tagcccttcagcacgactgtagctcgcccaccccc

SEQ ID NO: 116342 - DNA, 35 bp, Artificial Sequence
  Synthetic oligonucleotide
gccccactgacaactgaccctggcaaatgcccccc

SEQ ID NO: 116343 - DNA, 35 bp, Artificial Sequence
  Synthetic oligonucleotide
gtgggggggaggaaggcgataggttcggctagcaa

SEQ ID NO: 116344 - DNA, 35 bp, Artificial Sequence
  Synthetic oligonucleotide
acatcctccgttgctaccctcgctgtgttcactca

SEQ ID NO: 116345 - DNA, 38 bp, Artificial Sequence
  Synthetic oligonucleotide
atctccatgccacctagtttttcacgccacagtcttga

SEQ ID NO: 116346 - DNA, 35 bp, Artificial Sequence
  Synthetic oligonucleotide
gccatccttgtggcgtatttgccttctgcctgaac

SEQ ID NO: 116347 - DNA, 35 bp, Artificial Sequence
  Synthetic oligonucleotide
tgtgctggcccccacttgttctgctcacataccgc

SEQ ID NO: 116348 - DNA, 35 bp, Artificial Sequence
  Synthetic oligonucleotide
gattaggagaaagggtaggaaggtggagctgttgg

SEQ ID NO: 116349 - DNA, 36 bp, Artificial Sequence
  Synthetic oligonucleotide
tactgccatccccctctgggtctattgaacccgcca

SEQ ID NO: 116350 - DNA, 36 bp, Artificial Sequence
  Synthetic oligonucleotide
gcccgcaccggatattccccgaggccccgtttgtta

SEQ ID NO: 116351 - DNA, 35 bp, Artificial Sequence
  Synthetic oligonucleotide
tgacgccctcctcgctccctaacccacagggcaac

SEQ ID NO: 116352 - DNA, 34 bp, Artificial Sequence
  Synthetic oligonucleotide
ttcaacgccgtgccatccgcattgatcccttgac

SEQ ID NO: 116353 - DNA, 37 bp, Artificial Sequence
  Synthetic oligonucleotide
aaagagaggggggtgggtgggcaccagaaggaggtga

SEQ ID NO: 116354 - DNA, 35 bp, Artificial Sequence
  Synthetic oligonucleotide
taggccacgtgtcacactgcccacccatcattgcc

SEQ ID NO: 116355 - DNA, 35 bp, Artificial Sequence
  Synthetic oligonucleotide
aatactagcgcagtcttcatcgcccgtctactctc

SEQ ID NO: 116356 - DNA, 35 bp, Artificial Sequence
  Synthetic oligonucleotide
ttgcaccaccgcagctcgatttcccctgactcact

SEQ ID NO: 116357 - DNA, 38 bp, Artificial Sequence
  Synthetic oligonucleotide
gcgagggtgggaggggatgggcccgtggatatttgtga

SEQ ID NO: 116358 - DNA, 36 bp, Artificial Sequence
  Synthetic oligonucleotide
tctgcaaggaggggaaaaatgggaaaggggctggta

SEQ ID NO: 116359 - DNA, 35 bp, Artificial Sequence
  Synthetic oligonucleotide
gcctgtatccgcctcacatgtgcgcatgtgtcctc

SEQ ID NO: 116360 - DNA, 35 bp, Artificial Sequence
  Synthetic oligonucleotide
taggcaccccctgcatatccgtctacaactccctg

SEQ ID NO: 116361 - DNA, 35 bp, Artificial Sequence
  Synthetic oligonucleotide
acatcaccttcagcccagcccgacgcttctcacat

SEQ ID NO: 116362 - DNA, 35 bp, Artificial Sequence
  Synthetic oligonucleotide
acgtgctcccttcccacccgtttatattgccatgt

SEQ ID NO: 116363 - DNA, 36 bp, Artificial Sequence
  Synthetic oligonucleotide
gacacaggttgaagggagtggtgaatcgggagggaa

SEQ ID NO: 116364 - DNA, 35 bp, Artificial Sequence
  Synthetic oligonucleotide
atgcaccatcacacgctttcactacgaccacaaca

SEQ ID NO: 116365 - DNA, 35 bp, Artificial Sequence
  Synthetic oligonucleotide
gtgccacccattctgtacctatttcatgccatcac

SEQ ID NO: 116366 - DNA, 35 bp, Artificial Sequence
  Synthetic oligonucleotide
gccccgccgcccttgtggttttatctcgccccgtg

SEQ ID NO: 116367 - DNA, 36 bp, Artificial Sequence
  Synthetic oligonucleotide
ttacgtccgcctgccatctgtcgccgctctgtaaca

SEQ ID NO: 116368 - DNA, 36 bp, Artificial Sequence
  Synthetic oligonucleotide
acacccttgccctgcttgccatagtcactagagtga

SEQ ID NO: 116369 - DNA, 35 bp, Artificial Sequence
  Synthetic oligonucleotide
tgtacaatgtgtgcctctcgtgtctcgtccccata

SEQ ID NO: 116370 - DNA, 35 bp, Artificial Sequence
  Synthetic oligonucleotide
gacgagtcctcgctacacccgtcaagtccaccacc

SEQ ID NO: 116371 - DNA, 35 bp, Artificial Sequence
  Synthetic oligonucleotide
gtggtccagactatgctgcctatcctcccctgccc

SEQ ID NO: 116372 - DNA, 35 bp, Artificial Sequence
  Synthetic oligonucleotide
gttggcgaagccgctgttgccttttgttccgatcc

SEQ ID NO: 116373 - DNA, 35 bp, Artificial Sequence
  Synthetic oligonucleotide
gtcgagcacttgttccctctgcatctgacctgtcc

SEQ ID NO: 116374 - DNA, 35 bp, Artificial Sequence
  Synthetic oligonucleotide
atcccgccctttcgtgtttattccgtccacaccct

SEQ ID NO: 116375 - DNA, 35 bp, Artificial Sequence
  Synthetic oligonucleotide
tgtgccccgtattggctatccctctcgcacgccct

SEQ ID NO: 116376 - DNA, 35 bp, Artificial Sequence
  Synthetic oligonucleotide
gtgcatcgctccctgtctcacggccccctgtacgt

SEQ ID NO: 116377 - DNA, 37 bp, Artificial Sequence
  Synthetic oligonucleotide
gcctgcctaggcaatgctcccgttcccccctgctgga

SEQ ID NO: 116378 - DNA, 35 bp, Artificial Sequence
  Synthetic oligonucleotide
gacccccgcactagatttgcctttgccgactcacc

SEQ ID NO: 116379 - DNA, 35 bp, Artificial Sequence
  Synthetic oligonucleotide
acgatggtaggcatgttgtcttcctgttcgcctcc

SEQ ID NO: 116380 - DNA, 35 bp, Artificial Sequence
  Synthetic oligonucleotide
agacaggcgagggagggggagtcggggattaatgc

SEQ ID NO: 116381 - DNA, 35 bp, Artificial Sequence
  Synthetic oligonucleotide
gccacccgccggagctatgtaacatcaccgcattc

SEQ ID NO: 116382 - DNA, 35 bp, Artificial Sequence
  Synthetic oligonucleotide
accatcccgctggtatttgatatgatgccctccac

SEQ ID NO: 116383 - DNA, 35 bp, Artificial Sequence
  Synthetic oligonucleotide
atgttcccccgctcgtacgatacgatggctctccc

SEQ ID NO: 116384 - DNA, 35 bp, Artificial Sequence
  Synthetic oligonucleotide
tcacctcccgtaatgcagattacgctcacacttgc

SEQ ID NO: 116385 - DNA, 35 bp, Artificial Sequence
  Synthetic oligonucleotide
acccgtaccccgcacgtccacgctccatttcttct

SEQ ID NO: 116386 - DNA, 35 bp, Artificial Sequence
  Synthetic oligonucleotide
tatcatcaccccatgcccagtatctgtccttcaca

SEQ ID NO: 116387 - DNA, 35 bp, Artificial Sequence
  Synthetic oligonucleotide
atgacaccgtagccacccccgataatacgcctcca

SEQ ID NO: 116388 - DNA, 36 bp, Artificial Sequence
  Synthetic oligonucleotide
tgtctagcacgcccgtcgtcccttcccctcactgca

SEQ ID NO: 116389 - DNA, 35 bp, Artificial Sequence
  Synthetic oligonucleotide
ttacccggctcactctgtcatctccacttgcacga

SEQ ID NO: 116390 - DNA, 35 bp, Artificial Sequence
  Synthetic oligonucleotide
tccgacaccacgtatgctacgcttcgccgctttcc

SEQ ID NO: 116391 - DNA, 35 bp, Artificial Sequence
  Synthetic oligonucleotide
gtccgcccacctttgcatatcccatgtccctgact

SEQ ID NO: 116392 - DNA, 35 bp, Artificial Sequence
  Synthetic oligonucleotide
accccacacattcctggcggcccttctcacccgct

SEQ ID NO: 116393 - DNA, 35 bp, Artificial Sequence
  Synthetic oligonucleotide
gccatcgcgccccgccactccgctacgctactttt

SEQ ID NO: 116394 - DNA, 35 bp, Artificial Sequence
  Synthetic oligonucleotide
tctgtgcccctcctctgagcctccccgttgaacca

SEQ ID NO: 116395 - DNA, 36 bp, Artificial Sequence
  Synthetic oligonucleotide
tgcattgccatgccatggtatccccctcgttcttca

SEQ ID NO: 116396 - DNA, 38 bp, Artificial Sequence
  Synthetic oligonucleotide
acgaggacgttggacggggaagggtgagggtgggatga

SEQ ID NO: 116397 - DNA, 35 bp, Artificial Sequence
  Synthetic oligonucleotide
tgcctcgtccgtctctctcgcttccttttgttgct

SEQ ID NO: 116398 - DNA, 35 bp, Artificial Sequence
  Synthetic oligonucleotide
acccgccgcctcctgttggtgctccctgttctata

SEQ ID NO: 116399 - DNA, 35 bp, Artificial Sequence
  Synthetic oligonucleotide
atgcgtaccgccccccgtgaatgccacttagtaac

SEQ ID NO: 116400 - DNA, 35 bp, Artificial Sequence
  Synthetic oligonucleotide
acacatccgctccacatgttcgattatcatcttgg

SEQ ID NO: 116401 - DNA, 35 bp, Artificial Sequence
  Synthetic oligonucleotide
aatgcacgtgcgccgctctctatccatcacactct

SEQ ID NO: 116402 - DNA, 36 bp, Artificial Sequence
  Synthetic oligonucleotide
ccccgcccatccccctcgccataccagacacggcca

SEQ ID NO: 116403 - DNA, 36 bp, Artificial Sequence
  Synthetic oligonucleotide
atgtcaatcccccccctgaagtgtcgcccggcccta

SEQ ID NO: 116404 - DNA, 35 bp, Artificial Sequence
  Synthetic oligonucleotide
taatgcaacgctgtccgtttcgctccctaaagtcc

SEQ ID NO: 116405 - DNA, 35 bp, Artificial Sequence
  Synthetic oligonucleotide
tccgccccctcgctcttagcgacataggtacacct

SEQ ID NO: 116406 - DNA, 37 bp, Artificial Sequence
  Synthetic oligonucleotide
ggaggaggggaggaagtggtgggcccgaggaacaaga

SEQ ID NO: 116407 - DNA, 37 bp, Artificial Sequence
  Synthetic oligonucleotide
tcacgacacatgccgctcccctcctccaggcttacga

SEQ ID NO: 116408 - DNA, 35 bp, Artificial Sequence
  Synthetic oligonucleotide
gatgcacagccaagaccgccctgccttaccatctg

SEQ ID NO: 116409 - DNA, 36 bp, Artificial Sequence
  Synthetic oligonucleotide
ttcccacgccatcatctttgcactccgtcgcccgaa

SEQ ID NO: 116410 - DNA, 35 bp, Artificial Sequence
  Synthetic oligonucleotide
gtccccggtccccgtgcccatctcgtttttcgcta

SEQ ID NO: 116411 - DNA, 35 bp, Artificial Sequence
  Synthetic oligonucleotide
aaccaactcgcatctttttcttcgcctggctattc

SEQ ID NO: 116412 - DNA, 37 bp, Artificial Sequence
  Synthetic oligonucleotide
tagggtgggcaagggggggggattgcgggtccaacga

SEQ ID NO: 116413 - DNA, 37 bp, Artificial Sequence
  Synthetic oligonucleotide
acactgccagctgtcactgttaccctgccaccttcga

SEQ ID NO: 116414 - DNA, 38 bp, Artificial Sequence
  Synthetic oligonucleotide
aacccagccgcccctagttcctcgctccctgccgttga

SEQ ID NO: 116415 - DNA, 35 bp, Artificial Sequence
  Synthetic oligonucleotide
tcacctcacctgccacacctctagccagcccgccc

SEQ ID NO: 116416 - DNA, 37 bp, Artificial Sequence
  Synthetic oligonucleotide
aaacgggtcaggggatggggagcaaggggggggaaga

SEQ ID NO: 116417 - DNA, 38 bp, Artificial Sequence
  Synthetic oligonucleotide
agacctgccccatgatcgtccatacatccgccccctga

SEQ ID NO: 116418 - DNA, 36 bp, Artificial Sequence
  Synthetic oligonucleotide
aagacccacagggaaggcgaaatgaaggggggggta

SEQ ID NO: 116419 - DNA, 35 bp, Artificial Sequence
  Synthetic oligonucleotide
gatccatcacccgactgctcacactcgccgcctgt

SEQ ID NO: 116420 - DNA, 35 bp, Artificial Sequence
  Synthetic oligonucleotide
taagcaggggggcggggaaagcaggccgaaatgaa

SEQ ID NO: 116421 - DNA, 36 bp, Artificial Sequence
  Synthetic oligonucleotide
gtccccacaccatgcgcccactaggccctccgttca

SEQ ID NO: 116422 - DNA, 35 bp, Artificial Sequence
  Synthetic oligonucleotide
gcgctgcattctcacgtccacccccgcttgtgccc

SEQ ID NO: 116423 - DNA, 35 bp, Artificial Sequence
  Synthetic oligonucleotide
gccctgttcactcccatggacctatcgctcccacg

SEQ ID NO: 116424 - DNA, 36 bp, Artificial Sequence
  Synthetic oligonucleotide
ttccgtcgccaccctttccgtatgctgttttcgtca

SEQ ID NO: 116425 - DNA, 38 bp, Artificial Sequence
  Synthetic oligonucleotide
ttcgcaggcgcccgcccctctattccgccacgccctga

SEQ ID NO: 116426 - DNA, 35 bp, Artificial Sequence
  Synthetic oligonucleotide
ttaccgccacccctgagctttttgacgacgtgacc

SEQ ID NO: 116427 - DNA, 35 bp, Artificial Sequence
  Synthetic oligonucleotide
gtgcgtagccgtggactacctaactgtgccctccc

SEQ ID NO: 116428 - DNA, 35 bp, Artificial Sequence
  Synthetic oligonucleotide
acctacaccatgccgtatagttcgctctttcaatc

SEQ ID NO: 116429 - DNA, 35 bp, Artificial Sequence
  Synthetic oligonucleotide
actaccccgggcccccgcacatgttatcctccttc

SEQ ID NO: 116430 - DNA, 35 bp, Artificial Sequence
  Synthetic oligonucleotide
tccccgttcactagtcgtttctcacccgtcttgac

SEQ ID NO: 116431 - DNA, 35 bp, Artificial Sequence
  Synthetic oligonucleotide
ttcgttctgccctgcgttgtttttccgtcttcccc

SEQ ID NO: 116432 - DNA, 35 bp, Artificial Sequence
  Synthetic oligonucleotide
agtgcgccctcggacctattgacctgtttgcccat

SEQ ID NO: 116433 - DNA, 35 bp, Artificial Sequence
  Synthetic oligonucleotide
gcccggtgccaatcccttctgccccagtcctgact

SEQ ID NO: 116434 - DNA, 35 bp, Artificial Sequence
  Synthetic oligonucleotide
atcatacgccctccctgctgcatacttagcctaca

SEQ ID NO: 116435 - DNA, 35 bp, Artificial Sequence
  Synthetic oligonucleotide
gccgcagtctcaccctttccatccattgcacgcca

SEQ ID NO: 116436 - DNA, 36 bp, Artificial Sequence
  Synthetic oligonucleotide
ccgaaaccgccgtactacttgccactcgcttactca

SEQ ID NO: 116437 - DNA, 36 bp, Artificial Sequence
  Synthetic oligonucleotide
agaacaggaggggtggggccggggggggcacagaga

SEQ ID NO: 116438 - DNA, 35 bp, Artificial Sequence
  Synthetic oligonucleotide
tgttccagcctccctcgtacgcccagtgaccgcgc

SEQ ID NO: 116439 - DNA, 37 bp, Artificial Sequence
  Synthetic oligonucleotide
gatggaaaggggtatggggaacggtacatgggggcga

SEQ ID NO: 116440 - DNA, 35 bp, Artificial Sequence
  Synthetic oligonucleotide
atacaccgacacttacgctaatgttcagcacctcc

SEQ ID NO: 116441 - DNA, 35 bp, Artificial Sequence
  Synthetic oligonucleotide
gttccgcacccctagtagtcccttccgcttattgc

SEQ ID NO: 116442 - DNA, 35 bp, Artificial Sequence
  Synthetic oligonucleotide
gtgcgccgacgccctcgcctttgtgcattccccct

SEQ ID NO: 116443 - DNA, 37 bp, Artificial Sequence
  Synthetic oligonucleotide
gatggggtggtagtggataggggtgggagggctacga

SEQ ID NO: 116444 - DNA, 34 bp, Artificial Sequence
  Synthetic oligonucleotide
tcagccactgcccccctggttggtttttttttcc

SEQ ID NO: 116445 - DNA, 35 bp, Artificial Sequence
  Synthetic oligonucleotide
gttcgcaactcgatcaggctttcacttctcacctc

SEQ ID NO: 116446 - DNA, 35 bp, Artificial Sequence
  Synthetic oligonucleotide
gggtcgcctcatgttgcttccttgcctcacttctc

SEQ ID NO: 116447 - DNA, 34 bp, Artificial Sequence
  Synthetic oligonucleotide
tgcatactcccaccgccatattgatgccttactg

SEQ ID NO: 116448 - DNA, 36 bp, Artificial Sequence
  Synthetic oligonucleotide
gccgccccgccgacgactataatcccccgagcacga

SEQ ID NO: 116449 - DNA, 38 bp, Artificial Sequence
  Synthetic oligonucleotide
ttcacccccctatgcatctccatcagcacgaaccgtga

SEQ ID NO: 116450 - DNA, 35 bp, Artificial Sequence
  Synthetic oligonucleotide
gtgcctgaccccgacccgtcaatactttagcttcc

SEQ ID NO: 116451 - DNA, 35 bp, Artificial Sequence
  Synthetic oligonucleotide
tcagtcctcctggcagagcttaagccccacccttc

SEQ ID NO: 116452 - DNA, 38 bp, Artificial Sequence
  Synthetic oligonucleotide
tgtgtgcgccgcctgcctgacacatgccactcccctga

SEQ ID NO: 116453 - DNA, 35 bp, Artificial Sequence
  Synthetic oligonucleotide
ttgttcaccccagatccatgctctctgttccccac

SEQ ID NO: 116454 - DNA, 35 bp, Artificial Sequence
  Synthetic oligonucleotide
tacgtcggactccgcgagcttattcacctccctgc

SEQ ID NO: 116455 - DNA, 35 bp, Artificial Sequence
  Synthetic oligonucleotide
gtccgccccacaaatctccacccccacccgaaggt

SEQ ID NO: 116456 - DNA, 36 bp, Artificial Sequence
  Synthetic oligonucleotide
ttgcgcccggcctcgtgcctgacaccatcctctcca

SEQ ID NO: 116457 - DNA, 36 bp, Artificial Sequence
  Synthetic oligonucleotide
gagtagtgggagtagaggggggggagaggaaggctc

SEQ ID NO: 116458 - DNA, 35 bp, Artificial Sequence
  Synthetic oligonucleotide
gacgcctgtccggtcgcgttatatccccggctgtc

SEQ ID NO: 116459 - DNA, 37 bp, Artificial Sequence
  Synthetic oligonucleotide
tccttcctccgcccttgtgtcgtccgtgacacttaga

SEQ ID NO: 116460 - DNA, 36 bp, Artificial Sequence
  Synthetic oligonucleotide
atcacgcctcccctcacaccgccagtccgtcttcaa

SEQ ID NO: 116461 - DNA, 35 bp, Artificial Sequence
  Synthetic oligonucleotide
gccggagcccccccccctcgtgtctggttccacca

SEQ ID NO: 116462 - DNA, 36 bp, Artificial Sequence
  Synthetic oligonucleotide
tgccctttcacccgctccttgcccctgcgacccgga

SEQ ID NO: 116463 - DNA, 38 bp, Artificial Sequence
  Synthetic oligonucleotide
tgcccgccgccctgcccgccatgtcctcacgcttatga

SEQ ID NO: 116464 - DNA, 35 bp, Artificial Sequence
  Synthetic oligonucleotide
ttaccaccgcacgtatgcccacgcttagtcctaac

SEQ ID NO: 116465 - DNA, 35 bp, Artificial Sequence
  Synthetic oligonucleotide
tgcgcccaggtcttctgctccacccgcaacccggt

SEQ ID NO: 116466 - DNA, 36 bp, Artificial Sequence
  Synthetic oligonucleotide
gagccccacccgctgtgtgcacttgcccgaatttca

SEQ ID NO: 116467 - DNA, 38 bp, Artificial Sequence
  Synthetic oligonucleotide
tgtatcgggcaagggaggggaagggaacagtgaactga

SEQ ID NO: 116468 - DNA, 35 bp, Artificial Sequence
  Synthetic oligonucleotide
cccgttaccccgctaccccgagttcaatcgccgac

SEQ ID NO: 116469 - DNA, 35 bp, Artificial Sequence
  Synthetic oligonucleotide
tctccgggtccatgtagcgtccaccatcttgcgcc

SEQ ID NO: 116470 - DNA, 34 bp, Artificial Sequence
  Synthetic oligonucleotide
aacactgtccgaggccacatgcacccgtcccccg

SEQ ID NO: 116471 - DNA, 35 bp, Artificial Sequence
  Synthetic oligonucleotide
gactgccccttttctacgtcgtccgctgcacccac

SEQ ID NO: 116472 - DNA, 35 bp, Artificial Sequence
  Synthetic oligonucleotide
gtccacctctcaagttgtttgttgcgccgcatccc

SEQ ID NO: 116473 - DNA, 35 bp, Artificial Sequence
  Synthetic oligonucleotide
ataccaaggtacccacgtgtcaccctccactgtcc

SEQ ID NO: 116474 - DNA, 35 bp, Artificial Sequence
  Synthetic oligonucleotide
gcgcccgtcctctgtttgtttttcgtttgctcctc

SEQ ID NO: 116475 - DNA, 35 bp, Artificial Sequence
  Synthetic oligonucleotide
tgccaacacacaccatcaccaccaccgcccctgcg

SEQ ID NO: 116476 - DNA, 36 bp, Artificial Sequence
  Synthetic oligonucleotide
gtccccgccccccaacgatccgtctatcagatcaca

SEQ ID NO: 116477 - DNA, 37 bp, Artificial Sequence
  Synthetic oligonucleotide
gttgggtgggaggtaggaggcggggggcgatgtatga

SEQ ID NO: 116478 - DNA, 38 bp, Artificial Sequence
  Synthetic oligonucleotide
tccccccctccttatgccttgtcgacccttggccttga

SEQ ID NO: 116479 - DNA, 37 bp, Artificial Sequence
  Synthetic oligonucleotide
gtcccctgtcccctgatgcatttggccccgattttga

SEQ ID NO: 116480 - DNA, 35 bp, Artificial Sequence
  Synthetic oligonucleotide
ttgccaccgttctatttccgtccttgccctcttgg

SEQ ID NO: 116481 - DNA, 37 bp, Artificial Sequence
  Synthetic oligonucleotide
acaggggaacgtgagaccactaatggggagggcggga

SEQ ID NO: 116482 - DNA, 37 bp, Artificial Sequence
  Synthetic oligonucleotide
acagccaggatgccctttctccgccgtcccgccctga

SEQ ID NO: 116483 - DNA, 35 bp, Artificial Sequence
  Synthetic oligonucleotide
gaccttcccggccgtaatctccgtcgccctgcttc

SEQ ID NO: 116484 - DNA, 35 bp, Artificial Sequence
  Synthetic oligonucleotide
gagtggggataaggaggggatggtaagggaaggct

SEQ ID NO: 116485 - DNA, 36 bp, Artificial Sequence
  Synthetic oligonucleotide
gcaaccgcattctattctactgttcgtgccacccca

SEQ ID NO: 116486 - DNA, 35 bp, Artificial Sequence
  Synthetic oligonucleotide
tagggcccccttcatgtcgctagctagctacctcc

SEQ ID NO: 116487 - DNA, 35 bp, Artificial Sequence
  Synthetic oligonucleotide
gagtaagtggaggggggtgtgcgggaggaatagag

SEQ ID NO: 116488 - DNA, 35 bp, Artificial Sequence
  Synthetic oligonucleotide
gtttacaccttcaccgccgtgctcacccatgctct

SEQ ID NO: 116489 - DNA, 35 bp, Artificial Sequence
  Synthetic oligonucleotide
gtgggcccatcttctgtcgcttaccaatgcctacc

SEQ ID NO: 116490 - DNA, 35 bp, Artificial Sequence
  Synthetic oligonucleotide
gtttccagccccccgttgactaaacgacccagccc

SEQ ID NO: 116491 - DNA, 35 bp, Artificial Sequence
  Synthetic oligonucleotide
acacagcctctcccagatccacgccccatcccgct

SEQ ID NO: 116492 - DNA, 35 bp, Artificial Sequence
  Synthetic oligonucleotide
ggtagccgcactattgttctgctcccctttcctct

SEQ ID NO: 116493 - DNA, 35 bp, Artificial Sequence
  Synthetic oligonucleotide
ttgctggtccgcttacgtttcccttgtactgcctt

SEQ ID NO: 116494 - DNA, 35 bp, Artificial Sequence
  Synthetic oligonucleotide
gtgcacggctcccgctccctgttattactccatcg

SEQ ID NO: 116495 - DNA, 35 bp, Artificial Sequence
  Synthetic oligonucleotide
gccaccgcacctttattcgtctacccgctcgatcg

SEQ ID NO: 116496 - DNA, 35 bp, Artificial Sequence
  Synthetic oligonucleotide
tgctccgcagacgccccctagcttcccttcgttat

SEQ ID NO: 116497 - DNA, 36 bp, Artificial Sequence
  Synthetic oligonucleotide
tctacccgccttcctccagttgcgcacatccttcca

SEQ ID NO: 116498 - DNA, 35 bp, Artificial Sequence
  Synthetic oligonucleotide
gtaccccagccgtccttttatttctggttccaccc

SEQ ID NO: 116499 - DNA, 35 bp, Artificial Sequence
  Synthetic oligonucleotide
taccggacccgcttacctgtttgccccgccttatt

SEQ ID NO: 116500 - DNA, 36 bp, Artificial Sequence
  Synthetic oligonucleotide
accaccagagcccatgctgcgtgcccttgccccata

SEQ ID NO: 116501 - DNA, 35 bp, Artificial Sequence
  Synthetic oligonucleotide
taacgtggcctccgagtactccgcctttccctgcc

SEQ ID NO: 116502 - DNA, 35 bp, Artificial Sequence
  Synthetic oligonucleotide
gttagtccccgctgtctgccccctgttgtgccgtt

SEQ ID NO: 116503 - DNA, 37 bp, Artificial Sequence
  Synthetic oligonucleotide
actcccactgcctcaggttatgcatccctcccctcga

SEQ ID NO: 116504 - DNA, 35 bp, Artificial Sequence
  Synthetic oligonucleotide
tagctgcctgcgatgatttaccgtcctccttttcc

SEQ ID NO: 116505 - DNA, 35 bp, Artificial Sequence
  Synthetic oligonucleotide
tcatcgcactttttgtcacctctgctccgtcctcg

SEQ ID NO: 116506 - DNA, 28 bp, Artificial Sequence
  Synthetic oligonucleotide
tagtcgtggaccccccccgtcctgcctt

SEQ ID NO: 116507 - DNA, 36 bp, Artificial Sequence
  Synthetic oligonucleotide
ggagaggggaggacaaaaactatgacaggtggcaca

SEQ ID NO: 116508 - DNA, 35 bp, Artificial Sequence
  Synthetic oligonucleotide
gtccgactccgcttctgcccggccctctctatgca

SEQ ID NO: 116509 - DNA, 35 bp, Artificial Sequence
  Synthetic oligonucleotide
ttgcctgcccgcccccatttggtagcccagcaacg

SEQ ID NO: 116510 - DNA, 36 bp, Artificial Sequence
  Synthetic oligonucleotide
atcccgccgcctgatgattgccatcactcactctca

SEQ ID NO: 116511 - DNA, 35 bp, Artificial Sequence
  Synthetic oligonucleotide
tgactcaccacgaaggtacccagactactcccccc

SEQ ID NO: 116512 - DNA, 35 bp, Artificial Sequence
  Synthetic oligonucleotide
tacgccgcccctattcgctctctatgttccgtctt

SEQ ID NO: 116513 - DNA, 35 bp, Artificial Sequence
  Synthetic oligonucleotide
atccgcaagcctcatgcgtcccctaccgcaccttt

SEQ ID NO: 116514 - DNA, 35 bp, Artificial Sequence
  Synthetic oligonucleotide
gtacgactccggctgcattgtccacctctcctaca

SEQ ID NO: 116515 - DNA, 35 bp, Artificial Sequence
  Synthetic oligonucleotide
tcgtaccgcggtttctatctcctgcacgttaccac

SEQ ID NO: 116516 - DNA, 35 bp, Artificial Sequence
  Synthetic oligonucleotide
atcctctcgcccacccgtacgtcccttcgtgggac

SEQ ID NO: 116517 - DNA, 35 bp, Artificial Sequence
  Synthetic oligonucleotide
gtcccctcgattgactgttatccgtccttggctcc

SEQ ID NO: 116518 - DNA, 35 bp, Artificial Sequence
  Synthetic oligonucleotide
gtttggcgcagagcccccacgccttcctccactcg

SEQ ID NO: 116519 - DNA, 35 bp, Artificial Sequence
  Synthetic oligonucleotide
gaaggagggggaaggaattatgggataggcgcggt

SEQ ID NO: 116520 - DNA, 37 bp, Artificial Sequence
  Synthetic oligonucleotide
gactgggtggcaggggaggaaagggtctggcggtgga

SEQ ID NO: 116521 - DNA, 36 bp, Artificial Sequence
  Synthetic oligonucleotide
ggtcacgccccgccactcgtaccctgttatttcgta

SEQ ID NO: 116522 - DNA, 36 bp, Artificial Sequence
  Synthetic oligonucleotide
gatgcactccattcacctgcctattctccagtctta

SEQ ID NO: 116523 - DNA, 35 bp, Artificial Sequence
  Synthetic oligonucleotide
tacgtgttgcactccctggttttgtgccgccctgc

SEQ ID NO: 116524 - DNA, 35 bp, Artificial Sequence
  Synthetic oligonucleotide
gtcacggtcgtgctgttcagcccttgccttcctgc

SEQ ID NO: 116525 - DNA, 35 bp, Artificial Sequence
  Synthetic oligonucleotide
gtgactcgctcactcgatcccggttccctgtttgc

SEQ ID NO: 116526 - DNA, 35 bp, Artificial Sequence
  Synthetic oligonucleotide
gacgtcaatcgcctccatctcacgcagatgtcctc

SEQ ID NO: 116527 - DNA, 33 bp, Artificial Sequence
  Synthetic oligonucleotide
gacccccgactttcgtgcccctatatccgccgg

SEQ ID NO: 116528 - DNA, 35 bp, Artificial Sequence
  Synthetic oligonucleotide
gatcgcaactcgctcccagtcctccacccatgttg

SEQ ID NO: 116529 - DNA, 35 bp, Artificial Sequence
  Synthetic oligonucleotide
gaccaccgccccgcccccgtgccaacgtaaaggct

SEQ ID NO: 116530 - DNA, 35 bp, Artificial Sequence
  Synthetic oligonucleotide
gacccaccgcataggtaacgctacttaacccttca

SEQ ID NO: 116531 - DNA, 37 bp, Artificial Sequence
  Synthetic oligonucleotide
gtagcacccgcccctgccccattattcccttgcgaga

SEQ ID NO: 116532 - DNA, 37 bp, Artificial Sequence
  Synthetic oligonucleotide
gcccaccatttactgctgatccgttctcttcctggga

SEQ ID NO: 116533 - DNA, 38 bp, Artificial Sequence
  Synthetic oligonucleotide
tcagtgggcgggggtggagggacaaggtcgcttactga

SEQ ID NO: 116534 - DNA, 35 bp, Artificial Sequence
  Synthetic oligonucleotide
gttcgcctcctcggagtcacccccactctctctga

SEQ ID NO: 116535 - DNA, 35 bp, Artificial Sequence
  Synthetic oligonucleotide
acgcggcccccgttgccctgttttaatctaacctt

SEQ ID NO: 116536 - DNA, 36 bp, Artificial Sequence
  Synthetic oligonucleotide
gacaccttcctccttattgcgctagttgcaacgcca

SEQ ID NO: 116537 - DNA, 35 bp, Artificial Sequence
  Synthetic oligonucleotide
tcacaccctcttcacgtcagggcgccctcttacga

SEQ ID NO: 116538 - DNA, 38 bp, Artificial Sequence
  Synthetic oligonucleotide
accctgctgccaccacgcctaacgaccacgccgcttga

SEQ ID NO: 116539 - DNA, 35 bp, Artificial Sequence
  Synthetic oligonucleotide
acacaccttggatcttctattgctctctgtttccc

SEQ ID NO: 116540 - DNA, 35 bp, Artificial Sequence
  Synthetic oligonucleotide
gtcctcagccgaccgcctgttacatgtccactcgc

SEQ ID NO: 116541 - DNA, 35 bp, Artificial Sequence
  Synthetic oligonucleotide
tgtgccccgcccaccttacttcacgttagcttcgc

SEQ ID NO: 116542 - DNA, 35 bp, Artificial Sequence
  Synthetic oligonucleotide
ataccgccgatatccgtacccgccctttacactgc

SEQ ID NO: 116543 - DNA, 35 bp, Artificial Sequence
  Synthetic oligonucleotide
gccccccgtcgatacgcataccggtgccccttatc

SEQ ID NO: 116544 - DNA, 35 bp, Artificial Sequence
  Synthetic oligonucleotide
agaaggggtagtaggggataagggtgagtgggacg

SEQ ID NO: 116545 - DNA, 35 bp, Artificial Sequence
  Synthetic oligonucleotide
tagcccatccgtgccgctatggtttcttcatactt

SEQ ID NO: 116546 - DNA, 37 bp, Artificial Sequence
  Synthetic oligonucleotide
acgaccagtcgtctgctcccccttgcctctaccacga

SEQ ID NO: 116547 - DNA, 37 bp, Artificial Sequence
  Synthetic oligonucleotide
actgacgagggagggggacggggaggttgtagcagga

SEQ ID NO: 116548 - DNA, 35 bp, Artificial Sequence
  Synthetic oligonucleotide
gactagatccgtcctgcttctcgtagcctctgccc

SEQ ID NO: 116549 - DNA, 35 bp, Artificial Sequence
  Synthetic oligonucleotide
tacaggtcgaagttctgtccgccctctgtttgccc

SEQ ID NO: 116550 - DNA, 35 bp, Artificial Sequence
  Synthetic oligonucleotide
ttcatcgccccattgctacaagccttgattccccg

SEQ ID NO: 116551 - DNA, 35 bp, Artificial Sequence
  Synthetic oligonucleotide
tcaatacctccgcccccgacgcacatgcgatgcca

SEQ ID NO: 116552 - DNA, 38 bp, Artificial Sequence
  Synthetic oligonucleotide
gcctccgcccaactgaccactccccatccatatcatga

SEQ ID NO: 116553 - DNA, 35 bp, Artificial Sequence
  Synthetic oligonucleotide
acgacacccctcctacgtccgtcgatcctcatcac

SEQ ID NO: 116554 - DNA, 35 bp, Artificial Sequence
  Synthetic oligonucleotide
accaagcgcgcggcctatgccccctccgttgtccc

SEQ ID NO: 116555 - DNA, 35 bp, Artificial Sequence
  Synthetic oligonucleotide
tgtgtgccgccccccttagccgatataaacccgcc

SEQ ID NO: 116556 - DNA, 35 bp, Artificial Sequence
  Synthetic oligonucleotide
tagccgtcgcctccctcatctgatcttagttttcc

SEQ ID NO: 116557 - DNA, 35 bp, Artificial Sequence
  Synthetic oligonucleotide
gtgggggggaagggactttgggagagcagtacgag

SEQ ID NO: 116558 - DNA, 35 bp, Artificial Sequence
  Synthetic oligonucleotide
tgttcgcccccagacctccattaccagttcattgt

SEQ ID NO: 116559 - DNA, 35 bp, Artificial Sequence
  Synthetic oligonucleotide
gtcaccctccgttggagcttattccccctttagtt

SEQ ID NO: 116560 - DNA, 37 bp, Artificial Sequence
  Synthetic oligonucleotide
agccggaggggagaaggggaagaggcgtggcattaga

SEQ ID NO: 116561 - DNA, 37 bp, Artificial Sequence
  Synthetic oligonucleotide
gagtggaagaggggtatcgggggcaggggggcgacga

SEQ ID NO: 116562 - DNA, 35 bp, Artificial Sequence
  Synthetic oligonucleotide
tgccctctcatcccccgtttattcttgctgctatc

SEQ ID NO: 116563 - DNA, 35 bp, Artificial Sequence
  Synthetic oligonucleotide
gatgtgagccgggagggggggttaggtatcgggtg

SEQ ID NO: 116564 - DNA, 36 bp, Artificial Sequence
  Synthetic oligonucleotide
aacgccccttcttccttgtggtatctacaccctcga

SEQ ID NO: 116565 - DNA, 37 bp, Artificial Sequence
  Synthetic oligonucleotide
tgctcctcactccacactcaatgcgcgaccctcttga

SEQ ID NO: 116566 - DNA, 38 bp, Artificial Sequence
  Synthetic oligonucleotide
gaacgcgggtaagagcggagggaggcggaggggtttga

SEQ ID NO: 116567 - DNA, 35 bp, Artificial Sequence
  Synthetic oligonucleotide
gccggtcaacaggagcaagggtggtgcgggggggc

SEQ ID NO: 116568 - DNA, 38 bp, Artificial Sequence
  Synthetic oligonucleotide
tccccacaccgcctccctcagcagagtctgtttactga

SEQ ID NO: 116569 - DNA, 37 bp, Artificial Sequence
  Synthetic oligonucleotide
gccccccgctgttccgccatatgccctcttctgttga

SEQ ID NO: 116570 - DNA, 35 bp, Artificial Sequence
  Synthetic oligonucleotide
gatgccactgtgtttctctgccgctccctttgata

SEQ ID NO: 116571 - DNA, 35 bp, Artificial Sequence
  Synthetic oligonucleotide
acccacttcgcccccggtttcggtgctactggccc

SEQ ID NO: 116572 - DNA, 35 bp, Artificial Sequence
  Synthetic oligonucleotide
taacaactcaggatggcttcttgttcctgttcctc

SEQ ID NO: 116573 - DNA, 35 bp, Artificial Sequence
  Synthetic oligonucleotide
tccattcctggtgtgttgcccacgcttgctccttc

SEQ ID NO: 116574 - DNA, 35 bp, Artificial Sequence
  Synthetic oligonucleotide
gctccctgcctcggacccaagtaacgcacccatct

SEQ ID NO: 116575 - DNA, 35 bp, Artificial Sequence
  Synthetic oligonucleotide
gctgtgccggcgcgtacctgtcattttctcccctt

SEQ ID NO: 116576 - DNA, 35 bp, Artificial Sequence
  Synthetic oligonucleotide
gcgccccactctgctctatagcgttccgcccttat

SEQ ID NO: 116577 - DNA, 35 bp, Artificial Sequence
  Synthetic oligonucleotide
tttaggggcaagggggggcggagcagggggaaggg

SEQ ID NO: 116578 - DNA, 35 bp, Artificial Sequence
  Synthetic oligonucleotide
tacgcaacgcgtggcaaccccttccaattgttcct

SEQ ID NO: 116579 - DNA, 35 bp, Artificial Sequence
  Synthetic oligonucleotide
tgtggcccaactgtagcgcgatcctttcttgttct

SEQ ID NO: 116580 - DNA, 35 bp, Artificial Sequence
  Synthetic oligonucleotide
tacgtatccgccacacctctgtccatgccctcagt

SEQ ID NO: 116581 - DNA, 35 bp, Artificial Sequence
  Synthetic oligonucleotide
gggggggggggggtacgggcaatgaacggagggaa

SEQ ID NO: 116582 - DNA, 36 bp, Artificial Sequence
  Synthetic oligonucleotide
agcctggccagccttttgtaccttttgtccctgcca

SEQ ID NO: 116583 - DNA, 38 bp, Artificial Sequence
  Synthetic oligonucleotide
agtggaggagggggatacgggagggcggacggtcatga

SEQ ID NO: 116584 - DNA, 35 bp, Artificial Sequence
  Synthetic oligonucleotide
ttcgcccaccgactcctgcgccaccggacatgtac

SEQ ID NO: 116585 - DNA, 35 bp, Artificial Sequence
  Synthetic oligonucleotide
acgaactcctcgtccgaccgcgcccttctcctctc

SEQ ID NO: 116586 - DNA, 35 bp, Artificial Sequence
  Synthetic oligonucleotide
atagatgacgtggaagggcggagaaaggggcgtgg

SEQ ID NO: 116587 - DNA, 35 bp, Artificial Sequence
  Synthetic oligonucleotide
gtggatcccgctgtttgtcccagctctttgcccct

SEQ ID NO: 116588 - DNA, 35 bp, Artificial Sequence
  Synthetic oligonucleotide
agcaatgccacccgccgcctcgacacctgcattgt

SEQ ID NO: 116589 - DNA, 35 bp, Artificial Sequence
  Synthetic oligonucleotide
acgatgcgaatgggttcgttttatcctgccgcctt

SEQ ID NO: 116590 - DNA, 35 bp, Artificial Sequence
  Synthetic oligonucleotide
tgtaacactgcccccccctgttgttacacctcctt

SEQ ID NO: 116591 - DNA, 35 bp, Artificial Sequence
  Synthetic oligonucleotide
gattccccgtatgcccctgtgtcttgtcgtccttt

SEQ ID NO: 116592 - DNA, 35 bp, Artificial Sequence
  Synthetic oligonucleotide
tgttgctcgccgccccccgaccagatcggttcttt

SEQ ID NO: 116593 - DNA, 35 bp, Artificial Sequence
  Synthetic oligonucleotide
tgcccacaccccctggtcgtacctaacattccaca

SEQ ID NO: 116594 - DNA, 35 bp, Artificial Sequence
  Synthetic oligonucleotide
gacgggggaaagggggacaatagaagcaccgtaga

SEQ ID NO: 116595 - DNA, 37 bp, Artificial Sequence
  Synthetic oligonucleotide
agcaccactcgcccgtacctttgcctgccccgcggga

SEQ ID NO: 116596 - DNA, 35 bp, Artificial Sequence
  Synthetic oligonucleotide
accccccccctacattggcgtgaacatggatcccc

SEQ ID NO: 116597 - DNA, 35 bp, Artificial Sequence
  Synthetic oligonucleotide
gccacccatgccttggctgttctacttgaccactt

SEQ ID NO: 116598 - DNA, 36 bp, Artificial Sequence
  Synthetic oligonucleotide
tgaccctctgtacggaatatcgctccctcgcaccca

SEQ ID NO: 116599 - DNA, 37 bp, Artificial Sequence
  Synthetic oligonucleotide
gtgggcatgaagggcgggtgggtctatacatatctga

SEQ ID NO: 116600 - DNA, 35 bp, Artificial Sequence
  Synthetic oligonucleotide
acatcctcccacctggtctacagccgctgttagcc

SEQ ID NO: 116601 - DNA, 35 bp, Artificial Sequence
  Synthetic oligonucleotide
gttgaggactagggtggaaggggtgggagacgggg

SEQ ID NO: 116602 - DNA, 35 bp, Artificial Sequence
  Synthetic oligonucleotide
tgaacaaaagcgggaggggggcaatcagggagggt

SEQ ID NO: 116603 - DNA, 35 bp, Artificial Sequence
  Synthetic oligonucleotide
gatccctgtcgccagcccgttaatcccccggtctt

SEQ ID NO: 116604 - DNA, 37 bp, Artificial Sequence
  Synthetic oligonucleotide
gacggggagggaggagtggagatgaacgaaggccgga

SEQ ID NO: 116605 - DNA, 37 bp, Artificial Sequence
  Synthetic oligonucleotide
gacgtcgcggagggaggggcggctagggggggcatga

SEQ ID NO: 116606 - DNA, 35 bp, Artificial Sequence
  Synthetic oligonucleotide
gcccagccttaggaactttcagtcatggcctcccc

SEQ ID NO: 116607 - DNA, 35 bp, Artificial Sequence
  Synthetic oligonucleotide
gttcgacccccacgcctttgctttcgctggtaatc

SEQ ID NO: 116608 - DNA, 35 bp, Artificial Sequence
  Synthetic oligonucleotide
atgggcccctgccgctgccccctggggttcccctc

SEQ ID NO: 116609 - DNA, 35 bp, Artificial Sequence
  Synthetic oligonucleotide
acccaacctcaccgtgcattgcgctacttgccgtg

SEQ ID NO: 116610 - DNA, 35 bp, Artificial Sequence
  Synthetic oligonucleotide
gcactccgcaggcttatatactcgctttgttacat

SEQ ID NO: 116611 - DNA, 36 bp, Artificial Sequence
  Synthetic oligonucleotide
gtctgctgccccatgtcccgcttccgctgcttacca

SEQ ID NO: 116612 - DNA, 37 bp, Artificial Sequence
  Synthetic oligonucleotide
tccgcctccattcgcactttatagcacaccactctga

SEQ ID NO: 116613 - DNA, 35 bp, Artificial Sequence
  Synthetic oligonucleotide
accacactcctcgaaggttcgcctgtgacaccccc

SEQ ID NO: 116614 - DNA, 35 bp, Artificial Sequence
  Synthetic oligonucleotide
tcctcctctgcctgtcgttaggcccattgcctcgc

SEQ ID NO: 116615 - DNA, 35 bp, Artificial Sequence
  Synthetic oligonucleotide
tccccatcgcctttctgtctctcgaatgacgtctc

SEQ ID NO: 116616 - DNA, 35 bp, Artificial Sequence
  Synthetic oligonucleotide
tcccgaccccgacccgcttgccctcacacgagtaa

SEQ ID NO: 116617 - DNA, 35 bp, Artificial Sequence
  Synthetic oligonucleotide
tgtactccgcaccctccgcactgtctctgttccgg

SEQ ID NO: 116618 - DNA, 35 bp, Artificial Sequence
  Synthetic oligonucleotide
gtccgaccacccccgccctcgctttaccagctatg

SEQ ID NO: 116619 - DNA, 38 bp, Artificial Sequence
  Synthetic oligonucleotide
ttcgcgggttgcagctgtctattccccctccaccatga

SEQ ID NO: 116620 - DNA, 35 bp, Artificial Sequence
  Synthetic oligonucleotide
tagatcgctcccccgtcgtgtttctcccctcttga

SEQ ID NO: 116621 - DNA, 35 bp, Artificial Sequence
  Synthetic oligonucleotide
gcctcgccgtagccctcctcacaacacccgctgta

SEQ ID NO: 116622 - DNA, 36 bp, Artificial Sequence
  Synthetic oligonucleotide
aggggacggggaatggcgatagagggcacggtcaca

SEQ ID NO: 116623 - DNA, 38 bp, Artificial Sequence
  Synthetic oligonucleotide
gtacccgccttccatctattgccatgtccctgtagtga

SEQ ID NO: 116624 - DNA, 36 bp, Artificial Sequence
  Synthetic oligonucleotide
atcgccacttccatccccggtaacacacacttcgta

SEQ ID NO: 116625 - DNA, 35 bp, Artificial Sequence
  Synthetic oligonucleotide
gtgccgggtctgcatccgccccacctctcgccttg

SEQ ID NO: 116626 - DNA, 35 bp, Artificial Sequence
  Synthetic oligonucleotide
tcgcacgcccgccggtttctcgataacacactgct

SEQ ID NO: 116627 - DNA, 35 bp, Artificial Sequence
  Synthetic oligonucleotide
agtacgagggggaggtagggaatgatagggtaagt

SEQ ID NO: 116628 - DNA, 35 bp, Artificial Sequence
  Synthetic oligonucleotide
tacacccgcctttcgttaagcccttttttatttgt

SEQ ID NO: 116629 - DNA, 37 bp, Artificial Sequence
  Synthetic oligonucleotide
gtgcgacccccctccgtgcctgtagcctttcgcttga

SEQ ID NO: 116630 - DNA, 36 bp, Artificial Sequence
  Synthetic oligonucleotide
acccccgccctgattgtactgccggtacaaggtata

SEQ ID NO: 116631 - DNA, 35 bp, Artificial Sequence
  Synthetic oligonucleotide
tgctccccttcatggtcccaccgacgttccgctcc

SEQ ID NO: 116632 - DNA, 35 bp, Artificial Sequence
  Synthetic oligonucleotide
acccactcccccaacacccggtaccgagatagctc

SEQ ID NO: 116633 - DNA, 35 bp, Artificial Sequence
  Synthetic oligonucleotide
caacgccccttccgactcgtcccatagaccctccg

SEQ ID NO: 116634 - DNA, 36 bp, Artificial Sequence
  Synthetic oligonucleotide
tcatcacgcaaccgcattgtccgccaccccgttaca

SEQ ID NO: 116635 - DNA, 37 bp, Artificial Sequence
  Synthetic oligonucleotide
ggtacgtgagggaagagggaaggaggagtaagagcga

SEQ ID NO: 116636 - DNA, 35 bp, Artificial Sequence
  Synthetic oligonucleotide
gctcacacctgccttgttacaacatcgaacgctcc

SEQ ID NO: 116637 - DNA, 35 bp, Artificial Sequence
  Synthetic oligonucleotide
gatctccgtagactgtctcccgtcctggcccccat

SEQ ID NO: 116638 - DNA, 35 bp, Artificial Sequence
  Synthetic oligonucleotide
gtcatgcaccgcttgacggttttatctttcaccct

SEQ ID NO: 116639 - DNA, 36 bp, Artificial Sequence
  Synthetic oligonucleotide
tcaccgcccatggaactcgcctactgtccgaagcca

SEQ ID NO: 116640 - DNA, 38 bp, Artificial Sequence
  Synthetic oligonucleotide
gccctgtgcatctgctagccccttaatcgccctcttga

SEQ ID NO: 116641 - DNA, 35 bp, Artificial Sequence
  Synthetic oligonucleotide
tttgcgtgccctctttgtccccgccacagtaccta

SEQ ID NO: 116642 - DNA, 35 bp, Artificial Sequence
  Synthetic oligonucleotide
gtacagccggcctccagacgctgcatatctccttc

SEQ ID NO: 116643 - DNA, 35 bp, Artificial Sequence
  Synthetic oligonucleotide
gcgaccgtacttagtcttgaaaccgctcccacccc

SEQ ID NO: 116644 - DNA, 35 bp, Artificial Sequence
  Synthetic oligonucleotide
aactcacctggagatactgttagccccactccgcc

SEQ ID NO: 116645 - DNA, 35 bp, Artificial Sequence
  Synthetic oligonucleotide
tccccgatgccccacccgtctcctgggtactgtcc

SEQ ID NO: 116646 - DNA, 35 bp, Artificial Sequence
  Synthetic oligonucleotide
ttcagtcacatggtcctcttctttgcactcccctg

SEQ ID NO: 116647 - DNA, 35 bp, Artificial Sequence
  Synthetic oligonucleotide
gacctcctccaggcctcccgtatgttacgtaccct

SEQ ID NO: 116648 - DNA, 35 bp, Artificial Sequence
  Synthetic oligonucleotide
atcgcctacccccatggagcctccttctacgatct

SEQ ID NO: 116649 - DNA, 38 bp, Artificial Sequence
  Synthetic oligonucleotide
tcagtatgtgtcactgttctttagccctctcgtcgtga

SEQ ID NO: 116650 - DNA, 37 bp, Artificial Sequence
  Synthetic oligonucleotide
gtaggggtcggggtccaagtagggggcagaccgggga

SEQ ID NO: 116651 - DNA, 37 bp, Artificial Sequence
  Synthetic oligonucleotide
tccacgtcggtgtattcccgcccctctgtttcgctga

SEQ ID NO: 116652 - DNA, 35 bp, Artificial Sequence
  Synthetic oligonucleotide
tgcgagtcagtctatacgttcccccagtccgtccc

SEQ ID NO: 116653 - DNA, 36 bp, Artificial Sequence
  Synthetic oligonucleotide
atccgccctctgccttcccatatcggactttatgca

SEQ ID NO: 116654 - DNA, 37 bp, Artificial Sequence
  Synthetic oligonucleotide
tctccacgcgcccacgctccatttcagaccactccga

SEQ ID NO: 116655 - DNA, 34 bp, Artificial Sequence
  Synthetic oligonucleotide
ttgttgaacccgccgcccttacagctcgcctgga

SEQ ID NO: 116656 - DNA, 37 bp, Artificial Sequence
  Synthetic oligonucleotide
gtgggggagggggtagaggggaagaccatatcaatga

SEQ ID NO: 116657 - DNA, 35 bp, Artificial Sequence
  Synthetic oligonucleotide
tgtccgccaccaccctgcctctgtccgtaataaac

SEQ ID NO: 116658 - DNA, 35 bp, Artificial Sequence
  Synthetic oligonucleotide
gggggggggagaggggagtaggagctggagtggac

SEQ ID NO: 116659 - DNA, 35 bp, Artificial Sequence
  Synthetic oligonucleotide
agatcgggatacgggagggaggggtgctaggcaag

SEQ ID NO: 116660 - DNA, 35 bp, Artificial Sequence
  Synthetic oligonucleotide
gacgcaccgtatgcctccccatatattggtccctt

SEQ ID NO: 116661 - DNA, 35 bp, Artificial Sequence
  Synthetic oligonucleotide
tagactgctgcacctgttcagttaccctgctcctt

SEQ ID NO: 116662 - DNA, 36 bp, Artificial Sequence
  Synthetic oligonucleotide
acccgactcgcccaccttgcatcttctgccacgcaa

SEQ ID NO: 116663 - DNA, 29 bp, Artificial Sequence
  Synthetic oligonucleotide
gcctgtaccgcctgccgccgcccatctaa

SEQ ID NO: 116664 - DNA, 36 bp, Artificial Sequence
  Synthetic oligonucleotide
gtcctgtgcgccgttggtcgtttgtccccgctccca

SEQ ID NO: 116665 - DNA, 35 bp, Artificial Sequence
  Synthetic oligonucleotide
aagtcagccccgggtcccatccctccaccttcggc

SEQ ID NO: 116666 - DNA, 35 bp, Artificial Sequence
  Synthetic oligonucleotide
gtcccaccctctgaacctgaacatttgctcctggc

SEQ ID NO: 116667 - DNA, 35 bp, Artificial Sequence
  Synthetic oligonucleotide
gatggcccccgcacccttgactttctcgggaactc

SEQ ID NO: 116668 - DNA, 36 bp, Artificial Sequence
  Synthetic oligonucleotide
accgcctacccgccagactcatggttcctccgcaca

SEQ ID NO: 116669 - DNA, 37 bp, Artificial Sequence
  Synthetic oligonucleotide
gaagaagaaggaagggggaagagattgaggagttgga

SEQ ID NO: 116670 - DNA, 38 bp, Artificial Sequence
  Synthetic oligonucleotide
gggacgccgggggtaggagcaggtggaaggggcggtga

SEQ ID NO: 116671 - DNA, 35 bp, Artificial Sequence
  Synthetic oligonucleotide
gttgcaccttctgcgctcccgttatcacatcgccc

SEQ ID NO: 116672 - DNA, 35 bp, Artificial Sequence
  Synthetic oligonucleotide
gcgggccatccacgtgcgtgactatcgttccatcc

SEQ ID NO: 116673 - DNA, 35 bp, Artificial Sequence
  Synthetic oligonucleotide
gacccccgattgcatacacgaacttcctcctactt

SEQ ID NO: 116674 - DNA, 35 bp, Artificial Sequence
  Synthetic oligonucleotide
gtccgccacccgcctatttacgtcagacccaccaa

SEQ ID NO: 116675 - DNA, 36 bp, Artificial Sequence
  Synthetic oligonucleotide
tgtctcgccaccgtctttcgtcccctcttgtttaca

SEQ ID NO: 116676 - DNA, 36 bp, Artificial Sequence
  Synthetic oligonucleotide
gccacctctggacatccactgccttcccgtgacgca

SEQ ID NO: 116677 - DNA, 38 bp, Artificial Sequence
  Synthetic oligonucleotide
tccgtccacccctgcattcgtaaccgagccccccatga

SEQ ID NO: 116678 - DNA, 35 bp, Artificial Sequence
  Synthetic oligonucleotide
gtcacaaccgacgctgtcgctccaaattgttcctc

SEQ ID NO: 116679 - DNA, 35 bp, Artificial Sequence
  Synthetic oligonucleotide
gcttcggccacatgctcgccctcaataccaccacg

SEQ ID NO: 116680 - DNA, 35 bp, Artificial Sequence
  Synthetic oligonucleotide
gatgcgcatcttatcccgcctattgcacaccgcct

SEQ ID NO: 116681 - DNA, 35 bp, Artificial Sequence
  Synthetic oligonucleotide
ggaggtcgtgtgtcacccctgcttacctccccatt

SEQ ID NO: 116682 - DNA, 36 bp, Artificial Sequence
  Synthetic oligonucleotide
tcctgccgcatgtcaatacccgcctttccgccattt

SEQ ID NO: 116683 - DNA, 35 bp, Artificial Sequence
  Synthetic oligonucleotide
tacagccggccccgcagctcgtacccccaccgttt

SEQ ID NO: 116684 - DNA, 35 bp, Artificial Sequence
  Synthetic oligonucleotide
tgcggaccacctcactgttcatgtttgacctaacc

SEQ ID NO: 116685 - DNA, 36 bp, Artificial Sequence
  Synthetic oligonucleotide
agactcgtaccacccccatccggcatcggccccctg

SEQ ID NO: 116686 - DNA, 35 bp, Artificial Sequence
  Synthetic oligonucleotide
gctggcatgtttggctcccctccactgtcttcact

SEQ ID NO: 116687 - DNA, 35 bp, Artificial Sequence
  Synthetic oligonucleotide
tactacgcgaccatgtctcacccctccattttgct

SEQ ID NO: 116688 - DNA, 35 bp, Artificial Sequence
  Synthetic oligonucleotide
tgtacagaccatccagctgactttcgctccccatt

SEQ ID NO: 116689 - DNA, 36 bp, Artificial Sequence
  Synthetic oligonucleotide
ggggtgggcggaattaggggaacagggaggagacta

SEQ ID NO: 116690 - DNA, 35 bp, Artificial Sequence
  Synthetic oligonucleotide
agtggtaggggtggggaggggagggtaaatttgac

SEQ ID NO: 116691 - DNA, 35 bp, Artificial Sequence
  Synthetic oligonucleotide
gtctcctccgtaggtcgtcattcgaatccacttcc

SEQ ID NO: 116692 - DNA, 35 bp, Artificial Sequence
  Synthetic oligonucleotide
gtccagggaggaggggagataggaactggtgggcg

SEQ ID NO: 116693 - DNA, 35 bp, Artificial Sequence
  Synthetic oligonucleotide
tccctgtcctcacccgtgaagggtatgatttcttt

SEQ ID NO: 116694 - DNA, 37 bp, Artificial Sequence
  Synthetic oligonucleotide
gtcacgttccatcttttgtcctccgcgctcccaccga

SEQ ID NO: 116695 - DNA, 38 bp, Artificial Sequence
  Synthetic oligonucleotide
gaccaccacaccgttcgcaataacacccgtcctactga

SEQ ID NO: 116696 - DNA, 35 bp, Artificial Sequence
  Synthetic oligonucleotide
tcccgctcactctctgccggcttcattccccgtta

SEQ ID NO: 116697 - DNA, 35 bp, Artificial Sequence
  Synthetic oligonucleotide
gactaccaactatgcctaaggtccctgttactgcc

SEQ ID NO: 116698 - DNA, 36 bp, Artificial Sequence
  Synthetic oligonucleotide
tccgattccgccttggtttttcctcctgtccttcga

SEQ ID NO: 116699 - DNA, 35 bp, Artificial Sequence
  Synthetic oligonucleotide
gtaccactagccccctccgctgttaacgcatctcc

SEQ ID NO: 116700 - DNA, 35 bp, Artificial Sequence
  Synthetic oligonucleotide
gtccctcctggtctgtaccgtactcaacactatgc

SEQ ID NO: 116701 - DNA, 35 bp, Artificial Sequence
  Synthetic oligonucleotide
tccactgccaccgcactattgtccttttacgtgtc

SEQ ID NO: 116702 - DNA, 35 bp, Artificial Sequence
  Synthetic oligonucleotide
atccacatccgctctgtcatagccgcgctgacttc

SEQ ID NO: 116703 - DNA, 31 bp, Artificial Sequence
  Synthetic oligonucleotide
tgactcgacccgcgccatcctccatctgctg

SEQ ID NO: 116704 - DNA, 35 bp, Artificial Sequence
  Synthetic oligonucleotide
gcctggtgcctgttaatcgctgttcattctcccct

SEQ ID NO: 116705 - DNA, 38 bp, Artificial Sequence
  Synthetic oligonucleotide
gggatgggcgggaaaggggtgggaagtcgcaacggtga

SEQ ID NO: 116706 - DNA, 36 bp, Artificial Sequence
  Synthetic oligonucleotide
gatgtgacgcctcctttcccgtggtatccgatccta

SEQ ID NO: 116707 - DNA, 36 bp, Artificial Sequence
  Synthetic oligonucleotide
tgcatgtcaccttcgtattgtctccttgccccggta

SEQ ID NO: 116708 - DNA, 35 bp, Artificial Sequence
  Synthetic oligonucleotide
tggtcccgtccctcaactgtctgctgttcccccgc

SEQ ID NO: 116709 - DNA, 35 bp, Artificial Sequence
  Synthetic oligonucleotide
acttgccctttcttgtatcgtgttccgccctccgc

SEQ ID NO: 116710 - DNA, 38 bp, Artificial Sequence
  Synthetic oligonucleotide
actgcgcccagaaaagggatgggggggctgaagggtga

SEQ ID NO: 116711 - DNA, 36 bp, Artificial Sequence
  Synthetic oligonucleotide
gcccgtgttccccctgtcgtaaagctgccttcccta

SEQ ID NO: 116712 - DNA, 35 bp, Artificial Sequence
  Synthetic oligonucleotide
tacatcgcgcacctagtccgcacgctcgcccaatc

SEQ ID NO: 116713 - DNA, 35 bp, Artificial Sequence
  Synthetic oligonucleotide
gaatcaccgcctctgctaccctgctttattcgtat

SEQ ID NO: 116714 - DNA, 36 bp, Artificial Sequence
  Synthetic oligonucleotide
acgtggggagggcgggccgaaatagttggggcacaa

SEQ ID NO: 116715 - DNA, 35 bp, Artificial Sequence
  Synthetic oligonucleotide
ttgacgttccatccgccgttgttctgcacccacca

SEQ ID NO: 116716 - DNA, 37 bp, Artificial Sequence
  Synthetic oligonucleotide
gactcccctcgtccatgcctgccccaacatctgtcga

SEQ ID NO: 116717 - DNA, 37 bp, Artificial Sequence
  Synthetic oligonucleotide
tcgtccaaacgcctctgtactgcgcctcccccccgga

SEQ ID NO: 116718 - DNA, 35 bp, Artificial Sequence
  Synthetic oligonucleotide
tgccccgccatcgtaactctttctgtcttttcgtc

SEQ ID NO: 116719 - DNA, 35 bp, Artificial Sequence
  Synthetic oligonucleotide
gagcacggtcacgcaacaccggcccgatcttccct

SEQ ID NO: 116720 - DNA, 37 bp, Artificial Sequence
  Synthetic oligonucleotide
gtttggggctgatgggggcctttgggagggggattga

SEQ ID NO: 116721 - DNA, 35 bp, Artificial Sequence
  Synthetic oligonucleotide
gttccctcctgccgccgagccccgtttccatctta

SEQ ID NO: 116722 - DNA, 35 bp, Artificial Sequence
  Synthetic oligonucleotide
tccgcttccaccgttatttcatcagccatgtcgcc

SEQ ID NO: 116723 - DNA, 35 bp, Artificial Sequence
  Synthetic oligonucleotide
ttcgcacttctccgtctacctacgctctctgccgc

SEQ ID NO: 116724 - DNA, 35 bp, Artificial Sequence
  Synthetic oligonucleotide
gctgagtgccggtcgttctgcctccccccctagtg

SEQ ID NO: 116725 - DNA, 35 bp, Artificial Sequence
  Synthetic oligonucleotide
ttgccccgttgcttgatctcccactttctttcgtg

SEQ ID NO: 116726 - DNA, 35 bp, Artificial Sequence
  Synthetic oligonucleotide
gcaaatggttagctgcgtccacttcccccccgccg

SEQ ID NO: 116727 - DNA, 35 bp, Artificial Sequence
  Synthetic oligonucleotide
actgtgctgatcctacattgcacgacgttctacct

SEQ ID NO: 116728 - DNA, 38 bp, Artificial Sequence
  Synthetic oligonucleotide
accactacatcacactggtttcctcctgccactcctga

SEQ ID NO: 116729 - DNA, 35 bp, Artificial Sequence
  Synthetic oligonucleotide
actactcccatcagtccacaccactgcctttggcc

SEQ ID NO: 116730 - DNA, 37 bp, Artificial Sequence
  Synthetic oligonucleotide
ggacccccgcacgtgatttgcgctaccctctttcgaa

SEQ ID NO: 116731 - DNA, 36 bp, Artificial Sequence
  Synthetic oligonucleotide
taagcgcgggccccgacgtttccagttccttcccca

SEQ ID NO: 116732 - DNA, 38 bp, Artificial Sequence
  Synthetic oligonucleotide
catcctgccccctgctgacaacactcgtaacaccttga

SEQ ID NO: 116733 - DNA, 35 bp, Artificial Sequence
  Synthetic oligonucleotide
tgcactctgagttctgtcttctcgctatggccgcc

SEQ ID NO: 116734 - DNA, 35 bp, Artificial Sequence
  Synthetic oligonucleotide
acctcgcgtcgctccaccccacttgacgtgcttcc

SEQ ID NO: 116735 - DNA, 35 bp, Artificial Sequence
  Synthetic oligonucleotide
gtgcatggggggcgggggtaacaatggggacttag

SEQ ID NO: 116736 - DNA, 36 bp, Artificial Sequence
  Synthetic oligonucleotide
gttcaccccctcctatctgctgccaatgtcaccaca

SEQ ID NO: 116737 - DNA, 36 bp, Artificial Sequence
  Synthetic oligonucleotide
tagaagggagaggtgggccgtgggggcgagggagga

SEQ ID NO: 116738 - DNA, 37 bp, Artificial Sequence
  Synthetic oligonucleotide
acatacgtccgccccattaaccgcgccccctgcctga

SEQ ID NO: 116739 - DNA, 36 bp, Artificial Sequence
  Synthetic oligonucleotide
tcccaaccgaccatctggatctgcccctgtttgtga

SEQ ID NO: 116740 - DNA, 35 bp, Artificial Sequence
  Synthetic oligonucleotide
tgcacctctccttgctaatgtactttggtttctct

SEQ ID NO: 116741 - DNA, 34 bp, Artificial Sequence
  Synthetic oligonucleotide
gcacgcaattggccgtttcgtcacactagcttct

SEQ ID NO: 116742 - DNA, 36 bp, Artificial Sequence
  Synthetic oligonucleotide
gagaggagggtagtgggtggcggggaagggctttca

SEQ ID NO: 116743 - DNA, 35 bp, Artificial Sequence
  Synthetic oligonucleotide
tgcgtgctgcccgggctttctttctctcatctcga

SEQ ID NO: 116744 - DNA, 35 bp, Artificial Sequence
  Synthetic oligonucleotide
gacccgccactatggctcattcccgaacgtttcta

SEQ ID NO: 116745 - DNA, 35 bp, Artificial Sequence
  Synthetic oligonucleotide
tgcctccacacgatcgtcagccccgcgtgccgccc

SEQ ID NO: 116746 - DNA, 35 bp, Artificial Sequence
  Synthetic oligonucleotide
ttcaccaccccatgcgcatgcccgcgctaaagccg

SEQ ID NO: 116747 - DNA, 35 bp, Artificial Sequence
  Synthetic oligonucleotide
ttcccacccaacctccgctgtgtacatacttctgg

SEQ ID NO: 116748 - DNA, 35 bp, Artificial Sequence
  Synthetic oligonucleotide
tacgccggtgcgcgctcctccttgttgcttcctga

SEQ ID NO: 116749 - DNA, 37 bp, Artificial Sequence
  Synthetic oligonucleotide
tctgcgtagtggaggggggcaagtaagggggcggtga

SEQ ID NO: 116750 - DNA, 35 bp, Artificial Sequence
  Synthetic oligonucleotide
atgccccccactgctcgtgtcctagcggttagctc

SEQ ID NO: 116751 - DNA, 36 bp, Artificial Sequence
  Synthetic oligonucleotide
gatgcgagagtacgcccgccctgtggtccccctgtc

SEQ ID NO: 116752 - DNA, 35 bp, Artificial Sequence
  Synthetic oligonucleotide
tccccctccttccacccacgcatgcgcataaaacc

SEQ ID NO: 116753 - DNA, 35 bp, Artificial Sequence
  Synthetic oligonucleotide
tagccccgagctgatactgcctgcccttgcacctc

SEQ ID NO: 116754 - DNA, 35 bp, Artificial Sequence
  Synthetic oligonucleotide
gcatgtacccctcgtgtgcctcctgcttacttccg

SEQ ID NO: 116755 - DNA, 35 bp, Artificial Sequence
  Synthetic oligonucleotide
acgacgcccgttgcctcccgacctggactatttcg

SEQ ID NO: 116756 - DNA, 35 bp, Artificial Sequence
  Synthetic oligonucleotide
gccctccactatcacctgtcgtaatcgcatatcct

SEQ ID NO: 116757 - DNA, 37 bp, Artificial Sequence
  Synthetic oligonucleotide
tgcctccctgcctatgggatcacctaccctccaccga

SEQ ID NO: 116758 - DNA, 37 bp, Artificial Sequence
  Synthetic oligonucleotide
gaggaaggaggcggggagtggccatgggcacggggga

SEQ ID NO: 116759 - DNA, 35 bp, Artificial Sequence
  Synthetic oligonucleotide
atacacctgtctcgcgataccagctccatcttggc

SEQ ID NO: 116760 - DNA, 36 bp, Artificial Sequence
  Synthetic oligonucleotide
tacctcgcatcaccgtagcacagcctcttcactatc

SEQ ID NO: 116761 - DNA, 35 bp, Artificial Sequence
  Synthetic oligonucleotide
gcctgaccgcggtggtcacgtaccttctcatcttc

SEQ ID NO: 116762 - DNA, 35 bp, Artificial Sequence
  Synthetic oligonucleotide
gactgaccctgactacctcctccgtgttaagcatg

SEQ ID NO: 116763 - DNA, 35 bp, Artificial Sequence
  Synthetic oligonucleotide
tgtacctctcacactgcgtcccatctctcctgtct

SEQ ID NO: 116764 - DNA, 36 bp, Artificial Sequence
  Synthetic oligonucleotide
taccggtcaagctgtcagtccttaggcccttctcca

SEQ ID NO: 116765 - DNA, 36 bp, Artificial Sequence
  Synthetic oligonucleotide
tccaaacaagggggggtggggtgcaacgagggcgga

SEQ ID NO: 116766 - DNA, 36 bp, Artificial Sequence
  Synthetic oligonucleotide
ttcacccgccgctattctttaccactactgttgcta

SEQ ID NO: 116767 - DNA, 35 bp, Artificial Sequence
  Synthetic oligonucleotide
tgcatccactcgactcacctctgcttgcgcttcac

SEQ ID NO: 116768 - DNA, 35 bp, Artificial Sequence
  Synthetic oligonucleotide
tccgcccgaaagctataatacccgccgttgttgcc

SEQ ID NO: 116769 - DNA, 37 bp, Artificial Sequence
  Synthetic oligonucleotide
tcagcccaccgctcagcctgcagtattctccctccga

SEQ ID NO: 116770 - DNA, 35 bp, Artificial Sequence
  Synthetic oligonucleotide
gcaatcaccgctgcactcgtcctaagtcgcaccac

SEQ ID NO: 116771 - DNA, 35 bp, Artificial Sequence
  Synthetic oligonucleotide
ttgatggcccagcactgcatcgtttcccgcccttt

SEQ ID NO: 116772 - DNA, 36 bp, Artificial Sequence
  Synthetic oligonucleotide
tccgaggtgggcaggaggacaggagcggggtggtga

SEQ ID NO: 116773 - DNA, 35 bp, Artificial Sequence
  Synthetic oligonucleotide
tgtcctgccttgtcgttcctgtctacatcatcctt

SEQ ID NO: 116774 - DNA, 38 bp, Artificial Sequence
  Synthetic oligonucleotide
ggggacgggtagggagggcaggaggaaccgtcagcgga

SEQ ID NO: 116775 - DNA, 35 bp, Artificial Sequence
  Synthetic oligonucleotide
aaccccgactccgcacacaatcactgggttcatcc

SEQ ID NO: 116776 - DNA, 35 bp, Artificial Sequence
  Synthetic oligonucleotide
tgacgccaccggtaccagcctaagttccctgctcc

SEQ ID NO: 116777 - DNA, 35 bp, Artificial Sequence
  Synthetic oligonucleotide
gccccgcacgcccttgccccagacattatgaatcg

SEQ ID NO: 116778 - DNA, 35 bp, Artificial Sequence
  Synthetic oligonucleotide
gcatacaacgttcccatagtggcccctcctcttcg

SEQ ID NO: 116779 - DNA, 35 bp, Artificial Sequence
  Synthetic oligonucleotide
atgctatgccagtcggtcattcctcctgcactcct

SEQ ID NO: 116780 - DNA, 35 bp, Artificial Sequence
  Synthetic oligonucleotide
actcgctcccatgcatgtggctgttcctcgttcct

SEQ ID NO: 116781 - DNA, 36 bp, Artificial Sequence
  Synthetic oligonucleotide
gcccgcacaataggcttatccgatcccccctccgca

SEQ ID NO: 116782 - DNA, 35 bp, Artificial Sequence
  Synthetic oligonucleotide
cccacgttccaaatcgtggtcgccttatcttttca

SEQ ID NO: 116783 - DNA, 37 bp, Artificial Sequence
  Synthetic oligonucleotide
tgggagggggtaggtggtgggtggaggttcgagaaga

SEQ ID NO: 116784 - DNA, 37 bp, Artificial Sequence
  Synthetic oligonucleotide
gacaacaccgcaatggtgctggttaacactcccccga

SEQ ID NO: 116785 - DNA, 36 bp, Artificial Sequence
  Synthetic oligonucleotide
tgtcccactcgattggtctcgccccgttggttccta

SEQ ID NO: 116786 - DNA, 35 bp, Artificial Sequence
  Synthetic oligonucleotide
atcgcccaatcaatgagaattgcacccgctcgctc

SEQ ID NO: 116787 - DNA, 35 bp, Artificial Sequence
  Synthetic oligonucleotide
atgactccgccccatatacgcttttaatgattctt

SEQ ID NO: 116788 - DNA, 35 bp, Artificial Sequence
  Synthetic oligonucleotide
taccaccccttctgcatttccgacgcgccgaacca

SEQ ID NO: 116789 - DNA, 35 bp, Artificial Sequence
  Synthetic oligonucleotide
atacccatcagtgcggatctgcccccctgctgcca

SEQ ID NO: 116790 - DNA, 35 bp, Artificial Sequence
  Synthetic oligonucleotide
acgaacaggtagcctccccccttcgccttttgatc

SEQ ID NO: 116791 - DNA, 33 bp, Artificial Sequence
  Synthetic oligonucleotide
gacactttaccggcgccctacccaacggccctt

SEQ ID NO: 116792 - DNA, 37 bp, Artificial Sequence
  Synthetic oligonucleotide
atggtgcccgtcactcctgcctagtgtctgccgccga

SEQ ID NO: 116793 - DNA, 35 bp, Artificial Sequence
  Synthetic oligonucleotide
gagtcagcccctaggtcgccattcctcatccttcc

SEQ ID NO: 116794 - DNA, 35 bp, Artificial Sequence
  Synthetic oligonucleotide
tcccgtccccgctcaatatcctgtcactgttgttc

SEQ ID NO: 116795 - DNA, 36 bp, Artificial Sequence
  Synthetic oligonucleotide
gggggtgttcagggctattggtggggactgtgcgga

SEQ ID NO: 116796 - DNA, 36 bp, Artificial Sequence
  Synthetic oligonucleotide
accccgcccacattcatttagcctggacctctgtta

SEQ ID NO: 116797 - DNA, 35 bp, Artificial Sequence
  Synthetic oligonucleotide
tgcaccgcccactatattaaactgaatgccctgcc

SEQ ID NO: 116798 - DNA, 35 bp, Artificial Sequence
  Synthetic oligonucleotide
acacgcctagtgccgtgctcctcgaactatctctt

SEQ ID NO: 116799 - DNA, 36 bp, Artificial Sequence
  Synthetic oligonucleotide
aagcaccgacgacgcccttccgttatggcccctgca

SEQ ID NO: 116800 - DNA, 36 bp, Artificial Sequence
  Synthetic oligonucleotide
gcccacacgccttggatagtcgatcaccctcctgca

SEQ ID NO: 116801 - DNA, 35 bp, Artificial Sequence
  Synthetic oligonucleotide
tcacctctctcgcccggacacgtctcccatcggga

SEQ ID NO: 116802 - DNA, 35 bp, Artificial Sequence
  Synthetic oligonucleotide
tctactatcgccctcacttgttctgttcgtacact

SEQ ID NO: 116803 - DNA, 35 bp, Artificial Sequence
  Synthetic oligonucleotide
accgtactaccctcgcgactgcatatggcaaccct

SEQ ID NO: 116804 - DNA, 35 bp, Artificial Sequence
  Synthetic oligonucleotide
gcaggtctcacattgttccgtcactctcgtcctgt

SEQ ID NO: 116805 - DNA, 35 bp, Artificial Sequence
  Synthetic oligonucleotide
acccccccctgcgccgccatatcaacactgggttt

SEQ ID NO: 116806 - DNA, 35 bp, Artificial Sequence
  Synthetic oligonucleotide
ggaccgtatctggctcgctccccgtcttagctccc

SEQ ID NO: 116807 - DNA, 35 bp, Artificial Sequence
  Synthetic oligonucleotide
tcagagctatagccgccgcccacgacccctacgtt

SEQ ID NO: 116808 - DNA, 37 bp, Artificial Sequence
  Synthetic oligonucleotide
accatccgcttacgatctgcccccaactcacctttga

SEQ ID NO: 116809 - DNA, 36 bp, Artificial Sequence
  Synthetic oligonucleotide
aagcaatcgccgatcatctgccccctgccttgccta

SEQ ID NO: 116810 - DNA, 36 bp, Artificial Sequence
  Synthetic oligonucleotide
actgcctcactcccgcccgtatctactcacgcgcta

SEQ ID NO: 116811 - DNA, 35 bp, Artificial Sequence
  Synthetic oligonucleotide
tccctgacctcactctgcgtttttgctatatcccc

SEQ ID NO: 116812 - DNA, 35 bp, Artificial Sequence
  Synthetic oligonucleotide
gtccccgttctatccattggcataagcccccgccg

SEQ ID NO: 116813 - DNA, 32 bp, Artificial Sequence
  Synthetic oligonucleotide
tgatcggatcctgtactgccccttcccatgcg

SEQ ID NO: 116814 - DNA, 35 bp, Artificial Sequence
  Synthetic oligonucleotide
tacacccgcttagccgttgcgccacctccccctcg

SEQ ID NO: 116815 - DNA, 37 bp, Artificial Sequence
  Synthetic oligonucleotide
accgtgggggcttgggtggggtgggactgtagacgga

SEQ ID NO: 116816 - DNA, 36 bp, Artificial Sequence
  Synthetic oligonucleotide
taacattcgccctgttgcctaaactgcccttctgta

SEQ ID NO: 116817 - DNA, 35 bp, Artificial Sequence
  Synthetic oligonucleotide
gaaggaaggagggggggaggcacggatggaagagt

SEQ ID NO: 116818 - DNA, 36 bp, Artificial Sequence
  Synthetic oligonucleotide
gagggggtgaggcgggagaatacggcgcaggtgaaa

SEQ ID NO: 116819 - DNA, 36 bp, Artificial Sequence
  Synthetic oligonucleotide
tgtgccactatgccgttttaccttacccgttctgca

SEQ ID NO: 116820 - DNA, 35 bp, Artificial Sequence
  Synthetic oligonucleotide
tgacgcacactctgtacggtttatctcactcctgc

SEQ ID NO: 116821 - DNA, 35 bp, Artificial Sequence
  Synthetic oligonucleotide
gtccccatgcccttttgacccccctctgtgacacg

SEQ ID NO: 116822 - DNA, 34 bp, Artificial Sequence
  Synthetic oligonucleotide
tacacaggaacgagagaaggacgggtgagtgggg

SEQ ID NO: 116823 - DNA, 35 bp, Artificial Sequence
  Synthetic oligonucleotide
atgcaccaggggacaaagcggttggagggagggtg

SEQ ID NO: 116824 - DNA, 35 bp, Artificial Sequence
  Synthetic oligonucleotide
tcaaacggagtaggatcggcgcccaattccatctt

SEQ ID NO: 116825 - DNA, 35 bp, Artificial Sequence
  Synthetic oligonucleotide
gacacacgacagacgtccttgcaccacccgcacta

SEQ ID NO: 116826 - DNA, 35 bp, Artificial Sequence
  Synthetic oligonucleotide
gtgccacctccatcccgcctctacgtcgacgtcta

SEQ ID NO: 116827 - DNA, 35 bp, Artificial Sequence
  Synthetic oligonucleotide
attgcacctcggtccgtttcacccctgtctacctg

SEQ ID NO: 116828 - DNA, 35 bp, Artificial Sequence
  Synthetic oligonucleotide
tgttcccgccggtctccttatgcatacccatctct

SEQ ID NO: 116829 - DNA, 36 bp, Artificial Sequence
  Synthetic oligonucleotide
gagggcgggatcattagtttgggtgcgtaattggga

SEQ ID NO: 116830 - DNA, 38 bp, Artificial Sequence
  Synthetic oligonucleotide
gaagacgggagggacgggaggggtagaatcggggatga

SEQ ID NO: 116831 - DNA, 36 bp, Artificial Sequence
  Synthetic oligonucleotide
agcccgcctgtcgcgctcactgctcttctcttggta

SEQ ID NO: 116832 - DNA, 35 bp, Artificial Sequence
  Synthetic oligonucleotide
gcatgggtcccacgcccgtccaacgtacccgcccc

SEQ ID NO: 116833 - DNA, 35 bp, Artificial Sequence
  Synthetic oligonucleotide
tacgtgactcgtacggcacccgcatacttctgtcc

SEQ ID NO: 116834 - DNA, 35 bp, Artificial Sequence
  Synthetic oligonucleotide
gtccgcccctatgccgggggttttcacactctttc

SEQ ID NO: 116835 - DNA, 35 bp, Artificial Sequence
  Synthetic oligonucleotide
ggacccacaatgcccatctctcgacttctacctgg

SEQ ID NO: 116836 - DNA, 35 bp, Artificial Sequence
  Synthetic oligonucleotide
gaagcgccctcgagtcgttttctaccccgccgtta

SEQ ID NO: 116837 - DNA, 35 bp, Artificial Sequence
  Synthetic oligonucleotide
agttacgcccgcactgctctatattacggtaatcc

SEQ ID NO: 116838 - DNA, 36 bp, Artificial Sequence
  Synthetic oligonucleotide
gcctcagcccccactctctcgtatgtccgtcgaaca

SEQ ID NO: 116839 - DNA, 37 bp, Artificial Sequence
  Synthetic oligonucleotide
gcaacccattgtagttttctcctcctcactctcgtga

SEQ ID NO: 116840 - DNA, 35 bp, Artificial Sequence
  Synthetic oligonucleotide
ttcaacctgcccaaacgtacttagccccccggagc

SEQ ID NO: 116841 - DNA, 35 bp, Artificial Sequence
  Synthetic oligonucleotide
ttcgcccctccgtttaacgtcattatacgccctgc

SEQ ID NO: 116842 - DNA, 36 bp, Artificial Sequence
  Synthetic oligonucleotide
atgacatccatcacccgctaggtatagccttctcca

SEQ ID NO: 116843 - DNA, 37 bp, Artificial Sequence
  Synthetic oligonucleotide
ggaggaagggttaaggaaggtggtaagtgaacgggga

SEQ ID NO: 116844 - DNA, 34 bp, Artificial Sequence
  Synthetic oligonucleotide
ttacgcccgctcactggctttctcttgtttctta

SEQ ID NO: 116845 - DNA, 35 bp, Artificial Sequence
  Synthetic oligonucleotide
gccctgtagcccatccttttaccgaccgctgtttc

SEQ ID NO: 116846 - DNA, 35 bp, Artificial Sequence
  Synthetic oligonucleotide
accccatctccacgcgttaggcgcctatctcccat

SEQ ID NO: 116847 - DNA, 37 bp, Artificial Sequence
  Synthetic oligonucleotide
gttgccttcccacgtatgtacgcgctccaccacgcga

SEQ ID NO: 116848 - DNA, 36 bp, Artificial Sequence
  Synthetic oligonucleotide
tgggggacggaagggggaggtaggggttgtgacata

SEQ ID NO: 116849 - DNA, 36 bp, Artificial Sequence
  Synthetic oligonucleotide
gaacaccctcgcccaccaatgctcccctaccaggaa

SEQ ID NO: 116850 - DNA, 31 bp, Artificial Sequence
  Synthetic oligonucleotide
ggtgaggggcagggggaggcaaagaaatgga

SEQ ID NO: 116851 - DNA, 38 bp, Artificial Sequence
  Synthetic oligonucleotide
ggagggatatcagatatgcaggggagggcgggacctga

SEQ ID NO: 116852 - DNA, 36 bp, Artificial Sequence
  Synthetic oligonucleotide
gcgaagggtaattgggaagggtggagggggtagtta

SEQ ID NO: 116853 - DNA, 31 bp, Artificial Sequence
  Synthetic oligonucleotide
tccactctcgacatcgcatcttatctcgcac

SEQ ID NO: 116854 - DNA, 35 bp, Artificial Sequence
  Synthetic oligonucleotide
tccaacacctccctattttgcaggttcccgatacc

SEQ ID NO: 116855 - DNA, 35 bp, Artificial Sequence
  Synthetic oligonucleotide
ggaccatgcagctcactgtcccctttcgccgcccc

SEQ ID NO: 116856 - DNA, 35 bp, Artificial Sequence
  Synthetic oligonucleotide
tgacgccatttgagcgtgcactagtttctatcctc

SEQ ID NO: 116857 - DNA, 35 bp, Artificial Sequence
  Synthetic oligonucleotide
ggaaaggggtcgaggggggtcggggcacaaggcat

SEQ ID NO: 116858 - DNA, 36 bp, Artificial Sequence
  Synthetic oligonucleotide
acctcacctctgttcgccatagtttcagccccccca

SEQ ID NO: 116859 - DNA, 36 bp, Artificial Sequence
  Synthetic oligonucleotide
ttggtagggggggccggaggggaaatggaatggaga

SEQ ID NO: 116860 - DNA, 37 bp, Artificial Sequence
  Synthetic oligonucleotide
gattgcaagagaacagggcggagggacgaggagtgga

SEQ ID NO: 116861 - DNA, 34 bp, Artificial Sequence
  Synthetic oligonucleotide
gaccctaccgctcctaccgcagtcgctacttcac

SEQ ID NO: 116862 - DNA, 35 bp, Artificial Sequence
  Synthetic oligonucleotide
gtcgttccccaggaccactgtgccatacttcttcc

SEQ ID NO: 116863 - DNA, 35 bp, Artificial Sequence
  Synthetic oligonucleotide
gcctacgcccgagtcattctttccgtcctagccct

SEQ ID NO: 116864 - DNA, 36 bp, Artificial Sequence
  Synthetic oligonucleotide
acggggaggggggggtggaggtgggaagtttcggaa

SEQ ID NO: 116865 - DNA, 35 bp, Artificial Sequence
  Synthetic oligonucleotide
agcgcaccgttaagcataacgcccccgtccgtccc

SEQ ID NO: 116866 - DNA, 37 bp, Artificial Sequence
  Synthetic oligonucleotide
gacggggaggagaagcagggtggcacagagcgcgaga

SEQ ID NO: 116867 - DNA, 35 bp, Artificial Sequence
  Synthetic oligonucleotide
ttagaccattccgtcacacgctctgcgcgtctcac

SEQ ID NO: 116868 - DNA, 35 bp, Artificial Sequence
  Synthetic oligonucleotide
ccacaccccaatgctagcccggtttggccctttcc

SEQ ID NO: 116869 - DNA, 35 bp, Artificial Sequence
  Synthetic oligonucleotide
tgaccgccgtcgcctcccttgttcctgttttcgat

SEQ ID NO: 116870 - DNA, 36 bp, Artificial Sequence
  Synthetic oligonucleotide
accgaacggaggaggggattcacgggggatacaaaa

SEQ ID NO: 116871 - DNA, 38 bp, Artificial Sequence
  Synthetic oligonucleotide
tagacaagggggcggagggggttaaggggtagtagtga

SEQ ID NO: 116872 - DNA, 36 bp, Artificial Sequence
  Synthetic oligonucleotide
ccacatccccccccgccgcgtccatgcttttcggta

SEQ ID NO: 116873 - DNA, 35 bp, Artificial Sequence
  Synthetic oligonucleotide
aacgcctgtcgccaccatcaattcccgttgccacc

SEQ ID NO: 116874 - DNA, 35 bp, Artificial Sequence
  Synthetic oligonucleotide
tacatccgccacggccccgagcctcattttccctc

SEQ ID NO: 116875 - DNA, 36 bp, Artificial Sequence
  Synthetic oligonucleotide
accctgtcccctgaatttgcttacccgcccttttaa

SEQ ID NO: 116876 - DNA, 35 bp, Artificial Sequence
  Synthetic oligonucleotide
actgccctgcctctgttcggtcaccatagttttca

SEQ ID NO: 116877 - DNA, 37 bp, Artificial Sequence
  Synthetic oligonucleotide
tctggggccgaatacggggtggaggaaggggggtaga

SEQ ID NO: 116878 - DNA, 35 bp, Artificial Sequence
  Synthetic oligonucleotide
gcaagcactgcgccgactgccctggttacatcgcc

SEQ ID NO: 116879 - DNA, 35 bp, Artificial Sequence
  Synthetic oligonucleotide
gcacgttacctccccgcccgccgcgctgagtccgc

SEQ ID NO: 116880 - DNA, 35 bp, Artificial Sequence
  Synthetic oligonucleotide
gacgcccctcatttctgtcctgcccgccctttacg

SEQ ID NO: 116881 - DNA, 35 bp, Artificial Sequence
  Synthetic oligonucleotide
acctccgtccctcccctttgcgtatgatgcctggt

SEQ ID NO: 116882 - DNA, 35 bp, Artificial Sequence
  Synthetic oligonucleotide
accgtggccctcttcgtctttcctccctgctggca

SEQ ID NO: 116883 - DNA, 38 bp, Artificial Sequence
  Synthetic oligonucleotide
tgagagcgggtgacggaggggctgggggagggtgatga

SEQ ID NO: 116884 - DNA, 36 bp, Artificial Sequence
  Synthetic oligonucleotide
acgaagccgtaattggaattgccctgcccctcttga

SEQ ID NO: 116885 - DNA, 35 bp, Artificial Sequence
  Synthetic oligonucleotide
gagagctcgccataatcgtcccttctcagtccacc

SEQ ID NO: 116886 - DNA, 35 bp, Artificial Sequence
  Synthetic oligonucleotide
atcctgtcacctcgcccggtatcgtaactcacctc

SEQ ID NO: 116887 - DNA, 35 bp, Artificial Sequence
  Synthetic oligonucleotide
tatcgccttcctcccctgccgtcaaaacgtgcctg

SEQ ID NO: 116888 - DNA, 35 bp, Artificial Sequence
  Synthetic oligonucleotide
gctccacctcacttgtactactgtccgctcccccc

SEQ ID NO: 116889 - DNA, 35 bp, Artificial Sequence
  Synthetic oligonucleotide
tgacgccggccggtcgcgcttctgcttggtcctcc

SEQ ID NO: 116890 - DNA, 35 bp, Artificial Sequence
  Synthetic oligonucleotide
tcgccactgtagttcgttctaattttccatctcgc

SEQ ID NO: 116891 - DNA, 35 bp, Artificial Sequence
  Synthetic oligonucleotide
tctcacccttccgtatttgttcaagctttctcgtc

SEQ ID NO: 116892 - DNA, 35 bp, Artificial Sequence
  Synthetic oligonucleotide
ttgtcccgccaacatgtcctcgccgcctaaccccg

SEQ ID NO: 116893 - DNA, 35 bp, Artificial Sequence
  Synthetic oligonucleotide
gagagacagtgcgaggaggtcaggagggaagtggg

SEQ ID NO: 116894 - DNA, 35 bp, Artificial Sequence
  Synthetic oligonucleotide
gtggttgtcgcactgcttaccctccgctgtaccct

SEQ ID NO: 116895 - DNA, 35 bp, Artificial Sequence
  Synthetic oligonucleotide
gtacgcccttccttacccatccatccctactggga

SEQ ID NO: 116896 - DNA, 38 bp, Artificial Sequence
  Synthetic oligonucleotide
gtgccccacatctcccctaagctgcaaccttgccttga

SEQ ID NO: 116897 - DNA, 35 bp, Artificial Sequence
  Synthetic oligonucleotide
tggatagcccctttatcgttcataccctggtcccc

SEQ ID NO: 116898 - DNA, 36 bp, Artificial Sequence
  Synthetic oligonucleotide
tgccgccactgacccattcgacgcatttccaccaca

SEQ ID NO: 116899 - DNA, 36 bp, Artificial Sequence
  Synthetic oligonucleotide
gactggcccactcctttctgcattgttctgctctca

SEQ ID NO: 116900 - DNA, 37 bp, Artificial Sequence
  Synthetic oligonucleotide
gtttgggtgggagggggatacggttagggggttccga

SEQ ID NO: 116901 - DNA, 35 bp, Artificial Sequence
  Synthetic oligonucleotide
ttcgccctccctcttgatagcgtacttgattagcc

SEQ ID NO: 116902 - DNA, 36 bp, Artificial Sequence
  Synthetic oligonucleotide
gcctcgcaaatgttctttgcctcgcgatgcacctcc

SEQ ID NO: 116903 - DNA, 35 bp, Artificial Sequence
  Synthetic oligonucleotide
gagcctcatcttttggtttacgcccccttcactgc

SEQ ID NO: 116904 - DNA, 35 bp, Artificial Sequence
  Synthetic oligonucleotide
gcacgaccaagtgttccgttttgatccctgttccg

SEQ ID NO: 116905 - DNA, 36 bp, Artificial Sequence
  Synthetic oligonucleotide
gatcccacccgtcaacgtctttcggaccccccacaa

SEQ ID NO: 116906 - DNA, 33 bp, Artificial Sequence
  Synthetic oligonucleotide
actgacggagccaagcgctgcaccttctcccca

SEQ ID NO: 116907 - DNA, 36 bp, Artificial Sequence
  Synthetic oligonucleotide
ggtgcccctgtccccccattatagtacgtttcccca

SEQ ID NO: 116908 - DNA, 35 bp, Artificial Sequence
  Synthetic oligonucleotide
ggacaccgacctgttccacgccgtagctttctcca

SEQ ID NO: 116909 - DNA, 35 bp, Artificial Sequence
  Synthetic oligonucleotide
gctaccgcccctcccccgatgtcctaccgttctca

SEQ ID NO: 116910 - DNA, 38 bp, Artificial Sequence
  Synthetic oligonucleotide
tgaccatcggccttgcatagctccccttcctcccgtga

SEQ ID NO: 116911 - DNA, 36 bp, Artificial Sequence
  Synthetic oligonucleotide
gccctgtcccatccacgctgccttctgtacgttgta

SEQ ID NO: 116912 - DNA, 35 bp, Artificial Sequence
  Synthetic oligonucleotide
gcctgacatccgcctctgagagtacctcatttccc

SEQ ID NO: 116913 - DNA, 37 bp, Artificial Sequence
  Synthetic oligonucleotide
gccaatgcatcgggcggggggggtaagggtctctgga

SEQ ID NO: 116914 - DNA, 35 bp, Artificial Sequence
  Synthetic oligonucleotide
gttcgccgccctcctacgtactgtaaaggcgcccc

SEQ ID NO: 116915 - DNA, 35 bp, Artificial Sequence
  Synthetic oligonucleotide
gcacgacggacttccattcggccacattcccccgc

SEQ ID NO: 116916 - DNA, 35 bp, Artificial Sequence
  Synthetic oligonucleotide
gaaaacatagcgacaccgtccacgccgctctcccg

SEQ ID NO: 116917 - DNA, 35 bp, Artificial Sequence
  Synthetic oligonucleotide
gacgcctcaatggataccccactcaccgcatgcca

SEQ ID NO: 116918 - DNA, 34 bp, Artificial Sequence
  Synthetic oligonucleotide
taccccgcaccacccacccttgcagatgcacgca

SEQ ID NO: 116919 - DNA, 35 bp, Artificial Sequence
  Synthetic oligonucleotide
tgacccccctgctttcgccgtaagcgcaggccacc

SEQ ID NO: 116920 - DNA, 35 bp, Artificial Sequence
  Synthetic oligonucleotide
tagcgctccaccatcctgtctcaggcagtacatcc

SEQ ID NO: 116921 - DNA, 35 bp, Artificial Sequence
  Synthetic oligonucleotide
tgcccctccggctgacaccatctaccgcttttatc

SEQ ID NO: 116922 - DNA, 35 bp, Artificial Sequence
  Synthetic oligonucleotide
accccaacggtcagcagctgctcaaccctggcctc

SEQ ID NO: 116923 - DNA, 35 bp, Artificial Sequence
  Synthetic oligonucleotide
atccgtaaggaccgcccacgcattcatctccatcc

SEQ ID NO: 116924 - DNA, 35 bp, Artificial Sequence
  Synthetic oligonucleotide
tccaccactacatctcattatagcgtgcgcccccg

SEQ ID NO: 116925 - DNA, 36 bp, Artificial Sequence
  Synthetic oligonucleotide
gcaaagctcacttcgctgccgttctgtccgccccca

SEQ ID NO: 116926 - DNA, 36 bp, Artificial Sequence
  Synthetic oligonucleotide
gtcacccctgttcaccgtctccccgtcccgcattca

SEQ ID NO: 116927 - DNA, 35 bp, Artificial Sequence
  Synthetic oligonucleotide
gcacggccacgcctacccactgctgctcaccttca

SEQ ID NO: 116928 - DNA, 35 bp, Artificial Sequence
  Synthetic oligonucleotide
acacttccacatctgcattaaaagttacgccactc

SEQ ID NO: 116929 - DNA, 38 bp, Artificial Sequence
  Synthetic oligonucleotide
gcccctctcacatcctactacctcctctagtagcctga

SEQ ID NO: 116930 - DNA, 38 bp, Artificial Sequence
  Synthetic oligonucleotide
gagcggtggcgctggtggggggaacgggggtggagtga

SEQ ID NO: 116931 - DNA, 36 bp, Artificial Sequence
  Synthetic oligonucleotide
gtgactggaaggctggtggggtatcggtggaaggta

SEQ ID NO: 116932 - DNA, 35 bp, Artificial Sequence
  Synthetic oligonucleotide
atgtcccatcaatgcctcccttcaccaaaggccgc

SEQ ID NO: 116933 - DNA, 35 bp, Artificial Sequence
  Synthetic oligonucleotide
tccatcaccctggctatgaacaccacgacctttcg

SEQ ID NO: 116934 - DNA, 35 bp, Artificial Sequence
  Synthetic oligonucleotide
gcgaccgtccaatttcgttcgtttcagcccgcacc

SEQ ID NO: 116935 - DNA, 35 bp, Artificial Sequence
  Synthetic oligonucleotide
gccttcccaaagtcgtttccgtccacgctcctacc

SEQ ID NO: 116936 - DNA, 35 bp, Artificial Sequence
  Synthetic oligonucleotide
taccgagcgcgccatcgtcctcgttccccagtgcc

SEQ ID NO: 116937 - DNA, 35 bp, Artificial Sequence
  Synthetic oligonucleotide
ttgcctcctccgtacgacacagtccttttttattc

SEQ ID NO: 116938 - DNA, 35 bp, Artificial Sequence
  Synthetic oligonucleotide
gctcctgcctccttcgtacatcgccggccaacctg

SEQ ID NO: 116939 - DNA, 36 bp, Artificial Sequence
  Synthetic oligonucleotide
gcttaacgccgccatccgtccgcctgtgagccgtaa

SEQ ID NO: 116940 - DNA, 35 bp, Artificial Sequence
  Synthetic oligonucleotide
tcacccgctttgggccgttgccgttgctcccccca

SEQ ID NO: 116941 - DNA, 36 bp, Artificial Sequence
  Synthetic oligonucleotide
tatgccttgtcacgccgcttcccttcgtccctgtta

SEQ ID NO: 116942 - DNA, 35 bp, Artificial Sequence
  Synthetic oligonucleotide
atcgcgccagccgtttggctccctcctcggttatc

SEQ ID NO: 116943 - DNA, 35 bp, Artificial Sequence
  Synthetic oligonucleotide
ttcactcgcatggtgatacgcttttgtttcttctc

SEQ ID NO: 116944 - DNA, 35 bp, Artificial Sequence
  Synthetic oligonucleotide
gtccgcagccaacgttatcctactcgccgcccacg

SEQ ID NO: 116945 - DNA, 35 bp, Artificial Sequence
  Synthetic oligonucleotide
gttgccgacgtaccccgctctcacgatacctctgt

SEQ ID NO: 116946 - DNA, 35 bp, Artificial Sequence
  Synthetic oligonucleotide
tgtgcctgccgagccccccctccatgtcgtttttt

SEQ ID NO: 116947 - DNA, 35 bp, Artificial Sequence
  Synthetic oligonucleotide
gatgacgcctatgctaccgttcgcccctaaacacc

SEQ ID NO: 116948 - DNA, 35 bp, Artificial Sequence
  Synthetic oligonucleotide
atccgcactgttctttccctcctcacgtttgcacc

SEQ ID NO: 116949 - DNA, 35 bp, Artificial Sequence
  Synthetic oligonucleotide
tgcgcaccacttggtatccctccccgacccccgtt

SEQ ID NO: 116950 - DNA, 36 bp, Artificial Sequence
  Synthetic oligonucleotide
ttcgtagccggagcctcgcacgttccccccccatga

SEQ ID NO: 116951 - DNA, 37 bp, Artificial Sequence
  Synthetic oligonucleotide
tgacctcacttacggtccctgtctctacaccttatga

SEQ ID NO: 116952 - DNA, 35 bp, Artificial Sequence
  Synthetic oligonucleotide
tacctcatcagttccccgtatgcaacacctccacg

SEQ ID NO: 116953 - DNA, 35 bp, Artificial Sequence
  Synthetic oligonucleotide
gatagagaggggggaagagaagagagtgtccgacg

SEQ ID NO: 116954 - DNA, 35 bp, Artificial Sequence
  Synthetic oligonucleotide
accaacctcacatccgtccagcggctctatccggt

SEQ ID NO: 116955 - DNA, 34 bp, Artificial Sequence
  Synthetic oligonucleotide
tcaaacgacccgcctcacacctctgtataactcc

SEQ ID NO: 116956 - DNA, 35 bp, Artificial Sequence
  Synthetic oligonucleotide
gcgttgcctaccagtttcgtttcagcccttcctca

SEQ ID NO: 116957 - DNA, 36 bp, Artificial Sequence
  Synthetic oligonucleotide
gccaccgctccccgtctatctgccagctggtcccga

SEQ ID NO: 116958 - DNA, 38 bp, Artificial Sequence
  Synthetic oligonucleotide
tcacgtacatgggggaagggcgggtgggtcggaactga

SEQ ID NO: 116959 - DNA, 35 bp, Artificial Sequence
  Synthetic oligonucleotide
gttcgcctcatgcgttattcgtcctttccttacac

SEQ ID NO: 116960 - DNA, 36 bp, Artificial Sequence
  Synthetic oligonucleotide
actcacgcctctctcgtgttttcgtcttctcttaca

SEQ ID NO: 116961 - DNA, 35 bp, Artificial Sequence
  Synthetic oligonucleotide
taacgggcgcctcgctttccgttttcttgatcccc

SEQ ID NO: 116962 - DNA, 35 bp, Artificial Sequence
  Synthetic oligonucleotide
tccgccggacgagctagccgactacacccttctcc

SEQ ID NO: 116963 - DNA, 35 bp, Artificial Sequence
  Synthetic oligonucleotide
tcacctatcaccctccgtatgggacaatgtccttc

SEQ ID NO: 116964 - DNA, 36 bp, Artificial Sequence
  Synthetic oligonucleotide
ttgaccccccctcgcaattgttacccgttgtttaaa

SEQ ID NO: 116965 - DNA, 36 bp, Artificial Sequence
  Synthetic oligonucleotide
attgcgtataacgggggttgggagggacgggagcta

SEQ ID NO: 116966 - DNA, 35 bp, Artificial Sequence
  Synthetic oligonucleotide
tgccgcccaaatgcgcactccgacccgccattacc

SEQ ID NO: 116967 - DNA, 35 bp, Artificial Sequence
  Synthetic oligonucleotide
acccgcttagtgagctccaccgttggtcccttccc

SEQ ID NO: 116968 - DNA, 35 bp, Artificial Sequence
  Synthetic oligonucleotide
atcaacttacggaactgcccaggctctttgcactc

SEQ ID NO: 116969 - DNA, 35 bp, Artificial Sequence
  Synthetic oligonucleotide
ttcaccgtcccgccccagtcaacccgccgttgccg

SEQ ID NO: 116970 - DNA, 37 bp, Artificial Sequence
  Synthetic oligonucleotide
tatgccgtccagcacttccctgttccctttcccagga

SEQ ID NO: 116971 - DNA, 37 bp, Artificial Sequence
  Synthetic oligonucleotide
gtgagagacaagggcggttgcgagagagggagctgga

SEQ ID NO: 116972 - DNA, 35 bp, Artificial Sequence
  Synthetic oligonucleotide
tccccacaggccctttgtccctatgaaccgccatc

SEQ ID NO: 116973 - DNA, 35 bp, Artificial Sequence
  Synthetic oligonucleotide
agtccatgctgccagtcgtcgcctctccgcacctg

SEQ ID NO: 116974 - DNA, 35 bp, Artificial Sequence
  Synthetic oligonucleotide
attcgaggggggggtgagagttaggggaagcgggt

SEQ ID NO: 116975 - DNA, 36 bp, Artificial Sequence
  Synthetic oligonucleotide
tgtcgccacctcagtatctgctctgtccaccttaca

SEQ ID NO: 116976 - DNA, 37 bp, Artificial Sequence
  Synthetic oligonucleotide
accatgtgccccgacgtgctgctcacttcgcccccga

SEQ ID NO: 116977 - DNA, 35 bp, Artificial Sequence
  Synthetic oligonucleotide
gacaaactgacctccgctcacaccgctatgctgcc

SEQ ID NO: 116978 - DNA, 35 bp, Artificial Sequence
  Synthetic oligonucleotide
tgtgctcatcgccacccgcaactacgacgccctcc

SEQ ID NO: 116979 - DNA, 35 bp, Artificial Sequence
  Synthetic oligonucleotide
aatgcaggacggcgtggggtgaaggtagggcgtag

SEQ ID NO: 116980 - DNA, 35 bp, Artificial Sequence
  Synthetic oligonucleotide
agactaacggaggggggggagcatatagggaggcg

SEQ ID NO: 116981 - DNA, 35 bp, Artificial Sequence
  Synthetic oligonucleotide
gctaccgtcgctccagtatcggctccctttcctcg

SEQ ID NO: 116982 - DNA, 36 bp, Artificial Sequence
  Synthetic oligonucleotide
ttgcacccctttcatgttttgccacacgcttcccaa

SEQ ID NO: 116983 - DNA, 37 bp, Artificial Sequence
  Synthetic oligonucleotide
actgccccccaccgttgctttataatacccgctccaa

SEQ ID NO: 116984 - DNA, 36 bp, Artificial Sequence
  Synthetic oligonucleotide
accgagtgcggccaattctcctgcttgggcctttca

SEQ ID NO: 116985 - DNA, 37 bp, Artificial Sequence
  Synthetic oligonucleotide
tgtgcgctcggcctcctgcccattttgccactcctga

SEQ ID NO: 116986 - DNA, 35 bp, Artificial Sequence
  Synthetic oligonucleotide
gctgcatgtctccgtctcgttgtctgcgccatcac

SEQ ID NO: 116987 - DNA, 35 bp, Artificial Sequence
  Synthetic oligonucleotide
gacaagcatcgctgtttcttcaaccctcctcgtac

SEQ ID NO: 116988 - DNA, 35 bp, Artificial Sequence
  Synthetic oligonucleotide
atgagccgtccccagatcgtatcctcccccactgc

SEQ ID NO: 116989 - DNA, 35 bp, Artificial Sequence
  Synthetic oligonucleotide
actgcccggatgcttatccccctgcctccaccgat

SEQ ID NO: 116990 - DNA, 37 bp, Artificial Sequence
  Synthetic oligonucleotide
aagcaagggaaggggtggaggtggaacatttggtgga

SEQ ID NO: 116991 - DNA, 36 bp, Artificial Sequence
  Synthetic oligonucleotide
ttcgccttcccctcccggtgtcgtatccccacggta

SEQ ID NO: 116992 - DNA, 35 bp, Artificial Sequence
  Synthetic oligonucleotide
gccttgtcccttgtagcattgtcccccttccttcc

SEQ ID NO: 116993 - DNA, 35 bp, Artificial Sequence
  Synthetic oligonucleotide
acatcactgccacaccatgcttctatggtacctgc

SEQ ID NO: 116994 - DNA, 35 bp, Artificial Sequence
  Synthetic oligonucleotide
gggtacgggtgaagggggatcgggttggagcgggg

SEQ ID NO: 116995 - DNA, 35 bp, Artificial Sequence
  Synthetic oligonucleotide
tcacctccctcagtcccttgccgctatacatttct

SEQ ID NO: 116996 - DNA, 35 bp, Artificial Sequence
  Synthetic oligonucleotide
gacgcccatcgcccaccctcttgccctaggtcaca

SEQ ID NO: 116997 - DNA, 37 bp, Artificial Sequence
  Synthetic oligonucleotide
agaaggggggatgcaggaaggggaagcgggcccggga

SEQ ID NO: 116998 - DNA, 35 bp, Artificial Sequence
  Synthetic oligonucleotide
acaacccccccctgtcgacgacccactgggtccac

SEQ ID NO: 116999 - DNA, 35 bp, Artificial Sequence
  Synthetic oligonucleotide
tattccccgaacatttgctgacacatcactctccg

SEQ ID NO: 117000 - DNA, 35 bp, Artificial Sequence
  Synthetic oligonucleotide
atctgcacccatcgttcgcgccccttttccattct

SEQ ID NO: 117001 - DNA, 36 bp, Artificial Sequence
  Synthetic oligonucleotide
ttgtcacttcatgcgtaccagccttccctgttttca

SEQ ID NO: 117002 - DNA, 35 bp, Artificial Sequence
  Synthetic oligonucleotide
ttgctccacacctgcttcccagtactatgcttgtc

SEQ ID NO: 117003 - DNA, 35 bp, Artificial Sequence
  Synthetic oligonucleotide
tgtgaacctgccacccacatcggcgtattttccct

SEQ ID NO: 117004 - DNA, 35 bp, Artificial Sequence
  Synthetic oligonucleotide
tccagtgcattctttcgcggactgttctatcctct

SEQ ID NO: 117005 - DNA, 37 bp, Artificial Sequence
  Synthetic oligonucleotide
gtgcatgccgcacctccttcatgcctcgcccaatgga

SEQ ID NO: 117006 - DNA, 38 bp, Artificial Sequence
  Synthetic oligonucleotide
tccaggcctctccactgctaccatcgccgcccttgtga

SEQ ID NO: 117007 - DNA, 36 bp, Artificial Sequence
  Synthetic oligonucleotide
tccttcaccgctgtattgcctacccacctctcacta

SEQ ID NO: 117008 - DNA, 35 bp, Artificial Sequence
  Synthetic oligonucleotide
acagcctagcccccgtcttgtgcttcccccttgta

SEQ ID NO: 117009 - DNA, 35 bp, Artificial Sequence
  Synthetic oligonucleotide
atccccacctccgagcccaacggacagggtccccc

SEQ ID NO: 117010 - DNA, 35 bp, Artificial Sequence
  Synthetic oligonucleotide
agacaggaacggggggggagaaagggcgcgttcag

SEQ ID NO: 117011 - DNA, 36 bp, Artificial Sequence
  Synthetic oligonucleotide
gtcacccccccgaattcgcccagttgtatggatcaa

SEQ ID NO: 117012 - DNA, 35 bp, Artificial Sequence
  Synthetic oligonucleotide
tcagacccgcgggatcttgcccctctggtttcacc

SEQ ID NO: 117013 - DNA, 35 bp, Artificial Sequence
  Synthetic oligonucleotide
tgatcaacacctgacggccattacacctcattctt

SEQ ID NO: 117014 - DNA, 35 bp, Artificial Sequence
  Synthetic oligonucleotide
tcccatcactgcactgttactctcatcgacacgca

SEQ ID NO: 117015 - DNA, 37 bp, Artificial Sequence
  Synthetic oligonucleotide
tgactcgctacgttccgtttccacctgccatctacga

SEQ ID NO: 117016 - DNA, 35 bp, Artificial Sequence
  Synthetic oligonucleotide
ttcccgagcgctcagtttcaccttcaccattgccc

SEQ ID NO: 117017 - DNA, 35 bp, Artificial Sequence
  Synthetic oligonucleotide
ttcctaccagcgccgcgctactacacaccacctcg

SEQ ID NO: 117018 - DNA, 35 bp, Artificial Sequence
  Synthetic oligonucleotide
gggggacgggaggatcgatcgggaagggttgacgg

SEQ ID NO: 117019 - DNA, 35 bp, Artificial Sequence
  Synthetic oligonucleotide
gaagtccctccccgccgcatccgtgaacatccttg

SEQ ID NO: 117020 - DNA, 35 bp, Artificial Sequence
  Synthetic oligonucleotide
gagcccgtaccaggtcatacgtcccattcccacct

SEQ ID NO: 117021 - DNA, 35 bp, Artificial Sequence
  Synthetic oligonucleotide
aaccgcgccccacttgctatctttatactctcgtt

SEQ ID NO: 117022 - DNA, 35 bp, Artificial Sequence
  Synthetic oligonucleotide
tcatccttcgcccctcacctatcgtttgtgcgttt

SEQ ID NO: 117023 - DNA, 37 bp, Artificial Sequence
  Synthetic oligonucleotide
taggagcggacgggacggggatggagcggcgggaaga

SEQ ID NO: 117024 - DNA, 37 bp, Artificial Sequence
  Synthetic oligonucleotide
tctcggcggaggtcgggggccagtggagagggcggga

SEQ ID NO: 117025 - DNA, 35 bp, Artificial Sequence
  Synthetic oligonucleotide
tgtaccacctgtcgtggcgaccctccccaactccc

SEQ ID NO: 117026 - DNA, 35 bp, Artificial Sequence
  Synthetic oligonucleotide
ttgccaggactcaatcatggctattcccacttccc

SEQ ID NO: 117027 - DNA, 35 bp, Artificial Sequence
  Synthetic oligonucleotide
ttagcgctcgccccacgatcatccaacgtaactcc

SEQ ID NO: 117028 - DNA, 35 bp, Artificial Sequence
  Synthetic oligonucleotide
gagccctccctgcatcattcgaacgcttacctccg

SEQ ID NO: 117029 - DNA, 37 bp, Artificial Sequence
  Synthetic oligonucleotide
tagagtgggataggggtggggaaagggaagggaggga

SEQ ID NO: 117030 - DNA, 35 bp, Artificial Sequence
  Synthetic oligonucleotide
gcacccgacatgctattgcaccccgcacaccttac

SEQ ID NO: 117031 - DNA, 35 bp, Artificial Sequence
  Synthetic oligonucleotide
tcacgtgctgttacgatccccgctgactcattgcc

SEQ ID NO: 117032 - DNA, 35 bp, Artificial Sequence
  Synthetic oligonucleotide
gaacgggggatgatgaagggaagggatcggagctg

SEQ ID NO: 117033 - DNA, 35 bp, Artificial Sequence
  Synthetic oligonucleotide
gcctccacactgcattatgttccggtttcactact

SEQ ID NO: 117034 - DNA, 35 bp, Artificial Sequence
  Synthetic oligonucleotide
gtcctcgaacacatgtcccggccctaaccccgcct

SEQ ID NO: 117035 - DNA, 37 bp, Artificial Sequence
  Synthetic oligonucleotide
atgcccgcaccatctcctcttctcgcacagttcagga

SEQ ID NO: 117036 - DNA, 35 bp, Artificial Sequence
  Synthetic oligonucleotide
gttgtgatccccgctgcgccccctgtcattcccta

SEQ ID NO: 117037 - DNA, 35 bp, Artificial Sequence
  Synthetic oligonucleotide
tcccgccactgtcgcgccctcttttatcacagttt

SEQ ID NO: 117038 - DNA, 35 bp, Artificial Sequence
  Synthetic oligonucleotide
tgttgctcctgcacgttgctacctcctggctcgcc

SEQ ID NO: 117039 - DNA, 35 bp, Artificial Sequence
  Synthetic oligonucleotide
gatagctccccctgcctgccccgatgccctgttaa

SEQ ID NO: 117040 - DNA, 35 bp, Artificial Sequence
  Synthetic oligonucleotide
gaccccgttcttggcttcttctcccctgtcgcaca

SEQ ID NO: 117041 - DNA, 35 bp, Artificial Sequence
  Synthetic oligonucleotide
gagcaacttgtccagctcgctcatactaccgccca

SEQ ID NO: 117042 - DNA, 36 bp, Artificial Sequence
  Synthetic oligonucleotide
gccgagccccacttgctgtccctagtccgttgatca

SEQ ID NO: 117043 - DNA, 38 bp, Artificial Sequence
  Synthetic oligonucleotide
tcaggtcaccgcaatccgtccttcccccagctccttga

SEQ ID NO: 117044 - DNA, 36 bp, Artificial Sequence
  Synthetic oligonucleotide
tccagcccaggtacaccgtctccttgccctcgctta

SEQ ID NO: 117045 - DNA, 35 bp, Artificial Sequence
  Synthetic oligonucleotide
tttggcgcagccttgtttttgtttccgttgcgctc

SEQ ID NO: 117046 - DNA, 35 bp, Artificial Sequence
  Synthetic oligonucleotide
agacgtgcctccctgctggttttcttccttatgtg

SEQ ID NO: 117047 - DNA, 35 bp, Artificial Sequence
  Synthetic oligonucleotide
gacctgctcgttcccctgtccctttgctccatgat

SEQ ID NO: 117048 - DNA, 35 bp, Artificial Sequence
  Synthetic oligonucleotide
gggggaagggcggggtaaaaaacggggacaatttt

SEQ ID NO: 117049 - DNA, 36 bp, Artificial Sequence
  Synthetic oligonucleotide
cacatgggtgggggagggaggaataggaacggggca

SEQ ID NO: 117050 - DNA, 37 bp, Artificial Sequence
  Synthetic oligonucleotide
aatggtgggaagggtggggtaaggagtacaaccggga

SEQ ID NO: 117051 - DNA, 35 bp, Artificial Sequence
  Synthetic oligonucleotide
tgtgaccatctatcaagtacactgcccccattcgc

SEQ ID NO: 117052 - DNA, 35 bp, Artificial Sequence
  Synthetic oligonucleotide
gttgctagcgcttcatgcatttcccgtccgcccca

SEQ ID NO: 117053 - DNA, 35 bp, Artificial Sequence
  Synthetic oligonucleotide
gctgcccgcacagaagcttccctcgtccatcacct

SEQ ID NO: 117054 - DNA, 35 bp, Artificial Sequence
  Synthetic oligonucleotide
gtctgtgcactatctatgctgttccttgcgcctct

SEQ ID NO: 117055 - DNA, 35 bp, Artificial Sequence
  Synthetic oligonucleotide
tcagcccccgcagcatctgcagcttcacgcctcca

SEQ ID NO: 117056 - DNA, 35 bp, Artificial Sequence
  Synthetic oligonucleotide
tgtactgcgcccacgccttttttgtcctgtctcca

SEQ ID NO: 117057 - DNA, 36 bp, Artificial Sequence
  Synthetic oligonucleotide
gcatacatccgggtcttaggatcgcccttactatca

SEQ ID NO: 117058 - DNA, 37 bp, Artificial Sequence
  Synthetic oligonucleotide
gcgagtgagggggtgcgatacgggaggaaatggcaga

SEQ ID NO: 117059 - DNA, 36 bp, Artificial Sequence
  Synthetic oligonucleotide
gacaatcggcagttttcacctctgccctctcctgga

SEQ ID NO: 117060 - DNA, 36 bp, Artificial Sequence
  Synthetic oligonucleotide
gccgttcccgccggcttaccacatgataccccctga

SEQ ID NO: 117061 - DNA, 35 bp, Artificial Sequence
  Synthetic oligonucleotide
accgcggatgcgcgcctggacgtactgcaccaccc

SEQ ID NO: 117062 - DNA, 35 bp, Artificial Sequence
  Synthetic oligonucleotide
gacctccccgcaagcactgagcacgcattgccctc

SEQ ID NO: 117063 - DNA, 36 bp, Artificial Sequence
  Synthetic oligonucleotide
aatccacctcagccttcgcatgatgcttcaccttca

SEQ ID NO: 117064 - DNA, 37 bp, Artificial Sequence
  Synthetic oligonucleotide
gtctgcgctccacccattctcacgccgcccccgccga

SEQ ID NO: 117065 - DNA, 36 bp, Artificial Sequence
  Synthetic oligonucleotide
agtccgtccggcccgctctgtttctccactgcctga

SEQ ID NO: 117066 - DNA, 37 bp, Artificial Sequence
  Synthetic oligonucleotide
gccccacaccactgctgactaactacatcgcctgtga

SEQ ID NO: 117067 - DNA, 35 bp, Artificial Sequence
  Synthetic oligonucleotide
gcgacggacgaatctgttgaaccgccgcccctacc

SEQ ID NO: 117068 - DNA, 35 bp, Artificial Sequence
  Synthetic oligonucleotide
actccgtccaccgtatctgcttcctttacacacat

SEQ ID NO: 117069 - DNA, 36 bp, Artificial Sequence
  Synthetic oligonucleotide
gcaaagcacagtccgctctgtacccccccattccca

SEQ ID NO: 117070 - DNA, 36 bp, Artificial Sequence
  Synthetic oligonucleotide
acgcttaggcctcccgatccttatagcccttgttca

SEQ ID NO: 117071 - DNA, 38 bp, Artificial Sequence
  Synthetic oligonucleotide
gagccccgtacccaatgtcgccccgctccccctactga

SEQ ID NO: 117072 - DNA, 35 bp, Artificial Sequence
  Synthetic oligonucleotide
ttgccgtcgccccggccgctgtatccaatcgttct

SEQ ID NO: 117073 - DNA, 35 bp, Artificial Sequence
  Synthetic oligonucleotide
gtcgcgccactctcctgtttccactcgcatcatgt

SEQ ID NO: 117074 - DNA, 35 bp, Artificial Sequence
  Synthetic oligonucleotide
tgcattaacccgccgccctgccttcgtgcgaacga

SEQ ID NO: 117075 - DNA, 37 bp, Artificial Sequence
  Synthetic oligonucleotide
gatggagagtggggcacgggggagtacggagggtgga

SEQ ID NO: 117076 - DNA, 36 bp, Artificial Sequence
  Synthetic oligonucleotide
gccaacgtatcagtgttctccctcgtgtcaccttta

SEQ ID NO: 117077 - DNA, 35 bp, Artificial Sequence
  Synthetic oligonucleotide
ccaaacccctgttgcctcccttgccctgtttccac

SEQ ID NO: 117078 - DNA, 35 bp, Artificial Sequence
  Synthetic oligonucleotide
tacggtcccgcagtccgggctccccccacgtcccc

SEQ ID NO: 117079 - DNA, 35 bp, Artificial Sequence
  Synthetic oligonucleotide
gcagtccgccgaccgggtttacaatctgtcctctc

SEQ ID NO: 117080 - DNA, 35 bp, Artificial Sequence
  Synthetic oligonucleotide
acaccaccgactcctgcattcgaccactgagtaca

SEQ ID NO: 117081 - DNA, 36 bp, Artificial Sequence
  Synthetic oligonucleotide
ttcaccatccccgtcgtccatacgttctgtcgtaga

SEQ ID NO: 117082 - DNA, 38 bp, Artificial Sequence
  Synthetic oligonucleotide
tccccccctacacgctgtcccagtcatcgcccccttga

SEQ ID NO: 117083 - DNA, 34 bp, Artificial Sequence
  Synthetic oligonucleotide
tgtatgtgatcccattgctcctgtcctgctttac

SEQ ID NO: 117084 - DNA, 35 bp, Artificial Sequence
  Synthetic oligonucleotide
tcaccatgtgttgtgctttggtctctccacctccc

SEQ ID NO: 117085 - DNA, 35 bp, Artificial Sequence
  Synthetic oligonucleotide
tctccggcccttttgccttatagcatcgccccgcc

SEQ ID NO: 117086 - DNA, 35 bp, Artificial Sequence
  Synthetic oligonucleotide
gggactccacaatcacatatttctgctccgccctg

SEQ ID NO: 117087 - DNA, 35 bp, Artificial Sequence
  Synthetic oligonucleotide
acgcccttcgcgagccctggtttccttccgttatt

SEQ ID NO: 117088 - DNA, 35 bp, Artificial Sequence
  Synthetic oligonucleotide
atcgcccaccagtccgcctacagtgtcctcttttt

SEQ ID NO: 117089 - DNA, 36 bp, Artificial Sequence
  Synthetic oligonucleotide
tctcgccccctctgtattatccatctacgtcattca

SEQ ID NO: 117090 - DNA, 37 bp, Artificial Sequence
  Synthetic oligonucleotide
atgggggcgggtgggccatggggggagtctaactgga

SEQ ID NO: 117091 - DNA, 38 bp, Artificial Sequence
  Synthetic oligonucleotide
tagtctgcccagttttgcccttccgcgtgccatcttga

SEQ ID NO: 117092 - DNA, 35 bp, Artificial Sequence
  Synthetic oligonucleotide
tccacatcgtgcgtcgtttttgacccgcctttcta

SEQ ID NO: 117093 - DNA, 36 bp, Artificial Sequence
  Synthetic oligonucleotide
gcctcccgccccctccccgtacaagaacccgcggta

SEQ ID NO: 117094 - DNA, 35 bp, Artificial Sequence
  Synthetic oligonucleotide
gcatcctgcatggaactctatccagcccctctgcc

SEQ ID NO: 117095 - DNA, 35 bp, Artificial Sequence
  Synthetic oligonucleotide
gttgcaccgtgaccgctctcgaaacctgcctctgc

SEQ ID NO: 117096 - DNA, 35 bp, Artificial Sequence
  Synthetic oligonucleotide
taactggagtcccgcctccctcccttcgagacgtg

SEQ ID NO: 117097 - DNA, 35 bp, Artificial Sequence
  Synthetic oligonucleotide
atgcacgaggaagacagggaaggaacggcgagttg

SEQ ID NO: 117098 - DNA, 37 bp, Artificial Sequence
  Synthetic oligonucleotide
tcctatgccacagcacgccactgtctcctttagccga

SEQ ID NO: 117099 - DNA, 35 bp, Artificial Sequence
  Synthetic oligonucleotide
tctgcccttggtgcgcaccaagagccattgccccc

SEQ ID NO: 117100 - DNA, 35 bp, Artificial Sequence
  Synthetic oligonucleotide
gatcaacgtttgcctccttcgcctgtccgcctgcc

SEQ ID NO: 117101 - DNA, 35 bp, Artificial Sequence
  Synthetic oligonucleotide
ggacccattgcgcttcttcgtcacagcccaccttc

SEQ ID NO: 117102 - DNA, 34 bp, Artificial Sequence
  Synthetic oligonucleotide
acccctgcggcttcccgcccatctcgtgccatcg

SEQ ID NO: 117103 - DNA, 34 bp, Artificial Sequence
  Synthetic oligonucleotide
tcgccacaccaccgacttacatgcccatttctcg

SEQ ID NO: 117104 - DNA, 35 bp, Artificial Sequence
  Synthetic oligonucleotide
tgcacaccctccgccctgttggtcgctgtttcact

SEQ ID NO: 117105 - DNA, 37 bp, Artificial Sequence
  Synthetic oligonucleotide
tatggccactcgccgccctcctaggtacatcccccga

SEQ ID NO: 117106 - DNA, 35 bp, Artificial Sequence
  Synthetic oligonucleotide
tttgacgaagcccgcaccatgccccctaccatgcc

SEQ ID NO: 117107 - DNA, 35 bp, Artificial Sequence
  Synthetic oligonucleotide
gaccccccctgtcccatgtacctaacagcggatcc

SEQ ID NO: 117108 - DNA, 35 bp, Artificial Sequence
  Synthetic oligonucleotide
tgctgaccgaccacgcgttacaccaaccatactcc

SEQ ID NO: 117109 - DNA, 35 bp, Artificial Sequence
  Synthetic oligonucleotide
attgcctcggtccgcttggcaaacttctctttccc

SEQ ID NO: 117110 - DNA, 35 bp, Artificial Sequence
  Synthetic oligonucleotide
aatgcccccccgcacacgtttgccccactacatcc

SEQ ID NO: 117111 - DNA, 35 bp, Artificial Sequence
  Synthetic oligonucleotide
tgcgccgcacggtttatcttctgcctgttctagtc

SEQ ID NO: 117112 - DNA, 35 bp, Artificial Sequence
  Synthetic oligonucleotide
atcgccgacccacgttagctgccctcatcctctgt

SEQ ID NO: 117113 - DNA, 37 bp, Artificial Sequence
  Synthetic oligonucleotide
tgcaccctctctgcaatgcccgttatgcttacgccga

SEQ ID NO: 117114 - DNA, 35 bp, Artificial Sequence
  Synthetic oligonucleotide
agctgagccgccccgttccaccttccagcattact

SEQ ID NO: 117115 - DNA, 35 bp, Artificial Sequence
  Synthetic oligonucleotide
tctgtctccccccgttgtttcgctccggtaggtct

SEQ ID NO: 117116 - DNA, 35 bp, Artificial Sequence
  Synthetic oligonucleotide
ttggggctgggggggaggaggcacatggaggaaaa

SEQ ID NO: 117117 - DNA, 36 bp, Artificial Sequence
  Synthetic oligonucleotide
tgtggggggggaggggcatagatacgagcgcagaga

SEQ ID NO: 117118 - DNA, 37 bp, Artificial Sequence
  Synthetic oligonucleotide
gccgaaggggagggagtactagtggcgggggcaagga

SEQ ID NO: 117119 - DNA, 37 bp, Artificial Sequence
  Synthetic oligonucleotide
tcactgccatcccgtgatatttactcccctgctttga

SEQ ID NO: 117120 - DNA, 36 bp, Artificial Sequence
  Synthetic oligonucleotide
tggacatgtcctgctgttccgcgcctccatccacta

SEQ ID NO: 117121 - DNA, 35 bp, Artificial Sequence
  Synthetic oligonucleotide
tgtactcgccaacacttgcttatggtttcacctcc

SEQ ID NO: 117122 - DNA, 35 bp, Artificial Sequence
  Synthetic oligonucleotide
gtgagcctctgcgcgtgtctcatccgtttccactc

SEQ ID NO: 117123 - DNA, 35 bp, Artificial Sequence
  Synthetic oligonucleotide
gcatctactccggctatggcataacctcccctccg

SEQ ID NO: 117124 - DNA, 35 bp, Artificial Sequence
  Synthetic oligonucleotide
atcgccacctcctttggagcacattcccgtatcct

SEQ ID NO: 117125 - DNA, 35 bp, Artificial Sequence
  Synthetic oligonucleotide
tgccctgccccctggttcctgctgacttacctcct

SEQ ID NO: 117126 - DNA, 37 bp, Artificial Sequence
  Synthetic oligonucleotide
tcaatctccgcccatcaatcgtagcgatctcctccga

SEQ ID NO: 117127 - DNA, 35 bp, Artificial Sequence
  Synthetic oligonucleotide
aatcgtcacgccccgtccctccccctccaaggacc

SEQ ID NO: 117128 - DNA, 35 bp, Artificial Sequence
  Synthetic oligonucleotide
agtcccccagcctccgtagtgcccctcgtcccatc

SEQ ID NO: 117129 - DNA, 35 bp, Artificial Sequence
  Synthetic oligonucleotide
gcgcatcatcgttcccgttactgccccattgtttg

SEQ ID NO: 117130 - DNA, 35 bp, Artificial Sequence
  Synthetic oligonucleotide
tgcaacgcaatccgcccacattgcagccctacgct

SEQ ID NO: 117131 - DNA, 38 bp, Artificial Sequence
  Synthetic oligonucleotide
gccgcacctctccccctgttgtcaccgccggtctatga

SEQ ID NO: 117132 - DNA, 35 bp, Artificial Sequence
  Synthetic oligonucleotide
aggagcagtacggagggcgggtgggtgacggtaag

SEQ ID NO: 117133 - DNA, 35 bp, Artificial Sequence
  Synthetic oligonucleotide
acgcgctcttctgtagctgtcgctccttccgctcc

SEQ ID NO: 117134 - DNA, 32 bp, Artificial Sequence
  Synthetic oligonucleotide
acgcggccactccccggtttgggccctacttc

SEQ ID NO: 117135 - DNA, 35 bp, Artificial Sequence
  Synthetic oligonucleotide
gcgataaggaaggtgataggcggggtcggataggt

SEQ ID NO: 117136 - DNA, 36 bp, Artificial Sequence
  Synthetic oligonucleotide
gtaccatccgcgccctccccgtaagccaccatgtga

SEQ ID NO: 117137 - DNA, 38 bp, Artificial Sequence
  Synthetic oligonucleotide
tcaggactgcgccgcattcgcacttgatcctcccttga

SEQ ID NO: 117138 - DNA, 37 bp, Artificial Sequence
  Synthetic oligonucleotide
gacacccgcgcaagtgttcgtctcccctccttgttga

SEQ ID NO: 117139 - DNA, 36 bp, Artificial Sequence
  Synthetic oligonucleotide
gtcgcgggggggtgggcagggtaagtacaactggta

SEQ ID NO: 117140 - DNA, 36 bp, Artificial Sequence
  Synthetic oligonucleotide
gatgatgaggaagaagtggcggagcgggtgggaaaa

SEQ ID NO: 117141 - DNA, 37 bp, Artificial Sequence
  Synthetic oligonucleotide
tgactatcggggtgggtggcgggctacggagggagga

SEQ ID NO: 117142 - DNA, 35 bp, Artificial Sequence
  Synthetic oligonucleotide
gttgcccgtgatatcggaaccctgtcatcctgtcc

SEQ ID NO: 117143 - DNA, 35 bp, Artificial Sequence
  Synthetic oligonucleotide
tgcacattgcctggtactccccacgaccctttcat

SEQ ID NO: 117144 - DNA, 35 bp, Artificial Sequence
  Synthetic oligonucleotide
tcgcccccaccgtggcattccttatagttccctca

SEQ ID NO: 117145 - DNA, 37 bp, Artificial Sequence
  Synthetic oligonucleotide
tgcgaagcgacggcgtcatcctgctgctcacccccga

SEQ ID NO: 117146 - DNA, 35 bp, Artificial Sequence
  Synthetic oligonucleotide
gtccgccccttatacgcatatcgtcgtctctgtcc

SEQ ID NO: 117147 - DNA, 35 bp, Artificial Sequence
  Synthetic oligonucleotide
tcaccggacggcgtgccacccctgcttctgccatc

SEQ ID NO: 117148 - DNA, 35 bp, Artificial Sequence
  Synthetic oligonucleotide
gccccaaccacgcctgtacctgctacccatgtatg

SEQ ID NO: 117149 - DNA, 35 bp, Artificial Sequence
  Synthetic oligonucleotide
gcccacgccggcccctatcatacgatatcgcccca

SEQ ID NO: 117150 - DNA, 37 bp, Artificial Sequence
  Synthetic oligonucleotide
gtgcaggagcggtaaattgcggtgggggggcggggga

SEQ ID NO: 117151 - DNA, 38 bp, Artificial Sequence
  Synthetic oligonucleotide
tcaccacactcactctggtacctgctcatcctttttga

SEQ ID NO: 117152 - DNA, 36 bp, Artificial Sequence
  Synthetic oligonucleotide
gcaccctccacgagtcctaagcacctgtcttaccta

SEQ ID NO: 117153 - DNA, 35 bp, Artificial Sequence
  Synthetic oligonucleotide
aacgcgccccacctctcttccatgtttgttatgcc

SEQ ID NO: 117154 - DNA, 35 bp, Artificial Sequence
  Synthetic oligonucleotide
caccacgttgcctgtcctgtttgtcactaccttcc

SEQ ID NO: 117155 - DNA, 34 bp, Artificial Sequence
  Synthetic oligonucleotide
gacgggaggaagggctagaggaggcacggggtaa

SEQ ID NO: 117156 - DNA, 37 bp, Artificial Sequence
  Synthetic oligonucleotide
gaacaatgagagctggggagaagggcggctggagaga

SEQ ID NO: 117157 - DNA, 35 bp, Artificial Sequence
  Synthetic oligonucleotide
agcaccactagcctatgtccggttatcatgctctc

SEQ ID NO: 117158 - DNA, 35 bp, Artificial Sequence
  Synthetic oligonucleotide
ttatgccccctcctgcccacgccgccactgccttg

SEQ ID NO: 117159 - DNA, 38 bp, Artificial Sequence
  Synthetic oligonucleotide
atgggaagacgaggggggtgggaagggcatcagcatga

SEQ ID NO: 117160 - DNA, 35 bp, Artificial Sequence
  Synthetic oligonucleotide
tctctgccgtgccgcttcgtttttcctctcagcct

SEQ ID NO: 117161 - DNA, 35 bp, Artificial Sequence
  Synthetic oligonucleotide
gcaggaggattaccggaaaaagggggaggaagggt

SEQ ID NO: 117162 - DNA, 35 bp, Artificial Sequence
  Synthetic oligonucleotide
tgacttcacccgcacgatctttgggcctcgatttt

SEQ ID NO: 117163 - DNA, 35 bp, Artificial Sequence
  Synthetic oligonucleotide
atcgcatgccactgtcctacaaggtcccttctcaa

SEQ ID NO: 117164 - DNA, 35 bp, Artificial Sequence
  Synthetic oligonucleotide
tcccatcccctccggtttccagtggaatcactaca

SEQ ID NO: 117165 - DNA, 36 bp, Artificial Sequence
  Synthetic oligonucleotide
tagcacgctccagcgttcacccactctccgctagca

SEQ ID NO: 117166 - DNA, 35 bp, Artificial Sequence
  Synthetic oligonucleotide
acagctccgcccttctttcgttctggtcactttca

SEQ ID NO: 117167 - DNA, 35 bp, Artificial Sequence
  Synthetic oligonucleotide
gccgcctgtcgctcgtactggcataccaccctgtc

SEQ ID NO: 117168 - DNA, 35 bp, Artificial Sequence
  Synthetic oligonucleotide
cgaacgtaactcctcatgtcgctccccctttctgg

SEQ ID NO: 117169 - DNA, 35 bp, Artificial Sequence
  Synthetic oligonucleotide
attcccccacccgtcaattggttacttttctgcct

SEQ ID NO: 117170 - DNA, 35 bp, Artificial Sequence
  Synthetic oligonucleotide
accacccccgttgtcgctcacgacgcaagacctgt

SEQ ID NO: 117171 - DNA, 35 bp, Artificial Sequence
  Synthetic oligonucleotide
atccactgcccttgtattctgtctatgtcactttt

SEQ ID NO: 117172 - DNA, 36 bp, Artificial Sequence
  Synthetic oligonucleotide
ttccacctcaactgtccctccgcctcgtaacccgca

SEQ ID NO: 117173 - DNA, 38 bp, Artificial Sequence
  Synthetic oligonucleotide
ttcaccacctgctgcctatattttcgcgtgatccctga

SEQ ID NO: 117174 - DNA, 38 bp, Artificial Sequence
  Synthetic oligonucleotide
tacaacctcagctctgcattccttcgccttcccagtga

SEQ ID NO: 117175 - DNA, 35 bp, Artificial Sequence
  Synthetic oligonucleotide
gccacccccgacttcttcccgtccggtcatagact

SEQ ID NO: 117176 - DNA, 35 bp, Artificial Sequence
  Synthetic oligonucleotide
gatacatccgatagccttccgtccctgccgttcct

SEQ ID NO: 117177 - DNA, 37 bp, Artificial Sequence
  Synthetic oligonucleotide
tagagggcgaaaggtaatgggggagggctggggtaga

SEQ ID NO: 117178 - DNA, 37 bp, Artificial Sequence
  Synthetic oligonucleotide
gtagcccccgacaatgacatccccgtccgcacctcga

SEQ ID NO: 117179 - DNA, 36 bp, Artificial Sequence
  Synthetic oligonucleotide
taggccgtttcgatcgcgcgcctccccctcctcgta

SEQ ID NO: 117180 - DNA, 35 bp, Artificial Sequence
  Synthetic oligonucleotide
ttggacattgcgctcccgatattctacctgtcccc

SEQ ID NO: 117181 - DNA, 36 bp, Artificial Sequence
  Synthetic oligonucleotide
gtgagggggcgggtttgggtagggagcgcgcgctga

SEQ ID NO: 117182 - DNA, 35 bp, Artificial Sequence
  Synthetic oligonucleotide
ggcggaacagccatgcccccattcctctccggtcc

SEQ ID NO: 117183 - DNA, 35 bp, Artificial Sequence
  Synthetic oligonucleotide
gccgccgccgccgctcatagccctgtgtcacgtca

SEQ ID NO: 117184 - DNA, 36 bp, Artificial Sequence
  Synthetic oligonucleotide
tcgacgcccaccaatcgtatctgctctgtcccctta

SEQ ID NO: 117185 - DNA, 35 bp, Artificial Sequence
  Synthetic oligonucleotide
gagagggccccacatgcctccccagtttgccacac

SEQ ID NO: 117186 - DNA, 35 bp, Artificial Sequence
  Synthetic oligonucleotide
tgtatccccgtacacgacgtctttatgcctcatcc

SEQ ID NO: 117187 - DNA, 35 bp, Artificial Sequence
  Synthetic oligonucleotide
tgtgggacgggacagacgggtgggaaaggagggag

SEQ ID NO: 117188 - DNA, 35 bp, Artificial Sequence
  Synthetic oligonucleotide
atcgccccacctttggctcgtgctttaaaacacca

SEQ ID NO: 117189 - DNA, 36 bp, Artificial Sequence
  Synthetic oligonucleotide
acctccgtcgtgccatccggcgttccacctcgttca

SEQ ID NO: 117190 - DNA, 37 bp, Artificial Sequence
  Synthetic oligonucleotide
gaggcccccgcctgcctaattcatcacctgctcccga

SEQ ID NO: 117191 - DNA, 38 bp, Artificial Sequence
  Synthetic oligonucleotide
ttggccccccttgccgtgttttcaccctccgtctctga

SEQ ID NO: 117192 - DNA, 35 bp, Artificial Sequence
  Synthetic oligonucleotide
ttgcgcccagccgcgcaccttcttccctactcccg

SEQ ID NO: 117193 - DNA, 35 bp, Artificial Sequence
  Synthetic oligonucleotide
tacgcgcatccgccccactgctacctccgagacat

SEQ ID NO: 117194 - DNA, 35 bp, Artificial Sequence
  Synthetic oligonucleotide
acccacgtcccgccgtgacacacgttgtcctctat

SEQ ID NO: 117195 - DNA, 37 bp, Artificial Sequence
  Synthetic oligonucleotide
tgtcctgttcccgacgtgctcgatcggccccccttga

SEQ ID NO: 117196 - DNA, 35 bp, Artificial Sequence
  Synthetic oligonucleotide
tgtgtactattttgcccaccaccgcctcggtatcc

SEQ ID NO: 117197 - DNA, 35 bp, Artificial Sequence
  Synthetic oligonucleotide
agctgatccaccatcctgtttatagccctcgctcg

SEQ ID NO: 117198 - DNA, 36 bp, Artificial Sequence
  Synthetic oligonucleotide
actacctgccgaccagacgatcactccctgctttca

SEQ ID NO: 117199 - DNA, 37 bp, Artificial Sequence
  Synthetic oligonucleotide
gaactacgggctgttggcggctggggttcgggaagga

SEQ ID NO: 117200 - DNA, 35 bp, Artificial Sequence
  Synthetic oligonucleotide
gacgccccctccgcaaaggtcctcttgattcgacc

SEQ ID NO: 117201 - DNA, 35 bp, Artificial Sequence
  Synthetic oligonucleotide
acacacacgtatctatgctttgccccgtaggttcc

SEQ ID NO: 117202 - DNA, 35 bp, Artificial Sequence
  Synthetic oligonucleotide
gtaactccgctcctgaattgcttgcgcatagcctc

SEQ ID NO: 117203 - DNA, 35 bp, Artificial Sequence
  Synthetic oligonucleotide
agacgccccagcgcattttagactttgccatccct

SEQ ID NO: 117204 - DNA, 35 bp, Artificial Sequence
  Synthetic oligonucleotide
gttcgcctccctcaatgcccagtcccgactaaagt

SEQ ID NO: 117205 - DNA, 35 bp, Artificial Sequence
  Synthetic oligonucleotide
gcacatattcgccgtactcttcgtccacactctgt

SEQ ID NO: 117206 - DNA, 38 bp, Artificial Sequence
  Synthetic oligonucleotide
ggggggcgggtcaggggatttgttgtttggggtcctga

SEQ ID NO: 117207 - DNA, 37 bp, Artificial Sequence
  Synthetic oligonucleotide
tgtccactcccctgtaatgccatggcgccctccacga

SEQ ID NO: 117208 - DNA, 37 bp, Artificial Sequence
  Synthetic oligonucleotide
tactgccgaaccacatgccactccgcttatcgcccga

SEQ ID NO: 117209 - DNA, 37 bp, Artificial Sequence
  Synthetic oligonucleotide
gggggaaagaccagggcgggggacgtctcttggggga

SEQ ID NO: 117210 - DNA, 38 bp, Artificial Sequence
  Synthetic oligonucleotide
gcgtgcgcaatggtacacaccgcccccccccgctctga

SEQ ID NO: 117211 - DNA, 35 bp, Artificial Sequence
  Synthetic oligonucleotide
tgtgacccttggcgcccctggtactcgctatgccc

SEQ ID NO: 117212 - DNA, 35 bp, Artificial Sequence
  Synthetic oligonucleotide
ccctgccttcgctctgcactctcgccttacctgcc

SEQ ID NO: 117213 - DNA, 35 bp, Artificial Sequence
  Synthetic oligonucleotide
tgtaccccactcagagcgctttattccaccgggtc

SEQ ID NO: 117214 - DNA, 35 bp, Artificial Sequence
  Synthetic oligonucleotide
tctcaccccgtcctctgaggccaccgagctcattt

SEQ ID NO: 117215 - DNA, 37 bp, Artificial Sequence
  Synthetic oligonucleotide
acgaggggacgggagggaactgaagctgggtgtggga

SEQ ID NO: 117216 - DNA, 35 bp, Artificial Sequence
  Synthetic oligonucleotide
atccgccccgcattcctaccctcacacgctggcta

SEQ ID NO: 117217 - DNA, 37 bp, Artificial Sequence
  Synthetic oligonucleotide
gtcccatctccgccaccgtgccgtttctttccggatc

SEQ ID NO: 117218 - DNA, 35 bp, Artificial Sequence
  Synthetic oligonucleotide
ttcgctgtccgcagttccgtacttccaatctcttc

SEQ ID NO: 117219 - DNA, 35 bp, Artificial Sequence
  Synthetic oligonucleotide
ttagcaccacatcggcctttaatgtagttcccccg

SEQ ID NO: 117220 - DNA, 35 bp, Artificial Sequence
  Synthetic oligonucleotide
atttgcggccttcgtgctactctcacttcacctct

SEQ ID NO: 117221 - DNA, 35 bp, Artificial Sequence
  Synthetic oligonucleotide
tcgcttccacctgcgcttctccgcctagctcctgc

SEQ ID NO: 117222 - DNA, 36 bp, Artificial Sequence
  Synthetic oligonucleotide
aagggccggaaggggaacgggggggggaaccggaaa

SEQ ID NO: 117223 - DNA, 36 bp, Artificial Sequence
  Synthetic oligonucleotide
tagtcgctcacctcccctgctgtaactccctgccca

SEQ ID NO: 117224 - DNA, 37 bp, Artificial Sequence
  Synthetic oligonucleotide
tcaccgacaaccacactgtctcagctcccctctccga

SEQ ID NO: 117225 - DNA, 38 bp, Artificial Sequence
  Synthetic oligonucleotide
taactcccccccccgcccgtcagatttcatgcacatga

SEQ ID NO: 117226 - DNA, 38 bp, Artificial Sequence
  Synthetic oligonucleotide
agtggggacgaggggaagggcgcaaagttgaagggtga

SEQ ID NO: 117227 - DNA, 35 bp, Artificial Sequence
  Synthetic oligonucleotide
gattgccacccgcactacctccaggacgaaccgac

SEQ ID NO: 117228 - DNA, 35 bp, Artificial Sequence
  Synthetic oligonucleotide
taggcgcccgccgccggtccaacaccccctttctc

SEQ ID NO: 117229 - DNA, 35 bp, Artificial Sequence
  Synthetic oligonucleotide
gagaggaagggatgggggaggttagtagatgcaag

SEQ ID NO: 117230 - DNA, 36 bp, Artificial Sequence
  Synthetic oligonucleotide
ttctgcccaccctgttattccccatagtctggttca

SEQ ID NO: 117231 - DNA, 36 bp, Artificial Sequence
  Synthetic oligonucleotide
gcataccgcccgcttggttgttttctcctgtttcga

SEQ ID NO: 117232 - DNA, 36 bp, Artificial Sequence
  Synthetic oligonucleotide
tagggcgctgaccggagggaaagggtacggggggga

SEQ ID NO: 117233 - DNA, 35 bp, Artificial Sequence
  Synthetic oligonucleotide
gaactatccgccgcatgtactattcactgcccaat

SEQ ID NO: 117234 - DNA, 35 bp, Artificial Sequence
  Synthetic oligonucleotide
acccggcctccgaaaacacccatgctgccctgcca

SEQ ID NO: 117235 - DNA, 35 bp, Artificial Sequence
  Synthetic oligonucleotide
gccgttggccggacccgtttccctcgttcccctca

SEQ ID NO: 117236 - DNA, 37 bp, Artificial Sequence
  Synthetic oligonucleotide
gtgccgacgggcaggtgggggggcggtaagggagaga

SEQ ID NO: 117237 - DNA, 35 bp, Artificial Sequence
  Synthetic oligonucleotide
gcgatggagggtgggagggcgcgcggaggcgagga

SEQ ID NO: 117238 - DNA, 37 bp, Artificial Sequence
  Synthetic oligonucleotide
gaaccgccccctccagcccgactgtcactcagtttga

SEQ ID NO: 117239 - DNA, 35 bp, Artificial Sequence
  Synthetic oligonucleotide
gccctgacccagtctgcacatacctttccatggcc

SEQ ID NO: 117240 - DNA, 35 bp, Artificial Sequence
  Synthetic oligonucleotide
gtcctgccccatcccaatagcgtatttggccaatc

SEQ ID NO: 117241 - DNA, 35 bp, Artificial Sequence
  Synthetic oligonucleotide
ttcgttaccgccgcatgccataactgttcttggtc

SEQ ID NO: 117242 - DNA, 35 bp, Artificial Sequence
  Synthetic oligonucleotide
tcccgcagtcgcccctgttctacgtctaactgccg

SEQ ID NO: 117243 - DNA, 35 bp, Artificial Sequence
  Synthetic oligonucleotide
acacgactccaccatgttttgtctgcctttctgtt

SEQ ID NO: 117244 - DNA, 35 bp, Artificial Sequence
  Synthetic oligonucleotide
atgcctcgccaaatctctcacgcccggctaacgcc

SEQ ID NO: 117245 - DNA, 38 bp, Artificial Sequence
  Synthetic oligonucleotide
tgacctcctccgctgctgctgccgacttattctcgtga

SEQ ID NO: 117246 - DNA, 38 bp, Artificial Sequence
  Synthetic oligonucleotide
tcctgcgccctccatcacgtacgcccacctgctgttga

SEQ ID NO: 117247 - DNA, 35 bp, Artificial Sequence
  Synthetic oligonucleotide
ttgcgcctcatcctatcccatcccgttgaagccac

SEQ ID NO: 117248 - DNA, 35 bp, Artificial Sequence
  Synthetic oligonucleotide
acatgacacaaatcgccgtatattgctccccttac

SEQ ID NO: 117249 - DNA, 35 bp, Artificial Sequence
  Synthetic oligonucleotide
ttacacgtcacttatcatcgtcactcgggccttct

SEQ ID NO: 117250 - DNA, 35 bp, Artificial Sequence
  Synthetic oligonucleotide
tgccacctccagtcccgctcgatagggcactcttt

SEQ ID NO: 117251 - DNA, 35 bp, Artificial Sequence
  Synthetic oligonucleotide
tgaccaccacccatccgctttggtgtcctttctca

SEQ ID NO: 117252 - DNA, 36 bp, Artificial Sequence
  Synthetic oligonucleotide
ttggtctcacttccctgccgttatgccctgctttca

SEQ ID NO: 117253 - DNA, 37 bp, Artificial Sequence
  Synthetic oligonucleotide
gtagcggggccgtaacggcatgagagggaggggggga

SEQ ID NO: 117254 - DNA, 36 bp, Artificial Sequence
  Synthetic oligonucleotide
atcgcgcatcccacggttctttggccacccgatcta

SEQ ID NO: 117255 - DNA, 35 bp, Artificial Sequence
  Synthetic oligonucleotide
gagatcaccgccgccgactttctacggtcatacct

SEQ ID NO: 117256 - DNA, 35 bp, Artificial Sequence
  Synthetic oligonucleotide
gagtcccatgctgcatccccgccatgttcttactc

SEQ ID NO: 117257 - DNA, 35 bp, Artificial Sequence
  Synthetic oligonucleotide
ttgccacatagctatcaaacgtgcaccacctctcg

SEQ ID NO: 117258 - DNA, 35 bp, Artificial Sequence
  Synthetic oligonucleotide
gcacataggagggagggcggtaaaaccaggtgggg

SEQ ID NO: 117259 - DNA, 35 bp, Artificial Sequence
  Synthetic oligonucleotide
gatgcgctatcaacacggggggagggcgggaagtg

SEQ ID NO: 117260 - DNA, 35 bp, Artificial Sequence
  Synthetic oligonucleotide
gccactcgtcctctggcgtcccagtttcacccttg

SEQ ID NO: 117261 - DNA, 35 bp, Artificial Sequence
  Synthetic oligonucleotide
gacacgcacgtccgtcggtcttcctccgcccttaa

SEQ ID NO: 117262 - DNA, 38 bp, Artificial Sequence
  Synthetic oligonucleotide
gttgggttgggtggggagggactagagcgagtacgtga

SEQ ID NO: 117263 - DNA, 38 bp, Artificial Sequence
  Synthetic oligonucleotide
gtgagacgtacggaaggaaacaaggggcgggcgtgtga

SEQ ID NO: 117264 - DNA, 37 bp, Artificial Sequence
  Synthetic oligonucleotide
gaatgtccgaaagcgccacaagccccaccgcccttga

SEQ ID NO: 117265 - DNA, 35 bp, Artificial Sequence
  Synthetic oligonucleotide
acacccctatcgccccgtgactaccttaggttacc

SEQ ID NO: 117266 - DNA, 35 bp, Artificial Sequence
  Synthetic oligonucleotide
aacccggccccaccagcggtcaacgctctcgttcc

SEQ ID NO: 117267 - DNA, 35 bp, Artificial Sequence
  Synthetic oligonucleotide
gtctgcccaatacctatgcacccttgcgctacacg

SEQ ID NO: 117268 - DNA, 35 bp, Artificial Sequence
  Synthetic oligonucleotide
tgttcacccaactgcccgttatccttgaccgaccg

SEQ ID NO: 117269 - DNA, 35 bp, Artificial Sequence
  Synthetic oligonucleotide
ggtatacaaagggtggaggtgggaaggagaagggt

SEQ ID NO: 117270 - DNA, 36 bp, Artificial Sequence
  Synthetic oligonucleotide
tccgccaaccattcgagctttcccgtgcctgtgaaa

SEQ ID NO: 117271 - DNA, 36 bp, Artificial Sequence
  Synthetic oligonucleotide
ttcaccttccccagagtcgtttcgctaggcctttca

SEQ ID NO: 117272 - DNA, 35 bp, Artificial Sequence
  Synthetic oligonucleotide
atcacccacaccgcctgcatcttctgggcaattac

SEQ ID NO: 117273 - DNA, 35 bp, Artificial Sequence
  Synthetic oligonucleotide
acgaccacgtgcctctaaaccgtcgctcccccgct

SEQ ID NO: 117274 - DNA, 35 bp, Artificial Sequence
  Synthetic oligonucleotide
accgcacccgttacaggcgcttgtttccatccctt

SEQ ID NO: 117275 - DNA, 35 bp, Artificial Sequence
  Synthetic oligonucleotide
gtcgccccatggcgttatcctcaccctcctcggtt

SEQ ID NO: 117276 - DNA, 35 bp, Artificial Sequence
  Synthetic oligonucleotide
gaccacttccacagtaattagttcctctgttctcg

SEQ ID NO: 117277 - DNA, 35 bp, Artificial Sequence
  Synthetic oligonucleotide
taacccaggacccccgtgcttttagtgccatcgtg

SEQ ID NO: 117278 - DNA, 36 bp, Artificial Sequence
  Synthetic oligonucleotide
tcccatccgccttcctatctgccgtatgtttgccaa

SEQ ID NO: 117279 - DNA, 35 bp, Artificial Sequence
  Synthetic oligonucleotide
gatgcaagtacatggaggggtgggtgagggtgaga

SEQ ID NO: 117280 - DNA, 37 bp, Artificial Sequence
  Synthetic oligonucleotide
acgggggaggtggggggaaggtggcggtatgaatcga

SEQ ID NO: 117281 - DNA, 35 bp, Artificial Sequence
  Synthetic oligonucleotide
tcgctcccacggatctgcacctgttttctttctga

SEQ ID NO: 117282 - DNA, 35 bp, Artificial Sequence
  Synthetic oligonucleotide
tcctgtaccgcaccattgcattaacgcatacctta

SEQ ID NO: 117283 - DNA, 36 bp, Artificial Sequence
  Synthetic oligonucleotide
gcccgtgctcctaggtacttatcgccatccgctcca

SEQ ID NO: 117284 - DNA, 35 bp, Artificial Sequence
  Synthetic oligonucleotide
atcatgctggcatgagtttaggccccctccccgcc

SEQ ID NO: 117285 - DNA, 35 bp, Artificial Sequence
  Synthetic oligonucleotide
tgtttccaccctcccatagcactgcacgcacgccg

SEQ ID NO: 117286 - DNA, 35 bp, Artificial Sequence
  Synthetic oligonucleotide
agctccacaccacctcggtatccactgctctactg

SEQ ID NO: 117287 - DNA, 35 bp, Artificial Sequence
  Synthetic oligonucleotide
gccgttccactccacacgcccgccccgccccgctg

SEQ ID NO: 117288 - DNA, 35 bp, Artificial Sequence
  Synthetic oligonucleotide
gtgagtgggagaaggtctctaagggggaggggggt

SEQ ID NO: 117289 - DNA, 35 bp, Artificial Sequence
  Synthetic oligonucleotide
tcatctggcccccatatgtcactatcaccttctca

SEQ ID NO: 117290 - DNA, 35 bp, Artificial Sequence
  Synthetic oligonucleotide
gtggggagagtggtgaggggaggttgctggagaga

SEQ ID NO: 117291 - DNA, 37 bp, Artificial Sequence
  Synthetic oligonucleotide
tcctccgcccaatgcacgtttaccggacccttcacga

SEQ ID NO: 117292 - DNA, 37 bp, Artificial Sequence
  Synthetic oligonucleotide
acgcaactgtccacctcttgcaaatgccacccctcga

SEQ ID NO: 117293 - DNA, 37 bp, Artificial Sequence
  Synthetic oligonucleotide
agtgaaggtggacggggaggaaggaaggtccattgga

SEQ ID NO: 117294 - DNA, 34 bp, Artificial Sequence
  Synthetic oligonucleotide
atgcacctagcgtagcaatgcacccccacccctc

SEQ ID NO: 117295 - DNA, 36 bp, Artificial Sequence
  Synthetic oligonucleotide
gtggtgccttccgcctctgttctccgtttcaggcaa

SEQ ID NO: 117296 - DNA, 36 bp, Artificial Sequence
  Synthetic oligonucleotide
tccttgcccgccccacggtattaacagccttgccca

SEQ ID NO: 117297 - DNA, 36 bp, Artificial Sequence
  Synthetic oligonucleotide
gccgagcccttgacgtgcccctaagccgcccatcca

SEQ ID NO: 117298 - DNA, 36 bp, Artificial Sequence
  Synthetic oligonucleotide
tacgggtcgacggcgggaggggaacagggtcaacga

SEQ ID NO: 117299 - DNA, 37 bp, Artificial Sequence
  Synthetic oligonucleotide
acaactcccctgtgcttatctactacctcccttgcga

SEQ ID NO: 117300 - DNA, 35 bp, Artificial Sequence
  Synthetic oligonucleotide
gatgcaccgtgggacctctgagcctcatcgccctc

SEQ ID NO: 117301 - DNA, 35 bp, Artificial Sequence
  Synthetic oligonucleotide
tccagccaacaatatgatccgatatgtcctgcctc

SEQ ID NO: 117302 - DNA, 36 bp, Artificial Sequence
  Synthetic oligonucleotide
atccgccaccccctctgccgtagttgtcacggtaaa

SEQ ID NO: 117303 - DNA, 35 bp, Artificial Sequence
  Synthetic oligonucleotide
acccccctgcctcatctctcgggtacatcctctac

SEQ ID NO: 117304 - DNA, 35 bp, Artificial Sequence
  Synthetic oligonucleotide
atcccttcgccaccagtgctgcttctcacctttcc

SEQ ID NO: 117305 - DNA, 35 bp, Artificial Sequence
  Synthetic oligonucleotide
gcatgcttatcccgcccgttgttggtccaccgctc

SEQ ID NO: 117306 - DNA, 36 bp, Artificial Sequence
  Synthetic oligonucleotide
ggtccaacccttacctgtgccaagccacatctttca

SEQ ID NO: 117307 - DNA, 35 bp, Artificial Sequence
  Synthetic oligonucleotide
tcccacataccatccgtcatcctcccggcgaaagc

SEQ ID NO: 117308 - DNA, 35 bp, Artificial Sequence
  Synthetic oligonucleotide
acgtatggctctactcgcacctgttctgccaccgc

SEQ ID NO: 117309 - DNA, 36 bp, Artificial Sequence
  Synthetic oligonucleotide
tccgtcagagctcctatccctctcacccatgcctgc

SEQ ID NO: 117310 - DNA, 35 bp, Artificial Sequence
  Synthetic oligonucleotide
gaacgaaatgggaaggggactctgggctggaaggg

SEQ ID NO: 117311 - DNA, 35 bp, Artificial Sequence
  Synthetic oligonucleotide
tgtccagtgccagcgctctacacaaccactgccct

SEQ ID NO: 117312 - DNA, 35 bp, Artificial Sequence
  Synthetic oligonucleotide
gccccgcacccaccttagtactgcctcagccgcct

SEQ ID NO: 117313 - DNA, 37 bp, Artificial Sequence
  Synthetic oligonucleotide
tgacacggcagaccgccacgccgccgccctttcatga

SEQ ID NO: 117314 - DNA, 35 bp, Artificial Sequence
  Synthetic oligonucleotide
gacccgttcgcagcgcaccctccgcctctcgctta

SEQ ID NO: 117315 - DNA, 35 bp, Artificial Sequence
  Synthetic oligonucleotide
ggacacgccccccctcttccattgacgcccgtccg

SEQ ID NO: 117316 - DNA, 35 bp, Artificial Sequence
  Synthetic oligonucleotide
tccagtcccgccattcaggatattctcccgtgcct

SEQ ID NO: 117317 - DNA, 35 bp, Artificial Sequence
  Synthetic oligonucleotide
atgtccactccctgcctcgccatgacgctcctatt

SEQ ID NO: 117318 - DNA, 35 bp, Artificial Sequence
  Synthetic oligonucleotide
acaccatcccgctgatctgcacgtgcgccacataa

SEQ ID NO: 117319 - DNA, 35 bp, Artificial Sequence
  Synthetic oligonucleotide
gacccagtcgccgcttgcttttcctcattccataa

SEQ ID NO: 117320 - DNA, 37 bp, Artificial Sequence
  Synthetic oligonucleotide
taccacccgtccgccggtttgattacactctccacga

SEQ ID NO: 117321 - DNA, 35 bp, Artificial Sequence
  Synthetic oligonucleotide
atgacgcactcactgcgacttttatcgataccacc

SEQ ID NO: 117322 - DNA, 35 bp, Artificial Sequence
  Synthetic oligonucleotide
gcacctgcgcttgtgatcgcccccatctgcccccc

SEQ ID NO: 117323 - DNA, 35 bp, Artificial Sequence
  Synthetic oligonucleotide
atgccactcacctcccatgctgtccacttgtcctt

SEQ ID NO: 117324 - DNA, 36 bp, Artificial Sequence
  Synthetic oligonucleotide
tactgggggagtgggaggacggaggttgcggatgga

SEQ ID NO: 117325 - DNA, 37 bp, Artificial Sequence
  Synthetic oligonucleotide
gcgcccctctgtccgtccattgccaccgctgccctga

SEQ ID NO: 117326 - DNA, 35 bp, Artificial Sequence
  Synthetic oligonucleotide
gtaaggacgggaagaggggaggtgatgggtcgatg

SEQ ID NO: 117327 - DNA, 35 bp, Artificial Sequence
  Synthetic oligonucleotide
ttacccccagccccggccagctctgacatacctct

SEQ ID NO: 117328 - DNA, 37 bp, Artificial Sequence
  Synthetic oligonucleotide
ttagtcagtgggggaacgaaagggcaaggggaatgga

SEQ ID NO: 117329 - DNA, 37 bp, Artificial Sequence
  Synthetic oligonucleotide
gccacaggggggggatgggagtacagggtacatgtga

SEQ ID NO: 117330 - DNA, 35 bp, Artificial Sequence
  Synthetic oligonucleotide
gcccatccagcacgtgacccggcaggctccaccac

SEQ ID NO: 117331 - DNA, 35 bp, Artificial Sequence
  Synthetic oligonucleotide
gccagccttgccttgcgtgaaccagtcctctcttc

SEQ ID NO: 117332 - DNA, 33 bp, Artificial Sequence
  Synthetic oligonucleotide
agccccgacccgcctccgatacatgcagtaacg

SEQ ID NO: 117333 - DNA, 35 bp, Artificial Sequence
  Synthetic oligonucleotide
tccgacgaactgcctcacatccaccgcgccacacg

SEQ ID NO: 117334 - DNA, 36 bp, Artificial Sequence
  Synthetic oligonucleotide
tgcgctaggggggacgggggaatagcgggcggggaa

SEQ ID NO: 117335 - DNA, 36 bp, Artificial Sequence
  Synthetic oligonucleotide
ggtacgtgccacttgccctcgtcctgtcgcccttaa

SEQ ID NO: 117336 - DNA, 36 bp, Artificial Sequence
  Synthetic oligonucleotide
gacgcacattcagcctgtcctcgtccggtactttca

SEQ ID NO: 117337 - DNA, 35 bp, Artificial Sequence
  Synthetic oligonucleotide
acgccctgacgcctcgaactcacgcatcccttgga

SEQ ID NO: 117338 - DNA, 35 bp, Artificial Sequence
  Synthetic oligonucleotide
actccatgcacccctgctcaccttcatgtcttaac

SEQ ID NO: 117339 - DNA, 35 bp, Artificial Sequence
  Synthetic oligonucleotide
atgcctccccatcagaatggtgtgcccgctcctcc

SEQ ID NO: 117340 - DNA, 35 bp, Artificial Sequence
  Synthetic oligonucleotide
acccctatgcccacattgagctatactacccccat

SEQ ID NO: 117341 - DNA, 35 bp, Artificial Sequence
  Synthetic oligonucleotide
actcatccccggttgaattgcctcccctgttgcat

SEQ ID NO: 117342 - DNA, 35 bp, Artificial Sequence
  Synthetic oligonucleotide
acatacatgcctacctgctttcgagatcctcgcct

SEQ ID NO: 117343 - DNA, 37 bp, Artificial Sequence
  Synthetic oligonucleotide
gatggtcggggggaaggacgagggagacgacagctga

SEQ ID NO: 117344 - DNA, 35 bp, Artificial Sequence
  Synthetic oligonucleotide
accagcccctaacatgtacgcgcctaataccccgc

SEQ ID NO: 117345 - DNA, 35 bp, Artificial Sequence
  Synthetic oligonucleotide
gatccgcccgacgcagtccccgctcctggtgattc

SEQ ID NO: 117346 - DNA, 35 bp, Artificial Sequence
  Synthetic oligonucleotide
aagggatgaagacggggatgggagcgggtgggtat

SEQ ID NO: 117347 - DNA, 35 bp, Artificial Sequence
  Synthetic oligonucleotide
tgttatgcatcagccgctttcacccctccggcctt

SEQ ID NO: 117348 - DNA, 35 bp, Artificial Sequence
  Synthetic oligonucleotide
tcccatcggcccacacccccttcacggccctggaa

SEQ ID NO: 117349 - DNA, 35 bp, Artificial Sequence
  Synthetic oligonucleotide
accatcaccgccccttatctaacagactggtcgca

SEQ ID NO: 117350 - DNA, 38 bp, Artificial Sequence
  Synthetic oligonucleotide
gaccgcccgtctgcttcccatcgctaccccttttgtga

SEQ ID NO: 117351 - DNA, 35 bp, Artificial Sequence
  Synthetic oligonucleotide
gggactcacgcccgcacccgtcgccttactgcaac

SEQ ID NO: 117352 - DNA, 36 bp, Artificial Sequence
  Synthetic oligonucleotide
tgtgcgtagcccgggtcgctccacttgattcataca

SEQ ID NO: 117353 - DNA, 36 bp, Artificial Sequence
  Synthetic oligonucleotide
tgtggagccccgtgattcgttcggtaccattctcca

SEQ ID NO: 117354 - DNA, 35 bp, Artificial Sequence
  Synthetic oligonucleotide
gacgtccgacacactatccgttccttccctgcgga

SEQ ID NO: 117355 - DNA, 37 bp, Artificial Sequence
  Synthetic oligonucleotide
ttgcaacggggacagttatgcaagggagggacgggga

SEQ ID NO: 117356 - DNA, 35 bp, Artificial Sequence
  Synthetic oligonucleotide
gttcagatgccctgccctagctgcctttgccctac

SEQ ID NO: 117357 - DNA, 35 bp, Artificial Sequence
  Synthetic oligonucleotide
tgcctcaacactgagtctcgtagtaacatccgccc

SEQ ID NO: 117358 - DNA, 35 bp, Artificial Sequence
  Synthetic oligonucleotide
tatgcatactgccgccgtcatacctcctgcacctc

SEQ ID NO: 117359 - DNA, 35 bp, Artificial Sequence
  Synthetic oligonucleotide
atcacgctgttctcgctcacttgtgctctgccctc

SEQ ID NO: 117360 - DNA, 35 bp, Artificial Sequence
  Synthetic oligonucleotide
tcgcatacggatcatccgtacgcgttcaccctctt

SEQ ID NO: 117361 - DNA, 35 bp, Artificial Sequence
  Synthetic oligonucleotide
gacgccgccccttagctcccatcgaccaactgcca

SEQ ID NO: 117362 - DNA, 36 bp, Artificial Sequence
  Synthetic oligonucleotide
tgcccatgggacagtaggaggggtaaagagggtgga

SEQ ID NO: 117363 - DNA, 36 bp, Artificial Sequence
  Synthetic oligonucleotide
gacgcgctcaggtacactgcaccccgccctgtccta

SEQ ID NO: 117364 - DNA, 35 bp, Artificial Sequence
  Synthetic oligonucleotide
gccctgttacctctgctgtaccatcatgcctccac

SEQ ID NO: 117365 - DNA, 35 bp, Artificial Sequence
  Synthetic oligonucleotide
gcattcatcgctacctctccgcccccccgtctcgt

SEQ ID NO: 117366 - DNA, 36 bp, Artificial Sequence
  Synthetic oligonucleotide
gcccactgtctagctttgcaggtccccccgccttca

SEQ ID NO: 117367 - DNA, 35 bp, Artificial Sequence
  Synthetic oligonucleotide
tgtgcgcccggcgcgtccttactatcgtccccgcc

SEQ ID NO: 117368 - DNA, 35 bp, Artificial Sequence
  Synthetic oligonucleotide
aacgccgctcttctgttctctcccccgtttctggc

SEQ ID NO: 117369 - DNA, 35 bp, Artificial Sequence
  Synthetic oligonucleotide
tccctccgttctctgtctatccctttgagtgcctc

SEQ ID NO: 117370 - DNA, 35 bp, Artificial Sequence
  Synthetic oligonucleotide
tcagacggagggggcctcaagggacgggaggggct

SEQ ID NO: 117371 - DNA, 37 bp, Artificial Sequence
  Synthetic oligonucleotide
gttgccactccttgtacatagtcccccgcacttccga

SEQ ID NO: 117372 - DNA, 35 bp, Artificial Sequence
  Synthetic oligonucleotide
tatgacgcccgccaagtatccctgtcctaacccac

SEQ ID NO: 117373 - DNA, 35 bp, Artificial Sequence
  Synthetic oligonucleotide
tggggccagtccgccgggtctgtctcgttccacct

SEQ ID NO: 117374 - DNA, 35 bp, Artificial Sequence
  Synthetic oligonucleotide
tctcgaacccatgatctgcctccagccacgtttaa

SEQ ID NO: 117375 - DNA, 36 bp, Artificial Sequence
  Synthetic oligonucleotide
tttgcgtagttcctgtcccccgttgtcctaggccca

SEQ ID NO: 117376 - DNA, 38 bp, Artificial Sequence
  Synthetic oligonucleotide
tcccgaaccgcgccacttcgtttgaattgcccccctga

SEQ ID NO: 117377 - DNA, 38 bp, Artificial Sequence
  Synthetic oligonucleotide
aacacgcgttgcgtttggaagcgtccctcccccgctga

SEQ ID NO: 117378 - DNA, 35 bp, Artificial Sequence
  Synthetic oligonucleotide
tccgctgtgatctgttccccgcgtacccgctccgc

SEQ ID NO: 117379 - DNA, 35 bp, Artificial Sequence
  Synthetic oligonucleotide
acatattgcactgtaccccattgtcccacgccctg

SEQ ID NO: 117380 - DNA, 37 bp, Artificial Sequence
  Synthetic oligonucleotide
gccaggggccagggggggcaagggagtgacggaagga

SEQ ID NO: 117381 - DNA, 30 bp, Artificial Sequence
  Synthetic oligonucleotide
tacctgggcctgggcgagggagggggggga

SEQ ID NO: 117382 - DNA, 38 bp, Artificial Sequence
  Synthetic oligonucleotide
actccaccccacatgtctccagcctttgacccagttga

SEQ ID NO: 117383 - DNA, 35 bp, Artificial Sequence
  Synthetic oligonucleotide
acacccaccatactgtaatcctttggactgtgctc

SEQ ID NO: 117384 - DNA, 38 bp, Artificial Sequence
  Synthetic oligonucleotide
accgcaaccgccattcctgcgcacgacacctctcatga

SEQ ID NO: 117385 - DNA, 36 bp, Artificial Sequence
  Synthetic oligonucleotide
atgagcacaaggggataggggaagtgggggccgtga

SEQ ID NO: 117386 - DNA, 38 bp, Artificial Sequence
  Synthetic oligonucleotide
tcccgcatcatgtgcgcccccgcctccgatcttcgtga

SEQ ID NO: 117387 - DNA, 37 bp, Artificial Sequence
  Synthetic oligonucleotide
gcgacggctccaagttttgcccttccctccgaccata

SEQ ID NO: 117388 - DNA, 35 bp, Artificial Sequence
  Synthetic oligonucleotide
actacatcgcgtcgcccgccccatcgcgtcacccc

SEQ ID NO: 117389 - DNA, 35 bp, Artificial Sequence
  Synthetic oligonucleotide
tttgtgcccccttccttgactgagccccggttatc

SEQ ID NO: 117390 - DNA, 35 bp, Artificial Sequence
  Synthetic oligonucleotide
acacgacttcgtgttaggccacctattcccacctg

SEQ ID NO: 117391 - DNA, 35 bp, Artificial Sequence
  Synthetic oligonucleotide
tccttcactgtccggtccttgctcctatacggtct

SEQ ID NO: 117392 - DNA, 35 bp, Artificial Sequence
  Synthetic oligonucleotide
tccaagcccacactggtttcgattcctccatttgt

SEQ ID NO: 117393 - DNA, 35 bp, Artificial Sequence
  Synthetic oligonucleotide
gtctcacctgtccgactgttctgtgcgcccgcccc

SEQ ID NO: 117394 - DNA, 35 bp, Artificial Sequence
  Synthetic oligonucleotide
aagcgtgaacgcctgtgtcaacgtccgccctttcc

SEQ ID NO: 117395 - DNA, 35 bp, Artificial Sequence
  Synthetic oligonucleotide
tagtcaccgagctttgtccattgggccctcccctg

SEQ ID NO: 117396 - DNA, 36 bp, Artificial Sequence
  Synthetic oligonucleotide
gtcaccctccacctatgcgcctttaactgccataca

SEQ ID NO: 117397 - DNA, 35 bp, Artificial Sequence
  Synthetic oligonucleotide
ccccacccccctgcttctgtagcagccttatccta

SEQ ID NO: 117398 - DNA, 36 bp, Artificial Sequence
  Synthetic oligonucleotide
tgagccccagaccctgcttccgcccgctaaccgtta

SEQ ID NO: 117399 - DNA, 35 bp, Artificial Sequence
  Synthetic oligonucleotide
gccctcccgcgcacgagtacttgttcgtccttgcc

SEQ ID NO: 117400 - DNA, 35 bp, Artificial Sequence
  Synthetic oligonucleotide
gagggggaaggatgaggtggggggcggaatgcagc

SEQ ID NO: 117401 - DNA, 35 bp, Artificial Sequence
  Synthetic oligonucleotide
agacccctcccgtacagaattcctggccttacccg

SEQ ID NO: 117402 - DNA, 35 bp, Artificial Sequence
  Synthetic oligonucleotide
gcgctgccactatttaccggacccctcccttcgcc

SEQ ID NO: 117403 - DNA, 36 bp, Artificial Sequence
  Synthetic oligonucleotide
gcacccaccgtgtccctcatgcctatctaatgccta

SEQ ID NO: 117404 - DNA, 35 bp, Artificial Sequence
  Synthetic oligonucleotide
atacgcgaaccttctcctgcatattgtagtggccc

SEQ ID NO: 117405 - DNA, 35 bp, Artificial Sequence
  Synthetic oligonucleotide
gctgacggcgcagccgccctaccacgtttcatccc

SEQ ID NO: 117406 - DNA, 35 bp, Artificial Sequence
  Synthetic oligonucleotide
gatcagtgcccgcgtgacttgcccccatttgtctc

SEQ ID NO: 117407 - DNA, 35 bp, Artificial Sequence
  Synthetic oligonucleotide
tgagccctgccctcacttgcatatttatctagttc

SEQ ID NO: 117408 - DNA, 35 bp, Artificial Sequence
  Synthetic oligonucleotide
tagagccccatagcccgtaccaccatgatcccgcg

SEQ ID NO: 117409 - DNA, 35 bp, Artificial Sequence
  Synthetic oligonucleotide
gcctgagccgtccgcgccccgccccgttgcccaca

SEQ ID NO: 117410 - DNA, 36 bp, Artificial Sequence
  Synthetic oligonucleotide
accgcactcgcactgctacttatttgtttcttccca

SEQ ID NO: 117411 - DNA, 35 bp, Artificial Sequence
  Synthetic oligonucleotide
tacgttccacccgcgctttattcacatccgtatca

SEQ ID NO: 117412 - DNA, 35 bp, Artificial Sequence
  Synthetic oligonucleotide
gatccacctggtggcatggaccccccgctccaccc

SEQ ID NO: 117413 - DNA, 35 bp, Artificial Sequence
  Synthetic oligonucleotide
gcctaccaccatctcatcatgcatccaccgggatc

SEQ ID NO: 117414 - DNA, 35 bp, Artificial Sequence
  Synthetic oligonucleotide
atcactgtggcccatctggatttctctgttccccg

SEQ ID NO: 117415 - DNA, 35 bp, Artificial Sequence
  Synthetic oligonucleotide
agtggctcccctccgcatttggtacgtctccctct

SEQ ID NO: 117416 - DNA, 35 bp, Artificial Sequence
  Synthetic oligonucleotide
tcttaccgacgcctcccattgttctcagccaattt

SEQ ID NO: 117417 - DNA, 36 bp, Artificial Sequence
  Synthetic oligonucleotide
tctcgagagggtggtaagcagtggaagggcaaagaa

SEQ ID NO: 117418 - DNA, 37 bp, Artificial Sequence
  Synthetic oligonucleotide
acgcccaccctcctcgcccgtattatttgaatcccga

SEQ ID NO: 117419 - DNA, 35 bp, Artificial Sequence
  Synthetic oligonucleotide
gatcccgcccggagcactttggcggttatcccacc

SEQ ID NO: 117420 - DNA, 35 bp, Artificial Sequence
  Synthetic oligonucleotide
attagcggacaccatccaccgtccttctctcactg

SEQ ID NO: 117421 - DNA, 35 bp, Artificial Sequence
  Synthetic oligonucleotide
taagctctgcttccccgtgccctgcctgttccttg

SEQ ID NO: 117422 - DNA, 35 bp, Artificial Sequence
  Synthetic oligonucleotide
gaacatccccgtctacatttgcccggtggccttcc

SEQ ID NO: 117423 - DNA, 37 bp, Artificial Sequence
  Synthetic oligonucleotide
ggatgcccctccaatgctccaccgccctcctgtacga

SEQ ID NO: 117424 - DNA, 38 bp, Artificial Sequence
  Synthetic oligonucleotide
acgtgcccccgcagcgcattacgttccctcttccctga

SEQ ID NO: 117425 - DNA, 37 bp, Artificial Sequence
  Synthetic oligonucleotide
atcaccccgccgcccgcccgcacacttctccgattga

SEQ ID NO: 117426 - DNA, 35 bp, Artificial Sequence
  Synthetic oligonucleotide
ttcaccctcacgacccacgcccgtatgactctttc

SEQ ID NO: 117427 - DNA, 35 bp, Artificial Sequence
  Synthetic oligonucleotide
tgatcctcgctccctatcgacccacgcctgccacg

SEQ ID NO: 117428 - DNA, 35 bp, Artificial Sequence
  Synthetic oligonucleotide
gacacccgccattactttcctccaaccctgagtgt

SEQ ID NO: 117429 - DNA, 35 bp, Artificial Sequence
  Synthetic oligonucleotide
aagcacggcccatgtgataccctcctcctctcatt

SEQ ID NO: 117430 - DNA, 36 bp, Artificial Sequence
  Synthetic oligonucleotide
tgcatgaatgcgtactgtccgtccctctctcgtgca

SEQ ID NO: 117431 - DNA, 36 bp, Artificial Sequence
  Synthetic oligonucleotide
tccctgcctaccaggcttattgccgttccatctcta

SEQ ID NO: 117432 - DNA, 35 bp, Artificial Sequence
  Synthetic oligonucleotide
accacactcgtccgccaataatcctgctctccttg

SEQ ID NO: 117433 - DNA, 35 bp, Artificial Sequence
  Synthetic oligonucleotide
tgacccgagcggtcttcgcgccccccctgacctat

SEQ ID NO: 117434 - DNA, 35 bp, Artificial Sequence
  Synthetic oligonucleotide
gagctctgtctcgcctgccttcatccccttcctgt

SEQ ID NO: 117435 - DNA, 36 bp, Artificial Sequence
  Synthetic oligonucleotide
gtgtacctgccccttgatgccttcccgctacatcca

SEQ ID NO: 117436 - DNA, 37 bp, Artificial Sequence
  Synthetic oligonucleotide
tcgcaccctcacgacccccgcccgtctattgcattga

SEQ ID NO: 117437 - DNA, 36 bp, Artificial Sequence
  Synthetic oligonucleotide
gccccaccctcctaccgtcctgaagaccgctggcta

SEQ ID NO: 117438 - DNA, 36 bp, Artificial Sequence
  Synthetic oligonucleotide
tgctgggtggggttagatcgggggactttaggggta

SEQ ID NO: 117439 - DNA, 35 bp, Artificial Sequence
  Synthetic oligonucleotide
tccccattggtcccgccctccacgcaacttgtgcc

SEQ ID NO: 117440 - DNA, 35 bp, Artificial Sequence
  Synthetic oligonucleotide
attgcccctgattcatggacctcccactttctgcg

SEQ ID NO: 117441 - DNA, 35 bp, Artificial Sequence
  Synthetic oligonucleotide
tctaagccgttaagtgcgccttcccttgttccctg

SEQ ID NO: 117442 - DNA, 36 bp, Artificial Sequence
  Synthetic oligonucleotide
tccatggtcctggtcctcacaatctgtgcctcccca

SEQ ID NO: 117443 - DNA, 36 bp, Artificial Sequence
  Synthetic oligonucleotide
acccccatccatgcgcttgcatccttgttctacgta

SEQ ID NO: 117444 - DNA, 36 bp, Artificial Sequence
  Synthetic oligonucleotide
acgcacccctgcttctcctttacccgttcctcgtta

SEQ ID NO: 117445 - DNA, 35 bp, Artificial Sequence
  Synthetic oligonucleotide
atcaccagccgtttccattccgatccgtttgctac

SEQ ID NO: 117446 - DNA, 35 bp, Artificial Sequence
  Synthetic oligonucleotide
tacagcatcgttccatctgaagccgtacaccatcc

SEQ ID NO: 117447 - DNA, 35 bp, Artificial Sequence
  Synthetic oligonucleotide
tggacggccactgaccccctgtacccgcgctatcc

SEQ ID NO: 117448 - DNA, 35 bp, Artificial Sequence
  Synthetic oligonucleotide
cctcaacggcgcgtgccccctgattcgttccttgt

SEQ ID NO: 117449 - DNA, 35 bp, Artificial Sequence
  Synthetic oligonucleotide
gtcattccgcccctcctgccgccttaatggcgata

SEQ ID NO: 117450 - DNA, 36 bp, Artificial Sequence
  Synthetic oligonucleotide
aagtgtacccgccgattagcctccaccgcccttgta

SEQ ID NO: 117451 - DNA, 35 bp, Artificial Sequence
  Synthetic oligonucleotide
ggtgcattgcgctcggttcacttgcccttccctta

SEQ ID NO: 117452 - DNA, 35 bp, Artificial Sequence
  Synthetic oligonucleotide
ggatcacttcagccccccccgcccgttgcgcaccc

SEQ ID NO: 117453 - DNA, 35 bp, Artificial Sequence
  Synthetic oligonucleotide
tagccgtcaatccctgcttcccaatggcccggccc

SEQ ID NO: 117454 - DNA, 35 bp, Artificial Sequence
  Synthetic oligonucleotide
tcatgctcagcatttgggctcccgttcgtttctcc

SEQ ID NO: 117455 - DNA, 35 bp, Artificial Sequence
  Synthetic oligonucleotide
tgttcgcccaacctctgttatctccctccatcagg

SEQ ID NO: 117456 - DNA, 35 bp, Artificial Sequence
  Synthetic oligonucleotide
ggagagcaagggaacggagggcggggggtgcgggt

SEQ ID NO: 117457 - DNA, 35 bp, Artificial Sequence
  Synthetic oligonucleotide
gccacgtcgagccgcgctcatctgtcccgcctctt

SEQ ID NO: 117458 - DNA, 36 bp, Artificial Sequence
  Synthetic oligonucleotide
gcattgctcagccctggccttccacgcatacctcga

SEQ ID NO: 117459 - DNA, 35 bp, Artificial Sequence
  Synthetic oligonucleotide
gatcctctgctctccgccgtgacccctgtttctac

SEQ ID NO: 117460 - DNA, 35 bp, Artificial Sequence
  Synthetic oligonucleotide
ggaactgtgtcctttgactttcctcattgtcgccc

SEQ ID NO: 117461 - DNA, 35 bp, Artificial Sequence
  Synthetic oligonucleotide
tgtggagaaggcgggagggataaaaaaggcgggag

SEQ ID NO: 117462 - DNA, 35 bp, Artificial Sequence
  Synthetic oligonucleotide
tgacaccgctccgtcattcgggacgtcccttctca

SEQ ID NO: 117463 - DNA, 36 bp, Artificial Sequence
  Synthetic oligonucleotide
gccgacctcaccgcacccatactgatcgccacttca

SEQ ID NO: 117464 - DNA, 35 bp, Artificial Sequence
  Synthetic oligonucleotide
taggggcgagcaggggggggctgcgggagggaggc

SEQ ID NO: 117465 - DNA, 35 bp, Artificial Sequence
  Synthetic oligonucleotide
accgccctcccccgtttgcaatcgaccctaggttc

SEQ ID NO: 117466 - DNA, 35 bp, Artificial Sequence
  Synthetic oligonucleotide
gatacgtcattctccgtcaccaccgctcccgttgt

SEQ ID NO: 117467 - DNA, 36 bp, Artificial Sequence
  Synthetic oligonucleotide
gcactccccgccgcccgttttgtgcctcttgaaaca

SEQ ID NO: 117468 - DNA, 35 bp, Artificial Sequence
  Synthetic oligonucleotide
attcctgcctggcatcacgatctgtcctcctctca

SEQ ID NO: 117469 - DNA, 35 bp, Artificial Sequence
  Synthetic oligonucleotide
gatcaccgctctgtggtttcgcccgacccctttcc

SEQ ID NO: 117470 - DNA, 35 bp, Artificial Sequence
  Synthetic oligonucleotide
agcacggcccatccatcctgctttgtcgccaccat

SEQ ID NO: 117471 - DNA, 34 bp, Artificial Sequence
  Synthetic oligonucleotide
tcctctacgcacctgcctggattcgcctttgtaa

SEQ ID NO: 117472 - DNA, 35 bp, Artificial Sequence
  Synthetic oligonucleotide
gcccgaccgcccggagtccccctcgtgtgccctca

SEQ ID NO: 117473 - DNA, 38 bp, Artificial Sequence
  Synthetic oligonucleotide
tccgaccatgcccctccccgcactccagtcacaagtga

SEQ ID NO: 117474 - DNA, 36 bp, Artificial Sequence
  Synthetic oligonucleotide
gagtactgcccatcccgttgttagtcgtccacatta

SEQ ID NO: 117475 - DNA, 35 bp, Artificial Sequence
  Synthetic oligonucleotide
ggtgcattcagcacatctcttccctggcacacctc

SEQ ID NO: 117476 - DNA, 35 bp, Artificial Sequence
  Synthetic oligonucleotide
gtaccgccaggttttatcgccccaagccacaccca

SEQ ID NO: 117477 - DNA, 36 bp, Artificial Sequence
  Synthetic oligonucleotide
ttcgacaccccggccatcgttgctacctactctcga

SEQ ID NO: 117478 - DNA, 38 bp, Artificial Sequence
  Synthetic oligonucleotide
atccccgcacccgccttgctaacgttcatccgttttga

SEQ ID NO: 117479 - DNA, 33 bp, Artificial Sequence
  Synthetic oligonucleotide
gcaccctacaaacacccgcctgtcactgcctta

SEQ ID NO: 117480 - DNA, 35 bp, Artificial Sequence
  Synthetic oligonucleotide
gcctcagctcccgacgtcgctccaatgtttgcccc

SEQ ID NO: 117481 - DNA, 35 bp, Artificial Sequence
  Synthetic oligonucleotide
gatagcgcccctcgtacagtcagttccccctgcct

SEQ ID NO: 117482 - DNA, 35 bp, Artificial Sequence
  Synthetic oligonucleotide
gctcccgcccaccggttccctgaccgatcctaggt

SEQ ID NO: 117483 - DNA, 36 bp, Artificial Sequence
  Synthetic oligonucleotide
tccatctcgcctcacttttcggttatttgtacgcca

SEQ ID NO: 117484 - DNA, 35 bp, Artificial Sequence
  Synthetic oligonucleotide
gaccacccgctcccaaagaaggctactccatctac

SEQ ID NO: 117485 - DNA, 35 bp, Artificial Sequence
  Synthetic oligonucleotide
gccccccgcttgtgtctcccacccctcatcaatcg

SEQ ID NO: 117486 - DNA, 35 bp, Artificial Sequence
  Synthetic oligonucleotide
accgactccgctcttttccgcattacgacactctg

SEQ ID NO: 117487 - DNA, 35 bp, Artificial Sequence
  Synthetic oligonucleotide
tgtgcctctgccgctccgttcgcgtaccatttcaa

SEQ ID NO: 117488 - DNA, 35 bp, Artificial Sequence
  Synthetic oligonucleotide
gaatcgacaccgctgttcttcatttgctccatcca

SEQ ID NO: 117489 - DNA, 35 bp, Artificial Sequence
  Synthetic oligonucleotide
tgccacaaccgctgtcatctctactccccgcttca

SEQ ID NO: 117490 - DNA, 38 bp, Artificial Sequence
  Synthetic oligonucleotide
tccacaccacccgtatgcccctgattctgtcgttttga

SEQ ID NO: 117491 - DNA, 35 bp, Artificial Sequence
  Synthetic oligonucleotide
tccgcctccagtccacgtttcttagcctccccccg

SEQ ID NO: 117492 - DNA, 35 bp, Artificial Sequence
  Synthetic oligonucleotide
tccagaccctgccctctcgttgttccgactcagcg

SEQ ID NO: 117493 - DNA, 36 bp, Artificial Sequence
  Synthetic oligonucleotide
ttgtgccccactatgaacccgcctgttgcgttccca

SEQ ID NO: 117494 - DNA, 35 bp, Artificial Sequence
  Synthetic oligonucleotide
tagatccgcctggtgacacgcctcgataccctcca

SEQ ID NO: 117495 - DNA, 38 bp, Artificial Sequence
  Synthetic oligonucleotide
gaggaaggctgggggaggaggggaatagctcggaggga

SEQ ID NO: 117496 - DNA, 38 bp, Artificial Sequence
  Synthetic oligonucleotide
ggagggtgggagtatgggggggaaggtgcagagcgtga

SEQ ID NO: 117497 - DNA, 35 bp, Artificial Sequence
  Synthetic oligonucleotide
gttcccctccgccgtctaaaaaccatgtcgctcac

SEQ ID NO: 117498 - DNA, 35 bp, Artificial Sequence
  Synthetic oligonucleotide
ggagcctgtcatcctctcgtaattgtccgttgtcc

SEQ ID NO: 117499 - DNA, 35 bp, Artificial Sequence
  Synthetic oligonucleotide
actccgccactgacgttaacgcactatgccatcgc

SEQ ID NO: 117500 - DNA, 35 bp, Artificial Sequence
  Synthetic oligonucleotide
ttccgacccaccaccctgttagccacgcgttatcg

SEQ ID NO: 117501 - DNA, 35 bp, Artificial Sequence
  Synthetic oligonucleotide
tcacccttaccacccgctgcagcatgatttttcat

SEQ ID NO: 117502 - DNA, 35 bp, Artificial Sequence
  Synthetic oligonucleotide
ggagcaccgccacgccgccgttcttgtggcctcct

SEQ ID NO: 117503 - DNA, 35 bp, Artificial Sequence
  Synthetic oligonucleotide
actatccaccgccaccctggtttggccttttccaa

SEQ ID NO: 117504 - DNA, 36 bp, Artificial Sequence
  Synthetic oligonucleotide
tggggtggggtacattggggtgacaagagggggcta

SEQ ID NO: 117505 - DNA, 36 bp, Artificial Sequence
  Synthetic oligonucleotide
aagtgccgggcgggagggaggaggggtgattgccgt

SEQ ID NO: 117506 - DNA, 35 bp, Artificial Sequence
  Synthetic oligonucleotide
tagaggaagggaagggaaaagggtaaggcgggtca

SEQ ID NO: 117507 - DNA, 35 bp, Artificial Sequence
  Synthetic oligonucleotide
agttcgccccccatgtctcgccttcgcagatatac

SEQ ID NO: 117508 - DNA, 35 bp, Artificial Sequence
  Synthetic oligonucleotide
gtgcactttccccgactatcacgtacgtacaacct

SEQ ID NO: 117509 - DNA, 35 bp, Artificial Sequence
  Synthetic oligonucleotide
tcaccacacgcctccacccgcaatgagttccacgt

SEQ ID NO: 117510 - DNA, 35 bp, Artificial Sequence
  Synthetic oligonucleotide
tacctagtcatgtgccatcagcccttccttccgct

SEQ ID NO: 117511 - DNA, 37 bp, Artificial Sequence
  Synthetic oligonucleotide
gaagaggaggagagggttttaagggggacggtacaga

SEQ ID NO: 117512 - DNA, 37 bp, Artificial Sequence
  Synthetic oligonucleotide
tctgtcaccactcgatcttgcatacctcttttcacga

SEQ ID NO: 117513 - DNA, 35 bp, Artificial Sequence
  Synthetic oligonucleotide
gtgattgcctcctccgcctccctatggacagtatc

SEQ ID NO: 117514 - DNA, 35 bp, Artificial Sequence
  Synthetic oligonucleotide
gttgcatctcccccctgccttcgtacgttaatcgt

SEQ ID NO: 117515 - DNA, 37 bp, Artificial Sequence
  Synthetic oligonucleotide
gtagcgatcgacgtatccattggtgcccctcccccga

SEQ ID NO: 117516 - DNA, 37 bp, Artificial Sequence
  Synthetic oligonucleotide
tagctcgccctatgcctcctttgttaccttgttccga

SEQ ID NO: 117517 - DNA, 36 bp, Artificial Sequence
  Synthetic oligonucleotide
gcgaacccccacccctcccaccaggccttgctgata

SEQ ID NO: 117518 - DNA, 35 bp, Artificial Sequence
  Synthetic oligonucleotide
gaccacgtgcggaatttattagctctttccacccc

SEQ ID NO: 117519 - DNA, 35 bp, Artificial Sequence
  Synthetic oligonucleotide
gcccgcccgacgtcccgatcatcttgagcctcccc

SEQ ID NO: 117520 - DNA, 35 bp, Artificial Sequence
  Synthetic oligonucleotide
gtcacctgccgtatctcgcgttaacttcccttatc

SEQ ID NO: 117521 - DNA, 35 bp, Artificial Sequence
  Synthetic oligonucleotide
gccgctccccgcctggttttcctgcccacttaccg

SEQ ID NO: 117522 - DNA, 35 bp, Artificial Sequence
  Synthetic oligonucleotide
gtgcccgtctcacctgctcatactgctaggtctcg

SEQ ID NO: 117523 - DNA, 35 bp, Artificial Sequence
  Synthetic oligonucleotide
tcccaggcccctatggacaacttggaccccttcac

SEQ ID NO: 117524 - DNA, 35 bp, Artificial Sequence
  Synthetic oligonucleotide
gtgtcgccgtagtcgtagtctcggaacccccaccc

SEQ ID NO: 117525 - DNA, 36 bp, Artificial Sequence
  Synthetic oligonucleotide
gatccctctttgtcgtactagtaccgccctcgcgcc

SEQ ID NO: 117526 - DNA, 35 bp, Artificial Sequence
  Synthetic oligonucleotide
gattaccccatgatgccgccgttctagcctgatcc

SEQ ID NO: 117527 - DNA, 34 bp, Artificial Sequence
  Synthetic oligonucleotide
gcacatctcgtgcccaccccctatttgccggtcc

SEQ ID NO: 117528 - DNA, 35 bp, Artificial Sequence
  Synthetic oligonucleotide
tgcgagaaccgcaaactacgacgcaccccctccgc

SEQ ID NO: 117529 - DNA, 36 bp, Artificial Sequence
  Synthetic oligonucleotide
aatacaagaattggagcacggggaggggaaggggaa

SEQ ID NO: 117530 - DNA, 37 bp, Artificial Sequence
  Synthetic oligonucleotide
gagaatggaggaacggtgagaggacggggacgcgaga

SEQ ID NO: 117531 - DNA, 37 bp, Artificial Sequence
  Synthetic oligonucleotide
atgtctgccccccatcgtctccgaaacctcgcaccga

SEQ ID NO: 117532 - DNA, 35 bp, Artificial Sequence
  Synthetic oligonucleotide
tagcccctcacgcgcactgagcctcttaacccgac

SEQ ID NO: 117533 - DNA, 35 bp, Artificial Sequence
  Synthetic oligonucleotide
tacacagcgcctgtaaatcgtcgccgcccgttacc

SEQ ID NO: 117534 - DNA, 35 bp, Artificial Sequence
  Synthetic oligonucleotide
ttcgccgcggtcccgcctcttcgttacaaccgccc

SEQ ID NO: 117535 - DNA, 35 bp, Artificial Sequence
  Synthetic oligonucleotide
gttccgtcacatcattttccctgtccgcggtactc

SEQ ID NO: 117536 - DNA, 37 bp, Artificial Sequence
  Synthetic oligonucleotide
ggggaagaaggaggggggacgggagccgaagataaga

SEQ ID NO: 117537 - DNA, 36 bp, Artificial Sequence
  Synthetic oligonucleotide
tgccccacactgttgcctccgcttctccagtctcta

SEQ ID NO: 117538 - DNA, 35 bp, Artificial Sequence
  Synthetic oligonucleotide
tcaaacgggagggaagggttgagcatgggtgatcg

SEQ ID NO: 117539 - DNA, 35 bp, Artificial Sequence
  Synthetic oligonucleotide
gcaagcccgatccgtcgcccccctttaatcacgct

SEQ ID NO: 117540 - DNA, 36 bp, Artificial Sequence
  Synthetic oligonucleotide
acctcaacgcactgctccccatacggcccgcctcca

SEQ ID NO: 117541 - DNA, 35 bp, Artificial Sequence
  Synthetic oligonucleotide
gtatgcgcatagtcctccgtgctccgcccttttcg

SEQ ID NO: 117542 - DNA, 35 bp, Artificial Sequence
  Synthetic oligonucleotide
aggtcaatcctccgcggcgccccgtccctgtgctg

SEQ ID NO: 117543 - DNA, 35 bp, Artificial Sequence
  Synthetic oligonucleotide
taccccgtccttggcctctccgtagatcgcaccat

SEQ ID NO: 117544 - DNA, 35 bp, Artificial Sequence
  Synthetic oligonucleotide
agcttgcctcgactgtcattccctgcccactgctt

SEQ ID NO: 117545 - DNA, 37 bp, Artificial Sequence
  Synthetic oligonucleotide
tacgtccagcccggacgttgtagccttcaccttccga

SEQ ID NO: 117546 - DNA, 38 bp, Artificial Sequence
  Synthetic oligonucleotide
atcaacagagcacggataggggaaggaaggagggatga

SEQ ID NO: 117547 - DNA, 34 bp, Artificial Sequence
  Synthetic oligonucleotide
gtcacccttccacgcacatgtatccgacccttga

SEQ ID NO: 117548 - DNA, 36 bp, Artificial Sequence
  Synthetic oligonucleotide
tctcgccccaggcctcatgcccgttcactactgcta

SEQ ID NO: 117549 - DNA, 35 bp, Artificial Sequence
  Synthetic oligonucleotide
tcacgtacactccccaacgttctgcgttttatcgc

SEQ ID NO: 117550 - DNA, 35 bp, Artificial Sequence
  Synthetic oligonucleotide
tgcaccactcgcgcctcgtttggttgtttccatct

SEQ ID NO: 117551 - DNA, 37 bp, Artificial Sequence
  Synthetic oligonucleotide
gccccctccacccgtcccgccgatgtccggctgtaga

SEQ ID NO: 117552 - DNA, 36 bp, Artificial Sequence
  Synthetic oligonucleotide
aacaccgggcgggtgggtgtgtatgggtgtacacga

SEQ ID NO: 117553 - DNA, 35 bp, Artificial Sequence
  Synthetic oligonucleotide
tgccatgcgcccactgcacgagtccccatcctagc

SEQ ID NO: 117554 - DNA, 35 bp, Artificial Sequence
  Synthetic oligonucleotide
gaccgttccgcagcctcttaccttgcgtcatcttc

SEQ ID NO: 117555 - DNA, 35 bp, Artificial Sequence
  Synthetic oligonucleotide
ttcacgtcaccggttttccccacaaggcccccact

SEQ ID NO: 117556 - DNA, 35 bp, Artificial Sequence
  Synthetic oligonucleotide
tgcccacataagtgtcttaccaacccgtcccttca

SEQ ID NO: 117557 - DNA, 37 bp, Artificial Sequence
  Synthetic oligonucleotide
gccacccgccctgccttctcaacctatgggtccttga

SEQ ID NO: 117558 - DNA, 35 bp, Artificial Sequence
  Synthetic oligonucleotide
ttgacctcctcgcttagttcccgctttgtcgggcc

SEQ ID NO: 117559 - DNA, 35 bp, Artificial Sequence
  Synthetic oligonucleotide
acgcactgttgtaatgtcgcgtcctgcctcttgcc

SEQ ID NO: 117560 - DNA, 35 bp, Artificial Sequence
  Synthetic oligonucleotide
ttccacaccctgccccttctgccctatggacgtgc

SEQ ID NO: 117561 - DNA, 35 bp, Artificial Sequence
  Synthetic oligonucleotide
actgccccccgcgcgctctagatatctccccgctg

SEQ ID NO: 117562 - DNA, 35 bp, Artificial Sequence
  Synthetic oligonucleotide
tgtcgccgccccttgcacttattcgtccccccttg

SEQ ID NO: 117563 - DNA, 35 bp, Artificial Sequence
  Synthetic oligonucleotide
gtattcgctgcctcccacctctgtcttcgcagtct

SEQ ID NO: 117564 - DNA, 35 bp, Artificial Sequence
  Synthetic oligonucleotide
gctacccactgtgctcgcatatcgtcctcccctcc

SEQ ID NO: 117565 - DNA, 35 bp, Artificial Sequence
  Synthetic oligonucleotide
ttgaacagccccctgcctccccctcgtaaccgcgc

SEQ ID NO: 117566 - DNA, 35 bp, Artificial Sequence
  Synthetic oligonucleotide
tgagcccgtgccctccagttctggtcgttgccctt

SEQ ID NO: 117567 - DNA, 36 bp, Artificial Sequence
  Synthetic oligonucleotide
gtccatcctctgccttccctgaacgtctaccgttca

SEQ ID NO: 117568 - DNA, 36 bp, Artificial Sequence
  Synthetic oligonucleotide
gcaaggatcgtccgtctgtttctcgccacacctcta

SEQ ID NO: 117569 - DNA, 35 bp, Artificial Sequence
  Synthetic oligonucleotide
atcttgcctcgttcacagcacctgcttattgccac

SEQ ID NO: 117570 - DNA, 35 bp, Artificial Sequence
  Synthetic oligonucleotide
accgacacccgcgaccccaggcaagtcaccgcccc

SEQ ID NO: 117571 - DNA, 35 bp, Artificial Sequence
  Synthetic oligonucleotide
gttgccggctgttctactcagtcctcccttccatg

SEQ ID NO: 117572 - DNA, 35 bp, Artificial Sequence
  Synthetic oligonucleotide
agccactcaccggctggtccattccgcctctcgct

SEQ ID NO: 117573 - DNA, 35 bp, Artificial Sequence
  Synthetic oligonucleotide
tagacctgcacccctctctaacagccacgcctcca

SEQ ID NO: 117574 - DNA, 36 bp, Artificial Sequence
  Synthetic oligonucleotide
aatccacctcactgtcctgacgcccttccatgctta

SEQ ID NO: 117575 - DNA, 35 bp, Artificial Sequence
  Synthetic oligonucleotide
ttgtgcccgcccggcgattctacccgcatgttgtc

SEQ ID NO: 117576 - DNA, 35 bp, Artificial Sequence
  Synthetic oligonucleotide
tcgcggatccacctggttgttagcttcccctaccg

SEQ ID NO: 117577 - DNA, 35 bp, Artificial Sequence
  Synthetic oligonucleotide
aacagggagtagggaggggaggcccggcgaagtaa

SEQ ID NO: 117578 - DNA, 36 bp, Artificial Sequence
  Synthetic oligonucleotide
tccattcccgacggtaactgatgacctgctccctca

SEQ ID NO: 117579 - DNA, 36 bp, Artificial Sequence
  Synthetic oligonucleotide
atgccttcccctcactgagctccgaccgtttcccga

SEQ ID NO: 117580 - DNA, 35 bp, Artificial Sequence
  Synthetic oligonucleotide
tgctcagtgctatcttgctcgtgcttcggttcccc

SEQ ID NO: 117581 - DNA, 35 bp, Artificial Sequence
  Synthetic oligonucleotide
gtgtctgccgcaccgtgtctactttatcgccgccc

SEQ ID NO: 117582 - DNA, 35 bp, Artificial Sequence
  Synthetic oligonucleotide
agttcgcagatgagtccggcccgccactcccttgc

SEQ ID NO: 117583 - DNA, 35 bp, Artificial Sequence
  Synthetic oligonucleotide
gttcaccgccccagaacataatcgtttccccggct

SEQ ID NO: 117584 - DNA, 35 bp, Artificial Sequence
  Synthetic oligonucleotide
atccaacaccgtctcgtctcattcctgtgtcccac

SEQ ID NO: 117585 - DNA, 35 bp, Artificial Sequence
  Synthetic oligonucleotide
actcagacccagccgttttctgctgactgccaccc

SEQ ID NO: 117586 - DNA, 35 bp, Artificial Sequence
  Synthetic oligonucleotide
gagggggggggaataaatatagagaggggtaagag

SEQ ID NO: 117587 - DNA, 35 bp, Artificial Sequence
  Synthetic oligonucleotide
tccactcttccgtatcttgtacagtttctgcccct

SEQ ID NO: 117588 - DNA, 35 bp, Artificial Sequence
  Synthetic oligonucleotide
accccgtcctcgcctccgcatgccatctgcctcgt

SEQ ID NO: 117589 - DNA, 36 bp, Artificial Sequence
  Synthetic oligonucleotide
gtgggttggagcgggcggggggggctaatatagcaa

SEQ ID NO: 117590 - DNA, 36 bp, Artificial Sequence
  Synthetic oligonucleotide
tttgcagggccctcatcgtactattaccgcttcaca

SEQ ID NO: 117591 - DNA, 37 bp, Artificial Sequence
  Synthetic oligonucleotide
acaggatggagggagggcggagggagactacatagga

SEQ ID NO: 117592 - DNA, 38 bp, Artificial Sequence
  Synthetic oligonucleotide
tccaccagtcgcgcgcgtatggtcttcactctccctga

SEQ ID NO: 117593 - DNA, 35 bp, Artificial Sequence
  Synthetic oligonucleotide
tccgtgcgtgcgacagatccctccctgccttttcc

SEQ ID NO: 117594 - DNA, 38 bp, Artificial Sequence
  Synthetic oligonucleotide
agtacagcgggagagggaggggaacacgggaggggtga

SEQ ID NO: 117595 - DNA, 36 bp, Artificial Sequence
  Synthetic oligonucleotide
tcctgcctaggtctccttgatctgtccctgttccta

SEQ ID NO: 117596 - DNA, 35 bp, Artificial Sequence
  Synthetic oligonucleotide
ttgtcaagcacttccaccgctgtacgctacttagc

SEQ ID NO: 117597 - DNA, 35 bp, Artificial Sequence
  Synthetic oligonucleotide
gtcgccctatggccccgagccctccatgcttcttc

SEQ ID NO: 117598 - DNA, 35 bp, Artificial Sequence
  Synthetic oligonucleotide
tctgtgggggggatggggtatgggggcggttgcat

SEQ ID NO: 117599 - DNA, 36 bp, Artificial Sequence
  Synthetic oligonucleotide
gccgccgcatagccctgtcccggcccttctatacca

SEQ ID NO: 117600 - DNA, 37 bp, Artificial Sequence
  Synthetic oligonucleotide
tcagacgagggcaggggtggggagggttgctggcgga

SEQ ID NO: 117601 - DNA, 35 bp, Artificial Sequence
  Synthetic oligonucleotide
gccggacacaatgtttctagcgcccgtttcgcccc

SEQ ID NO: 117602 - DNA, 35 bp, Artificial Sequence
  Synthetic oligonucleotide
gcgccggttgtgcgtcctggcctctttctctcctc

SEQ ID NO: 117603 - DNA, 35 bp, Artificial Sequence
  Synthetic oligonucleotide
tccgctccccctctaagtttgctccgccttcggtc

SEQ ID NO: 117604 - DNA, 35 bp, Artificial Sequence
  Synthetic oligonucleotide
accaccccttccccacgattttccgccgcccgtag

SEQ ID NO: 117605 - DNA, 35 bp, Artificial Sequence
  Synthetic oligonucleotide
aaatgtgtcgcagcgtatcaccttcccgccccccg

SEQ ID NO: 117606 - DNA, 35 bp, Artificial Sequence
  Synthetic oligonucleotide
gcccccctcagccgtgcgtgtccattgcctccctg

SEQ ID NO: 117607 - DNA, 35 bp, Artificial Sequence
  Synthetic oligonucleotide
tccatgtctcgccgcatccttctttccgtgtccgt

SEQ ID NO: 117608 - DNA, 36 bp, Artificial Sequence
  Synthetic oligonucleotide
acccccttgtcaccacgttcgttcccttgccgacca

SEQ ID NO: 117609 - DNA, 36 bp, Artificial Sequence
  Synthetic oligonucleotide
acaacccccagaccggtccctgattaggctctccca

SEQ ID NO: 117610 - DNA, 38 bp, Artificial Sequence
  Synthetic oligonucleotide
atccgcaccatcagcctggttctctgctcctctcgtga

SEQ ID NO: 117611 - DNA, 38 bp, Artificial Sequence
  Synthetic oligonucleotide
tctgcccgtcactctcttcaccgccatgccctctgtga

SEQ ID NO: 117612 - DNA, 35 bp, Artificial Sequence
  Synthetic oligonucleotide
gctactgccttcacatccggcctgcccactagtcc

SEQ ID NO: 117613 - DNA, 35 bp, Artificial Sequence
  Synthetic oligonucleotide
aactcgccaggccgtccctagcgttttgtaccttc

SEQ ID NO: 117614 - DNA, 35 bp, Artificial Sequence
  Synthetic oligonucleotide
acagtcccgccccccgcattgtcccatccttttgg

SEQ ID NO: 117615 - DNA, 35 bp, Artificial Sequence
  Synthetic oligonucleotide
taagacccagccgcccccacccggtctattcaact

SEQ ID NO: 117616 - DNA, 35 bp, Artificial Sequence
  Synthetic oligonucleotide
tgtcacatcgacccctacagcacgcctccacacgc

SEQ ID NO: 117617 - DNA, 35 bp, Artificial Sequence
  Synthetic oligonucleotide
tgcgacgcacgatgacgctcaagtcctacctcctg

SEQ ID NO: 117618 - DNA, 35 bp, Artificial Sequence
  Synthetic oligonucleotide
gtagagtagggagtaggttgggcggagggcgggtt

SEQ ID NO: 117619 - DNA, 35 bp, Artificial Sequence
  Synthetic oligonucleotide
tcgtatgcacccccgactttctatctacgttgctc

SEQ ID NO: 117620 - DNA, 35 bp, Artificial Sequence
  Synthetic oligonucleotide
gtgtctacacacatgcctcctgttgcccttttttc

SEQ ID NO: 117621 - DNA, 35 bp, Artificial Sequence
  Synthetic oligonucleotide
tctgacgaccgtcgcctatgccctccatacgtact

SEQ ID NO: 117622 - DNA, 37 bp, Artificial Sequence
  Synthetic oligonucleotide
gccgccccgccttctatcggacacttcccttcctaga

SEQ ID NO: 117623 - DNA, 35 bp, Artificial Sequence
  Synthetic oligonucleotide
agccaaccccgttatccgcgcatttcccgctccat

SEQ ID NO: 117624 - DNA, 35 bp, Artificial Sequence
  Synthetic oligonucleotide
tcactccccatctgatggctacatctatgtctttt

SEQ ID NO: 117625 - DNA, 35 bp, Artificial Sequence
  Synthetic oligonucleotide
tccttgccaccaccctgcctgccatagaccccgac

SEQ ID NO: 117626 - DNA, 35 bp, Artificial Sequence
  Synthetic oligonucleotide
gtagacgcgccacatacacatttcgtcacccgtcc

SEQ ID NO: 117627 - DNA, 35 bp, Artificial Sequence
  Synthetic oligonucleotide
actcacatctcgatactacggccttcccatctccg

SEQ ID NO: 117628 - DNA, 35 bp, Artificial Sequence
  Synthetic oligonucleotide
acccgctaaactatctgtcctgcctgctgttcctt

SEQ ID NO: 117629 - DNA, 36 bp, Artificial Sequence
  Synthetic oligonucleotide
tagtgccgcatcaccctctctgaccctgttgccaca

SEQ ID NO: 117630 - DNA, 37 bp, Artificial Sequence
  Synthetic oligonucleotide
acgaccctcccacggtttaacggcccttcttcatcga

SEQ ID NO: 117631 - DNA, 37 bp, Artificial Sequence
  Synthetic oligonucleotide
aagcatggaagggggaggggaccgggtggtcggtgga

SEQ ID NO: 117632 - DNA, 35 bp, Artificial Sequence
  Synthetic oligonucleotide
aattcgccggcccacttttaccagtcttgttccac

SEQ ID NO: 117633 - DNA, 35 bp, Artificial Sequence
  Synthetic oligonucleotide
gcgtgccacccgtcgacccatcgtcactgcaactc

SEQ ID NO: 117634 - DNA, 35 bp, Artificial Sequence
  Synthetic oligonucleotide
gccccgtcgggtcctctgtcatacttaccatcctt

SEQ ID NO: 117635 - DNA, 36 bp, Artificial Sequence
  Synthetic oligonucleotide
tgcacctaccgctcgcctccgtacccagtctggaaa

SEQ ID NO: 117636 - DNA, 36 bp, Artificial Sequence
  Synthetic oligonucleotide
tccaccccccgtctatagacgaccccagtaccttaa

SEQ ID NO: 117637 - DNA, 35 bp, Artificial Sequence
  Synthetic oligonucleotide
tgagcactcatgagctcgttctcccgttccccaca

SEQ ID NO: 117638 - DNA, 36 bp, Artificial Sequence
  Synthetic oligonucleotide
gtccacctccctctaccacagtcctgacacgatgga

SEQ ID NO: 117639 - DNA, 37 bp, Artificial Sequence
  Synthetic oligonucleotide
acgcttgcctcctgacccttttcagccgcccttttga

SEQ ID NO: 117640 - DNA, 35 bp, Artificial Sequence
  Synthetic oligonucleotide
acgtggccccctgttgaatcaccaattgttcctcc

SEQ ID NO: 117641 - DNA, 35 bp, Artificial Sequence
  Synthetic oligonucleotide
accccccctacatcgcaacccgcagtgcctttggc

SEQ ID NO: 117642 - DNA, 35 bp, Artificial Sequence
  Synthetic oligonucleotide
gatcatatcggtgcttacattacctgctcccctgc

SEQ ID NO: 117643 - DNA, 35 bp, Artificial Sequence
  Synthetic oligonucleotide
ttgtgccgtactgtttctcatccctcctcatggct

SEQ ID NO: 117644 - DNA, 37 bp, Artificial Sequence
  Synthetic oligonucleotide
gaccacactacactatgccttggcctgtctccaccga

SEQ ID NO: 117645 - DNA, 37 bp, Artificial Sequence
  Synthetic oligonucleotide
aaaagagggacgggagcgaaaaaggagcgggattgga

SEQ ID NO: 117646 - DNA, 35 bp, Artificial Sequence
  Synthetic oligonucleotide
atgcacccactgccctctggtgtcacatccccacg

SEQ ID NO: 117647 - DNA, 35 bp, Artificial Sequence
  Synthetic oligonucleotide
acaacccgtttccaccgccccgatcgtgcacatcg

SEQ ID NO: 117648 - DNA, 35 bp, Artificial Sequence
  Synthetic oligonucleotide
ttcacccgcccgttttcagctgaacttctctgctt

SEQ ID NO: 117649 - DNA, 35 bp, Artificial Sequence
  Synthetic oligonucleotide
gccccatcttgttaaagcacccccgcgcctatctt

SEQ ID NO: 117650 - DNA, 37 bp, Artificial Sequence
  Synthetic oligonucleotide
gaggtggaaggtgggggaattagcggagtttggtgga

SEQ ID NO: 117651 - DNA, 38 bp, Artificial Sequence
  Synthetic oligonucleotide
gccccacgacctgtctatatctgttgccgtgcccttga

SEQ ID NO: 117652 - DNA, 35 bp, Artificial Sequence
  Synthetic oligonucleotide
tcaccgccggcattaggcattctagcatctctcac

SEQ ID NO: 117653 - DNA, 35 bp, Artificial Sequence
  Synthetic oligonucleotide
gtgaacctcgccgactgtccgctgtaccccatctc

SEQ ID NO: 117654 - DNA, 35 bp, Artificial Sequence
  Synthetic oligonucleotide
gtgcccccgaaccgaccactactccgcccggtctc

SEQ ID NO: 117655 - DNA, 38 bp, Artificial Sequence
  Synthetic oligonucleotide
agcccacacccgttgcgctcaaagacctccccctttga

SEQ ID NO: 117656 - DNA, 35 bp, Artificial Sequence
  Synthetic oligonucleotide
aactcgcagcccctggacgcgccctgcccccaacc

SEQ ID NO: 117657 - DNA, 35 bp, Artificial Sequence
  Synthetic oligonucleotide
gtccaccacgactagtacgcgccgttactgccatc

SEQ ID NO: 117658 - DNA, 35 bp, Artificial Sequence
  Synthetic oligonucleotide
atgccaccacctcctgcgctttaaaagtcggtttc

SEQ ID NO: 117659 - DNA, 35 bp, Artificial Sequence
  Synthetic oligonucleotide
accacttcgcactgtccttcgctatcctttcggcg

SEQ ID NO: 117660 - DNA, 35 bp, Artificial Sequence
  Synthetic oligonucleotide
tcctaccgcccttccactgtacacaggccgatcct

SEQ ID NO: 117661 - DNA, 35 bp, Artificial Sequence
  Synthetic oligonucleotide
actacatccgcctggctcgaagcttgactcccgct

SEQ ID NO: 117662 - DNA, 36 bp, Artificial Sequence
  Synthetic oligonucleotide
aacatccgctcgactgcctgcctccgagcccctcca

SEQ ID NO: 117663 - DNA, 37 bp, Artificial Sequence
  Synthetic oligonucleotide
gggggtggtggcggggtcgagggatcgggtagggaga

SEQ ID NO: 117664 - DNA, 35 bp, Artificial Sequence
  Synthetic oligonucleotide
gatgggacaggggctagagcagggggacgggtgta

SEQ ID NO: 117665 - DNA, 35 bp, Artificial Sequence
  Synthetic oligonucleotide
attgctgccatcgttaaagcgtccccgccccctta

SEQ ID NO: 117666 - DNA, 35 bp, Artificial Sequence
  Synthetic oligonucleotide
gctgcctccccctgttctctttagtgacgcttccc

SEQ ID NO: 117667 - DNA, 35 bp, Artificial Sequence
  Synthetic oligonucleotide
acatcccgacaaagtacgtcagccacccccccgct

SEQ ID NO: 117668 - DNA, 35 bp, Artificial Sequence
  Synthetic oligonucleotide
tgctatgctcccccgtcattcctgtccatcctgaa

SEQ ID NO: 117669 - DNA, 36 bp, Artificial Sequence
  Synthetic oligonucleotide
tccacgccccacagccacccggagtcacggtcttca

SEQ ID NO: 117670 - DNA, 37 bp, Artificial Sequence
  Synthetic oligonucleotide
tcccgcccagaagtctcatccccactcatgccgccga

SEQ ID NO: 117671 - DNA, 35 bp, Artificial Sequence
  Synthetic oligonucleotide
attcgctacggccctacgtgcgaatgaccttcccc

SEQ ID NO: 117672 - DNA, 35 bp, Artificial Sequence
  Synthetic oligonucleotide
gagcccccgcccccccgacgcagtcgaagacaatc

SEQ ID NO: 117673 - DNA, 35 bp, Artificial Sequence
  Synthetic oligonucleotide
tcccaccgccttcctcagagcccgtctgccctgtg

SEQ ID NO: 117674 - DNA, 37 bp, Artificial Sequence
  Synthetic oligonucleotide
ttgtcgcccactgttctccctgcccatttcatgctga

SEQ ID NO: 117675 - DNA, 35 bp, Artificial Sequence
  Synthetic oligonucleotide
ttccgcaccctactccggccctacacccagctcgg

SEQ ID NO: 117676 - DNA, 34 bp, Artificial Sequence
  Synthetic oligonucleotide
ttgatcatgcctgcgtgtatcttttcccatccat

SEQ ID NO: 117677 - DNA, 35 bp, Artificial Sequence
  Synthetic oligonucleotide
gcaacactcctcagcctgctcacgtcctccagtat

SEQ ID NO: 117678 - DNA, 36 bp, Artificial Sequence
  Synthetic oligonucleotide
gccacaacacatcgaactcttccgcccattaggtca

SEQ ID NO: 117679 - DNA, 37 bp, Artificial Sequence
  Synthetic oligonucleotide
gggtgagaagatgggcggaggtgaagggggtggcgga

SEQ ID NO: 117680 - DNA, 38 bp, Artificial Sequence
  Synthetic oligonucleotide
gtgataagggcgtggagggggagggaaagagcgtctga

SEQ ID NO: 117681 - DNA, 38 bp, Artificial Sequence
  Synthetic oligonucleotide
acgatgggcggggcaaaggggcgggagggtgatcttga

SEQ ID NO: 117682 - DNA, 35 bp, Artificial Sequence
  Synthetic oligonucleotide
gttgacctcccatggtgaatgaacaccccctttta

SEQ ID NO: 117683 - DNA, 35 bp, Artificial Sequence
  Synthetic oligonucleotide
accccccgcctagacctgatttcgctggcctttta

SEQ ID NO: 117684 - DNA, 35 bp, Artificial Sequence
  Synthetic oligonucleotide
tcgacgcaccacagcatccccagttagttcccgcc

SEQ ID NO: 117685 - DNA, 35 bp, Artificial Sequence
  Synthetic oligonucleotide
gtccattgccctttgttattgcgcatgttactcct

SEQ ID NO: 117686 - DNA, 36 bp, Artificial Sequence
  Synthetic oligonucleotide
gctccacgtcactcgcactccagccgccgccacgta

SEQ ID NO: 117687 - DNA, 35 bp, Artificial Sequence
  Synthetic oligonucleotide
gtgcaatcctcatggttccctccacttgtctctcg

SEQ ID NO: 117688 - DNA, 35 bp, Artificial Sequence
  Synthetic oligonucleotide
tgccgacccaatttttagctccctgactcactcgt

SEQ ID NO: 117689 - DNA, 35 bp, Artificial Sequence
  Synthetic oligonucleotide
acttacctctgcctccatcgtacctcgccataacc

SEQ ID NO: 117690 - DNA, 35 bp, Artificial Sequence
  Synthetic oligonucleotide
ttgtacgcctcaacgtcctcttccagttagctgcc

SEQ ID NO: 117691 - DNA, 35 bp, Artificial Sequence
  Synthetic oligonucleotide
gcggtacgtagcccctccttttccgtgccatgtcc

SEQ ID NO: 117692 - DNA, 35 bp, Artificial Sequence
  Synthetic oligonucleotide
atgctcaccccctctgagttccccggttaactatc

SEQ ID NO: 117693 - DNA, 35 bp, Artificial Sequence
  Synthetic oligonucleotide
atcgcatagctctcgtgcctgtcctacttcctatc

SEQ ID NO: 117694 - DNA, 35 bp, Artificial Sequence
  Synthetic oligonucleotide
atgccgagcccgcccgacctccgtaggaccgtttc

SEQ ID NO: 117695 - DNA, 35 bp, Artificial Sequence
  Synthetic oligonucleotide
gtatccgccccacccgaatgtttaggttcaaccct

SEQ ID NO: 117696 - DNA, 35 bp, Artificial Sequence
  Synthetic oligonucleotide
ttgcctgccaccatctatccgcgttaggcgtactt

SEQ ID NO: 117697 - DNA, 36 bp, Artificial Sequence
  Synthetic oligonucleotide
tcattcccgtctcgccttagcccatgcacctagcca

SEQ ID NO: 117698 - DNA, 35 bp, Artificial Sequence
  Synthetic oligonucleotide
gttccaccctcggtgtggttactacccgccctcca

SEQ ID NO: 117699 - DNA, 36 bp, Artificial Sequence
  Synthetic oligonucleotide
attgccccgacctccccacactctccctttatggga

SEQ ID NO: 117700 - DNA, 38 bp, Artificial Sequence
  Synthetic oligonucleotide
tcataccccgcctgttttccttttcaatgagacggtga

SEQ ID NO: 117701 - DNA, 35 bp, Artificial Sequence
  Synthetic oligonucleotide
ttgaaatggggcgggggggcggaatgggtgaaagg

SEQ ID NO: 117702 - DNA, 35 bp, Artificial Sequence
  Synthetic oligonucleotide
gttccccgcctccagtgcatgatccgcttcacgct

SEQ ID NO: 117703 - DNA, 36 bp, Artificial Sequence
  Synthetic oligonucleotide
gggaccagcaggcgggggggtagcggtaggtactaa

SEQ ID NO: 117704 - DNA, 37 bp, Artificial Sequence
  Synthetic oligonucleotide
taggacatcggggacggattgggactgatgggtggga

SEQ ID NO: 117705 - DNA, 38 bp, Artificial Sequence
  Synthetic oligonucleotide
gaccgacaggtcctgtaatcctgtccctcccttgctga

SEQ ID NO: 117706 - DNA, 35 bp, Artificial Sequence
  Synthetic oligonucleotide
tgtgtgcctacaatcccagcccctgctcgctgtcc

SEQ ID NO: 117707 - DNA, 35 bp, Artificial Sequence
  Synthetic oligonucleotide
gaatcaccgcccgctctctgctcaataacggtttc

SEQ ID NO: 117708 - DNA, 35 bp, Artificial Sequence
  Synthetic oligonucleotide
tttcgccctcctattgccctcgacgcacccttgcg

SEQ ID NO: 117709 - DNA, 35 bp, Artificial Sequence
  Synthetic oligonucleotide
acttcaccgggctgtatagcctgaccttttccttt

SEQ ID NO: 117710 - DNA, 36 bp, Artificial Sequence
  Synthetic oligonucleotide
gagggcggaggaagggggcctggaatggttgcaaaa

SEQ ID NO: 117711 - DNA, 36 bp, Artificial Sequence
  Synthetic oligonucleotide
tctgaaccgtcccgtgcatctcgctttcctgcttca

SEQ ID NO: 117712 - DNA, 35 bp, Artificial Sequence
  Synthetic oligonucleotide
gctgcatgtccaaaatgctttgttactcctgctcc

SEQ ID NO: 117713 - DNA, 35 bp, Artificial Sequence
  Synthetic oligonucleotide
tcgccaatccctcatccccgtactactgtcgctag

SEQ ID NO: 117714 - DNA, 35 bp, Artificial Sequence
  Synthetic oligonucleotide
ttgccctgccctcctaatgaggatccccttacact

SEQ ID NO: 117715 - DNA, 37 bp, Artificial Sequence
  Synthetic oligonucleotide
tcctccaccgccactcgatatccacatccctcagaga

SEQ ID NO: 117716 - DNA, 37 bp, Artificial Sequence
  Synthetic oligonucleotide
atggtaagggaactggaggggcgggagggacaagcga

SEQ ID NO: 117717 - DNA, 38 bp, Artificial Sequence
  Synthetic oligonucleotide
gtgggcgggccgggaggggggacgctaatgctaggtga

SEQ ID NO: 117718 - DNA, 37 bp, Artificial Sequence
  Synthetic oligonucleotide
gagtgtcaatgggaggggggcaggagggaggtggtga

SEQ ID NO: 117719 - DNA, 35 bp, Artificial Sequence
  Synthetic oligonucleotide
gagagcctccattcagcttaacgtgccacatcccc

SEQ ID NO: 117720 - DNA, 35 bp, Artificial Sequence
  Synthetic oligonucleotide
gctgactcccccagtgttcacactgctcccctgtt

SEQ ID NO: 117721 - DNA, 36 bp, Artificial Sequence
  Synthetic oligonucleotide
tgagggagggcggggctatgggggcggtggaagaca

SEQ ID NO: 117722 - DNA, 36 bp, Artificial Sequence
  Synthetic oligonucleotide
acgccacctcgctccgaccttgtcccttcgctgaca

SEQ ID NO: 117723 - DNA, 35 bp, Artificial Sequence
  Synthetic oligonucleotide
gcaccaccccacatgtcacttagcctccctcacca

SEQ ID NO: 117724 - DNA, 36 bp, Artificial Sequence
  Synthetic oligonucleotide
tctactcctccgctctggacaacgactgtggtccta

SEQ ID NO: 117725 - DNA, 35 bp, Artificial Sequence
  Synthetic oligonucleotide
gcatccctcatcattggcctcccccggcgaaagcc

SEQ ID NO: 117726 - DNA, 35 bp, Artificial Sequence
  Synthetic oligonucleotide
tgtcaatcggccttacctcctcggctccatcttgc

SEQ ID NO: 117727 - DNA, 35 bp, Artificial Sequence
  Synthetic oligonucleotide
aagtgtcacatgcctttaccgccttcctcactccg

SEQ ID NO: 117728 - DNA, 35 bp, Artificial Sequence
  Synthetic oligonucleotide
gatgcctgagtcccccgtccgttaccccgcgcact

SEQ ID NO: 117729 - DNA, 36 bp, Artificial Sequence
  Synthetic oligonucleotide
gtacatgccttccacctgctttgcttagaccataca

SEQ ID NO: 117730 - DNA, 34 bp, Artificial Sequence
  Synthetic oligonucleotide
agagaacagccactttgcttaccatgccccatcc

SEQ ID NO: 117731 - DNA, 35 bp, Artificial Sequence
  Synthetic oligonucleotide
atcctacgcctctggccttgttatctgtgtacctc

SEQ ID NO: 117732 - DNA, 35 bp, Artificial Sequence
  Synthetic oligonucleotide
aagggtgggtgctggggggggaggaaaaacttcaa

SEQ ID NO: 117733 - DNA, 36 bp, Artificial Sequence
  Synthetic oligonucleotide
ttcgtccgaccgtaccttgtctccctgatcccatta

SEQ ID NO: 117734 - DNA, 35 bp, Artificial Sequence
  Synthetic oligonucleotide
gcctaacgccagtttcttcgtcgtaccctccgaac

SEQ ID NO: 117735 - DNA, 35 bp, Artificial Sequence
  Synthetic oligonucleotide
atgtcagccacggtgatccctgccttgctgtcctc

SEQ ID NO: 117736 - DNA, 36 bp, Artificial Sequence
  Synthetic oligonucleotide
gtccactgctccaccgactgttccgctgactcctcg

SEQ ID NO: 117737 - DNA, 35 bp, Artificial Sequence
  Synthetic oligonucleotide
gcctccgacctgcgcattagtcgttcgctttctat

SEQ ID NO: 117738 - DNA, 35 bp, Artificial Sequence
  Synthetic oligonucleotide
ttggaaccccccttgctggtttgacacttattcct

SEQ ID NO: 117739 - DNA, 35 bp, Artificial Sequence
  Synthetic oligonucleotide
accatccacccgccgctgtactcttccgcgacgct

SEQ ID NO: 117740 - DNA, 35 bp, Artificial Sequence
  Synthetic oligonucleotide
gtggtgcctcctcccactgattcagatcgcgctct

SEQ ID NO: 117741 - DNA, 35 bp, Artificial Sequence
  Synthetic oligonucleotide
gacactgccttcctccgtttctaaagtttccgcac

SEQ ID NO: 117742 - DNA, 35 bp, Artificial Sequence
  Synthetic oligonucleotide
tcaccgccggtggttacccgggttccatccgcccc

SEQ ID NO: 117743 - DNA, 35 bp, Artificial Sequence
  Synthetic oligonucleotide
accccctgcgctaggagaattcgcccgcctgtccc

SEQ ID NO: 117744 - DNA, 35 bp, Artificial Sequence
  Synthetic oligonucleotide
ttcacctcgccaattgagccctatagcctttgtcc

SEQ ID NO: 117745 - DNA, 35 bp, Artificial Sequence
  Synthetic oligonucleotide
acacatcacctgttgcgtcttaataccggttcctc

SEQ ID NO: 117746 - DNA, 35 bp, Artificial Sequence
  Synthetic oligonucleotide
gcccccatctgcccggccttttcgatcatttgaca

SEQ ID NO: 117747 - DNA, 37 bp, Artificial Sequence
  Synthetic oligonucleotide
tacaccctctgccgcccgacctagcccttattggaga

SEQ ID NO: 117748 - DNA, 36 bp, Artificial Sequence
  Synthetic oligonucleotide
atccacgtacgggctacacctggtccactctcccta

SEQ ID NO: 117749 - DNA, 35 bp, Artificial Sequence
  Synthetic oligonucleotide
gacgtcgcccaaccgataattcatgccttctgccc

SEQ ID NO: 117750 - DNA, 35 bp, Artificial Sequence
  Synthetic oligonucleotide
accccacctcccgagtgccacatccgtttaaccgc

SEQ ID NO: 117751 - DNA, 35 bp, Artificial Sequence
  Synthetic oligonucleotide
agaccgccctccccacgaccactgtcagttctctc

SEQ ID NO: 117752 - DNA, 35 bp, Artificial Sequence
  Synthetic oligonucleotide
ttagaccgccgctcctattggcctctcgtcccacg

SEQ ID NO: 117753 - DNA, 35 bp, Artificial Sequence
  Synthetic oligonucleotide
acattaacgcccccctgtttcaactaacgctaccg

SEQ ID NO: 117754 - DNA, 35 bp, Artificial Sequence
  Synthetic oligonucleotide
tgaaccgccacctacgttgtctctcgagccctttg

SEQ ID NO: 117755 - DNA, 35 bp, Artificial Sequence
  Synthetic oligonucleotide
gtcgaacagaccgcattttccgtccatgaatctat

SEQ ID NO: 117756 - DNA, 36 bp, Artificial Sequence
  Synthetic oligonucleotide
gaaagcggaggggacgggaagaagggggggcgtcga

SEQ ID NO: 117757 - DNA, 37 bp, Artificial Sequence
  Synthetic oligonucleotide
gcgaacggtcgggaagaggatgggggcacggcgcgga

SEQ ID NO: 117758 - DNA, 35 bp, Artificial Sequence
  Synthetic oligonucleotide
tgaccagtgcaagtttcagtgtcaccttctccgtc

SEQ ID NO: 117759 - DNA, 35 bp, Artificial Sequence
  Synthetic oligonucleotide
tcacacccttccacgtacccacaccacgcgatccg

SEQ ID NO: 117760 - DNA, 35 bp, Artificial Sequence
  Synthetic oligonucleotide
ccccagtgcctatcatctatctcgccctgtactcg

SEQ ID NO: 117761 - DNA, 35 bp, Artificial Sequence
  Synthetic oligonucleotide
acactgtgcgccccgacccgtttcatccctaagtg

SEQ ID NO: 117762 - DNA, 35 bp, Artificial Sequence
  Synthetic oligonucleotide
aacgccgcccccgtccgctaaatactggctgttct

SEQ ID NO: 117763 - DNA, 35 bp, Artificial Sequence
  Synthetic oligonucleotide
gtcgacattgcgccgcgccttcctttccagtttct

SEQ ID NO: 117764 - DNA, 36 bp, Artificial Sequence
  Synthetic oligonucleotide
tcaccatctggggcgttgtgcctaccttcccacgta

SEQ ID NO: 117765 - DNA, 35 bp, Artificial Sequence
  Synthetic oligonucleotide
taacctgcccccgacctctctatggctgcgtttac

SEQ ID NO: 117766 - DNA, 35 bp, Artificial Sequence
  Synthetic oligonucleotide
gcctgccccgccctcctacgatcgcagggttttct

SEQ ID NO: 117767 - DNA, 35 bp, Artificial Sequence
  Synthetic oligonucleotide
cccaccatccctcgttcgcatacctgtgctgccca

SEQ ID NO: 117768 - DNA, 35 bp, Artificial Sequence
  Synthetic oligonucleotide
tgtcactccacttcgcccttgtgacgtatacttcc

SEQ ID NO: 117769 - DNA, 35 bp, Artificial Sequence
  Synthetic oligonucleotide
ttctcaacgcgccttcaagtccatcgttcttccgc

SEQ ID NO: 117770 - DNA, 35 bp, Artificial Sequence
  Synthetic oligonucleotide
acgccctcgagaccccctgcgtcctctccgttctc

SEQ ID NO: 117771 - DNA, 35 bp, Artificial Sequence
  Synthetic oligonucleotide
tataccctccacctctcagatgccccaactccccg

SEQ ID NO: 117772 - DNA, 35 bp, Artificial Sequence
  Synthetic oligonucleotide
gctaggtggtggtggggggagggtggtaaagctgg

SEQ ID NO: 117773 - DNA, 35 bp, Artificial Sequence
  Synthetic oligonucleotide
gcgagactcatcgggcgggagggagggaggacgat

SEQ ID NO: 117774 - DNA, 35 bp, Artificial Sequence
  Synthetic oligonucleotide
atgggtgggaggtggcgaaggtggtaggtgggaca

SEQ ID NO: 117775 - DNA, 37 bp, Artificial Sequence
  Synthetic oligonucleotide
gtcccatccctctatcccgaaaagccctggccttgga

SEQ ID NO: 117776 - DNA, 35 bp, Artificial Sequence
  Synthetic oligonucleotide
atgccgtcaccagatcaccccccgcggtacccacc

SEQ ID NO: 117777 - DNA, 35 bp, Artificial Sequence
  Synthetic oligonucleotide
ttctcacgcaagtgctgctcaccgcccattagccc

SEQ ID NO: 117778 - DNA, 35 bp, Artificial Sequence
  Synthetic oligonucleotide
gtcactacgcaggattgatccggatcccccccgcc

SEQ ID NO: 117779 - DNA, 35 bp, Artificial Sequence
  Synthetic oligonucleotide
tcttaccccttccccatgtgattctcgctccgggc

SEQ ID NO: 117780 - DNA, 35 bp, Artificial Sequence
  Synthetic oligonucleotide
taggtcaccgctgcacggtctcgccacttttatct

SEQ ID NO: 117781 - DNA, 35 bp, Artificial Sequence
  Synthetic oligonucleotide
gcactgcatcgccctcgagcccgtacgaccatctt

SEQ ID NO: 117782 - DNA, 36 bp, Artificial Sequence
  Synthetic oligonucleotide
gcaacgctgccctgtactcactctccggcctttaga

SEQ ID NO: 117783 - DNA, 37 bp, Artificial Sequence
  Synthetic oligonucleotide
tacccaaccttactcagtgctttttggcgctctccga

SEQ ID NO: 117784 - DNA, 35 bp, Artificial Sequence
  Synthetic oligonucleotide
tgactcccccatatgacttttactggtttcgtttc

SEQ ID NO: 117785 - DNA, 35 bp, Artificial Sequence
  Synthetic oligonucleotide
gagagacgccctgtaccgtgcctgctaatccccgt

SEQ ID NO: 117786 - DNA, 35 bp, Artificial Sequence
  Synthetic oligonucleotide
tcgactacgacctgtagcgtaccaatctgcacctt

SEQ ID NO: 117787 - DNA, 35 bp, Artificial Sequence
  Synthetic oligonucleotide
tgggtagggggggaggggagaatctgctcttcgca

SEQ ID NO: 117788 - DNA, 37 bp, Artificial Sequence
  Synthetic oligonucleotide
tgtagtggggaacggtaaacgggacgggagggactga

SEQ ID NO: 117789 - DNA, 37 bp, Artificial Sequence
  Synthetic oligonucleotide
tccaccttctgcattgccccctgtctcagttgcctga

SEQ ID NO: 117790 - DNA, 35 bp, Artificial Sequence
  Synthetic oligonucleotide
tacacccgtatgcactcgctccacacacatgccac

SEQ ID NO: 117791 - DNA, 35 bp, Artificial Sequence
  Synthetic oligonucleotide
actcgttccccttccgtccgttgcgcctttcgaca

SEQ ID NO: 117792 - DNA, 37 bp, Artificial Sequence
  Synthetic oligonucleotide
gatgggggggcgggagatcgggtaaatgtgcccgaga

SEQ ID NO: 117793 - DNA, 37 bp, Artificial Sequence
  Synthetic oligonucleotide
gacaccccgcctcccgccatattcccagtcccagcga

SEQ ID NO: 117794 - DNA, 36 bp, Artificial Sequence
  Synthetic oligonucleotide
tgtgggtgagaggggggtgtcggagggccgggtgga

SEQ ID NO: 117795 - DNA, 38 bp, Artificial Sequence
  Synthetic oligonucleotide
gagcgccggctgttctgcttctcttccctgtccgctga

SEQ ID NO: 117796 - DNA, 38 bp, Artificial Sequence
  Synthetic oligonucleotide
tctcacgcccaccttgctgcatgctctccgccctttga

SEQ ID NO: 117797 - DNA, 35 bp, Artificial Sequence
  Synthetic oligonucleotide
gtacaccgtccccttccacccccattgtgactgcc

SEQ ID NO: 117798 - DNA, 35 bp, Artificial Sequence
  Synthetic oligonucleotide
tctgaccgagacgtgccacccctcgcccttaatcc

SEQ ID NO: 117799 - DNA, 35 bp, Artificial Sequence
  Synthetic oligonucleotide
gacgcgcaaaattatgcctgtccatgtaccctccg

SEQ ID NO: 117800 - DNA, 35 bp, Artificial Sequence
  Synthetic oligonucleotide
gtacatcgccgttattctcgtccgtccccgttgcg

SEQ ID NO: 117801 - DNA, 35 bp, Artificial Sequence
  Synthetic oligonucleotide
tagtaatgggaggtggcggggcatggtggtgttgg

SEQ ID NO: 117802 - DNA, 35 bp, Artificial Sequence
  Synthetic oligonucleotide
agcaccccatccccccccgtcactaagtgcttcgt

SEQ ID NO: 117803 - DNA, 34 bp, Artificial Sequence
  Synthetic oligonucleotide
aatccacccctgtggtccttgagcctttaacttt

SEQ ID NO: 117804 - DNA, 36 bp, Artificial Sequence
  Synthetic oligonucleotide
gaggaggggcacggggaggcgggtaggtaatttgaa

SEQ ID NO: 117805 - DNA, 35 bp, Artificial Sequence
  Synthetic oligonucleotide
gagacgatgctcagactggcttctcctccccccca

SEQ ID NO: 117806 - DNA, 35 bp, Artificial Sequence
  Synthetic oligonucleotide
ttcccacacagtcctgtacttgtccccgcattcta

SEQ ID NO: 117807 - DNA, 35 bp, Artificial Sequence
  Synthetic oligonucleotide
tcagccttcacctcgcgtctcatcgttagctctac

SEQ ID NO: 117808 - DNA, 35 bp, Artificial Sequence
  Synthetic oligonucleotide
agtacaccacacttccccccaaacgccaggtcctc

SEQ ID NO: 117809 - DNA, 35 bp, Artificial Sequence
  Synthetic oligonucleotide
atagcaaacgtgccgctgccttaacaccattcttc

SEQ ID NO: 117810 - DNA, 35 bp, Artificial Sequence
  Synthetic oligonucleotide
gaatggcctctctcatggttttcgttcatccccct

SEQ ID NO: 117811 - DNA, 37 bp, Artificial Sequence
  Synthetic oligonucleotide
gacggggggaccggacggacaaggtgacgggggaaga

SEQ ID NO: 117812 - DNA, 35 bp, Artificial Sequence
  Synthetic oligonucleotide
agccccacgccgcggtgccaccactacgttaccta

SEQ ID NO: 117813 - DNA, 36 bp, Artificial Sequence
  Synthetic oligonucleotide
attgtaaagagggatggatcgggtgggagggggaca

SEQ ID NO: 117814 - DNA, 36 bp, Artificial Sequence
  Synthetic oligonucleotide
gtggcctacagccgttccatcgacctcacccctgga

SEQ ID NO: 117815 - DNA, 35 bp, Artificial Sequence
  Synthetic oligonucleotide
accccgacccgcttattggatccttagcatggccc

SEQ ID NO: 117816 - DNA, 35 bp, Artificial Sequence
  Synthetic oligonucleotide
atccccccccgctgacgggcgtataatcccactgc

SEQ ID NO: 117817 - DNA, 36 bp, Artificial Sequence
  Synthetic oligonucleotide
ttccgaaggctatcaatgtctaccgtcctgccccca

SEQ ID NO: 117818 - DNA, 37 bp, Artificial Sequence
  Synthetic oligonucleotide
taactagcccccctcctgctcctctcgcgtcgctaga

SEQ ID NO: 117819 - DNA, 37 bp, Artificial Sequence
  Synthetic oligonucleotide
tttagccccctctcatgtagtacctgctgcctggcga

SEQ ID NO: 117820 - DNA, 38 bp, Artificial Sequence
  Synthetic oligonucleotide
tcagtgaaggagacgaaaggggaaggagagtgtagtga

SEQ ID NO: 117821 - DNA, 37 bp, Artificial Sequence
  Synthetic oligonucleotide
tactcgctccgtctgcttctcttcgggtacaccttga

SEQ ID NO: 117822 - DNA, 35 bp, Artificial Sequence
  Synthetic oligonucleotide
agtcatactccgctgctggacttagctattccccc

SEQ ID NO: 117823 - DNA, 35 bp, Artificial Sequence
  Synthetic oligonucleotide
tacggtcacgtttgcgattcccctcccgtggcccc

SEQ ID NO: 117824 - DNA, 35 bp, Artificial Sequence
  Synthetic oligonucleotide
gactacgactgtccctctccgaaacacctccagcc

SEQ ID NO: 117825 - DNA, 35 bp, Artificial Sequence
  Synthetic oligonucleotide
gcaccacacccatctctccacccacacgacgtgat

SEQ ID NO: 117826 - DNA, 37 bp, Artificial Sequence
  Synthetic oligonucleotide
tcatgggggagcaacggtcaacaggggagggcgggga

SEQ ID NO: 117827 - DNA, 35 bp, Artificial Sequence
  Synthetic oligonucleotide
ttccccgcctttctcgcctaccagtgccctgcccc

SEQ ID NO: 117828 - DNA, 35 bp, Artificial Sequence
  Synthetic oligonucleotide
tatcgagcgaaagggaggaagagggtgggaaaacg

SEQ ID NO: 117829 - DNA, 35 bp, Artificial Sequence
  Synthetic oligonucleotide
tatgcccgttaccgactcgctccatcccccacagg

SEQ ID NO: 117830 - DNA, 35 bp, Artificial Sequence
  Synthetic oligonucleotide
ggggcacgtcttctatgatcagggcggggagggaa

SEQ ID NO: 117831 - DNA, 38 bp, Artificial Sequence
  Synthetic oligonucleotide
gccgtgcctcactggttcatgacacctatccgccctga

SEQ ID NO: 117832 - DNA, 38 bp, Artificial Sequence
  Synthetic oligonucleotide
tgatccctcccctccaccgtgagacaggtctctcctga

SEQ ID NO: 117833 - DNA, 30 bp, Artificial Sequence
  Synthetic oligonucleotide
aaggggctcggggagggtgggttaaaggta

SEQ ID NO: 117834 - DNA, 35 bp, Artificial Sequence
  Synthetic oligonucleotide
tagccaacctctcctcgtgcttttcgctgttcacc

SEQ ID NO: 117835 - DNA, 35 bp, Artificial Sequence
  Synthetic oligonucleotide
gtcccccacccggtacagttgagtcccccttttag

SEQ ID NO: 117836 - DNA, 34 bp, Artificial Sequence
  Synthetic oligonucleotide
ccatacacacatgctcacacgcatcgactctttt

SEQ ID NO: 117837 - DNA, 36 bp, Artificial Sequence
  Synthetic oligonucleotide
tagccccactcctcgttattatccccgactgccgca

SEQ ID NO: 117838 - DNA, 35 bp, Artificial Sequence
  Synthetic oligonucleotide
atgctccgttatcgcgccctcgccatgccgcttcc

SEQ ID NO: 117839 - DNA, 35 bp, Artificial Sequence
  Synthetic oligonucleotide
gtgacgtaccgacgcgtgctctgcactacctttcc

SEQ ID NO: 117840 - DNA, 35 bp, Artificial Sequence
  Synthetic oligonucleotide
accaacaccgtgctcgggtccttacattcttcctc

SEQ ID NO: 117841 - DNA, 35 bp, Artificial Sequence
  Synthetic oligonucleotide
tccccgtccatgcaagcgagcgctacgcccaccct

SEQ ID NO: 117842 - DNA, 36 bp, Artificial Sequence
  Synthetic oligonucleotide
gcacccatcacgctactaagccgccccccgtaaaca

SEQ ID NO: 117843 - DNA, 38 bp, Artificial Sequence
  Synthetic oligonucleotide
aaaaggggggtagacgggaggggtgccaagcggggtga

SEQ ID NO: 117844 - DNA, 37 bp, Artificial Sequence
  Synthetic oligonucleotide
gtacccctccgtgtaacaccgcccctcatcccgttga

SEQ ID NO: 117845 - DNA, 35 bp, Artificial Sequence
  Synthetic oligonucleotide
ttccgacctccacgcatccaccctaacagtttcac

SEQ ID NO: 117846 - DNA, 36 bp, Artificial Sequence
  Synthetic oligonucleotide
gacatcgctcgcaccgtgcgccctccgatttccacc

SEQ ID NO: 117847 - DNA, 35 bp, Artificial Sequence
  Synthetic oligonucleotide
atccatctagtgccgttcgcccacgggttttctcc

SEQ ID NO: 117848 - DNA, 35 bp, Artificial Sequence
  Synthetic oligonucleotide
ggacagacgcatctcccctcacatcgatacttcgc

SEQ ID NO: 117849 - DNA, 35 bp, Artificial Sequence
  Synthetic oligonucleotide
gttcgcctgcttatagttgcttatcgccccccgtc

SEQ ID NO: 117850 - DNA, 35 bp, Artificial Sequence
  Synthetic oligonucleotide
tgttacgcttgcctgtaccccctatgcaacacttc

SEQ ID NO: 117851 - DNA, 35 bp, Artificial Sequence
  Synthetic oligonucleotide
tctcccagccgtgagctcctatttgccttaccttc

SEQ ID NO: 117852 - DNA, 35 bp, Artificial Sequence
  Synthetic oligonucleotide
gatccatccgacccgctgaacaccctcaacccttg

SEQ ID NO: 117853 - DNA, 35 bp, Artificial Sequence
  Synthetic oligonucleotide
tccaccgacgaccacatgcgccgccccgaaaccaa

SEQ ID NO: 117854 - DNA, 35 bp, Artificial Sequence
  Synthetic oligonucleotide
atcatcccctatgcccttatgtctcgccagtaaca

SEQ ID NO: 117855 - DNA, 36 bp, Artificial Sequence
  Synthetic oligonucleotide
atgcccaccccttcgcactgtgtgttcgcacctcca

SEQ ID NO: 117856 - DNA, 37 bp, Artificial Sequence
  Synthetic oligonucleotide
acgagagagtggggagaagaaagggtaaggtaacgga

SEQ ID NO: 117857 - DNA, 36 bp, Artificial Sequence
  Synthetic oligonucleotide
gtcctggtcgggtgggatagggccgtgcgggtggga

SEQ ID NO: 117858 - DNA, 37 bp, Artificial Sequence
  Synthetic oligonucleotide
gagggggtgggtggagaggcgggacagtagtgtggga

SEQ ID NO: 117859 - DNA, 37 bp, Artificial Sequence
  Synthetic oligonucleotide
tccgacatccgccacaccaccgcccctttgtctctga

SEQ ID NO: 117860 - DNA, 35 bp, Artificial Sequence
  Synthetic oligonucleotide
taggacgggcgtacatgactcggctcttcaccttc

SEQ ID NO: 117861 - DNA, 35 bp, Artificial Sequence
  Synthetic oligonucleotide
gtgcgagaggggggtggatcacggtggggccgaag

SEQ ID NO: 117862 - DNA, 35 bp, Artificial Sequence
  Synthetic oligonucleotide
atgttacgccacattatatcgcaccacctgttatg

SEQ ID NO: 117863 - DNA, 36 bp, Artificial Sequence
  Synthetic oligonucleotide
ggaccctcccgccctttgtttcttcagcacttgaca

SEQ ID NO: 117864 - DNA, 36 bp, Artificial Sequence
  Synthetic oligonucleotide
tctccacgccccgcaatctgttaaatactctccata

SEQ ID NO: 117865 - DNA, 35 bp, Artificial Sequence
  Synthetic oligonucleotide
gctccaccaccgcttccttactgactggttagttc

SEQ ID NO: 117866 - DNA, 38 bp, Artificial Sequence
  Synthetic oligonucleotide
tttgcaccttcccgtcgtaaccccacacactctgatga

SEQ ID NO: 117867 - DNA, 35 bp, Artificial Sequence
  Synthetic oligonucleotide
tccccccccgccgtgcgactgtacgcacacgaaac

SEQ ID NO: 117868 - DNA, 35 bp, Artificial Sequence
  Synthetic oligonucleotide
atcacctatcccgccctgaatgttaccgccatacg

SEQ ID NO: 117869 - DNA, 35 bp, Artificial Sequence
  Synthetic oligonucleotide
gcccccgcgctcctgcggtaccattcatttttgct

SEQ ID NO: 117870 - DNA, 36 bp, Artificial Sequence
  Synthetic oligonucleotide
gttaggggcagggaagggggtcgggggagcgagcaa

SEQ ID NO: 117871 - DNA, 37 bp, Artificial Sequence
  Synthetic oligonucleotide
tacatgcgccacggtggtccaccctctcgccccccga

SEQ ID NO: 117872 - DNA, 38 bp, Artificial Sequence
  Synthetic oligonucleotide
actggaggggggagggcggacgggacggagcagactga

SEQ ID NO: 117873 - DNA, 38 bp, Artificial Sequence
  Synthetic oligonucleotide
accgaccccgcttaccgtgttacttccttgtcccctga

SEQ ID NO: 117874 - DNA, 36 bp, Artificial Sequence
  Synthetic oligonucleotide
gtgagcagaactcacatatatgctcgcccttcctga

SEQ ID NO: 117875 - DNA, 37 bp, Artificial Sequence
  Synthetic oligonucleotide
aacgcccgtgccatctgggcttaccaccccatcttga

SEQ ID NO: 117876 - DNA, 35 bp, Artificial Sequence
  Synthetic oligonucleotide
gtagggtcgcatcagccgtttctgccctctttcat

SEQ ID NO: 117877 - DNA, 35 bp, Artificial Sequence
  Synthetic oligonucleotide
atttaggtagcgcccgcctgcttaccgccacttct

SEQ ID NO: 117878 - DNA, 34 bp, Artificial Sequence
  Synthetic oligonucleotide
ttgctcagtcaatccgtccgccgcctactcactt

SEQ ID NO: 117879 - DNA, 35 bp, Artificial Sequence
  Synthetic oligonucleotide
gatcgcccgctgccctgtttcagacccttgtcctt

SEQ ID NO: 117880 - DNA, 38 bp, Artificial Sequence
  Synthetic oligonucleotide
gaccccgacagcttgtttttcgcgctacctcctcatga

SEQ ID NO: 117881 - DNA, 35 bp, Artificial Sequence
  Synthetic oligonucleotide
gtgaacctccacaatggcctggaccgccgtaccac

SEQ ID NO: 117882 - DNA, 35 bp, Artificial Sequence
  Synthetic oligonucleotide
gcatgcatgcctccagctccccgactacccccgcc

SEQ ID NO: 117883 - DNA, 35 bp, Artificial Sequence
  Synthetic oligonucleotide
tttcacctcgctctgttatggcctgatttcccgtg

SEQ ID NO: 117884 - DNA, 35 bp, Artificial Sequence
  Synthetic oligonucleotide
gcgctgactgcctctctcgtactccctgggctcca

SEQ ID NO: 117885 - DNA, 37 bp, Artificial Sequence
  Synthetic oligonucleotide
ttacgagacgacggggtggcagggcgggaagaataga

SEQ ID NO: 117886 - DNA, 35 bp, Artificial Sequence
  Synthetic oligonucleotide
tcacacttgcagactccccatcacgcaccgattgc

SEQ ID NO: 117887 - DNA, 35 bp, Artificial Sequence
  Synthetic oligonucleotide
taacgccaccagcacctcgttcttcatagttgttc

SEQ ID NO: 117888 - DNA, 35 bp, Artificial Sequence
  Synthetic oligonucleotide
tgtgcgctgtttcatctcccccctttgagcccgtg

SEQ ID NO: 117889 - DNA, 35 bp, Artificial Sequence
  Synthetic oligonucleotide
gaggaccgaccaccgaccctagcccacctttgcct

SEQ ID NO: 117890 - DNA, 35 bp, Artificial Sequence
  Synthetic oligonucleotide
tgcactccacccttgctttccgccagctggctttt

SEQ ID NO: 117891 - DNA, 36 bp, Artificial Sequence
  Synthetic oligonucleotide
gacatcgcacaatatctgtaatcttcctgctcgcca

SEQ ID NO: 117892 - DNA, 37 bp, Artificial Sequence
  Synthetic oligonucleotide
ggggaaggcggggggggtggatgactgagtgcgccga

SEQ ID NO: 117893 - DNA, 38 bp, Artificial Sequence
  Synthetic oligonucleotide
tcaccgccgcgccctcgttctccaccgcgcatcactga

SEQ ID NO: 117894 - DNA, 35 bp, Artificial Sequence
  Synthetic oligonucleotide
gactgccagaagcggcaggtcctcgctccacccgc

SEQ ID NO: 117895 - DNA, 35 bp, Artificial Sequence
  Synthetic oligonucleotide
tgtcaacggcgctcctcttcttatcccccctgctg

SEQ ID NO: 117896 - DNA, 35 bp, Artificial Sequence
  Synthetic oligonucleotide
ggtggtagaggggaggaagaagtggggggattggt

SEQ ID NO: 117897 - DNA, 36 bp, Artificial Sequence
  Synthetic oligonucleotide
actgctcgctctctcgtcctgtttgccatcctatca

SEQ ID NO: 117898 - DNA, 37 bp, Artificial Sequence
  Synthetic oligonucleotide
gtgtaggggggggtggttaagctagggccggatgaga

SEQ ID NO: 117899 - DNA, 37 bp, Artificial Sequence
  Synthetic oligonucleotide
gaagaagcggggggggagggaacagcggactgggtga

SEQ ID NO: 117900 - DNA, 36 bp, Artificial Sequence
  Synthetic oligonucleotide
accagggcgggacgggaagggacatctaggttgata

SEQ ID NO: 117901 - DNA, 36 bp, Artificial Sequence
  Synthetic oligonucleotide
tgcgcaggaaagggtggagggaatggaggaggcgta

SEQ ID NO: 117902 - DNA, 35 bp, Artificial Sequence
  Synthetic oligonucleotide
accctccaccttctcgccggtttgggtagcaaacc

SEQ ID NO: 117903 - DNA, 35 bp, Artificial Sequence
  Synthetic oligonucleotide
tctagccccgccacttgggaccactcttatctttg

SEQ ID NO: 117904 - DNA, 35 bp, Artificial Sequence
  Synthetic oligonucleotide
tacaccgccacccctctcagctcgcagaccaggat

SEQ ID NO: 117905 - DNA, 35 bp, Artificial Sequence
  Synthetic oligonucleotide
tccgagcacattccttgcctccttgccgagtccct

SEQ ID NO: 117906 - DNA, 35 bp, Artificial Sequence
  Synthetic oligonucleotide
accggaacgctctcccgtgtctcgcgcccttcctt

SEQ ID NO: 117907 - DNA, 36 bp, Artificial Sequence
  Synthetic oligonucleotide
aacgcccccgctcctgtttttcactcaagttctcaa

SEQ ID NO: 117908 - DNA, 37 bp, Artificial Sequence
  Synthetic oligonucleotide
agagacgagcatggaagggtaagaaaggaacggggga

SEQ ID NO: 117909 - DNA, 37 bp, Artificial Sequence
  Synthetic oligonucleotide
tagctcaccgccgcatctggttcccctatcacttgga

SEQ ID NO: 117910 - DNA, 36 bp, Artificial Sequence
  Synthetic oligonucleotide
tcactgctgccttagttctccctctgacccccttga

SEQ ID NO: 117911 - DNA, 36 bp, Artificial Sequence
  Synthetic oligonucleotide
agaggagggggaggggttggttgtagggaggtgata

SEQ ID NO: 117912 - DNA, 35 bp, Artificial Sequence
  Synthetic oligonucleotide
agccccatcgttcgctggccccacttccttctcac

SEQ ID NO: 117913 - DNA, 35 bp, Artificial Sequence
  Synthetic oligonucleotide
aaacggagcccatatcgtatccctctgtccgtgcc

SEQ ID NO: 117914 - DNA, 35 bp, Artificial Sequence
  Synthetic oligonucleotide
gcctcccgcatactgtttccatctccggctgtatc

SEQ ID NO: 117915 - DNA, 35 bp, Artificial Sequence
  Synthetic oligonucleotide
tgaaagcagggggtagactatgggaaagggtcggg

SEQ ID NO: 117916 - DNA, 36 bp, Artificial Sequence
  Synthetic oligonucleotide
atcaccccgctagttcccgtgcctgcgcatcctgca

SEQ ID NO: 117917 - DNA, 37 bp, Artificial Sequence
  Synthetic oligonucleotide
agagacgacacggggagaaggggaggactaggggtga

SEQ ID NO: 117918 - DNA, 35 bp, Artificial Sequence
  Synthetic oligonucleotide
tattccaccgccaacatgcaatgcgcgccacttac

SEQ ID NO: 117919 - DNA, 35 bp, Artificial Sequence
  Synthetic oligonucleotide
gtcaacaagccgtatgtgtcggttcttccctgccc

SEQ ID NO: 117920 - DNA, 35 bp, Artificial Sequence
  Synthetic oligonucleotide
tcccctgacgccgctgatcaaggcttactctatcc

SEQ ID NO: 117921 - DNA, 35 bp, Artificial Sequence
  Synthetic oligonucleotide
ttcgcgcggtcccgcctatgacgaacgcctccctc

SEQ ID NO: 117922 - DNA, 35 bp, Artificial Sequence
  Synthetic oligonucleotide
tccaccgcattcgtgtgcgtcactcttatacgccg

SEQ ID NO: 117923 - DNA, 34 bp, Artificial Sequence
  Synthetic oligonucleotide
atgtgcggtctttcctgtctgggtccattcctcg

SEQ ID NO: 117924 - DNA, 35 bp, Artificial Sequence
  Synthetic oligonucleotide
gtcgcctgcccataatggtttacgcgtttctcctt

SEQ ID NO: 117925 - DNA, 35 bp, Artificial Sequence
  Synthetic oligonucleotide
tccacccgccaagcccctgagaccctagtcccgtt

SEQ ID NO: 117926 - DNA, 35 bp, Artificial Sequence
  Synthetic oligonucleotide
ggtgcccccccccttcagcagcttgttatcgctaa

SEQ ID NO: 117927 - DNA, 36 bp, Artificial Sequence
  Synthetic oligonucleotide
ttagtccgccattgtctctctgtctagccttcttca

SEQ ID NO: 117928 - DNA, 37 bp, Artificial Sequence
  Synthetic oligonucleotide
gcacccacgctcccgttcttagccactcttcgttcga

SEQ ID NO: 117929 - DNA, 36 bp, Artificial Sequence
  Synthetic oligonucleotide
gtgatgccctcgccccctcccgttctggacgcagga

SEQ ID NO: 117930 - DNA, 37 bp, Artificial Sequence
  Synthetic oligonucleotide
gggggtgggacggggtgggtagttcaggcgattcgga

SEQ ID NO: 117931 - DNA, 35 bp, Artificial Sequence
  Synthetic oligonucleotide
tcccaccttcaagtcttcgcctacactctgttccg

SEQ ID NO: 117932 - DNA, 35 bp, Artificial Sequence
  Synthetic oligonucleotide
gcacgagtgggggcgggaggggctcagacaggggg

SEQ ID NO: 117933 - DNA, 35 bp, Artificial Sequence
  Synthetic oligonucleotide
gccgccacccaacatgtcgatcgccctctcgtgct

SEQ ID NO: 117934 - DNA, 36 bp, Artificial Sequence
  Synthetic oligonucleotide
gcaactaccgccccgtgccacaccacactcgctgca

SEQ ID NO: 117935 - DNA, 37 bp, Artificial Sequence
  Synthetic oligonucleotide
agtccggcctctctcttcgtatgtcctccctccgtga

SEQ ID NO: 117936 - DNA, 36 bp, Artificial Sequence
  Synthetic oligonucleotide
atgtcccatccccgcgggtactgctactgtctcctc

SEQ ID NO: 117937 - DNA, 35 bp, Artificial Sequence
  Synthetic oligonucleotide
taaatccacgccctcagtgcttcttgccacactct

SEQ ID NO: 117938 - DNA, 35 bp, Artificial Sequence
  Synthetic oligonucleotide
acactccgtattgccgttttggtccgcctcctctt

SEQ ID NO: 117939 - DNA, 36 bp, Artificial Sequence
  Synthetic oligonucleotide
gcaagcggaggaggggaactagggggacttgggaga

SEQ ID NO: 117940 - DNA, 38 bp, Artificial Sequence
  Synthetic oligonucleotide
atcgcctgcccaacgttctcaagcctgcctctccctga

SEQ ID NO: 117941 - DNA, 35 bp, Artificial Sequence
  Synthetic oligonucleotide
tcgaccatcctggatgcttaccaatgtccttgccc

SEQ ID NO: 117942 - DNA, 35 bp, Artificial Sequence
  Synthetic oligonucleotide
tgatcccccgtctcaattagccgtcttgtagctcc

SEQ ID NO: 117943 - DNA, 35 bp, Artificial Sequence
  Synthetic oligonucleotide
gttccgctcctgttctccatctcgagcacgttgtc

SEQ ID NO: 117944 - DNA, 36 bp, Artificial Sequence
  Synthetic oligonucleotide
ggatgcccgatccctggaagtcacttgcctccgcca

SEQ ID NO: 117945 - DNA, 38 bp, Artificial Sequence
  Synthetic oligonucleotide
tccacgtccttcgttctactgttgccgccgacccttga

SEQ ID NO: 117946 - DNA, 35 bp, Artificial Sequence
  Synthetic oligonucleotide
atgacacgctcttccccacagtttatgtcctcgcc

SEQ ID NO: 117947 - DNA, 35 bp, Artificial Sequence
  Synthetic oligonucleotide
gttgcacggccgaccgcacgcgtaccttccgatcc

SEQ ID NO: 117948 - DNA, 35 bp, Artificial Sequence
  Synthetic oligonucleotide
ggaccacctctcctgcacgtgcgctcctcgagagc

SEQ ID NO: 117949 - DNA, 35 bp, Artificial Sequence
  Synthetic oligonucleotide
aatctcggcacatcgtctctcgtaccatctctccg

SEQ ID NO: 117950 - DNA, 35 bp, Artificial Sequence
  Synthetic oligonucleotide
gaacgcgcgtactcccaccttgttgcccgacctgt

SEQ ID NO: 117951 - DNA, 35 bp, Artificial Sequence
  Synthetic oligonucleotide
tatcagttcacatgcagcattctactccatctctt

SEQ ID NO: 117952 - DNA, 36 bp, Artificial Sequence
  Synthetic oligonucleotide
accgcccccatcgctcgcttatacggcttaccatta

SEQ ID NO: 117953 - DNA, 35 bp, Artificial Sequence
  Synthetic oligonucleotide
gctggtcctggccgtctccccgtctaaactgtccc

SEQ ID NO: 117954 - DNA, 35 bp, Artificial Sequence
  Synthetic oligonucleotide
tgccgatccagtgcaccgtaaccggctatcttctc

SEQ ID NO: 117955 - DNA, 35 bp, Artificial Sequence
  Synthetic oligonucleotide
ttcctctgcgcacagtcctttacgcactcctcccg

SEQ ID NO: 117956 - DNA, 37 bp, Artificial Sequence
  Synthetic oligonucleotide
tcccatcccccctctttgtgcacgtgattaaccgtga

SEQ ID NO: 117957 - DNA, 36 bp, Artificial Sequence
  Synthetic oligonucleotide
gccataccacctctcgatgacgagccccctgtctta

SEQ ID NO: 117958 - DNA, 35 bp, Artificial Sequence
  Synthetic oligonucleotide
atcgctacccccgctctgacctcgcacgtccccac

SEQ ID NO: 117959 - DNA, 35 bp, Artificial Sequence
  Synthetic oligonucleotide
gatccgcccggccgtgcaaaccatctctcgttgac

SEQ ID NO: 117960 - DNA, 34 bp, Artificial Sequence
  Synthetic oligonucleotide
ttcggtgccatttcatcacgcctgttctcgcccc

SEQ ID NO: 117961 - DNA, 35 bp, Artificial Sequence
  Synthetic oligonucleotide
agcccccggctgcatactatctcgcccatactacg

SEQ ID NO: 117962 - DNA, 36 bp, Artificial Sequence
  Synthetic oligonucleotide
gagagagaagaggggccatgggagcgtgagaccgaa

SEQ ID NO: 117963 - DNA, 35 bp, Artificial Sequence
  Synthetic oligonucleotide
gtagcggcggtgtgggaaagggggggaggggaaga

SEQ ID NO: 117964 - DNA, 37 bp, Artificial Sequence
  Synthetic oligonucleotide
gtcatccactcgcatcatcggcgtctccacctgccga

SEQ ID NO: 117965 - DNA, 38 bp, Artificial Sequence
  Synthetic oligonucleotide
gacgaagtctgtggggggggtggagtaggggcaggtga

SEQ ID NO: 117966 - DNA, 37 bp, Artificial Sequence
  Synthetic oligonucleotide
ttgccactcccctctgttcggtcgtacaatcttttga

SEQ ID NO: 117967 - DNA, 35 bp, Artificial Sequence
  Synthetic oligonucleotide
gctaccgccctgcaccacccgccaacaagcccgta

SEQ ID NO: 117968 - DNA, 35 bp, Artificial Sequence
  Synthetic oligonucleotide
gcaacatcccatgcgatatgtcctttccgcccgcc

SEQ ID NO: 117969 - DNA, 35 bp, Artificial Sequence
  Synthetic oligonucleotide
ggtgaccgctttggtattcgcccgtcttcgccgcc

SEQ ID NO: 117970 - DNA, 35 bp, Artificial Sequence
  Synthetic oligonucleotide
aagacgctcacaggcgttttgccttccccctggcc

SEQ ID NO: 117971 - DNA, 35 bp, Artificial Sequence
  Synthetic oligonucleotide
acgctacatcccgtcccgaccgcttactctcgtcc

SEQ ID NO: 117972 - DNA, 35 bp, Artificial Sequence
  Synthetic oligonucleotide
actacccgcggtcagggcaccccccccttcattcc

SEQ ID NO: 117973 - DNA, 35 bp, Artificial Sequence
  Synthetic oligonucleotide
ggacaccctaagtgttagttcgccctctcttacgc

SEQ ID NO: 117974 - DNA, 37 bp, Artificial Sequence
  Synthetic oligonucleotide
ttcctaccgcagcctcctcattcgcgttcgcctccga

SEQ ID NO: 117975 - DNA, 37 bp, Artificial Sequence
  Synthetic oligonucleotide
atactgtgtacagggggggaaggagtaggtaacggga

SEQ ID NO: 117976 - DNA, 36 bp, Artificial Sequence
  Synthetic oligonucleotide
gtgcccccacgttctcgctcttttactctgccctga

SEQ ID NO: 117977 - DNA, 35 bp, Artificial Sequence
  Synthetic oligonucleotide
ttctgccccctgatcgctcaagctgcaacttgccc

SEQ ID NO: 117978 - DNA, 35 bp, Artificial Sequence
  Synthetic oligonucleotide
ggtactcacataggtctcgtccactgcctttcgcc

SEQ ID NO: 117979 - DNA, 35 bp, Artificial Sequence
  Synthetic oligonucleotide
tgtactcacccagccgtcttattcaccacgctatc

SEQ ID NO: 117980 - DNA, 35 bp, Artificial Sequence
  Synthetic oligonucleotide
tcccgcagactcccgctgcttctttcatggtcgct

SEQ ID NO: 117981 - DNA, 35 bp, Artificial Sequence
  Synthetic oligonucleotide
gtccaatctgcgtgcttctggtccctccttctgct

SEQ ID NO: 117982 - DNA, 34 bp, Artificial Sequence
  Synthetic oligonucleotide
tgggaccctctgtccgttgcctacgttttatctt

SEQ ID NO: 117983 - DNA, 35 bp, Artificial Sequence
  Synthetic oligonucleotide
accggtgtgccccctgctcgagtatcttccacttt

SEQ ID NO: 117984 - DNA, 36 bp, Artificial Sequence
  Synthetic oligonucleotide
tcttccccgcggacttgtgctcgcccccgtacataa

SEQ ID NO: 117985 - DNA, 37 bp, Artificial Sequence
  Synthetic oligonucleotide
ggtcacgggggtggaagggaaggagggttacgtgaga

SEQ ID NO: 117986 - DNA, 36 bp, Artificial Sequence
  Synthetic oligonucleotide
tcactccgtcctcttctgtgccgcccattatgtcta

SEQ ID NO: 117987 - DNA, 35 bp, Artificial Sequence
  Synthetic oligonucleotide
ttcgggagggagggaggggctggaccgtgtctgag

SEQ ID NO: 117988 - DNA, 35 bp, Artificial Sequence
  Synthetic oligonucleotide
atcgacgcccacctgttcggttccgctttcataat

SEQ ID NO: 117989 - DNA, 35 bp, Artificial Sequence
  Synthetic oligonucleotide
tttcgtacccaccgccatgcttacctatcgtaggt

SEQ ID NO: 117990 - DNA, 35 bp, Artificial Sequence
  Synthetic oligonucleotide
gtgacgccccatacttgtgcaggttccttcttttt

SEQ ID NO: 117991 - DNA, 35 bp, Artificial Sequence
  Synthetic oligonucleotide
tacaccgcacattcggctagttgcgcgccctttca

SEQ ID NO: 117992 - DNA, 37 bp, Artificial Sequence
  Synthetic oligonucleotide
gtcgggtaggaggagggagtcgggcggtggaagggga

SEQ ID NO: 117993 - DNA, 35 bp, Artificial Sequence
  Synthetic oligonucleotide
tcgctccacgcctcctctctgcaatccgactggta

SEQ ID NO: 117994 - DNA, 35 bp, Artificial Sequence
  Synthetic oligonucleotide
ggtgtggatctccacctgcatattgcctgaccccc

SEQ ID NO: 117995 - DNA, 35 bp, Artificial Sequence
  Synthetic oligonucleotide
tttggacccgccactcttatcttgggtgttccccc

SEQ ID NO: 117996 - DNA, 35 bp, Artificial Sequence
  Synthetic oligonucleotide
aaaccctcggatagcgcgaccctcctgtcttcgcc

SEQ ID NO: 117997 - DNA, 35 bp, Artificial Sequence
  Synthetic oligonucleotide
acgatgtcagcatccaccaatatgcctccccgtcc

SEQ ID NO: 117998 - DNA, 35 bp, Artificial Sequence
  Synthetic oligonucleotide
gttgccggggccatatcgctttccttccacacttc

SEQ ID NO: 117999 - DNA, 35 bp, Artificial Sequence
  Synthetic oligonucleotide
agttaggggaggtagtggggggaatagggaatgag

SEQ ID NO: 118000 - DNA, 35 bp, Artificial Sequence
  Synthetic oligonucleotide
atgcactccgttgcgcgccccatcaccgcctatcg

SEQ ID NO: 118001 - DNA, 36 bp, Artificial Sequence
  Synthetic oligonucleotide
gtctgggtgatggggcgggaaggggaaataggtcaa

SEQ ID NO: 118002 - DNA, 37 bp, Artificial Sequence
  Synthetic oligonucleotide
tgcgaccgacccgcctactcaacgcagaccctgccga

SEQ ID NO: 118003 - DNA, 37 bp, Artificial Sequence
  Synthetic oligonucleotide
aaccgtcggatccgaacctggccccctctcttcatga

SEQ ID NO: 118004 - DNA, 36 bp, Artificial Sequence
  Synthetic oligonucleotide
gacgtgaggggagcggggggtaatggggaagccgta

SEQ ID NO: 118005 - DNA, 36 bp, Artificial Sequence
  Synthetic oligonucleotide
gacccatctccccttgctagtttcccagggcgcacc

SEQ ID NO: 118006 - DNA, 35 bp, Artificial Sequence
  Synthetic oligonucleotide
ttgctgctccgcccaccctgccaccccccccatgg

SEQ ID NO: 118007 - DNA, 35 bp, Artificial Sequence
  Synthetic oligonucleotide
tcccccctctatgctatcgatcggtcaacttacct

SEQ ID NO: 118008 - DNA, 35 bp, Artificial Sequence
  Synthetic oligonucleotide
ttagcggtgtccgtgtcctgtcatgttctgctgtt

SEQ ID NO: 118009 - DNA, 36 bp, Artificial Sequence
  Synthetic oligonucleotide
gttcccttccgcaaccatctgacaccgtgtctttaa

SEQ ID NO: 118010 - DNA, 37 bp, Artificial Sequence
  Synthetic oligonucleotide
agccacccgccagtccgcccgaacgccttatcaccga

SEQ ID NO: 118011 - DNA, 35 bp, Artificial Sequence
  Synthetic oligonucleotide
tcttccccccgcatcgcatcgcgcctgttgctccc

SEQ ID NO: 118012 - DNA, 35 bp, Artificial Sequence
  Synthetic oligonucleotide
gtccaacctgcacactgccttgaggaaccgaactc

SEQ ID NO: 118013 - DNA, 35 bp, Artificial Sequence
  Synthetic oligonucleotide
ggaacgtccgccactgcgagtccctctattccgtc

SEQ ID NO: 118014 - DNA, 35 bp, Artificial Sequence
  Synthetic oligonucleotide
tccgccccttgtcaactccggccccccgaatattg

SEQ ID NO: 118015 - DNA, 35 bp, Artificial Sequence
  Synthetic oligonucleotide
agtctgtccgcctcccagtgccctttcgacctatt

SEQ ID NO: 118016 - DNA, 36 bp, Artificial Sequence
  Synthetic oligonucleotide
ttcgacaccatccatcggctcatcacagtcttaaca

SEQ ID NO: 118017 - DNA, 36 bp, Artificial Sequence
  Synthetic oligonucleotide
accgtccagccctctcatctattctgtcccttacca

SEQ ID NO: 118018 - DNA, 37 bp, Artificial Sequence
  Synthetic oligonucleotide
gaccacctcccgccactcccgacgtctgcctgcgaga

SEQ ID NO: 118019 - DNA, 37 bp, Artificial Sequence
  Synthetic oligonucleotide
gtcacctccgaactcgctaagcctgttactcttccga

SEQ ID NO: 118020 - DNA, 33 bp, Artificial Sequence
  Synthetic oligonucleotide
tcagacgctctgcgcttgttcctacaccccctc

SEQ ID NO: 118021 - DNA, 35 bp, Artificial Sequence
  Synthetic oligonucleotide
ttctccaccgccaaccgaccgcctctctcaggctg

SEQ ID NO: 118022 - DNA, 35 bp, Artificial Sequence
  Synthetic oligonucleotide
gcactactgtgccttgtacttcgctttgcaaccct

SEQ ID NO: 118023 - DNA, 35 bp, Artificial Sequence
  Synthetic oligonucleotide
gccaccggtcaactactaacgctggcgcccttacc

SEQ ID NO: 118024 - DNA, 35 bp, Artificial Sequence
  Synthetic oligonucleotide
gatcgtgcgctggacccgtttggcctactacctcc

SEQ ID NO: 118025 - DNA, 36 bp, Artificial Sequence
  Synthetic oligonucleotide
gcattggagggggaaatgagaggaaggggcggctca

SEQ ID NO: 118026 - DNA, 37 bp, Artificial Sequence
  Synthetic oligonucleotide
tcagggaaagggcgggtaggaaaggtaggttggcaga

SEQ ID NO: 118027 - DNA, 37 bp, Artificial Sequence
  Synthetic oligonucleotide
aatcaccgccgaccagcgaatttttgccacccctcga

SEQ ID NO: 118028 - DNA, 35 bp, Artificial Sequence
  Synthetic oligonucleotide
gctcaccatcacgccgatcccgtgtcagccatccc

SEQ ID NO: 118029 - DNA, 35 bp, Artificial Sequence
  Synthetic oligonucleotide
accgtcgcccgctcccccccattacaatctggtcc

SEQ ID NO: 118030 - DNA, 34 bp, Artificial Sequence
  Synthetic oligonucleotide
ataccgcgtcccatcgtgcacgtttcccctgccg

SEQ ID NO: 118031 - DNA, 35 bp, Artificial Sequence
  Synthetic oligonucleotide
tatttcccgcccctcttttgttatgttgttccatg

SEQ ID NO: 118032 - DNA, 35 bp, Artificial Sequence
  Synthetic oligonucleotide
gcaaaccccccgagcctatattgcctccttatggt

SEQ ID NO: 118033 - DNA, 35 bp, Artificial Sequence
  Synthetic oligonucleotide
accgccccctcgaattgcccctatatgcccgagaa

SEQ ID NO: 118034 - DNA, 36 bp, Artificial Sequence
  Synthetic oligonucleotide
tccgcaccctgagttgcctttactatccgttgccga

SEQ ID NO: 118035 - DNA, 35 bp, Artificial Sequence
  Synthetic oligonucleotide
ttttgaccccgtccacatccggaattctggccacc

SEQ ID NO: 118036 - DNA, 35 bp, Artificial Sequence
  Synthetic oligonucleotide
gccgcatctttccctgccgcgtgattcccttggcc

SEQ ID NO: 118037 - DNA, 35 bp, Artificial Sequence
  Synthetic oligonucleotide
gatccaaccgacccatttcctgtacaccgcccgag

SEQ ID NO: 118038 - DNA, 36 bp, Artificial Sequence
  Synthetic oligonucleotide
gaatgcgcgcctcccttacctagccgccgtaaaccg

SEQ ID NO: 118039 - DNA, 35 bp, Artificial Sequence
  Synthetic oligonucleotide
gatgcgcgacctctcacctctttcactgcccgttg

SEQ ID NO: 118040 - DNA, 36 bp, Artificial Sequence
  Synthetic oligonucleotide
gacccaaccgccacacccgcagagccatccgctgaa

SEQ ID NO: 118041 - DNA, 37 bp, Artificial Sequence
  Synthetic oligonucleotide
ttcacactcgccgcattgtttctaccgcatcctacga

SEQ ID NO: 118042 - DNA, 37 bp, Artificial Sequence
  Synthetic oligonucleotide
ttgacaccccgtccagcagtgcctcccgctccactga

SEQ ID NO: 118043 - DNA, 35 bp, Artificial Sequence
  Synthetic oligonucleotide
tcatgtgcccaatatctgttctcgctatcccccgc

SEQ ID NO: 118044 - DNA, 35 bp, Artificial Sequence
  Synthetic oligonucleotide
tgcgcctcctatcctcctcgtgttccccctgagtg

SEQ ID NO: 118045 - DNA, 35 bp, Artificial Sequence
  Synthetic oligonucleotide
gcaaaccgtgctcccgttcctgccgccttaaacat

SEQ ID NO: 118046 - DNA, 36 bp, Artificial Sequence
  Synthetic oligonucleotide
gaccgcccccgctgcctcctgcccgcactttttgaa

SEQ ID NO: 118047 - DNA, 35 bp, Artificial Sequence
  Synthetic oligonucleotide
gccagagcgtgcacggtttatcgcccccgctgccc

SEQ ID NO: 118048 - DNA, 35 bp, Artificial Sequence
  Synthetic oligonucleotide
tgccctccgcttagattccaccgtcagtatctccc

SEQ ID NO: 118049 - DNA, 36 bp, Artificial Sequence
  Synthetic oligonucleotide
gtgggaaggcgggggggggaacaggcggaatcacaa

SEQ ID NO: 118050 - DNA, 38 bp, Artificial Sequence
  Synthetic oligonucleotide
tcatcgggtagcagggaaagggggtggaggggtggtga

SEQ ID NO: 118051 - DNA, 35 bp, Artificial Sequence
  Synthetic oligonucleotide
acgctccgcccgttcacccttttcgtgctgcgcac

SEQ ID NO: 118052 - DNA, 35 bp, Artificial Sequence
  Synthetic oligonucleotide
taacgacccgccgctggattccgctcaccacgatt

SEQ ID NO: 118053 - DNA, 37 bp, Artificial Sequence
  Synthetic oligonucleotide
accccccctccgtgtgatcctgccgtggcccaataga

SEQ ID NO: 118054 - DNA, 37 bp, Artificial Sequence
  Synthetic oligonucleotide
tgcaccccgcgtgtctatcctcctgctgggctcccga

SEQ ID NO: 118055 - DNA, 38 bp, Artificial Sequence
  Synthetic oligonucleotide
acgacccctcccttttgtgccgcctctacaggccctga

SEQ ID NO: 118056 - DNA, 35 bp, Artificial Sequence
  Synthetic oligonucleotide
tgaggctcccgacctcgttgttgtctcgctcctgc

SEQ ID NO: 118057 - DNA, 35 bp, Artificial Sequence
  Synthetic oligonucleotide
gtgcccttccgatcaccccaccctgttctttgttc

SEQ ID NO: 118058 - DNA, 35 bp, Artificial Sequence
  Synthetic oligonucleotide
tgagcactctaacgcacttggaccatcgcctccct

SEQ ID NO: 118059 - DNA, 35 bp, Artificial Sequence
  Synthetic oligonucleotide
acgtatcatcaggtgcgtccttctcttccgtcgct

SEQ ID NO: 118060 - DNA, 36 bp, Artificial Sequence
  Synthetic oligonucleotide
gccacgccacattctacctttcgactctttccatca

SEQ ID NO: 118061 - DNA, 36 bp, Artificial Sequence
  Synthetic oligonucleotide
tcatgacgcctctccatcgtattcaccgcttgatca

SEQ ID NO: 118062 - DNA, 36 bp, Artificial Sequence
  Synthetic oligonucleotide
gagtccgcactattgcctaggtccaccccgttctca

SEQ ID NO: 118063 - DNA, 37 bp, Artificial Sequence
  Synthetic oligonucleotide
gtgggcgggtgggctcttgggtaggttgacatcgcga

SEQ ID NO: 118064 - DNA, 38 bp, Artificial Sequence
  Synthetic oligonucleotide
attcaccgccctgttttgccccgccgttttcttggtga

SEQ ID NO: 118065 - DNA, 36 bp, Artificial Sequence
  Synthetic oligonucleotide
tcaaccgctcttgcgctgtccctgttccgaacctta

SEQ ID NO: 118066 - DNA, 35 bp, Artificial Sequence
  Synthetic oligonucleotide
ggactgtctcttgtacgcccccacccccgtgctcc

SEQ ID NO: 118067 - DNA, 35 bp, Artificial Sequence
  Synthetic oligonucleotide
gaccgtcgtcccttgcgcccatttatgcctgttcc

SEQ ID NO: 118068 - DNA, 35 bp, Artificial Sequence
  Synthetic oligonucleotide
ggtcctgaacgcatactatccccgtgcctgcttgc

SEQ ID NO: 118069 - DNA, 35 bp, Artificial Sequence
  Synthetic oligonucleotide
gatgacccttagcacggcatctgcccctcctcatc

SEQ ID NO: 118070 - DNA, 36 bp, Artificial Sequence
  Synthetic oligonucleotide
atgggagggggcaatcgattgggggaatgctgggga

SEQ ID NO: 118071 - DNA, 37 bp, Artificial Sequence
  Synthetic oligonucleotide
acgaccaggcgacaggaaggaggggggatggtgatga

SEQ ID NO: 118072 - DNA, 35 bp, Artificial Sequence
  Synthetic oligonucleotide
tccacaacccctgcttggtctccggatcgacttac

SEQ ID NO: 118073 - DNA, 35 bp, Artificial Sequence
  Synthetic oligonucleotide
gcccatcggctgggaagcacccccccctccgttac

SEQ ID NO: 118074 - DNA, 35 bp, Artificial Sequence
  Synthetic oligonucleotide
tagcaccgcagtatatcgtacttcaacccgcccgc

SEQ ID NO: 118075 - DNA, 35 bp, Artificial Sequence
  Synthetic oligonucleotide
gcgaatacacgctccttctcggaaactggccccct

SEQ ID NO: 118076 - DNA, 35 bp, Artificial Sequence
  Synthetic oligonucleotide
taacgcccctgtttttgatcacatcagtttcccct

SEQ ID NO: 118077 - DNA, 35 bp, Artificial Sequence
  Synthetic oligonucleotide
gaaccgtgctccggtggccttatcctcacctcctt

SEQ ID NO: 118078 - DNA, 35 bp, Artificial Sequence
  Synthetic oligonucleotide
gtccactctacacattgctacctcacgaccacaca

SEQ ID NO: 118079 - DNA, 35 bp, Artificial Sequence
  Synthetic oligonucleotide
agatgcctcccagttattcctaggccattcctcca

SEQ ID NO: 118080 - DNA, 38 bp, Artificial Sequence
  Synthetic oligonucleotide
gttggggggaggagcgggaatggagggcatgggagtga

SEQ ID NO: 118081 - DNA, 35 bp, Artificial Sequence
  Synthetic oligonucleotide
actccgccaatcgcttctggccctccgcttatgac

SEQ ID NO: 118082 - DNA, 38 bp, Artificial Sequence
  Synthetic oligonucleotide
gatgccgtttcagtgtagttcctctcgcgcccccctga

SEQ ID NO: 118083 - DNA, 36 bp, Artificial Sequence
  Synthetic oligonucleotide
gtcgccgcccactctctgtcttctcttggttcttga

SEQ ID NO: 118084 - DNA, 36 bp, Artificial Sequence
  Synthetic oligonucleotide
aagcacagcctgcccttgtcttaccaccatagtcta

SEQ ID NO: 118085 - DNA, 35 bp, Artificial Sequence
  Synthetic oligonucleotide
tagccgtaatgcacaatggcctcacctccacttcc

SEQ ID NO: 118086 - DNA, 35 bp, Artificial Sequence
  Synthetic oligonucleotide
tcacccggcactgtttccccaccgtccctatgatc

SEQ ID NO: 118087 - DNA, 35 bp, Artificial Sequence
  Synthetic oligonucleotide
gaactgctatccctgttaccgttgtcatccctgtc

SEQ ID NO: 118088 - DNA, 35 bp, Artificial Sequence
  Synthetic oligonucleotide
gagtcgcacatcagcacgtcgttcccatcctatcg

SEQ ID NO: 118089 - DNA, 35 bp, Artificial Sequence
  Synthetic oligonucleotide
gccccaagacccatgttcgggagccactacaccct

SEQ ID NO: 118090 - DNA, 34 bp, Artificial Sequence
  Synthetic oligonucleotide
tgcgcaccacaatcttatccacctgtctctcgca

SEQ ID NO: 118091 - DNA, 35 bp, Artificial Sequence
  Synthetic oligonucleotide
acgtgatccacacatgaacatctttgactacgccc

SEQ ID NO: 118092 - DNA, 35 bp, Artificial Sequence
  Synthetic oligonucleotide
acgatgccggccagccacgcccctctttaggtccc

SEQ ID NO: 118093 - DNA, 35 bp, Artificial Sequence
  Synthetic oligonucleotide
gtgaccgggcgtatatgggagggtgggagcacagc

SEQ ID NO: 118094 - DNA, 35 bp, Artificial Sequence
  Synthetic oligonucleotide
gcccaccccccagccagtctaagatcataccgcgc

SEQ ID NO: 118095 - DNA, 36 bp, Artificial Sequence
  Synthetic oligonucleotide
tcacatctcagcccctcctagcatagcctgtccaca

SEQ ID NO: 118096 - DNA, 36 bp, Artificial Sequence
  Synthetic oligonucleotide
tggtgcatgggggggggaggccaaagcaggagggga

SEQ ID NO: 118097 - DNA, 37 bp, Artificial Sequence
  Synthetic oligonucleotide
gcggggaacgaggaaagggggtggagggagattggga

SEQ ID NO: 118098 - DNA, 35 bp, Artificial Sequence
  Synthetic oligonucleotide
tcaccgtacggtgtacctaccctccttgtcttccc

SEQ ID NO: 118099 - DNA, 35 bp, Artificial Sequence
  Synthetic oligonucleotide
tcacagccctccttaccgatcgtctacatctagcc

SEQ ID NO: 118100 - DNA, 35 bp, Artificial Sequence
  Synthetic oligonucleotide
tttccccctcccgtcctgcgcttcgtgaactactc

SEQ ID NO: 118101 - DNA, 35 bp, Artificial Sequence
  Synthetic oligonucleotide
tctgtcccccgtcctcggctagtgaggacctactc

SEQ ID NO: 118102 - DNA, 35 bp, Artificial Sequence
  Synthetic oligonucleotide
gctgctaaatgttgcctgttcgccttccctcttcg

SEQ ID NO: 118103 - DNA, 35 bp, Artificial Sequence
  Synthetic oligonucleotide
gggagggtagaagggtgcgggagggagttatcagt

SEQ ID NO: 118104 - DNA, 37 bp, Artificial Sequence
  Synthetic oligonucleotide
agcacgatcagcctccccctgcgctattgccctcgga

SEQ ID NO: 118105 - DNA, 36 bp, Artificial Sequence
  Synthetic oligonucleotide
acaccgaaagatgagccaccgccccctccactttga

SEQ ID NO: 118106 - DNA, 35 bp, Artificial Sequence
  Synthetic oligonucleotide
gtgtctcgcgccctaggttcgtttcgttcgctccc

SEQ ID NO: 118107 - DNA, 35 bp, Artificial Sequence
  Synthetic oligonucleotide
tgtcgtcacttcccatgttgccttttcacgtgttc

SEQ ID NO: 118108 - DNA, 35 bp, Artificial Sequence
  Synthetic oligonucleotide
tgtaagaacccacggtccctgcccaccttctcccg

SEQ ID NO: 118109 - DNA, 35 bp, Artificial Sequence
  Synthetic oligonucleotide
tgcatgttgttgcgattagcgctccctctctgtct

SEQ ID NO: 118110 - DNA, 35 bp, Artificial Sequence
  Synthetic oligonucleotide
tatgacgggtaggaaggggtggggagcgaaatagt

SEQ ID NO: 118111 - DNA, 35 bp, Artificial Sequence
  Synthetic oligonucleotide
tagccattgccgcccctcatggtgttcccgctctt

SEQ ID NO: 118112 - DNA, 35 bp, Artificial Sequence
  Synthetic oligonucleotide
gcgagactgccctccgttctaccgtcgcacgtttt

SEQ ID NO: 118113 - DNA, 36 bp, Artificial Sequence
  Synthetic oligonucleotide
attagaccccgtctgccctgtcccccgacccgatca

SEQ ID NO: 118114 - DNA, 36 bp, Artificial Sequence
  Synthetic oligonucleotide
tatacacgcgcccaatttcccatctctgcccgttca

SEQ ID NO: 118115 - DNA, 37 bp, Artificial Sequence
  Synthetic oligonucleotide
ttcccatcccgccctggcaatgaaccacacctaacga

SEQ ID NO: 118116 - DNA, 35 bp, Artificial Sequence
  Synthetic oligonucleotide
ttccctgcccagtccactatcgccccctgtcaata

SEQ ID NO: 118117 - DNA, 35 bp, Artificial Sequence
  Synthetic oligonucleotide
acgccttgactatgcccaccggcccccaccagccc

SEQ ID NO: 118118 - DNA, 34 bp, Artificial Sequence
  Synthetic oligonucleotide
gcgcaagacaccttagttcaccccggacctgccc

SEQ ID NO: 118119 - DNA, 35 bp, Artificial Sequence
  Synthetic oligonucleotide
tatcccatccgcctccccatagcctcattgatgtg

SEQ ID NO: 118120 - DNA, 35 bp, Artificial Sequence
  Synthetic oligonucleotide
tcagactccccctcaaatgcgttccactaccgggt

SEQ ID NO: 118121 - DNA, 33 bp, Artificial Sequence
  Synthetic oligonucleotide
tcccatcccgacacccttctgatccaagcttaa

SEQ ID NO: 118122 - DNA, 35 bp, Artificial Sequence
  Synthetic oligonucleotide
gtttagcgccggcacttgctttttctatccgctca

SEQ ID NO: 118123 - DNA, 35 bp, Artificial Sequence
  Synthetic oligonucleotide
tgcttccccccagccatgctttcttcaccgcttca

SEQ ID NO: 118124 - DNA, 36 bp, Artificial Sequence
  Synthetic oligonucleotide
gaggggtgagggaggggagatacggtgggactcaga

SEQ ID NO: 118125 - DNA, 38 bp, Artificial Sequence
  Synthetic oligonucleotide
tccccacccctcgcatgcccctcattcctcacgtgtga

SEQ ID NO: 118126 - DNA, 35 bp, Artificial Sequence
  Synthetic oligonucleotide
aacccctcaagcttgcccgttatcgccactcgctc

SEQ ID NO: 118127 - DNA, 35 bp, Artificial Sequence
  Synthetic oligonucleotide
accatacgatcggtcccaccctgccgcctctcgat

SEQ ID NO: 118128 - DNA, 37 bp, Artificial Sequence
  Synthetic oligonucleotide
atgccccgtacgaatttccccttcctgccttgctcga

SEQ ID NO: 118129 - DNA, 35 bp, Artificial Sequence
  Synthetic oligonucleotide
gtacgcccctgccatgccccagtcagcacccgtgc

SEQ ID NO: 118130 - DNA, 35 bp, Artificial Sequence
  Synthetic oligonucleotide
atccatcccgacgccatactttcccagtttcgctg

SEQ ID NO: 118131 - DNA, 36 bp, Artificial Sequence
  Synthetic oligonucleotide
aacagggggggaaggggaccctagggacgaaaggaa

SEQ ID NO: 118132 - DNA, 37 bp, Artificial Sequence
  Synthetic oligonucleotide
gccctgcctcgcctcgttcaagcctgccccattatga

SEQ ID NO: 118133 - DNA, 35 bp, Artificial Sequence
  Synthetic oligonucleotide
gaaggggggggacggtcggaaacggactgatagta

SEQ ID NO: 118134 - DNA, 35 bp, Artificial Sequence
  Synthetic oligonucleotide
tagcaacaatcacctgcctgccttcgtttcttgac

SEQ ID NO: 118135 - DNA, 33 bp, Artificial Sequence
  Synthetic oligonucleotide
acaccatctgccacccctgagctaaaccttgcg

SEQ ID NO: 118136 - DNA, 35 bp, Artificial Sequence
  Synthetic oligonucleotide
tatcccgacccgtagtgccatcccatcgttaccga

SEQ ID NO: 118137 - DNA, 36 bp, Artificial Sequence
  Synthetic oligonucleotide
tccaccaaccctcatgcttaggatcacgcaccctga

SEQ ID NO: 118138 - DNA, 36 bp, Artificial Sequence
  Synthetic oligonucleotide
gcagagggtagcagggagggcggggattctggccta

SEQ ID NO: 118139 - DNA, 35 bp, Artificial Sequence
  Synthetic oligonucleotide
accacgcatcatgtactatctacgcgtcccccccc

SEQ ID NO: 118140 - DNA, 35 bp, Artificial Sequence
  Synthetic oligonucleotide
tatcccacccggccgctgaattgtggcttcaatcc

SEQ ID NO: 118141 - DNA, 35 bp, Artificial Sequence
  Synthetic oligonucleotide
gtggggttcggtagatggtccgccgccccctgtcc

SEQ ID NO: 118142 - DNA, 35 bp, Artificial Sequence
  Synthetic oligonucleotide
tctttgcgccgcccgacccgctcactgctttctaa

SEQ ID NO: 118143 - DNA, 36 bp, Artificial Sequence
  Synthetic oligonucleotide
ggaacccatctccatgtcctagccagactccaccca

SEQ ID NO: 118144 - DNA, 37 bp, Artificial Sequence
  Synthetic oligonucleotide
tgcacatcagcccgccgagtcccctgcttccccgaga

SEQ ID NO: 118145 - DNA, 38 bp, Artificial Sequence
  Synthetic oligonucleotide
tcaccacctgcctcacgcgttaccttcctttcaagtga

SEQ ID NO: 118146 - DNA, 35 bp, Artificial Sequence
  Synthetic oligonucleotide
taccgcccacatatcatgtgctagcccgcctaacc

SEQ ID NO: 118147 - DNA, 35 bp, Artificial Sequence
  Synthetic oligonucleotide
gcactctcgcatacagtaataccgatcgcctcgcc

SEQ ID NO: 118148 - DNA, 35 bp, Artificial Sequence
  Synthetic oligonucleotide
tcgaaggaacaatcgcggggaagagagggggatgg

SEQ ID NO: 118149 - DNA, 35 bp, Artificial Sequence
  Synthetic oligonucleotide
gcacatcgggctaagcttctcccctcgcgcgctct

SEQ ID NO: 118150 - DNA, 36 bp, Artificial Sequence
  Synthetic oligonucleotide
acgccctccattatctgatctgcctctgtttctaca

SEQ ID NO: 118151 - DNA, 35 bp, Artificial Sequence
  Synthetic oligonucleotide
tagtctcagcctgtccgctcggtccttcttgccca

SEQ ID NO: 118152 - DNA, 37 bp, Artificial Sequence
  Synthetic oligonucleotide
taccacccttctgcttattccttcgcgcccataggga

SEQ ID NO: 118153 - DNA, 36 bp, Artificial Sequence
  Synthetic oligonucleotide
gtatcacctcccctgccgcccccgtgtgtctctaca

SEQ ID NO: 118154 - DNA, 37 bp, Artificial Sequence
  Synthetic oligonucleotide
ggtgtagatagaggaagtgaagggggagagttcagga

SEQ ID NO: 118155 - DNA, 37 bp, Artificial Sequence
  Synthetic oligonucleotide
ggggaccgggacgaggggtggggagtggcaacgttga

SEQ ID NO: 118156 - DNA, 35 bp, Artificial Sequence
  Synthetic oligonucleotide
ttcatgcgcgtacccgttcggtcctcccatcattc

SEQ ID NO: 118157 - DNA, 35 bp, Artificial Sequence
  Synthetic oligonucleotide
atgcctgacatccattttgttcccgttgccccctt

SEQ ID NO: 118158 - DNA, 34 bp, Artificial Sequence
  Synthetic oligonucleotide
tctgtccacgccgcctagactgcacccgatcttt

SEQ ID NO: 118159 - DNA, 36 bp, Artificial Sequence
  Synthetic oligonucleotide
tacaccctcactgaccgacgatcgcgtctccgcaca

SEQ ID NO: 118160 - DNA, 36 bp, Artificial Sequence
  Synthetic oligonucleotide
gctccatctcgcagcctctgtacacacacggcccca

SEQ ID NO: 118161 - DNA, 35 bp, Artificial Sequence
  Synthetic oligonucleotide
attgcccccttaatgttcctttttcccgccgaggc

SEQ ID NO: 118162 - DNA, 34 bp, Artificial Sequence
  Synthetic oligonucleotide
gacttgcctctccgtttctttgccgcgggtgctc

SEQ ID NO: 118163 - DNA, 36 bp, Artificial Sequence
  Synthetic oligonucleotide
tcccacccactatctcccgaattaggactgtcgcca

SEQ ID NO: 118164 - DNA, 36 bp, Artificial Sequence
  Synthetic oligonucleotide
gatcgcctgggccctatctgcttaataccctgttga

SEQ ID NO: 118165 - DNA, 35 bp, Artificial Sequence
  Synthetic oligonucleotide
tgcacctctactggttcctctcatggccgcactac

SEQ ID NO: 118166 - DNA, 35 bp, Artificial Sequence
  Synthetic oligonucleotide
accaacgcatgtgtcccatcccagccgcaaatccc

SEQ ID NO: 118167 - DNA, 35 bp, Artificial Sequence
  Synthetic oligonucleotide
tcgtgccctccatgctactatcgcgcacgccacgc

SEQ ID NO: 118168 - DNA, 35 bp, Artificial Sequence
  Synthetic oligonucleotide
acacgatcactgggctctatcaggtcacctccctt

SEQ ID NO: 118169 - DNA, 35 bp, Artificial Sequence
  Synthetic oligonucleotide
gttggtcccccgcactcacttgctaaatggccttt

SEQ ID NO: 118170 - DNA, 35 bp, Artificial Sequence
  Synthetic oligonucleotide
gggtgtcccgcctgccttttgaactgcccttgaac

SEQ ID NO: 118171 - DNA, 35 bp, Artificial Sequence
  Synthetic oligonucleotide
ccaccgccctgctacggcccattatctccgacgtc

SEQ ID NO: 118172 - DNA, 35 bp, Artificial Sequence
  Synthetic oligonucleotide
gacgagtggacagggcggaaggtgggaaggagttg

SEQ ID NO: 118173 - DNA, 37 bp, Artificial Sequence
  Synthetic oligonucleotide
gcccccccgtgctgccccttagcctttcttcttcgga

SEQ ID NO: 118174 - DNA, 38 bp, Artificial Sequence
  Synthetic oligonucleotide
agacacctcaccaatgtttccaatcgtacctctcatga

SEQ ID NO: 118175 - DNA, 36 bp, Artificial Sequence
  Synthetic oligonucleotide
gcatgggggacgtggagcttggggcgggacggggta

SEQ ID NO: 118176 - DNA, 35 bp, Artificial Sequence
  Synthetic oligonucleotide
gcctgtccccagcaactacggtccctccctgtccg

SEQ ID NO: 118177 - DNA, 35 bp, Artificial Sequence
  Synthetic oligonucleotide
gggaactagtccctgcccgcccgcctgtacgccct

SEQ ID NO: 118178 - DNA, 35 bp, Artificial Sequence
  Synthetic oligonucleotide
gttgacaaggggggatataggagggggacaacgct

SEQ ID NO: 118179 - DNA, 37 bp, Artificial Sequence
  Synthetic oligonucleotide
atctggggaggggggtaaaggacggagggacggttga

SEQ ID NO: 118180 - DNA, 35 bp, Artificial Sequence
  Synthetic oligonucleotide
ttggacaacctccggatcgtagtgcactccctctc

SEQ ID NO: 118181 - DNA, 35 bp, Artificial Sequence
  Synthetic oligonucleotide
atcgcaaggcagaccctccaccccttcatgctttc

SEQ ID NO: 118182 - DNA, 35 bp, Artificial Sequence
  Synthetic oligonucleotide
tcagtccgtctccccatcatgttctgtgtctcttg

SEQ ID NO: 118183 - DNA, 35 bp, Artificial Sequence
  Synthetic oligonucleotide
acaacatccatgcgtacagcgattccacgttctct

SEQ ID NO: 118184 - DNA, 37 bp, Artificial Sequence
  Synthetic oligonucleotide
gatgagaggtggctggggtcgggaagggaaggcgcga

SEQ ID NO: 118185 - DNA, 37 bp, Artificial Sequence
  Synthetic oligonucleotide
tactgcggacggacggggaaggggcgtgcgcggggga

SEQ ID NO: 118186 - DNA, 38 bp, Artificial Sequence
  Synthetic oligonucleotide
acgaccccgccaccatgcttcctaacacctttacatga

SEQ ID NO: 118187 - DNA, 37 bp, Artificial Sequence
  Synthetic oligonucleotide
gtgggagggacgggggggtagtcttctcattatatga

SEQ ID NO: 118188 - DNA, 35 bp, Artificial Sequence
  Synthetic oligonucleotide
ggggtgagggggaaggtgggagcaggtgcggcaat

SEQ ID NO: 118189 - DNA, 35 bp, Artificial Sequence
  Synthetic oligonucleotide
gccgaagtgcccctgatatgccagcatctcctcct

SEQ ID NO: 118190 - DNA, 37 bp, Artificial Sequence
  Synthetic oligonucleotide
agatgcacgaggggggggatgggaccgtaatgggaga

SEQ ID NO: 118191 - DNA, 37 bp, Artificial Sequence
  Synthetic oligonucleotide
ggcctagcccaatgtgcgcccgcccctgccttctcga

SEQ ID NO: 118192 - DNA, 36 bp, Artificial Sequence
  Synthetic oligonucleotide
accgaccccttgtcacctttctcgacccacggttta

SEQ ID NO: 118193 - DNA, 35 bp, Artificial Sequence
  Synthetic oligonucleotide
atactcgctcccccacacggtaacccgcctgctcc

SEQ ID NO: 118194 - DNA, 35 bp, Artificial Sequence
  Synthetic oligonucleotide
agaccacccgacgtactgttctcctatattccatc

SEQ ID NO: 118195 - DNA, 35 bp, Artificial Sequence
  Synthetic oligonucleotide
acgtcgccgtctcgcctcgtactttcacctcacct

SEQ ID NO: 118196 - DNA, 37 bp, Artificial Sequence
  Synthetic oligonucleotide
tccaccttcaccccatgctttcgtgcccttagaccga

SEQ ID NO: 118197 - DNA, 35 bp, Artificial Sequence
  Synthetic oligonucleotide
gacagcccctctgccgttgcccaccatactactat

SEQ ID NO: 118198 - DNA, 35 bp, Artificial Sequence
  Synthetic oligonucleotide
tcccccacctctcgttcgcccccagttacaatggt

SEQ ID NO: 118199 - DNA, 36 bp, Artificial Sequence
  Synthetic oligonucleotide
tcctgcccctggcttagttcgctgaccttcttctta

SEQ ID NO: 118200 - DNA, 35 bp, Artificial Sequence
  Synthetic oligonucleotide
gtgcactatcaatttcccgtcgcgcgttatctccg

SEQ ID NO: 118201 - DNA, 35 bp, Artificial Sequence
  Synthetic oligonucleotide
tccattgaatgtgtccccgtcctcccgcctgctcg

SEQ ID NO: 118202 - DNA, 33 bp, Artificial Sequence
  Synthetic oligonucleotide
atggaggggacgggtgttggtgggtggaagcgg

SEQ ID NO: 118203 - DNA, 35 bp, Artificial Sequence
  Synthetic oligonucleotide
actgccccgtttgctttggttgccgctaccccctg

SEQ ID NO: 118204 - DNA, 35 bp, Artificial Sequence
  Synthetic oligonucleotide
acgacccggtcctactctttcgcgcgacacccctt

SEQ ID NO: 118205 - DNA, 36 bp, Artificial Sequence
  Synthetic oligonucleotide
aaaccacccccgccgctcctcgcgatttagcacaca

SEQ ID NO: 118206 - DNA, 35 bp, Artificial Sequence
  Synthetic oligonucleotide
atgtgccagtaggagggacgtacgaggggagggga

SEQ ID NO: 118207 - DNA, 35 bp, Artificial Sequence
  Synthetic oligonucleotide
accgatcgtgcatattcggcctagctacacctccc

SEQ ID NO: 118208 - DNA, 35 bp, Artificial Sequence
  Synthetic oligonucleotide
tccccatcttgtcctgccatcccgatagttccgtt

SEQ ID NO: 118209 - DNA, 35 bp, Artificial Sequence
  Synthetic oligonucleotide
actccacccccacatgccgctacacagctcgccag

SEQ ID NO: 118210 - DNA, 35 bp, Artificial Sequence
  Synthetic oligonucleotide
atgactcccacatatggctccgcattcccctcgcg

SEQ ID NO: 118211 - DNA, 35 bp, Artificial Sequence
  Synthetic oligonucleotide
gtcgcacccgttcaatgactattccctcttcgttg

SEQ ID NO: 118212 - DNA, 35 bp, Artificial Sequence
  Synthetic oligonucleotide
tagagggagggagggagacgggactgcaagaacat

SEQ ID NO: 118213 - DNA, 37 bp, Artificial Sequence
  Synthetic oligonucleotide
agtagggaggggggggcatatacgcatgaaagggaga

SEQ ID NO: 118214 - DNA, 37 bp, Artificial Sequence
  Synthetic oligonucleotide
ggacgagggacgaagggggggtggggactggtctaga

SEQ ID NO: 118215 - DNA, 36 bp, Artificial Sequence
  Synthetic oligonucleotide
agcgctccctcgctctcctgccgttacctcccacga

SEQ ID NO: 118216 - DNA, 38 bp, Artificial Sequence
  Synthetic oligonucleotide
gacgccccccatgtcatccacgtcctttcacattttga

SEQ ID NO: 118217 - DNA, 36 bp, Artificial Sequence
  Synthetic oligonucleotide
gatgtgtccttgtgccttacaccgccccctcaccta

SEQ ID NO: 118218 - DNA, 36 bp, Artificial Sequence
  Synthetic oligonucleotide
gtcccgctcacttcgttgcaatgccctccacgttta

SEQ ID NO: 118219 - DNA, 35 bp, Artificial Sequence
  Synthetic oligonucleotide
tgtgcacatccccatctgaatcccgttaagccccc

SEQ ID NO: 118220 - DNA, 35 bp, Artificial Sequence
  Synthetic oligonucleotide
tgacaccacccatccgctcgctctgcttgcccttg

SEQ ID NO: 118221 - DNA, 35 bp, Artificial Sequence
  Synthetic oligonucleotide
acgatgcatgccgagcgccttcctgtcacatcttt

SEQ ID NO: 118222 - DNA, 36 bp, Artificial Sequence
  Synthetic oligonucleotide
gggagggctggtgggagggcggggcatgctactcaa

SEQ ID NO: 118223 - DNA, 37 bp, Artificial Sequence
  Synthetic oligonucleotide
tcacgcaggtcccaagcggagaggggcggggtagaga

SEQ ID NO: 118224 - DNA, 35 bp, Artificial Sequence
  Synthetic oligonucleotide
atcccactgatctgttcttgtaacctccgctacac

SEQ ID NO: 118225 - DNA, 35 bp, Artificial Sequence
  Synthetic oligonucleotide
tgcgaccctttccgctatcctacgggccctcgctc

SEQ ID NO: 118226 - DNA, 35 bp, Artificial Sequence
  Synthetic oligonucleotide
gtgcatcctcggaccccccattttcttgcccgttc

SEQ ID NO: 118227 - DNA, 35 bp, Artificial Sequence
  Synthetic oligonucleotide
gacctcccttcagcggtcataagttctgctgccct

SEQ ID NO: 118228 - DNA, 35 bp, Artificial Sequence
  Synthetic oligonucleotide
aatcgtacatcagccgctccctgtcgcactccctt

SEQ ID NO: 118229 - DNA, 35 bp, Artificial Sequence
  Synthetic oligonucleotide
gtacgaccatcgccgatcccttttttcccgttgtt

SEQ ID NO: 118230 - DNA, 37 bp, Artificial Sequence
  Synthetic oligonucleotide
ggaaaaggtgagggagcgggcaaggggatgggagtga

SEQ ID NO: 118231 - DNA, 37 bp, Artificial Sequence
  Synthetic oligonucleotide
tctcaccctccaccatatgacctcctcagtcgcttga

SEQ ID NO: 118232 - DNA, 35 bp, Artificial Sequence
  Synthetic oligonucleotide
ggacctcctgccaccgttgtctcactgcactaata

SEQ ID NO: 118233 - DNA, 35 bp, Artificial Sequence
  Synthetic oligonucleotide
gcccccactagttgctcgtctatcgccacccctag

SEQ ID NO: 118234 - DNA, 35 bp, Artificial Sequence
  Synthetic oligonucleotide
gtcaccccctccctgccgctttgctttctgtcgtg

SEQ ID NO: 118235 - DNA, 34 bp, Artificial Sequence
  Synthetic oligonucleotide
gtccgggctcctcctgctgctatacctttacctt

SEQ ID NO: 118236 - DNA, 35 bp, Artificial Sequence
  Synthetic oligonucleotide
agtgcctcactgtagctgcatatccctgccaccca

SEQ ID NO: 118237 - DNA, 36 bp, Artificial Sequence
  Synthetic oligonucleotide
tcagccccgacaccatggtgttggccttctacctca

SEQ ID NO: 118238 - DNA, 37 bp, Artificial Sequence
  Synthetic oligonucleotide
acagtagggtggtgggtgggcggaaaaggtagcgtga

SEQ ID NO: 118239 - DNA, 35 bp, Artificial Sequence
  Synthetic oligonucleotide
tagaccaacccctgattcgcgccctccatccacac

SEQ ID NO: 118240 - DNA, 35 bp, Artificial Sequence
  Synthetic oligonucleotide
ttcgtgcaggtcgtcgttttgccttatctctcctg

SEQ ID NO: 118241 - DNA, 35 bp, Artificial Sequence
  Synthetic oligonucleotide
gtcggaccgcactgcgcaaacccgccaccacccct

SEQ ID NO: 118242 - DNA, 36 bp, Artificial Sequence
  Synthetic oligonucleotide
tcctgcccccatccctggctactacggacttccaaa

SEQ ID NO: 118243 - DNA, 35 bp, Artificial Sequence
  Synthetic oligonucleotide
atcccgcctcactcacgcctgagtgccccatttaa

SEQ ID NO: 118244 - DNA, 35 bp, Artificial Sequence
  Synthetic oligonucleotide
acttgggggcggtgatagggagggagggagagcac

SEQ ID NO: 118245 - DNA, 35 bp, Artificial Sequence
  Synthetic oligonucleotide
acgcccaaggcctcacgttccactgtagttccctc

SEQ ID NO: 118246 - DNA, 36 bp, Artificial Sequence
  Synthetic oligonucleotide
atccgcgccctccttctcctctggttgactagcaca

SEQ ID NO: 118247 - DNA, 37 bp, Artificial Sequence
  Synthetic oligonucleotide
ggagcgggacgagggagggtagaggcgggtaatcaga

SEQ ID NO: 118248 - DNA, 38 bp, Artificial Sequence
  Synthetic oligonucleotide
gactcacgggggggcgtaagggaagggaagaaagatga

SEQ ID NO: 118249 - DNA, 37 bp, Artificial Sequence
  Synthetic oligonucleotide
tcgaccgggcctcctgccttcacccctgtcaacctga

SEQ ID NO: 118250 - DNA, 36 bp, Artificial Sequence
  Synthetic oligonucleotide
ggacgtacgccctcgccgcctatagacccacaccta

SEQ ID NO: 118251 - DNA, 35 bp, Artificial Sequence
  Synthetic oligonucleotide
gtgactgccgcaattggttttccacacacccctct

SEQ ID NO: 118252 - DNA, 35 bp, Artificial Sequence
  Synthetic oligonucleotide
ttaaccaccgccgtgacctcgcacttgttacattt

SEQ ID NO: 118253 - DNA, 35 bp, Artificial Sequence
  Synthetic oligonucleotide
acttccccccgcgcggttcccgataacacctacca

SEQ ID NO: 118254 - DNA, 35 bp, Artificial Sequence
  Synthetic oligonucleotide
tccttacagacgatcgtgcctaggctcccttcacc

SEQ ID NO: 118255 - DNA, 35 bp, Artificial Sequence
  Synthetic oligonucleotide
tccgtcccaactgcatctggtacttcctggcgccc

SEQ ID NO: 118256 - DNA, 35 bp, Artificial Sequence
  Synthetic oligonucleotide
acccacaagggcccgcttttctgtcttacctctgc

SEQ ID NO: 118257 - DNA, 35 bp, Artificial Sequence
  Synthetic oligonucleotide
tttgcatccgccgccctctatcgcattgcgaactt

SEQ ID NO: 118258 - DNA, 35 bp, Artificial Sequence
  Synthetic oligonucleotide
tgaccaacactcctgcgcccttgaatcggttcttt

SEQ ID NO: 118259 - DNA, 35 bp, Artificial Sequence
  Synthetic oligonucleotide
acccactgcctaatggtacctccgcctttctggga

SEQ ID NO: 118260 - DNA, 35 bp, Artificial Sequence
  Synthetic oligonucleotide
gccccccgcttggcatagtatccctcgaacccctc

SEQ ID NO: 118261 - DNA, 35 bp, Artificial Sequence
  Synthetic oligonucleotide
aaatgggggagggaaagagggggtattctcggggg

SEQ ID NO: 118262 - DNA, 30 bp, Artificial Sequence
  Synthetic oligonucleotide
aagaacacccctacacattgcgcccctcat

SEQ ID NO: 118263 - DNA, 35 bp, Artificial Sequence
  Synthetic oligonucleotide
tcaatgacatcacgccgcacccaggtactcctgct

SEQ ID NO: 118264 - DNA, 35 bp, Artificial Sequence
  Synthetic oligonucleotide
ttcgcatagtcctgtctcctcctaccctgtcgctt

SEQ ID NO: 118265 - DNA, 35 bp, Artificial Sequence
  Synthetic oligonucleotide
gcctgtccaccgccgcttgttcgtaccgcatgcca

SEQ ID NO: 118266 - DNA, 37 bp, Artificial Sequence
  Synthetic oligonucleotide
gcaatccgacgggggggaaaggggcgatgggaacgga

SEQ ID NO: 118267 - DNA, 35 bp, Artificial Sequence
  Synthetic oligonucleotide
ttggggaacgatctggggtgggttgtaggggttac

SEQ ID NO: 118268 - DNA, 35 bp, Artificial Sequence
  Synthetic oligonucleotide
aagtgcgccagttagctccacgccgttgcctgtcc

SEQ ID NO: 118269 - DNA, 35 bp, Artificial Sequence
  Synthetic oligonucleotide
atgcatccatctggccccgacccgaggcacacctc

SEQ ID NO: 118270 - DNA, 35 bp, Artificial Sequence
  Synthetic oligonucleotide
aacgccacacgcgtgtatacccttcgcctccatcg

SEQ ID NO: 118271 - DNA, 35 bp, Artificial Sequence
  Synthetic oligonucleotide
tgtaaccctctccaactgccccccgttcctgatcg

SEQ ID NO: 118272 - DNA, 35 bp, Artificial Sequence
  Synthetic oligonucleotide
acatctcgacgccacacattcctcagtcatcgact

SEQ ID NO: 118273 - DNA, 35 bp, Artificial Sequence
  Synthetic oligonucleotide
aactcaatcgcctgaaaggtctatacctgtcctct

SEQ ID NO: 118274 - DNA, 35 bp, Artificial Sequence
  Synthetic oligonucleotide
ggggaagggtgggggcattagctggagcggaggca

SEQ ID NO: 118275 - DNA, 35 bp, Artificial Sequence
  Synthetic oligonucleotide
gattgcaccctagttccgtttaccctgcctgtgca

SEQ ID NO: 118276 - DNA, 37 bp, Artificial Sequence
  Synthetic oligonucleotide
tccaccacccccgtgattcgccagtctttcttctgga

SEQ ID NO: 118277 - DNA, 36 bp, Artificial Sequence
  Synthetic oligonucleotide
ccctccgcccggtaattgatacacccgccaacttga

SEQ ID NO: 118278 - DNA, 35 bp, Artificial Sequence
  Synthetic oligonucleotide
gaagctgcctcaaacaccgccgcgccccgacgacc

SEQ ID NO: 118279 - DNA, 35 bp, Artificial Sequence
  Synthetic oligonucleotide
acgatccatcgccgcccccttgttcacgataatgt

SEQ ID NO: 118280 - DNA, 35 bp, Artificial Sequence
  Synthetic oligonucleotide
gttagcaacgcccttgagccaccccccgctgacca

SEQ ID NO: 118281 - DNA, 35 bp, Artificial Sequence
  Synthetic oligonucleotide
gttccctcgcccacccatttatctaccgactacgt

SEQ ID NO: 118282 - DNA, 35 bp, Artificial Sequence
  Synthetic oligonucleotide
ttccatttcgctgcccctctcgtccggtctcggtt

SEQ ID NO: 118283 - DNA, 38 bp, Artificial Sequence
  Synthetic oligonucleotide
gatgtgtgtgggtggagggagggaagggacaggtatga

SEQ ID NO: 118284 - DNA, 37 bp, Artificial Sequence
  Synthetic oligonucleotide
ggactccctctgcctggtatcaccttttcgttcctga

SEQ ID NO: 118285 - DNA, 35 bp, Artificial Sequence
  Synthetic oligonucleotide
gtggctcggtaccgttcgtcgcttttctctgccac

SEQ ID NO: 118286 - DNA, 34 bp, Artificial Sequence
  Synthetic oligonucleotide
ggtcgctgccagctatccgctcactctcatccac

SEQ ID NO: 118287 - DNA, 35 bp, Artificial Sequence
  Synthetic oligonucleotide
agcaactgcaatcgtcgtcctcctgctcatgccgc

SEQ ID NO: 118288 - DNA, 35 bp, Artificial Sequence
  Synthetic oligonucleotide
tcacacctcaatttctgatcgctccacctttatgc

SEQ ID NO: 118289 - DNA, 35 bp, Artificial Sequence
  Synthetic oligonucleotide
tccctgccccgcgacgcgatactacttgtcttgtc

SEQ ID NO: 118290 - DNA, 35 bp, Artificial Sequence
  Synthetic oligonucleotide
gccgatctcctgtcttccaaccctcactttgtccg

SEQ ID NO: 118291 - DNA, 35 bp, Artificial Sequence
  Synthetic oligonucleotide
accacaccgcttacatagttttctgatcccgctgg

SEQ ID NO: 118292 - DNA, 35 bp, Artificial Sequence
  Synthetic oligonucleotide
gtccaccgcgtttctgacgcgtcgctaaatccctt

SEQ ID NO: 118293 - DNA, 37 bp, Artificial Sequence
  Synthetic oligonucleotide
tgctccgccaggtccgccttatccttcgccatactga

SEQ ID NO: 118294 - DNA, 35 bp, Artificial Sequence
  Synthetic oligonucleotide
tccgtgcagtgcacccctactgctgtttgtacccc

SEQ ID NO: 118295 - DNA, 35 bp, Artificial Sequence
  Synthetic oligonucleotide
gattcgcggacgcctgggtccttcgcccttcctgc

SEQ ID NO: 118296 - DNA, 35 bp, Artificial Sequence
  Synthetic oligonucleotide
tacaccccccttctcctacgcatgtacgagccttg

SEQ ID NO: 118297 - DNA, 35 bp, Artificial Sequence
  Synthetic oligonucleotide
gacgtgtagtgccgttctatctattgcgttcccat

SEQ ID NO: 118298 - DNA, 36 bp, Artificial Sequence
  Synthetic oligonucleotide
gtgtagccccgcccctgttcaagccccaagatcgca

SEQ ID NO: 118299 - DNA, 37 bp, Artificial Sequence
  Synthetic oligonucleotide
tgaagggcgggggtagaactggggaagggggtatcga

SEQ ID NO: 118300 - DNA, 37 bp, Artificial Sequence
  Synthetic oligonucleotide
gttccgggaggggttgtttggggtgtcgctctgggga

SEQ ID NO: 118301 - DNA, 38 bp, Artificial Sequence
  Synthetic oligonucleotide
acaccctcccgcggtatactggttctgttccctcctga

SEQ ID NO: 118302 - DNA, 37 bp, Artificial Sequence
  Synthetic oligonucleotide
tgggtacccacccgatcctgtttgctcctctccttga

SEQ ID NO: 118303 - DNA, 35 bp, Artificial Sequence
  Synthetic oligonucleotide
gacacccccttctcgctttgttttacttgtggtac

SEQ ID NO: 118304 - DNA, 35 bp, Artificial Sequence
  Synthetic oligonucleotide
tctggagcccatctcgtttcctttgcttcactgcc

SEQ ID NO: 118305 - DNA, 35 bp, Artificial Sequence
  Synthetic oligonucleotide
acacactttacacgctgcctccaccgaagcctcgc

SEQ ID NO: 118306 - DNA, 35 bp, Artificial Sequence
  Synthetic oligonucleotide
tagaaatgacgggggggtggagaagcgggacaacg

SEQ ID NO: 118307 - DNA, 35 bp, Artificial Sequence
  Synthetic oligonucleotide
tctgggcgggagaatgaaagggaggggtatcttat

SEQ ID NO: 118308 - DNA, 35 bp, Artificial Sequence
  Synthetic oligonucleotide
gctgtccgccattgtttgaaactcctcctccgcct

SEQ ID NO: 118309 - DNA, 36 bp, Artificial Sequence
  Synthetic oligonucleotide
gagggaacgatagggggagttgaggtagcgggtata

SEQ ID NO: 118310 - DNA, 35 bp, Artificial Sequence
  Synthetic oligonucleotide
tcacatccgcatttttcttattcctgctcgttgcc

SEQ ID NO: 118311 - DNA, 35 bp, Artificial Sequence
  Synthetic oligonucleotide
ggccaaacgcaccaccttgtgtaacccgcccccct

SEQ ID NO: 118312 - DNA, 35 bp, Artificial Sequence
  Synthetic oligonucleotide
ttggccacctacacacgttctcactgcaatacctt

SEQ ID NO: 118313 - DNA, 35 bp, Artificial Sequence
  Synthetic oligonucleotide
tcctccctagctccacctcgtagtatcacggtaca

SEQ ID NO: 118314 - DNA, 36 bp, Artificial Sequence
  Synthetic oligonucleotide
ttcggtcgtcgttacttgctttttcttgccgcccga

SEQ ID NO: 118315 - DNA, 36 bp, Artificial Sequence
  Synthetic oligonucleotide
gacggccccttgcctgcttttgttctttctgcacta

SEQ ID NO: 118316 - DNA, 35 bp, Artificial Sequence
  Synthetic oligonucleotide
gtccaccgcacctgccttcacaaactcattcgatc

SEQ ID NO: 118317 - DNA, 35 bp, Artificial Sequence
  Synthetic oligonucleotide
tccgacccctaggccttgttatcttgctctttctc

SEQ ID NO: 118318 - DNA, 35 bp, Artificial Sequence
  Synthetic oligonucleotide
gcgtgtccggccggcccccctctcctcacagtgtc

SEQ ID NO: 118319 - DNA, 35 bp, Artificial Sequence
  Synthetic oligonucleotide
gtgagagcgctgttcctttccgttattatgcccgt

SEQ ID NO: 118320 - DNA, 35 bp, Artificial Sequence
  Synthetic oligonucleotide
aactgccccccctccgtgttatcggctattgatca

SEQ ID NO: 118321 - DNA, 35 bp, Artificial Sequence
  Synthetic oligonucleotide
ttggaccgccaactacccgactcgagctccgtgcc

SEQ ID NO: 118322 - DNA, 35 bp, Artificial Sequence
  Synthetic oligonucleotide
tgtcgctgcacccgcctgactcccctctgttaagc

SEQ ID NO: 118323 - DNA, 35 bp, Artificial Sequence
  Synthetic oligonucleotide
tcagctcgtcactagtaccccgttcccctattggc

SEQ ID NO: 118324 - DNA, 35 bp, Artificial Sequence
  Synthetic oligonucleotide
tcgatcgcctcttcccggttgcattttggctcttt

SEQ ID NO: 118325 - DNA, 35 bp, Artificial Sequence
  Synthetic oligonucleotide
acttatcccgcctgccatgccgactcgttactttt

SEQ ID NO: 118326 - DNA, 36 bp, Artificial Sequence
  Synthetic oligonucleotide
tgacccgcatatatattgctatccgttcccctgtca

SEQ ID NO: 118327 - DNA, 36 bp, Artificial Sequence
  Synthetic oligonucleotide
acgagatgaccccgtgcgctattcgttacatcctta

SEQ ID NO: 118328 - DNA, 35 bp, Artificial Sequence
  Synthetic oligonucleotide
gcgtgaccgccccccccgtttatcgccttactgac

SEQ ID NO: 118329 - DNA, 35 bp, Artificial Sequence
  Synthetic oligonucleotide
aaagcgttgacgccctgaagcccgcccgatatccc

SEQ ID NO: 118330 - DNA, 35 bp, Artificial Sequence
  Synthetic oligonucleotide
gtgctagctccaggatccgccttcacgtccctgcc

SEQ ID NO: 118331 - DNA, 35 bp, Artificial Sequence
  Synthetic oligonucleotide
gttgcgccgttccttctgtcccttcgcctttgtat

SEQ ID NO: 118332 - DNA, 36 bp, Artificial Sequence
  Synthetic oligonucleotide
tgttcccagctggtatccattcgccgctccgcatca

SEQ ID NO: 118333 - DNA, 36 bp, Artificial Sequence
  Synthetic oligonucleotide
accacgggacaagggtggaggggatctgggccgaga

SEQ ID NO: 118334 - DNA, 35 bp, Artificial Sequence
  Synthetic oligonucleotide
tgacacctacctagtttgttcgacccctgcgctac

SEQ ID NO: 118335 - DNA, 35 bp, Artificial Sequence
  Synthetic oligonucleotide
gccccccggttctacgtgcccatggctcacccctc

SEQ ID NO: 118336 - DNA, 35 bp, Artificial Sequence
  Synthetic oligonucleotide
tcctacacgccgcaccttcctgcttttacatccat

SEQ ID NO: 118337 - DNA, 35 bp, Artificial Sequence
  Synthetic oligonucleotide
tgtcactgtcgccccctgggttcttccccctgctt

SEQ ID NO: 118338 - DNA, 36 bp, Artificial Sequence
  Synthetic oligonucleotide
gaagcccgctgccgttctagctactctttcttccca

SEQ ID NO: 118339 - DNA, 37 bp, Artificial Sequence
  Synthetic oligonucleotide
gccccctcctgcaattgcccgcttgtactgacgaaga

SEQ ID NO: 118340 - DNA, 37 bp, Artificial Sequence
  Synthetic oligonucleotide
gagggcggaggaaatagaatgcggggcatgtggagga

SEQ ID NO: 118341 - DNA, 37 bp, Artificial Sequence
  Synthetic oligonucleotide
acccaccttgctccagcgtactcccgccattccgtga

SEQ ID NO: 118342 - DNA, 35 bp, Artificial Sequence
  Synthetic oligonucleotide
acactctgtccccatgtcctatttcgtgcttcgtg

SEQ ID NO: 118343 - DNA, 31 bp, Artificial Sequence
  Synthetic oligonucleotide
gtcccgggccccactgtctgccgcctaccct

SEQ ID NO: 118344 - DNA, 35 bp, Artificial Sequence
  Synthetic oligonucleotide
tgtgcacattgatctgcctctctcaggacctccct

SEQ ID NO: 118345 - DNA, 35 bp, Artificial Sequence
  Synthetic oligonucleotide
gccggactccccctgatagtccttatacccttctt

SEQ ID NO: 118346 - DNA, 35 bp, Artificial Sequence
  Synthetic oligonucleotide
gcaagctcatagctgcccccttagtgccacctttt

SEQ ID NO: 118347 - DNA, 36 bp, Artificial Sequence
  Synthetic oligonucleotide
tcaacgggagggtagggggggactagtataaagaga

SEQ ID NO: 118348 - DNA, 37 bp, Artificial Sequence
  Synthetic oligonucleotide
atcattccccgctgcctcgccccgtcatcttctctga

SEQ ID NO: 118349 - DNA, 37 bp, Artificial Sequence
  Synthetic oligonucleotide
ttgtcgactcctgcttgacctttaacatcacctttga

SEQ ID NO: 118350 - DNA, 34 bp, Artificial Sequence
  Synthetic oligonucleotide
tcaagcgcgatctctggtccgaaccttcacgccc

SEQ ID NO: 118351 - DNA, 35 bp, Artificial Sequence
  Synthetic oligonucleotide
aacgctgctcccccccgccgcaacaatccctggtt

SEQ ID NO: 118352 - DNA, 36 bp, Artificial Sequence
  Synthetic oligonucleotide
tgattggtcactatctctgtcgctccctctgaacca

SEQ ID NO: 118353 - DNA, 34 bp, Artificial Sequence
  Synthetic oligonucleotide
tactcccccgcctcaccccggcccatacgggtca

SEQ ID NO: 118354 - DNA, 37 bp, Artificial Sequence
  Synthetic oligonucleotide
aagaccactgccccctgcgaaaatgaccgcacctcga

SEQ ID NO: 118355 - DNA, 37 bp, Artificial Sequence
  Synthetic oligonucleotide
tcagagggcgataaagggtcggaggggaagaagggga

SEQ ID NO: 118356 - DNA, 38 bp, Artificial Sequence
  Synthetic oligonucleotide
tctcgagagtagggaagggtggagaggagggggtgtga

SEQ ID NO: 118357 - DNA, 35 bp, Artificial Sequence
  Synthetic oligonucleotide
acgcctaccgcctggcacactgctccttttacccc

SEQ ID NO: 118358 - DNA, 35 bp, Artificial Sequence
  Synthetic oligonucleotide
tgtggcgagtattggcgcccctttttaaccgttcc

SEQ ID NO: 118359 - DNA, 34 bp, Artificial Sequence
  Synthetic oligonucleotide
acgtcactcatgcattttcacctcgctcgcacgc

SEQ ID NO: 118360 - DNA, 35 bp, Artificial Sequence
  Synthetic oligonucleotide
gtgcgcatctcggcctagctaccatggttcccccg

SEQ ID NO: 118361 - DNA, 35 bp, Artificial Sequence
  Synthetic oligonucleotide
gccacctcagcattttcaccttcgctctgtccatt

SEQ ID NO: 118362 - DNA, 35 bp, Artificial Sequence
  Synthetic oligonucleotide
gctgaagtggggattgtagggtacgggggggtgaa

SEQ ID NO: 118363 - DNA, 33 bp, Artificial Sequence
  Synthetic oligonucleotide
atcccttacacatcggcccccgcccctgcccca

SEQ ID NO: 118364 - DNA, 35 bp, Artificial Sequence
  Synthetic oligonucleotide
tcagccactgacttcccgtctctggatccctctca

SEQ ID NO: 118365 - DNA, 38 bp, Artificial Sequence
  Synthetic oligonucleotide
tttacggggaagggagggaggaagtgaagggggtgtga

SEQ ID NO: 118366 - DNA, 38 bp, Artificial Sequence
  Synthetic oligonucleotide
gaagaagccggggggtgtgggcgggacgtcttagttga

SEQ ID NO: 118367 - DNA, 35 bp, Artificial Sequence
  Synthetic oligonucleotide
tggacactgctctctacctatcccgctgccctgcc

SEQ ID NO: 118368 - DNA, 35 bp, Artificial Sequence
  Synthetic oligonucleotide
actgtacgtccacagtatgtgccgcctgttccccg

SEQ ID NO: 118369 - DNA, 35 bp, Artificial Sequence
  Synthetic oligonucleotide
aagccctgactcccgacgtcgctcgtccatttttg

SEQ ID NO: 118370 - DNA, 35 bp, Artificial Sequence
  Synthetic oligonucleotide
gaacaccccaccgctgcctatgctacaaagtagca

SEQ ID NO: 118371 - DNA, 35 bp, Artificial Sequence
  Synthetic oligonucleotide
gacgtaccccctcacgcccgttgtcgccccatgta

SEQ ID NO: 118372 - DNA, 35 bp, Artificial Sequence
  Synthetic oligonucleotide
gccccacccctccttgggccttaacctcttgagac

SEQ ID NO: 118373 - DNA, 35 bp, Artificial Sequence
  Synthetic oligonucleotide
tgcaccatgcacctgtaatatgcctcctctgatcc

SEQ ID NO: 118374 - DNA, 35 bp, Artificial Sequence
  Synthetic oligonucleotide
gacacggctccgacgtatcgaaacgcccgccttat

SEQ ID NO: 118375 - DNA, 35 bp, Artificial Sequence
  Synthetic oligonucleotide
tccactcgatgtgacccgttccctctattaaccgt

SEQ ID NO: 118376 - DNA, 35 bp, Artificial Sequence
  Synthetic oligonucleotide
gactcgggtgggcgatggggagggccactgaactt

SEQ ID NO: 118377 - DNA, 36 bp, Artificial Sequence
  Synthetic oligonucleotide
acctttgcaccatcgccttgtctctcccctgtcaca

SEQ ID NO: 118378 - DNA, 36 bp, Artificial Sequence
  Synthetic oligonucleotide
gtctcaccctcgatgccccgttgctcgttctcacca

SEQ ID NO: 118379 - DNA, 36 bp, Artificial Sequence
  Synthetic oligonucleotide
tccatgcctccccgctgttgaccctcctatgctcga

SEQ ID NO: 118380 - DNA, 37 bp, Artificial Sequence
  Synthetic oligonucleotide
tatgggcggagggcgaagggacggggttggtggagga

SEQ ID NO: 118381 - DNA, 37 bp, Artificial Sequence
  Synthetic oligonucleotide
tgaactccgccctgttcgcctccctctcggtttttga

SEQ ID NO: 118382 - DNA, 35 bp, Artificial Sequence
  Synthetic oligonucleotide
agacaatgtccgcactccagccccgtactatcatc

SEQ ID NO: 118383 - DNA, 35 bp, Artificial Sequence
  Synthetic oligonucleotide
tcgcgtgcctctcgctcccacatatgcctactttg

SEQ ID NO: 118384 - DNA, 35 bp, Artificial Sequence
  Synthetic oligonucleotide
gtggccgtcacgccacgaatcctgcccccttagct

SEQ ID NO: 118385 - DNA, 35 bp, Artificial Sequence
  Synthetic oligonucleotide
ggtagtcgggggggcggggagcaggggacgggtgt

SEQ ID NO: 118386 - DNA, 35 bp, Artificial Sequence
  Synthetic oligonucleotide
atcacatcacagctgtatgtctttacccctcttgt

SEQ ID NO: 118387 - DNA, 35 bp, Artificial Sequence
  Synthetic oligonucleotide
gtccgcgcaggatcccgtttctccctccctctcac

SEQ ID NO: 118388 - DNA, 35 bp, Artificial Sequence
  Synthetic oligonucleotide
ggtgagccgcctacatccgtctgcttcgccccccc

SEQ ID NO: 118389 - DNA, 35 bp, Artificial Sequence
  Synthetic oligonucleotide
tcatctcgttgctgtcttgttcttgtcctctggtc

SEQ ID NO: 118390 - DNA, 35 bp, Artificial Sequence
  Synthetic oligonucleotide
actgtccctccgccgtcttacttctactggtactt

SEQ ID NO: 118391 - DNA, 35 bp, Artificial Sequence
  Synthetic oligonucleotide
gaaacaggcgcgggaagcatgagggggcgggaaga

SEQ ID NO: 118392 - DNA, 37 bp, Artificial Sequence
  Synthetic oligonucleotide
gagtgcgggggaactgggtgaggcggatacgggcgga

SEQ ID NO: 118393 - DNA, 35 bp, Artificial Sequence
  Synthetic oligonucleotide
tcctcccgcatccctgtggatcgaagcttccctcc

SEQ ID NO: 118394 - DNA, 35 bp, Artificial Sequence
  Synthetic oligonucleotide
gtcaatccttgctccatctgttgcgcacgtttctc

SEQ ID NO: 118395 - DNA, 35 bp, Artificial Sequence
  Synthetic oligonucleotide
tccactgggccccattcgttacgctttctatcgct

SEQ ID NO: 118396 - DNA, 36 bp, Artificial Sequence
  Synthetic oligonucleotide
agtgagtggggcacgggggtggggtagaggaatgga

SEQ ID NO: 118397 - DNA, 38 bp, Artificial Sequence
  Synthetic oligonucleotide
gatggtcgtagccatgggggggataggggaggaaatga

SEQ ID NO: 118398 - DNA, 35 bp, Artificial Sequence
  Synthetic oligonucleotide
tgtacgatcacattgcgttgtccgtttccaccata

SEQ ID NO: 118399 - DNA, 35 bp, Artificial Sequence
  Synthetic oligonucleotide
tcatgtatccggtgctatcgtaggctcttcgctcc

SEQ ID NO: 118400 - DNA, 35 bp, Artificial Sequence
  Synthetic oligonucleotide
gtgcccagcctcccctcgtgctaccatccgtgagc

SEQ ID NO: 118401 - DNA, 35 bp, Artificial Sequence
  Synthetic oligonucleotide
ttcccccatgttcgttgtctcctggtccgcttagc

SEQ ID NO: 118402 - DNA, 34 bp, Artificial Sequence
  Synthetic oligonucleotide
ggacagcccctgccctttttttgcatgacccttc

SEQ ID NO: 118403 - DNA, 35 bp, Artificial Sequence
  Synthetic oligonucleotide
attccgcccacgatctcccgcgacacagaacgcct

SEQ ID NO: 118404 - DNA, 36 bp, Artificial Sequence
  Synthetic oligonucleotide
acactctccgctctgatgtcccctaccgcgtcccta

SEQ ID NO: 118405 - DNA, 35 bp, Artificial Sequence
  Synthetic oligonucleotide
gcgctcgcatgatctatgtctccggcccttcttac

SEQ ID NO: 118406 - DNA, 35 bp, Artificial Sequence
  Synthetic oligonucleotide
tgtccccgatgctctcccagtcccgcgagtttccc

SEQ ID NO: 118407 - DNA, 35 bp, Artificial Sequence
  Synthetic oligonucleotide
agtacccctgtccgcttgaccctctgaactgcgcc

SEQ ID NO: 118408 - DNA, 35 bp, Artificial Sequence
  Synthetic oligonucleotide
atcgccacttacttgttatttacactggcccgatc

SEQ ID NO: 118409 - DNA, 35 bp, Artificial Sequence
  Synthetic oligonucleotide
gtcaaagcccgatctagtatctgtcctgcccttac

SEQ ID NO: 118410 - DNA, 35 bp, Artificial Sequence
  Synthetic oligonucleotide
gccccatctgcccaacgcgagcgcttaagccccgc

SEQ ID NO: 118411 - DNA, 35 bp, Artificial Sequence
  Synthetic oligonucleotide
gccactatccctgctattgaccgttagtccactgc

SEQ ID NO: 118412 - DNA, 35 bp, Artificial Sequence
  Synthetic oligonucleotide
tgatcgcgtcccgagtaccgcccccgtcgtctgtc

SEQ ID NO: 118413 - DNA, 36 bp, Artificial Sequence
  Synthetic oligonucleotide
acacctgccctatcatctccgccatagagagacttc

SEQ ID NO: 118414 - DNA, 35 bp, Artificial Sequence
  Synthetic oligonucleotide
gaccacgaccttgtccttttggcctttccagtttc

SEQ ID NO: 118415 - DNA, 36 bp, Artificial Sequence
  Synthetic oligonucleotide
tcgattcgacatcctcccccggttcctcccaacggt

SEQ ID NO: 118416 - DNA, 36 bp, Artificial Sequence
  Synthetic oligonucleotide
tcagtcctgtccgttcgccctatccttccgtatcaa

SEQ ID NO: 118417 - DNA, 35 bp, Artificial Sequence
  Synthetic oligonucleotide
tccactgtagcgcaactgtccatcgccccttgtaa

SEQ ID NO: 118418 - DNA, 35 bp, Artificial Sequence
  Synthetic oligonucleotide
acccccagccggctcccctcgtgctatactcccga

SEQ ID NO: 118419 - DNA, 37 bp, Artificial Sequence
  Synthetic oligonucleotide
tgcatccctctcgttgttgtttctcttctcctccgga

SEQ ID NO: 118420 - DNA, 34 bp, Artificial Sequence
  Synthetic oligonucleotide
ttgccgttgctccgacgtatgtttctcgcctacc

SEQ ID NO: 118421 - DNA, 35 bp, Artificial Sequence
  Synthetic oligonucleotide
aatggcacactgcatgctcttttgtcgctctcatc

SEQ ID NO: 118422 - DNA, 35 bp, Artificial Sequence
  Synthetic oligonucleotide
tagtgcgtcccgtttgtctccgcgttctccacttc

SEQ ID NO: 118423 - DNA, 35 bp, Artificial Sequence
  Synthetic oligonucleotide
taccacccgccaactgacacctacattagatctat

SEQ ID NO: 118424 - DNA, 35 bp, Artificial Sequence
  Synthetic oligonucleotide
gcccaacctcggcaatcgtgccaatctcttcctgt

SEQ ID NO: 118425 - DNA, 35 bp, Artificial Sequence
  Synthetic oligonucleotide
gtgacccgccttccgccaatcgacgcaatcgcttt

SEQ ID NO: 118426 - DNA, 35 bp, Artificial Sequence
  Synthetic oligonucleotide
attggtcggcgtactgtgcctctccttctcgttcc

SEQ ID NO: 118427 - DNA, 35 bp, Artificial Sequence
  Synthetic oligonucleotide
gcctcacagtgagctccctctacccccctacgggc

SEQ ID NO: 118428 - DNA, 35 bp, Artificial Sequence
  Synthetic oligonucleotide
attgcaccgcttgtgtttttcgatttcccgccgtc

SEQ ID NO: 118429 - DNA, 35 bp, Artificial Sequence
  Synthetic oligonucleotide
acgacaaaaagagtggggaatgcggggagaggggg

SEQ ID NO: 118430 - DNA, 35 bp, Artificial Sequence
  Synthetic oligonucleotide
accctccgccctgccccctggtactttgacgccaa

SEQ ID NO: 118431 - DNA, 36 bp, Artificial Sequence
  Synthetic oligonucleotide
acacgaagcctcccgatttcgccgtaactttctcca

SEQ ID NO: 118432 - DNA, 36 bp, Artificial Sequence
  Synthetic oligonucleotide
aaggaggggcatggatagcagggggtgggaggtcga

SEQ ID NO: 118433 - DNA, 35 bp, Artificial Sequence
  Synthetic oligonucleotide
gtgagaaggaccggaatggggtgggtgaagcagga

SEQ ID NO: 118434 - DNA, 35 bp, Artificial Sequence
  Synthetic oligonucleotide
acccctgctctctgcttttttcccccagtgatccc

SEQ ID NO: 118435 - DNA, 35 bp, Artificial Sequence
  Synthetic oligonucleotide
gtcctactcccccgtccatggccagatcctgcctc

SEQ ID NO: 118436 - DNA, 35 bp, Artificial Sequence
  Synthetic oligonucleotide
aagcgtagcgatcaagtatcaccgccgcccccttc

SEQ ID NO: 118437 - DNA, 36 bp, Artificial Sequence
  Synthetic oligonucleotide
ttgcctcccaaatccctatgagtcccctgctttaca

SEQ ID NO: 118438 - DNA, 36 bp, Artificial Sequence
  Synthetic oligonucleotide
acgcgccacagaccccgcgctcactcctttctggca

SEQ ID NO: 118439 - DNA, 37 bp, Artificial Sequence
  Synthetic oligonucleotide
tgtggtgggagtgagggtaaaacggcaagggaacgga

SEQ ID NO: 118440 - DNA, 35 bp, Artificial Sequence
  Synthetic oligonucleotide
tcatccccattgggttcctgtgctaacctgcctta

SEQ ID NO: 118441 - DNA, 35 bp, Artificial Sequence
  Synthetic oligonucleotide
gcgatcctccgcattctactacctcacagtcccac

SEQ ID NO: 118442 - DNA, 35 bp, Artificial Sequence
  Synthetic oligonucleotide
taacacagacacactcgtatttggtccgcttttcc

SEQ ID NO: 118443 - DNA, 35 bp, Artificial Sequence
  Synthetic oligonucleotide
taccccctgtcctgtccgccaaagtaagttcccgc

SEQ ID NO: 118444 - DNA, 35 bp, Artificial Sequence
  Synthetic oligonucleotide
tccatcccgtaatgtcttcacgcttccatttctgt

SEQ ID NO: 118445 - DNA, 35 bp, Artificial Sequence
  Synthetic oligonucleotide
atcgacctctccccgccgtgtctttcactcctgtt

SEQ ID NO: 118446 - DNA, 36 bp, Artificial Sequence
  Synthetic oligonucleotide
actgtactcctccattctgcgccccaacctcgcgga

SEQ ID NO: 118447 - DNA, 35 bp, Artificial Sequence
  Synthetic oligonucleotide
acgccccatctgcctgatctattgtcttttcccac

SEQ ID NO: 118448 - DNA, 35 bp, Artificial Sequence
  Synthetic oligonucleotide
tcgagaagtagcgcgttttatgctcccccccccgc

SEQ ID NO: 118449 - DNA, 35 bp, Artificial Sequence
  Synthetic oligonucleotide
gaacggccccgctcgctttctttctagctcacttc

SEQ ID NO: 118450 - DNA, 35 bp, Artificial Sequence
  Synthetic oligonucleotide
gtcatggtggggggtaagaaggggggtcggtcacg

SEQ ID NO: 118451 - DNA, 35 bp, Artificial Sequence
  Synthetic oligonucleotide
gctgacagagtcaacacgctacccgtctcccctcg

SEQ ID NO: 118452 - DNA, 35 bp, Artificial Sequence
  Synthetic oligonucleotide
acccatgcctccgaatgtccggaattaccacccct

SEQ ID NO: 118453 - DNA, 35 bp, Artificial Sequence
  Synthetic oligonucleotide
tgatcgcgactatgctcccttccgccgtacaagct

SEQ ID NO: 118454 - DNA, 38 bp, Artificial Sequence
  Synthetic oligonucleotide
tcaggggtgggaggggaggaccaaagtgggcagtaaga

SEQ ID NO: 118455 - DNA, 36 bp, Artificial Sequence
  Synthetic oligonucleotide
tgcacccgccattctggttgccttacgtatttccta

SEQ ID NO: 118456 - DNA, 35 bp, Artificial Sequence
  Synthetic oligonucleotide
atttgcccccccagttcctgagtagctacttttac

SEQ ID NO: 118457 - DNA, 35 bp, Artificial Sequence
  Synthetic oligonucleotide
accaccgtccgaatgtgcttgttacctatcctccc

SEQ ID NO: 118458 - DNA, 36 bp, Artificial Sequence
  Synthetic oligonucleotide
gaccccgcccttgcgagttgtgccactgcctcacca

SEQ ID NO: 118459 - DNA, 36 bp, Artificial Sequence
  Synthetic oligonucleotide
ttggtccccgcccaaccgatctggtacacctcctca

SEQ ID NO: 118460 - DNA, 35 bp, Artificial Sequence
  Synthetic oligonucleotide
tgaccccccatttgcgccctttatgctctccgcac

SEQ ID NO: 118461 - DNA, 35 bp, Artificial Sequence
  Synthetic oligonucleotide
ttgtcccatccctcagcgtgtaatcgtactattac

SEQ ID NO: 118462 - DNA, 35 bp, Artificial Sequence
  Synthetic oligonucleotide
gttaggcgctcagttttcaccgtctgcccgcttcc

SEQ ID NO: 118463 - DNA, 35 bp, Artificial Sequence
  Synthetic oligonucleotide
tcctcatcccccagtggatcctcccattcgtgtgc

SEQ ID NO: 118464 - DNA, 35 bp, Artificial Sequence
  Synthetic oligonucleotide
acaccgtacctctccgctacaccatcgctcacggg

SEQ ID NO: 118465 - DNA, 35 bp, Artificial Sequence
  Synthetic oligonucleotide
aaacaggcgcctccgcttcctacttcaccttcatg

SEQ ID NO: 118466 - DNA, 36 bp, Artificial Sequence
  Synthetic oligonucleotide
ttgcccccgccccatttttggacctcgacaccccaa

SEQ ID NO: 118467 - DNA, 36 bp, Artificial Sequence
  Synthetic oligonucleotide
ttgggggagggggtcgggtcggaggggtggcgtgaa

SEQ ID NO: 118468 - DNA, 35 bp, Artificial Sequence
  Synthetic oligonucleotide
gaccccttccgacgctatgcctccttcgccttaca

SEQ ID NO: 118469 - DNA, 35 bp, Artificial Sequence
  Synthetic oligonucleotide
ggttgcacgttcctagcattgcccccgctcccgcc

SEQ ID NO: 118470 - DNA, 36 bp, Artificial Sequence
  Synthetic oligonucleotide
tccctcaccctctccgtccttggccctcccaagcca

SEQ ID NO: 118471 - DNA, 38 bp, Artificial Sequence
  Synthetic oligonucleotide
atgcgaaggaggacacggggtgaaggggcggaaagtga

SEQ ID NO: 118472 - DNA, 35 bp, Artificial Sequence
  Synthetic oligonucleotide
gtgcaccacaactcactccgcccgcaagccggtcc

SEQ ID NO: 118473 - DNA, 35 bp, Artificial Sequence
  Synthetic oligonucleotide
gtcccctcccgcggagcttaacgacttctttttgc

SEQ ID NO: 118474 - DNA, 35 bp, Artificial Sequence
  Synthetic oligonucleotide
tcacacacccaccctgcgtacaccccgaccccatg

SEQ ID NO: 118475 - DNA, 35 bp, Artificial Sequence
  Synthetic oligonucleotide
atgtcaccatgctccatctcgatccgccactctgt

SEQ ID NO: 118476 - DNA, 36 bp, Artificial Sequence
  Synthetic oligonucleotide
aacgtcccctgcctgcctccatagattcgttttgta

SEQ ID NO: 118477 - DNA, 35 bp, Artificial Sequence
  Synthetic oligonucleotide
ggtgggggggtgggtgcgggtagtgaacataatta

SEQ ID NO: 118478 - DNA, 35 bp, Artificial Sequence
  Synthetic oligonucleotide
accgctcacccagcagagcacgccctgacctacac

SEQ ID NO: 118479 - DNA, 35 bp, Artificial Sequence
  Synthetic oligonucleotide
gtcgacgacaactgccttcctccctgcgggcttac

SEQ ID NO: 118480 - DNA, 35 bp, Artificial Sequence
  Synthetic oligonucleotide
gtttcgtaagccctgtgcgttctccccttgctccc

SEQ ID NO: 118481 - DNA, 35 bp, Artificial Sequence
  Synthetic oligonucleotide
tactacgcccgcttttggcttaaactccacctatc

SEQ ID NO: 118482 - DNA, 35 bp, Artificial Sequence
  Synthetic oligonucleotide
acacaagctggtggagggaaggtgaggatgcagct

SEQ ID NO: 118483 - DNA, 35 bp, Artificial Sequence
  Synthetic oligonucleotide
acgccccttcacttcttgtcctatcgcccgtgatt

SEQ ID NO: 118484 - DNA, 36 bp, Artificial Sequence
  Synthetic oligonucleotide
accctcttccacccctgtttctatttgtgactcaca

SEQ ID NO: 118485 - DNA, 37 bp, Artificial Sequence
  Synthetic oligonucleotide
tcgcacacccccctctgtataccatcgagctccccga

SEQ ID NO: 118486 - DNA, 35 bp, Artificial Sequence
  Synthetic oligonucleotide
gtacccatcctccttcgatgaacatgcctgtttcc

SEQ ID NO: 118487 - DNA, 35 bp, Artificial Sequence
  Synthetic oligonucleotide
tgtccgcaacctgtcctttgctcatcctgccactc

SEQ ID NO: 118488 - DNA, 35 bp, Artificial Sequence
  Synthetic oligonucleotide
acctccgtcgcacattctgtctctctagcctactg

SEQ ID NO: 118489 - DNA, 35 bp, Artificial Sequence
  Synthetic oligonucleotide
tcctcaacagccgtactgcccgtttctgtgccctg

SEQ ID NO: 118490 - DNA, 35 bp, Artificial Sequence
  Synthetic oligonucleotide
aatgcgccctcaccccagctgctttatcttccgct

SEQ ID NO: 118491 - DNA, 35 bp, Artificial Sequence
  Synthetic oligonucleotide
tggaggtggaggggggtggcaccagtggtggatct

SEQ ID NO: 118492 - DNA, 35 bp, Artificial Sequence
  Synthetic oligonucleotide
tgccaaaccccccccctcgcctctgccacccatgt

SEQ ID NO: 118493 - DNA, 36 bp, Artificial Sequence
  Synthetic oligonucleotide
gttcaccagctgtaccactgataccctgcctttcca

SEQ ID NO: 118494 - DNA, 37 bp, Artificial Sequence
  Synthetic oligonucleotide
agaggagggcgggggtgatggcgcaggcaggctaaga

SEQ ID NO: 118495 - DNA, 35 bp, Artificial Sequence
  Synthetic oligonucleotide
gttccacacagcaacgtcgtccccctcgtccacgc

SEQ ID NO: 118496 - DNA, 35 bp, Artificial Sequence
  Synthetic oligonucleotide
tcctccggtacagatctgcctcgctaccgtttgtc

SEQ ID NO: 118497 - DNA, 35 bp, Artificial Sequence
  Synthetic oligonucleotide
tccctgccctcactcgctctacgccgattccacgt

SEQ ID NO: 118498 - DNA, 38 bp, Artificial Sequence
  Synthetic oligonucleotide
tccgaggggaaggatttggcggggagggcgggacgtga

SEQ ID NO: 118499 - DNA, 36 bp, Artificial Sequence
  Synthetic oligonucleotide
gggtgggtgccgggtgggtcaattgaggcctcttga

SEQ ID NO: 118500 - DNA, 35 bp, Artificial Sequence
  Synthetic oligonucleotide
tgactcggccctgctgcctacttcgccataaacac

SEQ ID NO: 118501 - DNA, 35 bp, Artificial Sequence
  Synthetic oligonucleotide
tgttacccatcgaccccccccgtctgtctcgccac

SEQ ID NO: 118502 - DNA, 35 bp, Artificial Sequence
  Synthetic oligonucleotide
aactcccgctccatgcttctcccagcccctctgcc

SEQ ID NO: 118503 - DNA, 35 bp, Artificial Sequence
  Synthetic oligonucleotide
tccctcccgttggtctttgcctgtgcccccgtcgc

SEQ ID NO: 118504 - DNA, 35 bp, Artificial Sequence
  Synthetic oligonucleotide
actacctcccccgttggtcgactggttttgctctc

SEQ ID NO: 118505 - DNA, 35 bp, Artificial Sequence
  Synthetic oligonucleotide
gagcactctcgcgccgttcgacttattcccttacg

SEQ ID NO: 118506 - DNA, 35 bp, Artificial Sequence
  Synthetic oligonucleotide
accccctcccatccaccacgacgttcttcgcggat

SEQ ID NO: 118507 - DNA, 35 bp, Artificial Sequence
  Synthetic oligonucleotide
gggggcggggcggggagggcgggtagtgccaagct

SEQ ID NO: 118508 - DNA, 35 bp, Artificial Sequence
  Synthetic oligonucleotide
aacccccgacccgaggcgcttaacagtcccgtttt

SEQ ID NO: 118509 - DNA, 36 bp, Artificial Sequence
  Synthetic oligonucleotide
gccttcgccgccttaaggtcgtacctccgcctacca

SEQ ID NO: 118510 - DNA, 37 bp, Artificial Sequence
  Synthetic oligonucleotide
ggagtggggggttacgggaaacaggaggacggcggga

SEQ ID NO: 118511 - DNA, 35 bp, Artificial Sequence
  Synthetic oligonucleotide
tagcccccgcctaatcttgaaacaaagcactacct

SEQ ID NO: 118512 - DNA, 36 bp, Artificial Sequence
  Synthetic oligonucleotide
tggttgctcagtgcccgctttactcgcccgttccta

SEQ ID NO: 118513 - DNA, 35 bp, Artificial Sequence
  Synthetic oligonucleotide
taacagtcaatcccctcatgcgctcccgtcaagcc

SEQ ID NO: 118514 - DNA, 38 bp, Artificial Sequence
  Synthetic oligonucleotide
tccggacaacccacctgatttctcgcccccgcccgtga

SEQ ID NO: 118515 - DNA, 35 bp, Artificial Sequence
  Synthetic oligonucleotide
acctgtcaccggtcttagtcctttaagcttcctcc

SEQ ID NO: 118516 - DNA, 35 bp, Artificial Sequence
  Synthetic oligonucleotide
aggacggctgccgacctgctccacacaccactcgc

SEQ ID NO: 118517 - DNA, 35 bp, Artificial Sequence
  Synthetic oligonucleotide
actcagtaacacatacttgtcatttgccgcccttc

SEQ ID NO: 118518 - DNA, 35 bp, Artificial Sequence
  Synthetic oligonucleotide
tgcctacttgctgatccttgttcgacctctagcct

SEQ ID NO: 118519 - DNA, 36 bp, Artificial Sequence
  Synthetic oligonucleotide
tttcaaccctcctgccgttctaggaccatcttcgca

SEQ ID NO: 118520 - DNA, 37 bp, Artificial Sequence
  Synthetic oligonucleotide
gagggggtagagaggtaggggcaagggtaccggcaga

SEQ ID NO: 118521 - DNA, 35 bp, Artificial Sequence
  Synthetic oligonucleotide
tgcccctcactgattgctccccgaatcgctctcga

SEQ ID NO: 118522 - DNA, 35 bp, Artificial Sequence
  Synthetic oligonucleotide
ttccccgtccctgctctctccgatccacgatgtta

SEQ ID NO: 118523 - DNA, 35 bp, Artificial Sequence
  Synthetic oligonucleotide
cactgaagagcgccgtttacataccgccccccgcg

SEQ ID NO: 118524 - DNA, 35 bp, Artificial Sequence
  Synthetic oligonucleotide
ggatccgccgggccccataacatcctacaaccgtg

SEQ ID NO: 118525 - DNA, 35 bp, Artificial Sequence
  Synthetic oligonucleotide
taccatggccgtcggtcctcgttccccatctttgt

SEQ ID NO: 118526 - DNA, 36 bp, Artificial Sequence
  Synthetic oligonucleotide
tcacttcccggccgtttcggttccgcccccgccgca

SEQ ID NO: 118527 - DNA, 35 bp, Artificial Sequence
  Synthetic oligonucleotide
tctaccctctctccgttgtaattgcgacgcaccta

SEQ ID NO: 118528 - DNA, 36 bp, Artificial Sequence
  Synthetic oligonucleotide
gcccaccgccatgccccgtccattctaggaatcgta

SEQ ID NO: 118529 - DNA, 35 bp, Artificial Sequence
  Synthetic oligonucleotide
tatgtgcctgccctccaattggttgctatccccgc

SEQ ID NO: 118530 - DNA, 35 bp, Artificial Sequence
  Synthetic oligonucleotide
actgccgtcgcagccgctgttatgtccctctacct

SEQ ID NO: 118531 - DNA, 35 bp, Artificial Sequence
  Synthetic oligonucleotide
tcccccgttcccgcttatttgcctttatgcaggca

SEQ ID NO: 118532 - DNA, 38 bp, Artificial Sequence
  Synthetic oligonucleotide
gacaagagacaggagatggacagcgggagggggaatga

SEQ ID NO: 118533 - DNA, 38 bp, Artificial Sequence
  Synthetic oligonucleotide
gagagcgcagatcatacctccggcctctccttccctga

SEQ ID NO: 118534 - DNA, 35 bp, Artificial Sequence
  Synthetic oligonucleotide
tccaacgtgctttgtagctccctgtatccccatcc

SEQ ID NO: 118535 - DNA, 35 bp, Artificial Sequence
  Synthetic oligonucleotide
tcgtgacatcccccccacagtctatattaggcctc

SEQ ID NO: 118536 - DNA, 35 bp, Artificial Sequence
  Synthetic oligonucleotide
atgtctgccgaatctctcgctcttagtcctgtccg

SEQ ID NO: 118537 - DNA, 35 bp, Artificial Sequence
  Synthetic oligonucleotide
tcttggcccactcttgctttccgattagctgccct

SEQ ID NO: 118538 - DNA, 35 bp, Artificial Sequence
  Synthetic oligonucleotide
tccactacacccgcaccgacaaaaggtcggccctt

SEQ ID NO: 118539 - DNA, 36 bp, Artificial Sequence
  Synthetic oligonucleotide
tgttgacccgccacgttcccttcccctgtgtgtaca

SEQ ID NO: 118540 - DNA, 37 bp, Artificial Sequence
  Synthetic oligonucleotide
acaccttcgcactttgacctgctgacccgtctcccga

SEQ ID NO: 118541 - DNA, 35 bp, Artificial Sequence
  Synthetic oligonucleotide
gtgcctcgctacatctaacgtcctgcctgccgtac

SEQ ID NO: 118542 - DNA, 35 bp, Artificial Sequence
  Synthetic oligonucleotide
tcacaagaggccggaggggggagatagaggcgccg

SEQ ID NO: 118543 - DNA, 35 bp, Artificial Sequence
  Synthetic oligonucleotide
gcactcgccggtgaattcgcttggccttcctcttt

SEQ ID NO: 118544 - DNA, 36 bp, Artificial Sequence
  Synthetic oligonucleotide
gacaccccggatggcacactccccgtttttacgcca

SEQ ID NO: 118545 - DNA, 35 bp, Artificial Sequence
  Synthetic oligonucleotide
gctatctgcctcactttcttctcgccggtaaagcc

SEQ ID NO: 118546 - DNA, 35 bp, Artificial Sequence
  Synthetic oligonucleotide
gtcaagccactgattctcaccatcaagccgccact

SEQ ID NO: 118547 - DNA, 35 bp, Artificial Sequence
  Synthetic oligonucleotide
gacgcattcgggtcgggatggggagggacgcttaa

SEQ ID NO: 118548 - DNA, 37 bp, Artificial Sequence
  Synthetic oligonucleotide
gaggggggtgacgaggggctgaagcgaggtggaaaga

SEQ ID NO: 118549 - DNA, 34 bp, Artificial Sequence
  Synthetic oligonucleotide
gcaagagggaccggggcaaaagatgggattggga

SEQ ID NO: 118550 - DNA, 38 bp, Artificial Sequence
  Synthetic oligonucleotide
ttgctgggaagggcgggagggaagacggggggtgctga

SEQ ID NO: 118551 - DNA, 38 bp, Artificial Sequence
  Synthetic oligonucleotide
atccacggaaggaggaggaatggggaggcatagggtga

SEQ ID NO: 118552 - DNA, 35 bp, Artificial Sequence
  Synthetic oligonucleotide
tccgctcctgctagccctacctccgccgtatatcc

SEQ ID NO: 118553 - DNA, 35 bp, Artificial Sequence
  Synthetic oligonucleotide
ttcgctccctggtactgcaatgtcattctgcccct

SEQ ID NO: 118554 - DNA, 35 bp, Artificial Sequence
  Synthetic oligonucleotide
ttcaccttctactgtcattagcctggtcttcatct

SEQ ID NO: 118555 - DNA, 36 bp, Artificial Sequence
  Synthetic oligonucleotide
gacgacgtggagcagggaggggcaatttggcgaaga

SEQ ID NO: 118556 - DNA, 35 bp, Artificial Sequence
  Synthetic oligonucleotide
tccccgtgacccctccatcggcgttttgaccccct

SEQ ID NO: 118557 - DNA, 35 bp, Artificial Sequence
  Synthetic oligonucleotide
gtacttcctctcatgtgcacctgccaccaacttgt

SEQ ID NO: 118558 - DNA, 37 bp, Artificial Sequence
  Synthetic oligonucleotide
tctacctccatcgattgcaccttcgcccttttgtcga

SEQ ID NO: 118559 - DNA, 35 bp, Artificial Sequence
  Synthetic oligonucleotide
tcctcatcgcccctcttgcacatgtcatcgcccta

SEQ ID NO: 118560 - DNA, 35 bp, Artificial Sequence
  Synthetic oligonucleotide
acatcgccgtgcacttggatcttgctcattacacc

SEQ ID NO: 118561 - DNA, 35 bp, Artificial Sequence
  Synthetic oligonucleotide
gcaacgccccccctgtcatccctcctccgtgctcg

SEQ ID NO: 118562 - DNA, 35 bp, Artificial Sequence
  Synthetic oligonucleotide
agccgcccgcacctccccccaggccttgttgccat

SEQ ID NO: 118563 - DNA, 35 bp, Artificial Sequence
  Synthetic oligonucleotide
actcctccgcaccatgtacccaatccgtgtaactt

SEQ ID NO: 118564 - DNA, 35 bp, Artificial Sequence
  Synthetic oligonucleotide
ggatcagttccggtcgtctgtcctggctccacctt

SEQ ID NO: 118565 - DNA, 36 bp, Artificial Sequence
  Synthetic oligonucleotide
tccttcctcaaactgtactaatggcctccgatccca

SEQ ID NO: 118566 - DNA, 35 bp, Artificial Sequence
  Synthetic oligonucleotide
tcgaccacccacagctccctctccgttgcgtctcc

SEQ ID NO: 118567 - DNA, 35 bp, Artificial Sequence
  Synthetic oligonucleotide
gccccacgcccccgtttccccttcaccacctgggg

SEQ ID NO: 118568 - DNA, 35 bp, Artificial Sequence
  Synthetic oligonucleotide
ttccgcccaattgccccgatcccatcctccgtgtg

SEQ ID NO: 118569 - DNA, 35 bp, Artificial Sequence
  Synthetic oligonucleotide
aatcacgtccaggttaccctcccctcccctacggt

SEQ ID NO: 118570 - DNA, 35 bp, Artificial Sequence
  Synthetic oligonucleotide
gcactgctccgtactccccccacccacgtgcgtaa

SEQ ID NO: 118571 - DNA, 35 bp, Artificial Sequence
  Synthetic oligonucleotide
ggtggtcgactcgttttacgcctgctccctgtcac

SEQ ID NO: 118572 - DNA, 35 bp, Artificial Sequence
  Synthetic oligonucleotide
atccccaccctccccctgtgtgcacttgcgaaacc

SEQ ID NO: 118573 - DNA, 35 bp, Artificial Sequence
  Synthetic oligonucleotide
tccttagcccgccccttctcagacacccaatggcc

SEQ ID NO: 118574 - DNA, 35 bp, Artificial Sequence
  Synthetic oligonucleotide
gtcactcccctagcccgtgtctatcgctctggatc

SEQ ID NO: 118575 - DNA, 36 bp, Artificial Sequence
  Synthetic oligonucleotide
acgactcggcctcatcccctgtcaaagtaaccgcca

SEQ ID NO: 118576 - DNA, 34 bp, Artificial Sequence
  Synthetic oligonucleotide
tactgcctcctgacctcttcggttttgttcacac

SEQ ID NO: 118577 - DNA, 35 bp, Artificial Sequence
  Synthetic oligonucleotide
tgcctagggccacctcgtgctaacgctttcgctct

SEQ ID NO: 118578 - DNA, 35 bp, Artificial Sequence
  Synthetic oligonucleotide
gggagggtgagaaaccgcgggtaagggtggtggaa

SEQ ID NO: 118579 - DNA, 35 bp, Artificial Sequence
  Synthetic oligonucleotide
tgtgacccacacggtaccagcgaactgccgccctc

SEQ ID NO: 118580 - DNA, 35 bp, Artificial Sequence
  Synthetic oligonucleotide
gcccctgcctgcctacatttatttcgcgtacaccg

SEQ ID NO: 118581 - DNA, 35 bp, Artificial Sequence
  Synthetic oligonucleotide
ggacactccgacgctgcctacccgccgatgcctcg

SEQ ID NO: 118582 - DNA, 35 bp, Artificial Sequence
  Synthetic oligonucleotide
agccctcttcggcgtgttcccgttctctgcccttt

SEQ ID NO: 118583 - DNA, 35 bp, Artificial Sequence
  Synthetic oligonucleotide
acacctgcctcatacgacgctgtatgcgtcccgcc

SEQ ID NO: 118584 - DNA, 36 bp, Artificial Sequence
  Synthetic oligonucleotide
gcgaactcccgcctggccccaagatcctgctgaaca

SEQ ID NO: 118585 - DNA, 38 bp, Artificial Sequence
  Synthetic oligonucleotide
ttgaccctgctccttttgcgccgcgccatgtcccatga

SEQ ID NO: 118586 - DNA, 35 bp, Artificial Sequence
  Synthetic oligonucleotide
tgtccccgctatcgtaagcccagttccggccatcc

SEQ ID NO: 118587 - DNA, 37 bp, Artificial Sequence
  Synthetic oligonucleotide
gacggggtgatcagtaatgggtgggtgcctatcggga

SEQ ID NO: 118588 - DNA, 35 bp, Artificial Sequence
  Synthetic oligonucleotide
aacgagggtggagggggataacattttggtggtga

SEQ ID NO: 118589 - DNA, 36 bp, Artificial Sequence
  Synthetic oligonucleotide
gcagggagcaaggatgggcacgggggggggaaggta

SEQ ID NO: 118590 - DNA, 35 bp, Artificial Sequence
  Synthetic oligonucleotide
gagccccatcgccatctgacttacgtcgcaattac

SEQ ID NO: 118591 - DNA, 35 bp, Artificial Sequence
  Synthetic oligonucleotide
aacgtgaccacgcccccctcgctcttatcagttac

SEQ ID NO: 118592 - DNA, 35 bp, Artificial Sequence
  Synthetic oligonucleotide
gtacctcctccgactgtacctataatgccctgccc

SEQ ID NO: 118593 - DNA, 35 bp, Artificial Sequence
  Synthetic oligonucleotide
tacacccctgccgtgaccgcccggatgctcccctc

SEQ ID NO: 118594 - DNA, 35 bp, Artificial Sequence
  Synthetic oligonucleotide
accttcagcaggccatctctgcgcatattgttccg

SEQ ID NO: 118595 - DNA, 35 bp, Artificial Sequence
  Synthetic oligonucleotide
taaaatgcgccgaccgttacaccatgcttccatct

SEQ ID NO: 118596 - DNA, 35 bp, Artificial Sequence
  Synthetic oligonucleotide
tacgccctcggttcaattaagttctgttctctgtt

SEQ ID NO: 118597 - DNA, 35 bp, Artificial Sequence
  Synthetic oligonucleotide
ttgaccaagccgcattattactcctccgcacatgc

SEQ ID NO: 118598 - DNA, 35 bp, Artificial Sequence
  Synthetic oligonucleotide
tccgacggcctcgctttatttttccgtacgttgtc

SEQ ID NO: 118599 - DNA, 36 bp, Artificial Sequence
  Synthetic oligonucleotide
ttccaccccgcctccattttcagtacggccttcgaa

SEQ ID NO: 118600 - DNA, 35 bp, Artificial Sequence
  Synthetic oligonucleotide
tcactccatgatcgtgttacctcccccgccaccca

SEQ ID NO: 118601 - DNA, 35 bp, Artificial Sequence
  Synthetic oligonucleotide
agcgtgcgcccgcacctctctgtttacgcccctga

SEQ ID NO: 118602 - DNA, 35 bp, Artificial Sequence
  Synthetic oligonucleotide
gtccccccgaatgcatcaccgtacactgccgtccc

SEQ ID NO: 118603 - DNA, 35 bp, Artificial Sequence
  Synthetic oligonucleotide
gccaccaccgcccttagtgtacgtccaactcctgc

SEQ ID NO: 118604 - DNA, 35 bp, Artificial Sequence
  Synthetic oligonucleotide
tccaccgccctccatatacaagccctcacaatgtc

SEQ ID NO: 118605 - DNA, 35 bp, Artificial Sequence
  Synthetic oligonucleotide
tgaccaacaccacctccccttccggtcaccgaacg

SEQ ID NO: 118606 - DNA, 36 bp, Artificial Sequence
  Synthetic oligonucleotide
acacgacggggaggagaggggacgcagagacataaa

SEQ ID NO: 118607 - DNA, 37 bp, Artificial Sequence
  Synthetic oligonucleotide
ttgggcggaggggctcgtgcggtaaggtgggggatga

SEQ ID NO: 118608 - DNA, 38 bp, Artificial Sequence
  Synthetic oligonucleotide
tgcacctctatgcctcatgcccatccgctacgctttga

SEQ ID NO: 118609 - DNA, 33 bp, Artificial Sequence
  Synthetic oligonucleotide
atggacacgcagccacacgtcgttctactattc

SEQ ID NO: 118610 - DNA, 35 bp, Artificial Sequence
  Synthetic oligonucleotide
ttcctcacgcctcccgctgcgcactttcctcatgt

SEQ ID NO: 118611 - DNA, 36 bp, Artificial Sequence
  Synthetic oligonucleotide
accacgtctcgccctcacccaccgtctgctacccca

SEQ ID NO: 118612 - DNA, 37 bp, Artificial Sequence
  Synthetic oligonucleotide
gatcgcaccatctttcaccatcctgcactctgtgcga

SEQ ID NO: 118613 - DNA, 35 bp, Artificial Sequence
  Synthetic oligonucleotide
gttccagcacgcccgccgctttcacactcccagga

SEQ ID NO: 118614 - DNA, 35 bp, Artificial Sequence
  Synthetic oligonucleotide
tcccggtcactctgacgcgcccccccctagctgga

SEQ ID NO: 118615 - DNA, 36 bp, Artificial Sequence
  Synthetic oligonucleotide
gacacccctgcatcgtttactttccctccggcctga

SEQ ID NO: 118616 - DNA, 38 bp, Artificial Sequence
  Synthetic oligonucleotide
gccgctgcctcgcccacccctgaatcgtgtctgcctga

SEQ ID NO: 118617 - DNA, 35 bp, Artificial Sequence
  Synthetic oligonucleotide
acaaaggggggagggagggtagacaactgtatgta

SEQ ID NO: 118618 - DNA, 35 bp, Artificial Sequence
  Synthetic oligonucleotide
gggtatggccgccacccgtcgattatgcccttccc

SEQ ID NO: 118619 - DNA, 35 bp, Artificial Sequence
  Synthetic oligonucleotide
tccaccgccggttgctgctgccttcgactttttcg

SEQ ID NO: 118620 - DNA, 35 bp, Artificial Sequence
  Synthetic oligonucleotide
tcccaacgattccaagtgttggttccgtactccct

SEQ ID NO: 118621 - DNA, 35 bp, Artificial Sequence
  Synthetic oligonucleotide
aagggagcccccttccgttgtccattgcactcttt

SEQ ID NO: 118622 - DNA, 35 bp, Artificial Sequence
  Synthetic oligonucleotide
aggggagtagggcacggggaaggggcagagggcga

SEQ ID NO: 118623 - DNA, 37 bp, Artificial Sequence
  Synthetic oligonucleotide
tccgcgacagttgatcctcttacgccgcccttcatga

SEQ ID NO: 118624 - DNA, 35 bp, Artificial Sequence
  Synthetic oligonucleotide
tccgtctgtcggactgtccctctaccatccttccc

SEQ ID NO: 118625 - DNA, 35 bp, Artificial Sequence
  Synthetic oligonucleotide
taatccgtccactgcacgttcgtccttagttctcc

SEQ ID NO: 118626 - DNA, 35 bp, Artificial Sequence
  Synthetic oligonucleotide
ttcggaggtcacttgaatccatcccccccctgttg

SEQ ID NO: 118627 - DNA, 38 bp, Artificial Sequence
  Synthetic oligonucleotide
tacgcctcccttgtttgctgccacgctggttcacctga

SEQ ID NO: 118628 - DNA, 36 bp, Artificial Sequence
  Synthetic oligonucleotide
ggggtgggtcgcgcaggttcttagggaggggttata

SEQ ID NO: 118629 - DNA, 35 bp, Artificial Sequence
  Synthetic oligonucleotide
gactccctgccgaggtttatgttccattcgttcct

SEQ ID NO: 118630 - DNA, 35 bp, Artificial Sequence
  Synthetic oligonucleotide
ttcgcaaccgggagggtgggatcatgattacgggt

SEQ ID NO: 118631 - DNA, 35 bp, Artificial Sequence
  Synthetic oligonucleotide
aaccaccgcactgacactattccagccctcctatt

SEQ ID NO: 118632 - DNA, 36 bp, Artificial Sequence
  Synthetic oligonucleotide
gatgcccgccgtatttggcactgtcctttactccca

SEQ ID NO: 118633 - DNA, 37 bp, Artificial Sequence
  Synthetic oligonucleotide
tccccctctgcccgatatgcactgtcaccctaccgga

SEQ ID NO: 118634 - DNA, 35 bp, Artificial Sequence
  Synthetic oligonucleotide
ggtaacaccgcgcgtctcacagttgccctgccctc

SEQ ID NO: 118635 - DNA, 35 bp, Artificial Sequence
  Synthetic oligonucleotide
gttaccgcccgatctgctttcgtacaccccttgtc

SEQ ID NO: 118636 - DNA, 37 bp, Artificial Sequence
  Synthetic oligonucleotide
ggacggaggaggcggtgaggcacatcggggaacggga

SEQ ID NO: 118637 - DNA, 36 bp, Artificial Sequence
  Synthetic oligonucleotide
gaagggtaggggtggagcagggatacgtcggtggga

SEQ ID NO: 118638 - DNA, 35 bp, Artificial Sequence
  Synthetic oligonucleotide
atggagcccctgactcaactccgccgtttcacgcc

SEQ ID NO: 118639 - DNA, 36 bp, Artificial Sequence
  Synthetic oligonucleotide
tgggtgggatgggagggaccagaggagcaatgcaaa

SEQ ID NO: 118640 - DNA, 38 bp, Artificial Sequence
  Synthetic oligonucleotide
tcaccgtcgacgatcctccgctaactgccctctactga

SEQ ID NO: 118641 - DNA, 35 bp, Artificial Sequence
  Synthetic oligonucleotide
atcctcccgccactggttcttgatctgcagatcac

SEQ ID NO: 118642 - DNA, 35 bp, Artificial Sequence
  Synthetic oligonucleotide
tgtaaggcgcccagccttgtttccggctcaccccc

SEQ ID NO: 118643 - DNA, 35 bp, Artificial Sequence
  Synthetic oligonucleotide
gtccccgctgccagcgcgatagtctgtcccttccc

SEQ ID NO: 118644 - DNA, 35 bp, Artificial Sequence
  Synthetic oligonucleotide
tagtccgccacctctcatgcccagccttttttcgg

SEQ ID NO: 118645 - DNA, 35 bp, Artificial Sequence
  Synthetic oligonucleotide
aaccaccctcaggaccattatgtctcccgatcgct

SEQ ID NO: 118646 - DNA, 35 bp, Artificial Sequence
  Synthetic oligonucleotide
tggaaggcggaggggggtggttctggacggtggct

SEQ ID NO: 118647 - DNA, 31 bp, Artificial Sequence
  Synthetic oligonucleotide
tgcactcagcgctgcaaacccctgccttcgt

SEQ ID NO: 118648 - DNA, 36 bp, Artificial Sequence
  Synthetic oligonucleotide
gccgtaccaccgctaatgtcctaattcatacctgta

SEQ ID NO: 118649 - DNA, 35 bp, Artificial Sequence
  Synthetic oligonucleotide
tcccatccctcggtaagtgtgacgctgccttcatc

SEQ ID NO: 118650 - DNA, 35 bp, Artificial Sequence
  Synthetic oligonucleotide
cccagcccgcccttgtctcgctttattgtgctatc

SEQ ID NO: 118651 - DNA, 35 bp, Artificial Sequence
  Synthetic oligonucleotide
gttctgctttgattctacgtcttccccctccttgg

SEQ ID NO: 118652 - DNA, 35 bp, Artificial Sequence
  Synthetic oligonucleotide
gtgtcgcccggcacgtaataaagtacctcccctat

SEQ ID NO: 118653 - DNA, 35 bp, Artificial Sequence
  Synthetic oligonucleotide
ggacattgccccccgccgttctgccagcttaccgt

SEQ ID NO: 118654 - DNA, 35 bp, Artificial Sequence
  Synthetic oligonucleotide
gaaccgcctttcatcctccaagacgctgctctttc

SEQ ID NO: 118655 - DNA, 34 bp, Artificial Sequence
  Synthetic oligonucleotide
ttctatccactgatgtgcgctccttgttcccctg

SEQ ID NO: 118656 - DNA, 37 bp, Artificial Sequence
  Synthetic oligonucleotide
ttgggtgacagggtggaagggggtgctgggtggggga

SEQ ID NO: 118657 - DNA, 35 bp, Artificial Sequence
  Synthetic oligonucleotide
tccgtccctgccgctctgctgcgtgacgttcatcc

SEQ ID NO: 118658 - DNA, 35 bp, Artificial Sequence
  Synthetic oligonucleotide
ttctacgacctgacgcctatatagcccaatacctc

SEQ ID NO: 118659 - DNA, 35 bp, Artificial Sequence
  Synthetic oligonucleotide
gcacatcgcagaccgcaaattcttgtgaccctctc

SEQ ID NO: 118660 - DNA, 35 bp, Artificial Sequence
  Synthetic oligonucleotide
gtccccgctcgctgttttgccccgcgtttccgaac

SEQ ID NO: 118661 - DNA, 35 bp, Artificial Sequence
  Synthetic oligonucleotide
ttcgatgtcgcacgctggccccatcataacgctcc

SEQ ID NO: 118662 - DNA, 35 bp, Artificial Sequence
  Synthetic oligonucleotide
ccctcccccgcgcccgtatcgttcttgcgccttgc

SEQ ID NO: 118663 - DNA, 36 bp, Artificial Sequence
  Synthetic oligonucleotide
acacccacgacgttccctgccaatgtatcctcgcca

SEQ ID NO: 118664 - DNA, 35 bp, Artificial Sequence
  Synthetic oligonucleotide
gcgcatccggcatgtcaactctctccacgtcgcca

SEQ ID NO: 118665 - DNA, 37 bp, Artificial Sequence
  Synthetic oligonucleotide
gctgggtgggagaggtgggttcgaacttgttgcccga

SEQ ID NO: 118666 - DNA, 35 bp, Artificial Sequence
  Synthetic oligonucleotide
accagcctcgtaccgaaatgtcaccgtatcgcccc

SEQ ID NO: 118667 - DNA, 35 bp, Artificial Sequence
  Synthetic oligonucleotide
tgaaccgccatttcggtcaccgcgcccccattgtg

SEQ ID NO: 118668 - DNA, 35 bp, Artificial Sequence
  Synthetic oligonucleotide
aacgtgtgaccatgcgtatgcaccttcccctcttg

SEQ ID NO: 118669 - DNA, 36 bp, Artificial Sequence
  Synthetic oligonucleotide
tctcgcccacaccccattgtatgaaccatcgattca

SEQ ID NO: 118670 - DNA, 35 bp, Artificial Sequence
  Synthetic oligonucleotide
gtgctcccccagactgacatgccgatccgatcccc

SEQ ID NO: 118671 - DNA, 35 bp, Artificial Sequence
  Synthetic oligonucleotide
tacctcccgcccccgattactaggatgactgatcc

SEQ ID NO: 118672 - DNA, 35 bp, Artificial Sequence
  Synthetic oligonucleotide
aattgcgcatccgccccttcccatccgatccgccg

SEQ ID NO: 118673 - DNA, 36 bp, Artificial Sequence
  Synthetic oligonucleotide
tgcatgccactccgtcctggactttccttctcgcaa

SEQ ID NO: 118674 - DNA, 37 bp, Artificial Sequence
  Synthetic oligonucleotide
attgccaatgccctatgcccttagtgatccaccctga

SEQ ID NO: 118675 - DNA, 38 bp, Artificial Sequence
  Synthetic oligonucleotide
tagaccaccgccccgcttagtacttgagctatccctga

SEQ ID NO: 118676 - DNA, 38 bp, Artificial Sequence
  Synthetic oligonucleotide
aaagcgagacaggtgaaggatggaacgagaagggctga

SEQ ID NO: 118677 - DNA, 35 bp, Artificial Sequence
  Synthetic oligonucleotide
gtccgcccatagtaatcccctggccctgttgttac

SEQ ID NO: 118678 - DNA, 35 bp, Artificial Sequence
  Synthetic oligonucleotide
acctcatgtctccagcccctcgcccaatgtccacc

SEQ ID NO: 118679 - DNA, 35 bp, Artificial Sequence
  Synthetic oligonucleotide
tcaagtgcccacgcgccacgccggtcctctccgcc

SEQ ID NO: 118680 - DNA, 35 bp, Artificial Sequence
  Synthetic oligonucleotide
actgcgggccctgctgccctgacgatttcttctcc

SEQ ID NO: 118681 - DNA, 35 bp, Artificial Sequence
  Synthetic oligonucleotide
tgttaacacagccttgcctcccgacgctgcctctc

SEQ ID NO: 118682 - DNA, 35 bp, Artificial Sequence
  Synthetic oligonucleotide
tcttcggtccatgtaccttccctgctccactttag

SEQ ID NO: 118683 - DNA, 35 bp, Artificial Sequence
  Synthetic oligonucleotide
tgatcctactcgctcctcttcctgtgtcctgtcct

SEQ ID NO: 118684 - DNA, 36 bp, Artificial Sequence
  Synthetic oligonucleotide
atagggggcgggtgggcgtcatatccggggaaccaa

SEQ ID NO: 118685 - DNA, 36 bp, Artificial Sequence
  Synthetic oligonucleotide
gtgggtgggtgcggtgggcgaaatgttgctaaccta

SEQ ID NO: 118686 - DNA, 35 bp, Artificial Sequence
  Synthetic oligonucleotide
tcaacctccacatgcataccggatctgccttctac

SEQ ID NO: 118687 - DNA, 34 bp, Artificial Sequence
  Synthetic oligonucleotide
tccgcacctgctgccccctctccgaactgagttc

SEQ ID NO: 118688 - DNA, 35 bp, Artificial Sequence
  Synthetic oligonucleotide
aatcaccaaacggagtgtctcattcgcatcccccg

SEQ ID NO: 118689 - DNA, 35 bp, Artificial Sequence
  Synthetic oligonucleotide
gagccccgccccctctcaccttagcaattctttgg

SEQ ID NO: 118690 - DNA, 35 bp, Artificial Sequence
  Synthetic oligonucleotide
acctccacacgccttctttcttgggactctctcca

SEQ ID NO: 118691 - DNA, 37 bp, Artificial Sequence
  Synthetic oligonucleotide
atgctcagccgccccagcccccctgccacctctccga

SEQ ID NO: 118692 - DNA, 35 bp, Artificial Sequence
  Synthetic oligonucleotide
tcccacccttcacgattcgatttcctcaccataac

SEQ ID NO: 118693 - DNA, 35 bp, Artificial Sequence
  Synthetic oligonucleotide
tccacgtgcgttaacttcctcgtaccttagcctcc

SEQ ID NO: 118694 - DNA, 35 bp, Artificial Sequence
  Synthetic oligonucleotide
tgcactccccatctgcatcgaaccacttaattcaa

SEQ ID NO: 118695 - DNA, 37 bp, Artificial Sequence
  Synthetic oligonucleotide
gagaggggggacagccgggaggacggagggacgaaga

SEQ ID NO: 118696 - DNA, 35 bp, Artificial Sequence
  Synthetic oligonucleotide
aagccaccttccgaatcccgtcccgcctgacatga

SEQ ID NO: 118697 - DNA, 36 bp, Artificial Sequence
  Synthetic oligonucleotide
gcaacccgcctgttcctccccctcggttcactacta

SEQ ID NO: 118698 - DNA, 35 bp, Artificial Sequence
  Synthetic oligonucleotide
accaacgccccactctcctattactcgcagtcaac

SEQ ID NO: 118699 - DNA, 35 bp, Artificial Sequence
  Synthetic oligonucleotide
gtaacgcattcccacccctcagccccctggttgcc

SEQ ID NO: 118700 - DNA, 35 bp, Artificial Sequence
  Synthetic oligonucleotide
tccacaggcatccgttaatcacccgtacccgccgc

SEQ ID NO: 118701 - DNA, 35 bp, Artificial Sequence
  Synthetic oligonucleotide
tttgaatcggccccgcgtccacccgtccccgtatc

SEQ ID NO: 118702 - DNA, 36 bp, Artificial Sequence
  Synthetic oligonucleotide
acgccccgggttccctgtttgctcctgtggttacca

SEQ ID NO: 118703 - DNA, 36 bp, Artificial Sequence
  Synthetic oligonucleotide
gtgctgctgcctgctctacgcccgacactccaccca

SEQ ID NO: 118704 - DNA, 37 bp, Artificial Sequence
  Synthetic oligonucleotide
gtggtggggccgttgcgtccaaggggggggcggatga

SEQ ID NO: 118705 - DNA, 36 bp, Artificial Sequence
  Synthetic oligonucleotide
gttgccctccctccctgctatgagttcgggtcccta

SEQ ID NO: 118706 - DNA, 36 bp, Artificial Sequence
  Synthetic oligonucleotide
tcagagctgtatcgtgctgcatctctctcttccgta

SEQ ID NO: 118707 - DNA, 35 bp, Artificial Sequence
  Synthetic oligonucleotide
tgtaaccgctcttgccctggtatcggctctactcc

SEQ ID NO: 118708 - DNA, 35 bp, Artificial Sequence
  Synthetic oligonucleotide
ttgccgggtccccgtcgttccattcccctcctgtg

SEQ ID NO: 118709 - DNA, 35 bp, Artificial Sequence
  Synthetic oligonucleotide
accagccgtgagtgcgcgcgttacatctacttcct

SEQ ID NO: 118710 - DNA, 35 bp, Artificial Sequence
  Synthetic oligonucleotide
tggtcgagcctcccattgcctgtctccgcccctga

SEQ ID NO: 118711 - DNA, 37 bp, Artificial Sequence
  Synthetic oligonucleotide
tcctccgcctacaagcctgtcccgcgcctcctgctga

SEQ ID NO: 118712 - DNA, 35 bp, Artificial Sequence
  Synthetic oligonucleotide
accactcctccgaccttggataatcggcttttcct

SEQ ID NO: 118713 - DNA, 35 bp, Artificial Sequence
  Synthetic oligonucleotide
tctgaccgcctgggccctataccgttacttaccaa

SEQ ID NO: 118714 - DNA, 36 bp, Artificial Sequence
  Synthetic oligonucleotide
taacgcgggtgaggggggggtggaatgctgttggga

SEQ ID NO: 118715 - DNA, 36 bp, Artificial Sequence
  Synthetic oligonucleotide
attgccccgccctagagtatctctgatcatccgcta

SEQ ID NO: 118716 - DNA, 35 bp, Artificial Sequence
  Synthetic oligonucleotide
tcacaacccgccatctactgtcatttcggcgcttt

SEQ ID NO: 118717 - DNA, 35 bp, Artificial Sequence
  Synthetic oligonucleotide
tgagccccccgaaatgtggtgcgtccaacccccgc

SEQ ID NO: 118718 - DNA, 35 bp, Artificial Sequence
  Synthetic oligonucleotide
gtgcactcctggcccttatgcgactcccctttaag

SEQ ID NO: 118719 - DNA, 35 bp, Artificial Sequence
  Synthetic oligonucleotide
acctcattggtccctcgttatatgcacctcctttg

SEQ ID NO: 118720 - DNA, 35 bp, Artificial Sequence
  Synthetic oligonucleotide
gctgacccccatgcatgcatctccactactgttta

SEQ ID NO: 118721 - DNA, 35 bp, Artificial Sequence
  Synthetic oligonucleotide
tgcaagcccgcttgctccttttgactgccgacgcc

SEQ ID NO: 118722 - DNA, 35 bp, Artificial Sequence
  Synthetic oligonucleotide
atcgacaattcgctccccgcttcacgcctgctgcc

SEQ ID NO: 118723 - DNA, 35 bp, Artificial Sequence
  Synthetic oligonucleotide
atccacgccgtttgccttctccctttgcaggccgc

SEQ ID NO: 118724 - DNA, 35 bp, Artificial Sequence
  Synthetic oligonucleotide
acccacagccccgccccgctgctccgtgccactgc

SEQ ID NO: 118725 - DNA, 35 bp, Artificial Sequence
  Synthetic oligonucleotide
agcccctgctccattgtgattccctgtttccttag

SEQ ID NO: 118726 - DNA, 35 bp, Artificial Sequence
  Synthetic oligonucleotide
aatgtcaggcacgccctccctgctatcccgtctcg

SEQ ID NO: 118727 - DNA, 35 bp, Artificial Sequence
  Synthetic oligonucleotide
tcatgccctccgctttgtcccctcacgttgacgga

SEQ ID NO: 118728 - DNA, 37 bp, Artificial Sequence
  Synthetic oligonucleotide
ttcgactccaccgctccccatcgtgtctcatttgtga

SEQ ID NO: 118729 - DNA, 35 bp, Artificial Sequence
  Synthetic oligonucleotide
tgccctcgccatttgcccttctggacgtatccttc

SEQ ID NO: 118730 - DNA, 26 bp, Artificial Sequence
  Synthetic oligonucleotide
tacgcactcctatcttcttttctttg

SEQ ID NO: 118731 - DNA, 37 bp, Artificial Sequence
  Synthetic oligonucleotide
tgagctaagggcgggagggggcaagggcgggtctaga

SEQ ID NO: 118732 - DNA, 36 bp, Artificial Sequence
  Synthetic oligonucleotide
aacagaccccctgcgcaccaactcctccgtggccga

SEQ ID NO: 118733 - DNA, 37 bp, Artificial Sequence
  Synthetic oligonucleotide
gctgtccccgtcccttacttccatttgcagattgcga

SEQ ID NO: 118734 - DNA, 38 bp, Artificial Sequence
  Synthetic oligonucleotide
tgcaccccgccgagttaaccacccccacaccagcgtga

SEQ ID NO: 118735 - DNA, 35 bp, Artificial Sequence
  Synthetic oligonucleotide
tatcacgcctccctgtcgaccatgaagcatcttcc

SEQ ID NO: 118736 - DNA, 35 bp, Artificial Sequence
  Synthetic oligonucleotide
atcgcgtgcccgacagtggcctctcgtccctccgc

SEQ ID NO: 118737 - DNA, 35 bp, Artificial Sequence
  Synthetic oligonucleotide
acgtccggtgccccaccaccctcatcgccctcatc

SEQ ID NO: 118738 - DNA, 35 bp, Artificial Sequence
  Synthetic oligonucleotide
gccaatgcccccgcacacacatcgcccctctatcg

SEQ ID NO: 118739 - DNA, 35 bp, Artificial Sequence
  Synthetic oligonucleotide
tgtgcctgcatccacgatcgaattcgctccactcg

SEQ ID NO: 118740 - DNA, 35 bp, Artificial Sequence
  Synthetic oligonucleotide
gaacggaggaaaggagtggcgggggtaagtacggg

SEQ ID NO: 118741 - DNA, 35 bp, Artificial Sequence
  Synthetic oligonucleotide
accccatcccccccgcgcaattgttttcccttatt

SEQ ID NO: 118742 - DNA, 35 bp, Artificial Sequence
  Synthetic oligonucleotide
tgcacggccagatattctaacttccactcgccgtt

SEQ ID NO: 118743 - DNA, 35 bp, Artificial Sequence
  Synthetic oligonucleotide
tcgagtcgtctgtacctgtccatacctcgccacca

SEQ ID NO: 118744 - DNA, 36 bp, Artificial Sequence
  Synthetic oligonucleotide
accgtcccacccatttgctgtcctcccgttcgagca

SEQ ID NO: 118745 - DNA, 36 bp, Artificial Sequence
  Synthetic oligonucleotide
tccacctcccctagtatcaacccaacagtgccccga

SEQ ID NO: 118746 - DNA, 37 bp, Artificial Sequence
  Synthetic oligonucleotide
taccgcccgccgacgccattagcctcctctatcgtga

SEQ ID NO: 118747 - DNA, 36 bp, Artificial Sequence
  Synthetic oligonucleotide
aagtcacccacccgtttccagccggcccttttcgta

SEQ ID NO: 118748 - DNA, 35 bp, Artificial Sequence
  Synthetic oligonucleotide
accgcagtgcagtgaaccctttcgccacattctcg

SEQ ID NO: 118749 - DNA, 35 bp, Artificial Sequence
  Synthetic oligonucleotide
atcgcctccttgcccgacgcctctaataagccttg

SEQ ID NO: 118750 - DNA, 37 bp, Artificial Sequence
  Synthetic oligonucleotide
gaccccatcttttctgtactgagtcactccattccga

SEQ ID NO: 118751 - DNA, 37 bp, Artificial Sequence
  Synthetic oligonucleotide
gccgcccgccacacctgcgtgactaatattttcctga

SEQ ID NO: 118752 - DNA, 35 bp, Artificial Sequence
  Synthetic oligonucleotide
gccccaccgctaccgcccgccaccccgaacgatac

SEQ ID NO: 118753 - DNA, 35 bp, Artificial Sequence
  Synthetic oligonucleotide
tcagatggcggactaaatgggcggagggggcggat

SEQ ID NO: 118754 - DNA, 35 bp, Artificial Sequence
  Synthetic oligonucleotide
ttgtgtattcgtcctcccatggctactcctctgtc

SEQ ID NO: 118755 - DNA, 35 bp, Artificial Sequence
  Synthetic oligonucleotide
aattgcgggaacgggtgggtgggaggatagctcgg

SEQ ID NO: 118756 - DNA, 35 bp, Artificial Sequence
  Synthetic oligonucleotide
gagatagcatcccgtcgtcgttcccctgccgtgat

SEQ ID NO: 118757 - DNA, 35 bp, Artificial Sequence
  Synthetic oligonucleotide
agtgactccgaacctcgcgcataagcccctccact

SEQ ID NO: 118758 - DNA, 35 bp, Artificial Sequence
  Synthetic oligonucleotide
tcgataccgcccggcccccgtcacccgcacctcgt

SEQ ID NO: 118759 - DNA, 35 bp, Artificial Sequence
  Synthetic oligonucleotide
tgccccctcgagcgcgctctaccccctttgccatt

SEQ ID NO: 118760 - DNA, 35 bp, Artificial Sequence
  Synthetic oligonucleotide
tcactgctctaccctgttcttagcctggccaccaa

SEQ ID NO: 118761 - DNA, 37 bp, Artificial Sequence
  Synthetic oligonucleotide
gtgtcgccactgatccccccctcactaccgtcgccga

SEQ ID NO: 118762 - DNA, 35 bp, Artificial Sequence
  Synthetic oligonucleotide
gacgcgtcgccgccattccctccccatgaacgcac

SEQ ID NO: 118763 - DNA, 35 bp, Artificial Sequence
  Synthetic oligonucleotide
gtcacccccagcattatgcccacgaactcgctgac

SEQ ID NO: 118764 - DNA, 35 bp, Artificial Sequence
  Synthetic oligonucleotide
ttgcacctagtctgccgactcgcccttccttagcc

SEQ ID NO: 118765 - DNA, 35 bp, Artificial Sequence
  Synthetic oligonucleotide
gcccaacccgaatctgcttgccgttatcactctcg

SEQ ID NO: 118766 - DNA, 34 bp, Artificial Sequence
  Synthetic oligonucleotide
tccctgttccgcccgctattgcagattttcgcca

SEQ ID NO: 118767 - DNA, 34 bp, Artificial Sequence
  Synthetic oligonucleotide
gtctcgggcctcctctgccaccccgttcctcgta

SEQ ID NO: 118768 - DNA, 35 bp, Artificial Sequence
  Synthetic oligonucleotide
gttcgcgcccaatcatctgtccgaacacttttccc

SEQ ID NO: 118769 - DNA, 35 bp, Artificial Sequence
  Synthetic oligonucleotide
actagcggagtgccctcagccatggtccttcctcc

SEQ ID NO: 118770 - DNA, 35 bp, Artificial Sequence
  Synthetic oligonucleotide
ttggcatccagcacgcatacgctccacctgcttcc

SEQ ID NO: 118771 - DNA, 35 bp, Artificial Sequence
  Synthetic oligonucleotide
tccccattgctccctcctaatcgttgccattttgc

SEQ ID NO: 118772 - DNA, 35 bp, Artificial Sequence
  Synthetic oligonucleotide
actcccaagcctcccgctgcctgtatcaactacat

SEQ ID NO: 118773 - DNA, 35 bp, Artificial Sequence
  Synthetic oligonucleotide
gccagccggacactgacattgcccctccgccccat

SEQ ID NO: 118774 - DNA, 35 bp, Artificial Sequence
  Synthetic oligonucleotide
tccgcctcctattcccgctgcacatttcgaccggt

SEQ ID NO: 118775 - DNA, 37 bp, Artificial Sequence
  Synthetic oligonucleotide
aaggcggggtgggggtgtgggggatggcggccgcgga

SEQ ID NO: 118776 - DNA, 33 bp, Artificial Sequence
  Synthetic oligonucleotide
atgcgctcgccaccatccgtacttgtttgtcct

SEQ ID NO: 118777 - DNA, 36 bp, Artificial Sequence
  Synthetic oligonucleotide
aagaagccgccgccgcaatttacgcctgtcttcaca

SEQ ID NO: 118778 - DNA, 37 bp, Artificial Sequence
  Synthetic oligonucleotide
gtgggcccttccctgtctttgacccaatacctctgga

SEQ ID NO: 118779 - DNA, 35 bp, Artificial Sequence
  Synthetic oligonucleotide
ccccgccgccatgcgcttttcactgctgtcacacc

SEQ ID NO: 118780 - DNA, 35 bp, Artificial Sequence
  Synthetic oligonucleotide
ggaccgccacgcagctatagccttcttgacctctc

SEQ ID NO: 118781 - DNA, 35 bp, Artificial Sequence
  Synthetic oligonucleotide
tcgcggtcacaggatcgcaccccccgtcttgcccg

SEQ ID NO: 118782 - DNA, 35 bp, Artificial Sequence
  Synthetic oligonucleotide
ttccgcggtcagagttttctatccgtttgctccct

SEQ ID NO: 118783 - DNA, 36 bp, Artificial Sequence
  Synthetic oligonucleotide
gtagtcccgccacgttcctacacctccgttttccga

SEQ ID NO: 118784 - DNA, 36 bp, Artificial Sequence
  Synthetic oligonucleotide
tgataccgccaccacagtggttccgcccccccccta

SEQ ID NO: 118785 - DNA, 35 bp, Artificial Sequence
  Synthetic oligonucleotide
acatgtgcacgtcccacctctccatttgttgcacc

SEQ ID NO: 118786 - DNA, 35 bp, Artificial Sequence
  Synthetic oligonucleotide
gggcctcatgccgccctgttgctcacggtacctcc

SEQ ID NO: 118787 - DNA, 35 bp, Artificial Sequence
  Synthetic oligonucleotide
gatcggtgtcctgatcctctaccgtcgtcttcctc

SEQ ID NO: 118788 - DNA, 35 bp, Artificial Sequence
  Synthetic oligonucleotide
ttcgtcctccagactgtcttatacccgccacgcct

SEQ ID NO: 118789 - DNA, 36 bp, Artificial Sequence
  Synthetic oligonucleotide
tagacaccgactcccccgggtttgcccttgctctca

SEQ ID NO: 118790 - DNA, 34 bp, Artificial Sequence
  Synthetic oligonucleotide
atcgccatatcgcatcttccatgaccacccctga

SEQ ID NO: 118791 - DNA, 35 bp, Artificial Sequence
  Synthetic oligonucleotide
tgggggggggggggggtagcacgagttggggccac

SEQ ID NO: 118792 - DNA, 35 bp, Artificial Sequence
  Synthetic oligonucleotide
gtgcaaggctaatcgtgcgcacatttcttccctcc

SEQ ID NO: 118793 - DNA, 35 bp, Artificial Sequence
  Synthetic oligonucleotide
gtctccacccttctgttaccggccccaacgcacgg

SEQ ID NO: 118794 - DNA, 35 bp, Artificial Sequence
  Synthetic oligonucleotide
ttgcccgccccgtcccatactctttctcttcccgg

SEQ ID NO: 118795 - DNA, 35 bp, Artificial Sequence
  Synthetic oligonucleotide
gtgccccgcccccgctatgactttgcatgccccct

SEQ ID NO: 118796 - DNA, 35 bp, Artificial Sequence
  Synthetic oligonucleotide
gaatgccagttaacgtacacgcccgccccatcctt

SEQ ID NO: 118797 - DNA, 35 bp, Artificial Sequence
  Synthetic oligonucleotide
cccaccgaccgccttgcacgtatcgttctcccgtt

SEQ ID NO: 118798 - DNA, 35 bp, Artificial Sequence
  Synthetic oligonucleotide
gagtcgtccgcccaacatgttcctcccccgtgttt

SEQ ID NO: 118799 - DNA, 36 bp, Artificial Sequence
  Synthetic oligonucleotide
tgcagggggagggtggggtaatcgggagggtgtaaa

SEQ ID NO: 118800 - DNA, 37 bp, Artificial Sequence
  Synthetic oligonucleotide
gaccatgcatcctgccctgccagcccctcgctcctga

SEQ ID NO: 118801 - DNA, 35 bp, Artificial Sequence
  Synthetic oligonucleotide
ttcccgccctgcatttacttctctacgagccacac

SEQ ID NO: 118802 - DNA, 35 bp, Artificial Sequence
  Synthetic oligonucleotide
gtggtgacgcatgcggtctttcgatcacctcctac

SEQ ID NO: 118803 - DNA, 35 bp, Artificial Sequence
  Synthetic oligonucleotide
tgtgcatgattcgtgaccacaccgccgcccgcccc

SEQ ID NO: 118804 - DNA, 35 bp, Artificial Sequence
  Synthetic oligonucleotide
gaccctccccggtcatatgtgggaacctccgctcc

SEQ ID NO: 118805 - DNA, 35 bp, Artificial Sequence
  Synthetic oligonucleotide
gtccgaacatcatcaattagccgcttttgccctgc

SEQ ID NO: 118806 - DNA, 35 bp, Artificial Sequence
  Synthetic oligonucleotide
ccactgccacaccgccgtttcctcatcgtgcactc

SEQ ID NO: 118807 - DNA, 35 bp, Artificial Sequence
  Synthetic oligonucleotide
ctgcgctgatcctattcccggtcccctcttcctgg

SEQ ID NO: 118808 - DNA, 35 bp, Artificial Sequence
  Synthetic oligonucleotide
tcccgtacacgctgccccgtccatcccagcctaat

SEQ ID NO: 118809 - DNA, 35 bp, Artificial Sequence
  Synthetic oligonucleotide
tatgcatgtcactaccgtcatcgaatttcacctgt

SEQ ID NO: 118810 - DNA, 35 bp, Artificial Sequence
  Synthetic oligonucleotide
tgtgcacgtggaccgtttttaaatccctttcgctt

SEQ ID NO: 118811 - DNA, 38 bp, Artificial Sequence
  Synthetic oligonucleotide
tttggacccacattgtacctgccccctctctttggtga

SEQ ID NO: 118812 - DNA, 35 bp, Artificial Sequence
  Synthetic oligonucleotide
gctgtcctggcccgtgcttcttgactatccgcccc

SEQ ID NO: 118813 - DNA, 35 bp, Artificial Sequence
  Synthetic oligonucleotide
tgtcgcctccctgcgattggatcgcccccatggcc

SEQ ID NO: 118814 - DNA, 35 bp, Artificial Sequence
  Synthetic oligonucleotide
tcgtgggcctcctcgtgcttcatagccgcattctc

SEQ ID NO: 118815 - DNA, 35 bp, Artificial Sequence
  Synthetic oligonucleotide
ttcgacccgctccctattcccacttcctaacgttg

SEQ ID NO: 118816 - DNA, 35 bp, Artificial Sequence
  Synthetic oligonucleotide
gtagtcagcggggggaggggggaacacggggtgaa

SEQ ID NO: 118817 - DNA, 36 bp, Artificial Sequence
  Synthetic oligonucleotide
gaccccgctagccgcattgctttgttcatcctctca

SEQ ID NO: 118818 - DNA, 38 bp, Artificial Sequence
  Synthetic oligonucleotide
gtacgccgatggaccgcgcctgtttcattccctcctga

SEQ ID NO: 118819 - DNA, 35 bp, Artificial Sequence
  Synthetic oligonucleotide
atcagccgaccgcgccctgtcttttactcgcacac

SEQ ID NO: 118820 - DNA, 35 bp, Artificial Sequence
  Synthetic oligonucleotide
agcatacccccctccgtgctgtttttcgactgccc

SEQ ID NO: 118821 - DNA, 35 bp, Artificial Sequence
  Synthetic oligonucleotide
acttgccatcacgcccctgtcgtcgaactcgactc

SEQ ID NO: 118822 - DNA, 35 bp, Artificial Sequence
  Synthetic oligonucleotide
tgtgccgtctaactcttcttcgcctcgctctgctc

SEQ ID NO: 118823 - DNA, 35 bp, Artificial Sequence
  Synthetic oligonucleotide
gtcgatccatcctcccaagtgtacccccgatcgtt

SEQ ID NO: 118824 - DNA, 36 bp, Artificial Sequence
  Synthetic oligonucleotide
tcctcgctccgcccttgctcgacatgccatctttaa

SEQ ID NO: 118825 - DNA, 37 bp, Artificial Sequence
  Synthetic oligonucleotide
tccccatctcccatgtcgctttcaccgatgcactgca

SEQ ID NO: 118826 - DNA, 37 bp, Artificial Sequence
  Synthetic oligonucleotide
gaggtgatacgcaggggtggaaggaaaaggtgtcaga

SEQ ID NO: 118827 - DNA, 37 bp, Artificial Sequence
  Synthetic oligonucleotide
gccctgctcctgccgattacagccgttccgctcttga

SEQ ID NO: 118828 - DNA, 35 bp, Artificial Sequence
  Synthetic oligonucleotide
agtatgtgagccgcctgttctattatgcccacgcc

SEQ ID NO: 118829 - DNA, 35 bp, Artificial Sequence
  Synthetic oligonucleotide
tcctcactgcacacccattggaaccttgctcctct

SEQ ID NO: 118830 - DNA, 35 bp, Artificial Sequence
  Synthetic oligonucleotide
acaccaaccagctgggtcgaattgcctccccttct

SEQ ID NO: 118831 - DNA, 35 bp, Artificial Sequence
  Synthetic oligonucleotide
gctgggtgggggggtagaattcagggatcatgggt

SEQ ID NO: 118832 - DNA, 36 bp, Artificial Sequence
  Synthetic oligonucleotide
gtgacccgcaatgaaccctcccccgttgtgacccaa

SEQ ID NO: 118833 - DNA, 36 bp, Artificial Sequence
  Synthetic oligonucleotide
tgaggggggagaagggggggtgggagtagggtgcaa

SEQ ID NO: 118834 - DNA, 36 bp, Artificial Sequence
  Synthetic oligonucleotide
gtgtacgcccacattgcctttcctcaacgactccta

SEQ ID NO: 118835 - DNA, 35 bp, Artificial Sequence
  Synthetic oligonucleotide
actgctccacacatcacggccggccccgatcgccc

SEQ ID NO: 118836 - DNA, 35 bp, Artificial Sequence
  Synthetic oligonucleotide
tcacctgctcctttgcgattggcaccctctctgtc

SEQ ID NO: 118837 - DNA, 35 bp, Artificial Sequence
  Synthetic oligonucleotide
gtgcccctgccttcgccgccttattaccacttttg

SEQ ID NO: 118838 - DNA, 35 bp, Artificial Sequence
  Synthetic oligonucleotide
gcacgccgcaccagtccggtatatcgttccttaat

SEQ ID NO: 118839 - DNA, 35 bp, Artificial Sequence
  Synthetic oligonucleotide
gcacacctcacgtggcccctccctatcgtatcgat

SEQ ID NO: 118840 - DNA, 35 bp, Artificial Sequence
  Synthetic oligonucleotide
tagtagacgccacggtaatgtcctatctgccccct

SEQ ID NO: 118841 - DNA, 35 bp, Artificial Sequence
  Synthetic oligonucleotide
tctcgctcgagtgttgtctcgccgtccctttcgtt

SEQ ID NO: 118842 - DNA, 35 bp, Artificial Sequence
  Synthetic oligonucleotide
gatgcaccgcgccttttgctcttgtctcgtaaacc

SEQ ID NO: 118843 - DNA, 35 bp, Artificial Sequence
  Synthetic oligonucleotide
acccacctgcgcacccagagcaaaagcccctcacc

SEQ ID NO: 118844 - DNA, 35 bp, Artificial Sequence
  Synthetic oligonucleotide
gccgcacgttctcgccgttcttgtcgcccttgccc

SEQ ID NO: 118845 - DNA, 35 bp, Artificial Sequence
  Synthetic oligonucleotide
tcatcggactactatgttcacccccttgtgcttcg

SEQ ID NO: 118846 - DNA, 35 bp, Artificial Sequence
  Synthetic oligonucleotide
atgagcctcagccctttcgtctatcgctactcgct

SEQ ID NO: 118847 - DNA, 35 bp, Artificial Sequence
  Synthetic oligonucleotide
gatcgctcgacgcataacttccaggttccatctct

SEQ ID NO: 118848 - DNA, 35 bp, Artificial Sequence
  Synthetic oligonucleotide
ttcgcacgctccccctgcgtcgaggccttacctgt

SEQ ID NO: 118849 - DNA, 35 bp, Artificial Sequence
  Synthetic oligonucleotide
tccgtgtccctccccacagcgaccgccttttcgtt

SEQ ID NO: 118850 - DNA, 37 bp, Artificial Sequence
  Synthetic oligonucleotide
gacagggagacagtcaagagaagggcaggtggacaga

SEQ ID NO: 118851 - DNA, 37 bp, Artificial Sequence
  Synthetic oligonucleotide
gtgggacgggccggggtgctctaaaggggaggaagga

SEQ ID NO: 118852 - DNA, 36 bp, Artificial Sequence
  Synthetic oligonucleotide
tcgcaaggcccgttacgtttctccgccgcccattga

SEQ ID NO: 118853 - DNA, 36 bp, Artificial Sequence
  Synthetic oligonucleotide
gccgtcctcgttctctgtcctctacctgttgtttta

SEQ ID NO: 118854 - DNA, 35 bp, Artificial Sequence
  Synthetic oligonucleotide
tgatgcacggctggcttccggatctgcacctctac

SEQ ID NO: 118855 - DNA, 35 bp, Artificial Sequence
  Synthetic oligonucleotide
tttgccaccgttctcaggctataaccgtctccacc

SEQ ID NO: 118856 - DNA, 37 bp, Artificial Sequence
  Synthetic oligonucleotide
aacggtggaggggaaatggatggccgtgttggggaga

SEQ ID NO: 118857 - DNA, 37 bp, Artificial Sequence
  Synthetic oligonucleotide
aactgcgacagcttgcaccgcccgtccaccactctga

SEQ ID NO: 118858 - DNA, 37 bp, Artificial Sequence
  Synthetic oligonucleotide
tgctccccgacaattccccaccccgttgcgcttgcta

SEQ ID NO: 118859 - DNA, 35 bp, Artificial Sequence
  Synthetic oligonucleotide
gcttagcctctgtccccttcccccaccgaaccgcg

SEQ ID NO: 118860 - DNA, 35 bp, Artificial Sequence
  Synthetic oligonucleotide
gggggtccacccagctcgtatttctttcactatgt

SEQ ID NO: 118861 - DNA, 36 bp, Artificial Sequence
  Synthetic oligonucleotide
ttagcctgttccgcccgttcgccgttcccactcaca

SEQ ID NO: 118862 - DNA, 37 bp, Artificial Sequence
  Synthetic oligonucleotide
acccccccggccccattgtacttaccggcatactaga

SEQ ID NO: 118863 - DNA, 37 bp, Artificial Sequence
  Synthetic oligonucleotide
accctcggttctatccagcattgcgcacagtcatcga

SEQ ID NO: 118864 - DNA, 38 bp, Artificial Sequence
  Synthetic oligonucleotide
atcaccgcctcatcaccccctcagtcagctcgcactga

SEQ ID NO: 118865 - DNA, 35 bp, Artificial Sequence
  Synthetic oligonucleotide
tgtgctgtcagctcacgcccgaccctccgtttccc

SEQ ID NO: 118866 - DNA, 35 bp, Artificial Sequence
  Synthetic oligonucleotide
gatcgccgacgctatcagcgcgcactcctgcctcc

SEQ ID NO: 118867 - DNA, 35 bp, Artificial Sequence
  Synthetic oligonucleotide
tccgactcacctctatgctactgtttaattcgtgc

SEQ ID NO: 118868 - DNA, 35 bp, Artificial Sequence
  Synthetic oligonucleotide
gccatcccccattgcccatgagcggacctaacttc

SEQ ID NO: 118869 - DNA, 35 bp, Artificial Sequence
  Synthetic oligonucleotide
tagacgcaacgcgcgggggaggagggcctgggtaa

SEQ ID NO: 118870 - DNA, 36 bp, Artificial Sequence
  Synthetic oligonucleotide
gtcgcctctcccgtaattgcctccgtgtctagccca

SEQ ID NO: 118871 - DNA, 37 bp, Artificial Sequence
  Synthetic oligonucleotide
ggacgggggtggggcggacacttatcacaggcggaga

SEQ ID NO: 118872 - DNA, 36 bp, Artificial Sequence
  Synthetic oligonucleotide
gcctccacccgtgttgtttccctgttacgatttcga

SEQ ID NO: 118873 - DNA, 36 bp, Artificial Sequence
  Synthetic oligonucleotide
aactccaccatatgccgtagctgttgccatccatga

SEQ ID NO: 118874 - DNA, 38 bp, Artificial Sequence
  Synthetic oligonucleotide
gactccatcctcgcctcctgctataactgaatagttga

SEQ ID NO: 118875 - DNA, 35 bp, Artificial Sequence
  Synthetic oligonucleotide
gagcgcccctgtgcttgtctcaatcatgtcccacc

SEQ ID NO: 118876 - DNA, 35 bp, Artificial Sequence
  Synthetic oligonucleotide
acgagccaccggctctgtttaccgacgtcccctcc

SEQ ID NO: 118877 - DNA, 35 bp, Artificial Sequence
  Synthetic oligonucleotide
ttcccagtcccctctttgcgccactattgccatgc

SEQ ID NO: 118878 - DNA, 35 bp, Artificial Sequence
  Synthetic oligonucleotide
acatgtccccaggtgtcttcttctacccgcttgtc

SEQ ID NO: 118879 - DNA, 35 bp, Artificial Sequence
  Synthetic oligonucleotide
gcgctcgtcgctccccctcgcgcttggttccttcg

SEQ ID NO: 118880 - DNA, 35 bp, Artificial Sequence
  Synthetic oligonucleotide
ttgccggaccaacgagctgtcccccattgtaccat

SEQ ID NO: 118881 - DNA, 35 bp, Artificial Sequence
  Synthetic oligonucleotide
aagcccacgcccatctgattctcgcctgttcccct

SEQ ID NO: 118882 - DNA, 35 bp, Artificial Sequence
  Synthetic oligonucleotide
gaagccatatcatgcctaagtttgcctgttctcct

SEQ ID NO: 118883 - DNA, 36 bp, Artificial Sequence
  Synthetic oligonucleotide
tcccaccccctgcgattgtcaacgagcttcttcaca

SEQ ID NO: 118884 - DNA, 38 bp, Artificial Sequence
  Synthetic oligonucleotide
tgccaaccccatgggatacaccttgctccttttcgtga

SEQ ID NO: 118885 - DNA, 36 bp, Artificial Sequence
  Synthetic oligonucleotide
ttggaggcggtccccagccacctgttcctctgctta

SEQ ID NO: 118886 - DNA, 35 bp, Artificial Sequence
  Synthetic oligonucleotide
acatccgttgcccgctatccattccccactgccgc

SEQ ID NO: 118887 - DNA, 36 bp, Artificial Sequence
  Synthetic oligonucleotide
acttccgcactctgcccccctcgctatgttgttcca

SEQ ID NO: 118888 - DNA, 38 bp, Artificial Sequence
  Synthetic oligonucleotide
gaagtggaggagaggggtgagtgaggtacaggaagtga

SEQ ID NO: 118889 - DNA, 35 bp, Artificial Sequence
  Synthetic oligonucleotide
gatagccgtccctccgtaatttgccgccctgacag

SEQ ID NO: 118890 - DNA, 35 bp, Artificial Sequence
  Synthetic oligonucleotide
tacgacgctcgccccggtgccttgaactcccgact

SEQ ID NO: 118891 - DNA, 37 bp, Artificial Sequence
  Synthetic oligonucleotide
gagcccatccggcacgctgcccacagacgctgcacga

SEQ ID NO: 118892 - DNA, 36 bp, Artificial Sequence
  Synthetic oligonucleotide
aaaggccccagctgtcatgtactcgcccgcccccga

SEQ ID NO: 118893 - DNA, 38 bp, Artificial Sequence
  Synthetic oligonucleotide
tcagcgccgccccagctcttatttttgttgccccctga

SEQ ID NO: 118894 - DNA, 35 bp, Artificial Sequence
  Synthetic oligonucleotide
tccgtacaccctggtccgtttcccccctagccaac

SEQ ID NO: 118895 - DNA, 35 bp, Artificial Sequence
  Synthetic oligonucleotide
tcactgagggagcgggggggaggaattggggtagc

SEQ ID NO: 118896 - DNA, 35 bp, Artificial Sequence
  Synthetic oligonucleotide
gtcactctagttgccgatttcagccccgccgcctg

SEQ ID NO: 118897 - DNA, 32 bp, Artificial Sequence
  Synthetic oligonucleotide
tcatgacccagctccgcgacttccaccctact

SEQ ID NO: 118898 - DNA, 37 bp, Artificial Sequence
  Synthetic oligonucleotide
ttgcgctctcacttccggcccccctcctgctcgccga

SEQ ID NO: 118899 - DNA, 35 bp, Artificial Sequence
  Synthetic oligonucleotide
attgatcgccgccccttccgttcgccctgtggtac

SEQ ID NO: 118900 - DNA, 35 bp, Artificial Sequence
  Synthetic oligonucleotide
gaaccccgtcatacgttttccacttacgccgccgc

SEQ ID NO: 118901 - DNA, 35 bp, Artificial Sequence
  Synthetic oligonucleotide
aaccaacctccgagcctttcgggacttaccgcctc

SEQ ID NO: 118902 - DNA, 35 bp, Artificial Sequence
  Synthetic oligonucleotide
gtccaccctcaacacggccgctccccgcccggctc

SEQ ID NO: 118903 - DNA, 35 bp, Artificial Sequence
  Synthetic oligonucleotide
tagcccctcgactttgtgctccacctcatccatct

SEQ ID NO: 118904 - DNA, 35 bp, Artificial Sequence
  Synthetic oligonucleotide
gacaacgccccccagcacgctattagccccttcaa

SEQ ID NO: 118905 - DNA, 36 bp, Artificial Sequence
  Synthetic oligonucleotide
gtgggaggggagtggggaggaaactataaaagggaa

SEQ ID NO: 118906 - DNA, 35 bp, Artificial Sequence
  Synthetic oligonucleotide
atcccgcccttacgcgccttctcgtgactttggaa

SEQ ID NO: 118907 - DNA, 36 bp, Artificial Sequence
  Synthetic oligonucleotide
ggagcccctgttcggtttgatcactcgccctcttca

SEQ ID NO: 118908 - DNA, 36 bp, Artificial Sequence
  Synthetic oligonucleotide
gatggtaggcacggggaagaagcggctagggggcga

SEQ ID NO: 118909 - DNA, 37 bp, Artificial Sequence
  Synthetic oligonucleotide
gtccgccttccctccggataacgtgtcttcctcctga

SEQ ID NO: 118910 - DNA, 37 bp, Artificial Sequence
  Synthetic oligonucleotide
gggatctgcccctttgtttttgccgccccttgtttga

SEQ ID NO: 118911 - DNA, 35 bp, Artificial Sequence
  Synthetic oligonucleotide
gcacctcacccgacgtgccattgctccgctaccct

SEQ ID NO: 118912 - DNA, 35 bp, Artificial Sequence
  Synthetic oligonucleotide
gtttcgccacattgttttctcacctttcgatgtct

SEQ ID NO: 118913 - DNA, 35 bp, Artificial Sequence
  Synthetic oligonucleotide
tctacttcgctctgcccgtggctgttcacccttct

SEQ ID NO: 118914 - DNA, 37 bp, Artificial Sequence
  Synthetic oligonucleotide
gacgaacgtgcgggtgggtgggtatacgtaattggga

SEQ ID NO: 118915 - DNA, 35 bp, Artificial Sequence
  Synthetic oligonucleotide
ttatcaccccgaggttcgtttaatgccgctctccc

SEQ ID NO: 118916 - DNA, 35 bp, Artificial Sequence
  Synthetic oligonucleotide
tccatgttgtcgctccactcgtgtttcctaccctc

SEQ ID NO: 118917 - DNA, 35 bp, Artificial Sequence
  Synthetic oligonucleotide
agggaaaggggtggtatggaatgagggagtggaag

SEQ ID NO: 118918 - DNA, 35 bp, Artificial Sequence
  Synthetic oligonucleotide
atgattccccgtgccgttttgtactcctcctcgcg

SEQ ID NO: 118919 - DNA, 35 bp, Artificial Sequence
  Synthetic oligonucleotide
ggtggcccgcgccctgcttatgttttcctcgttat

SEQ ID NO: 118920 - DNA, 37 bp, Artificial Sequence
  Synthetic oligonucleotide
gtctgccctcacctcccaccactccatcagctggcga

SEQ ID NO: 118921 - DNA, 38 bp, Artificial Sequence
  Synthetic oligonucleotide
gaccggggcacaggggtaggagcgggagggggcgatga

SEQ ID NO: 118922 - DNA, 35 bp, Artificial Sequence
  Synthetic oligonucleotide
taacctcgcacctaaaccatccgctctgttctcac

SEQ ID NO: 118923 - DNA, 35 bp, Artificial Sequence
  Synthetic oligonucleotide
gtccaactactcatacgtacccagcctcgctacgc

SEQ ID NO: 118924 - DNA, 35 bp, Artificial Sequence
  Synthetic oligonucleotide
tgtgcgcccctattgctcattccgcttgttgtttc

SEQ ID NO: 118925 - DNA, 35 bp, Artificial Sequence
  Synthetic oligonucleotide
tccgcgagactcgcgcgttcctatctgctacccct

SEQ ID NO: 118926 - DNA, 35 bp, Artificial Sequence
  Synthetic oligonucleotide
tccgccccccgtccccgatgccactcacccgcctt

SEQ ID NO: 118927 - DNA, 35 bp, Artificial Sequence
  Synthetic oligonucleotide
gttgtctcaagccgggtggggagggaacgggactg

SEQ ID NO: 118928 - DNA, 36 bp, Artificial Sequence
  Synthetic oligonucleotide
ccctcgtccactcgaaccgtattgtatgcatttgca

SEQ ID NO: 118929 - DNA, 36 bp, Artificial Sequence
  Synthetic oligonucleotide
atccttcacctctgccccccttggtctgagacacta

SEQ ID NO: 118930 - DNA, 35 bp, Artificial Sequence
  Synthetic oligonucleotide
ttcggagacgactcctgctagttacctgatcccac

SEQ ID NO: 118931 - DNA, 35 bp, Artificial Sequence
  Synthetic oligonucleotide
atcccctcctgttcactgttgactttttgtactgc

SEQ ID NO: 118932 - DNA, 36 bp, Artificial Sequence
  Synthetic oligonucleotide
aaacaaggggtagaggagaaggagaggggttacgaa

SEQ ID NO: 118933 - DNA, 36 bp, Artificial Sequence
  Synthetic oligonucleotide
aacgggacaggtggggtgtagggccagttctgggga

SEQ ID NO: 118934 - DNA, 37 bp, Artificial Sequence
  Synthetic oligonucleotide
gtgtgccatcgcgggtcaagtaacgggcgggtgggga

SEQ ID NO: 118935 - DNA, 36 bp, Artificial Sequence
  Synthetic oligonucleotide
aatgcgtagtccacccactcacccacacctgtctga

SEQ ID NO: 118936 - DNA, 35 bp, Artificial Sequence
  Synthetic oligonucleotide
tcacgatgtcaccctacgcatatgtcccatccgtc

SEQ ID NO: 118937 - DNA, 37 bp, Artificial Sequence
  Synthetic oligonucleotide
acccttgccaaatgctttttaacgttccatccatcga

SEQ ID NO: 118938 - DNA, 38 bp, Artificial Sequence
  Synthetic oligonucleotide
aagcaacgggcgggaggggcgaaggggtcataggctga

SEQ ID NO: 118939 - DNA, 35 bp, Artificial Sequence
  Synthetic oligonucleotide
tagtcccagtgtcagataagtctcttccccccgcc

SEQ ID NO: 118940 - DNA, 36 bp, Artificial Sequence
  Synthetic oligonucleotide
acaccaccctgtcctctcactgttgccaattaagca

SEQ ID NO: 118941 - DNA, 37 bp, Artificial Sequence
  Synthetic oligonucleotide
gggtggggctgggggttaacaaagcttgataagggga

SEQ ID NO: 118942 - DNA, 36 bp, Artificial Sequence
  Synthetic oligonucleotide
gtaacacgccctctaccgacgtgcccccgcccatta

SEQ ID NO: 118943 - DNA, 35 bp, Artificial Sequence
  Synthetic oligonucleotide
gatcctctccgttggcccagaccgggcttgaccac

SEQ ID NO: 118944 - DNA, 35 bp, Artificial Sequence
  Synthetic oligonucleotide
gttgccccgtcccctctacccattacgaccgcagg

SEQ ID NO: 118945 - DNA, 35 bp, Artificial Sequence
  Synthetic oligonucleotide
tgtatccacccattctatctcgagcccaggttcaa

SEQ ID NO: 118946 - DNA, 36 bp, Artificial Sequence
  Synthetic oligonucleotide
gtctgcctccatcttcgttccatttgactctgcata

SEQ ID NO: 118947 - DNA, 35 bp, Artificial Sequence
  Synthetic oligonucleotide
atttcctccgccctcaacatctgtttttgcatcta

SEQ ID NO: 118948 - DNA, 35 bp, Artificial Sequence
  Synthetic oligonucleotide
gcccgcgctgcacttctggctcccgcattttgtcc

SEQ ID NO: 118949 - DNA, 33 bp, Artificial Sequence
  Synthetic oligonucleotide
gacgctccggcctttgtccctttttcgctaatc

SEQ ID NO: 118950 - DNA, 35 bp, Artificial Sequence
  Synthetic oligonucleotide
cctggctggcaattctgcatccaagcactttcctc

SEQ ID NO: 118951 - DNA, 35 bp, Artificial Sequence
  Synthetic oligonucleotide
gtgttgcgcttgcccgttctcctcgttcctacacg

SEQ ID NO: 118952 - DNA, 35 bp, Artificial Sequence
  Synthetic oligonucleotide
gatccgtagttcacgccgcaccattcttgcccccg

SEQ ID NO: 118953 - DNA, 35 bp, Artificial Sequence
  Synthetic oligonucleotide
acacctaccttcagcttgacccccaatgaccctcg

SEQ ID NO: 118954 - DNA, 35 bp, Artificial Sequence
  Synthetic oligonucleotide
acgcccctttcgtgcctcgacgcctgtatctcgct

SEQ ID NO: 118955 - DNA, 35 bp, Artificial Sequence
  Synthetic oligonucleotide
acacccacccacacctgcattcgacttgcttcttt

SEQ ID NO: 118956 - DNA, 37 bp, Artificial Sequence
  Synthetic oligonucleotide
gcgccaccgacgttgcttttccaccccttgccttcga

SEQ ID NO: 118957 - DNA, 38 bp, Artificial Sequence
  Synthetic oligonucleotide
tcacccactccgctcttgtctttgttcagcccgattga

SEQ ID NO: 118958 - DNA, 35 bp, Artificial Sequence
  Synthetic oligonucleotide
gttcgcccaccatcttcattcctcggtgtacttac

SEQ ID NO: 118959 - DNA, 35 bp, Artificial Sequence
  Synthetic oligonucleotide
tcagcccgttggtgcattccccctctcttcgaacc

SEQ ID NO: 118960 - DNA, 35 bp, Artificial Sequence
  Synthetic oligonucleotide
ttaacctgtcccatcggtggccccctttcgtgccc

SEQ ID NO: 118961 - DNA, 35 bp, Artificial Sequence
  Synthetic oligonucleotide
acaccccaacatgttcccattatgatagccacgcc

SEQ ID NO: 118962 - DNA, 35 bp, Artificial Sequence
  Synthetic oligonucleotide
gacatgagccatcggttatagccacctttctctcg

SEQ ID NO: 118963 - DNA, 35 bp, Artificial Sequence
  Synthetic oligonucleotide
agccatccccctgtgtcttccctcctgtagtagtt

SEQ ID NO: 118964 - DNA, 37 bp, Artificial Sequence
  Synthetic oligonucleotide
ggagggggagggagggtctagggccagctatccgcga

SEQ ID NO: 118965 - DNA, 38 bp, Artificial Sequence
  Synthetic oligonucleotide
gcagggggggtgggatgggaacacgtgggcacgcctga

SEQ ID NO: 118966 - DNA, 35 bp, Artificial Sequence
  Synthetic oligonucleotide
gcccccgcccgtccatgcatgaacatcgtccacca

SEQ ID NO: 118967 - DNA, 37 bp, Artificial Sequence
  Synthetic oligonucleotide
gagtgtacgaagtcggaggggagggagataggtggga

SEQ ID NO: 118968 - DNA, 35 bp, Artificial Sequence
  Synthetic oligonucleotide
gaccccatctcacccctatgtctttggcaacctcc

SEQ ID NO: 118969 - DNA, 35 bp, Artificial Sequence
  Synthetic oligonucleotide
gtgtgcccccgtcgcacatttgccctcttctaggc

SEQ ID NO: 118970 - DNA, 35 bp, Artificial Sequence
  Synthetic oligonucleotide
agccaggtcgacgcctgtcctatgacctcccgcct

SEQ ID NO: 118971 - DNA, 35 bp, Artificial Sequence
  Synthetic oligonucleotide
tcacaacgacgccgcagccttgcccccccattggt

SEQ ID NO: 118972 - DNA, 35 bp, Artificial Sequence
  Synthetic oligonucleotide
agccaacctccgactcgcgtgctctccgtccataa

SEQ ID NO: 118973 - DNA, 36 bp, Artificial Sequence
  Synthetic oligonucleotide
accacactgccacaccataaggttcgccccattcca

SEQ ID NO: 118974 - DNA, 36 bp, Artificial Sequence
  Synthetic oligonucleotide
accactggtacgccgcccgtgtatgggttcctctca

SEQ ID NO: 118975 - DNA, 36 bp, Artificial Sequence
  Synthetic oligonucleotide
tacgagacgagagtggagggaaggagcgcttggaga

SEQ ID NO: 118976 - DNA, 37 bp, Artificial Sequence
  Synthetic oligonucleotide
tgcctcccccttgccagtaccgcctcccgtttgccga

SEQ ID NO: 118977 - DNA, 36 bp, Artificial Sequence
  Synthetic oligonucleotide
gttcgccctccatctctatgctattatgcacttgta

SEQ ID NO: 118978 - DNA, 35 bp, Artificial Sequence
  Synthetic oligonucleotide
gtcgcctcattctaactagttgcctccactctgcg

SEQ ID NO: 118979 - DNA, 35 bp, Artificial Sequence
  Synthetic oligonucleotide
acccggaagaagtggggagcgtgggtggaggaggg

SEQ ID NO: 118980 - DNA, 35 bp, Artificial Sequence
  Synthetic oligonucleotide
acaccacaatcgcagttgcctcatgctaaccctct

SEQ ID NO: 118981 - DNA, 35 bp, Artificial Sequence
  Synthetic oligonucleotide
tagattgtgtgccttgttcgtctctcgcgttcctt

SEQ ID NO: 118982 - DNA, 35 bp, Artificial Sequence
  Synthetic oligonucleotide
gactactaccactcggcatatttgcccttctgttt

SEQ ID NO: 118983 - DNA, 36 bp, Artificial Sequence
  Synthetic oligonucleotide
gcatccccacttatcgtatcttgttccagctctcaa

SEQ ID NO: 118984 - DNA, 36 bp, Artificial Sequence
  Synthetic oligonucleotide
agggggagtagtggtacggaggggaggggaagtgga

SEQ ID NO: 118985 - DNA, 35 bp, Artificial Sequence
  Synthetic oligonucleotide
gtgttcgccgccctgttgtttctctcccattgcta

SEQ ID NO: 118986 - DNA, 35 bp, Artificial Sequence
  Synthetic oligonucleotide
tctcccctgcatcattgtaaccccaccgtcttccc

SEQ ID NO: 118987 - DNA, 35 bp, Artificial Sequence
  Synthetic oligonucleotide
agtcaccacacactgccgggcagattcccccctcc

SEQ ID NO: 118988 - DNA, 35 bp, Artificial Sequence
  Synthetic oligonucleotide
gctcaccccctcatgacttttcgtacactcgactt

SEQ ID NO: 118989 - DNA, 37 bp, Artificial Sequence
  Synthetic oligonucleotide
gtcaaacggggtgggcagggggagggtccgatcacga

SEQ ID NO: 118990 - DNA, 36 bp, Artificial Sequence
  Synthetic oligonucleotide
acgtggagggtgggactagaaacgggaggaaagcga

SEQ ID NO: 118991 - DNA, 38 bp, Artificial Sequence
  Synthetic oligonucleotide
accaaccccttcactgtgctccgcttagcctggcctga

SEQ ID NO: 118992 - DNA, 35 bp, Artificial Sequence
  Synthetic oligonucleotide
tgcgaaaagggggtaggactgagggcggtggtagg

SEQ ID NO: 118993 - DNA, 35 bp, Artificial Sequence
  Synthetic oligonucleotide
gccgcccccacacgttcctattggttccagttcct

SEQ ID NO: 118994 - DNA, 36 bp, Artificial Sequence
  Synthetic oligonucleotide
gtccgccttctgcatccccccactaccgtcctacga

SEQ ID NO: 118995 - DNA, 35 bp, Artificial Sequence
  Synthetic oligonucleotide
acgccaccccgctccttttgctttatcagttctta

SEQ ID NO: 118996 - DNA, 35 bp, Artificial Sequence
  Synthetic oligonucleotide
acccgacctcatagacactccccagtgccccgacc

SEQ ID NO: 118997 - DNA, 35 bp, Artificial Sequence
  Synthetic oligonucleotide
agcccctgcagcaccgcttataccctttcgtgccc

SEQ ID NO: 118998 - DNA, 35 bp, Artificial Sequence
  Synthetic oligonucleotide
gatgtcactgctcgctcccgcctctttgtctatct

SEQ ID NO: 118999 - DNA, 35 bp, Artificial Sequence
  Synthetic oligonucleotide
agcatgagcacaatgccgtcccccccggtcccgtt

SEQ ID NO: 119000 - DNA, 36 bp, Artificial Sequence
  Synthetic oligonucleotide
actgacgcccgcccgtcgtatgttgcgccaccccca

SEQ ID NO: 119001 - DNA, 36 bp, Artificial Sequence
  Synthetic oligonucleotide
gtgtggggcgggcgtggggtcagagctggatgggga

SEQ ID NO: 119002 - DNA, 38 bp, Artificial Sequence
  Synthetic oligonucleotide
gtgcccactatatctgtatttcggcctcccaaccttga

SEQ ID NO: 119003 - DNA, 32 bp, Artificial Sequence
  Synthetic oligonucleotide
taatgtgagggtggggctggggggagggttga

SEQ ID NO: 119004 - DNA, 36 bp, Artificial Sequence
  Synthetic oligonucleotide
tgtgacatgcaaggaggggtgggatggtgaggggta

SEQ ID NO: 119005 - DNA, 36 bp, Artificial Sequence
  Synthetic oligonucleotide
atgcacgcactgctccggttccccttgccatcttta

SEQ ID NO: 119006 - DNA, 35 bp, Artificial Sequence
  Synthetic oligonucleotide
atcacccgtctggaagtccggtccagttctcgcct

SEQ ID NO: 119007 - DNA, 37 bp, Artificial Sequence
  Synthetic oligonucleotide
gccattccctcacatcgtgcaattctcttcccctgga

SEQ ID NO: 119008 - DNA, 36 bp, Artificial Sequence
  Synthetic oligonucleotide
ttacccctcgcctatgttacgcgccctgaattttga

SEQ ID NO: 119009 - DNA, 36 bp, Artificial Sequence
  Synthetic oligonucleotide
tcctccccgtagtctgtacatcatcccctgtcttta

SEQ ID NO: 119010 - DNA, 35 bp, Artificial Sequence
  Synthetic oligonucleotide
agcacacccgccactccctccctgatgtgctatcc

SEQ ID NO: 119011 - DNA, 35 bp, Artificial Sequence
  Synthetic oligonucleotide
tgccgatgtaactatgctccactctgaccccctgc

SEQ ID NO: 119012 - DNA, 35 bp, Artificial Sequence
  Synthetic oligonucleotide
atctcttgcccgccctgcgccatccctaatttctc

SEQ ID NO: 119013 - DNA, 35 bp, Artificial Sequence
  Synthetic oligonucleotide
gtgagacttagttgggagggagggagcagggccgg

SEQ ID NO: 119014 - DNA, 35 bp, Artificial Sequence
  Synthetic oligonucleotide
gatgcccgctgatacacccgccactcgatcctcac

SEQ ID NO: 119015 - DNA, 35 bp, Artificial Sequence
  Synthetic oligonucleotide
tcgatccccgcatcctgcccggtcgcctggtttac

SEQ ID NO: 119016 - DNA, 35 bp, Artificial Sequence
  Synthetic oligonucleotide
aacaacacgcgcatagctccccctgcgtgcctatc

SEQ ID NO: 119017 - DNA, 35 bp, Artificial Sequence
  Synthetic oligonucleotide
accgaccccccgcaactatcatctaggagaccgat

SEQ ID NO: 119018 - DNA, 35 bp, Artificial Sequence
  Synthetic oligonucleotide
gggtggcgggggggttttgcggatggcacatcgct

SEQ ID NO: 119019 - DNA, 38 bp, Artificial Sequence
  Synthetic oligonucleotide
acctcgcaccaccaattggcacccatagtcatgcctga

SEQ ID NO: 119020 - DNA, 37 bp, Artificial Sequence
  Synthetic oligonucleotide
taagaggggagggaggagagcgggcgtggcatgctga

SEQ ID NO: 119021 - DNA, 35 bp, Artificial Sequence
  Synthetic oligonucleotide
acacgctacctccatgccgtattatcccctgggcc

SEQ ID NO: 119022 - DNA, 35 bp, Artificial Sequence
  Synthetic oligonucleotide
tgcccgcagccccgtacgcttcaccaatccgctcc

SEQ ID NO: 119023 - DNA, 35 bp, Artificial Sequence
  Synthetic oligonucleotide
ggtctgcccagcgccatccaagcagtccttgtatc

SEQ ID NO: 119024 - DNA, 35 bp, Artificial Sequence
  Synthetic oligonucleotide
gttgtaccttccgcctcccctgattagtgcgtgtc

SEQ ID NO: 119025 - DNA, 35 bp, Artificial Sequence
  Synthetic oligonucleotide
gagccagccctatacgccccgaggttttccccccg

SEQ ID NO: 119026 - DNA, 35 bp, Artificial Sequence
  Synthetic oligonucleotide
gctataccccgcccctcctcgatacgaagtagact

SEQ ID NO: 119027 - DNA, 35 bp, Artificial Sequence
  Synthetic oligonucleotide
tcgccccatcgcctgtcatccctgtacctaagcgt

SEQ ID NO: 119028 - DNA, 35 bp, Artificial Sequence
  Synthetic oligonucleotide
gttgatcaccgccgcccctcacccgcagttttttt

SEQ ID NO: 119029 - DNA, 36 bp, Artificial Sequence
  Synthetic oligonucleotide
acccccgctccctgcttctacctagtgtcatgaaca

SEQ ID NO: 119030 - DNA, 36 bp, Artificial Sequence
  Synthetic oligonucleotide
gctcagtgccggatgtccctgtcccctcgccgtgca

SEQ ID NO: 119031 - DNA, 35 bp, Artificial Sequence
  Synthetic oligonucleotide
gtgagtcggggtggagattaacaggggaggagcga

SEQ ID NO: 119032 - DNA, 36 bp, Artificial Sequence
  Synthetic oligonucleotide
tatgtaccaccgctccatgtttacccctccaggcga

SEQ ID NO: 119033 - DNA, 35 bp, Artificial Sequence
  Synthetic oligonucleotide
gtcaacacccctcttgtgcctaactttcatgtcac

SEQ ID NO: 119034 - DNA, 35 bp, Artificial Sequence
  Synthetic oligonucleotide
agccgccccccgcgtattctagggtcgccctcgcc

SEQ ID NO: 119035 - DNA, 35 bp, Artificial Sequence
  Synthetic oligonucleotide
ataccgccctgtccaacccctgcctactagaatcc

SEQ ID NO: 119036 - DNA, 35 bp, Artificial Sequence
  Synthetic oligonucleotide
ttaccgcacagttccgacatcactaccggccatcc

SEQ ID NO: 119037 - DNA, 35 bp, Artificial Sequence
  Synthetic oligonucleotide
tgtcccacccccggttgatgaaccctcgaccatgc

SEQ ID NO: 119038 - DNA, 35 bp, Artificial Sequence
  Synthetic oligonucleotide
ttgtccctcggacagacgtgacgccatccctcctt

SEQ ID NO: 119039 - DNA, 36 bp, Artificial Sequence
  Synthetic oligonucleotide
atgcaagacaatcgcgttatttcctgctctcttcac

SEQ ID NO: 119040 - DNA, 35 bp, Artificial Sequence
  Synthetic oligonucleotide
gatggctgctgtcgctcctgcccccccctttaggt

SEQ ID NO: 119041 - DNA, 37 bp, Artificial Sequence
  Synthetic oligonucleotide
tgtgggagggacgtgggaaggggagagagggagggga

SEQ ID NO: 119042 - DNA, 36 bp, Artificial Sequence
  Synthetic oligonucleotide
tgaacacaggaaggggaggagggaattgggtcagac

SEQ ID NO: 119043 - DNA, 35 bp, Artificial Sequence
  Synthetic oligonucleotide
tcacgtgcgctcctactgtcacttgttctctttac

SEQ ID NO: 119044 - DNA, 35 bp, Artificial Sequence
  Synthetic oligonucleotide
gttgtccaatcgccactcaataaccgacctcctcg

SEQ ID NO: 119045 - DNA, 35 bp, Artificial Sequence
  Synthetic oligonucleotide
aacgcactcgaccgaagtcgtcacatctctctctt

SEQ ID NO: 119046 - DNA, 37 bp, Artificial Sequence
  Synthetic oligonucleotide
gctcacgcctctccgtcattctgcattctgtcccgga

SEQ ID NO: 119047 - DNA, 35 bp, Artificial Sequence
  Synthetic oligonucleotide
ttcgtgcacccatgcccggcccacctgtgtcgccc

SEQ ID NO: 119048 - DNA, 35 bp, Artificial Sequence
  Synthetic oligonucleotide
gcctcctgctgagtagtccacccgcttacctacgc

SEQ ID NO: 119049 - DNA, 36 bp, Artificial Sequence
  Synthetic oligonucleotide
acgataccagcgcttttggtcctttggcgttccatc

SEQ ID NO: 119050 - DNA, 35 bp, Artificial Sequence
  Synthetic oligonucleotide
gcctccccccacaatggtacaacgcaaaccgtatc

SEQ ID NO: 119051 - DNA, 35 bp, Artificial Sequence
  Synthetic oligonucleotide
tcagccgcccatcccccctatttcagcttccgctg

SEQ ID NO: 119052 - DNA, 35 bp, Artificial Sequence
  Synthetic oligonucleotide
acatccaaccatcattcgcaccatccttgtggttg

SEQ ID NO: 119053 - DNA, 35 bp, Artificial Sequence
  Synthetic oligonucleotide
gtcacccaccactgctttcgttactgccgcaccct

SEQ ID NO: 119054 - DNA, 35 bp, Artificial Sequence
  Synthetic oligonucleotide
gcccttgctcgccattccatcgtatacgcactcct

SEQ ID NO: 119055 - DNA, 35 bp, Artificial Sequence
  Synthetic oligonucleotide
tctaccatcgcgtgttcttctgccccttgtatccc

SEQ ID NO: 119056 - DNA, 35 bp, Artificial Sequence
  Synthetic oligonucleotide
agtcccgcctaccagcgtgtcttgtccgcccttgt

SEQ ID NO: 119057 - DNA, 37 bp, Artificial Sequence
  Synthetic oligonucleotide
gagatgggaggggaggttgtaggaacaaaggacaaga

SEQ ID NO: 119058 - DNA, 35 bp, Artificial Sequence
  Synthetic oligonucleotide
taaagacgcccacttgctgttcatcccgcccttga

SEQ ID NO: 119059 - DNA, 35 bp, Artificial Sequence
  Synthetic oligonucleotide
gtacgcagtcctctctcgcggtctcttttgccata

SEQ ID NO: 119060 - DNA, 35 bp, Artificial Sequence
  Synthetic oligonucleotide
aactctgctccacgattcgttgtctccgcctcgcc

SEQ ID NO: 119061 - DNA, 35 bp, Artificial Sequence
  Synthetic oligonucleotide
attggagggcgggaaaagtgcgggaggggaaattg

SEQ ID NO: 119062 - DNA, 35 bp, Artificial Sequence
  Synthetic oligonucleotide
tacatccttagttcgttcattatagcgcctcccca

SEQ ID NO: 119063 - DNA, 35 bp, Artificial Sequence
  Synthetic oligonucleotide
accgccacccccatctcttccattcagttcatgca

SEQ ID NO: 119064 - DNA, 38 bp, Artificial Sequence
  Synthetic oligonucleotide
tcccatgtggcggtctgttctactcttctcctcgctga

SEQ ID NO: 119065 - DNA, 36 bp, Artificial Sequence
  Synthetic oligonucleotide
gacccctcctcctgctgtctcaattaccgagcttta

SEQ ID NO: 119066 - DNA, 35 bp, Artificial Sequence
  Synthetic oligonucleotide
tgtatcgtccacgcgtgcaacccctactcgctccc

SEQ ID NO: 119067 - DNA, 35 bp, Artificial Sequence
  Synthetic oligonucleotide
tccccagactgaatctgatagtccctcctcgccct

SEQ ID NO: 119068 - DNA, 35 bp, Artificial Sequence
  Synthetic oligonucleotide
tgcatgttgggcggggctcgtatgtatggtggctt

SEQ ID NO: 119069 - DNA, 36 bp, Artificial Sequence
  Synthetic oligonucleotide
tctccactcgatttgaacctgctccccggtatgcca

SEQ ID NO: 119070 - DNA, 36 bp, Artificial Sequence
  Synthetic oligonucleotide
aagccgacgctcgtcttttatgctcttctccctcca

SEQ ID NO: 119071 - DNA, 38 bp, Artificial Sequence
  Synthetic oligonucleotide
tcccccgccattcgcgcatcactgttagctctttctga

SEQ ID NO: 119072 - DNA, 35 bp, Artificial Sequence
  Synthetic oligonucleotide
ggatcatcgccctacacgccgtccgtgacccgctc

SEQ ID NO: 119073 - DNA, 34 bp, Artificial Sequence
  Synthetic oligonucleotide
ggttgagtcgccatccgatcactcgcccccgttc

SEQ ID NO: 119074 - DNA, 35 bp, Artificial Sequence
  Synthetic oligonucleotide
accgcctcctctcgcactcattaaagctcgctgcg

SEQ ID NO: 119075 - DNA, 35 bp, Artificial Sequence
  Synthetic oligonucleotide
acacttgttccgctgcttatttacgcctgttctcg

SEQ ID NO: 119076 - DNA, 35 bp, Artificial Sequence
  Synthetic oligonucleotide
gaaaccaccttcacctccgccccgctgtccattcg

SEQ ID NO: 119077 - DNA, 35 bp, Artificial Sequence
  Synthetic oligonucleotide
ggttacccatccgcccctccccgtctgcatccttg

SEQ ID NO: 119078 - DNA, 35 bp, Artificial Sequence
  Synthetic oligonucleotide
ttgatcgcactccaccctaccacgtccctggttgt

SEQ ID NO: 119079 - DNA, 36 bp, Artificial Sequence
  Synthetic oligonucleotide
ggtgagggacagggaggtaagggactagcaacgtca

SEQ ID NO: 119080 - DNA, 37 bp, Artificial Sequence
  Synthetic oligonucleotide
tccgtctccgcccttcccccccagtcccatgctacga

SEQ ID NO: 119081 - DNA, 35 bp, Artificial Sequence
  Synthetic oligonucleotide
acgaccccgcccctacgtttagtctgtcgccccga

SEQ ID NO: 119082 - DNA, 36 bp, Artificial Sequence
  Synthetic oligonucleotide
gttcgccttcgccctcttgaatagtcacccgtttta

SEQ ID NO: 119083 - DNA, 35 bp, Artificial Sequence
  Synthetic oligonucleotide
ggaccccccgtactaccgttttatcaagcaccgcg

SEQ ID NO: 119084 - DNA, 35 bp, Artificial Sequence
  Synthetic oligonucleotide
agcaggggaagcaggaggggggagggtatctgggg

SEQ ID NO: 119085 - DNA, 35 bp, Artificial Sequence
  Synthetic oligonucleotide
tgtcgcctccgagtcttctttatcgctctggctct

SEQ ID NO: 119086 - DNA, 35 bp, Artificial Sequence
  Synthetic oligonucleotide
tactgccccctgatcctgcgcctttttacggaatt

SEQ ID NO: 119087 - DNA, 38 bp, Artificial Sequence
  Synthetic oligonucleotide
tgtaccatccccgtgccctcatggcgccctgcctttga

SEQ ID NO: 119088 - DNA, 35 bp, Artificial Sequence
  Synthetic oligonucleotide
aagtggggcgggaaaatgaagggtagggagttcgg

SEQ ID NO: 119089 - DNA, 35 bp, Artificial Sequence
  Synthetic oligonucleotide
aggatagggaagggagggcttaacaaggggggtgg

SEQ ID NO: 119090 - DNA, 34 bp, Artificial Sequence
  Synthetic oligonucleotide
agctctgcctcgagcgtaaacaccactcctcctg

SEQ ID NO: 119091 - DNA, 38 bp, Artificial Sequence
  Synthetic oligonucleotide
ggtgtaggggaagggtgaggggcaaggcaacagtgtga

SEQ ID NO: 119092 - DNA, 35 bp, Artificial Sequence
  Synthetic oligonucleotide
tccctccgacctcacgcttatattctggtccctta

SEQ ID NO: 119093 - DNA, 35 bp, Artificial Sequence
  Synthetic oligonucleotide
gttcacgccgtaccctagttgcccgatatttatac

SEQ ID NO: 119094 - DNA, 35 bp, Artificial Sequence
  Synthetic oligonucleotide
ttgtaagcggccagattgcctccccccttgtgcgc

SEQ ID NO: 119095 - DNA, 35 bp, Artificial Sequence
  Synthetic oligonucleotide
ttcgctcacaatgctcccctttgcctgatcaaatc

SEQ ID NO: 119096 - DNA, 35 bp, Artificial Sequence
  Synthetic oligonucleotide
gccgcaccgctggtgcaatttaccgcatccctatc

SEQ ID NO: 119097 - DNA, 35 bp, Artificial Sequence
  Synthetic oligonucleotide
gccaccgtcacactcgtcgttttcccccaaaccct

SEQ ID NO: 119098 - DNA, 37 bp, Artificial Sequence
  Synthetic oligonucleotide
gatcagggacaacaaaaggggggcggacgcgggacga

SEQ ID NO: 119099 - DNA, 37 bp, Artificial Sequence
  Synthetic oligonucleotide
tctgagcgccacaagcttatatcaccccttcctctga

SEQ ID NO: 119100 - DNA, 38 bp, Artificial Sequence
  Synthetic oligonucleotide
atgctccatccatggcgtcataccgattcctctcttga

SEQ ID NO: 119101 - DNA, 36 bp, Artificial Sequence
  Synthetic oligonucleotide
gcccaccccctgcattcttcccgttccgaaccgtta

SEQ ID NO: 119102 - DNA, 35 bp, Artificial Sequence
  Synthetic oligonucleotide
tgccgtacacctcgctgatctctgcctatcattgc

SEQ ID NO: 119103 - DNA, 35 bp, Artificial Sequence
  Synthetic oligonucleotide
tgatcccccagagtcgatgccctttcctccgcctt

SEQ ID NO: 119104 - DNA, 35 bp, Artificial Sequence
  Synthetic oligonucleotide
tgcacctcctcgtcccctgttcctatacggtccca

SEQ ID NO: 119105 - DNA, 37 bp, Artificial Sequence
  Synthetic oligonucleotide
ttcgcgcagacactttgcctatcacctctctttccga

SEQ ID NO: 119106 - DNA, 35 bp, Artificial Sequence
  Synthetic oligonucleotide
cacacgccaccagctcttgttctttccgtccctta

SEQ ID NO: 119107 - DNA, 35 bp, Artificial Sequence
  Synthetic oligonucleotide
acgccctgcactgttccatcccgcttggataccac

SEQ ID NO: 119108 - DNA, 35 bp, Artificial Sequence
  Synthetic oligonucleotide
ttgactacgccatcccttgcttgttcccgcttttt

SEQ ID NO: 119109 - DNA, 37 bp, Artificial Sequence
  Synthetic oligonucleotide
accctcaccacactacgcccagcccacccggagtgga

SEQ ID NO: 119110 - DNA, 36 bp, Artificial Sequence
  Synthetic oligonucleotide
gtccaccgcaatctcgtgagggccactaccctttga

SEQ ID NO: 119111 - DNA, 35 bp, Artificial Sequence
  Synthetic oligonucleotide
acatctacctccgcctgaacgaagttggttcaccc

SEQ ID NO: 119112 - DNA, 35 bp, Artificial Sequence
  Synthetic oligonucleotide
ttcctctgtcctccgcggtgctctccccttccctc

SEQ ID NO: 119113 - DNA, 36 bp, Artificial Sequence
  Synthetic oligonucleotide
gcccatccgtcatcttcgtgctgctctacattgctc

SEQ ID NO: 119114 - DNA, 35 bp, Artificial Sequence
  Synthetic oligonucleotide
tcattaccctctgtacgctgcatgagcaacttctc

SEQ ID NO: 119115 - DNA, 35 bp, Artificial Sequence
  Synthetic oligonucleotide
tattggtacccgccccgccctgctgctcatccctt

SEQ ID NO: 119116 - DNA, 35 bp, Artificial Sequence
  Synthetic oligonucleotide
ttagcccagcccttcttgatacccggcccgtattt

SEQ ID NO: 119117 - DNA, 37 bp, Artificial Sequence
  Synthetic oligonucleotide
tcacgtcacctgctccgtctcgggttcatcttgtcga

SEQ ID NO: 119118 - DNA, 37 bp, Artificial Sequence
  Synthetic oligonucleotide
agaggaaaggccagggaagggcaaagaggggaaggga

SEQ ID NO: 119119 - DNA, 33 bp, Artificial Sequence
  Synthetic oligonucleotide
tagcaacctgtggcccccccccgctccactagc

SEQ ID NO: 119120 - DNA, 35 bp, Artificial Sequence
  Synthetic oligonucleotide
ggagccgttcaactgttatcttctcttcctcttcg

SEQ ID NO: 119121 - DNA, 35 bp, Artificial Sequence
  Synthetic oligonucleotide
attgggggggagggatcggtgatagttgggcgttg

SEQ ID NO: 119122 - DNA, 33 bp, Artificial Sequence
  Synthetic oligonucleotide
actcgactccgccgcaccgagcactcttttgca

SEQ ID NO: 119123 - DNA, 37 bp, Artificial Sequence
  Synthetic oligonucleotide
gactcgctccgaacgcccctctccacatctgtcccga

SEQ ID NO: 119124 - DNA, 38 bp, Artificial Sequence
  Synthetic oligonucleotide
gacccctccgagccctggacttggccacccattcttga

SEQ ID NO: 119125 - DNA, 33 bp, Artificial Sequence
  Synthetic oligonucleotide
tctcggaacggtcctgacctccatttttcccac

SEQ ID NO: 119126 - DNA, 34 bp, Artificial Sequence
  Synthetic oligonucleotide
gtaccgtaaatccgccgctgcccccccgcacttg

SEQ ID NO: 119127 - DNA, 35 bp, Artificial Sequence
  Synthetic oligonucleotide
atcgccgatgtccaatgccgctacattcgccgcct

SEQ ID NO: 119128 - DNA, 35 bp, Artificial Sequence
  Synthetic oligonucleotide
ggaccacgtccaccgttcccaaagccacacgccca

SEQ ID NO: 119129 - DNA, 36 bp, Artificial Sequence
  Synthetic oligonucleotide
gcacgtgttgtttggtaccgttccccctctatctca

SEQ ID NO: 119130 - DNA, 36 bp, Artificial Sequence
  Synthetic oligonucleotide
gagtcagggaaggaggccggtgtgggggtggtgaga

SEQ ID NO: 119131 - DNA, 37 bp, Artificial Sequence
  Synthetic oligonucleotide
ttaccacggcaagggggcaggggtgggagggggcgga

SEQ ID NO: 119132 - DNA, 35 bp, Artificial Sequence
  Synthetic oligonucleotide
ttcgcacacactccattcctggccatgaacactta

SEQ ID NO: 119133 - DNA, 35 bp, Artificial Sequence
  Synthetic oligonucleotide
tgcactgccacacatacccatctcctaccagggcc

SEQ ID NO: 119134 - DNA, 35 bp, Artificial Sequence
  Synthetic oligonucleotide
ttgcacaacattctctggcactccgggcgttctcc

SEQ ID NO: 119135 - DNA, 35 bp, Artificial Sequence
  Synthetic oligonucleotide
tccgtatcaaccaactgtctatagtacttcaccgc

SEQ ID NO: 119136 - DNA, 35 bp, Artificial Sequence
  Synthetic oligonucleotide
gtgacacgctacttcccctccccttaaactgcggg

SEQ ID NO: 119137 - DNA, 35 bp, Artificial Sequence
  Synthetic oligonucleotide
gagagaggggtataggatgggttaggaaagggggg

SEQ ID NO: 119138 - DNA, 35 bp, Artificial Sequence
  Synthetic oligonucleotide
accgcccctccatcctgtatctatatggccccaga

SEQ ID NO: 119139 - DNA, 37 bp, Artificial Sequence
  Synthetic oligonucleotide
acgttcgccctcctgtcctcgtatgcgccttccctga

SEQ ID NO: 119140 - DNA, 36 bp, Artificial Sequence
  Synthetic oligonucleotide
gctcctcccgccagaatcatacccttgcctgcccta

SEQ ID NO: 119141 - DNA, 35 bp, Artificial Sequence
  Synthetic oligonucleotide
ttccgagctcacgtttaggccttccacgttccccc

SEQ ID NO: 119142 - DNA, 36 bp, Artificial Sequence
  Synthetic oligonucleotide
ttcgaccacaccagcctcctaccaatgtccttcgag

SEQ ID NO: 119143 - DNA, 35 bp, Artificial Sequence
  Synthetic oligonucleotide
tagatgcatgccaccacctctccgtcacctgagcg

SEQ ID NO: 119144 - DNA, 37 bp, Artificial Sequence
  Synthetic oligonucleotide
gatggggtgggtgggtaattacagggacattgtatga

SEQ ID NO: 119145 - DNA, 37 bp, Artificial Sequence
  Synthetic oligonucleotide
tcactcgcgctctgccgctatacattgccctacctga

SEQ ID NO: 119146 - DNA, 36 bp, Artificial Sequence
  Synthetic oligonucleotide
tcaacgccctcccgttgtacctccttcatcaagaca

SEQ ID NO: 119147 - DNA, 36 bp, Artificial Sequence
  Synthetic oligonucleotide
tcgcgccccctccggctttcatggatttcgccccga

SEQ ID NO: 119148 - DNA, 37 bp, Artificial Sequence
  Synthetic oligonucleotide
ttgtactccggcacagtcgctacccgcccttccccga

SEQ ID NO: 119149 - DNA, 35 bp, Artificial Sequence
  Synthetic oligonucleotide
cacggggtttcgctgttgttcttctctatctccga

SEQ ID NO: 119150 - DNA, 37 bp, Artificial Sequence
  Synthetic oligonucleotide
gggacgggggggtacggaatagagggtggatatttga

SEQ ID NO: 119151 - DNA, 35 bp, Artificial Sequence
  Synthetic oligonucleotide
tgtacgctactgtcccgtcccgtatttatgcctcc

SEQ ID NO: 119152 - DNA, 35 bp, Artificial Sequence
  Synthetic oligonucleotide
gcctgcatggtgttcctgtccgtagtaccttccgc

SEQ ID NO: 119153 - DNA, 35 bp, Artificial Sequence
  Synthetic oligonucleotide
tcgaccggctctggcccctccccttattttggctc

SEQ ID NO: 119154 - DNA, 35 bp, Artificial Sequence
  Synthetic oligonucleotide
tgtcattgccatgcctcgttcctgtcttatttctg

SEQ ID NO: 119155 - DNA, 35 bp, Artificial Sequence
  Synthetic oligonucleotide
gccctccgcaactattcctagagtcttcgctcctt

SEQ ID NO: 119156 - DNA, 36 bp, Artificial Sequence
  Synthetic oligonucleotide
gtaccaccccaccgtgttcgagttcaaacgacccca

SEQ ID NO: 119157 - DNA, 36 bp, Artificial Sequence
  Synthetic oligonucleotide
aactccgcatgcactctatctcgttcgtaagcccca

SEQ ID NO: 119158 - DNA, 35 bp, Artificial Sequence
  Synthetic oligonucleotide
tctcagcccatactcccgcctggtctcgctaatgc

SEQ ID NO: 119159 - DNA, 35 bp, Artificial Sequence
  Synthetic oligonucleotide
tatcccctacggagtacctatggaccacccttttg

SEQ ID NO: 119160 - DNA, 35 bp, Artificial Sequence
  Synthetic oligonucleotide
actcgacccaccgcccgatttctgcctattaccat

SEQ ID NO: 119161 - DNA, 35 bp, Artificial Sequence
  Synthetic oligonucleotide
atgcacagacctgaccctcttttgttgacctcttt

SEQ ID NO: 119162 - DNA, 35 bp, Artificial Sequence
  Synthetic oligonucleotide
actcgttggactctgctatttcatctcgttcttca

SEQ ID NO: 119163 - DNA, 38 bp, Artificial Sequence
  Synthetic oligonucleotide
gcccacacctctgtccgtctccctacagtaccgcgtga

SEQ ID NO: 119164 - DNA, 34 bp, Artificial Sequence
  Synthetic oligonucleotide
gaccaacgccgcccctatccgcattagttcgtta

SEQ ID NO: 119165 - DNA, 35 bp, Artificial Sequence
  Synthetic oligonucleotide
atactccgccctcctttgttagcgcttccgctgcg

SEQ ID NO: 119166 - DNA, 35 bp, Artificial Sequence
  Synthetic oligonucleotide
gagcgcagatacaacttgtcgtccctgctcctaca

SEQ ID NO: 119167 - DNA, 35 bp, Artificial Sequence
  Synthetic oligonucleotide
acccaccctactccacggtaacatgtgattctccc

SEQ ID NO: 119168 - DNA, 35 bp, Artificial Sequence
  Synthetic oligonucleotide
agtgggggggaaggacgactacaggtgaaacggca

SEQ ID NO: 119169 - DNA, 38 bp, Artificial Sequence
  Synthetic oligonucleotide
gtgacggtggagagaggggaaagcggagtagcgtgtga

SEQ ID NO: 119170 - DNA, 35 bp, Artificial Sequence
  Synthetic oligonucleotide
tcccacacgctccgctgccacctggcttgaactcc

SEQ ID NO: 119171 - DNA, 35 bp, Artificial Sequence
  Synthetic oligonucleotide
actaacccccacttatgtcattgctcctgttcctt

SEQ ID NO: 119172 - DNA, 35 bp, Artificial Sequence
  Synthetic oligonucleotide
gctatcccgcatgttcttttagcctgtttcctttt

SEQ ID NO: 119173 - DNA, 36 bp, Artificial Sequence
  Synthetic oligonucleotide
gctcacccctcgctgaggtcctcgttaatcaaatca

SEQ ID NO: 119174 - DNA, 37 bp, Artificial Sequence
  Synthetic oligonucleotide
agccagtagggcgggttaggggaaagtgggggtacga

SEQ ID NO: 119175 - DNA, 37 bp, Artificial Sequence
  Synthetic oligonucleotide
ttcggaacgggattaggggcgggtggaaagggaggga

SEQ ID NO: 119176 - DNA, 35 bp, Artificial Sequence
  Synthetic oligonucleotide
gacgttcgcgagctggtgcgagcttttcccctcta

SEQ ID NO: 119177 - DNA, 35 bp, Artificial Sequence
  Synthetic oligonucleotide
atccgacactttgtgcttctttccatcgtgccctc

SEQ ID NO: 119178 - DNA, 35 bp, Artificial Sequence
  Synthetic oligonucleotide
gaccgacctcggctccacctgcacaacgcactgct

SEQ ID NO: 119179 - DNA, 35 bp, Artificial Sequence
  Synthetic oligonucleotide
gaaccccatctgctcgtgatttccccgttatccca

SEQ ID NO: 119180 - DNA, 37 bp, Artificial Sequence
  Synthetic oligonucleotide
acaagaacgggcagaggagggagggggttgaccgaga

SEQ ID NO: 119181 - DNA, 37 bp, Artificial Sequence
  Synthetic oligonucleotide
attgggggtgggaagggggataggagtgaaggctaga

SEQ ID NO: 119182 - DNA, 37 bp, Artificial Sequence
  Synthetic oligonucleotide
taccctcagccctgtgcttctccaccactccctggga

SEQ ID NO: 119183 - DNA, 38 bp, Artificial Sequence
  Synthetic oligonucleotide
gaatggtgacggccggaaaggggcggattggcgggtga

SEQ ID NO: 119184 - DNA, 36 bp, Artificial Sequence
  Synthetic oligonucleotide
tacatctagcccgccacccctgcctctaggagccta

SEQ ID NO: 119185 - DNA, 35 bp, Artificial Sequence
  Synthetic oligonucleotide
gtcacgcatttcagtgcccctcccgtgcccttcac

SEQ ID NO: 119186 - DNA, 35 bp, Artificial Sequence
  Synthetic oligonucleotide
ttggcattaccccagctccctgttctaccggccct

SEQ ID NO: 119187 - DNA, 35 bp, Artificial Sequence
  Synthetic oligonucleotide
gtacccctcgcccacgtttccctagcgtatccgct

SEQ ID NO: 119188 - DNA, 35 bp, Artificial Sequence
  Synthetic oligonucleotide
gttcacctgcgtacctcgtcgtctctgtctctctt

SEQ ID NO: 119189 - DNA, 37 bp, Artificial Sequence
  Synthetic oligonucleotide
acgaaccctccgctgtacttatcaacacgcctaccga

SEQ ID NO: 119190 - DNA, 36 bp, Artificial Sequence
  Synthetic oligonucleotide
agtagggaatggaggctggtaactgggtggggagga

SEQ ID NO: 119191 - DNA, 35 bp, Artificial Sequence
  Synthetic oligonucleotide
tgatccctttcctgccagttgcgtctgcgcgctcc

SEQ ID NO: 119192 - DNA, 35 bp, Artificial Sequence
  Synthetic oligonucleotide
ttgccgccccggatcctgcctcacccgaatactgc

SEQ ID NO: 119193 - DNA, 35 bp, Artificial Sequence
  Synthetic oligonucleotide
ttcccccgcccttcatcctttgttcaggttacgct

SEQ ID NO: 119194 - DNA, 35 bp, Artificial Sequence
  Synthetic oligonucleotide
tgtcgtcattcgcccatgcttctcctgcctcatgt

SEQ ID NO: 119195 - DNA, 35 bp, Artificial Sequence
  Synthetic oligonucleotide
gttgtgtgtaggcccgctcccccatccctggtaca

SEQ ID NO: 119196 - DNA, 35 bp, Artificial Sequence
  Synthetic oligonucleotide
ttctccgactggagtaacggtacttgccctctcca

SEQ ID NO: 119197 - DNA, 36 bp, Artificial Sequence
  Synthetic oligonucleotide
acccctcccgccatgctcgtcccacccgacttttca

SEQ ID NO: 119198 - DNA, 35 bp, Artificial Sequence
  Synthetic oligonucleotide
gttccaccgccataccgatccaccacatgcacgga

SEQ ID NO: 119199 - DNA, 37 bp, Artificial Sequence
  Synthetic oligonucleotide
gaggtggacggtgggggaaaggttcggtcgagaggga

SEQ ID NO: 119200 - DNA, 37 bp, Artificial Sequence
  Synthetic oligonucleotide
ggggaggggtacgggaggagggtagaaaacgtcgtga

SEQ ID NO: 119201 - DNA, 36 bp, Artificial Sequence
  Synthetic oligonucleotide
gcccaccgccctatttctgtgcctcttgatcttgta

SEQ ID NO: 119202 - DNA, 36 bp, Artificial Sequence
  Synthetic oligonucleotide
tcacccctgttctgtacttgcgattccgtagtctta

SEQ ID NO: 119203 - DNA, 35 bp, Artificial Sequence
  Synthetic oligonucleotide
atactaccgccctgcctgacgtttgcctcttgact

SEQ ID NO: 119204 - DNA, 35 bp, Artificial Sequence
  Synthetic oligonucleotide
ttagccggccctcctgcccacaagcctggcattct

SEQ ID NO: 119205 - DNA, 36 bp, Artificial Sequence
  Synthetic oligonucleotide
tacacccctgttgtctcattgcatgccggactttct

SEQ ID NO: 119206 - DNA, 35 bp, Artificial Sequence
  Synthetic oligonucleotide
gtcgcctcatccgccaacctcgctcattgccacga

SEQ ID NO: 119207 - DNA, 38 bp, Artificial Sequence
  Synthetic oligonucleotide
atcatcttccggttcccttcgccccagccttaggctga

SEQ ID NO: 119208 - DNA, 38 bp, Artificial Sequence
  Synthetic oligonucleotide
accagccgctccgttcttctctccactccctgtgctga

SEQ ID NO: 119209 - DNA, 35 bp, Artificial Sequence
  Synthetic oligonucleotide
atcctcccccccgttcactttaccggcctcagacc

SEQ ID NO: 119210 - DNA, 35 bp, Artificial Sequence
  Synthetic oligonucleotide
gccgaggtcgcccccctcgccggatcgttcccccc

SEQ ID NO: 119211 - DNA, 35 bp, Artificial Sequence
  Synthetic oligonucleotide
ataacatggacgactcctgccgtagcaccccctgc

SEQ ID NO: 119212 - DNA, 35 bp, Artificial Sequence
  Synthetic oligonucleotide
tcatcgcgcctatgcctggttcggccttcctcttg

SEQ ID NO: 119213 - DNA, 32 bp, Artificial Sequence
  Synthetic oligonucleotide
tccgaacagtccctggcccatacctcgctgaa

SEQ ID NO: 119214 - DNA, 35 bp, Artificial Sequence
  Synthetic oligonucleotide
gtgtgccacctggtcaccgcctcacttgctatcca

SEQ ID NO: 119215 - DNA, 35 bp, Artificial Sequence
  Synthetic oligonucleotide
tacccccgacccccatgatgcgcccctggacgaga

SEQ ID NO: 119216 - DNA, 37 bp, Artificial Sequence
  Synthetic oligonucleotide
taggggtgcaagtgacgtttcgatgggcgggcgggga

SEQ ID NO: 119217 - DNA, 38 bp, Artificial Sequence
  Synthetic oligonucleotide
tccccgcgttggagttgtcccgcctccccccccgttga

SEQ ID NO: 119218 - DNA, 35 bp, Artificial Sequence
  Synthetic oligonucleotide
tgacgtgccttccccggattccatatacgtccctc

SEQ ID NO: 119219 - DNA, 37 bp, Artificial Sequence
  Synthetic oligonucleotide
aacgggaggggcgggaacgggaagaattgcatagcga

SEQ ID NO: 119220 - DNA, 35 bp, Artificial Sequence
  Synthetic oligonucleotide
atcctgccagccgccgacactttggcaccctttcc

SEQ ID NO: 119221 - DNA, 35 bp, Artificial Sequence
  Synthetic oligonucleotide
actaaccaccctgcccgtcgctcctgttcgaaccg

SEQ ID NO: 119222 - DNA, 35 bp, Artificial Sequence
  Synthetic oligonucleotide
tccacaacattttgttatacttcttgccacctggt

SEQ ID NO: 119223 - DNA, 36 bp, Artificial Sequence
  Synthetic oligonucleotide
accttcggaggtggcgaaaaaggtggaggtggggca

SEQ ID NO: 119224 - DNA, 37 bp, Artificial Sequence
  Synthetic oligonucleotide
agagggtccgaagagcagatggagggagttgggcaga

SEQ ID NO: 119225 - DNA, 37 bp, Artificial Sequence
  Synthetic oligonucleotide
ggaaatgacacggactgggcagggagaaggggcggga

SEQ ID NO: 119226 - DNA, 35 bp, Artificial Sequence
  Synthetic oligonucleotide
gccactcgtacgcaattatacaccatgttcttcgc

SEQ ID NO: 119227 - DNA, 35 bp, Artificial Sequence
  Synthetic oligonucleotide
gtgcactcgcccgacttcgccccggtgacacccct

SEQ ID NO: 119228 - DNA, 34 bp, Artificial Sequence
  Synthetic oligonucleotide
tatctgtcgccctcactgccccatggtttgcttt

SEQ ID NO: 119229 - DNA, 36 bp, Artificial Sequence
  Synthetic oligonucleotide
gtccccacactcgctttagctgacgatccttgccca

SEQ ID NO: 119230 - DNA, 35 bp, Artificial Sequence
  Synthetic oligonucleotide
ggtctgtgcacctgctgcttcgtaatcccactcac

SEQ ID NO: 119231 - DNA, 35 bp, Artificial Sequence
  Synthetic oligonucleotide
gcatgctgctgccatgcacatttcctccccgtatc

SEQ ID NO: 119232 - DNA, 35 bp, Artificial Sequence
  Synthetic oligonucleotide
atcgttgcttgcccgccgacgccttgatacttctc

SEQ ID NO: 119233 - DNA, 36 bp, Artificial Sequence
  Synthetic oligonucleotide
tttcatgcccaggcccgccaccgacgttcgcccact

SEQ ID NO: 119234 - DNA, 36 bp, Artificial Sequence
  Synthetic oligonucleotide
tcgtggcccctgtatgctcacttcgactccgctttt

SEQ ID NO: 119235 - DNA, 37 bp, Artificial Sequence
  Synthetic oligonucleotide
tcacaccccgtggcccttgctcccatcctcgtaccga

SEQ ID NO: 119236 - DNA, 35 bp, Artificial Sequence
  Synthetic oligonucleotide
gaggagggctgagggcggggggcttctgaaaagta

SEQ ID NO: 119237 - DNA, 35 bp, Artificial Sequence
  Synthetic oligonucleotide
agctgacatcttggtaatcctgcctcgttcccgcc

SEQ ID NO: 119238 - DNA, 35 bp, Artificial Sequence
  Synthetic oligonucleotide
gaccctgacgaccgcccccccaatgaaaggcctgc

SEQ ID NO: 119239 - DNA, 35 bp, Artificial Sequence
  Synthetic oligonucleotide
gtcgtacctacccccgctggaatacctgtctcctc

SEQ ID NO: 119240 - DNA, 35 bp, Artificial Sequence
  Synthetic oligonucleotide
ggacaagggcgggaggccggggggaatgaagatgg

SEQ ID NO: 119241 - DNA, 37 bp, Artificial Sequence
  Synthetic oligonucleotide
gacacgtcctatttcatgccgccagcccttcttacga

SEQ ID NO: 119242 - DNA, 36 bp, Artificial Sequence
  Synthetic oligonucleotide
agtccccccgcatgttaacgctcccccatttcttga

SEQ ID NO: 119243 - DNA, 35 bp, Artificial Sequence
  Synthetic oligonucleotide
accctcgccggggttacaccttcccgctttcgctc

SEQ ID NO: 119244 - DNA, 35 bp, Artificial Sequence
  Synthetic oligonucleotide
gactcaccttcaagtgctgctttatttcccggttc

SEQ ID NO: 119245 - DNA, 35 bp, Artificial Sequence
  Synthetic oligonucleotide
ggagctcggcccgttctctagtatcgctccatcct

SEQ ID NO: 119246 - DNA, 35 bp, Artificial Sequence
  Synthetic oligonucleotide
gtcccccgcatcctccctacgttgtgagtccattt

SEQ ID NO: 119247 - DNA, 36 bp, Artificial Sequence
  Synthetic oligonucleotide
acagactgccgagcaggagagggaaaggggcgggca

SEQ ID NO: 119248 - DNA, 37 bp, Artificial Sequence
  Synthetic oligonucleotide
tcaaggtcgggggagtagagggattgcggggggacga

SEQ ID NO: 119249 - DNA, 36 bp, Artificial Sequence
  Synthetic oligonucleotide
atatgggagggcgggtgatgggctgaattgctacga

SEQ ID NO: 119250 - DNA, 36 bp, Artificial Sequence
  Synthetic oligonucleotide
gcccctacacatctgcttccgtgccatcgtttacga

SEQ ID NO: 119251 - DNA, 38 bp, Artificial Sequence
  Synthetic oligonucleotide
agccacccaactgttcgccccctggacgccccccgtga

SEQ ID NO: 119252 - DNA, 35 bp, Artificial Sequence
  Synthetic oligonucleotide
gcacctctactgatatccatgtcgtcctggtctcc

SEQ ID NO: 119253 - DNA, 35 bp, Artificial Sequence
  Synthetic oligonucleotide
acgccgttcctccgcttatgaaccccgccccgcgc

SEQ ID NO: 119254 - DNA, 35 bp, Artificial Sequence
  Synthetic oligonucleotide
gggtggcgggggggtttttcggatggcacatcgcg

SEQ ID NO: 119255 - DNA, 35 bp, Artificial Sequence
  Synthetic oligonucleotide
gcgtaagtcgcaccaactgtacacaaccgccccca

SEQ ID NO: 119256 - DNA, 37 bp, Artificial Sequence
  Synthetic oligonucleotide
tgaagggatcctcggaagggaaagggcgggagggaga

SEQ ID NO: 119257 - DNA, 36 bp, Artificial Sequence
  Synthetic oligonucleotide
gcccaggcctcattgcgcctcgatccaccccacgga

SEQ ID NO: 119258 - DNA, 38 bp, Artificial Sequence
  Synthetic oligonucleotide
gccctcgccctcttcccttaccagtcggaccaccctga

SEQ ID NO: 119259 - DNA, 38 bp, Artificial Sequence
  Synthetic oligonucleotide
aaccccccctcctgccacctatatagacactgccgtga

SEQ ID NO: 119260 - DNA, 36 bp, Artificial Sequence
  Synthetic oligonucleotide
gccacagcgtgtcctctgtctcggtcccgcccccta

SEQ ID NO: 119261 - DNA, 35 bp, Artificial Sequence
  Synthetic oligonucleotide
acttcacctctgccccgatatctttcgtccaccgc

SEQ ID NO: 119262 - DNA, 35 bp, Artificial Sequence
  Synthetic oligonucleotide
aacccagtgcgcgtcaccgcctcatcctgttcgtt

SEQ ID NO: 119263 - DNA, 35 bp, Artificial Sequence
  Synthetic oligonucleotide
tcatcacccctgcgcgtgacctctgataccccttt

SEQ ID NO: 119264 - DNA, 38 bp, Artificial Sequence
  Synthetic oligonucleotide
tgccacccgccgtcatttattatcccctctcgtcgtga

SEQ ID NO: 119265 - DNA, 35 bp, Artificial Sequence
  Synthetic oligonucleotide
ctacagtgatacacactgtcgtacttaaacgcccc

SEQ ID NO: 119266 - DNA, 35 bp, Artificial Sequence
  Synthetic oligonucleotide
gacgcccccgcccagccgccttggactcatctctc

SEQ ID NO: 119267 - DNA, 35 bp, Artificial Sequence
  Synthetic oligonucleotide
acccaggcagacccgcccccacgtttttttaggtc

SEQ ID NO: 119268 - DNA, 34 bp, Artificial Sequence
  Synthetic oligonucleotide
actccccgtcgctccaccgaatacaatcgcctat

SEQ ID NO: 119269 - DNA, 35 bp, Artificial Sequence
  Synthetic oligonucleotide
cccgcccctccgctgccaaccgtgcgttaatcaaa

SEQ ID NO: 119270 - DNA, 36 bp, Artificial Sequence
  Synthetic oligonucleotide
gagggcacctccgcctgtttgtctacccgtcttaca

SEQ ID NO: 119271 - DNA, 35 bp, Artificial Sequence
  Synthetic oligonucleotide
ttgaaccaccattctgagtactgctaaatgccctc

SEQ ID NO: 119272 - DNA, 35 bp, Artificial Sequence
  Synthetic oligonucleotide
gtgcgctgctgtcctctcatcgccttgccgttcct

SEQ ID NO: 119273 - DNA, 36 bp, Artificial Sequence
  Synthetic oligonucleotide
gaacgccctccgcctgtctccgtttgcaaggtccca

SEQ ID NO: 119274 - DNA, 38 bp, Artificial Sequence
  Synthetic oligonucleotide
tgagggcggagggaggggtgtggatttggacggtatga

SEQ ID NO: 119275 - DNA, 38 bp, Artificial Sequence
  Synthetic oligonucleotide
tcgtgcctccccccgccgtacgacatcgatcagtttga

SEQ ID NO: 119276 - DNA, 35 bp, Artificial Sequence
  Synthetic oligonucleotide
tatcccgagcactcgcgcacccgctgttctgcccc

SEQ ID NO: 119277 - DNA, 35 bp, Artificial Sequence
  Synthetic oligonucleotide
gctacggtttcttaccccgccccctctgtgagtcc

SEQ ID NO: 119278 - DNA, 35 bp, Artificial Sequence
  Synthetic oligonucleotide
gattagccctcaccttgctctaggtcctcgggtcc

SEQ ID NO: 119279 - DNA, 35 bp, Artificial Sequence
  Synthetic oligonucleotide
accctccgccgcatgcccacgttcagactgctatg

SEQ ID NO: 119280 - DNA, 35 bp, Artificial Sequence
  Synthetic oligonucleotide
gtcccatcccctcattcatgtggccatatgtcact

SEQ ID NO: 119281 - DNA, 35 bp, Artificial Sequence
  Synthetic oligonucleotide
gccgcaccggcctcttcatgcgttaatctgcccca

SEQ ID NO: 119282 - DNA, 36 bp, Artificial Sequence
  Synthetic oligonucleotide
gttgagctggctgttccacccgtttcgtgccatcca

SEQ ID NO: 119283 - DNA, 38 bp, Artificial Sequence
  Synthetic oligonucleotide
gagggcggagcgtcgcggaaaggtggagggcgcagtga

SEQ ID NO: 119284 - DNA, 35 bp, Artificial Sequence
  Synthetic oligonucleotide
agtccacgggctgggaagggcgggatatatcaaac

SEQ ID NO: 119285 - DNA, 35 bp, Artificial Sequence
  Synthetic oligonucleotide
gacgcccggttgacccatccccgctcggcctcacc

SEQ ID NO: 119286 - DNA, 35 bp, Artificial Sequence
  Synthetic oligonucleotide
tcccccagcccattctcttgaccacgcccccttgc

SEQ ID NO: 119287 - DNA, 35 bp, Artificial Sequence
  Synthetic oligonucleotide
atcaggccacctggtacgtttgggtccttctcctg

SEQ ID NO: 119288 - DNA, 35 bp, Artificial Sequence
  Synthetic oligonucleotide
gctcatcccatgcccctagtgacgccgtcccacct

SEQ ID NO: 119289 - DNA, 35 bp, Artificial Sequence
  Synthetic oligonucleotide
acaccccgccacaatattactctcgaacggatcaa

SEQ ID NO: 119290 - DNA, 35 bp, Artificial Sequence
  Synthetic oligonucleotide
gcgcccaccccaagtgaccttcctccgcacaccgc

SEQ ID NO: 119291 - DNA, 35 bp, Artificial Sequence
  Synthetic oligonucleotide
accgacacacgctgcacgacatgtatcttccctcg

SEQ ID NO: 119292 - DNA, 35 bp, Artificial Sequence
  Synthetic oligonucleotide
actgtcgggacaaggagggaagggactaatggatg

SEQ ID NO: 119293 - DNA, 35 bp, Artificial Sequence
  Synthetic oligonucleotide
atctcgccccctactctgctctatggacatgatct

SEQ ID NO: 119294 - DNA, 38 bp, Artificial Sequence
  Synthetic oligonucleotide
ttgacacgtctcgcatttctttcatcgccgttccttga

SEQ ID NO: 119295 - DNA, 35 bp, Artificial Sequence
  Synthetic oligonucleotide
tcacccaccagcccccagccatgatggctctccac

SEQ ID NO: 119296 - DNA, 35 bp, Artificial Sequence
  Synthetic oligonucleotide
gacacagccccctctctttcacgccgttcgcctac

SEQ ID NO: 119297 - DNA, 35 bp, Artificial Sequence
  Synthetic oligonucleotide
aactcacacgctttctgtacatcttcctcgctgcc

SEQ ID NO: 119298 - DNA, 35 bp, Artificial Sequence
  Synthetic oligonucleotide
tcccgtgcccgcatttcccgctgtattttcgcttc

SEQ ID NO: 119299 - DNA, 35 bp, Artificial Sequence
  Synthetic oligonucleotide
tgtgtcgtcgcaacgtgcaacctgctcctgcccct

SEQ ID NO: 119300 - DNA, 36 bp, Artificial Sequence
  Synthetic oligonucleotide
tccaccgtgcccgccaccatctccaccatggccgaa

SEQ ID NO: 119301 - DNA, 37 bp, Artificial Sequence
  Synthetic oligonucleotide
gagtggggccagatcggaagggggcgggtggcttgga

SEQ ID NO: 119302 - DNA, 35 bp, Artificial Sequence
  Synthetic oligonucleotide
gtggtccctcacacctccttgcttacacatttacg

SEQ ID NO: 119303 - DNA, 37 bp, Artificial Sequence
  Synthetic oligonucleotide
attcggggacgggcgagggcatagcggggaggggcga

SEQ ID NO: 119304 - DNA, 35 bp, Artificial Sequence
  Synthetic oligonucleotide
atggccccccattcactctgcgtatgccccgccac

SEQ ID NO: 119305 - DNA, 35 bp, Artificial Sequence
  Synthetic oligonucleotide
ttcgcaccatctactatgcttcactctccgcctgc

SEQ ID NO: 119306 - DNA, 35 bp, Artificial Sequence
  Synthetic oligonucleotide
gaacgatgaccgccctgtccccctgaagagccctt

SEQ ID NO: 119307 - DNA, 36 bp, Artificial Sequence
  Synthetic oligonucleotide
tacgtgctccctcagccctctgtcgtacacctgtca

SEQ ID NO: 119308 - DNA, 35 bp, Artificial Sequence
  Synthetic oligonucleotide
tgccaccccctcgtatgccttacacttctacatga

SEQ ID NO: 119309 - DNA, 38 bp, Artificial Sequence
  Synthetic oligonucleotide
gggaggcactcggtttgaggaacggtggaggtacctga

SEQ ID NO: 119310 - DNA, 35 bp, Artificial Sequence
  Synthetic oligonucleotide
gtcatacctgatcgtcttgtcgactacgttccccc

SEQ ID NO: 119311 - DNA, 35 bp, Artificial Sequence
  Synthetic oligonucleotide
tttagccactcaccccgccgcgccaatctcgctcc

SEQ ID NO: 119312 - DNA, 35 bp, Artificial Sequence
  Synthetic oligonucleotide
acatctgagtgcaccacgcgttttcatccccgttc

SEQ ID NO: 119313 - DNA, 37 bp, Artificial Sequence
  Synthetic oligonucleotide
gcgctcaccctccgcttttgagcctttgttccatcga

SEQ ID NO: 119314 - DNA, 37 bp, Artificial Sequence
  Synthetic oligonucleotide
ggacaaggaaagagggagcaaataggcgggcgacgga

SEQ ID NO: 119315 - DNA, 35 bp, Artificial Sequence
  Synthetic oligonucleotide
acccgggcctcatatccgcctcgacttctcacgac

SEQ ID NO: 119316 - DNA, 35 bp, Artificial Sequence
  Synthetic oligonucleotide
tcccaaatcccactagttatcgagtcacccagccc

SEQ ID NO: 119317 - DNA, 35 bp, Artificial Sequence
  Synthetic oligonucleotide
aagccccatcccgttctagcaaatgttcctgttcc

SEQ ID NO: 119318 - DNA, 35 bp, Artificial Sequence
  Synthetic oligonucleotide
acgcccaggtatgaactgctaatccccgccctctc

SEQ ID NO: 119319 - DNA, 35 bp, Artificial Sequence
  Synthetic oligonucleotide
taagcccaccgtgtgcctccgttcttgcccaaccg

SEQ ID NO: 119320 - DNA, 34 bp, Artificial Sequence
  Synthetic oligonucleotide
tgcccacagccgctgctctgtgcctactcgctat

SEQ ID NO: 119321 - DNA, 36 bp, Artificial Sequence
  Synthetic oligonucleotide
gcggatggggaagggattgaggggataaggggtgca

SEQ ID NO: 119322 - DNA, 37 bp, Artificial Sequence
  Synthetic oligonucleotide
gaaacgaagggaagggcaagggcagggattgagtaga

SEQ ID NO: 119323 - DNA, 37 bp, Artificial Sequence
  Synthetic oligonucleotide
tgaccaggagaggggggtgggggagctggtaagagga

SEQ ID NO: 119324 - DNA, 37 bp, Artificial Sequence
  Synthetic oligonucleotide
cccgaccgcggatgttgccccgcctgcccgcccctga

SEQ ID NO: 119325 - DNA, 37 bp, Artificial Sequence
  Synthetic oligonucleotide
tgtcccccggcttctcgtacctactgccacaccttga

SEQ ID NO: 119326 - DNA, 35 bp, Artificial Sequence
  Synthetic oligonucleotide
gatccaccgcttgttccgttaatctacggcctccc

SEQ ID NO: 119327 - DNA, 35 bp, Artificial Sequence
  Synthetic oligonucleotide
gcactgaccccacacgacctcccctccttggtgcg

SEQ ID NO: 119328 - DNA, 35 bp, Artificial Sequence
  Synthetic oligonucleotide
actagactgcagccctccgtcgcgtaccccttcct

SEQ ID NO: 119329 - DNA, 35 bp, Artificial Sequence
  Synthetic oligonucleotide
ttgtccgctcataactgctcgaactgcccatctct

SEQ ID NO: 119330 - DNA, 35 bp, Artificial Sequence
  Synthetic oligonucleotide
acgcatcctatgtctgtcccgaccctcccgcttag

SEQ ID NO: 119331 - DNA, 35 bp, Artificial Sequence
  Synthetic oligonucleotide
attgccgtcgagggggttggagtgggggggtcggg

SEQ ID NO: 119332 - DNA, 35 bp, Artificial Sequence
  Synthetic oligonucleotide
cacgacctctgcttccctaaatcgccccccgctgg

SEQ ID NO: 119333 - DNA, 35 bp, Artificial Sequence
  Synthetic oligonucleotide
atccgcaagggtgcggaggggggggtgatgcactg

SEQ ID NO: 119334 - DNA, 35 bp, Artificial Sequence
  Synthetic oligonucleotide
acgcgccacggcatctagtgcttcctccgttgtct

SEQ ID NO: 119335 - DNA, 35 bp, Artificial Sequence
  Synthetic oligonucleotide
gcacgtaatccgaccgccctgttgctccacttgtt

SEQ ID NO: 119336 - DNA, 35 bp, Artificial Sequence
  Synthetic oligonucleotide
gtactagcaccttccctgttatgcgttcctcgttt

SEQ ID NO: 119337 - DNA, 35 bp, Artificial Sequence
  Synthetic oligonucleotide
ttgactggcccacccttccgtatgcgactctttca

SEQ ID NO: 119338 - DNA, 37 bp, Artificial Sequence
  Synthetic oligonucleotide
aagtgaagaagggatggggagataaatgggcgaggga

SEQ ID NO: 119339 - DNA, 37 bp, Artificial Sequence
  Synthetic oligonucleotide
gaacccccctacaccgtgcgtacgactccccccggga

SEQ ID NO: 119340 - DNA, 35 bp, Artificial Sequence
  Synthetic oligonucleotide
gtacctccgcactgtccgtttcgcataacctgccc

SEQ ID NO: 119341 - DNA, 35 bp, Artificial Sequence
  Synthetic oligonucleotide
acgtgatcacccagccttccgaccgtctttttccc

SEQ ID NO: 119342 - DNA, 37 bp, Artificial Sequence
  Synthetic oligonucleotide
acacgaacctcgatgcccaagcaccccgccatcccga

SEQ ID NO: 119343 - DNA, 37 bp, Artificial Sequence
  Synthetic oligonucleotide
tgtgctggttacgggggggataggggctgggttcgga

SEQ ID NO: 119344 - DNA, 37 bp, Artificial Sequence
  Synthetic oligonucleotide
ggtgagtgcagggaggagggagggtgctgcagatgga

SEQ ID NO: 119345 - DNA, 35 bp, Artificial Sequence
  Synthetic oligonucleotide
acgccatctgccgcaaggcttttcctcgtactacc

SEQ ID NO: 119346 - DNA, 35 bp, Artificial Sequence
  Synthetic oligonucleotide
atccgcccatgcagtgtcggcgcggtcccttcccc

SEQ ID NO: 119347 - DNA, 35 bp, Artificial Sequence
  Synthetic oligonucleotide
tcactccggcctcggtatattattcccccattgcc

SEQ ID NO: 119348 - DNA, 35 bp, Artificial Sequence
  Synthetic oligonucleotide
gcctaaacacccgtcctccgctcgcactgtgctcc

SEQ ID NO: 119349 - DNA, 35 bp, Artificial Sequence
  Synthetic oligonucleotide
aagagaggagggtgagaggaggacggcttgggaag

SEQ ID NO: 119350 - DNA, 35 bp, Artificial Sequence
  Synthetic oligonucleotide
gtgggtagggtgggaagggatcaatcaaagttggg

SEQ ID NO: 119351 - DNA, 35 bp, Artificial Sequence
  Synthetic oligonucleotide
gcccacactcgcccactgtgtcccccacactgttg

SEQ ID NO: 119352 - DNA, 36 bp, Artificial Sequence
  Synthetic oligonucleotide
gcccgtcctagtgtccccgctcgtctgaccctgcca

SEQ ID NO: 119353 - DNA, 35 bp, Artificial Sequence
  Synthetic oligonucleotide
gcccgcccccgtactttgctcttccggtggttccc

SEQ ID NO: 119354 - DNA, 35 bp, Artificial Sequence
  Synthetic oligonucleotide
ggagccttccgccacatatagtcgtgttcctcctc

SEQ ID NO: 119355 - DNA, 35 bp, Artificial Sequence
  Synthetic oligonucleotide
tactgacttcatcactctaggtaccccaatcttcg

SEQ ID NO: 119356 - DNA, 35 bp, Artificial Sequence
  Synthetic oligonucleotide
gtactccgcgtgggcctgccttgtttcatccttgt

SEQ ID NO: 119357 - DNA, 36 bp, Artificial Sequence
  Synthetic oligonucleotide
gtctatcacgccctcccgatactgccttatggtaca

SEQ ID NO: 119358 - DNA, 35 bp, Artificial Sequence
  Synthetic oligonucleotide
gtgcgccacgcccccttgtattgcatacgccttca

SEQ ID NO: 119359 - DNA, 37 bp, Artificial Sequence
  Synthetic oligonucleotide
atcgggaaaggagagggagggcgctaagaggaggtga

SEQ ID NO: 119360 - DNA, 36 bp, Artificial Sequence
  Synthetic oligonucleotide
acgtaggtcaatcgtcgtcccccaccccccgttcta

SEQ ID NO: 119361 - DNA, 35 bp, Artificial Sequence
  Synthetic oligonucleotide
gacatgtcctcaggtttcttagccttgctcgctcc

SEQ ID NO: 119362 - DNA, 35 bp, Artificial Sequence
  Synthetic oligonucleotide
acctctactccagccccctgtttcgactcacctgg

SEQ ID NO: 119363 - DNA, 35 bp, Artificial Sequence
  Synthetic oligonucleotide
tccccagtccgttacatcgcggcaactctccttgt

SEQ ID NO: 119364 - DNA, 29 bp, Artificial Sequence
  Synthetic oligonucleotide
tagtcgtggaccaccccccgtcctgcctt

SEQ ID NO: 119365 - DNA, 36 bp, Artificial Sequence
  Synthetic oligonucleotide
ttgttgtcgcacgcaatgtttttgcccctctaccta

SEQ ID NO: 119366 - DNA, 35 bp, Artificial Sequence
  Synthetic oligonucleotide
tccccccgctctggctatcgggctcgctgaacccc

SEQ ID NO: 119367 - DNA, 35 bp, Artificial Sequence
  Synthetic oligonucleotide
gcctcacatcggcggctatccttctcaccgtcccc

SEQ ID NO: 119368 - DNA, 35 bp, Artificial Sequence
  Synthetic oligonucleotide
aacgctgttgcctggccgtagcacctacacctctc

SEQ ID NO: 119369 - DNA, 35 bp, Artificial Sequence
  Synthetic oligonucleotide
aagacgggctacgatgaaagggggggcgggctcat

SEQ ID NO: 119370 - DNA, 35 bp, Artificial Sequence
  Synthetic oligonucleotide
acccacccgatgttggtgctactggacccctctca

SEQ ID NO: 119371 - DNA, 37 bp, Artificial Sequence
  Synthetic oligonucleotide
taagcaaggagggaagaaatggagggtcaagggggga

SEQ ID NO: 119372 - DNA, 36 bp, Artificial Sequence
  Synthetic oligonucleotide
taagcaccacaccttctcgtatacttgcctttgtga

SEQ ID NO: 119373 - DNA, 36 bp, Artificial Sequence
  Synthetic oligonucleotide
tggaggggaggaaggggtatacaggataagagtcta

SEQ ID NO: 119374 - DNA, 36 bp, Artificial Sequence
  Synthetic oligonucleotide
gaatctgccccttgccgtgccgacccgcttacctta

SEQ ID NO: 119375 - DNA, 35 bp, Artificial Sequence
  Synthetic oligonucleotide
gaccgcctccgccaccgctctactagcacaaagtc

SEQ ID NO: 119376 - DNA, 35 bp, Artificial Sequence
  Synthetic oligonucleotide
ttcgcccgctccctcgtggtcgtttgactccattc

SEQ ID NO: 119377 - DNA, 35 bp, Artificial Sequence
  Synthetic oligonucleotide
ggtccagtccgccgatcttttctcccagttgcccg

SEQ ID NO: 119378 - DNA, 35 bp, Artificial Sequence
  Synthetic oligonucleotide
atcactgaccacatgcctcgcgtactcgacccctg

SEQ ID NO: 119379 - DNA, 35 bp, Artificial Sequence
  Synthetic oligonucleotide
gtgatgtgtttgtgtcggtcccctctcgcgccctg

SEQ ID NO: 119380 - DNA, 35 bp, Artificial Sequence
  Synthetic oligonucleotide
aagcgacggccccctgttccatccctattgttgat

SEQ ID NO: 119381 - DNA, 35 bp, Artificial Sequence
  Synthetic oligonucleotide
gtccctgttccggaaatgctaatcgctcgccctca

SEQ ID NO: 119382 - DNA, 35 bp, Artificial Sequence
  Synthetic oligonucleotide
aacgccattcccgccaacgacatctacgagcccac

SEQ ID NO: 119383 - DNA, 35 bp, Artificial Sequence
  Synthetic oligonucleotide
tgacatgcattcccctgtccgtctgtactcggccc

SEQ ID NO: 119384 - DNA, 35 bp, Artificial Sequence
  Synthetic oligonucleotide
gatgccggctcatcctgtccatccttctaagtctc

SEQ ID NO: 119385 - DNA, 35 bp, Artificial Sequence
  Synthetic oligonucleotide
gttcgtccgccgccctgttctacatcatagtttct

SEQ ID NO: 119386 - DNA, 35 bp, Artificial Sequence
  Synthetic oligonucleotide
gcgaagggggaggggggtagctgtagggttagggt

SEQ ID NO: 119387 - DNA, 36 bp, Artificial Sequence
  Synthetic oligonucleotide
gatccgccatctcgcattcgccgccctgtccaccca

SEQ ID NO: 119388 - DNA, 36 bp, Artificial Sequence
  Synthetic oligonucleotide
agttcgtgcccgcccgcctattctcccttgtgccca

SEQ ID NO: 119389 - DNA, 38 bp, Artificial Sequence
  Synthetic oligonucleotide
gcctggtgagagggagggcggggaaggaacgtacgtga

SEQ ID NO: 119390 - DNA, 36 bp, Artificial Sequence
  Synthetic oligonucleotide
tacgtgcctgctgccgtatacccgttcctgttctta

SEQ ID NO: 119391 - DNA, 35 bp, Artificial Sequence
  Synthetic oligonucleotide
tcccctagcgcagttcgcttccaccgcccagttac

SEQ ID NO: 119392 - DNA, 35 bp, Artificial Sequence
  Synthetic oligonucleotide
acactacgtggacagcccgcccgacccttgacccc

SEQ ID NO: 119393 - DNA, 35 bp, Artificial Sequence
  Synthetic oligonucleotide
tccgctcccctagcaaattgtcttccgtacggccc

SEQ ID NO: 119394 - DNA, 35 bp, Artificial Sequence
  Synthetic oligonucleotide
tcatcgacctcgaggtcgccctctgtatcacctcc

SEQ ID NO: 119395 - DNA, 35 bp, Artificial Sequence
  Synthetic oligonucleotide
gcgagtcacggggcagggttagggcggggatgggc

SEQ ID NO: 119396 - DNA, 34 bp, Artificial Sequence
  Synthetic oligonucleotide
gacccacgccttccgccaatatggaactttgcca

SEQ ID NO: 119397 - DNA, 37 bp, Artificial Sequence
  Synthetic oligonucleotide
ttgcacggtttgcccttcgcctgtcttccctacccga

SEQ ID NO: 119398 - DNA, 36 bp, Artificial Sequence
  Synthetic oligonucleotide
tacagggaaggggaaggtggcgataaaaaatgcgga

SEQ ID NO: 119399 - DNA, 36 bp, Artificial Sequence
  Synthetic oligonucleotide
acctcccacgccccatgccttagttacaagttatta

SEQ ID NO: 119400 - DNA, 35 bp, Artificial Sequence
  Synthetic oligonucleotide
aactcccgctccatgcgtctcccagcccctcttcc

SEQ ID NO: 119401 - DNA, 31 bp, Artificial Sequence
  Synthetic oligonucleotide
gcctatagcgctgtccctctcttttttacct

SEQ ID NO: 119402 - DNA, 35 bp, Artificial Sequence
  Synthetic oligonucleotide
acgcccccgccatctgaagccttccctcatgttct

SEQ ID NO: 119403 - DNA, 35 bp, Artificial Sequence
  Synthetic oligonucleotide
gtgacgggggaggaagacagagaaaaggatggaga

SEQ ID NO: 119404 - DNA, 36 bp, Artificial Sequence
  Synthetic oligonucleotide
gtgaccgacatttagctttggccctgaccctctcga

SEQ ID NO: 119405 - DNA, 36 bp, Artificial Sequence
  Synthetic oligonucleotide
gatggcacgagaaaaaggggaaaaggggtacgggga

SEQ ID NO: 119406 - DNA, 36 bp, Artificial Sequence
  Synthetic oligonucleotide
taccccctccgccgcccggtaagaattgccgatata

SEQ ID NO: 119407 - DNA, 36 bp, Artificial Sequence
  Synthetic oligonucleotide
gtgggcggtcctcactgcatccgggcctcaccttta

SEQ ID NO: 119408 - DNA, 35 bp, Artificial Sequence
  Synthetic oligonucleotide
gtaacgtacctatctgctccacgcgcacaccttac

SEQ ID NO: 119409 - DNA, 35 bp, Artificial Sequence
  Synthetic oligonucleotide
gtccctccgacccatgtttccacgacattcaatgc

SEQ ID NO: 119410 - DNA, 35 bp, Artificial Sequence
  Synthetic oligonucleotide
gccctgccccttgttatgttcgtctcccctcgctc

SEQ ID NO: 119411 - DNA, 35 bp, Artificial Sequence
  Synthetic oligonucleotide
acacctcgctcgagtcttatcctctctcttccaag

SEQ ID NO: 119412 - DNA, 35 bp, Artificial Sequence
  Synthetic oligonucleotide
tcgactcctcggcaccctcccttcgtactttcacg

SEQ ID NO: 119413 - DNA, 35 bp, Artificial Sequence
  Synthetic oligonucleotide
gtcccaccgctcctctcccggtaagagcatgagct

SEQ ID NO: 119414 - DNA, 35 bp, Artificial Sequence
  Synthetic oligonucleotide
acccgccgagccttccccccctcccgctctttcgt

SEQ ID NO: 119415 - DNA, 37 bp, Artificial Sequence
  Synthetic oligonucleotide
gtgcgcccaattcttctccccggccctgattccgtga

SEQ ID NO: 119416 - DNA, 35 bp, Artificial Sequence
  Synthetic oligonucleotide
ttcgtccgggagggtgggaagggattagggagtac

SEQ ID NO: 119417 - DNA, 35 bp, Artificial Sequence
  Synthetic oligonucleotide
gcgctgactttcccgtgcacgcccctcttatggtc

SEQ ID NO: 119418 - DNA, 35 bp, Artificial Sequence
  Synthetic oligonucleotide
tagagaggcggggaggctgggagaagggcgagtaa

SEQ ID NO: 119419 - DNA, 36 bp, Artificial Sequence
  Synthetic oligonucleotide
tcacacacttccctgccttctacgctgtcagtccta

SEQ ID NO: 119420 - DNA, 35 bp, Artificial Sequence
  Synthetic oligonucleotide
ttcgcatcccgttcaccagcttaagcctctcgtac

SEQ ID NO: 119421 - DNA, 35 bp, Artificial Sequence
  Synthetic oligonucleotide
tgcatacccaccatccatgctccgatccataggat

SEQ ID NO: 119422 - DNA, 35 bp, Artificial Sequence
  Synthetic oligonucleotide
gtgacaccatattgcaagtgcccatacacctccct

SEQ ID NO: 119423 - DNA, 35 bp, Artificial Sequence
  Synthetic oligonucleotide
gatccccctccgtccccagaacgtagttcggactt

SEQ ID NO: 119424 - DNA, 37 bp, Artificial Sequence
  Synthetic oligonucleotide
tcatgcctcgactgcaaatctcccgcctgttccctga

SEQ ID NO: 119425 - DNA, 35 bp, Artificial Sequence
  Synthetic oligonucleotide
tgcatacatccattgctccctttatgtctcctttg

SEQ ID NO: 119426 - DNA, 37 bp, Artificial Sequence
  Synthetic oligonucleotide
gacccgggcggagagggagggttgagataaatctcga

SEQ ID NO: 119427 - DNA, 35 bp, Artificial Sequence
  Synthetic oligonucleotide
gagctccgtccgtaagcgtcttttttcactctcga

SEQ ID NO: 119428 - DNA, 37 bp, Artificial Sequence
  Synthetic oligonucleotide
tgtgcccgcctcctctctgttgtttgcctcttcagga

SEQ ID NO: 119429 - DNA, 36 bp, Artificial Sequence
  Synthetic oligonucleotide
atcaccccgactcattgccagagtcctgccattgga

SEQ ID NO: 119430 - DNA, 38 bp, Artificial Sequence
  Synthetic oligonucleotide
atccaccgcagtcctgttacttcaccctccttatatga

SEQ ID NO: 119431 - DNA, 37 bp, Artificial Sequence
  Synthetic oligonucleotide
acacgcagccccttatcccccccccggtccaccgtga

SEQ ID NO: 119432 - DNA, 38 bp, Artificial Sequence
  Synthetic oligonucleotide
aagtgccccctcgcccccgtttttgaacagtcatgtga

SEQ ID NO: 119433 - DNA, 35 bp, Artificial Sequence
  Synthetic oligonucleotide
gtgacttctctgctgtaatacccctttgtcctgcc

SEQ ID NO: 119434 - DNA, 35 bp, Artificial Sequence
  Synthetic oligonucleotide
ttagcttcggtcgtcctgtctactgttctcgttcc

SEQ ID NO: 119435 - DNA, 36 bp, Artificial Sequence
  Synthetic oligonucleotide
tacgccccctgccattccccatcgtgtactgggtaa

SEQ ID NO: 119436 - DNA, 35 bp, Artificial Sequence
  Synthetic oligonucleotide
ttcgtgcggtcctgcacttatccctggtccttcac

SEQ ID NO: 119437 - DNA, 35 bp, Artificial Sequence
  Synthetic oligonucleotide
tcgccctctgcctgcttagcattgtcggtcttccc

SEQ ID NO: 119438 - DNA, 35 bp, Artificial Sequence
  Synthetic oligonucleotide
tacccacattcggtcgcccgctcctacccggttcc

SEQ ID NO: 119439 - DNA, 35 bp, Artificial Sequence
  Synthetic oligonucleotide
ggtagaccgccgctagcgtaactgcacctctcact

SEQ ID NO: 119440 - DNA, 35 bp, Artificial Sequence
  Synthetic oligonucleotide
ttggagagtgggtgggagggttctggcaccactgt

SEQ ID NO: 119441 - DNA, 36 bp, Artificial Sequence
  Synthetic oligonucleotide
atccccacgccctctcgagtccctcctgtaccatca

SEQ ID NO: 119442 - DNA, 37 bp, Artificial Sequence
  Synthetic oligonucleotide
gaccgtcggtggggagggtgagggggtggacggccga

SEQ ID NO: 119443 - DNA, 36 bp, Artificial Sequence
  Synthetic oligonucleotide
ggggcggggtttgcgatgaggggtgtcagcggggga

SEQ ID NO: 119444 - DNA, 35 bp, Artificial Sequence
  Synthetic oligonucleotide
tgggggggggggcgggtagcacgagttggggccac

SEQ ID NO: 119445 - DNA, 35 bp, Artificial Sequence
  Synthetic oligonucleotide
acgcaagcacggagccccgtgaccgcttttcttcc

SEQ ID NO: 119446 - DNA, 36 bp, Artificial Sequence
  Synthetic oligonucleotide
gatctcccctcccacgccgtatatcacctagtgtaa

SEQ ID NO: 119447 - DNA, 36 bp, Artificial Sequence
  Synthetic oligonucleotide
tgaccgtctatggctacccccaccgctccactagta

SEQ ID NO: 119448 - DNA, 35 bp, Artificial Sequence
  Synthetic oligonucleotide
aatggcgggtactctctcgttctagctgcttccac

SEQ ID NO: 119449 - DNA, 35 bp, Artificial Sequence
  Synthetic oligonucleotide
aatccacccgtgtaatccggccttcacttcttgcc

SEQ ID NO: 119450 - DNA, 35 bp, Artificial Sequence
  Synthetic oligonucleotide
acgcacagtaccatctcctcgttctttaggattcc

SEQ ID NO: 119451 - DNA, 35 bp, Artificial Sequence
  Synthetic oligonucleotide
tgcgtcggtacgcagccagctctcgcccccgttcc

SEQ ID NO: 119452 - DNA, 35 bp, Artificial Sequence
  Synthetic oligonucleotide
tacgttccatctcgcggcttagacttctctccggt

SEQ ID NO: 119453 - DNA, 35 bp, Artificial Sequence
  Synthetic oligonucleotide
ttcagtcggtcgtccttcctctgtttaacccgcca

SEQ ID NO: 119454 - DNA, 35 bp, Artificial Sequence
  Synthetic oligonucleotide
gatagccgacgctcggcttcattagactccctccc

SEQ ID NO: 119455 - DNA, 35 bp, Artificial Sequence
  Synthetic oligonucleotide
atgtccaccacctgcgcgattcttaggtcgttctc

SEQ ID NO: 119456 - DNA, 36 bp, Artificial Sequence
  Synthetic oligonucleotide
gacctccacctagctgtaccggtctgttaccattct

SEQ ID NO: 119457 - DNA, 35 bp, Artificial Sequence
  Synthetic oligonucleotide
aagaaggggtggtgggtacgtggaggaaaaggcaa

SEQ ID NO: 119458 - DNA, 36 bp, Artificial Sequence
  Synthetic oligonucleotide
gatacccctccattgctacccgtgacgataccctaa

SEQ ID NO: 119459 - DNA, 37 bp, Artificial Sequence
  Synthetic oligonucleotide
gcactctctgcactgtatggcccaccgtttccctcga

SEQ ID NO: 119460 - DNA, 36 bp, Artificial Sequence
  Synthetic oligonucleotide
gcccgcccatattcgctcttctcgtcccatgcgtga

SEQ ID NO: 119461 - DNA, 35 bp, Artificial Sequence
  Synthetic oligonucleotide
gatgctccgttctgcaatactgcctccaatgccgc

SEQ ID NO: 119462 - DNA, 35 bp, Artificial Sequence
  Synthetic oligonucleotide
tcacgactcatcagtcttccgcatccttcccgcct

SEQ ID NO: 119463 - DNA, 35 bp, Artificial Sequence
  Synthetic oligonucleotide
aacgccgccaccatctgcccctgttcaacgtttct

SEQ ID NO: 119464 - DNA, 34 bp, Artificial Sequence
  Synthetic oligonucleotide
gggaggggggggtacgggcaatgaacggagggaa

SEQ ID NO: 119465 - DNA, 35 bp, Artificial Sequence
  Synthetic oligonucleotide
tgcggtgcccctcttctgtcagtatacatcctcca

SEQ ID NO: 119466 - DNA, 37 bp, Artificial Sequence
  Synthetic oligonucleotide
atgggaaggggaggtagacggtgagaggagagtcaga

SEQ ID NO: 119467 - DNA, 36 bp, Artificial Sequence
  Synthetic oligonucleotide
gaacgattaagacgggggtatgggcgggggaacgga

SEQ ID NO: 119468 - DNA, 38 bp, Artificial Sequence
  Synthetic oligonucleotide
ttagccagctcgcccgctgtctcaacacctccccctga

SEQ ID NO: 119469 - DNA, 35 bp, Artificial Sequence
  Synthetic oligonucleotide
tcgacctaaccccgccgcctgttcaccatcacgac

SEQ ID NO: 119470 - DNA, 35 bp, Artificial Sequence
  Synthetic oligonucleotide
agcctggcccaatccttcccagtccttcacctgcc

SEQ ID NO: 119471 - DNA, 35 bp, Artificial Sequence
  Synthetic oligonucleotide
gtcacgaaagaagtcctccccaagccgcacctgtc

SEQ ID NO: 119472 - DNA, 35 bp, Artificial Sequence
  Synthetic oligonucleotide
acgccttccctccctgacttcaatgcccgccgtgg

SEQ ID NO: 119473 - DNA, 36 bp, Artificial Sequence
  Synthetic oligonucleotide
gtcaagtgctggtcggggggtagggtggggcggaga

SEQ ID NO: 119474 - DNA, 35 bp, Artificial Sequence
  Synthetic oligonucleotide
gactcctcacctgacctgctgtacattctcaaacc

SEQ ID NO: 119475 - DNA, 36 bp, Artificial Sequence
  Synthetic oligonucleotide
tttgctccgcctcactagttctcatccatgtacacc

SEQ ID NO: 119476 - DNA, 35 bp, Artificial Sequence
  Synthetic oligonucleotide
tgaccccccgtcaccgcacgcacgctcagcacctc

SEQ ID NO: 119477 - DNA, 35 bp, Artificial Sequence
  Synthetic oligonucleotide
taccgctcgccctatagtatcctcctcgtcaagtc

SEQ ID NO: 119478 - DNA, 35 bp, Artificial Sequence
  Synthetic oligonucleotide
gatgcactaccccggcagtttatggtactttccgt

SEQ ID NO: 119479 - DNA, 35 bp, Artificial Sequence
  Synthetic oligonucleotide
tgcacatcatcagcctcgcttccaccgccgcataa

SEQ ID NO: 119480 - DNA, 36 bp, Artificial Sequence
  Synthetic oligonucleotide
taagcacgtcccaaccgcgtctgtccctacattcca

SEQ ID NO: 119481 - DNA, 37 bp, Artificial Sequence
  Synthetic oligonucleotide
atcgaggaggtttggggctgggtgacgggggagtaga

SEQ ID NO: 119482 - DNA, 36 bp, Artificial Sequence
  Synthetic oligonucleotide
tcccccctcatggtttcgatctttgacacatcctga

SEQ ID NO: 119483 - DNA, 35 bp, Artificial Sequence
  Synthetic oligonucleotide
cacatgctccctgcgattatgctgcctgccttctc

SEQ ID NO: 119484 - DNA, 35 bp, Artificial Sequence
  Synthetic oligonucleotide
ggtctcgcacgcgggctttccactgtcattccttc

SEQ ID NO: 119485 - DNA, 35 bp, Artificial Sequence
  Synthetic oligonucleotide
acaccgacgtccaacgggcgaattcgtactctttc

SEQ ID NO: 119486 - DNA, 35 bp, Artificial Sequence
  Synthetic oligonucleotide
atgagagggagggtgaggtgggtttgcagatcatg

SEQ ID NO: 119487 - DNA, 35 bp, Artificial Sequence
  Synthetic oligonucleotide
gctcagctgtcgcctgtctctgtcttttcgcccca

SEQ ID NO: 119488 - DNA, 37 bp, Artificial Sequence
  Synthetic oligonucleotide
acctccgcccgccctattcatcgacgactaatgccga

SEQ ID NO: 119489 - DNA, 35 bp, Artificial Sequence
  Synthetic oligonucleotide
taggtgccgcatctggctgacttcccttgttacac

SEQ ID NO: 119490 - DNA, 35 bp, Artificial Sequence
  Synthetic oligonucleotide
gctggagggtgggtgcggaatggagggataacggg

SEQ ID NO: 119491 - DNA, 35 bp, Artificial Sequence
  Synthetic oligonucleotide
tcgcaaaccgcagccgccaacgatacccggccctt

SEQ ID NO: 119492 - DNA, 37 bp, Artificial Sequence
  Synthetic oligonucleotide
acaccgcccttccctgtttcggagtcgcccaacacga

SEQ ID NO: 119493 - DNA, 35 bp, Artificial Sequence
  Synthetic oligonucleotide
tccaccatccaggccgacggcatacccccgcctta

SEQ ID NO: 119494 - DNA, 35 bp, Artificial Sequence
  Synthetic oligonucleotide
acacaggcataccctctgcaagcttctgcaacatc

SEQ ID NO: 119495 - DNA, 35 bp, Artificial Sequence
  Synthetic oligonucleotide
tccaccaatcggtctcagcttataatgcacctctc

SEQ ID NO: 119496 - DNA, 35 bp, Artificial Sequence
  Synthetic oligonucleotide
tcaccatgcgagcgcttatctcatcactgtccctg

SEQ ID NO: 119497 - DNA, 36 bp, Artificial Sequence
  Synthetic oligonucleotide
gatgcccgccctgcatacgcggtagtaccaccacca

SEQ ID NO: 119498 - DNA, 37 bp, Artificial Sequence
  Synthetic oligonucleotide
acgtgcctgtactcggtttttgctccatctctccgga

SEQ ID NO: 119499 - DNA, 37 bp, Artificial Sequence
  Synthetic oligonucleotide
tcactactccgactctgttttacgtccctgtccgtga

SEQ ID NO: 119500 - DNA, 35 bp, Artificial Sequence
  Synthetic oligonucleotide
ttggagcatccccggtctgttcgcacctcccttag

SEQ ID NO: 119501 - DNA, 38 bp, Artificial Sequence
  Synthetic oligonucleotide
tcaccaccttcccgctgccctttagtgttcattgttga

SEQ ID NO: 119502 - DNA, 35 bp, Artificial Sequence
  Synthetic oligonucleotide
tcgttgtctcgccatacgcccggtctgtccctgcc

SEQ ID NO: 119503 - DNA, 35 bp, Artificial Sequence
  Synthetic oligonucleotide
acgccctagcaacaactgcgcacacacggcccatc

SEQ ID NO: 119504 - DNA, 35 bp, Artificial Sequence
  Synthetic oligonucleotide
actacgcgcattccgttcgccttcccacttttccg

SEQ ID NO: 119505 - DNA, 37 bp, Artificial Sequence
  Synthetic oligonucleotide
agggggaaagggtgggggagaagggcagaagtaggga

SEQ ID NO: 119506 - DNA, 35 bp, Artificial Sequence
  Synthetic oligonucleotide
gtccccagccccgcgttaaagtccgtctccgcccc

SEQ ID NO: 119507 - DNA, 35 bp, Artificial Sequence
  Synthetic oligonucleotide
gccgtgtagggcgggtaggggtgggagcgctctcc

SEQ ID NO: 119508 - DNA, 35 bp, Artificial Sequence
  Synthetic oligonucleotide
aatttgcccccgcctggtccattaagcccccgttc

SEQ ID NO: 119509 - DNA, 35 bp, Artificial Sequence
  Synthetic oligonucleotide
agatcgcgggggaggggaagacgggaaacgtgggg

SEQ ID NO: 119510 - DNA, 35 bp, Artificial Sequence
  Synthetic oligonucleotide
ttacccccgctcacatttgctcgccgattcgccat

SEQ ID NO: 119511 - DNA, 36 bp, Artificial Sequence
  Synthetic oligonucleotide
gtcacaccgcccgccgccttcccagtcgtattggaa

SEQ ID NO: 119512 - DNA, 35 bp, Artificial Sequence
  Synthetic oligonucleotide
aaccgacaccaccccccgatgccgcatcctctcga

SEQ ID NO: 119513 - DNA, 37 bp, Artificial Sequence
  Synthetic oligonucleotide
tacctaggggctggccgactggggatctgaggaggga

SEQ ID NO: 119514 - DNA, 36 bp, Artificial Sequence
  Synthetic oligonucleotide
gcaatcaccgtcctttgcctccgcaccatgccttga

SEQ ID NO: 119515 - DNA, 35 bp, Artificial Sequence
  Synthetic oligonucleotide
gtcctccagcctatgcattgccaccacccctcgac

SEQ ID NO: 119516 - DNA, 35 bp, Artificial Sequence
  Synthetic oligonucleotide
tcgagccctcctctgcagtactgtcgtctggctcc

SEQ ID NO: 119517 - DNA, 35 bp, Artificial Sequence
  Synthetic oligonucleotide
accgtatgtctccgctgtaccttattgcctcttgc

SEQ ID NO: 119518 - DNA, 35 bp, Artificial Sequence
  Synthetic oligonucleotide
atacacctcgacccgttatttgatcatcttcattg

SEQ ID NO: 119519 - DNA, 35 bp, Artificial Sequence
  Synthetic oligonucleotide
tgccccatccagctgcctagcgggctacgtaccct

SEQ ID NO: 119520 - DNA, 35 bp, Artificial Sequence
  Synthetic oligonucleotide
tgctgacctccgtgaaatgcccgaacctacgcctt

SEQ ID NO: 119521 - DNA, 36 bp, Artificial Sequence
  Synthetic oligonucleotide
gagagggaggcatacgggagcaaagggtgaggtaga

SEQ ID NO: 119522 - DNA, 37 bp, Artificial Sequence
  Synthetic oligonucleotide
gtgaagaggggggtaatgggaggttgacagtaaggga

SEQ ID NO: 119523 - DNA, 35 bp, Artificial Sequence
  Synthetic oligonucleotide
acccgccactttcggttcttgaacttctcatttta

SEQ ID NO: 119524 - DNA, 35 bp, Artificial Sequence
  Synthetic oligonucleotide
acccgacgcccttcctctccggagtagtaaactat

SEQ ID NO: 119525 - DNA, 36 bp, Artificial Sequence
  Synthetic oligonucleotide
agaaagacaggaaaagggggcgggaagacggggata

SEQ ID NO: 119526 - DNA, 36 bp, Artificial Sequence
  Synthetic oligonucleotide
cccgaaccatctgcattcgctctctctccgtacgta

SEQ ID NO: 119527 - DNA, 35 bp, Artificial Sequence
  Synthetic oligonucleotide
gccatagccggcgcccgttcgcgatgctctacacc

SEQ ID NO: 119528 - DNA, 35 bp, Artificial Sequence
  Synthetic oligonucleotide
tgttccaccccacggagccctcgtcgcacgaccag

SEQ ID NO: 119529 - DNA, 35 bp, Artificial Sequence
  Synthetic oligonucleotide
ggaaccattctgcctctgtaatcctcctccttggg

SEQ ID NO: 119530 - DNA, 35 bp, Artificial Sequence
  Synthetic oligonucleotide
gcaccctctggttgccccattttatgccatgtcct

SEQ ID NO: 119531 - DNA, 37 bp, Artificial Sequence
  Synthetic oligonucleotide
atgaccgcggtgagcgtgggggcagggagggagcaga

SEQ ID NO: 119532 - DNA, 38 bp, Artificial Sequence
  Synthetic oligonucleotide
gaggggagtgaaagaggggaaggaaaacggcacggtga

SEQ ID NO: 119533 - DNA, 35 bp, Artificial Sequence
  Synthetic oligonucleotide
ccaccgccgccccaaccgtgccattagcgtgccct

SEQ ID NO: 119534 - DNA, 35 bp, Artificial Sequence
  Synthetic oligonucleotide
tattccctccgacgttctccaatcaggcccttgct

SEQ ID NO: 119535 - DNA, 36 bp, Artificial Sequence
  Synthetic oligonucleotide
gatgggggggagggctaatagacagggatagggaga

SEQ ID NO: 119536 - DNA, 35 bp, Artificial Sequence
  Synthetic oligonucleotide
tgtccgtgccccacgtccccttattagtgccccga

SEQ ID NO: 119537 - DNA, 37 bp, Artificial Sequence
  Synthetic oligonucleotide
ggacaggaggggggccggaaaggaggagaaaatggga

SEQ ID NO: 119538 - DNA, 35 bp, Artificial Sequence
  Synthetic oligonucleotide
acaccgatcacggtgaccactcctcccggctcgac

SEQ ID NO: 119539 - DNA, 35 bp, Artificial Sequence
  Synthetic oligonucleotide
tcagtacgcaccttattttcacgaccacgccctac

SEQ ID NO: 119540 - DNA, 36 bp, Artificial Sequence
  Synthetic oligonucleotide
actgaccttagcctgtgtccccccccctttcccggc

SEQ ID NO: 119541 - DNA, 35 bp, Artificial Sequence
  Synthetic oligonucleotide
accccgcctcgtgcctattttctctagaaccgtgc

SEQ ID NO: 119542 - DNA, 35 bp, Artificial Sequence
  Synthetic oligonucleotide
acacagtgtggactttgccccttgccttgcccttc

SEQ ID NO: 119543 - DNA, 35 bp, Artificial Sequence
  Synthetic oligonucleotide
ggaggggttgggactgggctgggaggggttatggt

SEQ ID NO: 119544 - DNA, 35 bp, Artificial Sequence
  Synthetic oligonucleotide
tacgacacggtacacatctttcggcctctcttgca

SEQ ID NO: 119545 - DNA, 35 bp, Artificial Sequence
  Synthetic oligonucleotide
gtcgcactcacttgttttgaaacttctgtctcccc

SEQ ID NO: 119546 - DNA, 35 bp, Artificial Sequence
  Synthetic oligonucleotide
cccgccgtaccttacccccgctgattagtcttgct

SEQ ID NO: 119547 - DNA, 35 bp, Artificial Sequence
  Synthetic oligonucleotide
acgaaggagctagcgggggagggagggctagtggt

SEQ ID NO: 119548 - DNA, 36 bp, Artificial Sequence
  Synthetic oligonucleotide
agatcccgctccctcctcgttatcgactcacattca

SEQ ID NO: 119549 - DNA, 37 bp, Artificial Sequence
  Synthetic oligonucleotide
tgcaacaccgcccggtgtcgactttttccatccctga

SEQ ID NO: 119550 - DNA, 38 bp, Artificial Sequence
  Synthetic oligonucleotide
tgggtggggtcgcgaatggggccgaatgggggtcctga

SEQ ID NO: 119551 - DNA, 35 bp, Artificial Sequence
  Synthetic oligonucleotide
aggtgggagggacacgggaggggcggacacgagta

SEQ ID NO: 119552 - DNA, 35 bp, Artificial Sequence
  Synthetic oligonucleotide
acttgtccgccccagttccctcgtttcccgtcacc

SEQ ID NO: 119553 - DNA, 36 bp, Artificial Sequence
  Synthetic oligonucleotide
gtatcgcgttggtagcctcctgtttcgccccgtttc

SEQ ID NO: 119554 - DNA, 35 bp, Artificial Sequence
  Synthetic oligonucleotide
aaagacgaggggtggtgtggggcaaaggctcgcgg

SEQ ID NO: 119555 - DNA, 36 bp, Artificial Sequence
  Synthetic oligonucleotide
gcaagggggaaacgggtgggaggcttgaaggatcaa

SEQ ID NO: 119556 - DNA, 36 bp, Artificial Sequence
  Synthetic oligonucleotide
tgcaaacaccacacagccgtcgatgctcccctccca

SEQ ID NO: 119557 - DNA, 35 bp, Artificial Sequence
  Synthetic oligonucleotide
ggaccgccgcatctgtccgttactcaaccttttca

SEQ ID NO: 119558 - DNA, 35 bp, Artificial Sequence
  Synthetic oligonucleotide
atcagtcagtcgcggtagccccccctcgttcctac

SEQ ID NO: 119559 - DNA, 35 bp, Artificial Sequence
  Synthetic oligonucleotide
ggacgtcacgccactctcatgccaggttgtccccc

SEQ ID NO: 119560 - DNA, 35 bp, Artificial Sequence
  Synthetic oligonucleotide
gccgttagtccctgtccgtcgcttctgtcactcgc

SEQ ID NO: 119561 - DNA, 35 bp, Artificial Sequence
  Synthetic oligonucleotide
accatccgtcaagttcccccgtccgctggttgttg

SEQ ID NO: 119562 - DNA, 35 bp, Artificial Sequence
  Synthetic oligonucleotide
gacaccctcgttgcaatttccccctccctctgaat

SEQ ID NO: 119563 - DNA, 35 bp, Artificial Sequence
  Synthetic oligonucleotide
gcacccgcaccatccttcacgtcgccttttagcct

SEQ ID NO: 119564 - DNA, 37 bp, Artificial Sequence
  Synthetic oligonucleotide
gttgccgcccctaccttgtatttcttgctacccccga

SEQ ID NO: 119565 - DNA, 38 bp, Artificial Sequence
  Synthetic oligonucleotide
tctgggcccctatctgtacgccgactccaccacgctga

SEQ ID NO: 119566 - DNA, 37 bp, Artificial Sequence
  Synthetic oligonucleotide
gaaggtcggggggaggaggagccagggaaggcgttga

SEQ ID NO: 119567 - DNA, 35 bp, Artificial Sequence
  Synthetic oligonucleotide
tgccccctccccgccctcctacgtagtaggcgttc

SEQ ID NO: 119568 - DNA, 35 bp, Artificial Sequence
  Synthetic oligonucleotide
atcgccctcccgtcacaactcgatcgcatacctag

SEQ ID NO: 119569 - DNA, 35 bp, Artificial Sequence
  Synthetic oligonucleotide
gcccctccatccccgcgtcctctcgcgcgcatccg

SEQ ID NO: 119570 - DNA, 36 bp, Artificial Sequence
  Synthetic oligonucleotide
gcctcccatatggtccatctttccctgtccctgaga

SEQ ID NO: 119571 - DNA, 36 bp, Artificial Sequence
  Synthetic oligonucleotide
gttcatcgccaccgcgcactttcgacctgatcccga

SEQ ID NO: 119572 - DNA, 37 bp, Artificial Sequence
  Synthetic oligonucleotide
tgagacagggaaggattagggcgaaatggagagcgga

SEQ ID NO: 119573 - DNA, 36 bp, Artificial Sequence
  Synthetic oligonucleotide
atgacccatctcgttcgcaccccccagtcacgttta

SEQ ID NO: 119574 - DNA, 35 bp, Artificial Sequence
  Synthetic oligonucleotide
gccccaaccttccccacctgcatctggtttacgcc

SEQ ID NO: 119575 - DNA, 34 bp, Artificial Sequence
  Synthetic oligonucleotide
ttgccactacacccgccccgcgtaattcaaacgc

SEQ ID NO: 119576 - DNA, 35 bp, Artificial Sequence
  Synthetic oligonucleotide
gaacgcgccacccttctcttcccctggtatttcgc

SEQ ID NO: 119577 - DNA, 35 bp, Artificial Sequence
  Synthetic oligonucleotide
atacctctcgtgccgaaccgcctgttacctttgtc

SEQ ID NO: 119578 - DNA, 35 bp, Artificial Sequence
  Synthetic oligonucleotide
acagaaaggagattggtggataggggggagggcgg

SEQ ID NO: 119579 - DNA, 37 bp, Artificial Sequence
  Synthetic oligonucleotide
gcagtgacgtggacggggaggcgggggcaagaacgga

SEQ ID NO: 119580 - DNA, 36 bp, Artificial Sequence
  Synthetic oligonucleotide
gtacgggtctacgtggggggggcgggatcggtggga

SEQ ID NO: 119581 - DNA, 35 bp, Artificial Sequence
  Synthetic oligonucleotide
gccctatgccatcacgttacctggtcgtactacca

SEQ ID NO: 119582 - DNA, 36 bp, Artificial Sequence
  Synthetic oligonucleotide
gatccagccgcatgagccgtttactcttatcctcca

SEQ ID NO: 119583 - DNA, 37 bp, Artificial Sequence
  Synthetic oligonucleotide
tctgcccgctccacctgttacactccgataccgctga

SEQ ID NO: 119584 - DNA, 35 bp, Artificial Sequence
  Synthetic oligonucleotide
atcaccgtgccacactcgttgaatacaccatgccc

SEQ ID NO: 119585 - DNA, 35 bp, Artificial Sequence
  Synthetic oligonucleotide
gtgggtgggtactgacgggggaggggagtatcatc

SEQ ID NO: 119586 - DNA, 35 bp, Artificial Sequence
  Synthetic oligonucleotide
gaactagggggggactgaagaagcgatgggagggt

SEQ ID NO: 119587 - DNA, 35 bp, Artificial Sequence
  Synthetic oligonucleotide
gtcatcaccaacgcttgccattgccatcggtcccc

SEQ ID NO: 119588 - DNA, 35 bp, Artificial Sequence
  Synthetic oligonucleotide
tccctctgctgcatcgcggccgttatccaccttcc

SEQ ID NO: 119589 - DNA, 35 bp, Artificial Sequence
  Synthetic oligonucleotide
aactcctgccactggccttgccctctcattagagc

SEQ ID NO: 119590 - DNA, 35 bp, Artificial Sequence
  Synthetic oligonucleotide
gtgcaccatcaatgcatcagtttctcacctacttc

SEQ ID NO: 119591 - DNA, 35 bp, Artificial Sequence
  Synthetic oligonucleotide
agagcacccttcgccgtcccgtatccccttggttc

SEQ ID NO: 119592 - DNA, 35 bp, Artificial Sequence
  Synthetic oligonucleotide
atccacaccctcgccttacgggtatactaccctat

SEQ ID NO: 119593 - DNA, 35 bp, Artificial Sequence
  Synthetic oligonucleotide
tcaccccccgctctgttccggttactactgtgcct

SEQ ID NO: 119594 - DNA, 36 bp, Artificial Sequence
  Synthetic oligonucleotide
gattgtgtggtggagggcggaggggggcgataagaa

SEQ ID NO: 119595 - DNA, 37 bp, Artificial Sequence
  Synthetic oligonucleotide
gccatcgccgttgctcccttggttacctctttaatga

SEQ ID NO: 119596 - DNA, 35 bp, Artificial Sequence
  Synthetic oligonucleotide
acacagccagtttcgtaccactcctagctccccta

SEQ ID NO: 119597 - DNA, 35 bp, Artificial Sequence
  Synthetic oligonucleotide
ttccccgttcattcccggtgcccttccagctgccc

SEQ ID NO: 119598 - DNA, 35 bp, Artificial Sequence
  Synthetic oligonucleotide
tgccgtactgttcaccgctccgtcacctttcctgt

SEQ ID NO: 119599 - DNA, 37 bp, Artificial Sequence
  Synthetic oligonucleotide
ttggggatcgagatgcggggtgggaggggatccgaga

SEQ ID NO: 119600 - DNA, 37 bp, Artificial Sequence
  Synthetic oligonucleotide
accctgcccgccctgacgcccggtccttcctcattga

SEQ ID NO: 119601 - DNA, 35 bp, Artificial Sequence
  Synthetic oligonucleotide
accctcgctccgtcctggtgctcatctccatctgc

SEQ ID NO: 119602 - DNA, 35 bp, Artificial Sequence
  Synthetic oligonucleotide
agccaagctcagtcctcgaacccgctttgtcctgt

SEQ ID NO: 119603 - DNA, 36 bp, Artificial Sequence
  Synthetic oligonucleotide
tgctgacctacagccccctgtctcttagccccttaa

SEQ ID NO: 119604 - DNA, 35 bp, Artificial Sequence
  Synthetic oligonucleotide
acaaccaccctgccttggcgataacaccctctaca

SEQ ID NO: 119605 - DNA, 37 bp, Artificial Sequence
  Synthetic oligonucleotide
ttgaagggtgggttgacggaacgcggggagggcggga

SEQ ID NO: 119606 - DNA, 38 bp, Artificial Sequence
  Synthetic oligonucleotide
gttccaccgcatccatgccttcctttagacacacgtga

SEQ ID NO: 119607 - DNA, 38 bp, Artificial Sequence
  Synthetic oligonucleotide
attcgccgcccacatggtccctcgcttccaaccgttga

SEQ ID NO: 119608 - DNA, 35 bp, Artificial Sequence
  Synthetic oligonucleotide
agttccagcgcctcactcccccgggctgctaccac

SEQ ID NO: 119609 - DNA, 35 bp, Artificial Sequence
  Synthetic oligonucleotide
tccacgcaggaacgcctgtattatcgcttctccct

SEQ ID NO: 119610 - DNA, 36 bp, Artificial Sequence
  Synthetic oligonucleotide
gccgacgcgctcactgcatttcctgaaaccctccga

SEQ ID NO: 119611 - DNA, 37 bp, Artificial Sequence
  Synthetic oligonucleotide
tacgggagccgtatgccctccttatccacctcgttga

SEQ ID NO: 119612 - DNA, 35 bp, Artificial Sequence
  Synthetic oligonucleotide
acacagacccaggtgccggtaccctctcactcccc

SEQ ID NO: 119613 - DNA, 35 bp, Artificial Sequence
  Synthetic oligonucleotide
gagcaggccacaccccacctctcttcgctgttccg

SEQ ID NO: 119614 - DNA, 35 bp, Artificial Sequence
  Synthetic oligonucleotide
tatgcccccgactcatggccgagccttggtttcct

SEQ ID NO: 119615 - DNA, 35 bp, Artificial Sequence
  Synthetic oligonucleotide
gactggccccgccctcttcacctcgcatcacccgt

SEQ ID NO: 119616 - DNA, 35 bp, Artificial Sequence
  Synthetic oligonucleotide
tgcaaggcgatcttgtccctgtcctgtccgccctt

SEQ ID NO: 119617 - DNA, 36 bp, Artificial Sequence
  Synthetic oligonucleotide
accctgccgcatcccccgtccatgagtgcccctgaa

SEQ ID NO: 119618 - DNA, 36 bp, Artificial Sequence
  Synthetic oligonucleotide
gccaacggcctgttcttatcttaccggtcattccca

SEQ ID NO: 119619 - DNA, 37 bp, Artificial Sequence
  Synthetic oligonucleotide
ttgtccacccccgcagtttgcccctccgtgatacgga

SEQ ID NO: 119620 - DNA, 36 bp, Artificial Sequence
  Synthetic oligonucleotide
gactacaccctccatcgtgtcccgtttcacaattga

SEQ ID NO: 119621 - DNA, 35 bp, Artificial Sequence
  Synthetic oligonucleotide
actgcgcgccctgctcttcataactcctcgctggc

SEQ ID NO: 119622 - DNA, 35 bp, Artificial Sequence
  Synthetic oligonucleotide
gcatccacagcttgtctatgtcccgttcttcgcct

SEQ ID NO: 119623 - DNA, 37 bp, Artificial Sequence
  Synthetic oligonucleotide
aagccagccactatgcaacatccgccacccccttcga

SEQ ID NO: 119624 - DNA, 35 bp, Artificial Sequence
  Synthetic oligonucleotide
gtcgtcgccaggcgaacctgcactcctcccccccg

SEQ ID NO: 119625 - DNA, 35 bp, Artificial Sequence
  Synthetic oligonucleotide
tgtgggtgggagggagtcgggccatttaacgcact

SEQ ID NO: 119626 - DNA, 35 bp, Artificial Sequence
  Synthetic oligonucleotide
tttcacccccgccgccttgctctccatcgtcttgt

SEQ ID NO: 119627 - DNA, 36 bp, Artificial Sequence
  Synthetic oligonucleotide
gtcagacctcatcttgctcccgcctgtcttatatca

SEQ ID NO: 119628 - DNA, 35 bp, Artificial Sequence
  Synthetic oligonucleotide
gttgcccacggttcctgctacatctgacactatca

SEQ ID NO: 119629 - DNA, 37 bp, Artificial Sequence
  Synthetic oligonucleotide
agagactggggccgggcgggggaacacaatgtggtga

SEQ ID NO: 119630 - DNA, 38 bp, Artificial Sequence
  Synthetic oligonucleotide
gagagggtgggaggggcggttagatacagttagtgtga

SEQ ID NO: 119631 - DNA, 35 bp, Artificial Sequence
  Synthetic oligonucleotide
ttcgcccacccggcccctctcatgcctcaatcatc

SEQ ID NO: 119632 - DNA, 35 bp, Artificial Sequence
  Synthetic oligonucleotide
actcagcatctgcacgttacccctcggtccttctc

SEQ ID NO: 119633 - DNA, 35 bp, Artificial Sequence
  Synthetic oligonucleotide
attgctcgcattgcatttaattttcctggttccat

SEQ ID NO: 119634 - DNA, 36 bp, Artificial Sequence
  Synthetic oligonucleotide
ggagtggtggagggggggcaaggcggtcaaacagaa

SEQ ID NO: 119635 - DNA, 37 bp, Artificial Sequence
  Synthetic oligonucleotide
gttcacccgcatctgcttgccccatatctgttcctga

SEQ ID NO: 119636 - DNA, 35 bp, Artificial Sequence
  Synthetic oligonucleotide
accctcccgccacatcatcacatatcctgggctta

SEQ ID NO: 119637 - DNA, 35 bp, Artificial Sequence
  Synthetic oligonucleotide
accagcacccgtcccacctagtcaatgcctcgccc

SEQ ID NO: 119638 - DNA, 36 bp, Artificial Sequence
  Synthetic oligonucleotide
tacctgcttagaacgcccacccacgccgacctcgcc

SEQ ID NO: 119639 - DNA, 37 bp, Artificial Sequence
  Synthetic oligonucleotide
atgggtggggcacggaccctgtaggggaagaaaggga

SEQ ID NO: 119640 - DNA, 37 bp, Artificial Sequence
  Synthetic oligonucleotide
ggggagggcgcgaatcgggggctctcgtctacgggga

SEQ ID NO: 119641 - DNA, 38 bp, Artificial Sequence
  Synthetic oligonucleotide
tccgatcccaccacgcctttctatcgacagtttactga

SEQ ID NO: 119642 - DNA, 36 bp, Artificial Sequence
  Synthetic oligonucleotide
tcgttgcccgtcgccgtattgtcctccctccgtata

SEQ ID NO: 119643 - DNA, 34 bp, Artificial Sequence
  Synthetic oligonucleotide
tctaccaccgctctctgtattttggccatgccac

SEQ ID NO: 119644 - DNA, 35 bp, Artificial Sequence
  Synthetic oligonucleotide
tacaccaccgctaccacatacagccccgttaaccg

SEQ ID NO: 119645 - DNA, 35 bp, Artificial Sequence
  Synthetic oligonucleotide
acccgacactccccaccagcctatcttcgctactg

SEQ ID NO: 119646 - DNA, 36 bp, Artificial Sequence
  Synthetic oligonucleotide
gtatgggagagccagtgtgggaggggagggcattaa

SEQ ID NO: 119647 - DNA, 37 bp, Artificial Sequence
  Synthetic oligonucleotide
tacggactggggggcacgactgggtgggagggtaaca

SEQ ID NO: 119648 - DNA, 36 bp, Artificial Sequence
  Synthetic oligonucleotide
ttgttggccaccactcgcttcttctcgtcgctccga

SEQ ID NO: 119649 - DNA, 35 bp, Artificial Sequence
  Synthetic oligonucleotide
aacgccattcccgtagctgggccatccttccatga

SEQ ID NO: 119650 - DNA, 35 bp, Artificial Sequence
  Synthetic oligonucleotide
tccggggggggagcagatcagggacgggtgggtta

SEQ ID NO: 119651 - DNA, 35 bp, Artificial Sequence
  Synthetic oligonucleotide
agcccggcccagtatcctgccggctccccccatac

SEQ ID NO: 119652 - DNA, 35 bp, Artificial Sequence
  Synthetic oligonucleotide
agcaaggagaagggggtaagaacgggcaacgcagg

SEQ ID NO: 119653 - DNA, 35 bp, Artificial Sequence
  Synthetic oligonucleotide
atcacccgccgcaaactgtccagggccttcactct

SEQ ID NO: 119654 - DNA, 35 bp, Artificial Sequence
  Synthetic oligonucleotide
actccaccacgggcccctatatgaactgctccctt

SEQ ID NO: 119655 - DNA, 35 bp, Artificial Sequence
  Synthetic oligonucleotide
acacatcatccgcctggtccctatcacacactttt

SEQ ID NO: 119656 - DNA, 36 bp, Artificial Sequence
  Synthetic oligonucleotide
gacaccaaccgtccttctcatgggccctgatttaca

SEQ ID NO: 119657 - DNA, 36 bp, Artificial Sequence
  Synthetic oligonucleotide
tgcggatgctcccgttactgtccacggccccaccca

SEQ ID NO: 119658 - DNA, 35 bp, Artificial Sequence
  Synthetic oligonucleotide
tgtacgtacccgacctctctcgcccacagtttcga

SEQ ID NO: 119659 - DNA, 36 bp, Artificial Sequence
  Synthetic oligonucleotide
gactacccgcgctccatccttttgtcgtcacaggga

SEQ ID NO: 119660 - DNA, 38 bp, Artificial Sequence
  Synthetic oligonucleotide
gactcgtacactgctgcccgttccccccaatttattga

SEQ ID NO: 119661 - DNA, 36 bp, Artificial Sequence
  Synthetic oligonucleotide
gcaacgaacggagggcgagggccggaaagggaggta

SEQ ID NO: 119662 - DNA, 35 bp, Artificial Sequence
  Synthetic oligonucleotide
tatgacctccgccgcatacccgtttcgaatcgctc

SEQ ID NO: 119663 - DNA, 35 bp, Artificial Sequence
  Synthetic oligonucleotide
tgacaaccgccagcactgatcccattccccacctg

SEQ ID NO: 119664 - DNA, 35 bp, Artificial Sequence
  Synthetic oligonucleotide
gccgaccacctcccatgtttcacacccccgccctg

SEQ ID NO: 119665 - DNA, 36 bp, Artificial Sequence
  Synthetic oligonucleotide
atgtcgaatccgcctaatgtcttccatcagtccctg

SEQ ID NO: 119666 - DNA, 35 bp, Artificial Sequence
  Synthetic oligonucleotide
ttgtccgccgccacgcaccgacttcctctcccgtg

SEQ ID NO: 119667 - DNA, 35 bp, Artificial Sequence
  Synthetic oligonucleotide
tctcacgcaccttgtcagcgcctctcgccgcacct

SEQ ID NO: 119668 - DNA, 35 bp, Artificial Sequence
  Synthetic oligonucleotide
gtttcccgccacccaccattacgttcctgttccgt

SEQ ID NO: 119669 - DNA, 35 bp, Artificial Sequence
  Synthetic oligonucleotide
tgacgccacagcctgaaatcaccccccctcgccaa

SEQ ID NO: 119670 - DNA, 35 bp, Artificial Sequence
  Synthetic oligonucleotide
tacccccgcacactccatcctgccgtgtacacgaa

SEQ ID NO: 119671 - DNA, 36 bp, Artificial Sequence
  Synthetic oligonucleotide
gaaaggggggaggcgtgaaggcgtagggggtaggaa

SEQ ID NO: 119672 - DNA, 37 bp, Artificial Sequence
  Synthetic oligonucleotide
tgctcgccgtgtccatcgctaacgcccctcttcccga

SEQ ID NO: 119673 - DNA, 38 bp, Artificial Sequence
  Synthetic oligonucleotide
gttagagaaggtggacgggagggcgggagacaggctga

SEQ ID NO: 119674 - DNA, 35 bp, Artificial Sequence
  Synthetic oligonucleotide
cacacccgctgaataccctgggcccttgctccacc

SEQ ID NO: 119675 - DNA, 35 bp, Artificial Sequence
  Synthetic oligonucleotide
gccccatcgtacgcacacccccagttatcacagcc

SEQ ID NO: 119676 - DNA, 35 bp, Artificial Sequence
  Synthetic oligonucleotide
tacgcctcggcggtagtcatcgcatcaatcccctc

SEQ ID NO: 119677 - DNA, 35 bp, Artificial Sequence
  Synthetic oligonucleotide
gaaacgtcaacaatcatacgcgccgtcgcccgctc

SEQ ID NO: 119678 - DNA, 35 bp, Artificial Sequence
  Synthetic oligonucleotide
gtgtcaggcattccatctcttcgtgacgttccctt

SEQ ID NO: 119679 - DNA, 36 bp, Artificial Sequence
  Synthetic oligonucleotide
gccacccctccgtgctcgccctccgtaccgggctaa

SEQ ID NO: 119680 - DNA, 36 bp, Artificial Sequence
  Synthetic oligonucleotide
gtgactggcccccgttgtctttacattcctgaagca

SEQ ID NO: 119681 - DNA, 35 bp, Artificial Sequence
  Synthetic oligonucleotide
acagaacggctgtaggggaggggagggggattaga

SEQ ID NO: 119682 - DNA, 38 bp, Artificial Sequence
  Synthetic oligonucleotide
tttgggcggggaaatggggctcatgctctgggggttga

SEQ ID NO: 119683 - DNA, 35 bp, Artificial Sequence
  Synthetic oligonucleotide
tgaacactcaacgtgccccggtccattcataccac

SEQ ID NO: 119684 - DNA, 35 bp, Artificial Sequence
  Synthetic oligonucleotide
ttcgtgtcccactggtccctgtcttccgatctctc

SEQ ID NO: 119685 - DNA, 35 bp, Artificial Sequence
  Synthetic oligonucleotide
gacccccgcttgagccccccgattcttacccatgt

SEQ ID NO: 119686 - DNA, 37 bp, Artificial Sequence
  Synthetic oligonucleotide
tctcgccacgcccccgtagtcatttcacccccttgga

SEQ ID NO: 119687 - DNA, 36 bp, Artificial Sequence
  Synthetic oligonucleotide
tcctcccccccatcacatggtacactctggtaatta

SEQ ID NO: 119688 - DNA, 35 bp, Artificial Sequence
  Synthetic oligonucleotide
tagagggtgggagggtactcattgctccgggggac

SEQ ID NO: 119689 - DNA, 35 bp, Artificial Sequence
  Synthetic oligonucleotide
agagagagctcgggtctgggtgggtgggaagcagt

SEQ ID NO: 119690 - DNA, 35 bp, Artificial Sequence
  Synthetic oligonucleotide
acataccagtccacaacgctttgtcttatgccctt

SEQ ID NO: 119691 - DNA, 35 bp, Artificial Sequence
  Synthetic oligonucleotide
tcgcacatagatccgtccagctccccccctgttaa

SEQ ID NO: 119692 - DNA, 36 bp, Artificial Sequence
  Synthetic oligonucleotide
atgcaaggggggggagtagggcggttacagggtcga

SEQ ID NO: 119693 - DNA, 37 bp, Artificial Sequence
  Synthetic oligonucleotide
tgcaagggtgaggggggtgcgcgatcgggaggaggga

SEQ ID NO: 119694 - DNA, 38 bp, Artificial Sequence
  Synthetic oligonucleotide
gactcagccgccgttttctatccagcgtatattcctga

SEQ ID NO: 119695 - DNA, 36 bp, Artificial Sequence
  Synthetic oligonucleotide
tcccctccgccaaagagcttcgcccccactacccta

SEQ ID NO: 119696 - DNA, 35 bp, Artificial Sequence
  Synthetic oligonucleotide
actcccatgtatccgcctttatgcccagtttccgc

SEQ ID NO: 119697 - DNA, 35 bp, Artificial Sequence
  Synthetic oligonucleotide
tgctggcgccctagccgcgcttcgatctccttccg

SEQ ID NO: 119698 - DNA, 35 bp, Artificial Sequence
  Synthetic oligonucleotide
gtcgctcccccgcccccgatcactgtatacacctg

SEQ ID NO: 119699 - DNA, 35 bp, Artificial Sequence
  Synthetic oligonucleotide
tactcgccctgtcgccccaccctgttacgtttttg

SEQ ID NO: 119700 - DNA, 38 bp, Artificial Sequence
  Synthetic oligonucleotide
aatgagggtggagggggtgagcgagtagagggaggtga

SEQ ID NO: 119701 - DNA, 38 bp, Artificial Sequence
  Synthetic oligonucleotide
gcccctccctgccccatgaaacacgtgtcaccatgtga

SEQ ID NO: 119702 - DNA, 38 bp, Artificial Sequence
  Synthetic oligonucleotide
acgacgagtcgatcccgtttgccaccccgccatcttga

SEQ ID NO: 119703 - DNA, 35 bp, Artificial Sequence
  Synthetic oligonucleotide
tccagccggggccgcctccttgttctctggtccac

SEQ ID NO: 119704 - DNA, 35 bp, Artificial Sequence
  Synthetic oligonucleotide
acgcactcagtaaatctgctccgttcctttcgcgc

SEQ ID NO: 119705 - DNA, 35 bp, Artificial Sequence
  Synthetic oligonucleotide
gaggcaacgatcacggttctacccgccgttccatc

SEQ ID NO: 119706 - DNA, 35 bp, Artificial Sequence
  Synthetic oligonucleotide
atcacatgtcagaggctttcttcctcccgtgtctc

SEQ ID NO: 119707 - DNA, 35 bp, Artificial Sequence
  Synthetic oligonucleotide
gtcgatgtccacacgcgccgcccccaccgtctctg

SEQ ID NO: 119708 - DNA, 35 bp, Artificial Sequence
  Synthetic oligonucleotide
gcgaacctgtcaccctcatgtaatttctgttctat

SEQ ID NO: 119709 - DNA, 35 bp, Artificial Sequence
  Synthetic oligonucleotide
gtctcgccgccttcccgctcacctgtccacgtact

SEQ ID NO: 119710 - DNA, 35 bp, Artificial Sequence
  Synthetic oligonucleotide
accaccgccgatcacatttagccgcctacatagaa

SEQ ID NO: 119711 - DNA, 35 bp, Artificial Sequence
  Synthetic oligonucleotide
gttcgtgtcctggtgctcctgttccggtccttcca

SEQ ID NO: 119712 - DNA, 36 bp, Artificial Sequence
  Synthetic oligonucleotide
acccttcgtcacccggctgccccctgaacggcctta

SEQ ID NO: 119713 - DNA, 35 bp, Artificial Sequence
  Synthetic oligonucleotide
tcaccgcctggtcgcatcacgctatgctctacacc

SEQ ID NO: 119714 - DNA, 35 bp, Artificial Sequence
  Synthetic oligonucleotide
agacacgccgccctcaacctcgtgcacctatcgcc

SEQ ID NO: 119715 - DNA, 35 bp, Artificial Sequence
  Synthetic oligonucleotide
gattgctcgtcgctcgtcagttcccgtcctccgtc

SEQ ID NO: 119716 - DNA, 35 bp, Artificial Sequence
  Synthetic oligonucleotide
atgctcgccgccgcttgcatacatttaccacgttc

SEQ ID NO: 119717 - DNA, 35 bp, Artificial Sequence
  Synthetic oligonucleotide
gaaatcaggcggagggtggagtcgggggagtcgag

SEQ ID NO: 119718 - DNA, 36 bp, Artificial Sequence
  Synthetic oligonucleotide
gatccaccccgccactgagctgtgattttctcacca

SEQ ID NO: 119719 - DNA, 34 bp, Artificial Sequence
  Synthetic oligonucleotide
tcgcaccggcccttcctcctccgtgatcattcga

SEQ ID NO: 119720 - DNA, 35 bp, Artificial Sequence
  Synthetic oligonucleotide
acacctccgccattcaagctggttagttcgcccta

SEQ ID NO: 119721 - DNA, 35 bp, Artificial Sequence
  Synthetic oligonucleotide
ccacgtcgccatatattagcactccgcccctccac

SEQ ID NO: 119722 - DNA, 35 bp, Artificial Sequence
  Synthetic oligonucleotide
tgtgtggacgtctgtttctctgcttctccctggcc

SEQ ID NO: 119723 - DNA, 35 bp, Artificial Sequence
  Synthetic oligonucleotide
gtggtgctatccgctgcccctcccgactcatttag

SEQ ID NO: 119724 - DNA, 35 bp, Artificial Sequence
  Synthetic oligonucleotide
atcgcggtcacccgatgatccctttccgctctcct

SEQ ID NO: 119725 - DNA, 35 bp, Artificial Sequence
  Synthetic oligonucleotide
ttccaccgcctgtactcctccggatattttccggt

SEQ ID NO: 119726 - DNA, 36 bp, Artificial Sequence
  Synthetic oligonucleotide
gagcatggcatgggtgggagcggaggggcctctgca

SEQ ID NO: 119727 - DNA, 37 bp, Artificial Sequence
  Synthetic oligonucleotide
ggggaggggcggagaaacagggggagggagtccggga

SEQ ID NO: 119728 - DNA, 35 bp, Artificial Sequence
  Synthetic oligonucleotide
ttccctgcctcacgcacctgccaaggagcacttcc

SEQ ID NO: 119729 - DNA, 35 bp, Artificial Sequence
  Synthetic oligonucleotide
tccccgtcacagttcgttacatgcctgttattctc

SEQ ID NO: 119730 - DNA, 34 bp, Artificial Sequence
  Synthetic oligonucleotide
gttcgcagtacaccatcgtgaccactcctccgtc

SEQ ID NO: 119731 - DNA, 35 bp, Artificial Sequence
  Synthetic oligonucleotide
atcactcaccgagcccgtgccccttctcctgcttg

SEQ ID NO: 119732 - DNA, 35 bp, Artificial Sequence
  Synthetic oligonucleotide
gcctgtcgggagggtgggcagggttccggtccatt

SEQ ID NO: 119733 - DNA, 35 bp, Artificial Sequence
  Synthetic oligonucleotide
tcccgagccctacatgcgccttctccccgaaccaa

SEQ ID NO: 119734 - DNA, 37 bp, Artificial Sequence
  Synthetic oligonucleotide
gtgagtggctgagggggaacacgtgggggagggggga

SEQ ID NO: 119735 - DNA, 35 bp, Artificial Sequence
  Synthetic oligonucleotide
tccaaccgctgtcctctccaccgccacccgtggga

SEQ ID NO: 119736 - DNA, 35 bp, Artificial Sequence
  Synthetic oligonucleotide
tagcccgcctctgtgccctcctctaccccttcgtc

SEQ ID NO: 119737 - DNA, 35 bp, Artificial Sequence
  Synthetic oligonucleotide
tgtcctgagcgtgctcccgttgccctcccccttgt

SEQ ID NO: 119738 - DNA, 35 bp, Artificial Sequence
  Synthetic oligonucleotide
ttctcgccccgccgtttctctccatgcctatacca

SEQ ID NO: 119739 - DNA, 36 bp, Artificial Sequence
  Synthetic oligonucleotide
atatccgcccactgtttcctgcaggacacctctcga

SEQ ID NO: 119740 - DNA, 35 bp, Artificial Sequence
  Synthetic oligonucleotide
gccaccttgtcctgcgaacctgccttccctttgta

SEQ ID NO: 119741 - DNA, 35 bp, Artificial Sequence
  Synthetic oligonucleotide
tgcgacggtcaatcacacattagctcgttcctccc

SEQ ID NO: 119742 - DNA, 35 bp, Artificial Sequence
  Synthetic oligonucleotide
aatgtacctgccccgcccgttgtccgttacctgcc

SEQ ID NO: 119743 - DNA, 36 bp, Artificial Sequence
  Synthetic oligonucleotide
gccaacatccccgtcctgactcataaagtcctcatc

SEQ ID NO: 119744 - DNA, 33 bp, Artificial Sequence
  Synthetic oligonucleotide
tgctcccctccagaccgcacttcacttttttca

SEQ ID NO: 119745 - DNA, 35 bp, Artificial Sequence
  Synthetic oligonucleotide
ttcatcccccgacatcccatagggacgtttcgctc

SEQ ID NO: 119746 - DNA, 35 bp, Artificial Sequence
  Synthetic oligonucleotide
agcaacctcgccgcagctgcccgccgtcccacacg

SEQ ID NO: 119747 - DNA, 35 bp, Artificial Sequence
  Synthetic oligonucleotide
tgtagcctctccgaccggcggctcccccctctctt

SEQ ID NO: 119748 - DNA, 36 bp, Artificial Sequence
  Synthetic oligonucleotide
tgtccccctgcgccctcatccggtaggctcccatca

SEQ ID NO: 119749 - DNA, 36 bp, Artificial Sequence
  Synthetic oligonucleotide
gtactcgtccccgcctttcgcccagttccccgctca

SEQ ID NO: 119750 - DNA, 37 bp, Artificial Sequence
  Synthetic oligonucleotide
gacgccgtctacacatcctggcgccaccctcttccga

SEQ ID NO: 119751 - DNA, 37 bp, Artificial Sequence
  Synthetic oligonucleotide
gaacggaagggaggaagccaaaagaaggcgggtggga

SEQ ID NO: 119752 - DNA, 38 bp, Artificial Sequence
  Synthetic oligonucleotide
tgccaggaggtcgggagaaagggagggaaagggatgga

SEQ ID NO: 119753 - DNA, 38 bp, Artificial Sequence
  Synthetic oligonucleotide
acagtcagtcctgtgctctctctccacttatccgctga

SEQ ID NO: 119754 - DNA, 38 bp, Artificial Sequence
  Synthetic oligonucleotide
gaaaaggagtgggggtggagaagaagggccgtaagtga

SEQ ID NO: 119755 - DNA, 36 bp, Artificial Sequence
  Synthetic oligonucleotide
gcccccatccccgcctggcatcagactgtcttgtga

SEQ ID NO: 119756 - DNA, 36 bp, Artificial Sequence
  Synthetic oligonucleotide
tcccgactgccccacccttgtcgttgttgcaggata

SEQ ID NO: 119757 - DNA, 36 bp, Artificial Sequence
  Synthetic oligonucleotide
tctcccggtccaacttgcttatgcctctctttagta

SEQ ID NO: 119758 - DNA, 35 bp, Artificial Sequence
  Synthetic oligonucleotide
tagcatccgtacgccctcccccgagcgtaagcccc

SEQ ID NO: 119759 - DNA, 35 bp, Artificial Sequence
  Synthetic oligonucleotide
tgcctgatcgtaactaccgctgttcaccactcgcc

SEQ ID NO: 119760 - DNA, 35 bp, Artificial Sequence
  Synthetic oligonucleotide
gtctcgttcgattccgtccgccgtcccgctactcc

SEQ ID NO: 119761 - DNA, 35 bp, Artificial Sequence
  Synthetic oligonucleotide
tcaccgtgactcgtccgcactccctcacatcgctc

SEQ ID NO: 119762 - DNA, 35 bp, Artificial Sequence
  Synthetic oligonucleotide
tattgaggtcgccccatccgtgttccttccccctg

SEQ ID NO: 119763 - DNA, 35 bp, Artificial Sequence
  Synthetic oligonucleotide
acgcatgctcccccgcgcacttcttaaggttccct

SEQ ID NO: 119764 - DNA, 35 bp, Artificial Sequence
  Synthetic oligonucleotide
tgaccatcccactagtgcttcgatctatcacatct

SEQ ID NO: 119765 - DNA, 37 bp, Artificial Sequence
  Synthetic oligonucleotide
tctagctcgccctctgttctccctacgcctcggacga

SEQ ID NO: 119766 - DNA, 38 bp, Artificial Sequence
  Synthetic oligonucleotide
ttaggcgagggaggtagggaacgaaggagggggattga

SEQ ID NO: 119767 - DNA, 37 bp, Artificial Sequence
  Synthetic oligonucleotide
tgttccaccctccgattatatcttgttcactcgttga

SEQ ID NO: 119768 - DNA, 35 bp, Artificial Sequence
  Synthetic oligonucleotide
aacctgaggtacctaccgcgttgccccctcccatc

SEQ ID NO: 119769 - DNA, 35 bp, Artificial Sequence
  Synthetic oligonucleotide
atccatacccgctcatctgccttgctagctctccg

SEQ ID NO: 119770 - DNA, 35 bp, Artificial Sequence
  Synthetic oligonucleotide
atccactcctcaccagttattggtgccgactcgct

SEQ ID NO: 119771 - DNA, 37 bp, Artificial Sequence
  Synthetic oligonucleotide
tctgcctcccgcagcccacccttatcgccacttagga

SEQ ID NO: 119772 - DNA, 37 bp, Artificial Sequence
  Synthetic oligonucleotide
tgcggggatcggagaaaagggcaggagcaagggggga

SEQ ID NO: 119773 - DNA, 35 bp, Artificial Sequence
  Synthetic oligonucleotide
tacgaccacccggcttactggactcgcccacctga

SEQ ID NO: 119774 - DNA, 38 bp, Artificial Sequence
  Synthetic oligonucleotide
tccgccactccagctggtgcgttcctgtactcctttga

SEQ ID NO: 119775 - DNA, 35 bp, Artificial Sequence
  Synthetic oligonucleotide
gtcgaacccccagctcgaaatgccccgtaccgccc

SEQ ID NO: 119776 - DNA, 35 bp, Artificial Sequence
  Synthetic oligonucleotide
aaagcaagtgtgcctgcttcctgtccttgccctcc

SEQ ID NO: 119777 - DNA, 35 bp, Artificial Sequence
  Synthetic oligonucleotide
tgacctgcttggctctggacccccgcccgccccgc

SEQ ID NO: 119778 - DNA, 35 bp, Artificial Sequence
  Synthetic oligonucleotide
aatcgccccacacccgttataattcattgcattgc

SEQ ID NO: 119779 - DNA, 35 bp, Artificial Sequence
  Synthetic oligonucleotide
ttcaccgttccccatattcgccggttctgcctgtc

SEQ ID NO: 119780 - DNA, 35 bp, Artificial Sequence
  Synthetic oligonucleotide
tcaccccccattcctcgcgccccaactcgtattgg

SEQ ID NO: 119781 - DNA, 35 bp, Artificial Sequence
  Synthetic oligonucleotide
ttagttcccaccttctgccgttatcggatcacgct

SEQ ID NO: 119782 - DNA, 35 bp, Artificial Sequence
  Synthetic oligonucleotide
acgccacatgccttctgtgacactacctacacctt

SEQ ID NO: 119783 - DNA, 37 bp, Artificial Sequence
  Synthetic oligonucleotide
ttcgcctgcaccgccccgccctcacgaacagtctcga

SEQ ID NO: 119784 - DNA, 37 bp, Artificial Sequence
  Synthetic oligonucleotide
gtggacaggagaaggtggtgagggcggattggtggga

SEQ ID NO: 119785 - DNA, 35 bp, Artificial Sequence
  Synthetic oligonucleotide
gactcagccagtccgcgcgcttccatgatctctac

SEQ ID NO: 119786 - DNA, 34 bp, Artificial Sequence
  Synthetic oligonucleotide
gcctgccctccgttaactaccgctagaccacgtc

SEQ ID NO: 119787 - DNA, 35 bp, Artificial Sequence
  Synthetic oligonucleotide
tgccacccagttcgcattgtggcctccacctctcg

SEQ ID NO: 119788 - DNA, 35 bp, Artificial Sequence
  Synthetic oligonucleotide
actcccaccaatggccctgcgcttctttcaccttg

SEQ ID NO: 119789 - DNA, 36 bp, Artificial Sequence
  Synthetic oligonucleotide
gcgcactcagtacgccgccgatagcccacttctcca

SEQ ID NO: 119790 - DNA, 36 bp, Artificial Sequence
  Synthetic oligonucleotide
acccgctcccccgcgcttacatctttagtctgttta

SEQ ID NO: 119791 - DNA, 35 bp, Artificial Sequence
  Synthetic oligonucleotide
tacccccccgtccgtccactcgtcaacgcccgcac

SEQ ID NO: 119792 - DNA, 35 bp, Artificial Sequence
  Synthetic oligonucleotide
gaccacctcgcccccacctatagtagtgcgccccc

SEQ ID NO: 119793 - DNA, 35 bp, Artificial Sequence
  Synthetic oligonucleotide
tgataccactccgcaagccccggacctccgttccc

SEQ ID NO: 119794 - DNA, 35 bp, Artificial Sequence
  Synthetic oligonucleotide
ggtggggtaggggtcggttggggaaataggggaat

SEQ ID NO: 119795 - DNA, 35 bp, Artificial Sequence
  Synthetic oligonucleotide
tcacccgttcggtctgccttcgtacctatcttgct

SEQ ID NO: 119796 - DNA, 36 bp, Artificial Sequence
  Synthetic oligonucleotide
gactggtcacgtgtcgcccctccgcctgggtaccaa

SEQ ID NO: 119797 - DNA, 35 bp, Artificial Sequence
  Synthetic oligonucleotide
tttgtcgcctgcacactggtcccgaagccctccat

SEQ ID NO: 119798 - DNA, 35 bp, Artificial Sequence
  Synthetic oligonucleotide
atgagggacgggacgggggggccagtctcataaca

SEQ ID NO: 119799 - DNA, 37 bp, Artificial Sequence
  Synthetic oligonucleotide
gaggacggggaacatggtggaagttacggagcgggga

SEQ ID NO: 119800 - DNA, 35 bp, Artificial Sequence
  Synthetic oligonucleotide
gaccacgctctgctttcgctggcctttcgctatcc

SEQ ID NO: 119801 - DNA, 35 bp, Artificial Sequence
  Synthetic oligonucleotide
gcataccgggcgttgtccagtccccctccttgtcc

SEQ ID NO: 119802 - DNA, 35 bp, Artificial Sequence
  Synthetic oligonucleotide
ggtggccctctgcgtttggctacacctccgttatc

SEQ ID NO: 119803 - DNA, 35 bp, Artificial Sequence
  Synthetic oligonucleotide
tgttccctgacctatgtcgatcacacgcccttctc

SEQ ID NO: 119804 - DNA, 35 bp, Artificial Sequence
  Synthetic oligonucleotide
tgggaggggagggggcgtgggggaggtctgtaaca

SEQ ID NO: 119805 - DNA, 37 bp, Artificial Sequence
  Synthetic oligonucleotide
ggagcaagggaaggggggggtggggccgcacgctaga

SEQ ID NO: 119806 - DNA, 38 bp, Artificial Sequence
  Synthetic oligonucleotide
acaactctgctccttagccagcacacacctcgctttga

SEQ ID NO: 119807 - DNA, 35 bp, Artificial Sequence
  Synthetic oligonucleotide
tccccgagacgccacatcgatacatctactcagcc

SEQ ID NO: 119808 - DNA, 35 bp, Artificial Sequence
  Synthetic oligonucleotide
acaccctctatcagtcatttgcgccccgcgacctc

SEQ ID NO: 119809 - DNA, 35 bp, Artificial Sequence
  Synthetic oligonucleotide
gtcccccatccgctcgtccatagctcatttgtcat

SEQ ID NO: 119810 - DNA, 35 bp, Artificial Sequence
  Synthetic oligonucleotide
gtcctcgcacctggtacgcactcatccaccctata

SEQ ID NO: 119811 - DNA, 35 bp, Artificial Sequence
  Synthetic oligonucleotide
accgcccatcagtcctgcgcgtgacctctatgcac

SEQ ID NO: 119812 - DNA, 35 bp, Artificial Sequence
  Synthetic oligonucleotide
tctcccggcactgcccatcacatccgcccacgtcc

SEQ ID NO: 119813 - DNA, 35 bp, Artificial Sequence
  Synthetic oligonucleotide
gctcagtcataattactgccgccgactacgccatc

SEQ ID NO: 119814 - DNA, 34 bp, Artificial Sequence
  Synthetic oligonucleotide
acagtctcacctgcagcgccctgctcctctcaca

SEQ ID NO: 119815 - DNA, 34 bp, Artificial Sequence
  Synthetic oligonucleotide
gaccacttgtaatggagccctttcaccccgtaac

SEQ ID NO: 119816 - DNA, 35 bp, Artificial Sequence
  Synthetic oligonucleotide
accaactgacgttggtcattgacccacccataccc

SEQ ID NO: 119817 - DNA, 36 bp, Artificial Sequence
  Synthetic oligonucleotide
gcctcctccccatgtacccagcgttgcacgctcgcc

SEQ ID NO: 119818 - DNA, 35 bp, Artificial Sequence
  Synthetic oligonucleotide
gcctcctgccgctcccattttccagacaaccctgg

SEQ ID NO: 119819 - DNA, 35 bp, Artificial Sequence
  Synthetic oligonucleotide
acctcgtgtcgcttgtcaccctcctatcttctggt

SEQ ID NO: 119820 - DNA, 35 bp, Artificial Sequence
  Synthetic oligonucleotide
tcgggctgaccaccgttgcgtcaacttccgccctt

SEQ ID NO: 119821 - DNA, 35 bp, Artificial Sequence
  Synthetic oligonucleotide
taacatgctcctgctgcccataggcccaacccgtt

SEQ ID NO: 119822 - DNA, 36 bp, Artificial Sequence
  Synthetic oligonucleotide
gccgacccgtgcggctgccccctcctcgacttgcca

SEQ ID NO: 119823 - DNA, 37 bp, Artificial Sequence
  Synthetic oligonucleotide
aagggggggcctggtgaatgggaggggaggagtatga

SEQ ID NO: 119824 - DNA, 35 bp, Artificial Sequence
  Synthetic oligonucleotide
acacccgccctatcacccggccgagcccttcctac

SEQ ID NO: 119825 - DNA, 35 bp, Artificial Sequence
  Synthetic oligonucleotide
attgcgcaaccagcccttgcatcgttactagcccc

SEQ ID NO: 119826 - DNA, 35 bp, Artificial Sequence
  Synthetic oligonucleotide
tccccagcaatccgttaacccgtgcactcctccgc

SEQ ID NO: 119827 - DNA, 35 bp, Artificial Sequence
  Synthetic oligonucleotide
gccatagccccgggtgcccttggccttaccttcgc

SEQ ID NO: 119828 - DNA, 35 bp, Artificial Sequence
  Synthetic oligonucleotide
gcacatcgcacgtggcttctccctctgcaaactgc

SEQ ID NO: 119829 - DNA, 35 bp, Artificial Sequence
  Synthetic oligonucleotide
gcactcgccttagttcaagtcacaacacctcgctt

SEQ ID NO: 119830 - DNA, 35 bp, Artificial Sequence
  Synthetic oligonucleotide
gaaatccgcgccccttttagcccgttacctccgtt

SEQ ID NO: 119831 - DNA, 37 bp, Artificial Sequence
  Synthetic oligonucleotide
accaccgcctgccctgtcaaaacataacccactccga

SEQ ID NO: 119832 - DNA, 37 bp, Artificial Sequence
  Synthetic oligonucleotide
tcccacgcccctcccccgcataccacgtttcccggga

SEQ ID NO: 119833 - DNA, 37 bp, Artificial Sequence
  Synthetic oligonucleotide
tccacacatcgccccgccacccccgactccgctggga

SEQ ID NO: 119834 - DNA, 38 bp, Artificial Sequence
  Synthetic oligonucleotide
ggagccgtgagcctgtttgccttccaccctttgtttga

SEQ ID NO: 119835 - DNA, 35 bp, Artificial Sequence
  Synthetic oligonucleotide
gtcttcatccccacgatttgcgctagtggcccccc

SEQ ID NO: 119836 - DNA, 35 bp, Artificial Sequence
  Synthetic oligonucleotide
acatcaccactagtgtgttgattccctgccttccc

SEQ ID NO: 119837 - DNA, 35 bp, Artificial Sequence
  Synthetic oligonucleotide
gccactttgacggttggttactgtactccttcgcc

SEQ ID NO: 119838 - DNA, 35 bp, Artificial Sequence
  Synthetic oligonucleotide
tggaccttgctgctgcacttttgacgccttttctc

SEQ ID NO: 119839 - DNA, 35 bp, Artificial Sequence
  Synthetic oligonucleotide
tagagggcgaacaaagcggggggagggaaccacat

SEQ ID NO: 119840 - DNA, 36 bp, Artificial Sequence
  Synthetic oligonucleotide
tatgtacaccgccgccgcctccctcagggccgccaa

SEQ ID NO: 119841 - DNA, 36 bp, Artificial Sequence
  Synthetic oligonucleotide
acgatccaccactcccgctttcgagctcaggctcaa

SEQ ID NO: 119842 - DNA, 37 bp, Artificial Sequence
  Synthetic oligonucleotide
ggaccgggagggaaatggataggaggcggggacggga

SEQ ID NO: 119843 - DNA, 35 bp, Artificial Sequence
  Synthetic oligonucleotide
atgtcacccgccgcatggggccgtccgcctccgcc

SEQ ID NO: 119844 - DNA, 35 bp, Artificial Sequence
  Synthetic oligonucleotide
tcactcctctgcttatctcgttcatgacccctatc

SEQ ID NO: 119845 - DNA, 35 bp, Artificial Sequence
  Synthetic oligonucleotide
acacccccccacatgtctccattactcgtttgtag

SEQ ID NO: 119846 - DNA, 35 bp, Artificial Sequence
  Synthetic oligonucleotide
aaaagggggggccggtgactaaaggtggcgggaaa

SEQ ID NO: 119847 - DNA, 36 bp, Artificial Sequence
  Synthetic oligonucleotide
gacgagggccgttgggttgggaaaggcggaatagaa

SEQ ID NO: 119848 - DNA, 35 bp, Artificial Sequence
  Synthetic oligonucleotide
gcatacgccacttctcttcgatgccgctcctatca

SEQ ID NO: 119849 - DNA, 37 bp, Artificial Sequence
  Synthetic oligonucleotide
gagggcggggtgggtgatcggcgggagggattcggga

SEQ ID NO: 119850 - DNA, 37 bp, Artificial Sequence
  Synthetic oligonucleotide
gagcccagcttcacgttatttggctccctctctctga

SEQ ID NO: 119851 - DNA, 37 bp, Artificial Sequence
  Synthetic oligonucleotide
gcaccctcctgagccgaccggccatcatgctacttga

SEQ ID NO: 119852 - DNA, 35 bp, Artificial Sequence
  Synthetic oligonucleotide
gccgcacacgtacattttgctatcatcttgccgcc

SEQ ID NO: 119853 - DNA, 35 bp, Artificial Sequence
  Synthetic oligonucleotide
atgccccttccctgtgcgtcgtcacatatttttgc

SEQ ID NO: 119854 - DNA, 35 bp, Artificial Sequence
  Synthetic oligonucleotide
ggacgccctcttgcggttttcaccccgttcccatc

SEQ ID NO: 119855 - DNA, 35 bp, Artificial Sequence
  Synthetic oligonucleotide
ttgcccatgcgccctcgttacctgccgatgttcct

SEQ ID NO: 119856 - DNA, 34 bp, Artificial Sequence
  Synthetic oligonucleotide
ttgtcccccgcctttgcctatcgcgccacatata

SEQ ID NO: 119857 - DNA, 36 bp, Artificial Sequence
  Synthetic oligonucleotide
tcacccaccacgcactaggaacttgccccggcccta

SEQ ID NO: 119858 - DNA, 35 bp, Artificial Sequence
  Synthetic oligonucleotide
gtggcctaacctccgcctctgactgtctatccaac

SEQ ID NO: 119859 - DNA, 35 bp, Artificial Sequence
  Synthetic oligonucleotide
tccaacgcccccctcaataactcgtgaggtttacc

SEQ ID NO: 119860 - DNA, 37 bp, Artificial Sequence
  Synthetic oligonucleotide
atccgcacgtccactattctatgcccacgccaaccga

SEQ ID NO: 119861 - DNA, 36 bp, Artificial Sequence
  Synthetic oligonucleotide
tgccagaagcgccgccttcccttcgactgccttcta

SEQ ID NO: 119862 - DNA, 35 bp, Artificial Sequence
  Synthetic oligonucleotide
tccgctcagcaccacgctatctgtcctcgttcgac

SEQ ID NO: 119863 - DNA, 35 bp, Artificial Sequence
  Synthetic oligonucleotide
gggtcagatcgctggtgcaacaacctctctcttcc

SEQ ID NO: 119864 - DNA, 35 bp, Artificial Sequence
  Synthetic oligonucleotide
gcaagctcccccgtccctgttcccgtactccttag

SEQ ID NO: 119865 - DNA, 36 bp, Artificial Sequence
  Synthetic oligonucleotide
tatccctgccgcttagttacccgtcgtttggtccca

SEQ ID NO: 119866 - DNA, 35 bp, Artificial Sequence
  Synthetic oligonucleotide
atgcgccgaccagcacacgtcgcccttgttcgcca

SEQ ID NO: 119867 - DNA, 35 bp, Artificial Sequence
  Synthetic oligonucleotide
gtcagtccatcgttcatcccacctcgcccttagca

SEQ ID NO: 119868 - DNA, 36 bp, Artificial Sequence
  Synthetic oligonucleotide
tgaagtcgccctgctctgcgtgtcatccgctctcga

SEQ ID NO: 119869 - DNA, 37 bp, Artificial Sequence
  Synthetic oligonucleotide
tagctcccccgccgtcccatcccatctccagtctcga

SEQ ID NO: 119870 - DNA, 37 bp, Artificial Sequence
  Synthetic oligonucleotide
tagtaaggaggggatcggtggtgagcggggagaggga

SEQ ID NO: 119871 - DNA, 35 bp, Artificial Sequence
  Synthetic oligonucleotide
tgaagccgacctccgctccctagaagccatgctgc

SEQ ID NO: 119872 - DNA, 35 bp, Artificial Sequence
  Synthetic oligonucleotide
gtgcgcctgcgcccttcgtcacaaggccttcttct

SEQ ID NO: 119873 - DNA, 37 bp, Artificial Sequence
  Synthetic oligonucleotide
gtgcgccgcaaatgcgcccgactctccatccaactga

SEQ ID NO: 119874 - DNA, 37 bp, Artificial Sequence
  Synthetic oligonucleotide
tcttgcccggcgatatcctgtgcgctccaccccctga

SEQ ID NO: 119875 - DNA, 28 bp, Artificial Sequence
  Synthetic oligonucleotide
ccccggcctccgcccacctactacgccc

SEQ ID NO: 119876 - DNA, 35 bp, Artificial Sequence
  Synthetic oligonucleotide
gactcgcgtcctagacgtctttttacacctccccg

SEQ ID NO: 119877 - DNA, 35 bp, Artificial Sequence
  Synthetic oligonucleotide
atcgcctcatcacccattccgtcaccttcgcggtg

SEQ ID NO: 119878 - DNA, 35 bp, Artificial Sequence
  Synthetic oligonucleotide
acccccgcctttgttccaatagtgccctaatatct

SEQ ID NO: 119879 - DNA, 35 bp, Artificial Sequence
  Synthetic oligonucleotide
tgttccactcgcccgcgccctaatgcctactgcgt

SEQ ID NO: 119880 - DNA, 35 bp, Artificial Sequence
  Synthetic oligonucleotide
tcagctcgggggggacgggcggggacacgttccaa

SEQ ID NO: 119881 - DNA, 35 bp, Artificial Sequence
  Synthetic oligonucleotide
acacttcgcctcagctcgccgcactttagctttca

SEQ ID NO: 119882 - DNA, 37 bp, Artificial Sequence
  Synthetic oligonucleotide
gtccgccagaccacatcgccctcgccctccccgcaga

SEQ ID NO: 119883 - DNA, 37 bp, Artificial Sequence
  Synthetic oligonucleotide
tctccatgccgtcatctccggcttcgttctctcccga

SEQ ID NO: 119884 - DNA, 37 bp, Artificial Sequence
  Synthetic oligonucleotide
accaaccccgatttcttacgtacactgccccaacgga

SEQ ID NO: 119885 - DNA, 37 bp, Artificial Sequence
  Synthetic oligonucleotide
tcgagagggagtgggtggagtagggaatgactgatga

SEQ ID NO: 119886 - DNA, 38 bp, Artificial Sequence
  Synthetic oligonucleotide
gaatcccgcccgaccgttgccgctccagtcctttatga

SEQ ID NO: 119887 - DNA, 35 bp, Artificial Sequence
  Synthetic oligonucleotide
tttgacccgtccgcccctttccgtcgcggcactcc

SEQ ID NO: 119888 - DNA, 35 bp, Artificial Sequence
  Synthetic oligonucleotide
atcctacacgcagccccgaacgccgctccttacgc

SEQ ID NO: 119889 - DNA, 35 bp, Artificial Sequence
  Synthetic oligonucleotide
agccgcccgttcccgtctttatttaccgacctact

SEQ ID NO: 119890 - DNA, 36 bp, Artificial Sequence
  Synthetic oligonucleotide
gttgcacccaccgcgatctataagccctcccagcca

SEQ ID NO: 119891 - DNA, 35 bp, Artificial Sequence
  Synthetic oligonucleotide
tcacactcttcctcatgccatgccgtactgtttca

SEQ ID NO: 119892 - DNA, 37 bp, Artificial Sequence
  Synthetic oligonucleotide
acagaagtgggaggcggggtggggacggcagtcttga

SEQ ID NO: 119893 - DNA, 37 bp, Artificial Sequence
  Synthetic oligonucleotide
accaccccctcactttgaacaccactgtctcttttga

SEQ ID NO: 119894 - DNA, 35 bp, Artificial Sequence
  Synthetic oligonucleotide
ggtgagggccataaaggagggagcagaagggacag

SEQ ID NO: 119895 - DNA, 36 bp, Artificial Sequence
  Synthetic oligonucleotide
ggaccaacctcgtgctgactccatcctgtttgctaa

SEQ ID NO: 119896 - DNA, 37 bp, Artificial Sequence
  Synthetic oligonucleotide
ttcgccacttcggcctctgctagccccatccccagga

SEQ ID NO: 119897 - DNA, 36 bp, Artificial Sequence
  Synthetic oligonucleotide
ggggttggcgcatgccataatatagtgaaagaggga

SEQ ID NO: 119898 - DNA, 38 bp, Artificial Sequence
  Synthetic oligonucleotide
aacggtcagggggggagggacgggagcgcactaactga

SEQ ID NO: 119899 - DNA, 35 bp, Artificial Sequence
  Synthetic oligonucleotide
gccagtgccccgccgtcaattctaccccacttatc

SEQ ID NO: 119900 - DNA, 35 bp, Artificial Sequence
  Synthetic oligonucleotide
acatccacccgtcctccaccacatggcagattgtc

SEQ ID NO: 119901 - DNA, 35 bp, Artificial Sequence
  Synthetic oligonucleotide
tgaaggatcgcccgccttcccgtttatcacccacg

SEQ ID NO: 119902 - DNA, 35 bp, Artificial Sequence
  Synthetic oligonucleotide
tgtcacagtcgcccagcatccttcgccccccctgt

SEQ ID NO: 119903 - DNA, 35 bp, Artificial Sequence
  Synthetic oligonucleotide
taacgtcacgtcctcgttcgcattccttggttcca

SEQ ID NO: 119904 - DNA, 37 bp, Artificial Sequence
  Synthetic oligonucleotide
tacgcaatgggtgggtgggataatgggccttacgcga

SEQ ID NO: 119905 - DNA, 37 bp, Artificial Sequence
  Synthetic oligonucleotide
gtgcgggaaagtgtgagaacggggagggcgggtatga

SEQ ID NO: 119906 - DNA, 36 bp, Artificial Sequence
  Synthetic oligonucleotide
tcagatgtcctggtcttattgttgccccgtactcta

SEQ ID NO: 119907 - DNA, 35 bp, Artificial Sequence
  Synthetic oligonucleotide
acacggccatattatcccaacggttcctcgcttac

SEQ ID NO: 119908 - DNA, 35 bp, Artificial Sequence
  Synthetic oligonucleotide
taccgcccaccgcagtcccatgtgtctaccccgcc

SEQ ID NO: 119909 - DNA, 35 bp, Artificial Sequence
  Synthetic oligonucleotide
gactaccacctctgacatccgccgcgttgccccgc

SEQ ID NO: 119910 - DNA, 35 bp, Artificial Sequence
  Synthetic oligonucleotide
tccccctaacgccttaccctcgtggattttgccct

SEQ ID NO: 119911 - DNA, 35 bp, Artificial Sequence
  Synthetic oligonucleotide
tgtacctgactccctggccatacgtgatccacatt

SEQ ID NO: 119912 - DNA, 35 bp, Artificial Sequence
  Synthetic oligonucleotide
gggatcgggggggacgggctaacaataaagagaca

SEQ ID NO: 119913 - DNA, 35 bp, Artificial Sequence
  Synthetic oligonucleotide
accgccctcgttctctcactgaccctcgccttgac

SEQ ID NO: 119914 - DNA, 35 bp, Artificial Sequence
  Synthetic oligonucleotide
accaccatcacgcaggagcgctttgccgacctacc

SEQ ID NO: 119915 - DNA, 36 bp, Artificial Sequence
  Synthetic oligonucleotide
aacacgaggatctgaggtgggtagggatgggaggaa

SEQ ID NO: 119916 - DNA, 37 bp, Artificial Sequence
  Synthetic oligonucleotide
agtagagtgaggtgggtagtgggcgggtgggaagtga

SEQ ID NO: 119917 - DNA, 38 bp, Artificial Sequence
  Synthetic oligonucleotide
ggggaaccaagggaagcaaagaggatgagagggggtga

SEQ ID NO: 119918 - DNA, 35 bp, Artificial Sequence
  Synthetic oligonucleotide
tcccccatccatcgtgcgcatcataggccgtttgc

SEQ ID NO: 119919 - DNA, 35 bp, Artificial Sequence
  Synthetic oligonucleotide
tacgacacctgccgcctcactccttgaagtccgca

SEQ ID NO: 119920 - DNA, 36 bp, Artificial Sequence
  Synthetic oligonucleotide
gagagagctgtcaatgtttctgttccacccccgcta

SEQ ID NO: 119921 - DNA, 36 bp, Artificial Sequence
  Synthetic oligonucleotide
tgcctcgacatgcgctacttgccttgttccctctta

SEQ ID NO: 119922 - DNA, 35 bp, Artificial Sequence
  Synthetic oligonucleotide
gattccacctcgacctctgcatactattgcgggcc

SEQ ID NO: 119923 - DNA, 35 bp, Artificial Sequence
  Synthetic oligonucleotide
gccgtactgtgccccccgccgctttctctgtgttc

SEQ ID NO: 119924 - DNA, 35 bp, Artificial Sequence
  Synthetic oligonucleotide
taggagtgccctgtccccgccctatctcacccatg

SEQ ID NO: 119925 - DNA, 37 bp, Artificial Sequence
  Synthetic oligonucleotide
tcccccgcgtgcacttactgttcccgtccaaacttga

SEQ ID NO: 119926 - DNA, 35 bp, Artificial Sequence
  Synthetic oligonucleotide
aagtggagaaggggggagaagatgagaaagcttga

SEQ ID NO: 119927 - DNA, 36 bp, Artificial Sequence
  Synthetic oligonucleotide
atcaccgaccgtcccgtaactgcgctggcccatcta

SEQ ID NO: 119928 - DNA, 35 bp, Artificial Sequence
  Synthetic oligonucleotide
ttagttcgcgccactctgcgtccacaccatttgcc

SEQ ID NO: 119929 - DNA, 35 bp, Artificial Sequence
  Synthetic oligonucleotide
gccagatgtcccccacgtgatcgtgttgcacctcc

SEQ ID NO: 119930 - DNA, 35 bp, Artificial Sequence
  Synthetic oligonucleotide
ttggcacccggccctgttaccactccctagcttcc

SEQ ID NO: 119931 - DNA, 35 bp, Artificial Sequence
  Synthetic oligonucleotide
attgcccgcaactcactgaccggctcatccctttc

SEQ ID NO: 119932 - DNA, 35 bp, Artificial Sequence
  Synthetic oligonucleotide
agtgccgagaaggggggtgggactcaagggtgtgg

SEQ ID NO: 119933 - DNA, 35 bp, Artificial Sequence
  Synthetic oligonucleotide
acgaaccatgcccccctcgacctactctgatgact

SEQ ID NO: 119934 - DNA, 35 bp, Artificial Sequence
  Synthetic oligonucleotide
acgaacccacacctggctacacgagcctagactct

SEQ ID NO: 119935 - DNA, 36 bp, Artificial Sequence
  Synthetic oligonucleotide
tccctgcggggggggggtaaaatgctggggagggaa

SEQ ID NO: 119936 - DNA, 37 bp, Artificial Sequence
  Synthetic oligonucleotide
ggggacgggggtggtgtggcaggtcatccggcgggga

SEQ ID NO: 119937 - DNA, 36 bp, Artificial Sequence
  Synthetic oligonucleotide
gtcgatcacactgtccgtactcctgcctgaacccta

SEQ ID NO: 119938 - DNA, 36 bp, Artificial Sequence
  Synthetic oligonucleotide
gcctccgccaccccagtttccggggccatcctttac

SEQ ID NO: 119939 - DNA, 35 bp, Artificial Sequence
  Synthetic oligonucleotide
gcctgctcaccacgcgtttccggccgatattactc

SEQ ID NO: 119940 - DNA, 35 bp, Artificial Sequence
  Synthetic oligonucleotide
tgatcctacctccatgaccctgaacacgcacctgg

SEQ ID NO: 119941 - DNA, 35 bp, Artificial Sequence
  Synthetic oligonucleotide
acgtgctcgctcacccatcctctcatcgccgttct

SEQ ID NO: 119942 - DNA, 35 bp, Artificial Sequence
  Synthetic oligonucleotide
agacaagggaggcggggtgggggagccgagggtgt

SEQ ID NO: 119943 - DNA, 35 bp, Artificial Sequence
  Synthetic oligonucleotide
tgcccgccccttcagtaactgacgccatccgcttt

SEQ ID NO: 119944 - DNA, 35 bp, Artificial Sequence
  Synthetic oligonucleotide
gtgcgaaggggtgttgggaagggggagttgcggca

SEQ ID NO: 119945 - DNA, 37 bp, Artificial Sequence
  Synthetic oligonucleotide
ttggcatagtcatttagtgccctaccgcccctctcga

SEQ ID NO: 119946 - DNA, 38 bp, Artificial Sequence
  Synthetic oligonucleotide
tatgcgagtaagggggcggacggaggattgcaagggga

SEQ ID NO: 119947 - DNA, 38 bp, Artificial Sequence
  Synthetic oligonucleotide
gtcctggccccgtgtgtttgttcgccctttccccttga

SEQ ID NO: 119948 - DNA, 35 bp, Artificial Sequence
  Synthetic oligonucleotide
accctcgcttcactgtcctatgatcccactctcta

SEQ ID NO: 119949 - DNA, 35 bp, Artificial Sequence
  Synthetic oligonucleotide
tctgtggtgatggggggggcagggtgggtgagcag

SEQ ID NO: 119950 - DNA, 35 bp, Artificial Sequence
  Synthetic oligonucleotide
tgcagggcgcgctttgatttaactctcacctcctg

SEQ ID NO: 119951 - DNA, 35 bp, Artificial Sequence
  Synthetic oligonucleotide
gaccccttacctgtagcactgaaaccgagagtgtt

SEQ ID NO: 119952 - DNA, 35 bp, Artificial Sequence
  Synthetic oligonucleotide
gtggaggaggcggggggtggatggagggcaatcaa

SEQ ID NO: 119953 - DNA, 38 bp, Artificial Sequence
  Synthetic oligonucleotide
tgcgcactctacctgctattggctcctcccctcgttga

SEQ ID NO: 119954 - DNA, 35 bp, Artificial Sequence
  Synthetic oligonucleotide
gcgcacccatgtctttcgctcctcccattacgggc

SEQ ID NO: 119955 - DNA, 35 bp, Artificial Sequence
  Synthetic oligonucleotide
tagcccctgtcctgctttctatcgtgccacgcttc

SEQ ID NO: 119956 - DNA, 35 bp, Artificial Sequence
  Synthetic oligonucleotide
aacgtttgcccattatccgaccgttatgtctttcg

SEQ ID NO: 119957 - DNA, 35 bp, Artificial Sequence
  Synthetic oligonucleotide
ttgacccttccatcagtgtccttggcctttctctt

SEQ ID NO: 119958 - DNA, 35 bp, Artificial Sequence
  Synthetic oligonucleotide
gactgaaccatccaatcctgccgtcgccacttgtt

SEQ ID NO: 119959 - DNA, 36 bp, Artificial Sequence
  Synthetic oligonucleotide
gctgtgtcacagctcgcatttccgccccccgttgaa

SEQ ID NO: 119960 - DNA, 35 bp, Artificial Sequence
  Synthetic oligonucleotide
tcccgggcgggagggcgagattgggcagttaccca

SEQ ID NO: 119961 - DNA, 37 bp, Artificial Sequence
  Synthetic oligonucleotide
tagcgtgggaaagggaaggggggactagcagaacgga

SEQ ID NO: 119962 - DNA, 35 bp, Artificial Sequence
  Synthetic oligonucleotide
taaggcccccgtttgactcgacccgctcgcccccg

SEQ ID NO: 119963 - DNA, 35 bp, Artificial Sequence
  Synthetic oligonucleotide
tgtaacaaccctagcgtccatcctccttctgtccg

SEQ ID NO: 119964 - DNA, 35 bp, Artificial Sequence
  Synthetic oligonucleotide
aacacctatccgccgtgctatctgcctttgcctcg

SEQ ID NO: 119965 - DNA, 35 bp, Artificial Sequence
  Synthetic oligonucleotide
cacattccgcactatgttggccttctgtttattcg

SEQ ID NO: 119966 - DNA, 35 bp, Artificial Sequence
  Synthetic oligonucleotide
atgcaccgctgcccaggtctatttggctattcctt

SEQ ID NO: 119967 - DNA, 36 bp, Artificial Sequence
  Synthetic oligonucleotide
ttcatcccgccagccccgtaataccggctttcccca

SEQ ID NO: 119968 - DNA, 35 bp, Artificial Sequence
  Synthetic oligonucleotide
ttcgctacatcccgtatctgtacgcctctctttct

SEQ ID NO: 119969 - DNA, 35 bp, Artificial Sequence
  Synthetic oligonucleotide
tgaccgtacagcacttcttcgagcacgccacccca

SEQ ID NO: 119970 - DNA, 35 bp, Artificial Sequence
  Synthetic oligonucleotide
tgccccccgcaaggttccggacccccctcatagca

SEQ ID NO: 119971 - DNA, 36 bp, Artificial Sequence
  Synthetic oligonucleotide
gaatggcgggaaggggcaggggaggcccgccatcta

SEQ ID NO: 119972 - DNA, 35 bp, Artificial Sequence
  Synthetic oligonucleotide
tcacattgacaccccgaactgccgctgccccacgc

SEQ ID NO: 119973 - DNA, 35 bp, Artificial Sequence
  Synthetic oligonucleotide
agcggtcccttgcgctatgcctcgtcccccgtttc

SEQ ID NO: 119974 - DNA, 35 bp, Artificial Sequence
  Synthetic oligonucleotide
ggtgagggtgacgggagggaagcgagactggaaag

SEQ ID NO: 119975 - DNA, 35 bp, Artificial Sequence
  Synthetic oligonucleotide
ttcacatccaccgactatgcattgctttcaccgct

SEQ ID NO: 119976 - DNA, 35 bp, Artificial Sequence
  Synthetic oligonucleotide
tgtgttccgttgcagcttgttctatcccttttgtt

SEQ ID NO: 119977 - DNA, 37 bp, Artificial Sequence
  Synthetic oligonucleotide
gcaatccgccggtgcctcctaccgtcctcccttccga

SEQ ID NO: 119978 - DNA, 35 bp, Artificial Sequence
  Synthetic oligonucleotide
gaagacaacaatcgagacaaaagggagggacggga

SEQ ID NO: 119979 - DNA, 36 bp, Artificial Sequence
  Synthetic oligonucleotide
acacgggtggggaatctacaaggggtttctcgggga

SEQ ID NO: 119980 - DNA, 35 bp, Artificial Sequence
  Synthetic oligonucleotide
tttcccgcccttacagccgtgcatcacgtatcttc

SEQ ID NO: 119981 - DNA, 35 bp, Artificial Sequence
  Synthetic oligonucleotide
gcttgcccctccctttcaccacccgtacacgattg

SEQ ID NO: 119982 - DNA, 35 bp, Artificial Sequence
  Synthetic oligonucleotide
gtctaccccgttcatgcccaacaccagccctgcat

SEQ ID NO: 119983 - DNA, 36 bp, Artificial Sequence
  Synthetic oligonucleotide
acacttgcaggcgggtggaggggcggaatggtggta

SEQ ID NO: 119984 - DNA, 35 bp, Artificial Sequence
  Synthetic oligonucleotide
gccccactgtttccacttcacctgccttccagtgc

SEQ ID NO: 119985 - DNA, 35 bp, Artificial Sequence
  Synthetic oligonucleotide
tcaccacatggtggtcatataaccttcccgtaatc

SEQ ID NO: 119986 - DNA, 35 bp, Artificial Sequence
  Synthetic oligonucleotide
tgtggcctcacgacctggtattgtcgtaccttatc

SEQ ID NO: 119987 - DNA, 35 bp, Artificial Sequence
  Synthetic oligonucleotide
gggggggagggaaatggggacaggtatagggtgag

SEQ ID NO: 119988 - DNA, 38 bp, Artificial Sequence
  Synthetic oligonucleotide
gcaccctccccctcctgcgcagccacgccatggaatga

SEQ ID NO: 119989 - DNA, 35 bp, Artificial Sequence
  Synthetic oligonucleotide
aacccgccccatgatcatcacgctttcgttctcta

SEQ ID NO: 119990 - DNA, 34 bp, Artificial Sequence
  Synthetic oligonucleotide
gattgctccgtcccagcatttcgtttccgtgccc

SEQ ID NO: 119991 - DNA, 35 bp, Artificial Sequence
  Synthetic oligonucleotide
gcatgttcagttcttcctgtttgccgctaccccgc

SEQ ID NO: 119992 - DNA, 35 bp, Artificial Sequence
  Synthetic oligonucleotide
gacgcaccaacatcactgccctttgcctactctag

SEQ ID NO: 119993 - DNA, 35 bp, Artificial Sequence
  Synthetic oligonucleotide
acggacgtcaactgctccctcgtggccctccatct

SEQ ID NO: 119994 - DNA, 35 bp, Artificial Sequence
  Synthetic oligonucleotide
tgactgcctccgtgctctcccgcaaccgctcttgt

SEQ ID NO: 119995 - DNA, 35 bp, Artificial Sequence
  Synthetic oligonucleotide
tagagcacggtactatctgttttgcaaccgtcctt

SEQ ID NO: 119996 - DNA, 38 bp, Artificial Sequence
  Synthetic oligonucleotide
tgcctcatccttgtctttgcgctgtcgttcttccctga

SEQ ID NO: 119997 - DNA, 37 bp, Artificial Sequence
  Synthetic oligonucleotide
accgtcgctgccctttggtcttactttgccgccttga

SEQ ID NO: 119998 - DNA, 35 bp, Artificial Sequence
  Synthetic oligonucleotide
tccgaccccctccccctattcgaatatcgagttgc

SEQ ID NO: 119999 - DNA, 35 bp, Artificial Sequence
  Synthetic oligonucleotide
gccaatccctgttctcgttcatctctggcatactc

SEQ ID NO: 120000 - DNA, 35 bp, Artificial Sequence
  Synthetic oligonucleotide
atgcacggtcgttgggctttcggttccatcccctg

SEQ ID NO: 120001 - DNA, 35 bp, Artificial Sequence
  Synthetic oligonucleotide
agcacaccccgccctgctcacactcgagtttttat

SEQ ID NO: 120002 - DNA, 35 bp, Artificial Sequence
  Synthetic oligonucleotide
accgcgaacctcagctcacgtctttaccccccatt

SEQ ID NO: 120003 - DNA, 36 bp, Artificial Sequence
  Synthetic oligonucleotide
tacctcaccgccccattccacgtgtctgccctaaca

SEQ ID NO: 120004 - DNA, 36 bp, Artificial Sequence
  Synthetic oligonucleotide
atggcccgcccctgctaacctcagccgccttatgca

SEQ ID NO: 120005 - DNA, 38 bp, Artificial Sequence
  Synthetic oligonucleotide
gatagccgaggaaacgggataggggagagttggagtga

SEQ ID NO: 120006 - DNA, 36 bp, Artificial Sequence
  Synthetic oligonucleotide
acgcccctcgctcactttttcttgtccctcgcttga

SEQ ID NO: 120007 - DNA, 34 bp, Artificial Sequence
  Synthetic oligonucleotide
tcatcactccgcccaacgtgctccaccaggcccc

SEQ ID NO: 120008 - DNA, 35 bp, Artificial Sequence
  Synthetic oligonucleotide
tctggaacgcagctcactacttccgtccgggctcc

SEQ ID NO: 120009 - DNA, 35 bp, Artificial Sequence
  Synthetic oligonucleotide
tgttcctcccgaccctgtgcgccctagatctgtcc

SEQ ID NO: 120010 - DNA, 35 bp, Artificial Sequence
  Synthetic oligonucleotide
gatgcttcacgacctgttttcctgttattttacgc

SEQ ID NO: 120011 - DNA, 35 bp, Artificial Sequence
  Synthetic oligonucleotide
gtgtgcctccggaagccctaacgttaacccgccgc

SEQ ID NO: 120012 - DNA, 35 bp, Artificial Sequence
  Synthetic oligonucleotide
atacgccgccactatcttaattttgtcactctttg

SEQ ID NO: 120013 - DNA, 35 bp, Artificial Sequence
  Synthetic oligonucleotide
gccctccgcccttaacgtatcaaatcgctggccat

SEQ ID NO: 120014 - DNA, 35 bp, Artificial Sequence
  Synthetic oligonucleotide
tcccgcctccgcacggtataatcccaccaattgct

SEQ ID NO: 120015 - DNA, 35 bp, Artificial Sequence
  Synthetic oligonucleotide
aaccgccgccagccacgcatagactccttggccca

SEQ ID NO: 120016 - DNA, 37 bp, Artificial Sequence
  Synthetic oligonucleotide
tagactgccgtcctgagcttccgcccgacccccttga

SEQ ID NO: 120017 - DNA, 34 bp, Artificial Sequence
  Synthetic oligonucleotide
gcactcccgttcctgatatcgacttctgttctta

SEQ ID NO: 120018 - DNA, 35 bp, Artificial Sequence
  Synthetic oligonucleotide
gacaatccatcttccgctgccggtactggccctac

SEQ ID NO: 120019 - DNA, 35 bp, Artificial Sequence
  Synthetic oligonucleotide
gtcctcccgatgataacctgtgcccccctctgtac

SEQ ID NO: 120020 - DNA, 35 bp, Artificial Sequence
  Synthetic oligonucleotide
tccgcccctcatccgctatgtgggtacctatcgcc

SEQ ID NO: 120021 - DNA, 35 bp, Artificial Sequence
  Synthetic oligonucleotide
gaggaggagcaaggggggtaaagatatgacaaatg

SEQ ID NO: 120022 - DNA, 35 bp, Artificial Sequence
  Synthetic oligonucleotide
tgccacttagtatctgaccgccattcaccaccgct

SEQ ID NO: 120023 - DNA, 36 bp, Artificial Sequence
  Synthetic oligonucleotide
gagactgccccgcgttatgtattcgccatcgcccca

SEQ ID NO: 120024 - DNA, 35 bp, Artificial Sequence
  Synthetic oligonucleotide
gcgcacacgccccattaatgtacctcgcttcccca

SEQ ID NO: 120025 - DNA, 37 bp, Artificial Sequence
  Synthetic oligonucleotide
tctgggtggtggaggggggcaaggaatggcggaaaga

SEQ ID NO: 120026 - DNA, 37 bp, Artificial Sequence
  Synthetic oligonucleotide
actcctccgccgtttgtttcccttcttccttggtgga

SEQ ID NO: 120027 - DNA, 35 bp, Artificial Sequence
  Synthetic oligonucleotide
atcccactcccgcgttagctcgccctgtctatttc

SEQ ID NO: 120028 - DNA, 35 bp, Artificial Sequence
  Synthetic oligonucleotide
tcccccccgcccacacaccgccgaacaaccgcccg

SEQ ID NO: 120029 - DNA, 34 bp, Artificial Sequence
  Synthetic oligonucleotide
gatccgctcgaacgttaaacgcccccacactagt

SEQ ID NO: 120030 - DNA, 35 bp, Artificial Sequence
  Synthetic oligonucleotide
agcgaagctcagcggtttcgccccgcctactccca

SEQ ID NO: 120031 - DNA, 35 bp, Artificial Sequence
  Synthetic oligonucleotide
gtctccttccgcttggttcctgttttgcccgcacc

SEQ ID NO: 120032 - DNA, 35 bp, Artificial Sequence
  Synthetic oligonucleotide
acgtccccaggcaccgatccataccgtcgcactcc

SEQ ID NO: 120033 - DNA, 35 bp, Artificial Sequence
  Synthetic oligonucleotide
tctaccaccgccccaatcttacgtgcacaacgtag

SEQ ID NO: 120034 - DNA, 35 bp, Artificial Sequence
  Synthetic oligonucleotide
tgactcccccccatgcggcctcgcgtagcctctat

SEQ ID NO: 120035 - DNA, 35 bp, Artificial Sequence
  Synthetic oligonucleotide
attctccacctgtccacgctgttgcggtttcatct

SEQ ID NO: 120036 - DNA, 36 bp, Artificial Sequence
  Synthetic oligonucleotide
agcccagtcctatatgcacgctcaccggccctccca

SEQ ID NO: 120037 - DNA, 35 bp, Artificial Sequence
  Synthetic oligonucleotide
gacgtagccaggggcgggggggtttcgggaggaga

SEQ ID NO: 120038 - DNA, 38 bp, Artificial Sequence
  Synthetic oligonucleotide
gcacgccgctgcctcgctcttcttccacaacctgctga

SEQ ID NO: 120039 - DNA, 38 bp, Artificial Sequence
  Synthetic oligonucleotide
gtcactccatctgttctccttcaccggcccttctgtga

SEQ ID NO: 120040 - DNA, 37 bp, Artificial Sequence
  Synthetic oligonucleotide
gatccccgccctgccttttgcaccctggccctattga

SEQ ID NO: 120041 - DNA, 38 bp, Artificial Sequence
  Synthetic oligonucleotide
gcctgctcccttccgccgcggcgtttctgtttctttga

SEQ ID NO: 120042 - DNA, 35 bp, Artificial Sequence
  Synthetic oligonucleotide
agcccctcctatgggcacataatccccccccgcac

SEQ ID NO: 120043 - DNA, 35 bp, Artificial Sequence
  Synthetic oligonucleotide
tcccaacgccccgtttgaccaaacatgcactcacc

SEQ ID NO: 120044 - DNA, 35 bp, Artificial Sequence
  Synthetic oligonucleotide
acgccgttcagtttttccacccctatgcacgctcc

SEQ ID NO: 120045 - DNA, 35 bp, Artificial Sequence
  Synthetic oligonucleotide
gtctgtcgatgagctctctgcccgccgctcccttc

SEQ ID NO: 120046 - DNA, 35 bp, Artificial Sequence
  Synthetic oligonucleotide
tcgccgtgtcattgctcttgcgctttccatccctt

SEQ ID NO: 120047 - DNA, 35 bp, Artificial Sequence
  Synthetic oligonucleotide
tatgttcaccgtcccctgccccgccatttgtttca

SEQ ID NO: 120048 - DNA, 38 bp, Artificial Sequence
  Synthetic oligonucleotide
aagagaagggttaggaggggtagaggggcaataggtga

SEQ ID NO: 120049 - DNA, 35 bp, Artificial Sequence
  Synthetic oligonucleotide
tacgcccacctcgtttatgcaaacacatgcctcta

SEQ ID NO: 120050 - DNA, 36 bp, Artificial Sequence
  Synthetic oligonucleotide
gcacaagtgcccgccccctcagtttccccagctgta

SEQ ID NO: 120051 - DNA, 35 bp, Artificial Sequence
  Synthetic oligonucleotide
gcaccactgcaatgccttgaccgtttttcctgcac

SEQ ID NO: 120052 - DNA, 35 bp, Artificial Sequence
  Synthetic oligonucleotide
tgagatgcctataggtccacggtatcctccacccc

SEQ ID NO: 120053 - DNA, 35 bp, Artificial Sequence
  Synthetic oligonucleotide
ttgctacccacaatgtggcaattcttcccaccctc

SEQ ID NO: 120054 - DNA, 35 bp, Artificial Sequence
  Synthetic oligonucleotide
gtgcggaacacgttggtcccccgctctttcattcg

SEQ ID NO: 120055 - DNA, 35 bp, Artificial Sequence
  Synthetic oligonucleotide
acacccccgggtccctccgcgcacattgcgcttgt

SEQ ID NO: 120056 - DNA, 36 bp, Artificial Sequence
  Synthetic oligonucleotide
gccattgcagcctcccccatctagcgtctccgccga

SEQ ID NO: 120057 - DNA, 37 bp, Artificial Sequence
  Synthetic oligonucleotide
atgacgggcttagatgttctgcatccccctccctcga

SEQ ID NO: 120058 - DNA, 37 bp, Artificial Sequence
  Synthetic oligonucleotide
gtaaccgccccatagctcctcccatgtccttgctgga

SEQ ID NO: 120059 - DNA, 35 bp, Artificial Sequence
  Synthetic oligonucleotide
gcatgcgcacggttcctctgtcttctttccgctta

SEQ ID NO: 120060 - DNA, 35 bp, Artificial Sequence
  Synthetic oligonucleotide
tttgccaccctctttccgatcgcggttcaggatcc

SEQ ID NO: 120061 - DNA, 35 bp, Artificial Sequence
  Synthetic oligonucleotide
actagcgcacttatgcctctttagtcgccgccctc

SEQ ID NO: 120062 - DNA, 35 bp, Artificial Sequence
  Synthetic oligonucleotide
gcgtcgtgatcgcgtcccctcctgctttccgtgtc

SEQ ID NO: 120063 - DNA, 35 bp, Artificial Sequence
  Synthetic oligonucleotide
gccgctccagccaccctctgtccacctctttgctg

SEQ ID NO: 120064 - DNA, 35 bp, Artificial Sequence
  Synthetic oligonucleotide
acccccgctctacccccggtcacccgactgccggt

SEQ ID NO: 120065 - DNA, 35 bp, Artificial Sequence
  Synthetic oligonucleotide
gtgttgcgcccataggttcaatcgctcctgccctt

SEQ ID NO: 120066 - DNA, 35 bp, Artificial Sequence
  Synthetic oligonucleotide
tccgagtagcctccgctggactaccttttcgcttt

SEQ ID NO: 120067 - DNA, 35 bp, Artificial Sequence
  Synthetic oligonucleotide
ttcccgcccccttttgcgcctcaaagccccttgaa

SEQ ID NO: 120068 - DNA, 35 bp, Artificial Sequence
  Synthetic oligonucleotide
aacctcacccctccctgtgcctgaacagcgcttac

SEQ ID NO: 120069 - DNA, 35 bp, Artificial Sequence
  Synthetic oligonucleotide
gattccgcgcagtcaccttagaaataccgccgccg

SEQ ID NO: 120070 - DNA, 35 bp, Artificial Sequence
  Synthetic oligonucleotide
tcgcatcgtaccccctgcctgctcaccaatcgtcg

SEQ ID NO: 120071 - DNA, 36 bp, Artificial Sequence
  Synthetic oligonucleotide
gacgggtatgtgatgggggggagggcgtaaactttg

SEQ ID NO: 120072 - DNA, 35 bp, Artificial Sequence
  Synthetic oligonucleotide
tcacgccccggcccctttgaggttactccctgtct

SEQ ID NO: 120073 - DNA, 35 bp, Artificial Sequence
  Synthetic oligonucleotide
tgaccgaccctgccgcaattcttctccgaccatgt

SEQ ID NO: 120074 - DNA, 35 bp, Artificial Sequence
  Synthetic oligonucleotide
ttgcgagtcagccctccttcgctccccctacccac

SEQ ID NO: 120075 - DNA, 35 bp, Artificial Sequence
  Synthetic oligonucleotide
tgcccattctgtcttgccaaggtccgttactcccc

SEQ ID NO: 120076 - DNA, 35 bp, Artificial Sequence
  Synthetic oligonucleotide
tactgaacctccgacagcctccacgacctctgtcc

SEQ ID NO: 120077 - DNA, 36 bp, Artificial Sequence
  Synthetic oligonucleotide
gtgacgagggacggggggagcaaaatggggttatta

SEQ ID NO: 120078 - DNA, 35 bp, Artificial Sequence
  Synthetic oligonucleotide
gcgatcctcttgctgattgctcataactccgccac

SEQ ID NO: 120079 - DNA, 35 bp, Artificial Sequence
  Synthetic oligonucleotide
gtgctccgagctgccctataatatccctcgcttca

SEQ ID NO: 120080 - DNA, 35 bp, Artificial Sequence
  Synthetic oligonucleotide
gtgccccgcccaagttatgtcgcctgccccactga

SEQ ID NO: 120081 - DNA, 38 bp, Artificial Sequence
  Synthetic oligonucleotide
gagggacgggagtgatggacaggggacggcgcagttga

SEQ ID NO: 120082 - DNA, 35 bp, Artificial Sequence
  Synthetic oligonucleotide
tcgcaccctctcatccgctcgtgcttacggtcatc

SEQ ID NO: 120083 - DNA, 35 bp, Artificial Sequence
  Synthetic oligonucleotide
cagacccgctgccatcgctatatcttcgcctggtc

SEQ ID NO: 120084 - DNA, 35 bp, Artificial Sequence
  Synthetic oligonucleotide
gttgactccacccgctctgaacgctccgcaaagcg

SEQ ID NO: 120085 - DNA, 35 bp, Artificial Sequence
  Synthetic oligonucleotide
gtagctcacatccccgccccacggcccggctcact

SEQ ID NO: 120086 - DNA, 35 bp, Artificial Sequence
  Synthetic oligonucleotide
gtccctgccccctgtttgaggcttattaacttcct

SEQ ID NO: 120087 - DNA, 35 bp, Artificial Sequence
  Synthetic oligonucleotide
ggtgggtgggatgagcaggcgggtgggcatctatt

SEQ ID NO: 120088 - DNA, 35 bp, Artificial Sequence
  Synthetic oligonucleotide
acgccgcaattgtgcccgctgccttacccctcttt

SEQ ID NO: 120089 - DNA, 36 bp, Artificial Sequence
  Synthetic oligonucleotide
gcatactctagtcctgtccccccgagccctgccaca

SEQ ID NO: 120090 - DNA, 36 bp, Artificial Sequence
  Synthetic oligonucleotide
tctgcaagcaccgcccagcctcactactccgccgca

SEQ ID NO: 120091 - DNA, 35 bp, Artificial Sequence
  Synthetic oligonucleotide
gaagggggaaggcaggagaggggaaggtggaggca

SEQ ID NO: 120092 - DNA, 37 bp, Artificial Sequence
  Synthetic oligonucleotide
gtgacaacgcaggatggtagcctccgccgccctttga

SEQ ID NO: 120093 - DNA, 35 bp, Artificial Sequence
  Synthetic oligonucleotide
tatggaccgccagctttctaacgtgcccgttcctc

SEQ ID NO: 120094 - DNA, 35 bp, Artificial Sequence
  Synthetic oligonucleotide
aacatccattgctttccgtcacatcctgctcaccg

SEQ ID NO: 120095 - DNA, 35 bp, Artificial Sequence
  Synthetic oligonucleotide
aagctccatcagaagtcgccgtctctccactccct

SEQ ID NO: 120096 - DNA, 37 bp, Artificial Sequence
  Synthetic oligonucleotide
aaccacagtccgcgttcctaaaccactctcccctgga

SEQ ID NO: 120097 - DNA, 35 bp, Artificial Sequence
  Synthetic oligonucleotide
gactgtctccgcccgtgcgagctgccctaattacc

SEQ ID NO: 120098 - DNA, 35 bp, Artificial Sequence
  Synthetic oligonucleotide
gccacggaccaactgccttacaccgtgaccattcc

SEQ ID NO: 120099 - DNA, 35 bp, Artificial Sequence
  Synthetic oligonucleotide
tcctacgccccatcggttaagctttgcgccttggc

SEQ ID NO: 120100 - DNA, 35 bp, Artificial Sequence
  Synthetic oligonucleotide
gtcgcagctcgccgccgaccgcctcatgttacatc

SEQ ID NO: 120101 - DNA, 35 bp, Artificial Sequence
  Synthetic oligonucleotide
tgcgactggccactacgtgctcacataccttccat

SEQ ID NO: 120102 - DNA, 36 bp, Artificial Sequence
  Synthetic oligonucleotide
tgtgtgccatctggagcctatcgcccgtgcttctca

SEQ ID NO: 120103 - DNA, 37 bp, Artificial Sequence
  Synthetic oligonucleotide
acgcaccccaccttgtctgcttcatcccaccggagga

SEQ ID NO: 120104 - DNA, 35 bp, Artificial Sequence
  Synthetic oligonucleotide
taggagtaggggcgacgggcggagagggagggacc

SEQ ID NO: 120105 - DNA, 35 bp, Artificial Sequence
  Synthetic oligonucleotide
tacggacgccgcaccgctcactacccctacccgcc

SEQ ID NO: 120106 - DNA, 35 bp, Artificial Sequence
  Synthetic oligonucleotide
tgccaaatccgcctgcgcaatcccctcagctcgcc

SEQ ID NO: 120107 - DNA, 35 bp, Artificial Sequence
  Synthetic oligonucleotide
tcacgctgcgccccctttatcatgtcgcgttactc

SEQ ID NO: 120108 - DNA, 35 bp, Artificial Sequence
  Synthetic oligonucleotide
tgacacgacccggtcatatagcgctaacacctttc

SEQ ID NO: 120109 - DNA, 35 bp, Artificial Sequence
  Synthetic oligonucleotide
gatgcgcctagttccgctaccgttttccttatccg

SEQ ID NO: 120110 - DNA, 35 bp, Artificial Sequence
  Synthetic oligonucleotide
gatgcctgcgtgctgtcacgctgttcccatcccct

SEQ ID NO: 120111 - DNA, 37 bp, Artificial Sequence
  Synthetic oligonucleotide
gcccgcacccagttctattacggccgtcctacctcga

SEQ ID NO: 120112 - DNA, 37 bp, Artificial Sequence
  Synthetic oligonucleotide
gacagggggcgaggggtgggagggtaggggtcgtgga

SEQ ID NO: 120113 - DNA, 37 bp, Artificial Sequence
  Synthetic oligonucleotide
tcccgggcgctggattatttgcccttccctctcctga

SEQ ID NO: 120114 - DNA, 35 bp, Artificial Sequence
  Synthetic oligonucleotide
gctcgcactccgccccaaatgccgcgctactaccc

SEQ ID NO: 120115 - DNA, 35 bp, Artificial Sequence
  Synthetic oligonucleotide
ttcacgcttgaacgagcctgccttacccaccctcc

SEQ ID NO: 120116 - DNA, 35 bp, Artificial Sequence
  Synthetic oligonucleotide
gtgccccgcaacattttgtcttaccctcagcacat

SEQ ID NO: 120117 - DNA, 35 bp, Artificial Sequence
  Synthetic oligonucleotide
gacgccctgttcacctccgcctagcccatcactca

SEQ ID NO: 120118 - DNA, 35 bp, Artificial Sequence
  Synthetic oligonucleotide
ttaggaccgccacgatagccgaatgtcgcccgccc

SEQ ID NO: 120119 - DNA, 35 bp, Artificial Sequence
  Synthetic oligonucleotide
tacgatcatcctcgttaccccgcattgggaccgcc

SEQ ID NO: 120120 - DNA, 35 bp, Artificial Sequence
  Synthetic oligonucleotide
acccacagcggtcccttcccctgcgagttcaatcc

SEQ ID NO: 120121 - DNA, 35 bp, Artificial Sequence
  Synthetic oligonucleotide
actgagcgccgtcgcgccctccatccgttcgctcc

SEQ ID NO: 120122 - DNA, 35 bp, Artificial Sequence
  Synthetic oligonucleotide
gtactttccgccattgtccgtctctcagcgcttcc

SEQ ID NO: 120123 - DNA, 35 bp, Artificial Sequence
  Synthetic oligonucleotide
gacactgtctcggcatctctctgtcgcgccccctg

SEQ ID NO: 120124 - DNA, 36 bp, Artificial Sequence
  Synthetic oligonucleotide
gaaagggtagacagtggagggagggttgtggtacta

SEQ ID NO: 120125 - DNA, 34 bp, Artificial Sequence
  Synthetic oligonucleotide
gactcatgcatatgcttaccatggtcccctttac

SEQ ID NO: 120126 - DNA, 35 bp, Artificial Sequence
  Synthetic oligonucleotide
tcgcccccccgaacaccttagctcccaagcgagcc

SEQ ID NO: 120127 - DNA, 35 bp, Artificial Sequence
  Synthetic oligonucleotide
gatgctgaccttagatcctccgcccggtttccacg

SEQ ID NO: 120128 - DNA, 35 bp, Artificial Sequence
  Synthetic oligonucleotide
cccacgcccttttcccggactcctgcctacttgcg

SEQ ID NO: 120129 - DNA, 35 bp, Artificial Sequence
  Synthetic oligonucleotide
tcaccgatcctaccacgtgctacccctccgtgcct

SEQ ID NO: 120130 - DNA, 32 bp, Artificial Sequence
  Synthetic oligonucleotide
aggaccgccgttgtcgtctcccccccgttcct

SEQ ID NO: 120131 - DNA, 37 bp, Artificial Sequence
  Synthetic oligonucleotide
ttgtcgccgccgcagctctcatttcctggccctttga

SEQ ID NO: 120132 - DNA, 35 bp, Artificial Sequence
  Synthetic oligonucleotide
accgccgaccttctgctcccattcctggtctagac

SEQ ID NO: 120133 - DNA, 35 bp, Artificial Sequence
  Synthetic oligonucleotide
aatgtcaccacaccgttctatccttggtcctaacc

SEQ ID NO: 120134 - DNA, 35 bp, Artificial Sequence
  Synthetic oligonucleotide
gtgacccttcctagtttgcgtttcgtaccacccgc

SEQ ID NO: 120135 - DNA, 35 bp, Artificial Sequence
  Synthetic oligonucleotide
gcccaccttcctgccgccttcgtgcactcgccgtc

SEQ ID NO: 120136 - DNA, 35 bp, Artificial Sequence
  Synthetic oligonucleotide
ttccaccgacccgctcccggctcatattacagtct

SEQ ID NO: 120137 - DNA, 36 bp, Artificial Sequence
  Synthetic oligonucleotide
actatcgccgccgcactgcccatcagccctgcttaa

SEQ ID NO: 120138 - DNA, 35 bp, Artificial Sequence
  Synthetic oligonucleotide
tgccaccctcacgcgccagctccccctacctctca

SEQ ID NO: 120139 - DNA, 38 bp, Artificial Sequence
  Synthetic oligonucleotide
tcaccccccgcctttccctggtgactatcctgacatga

SEQ ID NO: 120140 - DNA, 38 bp, Artificial Sequence
  Synthetic oligonucleotide
ttcgcaccacccggcgctcgcccccgccaacagcttga

SEQ ID NO: 120141 - DNA, 36 bp, Artificial Sequence
  Synthetic oligonucleotide
tagtcctcctcctgtcgttatttcttcgcctcatta

SEQ ID NO: 120142 - DNA, 35 bp, Artificial Sequence
  Synthetic oligonucleotide
taccgaacccctgtatagccgtgcgttgttccacc

SEQ ID NO: 120143 - DNA, 35 bp, Artificial Sequence
  Synthetic oligonucleotide
agctcgcatccttgcgctcttctggaccgccgccc

SEQ ID NO: 120144 - DNA, 35 bp, Artificial Sequence
  Synthetic oligonucleotide
gttcacctcgcgcctcttctagtgcctctaccttc

SEQ ID NO: 120145 - DNA, 36 bp, Artificial Sequence
  Synthetic oligonucleotide
gctcgcctgttgccgcatattccctgcccctcgtca

SEQ ID NO: 120146 - DNA, 36 bp, Artificial Sequence
  Synthetic oligonucleotide
gtccactcctgatattgtcaggtaccccccctttca

SEQ ID NO: 120147 - DNA, 37 bp, Artificial Sequence
  Synthetic oligonucleotide
accttctgccccactgcctcgcgcacactttcatgga

SEQ ID NO: 120148 - DNA, 35 bp, Artificial Sequence
  Synthetic oligonucleotide
gaccggctcccgaactttgcgctaacttcccgccc

SEQ ID NO: 120149 - DNA, 35 bp, Artificial Sequence
  Synthetic oligonucleotide
gtgcaaccctgcctctgaagcccctgtactcggtc

SEQ ID NO: 120150 - DNA, 35 bp, Artificial Sequence
  Synthetic oligonucleotide
gcaactacgctcgcacctacccactccgcaccctg

SEQ ID NO: 120151 - DNA, 35 bp, Artificial Sequence
  Synthetic oligonucleotide
actcccgccccattgactcggtcataacctcctca

SEQ ID NO: 120152 - DNA, 36 bp, Artificial Sequence
  Synthetic oligonucleotide
tccctcgcccctctctttattagacatggtctaaga

SEQ ID NO: 120153 - DNA, 35 bp, Artificial Sequence
  Synthetic oligonucleotide
gacccgccccctcccttcgcccatcaccgatgaag

SEQ ID NO: 120154 - DNA, 36 bp, Artificial Sequence
  Synthetic oligonucleotide
gccaatccaccctgctgccgccgctagcatcgctaa

SEQ ID NO: 120155 - DNA, 36 bp, Artificial Sequence
  Synthetic oligonucleotide
atcgcccactggcaattgcctatcgctctcgttaca

SEQ ID NO: 120156 - DNA, 37 bp, Artificial Sequence
  Synthetic oligonucleotide
gaaggagaagggcggacgggggggcgtgattaacaga

SEQ ID NO: 120157 - DNA, 38 bp, Artificial Sequence
  Synthetic oligonucleotide
tccgctcgcagagcatccgtaaccctgcccctctgtga

SEQ ID NO: 120158 - DNA, 37 bp, Artificial Sequence
  Synthetic oligonucleotide
tgaacatgcctcacgctgctccatcctgttacaccta

SEQ ID NO: 120159 - DNA, 35 bp, Artificial Sequence
  Synthetic oligonucleotide
gtgatcacctacccccccgcattgctccacgcgcc

SEQ ID NO: 120160 - DNA, 35 bp, Artificial Sequence
  Synthetic oligonucleotide
tcctgtccctgtgagctccaagtccccctgcatcc

SEQ ID NO: 120161 - DNA, 35 bp, Artificial Sequence
  Synthetic oligonucleotide
ggcccaaccccgccgctccagttacaggtccctcc

SEQ ID NO: 120162 - DNA, 36 bp, Artificial Sequence
  Synthetic oligonucleotide
tgggtacttgtcacgccgtttttgccgcccccctgt

SEQ ID NO: 120163 - DNA, 36 bp, Artificial Sequence
  Synthetic oligonucleotide
ttgccaggtcctccccgcctgccgaatccgccttca

SEQ ID NO: 120164 - DNA, 35 bp, Artificial Sequence
  Synthetic oligonucleotide
tctgtggcgaagggggaggaacaaccagggggaga

SEQ ID NO: 120165 - DNA, 36 bp, Artificial Sequence
  Synthetic oligonucleotide
gaattgagcatgggtgggactgggaaaggggtagga

SEQ ID NO: 120166 - DNA, 35 bp, Artificial Sequence
  Synthetic oligonucleotide
acccaggagatccggttgcatgccgcctattttcc

SEQ ID NO: 120167 - DNA, 35 bp, Artificial Sequence
  Synthetic oligonucleotide
ttcgtgcccggccctgcctactagctgccacctcg

SEQ ID NO: 120168 - DNA, 35 bp, Artificial Sequence
  Synthetic oligonucleotide
ttgcgcctgctcgcacccctcatttatacgacctg

SEQ ID NO: 120169 - DNA, 35 bp, Artificial Sequence
  Synthetic oligonucleotide
accaacccttacgcccgccccatgtatcagtggct

SEQ ID NO: 120170 - DNA, 35 bp, Artificial Sequence
  Synthetic oligonucleotide
tttacgccaccaactctgttattacgcccctctaa

SEQ ID NO: 120171 - DNA, 37 bp, Artificial Sequence
  Synthetic oligonucleotide
atggagtcgggagggagtggggaagggtttgtcacga

SEQ ID NO: 120172 - DNA, 37 bp, Artificial Sequence
  Synthetic oligonucleotide
tcgcattcgcccgtcgtccatccttgcctgcccccga

SEQ ID NO: 120173 - DNA, 36 bp, Artificial Sequence
  Synthetic oligonucleotide
gcgtgaccgccggccgtatctttcctaatgccttga

SEQ ID NO: 120174 - DNA, 35 bp, Artificial Sequence
  Synthetic oligonucleotide
acgcgatactgcctttccgatcctccgacttcgcg

SEQ ID NO: 120175 - DNA, 35 bp, Artificial Sequence
  Synthetic oligonucleotide
tccgagtgagggggtagtagggttctgggaggggg

SEQ ID NO: 120176 - DNA, 35 bp, Artificial Sequence
  Synthetic oligonucleotide
aacaagggggaggggaggtagctaagacatgggtg

SEQ ID NO: 120177 - DNA, 35 bp, Artificial Sequence
  Synthetic oligonucleotide
tctcctgacgccgctgcctccccaatcgcccctat

SEQ ID NO: 120178 - DNA, 37 bp, Artificial Sequence
  Synthetic oligonucleotide
aagtgagagatgggaaaaggagcggtgaaggggcaga

SEQ ID NO: 120179 - DNA, 37 bp, Artificial Sequence
  Synthetic oligonucleotide
tagcggggcaatgggggggggacggggtagcacgaga

SEQ ID NO: 120180 - DNA, 37 bp, Artificial Sequence
  Synthetic oligonucleotide
ttccgcccccccatgccgtgtgtgcacacttcgtcga

SEQ ID NO: 120181 - DNA, 37 bp, Artificial Sequence
  Synthetic oligonucleotide
gatgggcgggtgggaaatgatgcctgttaacgggtga

SEQ ID NO: 120182 - DNA, 36 bp, Artificial Sequence
  Synthetic oligonucleotide
gcttactgccgccctgtaataccacgcatttatcac

SEQ ID NO: 120183 - DNA, 35 bp, Artificial Sequence
  Synthetic oligonucleotide
aacatccgcattctatctacaggccttgggttccc

SEQ ID NO: 120184 - DNA, 35 bp, Artificial Sequence
  Synthetic oligonucleotide
gaaatacgtctgctagtctcccctgcccctccgcc

SEQ ID NO: 120185 - DNA, 35 bp, Artificial Sequence
  Synthetic oligonucleotide
tgcaggccaaccccatcagtcgctggcccgccctc

SEQ ID NO: 120186 - DNA, 35 bp, Artificial Sequence
  Synthetic oligonucleotide
gcctcctctgttgaatcagttccctctccgtttcg

SEQ ID NO: 120187 - DNA, 35 bp, Artificial Sequence
  Synthetic oligonucleotide
gcccactccgccgtgaacgccacacagcccctcct

SEQ ID NO: 120188 - DNA, 35 bp, Artificial Sequence
  Synthetic oligonucleotide
acccgacgcgatagcgttacttcctcgcaccctct

SEQ ID NO: 120189 - DNA, 36 bp, Artificial Sequence
  Synthetic oligonucleotide
gcccccccagccccattggtacgcgatccccgcaaa

SEQ ID NO: 120190 - DNA, 35 bp, Artificial Sequence
  Synthetic oligonucleotide
agctccaggcgccccctctgtacattcccactcca

SEQ ID NO: 120191 - DNA, 37 bp, Artificial Sequence
  Synthetic oligonucleotide
tgactggcccatgtaatcagcctctctccccctacga

SEQ ID NO: 120192 - DNA, 35 bp, Artificial Sequence
  Synthetic oligonucleotide
tcgttgctcactccttgtctacccgcgaccacgcc

SEQ ID NO: 120193 - DNA, 35 bp, Artificial Sequence
  Synthetic oligonucleotide
acccgaggtcagcctctccgaccatttgttcttcc

SEQ ID NO: 120194 - DNA, 35 bp, Artificial Sequence
  Synthetic oligonucleotide
taaacccgcccatcatctaagcgccccccttgcgg

SEQ ID NO: 120195 - DNA, 35 bp, Artificial Sequence
  Synthetic oligonucleotide
tcccacccaggccggttggtactagttctctcctg

SEQ ID NO: 120196 - DNA, 35 bp, Artificial Sequence
  Synthetic oligonucleotide
gacacagggagggggtgaaacgctgggagcgggtt

SEQ ID NO: 120197 - DNA, 36 bp, Artificial Sequence
  Synthetic oligonucleotide
acaacccgggtgggtgggaagtacccgtaatgggaa

SEQ ID NO: 120198 - DNA, 36 bp, Artificial Sequence
  Synthetic oligonucleotide
tccacaccgtgatgtccaccttcatcctgcgcctca

SEQ ID NO: 120199 - DNA, 33 bp, Artificial Sequence
  Synthetic oligonucleotide
gacacactactttgctcctccttgccctctcga

SEQ ID NO: 120200 - DNA, 36 bp, Artificial Sequence
  Synthetic oligonucleotide
gacccaccgccggcacagacatactcctccgattta

SEQ ID NO: 120201 - DNA, 35 bp, Artificial Sequence
  Synthetic oligonucleotide
gttaccgttcgcccgactcctcctagtgaccacac

SEQ ID NO: 120202 - DNA, 35 bp, Artificial Sequence
  Synthetic oligonucleotide
tgcattaccatccgccctcttaagatctgccgtac

SEQ ID NO: 120203 - DNA, 35 bp, Artificial Sequence
  Synthetic oligonucleotide
atactccgccgccttgtacgttatgtccctgaacc

SEQ ID NO: 120204 - DNA, 35 bp, Artificial Sequence
  Synthetic oligonucleotide
aacccttgtcgcctaggtctatactcgttaccacc

SEQ ID NO: 120205 - DNA, 35 bp, Artificial Sequence
  Synthetic oligonucleotide
tccagccccatttctatagccactgtcccttcacc

SEQ ID NO: 120206 - DNA, 35 bp, Artificial Sequence
  Synthetic oligonucleotide
gacccatccctactccgcgccctgctatgactacc

SEQ ID NO: 120207 - DNA, 30 bp, Artificial Sequence
  Synthetic oligonucleotide
tagtcatccccgctcgcacgcccccgttcc

SEQ ID NO: 120208 - DNA, 38 bp, Artificial Sequence
  Synthetic oligonucleotide
tgaccgggtgggggggtgtgttcgttcgggacacttga

SEQ ID NO: 120209 - DNA, 36 bp, Artificial Sequence
  Synthetic oligonucleotide
atccatcccatccattggtccagacgatgcctcgta

SEQ ID NO: 120210 - DNA, 35 bp, Artificial Sequence
  Synthetic oligonucleotide
tactgagtcagcattgccagccctctcctatcgtc

SEQ ID NO: 120211 - DNA, 35 bp, Artificial Sequence
  Synthetic oligonucleotide
atcacggtgtcacgctgcctctccatcactttctg

SEQ ID NO: 120212 - DNA, 35 bp, Artificial Sequence
  Synthetic oligonucleotide
tcccgtgctgccccttctcgtctccttccccggtg

SEQ ID NO: 120213 - DNA, 35 bp, Artificial Sequence
  Synthetic oligonucleotide
ttcccactcgccgctcgtcctcacccgccatcgct

SEQ ID NO: 120214 - DNA, 36 bp, Artificial Sequence
  Synthetic oligonucleotide
tacaccgccttcatgtcccggttactagtactctca

SEQ ID NO: 120215 - DNA, 37 bp, Artificial Sequence
  Synthetic oligonucleotide
taacgcgacagttgtacattgccccccttcttcctga

SEQ ID NO: 120216 - DNA, 35 bp, Artificial Sequence
  Synthetic oligonucleotide
tgagaccgtcgcgctctcttcccgacactatacac

SEQ ID NO: 120217 - DNA, 35 bp, Artificial Sequence
  Synthetic oligonucleotide
tccacgttcgtcgttcgcgcattacgcacccctac

SEQ ID NO: 120218 - DNA, 35 bp, Artificial Sequence
  Synthetic oligonucleotide
actaaggcatccccgccacgaatagccgatccacc

SEQ ID NO: 120219 - DNA, 35 bp, Artificial Sequence
  Synthetic oligonucleotide
tcccaccgccccgaactggtaaccaaccacatccc

SEQ ID NO: 120220 - DNA, 36 bp, Artificial Sequence
  Synthetic oligonucleotide
tcccctaccgtaccatacaccgcgctgtgccccaca

SEQ ID NO: 120221 - DNA, 35 bp, Artificial Sequence
  Synthetic oligonucleotide
aacgacgcacttcccctggccgtccctctctttga

SEQ ID NO: 120222 - DNA, 36 bp, Artificial Sequence
  Synthetic oligonucleotide
acttccccctcatatgtctccagcctgtggttcgta

SEQ ID NO: 120223 - DNA, 35 bp, Artificial Sequence
  Synthetic oligonucleotide
ttccacgttccactgtccacctctccgtaggcccc

SEQ ID NO: 120224 - DNA, 36 bp, Artificial Sequence
  Synthetic oligonucleotide
tccgcccgccgcactgaaggtcttctcacgccacag

SEQ ID NO: 120225 - DNA, 35 bp, Artificial Sequence
  Synthetic oligonucleotide
gatcggtgtgagaggggtggacgggtgggtcgacg

SEQ ID NO: 120226 - DNA, 35 bp, Artificial Sequence
  Synthetic oligonucleotide
taccgcacgcgttcaccctcctctctctccgcttt

SEQ ID NO: 120227 - DNA, 35 bp, Artificial Sequence
  Synthetic oligonucleotide
ttgagaaggagagaggtggggaggggttagtggaa

SEQ ID NO: 120228 - DNA, 36 bp, Artificial Sequence
  Synthetic oligonucleotide
tcgagccggcctttcacgctcccccatgctgtttca

SEQ ID NO: 120229 - DNA, 38 bp, Artificial Sequence
  Synthetic oligonucleotide
gacgtgccgaagttgggtggagggggggtagcgcgtga

SEQ ID NO: 120230 - DNA, 37 bp, Artificial Sequence
  Synthetic oligonucleotide
gtggatgggaacacgaaactgagagaggggcgggtga

SEQ ID NO: 120231 - DNA, 35 bp, Artificial Sequence
  Synthetic oligonucleotide
tgccgctccccttctccatcattccgtcccggccg

SEQ ID NO: 120232 - DNA, 35 bp, Artificial Sequence
  Synthetic oligonucleotide
tccgcaccccctcacgccactggcctttccatact

SEQ ID NO: 120233 - DNA, 35 bp, Artificial Sequence
  Synthetic oligonucleotide
tatgtccctcccaccatcgctgccatgttcttgct

SEQ ID NO: 120234 - DNA, 35 bp, Artificial Sequence
  Synthetic oligonucleotide
gctcacaccatctgctgtttccacgtcatcgcttt

SEQ ID NO: 120235 - DNA, 35 bp, Artificial Sequence
  Synthetic oligonucleotide
tctgtgccactgtacttctgaccacccttccgaga

SEQ ID NO: 120236 - DNA, 37 bp, Artificial Sequence
  Synthetic oligonucleotide
tccgggggaggtaggtggccgaggagtgaaggaagga

SEQ ID NO: 120237 - DNA, 37 bp, Artificial Sequence
  Synthetic oligonucleotide
gggaggcggtgggggtggatccgttcgtggtgcggga

SEQ ID NO: 120238 - DNA, 35 bp, Artificial Sequence
  Synthetic oligonucleotide
tacagtgagaggagggtggttgggggagtaagtga

SEQ ID NO: 120239 - DNA, 35 bp, Artificial Sequence
  Synthetic oligonucleotide
gcccttgtatatcggttcaccaacaccctcttgcc

SEQ ID NO: 120240 - DNA, 35 bp, Artificial Sequence
  Synthetic oligonucleotide
atcgcaccgacagccactagtcttctgttacttcc

SEQ ID NO: 120241 - DNA, 35 bp, Artificial Sequence
  Synthetic oligonucleotide
gggtccccgcgcctcataccgcctttatcgcctgc

SEQ ID NO: 120242 - DNA, 35 bp, Artificial Sequence
  Synthetic oligonucleotide
tgcactggcccgccgcccactccttcgtctcctcg

SEQ ID NO: 120243 - DNA, 36 bp, Artificial Sequence
  Synthetic oligonucleotide
tcgtaccctctattccgttatacgtcctttccccga

SEQ ID NO: 120244 - DNA, 38 bp, Artificial Sequence
  Synthetic oligonucleotide
gccttctcgccacatctgttctctcgctatcttcctga

SEQ ID NO: 120245 - DNA, 35 bp, Artificial Sequence
  Synthetic oligonucleotide
aatgtgtattgccgccttccgcctactttaacgcc

SEQ ID NO: 120246 - DNA, 35 bp, Artificial Sequence
  Synthetic oligonucleotide
gcatcaggtcgcccgcaccccatgtccaccagtcc

SEQ ID NO: 120247 - DNA, 34 bp, Artificial Sequence
  Synthetic oligonucleotide
attccactcgccaccttgcttgttcctctatgga

SEQ ID NO: 120248 - DNA, 38 bp, Artificial Sequence
  Synthetic oligonucleotide
tccagcgccacacctcctgtccccccgtgtaccactga

SEQ ID NO: 120249 - DNA, 36 bp, Artificial Sequence
  Synthetic oligonucleotide
gattcccccctccgatatgccacaggacttcctata

SEQ ID NO: 120250 - DNA, 36 bp, Artificial Sequence
  Synthetic oligonucleotide
ttcgcaacatcctctcgaataagcaccatcctccta

SEQ ID NO: 120251 - DNA, 35 bp, Artificial Sequence
  Synthetic oligonucleotide
accgcgacacgccctaatgcccgtccaagttttct

SEQ ID NO: 120252 - DNA, 37 bp, Artificial Sequence
  Synthetic oligonucleotide
ccacccaccgttccagccgtttcgacctacccttcga

SEQ ID NO: 120253 - DNA, 38 bp, Artificial Sequence
  Synthetic oligonucleotide
gagcacaggctgacgggggggatggacggggggtgtga

SEQ ID NO: 120254 - DNA, 35 bp, Artificial Sequence
  Synthetic oligonucleotide
tctgtagccactaggtctacggcccccattctctc

SEQ ID NO: 120255 - DNA, 35 bp, Artificial Sequence
  Synthetic oligonucleotide
tcctacctcatcatctgtcgtgccaatctcgcttc

SEQ ID NO: 120256 - DNA, 36 bp, Artificial Sequence
  Synthetic oligonucleotide
ttagggagatggagaggggggggtaagagtggcaaa

SEQ ID NO: 120257 - DNA, 37 bp, Artificial Sequence
  Synthetic oligonucleotide
ggggtgggcatgacttgggggttcagatccaagggga

SEQ ID NO: 120258 - DNA, 35 bp, Artificial Sequence
  Synthetic oligonucleotide
gtgcccgccctgttaatccatgtacctcccactta

SEQ ID NO: 120259 - DNA, 35 bp, Artificial Sequence
  Synthetic oligonucleotide
ttcccgccggttcttctaatgacacgtcatcgccc

SEQ ID NO: 120260 - DNA, 35 bp, Artificial Sequence
  Synthetic oligonucleotide
tcaatgtgactgcgccgctcgccgcttccctgctc

SEQ ID NO: 120261 - DNA, 35 bp, Artificial Sequence
  Synthetic oligonucleotide
atatcaacccgcccgaatgtcatttattcgccact

SEQ ID NO: 120262 - DNA, 35 bp, Artificial Sequence
  Synthetic oligonucleotide
gctcccgccaatgccacgaatgaccgtcccctttt

SEQ ID NO: 120263 - DNA, 36 bp, Artificial Sequence
  Synthetic oligonucleotide
aagtgaggaggagagtggggaggaacattaatggaa

SEQ ID NO: 120264 - DNA, 36 bp, Artificial Sequence
  Synthetic oligonucleotide
tcgtgttcctcatgcctggttaattcgttcccgcca

SEQ ID NO: 120265 - DNA, 35 bp, Artificial Sequence
  Synthetic oligonucleotide
atgggatccgccacctcgttcttttctgtgcctca

SEQ ID NO: 120266 - DNA, 35 bp, Artificial Sequence
  Synthetic oligonucleotide
acacaccccgcccatcgtaggcgctatccgacacc

SEQ ID NO: 120267 - DNA, 35 bp, Artificial Sequence
  Synthetic oligonucleotide
tgttgcggctctgtccttcgtccgtcgttatcacc

SEQ ID NO: 120268 - DNA, 35 bp, Artificial Sequence
  Synthetic oligonucleotide
agagtcacgtagtgcgctatttcccgtgccccccc

SEQ ID NO: 120269 - DNA, 35 bp, Artificial Sequence
  Synthetic oligonucleotide
aactgctgcccgcccggcactctcttccttacgcc

SEQ ID NO: 120270 - DNA, 35 bp, Artificial Sequence
  Synthetic oligonucleotide
tcagtctgacagctacctcgcactacccgcccgcg

SEQ ID NO: 120271 - DNA, 35 bp, Artificial Sequence
  Synthetic oligonucleotide
gaatgaggtaggtgggcgatggagtgggagggggg

SEQ ID NO: 120272 - DNA, 36 bp, Artificial Sequence
  Synthetic oligonucleotide
acctcgccgccccctttctgtttcctggcaggccaa

SEQ ID NO: 120273 - DNA, 36 bp, Artificial Sequence
  Synthetic oligonucleotide
agactccgccctcgaaccgaccccgctattatgtca

SEQ ID NO: 120274 - DNA, 36 bp, Artificial Sequence
  Synthetic oligonucleotide
tccagacgccaccagtgccgtttcgtttaccatcta

SEQ ID NO: 120275 - DNA, 35 bp, Artificial Sequence
  Synthetic oligonucleotide
tgccatcccgcccgagattcgcttcatcttctgac

SEQ ID NO: 120276 - DNA, 35 bp, Artificial Sequence
  Synthetic oligonucleotide
gcgggcgccgcagcagcctacccacgccccgcccc

SEQ ID NO: 120277 - DNA, 35 bp, Artificial Sequence
  Synthetic oligonucleotide
ttctgccacccgcttagatcttgcgcaaccctccc

SEQ ID NO: 120278 - DNA, 35 bp, Artificial Sequence
  Synthetic oligonucleotide
accctcccgcagctatgctcatcccactttcggtc

SEQ ID NO: 120279 - DNA, 35 bp, Artificial Sequence
  Synthetic oligonucleotide
tccggacacgcagcggtaccctgccctattcctag

SEQ ID NO: 120280 - DNA, 35 bp, Artificial Sequence
  Synthetic oligonucleotide
tggacccgcccccttgcagtcccccacttccagcg

SEQ ID NO: 120281 - DNA, 35 bp, Artificial Sequence
  Synthetic oligonucleotide
gcactatgcacgtgctatcgctttatcctccatcg

SEQ ID NO: 120282 - DNA, 33 bp, Artificial Sequence
  Synthetic oligonucleotide
taacgacgggaagggcggggttttctcatgggg

SEQ ID NO: 120283 - DNA, 35 bp, Artificial Sequence
  Synthetic oligonucleotide
gggtacacctcgccccccccttgtcgttaggcact

SEQ ID NO: 120284 - DNA, 35 bp, Artificial Sequence
  Synthetic oligonucleotide
tggtgtcgcacccggctttatttgacccacttcct

SEQ ID NO: 120285 - DNA, 35 bp, Artificial Sequence
  Synthetic oligonucleotide
tcagccctcctcctgtacggtaccaggtattcatt

SEQ ID NO: 120286 - DNA, 38 bp, Artificial Sequence
  Synthetic oligonucleotide
tccgcccccggcacacgccttcctcatactcgccatga

SEQ ID NO: 120287 - DNA, 35 bp, Artificial Sequence
  Synthetic oligonucleotide
tgctctcggtccgacggtcagcctaccactcttcc

SEQ ID NO: 120288 - DNA, 35 bp, Artificial Sequence
  Synthetic oligonucleotide
tctgataccctcacctgtaaccggtgcctcttcgc

SEQ ID NO: 120289 - DNA, 35 bp, Artificial Sequence
  Synthetic oligonucleotide
gagcacctcacgcatcccgcctcaatcattattgc

SEQ ID NO: 120290 - DNA, 35 bp, Artificial Sequence
  Synthetic oligonucleotide
tgcacccccacgtacccaacgatgcgaaagccctc

SEQ ID NO: 120291 - DNA, 35 bp, Artificial Sequence
  Synthetic oligonucleotide
gcaacgccccccctgtaatccctcctccgtgcgcg

SEQ ID NO: 120292 - DNA, 35 bp, Artificial Sequence
  Synthetic oligonucleotide
gtgccatcttcaattgccgtactccccaacctttg

SEQ ID NO: 120293 - DNA, 35 bp, Artificial Sequence
  Synthetic oligonucleotide
atttgtccccgcacttctcactatgacgaggaact

SEQ ID NO: 120294 - DNA, 35 bp, Artificial Sequence
  Synthetic oligonucleotide
agaccctgtgccagctacccgtgaacttccccctt

SEQ ID NO: 120295 - DNA, 35 bp, Artificial Sequence
  Synthetic oligonucleotide
gtcctcatcggatcatgccttcctgcacctcttac

SEQ ID NO: 120296 - DNA, 35 bp, Artificial Sequence
  Synthetic oligonucleotide
acccatcatccggtggccaagtacccttccccagc

SEQ ID NO: 120297 - DNA, 35 bp, Artificial Sequence
  Synthetic oligonucleotide
gagccccacgctagcatcccgttcacctcttgttc

SEQ ID NO: 120298 - DNA, 36 bp, Artificial Sequence
  Synthetic oligonucleotide
gcctccctcagtcgcgccatttgacttccatcgtaa

SEQ ID NO: 120299 - DNA, 37 bp, Artificial Sequence
  Synthetic oligonucleotide
acatgatcggaagggaggagggaatgggcataaggga

SEQ ID NO: 120300 - DNA, 37 bp, Artificial Sequence
  Synthetic oligonucleotide
gaaaggaggggtacacgggtgggacggcgaccaggga

SEQ ID NO: 120301 - DNA, 36 bp, Artificial Sequence
  Synthetic oligonucleotide
tgagtactgcctgccccgtttatgaaccccatgtta

SEQ ID NO: 120302 - DNA, 35 bp, Artificial Sequence
  Synthetic oligonucleotide
gtgcgtggggggggggattagggccgggatagtag

SEQ ID NO: 120303 - DNA, 35 bp, Artificial Sequence
  Synthetic oligonucleotide
gtcacccaccgagctccctcaccagtcgaatccat

SEQ ID NO: 120304 - DNA, 35 bp, Artificial Sequence
  Synthetic oligonucleotide
gatgcgaatgcgggacggggggtgcgggaatggat

SEQ ID NO: 120305 - DNA, 36 bp, Artificial Sequence
  Synthetic oligonucleotide
aaccgggggggtggggaagcaacatgagccgggaaa

SEQ ID NO: 120306 - DNA, 36 bp, Artificial Sequence
  Synthetic oligonucleotide
tcgcctggccccatctgccccattccttcgttcgca

SEQ ID NO: 120307 - DNA, 35 bp, Artificial Sequence
  Synthetic oligonucleotide
acagatgcccccgctctctattgggatccctcata

SEQ ID NO: 120308 - DNA, 36 bp, Artificial Sequence
  Synthetic oligonucleotide
tgaagggggaaatggaggtgggagagaatggggata

SEQ ID NO: 120309 - DNA, 35 bp, Artificial Sequence
  Synthetic oligonucleotide
gttagaagggggggcgaaatgggaggaggggacta

SEQ ID NO: 120310 - DNA, 35 bp, Artificial Sequence
  Synthetic oligonucleotide
aactgcccgttccgttggccgctggacccccctac

SEQ ID NO: 120311 - DNA, 35 bp, Artificial Sequence
  Synthetic oligonucleotide
tatacgcgcccgtcccttctctaccccgaagcgtc

SEQ ID NO: 120312 - DNA, 35 bp, Artificial Sequence
  Synthetic oligonucleotide
tactgttccacgtgcactctgctgccattttccct

SEQ ID NO: 120313 - DNA, 35 bp, Artificial Sequence
  Synthetic oligonucleotide
tggacactcgctagcaacgtctttacctggccctt

SEQ ID NO: 120314 - DNA, 35 bp, Artificial Sequence
  Synthetic oligonucleotide
gatccgcactcctccctcgcactaccctgttggaa

SEQ ID NO: 120315 - DNA, 37 bp, Artificial Sequence
  Synthetic oligonucleotide
tcacctcctgctataatccctccttgtccctttcgga

SEQ ID NO: 120316 - DNA, 37 bp, Artificial Sequence
  Synthetic oligonucleotide
taagggtgctaggggcgtccggggttcggagctggga

SEQ ID NO: 120317 - DNA, 37 bp, Artificial Sequence
  Synthetic oligonucleotide
tccacccgcccacctaatctgttctcttagcccctga

SEQ ID NO: 120318 - DNA, 35 bp, Artificial Sequence
  Synthetic oligonucleotide
atgccatacgcacttatcctcaaaggccctgcacc

SEQ ID NO: 120319 - DNA, 35 bp, Artificial Sequence
  Synthetic oligonucleotide
tccacggcattcattatgacgctcttcatgccccc

SEQ ID NO: 120320 - DNA, 35 bp, Artificial Sequence
  Synthetic oligonucleotide
gatcatcgacgccctctctcacaccgcactcctgg

SEQ ID NO: 120321 - DNA, 36 bp, Artificial Sequence
  Synthetic oligonucleotide
tccatcggtctgtgtacaccgtcacttcccccgcca

SEQ ID NO: 120322 - DNA, 35 bp, Artificial Sequence
  Synthetic oligonucleotide
atcgagccctattacactgtcatcgcccgcttcca

SEQ ID NO: 120323 - DNA, 36 bp, Artificial Sequence
  Synthetic oligonucleotide
tcacgcacaccgcactacgcatgtactaccgcttca

SEQ ID NO: 120324 - DNA, 35 bp, Artificial Sequence
  Synthetic oligonucleotide
ttcccgcgcctaatcgcgttatgtcgccctcctga

SEQ ID NO: 120325 - DNA, 35 bp, Artificial Sequence
  Synthetic oligonucleotide
tcctccccctcgcccgttcaaatgttgccagtccc

SEQ ID NO: 120326 - DNA, 35 bp, Artificial Sequence
  Synthetic oligonucleotide
tcctaggtcaccatttaccagctcgactttccgcc

SEQ ID NO: 120327 - DNA, 35 bp, Artificial Sequence
  Synthetic oligonucleotide
gtcaccgccgccttcgccacatctcggccgattgc

SEQ ID NO: 120328 - DNA, 35 bp, Artificial Sequence
  Synthetic oligonucleotide
actgcgcatccactttcctcataagctccgccctc

SEQ ID NO: 120329 - DNA, 35 bp, Artificial Sequence
  Synthetic oligonucleotide
acaacgcgtccgccgtccgagttttacccgccttc

SEQ ID NO: 120330 - DNA, 33 bp, Artificial Sequence
  Synthetic oligonucleotide
accgcccttccaattgtgccttccgattcttgt

SEQ ID NO: 120331 - DNA, 35 bp, Artificial Sequence
  Synthetic oligonucleotide
tttgaccccctctgtccgttcctcagacacgccca

SEQ ID NO: 120332 - DNA, 35 bp, Artificial Sequence
  Synthetic oligonucleotide
acacaggagcatggggagtaacaggaggagcggca

SEQ ID NO: 120333 - DNA, 35 bp, Artificial Sequence
  Synthetic oligonucleotide
ggagaggtaggggggctcagggcatgccgggtgga

SEQ ID NO: 120334 - DNA, 35 bp, Artificial Sequence
  Synthetic oligonucleotide
agtacgaaccaggttctcggtccttctccatcacc

SEQ ID NO: 120335 - DNA, 35 bp, Artificial Sequence
  Synthetic oligonucleotide
acgatgcaacccgtcccacccgtcatttaaaagcc

SEQ ID NO: 120336 - DNA, 35 bp, Artificial Sequence
  Synthetic oligonucleotide
gccccgtagccacggtatgttcccctttattgtcg

SEQ ID NO: 120337 - DNA, 35 bp, Artificial Sequence
  Synthetic oligonucleotide
tacaccaacctcctgtcaatcgctgcagtactcct

SEQ ID NO: 120338 - DNA, 36 bp, Artificial Sequence
  Synthetic oligonucleotide
aacacgaggtggcgcggagggaggggtggctggtca

SEQ ID NO: 120339 - DNA, 38 bp, Artificial Sequence
  Synthetic oligonucleotide
tctcccccgccgaggttgtacctgcgtcctcattttga

SEQ ID NO: 120340 - DNA, 37 bp, Artificial Sequence
  Synthetic oligonucleotide
aacgggtggggcgggtgcagacggggagtccttttga

SEQ ID NO: 120341 - DNA, 35 bp, Artificial Sequence
  Synthetic oligonucleotide
tattccacacaccgtcccgttttgcttcgccgccc

SEQ ID NO: 120342 - DNA, 35 bp, Artificial Sequence
  Synthetic oligonucleotide
gaacctcgtagacgcacctgaccctccctcgcctc

SEQ ID NO: 120343 - DNA, 35 bp, Artificial Sequence
  Synthetic oligonucleotide
gtagccgccaccgttgttcgccctatcttcccgcg

SEQ ID NO: 120344 - DNA, 35 bp, Artificial Sequence
  Synthetic oligonucleotide
acctacccgtgctttcacctccgccgtcccgccgt

SEQ ID NO: 120345 - DNA, 37 bp, Artificial Sequence
  Synthetic oligonucleotide
gggtggtggtcggggatcgggacggtggttcggaaga

SEQ ID NO: 120346 - DNA, 35 bp, Artificial Sequence
  Synthetic oligonucleotide
tcttgcgtgttctgccggtttccccccttcgtgcc

SEQ ID NO: 120347 - DNA, 35 bp, Artificial Sequence
  Synthetic oligonucleotide
atttgcccccactgactcccaatagacgacaactc

SEQ ID NO: 120348 - DNA, 36 bp, Artificial Sequence
  Synthetic oligonucleotide
gtgttcgcctcctcctgcctcgttttcttcgtagaa

SEQ ID NO: 120349 - DNA, 36 bp, Artificial Sequence
  Synthetic oligonucleotide
tcgcccttccagctctatacaacggtccctctatca

SEQ ID NO: 120350 - DNA, 38 bp, Artificial Sequence
  Synthetic oligonucleotide
ggaaacgcagtgcttatgtccctcttgcctcccactga

SEQ ID NO: 120351 - DNA, 35 bp, Artificial Sequence
  Synthetic oligonucleotide
acgcgacgctgtccaataatccctgcctcacctga

SEQ ID NO: 120352 - DNA, 35 bp, Artificial Sequence
  Synthetic oligonucleotide
gtggacccttcagttcacgtgcacccctgttcctc

SEQ ID NO: 120353 - DNA, 35 bp, Artificial Sequence
  Synthetic oligonucleotide
gcctccgctcgcactctaattcgtcctcgttcgcg

SEQ ID NO: 120354 - DNA, 35 bp, Artificial Sequence
  Synthetic oligonucleotide
gcgtcccacagctgccattctcgttacgtcaccgt

SEQ ID NO: 120355 - DNA, 35 bp, Artificial Sequence
  Synthetic oligonucleotide
gtacgccgtggggggaggcgagggtaggagggaca

SEQ ID NO: 120356 - DNA, 37 bp, Artificial Sequence
  Synthetic oligonucleotide
tgaagcgttacctggtccatccttgccgacgccgcca

SEQ ID NO: 120357 - DNA, 36 bp, Artificial Sequence
  Synthetic oligonucleotide
ggaatgcgtaactggttaaccctgccctctctcgca

SEQ ID NO: 120358 - DNA, 36 bp, Artificial Sequence
  Synthetic oligonucleotide
gtcccccccctgcatccttaatatcgctctatgcga

SEQ ID NO: 120359 - DNA, 37 bp, Artificial Sequence
  Synthetic oligonucleotide
gtaggagggagacaggataaggggcatggtacgggga

SEQ ID NO: 120360 - DNA, 37 bp, Artificial Sequence
  Synthetic oligonucleotide
gaggaacgataaatggaggagggtaatggggcgggga

SEQ ID NO: 120361 - DNA, 35 bp, Artificial Sequence
  Synthetic oligonucleotide
tagcaactgcctgcccagactccgttcctgttcta

SEQ ID NO: 120362 - DNA, 35 bp, Artificial Sequence
  Synthetic oligonucleotide
gagcacgccacagcacctctggttccccgcattac

SEQ ID NO: 120363 - DNA, 35 bp, Artificial Sequence
  Synthetic oligonucleotide
gcccaccccacaccgagtcgtttcacaaactgacc

SEQ ID NO: 120364 - DNA, 35 bp, Artificial Sequence
  Synthetic oligonucleotide
tcaggcctcatctaccgtatttaccccggccgccc

SEQ ID NO: 120365 - DNA, 35 bp, Artificial Sequence
  Synthetic oligonucleotide
gttgcagttcaggacccatccgccgtacctcaccg

SEQ ID NO: 120366 - DNA, 37 bp, Artificial Sequence
  Synthetic oligonucleotide
gacgacccgtcagcacgccctcccccgttgctttaga

SEQ ID NO: 120367 - DNA, 38 bp, Artificial Sequence
  Synthetic oligonucleotide
acccatcctcggcggcattaagccttccccatccatga

SEQ ID NO: 120368 - DNA, 35 bp, Artificial Sequence
  Synthetic oligonucleotide
gtcaacgcgagccgtacggaacctgcgccatcccc

SEQ ID NO: 120369 - DNA, 35 bp, Artificial Sequence
  Synthetic oligonucleotide
ccacacctattacaagtactgccctccgccggccc

SEQ ID NO: 120370 - DNA, 35 bp, Artificial Sequence
  Synthetic oligonucleotide
tgccaccgccacggttctccaataggcccccctct

SEQ ID NO: 120371 - DNA, 38 bp, Artificial Sequence
  Synthetic oligonucleotide
attgacagccactctgcaccccaccgtcctccgcctga

SEQ ID NO: 120372 - DNA, 36 bp, Artificial Sequence
  Synthetic oligonucleotide
gtccactgtcacaccgccgttaaccgtttctccata

SEQ ID NO: 120373 - DNA, 36 bp, Artificial Sequence
  Synthetic oligonucleotide
accgactccacccgttactagatcgtcgcataccta

SEQ ID NO: 120374 - DNA, 35 bp, Artificial Sequence
  Synthetic oligonucleotide
atcctgccctctctgttgagtttcgccccctaaac

SEQ ID NO: 120375 - DNA, 35 bp, Artificial Sequence
  Synthetic oligonucleotide
ttcatccgtgccttgctgcccttggtatcacattc

SEQ ID NO: 120376 - DNA, 35 bp, Artificial Sequence
  Synthetic oligonucleotide
atccactctgaacgttaccctgactcttgttccat

SEQ ID NO: 120377 - DNA, 35 bp, Artificial Sequence
  Synthetic oligonucleotide
actcgcccccccacccagcacatgcgagagagcct

SEQ ID NO: 120378 - DNA, 36 bp, Artificial Sequence
  Synthetic oligonucleotide
gggacgtgccacttgccctcgtcctgtcgcccttaa

SEQ ID NO: 120379 - DNA, 36 bp, Artificial Sequence
  Synthetic oligonucleotide
gcacccttggcctatgtctccccgcccgccacccga

SEQ ID NO: 120380 - DNA, 36 bp, Artificial Sequence
  Synthetic oligonucleotide
ggtgggtggtgggggtgggaatggataagtcaggga

SEQ ID NO: 120381 - DNA, 37 bp, Artificial Sequence
  Synthetic oligonucleotide
tccggggcgggtaacgcgtgggggttgcaggagggga

SEQ ID NO: 120382 - DNA, 37 bp, Artificial Sequence
  Synthetic oligonucleotide
agcacgaggccaagagaagggggggcggaggtgggga

SEQ ID NO: 120383 - DNA, 38 bp, Artificial Sequence
  Synthetic oligonucleotide
acccgcgatcagttatctcctgttccttgccctgctga

SEQ ID NO: 120384 - DNA, 36 bp, Artificial Sequence
  Synthetic oligonucleotide
tgggaggggcgggggatagttggaattggaggcgta

SEQ ID NO: 120385 - DNA, 35 bp, Artificial Sequence
  Synthetic oligonucleotide
ggtaccgctcccgttcactcagtgcctaccgttcc

SEQ ID NO: 120386 - DNA, 35 bp, Artificial Sequence
  Synthetic oligonucleotide
gctctccccgcgctggtatctccccacttggcttc

SEQ ID NO: 120387 - DNA, 35 bp, Artificial Sequence
  Synthetic oligonucleotide
tcctgacagtccctccccctctagttcgctcctgt

SEQ ID NO: 120388 - DNA, 35 bp, Artificial Sequence
  Synthetic oligonucleotide
ttggccctccatcactgcccttgcccaaccaggtt

SEQ ID NO: 120389 - DNA, 37 bp, Artificial Sequence
  Synthetic oligonucleotide
gtttgcctcaccctcctcggtcttgatcggtctatga

SEQ ID NO: 120390 - DNA, 35 bp, Artificial Sequence
  Synthetic oligonucleotide
tgcacgcacctgttatccactctcggtcactccac

SEQ ID NO: 120391 - DNA, 33 bp, Artificial Sequence
  Synthetic oligonucleotide
gtcacccataggtcccgtcctgccccccgaggc

SEQ ID NO: 120392 - DNA, 35 bp, Artificial Sequence
  Synthetic oligonucleotide
acagcattcggctaacccatctggccttccctctg

SEQ ID NO: 120393 - DNA, 35 bp, Artificial Sequence
  Synthetic oligonucleotide
tcacgaacctagctcacgtttgcccgccacatcct

SEQ ID NO: 120394 - DNA, 34 bp, Artificial Sequence
  Synthetic oligonucleotide
gcattcccgtccactttcccctgcagtcttacgt

SEQ ID NO: 120395 - DNA, 36 bp, Artificial Sequence
  Synthetic oligonucleotide
ggggagtgggtggaggcgggtgggactagtgagaca

SEQ ID NO: 120396 - DNA, 36 bp, Artificial Sequence
  Synthetic oligonucleotide
accgacgccatctcgcccccaattggttacacccca

SEQ ID NO: 120397 - DNA, 37 bp, Artificial Sequence
  Synthetic oligonucleotide
gggagtggagggggtggatctggcattgatggggaga

SEQ ID NO: 120398 - DNA, 37 bp, Artificial Sequence
  Synthetic oligonucleotide
aactgggggcacatgggtacaaactatcgggagggga

SEQ ID NO: 120399 - DNA, 38 bp, Artificial Sequence
  Synthetic oligonucleotide
tcaggggcgggtggggaggctttgaggaaagggtgtga

SEQ ID NO: 120400 - DNA, 38 bp, Artificial Sequence
  Synthetic oligonucleotide
acatcccagcgattgctgcgccctaccccccatcttga

SEQ ID NO: 120401 - DNA, 35 bp, Artificial Sequence
  Synthetic oligonucleotide
gtactcctgctactttggtttcgaccacccgcctc

SEQ ID NO: 120402 - DNA, 35 bp, Artificial Sequence
  Synthetic oligonucleotide
tgcaaccccgatccctgtcctgcgcccacccgctc

SEQ ID NO: 120403 - DNA, 35 bp, Artificial Sequence
  Synthetic oligonucleotide
gatcgcctctgcctgctttctcaaacgaaccggtc

SEQ ID NO: 120404 - DNA, 35 bp, Artificial Sequence
  Synthetic oligonucleotide
tctcatgtccggctttcttctagtaccttcctttg

SEQ ID NO: 120405 - DNA, 35 bp, Artificial Sequence
  Synthetic oligonucleotide
tgagtgcgcattctcctcttacgtctactgccctt

SEQ ID NO: 120406 - DNA, 36 bp, Artificial Sequence
  Synthetic oligonucleotide
gccccaccctcacatgtctgttgagcactatcctca

SEQ ID NO: 120407 - DNA, 37 bp, Artificial Sequence
  Synthetic oligonucleotide
tcctgcccacactttagcatatgatcaccatcccgga

SEQ ID NO: 120408 - DNA, 37 bp, Artificial Sequence
  Synthetic oligonucleotide
tgtgggcggggaaatgttagggggtcagaccagggga

SEQ ID NO: 120409 - DNA, 35 bp, Artificial Sequence
  Synthetic oligonucleotide
gccacccccccagcgcaatccctttgctgcctcac

SEQ ID NO: 120410 - DNA, 35 bp, Artificial Sequence
  Synthetic oligonucleotide
tgatgacgtcggttccgcccttcctccttcgttac

SEQ ID NO: 120411 - DNA, 35 bp, Artificial Sequence
  Synthetic oligonucleotide
tacgtcatcctatctgcttccctctccagtggtcc

SEQ ID NO: 120412 - DNA, 35 bp, Artificial Sequence
  Synthetic oligonucleotide
ttggtgcctcgatgcactgctcccgcccatgtccg

SEQ ID NO: 120413 - DNA, 35 bp, Artificial Sequence
  Synthetic oligonucleotide
ggtactgctcagactcttccccctaccatcctttg

SEQ ID NO: 120414 - DNA, 35 bp, Artificial Sequence
  Synthetic oligonucleotide
gtcccgtccaactcgcactatctgtcccgactcat

SEQ ID NO: 120415 - DNA, 35 bp, Artificial Sequence
  Synthetic oligonucleotide
gttgtcgccacgagccgttcacgaacatttcacct

SEQ ID NO: 120416 - DNA, 35 bp, Artificial Sequence
  Synthetic oligonucleotide
atagccggaccctgttgccacctaagttccactct

SEQ ID NO: 120417 - DNA, 35 bp, Artificial Sequence
  Synthetic oligonucleotide
ttgaaccgcccacgcttctgctttttaacgccaca

SEQ ID NO: 120418 - DNA, 37 bp, Artificial Sequence
  Synthetic oligonucleotide
atccaccgccatactcgcatggaccctcctccagaga

SEQ ID NO: 120419 - DNA, 38 bp, Artificial Sequence
  Synthetic oligonucleotide
gtcatccccacgtgtctcccccgtccctcgcgatttga

SEQ ID NO: 120420 - DNA, 35 bp, Artificial Sequence
  Synthetic oligonucleotide
gccatgttactgccccattttaagcctacgttacc

SEQ ID NO: 120421 - DNA, 35 bp, Artificial Sequence
  Synthetic oligonucleotide
tgcccaacttagttgccggaatctgactacccccc

SEQ ID NO: 120422 - DNA, 35 bp, Artificial Sequence
  Synthetic oligonucleotide
tttgtccccgtacaagtgcttctcggccttccatc

SEQ ID NO: 120423 - DNA, 35 bp, Artificial Sequence
  Synthetic oligonucleotide
ttgattgcaacacatccttgccccctgcctggctc

SEQ ID NO: 120424 - DNA, 35 bp, Artificial Sequence
  Synthetic oligonucleotide
cacgcttccgccctggctcactgtccattcgattc

SEQ ID NO: 120425 - DNA, 35 bp, Artificial Sequence
  Synthetic oligonucleotide
gccatccttggtccccgcattaatacgcccccgcg

SEQ ID NO: 120426 - DNA, 35 bp, Artificial Sequence
  Synthetic oligonucleotide
tgtaccttccctcgcttatagagacgcctccccat

SEQ ID NO: 120427 - DNA, 35 bp, Artificial Sequence
  Synthetic oligonucleotide
gacccgtccgatcgccttggccgttacgttcccct

SEQ ID NO: 120428 - DNA, 35 bp, Artificial Sequence
  Synthetic oligonucleotide
gacaccgtggccttctggtcctatcgtttcacctt

SEQ ID NO: 120429 - DNA, 35 bp, Artificial Sequence
  Synthetic oligonucleotide
gtccccccgtgtggttacccggtttccctatccta

SEQ ID NO: 120430 - DNA, 35 bp, Artificial Sequence
  Synthetic oligonucleotide
gtttaccaccactagttatgccgccttcttgggtc

SEQ ID NO: 120431 - DNA, 35 bp, Artificial Sequence
  Synthetic oligonucleotide
gctcctacatcggttgcgcacctagtctgtccttc

SEQ ID NO: 120432 - DNA, 35 bp, Artificial Sequence
  Synthetic oligonucleotide
aagtgggaggaaaggcatagaaatgggaggtgagg

SEQ ID NO: 120433 - DNA, 34 bp, Artificial Sequence
  Synthetic oligonucleotide
ttccacgcacttccaccttcagccttgcgccctt

SEQ ID NO: 120434 - DNA, 35 bp, Artificial Sequence
  Synthetic oligonucleotide
tccccatcttgaactgttaatatgctcactgccca

SEQ ID NO: 120435 - DNA, 37 bp, Artificial Sequence
  Synthetic oligonucleotide
tgttgaccgcctctgctatttgcatctttcccaccga

SEQ ID NO: 120436 - DNA, 36 bp, Artificial Sequence
  Synthetic oligonucleotide
tgggggagggggaggggaggttcaggaccgatagga

SEQ ID NO: 120437 - DNA, 36 bp, Artificial Sequence
  Synthetic oligonucleotide
tgtggtgtcccgccttgtacgactgcccgttcccta

SEQ ID NO: 120438 - DNA, 36 bp, Artificial Sequence
  Synthetic oligonucleotide
acctctgccccccgcctttgttgcttggcctatcta

SEQ ID NO: 120439 - DNA, 35 bp, Artificial Sequence
  Synthetic oligonucleotide
gaacctcttctgccgcctcgcccttccctgttgta

SEQ ID NO: 120440 - DNA, 36 bp, Artificial Sequence
  Synthetic oligonucleotide
tcccagacttcgccctgcccacgctccattgtttta

SEQ ID NO: 120441 - DNA, 35 bp, Artificial Sequence
  Synthetic oligonucleotide
aatacccgagcaccgtgcccactgcctaccgtaac

SEQ ID NO: 120442 - DNA, 35 bp, Artificial Sequence
  Synthetic oligonucleotide
tgatcacgcggctcactctcctcctctgcgatgtc

SEQ ID NO: 120443 - DNA, 35 bp, Artificial Sequence
  Synthetic oligonucleotide
ttccccatccgccccaagtccattcaccggacttc

SEQ ID NO: 120444 - DNA, 35 bp, Artificial Sequence
  Synthetic oligonucleotide
tcctgtccgccccgcttttctcgtttgacctgtct

SEQ ID NO: 120445 - DNA, 35 bp, Artificial Sequence
  Synthetic oligonucleotide
accagccctcctgttcccccttgacatcctgggtt

SEQ ID NO: 120446 - DNA, 36 bp, Artificial Sequence
  Synthetic oligonucleotide
acatcaccgacgtatagctatccctgcctgttacaa

SEQ ID NO: 120447 - DNA, 37 bp, Artificial Sequence
  Synthetic oligonucleotide
tgctccctccatcctgcaatttcgcggtcttttgaga

SEQ ID NO: 120448 - DNA, 37 bp, Artificial Sequence
  Synthetic oligonucleotide
gttgccttgcccaccatcgtatccttccttgccagga

SEQ ID NO: 120449 - DNA, 38 bp, Artificial Sequence
  Synthetic oligonucleotide
gtaacacccgatggcatagctccactccactctcatga

SEQ ID NO: 120450 - DNA, 36 bp, Artificial Sequence
  Synthetic oligonucleotide
gctatcaccgctcctggtgctcctcttacatcctga

SEQ ID NO: 120451 - DNA, 38 bp, Artificial Sequence
  Synthetic oligonucleotide
tcctccttagctgtgactcgccacttgttctatcctga

SEQ ID NO: 120452 - DNA, 38 bp, Artificial Sequence
  Synthetic oligonucleotide
actccacccagccgacgctgtcctgctcctttctctga

SEQ ID NO: 120453 - DNA, 37 bp, Artificial Sequence
  Synthetic oligonucleotide
aacctccgctcccaacagtattgcttgtactccgtga

SEQ ID NO: 120454 - DNA, 37 bp, Artificial Sequence
  Synthetic oligonucleotide
gttggagggaccgggggaggataggcgggtaaattga

SEQ ID NO: 120455 - DNA, 38 bp, Artificial Sequence
  Synthetic oligonucleotide
atgtgcctccttgttttctgtgccgcccaccttattga

SEQ ID NO: 120456 - DNA, 35 bp, Artificial Sequence
  Synthetic oligonucleotide
tctcgccctctgtgatgctacatctcgcctaccta

SEQ ID NO: 120457 - DNA, 35 bp, Artificial Sequence
  Synthetic oligonucleotide
tagccccctcttgtgtcatcccacctttatactcc

SEQ ID NO: 120458 - DNA, 35 bp, Artificial Sequence
  Synthetic oligonucleotide
attcccctaccaccatggcttaagttgtctgctcc

SEQ ID NO: 120459 - DNA, 35 bp, Artificial Sequence
  Synthetic oligonucleotide
gagagggggatagaacgtaagagggtggggacggc

SEQ ID NO: 120460 - DNA, 36 bp, Artificial Sequence
  Synthetic oligonucleotide
tcccaccctgcaccccgcactcagtacacgccttga

SEQ ID NO: 120461 - DNA, 35 bp, Artificial Sequence
  Synthetic oligonucleotide
gactgacacaatgagtcctttccctcgccacttct

SEQ ID NO: 120462 - DNA, 35 bp, Artificial Sequence
  Synthetic oligonucleotide
gctacgatcctgactgcctgctttccacccttttt

SEQ ID NO: 120463 - DNA, 36 bp, Artificial Sequence
  Synthetic oligonucleotide
ttgaaccctctatctcgcataacgccacttttacca

SEQ ID NO: 120464 - DNA, 35 bp, Artificial Sequence
  Synthetic oligonucleotide
atcgcacctcccgacactttccgaccggtagtacc

SEQ ID NO: 120465 - DNA, 35 bp, Artificial Sequence
  Synthetic oligonucleotide
atcagcaacggcgcgtactacttcctcaccccgcc

SEQ ID NO: 120466 - DNA, 35 bp, Artificial Sequence
  Synthetic oligonucleotide
gactccatacaccccccgaacagccactttcgtgc

SEQ ID NO: 120467 - DNA, 35 bp, Artificial Sequence
  Synthetic oligonucleotide
agcgcaaactgcagtgtcctccttggttgcccctc

SEQ ID NO: 120468 - DNA, 35 bp, Artificial Sequence
  Synthetic oligonucleotide
gatcacgtctaggctctctttataccaccctactg

SEQ ID NO: 120469 - DNA, 35 bp, Artificial Sequence
  Synthetic oligonucleotide
actgtacctctcctgcccatgccgcttagtatcca

SEQ ID NO: 120470 - DNA, 35 bp, Artificial Sequence
  Synthetic oligonucleotide
gcctgcctccgttcttgccttgcacttcgacatca

SEQ ID NO: 120471 - DNA, 37 bp, Artificial Sequence
  Synthetic oligonucleotide
acaacacgtcacaaccctgcccccacacaccactgga

SEQ ID NO: 120472 - DNA, 35 bp, Artificial Sequence
  Synthetic oligonucleotide
agcgggagggaggtggggggacgggtcgattagta

SEQ ID NO: 120473 - DNA, 35 bp, Artificial Sequence
  Synthetic oligonucleotide
gaacatgtctggtcgctccttagccttcctctcac

SEQ ID NO: 120474 - DNA, 35 bp, Artificial Sequence
  Synthetic oligonucleotide
gtagtcaggtcacgctccattattgcccttttgtc

SEQ ID NO: 120475 - DNA, 35 bp, Artificial Sequence
  Synthetic oligonucleotide
aatcgacaccagcgttgtttcgtacccgttccctg

SEQ ID NO: 120476 - DNA, 35 bp, Artificial Sequence
  Synthetic oligonucleotide
gtggagggggattgagggaaatggaggaagcaggt

SEQ ID NO: 120477 - DNA, 36 bp, Artificial Sequence
  Synthetic oligonucleotide
ggtccgcccctccaccttttggcgcccttctttgga

SEQ ID NO: 120478 - DNA, 36 bp, Artificial Sequence
  Synthetic oligonucleotide
tccgcccacgcctctgttatgtccccccgcacgcta

SEQ ID NO: 120479 - DNA, 36 bp, Artificial Sequence
  Synthetic oligonucleotide
tgccccttcacctgattgcatgcttcttccgcggta

SEQ ID NO: 120480 - DNA, 35 bp, Artificial Sequence
  Synthetic oligonucleotide
ttgacgtccgtggctatcccatctccgctccatgc

SEQ ID NO: 120481 - DNA, 35 bp, Artificial Sequence
  Synthetic oligonucleotide
tacgctgtccagcaactcatccacctgcttcccat

SEQ ID NO: 120482 - DNA, 35 bp, Artificial Sequence
  Synthetic oligonucleotide
gtgttcgcgccgccatatataatctaccgtcctct

SEQ ID NO: 120483 - DNA, 35 bp, Artificial Sequence
  Synthetic oligonucleotide
tcacatcgtagcgcctttatacgtcccatcactgt

SEQ ID NO: 120484 - DNA, 35 bp, Artificial Sequence
  Synthetic oligonucleotide
tttccaccgcaaccggtatgcgcgctttagccctt

SEQ ID NO: 120485 - DNA, 38 bp, Artificial Sequence
  Synthetic oligonucleotide
tctgtcctgcctccatcgtattcccgctgccaatatga

SEQ ID NO: 120486 - DNA, 35 bp, Artificial Sequence
  Synthetic oligonucleotide
actcccccaccgaatcgctgtttcaatcacaagcc

SEQ ID NO: 120487 - DNA, 35 bp, Artificial Sequence
  Synthetic oligonucleotide
tgtccggtcgatggaatgtacaccctctcaccgcc

SEQ ID NO: 120488 - DNA, 35 bp, Artificial Sequence
  Synthetic oligonucleotide
tgagaccgactaggtacattgcccttctgttttcc

SEQ ID NO: 120489 - DNA, 35 bp, Artificial Sequence
  Synthetic oligonucleotide
gaccaccccttcagcaccgttcatctctcatctgc

SEQ ID NO: 120490 - DNA, 35 bp, Artificial Sequence
  Synthetic oligonucleotide
tactcctactccgtgcgtttagccttctgtttcat

SEQ ID NO: 120491 - DNA, 35 bp, Artificial Sequence
  Synthetic oligonucleotide
tcccaccgccccatctttgcatatgccctgccact

SEQ ID NO: 120492 - DNA, 35 bp, Artificial Sequence
  Synthetic oligonucleotide
tgctacgcacatatagattttgcccctccgcgcct

SEQ ID NO: 120493 - DNA, 36 bp, Artificial Sequence
  Synthetic oligonucleotide
tacctcgccctcttctgtccttgcaggtccacgcta

SEQ ID NO: 120494 - DNA, 35 bp, Artificial Sequence
  Synthetic oligonucleotide
ggacactctcacaagctctgtactaccccccttta

SEQ ID NO: 120495 - DNA, 35 bp, Artificial Sequence
  Synthetic oligonucleotide
atcaaacctccgactgaccgtccggcttaacaccc

SEQ ID NO: 120496 - DNA, 35 bp, Artificial Sequence
  Synthetic oligonucleotide
tttgccctactcgctgcggtgctcctctattcgcc

SEQ ID NO: 120497 - DNA, 35 bp, Artificial Sequence
  Synthetic oligonucleotide
gattgcacgttcccttatgctcctggctacgttcc

SEQ ID NO: 120498 - DNA, 35 bp, Artificial Sequence
  Synthetic oligonucleotide
gcaaacacgcctcttgctacgacatccctctccgc

SEQ ID NO: 120499 - DNA, 35 bp, Artificial Sequence
  Synthetic oligonucleotide
tctccgcacacatttctgcagcctacgctctaccg

SEQ ID NO: 120500 - DNA, 35 bp, Artificial Sequence
  Synthetic oligonucleotide
gatgccttccaagacgtgtcctccatcaccctgct

SEQ ID NO: 120501 - DNA, 35 bp, Artificial Sequence
  Synthetic oligonucleotide
tcccgttgccgtacatgcccacgtcgaccaattct

SEQ ID NO: 120502 - DNA, 35 bp, Artificial Sequence
  Synthetic oligonucleotide
gaagagggggctagtgagggatggtgcaggcgggt

SEQ ID NO: 120503 - DNA, 36 bp, Artificial Sequence
  Synthetic oligonucleotide
tctgcagtccgttgtctgcctgcacactgccttcca

SEQ ID NO: 120504 - DNA, 37 bp, Artificial Sequence
  Synthetic oligonucleotide
taagcggaggggtttagggcgggagggaacgaggcga

SEQ ID NO: 120505 - DNA, 37 bp, Artificial Sequence
  Synthetic oligonucleotide
atgaacacgggtggaacagggtagagggtggagggga

SEQ ID NO: 120506 - DNA, 38 bp, Artificial Sequence
  Synthetic oligonucleotide
atgagagacgggcgatagagagaggccgggatggatga

SEQ ID NO: 120507 - DNA, 35 bp, Artificial Sequence
  Synthetic oligonucleotide
attcccgagatgtcctcctgcctatgtttgtcccg

SEQ ID NO: 120508 - DNA, 35 bp, Artificial Sequence
  Synthetic oligonucleotide
actttcccgtagcctggcgtacttccgagccccat

SEQ ID NO: 120509 - DNA, 34 bp, Artificial Sequence
  Synthetic oligonucleotide
tctgccctccaatatgcctccaccgtgcgtgaaa

SEQ ID NO: 120510 - DNA, 36 bp, Artificial Sequence
  Synthetic oligonucleotide
ttgtcaacgctatccctgttgcgcactcccctccca

SEQ ID NO: 120511 - DNA, 36 bp, Artificial Sequence
  Synthetic oligonucleotide
atgtcgggggggaaggggtaccagatagggggatta

SEQ ID NO: 120512 - DNA, 35 bp, Artificial Sequence
  Synthetic oligonucleotide
gcccgacgccgcatctcgtcctagcccatcgtgac

SEQ ID NO: 120513 - DNA, 35 bp, Artificial Sequence
  Synthetic oligonucleotide
gcccagctctgctttgcgtcccttggtctatcgcc

SEQ ID NO: 120514 - DNA, 35 bp, Artificial Sequence
  Synthetic oligonucleotide
gtcgaccaatgagatgctgtgcacccctccccctc

SEQ ID NO: 120515 - DNA, 35 bp, Artificial Sequence
  Synthetic oligonucleotide
tccgctagaggccgcctgtccgttgccatcttcct

SEQ ID NO: 120516 - DNA, 35 bp, Artificial Sequence
  Synthetic oligonucleotide
tatcctcacccgctggagctaccccgtccctgtct

SEQ ID NO: 120517 - DNA, 35 bp, Artificial Sequence
  Synthetic oligonucleotide
tactcccgcccttgggatggttcgatcttcctgtt

SEQ ID NO: 120518 - DNA, 36 bp, Artificial Sequence
  Synthetic oligonucleotide
tcactgtactgccccttgccctctttggagacagaa

SEQ ID NO: 120519 - DNA, 32 bp, Artificial Sequence
  Synthetic oligonucleotide
gtatcgcccctctcagtctcccaacacttaca

SEQ ID NO: 120520 - DNA, 36 bp, Artificial Sequence
  Synthetic oligonucleotide
gtctgaccacaatccggtatggaccccgccctctca

SEQ ID NO: 120521 - DNA, 37 bp, Artificial Sequence
  Synthetic oligonucleotide
acaagcatccaccggtttcgtgttctacccccctcga

SEQ ID NO: 120522 - DNA, 38 bp, Artificial Sequence
  Synthetic oligonucleotide
tccccgtcacatctcgtactctgcaccttttcttgtga

SEQ ID NO: 120523 - DNA, 38 bp, Artificial Sequence
  Synthetic oligonucleotide
gcaacactctgccggcctctatctgccaccacgcttga

SEQ ID NO: 120524 - DNA, 35 bp, Artificial Sequence
  Synthetic oligonucleotide
gaacctagcgtagacagctctatattgcccccccc

SEQ ID NO: 120525 - DNA, 35 bp, Artificial Sequence
  Synthetic oligonucleotide
gctggtcctaagcagcccgtattttcacactcgcc

SEQ ID NO: 120526 - DNA, 35 bp, Artificial Sequence
  Synthetic oligonucleotide
atcatcccgcccacgcctttcctttgaggttgtct

SEQ ID NO: 120527 - DNA, 35 bp, Artificial Sequence
  Synthetic oligonucleotide
ttaccgccctctgccgtacccttcgatattcttgt

SEQ ID NO: 120528 - DNA, 37 bp, Artificial Sequence
  Synthetic oligonucleotide
gagagccaaggaggaaaaggtcggacagagatggaga

SEQ ID NO: 120529 - DNA, 37 bp, Artificial Sequence
  Synthetic oligonucleotide
gggggaggcgaggggtgatgattaagggcggcaacga

SEQ ID NO: 120530 - DNA, 36 bp, Artificial Sequence
  Synthetic oligonucleotide
acttcccgccgtatatctattgccccgacatcccga

SEQ ID NO: 120531 - DNA, 38 bp, Artificial Sequence
  Synthetic oligonucleotide
gtagcacgctgcgtacgccctgcactgccctaacttga

SEQ ID NO: 120532 - DNA, 35 bp, Artificial Sequence
  Synthetic oligonucleotide
tgtgcccacatcgcgctgtagtcccggctttactc

SEQ ID NO: 120533 - DNA, 35 bp, Artificial Sequence
  Synthetic oligonucleotide
tgcaaccttcgccctcttggccacatgcgcacctc

SEQ ID NO: 120534 - DNA, 35 bp, Artificial Sequence
  Synthetic oligonucleotide
tccacacttccacttttgttctcatgtcgccctcg

SEQ ID NO: 120535 - DNA, 35 bp, Artificial Sequence
  Synthetic oligonucleotide
tctggcggagggggctggctcacggggtggatggt

SEQ ID NO: 120536 - DNA, 35 bp, Artificial Sequence
  Synthetic oligonucleotide
tcaaccatctggcggtcttgacacctctcgtacca

SEQ ID NO: 120537 - DNA, 38 bp, Artificial Sequence
  Synthetic oligonucleotide
gcgtggaccgcaggtagggggggaggcgagggaggtga

SEQ ID NO: 120538 - DNA, 34 bp, Artificial Sequence
  Synthetic oligonucleotide
attggtcacactgtaacccgcccgccctctgtcc

SEQ ID NO: 120539 - DNA, 35 bp, Artificial Sequence
  Synthetic oligonucleotide
tctgcatggccagtctctccaccgttcgccactct

SEQ ID NO: 120540 - DNA, 35 bp, Artificial Sequence
  Synthetic oligonucleotide
acggaccactgctcgctccttgtcactccgccgtt

SEQ ID NO: 120541 - DNA, 36 bp, Artificial Sequence
  Synthetic oligonucleotide
acgatgggtagggtgggaaaccgtccgggccaacca

SEQ ID NO: 120542 - DNA, 38 bp, Artificial Sequence
  Synthetic oligonucleotide
gggaaagagagggaagggtaaggaagtggagatagtga

SEQ ID NO: 120543 - DNA, 37 bp, Artificial Sequence
  Synthetic oligonucleotide
tttgtgtgtacgctgcttatcccctcctgtcccgtga

SEQ ID NO: 120544 - DNA, 36 bp, Artificial Sequence
  Synthetic oligonucleotide
gccttgccgggtgggtgggtgagggccctcgtagta

SEQ ID NO: 120545 - DNA, 35 bp, Artificial Sequence
  Synthetic oligonucleotide
gcccggcctccctcgagttcttctgacatttacac

SEQ ID NO: 120546 - DNA, 34 bp, Artificial Sequence
  Synthetic oligonucleotide
tgacttatggggggcaagggagggaaggggcgtg

SEQ ID NO: 120547 - DNA, 35 bp, Artificial Sequence
  Synthetic oligonucleotide
gtgcggacatctgcccttcctctacgcactgtgct

SEQ ID NO: 120548 - DNA, 35 bp, Artificial Sequence
  Synthetic oligonucleotide
gcgagagggtaaggaatggcggcaagggggtaagt

SEQ ID NO: 120549 - DNA, 35 bp, Artificial Sequence
  Synthetic oligonucleotide
gaaccatccctctgttgcttacctcccgctacgtt

SEQ ID NO: 120550 - DNA, 36 bp, Artificial Sequence
  Synthetic oligonucleotide
taactcgccactgagccccatgcccttccaccgaaa

SEQ ID NO: 120551 - DNA, 37 bp, Artificial Sequence
  Synthetic oligonucleotide
gcaggacggtgcagggggagggtagtagggaggtaga

SEQ ID NO: 120552 - DNA, 37 bp, Artificial Sequence
  Synthetic oligonucleotide
agtccacctcactacctcttcatccacagtcgcacga

SEQ ID NO: 120553 - DNA, 36 bp, Artificial Sequence
  Synthetic oligonucleotide
ttcgttcccctcccctgtattacggctcccttgcga

SEQ ID NO: 120554 - DNA, 36 bp, Artificial Sequence
  Synthetic oligonucleotide
tcccccaccgccctactgcctacaggtctctcggga

SEQ ID NO: 120555 - DNA, 36 bp, Artificial Sequence
  Synthetic oligonucleotide
ggtgggagggttggaacggggcagggggggaatgta

SEQ ID NO: 120556 - DNA, 35 bp, Artificial Sequence
  Synthetic oligonucleotide
gccgcacctccccactgctttcgctatccgacacc

SEQ ID NO: 120557 - DNA, 35 bp, Artificial Sequence
  Synthetic oligonucleotide
ttcgccacttcgtcgcgttactgccccctcccacg

SEQ ID NO: 120558 - DNA, 35 bp, Artificial Sequence
  Synthetic oligonucleotide
gtggggggaggaagacgaattgagcagggctgggg

SEQ ID NO: 120559 - DNA, 35 bp, Artificial Sequence
  Synthetic oligonucleotide
tgaacaacgaccccgctcccgcctgctttggttct

SEQ ID NO: 120560 - DNA, 35 bp, Artificial Sequence
  Synthetic oligonucleotide
gactaccacggtggcccatagactttcctccccca

SEQ ID NO: 120561 - DNA, 36 bp, Artificial Sequence
  Synthetic oligonucleotide
tctccgccactcgagtgatcgtgcctccacctgcca

SEQ ID NO: 120562 - DNA, 35 bp, Artificial Sequence
  Synthetic oligonucleotide
gcatcatcccctactgttgccgcccgccacctgga

SEQ ID NO: 120563 - DNA, 37 bp, Artificial Sequence
  Synthetic oligonucleotide
acgctccctctgcggttatttctttcgccttccgtga

SEQ ID NO: 120564 - DNA, 37 bp, Artificial Sequence
  Synthetic oligonucleotide
aacccgccgctacctctggccctcgcaccatccttga

SEQ ID NO: 120565 - DNA, 35 bp, Artificial Sequence
  Synthetic oligonucleotide
gccccacgccccaaagccaaccatgtccgtttgcc

SEQ ID NO: 120566 - DNA, 35 bp, Artificial Sequence
  Synthetic oligonucleotide
ggttgtgctgcccccggacacagtttcctcttctc

SEQ ID NO: 120567 - DNA, 35 bp, Artificial Sequence
  Synthetic oligonucleotide
gccgtgcccactctccgtctacaagacactcattc

SEQ ID NO: 120568 - DNA, 35 bp, Artificial Sequence
  Synthetic oligonucleotide
gtaaagacagcctcccatccccgcccccagcactg

SEQ ID NO: 120569 - DNA, 35 bp, Artificial Sequence
  Synthetic oligonucleotide
tcccctacgacccacgttcgcccgttaggacctct

SEQ ID NO: 120570 - DNA, 35 bp, Artificial Sequence
  Synthetic oligonucleotide
gatggctgctatcccgtgccgtcccttgcctctca

SEQ ID NO: 120571 - DNA, 37 bp, Artificial Sequence
  Synthetic oligonucleotide
gccaggggtaggggagggaagttgggaccggggcaga

SEQ ID NO: 120572 - DNA, 38 bp, Artificial Sequence
  Synthetic oligonucleotide
ggggggccgaaacaggagggggcaaagcgaaggtctga

SEQ ID NO: 120573 - DNA, 32 bp, Artificial Sequence
  Synthetic oligonucleotide
atggttccaccgatcccctgttctccttgcgc

SEQ ID NO: 120574 - DNA, 35 bp, Artificial Sequence
  Synthetic oligonucleotide
gatcaggtcctccccctccgtgaactggcatactc

SEQ ID NO: 120575 - DNA, 35 bp, Artificial Sequence
  Synthetic oligonucleotide
tcaccgacaccccgcctcgccattgcactcttgat

SEQ ID NO: 120576 - DNA, 33 bp, Artificial Sequence
  Synthetic oligonucleotide
tcccgcctcacaatgcattgccactcatccgtt

SEQ ID NO: 120577 - DNA, 35 bp, Artificial Sequence
  Synthetic oligonucleotide
acccactcccgcccactatctcagttgcaagcgca

SEQ ID NO: 120578 - DNA, 37 bp, Artificial Sequence
  Synthetic oligonucleotide
atgggagggctaaagcacgaggaaaaagggtgggtga

SEQ ID NO: 120579 - DNA, 35 bp, Artificial Sequence
  Synthetic oligonucleotide
tgtcccccatctgtggtgcctcccgtatggttttc

SEQ ID NO: 120580 - DNA, 35 bp, Artificial Sequence
  Synthetic oligonucleotide
gatcacgagggggaatgggttagggagggaagggg

SEQ ID NO: 120581 - DNA, 35 bp, Artificial Sequence
  Synthetic oligonucleotide
gcccatttcagccaccctgttttcctaccattgtg

SEQ ID NO: 120582 - DNA, 35 bp, Artificial Sequence
  Synthetic oligonucleotide
gcatcaacgccctcactccccctttacggtctgtt

SEQ ID NO: 120583 - DNA, 37 bp, Artificial Sequence
  Synthetic oligonucleotide
gtggggtgcagagggcaagtaggggggcggcttggga

SEQ ID NO: 120584 - DNA, 37 bp, Artificial Sequence
  Synthetic oligonucleotide
tgcgactccgcagccttactcactctagccttcctga

SEQ ID NO: 120585 - DNA, 37 bp, Artificial Sequence
  Synthetic oligonucleotide
ggtcgtgggagggaatggggacgggatgacaaggtga

SEQ ID NO: 120586 - DNA, 38 bp, Artificial Sequence
  Synthetic oligonucleotide
gaaaggaaggcaaaggggggaaaatgggcacaggttga

SEQ ID NO: 120587 - DNA, 35 bp, Artificial Sequence
  Synthetic oligonucleotide
gcgatgtggccggtctcttacctctgttgtcccta

SEQ ID NO: 120588 - DNA, 35 bp, Artificial Sequence
  Synthetic oligonucleotide
gctgccattcttcgctctgtccgctaacacccgta

SEQ ID NO: 120589 - DNA, 35 bp, Artificial Sequence
  Synthetic oligonucleotide
gttggcaagcaccctgctttatccttccgctccgc

SEQ ID NO: 120590 - DNA, 35 bp, Artificial Sequence
  Synthetic oligonucleotide
gccccgaggcagtcagcccgctcccacaacatcgc

SEQ ID NO: 120591 - DNA, 35 bp, Artificial Sequence
  Synthetic oligonucleotide
agcggaccgcccgccactcacatcgctctctgaat

SEQ ID NO: 120592 - DNA, 35 bp, Artificial Sequence
  Synthetic oligonucleotide
gccctcctccgtgccattttgtcgatacggagtat

SEQ ID NO: 120593 - DNA, 35 bp, Artificial Sequence
  Synthetic oligonucleotide
tacgccccaaccctgttccttttcagccgtactct

SEQ ID NO: 120594 - DNA, 36 bp, Artificial Sequence
  Synthetic oligonucleotide
gcacgccccgctcccctatgcattatgggctcccaa

SEQ ID NO: 120595 - DNA, 36 bp, Artificial Sequence
  Synthetic oligonucleotide
gtgtcccccgcccgttccttcccgtgctcctataca

SEQ ID NO: 120596 - DNA, 37 bp, Artificial Sequence
  Synthetic oligonucleotide
gcaccacaccgccactccctcccttgacacttgtaga

SEQ ID NO: 120597 - DNA, 34 bp, Artificial Sequence
  Synthetic oligonucleotide
gtacccacaccttccatgtcgctcgcccccccga

SEQ ID NO: 120598 - DNA, 37 bp, Artificial Sequence
  Synthetic oligonucleotide
agctgcaaagcgggtcacgagggggggaggtggagga

SEQ ID NO: 120599 - DNA, 38 bp, Artificial Sequence
  Synthetic oligonucleotide
acccccctcatcctgtatcatgcctgcgcaccctctga

SEQ ID NO: 120600 - DNA, 35 bp, Artificial Sequence
  Synthetic oligonucleotide
atccgcgccacataattcgtgcaccctctttttac

SEQ ID NO: 120601 - DNA, 35 bp, Artificial Sequence
  Synthetic oligonucleotide
cccgccctccgaaccgccgacggcatcaacccccc

SEQ ID NO: 120602 - DNA, 35 bp, Artificial Sequence
  Synthetic oligonucleotide
tatcactcaccgctcggttttgcctctactggtcc

SEQ ID NO: 120603 - DNA, 38 bp, Artificial Sequence
  Synthetic oligonucleotide
tagcacgcttacatctggtacgccctcgccctctatga

SEQ ID NO: 120604 - DNA, 37 bp, Artificial Sequence
  Synthetic oligonucleotide
aactccgcccatacctggtttttgcacttgtccctga

SEQ ID NO: 120605 - DNA, 38 bp, Artificial Sequence
  Synthetic oligonucleotide
gccctctcgactcccatgcccacgctcctgtctcgtga

SEQ ID NO: 120606 - DNA, 35 bp, Artificial Sequence
  Synthetic oligonucleotide
tcaaccccctttgtgctcctgttttcaccgcaatc

SEQ ID NO: 120607 - DNA, 35 bp, Artificial Sequence
  Synthetic oligonucleotide
gcaggctcccgcctcgatcctttgcccgacacatc

SEQ ID NO: 120608 - DNA, 35 bp, Artificial Sequence
  Synthetic oligonucleotide
accgggaggggagtggcggggagcagcgagaaaag

SEQ ID NO: 120609 - DNA, 35 bp, Artificial Sequence
  Synthetic oligonucleotide
taccccctgcactgctcgacccgcctgtacccgtg

SEQ ID NO: 120610 - DNA, 35 bp, Artificial Sequence
  Synthetic oligonucleotide
acctgtcctgccgccttagtacatgttcctatttg

SEQ ID NO: 120611 - DNA, 35 bp, Artificial Sequence
  Synthetic oligonucleotide
gtgcgtgttgtccatttgttcctgcctgtccttgt

SEQ ID NO: 120612 - DNA, 35 bp, Artificial Sequence
  Synthetic oligonucleotide
gactccccactcgccgcgctagctactggccacca

SEQ ID NO: 120613 - DNA, 36 bp, Artificial Sequence
  Synthetic oligonucleotide
ggaggatgtgaggtggtacgggggtgagggggggca

SEQ ID NO: 120614 - DNA, 38 bp, Artificial Sequence
  Synthetic oligonucleotide
acgccctgtaacatcctgtaccgtgtactttcctttga

SEQ ID NO: 120615 - DNA, 35 bp, Artificial Sequence
  Synthetic oligonucleotide
gccagacctgcaatacgcctccttagcccgcgctc

SEQ ID NO: 120616 - DNA, 35 bp, Artificial Sequence
  Synthetic oligonucleotide
tccccctctcgtgctcatgaccaaccactatgctc

SEQ ID NO: 120617 - DNA, 35 bp, Artificial Sequence
  Synthetic oligonucleotide
tacgtcccgccctctcggtctttcggactctttcg

SEQ ID NO: 120618 - DNA, 35 bp, Artificial Sequence
  Synthetic oligonucleotide
aaaggaaggggggttggcatgggagggtggcaaat

SEQ ID NO: 120619 - DNA, 35 bp, Artificial Sequence
  Synthetic oligonucleotide
atcgtcaccactcgggtctctctacagttgctcct

SEQ ID NO: 120620 - DNA, 35 bp, Artificial Sequence
  Synthetic oligonucleotide
ttcatcccccattgtttgcagacctcgccctccgt

SEQ ID NO: 120621 - DNA, 36 bp, Artificial Sequence
  Synthetic oligonucleotide
gccacgtgtcggtcgcctccgccctcttgccacaca

SEQ ID NO: 120622 - DNA, 35 bp, Artificial Sequence
  Synthetic oligonucleotide
ctccgcatcccttcccgagttacctgccgtgacca

SEQ ID NO: 120623 - DNA, 36 bp, Artificial Sequence
  Synthetic oligonucleotide
acaccctcacccccagatcccagacccccgtgacga

SEQ ID NO: 120624 - DNA, 37 bp, Artificial Sequence
  Synthetic oligonucleotide
ttgccgccttttcatctcgtgtttcggccccctttga

SEQ ID NO: 120625 - DNA, 36 bp, Artificial Sequence
  Synthetic oligonucleotide
tatcgccacctgctttttgctaacctctgtctatta

SEQ ID NO: 120626 - DNA, 35 bp, Artificial Sequence
  Synthetic oligonucleotide
gcccatccctcacgccgggtgctgcccattgcccc

SEQ ID NO: 120627 - DNA, 35 bp, Artificial Sequence
  Synthetic oligonucleotide
gccccacccgaggtaattcttacggtttccatgcc

SEQ ID NO: 120628 - DNA, 35 bp, Artificial Sequence
  Synthetic oligonucleotide
atgctccccgccgtacgtttgtctccctcaactgc

SEQ ID NO: 120629 - DNA, 35 bp, Artificial Sequence
  Synthetic oligonucleotide
tcgccccgcctcgttccccctgcgcataccattga

SEQ ID NO: 120630 - DNA, 34 bp, Artificial Sequence
  Synthetic oligonucleotide
gccgcctcgccactgcccgaacttttgctcaata

SEQ ID NO: 120631 - DNA, 35 bp, Artificial Sequence
  Synthetic oligonucleotide
tcatcacgcacatctaacgataccactccgccgta

SEQ ID NO: 120632 - DNA, 35 bp, Artificial Sequence
  Synthetic oligonucleotide
ccacaccctcccccaatcgcgtacaagccgaccac

SEQ ID NO: 120633 - DNA, 35 bp, Artificial Sequence
  Synthetic oligonucleotide
ttgacgccgccgaccgccgtccacctcgagactac

SEQ ID NO: 120634 - DNA, 35 bp, Artificial Sequence
  Synthetic oligonucleotide
gaacccgcgctacattccgctattcccctctgctc

SEQ ID NO: 120635 - DNA, 35 bp, Artificial Sequence
  Synthetic oligonucleotide
gtcccgccatagcctgctttcgaaaactttccccg

SEQ ID NO: 120636 - DNA, 35 bp, Artificial Sequence
  Synthetic oligonucleotide
gcactacacctccgcatccgctttcgggcccttat

SEQ ID NO: 120637 - DNA, 36 bp, Artificial Sequence
  Synthetic oligonucleotide
gccgccggtgcgggagggagggacacgtgtgtgcca

SEQ ID NO: 120638 - DNA, 36 bp, Artificial Sequence
  Synthetic oligonucleotide
aaccatccgcatcatcctcttgtactggtcttctta

SEQ ID NO: 120639 - DNA, 35 bp, Artificial Sequence
  Synthetic oligonucleotide
ttcaagcccgccccgattctgttttcgttttgcat

SEQ ID NO: 120640 - DNA, 35 bp, Artificial Sequence
  Synthetic oligonucleotide
tttgaccccctgcctcctgacctgtcgatgcatca

SEQ ID NO: 120641 - DNA, 34 bp, Artificial Sequence
  Synthetic oligonucleotide
gcgcaaacgctacgaactatatttcctggccccc

SEQ ID NO: 120642 - DNA, 35 bp, Artificial Sequence
  Synthetic oligonucleotide
tcactcgtcatggcatttcatcacactcccctttg

SEQ ID NO: 120643 - DNA, 35 bp, Artificial Sequence
  Synthetic oligonucleotide
acccaccccgaccgatcaaacatctaaggcctttt

SEQ ID NO: 120644 - DNA, 36 bp, Artificial Sequence
  Synthetic oligonucleotide
ttgacctcgtattgctgctcgtttccccaccgttca

SEQ ID NO: 120645 - DNA, 37 bp, Artificial Sequence
  Synthetic oligonucleotide
atccaccctcctcaacgcgtaaagcgcctacgcccga

SEQ ID NO: 120646 - DNA, 37 bp, Artificial Sequence
  Synthetic oligonucleotide
aggaggggaggaggtgcagggagctggcaagggagga

SEQ ID NO: 120647 - DNA, 38 bp, Artificial Sequence
  Synthetic oligonucleotide
gacacgaaagcaaggggaggagggggggataaacctga

SEQ ID NO: 120648 - DNA, 38 bp, Artificial Sequence
  Synthetic oligonucleotide
gtttcgcccacaccttgtaattgctctgttctgcctga

SEQ ID NO: 120649 - DNA, 37 bp, Artificial Sequence
  Synthetic oligonucleotide
ggggaacgaggagtggcaggagaggggggggaattga

SEQ ID NO: 120650 - DNA, 35 bp, Artificial Sequence
  Synthetic oligonucleotide
gcctccatgcaatccccgccgtgcgtatcttcgcc

SEQ ID NO: 120651 - DNA, 35 bp, Artificial Sequence
  Synthetic oligonucleotide
actcaccgacggaagttacagccatccgcaccatc

SEQ ID NO: 120652 - DNA, 35 bp, Artificial Sequence
  Synthetic oligonucleotide
gtgcatcttatgcctcgtgtctttcgttctatctc

SEQ ID NO: 120653 - DNA, 35 bp, Artificial Sequence
  Synthetic oligonucleotide
atccatgcactcccgccacccccatcgagactcct

SEQ ID NO: 120654 - DNA, 35 bp, Artificial Sequence
  Synthetic oligonucleotide
aagcccgcaaagccgggcccacctttctccccttt

SEQ ID NO: 120655 - DNA, 37 bp, Artificial Sequence
  Synthetic oligonucleotide
tggggaaacggggtggggttaaaggcatggttgggga

SEQ ID NO: 120656 - DNA, 38 bp, Artificial Sequence
  Synthetic oligonucleotide
gaagaaacgggcggaggggcgaggggaagaggtcgtga

SEQ ID NO: 120657 - DNA, 37 bp, Artificial Sequence
  Synthetic oligonucleotide
gtgtcacgccttgctcgggttttccccacttccttga

SEQ ID NO: 120658 - DNA, 35 bp, Artificial Sequence
  Synthetic oligonucleotide
acaccacactcgagccctatcccgacctgtcttgc

SEQ ID NO: 120659 - DNA, 35 bp, Artificial Sequence
  Synthetic oligonucleotide
tccaggagcgccggtccgctcgcatttgtcccatc

SEQ ID NO: 120660 - DNA, 35 bp, Artificial Sequence
  Synthetic oligonucleotide
gctccacccacagactagtcactacctggcacctt

SEQ ID NO: 120661 - DNA, 37 bp, Artificial Sequence
  Synthetic oligonucleotide
taaccccgccctcgacactacacgcctggcccatgga

SEQ ID NO: 120662 - DNA, 35 bp, Artificial Sequence
  Synthetic oligonucleotide
tgatctgaccgaagcagtatcgttcctggccttcc

SEQ ID NO: 120663 - DNA, 35 bp, Artificial Sequence
  Synthetic oligonucleotide
gcctggtgcccctctgttttttacgtctttcatgg

SEQ ID NO: 120664 - DNA, 35 bp, Artificial Sequence
  Synthetic oligonucleotide
acaccacacagccccattacgcctcagacctccca

SEQ ID NO: 120665 - DNA, 36 bp, Artificial Sequence
  Synthetic oligonucleotide
acattcctcaccggccgtgcgcttcgaacttctcca

SEQ ID NO: 120666 - DNA, 37 bp, Artificial Sequence
  Synthetic oligonucleotide
tgcaccacgattaatgttcacgtgcccttccctccga

SEQ ID NO: 120667 - DNA, 36 bp, Artificial Sequence
  Synthetic oligonucleotide
gcccccgtccgcacatgccttcgccttttcgcccta

SEQ ID NO: 120668 - DNA, 36 bp, Artificial Sequence
  Synthetic oligonucleotide
atctgaccaccctcccgcttagtgcctagtgcttta

SEQ ID NO: 120669 - DNA, 36 bp, Artificial Sequence
  Synthetic oligonucleotide
tgtgatgtgttccgtgtcttctcctgtctcgtttta

SEQ ID NO: 120670 - DNA, 35 bp, Artificial Sequence
  Synthetic oligonucleotide
ttacatccgcgcctgcccccaggcccctctgcatc

SEQ ID NO: 120671 - DNA, 35 bp, Artificial Sequence
  Synthetic oligonucleotide
tctccaaccgaccgtcctttcatcgcctttgctcg

SEQ ID NO: 120672 - DNA, 35 bp, Artificial Sequence
  Synthetic oligonucleotide
gtacccatcaccgtgtcccaccttacacgctccca

SEQ ID NO: 120673 - DNA, 36 bp, Artificial Sequence
  Synthetic oligonucleotide
gcaatccacgctaactgttttctcagcccctgtcca

SEQ ID NO: 120674 - DNA, 36 bp, Artificial Sequence
  Synthetic oligonucleotide
gagatcgcgggagggtgtgactcagggggggaagca

SEQ ID NO: 120675 - DNA, 36 bp, Artificial Sequence
  Synthetic oligonucleotide
gcaccgttcctcctcgctatagtaggcccccattca

SEQ ID NO: 120676 - DNA, 37 bp, Artificial Sequence
  Synthetic oligonucleotide
gtggggtgaaagaatggggttaaaggggtagggggga

SEQ ID NO: 120677 - DNA, 37 bp, Artificial Sequence
  Synthetic oligonucleotide
aacacaataggaggcggggaagcacaggggtggtgga

SEQ ID NO: 120678 - DNA, 35 bp, Artificial Sequence
  Synthetic oligonucleotide
gaccaccgcgattcagtcgcagtttccattcaccc

SEQ ID NO: 120679 - DNA, 35 bp, Artificial Sequence
  Synthetic oligonucleotide
actccacatcctccgcacggacagttccgttgtcc

SEQ ID NO: 120680 - DNA, 35 bp, Artificial Sequence
  Synthetic oligonucleotide
gtgtcgttcattcctggttcggtgtcgcccctgtc

SEQ ID NO: 120681 - DNA, 35 bp, Artificial Sequence
  Synthetic oligonucleotide
tctatcacagcggccaatcctgccacccgaccact

SEQ ID NO: 120682 - DNA, 36 bp, Artificial Sequence
  Synthetic oligonucleotide
gcgtaggtgtccaccccgtcactgccccttgtccca

SEQ ID NO: 120683 - DNA, 36 bp, Artificial Sequence
  Synthetic oligonucleotide
atgccatcctgttcgtgctgctccttatccctctca

SEQ ID NO: 120684 - DNA, 38 bp, Artificial Sequence
  Synthetic oligonucleotide
gcaggtggggggggtaagggtcgagatgggagggatga

SEQ ID NO: 120685 - DNA, 35 bp, Artificial Sequence
  Synthetic oligonucleotide
tcatcgcgcactcctcggggcctccttcctactga

SEQ ID NO: 120686 - DNA, 34 bp, Artificial Sequence
  Synthetic oligonucleotide
tcaaacctcatccctgcccctgaagccgtattcg

SEQ ID NO: 120687 - DNA, 35 bp, Artificial Sequence
  Synthetic oligonucleotide
gccaaccaatgggcaagatccaccgtgcacctcct

SEQ ID NO: 120688 - DNA, 35 bp, Artificial Sequence
  Synthetic oligonucleotide
tgcccgcctcacggccacccacatcgtgcctttct

SEQ ID NO: 120689 - DNA, 35 bp, Artificial Sequence
  Synthetic oligonucleotide
ggaccgaccgcccatagttgcactgctttctcaca

SEQ ID NO: 120690 - DNA, 37 bp, Artificial Sequence
  Synthetic oligonucleotide
ttgctacgtccaccttagctctcactgcccccacaga

SEQ ID NO: 120691 - DNA, 36 bp, Artificial Sequence
  Synthetic oligonucleotide
atctccccgaccgccgctttcgtgaccccgggtcta

SEQ ID NO: 120692 - DNA, 35 bp, Artificial Sequence
  Synthetic oligonucleotide
gtgtccgacgcacatactactttcacactggcttc

SEQ ID NO: 120693 - DNA, 35 bp, Artificial Sequence
  Synthetic oligonucleotide
gcatccctgttccgcccacccatgagtttcccagg

SEQ ID NO: 120694 - DNA, 36 bp, Artificial Sequence
  Synthetic oligonucleotide
tcacctccgccacggttcgtgcccaattaaactaca

SEQ ID NO: 120695 - DNA, 35 bp, Artificial Sequence
  Synthetic oligonucleotide
gtgaggaaggggggtagacaacgggtgcagaggca

SEQ ID NO: 120696 - DNA, 35 bp, Artificial Sequence
  Synthetic oligonucleotide
tctaccccgacatgccactttacctgccgttacta

SEQ ID NO: 120697 - DNA, 35 bp, Artificial Sequence
  Synthetic oligonucleotide
gaacgctcgcgcagttctgctatctccactttcac

SEQ ID NO: 120698 - DNA, 35 bp, Artificial Sequence
  Synthetic oligonucleotide
tccaaccgcttagggttgcctacgccttttcctac

SEQ ID NO: 120699 - DNA, 35 bp, Artificial Sequence
  Synthetic oligonucleotide
tcatgcatgttacgcgaagctgcaccccgcccttc

SEQ ID NO: 120700 - DNA, 35 bp, Artificial Sequence
  Synthetic oligonucleotide
gttgccccccgccttgcctaatccaaatggacatg

SEQ ID NO: 120701 - DNA, 34 bp, Artificial Sequence
  Synthetic oligonucleotide
agtaagcggcacaatcgcttctgtctccgccctg

SEQ ID NO: 120702 - DNA, 35 bp, Artificial Sequence
  Synthetic oligonucleotide
gacgttgctgtaccgtttcgtttttttgttgcctg

SEQ ID NO: 120703 - DNA, 35 bp, Artificial Sequence
  Synthetic oligonucleotide
gccacgctcctctcctgccacgcctggttatccct

SEQ ID NO: 120704 - DNA, 35 bp, Artificial Sequence
  Synthetic oligonucleotide
ttccgcccggcctacacgttcattacctacttcgt

SEQ ID NO: 120705 - DNA, 35 bp, Artificial Sequence
  Synthetic oligonucleotide
tgcatccaccgttacattgacccccccttctatgt

SEQ ID NO: 120706 - DNA, 36 bp, Artificial Sequence
  Synthetic oligonucleotide
gatgccccgctctctattttcgattgaaccgcccca

SEQ ID NO: 120707 - DNA, 37 bp, Artificial Sequence
  Synthetic oligonucleotide
gggtggtggtctgggggacggaggtgggtgaccggga

SEQ ID NO: 120708 - DNA, 35 bp, Artificial Sequence
  Synthetic oligonucleotide
acacaggccgttgtttccgcccttcatttaatgga

SEQ ID NO: 120709 - DNA, 36 bp, Artificial Sequence
  Synthetic oligonucleotide
gacatcctccgccgagggcctttgctccacgtttta

SEQ ID NO: 120710 - DNA, 35 bp, Artificial Sequence
  Synthetic oligonucleotide
gtaagtgccctcattctgtacccgtgcctccctac

SEQ ID NO: 120711 - DNA, 35 bp, Artificial Sequence
  Synthetic oligonucleotide
gaacaggccctcactgtgcacgcgtatcctatccc

SEQ ID NO: 120712 - DNA, 35 bp, Artificial Sequence
  Synthetic oligonucleotide
ttacccccctccggatgtctactattctccctgaa

SEQ ID NO: 120713 - DNA, 37 bp, Artificial Sequence
  Synthetic oligonucleotide
aaccatgacacaggtgcgggggagggagggtttgcga

SEQ ID NO: 120714 - DNA, 37 bp, Artificial Sequence
  Synthetic oligonucleotide
gaacagttgcaaagcggagaggagggcggggcgcgga

SEQ ID NO: 120715 - DNA, 35 bp, Artificial Sequence
  Synthetic oligonucleotide
aaccaccccagcaatactcccacggtcgtgcctac

SEQ ID NO: 120716 - DNA, 35 bp, Artificial Sequence
  Synthetic oligonucleotide
gtgtccgcacgatgttgctctgtccttggccccgt

SEQ ID NO: 120717 - DNA, 37 bp, Artificial Sequence
  Synthetic oligonucleotide
ggggagtaggggaaggaggaggggatgacgggccaga

SEQ ID NO: 120718 - DNA, 36 bp, Artificial Sequence
  Synthetic oligonucleotide
gcacgatcgggcgcgtgctacctcccctgttccata

SEQ ID NO: 120719 - DNA, 35 bp, Artificial Sequence
  Synthetic oligonucleotide
gagagggtgaaaagggtgagagaagtcgtcatgag

SEQ ID NO: 120720 - DNA, 35 bp, Artificial Sequence
  Synthetic oligonucleotide
ccttcgccactgactgttcgcaacccgccttttag

SEQ ID NO: 120721 - DNA, 35 bp, Artificial Sequence
  Synthetic oligonucleotide
gacgcccctcatttctttcctgcccgccctgtacg

SEQ ID NO: 120722 - DNA, 35 bp, Artificial Sequence
  Synthetic oligonucleotide
gccagggcgtggaggtgggggggaggggtctagtg

SEQ ID NO: 120723 - DNA, 35 bp, Artificial Sequence
  Synthetic oligonucleotide
gagcaacaggccggagagtaagggggggtggtgat

SEQ ID NO: 120724 - DNA, 35 bp, Artificial Sequence
  Synthetic oligonucleotide
tgtgcactcctgtgatacgccgcttccttaccttt

SEQ ID NO: 120725 - DNA, 37 bp, Artificial Sequence
  Synthetic oligonucleotide
tactggtcagggcgggaagggaaaggtatggggagga

SEQ ID NO: 120726 - DNA, 37 bp, Artificial Sequence
  Synthetic oligonucleotide
aagaagagagaggtggggaggtgaggcatacagggga

SEQ ID NO: 120727 - DNA, 38 bp, Artificial Sequence
  Synthetic oligonucleotide
ggtagaacaggggagggagggcatcacatccgggatga

SEQ ID NO: 120728 - DNA, 35 bp, Artificial Sequence
  Synthetic oligonucleotide
ttccacagcgcgactctacgttaccctccgctacc

SEQ ID NO: 120729 - DNA, 35 bp, Artificial Sequence
  Synthetic oligonucleotide
tctgttcaacgtccgtcccgtctcttctctttgtc

SEQ ID NO: 120730 - DNA, 35 bp, Artificial Sequence
  Synthetic oligonucleotide
tccgcttctcccagcactatccactggccactccg

SEQ ID NO: 120731 - DNA, 35 bp, Artificial Sequence
  Synthetic oligonucleotide
tgcacctcccttgtccgcgggttgccccttgtgcg

SEQ ID NO: 120732 - DNA, 36 bp, Artificial Sequence
  Synthetic oligonucleotide
gtggggcacgggagggagggtgtacccctggaccaa

SEQ ID NO: 120733 - DNA, 36 bp, Artificial Sequence
  Synthetic oligonucleotide
tttcagcccgcctttctgttttactacacttcatca

SEQ ID NO: 120734 - DNA, 37 bp, Artificial Sequence
  Synthetic oligonucleotide
gagggggaacgtaacaagggcgggttggaaacgggga

SEQ ID NO: 120735 - DNA, 38 bp, Artificial Sequence
  Synthetic oligonucleotide
gatggggagtactgtgaggggattgggcgggggactga

SEQ ID NO: 120736 - DNA, 38 bp, Artificial Sequence
  Synthetic oligonucleotide
tcccccaccccgtcgctcgcattgcggacaccctctga

SEQ ID NO: 120737 - DNA, 35 bp, Artificial Sequence
  Synthetic oligonucleotide
ttccacccaaatgtcgtacctctatctgcttcacc

SEQ ID NO: 120738 - DNA, 35 bp, Artificial Sequence
  Synthetic oligonucleotide
ttcgccccccaccttagtatggtccaccgcctggg

SEQ ID NO: 120739 - DNA, 35 bp, Artificial Sequence
  Synthetic oligonucleotide
ttccgccgtcctcctgtctcatgcgtgatgtgcct

SEQ ID NO: 120740 - DNA, 36 bp, Artificial Sequence
  Synthetic oligonucleotide
accagccgctgcccgttctgtgccttcctctcgcca

SEQ ID NO: 120741 - DNA, 36 bp, Artificial Sequence
  Synthetic oligonucleotide
atgctcgctcgatcctcttagctccatcgtttctca

SEQ ID NO: 120742 - DNA, 35 bp, Artificial Sequence
  Synthetic oligonucleotide
gtcgtgtctccacctgttctgtttcgactccttca

SEQ ID NO: 120743 - DNA, 37 bp, Artificial Sequence
  Synthetic oligonucleotide
gactcgctgtctcatgctcttcatttgcgcccaccga

SEQ ID NO: 120744 - DNA, 37 bp, Artificial Sequence
  Synthetic oligonucleotide
gagagggcgggagggagctggctattgattgggttga

SEQ ID NO: 120745 - DNA, 35 bp, Artificial Sequence
  Synthetic oligonucleotide
caagggggggacagggaggggagaacggaggggta

SEQ ID NO: 120746 - DNA, 35 bp, Artificial Sequence
  Synthetic oligonucleotide
gcatcaccacagtcttctctctgctccccgcttta

SEQ ID NO: 120747 - DNA, 35 bp, Artificial Sequence
  Synthetic oligonucleotide
actcattgtagccttgttttcgtttcgcccctagc

SEQ ID NO: 120748 - DNA, 35 bp, Artificial Sequence
  Synthetic oligonucleotide
tctgcctccctatcatgaacgccgtaaccctgccg

SEQ ID NO: 120749 - DNA, 35 bp, Artificial Sequence
  Synthetic oligonucleotide
tccttggtcggtcgccattgcgcattctggccctt

SEQ ID NO: 120750 - DNA, 35 bp, Artificial Sequence
  Synthetic oligonucleotide
actcccactgcgccctgtttaattgccaccccgtt

SEQ ID NO: 120751 - DNA, 38 bp, Artificial Sequence
  Synthetic oligonucleotide
tttggggcgggtagggaggggcctgtgcccgactatga

SEQ ID NO: 120752 - DNA, 35 bp, Artificial Sequence
  Synthetic oligonucleotide
gctagcactgccgtgttcaacccccgccgtaccgc

SEQ ID NO: 120753 - DNA, 35 bp, Artificial Sequence
  Synthetic oligonucleotide
acgactacgcactgcggtaattccttggtcttctc

SEQ ID NO: 120754 - DNA, 35 bp, Artificial Sequence
  Synthetic oligonucleotide
ccacacccaaagcgcgtccagtcctccgcctgttc

SEQ ID NO: 120755 - DNA, 35 bp, Artificial Sequence
  Synthetic oligonucleotide
tccgctccgttttttctgactcccgttgccgctcg

SEQ ID NO: 120756 - DNA, 35 bp, Artificial Sequence
  Synthetic oligonucleotide
taactgtgcccctccaaacttgatacgaccacctg

SEQ ID NO: 120757 - DNA, 37 bp, Artificial Sequence
  Synthetic oligonucleotide
gcacacgcctctcacggccagcctgcctcctgtcgga

SEQ ID NO: 120758 - DNA, 36 bp, Artificial Sequence
  Synthetic oligonucleotide
tgtccacagtcctcatgtcgtccgcactcccgctta

SEQ ID NO: 120759 - DNA, 34 bp, Artificial Sequence
  Synthetic oligonucleotide
aacctcctgcccgctattagtccatcacgcgtta

SEQ ID NO: 120760 - DNA, 35 bp, Artificial Sequence
  Synthetic oligonucleotide
agctcaccctgcactgtcactcccaagcccagccc

SEQ ID NO: 120761 - DNA, 35 bp, Artificial Sequence
  Synthetic oligonucleotide
tccagctacattactgtaaactgatcctcgcctcc

SEQ ID NO: 120762 - DNA, 35 bp, Artificial Sequence
  Synthetic oligonucleotide
aagccacgaactcggggctatcaaaccctctccgc

SEQ ID NO: 120763 - DNA, 35 bp, Artificial Sequence
  Synthetic oligonucleotide
tcaacccattcagtttgccacgagtttgtgccctc

SEQ ID NO: 120764 - DNA, 35 bp, Artificial Sequence
  Synthetic oligonucleotide
ttggagggagaacggaacacagacggatgggaggg

SEQ ID NO: 120765 - DNA, 35 bp, Artificial Sequence
  Synthetic oligonucleotide
ttcggactgccttctagcaccatcctctcgcctga

SEQ ID NO: 120766 - DNA, 37 bp, Artificial Sequence
  Synthetic oligonucleotide
agatggcggtaggaggtggggcttatggtggcggtga

SEQ ID NO: 120767 - DNA, 35 bp, Artificial Sequence
  Synthetic oligonucleotide
tatcgcccatcgccgcagttcgttcaacacccacc

SEQ ID NO: 120768 - DNA, 35 bp, Artificial Sequence
  Synthetic oligonucleotide
ggatgtacagatgtgggggggccggggagggggag

SEQ ID NO: 120769 - DNA, 35 bp, Artificial Sequence
  Synthetic oligonucleotide
ggaccaaatgggtgggtactagtgcggagggaggg

SEQ ID NO: 120770 - DNA, 35 bp, Artificial Sequence
  Synthetic oligonucleotide
accgcgcatcccctgattaccgtgccttcaactct

SEQ ID NO: 120771 - DNA, 35 bp, Artificial Sequence
  Synthetic oligonucleotide
tatcgctcccgccgccctgactcgaaattagccaa

SEQ ID NO: 120772 - DNA, 37 bp, Artificial Sequence
  Synthetic oligonucleotide
tgtcgccgtcacccgcccctttcatcacccgtcccga

SEQ ID NO: 120773 - DNA, 35 bp, Artificial Sequence
  Synthetic oligonucleotide
tcgcccaccatgcctgcttaaaaggttctgccacc

SEQ ID NO: 120774 - DNA, 35 bp, Artificial Sequence
  Synthetic oligonucleotide
gtttcgcctcgaaccatcatcaccctgtctttgcc

SEQ ID NO: 120775 - DNA, 35 bp, Artificial Sequence
  Synthetic oligonucleotide
gtcctaccgcccggctccacatcctcgagacacgc

SEQ ID NO: 120776 - DNA, 35 bp, Artificial Sequence
  Synthetic oligonucleotide
tatcaccctgccctcgccatgcctactcagcctgg

SEQ ID NO: 120777 - DNA, 35 bp, Artificial Sequence
  Synthetic oligonucleotide
gacgagggagggtcgcaaaaggaagggtgtaggtt

SEQ ID NO: 120778 - DNA, 36 bp, Artificial Sequence
  Synthetic oligonucleotide
gagcccctacacgaattatcgaaactgcccttgcca

SEQ ID NO: 120779 - DNA, 35 bp, Artificial Sequence
  Synthetic oligonucleotide
atgggtgggggaggcggagggatcgagtctgggga

SEQ ID NO: 120780 - DNA, 36 bp, Artificial Sequence
  Synthetic oligonucleotide
ggaccatacgattcacatgtctcctccctgtcctta

SEQ ID NO: 120781 - DNA, 34 bp, Artificial Sequence
  Synthetic oligonucleotide
gtggcccgggccttaggtctgcatcttctcccac

SEQ ID NO: 120782 - DNA, 35 bp, Artificial Sequence
  Synthetic oligonucleotide
ggaacgcacgatcctttctctagcagttacccgcc

SEQ ID NO: 120783 - DNA, 35 bp, Artificial Sequence
  Synthetic oligonucleotide
atgtgcccccccggcatcccctcggattctattcc

SEQ ID NO: 120784 - DNA, 35 bp, Artificial Sequence
  Synthetic oligonucleotide
tcccgtgttcgttcggctacttgcaacatcttctc

SEQ ID NO: 120785 - DNA, 35 bp, Artificial Sequence
  Synthetic oligonucleotide
acgccaacatcttgctcatccgcttgtacgccctt

SEQ ID NO: 120786 - DNA, 35 bp, Artificial Sequence
  Synthetic oligonucleotide
aacacccttcttcactgtatcctggcctgtacgaa

SEQ ID NO: 120787 - DNA, 36 bp, Artificial Sequence
  Synthetic oligonucleotide
gcctccaacgtcacacgctgcattctcggttctcca

SEQ ID NO: 120788 - DNA, 37 bp, Artificial Sequence
  Synthetic oligonucleotide
atgaggggcatgggtagttgggggcgctgagagtgga

SEQ ID NO: 120789 - DNA, 38 bp, Artificial Sequence
  Synthetic oligonucleotide
gcgaaacaagggaaggacgggggggaggtgggtagtga

SEQ ID NO: 120790 - DNA, 36 bp, Artificial Sequence
  Synthetic oligonucleotide
acccactccattcaatgccctcgtatgactgcctta

SEQ ID NO: 120791 - DNA, 35 bp, Artificial Sequence
  Synthetic oligonucleotide
ttcccctctcgacagctcggtcctaatgccctttc

SEQ ID NO: 120792 - DNA, 35 bp, Artificial Sequence
  Synthetic oligonucleotide
tccgtgcccggactcctgtcttacccctcgttttt

SEQ ID NO: 120793 - DNA, 35 bp, Artificial Sequence
  Synthetic oligonucleotide
tccccctcccgccccccagttctactccggttcga

SEQ ID NO: 120794 - DNA, 38 bp, Artificial Sequence
  Synthetic oligonucleotide
gagaggtggtaagggtgaagggatgatagtggggatga

SEQ ID NO: 120795 - DNA, 37 bp, Artificial Sequence
  Synthetic oligonucleotide
tagcccccctgacctgtatcccaggctccccttttga

SEQ ID NO: 120796 - DNA, 35 bp, Artificial Sequence
  Synthetic oligonucleotide
tgcacatgtcctttcgcccgtgacgctcatagccc

SEQ ID NO: 120797 - DNA, 35 bp, Artificial Sequence
  Synthetic oligonucleotide
tgctaacccgtagtgcttcccgactccccaattgc

SEQ ID NO: 120798 - DNA, 35 bp, Artificial Sequence
  Synthetic oligonucleotide
tagaccggaggatacacaggggttggggatggtgg

SEQ ID NO: 120799 - DNA, 35 bp, Artificial Sequence
  Synthetic oligonucleotide
tcccccgcccctcgccatctcgtcacagatatgat

SEQ ID NO: 120800 - DNA, 36 bp, Artificial Sequence
  Synthetic oligonucleotide
tagagggagtgaggtgggtgggtggtcggtggatga

SEQ ID NO: 120801 - DNA, 35 bp, Artificial Sequence
  Synthetic oligonucleotide
acccccagcctcacctaccggccgtttagcattta

SEQ ID NO: 120802 - DNA, 35 bp, Artificial Sequence
  Synthetic oligonucleotide
gccgatagcagtcgtttgcgcacccgattctccac

SEQ ID NO: 120803 - DNA, 35 bp, Artificial Sequence
  Synthetic oligonucleotide
atgtcgcgtgcgtttgtcctatcacctacatgccc

SEQ ID NO: 120804 - DNA, 35 bp, Artificial Sequence
  Synthetic oligonucleotide
gagggggaggggggggtaagcacagacaagttcag

SEQ ID NO: 120805 - DNA, 35 bp, Artificial Sequence
  Synthetic oligonucleotide
tcgccccatcgcacgcatgaccttgtccttcttta

SEQ ID NO: 120806 - DNA, 35 bp, Artificial Sequence
  Synthetic oligonucleotide
gagactcgtccattgagttcgtgccctccttccac

SEQ ID NO: 120807 - DNA, 35 bp, Artificial Sequence
  Synthetic oligonucleotide
tccacattggccttctaaaacagcctggttccacc

SEQ ID NO: 120808 - DNA, 35 bp, Artificial Sequence
  Synthetic oligonucleotide
aattcaccgccgtgtggccattacgcccgcatacc

SEQ ID NO: 120809 - DNA, 35 bp, Artificial Sequence
  Synthetic oligonucleotide
gcgagccgcccagcccttctacgtcgaccgctccc

SEQ ID NO: 120810 - DNA, 35 bp, Artificial Sequence
  Synthetic oligonucleotide
gtccgcatcgcttctttgccgccgtaccttcccgc

SEQ ID NO: 120811 - DNA, 35 bp, Artificial Sequence
  Synthetic oligonucleotide
acccccccaccctacggtactttgtcacgacctgc

SEQ ID NO: 120812 - DNA, 35 bp, Artificial Sequence
  Synthetic oligonucleotide
tcccacctcgttctgtacgctacactacctcggag

SEQ ID NO: 120813 - DNA, 35 bp, Artificial Sequence
  Synthetic oligonucleotide
gaagccactcctccgactgctgtacgctccttcct

SEQ ID NO: 120814 - DNA, 36 bp, Artificial Sequence
  Synthetic oligonucleotide
tccgacaggtgtgggcgggggggagcgggagtttaa

SEQ ID NO: 120815 - DNA, 35 bp, Artificial Sequence
  Synthetic oligonucleotide
accaccgacgtcgccatcgcccgtgtcgcccgcca

SEQ ID NO: 120816 - DNA, 37 bp, Artificial Sequence
  Synthetic oligonucleotide
gcatcgaaggaggaggagggatcaaggggaggcagga

SEQ ID NO: 120817 - DNA, 36 bp, Artificial Sequence
  Synthetic oligonucleotide
taccacgccctctgtctttgctcgcttcctaattga

SEQ ID NO: 120818 - DNA, 37 bp, Artificial Sequence
  Synthetic oligonucleotide
gcaccaccaccgcaactaagtcgcctctgtcccttga

SEQ ID NO: 120819 - DNA, 35 bp, Artificial Sequence
  Synthetic oligonucleotide
gtccacaacgtctgatccttgccctgctatccatc

SEQ ID NO: 120820 - DNA, 35 bp, Artificial Sequence
  Synthetic oligonucleotide
gcctcctgtgctcgctcctctcactcgttgaacgt

SEQ ID NO: 120821 - DNA, 35 bp, Artificial Sequence
  Synthetic oligonucleotide
gagccacgcttgtcgagtatttcgccggttacctt

SEQ ID NO: 120822 - DNA, 37 bp, Artificial Sequence
  Synthetic oligonucleotide
gagagacatgagggtgggaaaggggcaagtgttaaga

SEQ ID NO: 120823 - DNA, 36 bp, Artificial Sequence
  Synthetic oligonucleotide
gagtgagcagacagggaaaaagcggggagtgaagga

SEQ ID NO: 120824 - DNA, 36 bp, Artificial Sequence
  Synthetic oligonucleotide
gtccccgcccgctttctcacatacggtatctccata

SEQ ID NO: 120825 - DNA, 35 bp, Artificial Sequence
  Synthetic oligonucleotide
tgctacgccaactctgcacagttccgccgttctac

SEQ ID NO: 120826 - DNA, 35 bp, Artificial Sequence
  Synthetic oligonucleotide
ttgtgtcctcgttcccacgcgtgttccatctcgcc

SEQ ID NO: 120827 - DNA, 35 bp, Artificial Sequence
  Synthetic oligonucleotide
ctaacggggcgggagggatgggagaacatcgcctc

SEQ ID NO: 120828 - DNA, 35 bp, Artificial Sequence
  Synthetic oligonucleotide
ggactactcctgtgcgtcctcgttccaccattctc

SEQ ID NO: 120829 - DNA, 35 bp, Artificial Sequence
  Synthetic oligonucleotide
tctcgccactccttgctgcaactctacacacgttt

SEQ ID NO: 120830 - DNA, 36 bp, Artificial Sequence
  Synthetic oligonucleotide
ggtggagcaggcatggggcgggagataggggggaca

SEQ ID NO: 120831 - DNA, 35 bp, Artificial Sequence
  Synthetic oligonucleotide
tgacgtacccgtatccgccacctgcccactcggca

SEQ ID NO: 120832 - DNA, 36 bp, Artificial Sequence
  Synthetic oligonucleotide
atcagtaggtgggcgggtggggatggcggtggtcga

SEQ ID NO: 120833 - DNA, 37 bp, Artificial Sequence
  Synthetic oligonucleotide
tacgtccccttcctgctccttgtactatcgttcctga

SEQ ID NO: 120834 - DNA, 38 bp, Artificial Sequence
  Synthetic oligonucleotide
tgagggtggggcctagacggggtcgcccaggggcttga

SEQ ID NO: 120835 - DNA, 35 bp, Artificial Sequence
  Synthetic oligonucleotide
gccctccctcgccggttactaagcctgtcgtaatt

SEQ ID NO: 120836 - DNA, 37 bp, Artificial Sequence
  Synthetic oligonucleotide
ttggcctcactgcacacgtgccccctgcccttgccga

SEQ ID NO: 120837 - DNA, 35 bp, Artificial Sequence
  Synthetic oligonucleotide
gaagggaggacgcggggggacaggcgaatcgggga

SEQ ID NO: 120838 - DNA, 35 bp, Artificial Sequence
  Synthetic oligonucleotide
agcaagaccgcctgtcacccccaccgattccgtcc

SEQ ID NO: 120839 - DNA, 36 bp, Artificial Sequence
  Synthetic oligonucleotide
tggtggaggcgggaggggttggggggtggccgacca

SEQ ID NO: 120840 - DNA, 34 bp, Artificial Sequence
  Synthetic oligonucleotide
tccgacccactcatatgagttcctatctccttca

SEQ ID NO: 120841 - DNA, 36 bp, Artificial Sequence
  Synthetic oligonucleotide
gacaccgcccctctttagtacatatccacccgtcta

SEQ ID NO: 120842 - DNA, 36 bp, Artificial Sequence
  Synthetic oligonucleotide
acgcccgtgccctgccacccaacactccgcccggta

SEQ ID NO: 120843 - DNA, 35 bp, Artificial Sequence
  Synthetic oligonucleotide
gacccaatcaggatttcgctatggccgcccctacc

SEQ ID NO: 120844 - DNA, 35 bp, Artificial Sequence
  Synthetic oligonucleotide
gtgcacacgatgccgcttccttcgttctctatgcc

SEQ ID NO: 120845 - DNA, 35 bp, Artificial Sequence
  Synthetic oligonucleotide
acatccgcgcgattatctggctctcctcttggttc

SEQ ID NO: 120846 - DNA, 35 bp, Artificial Sequence
  Synthetic oligonucleotide
gagtggcgacctgcccgacgtcattgcctcccccg

SEQ ID NO: 120847 - DNA, 35 bp, Artificial Sequence
  Synthetic oligonucleotide
gctcccccaacctgaacgttccgtccgccgccctg

SEQ ID NO: 120848 - DNA, 34 bp, Artificial Sequence
  Synthetic oligonucleotide
gtcgtcccgcctgccctgcaattgtcaccgctat

SEQ ID NO: 120849 - DNA, 35 bp, Artificial Sequence
  Synthetic oligonucleotide
tccgaccccgcgaaaagtgccctgcttccctgctt

SEQ ID NO: 120850 - DNA, 35 bp, Artificial Sequence
  Synthetic oligonucleotide
tagccccatcctggaccaatatgcccccatgccaa

SEQ ID NO: 120851 - DNA, 36 bp, Artificial Sequence
  Synthetic oligonucleotide
atgggggcgggacggggtgggcgctctggacgttaa

SEQ ID NO: 120852 - DNA, 35 bp, Artificial Sequence
  Synthetic oligonucleotide
gtcacctctctctcgcagacgcgcctattccgcca

SEQ ID NO: 120853 - DNA, 35 bp, Artificial Sequence
  Synthetic oligonucleotide
accccctgattcagtacgttgcacgttccagtgcc

SEQ ID NO: 120854 - DNA, 35 bp, Artificial Sequence
  Synthetic oligonucleotide
tgtccctcctgcagcccgagtccgcccgctgccgc

SEQ ID NO: 120855 - DNA, 35 bp, Artificial Sequence
  Synthetic oligonucleotide
gtgattcaccgtccacccactgccccaagttcccg

SEQ ID NO: 120856 - DNA, 37 bp, Artificial Sequence
  Synthetic oligonucleotide
gaagggggaggggggacagtgctggacgggaaggaga

SEQ ID NO: 120857 - DNA, 35 bp, Artificial Sequence
  Synthetic oligonucleotide
atcgaccgttgcctccaatgaccttgttaccgatc

SEQ ID NO: 120858 - DNA, 35 bp, Artificial Sequence
  Synthetic oligonucleotide
gggagagaggaaagggggggtggaggtgctgtgag

SEQ ID NO: 120859 - DNA, 34 bp, Artificial Sequence
  Synthetic oligonucleotide
ttgcccatgactgcccgctctctcgatattctat

SEQ ID NO: 120860 - DNA, 35 bp, Artificial Sequence
  Synthetic oligonucleotide
ggaccatggactcgcatgtctacctttatctccct

SEQ ID NO: 120861 - DNA, 35 bp, Artificial Sequence
  Synthetic oligonucleotide
atgtcgcatgcttagccgccctccaccgccgcaca

SEQ ID NO: 120862 - DNA, 37 bp, Artificial Sequence
  Synthetic oligonucleotide
tgctgcctccttttatatgccgagcgcgcccccccga

SEQ ID NO: 120863 - DNA, 37 bp, Artificial Sequence
  Synthetic oligonucleotide
tacgccgggggagggggaggcggttggtggagcagga

SEQ ID NO: 120864 - DNA, 38 bp, Artificial Sequence
  Synthetic oligonucleotide
taggtcccgtccgtctgtccccccgattcgcctgttga

SEQ ID NO: 120865 - DNA, 35 bp, Artificial Sequence
  Synthetic oligonucleotide
ggtcctcatccgcctgtcttctctcggcttaatac

SEQ ID NO: 120866 - DNA, 34 bp, Artificial Sequence
  Synthetic oligonucleotide
aaacgccccgactcgcccctatcagcaggactgc

SEQ ID NO: 120867 - DNA, 35 bp, Artificial Sequence
  Synthetic oligonucleotide
ggaaggactgggtggaaggcaggagcggcggtggt

SEQ ID NO: 120868 - DNA, 34 bp, Artificial Sequence
  Synthetic oligonucleotide
gccggagccccccccctcgtgtctggttccacca

SEQ ID NO: 120869 - DNA, 37 bp, Artificial Sequence
  Synthetic oligonucleotide
gcgcatagcggacacggggtggtggaatggggaagga

SEQ ID NO: 120870 - DNA, 35 bp, Artificial Sequence
  Synthetic oligonucleotide
gacacccccgtccatgttccgccatggtacaccac

SEQ ID NO: 120871 - DNA, 35 bp, Artificial Sequence
  Synthetic oligonucleotide
gcgatctggcgtgcaatctgccctattcccccgac

SEQ ID NO: 120872 - DNA, 35 bp, Artificial Sequence
  Synthetic oligonucleotide
ttccgttcagagagcccgcccatccactccttgcc

SEQ ID NO: 120873 - DNA, 36 bp, Artificial Sequence
  Synthetic oligonucleotide
gaagtgctggttacgccgcctgctcctcccttgagc

SEQ ID NO: 120874 - DNA, 35 bp, Artificial Sequence
  Synthetic oligonucleotide
tatgcctctcttagaactgctccacacatccctgc

SEQ ID NO: 120875 - DNA, 36 bp, Artificial Sequence
  Synthetic oligonucleotide
gtcatcgcctccgtctcaccgtgctaactgcccgaa

SEQ ID NO: 120876 - DNA, 37 bp, Artificial Sequence
  Synthetic oligonucleotide
tcccacccaccatactcctgagtcctgacctcatgga

SEQ ID NO: 120877 - DNA, 35 bp, Artificial Sequence
  Synthetic oligonucleotide
gtcaccatccttagttgctcagtagcacgcctcac

SEQ ID NO: 120878 - DNA, 35 bp, Artificial Sequence
  Synthetic oligonucleotide
gctctgtcccgaaccgcatctacacgctcactcgc

SEQ ID NO: 120879 - DNA, 35 bp, Artificial Sequence
  Synthetic oligonucleotide
gtccatcctgctctcggcttgcacataaacgccct

SEQ ID NO: 120880 - DNA, 35 bp, Artificial Sequence
  Synthetic oligonucleotide
tatccgcccctcctacccacgtgctcttgtagagt

SEQ ID NO: 120881 - DNA, 35 bp, Artificial Sequence
  Synthetic oligonucleotide
acagtcctgccacctgcaccagcccctcactaggt

SEQ ID NO: 120882 - DNA, 36 bp, Artificial Sequence
  Synthetic oligonucleotide
taggtgagggggaagggcggacaagcgacaggtaga

SEQ ID NO: 120883 - DNA, 38 bp, Artificial Sequence
  Synthetic oligonucleotide
gccgcccgtcattccgcatttagcccgcctcctactga

SEQ ID NO: 120884 - DNA, 35 bp, Artificial Sequence
  Synthetic oligonucleotide
ttgttcctggtccactttgaatcgttgccttcgcc

SEQ ID NO: 120885 - DNA, 35 bp, Artificial Sequence
  Synthetic oligonucleotide
agtctcccgccactgccatcgtttcgttccccagc

SEQ ID NO: 120886 - DNA, 35 bp, Artificial Sequence
  Synthetic oligonucleotide
gccgatacctgtccgggccctcacccccttctcgc

SEQ ID NO: 120887 - DNA, 35 bp, Artificial Sequence
  Synthetic oligonucleotide
tggatccgctgttcaccctcgttgctccctccccg

SEQ ID NO: 120888 - DNA, 35 bp, Artificial Sequence
  Synthetic oligonucleotide
taagccacccaggcccgttctaacacatctctgtt

SEQ ID NO: 120889 - DNA, 36 bp, Artificial Sequence
  Synthetic oligonucleotide
aaccgtcctcgcgcaccgtcgaatcgctccacctca

SEQ ID NO: 120890 - DNA, 35 bp, Artificial Sequence
  Synthetic oligonucleotide
gccgctctccgtagtctacattgcccgatcccgta

SEQ ID NO: 120891 - DNA, 35 bp, Artificial Sequence
  Synthetic oligonucleotide
gcgcgactggctatgccggcctccccgttaccgcc

SEQ ID NO: 120892 - DNA, 35 bp, Artificial Sequence
  Synthetic oligonucleotide
gacgccccaatcgcctttgataactcattgctctc

SEQ ID NO: 120893 - DNA, 35 bp, Artificial Sequence
  Synthetic oligonucleotide
ttccggcccacacaagtgccctttccacctccgtc

SEQ ID NO: 120894 - DNA, 35 bp, Artificial Sequence
  Synthetic oligonucleotide
accgccgagcaatttgctgacatccccatcctttc

SEQ ID NO: 120895 - DNA, 35 bp, Artificial Sequence
  Synthetic oligonucleotide
ttcacgcccatttaccgcccccagctttttcgtag

SEQ ID NO: 120896 - DNA, 35 bp, Artificial Sequence
  Synthetic oligonucleotide
gatgcgttacatccttacgtccacctactctgccg

SEQ ID NO: 120897 - DNA, 35 bp, Artificial Sequence
  Synthetic oligonucleotide
taacgccctcactgaaccatgcaccatctggcact

SEQ ID NO: 120898 - DNA, 36 bp, Artificial Sequence
  Synthetic oligonucleotide
gccaagggcgggtcggggttggggggaacggtaaca

SEQ ID NO: 120899 - DNA, 35 bp, Artificial Sequence
  Synthetic oligonucleotide
gctgacctacgcgactcgacctgcctccatccaca

SEQ ID NO: 120900 - DNA, 36 bp, Artificial Sequence
  Synthetic oligonucleotide
acaccctccgcctccgccgccgacctctctcggtta

SEQ ID NO: 120901 - DNA, 35 bp, Artificial Sequence
  Synthetic oligonucleotide
agactgagcgacaggctacgcaccactcgcccctc

SEQ ID NO: 120902 - DNA, 35 bp, Artificial Sequence
  Synthetic oligonucleotide
tccacacctctcatcgtgccacttatagtgtacgt

SEQ ID NO: 120903 - DNA, 35 bp, Artificial Sequence
  Synthetic oligonucleotide
gacgccatcgtcgttgcctctcccccctcgttctt

SEQ ID NO: 120904 - DNA, 35 bp, Artificial Sequence
  Synthetic oligonucleotide
gacccctctcactcacggacccgcttcctttagag

SEQ ID NO: 120905 - DNA, 35 bp, Artificial Sequence
  Synthetic oligonucleotide
acacccacatttggattcactcttcgcttacctcg

SEQ ID NO: 120906 - DNA, 33 bp, Artificial Sequence
  Synthetic oligonucleotide
ttgcctgcccgtgactcgatccctcaccccact

SEQ ID NO: 120907 - DNA, 36 bp, Artificial Sequence
  Synthetic oligonucleotide
tcccgccatctcgccgccctctgtttatggaatgaa

SEQ ID NO: 120908 - DNA, 35 bp, Artificial Sequence
  Synthetic oligonucleotide
acgcacggtggaggcggagcgggatgcagggggtg

SEQ ID NO: 120909 - DNA, 35 bp, Artificial Sequence
  Synthetic oligonucleotide
gatgtctgcgcccatgacctgtcctcgtttcatcg

SEQ ID NO: 120910 - DNA, 33 bp, Artificial Sequence
  Synthetic oligonucleotide
tcgttccggaggagagtggggacgggggaggtg

SEQ ID NO: 120911 - DNA, 35 bp, Artificial Sequence
  Synthetic oligonucleotide
gatgttgcagcctcctcttgacacttgcctctcct

SEQ ID NO: 120912 - DNA, 36 bp, Artificial Sequence
  Synthetic oligonucleotide
tccaaaacccacagatcgctcctccgcctgttcaaa

SEQ ID NO: 120913 - DNA, 36 bp, Artificial Sequence
  Synthetic oligonucleotide
tccgggcgggtgggtgaggttcaaggagccatacga

SEQ ID NO: 120914 - DNA, 36 bp, Artificial Sequence
  Synthetic oligonucleotide
gggatacgggaggaggggagaaggacgacagcagga

SEQ ID NO: 120915 - DNA, 35 bp, Artificial Sequence
  Synthetic oligonucleotide
taccccatccgccgtatccttgtccaggttccctc

SEQ ID NO: 120916 - DNA, 35 bp, Artificial Sequence
  Synthetic oligonucleotide
gccacccggtgcaccgaattctgcccttatcgttc

SEQ ID NO: 120917 - DNA, 36 bp, Artificial Sequence
  Synthetic oligonucleotide
ttggtcgccgggaaggcaggggtggggaaaatacga

SEQ ID NO: 120918 - DNA, 37 bp, Artificial Sequence
  Synthetic oligonucleotide
ttcagcccctggtcgttttctttctcaccctcacgga

SEQ ID NO: 120919 - DNA, 37 bp, Artificial Sequence
  Synthetic oligonucleotide
gggaacgggcacacaggggtgaggggggggaggggga

SEQ ID NO: 120920 - DNA, 37 bp, Artificial Sequence
  Synthetic oligonucleotide
gaaccgggtcaggaaatctttaggggaacggggggga

SEQ ID NO: 120921 - DNA, 35 bp, Artificial Sequence
  Synthetic oligonucleotide
tgcccatgacgtccgcctgtctgcctcacttgtcc

SEQ ID NO: 120922 - DNA, 35 bp, Artificial Sequence
  Synthetic oligonucleotide
gccgccctaaccgtccgcttacctcatacctgggc

SEQ ID NO: 120923 - DNA, 35 bp, Artificial Sequence
  Synthetic oligonucleotide
atcaccgccgactcggttcgaccattctcaaattc

SEQ ID NO: 120924 - DNA, 35 bp, Artificial Sequence
  Synthetic oligonucleotide
ttgagagcagcacttggtactcctgtcatcccttc

SEQ ID NO: 120925 - DNA, 35 bp, Artificial Sequence
  Synthetic oligonucleotide
acacagcgaaccagttcctcccccccgtgcccacg

SEQ ID NO: 120926 - DNA, 35 bp, Artificial Sequence
  Synthetic oligonucleotide
ttgcgacctacggctgtacctttctctgttctcct

SEQ ID NO: 120927 - DNA, 35 bp, Artificial Sequence
  Synthetic oligonucleotide
atgctctacgcccgcctcacatctgtttgtcgctt

SEQ ID NO: 120928 - DNA, 35 bp, Artificial Sequence
  Synthetic oligonucleotide
aagccgcccaccttggactgccctttttcccggtt

SEQ ID NO: 120929 - DNA, 35 bp, Artificial Sequence
  Synthetic oligonucleotide
tacatccccttcaatatgtgccgtgtgcctctttt

SEQ ID NO: 120930 - DNA, 36 bp, Artificial Sequence
  Synthetic oligonucleotide
acacccccgccctcaccacgctggataacgctacaa

SEQ ID NO: 120931 - DNA, 36 bp, Artificial Sequence
  Synthetic oligonucleotide
tcagttccgcctatgtactaccctcgtgtcacccaa

SEQ ID NO: 120932 - DNA, 35 bp, Artificial Sequence
  Synthetic oligonucleotide
gtacaccttgtcgttggctctatacttcccttcca

SEQ ID NO: 120933 - DNA, 36 bp, Artificial Sequence
  Synthetic oligonucleotide
tgaccgggtacggtgggaggggggtttgacgaaaga

SEQ ID NO: 120934 - DNA, 35 bp, Artificial Sequence
  Synthetic oligonucleotide
ggtggaagggaagaaaatgattagggggggcgata

SEQ ID NO: 120935 - DNA, 34 bp, Artificial Sequence
  Synthetic oligonucleotide
gaccgggggggtcgggtaagggctgtttactaac

SEQ ID NO: 120936 - DNA, 35 bp, Artificial Sequence
  Synthetic oligonucleotide
tacacccctccggcgctgactaccatccttagcac

SEQ ID NO: 120937 - DNA, 35 bp, Artificial Sequence
  Synthetic oligonucleotide
ttcgaatgtggcctcgcatctgctccatttacccc

SEQ ID NO: 120938 - DNA, 35 bp, Artificial Sequence
  Synthetic oligonucleotide
tggaggtgccaacatccgatccctggtcccctgcc

SEQ ID NO: 120939 - DNA, 35 bp, Artificial Sequence
  Synthetic oligonucleotide
gaccggacttcctccctctcaatcgccaccatggc

SEQ ID NO: 120940 - DNA, 35 bp, Artificial Sequence
  Synthetic oligonucleotide
tgccgtacgccccctcgatcatcctctccttcggg

SEQ ID NO: 120941 - DNA, 35 bp, Artificial Sequence
  Synthetic oligonucleotide
gtagagacaagcgggtgtggagcggaggagattat

SEQ ID NO: 120942 - DNA, 36 bp, Artificial Sequence
  Synthetic oligonucleotide
tccccaatccatcttgtccgtaccaccgcgcgagca

SEQ ID NO: 120943 - DNA, 35 bp, Artificial Sequence
  Synthetic oligonucleotide
tcccgggccctccgttccgtaacgataacctttca

SEQ ID NO: 120944 - DNA, 37 bp, Artificial Sequence
  Synthetic oligonucleotide
tcaacagtctccgcccttgctaagcctcatatctcga

SEQ ID NO: 120945 - DNA, 37 bp, Artificial Sequence
  Synthetic oligonucleotide
actggcgcgcggaatttggggaggctgcgagggagga

SEQ ID NO: 120946 - DNA, 37 bp, Artificial Sequence
  Synthetic oligonucleotide
tgccactctcgcatgcccgaacctgttctcttcctga

SEQ ID NO: 120947 - DNA, 35 bp, Artificial Sequence
  Synthetic oligonucleotide
gcacactcgagttttcttacgcctcccgcaagccc

SEQ ID NO: 120948 - DNA, 35 bp, Artificial Sequence
  Synthetic oligonucleotide
tgccacttcaaggactgatcgttgccccccctccg

SEQ ID NO: 120949 - DNA, 35 bp, Artificial Sequence
  Synthetic oligonucleotide
ggattgctccactctgcattttgtctgctcgcctt

SEQ ID NO: 120950 - DNA, 36 bp, Artificial Sequence
  Synthetic oligonucleotide
agcgaccgaccgggtggaggggaaggaaggagaaaa

SEQ ID NO: 120951 - DNA, 37 bp, Artificial Sequence
  Synthetic oligonucleotide
gcaccacatctgcgccctccactgcttctcttgacga

SEQ ID NO: 120952 - DNA, 37 bp, Artificial Sequence
  Synthetic oligonucleotide
gatggggggggaggttgtaggatagcttgcgggagga

SEQ ID NO: 120953 - DNA, 35 bp, Artificial Sequence
  Synthetic oligonucleotide
gaacgccacctatacccccgaccgcccctagttga

SEQ ID NO: 120954 - DNA, 38 bp, Artificial Sequence
  Synthetic oligonucleotide
tccgcccctcccccggtattcgcgtacgcaaactttga

SEQ ID NO: 120955 - DNA, 35 bp, Artificial Sequence
  Synthetic oligonucleotide
tcagcctgaccagcccgccgtccatgctccacgac

SEQ ID NO: 120956 - DNA, 35 bp, Artificial Sequence
  Synthetic oligonucleotide
tatcggtacgcctcgctctatctatacttgtcctc

SEQ ID NO: 120957 - DNA, 35 bp, Artificial Sequence
  Synthetic oligonucleotide
tcccttccgtcacggtctatcttgcctcgaacccg

SEQ ID NO: 120958 - DNA, 35 bp, Artificial Sequence
  Synthetic oligonucleotide
acgctggggggagtaagcggggtggggcgggaaat

SEQ ID NO: 120959 - DNA, 35 bp, Artificial Sequence
  Synthetic oligonucleotide
tcgagcctgacacggtcgagctctgtttcccccct

SEQ ID NO: 120960 - DNA, 35 bp, Artificial Sequence
  Synthetic oligonucleotide
aacccagggtcagctttccgaacacctctctgcct

SEQ ID NO: 120961 - DNA, 35 bp, Artificial Sequence
  Synthetic oligonucleotide
acgccgagatctcctcctgtttcgatcccgccctt

SEQ ID NO: 120962 - DNA, 37 bp, Artificial Sequence
  Synthetic oligonucleotide
tcccacgccggtcactcgtttgttccttccccgtaga

SEQ ID NO: 120963 - DNA, 37 bp, Artificial Sequence
  Synthetic oligonucleotide
tccacctcctccgccaaacatagttcgcactctgcga

SEQ ID NO: 120964 - DNA, 35 bp, Artificial Sequence
  Synthetic oligonucleotide
tcactgacgcccgactccctttgaaggttgcttta

SEQ ID NO: 120965 - DNA, 35 bp, Artificial Sequence
  Synthetic oligonucleotide
agagagggcggggtggaacgggaagagactcggct

SEQ ID NO: 120966 - DNA, 35 bp, Artificial Sequence
  Synthetic oligonucleotide
gttccaccgatcctcccgcacgactctctcgaggt

SEQ ID NO: 120967 - DNA, 35 bp, Artificial Sequence
  Synthetic oligonucleotide
gatcgcccccctctgtcttatctcacataatatgt

SEQ ID NO: 120968 - DNA, 36 bp, Artificial Sequence
  Synthetic oligonucleotide
tctgactgtcgccttgacataaacctgcccccccga

SEQ ID NO: 120969 - DNA, 37 bp, Artificial Sequence
  Synthetic oligonucleotide
gaaccaagccagttccgcccgtcctgcttctccttga

SEQ ID NO: 120970 - DNA, 35 bp, Artificial Sequence
  Synthetic oligonucleotide
gttgccaggtcctcttaccttccgcgacacctacc

SEQ ID NO: 120971 - DNA, 35 bp, Artificial Sequence
  Synthetic oligonucleotide
gatcacacctgtacaatgccttgccgcccccgctc

SEQ ID NO: 120972 - DNA, 35 bp, Artificial Sequence
  Synthetic oligonucleotide
gcctacctcacccctggccgcaactatacttgtcg

SEQ ID NO: 120973 - DNA, 35 bp, Artificial Sequence
  Synthetic oligonucleotide
tcactcccttcccccgtaaaagctgccttactggg

SEQ ID NO: 120974 - DNA, 36 bp, Artificial Sequence
  Synthetic oligonucleotide
gcgctcgcacgcatacgaaacgctcctcctccgggt

SEQ ID NO: 120975 - DNA, 35 bp, Artificial Sequence
  Synthetic oligonucleotide
atcaccacccgcgccacccgatcactttggcataa

SEQ ID NO: 120976 - DNA, 36 bp, Artificial Sequence
  Synthetic oligonucleotide
tccacgcccgcctcgtacctaaggtacgccactcca

SEQ ID NO: 120977 - DNA, 37 bp, Artificial Sequence
  Synthetic oligonucleotide
gactcccacgccatggcctatcggtactccatctcca

SEQ ID NO: 120978 - DNA, 36 bp, Artificial Sequence
  Synthetic oligonucleotide
cgttcaccccgcttgccccctgtatggtttaatgca

SEQ ID NO: 120979 - DNA, 36 bp, Artificial Sequence
  Synthetic oligonucleotide
ttacgcgccagccgtgccatgtcgtccccccgttca

SEQ ID NO: 120980 - DNA, 37 bp, Artificial Sequence
  Synthetic oligonucleotide
gaatgggtgggtgtggaggggggccggttcggtgcga

SEQ ID NO: 120981 - DNA, 36 bp, Artificial Sequence
  Synthetic oligonucleotide
aacaggggatagggggggctagggcgtgcacgtcga

SEQ ID NO: 120982 - DNA, 37 bp, Artificial Sequence
  Synthetic oligonucleotide
ggagtggggttgacgggggattggggacacacaggga

SEQ ID NO: 120983 - DNA, 38 bp, Artificial Sequence
  Synthetic oligonucleotide
acatgccccgcccctgtctgaatcctgcacctccatga

SEQ ID NO: 120984 - DNA, 38 bp, Artificial Sequence
  Synthetic oligonucleotide
acgtagcgcaccatcgtacttggttcccaccctcctga

SEQ ID NO: 120985 - DNA, 35 bp, Artificial Sequence
  Synthetic oligonucleotide
gtggtcgcccgttattctcaatccctggccttccc

SEQ ID NO: 120986 - DNA, 35 bp, Artificial Sequence
  Synthetic oligonucleotide
gcctctcgccccatcttaatgactcctcacgggtc

SEQ ID NO: 120987 - DNA, 35 bp, Artificial Sequence
  Synthetic oligonucleotide
gtcagatcccatgtcctccgcagcctccccgcaat

SEQ ID NO: 120988 - DNA, 37 bp, Artificial Sequence
  Synthetic oligonucleotide
agcctgggccccttgacgttcgccactctcctttgga

SEQ ID NO: 120989 - DNA, 36 bp, Artificial Sequence
  Synthetic oligonucleotide
atgcaccgcctatcggtctgccctgccctaagccta

SEQ ID NO: 120990 - DNA, 36 bp, Artificial Sequence
  Synthetic oligonucleotide
gatgcaccccgctgacgatcgccaacctacatctta

SEQ ID NO: 120991 - DNA, 35 bp, Artificial Sequence
  Synthetic oligonucleotide
atcgccccgtccatacgcctgtctcatgatccaac

SEQ ID NO: 120992 - DNA, 35 bp, Artificial Sequence
  Synthetic oligonucleotide
tatggggctggtggcggggtctgaagggcggtgcc

SEQ ID NO: 120993 - DNA, 34 bp, Artificial Sequence
  Synthetic oligonucleotide
gcgatcgctcgtccctcctagtatgcgatcttcc

SEQ ID NO: 120994 - DNA, 35 bp, Artificial Sequence
  Synthetic oligonucleotide
taccccgctctgtccctaatcctccgcctcaccag

SEQ ID NO: 120995 - DNA, 36 bp, Artificial Sequence
  Synthetic oligonucleotide
acgcattcggctgcctgcgaagctcgttccaccccg

SEQ ID NO: 120996 - DNA, 35 bp, Artificial Sequence
  Synthetic oligonucleotide
tccatcctcccgcactcgctattaacgccgattat

SEQ ID NO: 120997 - DNA, 35 bp, Artificial Sequence
  Synthetic oligonucleotide
gatacatccgatagccttccgtccctgccttgcct

SEQ ID NO: 120998 - DNA, 35 bp, Artificial Sequence
  Synthetic oligonucleotide
tgtccctccctccatgtaaccgattatcttgtttt

SEQ ID NO: 120999 - DNA, 37 bp, Artificial Sequence
  Synthetic oligonucleotide
tgacgctcgctgcacctactccacgcctcattgccga

SEQ ID NO: 121000 - DNA, 35 bp, Artificial Sequence
  Synthetic oligonucleotide
gactcgaccacacccgccggttccatgagccctta

SEQ ID NO: 121001 - DNA, 35 bp, Artificial Sequence
  Synthetic oligonucleotide
gatgcctgcctctcctcatccgtgcctcggtgaac

SEQ ID NO: 121002 - DNA, 35 bp, Artificial Sequence
  Synthetic oligonucleotide
aaggacaccatgcctctcgttatccccgcttcgcc

SEQ ID NO: 121003 - DNA, 35 bp, Artificial Sequence
  Synthetic oligonucleotide
tcacttcctccgcttcctgtgcgttaatttcccgc

SEQ ID NO: 121004 - DNA, 35 bp, Artificial Sequence
  Synthetic oligonucleotide
tcttccgcccacatatctttactggccactactgc

SEQ ID NO: 121005 - DNA, 35 bp, Artificial Sequence
  Synthetic oligonucleotide
ttcaccgtcctccgttgccgtgaccccgtatgctc

SEQ ID NO: 121006 - DNA, 35 bp, Artificial Sequence
  Synthetic oligonucleotide
tcccagcctccgcccactatcgccccgatcctaat

SEQ ID NO: 121007 - DNA, 35 bp, Artificial Sequence
  Synthetic oligonucleotide
gctggaaaggggggtgggtaaagggggcagatgat

SEQ ID NO: 121008 - DNA, 36 bp, Artificial Sequence
  Synthetic oligonucleotide
gcaacgcattcacctctaccgctactgcaccccgga

SEQ ID NO: 121009 - DNA, 37 bp, Artificial Sequence
  Synthetic oligonucleotide
gggggggataggggacgaagacggaggggcaggatga

SEQ ID NO: 121010 - DNA, 38 bp, Artificial Sequence
  Synthetic oligonucleotide
tccgcctccgcctccgacgcccttgaagatcctcgtga

SEQ ID NO: 121011 - DNA, 35 bp, Artificial Sequence
  Synthetic oligonucleotide
atgccctgccatacagtcttgacgccccacccaac

SEQ ID NO: 121012 - DNA, 35 bp, Artificial Sequence
  Synthetic oligonucleotide
acgcaacctccttcgtcactatctgttgtcatcac

SEQ ID NO: 121013 - DNA, 35 bp, Artificial Sequence
  Synthetic oligonucleotide
tctcaccgcaccttctttcgaggcgtctcgaccgc

SEQ ID NO: 121014 - DNA, 35 bp, Artificial Sequence
  Synthetic oligonucleotide
actttgccccgccatgtttttgcccttgccacgag

SEQ ID NO: 121015 - DNA, 35 bp, Artificial Sequence
  Synthetic oligonucleotide
gcatgtgaccgttgcccgctcccctaagttccctg

SEQ ID NO: 121016 - DNA, 35 bp, Artificial Sequence
  Synthetic oligonucleotide
acctcctggacgccccacctaccatgattggagtg

SEQ ID NO: 121017 - DNA, 36 bp, Artificial Sequence
  Synthetic oligonucleotide
tgcgggggaggagggggttgtagttagctggggaga

SEQ ID NO: 121018 - DNA, 37 bp, Artificial Sequence
  Synthetic oligonucleotide
agctaggggcggaggggataggggtgggtatgccgga

SEQ ID NO: 121019 - DNA, 37 bp, Artificial Sequence
  Synthetic oligonucleotide
agacaaaatggaggggggtaagagggaggagctcgga

SEQ ID NO: 121020 - DNA, 35 bp, Artificial Sequence
  Synthetic oligonucleotide
tagacggcgcaccctgttcccgccttgctgttcta

SEQ ID NO: 121021 - DNA, 35 bp, Artificial Sequence
  Synthetic oligonucleotide
gccatatcccgctttcctcacgtctgcgcgttcgc

SEQ ID NO: 121022 - DNA, 35 bp, Artificial Sequence
  Synthetic oligonucleotide
tgacctgcacctcttcggtttgtctctcgcctatc

SEQ ID NO: 121023 - DNA, 35 bp, Artificial Sequence
  Synthetic oligonucleotide
ttgatccgtcaccacactagcctatgccgcctttc

SEQ ID NO: 121024 - DNA, 35 bp, Artificial Sequence
  Synthetic oligonucleotide
agcaccctccgcttccctgcccgatcaacccggag

SEQ ID NO: 121025 - DNA, 35 bp, Artificial Sequence
  Synthetic oligonucleotide
agcgtgcccgcccgccatagttaccagacctcact

SEQ ID NO: 121026 - DNA, 35 bp, Artificial Sequence
  Synthetic oligonucleotide
accgcgttgcgcagcccgcccgaaccgccatacct

SEQ ID NO: 121027 - DNA, 35 bp, Artificial Sequence
  Synthetic oligonucleotide
tcctgtactccggtcatttcgtggcgcccctccct

SEQ ID NO: 121028 - DNA, 35 bp, Artificial Sequence
  Synthetic oligonucleotide
gccccctcccgcatgcgtcgccattcttgtcgctt

SEQ ID NO: 121029 - DNA, 35 bp, Artificial Sequence
  Synthetic oligonucleotide
tcgtgccgcacccccacatctgcgtcctctcgttt

SEQ ID NO: 121030 - DNA, 36 bp, Artificial Sequence
  Synthetic oligonucleotide
ggtgcaccagcctgcatccactgttacgtttcgcca

SEQ ID NO: 121031 - DNA, 35 bp, Artificial Sequence
  Synthetic oligonucleotide
tgctcccactccccggtctctacctacacctgtca

SEQ ID NO: 121032 - DNA, 35 bp, Artificial Sequence
  Synthetic oligonucleotide
atacgccccggtccacacacgccgcattatgcacc

SEQ ID NO: 121033 - DNA, 35 bp, Artificial Sequence
  Synthetic oligonucleotide
gtcacgatctccatccatacctgccttcacctgtt

SEQ ID NO: 121034 - DNA, 36 bp, Artificial Sequence
  Synthetic oligonucleotide
accccacttacgcccgcctcacacagttcacgccca

SEQ ID NO: 121035 - DNA, 35 bp, Artificial Sequence
  Synthetic oligonucleotide
gagagggtgggagggtactcatttctccgggggac

SEQ ID NO: 121036 - DNA, 35 bp, Artificial Sequence
  Synthetic oligonucleotide
tcacccccctgacctgatcttgactaggctattac

SEQ ID NO: 121037 - DNA, 35 bp, Artificial Sequence
  Synthetic oligonucleotide
gacccctcacaggttaatacttcgcactatcatcc

SEQ ID NO: 121038 - DNA, 35 bp, Artificial Sequence
  Synthetic oligonucleotide
atgcgccgccccatgtctttaactcattgccattg

SEQ ID NO: 121039 - DNA, 35 bp, Artificial Sequence
  Synthetic oligonucleotide
gacccgccccgaatctagactgcttcaccttaact

SEQ ID NO: 121040 - DNA, 35 bp, Artificial Sequence
  Synthetic oligonucleotide
acgcaagacatggagggcggggggggctgggcgga

SEQ ID NO: 121041 - DNA, 37 bp, Artificial Sequence
  Synthetic oligonucleotide
gtccatactccgtgcgcttagaaacgctccatcctga

SEQ ID NO: 121042 - DNA, 35 bp, Artificial Sequence
  Synthetic oligonucleotide
gtcctcacctatctccctctgttaacagtcattta

SEQ ID NO: 121043 - DNA, 35 bp, Artificial Sequence
  Synthetic oligonucleotide
tcctgcgtgctaaaacctgcccaacctcccttgcc

SEQ ID NO: 121044 - DNA, 35 bp, Artificial Sequence
  Synthetic oligonucleotide
tgtctccccgctacatcagccgcgcgctattcatc

SEQ ID NO: 121045 - DNA, 35 bp, Artificial Sequence
  Synthetic oligonucleotide
tctcgcaacctgtggctccatccatcccagctatc

SEQ ID NO: 121046 - DNA, 35 bp, Artificial Sequence
  Synthetic oligonucleotide
tcccttcccggtgtatcaccgttcgccctcatgtc

SEQ ID NO: 121047 - DNA, 35 bp, Artificial Sequence
  Synthetic oligonucleotide
gccctcaccgctgaccagcccgccttcgacgcatt

SEQ ID NO: 121048 - DNA, 37 bp, Artificial Sequence
  Synthetic oligonucleotide
ggagcctcccgccatccccgaccatcaccttgttaga

SEQ ID NO: 121049 - DNA, 37 bp, Artificial Sequence
  Synthetic oligonucleotide
aactggccggtcccttgtttctttgtacccatcccga

SEQ ID NO: 121050 - DNA, 37 bp, Artificial Sequence
  Synthetic oligonucleotide
gaccccactcgctctcgaaccgcatcccgccttggga

SEQ ID NO: 121051 - DNA, 38 bp, Artificial Sequence
  Synthetic oligonucleotide
tcccagccacaccgttaccgttagcactctctcaatga

SEQ ID NO: 121052 - DNA, 38 bp, Artificial Sequence
  Synthetic oligonucleotide
gcgagcctgactcgcctccttgcccgcctttttactga

SEQ ID NO: 121053 - DNA, 37 bp, Artificial Sequence
  Synthetic oligonucleotide
ctactcattgcgccagtccacctgcctacgtttctga

SEQ ID NO: 121054 - DNA, 38 bp, Artificial Sequence
  Synthetic oligonucleotide
acctgtactcatctcccgtcagcactcgcaccccgtga

SEQ ID NO: 121055 - DNA, 35 bp, Artificial Sequence
  Synthetic oligonucleotide
tcacgcgcccttcctgcattacttagaccacgtta

SEQ ID NO: 121056 - DNA, 35 bp, Artificial Sequence
  Synthetic oligonucleotide
agtccaacgtggcatcgtgtctctccatcccgcac

SEQ ID NO: 121057 - DNA, 35 bp, Artificial Sequence
  Synthetic oligonucleotide
tgacgctgcatgaactgtctccctcggtcgctgcc

SEQ ID NO: 121058 - DNA, 34 bp, Artificial Sequence
  Synthetic oligonucleotide
gtgaaggggacggggaggggggggaagcacacgc

SEQ ID NO: 121059 - DNA, 35 bp, Artificial Sequence
  Synthetic oligonucleotide
agcgatgcccttcccccgctaaatacgccacatgc

SEQ ID NO: 121060 - DNA, 35 bp, Artificial Sequence
  Synthetic oligonucleotide
tccgaacatccgcaccccatttgatctgatacccg

SEQ ID NO: 121061 - DNA, 35 bp, Artificial Sequence
  Synthetic oligonucleotide
atccgccaccccttctccagccttaacatgttagg

SEQ ID NO: 121062 - DNA, 36 bp, Artificial Sequence
  Synthetic oligonucleotide
gacctccgcccgctcctggattccacacaactctaa

SEQ ID NO: 121063 - DNA, 38 bp, Artificial Sequence
  Synthetic oligonucleotide
gccacgtccccagcgtccctttgccttcccaactgtga

SEQ ID NO: 121064 - DNA, 36 bp, Artificial Sequence
  Synthetic oligonucleotide
gtcaatcgtgacgtgaccgccccattccctccccta

SEQ ID NO: 121065 - DNA, 35 bp, Artificial Sequence
  Synthetic oligonucleotide
atgcacactcactattgctgcacatactttcctac

SEQ ID NO: 121066 - DNA, 34 bp, Artificial Sequence
  Synthetic oligonucleotide
gtgcgcgccgcacatctagcctccttattccctg

SEQ ID NO: 121067 - DNA, 37 bp, Artificial Sequence
  Synthetic oligonucleotide
atgcaggggaggaggcagtttggtaggtcaatgggga

SEQ ID NO: 121068 - DNA, 38 bp, Artificial Sequence
  Synthetic oligonucleotide
tcaactcgccgttggccatacgtgctctatccttttga

SEQ ID NO: 121069 - DNA, 36 bp, Artificial Sequence
  Synthetic oligonucleotide
ttgaacttgcaggaggcggaagggaggggaatggta

SEQ ID NO: 121070 - DNA, 35 bp, Artificial Sequence
  Synthetic oligonucleotide
tttcccaccactcgcttcgattctatttgctcgcc

SEQ ID NO: 121071 - DNA, 35 bp, Artificial Sequence
  Synthetic oligonucleotide
gcatttcgcccctgttgaaagcctgttcttctcca

SEQ ID NO: 121072 - DNA, 36 bp, Artificial Sequence
  Synthetic oligonucleotide
actgccccatctcgtttgttaatccctatccaagca

SEQ ID NO: 121073 - DNA, 35 bp, Artificial Sequence
  Synthetic oligonucleotide
agcctcatgcctctctgttcgcgtttctggtttca

SEQ ID NO: 121074 - DNA, 37 bp, Artificial Sequence
  Synthetic oligonucleotide
gacacggggggcggggaaagggctctccagacggaga

SEQ ID NO: 121075 - DNA, 37 bp, Artificial Sequence
  Synthetic oligonucleotide
tttggcggggggaggctgggggtggaagggatcagga

SEQ ID NO: 121076 - DNA, 38 bp, Artificial Sequence
  Synthetic oligonucleotide
tccaccacttcctgcgagtacctgcccccctcacgtga

SEQ ID NO: 121077 - DNA, 38 bp, Artificial Sequence
  Synthetic oligonucleotide
gagtgacaggggggggatagcggaaacgtgggtggtga

SEQ ID NO: 121078 - DNA, 36 bp, Artificial Sequence
  Synthetic oligonucleotide
agcactcccctcccgcttgtcataaccgttcacgta

SEQ ID NO: 121079 - DNA, 36 bp, Artificial Sequence
  Synthetic oligonucleotide
gtactgcggtcgtttcccacgggctacccttcgtta

SEQ ID NO: 121080 - DNA, 35 bp, Artificial Sequence
  Synthetic oligonucleotide
tgcccatcatctcgttgcaagacgctctatcgctc

SEQ ID NO: 121081 - DNA, 35 bp, Artificial Sequence
  Synthetic oligonucleotide
tgtcgccgggccatgttgctgggagggcgggtctc

SEQ ID NO: 121082 - DNA, 33 bp, Artificial Sequence
  Synthetic oligonucleotide
gctacgttcggcattttgtaccactccttcgtc

SEQ ID NO: 121083 - DNA, 35 bp, Artificial Sequence
  Synthetic oligonucleotide
gtgcgtgccccccttcgattttgtcattgtcaccg

SEQ ID NO: 121084 - DNA, 35 bp, Artificial Sequence
  Synthetic oligonucleotide
gcctgcagccgggcagtttactcgtcgtcctacct

SEQ ID NO: 121085 - DNA, 36 bp, Artificial Sequence
  Synthetic oligonucleotide
tcgactccgccgccgccgtacctcccccacatgtaa

SEQ ID NO: 121086 - DNA, 36 bp, Artificial Sequence
  Synthetic oligonucleotide
agtgtgcgggggggtgcggaaatacgaaacgtcaga

SEQ ID NO: 121087 - DNA, 37 bp, Artificial Sequence
  Synthetic oligonucleotide
atcactcgccccatagcctacacactcccatgcagga

SEQ ID NO: 121088 - DNA, 35 bp, Artificial Sequence
  Synthetic oligonucleotide
gagccactgcctatactgccgccacaagaccttga

SEQ ID NO: 121089 - DNA, 35 bp, Artificial Sequence
  Synthetic oligonucleotide
atcgtaaacacgttcgttgctcccccctcctggtc

SEQ ID NO: 121090 - DNA, 35 bp, Artificial Sequence
  Synthetic oligonucleotide
ttctccctccgcctgcacgacgctacacgaatttc

SEQ ID NO: 121091 - DNA, 35 bp, Artificial Sequence
  Synthetic oligonucleotide
tgatccccgtcccgcactactatcttatcgccgcg

SEQ ID NO: 121092 - DNA, 35 bp, Artificial Sequence
  Synthetic oligonucleotide
ggatggtgagagggtgacagggcgggtctctggtt

SEQ ID NO: 121093 - DNA, 35 bp, Artificial Sequence
  Synthetic oligonucleotide
tcttacgccccgcctatctgtccattattaatgca

SEQ ID NO: 121094 - DNA, 37 bp, Artificial Sequence
  Synthetic oligonucleotide
gccccgcccaccttatattacgttcgccccgtcggga

SEQ ID NO: 121095 - DNA, 36 bp, Artificial Sequence
  Synthetic oligonucleotide
tctgaaatgggcgggggggcgtagggcggttcggga

SEQ ID NO: 121096 - DNA, 36 bp, Artificial Sequence
  Synthetic oligonucleotide
gacgtcgcctccgttctctattcctgtgcccgctta

SEQ ID NO: 121097 - DNA, 35 bp, Artificial Sequence
  Synthetic oligonucleotide
acatgcctctaccgttaccaagcctccacctagcc

SEQ ID NO: 121098 - DNA, 35 bp, Artificial Sequence
  Synthetic oligonucleotide
atgtccttgcccttccgctgcagtgctccctggcc

SEQ ID NO: 121099 - DNA, 36 bp, Artificial Sequence
  Synthetic oligonucleotide
tgcgatgcccccagtccgagtcccctgctttacaca

SEQ ID NO: 121100 - DNA, 36 bp, Artificial Sequence
  Synthetic oligonucleotide
gtcacccctcccctgaacgattagacgtgctggaca

SEQ ID NO: 121101 - DNA, 35 bp, Artificial Sequence
  Synthetic oligonucleotide
ggtcaccacaccttgcctcccgcattctttgcgcc

SEQ ID NO: 121102 - DNA, 34 bp, Artificial Sequence
  Synthetic oligonucleotide
tccaactcgctcccgcgatctccctttgggttcc

SEQ ID NO: 121103 - DNA, 35 bp, Artificial Sequence
  Synthetic oligonucleotide
tgacagagggagccatgggggtgggatgaaggaag

SEQ ID NO: 121104 - DNA, 35 bp, Artificial Sequence
  Synthetic oligonucleotide
atggaacactggggcggggtgggagggtgctaggt

SEQ ID NO: 121105 - DNA, 36 bp, Artificial Sequence
  Synthetic oligonucleotide
gatgccgttcttttgcccctgtttgtcgctccttca

SEQ ID NO: 121106 - DNA, 37 bp, Artificial Sequence
  Synthetic oligonucleotide
agcccctgacgccaccgcaccatcccgtcgccctcga

SEQ ID NO: 121107 - DNA, 37 bp, Artificial Sequence
  Synthetic oligonucleotide
ggtgggaacgtacggggggggagtgctagaatgggga

SEQ ID NO: 121108 - DNA, 36 bp, Artificial Sequence
  Synthetic oligonucleotide
accccgtcgccgcctagatcgcaaatcctgtctcta

SEQ ID NO: 121109 - DNA, 36 bp, Artificial Sequence
  Synthetic oligonucleotide
tgagcgccccgccacctttgctttcttcgcccgtta

SEQ ID NO: 121110 - DNA, 35 bp, Artificial Sequence
  Synthetic oligonucleotide
acgtcccatcccgtttgcctaagggccctcccccc

SEQ ID NO: 121111 - DNA, 35 bp, Artificial Sequence
  Synthetic oligonucleotide
gctccattccgcctcgcatccacccacatatggtc

SEQ ID NO: 121112 - DNA, 35 bp, Artificial Sequence
  Synthetic oligonucleotide
ttcccacccttccctctcgataccgcgctgaaacg

SEQ ID NO: 121113 - DNA, 35 bp, Artificial Sequence
  Synthetic oligonucleotide
gcaacctctcgctgctgcctggcccctaacaagct

SEQ ID NO: 121114 - DNA, 35 bp, Artificial Sequence
  Synthetic oligonucleotide
ttaccgcccggtcatccgcattcccgttttgccaa

SEQ ID NO: 121115 - DNA, 35 bp, Artificial Sequence
  Synthetic oligonucleotide
tgagtagcccatatcgcgtacatcgttcctcccca

SEQ ID NO: 121116 - DNA, 37 bp, Artificial Sequence
  Synthetic oligonucleotide
atctcgtctgccgcccgctccctccccacgtcttcga

SEQ ID NO: 121117 - DNA, 35 bp, Artificial Sequence
  Synthetic oligonucleotide
tacccgccacctcaccgctttatccatagaccgga

SEQ ID NO: 121118 - DNA, 36 bp, Artificial Sequence
  Synthetic oligonucleotide
tggaatggggaggggagggtggatgcggggactgga

SEQ ID NO: 121119 - DNA, 38 bp, Artificial Sequence
  Synthetic oligonucleotide
acagacagggggacgcgggagggaaaaagggagcctga

SEQ ID NO: 121120 - DNA, 35 bp, Artificial Sequence
  Synthetic oligonucleotide
gcggacctcccgacgcacgtacgacctattaccta

SEQ ID NO: 121121 - DNA, 36 bp, Artificial Sequence
  Synthetic oligonucleotide
atgaaccgctgcagagcgccttttagtcccttccta

SEQ ID NO: 121122 - DNA, 35 bp, Artificial Sequence
  Synthetic oligonucleotide
aatgccctcggcgccccttttactctgtgccctta

SEQ ID NO: 121123 - DNA, 35 bp, Artificial Sequence
  Synthetic oligonucleotide
gttgacagttgagatctgccctcccacctcactcc

SEQ ID NO: 121124 - DNA, 35 bp, Artificial Sequence
  Synthetic oligonucleotide
acagccctgcatttatcccggcacatcccacttcg

SEQ ID NO: 121125 - DNA, 35 bp, Artificial Sequence
  Synthetic oligonucleotide
gtcatggtaacacatcctcgcccgcttgctccctg

SEQ ID NO: 121126 - DNA, 35 bp, Artificial Sequence
  Synthetic oligonucleotide
tcaacctcccgccgggcatgtctacttacccaact

SEQ ID NO: 121127 - DNA, 35 bp, Artificial Sequence
  Synthetic oligonucleotide
gatgctcctccatgccagccctgccacgaagcact

SEQ ID NO: 121128 - DNA, 35 bp, Artificial Sequence
  Synthetic oligonucleotide
tcgatcgccttgcctacgttctctagccacctgtt

SEQ ID NO: 121129 - DNA, 36 bp, Artificial Sequence
  Synthetic oligonucleotide
tcgatcccgcttttgccatgacacctatccgctcca

SEQ ID NO: 121130 - DNA, 36 bp, Artificial Sequence
  Synthetic oligonucleotide
acacgcgtccacagcggatagtcacccaccccctca

SEQ ID NO: 121131 - DNA, 37 bp, Artificial Sequence
  Synthetic oligonucleotide
acgactccgccaccccactgtacgccccaggcatcga

SEQ ID NO: 121132 - DNA, 36 bp, Artificial Sequence
  Synthetic oligonucleotide
tcaccctatccggtctatgccacacgtaaccccgta

SEQ ID NO: 121133 - DNA, 34 bp, Artificial Sequence
  Synthetic oligonucleotide
gaccattaccctccgcctgttatgacttgtgaac

SEQ ID NO: 121134 - DNA, 35 bp, Artificial Sequence
  Synthetic oligonucleotide
gccatctcaaccccccgtggcgcatgcttgcaccc

SEQ ID NO: 121135 - DNA, 35 bp, Artificial Sequence
  Synthetic oligonucleotide
gcgccccgcaccctccctaggtctgactctgcccc

SEQ ID NO: 121136 - DNA, 35 bp, Artificial Sequence
  Synthetic oligonucleotide
tctcgagtcagccctgctttgtttttcccccatgc

SEQ ID NO: 121137 - DNA, 35 bp, Artificial Sequence
  Synthetic oligonucleotide
tgactccccctcagcgtgccctgaccatgcagttc

SEQ ID NO: 121138 - DNA, 35 bp, Artificial Sequence
  Synthetic oligonucleotide
gacgcggcttccatctgtcaaaccagcccgtctct

SEQ ID NO: 121139 - DNA, 34 bp, Artificial Sequence
  Synthetic oligonucleotide
tgtggggggggtttgaggcgggaatatgaggtgt

SEQ ID NO: 121140 - DNA, 35 bp, Artificial Sequence
  Synthetic oligonucleotide
gttgcctatctgtacgcctggttctacgccttcaa

SEQ ID NO: 121141 - DNA, 36 bp, Artificial Sequence
  Synthetic oligonucleotide
agagaacgcgtaagtaggggggtggagggggccgaa

SEQ ID NO: 121142 - DNA, 36 bp, Artificial Sequence
  Synthetic oligonucleotide
tcatcttgccgtcagctcgcccacgttctccctaca

SEQ ID NO: 121143 - DNA, 35 bp, Artificial Sequence
  Synthetic oligonucleotide
accccggtccatcacgcctgtcgctattaccccga

SEQ ID NO: 121144 - DNA, 37 bp, Artificial Sequence
  Synthetic oligonucleotide
ggtgggacctcatcgccccttttgcctgccccctgga

SEQ ID NO: 121145 - DNA, 38 bp, Artificial Sequence
  Synthetic oligonucleotide
tctcgccccctctgttctgttacttgtctcaggtttga

SEQ ID NO: 121146 - DNA, 36 bp, Artificial Sequence
  Synthetic oligonucleotide
gcaccgccctctgcttggcccttagttcaaacccta

SEQ ID NO: 121147 - DNA, 35 bp, Artificial Sequence
  Synthetic oligonucleotide
gcgacattccgcccatgacttcggacactcactcc

SEQ ID NO: 121148 - DNA, 35 bp, Artificial Sequence
  Synthetic oligonucleotide
acccactgctgttacctcgatccgctaccctgctc

SEQ ID NO: 121149 - DNA, 35 bp, Artificial Sequence
  Synthetic oligonucleotide
gccgcctgttcctctcgctgttttcccatcttacg

SEQ ID NO: 121150 - DNA, 35 bp, Artificial Sequence
  Synthetic oligonucleotide
gcatcatctctctgcccgggggtcgtcttaccttg

SEQ ID NO: 121151 - DNA, 35 bp, Artificial Sequence
  Synthetic oligonucleotide
agccacctgtcgacctgctaccttcctaacacaca

SEQ ID NO: 121152 - DNA, 35 bp, Artificial Sequence
  Synthetic oligonucleotide
actgtgggggtggatctagggtgaagcggggggca

SEQ ID NO: 121153 - DNA, 37 bp, Artificial Sequence
  Synthetic oligonucleotide
gagagagaggcgcgtgaagggaagggggggctcaaga

SEQ ID NO: 121154 - DNA, 35 bp, Artificial Sequence
  Synthetic oligonucleotide
atcactccatgccaccacttgtattccctgtgtcc

SEQ ID NO: 121155 - DNA, 36 bp, Artificial Sequence
  Synthetic oligonucleotide
gattactaggggagggagagacaaaggaggaggagg

SEQ ID NO: 121156 - DNA, 35 bp, Artificial Sequence
  Synthetic oligonucleotide
gcaccgatagtctggtccatctctgcgtgcccact

SEQ ID NO: 121157 - DNA, 35 bp, Artificial Sequence
  Synthetic oligonucleotide
atatccagttcaacatcccgacgctctgtacctct

SEQ ID NO: 121158 - DNA, 35 bp, Artificial Sequence
  Synthetic oligonucleotide
tttgtcaccgcatttcgaattatcgggcccctcca

SEQ ID NO: 121159 - DNA, 38 bp, Artificial Sequence
  Synthetic oligonucleotide
tcccccaccacatcttgccgaccattgacacgaagtga

SEQ ID NO: 121160 - DNA, 35 bp, Artificial Sequence
  Synthetic oligonucleotide
tgtcccacccccttgagcataaacgtacctcccgc

SEQ ID NO: 121161 - DNA, 35 bp, Artificial Sequence
  Synthetic oligonucleotide
gccacccgccgattttttcacccgccaccaccacg

SEQ ID NO: 121162 - DNA, 35 bp, Artificial Sequence
  Synthetic oligonucleotide
gcatcgacgtgctcgtccgccccgttttatgccct

SEQ ID NO: 121163 - DNA, 35 bp, Artificial Sequence
  Synthetic oligonucleotide
tgccccatcccctcgtattgataccgcgcacctaa

SEQ ID NO: 121164 - DNA, 36 bp, Artificial Sequence
  Synthetic oligonucleotide
gcatctgcctcacccctgcatcccctttctctggca

SEQ ID NO: 121165 - DNA, 36 bp, Artificial Sequence
  Synthetic oligonucleotide
atgggacatcgagggtggggggtggtaggcggagga

SEQ ID NO: 121166 - DNA, 34 bp, Artificial Sequence
  Synthetic oligonucleotide
agattggggaaagcggggtaggcacgggggggta

SEQ ID NO: 121167 - DNA, 37 bp, Artificial Sequence
  Synthetic oligonucleotide
aagagggacggattgggaacggggggagttgctggga

SEQ ID NO: 121168 - DNA, 35 bp, Artificial Sequence
  Synthetic oligonucleotide
ttgtgtgtcacgctcgtctcgttttccccctgtac

SEQ ID NO: 121169 - DNA, 35 bp, Artificial Sequence
  Synthetic oligonucleotide
tgctcggcccccactatctgtctctatctgaaccc

SEQ ID NO: 121170 - DNA, 35 bp, Artificial Sequence
  Synthetic oligonucleotide
tccccagtgtgaccaccccacgcagccaggccccc

SEQ ID NO: 121171 - DNA, 35 bp, Artificial Sequence
  Synthetic oligonucleotide
tggagcagtccgccgtttcctattttcgcacgccc

SEQ ID NO: 121172 - DNA, 35 bp, Artificial Sequence
  Synthetic oligonucleotide
aagccgaccgcattacaagctccagcacccctctc

SEQ ID NO: 121173 - DNA, 35 bp, Artificial Sequence
  Synthetic oligonucleotide
agtgctaccttccgcacgtgtgctttcccttcctt

SEQ ID NO: 121174 - DNA, 36 bp, Artificial Sequence
  Synthetic oligonucleotide
gaggatgacgggagggactagcgctggtgcgggcaa

SEQ ID NO: 121175 - DNA, 36 bp, Artificial Sequence
  Synthetic oligonucleotide
tgctacctcctcggctttctctaacctgcctccgca

SEQ ID NO: 121176 - DNA, 37 bp, Artificial Sequence
  Synthetic oligonucleotide
gaaccgtaggaggggaagggcagggttccgtgggtga

SEQ ID NO: 121177 - DNA, 35 bp, Artificial Sequence
  Synthetic oligonucleotide
ggtagtgcttcagtctccgtcccgttctccttgcc

SEQ ID NO: 121178 - DNA, 35 bp, Artificial Sequence
  Synthetic oligonucleotide
tagttacccccccactgtaggtccatcagacttcc

SEQ ID NO: 121179 - DNA, 36 bp, Artificial Sequence
  Synthetic oligonucleotide
tccggaccccaggttgtcccgttctccactcgttgc

SEQ ID NO: 121180 - DNA, 35 bp, Artificial Sequence
  Synthetic oligonucleotide
gccaccgcccttcacacagctgagatgcccccatc

SEQ ID NO: 121181 - DNA, 35 bp, Artificial Sequence
  Synthetic oligonucleotide
tgatgccccgagcctatgcgacctattcctgccct

SEQ ID NO: 121182 - DNA, 35 bp, Artificial Sequence
  Synthetic oligonucleotide
tccgtcagagccgccgatgccctctgcttgttcct

SEQ ID NO: 121183 - DNA, 36 bp, Artificial Sequence
  Synthetic oligonucleotide
gtcacgttggctactgttcatcccgctccatcgtaa

SEQ ID NO: 121184 - DNA, 36 bp, Artificial Sequence
  Synthetic oligonucleotide
atccgccgtccgtcgtctgcgtctccgaagcctcca

SEQ ID NO: 121185 - DNA, 37 bp, Artificial Sequence
  Synthetic oligonucleotide
tgtaggaggggggcggtgggggcggagttaggtgaga

SEQ ID NO: 121186 - DNA, 35 bp, Artificial Sequence
  Synthetic oligonucleotide
acgtcctcccccccggcgtgctgtatttctaccac

SEQ ID NO: 121187 - DNA, 35 bp, Artificial Sequence
  Synthetic oligonucleotide
tcacatcatcccctgccgtaacctgcgccgccgcc

SEQ ID NO: 121188 - DNA, 35 bp, Artificial Sequence
  Synthetic oligonucleotide
acttcccatgcagcccctcatggtcctccgctcgc

SEQ ID NO: 121189 - DNA, 35 bp, Artificial Sequence
  Synthetic oligonucleotide
atccattagccctcacatcagtcttcgagccctcg

SEQ ID NO: 121190 - DNA, 35 bp, Artificial Sequence
  Synthetic oligonucleotide
atgacgcggttttactcctgcccaccatctcgtcg

SEQ ID NO: 121191 - DNA, 36 bp, Artificial Sequence
  Synthetic oligonucleotide
taccggcggggggggggtaaaatgctggggagggaa

SEQ ID NO: 121192 - DNA, 35 bp, Artificial Sequence
  Synthetic oligonucleotide
gcccctgactccgacccccgatgactagtgtctca

SEQ ID NO: 121193 - DNA, 37 bp, Artificial Sequence
  Synthetic oligonucleotide
gtccgaccccatccgccgccttaatgtctcatcagga

SEQ ID NO: 121194 - DNA, 37 bp, Artificial Sequence
  Synthetic oligonucleotide
ggatgggaccgtggtagaggggggaggtcgggatgga

SEQ ID NO: 121195 - DNA, 37 bp, Artificial Sequence
  Synthetic oligonucleotide
tgtccctgccccacctttccttgagatccgcccgtga

SEQ ID NO: 121196 - DNA, 36 bp, Artificial Sequence
  Synthetic oligonucleotide
accgtcacaccagttgacgcaccctttagcccccta

SEQ ID NO: 121197 - DNA, 36 bp, Artificial Sequence
  Synthetic oligonucleotide
tacccctcccgacatccttgtgctaggtcgcctcta

SEQ ID NO: 121198 - DNA, 35 bp, Artificial Sequence
  Synthetic oligonucleotide
gcgaactcgtaacgcgcccccctcatctgccgccc

SEQ ID NO: 121199 - DNA, 35 bp, Artificial Sequence
  Synthetic oligonucleotide
agtgccctcacaccccatactccgcgccgacctgc

SEQ ID NO: 121200 - DNA, 35 bp, Artificial Sequence
  Synthetic oligonucleotide
acctgtctatgccgcatctgttctgcccctcgttg

SEQ ID NO: 121201 - DNA, 36 bp, Artificial Sequence
  Synthetic oligonucleotide
gctacgcgcgcctttgcctgataacttacaccccca

SEQ ID NO: 121202 - DNA, 35 bp, Artificial Sequence
  Synthetic oligonucleotide
acctccgcccgacccagtaccttggtatccattca

SEQ ID NO: 121203 - DNA, 37 bp, Artificial Sequence
  Synthetic oligonucleotide
aatgtgtggaggaaggtggagagggtggagaaagtga

SEQ ID NO: 121204 - DNA, 35 bp, Artificial Sequence
  Synthetic oligonucleotide
gtcacctcgagtcgtcgcgcccttaggtttctccc

SEQ ID NO: 121205 - DNA, 35 bp, Artificial Sequence
  Synthetic oligonucleotide
tttccagacgaggtcgccgcccctccgccctttcc

SEQ ID NO: 121206 - DNA, 35 bp, Artificial Sequence
  Synthetic oligonucleotide
acccactatgtcatctcggtcgtaattgttccttc

SEQ ID NO: 121207 - DNA, 35 bp, Artificial Sequence
  Synthetic oligonucleotide
gtaccgcggtccatcctgcgttactatagtttcct

SEQ ID NO: 121208 - DNA, 35 bp, Artificial Sequence
  Synthetic oligonucleotide
gtcggttagcggactattcgctctgtcccgcctct

SEQ ID NO: 121209 - DNA, 36 bp, Artificial Sequence
  Synthetic oligonucleotide
gacccacttcgcccttcccaagggaaccctgttgaa

SEQ ID NO: 121210 - DNA, 36 bp, Artificial Sequence
  Synthetic oligonucleotide
gatgagcgacgagctctgccattaccgaacccctca

SEQ ID NO: 121211 - DNA, 36 bp, Artificial Sequence
  Synthetic oligonucleotide
gaggatggaacagagcagaaaaacaaggcaagtcga

SEQ ID NO: 121212 - DNA, 38 bp, Artificial Sequence
  Synthetic oligonucleotide
acagtacccgccgcatagttcccctcagcttttcctga

SEQ ID NO: 121213 - DNA, 35 bp, Artificial Sequence
  Synthetic oligonucleotide
ttaccacccgaccactgtatctgtcctgttcgata

SEQ ID NO: 121214 - DNA, 35 bp, Artificial Sequence
  Synthetic oligonucleotide
gagtacgttccgactcccccacgtatcttcaccgc

SEQ ID NO: 121215 - DNA, 35 bp, Artificial Sequence
  Synthetic oligonucleotide
tgaacctccccccgtcaacactgtgcgtcgccaca

SEQ ID NO: 121216 - DNA, 37 bp, Artificial Sequence
  Synthetic oligonucleotide
ttagccggatcaggagggggtaggggaataacgggga

SEQ ID NO: 121217 - DNA, 35 bp, Artificial Sequence
  Synthetic oligonucleotide
accatgtccagaccgcattgtgcctctttgttccg

SEQ ID NO: 121218 - DNA, 35 bp, Artificial Sequence
  Synthetic oligonucleotide
atgtacatgcgtcagtactacctgcccttctgcct

SEQ ID NO: 121219 - DNA, 34 bp, Artificial Sequence
  Synthetic oligonucleotide
atcgttgcagccgtttcgttccctccgtagctct

SEQ ID NO: 121220 - DNA, 35 bp, Artificial Sequence
  Synthetic oligonucleotide
tatgggggagggggaggtaagcaagtattgaaggt

SEQ ID NO: 121221 - DNA, 35 bp, Artificial Sequence
  Synthetic oligonucleotide
atagccacacctggtctgttccctccagttctatt

SEQ ID NO: 121222 - DNA, 35 bp, Artificial Sequence
  Synthetic oligonucleotide
gcatgccccgttgcccatgggatcccacacgtttt

SEQ ID NO: 121223 - DNA, 35 bp, Artificial Sequence
  Synthetic oligonucleotide
atcccgctccatcctgtccttttgaccgtcaggca

SEQ ID NO: 121224 - DNA, 37 bp, Artificial Sequence
  Synthetic oligonucleotide
tggaagggacggtgggggtggggcaataggtacggga

SEQ ID NO: 121225 - DNA, 37 bp, Artificial Sequence
  Synthetic oligonucleotide
aaccatctgcccgctgttatcccccccctgtttgtga

SEQ ID NO: 121226 - DNA, 38 bp, Artificial Sequence
  Synthetic oligonucleotide
tgcatctccagcccatcctatttgcgccgccattttga

SEQ ID NO: 121227 - DNA, 35 bp, Artificial Sequence
  Synthetic oligonucleotide
gatgacctcccacctgtatctaatgcaccctagac

SEQ ID NO: 121228 - DNA, 35 bp, Artificial Sequence
  Synthetic oligonucleotide
atcttccacgccctcggtttcaacttaggattccc

SEQ ID NO: 121229 - DNA, 35 bp, Artificial Sequence
  Synthetic oligonucleotide
gtgccaaccgctattcactgtgatacaccaccgcc

SEQ ID NO: 121230 - DNA, 35 bp, Artificial Sequence
  Synthetic oligonucleotide
tgtaccccctcgatcgcgcacagtgctggctcatc

SEQ ID NO: 121231 - DNA, 35 bp, Artificial Sequence
  Synthetic oligonucleotide
tgcagaggctcggcactgttctacccctgcttctc

SEQ ID NO: 121232 - DNA, 35 bp, Artificial Sequence
  Synthetic oligonucleotide
acaccctctgcaatcgttcctcatatgccctggtc

SEQ ID NO: 121233 - DNA, 35 bp, Artificial Sequence
  Synthetic oligonucleotide
aagacccctcccgtttgacccccgcctctcattcg

SEQ ID NO: 121234 - DNA, 35 bp, Artificial Sequence
  Synthetic oligonucleotide
tcgcataccgcctcagctgtatcccctcgttcctg

SEQ ID NO: 121235 - DNA, 35 bp, Artificial Sequence
  Synthetic oligonucleotide
accgccccccgtgtttgcgattccggaacaatcct

SEQ ID NO: 121236 - DNA, 35 bp, Artificial Sequence
  Synthetic oligonucleotide
tccatcatcatcgacctgctctaccgccatgtcca

SEQ ID NO: 121237 - DNA, 36 bp, Artificial Sequence
  Synthetic oligonucleotide
gactcatctccaccctgcatatagtggctcacttca

SEQ ID NO: 121238 - DNA, 36 bp, Artificial Sequence
  Synthetic oligonucleotide
ggtaggtggagggagggttagtcggggggacaggga

SEQ ID NO: 121239 - DNA, 35 bp, Artificial Sequence
  Synthetic oligonucleotide
ttgtacactcgctcccttgtaatttgggcccatac

SEQ ID NO: 121240 - DNA, 35 bp, Artificial Sequence
  Synthetic oligonucleotide
gagtcgtccaactggcttaactgacccccccgtcc

SEQ ID NO: 121241 - DNA, 35 bp, Artificial Sequence
  Synthetic oligonucleotide
gcatggtccggcgcctccaacacccttcactactc

SEQ ID NO: 121242 - DNA, 35 bp, Artificial Sequence
  Synthetic oligonucleotide
gcacgctggcgtaggcactgcatatcactcccttc

SEQ ID NO: 121243 - DNA, 35 bp, Artificial Sequence
  Synthetic oligonucleotide
gccccacccgactggtaatggctccctcgatcact

SEQ ID NO: 121244 - DNA, 35 bp, Artificial Sequence
  Synthetic oligonucleotide
ggtccgtgtaccgcctccgttagtccgcaccttct

SEQ ID NO: 121245 - DNA, 35 bp, Artificial Sequence
  Synthetic oligonucleotide
gatggtcggggagggaggcagagacgggaaggggt

SEQ ID NO: 121246 - DNA, 35 bp, Artificial Sequence
  Synthetic oligonucleotide
gtagggaggtgagggcgggggcaattgaggtttgt

SEQ ID NO: 121247 - DNA, 36 bp, Artificial Sequence
  Synthetic oligonucleotide
aaagaggaggagaaggagggaagagcgaacctaaga

SEQ ID NO: 121248 - DNA, 36 bp, Artificial Sequence
  Synthetic oligonucleotide
attcccgacccgtgcgtacgttccctctactataga

SEQ ID NO: 121249 - DNA, 37 bp, Artificial Sequence
  Synthetic oligonucleotide
acgaagggggagttaggaggcgaggacggacggggga

SEQ ID NO: 121250 - DNA, 38 bp, Artificial Sequence
  Synthetic oligonucleotide
gctggagagggaaaggtgggaatgggatcggcgaatga

SEQ ID NO: 121251 - DNA, 35 bp, Artificial Sequence
  Synthetic oligonucleotide
ggaacgcaccgccttcaagtccacaccaccctgta

SEQ ID NO: 121252 - DNA, 35 bp, Artificial Sequence
  Synthetic oligonucleotide
gcctaccgcccgactcagccctttagtagcgcacc

SEQ ID NO: 121253 - DNA, 35 bp, Artificial Sequence
  Synthetic oligonucleotide
atgccaccggttgttctccggcctccctgttagcc

SEQ ID NO: 121254 - DNA, 35 bp, Artificial Sequence
  Synthetic oligonucleotide
accccaccgatcggatgctcacatacacccccatc

SEQ ID NO: 121255 - DNA, 35 bp, Artificial Sequence
  Synthetic oligonucleotide
gtccgcccgtgcacatccggatccgacttcatact

SEQ ID NO: 121256 - DNA, 35 bp, Artificial Sequence
  Synthetic oligonucleotide
ttcgcggtcccagccccttgtactaccccgtgcct

SEQ ID NO: 121257 - DNA, 34 bp, Artificial Sequence
  Synthetic oligonucleotide
ttgacatacgcccctctcattgcttcttggttca

SEQ ID NO: 121258 - DNA, 37 bp, Artificial Sequence
  Synthetic oligonucleotide
gaattagaggggcagagagggagggaagggttacgga

SEQ ID NO: 121259 - DNA, 38 bp, Artificial Sequence
  Synthetic oligonucleotide
agatccatccgcataccctgcctacctgcacagcttga

SEQ ID NO: 121260 - DNA, 36 bp, Artificial Sequence
  Synthetic oligonucleotide
gagcgatcgccaccccgtcctgattcactcctagta

SEQ ID NO: 121261 - DNA, 35 bp, Artificial Sequence
  Synthetic oligonucleotide
gatcgcacacataacctgaaccgccctcgttgcac

SEQ ID NO: 121262 - DNA, 35 bp, Artificial Sequence
  Synthetic oligonucleotide
tgacgtctcgccacgcccaatcccagtacatcgcc

SEQ ID NO: 121263 - DNA, 34 bp, Artificial Sequence
  Synthetic oligonucleotide
tcccatcgctactcccgtgaacgcccacgctggc

SEQ ID NO: 121264 - DNA, 35 bp, Artificial Sequence
  Synthetic oligonucleotide
atgcccccccactttagcgtttcagcggcactatc

SEQ ID NO: 121265 - DNA, 35 bp, Artificial Sequence
  Synthetic oligonucleotide
tgcgtgcacctggtctatatttctgttaccacctc

SEQ ID NO: 121266 - DNA, 35 bp, Artificial Sequence
  Synthetic oligonucleotide
tcgcaagctcacagtcaccatcctgtccacatacg

SEQ ID NO: 121267 - DNA, 35 bp, Artificial Sequence
  Synthetic oligonucleotide
gacgctacagccatttcgccttccagtaaccttcg

SEQ ID NO: 121268 - DNA, 36 bp, Artificial Sequence
  Synthetic oligonucleotide
aatggggtggtgggatggcggaggaacggagctaca

SEQ ID NO: 121269 - DNA, 37 bp, Artificial Sequence
  Synthetic oligonucleotide
accgatgccccgttccaccactcttaaagacagttga

SEQ ID NO: 121270 - DNA, 35 bp, Artificial Sequence
  Synthetic oligonucleotide
gggtgtggtgggtggggcggtgaagagggggtgta

SEQ ID NO: 121271 - DNA, 35 bp, Artificial Sequence
  Synthetic oligonucleotide
tgtagccgccttctgcgattcgccccaccgtggtc

SEQ ID NO: 121272 - DNA, 34 bp, Artificial Sequence
  Synthetic oligonucleotide
tacaggctcgccacgaccgtcatcaacctccttc

SEQ ID NO: 121273 - DNA, 35 bp, Artificial Sequence
  Synthetic oligonucleotide
gtgacagatccggagggcggagggaggtaggtttg

SEQ ID NO: 121274 - DNA, 35 bp, Artificial Sequence
  Synthetic oligonucleotide
accgtgctcccactgcccctcctggacatctatat

SEQ ID NO: 121275 - DNA, 38 bp, Artificial Sequence
  Synthetic oligonucleotide
tgcccggagcttgtcgacctgctttaccccccccctga

SEQ ID NO: 121276 - DNA, 35 bp, Artificial Sequence
  Synthetic oligonucleotide
tccaccccctctgctgattatcacatttggtccac

SEQ ID NO: 121277 - DNA, 35 bp, Artificial Sequence
  Synthetic oligonucleotide
cacgccccaagtgcctctccactggttcccctgcc

SEQ ID NO: 121278 - DNA, 35 bp, Artificial Sequence
  Synthetic oligonucleotide
gacaccgacaactcgcctcccccctcgaaggtcgc

SEQ ID NO: 121279 - DNA, 35 bp, Artificial Sequence
  Synthetic oligonucleotide
taagacgggggagtgcggtagaagggagagcgccg

SEQ ID NO: 121280 - DNA, 37 bp, Artificial Sequence
  Synthetic oligonucleotide
cccaccgccccatccgtaaattctgtgaccacctcga

SEQ ID NO: 121281 - DNA, 37 bp, Artificial Sequence
  Synthetic oligonucleotide
tgcgctccccgcccctggatcctgcctttttattgga

SEQ ID NO: 121282 - DNA, 38 bp, Artificial Sequence
  Synthetic oligonucleotide
gagagggagtgagtgaggacagggggaacgagacttga

SEQ ID NO: 121283 - DNA, 34 bp, Artificial Sequence
  Synthetic oligonucleotide
gcccccaccgcaagcatcgcgattacctttgcta

SEQ ID NO: 121284 - DNA, 34 bp, Artificial Sequence
  Synthetic oligonucleotide
tcaagtcacacccctcacatgctccggcgccccc

SEQ ID NO: 121285 - DNA, 35 bp, Artificial Sequence
  Synthetic oligonucleotide
tgagtcaccctcctaccagtccgttttgcttagcc

SEQ ID NO: 121286 - DNA, 35 bp, Artificial Sequence
  Synthetic oligonucleotide
tggtaccatcattgcgtccttgaatccgcctcgcc

SEQ ID NO: 121287 - DNA, 35 bp, Artificial Sequence
  Synthetic oligonucleotide
atcgccccctctgtccgcgtcttagaactcaatcc

SEQ ID NO: 121288 - DNA, 35 bp, Artificial Sequence
  Synthetic oligonucleotide
gttgggacaagcgtccgcctgccttcacgtgctcc

SEQ ID NO: 121289 - DNA, 35 bp, Artificial Sequence
  Synthetic oligonucleotide
ttgacgcgtaggcgtgcacgttctcccccccggtg

SEQ ID NO: 121290 - DNA, 36 bp, Artificial Sequence
  Synthetic oligonucleotide
atggggagtggtgggggaatcgggccaaggcaggaa

SEQ ID NO: 121291 - DNA, 35 bp, Artificial Sequence
  Synthetic oligonucleotide
ttcacaccccccctctgttccgtttgttcgggcca

SEQ ID NO: 121292 - DNA, 35 bp, Artificial Sequence
  Synthetic oligonucleotide
aagcacgatgtaatgtctctcgccttccccctttc

SEQ ID NO: 121293 - DNA, 35 bp, Artificial Sequence
  Synthetic oligonucleotide
actcctcgccgcccgtaacatgatccgaccatgcg

SEQ ID NO: 121294 - DNA, 35 bp, Artificial Sequence
  Synthetic oligonucleotide
tcacctccgtttcttgcctggcgcctttaccgact

SEQ ID NO: 121295 - DNA, 35 bp, Artificial Sequence
  Synthetic oligonucleotide
ggaaggtacgagcggtgggggttgggagggggagt

SEQ ID NO: 121296 - DNA, 36 bp, Artificial Sequence
  Synthetic oligonucleotide
actgcccctctatgtcctctatctctcgttcggcaa

SEQ ID NO: 121297 - DNA, 36 bp, Artificial Sequence
  Synthetic oligonucleotide
gtgcccactccaacggtctatctcgctgttattgca

SEQ ID NO: 121298 - DNA, 35 bp, Artificial Sequence
  Synthetic oligonucleotide
ttcacgacccgcacatcgttttcctttctgttacc

SEQ ID NO: 121299 - DNA, 35 bp, Artificial Sequence
  Synthetic oligonucleotide
gatgtgcgtacggcaactgcacatgtcgcccctcc

SEQ ID NO: 121300 - DNA, 35 bp, Artificial Sequence
  Synthetic oligonucleotide
aacagcactccgcgcttacctcgcccatgcccttc

SEQ ID NO: 121301 - DNA, 35 bp, Artificial Sequence
  Synthetic oligonucleotide
gtcgctccgccactcttcatgactcttctcctgag

SEQ ID NO: 121302 - DNA, 35 bp, Artificial Sequence
  Synthetic oligonucleotide
aaaagcggtagcagggaaatcacgggaaggagggg

SEQ ID NO: 121303 - DNA, 35 bp, Artificial Sequence
  Synthetic oligonucleotide
aaagaggactagggggagtgatgagagggagtttg

SEQ ID NO: 121304 - DNA, 35 bp, Artificial Sequence
  Synthetic oligonucleotide
cccatcgggaggaggggaagcaagggggggaagga

SEQ ID NO: 121305 - DNA, 37 bp, Artificial Sequence
  Synthetic oligonucleotide
gcgaggagaaggggagccgggccagtgcaagggggga

SEQ ID NO: 121306 - DNA, 37 bp, Artificial Sequence
  Synthetic oligonucleotide
tccagtccgcttatcgttccgctccagccacgcttga

SEQ ID NO: 121307 - DNA, 35 bp, Artificial Sequence
  Synthetic oligonucleotide
gcatccctccagccgtcacacgtcttattccgtac

SEQ ID NO: 121308 - DNA, 35 bp, Artificial Sequence
  Synthetic oligonucleotide
tgcacactgttaccgcttagactccaccgccgttc

SEQ ID NO: 121309 - DNA, 35 bp, Artificial Sequence
  Synthetic oligonucleotide
tcctgcatccttcctagttgaatcttcccaccctg

SEQ ID NO: 121310 - DNA, 36 bp, Artificial Sequence
  Synthetic oligonucleotide
gccacgactctgccagttagctcgctcccgccccca

SEQ ID NO: 121311 - DNA, 35 bp, Artificial Sequence
  Synthetic oligonucleotide
actcacccatccctgtggttaacgctcccatccca

SEQ ID NO: 121312 - DNA, 35 bp, Artificial Sequence
  Synthetic oligonucleotide
tccagatgatgtgcctatcgccttttcctttcccc

SEQ ID NO: 121313 - DNA, 35 bp, Artificial Sequence
  Synthetic oligonucleotide
tcgcctcggaggccgtcccaccgctcgctttgccc

SEQ ID NO: 121314 - DNA, 35 bp, Artificial Sequence
  Synthetic oligonucleotide
tgtgatcgtttgtctgctcgtcgtcctccgccttc

SEQ ID NO: 121315 - DNA, 35 bp, Artificial Sequence
  Synthetic oligonucleotide
taagctcaggggcgggcgcgggaagggacgtacgg

SEQ ID NO: 121316 - DNA, 35 bp, Artificial Sequence
  Synthetic oligonucleotide
atccaccccctcccgatgtccatagttgtcgtact

SEQ ID NO: 121317 - DNA, 36 bp, Artificial Sequence
  Synthetic oligonucleotide
tgctccgccgagcccgttatgtctgtctctttgcca

SEQ ID NO: 121318 - DNA, 35 bp, Artificial Sequence
  Synthetic oligonucleotide
tgcgtcgcattccgtgacttctgcacctgtcccac

SEQ ID NO: 121319 - DNA, 35 bp, Artificial Sequence
  Synthetic oligonucleotide
gtgccactctcgcccgcgttattcgctaacctcac

SEQ ID NO: 121320 - DNA, 35 bp, Artificial Sequence
  Synthetic oligonucleotide
ttggaaccctccgatttcgaattttctcgctcccc

SEQ ID NO: 121321 - DNA, 35 bp, Artificial Sequence
  Synthetic oligonucleotide
gccgcctgcacctctcgcctacctggcctacaagc

SEQ ID NO: 121322 - DNA, 35 bp, Artificial Sequence
  Synthetic oligonucleotide
tacctccacctctacccgcgcctaaaggctcactc

SEQ ID NO: 121323 - DNA, 35 bp, Artificial Sequence
  Synthetic oligonucleotide
agcctatcactccccactttgatactgtatttccg

SEQ ID NO: 121324 - DNA, 34 bp, Artificial Sequence
  Synthetic oligonucleotide
tcatggccaggtcacgggccctgcaccccccact

SEQ ID NO: 121325 - DNA, 35 bp, Artificial Sequence
  Synthetic oligonucleotide
accaggggctaggagggggggtaatggaaaatgaa

SEQ ID NO: 121326 - DNA, 36 bp, Artificial Sequence
  Synthetic oligonucleotide
atgcccacacgagcgaatatttgagcctccccgcca

SEQ ID NO: 121327 - DNA, 35 bp, Artificial Sequence
  Synthetic oligonucleotide
tgcacctacactagtgcactcgcgcccctgacgcc

SEQ ID NO: 121328 - DNA, 35 bp, Artificial Sequence
  Synthetic oligonucleotide
tgcaccgcctttcgttaccgcccgcattccctgcc

SEQ ID NO: 121329 - DNA, 35 bp, Artificial Sequence
  Synthetic oligonucleotide
tgtggccgggggtgggtcggggggcgaagggcttg

SEQ ID NO: 121330 - DNA, 35 bp, Artificial Sequence
  Synthetic oligonucleotide
tcaccccattgcttattccgccgatcactgttttg

SEQ ID NO: 121331 - DNA, 35 bp, Artificial Sequence
  Synthetic oligonucleotide
tctgccccgacccagctcttgtacagctacgtact

SEQ ID NO: 121332 - DNA, 35 bp, Artificial Sequence
  Synthetic oligonucleotide
atgcaagctccactaacgccccctcgccgcagtct

SEQ ID NO: 121333 - DNA, 38 bp, Artificial Sequence
  Synthetic oligonucleotide
gaccagctcccggcgttgttctggctccaccactttga

SEQ ID NO: 121334 - DNA, 37 bp, Artificial Sequence
  Synthetic oligonucleotide
ggaggtggtggggtggacttatggcggtaccttttga

SEQ ID NO: 121335 - DNA, 35 bp, Artificial Sequence
  Synthetic oligonucleotide
gatcgcacccacaatgtgccctcgcttcatccagc

SEQ ID NO: 121336 - DNA, 35 bp, Artificial Sequence
  Synthetic oligonucleotide
gtcgccacggcaataccccgccttacaccaccggc

SEQ ID NO: 121337 - DNA, 35 bp, Artificial Sequence
  Synthetic oligonucleotide
acaaaggtaggagaaggggaggtgcatggatggtg

SEQ ID NO: 121338 - DNA, 35 bp, Artificial Sequence
  Synthetic oligonucleotide
gttcgccgcacaagtgccactagtcccttcctatt

SEQ ID NO: 121339 - DNA, 35 bp, Artificial Sequence
  Synthetic oligonucleotide
actcgcccccaatgtcatttcgccaaccattattt

SEQ ID NO: 121340 - DNA, 37 bp, Artificial Sequence
  Synthetic oligonucleotide
gacggtatggtaagggcgggtaacgggggaatgggga

SEQ ID NO: 121341 - DNA, 37 bp, Artificial Sequence
  Synthetic oligonucleotide
agactgaggggggagaaaggggaagggattagtatga

SEQ ID NO: 121342 - DNA, 35 bp, Artificial Sequence
  Synthetic oligonucleotide
gcatgtcttcgtcaatcaagcgtctccccgccccc

SEQ ID NO: 121343 - DNA, 35 bp, Artificial Sequence
  Synthetic oligonucleotide
tacgaccaccctctggtaacaacggacgttcttcc

SEQ ID NO: 121344 - DNA, 35 bp, Artificial Sequence
  Synthetic oligonucleotide
tcacgtgtcagtgacgcttctcataccttcacctc

SEQ ID NO: 121345 - DNA, 35 bp, Artificial Sequence
  Synthetic oligonucleotide
gcgactcacggtctgacgtcaatcactccctcgct

SEQ ID NO: 121346 - DNA, 35 bp, Artificial Sequence
  Synthetic oligonucleotide
ttcgaagccgactgtacagctcatccccccctgct

SEQ ID NO: 121347 - DNA, 37 bp, Artificial Sequence
  Synthetic oligonucleotide
acgtggacggggagggggaggaacatacgtggaagga

SEQ ID NO: 121348 - DNA, 35 bp, Artificial Sequence
  Synthetic oligonucleotide
aaggggagacacgggaagggcggggttatcgggga

SEQ ID NO: 121349 - DNA, 35 bp, Artificial Sequence
  Synthetic oligonucleotide
gaggtgggcagggggggtaggaaaataatgggcac

SEQ ID NO: 121350 - DNA, 35 bp, Artificial Sequence
  Synthetic oligonucleotide
gatgttcgcgccatcctcattcccgtttttgcagc

SEQ ID NO: 121351 - DNA, 35 bp, Artificial Sequence
  Synthetic oligonucleotide
gacgcccccccgttatggtatctggcccccttgtt

SEQ ID NO: 121352 - DNA, 38 bp, Artificial Sequence
  Synthetic oligonucleotide
tccgacgggggagggcgggcggggttgctttccgctga

SEQ ID NO: 121353 - DNA, 35 bp, Artificial Sequence
  Synthetic oligonucleotide
tctgcccctcgctctcattgcctttacgatggcac

SEQ ID NO: 121354 - DNA, 35 bp, Artificial Sequence
  Synthetic oligonucleotide
gtctcccccgtcgctctttgacccgcaagtattac

SEQ ID NO: 121355 - DNA, 34 bp, Artificial Sequence
  Synthetic oligonucleotide
gcgaccactgcccagttttacctcgtcttccgtc

SEQ ID NO: 121356 - DNA, 35 bp, Artificial Sequence
  Synthetic oligonucleotide
gcatcctccctggttctccagccagttatcttgtc

SEQ ID NO: 121357 - DNA, 35 bp, Artificial Sequence
  Synthetic oligonucleotide
taaccgccgctctcgccttagattagttcacccct

SEQ ID NO: 121358 - DNA, 35 bp, Artificial Sequence
  Synthetic oligonucleotide
tcctaccgcctctcgttttccttattggtgcctgt

SEQ ID NO: 121359 - DNA, 35 bp, Artificial Sequence
  Synthetic oligonucleotide
taatgggaggggtgggggggagataaccttggatt

SEQ ID NO: 121360 - DNA, 35 bp, Artificial Sequence
  Synthetic oligonucleotide
tccggtcgctccttcaccccgctttgtagcccgtt

SEQ ID NO: 121361 - DNA, 36 bp, Artificial Sequence
  Synthetic oligonucleotide
tccccgtaatggctgtaattataccctgccccccca

SEQ ID NO: 121362 - DNA, 37 bp, Artificial Sequence
  Synthetic oligonucleotide
tacatccgcctcacctgaccttgggttacatactcga

SEQ ID NO: 121363 - DNA, 36 bp, Artificial Sequence
  Synthetic oligonucleotide
ctaccgcctatcctacaaatgtcctccgtctttcga

SEQ ID NO: 121364 - DNA, 36 bp, Artificial Sequence
  Synthetic oligonucleotide
attacctcagatgcgttccatccgtttcgccactta

SEQ ID NO: 121365 - DNA, 34 bp, Artificial Sequence
  Synthetic oligonucleotide
ttgtccacccgcatgctactcccctctatggtac

SEQ ID NO: 121366 - DNA, 35 bp, Artificial Sequence
  Synthetic oligonucleotide
tcgctccttcgcaccctgttgaccctaggttatcc

SEQ ID NO: 121367 - DNA, 35 bp, Artificial Sequence
  Synthetic oligonucleotide
atccatccgccgtgtcgcttcagcggtatcacatc

SEQ ID NO: 121368 - DNA, 35 bp, Artificial Sequence
  Synthetic oligonucleotide
actaccgctcccgctgttctgtcttctcccatgat

SEQ ID NO: 121369 - DNA, 36 bp, Artificial Sequence
  Synthetic oligonucleotide
tccaccatgccctcaatgcgcccatctgacccgcct

SEQ ID NO: 121370 - DNA, 35 bp, Artificial Sequence
  Synthetic oligonucleotide
ttccagcctcgccgcaataacctgcacttctcaca

SEQ ID NO: 121371 - DNA, 36 bp, Artificial Sequence
  Synthetic oligonucleotide
gtccgccgcacgcccccatacgcccaagcttgccca

SEQ ID NO: 121372 - DNA, 35 bp, Artificial Sequence
  Synthetic oligonucleotide
taagaaagcgtcccccgccgtttgacccacctcca

SEQ ID NO: 121373 - DNA, 36 bp, Artificial Sequence
  Synthetic oligonucleotide
tgcctacctcacctcacataatcgcctgccattgca

SEQ ID NO: 121374 - DNA, 38 bp, Artificial Sequence
  Synthetic oligonucleotide
tgcgaaaggggactggagggaagggagggagagtctga

SEQ ID NO: 121375 - DNA, 35 bp, Artificial Sequence
  Synthetic oligonucleotide
tctaaccgcctcccgctattaagcctgtgcgaacc

SEQ ID NO: 121376 - DNA, 35 bp, Artificial Sequence
  Synthetic oligonucleotide
acaacgcagttgactccctcatttatatgcctccg

SEQ ID NO: 121377 - DNA, 33 bp, Artificial Sequence
  Synthetic oligonucleotide
accctcggccggtacctgctcatctctctccgg

SEQ ID NO: 121378 - DNA, 35 bp, Artificial Sequence
  Synthetic oligonucleotide
gtcgcccgatcctttttcccgtccaactggccttg

SEQ ID NO: 121379 - DNA, 35 bp, Artificial Sequence
  Synthetic oligonucleotide
aagctcgcccccctccctacttccgcacacgcttg

SEQ ID NO: 121380 - DNA, 35 bp, Artificial Sequence
  Synthetic oligonucleotide
gtccgcctctgcttttagtgcctgtcccgtcacct

SEQ ID NO: 121381 - DNA, 37 bp, Artificial Sequence
  Synthetic oligonucleotide
gttgggaggtgagggcgaatggggagcatgttcaaga

SEQ ID NO: 121382 - DNA, 37 bp, Artificial Sequence
  Synthetic oligonucleotide
acaggatggggcggataggggacgggtcgatggggga

SEQ ID NO: 121383 - DNA, 38 bp, Artificial Sequence
  Synthetic oligonucleotide
gtcacagtcagagtgctccaccgcccacctcagtctga

SEQ ID NO: 121384 - DNA, 35 bp, Artificial Sequence
  Synthetic oligonucleotide
tgcctcgctatctgccctggctactttacctctac

SEQ ID NO: 121385 - DNA, 35 bp, Artificial Sequence
  Synthetic oligonucleotide
ataccgccctgtacgctagtatgagcccttatctc

SEQ ID NO: 121386 - DNA, 35 bp, Artificial Sequence
  Synthetic oligonucleotide
tgcctactgccccaaccgaactcaagtcacccccg

SEQ ID NO: 121387 - DNA, 36 bp, Artificial Sequence
  Synthetic oligonucleotide
accgccattgtgagcggattcagccctttcctccca

SEQ ID NO: 121388 - DNA, 31 bp, Artificial Sequence
  Synthetic oligonucleotide
gctggtcacgctgccccatccgagcccccga

SEQ ID NO: 121389 - DNA, 37 bp, Artificial Sequence
  Synthetic oligonucleotide
atcgccccccagacttaacactgcactatcctctgga

SEQ ID NO: 121390 - DNA, 35 bp, Artificial Sequence
  Synthetic oligonucleotide
gtccggagcctgttttcagccagcctcgctccacc

SEQ ID NO: 121391 - DNA, 36 bp, Artificial Sequence
  Synthetic oligonucleotide
agcacacgcgctggcctccctccccgaaccggtacc

SEQ ID NO: 121392 - DNA, 35 bp, Artificial Sequence
  Synthetic oligonucleotide
tacctgcccaccctggacgtagtacgactgacctc

SEQ ID NO: 121393 - DNA, 35 bp, Artificial Sequence
  Synthetic oligonucleotide
gccagctagacgtgcctcgtccccttactcccgtc

SEQ ID NO: 121394 - DNA, 35 bp, Artificial Sequence
  Synthetic oligonucleotide
gacgtcgcattcttcctctgttccgtgatccaacg

SEQ ID NO: 121395 - DNA, 36 bp, Artificial Sequence
  Synthetic oligonucleotide
tccgcccgccggccggtattctcgcccttgttccaa

SEQ ID NO: 121396 - DNA, 37 bp, Artificial Sequence
  Synthetic oligonucleotide
gcacccgtacagagtacctaccccgccgccttcttga

SEQ ID NO: 121397 - DNA, 35 bp, Artificial Sequence
  Synthetic oligonucleotide
gacgctgctcacggtcgcccactcctcggatttcc

SEQ ID NO: 121398 - DNA, 35 bp, Artificial Sequence
  Synthetic oligonucleotide
gatgtcctcctggtgctggccttcttctttcgttc

SEQ ID NO: 121399 - DNA, 35 bp, Artificial Sequence
  Synthetic oligonucleotide
tcgaccggtggggctgggggggctgggaacttggg

SEQ ID NO: 121400 - DNA, 35 bp, Artificial Sequence
  Synthetic oligonucleotide
acctcccgcccctcatattcgtaacgtacccactg

SEQ ID NO: 121401 - DNA, 35 bp, Artificial Sequence
  Synthetic oligonucleotide
acccaccgtgtccgtaccctacgcctgtgcctcct

SEQ ID NO: 121402 - DNA, 35 bp, Artificial Sequence
  Synthetic oligonucleotide
tcgttgctccactgttccctgtctggctctactca

SEQ ID NO: 121403 - DNA, 37 bp, Artificial Sequence
  Synthetic oligonucleotide
gttgggggggcaaaccggggaatgagacgcaagggga

SEQ ID NO: 121404 - DNA, 35 bp, Artificial Sequence
  Synthetic oligonucleotide
attgcactcccccatcacatggtcgcacgcgttgc

SEQ ID NO: 121405 - DNA, 35 bp, Artificial Sequence
  Synthetic oligonucleotide
tgtctggcccacattgcttcacgatctcgtcctct

SEQ ID NO: 121406 - DNA, 35 bp, Artificial Sequence
  Synthetic oligonucleotide
gacaagcgcaccaggccgctaccaagttttcttct

SEQ ID NO: 121407 - DNA, 35 bp, Artificial Sequence
  Synthetic oligonucleotide
tccgacactgctctcctgtctttgacccagtcaca

SEQ ID NO: 121408 - DNA, 35 bp, Artificial Sequence
  Synthetic oligonucleotide
tgtgtgtagcactcctgttgtgatcctccgccacc

SEQ ID NO: 121409 - DNA, 35 bp, Artificial Sequence
  Synthetic oligonucleotide
acacgtaggcttactgagtccatccacgccctgcc

SEQ ID NO: 121410 - DNA, 35 bp, Artificial Sequence
  Synthetic oligonucleotide
gtggggacaggggtggagtatggcggagggacggc

SEQ ID NO: 121411 - DNA, 35 bp, Artificial Sequence
  Synthetic oligonucleotide
gacatccctcaaaaatgccgcaatgcccccccccg

SEQ ID NO: 121412 - DNA, 35 bp, Artificial Sequence
  Synthetic oligonucleotide
agtgtcctccgccgttccttccgcgctcccgaact

SEQ ID NO: 121413 - DNA, 35 bp, Artificial Sequence
  Synthetic oligonucleotide
aacgcacggtcaccttggccgggttttccactctt

SEQ ID NO: 121414 - DNA, 36 bp, Artificial Sequence
  Synthetic oligonucleotide
gccatgccccctcggtggtatctccctcttcaataa

SEQ ID NO: 121415 - DNA, 37 bp, Artificial Sequence
  Synthetic oligonucleotide
gaggtgcagggacggagggccgggaaggatcggagga

SEQ ID NO: 121416 - DNA, 35 bp, Artificial Sequence
  Synthetic oligonucleotide
accctgccactccctcctgtacgtgaggcccttga

SEQ ID NO: 121417 - DNA, 35 bp, Artificial Sequence
  Synthetic oligonucleotide
gcattgtcacgtcttgctcgatcacgccctccgta

SEQ ID NO: 121418 - DNA, 35 bp, Artificial Sequence
  Synthetic oligonucleotide
tcctccccccagcaaggtttcgcggtcttaccccc

SEQ ID NO: 121419 - DNA, 35 bp, Artificial Sequence
  Synthetic oligonucleotide
gtgatccgccctattgatgcgctcatatcgacttc

SEQ ID NO: 121420 - DNA, 35 bp, Artificial Sequence
  Synthetic oligonucleotide
gaagccgctgcgatcgttatcttcaccattcaccg

SEQ ID NO: 121421 - DNA, 35 bp, Artificial Sequence
  Synthetic oligonucleotide
gtgtgcggtgagcgtgcattctcccatctccctcg

SEQ ID NO: 121422 - DNA, 35 bp, Artificial Sequence
  Synthetic oligonucleotide
gtaccagctcgatctttttgcgccttcctctcttt

SEQ ID NO: 121423 - DNA, 36 bp, Artificial Sequence
  Synthetic oligonucleotide
agctcctcacgccgccccctgcacgtcccttggaca

SEQ ID NO: 121424 - DNA, 37 bp, Artificial Sequence
  Synthetic oligonucleotide
gccaccatccctgcgcgatatgctactccttgttcga

SEQ ID NO: 121425 - DNA, 38 bp, Artificial Sequence
  Synthetic oligonucleotide
gaaagaggcgcagggaagggggaaaagattgcgagtga

SEQ ID NO: 121426 - DNA, 36 bp, Artificial Sequence
  Synthetic oligonucleotide
gatgttctcgccccgtgttccaagcatgcccgctta

SEQ ID NO: 121427 - DNA, 35 bp, Artificial Sequence
  Synthetic oligonucleotide
gcgcaagctcccactatttttgctgcgccccatcc

SEQ ID NO: 121428 - DNA, 35 bp, Artificial Sequence
  Synthetic oligonucleotide
tgagctcgtcgcactcgtccctgaggccgccctcc

SEQ ID NO: 121429 - DNA, 35 bp, Artificial Sequence
  Synthetic oligonucleotide
gtacttgccccattcgatttagtctcctccctagg

SEQ ID NO: 121430 - DNA, 35 bp, Artificial Sequence
  Synthetic oligonucleotide
ctgtacgtccacccatgctgtcctccttcgtgtct

SEQ ID NO: 121431 - DNA, 35 bp, Artificial Sequence
  Synthetic oligonucleotide
gcgattggcgcctcgttccctgttgcactatctgt

SEQ ID NO: 121432 - DNA, 36 bp, Artificial Sequence
  Synthetic oligonucleotide
gtgggtggatggtggggtgctagtggaggcaggcaa

SEQ ID NO: 121433 - DNA, 36 bp, Artificial Sequence
  Synthetic oligonucleotide
gacgactcaccccctggctgtcttcctctagtttca

SEQ ID NO: 121434 - DNA, 38 bp, Artificial Sequence
  Synthetic oligonucleotide
tcagtgcccatatgcgtctttccactccctcctcatga

SEQ ID NO: 121435 - DNA, 36 bp, Artificial Sequence
  Synthetic oligonucleotide
atgggtggggtgggtagggttttatgctcgacgaca

SEQ ID NO: 121436 - DNA, 37 bp, Artificial Sequence
  Synthetic oligonucleotide
tcacacacggccacttgtgctctacccctttttccga

SEQ ID NO: 121437 - DNA, 36 bp, Artificial Sequence
  Synthetic oligonucleotide
tgtggcctcctgcgttgctccatcacccattccgga

SEQ ID NO: 121438 - DNA, 36 bp, Artificial Sequence
  Synthetic oligonucleotide
ttgagcgccgcgcgtaagctatcccaccttctccta

SEQ ID NO: 121439 - DNA, 35 bp, Artificial Sequence
  Synthetic oligonucleotide
ttgcccccatcaggcaaacgtccgtctttaatacc

SEQ ID NO: 121440 - DNA, 35 bp, Artificial Sequence
  Synthetic oligonucleotide
atagtcgccgtacagcccggttacagcaccatccc

SEQ ID NO: 121441 - DNA, 35 bp, Artificial Sequence
  Synthetic oligonucleotide
tccgtacggcgggccattgcgcacatcatacctcc

SEQ ID NO: 121442 - DNA, 35 bp, Artificial Sequence
  Synthetic oligonucleotide
acctgctacacccggttcaatctgacgcactttcc

SEQ ID NO: 121443 - DNA, 35 bp, Artificial Sequence
  Synthetic oligonucleotide
acatccgacgccactgctgaaaacagctccctatc

SEQ ID NO: 121444 - DNA, 35 bp, Artificial Sequence
  Synthetic oligonucleotide
gtgctatgcgtgcctcatccggttcgtttcttgtc

SEQ ID NO: 121445 - DNA, 35 bp, Artificial Sequence
  Synthetic oligonucleotide
aacaactgtcctgcagcgcctacgccttcgccttc

SEQ ID NO: 121446 - DNA, 37 bp, Artificial Sequence
  Synthetic oligonucleotide
gaagagggggaaagagagtcggggggaggcggtggga

SEQ ID NO: 121447 - DNA, 38 bp, Artificial Sequence
  Synthetic oligonucleotide
tggatcgcctccctggttcgttcactttgccttgctga

SEQ ID NO: 121448 - DNA, 36 bp, Artificial Sequence
  Synthetic oligonucleotide
atcccacacctgcctcaggctccacacactttgtga

SEQ ID NO: 121449 - DNA, 36 bp, Artificial Sequence
  Synthetic oligonucleotide
gtaccgtgcaatccgtgctatcactcgccattccta

SEQ ID NO: 121450 - DNA, 35 bp, Artificial Sequence
  Synthetic oligonucleotide
gcgatcgctgtcttgtcttccaccctgcgccctta

SEQ ID NO: 121451 - DNA, 35 bp, Artificial Sequence
  Synthetic oligonucleotide
gccaccacataatttctgtttcatgctgatctcac

SEQ ID NO: 121452 - DNA, 35 bp, Artificial Sequence
  Synthetic oligonucleotide
gaccccgcccattgctactcatggttctcattcac

SEQ ID NO: 121453 - DNA, 35 bp, Artificial Sequence
  Synthetic oligonucleotide
agtcccgcctctctgccttcaaataccgtcgactc

SEQ ID NO: 121454 - DNA, 27 bp, Artificial Sequence
  Synthetic oligonucleotide
gtccacccctcggtccccagccctctc

SEQ ID NO: 121455 - DNA, 35 bp, Artificial Sequence
  Synthetic oligonucleotide
cctcacaccgcaaccgtgcctaacctaccctttcg

SEQ ID NO: 121456 - DNA, 35 bp, Artificial Sequence
  Synthetic oligonucleotide
ttacgtgtcatcgcaaccctcacatgccgccgcct

SEQ ID NO: 121457 - DNA, 37 bp, Artificial Sequence
  Synthetic oligonucleotide
atgaaagggggtgggctgaggggaacactgggggaga

SEQ ID NO: 121458 - DNA, 37 bp, Artificial Sequence
  Synthetic oligonucleotide
gcagaatgcgcggggagggaggaaatgagtggggcga

SEQ ID NO: 121459 - DNA, 38 bp, Artificial Sequence
  Synthetic oligonucleotide
gagaagagggaggggagggtgtaatcagggcggtgtga

SEQ ID NO: 121460 - DNA, 35 bp, Artificial Sequence
  Synthetic oligonucleotide
ccatcgcccccgcagcccttccgcctctacagacc

SEQ ID NO: 121461 - DNA, 35 bp, Artificial Sequence
  Synthetic oligonucleotide
tggtacagcccacattctcgactgcctattgcccc

SEQ ID NO: 121462 - DNA, 35 bp, Artificial Sequence
  Synthetic oligonucleotide
gagcccagaccgttatcgcccgatgccatcctcgc

SEQ ID NO: 121463 - DNA, 35 bp, Artificial Sequence
  Synthetic oligonucleotide
gagatcgagcgtacgaatcgcctcaccctgtagtc

SEQ ID NO: 121464 - DNA, 35 bp, Artificial Sequence
  Synthetic oligonucleotide
tcactccacttggatctgccactgttacttcttag

SEQ ID NO: 121465 - DNA, 35 bp, Artificial Sequence
  Synthetic oligonucleotide
gcgaccgtagccttgttcctcacgttctgatccat

SEQ ID NO: 121466 - DNA, 35 bp, Artificial Sequence
  Synthetic oligonucleotide
catatcagtcacgactccgcgtgcgtgtttctccc

SEQ ID NO: 121467 - DNA, 35 bp, Artificial Sequence
  Synthetic oligonucleotide
aaacgcatcccgcccaccgccaccacagtctggcc

SEQ ID NO: 121468 - DNA, 35 bp, Artificial Sequence
  Synthetic oligonucleotide
gttgacagcctgttcccgtatcacactaccaccgc

SEQ ID NO: 121469 - DNA, 35 bp, Artificial Sequence
  Synthetic oligonucleotide
gacccctcgacaatatctttgagctcgtctccctc

SEQ ID NO: 121470 - DNA, 35 bp, Artificial Sequence
  Synthetic oligonucleotide
ttcacccacgcctgctttcgcaccaccagagtgcg

SEQ ID NO: 121471 - DNA, 35 bp, Artificial Sequence
  Synthetic oligonucleotide
acagagccgccgcccgctccccgttattacatgca

SEQ ID NO: 121472 - DNA, 36 bp, Artificial Sequence
  Synthetic oligonucleotide
tactccgcccactgtaatcgctgattctttacctga

SEQ ID NO: 121473 - DNA, 36 bp, Artificial Sequence
  Synthetic oligonucleotide
gcagacctcgcctgttttgaattgatctaccaccta

SEQ ID NO: 121474 - DNA, 35 bp, Artificial Sequence
  Synthetic oligonucleotide
atgccagttcactgtccacttatcacccaccttgc

SEQ ID NO: 121475 - DNA, 35 bp, Artificial Sequence
  Synthetic oligonucleotide
actaccccctgaccgtatcccttagctgttctatg

SEQ ID NO: 121476 - DNA, 35 bp, Artificial Sequence
  Synthetic oligonucleotide
tcttgcgcacacgactgtcatcgtatctcctctct

SEQ ID NO: 121477 - DNA, 37 bp, Artificial Sequence
  Synthetic oligonucleotide
accaccccctgcttttagacacactcgccaagcgtga

SEQ ID NO: 121478 - DNA, 35 bp, Artificial Sequence
  Synthetic oligonucleotide
gtatcgcttcggacccgcctcgttctcgctccata

SEQ ID NO: 121479 - DNA, 35 bp, Artificial Sequence
  Synthetic oligonucleotide
atgcgcatcacctcggtaacccaggctgctcaccc

SEQ ID NO: 121480 - DNA, 35 bp, Artificial Sequence
  Synthetic oligonucleotide
acgtgccacatccttgttttcgatctccgctaccc

SEQ ID NO: 121481 - DNA, 35 bp, Artificial Sequence
  Synthetic oligonucleotide
aatacccacccatgtgtttcctcccctcacgctct

SEQ ID NO: 121482 - DNA, 37 bp, Artificial Sequence
  Synthetic oligonucleotide
gatcaccccctgccatgtatacacttttttccttaga

SEQ ID NO: 121483 - DNA, 37 bp, Artificial Sequence
  Synthetic oligonucleotide
gcgcataccggtactgcccgccggccctccttcccga

SEQ ID NO: 121484 - DNA, 36 bp, Artificial Sequence
  Synthetic oligonucleotide
gtggggaggcggaagagaggaccggagatgtggcga

SEQ ID NO: 121485 - DNA, 37 bp, Artificial Sequence
  Synthetic oligonucleotide
ggtcacccctccgccgacctctgctccgtgctctcga

SEQ ID NO: 121486 - DNA, 38 bp, Artificial Sequence
  Synthetic oligonucleotide
gccgggtaggagcgtggggcggggggggaatgtagtga

SEQ ID NO: 121487 - DNA, 35 bp, Artificial Sequence
  Synthetic oligonucleotide
tgcaatcgggtatggtgttccctcctcgcctccgc

SEQ ID NO: 121488 - DNA, 35 bp, Artificial Sequence
  Synthetic oligonucleotide
gcgaacgccactaatctgttttctcctccatctcg

SEQ ID NO: 121489 - DNA, 35 bp, Artificial Sequence
  Synthetic oligonucleotide
atcgaaaagggtccaaaggggtgggaggtgaagtg

SEQ ID NO: 121490 - DNA, 35 bp, Artificial Sequence
  Synthetic oligonucleotide
agaccgtaccgaactgccatcccccctaggtatct

SEQ ID NO: 121491 - DNA, 36 bp, Artificial Sequence
  Synthetic oligonucleotide
ttgcacgcccatccagtattggtaactcctctccga

SEQ ID NO: 121492 - DNA, 37 bp, Artificial Sequence
  Synthetic oligonucleotide
aactgacggtgtgggagggggctacaagcatggagga

SEQ ID NO: 121493 - DNA, 37 bp, Artificial Sequence
  Synthetic oligonucleotide
gagtgggggttagcatccgggaggggtgcgaagggga

SEQ ID NO: 121494 - DNA, 36 bp, Artificial Sequence
  Synthetic oligonucleotide
tacacccgccatctgctatttcgctatatctcaata

SEQ ID NO: 121495 - DNA, 35 bp, Artificial Sequence
  Synthetic oligonucleotide
tccgataagcgcggatgtactatcgttcgctcccc

SEQ ID NO: 121496 - DNA, 35 bp, Artificial Sequence
  Synthetic oligonucleotide
tcaagtctccgctcactcacgtctatccacagccc

SEQ ID NO: 121497 - DNA, 35 bp, Artificial Sequence
  Synthetic oligonucleotide
gtccaacccggtattaggtccctttccctttcgtc

SEQ ID NO: 121498 - DNA, 35 bp, Artificial Sequence
  Synthetic oligonucleotide
taacgcaacatcactcgtcgattcgattccctccg

SEQ ID NO: 121499 - DNA, 35 bp, Artificial Sequence
  Synthetic oligonucleotide
actccaaccgctagggcttcctgctcacgaccctt

SEQ ID NO: 121500 - DNA, 35 bp, Artificial Sequence
  Synthetic oligonucleotide
gacattttcgccacgtgctcctccgcccccgcaca

SEQ ID NO: 121501 - DNA, 37 bp, Artificial Sequence
  Synthetic oligonucleotide
gactacgtactccatccgcctcttgtgacgaccctga

SEQ ID NO: 121502 - DNA, 38 bp, Artificial Sequence
  Synthetic oligonucleotide
gcgcatgtgctgctctctatgtaccttcctcctcttga

SEQ ID NO: 121503 - DNA, 36 bp, Artificial Sequence
  Synthetic oligonucleotide
ggatgggtccatgggtgggagggtagcattccatta

SEQ ID NO: 121504 - DNA, 35 bp, Artificial Sequence
  Synthetic oligonucleotide
tgcgacctccgctgtgctcgactccagctctcatc

SEQ ID NO: 121505 - DNA, 35 bp, Artificial Sequence
  Synthetic oligonucleotide
ttcacgttcaccctgtcgctcataaacccgccgct

SEQ ID NO: 121506 - DNA, 35 bp, Artificial Sequence
  Synthetic oligonucleotide
gttgcgcccgcctatctttctttgcacttacgttt

SEQ ID NO: 121507 - DNA, 35 bp, Artificial Sequence
  Synthetic oligonucleotide
gcgcatcccaccgcgtctcccgtctgtcactcaca

SEQ ID NO: 121508 - DNA, 36 bp, Artificial Sequence
  Synthetic oligonucleotide
cctcacgccacgtgtctgttttctgttgcctcccca

SEQ ID NO: 121509 - DNA, 38 bp, Artificial Sequence
  Synthetic oligonucleotide
tagaagaggcgaggggggaaatatagggagggtaatga

SEQ ID NO: 121510 - DNA, 36 bp, Artificial Sequence
  Synthetic oligonucleotide
tccacccccttaggtttacagacccccttgccgtga

SEQ ID NO: 121511 - DNA, 35 bp, Artificial Sequence
  Synthetic oligonucleotide
ttccacgtacgctatgacaagcggtttcccctccc

SEQ ID NO: 121512 - DNA, 30 bp, Artificial Sequence
  Synthetic oligonucleotide
gccaactcccgcactgaacttatgtctgcc

SEQ ID NO: 121513 - DNA, 35 bp, Artificial Sequence
  Synthetic oligonucleotide
tccgccccgtccggtccttgtccatcagtcgctcc

SEQ ID NO: 121514 - DNA, 35 bp, Artificial Sequence
  Synthetic oligonucleotide
tacgccggcaacccttacgttctgcttttggttcc

SEQ ID NO: 121515 - DNA, 35 bp, Artificial Sequence
  Synthetic oligonucleotide
tcacgccgctctcttcttcgtacacgtggtatctc

SEQ ID NO: 121516 - DNA, 35 bp, Artificial Sequence
  Synthetic oligonucleotide
acatcgcctccgcattcaagattctacccttaccg

SEQ ID NO: 121517 - DNA, 35 bp, Artificial Sequence
  Synthetic oligonucleotide
tagcccaggctcgctgtcggtccatcgctccttcg

SEQ ID NO: 121518 - DNA, 35 bp, Artificial Sequence
  Synthetic oligonucleotide
tgtgacttgtcctatcctgttgtcttgcctacctg

SEQ ID NO: 121519 - DNA, 35 bp, Artificial Sequence
  Synthetic oligonucleotide
taacaagcagtatgggtgagtggtggggagggggt

SEQ ID NO: 121520 - DNA, 36 bp, Artificial Sequence
  Synthetic oligonucleotide
tccctgtcgtccgttgccttagtttttctccctcca

SEQ ID NO: 121521 - DNA, 37 bp, Artificial Sequence
  Synthetic oligonucleotide
ggtggggtggggggaaggtggatggatacgtataaga

SEQ ID NO: 121522 - DNA, 36 bp, Artificial Sequence
  Synthetic oligonucleotide
acacctccgcaccccttcgatttatctcgctgacga

SEQ ID NO: 121523 - DNA, 36 bp, Artificial Sequence
  Synthetic oligonucleotide
gaacggtaagccaccagcgggtgtgggcggggggga

SEQ ID NO: 121524 - DNA, 37 bp, Artificial Sequence
  Synthetic oligonucleotide
gcttaacgccggcacctcgctgaattcctctcgctga

SEQ ID NO: 121525 - DNA, 38 bp, Artificial Sequence
  Synthetic oligonucleotide
gatggcgcctatgggttcttgctccatctttcccttga

SEQ ID NO: 121526 - DNA, 35 bp, Artificial Sequence
  Synthetic oligonucleotide
acgcctcctcaccttctacactcaggcccgggaac

SEQ ID NO: 121527 - DNA, 35 bp, Artificial Sequence
  Synthetic oligonucleotide
tgactcacgcactctgttacacctggttagtctac

SEQ ID NO: 121528 - DNA, 35 bp, Artificial Sequence
  Synthetic oligonucleotide
tccttcctggaccgccccgcctatggttcccgccc

SEQ ID NO: 121529 - DNA, 35 bp, Artificial Sequence
  Synthetic oligonucleotide
gtcgcattgccgctgccgggtctcccgttcacctt

SEQ ID NO: 121530 - DNA, 36 bp, Artificial Sequence
  Synthetic oligonucleotide
gtcacgatgggtgggggagatgagaggatggggcga

SEQ ID NO: 121531 - DNA, 36 bp, Artificial Sequence
  Synthetic oligonucleotide
ggaggaaaggggggggtagtggcgcaatcggacgga

SEQ ID NO: 121532 - DNA, 38 bp, Artificial Sequence
  Synthetic oligonucleotide
gtgcaaagaacgggggggcatggaggaagccggggtga

SEQ ID NO: 121533 - DNA, 35 bp, Artificial Sequence
  Synthetic oligonucleotide
tcactcgctccaccaggctacgtcccaaacatgcc

SEQ ID NO: 121534 - DNA, 35 bp, Artificial Sequence
  Synthetic oligonucleotide
tgacggtggggggggcacagtggggtggtcacggc

SEQ ID NO: 121535 - DNA, 35 bp, Artificial Sequence
  Synthetic oligonucleotide
gtcctggccagctgaacttatgcctttccccgtgc

SEQ ID NO: 121536 - DNA, 35 bp, Artificial Sequence
  Synthetic oligonucleotide
ttgttacctctgctcgtgacatccttgtcccattc

SEQ ID NO: 121537 - DNA, 34 bp, Artificial Sequence
  Synthetic oligonucleotide
tgcataacggggaggagaaaacaggggacgggaa

SEQ ID NO: 121538 - DNA, 36 bp, Artificial Sequence
  Synthetic oligonucleotide
gccttgccgccatgccttgccgatcacttccccgga

SEQ ID NO: 121539 - DNA, 37 bp, Artificial Sequence
  Synthetic oligonucleotide
gtcactgcctgcccttgctttacctacctctttggga

SEQ ID NO: 121540 - DNA, 38 bp, Artificial Sequence
  Synthetic oligonucleotide
ttgcgagggggggcggatataggagagggtgagggtga

SEQ ID NO: 121541 - DNA, 35 bp, Artificial Sequence
  Synthetic oligonucleotide
acccgcctgatgttcagctcacccggccctcacac

SEQ ID NO: 121542 - DNA, 35 bp, Artificial Sequence
  Synthetic oligonucleotide
actacccactggccgtgttttaggcctacttaacc

SEQ ID NO: 121543 - DNA, 35 bp, Artificial Sequence
  Synthetic oligonucleotide
accacgctcctttacatgccccccagttccccggt

SEQ ID NO: 121544 - DNA, 35 bp, Artificial Sequence
  Synthetic oligonucleotide
gaaggccaaccagaccgccgcccgtatacacgttt

SEQ ID NO: 121545 - DNA, 35 bp, Artificial Sequence
  Synthetic oligonucleotide
gtctacgcggggtctttcgaacctggtccctctca

SEQ ID NO: 121546 - DNA, 35 bp, Artificial Sequence
  Synthetic oligonucleotide
acacgcctctcccgtttggttgttcctttatccga

SEQ ID NO: 121547 - DNA, 37 bp, Artificial Sequence
  Synthetic oligonucleotide
gtgggcgtgagggaacaggaggaagggggcaccagga

SEQ ID NO: 121548 - DNA, 37 bp, Artificial Sequence
  Synthetic oligonucleotide
agtgaaacgggaacagccgtgggggggagggcaatga

SEQ ID NO: 121549 - DNA, 35 bp, Artificial Sequence
  Synthetic oligonucleotide
actcgccgagctatatctaatgtctttgcgcctcc

SEQ ID NO: 121550 - DNA, 35 bp, Artificial Sequence
  Synthetic oligonucleotide
ggaccgcaccacttcctatgcgtttttatcccttc

SEQ ID NO: 121551 - DNA, 35 bp, Artificial Sequence
  Synthetic oligonucleotide
gcgccgcccagtacctcatccctcccgccctcgag

SEQ ID NO: 121552 - DNA, 37 bp, Artificial Sequence
  Synthetic oligonucleotide
tgccaatgccagtgttgtgccttgccatccccgcccg

SEQ ID NO: 121553 - DNA, 35 bp, Artificial Sequence
  Synthetic oligonucleotide
gcccgcagtcccctgcttacctgtgggccctacct

SEQ ID NO: 121554 - DNA, 35 bp, Artificial Sequence
  Synthetic oligonucleotide
ttttaccacccttgcgctgtataagccacccccct

SEQ ID NO: 121555 - DNA, 35 bp, Artificial Sequence
  Synthetic oligonucleotide
gtatgtcggcccagtctcccgcactcccctgccct

SEQ ID NO: 121556 - DNA, 35 bp, Artificial Sequence
  Synthetic oligonucleotide
tgcccacgcccggcattttttagctttacgttcca

SEQ ID NO: 121557 - DNA, 35 bp, Artificial Sequence
  Synthetic oligonucleotide
ttgcaccgcactagttaccttccgtcccttgatca

SEQ ID NO: 121558 - DNA, 35 bp, Artificial Sequence
  Synthetic oligonucleotide
tgctggtcgcgcacgctagaaacctccctcctcgc

SEQ ID NO: 121559 - DNA, 35 bp, Artificial Sequence
  Synthetic oligonucleotide
acgggagggaggggagggcgcaccatcatagactc

SEQ ID NO: 121560 - DNA, 35 bp, Artificial Sequence
  Synthetic oligonucleotide
tcgtagtcctccttccgtctaccttcccgtcccgg

SEQ ID NO: 121561 - DNA, 35 bp, Artificial Sequence
  Synthetic oligonucleotide
ttggagccgcctcactccattggattgtaccacct

SEQ ID NO: 121562 - DNA, 35 bp, Artificial Sequence
  Synthetic oligonucleotide
atggtctacgtcgccccctgtcagcgctctcacct

SEQ ID NO: 121563 - DNA, 35 bp, Artificial Sequence
  Synthetic oligonucleotide
tcacgtccaggtcccccttcggattctcccccgtt

SEQ ID NO: 121564 - DNA, 35 bp, Artificial Sequence
  Synthetic oligonucleotide
gtgtgtttgccccatcgccgtattcgcactgttca

SEQ ID NO: 121565 - DNA, 36 bp, Artificial Sequence
  Synthetic oligonucleotide
gattccgccccttctcatcagtccgtacactaccga

SEQ ID NO: 121566 - DNA, 37 bp, Artificial Sequence
  Synthetic oligonucleotide
tttgcccagcactccgcctccacgtacttccttcgga

SEQ ID NO: 121567 - DNA, 38 bp, Artificial Sequence
  Synthetic oligonucleotide
atccggagagggcaagcacggggaggggcggaaaatga

SEQ ID NO: 121568 - DNA, 35 bp, Artificial Sequence
  Synthetic oligonucleotide
tgtctccgcacccgataaattgcttgtcccttgcc

SEQ ID NO: 121569 - DNA, 35 bp, Artificial Sequence
  Synthetic oligonucleotide
agtggatcgcctgccccgtcaatagctgccctgtc

SEQ ID NO: 121570 - DNA, 35 bp, Artificial Sequence
  Synthetic oligonucleotide
gagaccccgcatcacgctttcgtgccaccccacat

SEQ ID NO: 121571 - DNA, 35 bp, Artificial Sequence
  Synthetic oligonucleotide
acgtcttaccccatgctgataacccgttcttccct

SEQ ID NO: 121572 - DNA, 35 bp, Artificial Sequence
  Synthetic oligonucleotide
acctccagtgctaccccttctgtctttggttctct

SEQ ID NO: 121573 - DNA, 36 bp, Artificial Sequence
  Synthetic oligonucleotide
gtcactacactgtcctactgcacttggctcctgcaa

SEQ ID NO: 121574 - DNA, 35 bp, Artificial Sequence
  Synthetic oligonucleotide
gctccccacccgttttgcctctagctcattttaca

SEQ ID NO: 121575 - DNA, 36 bp, Artificial Sequence
  Synthetic oligonucleotide
acctgcacgcacttctggcctgacccccatttcgca

SEQ ID NO: 121576 - DNA, 37 bp, Artificial Sequence
  Synthetic oligonucleotide
ttgcgtctcagctcgtctcttgcctaccccacttgga

SEQ ID NO: 121577 - DNA, 35 bp, Artificial Sequence
  Synthetic oligonucleotide
tcacacccgagcgtggcgccattccgttctttccg

SEQ ID NO: 121578 - DNA, 35 bp, Artificial Sequence
  Synthetic oligonucleotide
aacgctactccctgtgtgcctcccaatgcattcct

SEQ ID NO: 121579 - DNA, 35 bp, Artificial Sequence
  Synthetic oligonucleotide
gccgtcccaccccgctctggcacgttctaccgtca

SEQ ID NO: 121580 - DNA, 36 bp, Artificial Sequence
  Synthetic oligonucleotide
actgacaccctccctacccgttccgcttggacccga

SEQ ID NO: 121581 - DNA, 38 bp, Artificial Sequence
  Synthetic oligonucleotide
gtgaatgggaggacgggtggggaagaggggagtgttga

SEQ ID NO: 121582 - DNA, 36 bp, Artificial Sequence
  Synthetic oligonucleotide
aactcgtaagacgcgtaccccctctgtcttccccta

SEQ ID NO: 121583 - DNA, 35 bp, Artificial Sequence
  Synthetic oligonucleotide
gacatcacaccctttaagcccccgttccaccagta

SEQ ID NO: 121584 - DNA, 35 bp, Artificial Sequence
  Synthetic oligonucleotide
tctcgactacacccgcccgcaagacccattcgcgc

SEQ ID NO: 121585 - DNA, 35 bp, Artificial Sequence
  Synthetic oligonucleotide
gcacgcacctcctgtttgctattccgtcttgcctc

SEQ ID NO: 121586 - DNA, 35 bp, Artificial Sequence
  Synthetic oligonucleotide
accatccttcgtgtcacctaccccttgctgttgtc

SEQ ID NO: 121587 - DNA, 35 bp, Artificial Sequence
  Synthetic oligonucleotide
acccgctcccgcctcgaccctctggctgctgattc

SEQ ID NO: 121588 - DNA, 35 bp, Artificial Sequence
  Synthetic oligonucleotide
tgtggggaaggaggtggggtgtcgggcgggtggtt

SEQ ID NO: 121589 - DNA, 35 bp, Artificial Sequence
  Synthetic oligonucleotide
gcctcggccacgcacctcatcgtatccctgccaca

SEQ ID NO: 121590 - DNA, 36 bp, Artificial Sequence
  Synthetic oligonucleotide
tccacagcccgagtcacctgtcatccatgcctccca

SEQ ID NO: 121591 - DNA, 33 bp, Artificial Sequence
  Synthetic oligonucleotide
tcctacctacgaccctgctgcaaccgctttcga

SEQ ID NO: 121592 - DNA, 35 bp, Artificial Sequence
  Synthetic oligonucleotide
aacaccccccccgctgaaatcctcccgagccacac

SEQ ID NO: 121593 - DNA, 35 bp, Artificial Sequence
  Synthetic oligonucleotide
gacccaatcacgtcccgaccatctgccgcccgtgc

SEQ ID NO: 121594 - DNA, 35 bp, Artificial Sequence
  Synthetic oligonucleotide
attcctcccgaccgctggcttagtgccccgttctc

SEQ ID NO: 121595 - DNA, 35 bp, Artificial Sequence
  Synthetic oligonucleotide
tgttgtccgtccacatctcctcgctgttacccact

SEQ ID NO: 121596 - DNA, 35 bp, Artificial Sequence
  Synthetic oligonucleotide
actgaccgctttccttgcttggttgcacattccct

SEQ ID NO: 121597 - DNA, 35 bp, Artificial Sequence
  Synthetic oligonucleotide
gccgccccctgccacctgcaccttatcatccgaca

SEQ ID NO: 121598 - DNA, 36 bp, Artificial Sequence
  Synthetic oligonucleotide
ttgcgaccgccccactattacgtaagtgccccttca

SEQ ID NO: 121599 - DNA, 35 bp, Artificial Sequence
  Synthetic oligonucleotide
gtcagtgcacgttacttacccttgcgtctcgcccc

SEQ ID NO: 121600 - DNA, 35 bp, Artificial Sequence
  Synthetic oligonucleotide
acgactattccgcacgcacagactacccctccccg

SEQ ID NO: 121601 - DNA, 37 bp, Artificial Sequence
  Synthetic oligonucleotide
gcgaccatccgtcccgtacttctcctccgtcttgaga

SEQ ID NO: 121602 - DNA, 35 bp, Artificial Sequence
  Synthetic oligonucleotide
tcatttgggtgggatagcgggaaggggaagtcgga

SEQ ID NO: 121603 - DNA, 37 bp, Artificial Sequence
  Synthetic oligonucleotide
gccccgcttacatccccgtgcgtcgaccgccccttga

SEQ ID NO: 121604 - DNA, 38 bp, Artificial Sequence
  Synthetic oligonucleotide
acgcatacccctgtgcagttcgcccagccacctcttga

SEQ ID NO: 121605 - DNA, 35 bp, Artificial Sequence
  Synthetic oligonucleotide
gcgatggtcgcagatccctctcctctttcacgcta

SEQ ID NO: 121606 - DNA, 35 bp, Artificial Sequence
  Synthetic oligonucleotide
gccattgccgcagccgagtttgtacatcgtccacc

SEQ ID NO: 121607 - DNA, 35 bp, Artificial Sequence
  Synthetic oligonucleotide
tgtacggccggctgtcgaactttacccgtgcctcc

SEQ ID NO: 121608 - DNA, 35 bp, Artificial Sequence
  Synthetic oligonucleotide
aaccggagggcctccactgttgttagtcttccttc

SEQ ID NO: 121609 - DNA, 35 bp, Artificial Sequence
  Synthetic oligonucleotide
ttcaacacgctttgatcgaatccctctgttccctg

SEQ ID NO: 121610 - DNA, 35 bp, Artificial Sequence
  Synthetic oligonucleotide
gacgttccacccctcccgccactctgggcgtcctg

SEQ ID NO: 121611 - DNA, 34 bp, Artificial Sequence
  Synthetic oligonucleotide
gcttcccccaaccacctgcgcccgtctctgtact

SEQ ID NO: 121612 - DNA, 37 bp, Artificial Sequence
  Synthetic oligonucleotide
gagaaagggggaggacggggtatacgtggagaccgga

SEQ ID NO: 121613 - DNA, 37 bp, Artificial Sequence
  Synthetic oligonucleotide
tagagatcaggggtaggggagggggaaggctgtggga

SEQ ID NO: 121614 - DNA, 35 bp, Artificial Sequence
  Synthetic oligonucleotide
tcacatcgcgccgtcgtaacttcctcatttgctga

SEQ ID NO: 121615 - DNA, 38 bp, Artificial Sequence
  Synthetic oligonucleotide
gggggaggtgggagatggagggtaggtagaaatcgtga

SEQ ID NO: 121616 - DNA, 35 bp, Artificial Sequence
  Synthetic oligonucleotide
taccgcccccccaccacggatcacggtaggtgccc

SEQ ID NO: 121617 - DNA, 35 bp, Artificial Sequence
  Synthetic oligonucleotide
aactcacccggtctttctttccgtatcaacgtgcc

SEQ ID NO: 121618 - DNA, 35 bp, Artificial Sequence
  Synthetic oligonucleotide
actcgctgtttccgcccatctgtcctcatatgctc

SEQ ID NO: 121619 - DNA, 35 bp, Artificial Sequence
  Synthetic oligonucleotide
tatcgccctgtttccgctgtctctttcagtgtctc

SEQ ID NO: 121620 - DNA, 35 bp, Artificial Sequence
  Synthetic oligonucleotide
ataccaccgtccagctcattcttcgcgtatccgtc

SEQ ID NO: 121621 - DNA, 35 bp, Artificial Sequence
  Synthetic oligonucleotide
aaggtggggggaaggaagaacggggcaggatatgg

SEQ ID NO: 121622 - DNA, 35 bp, Artificial Sequence
  Synthetic oligonucleotide
gtgacccgcctagactatcaggccatgtttttttt

SEQ ID NO: 121623 - DNA, 37 bp, Artificial Sequence
  Synthetic oligonucleotide
attgcacgcacggctctttaccgatctaccttcccga

SEQ ID NO: 121624 - DNA, 37 bp, Artificial Sequence
  Synthetic oligonucleotide
tgtatccacccgctcctctttacaagcctgttgccga

SEQ ID NO: 121625 - DNA, 36 bp, Artificial Sequence
  Synthetic oligonucleotide
accaccaccattgcttgcctgttgctttcactagta

SEQ ID NO: 121626 - DNA, 36 bp, Artificial Sequence
  Synthetic oligonucleotide
tcattcaccgcccctccaccgagatcacctcctgta

SEQ ID NO: 121627 - DNA, 35 bp, Artificial Sequence
  Synthetic oligonucleotide
tccctggtcacccttttaagcctgccccacactgc

SEQ ID NO: 121628 - DNA, 35 bp, Artificial Sequence
  Synthetic oligonucleotide
gcacccctcgtgtcaattgtcccggctactttttc

SEQ ID NO: 121629 - DNA, 35 bp, Artificial Sequence
  Synthetic oligonucleotide
gtccctgtcctcgagtaccatgaccttgtcctccg

SEQ ID NO: 121630 - DNA, 35 bp, Artificial Sequence
  Synthetic oligonucleotide
tcccaggcccaccatgtcccgacctccatcaggct

SEQ ID NO: 121631 - DNA, 37 bp, Artificial Sequence
  Synthetic oligonucleotide
gatagggtggaggaagttgcgggtggaacatgggaga

SEQ ID NO: 121632 - DNA, 37 bp, Artificial Sequence
  Synthetic oligonucleotide
aaagcggactgggggagtttcacgggagggcggggga

SEQ ID NO: 121633 - DNA, 37 bp, Artificial Sequence
  Synthetic oligonucleotide
tgaccggaggcgagtggagggggggggtagagtggga

SEQ ID NO: 121634 - DNA, 36 bp, Artificial Sequence
  Synthetic oligonucleotide
agtccccactggtccgcccgcgttccctccttcgta

SEQ ID NO: 121635 - DNA, 35 bp, Artificial Sequence
  Synthetic oligonucleotide
gttcacgccgtacacatgcccaacccctaccacac

SEQ ID NO: 121636 - DNA, 35 bp, Artificial Sequence
  Synthetic oligonucleotide
accctcccccgtccgcggactagacctacccgagc

SEQ ID NO: 121637 - DNA, 37 bp, Artificial Sequence
  Synthetic oligonucleotide
gactgacaccgtctatcgttttactccttagctcctc

SEQ ID NO: 121638 - DNA, 35 bp, Artificial Sequence
  Synthetic oligonucleotide
ttcacgcacgtcaccacaccatattgttttgcctg

SEQ ID NO: 121639 - DNA, 35 bp, Artificial Sequence
  Synthetic oligonucleotide
atgaccggtgtcacgcctctcttcatctgaccttg

SEQ ID NO: 121640 - DNA, 35 bp, Artificial Sequence
  Synthetic oligonucleotide
gcacagaccctgcattgccatgccccgccattact

SEQ ID NO: 121641 - DNA, 35 bp, Artificial Sequence
  Synthetic oligonucleotide
gccgcctccgcccgatctgatttgccttcattgaa

SEQ ID NO: 121642 - DNA, 35 bp, Artificial Sequence
  Synthetic oligonucleotide
gttgcgcataatgcgtgccgtaaccccctctacac

SEQ ID NO: 121643 - DNA, 35 bp, Artificial Sequence
  Synthetic oligonucleotide
ggaaaccgcgtattatgcccgtcgtccacctgtcc

SEQ ID NO: 121644 - DNA, 35 bp, Artificial Sequence
  Synthetic oligonucleotide
gccttcccgcccgttggccgagaggttccccttcc

SEQ ID NO: 121645 - DNA, 35 bp, Artificial Sequence
  Synthetic oligonucleotide
tgacccacgccctcttgtcgattattcagtccggc

SEQ ID NO: 121646 - DNA, 34 bp, Artificial Sequence
  Synthetic oligonucleotide
accaacctcacgctcaggccaaccacatgcctct

SEQ ID NO: 121647 - DNA, 35 bp, Artificial Sequence
  Synthetic oligonucleotide
tcaatgcgaggagggggtagggttggagtggaagt

SEQ ID NO: 121648 - DNA, 37 bp, Artificial Sequence
  Synthetic oligonucleotide
aatgggtggggtcggggggacgtgattggggattgga

SEQ ID NO: 121649 - DNA, 35 bp, Artificial Sequence
  Synthetic oligonucleotide
acccgaacactgttgctcgcctaacagcccccgcc

SEQ ID NO: 121650 - DNA, 35 bp, Artificial Sequence
  Synthetic oligonucleotide
gagttggtccatctctatctgtgcaatttgtcctc

SEQ ID NO: 121651 - DNA, 34 bp, Artificial Sequence
  Synthetic oligonucleotide
gaccacctcccccctcagtcgttgcttttcatag

SEQ ID NO: 121652 - DNA, 36 bp, Artificial Sequence
  Synthetic oligonucleotide
agctccacccgccctgttccgcattacctgcctgca

SEQ ID NO: 121653 - DNA, 37 bp, Artificial Sequence
  Synthetic oligonucleotide
atcggtacaggaggggaaaggggcgaaccgcggggga

SEQ ID NO: 121654 - DNA, 35 bp, Artificial Sequence
  Synthetic oligonucleotide
tgaacgcccccaccgcccttcacctgtataactga

SEQ ID NO: 121655 - DNA, 36 bp, Artificial Sequence
  Synthetic oligonucleotide
tcagatgtagccctcgcgccgcccgagccctgctga

SEQ ID NO: 121656 - DNA, 38 bp, Artificial Sequence
  Synthetic oligonucleotide
gcgaagggtggaggggggtaggccggtgagtcatgtga

SEQ ID NO: 121657 - DNA, 35 bp, Artificial Sequence
  Synthetic oligonucleotide
tccgccacctcacttatcttccgttagtctgttcc

SEQ ID NO: 121658 - DNA, 35 bp, Artificial Sequence
  Synthetic oligonucleotide
ttggagggaaggtgaagggttattgtggggcgggc

SEQ ID NO: 121659 - DNA, 35 bp, Artificial Sequence
  Synthetic oligonucleotide
tcacgctatgtgtcaacttttctcgcttctccgtc

SEQ ID NO: 121660 - DNA, 35 bp, Artificial Sequence
  Synthetic oligonucleotide
gcccacggataagcccctcccccgccgctggcttc

SEQ ID NO: 121661 - DNA, 36 bp, Artificial Sequence
  Synthetic oligonucleotide
aaaccctgccctgaattgtctatcctcatgctgcca

SEQ ID NO: 121662 - DNA, 36 bp, Artificial Sequence
  Synthetic oligonucleotide
aacacctgctccatccttccttcggcccgccgcgca

SEQ ID NO: 121663 - DNA, 36 bp, Artificial Sequence
  Synthetic oligonucleotide
gaggtgcctgcttgtctacaccgctccctttgttca

SEQ ID NO: 121664 - DNA, 35 bp, Artificial Sequence
  Synthetic oligonucleotide
gtcaacccccaatcgtactatctgccccactacga

SEQ ID NO: 121665 - DNA, 37 bp, Artificial Sequence
  Synthetic oligonucleotide
gagagagccatcagcgtttccaccaccatccatccga

SEQ ID NO: 121666 - DNA, 38 bp, Artificial Sequence
  Synthetic oligonucleotide
tccaacgccctccgaatgcccatctaggtactccctga

SEQ ID NO: 121667 - DNA, 38 bp, Artificial Sequence
  Synthetic oligonucleotide
gccaaccatccatctacgtttgccgaacctgttcttga

SEQ ID NO: 121668 - DNA, 36 bp, Artificial Sequence
  Synthetic oligonucleotide
acgtacaagcccggccgaccgcatccctccgttcta

SEQ ID NO: 121669 - DNA, 35 bp, Artificial Sequence
  Synthetic oligonucleotide
tgccttactcccccgatggcgccaaggtacctccc

SEQ ID NO: 121670 - DNA, 34 bp, Artificial Sequence
  Synthetic oligonucleotide
actgatcccaggatcaggggttcactctacttcc

SEQ ID NO: 121671 - DNA, 35 bp, Artificial Sequence
  Synthetic oligonucleotide
actgagcgacagcatcactgccatagcctcctcgc

SEQ ID NO: 121672 - DNA, 35 bp, Artificial Sequence
  Synthetic oligonucleotide
gctcagtgccacaagctcccctaagattccgccct

SEQ ID NO: 121673 - DNA, 35 bp, Artificial Sequence
  Synthetic oligonucleotide
tgctccgatctctggtccgcccccgctcacttggt

SEQ ID NO: 121674 - DNA, 38 bp, Artificial Sequence
  Synthetic oligonucleotide
gaaagggcggaatggaggagaggggggtaatgcgatga

SEQ ID NO: 121675 - DNA, 34 bp, Artificial Sequence
  Synthetic oligonucleotide
atccctcagttgtgtccatcgcccgtctcgtcta

SEQ ID NO: 121676 - DNA, 35 bp, Artificial Sequence
  Synthetic oligonucleotide
gccacctcacccacgagggtctcgcccctgtacgc

SEQ ID NO: 121677 - DNA, 35 bp, Artificial Sequence
  Synthetic oligonucleotide
atcacgatctccgtccattccgtctaccaccgtgc

SEQ ID NO: 121678 - DNA, 35 bp, Artificial Sequence
  Synthetic oligonucleotide
gcaaccgttggggtgggtgggtccagggttttgtc

SEQ ID NO: 121679 - DNA, 35 bp, Artificial Sequence
  Synthetic oligonucleotide
ggagtaggcatcacactgcgcttctacacccattc

SEQ ID NO: 121680 - DNA, 35 bp, Artificial Sequence
  Synthetic oligonucleotide
gacgagccctcggcccagtgttcaagtccctccct

SEQ ID NO: 121681 - DNA, 37 bp, Artificial Sequence
  Synthetic oligonucleotide
gatgttcccctgccgcctgttcctaaagccttcttga

SEQ ID NO: 121682 - DNA, 36 bp, Artificial Sequence
  Synthetic oligonucleotide
gctacacgtagcacccgccatacatcttccgccgta

SEQ ID NO: 121683 - DNA, 35 bp, Artificial Sequence
  Synthetic oligonucleotide
tgctgaacctgccctccgaattatttgctagcctc

SEQ ID NO: 121684 - DNA, 34 bp, Artificial Sequence
  Synthetic oligonucleotide
actgggggcgggcaatataggcggggaaggaggg

SEQ ID NO: 121685 - DNA, 35 bp, Artificial Sequence
  Synthetic oligonucleotide
tcagttcagcctccccctctgtgaaccagccacct

SEQ ID NO: 121686 - DNA, 35 bp, Artificial Sequence
  Synthetic oligonucleotide
gccgataccctcaacatgcctagcctggcacctct

SEQ ID NO: 121687 - DNA, 35 bp, Artificial Sequence
  Synthetic oligonucleotide
tcagcatcgctggtcccttgctccgttctcccata

SEQ ID NO: 121688 - DNA, 35 bp, Artificial Sequence
  Synthetic oligonucleotide
tgaatgtgtcgttgcgtcacccgataaccccctcc

SEQ ID NO: 121689 - DNA, 35 bp, Artificial Sequence
  Synthetic oligonucleotide
atggtcacccgttgtccctgctgattgcgttctcc

SEQ ID NO: 121690 - DNA, 35 bp, Artificial Sequence
  Synthetic oligonucleotide
actcgtgctccagagtgcgaggtccgtttcttctc

SEQ ID NO: 121691 - DNA, 35 bp, Artificial Sequence
  Synthetic oligonucleotide
tatacggccccctgcgctactcgtctctcttccgg

SEQ ID NO: 121692 - DNA, 35 bp, Artificial Sequence
  Synthetic oligonucleotide
taagtgcgggaaagctgggagggaagggcgttaat

SEQ ID NO: 121693 - DNA, 35 bp, Artificial Sequence
  Synthetic oligonucleotide
gagggtggggggggtaatgggcggtggcattcact

SEQ ID NO: 121694 - DNA, 35 bp, Artificial Sequence
  Synthetic oligonucleotide
tgccccgctactccactcatcctcggtgccccgct

SEQ ID NO: 121695 - DNA, 36 bp, Artificial Sequence
  Synthetic oligonucleotide
tcgccccgccgataagcgtctcgctccccggtccca

SEQ ID NO: 121696 - DNA, 35 bp, Artificial Sequence
  Synthetic oligonucleotide
gccggctcaacattgctccctcccgtgttctcgca

SEQ ID NO: 121697 - DNA, 37 bp, Artificial Sequence
  Synthetic oligonucleotide
gccgagtcctcagccagccgttccctcgcccctccga

SEQ ID NO: 121698 - DNA, 37 bp, Artificial Sequence
  Synthetic oligonucleotide
gatgggatgaatgcaaagggggctggggcgggtagga

SEQ ID NO: 121699 - DNA, 37 bp, Artificial Sequence
  Synthetic oligonucleotide
ttggagcgcaggaataggaggaaagggagggaaggga

SEQ ID NO: 121700 - DNA, 35 bp, Artificial Sequence
  Synthetic oligonucleotide
gccattgtcgccccgcaccgaattccttatcctga

SEQ ID NO: 121701 - DNA, 36 bp, Artificial Sequence
  Synthetic oligonucleotide
tactactccgcacattgcatgactgcacctgttcta

SEQ ID NO: 121702 - DNA, 35 bp, Artificial Sequence
  Synthetic oligonucleotide
ttatccccgccaggatcgccgccctctatctacgc

SEQ ID NO: 121703 - DNA, 35 bp, Artificial Sequence
  Synthetic oligonucleotide
atgatgcgccctctcatctcctgtcttgtccaggc

SEQ ID NO: 121704 - DNA, 35 bp, Artificial Sequence
  Synthetic oligonucleotide
tgcgggtgatggaggggggggaggatcgaagcgtc

SEQ ID NO: 121705 - DNA, 35 bp, Artificial Sequence
  Synthetic oligonucleotide
tgtatgcccagtgagctccctccccactttgcccg

SEQ ID NO: 121706 - DNA, 35 bp, Artificial Sequence
  Synthetic oligonucleotide
gtacagcaggaaggcggggggcggaggtaatggcg

SEQ ID NO: 121707 - DNA, 36 bp, Artificial Sequence
  Synthetic oligonucleotide
accaccgctttgtttccctgcgatagcctccccgca

SEQ ID NO: 121708 - DNA, 36 bp, Artificial Sequence
  Synthetic oligonucleotide
gcattgcccaccaatgacctatcaacactggcctca

SEQ ID NO: 121709 - DNA, 38 bp, Artificial Sequence
  Synthetic oligonucleotide
tcacctctctcctgtgacaacggaccaccacttcctga

SEQ ID NO: 121710 - DNA, 35 bp, Artificial Sequence
  Synthetic oligonucleotide
aacagcccgtcctcctatgctcacctgcgtctaac

SEQ ID NO: 121711 - DNA, 35 bp, Artificial Sequence
  Synthetic oligonucleotide
ggagggggtaagacgaagaaggaactggggggagg

SEQ ID NO: 121712 - DNA, 37 bp, Artificial Sequence
  Synthetic oligonucleotide
ggtggagagccgggggcgtagtggagcgggggagaga

SEQ ID NO: 121713 - DNA, 37 bp, Artificial Sequence
  Synthetic oligonucleotide
gaatgagccaattgggtggaggggggacgagaaacga

SEQ ID NO: 121714 - DNA, 35 bp, Artificial Sequence
  Synthetic oligonucleotide
gtgccctgcagtagtttgcctccctcgtccaccga

SEQ ID NO: 121715 - DNA, 37 bp, Artificial Sequence
  Synthetic oligonucleotide
gctgcgactcgcccgctgcgtattccttgccctccga

SEQ ID NO: 121716 - DNA, 37 bp, Artificial Sequence
  Synthetic oligonucleotide
acgggaaagcatggagcggggagggagggacctgtga

SEQ ID NO: 121717 - DNA, 36 bp, Artificial Sequence
  Synthetic oligonucleotide
accccctgagctccagctatgcctctcgatacacta

SEQ ID NO: 121718 - DNA, 35 bp, Artificial Sequence
  Synthetic oligonucleotide
gacgatgagggccatcgtcgcatacttttaccacc

SEQ ID NO: 121719 - DNA, 35 bp, Artificial Sequence
  Synthetic oligonucleotide
agaggcacctcctgctactttttggactctcatcc

SEQ ID NO: 121720 - DNA, 35 bp, Artificial Sequence
  Synthetic oligonucleotide
ggacagaaggagtgtggaaaacgggggaaagatgt

SEQ ID NO: 121721 - DNA, 35 bp, Artificial Sequence
  Synthetic oligonucleotide
tcatggcacatgtggccctggtcccggtccgcccc

SEQ ID NO: 121722 - DNA, 35 bp, Artificial Sequence
  Synthetic oligonucleotide
tttgctgcttgcgtttgcttcatggcctccgttcc

SEQ ID NO: 121723 - DNA, 35 bp, Artificial Sequence
  Synthetic oligonucleotide
atcgagccatcctgtgtacccgtcccccaccatgg

SEQ ID NO: 121724 - DNA, 35 bp, Artificial Sequence
  Synthetic oligonucleotide
gcaccgttcacttgcttctcactccatcaaactgg

SEQ ID NO: 121725 - DNA, 35 bp, Artificial Sequence
  Synthetic oligonucleotide
agaagggcgggaagaggggttgagaaggggtcgat

SEQ ID NO: 121726 - DNA, 35 bp, Artificial Sequence
  Synthetic oligonucleotide
tgatcccccgcgttacacctgacctacatcgcgct

SEQ ID NO: 121727 - DNA, 35 bp, Artificial Sequence
  Synthetic oligonucleotide
agtcaatcccccacgttactatatgcaccctcaca

SEQ ID NO: 121728 - DNA, 35 bp, Artificial Sequence
  Synthetic oligonucleotide
gggggaggggggtagaggagcgtggcagtaacaga

SEQ ID NO: 121729 - DNA, 36 bp, Artificial Sequence
  Synthetic oligonucleotide
acggtcgagaggggaagggtgagggcatggtgtgga

SEQ ID NO: 121730 - DNA, 37 bp, Artificial Sequence
  Synthetic oligonucleotide
gttcgccgtcaccaggttctttttcgcccttctttga

SEQ ID NO: 121731 - DNA, 36 bp, Artificial Sequence
  Synthetic oligonucleotide
cacccccgccaccatgcctgtcttcccgtgatctta

SEQ ID NO: 121732 - DNA, 35 bp, Artificial Sequence
  Synthetic oligonucleotide
acgctggaaccccccgtgtccctccctgtatggcc

SEQ ID NO: 121733 - DNA, 35 bp, Artificial Sequence
  Synthetic oligonucleotide
ttcggaagcaccgctgtcctgtagtcttccgttcc

SEQ ID NO: 121734 - DNA, 35 bp, Artificial Sequence
  Synthetic oligonucleotide
ggtccctttccgctcaccatttcttccagtcctgc

SEQ ID NO: 121735 - DNA, 35 bp, Artificial Sequence
  Synthetic oligonucleotide
gttcccgccctcatgttccccattatgttgttggt

SEQ ID NO: 121736 - DNA, 36 bp, Artificial Sequence
  Synthetic oligonucleotide
gtaggggctgggggggggagttaggggagagcagca

SEQ ID NO: 121737 - DNA, 36 bp, Artificial Sequence
  Synthetic oligonucleotide
atcgccccctccaccgtttcgtacagatgacgtgca

SEQ ID NO: 121738 - DNA, 37 bp, Artificial Sequence
  Synthetic oligonucleotide
gccacccttctcttgcctacgttagactatcctccga

SEQ ID NO: 121739 - DNA, 37 bp, Artificial Sequence
  Synthetic oligonucleotide
ttcgcaccactgaactactacaacttactgcccttga

SEQ ID NO: 121740 - DNA, 35 bp, Artificial Sequence
  Synthetic oligonucleotide
atcagccgaccgagtcttcccccgtctccaccgta

SEQ ID NO: 121741 - DNA, 36 bp, Artificial Sequence
  Synthetic oligonucleotide
ggagagggtggtgggctggacggtccggtggggtta

SEQ ID NO: 121742 - DNA, 35 bp, Artificial Sequence
  Synthetic oligonucleotide
tacaccctcaaactatggcttttggacccgtaacc

SEQ ID NO: 121743 - DNA, 35 bp, Artificial Sequence
  Synthetic oligonucleotide
acctgaacaggtacagcccgttgctcaatcttccc

SEQ ID NO: 121744 - DNA, 35 bp, Artificial Sequence
  Synthetic oligonucleotide
ttgcctcccccgtgttgccccctagttaatccagc

SEQ ID NO: 121745 - DNA, 35 bp, Artificial Sequence
  Synthetic oligonucleotide
gtcgtcaccttcttgtccctccataagccatccgc

SEQ ID NO: 121746 - DNA, 35 bp, Artificial Sequence
  Synthetic oligonucleotide
tgcacacccttcgaggtgccgcctgttctatcttc

SEQ ID NO: 121747 - DNA, 35 bp, Artificial Sequence
  Synthetic oligonucleotide
tgaaagtggaaagtgggggacgacgatggaggggg

SEQ ID NO: 121748 - DNA, 35 bp, Artificial Sequence
  Synthetic oligonucleotide
agcacgtactcgtccataatggctcccgctcttct

SEQ ID NO: 121749 - DNA, 35 bp, Artificial Sequence
  Synthetic oligonucleotide
ttggaggcgacggatggggggcgggctaggcggga

SEQ ID NO: 121750 - DNA, 36 bp, Artificial Sequence
  Synthetic oligonucleotide
tcctttcgccggttcgcacttccttcgcctgtctta

SEQ ID NO: 121751 - DNA, 34 bp, Artificial Sequence
  Synthetic oligonucleotide
tgccatgatcacctccccggtttacggtcactct

SEQ ID NO: 121752 - DNA, 36 bp, Artificial Sequence
  Synthetic oligonucleotide
caccttgctcgctacatcccgctgccagggactctc

SEQ ID NO: 121753 - DNA, 35 bp, Artificial Sequence
  Synthetic oligonucleotide
tgatcgcgtcccggaccacccgatgcccgccgttc

SEQ ID NO: 121754 - DNA, 35 bp, Artificial Sequence
  Synthetic oligonucleotide
tctttgcctccgtcctggccaccctttccaattcg

SEQ ID NO: 121755 - DNA, 35 bp, Artificial Sequence
  Synthetic oligonucleotide
taacctcatcgcgcctgcctctgccatgaccttct

SEQ ID NO: 121756 - DNA, 35 bp, Artificial Sequence
  Synthetic oligonucleotide
atgcgcgttgcaccgtccgctatgcctgcccgttt

SEQ ID NO: 121757 - DNA, 37 bp, Artificial Sequence
  Synthetic oligonucleotide
accaccgtcactgccctcccccatgctggttccaaga

SEQ ID NO: 121758 - DNA, 38 bp, Artificial Sequence
  Synthetic oligonucleotide
agatagaacggaggggaacgggggaggcatgatactga

SEQ ID NO: 121759 - DNA, 35 bp, Artificial Sequence
  Synthetic oligonucleotide
gtgacgctggacatttgcgctggcttcctctatcc

SEQ ID NO: 121760 - DNA, 35 bp, Artificial Sequence
  Synthetic oligonucleotide
gtggcctggaataccaccgctgtccgtcctcgcgc

SEQ ID NO: 121761 - DNA, 35 bp, Artificial Sequence
  Synthetic oligonucleotide
tcctgcaaaccgttacgccgccctgcttcacctgc

SEQ ID NO: 121762 - DNA, 35 bp, Artificial Sequence
  Synthetic oligonucleotide
tcgacccaggaccccaatgttgtcagtcccctctc

SEQ ID NO: 121763 - DNA, 35 bp, Artificial Sequence
  Synthetic oligonucleotide
ggtccaccttcgatctccccatgtttaccaccccg

SEQ ID NO: 121764 - DNA, 35 bp, Artificial Sequence
  Synthetic oligonucleotide
tgcacacggcgaccctctccgtatactcgttcccg

SEQ ID NO: 121765 - DNA, 35 bp, Artificial Sequence
  Synthetic oligonucleotide
taccccccgcccaattgtcgcccgctccctctccg

SEQ ID NO: 121766 - DNA, 35 bp, Artificial Sequence
  Synthetic oligonucleotide
tctacgcccatccctcgtttgcctgacctcttgtt

SEQ ID NO: 121767 - DNA, 36 bp, Artificial Sequence
  Synthetic oligonucleotide
accgcccccgcccgttggaccctctggactgtctaa

SEQ ID NO: 121768 - DNA, 37 bp, Artificial Sequence
  Synthetic oligonucleotide
gcagtgggaagaaggggtggggggcgtgggacctgga

SEQ ID NO: 121769 - DNA, 30 bp, Artificial Sequence
  Synthetic oligonucleotide
aacatgcaacacctggcaccctcgcttcta

SEQ ID NO: 121770 - DNA, 35 bp, Artificial Sequence
  Synthetic oligonucleotide
gggtggagggggggttttgcggatggcacatcgcg

SEQ ID NO: 121771 - DNA, 35 bp, Artificial Sequence
  Synthetic oligonucleotide
aacccccaccgtacgtcgcgagccctgtcctcggt

SEQ ID NO: 121772 - DNA, 35 bp, Artificial Sequence
  Synthetic oligonucleotide
gttgcccccgccattcgccaattcaatcagtacga

SEQ ID NO: 121773 - DNA, 38 bp, Artificial Sequence
  Synthetic oligonucleotide
tgcattgcgctggtcctaactcgcctgcccccccttga

SEQ ID NO: 121774 - DNA, 38 bp, Artificial Sequence
  Synthetic oligonucleotide
ttggtaactgtccgccgcactatctacgccccccttga

SEQ ID NO: 121775 - DNA, 35 bp, Artificial Sequence
  Synthetic oligonucleotide
tcccaccccgctgtcacaggctccaacatcactta

SEQ ID NO: 121776 - DNA, 35 bp, Artificial Sequence
  Synthetic oligonucleotide
gcctgcccacgcctatcatctagctctcgccggac

SEQ ID NO: 121777 - DNA, 35 bp, Artificial Sequence
  Synthetic oligonucleotide
tcaccatccgttctaaatcgcttcacttcaggccc

SEQ ID NO: 121778 - DNA, 35 bp, Artificial Sequence
  Synthetic oligonucleotide
agctctcatccggccctcagtgacctcccgttctc

SEQ ID NO: 121779 - DNA, 38 bp, Artificial Sequence
  Synthetic oligonucleotide
acatccagcgacctgtcgtctatctctaccctccctga

SEQ ID NO: 121780 - DNA, 36 bp, Artificial Sequence
  Synthetic oligonucleotide
gatctatcgactgatcccttcccgtgccacccttga

SEQ ID NO: 121781 - DNA, 36 bp, Artificial Sequence
  Synthetic oligonucleotide
gacacccccgtgtctactctcgtgttctcaccccta

SEQ ID NO: 121782 - DNA, 35 bp, Artificial Sequence
  Synthetic oligonucleotide
tttcacatcccctgctggttctagaactgttaccc

SEQ ID NO: 121783 - DNA, 35 bp, Artificial Sequence
  Synthetic oligonucleotide
tttgccagctcattcctcaaggaacctgccccccc

SEQ ID NO: 121784 - DNA, 35 bp, Artificial Sequence
  Synthetic oligonucleotide
gtggccagctccgtgccgtgcctagttcctccgtt

SEQ ID NO: 121785 - DNA, 35 bp, Artificial Sequence
  Synthetic oligonucleotide
gaccgccactcattgtttaccccttgtgccccacc

SEQ ID NO: 121786 - DNA, 35 bp, Artificial Sequence
  Synthetic oligonucleotide
atggtcatcggtcgccgccccgatttttcccatcc

SEQ ID NO: 121787 - DNA, 35 bp, Artificial Sequence
  Synthetic oligonucleotide
gtcaacgcagccctgtaattcttctgtaccgcatc

SEQ ID NO: 121788 - DNA, 34 bp, Artificial Sequence
  Synthetic oligonucleotide
accgtttggccagccatcctcccatcccttggtc

SEQ ID NO: 121789 - DNA, 35 bp, Artificial Sequence
  Synthetic oligonucleotide
gacatcgcggccatgcgttcttcttactatcctcg

SEQ ID NO: 121790 - DNA, 35 bp, Artificial Sequence
  Synthetic oligonucleotide
attggcccccttcctctcatgctccctcacgcctg

SEQ ID NO: 121791 - DNA, 35 bp, Artificial Sequence
  Synthetic oligonucleotide
ggggaccgagctggggaagggaggggaacatggtg

SEQ ID NO: 121792 - DNA, 35 bp, Artificial Sequence
  Synthetic oligonucleotide
tagccccgccaccgcactcaccgaccatacacttt

SEQ ID NO: 121793 - DNA, 35 bp, Artificial Sequence
  Synthetic oligonucleotide
tcacacccgcctgacgcctctcatgaatgtcgaca

SEQ ID NO: 121794 - DNA, 36 bp, Artificial Sequence
  Synthetic oligonucleotide
tcacctcgccctgtgtcacgctatgtccgtacacta

SEQ ID NO: 121795 - DNA, 36 bp, Artificial Sequence
  Synthetic oligonucleotide
atgctcacacgtgccttgttatcgtcccttccgtta

SEQ ID NO: 121796 - DNA, 35 bp, Artificial Sequence
  Synthetic oligonucleotide
gggaggcccttgttccttcacgtcctgccttctac

SEQ ID NO: 121797 - DNA, 35 bp, Artificial Sequence
  Synthetic oligonucleotide
ggacttgttcagcagcctgctatttccgctccctc

SEQ ID NO: 121798 - DNA, 35 bp, Artificial Sequence
  Synthetic oligonucleotide
tctcgcccatatgtccgtcccatccgccctccgcg

SEQ ID NO: 121799 - DNA, 35 bp, Artificial Sequence
  Synthetic oligonucleotide
gcactacaccggaactgcctaatctactgcccctt

SEQ ID NO: 121800 - DNA, 36 bp, Artificial Sequence
  Synthetic oligonucleotide
actacctcccccgcctctcgatcatgtccgaacgaa

SEQ ID NO: 121801 - DNA, 35 bp, Artificial Sequence
  Synthetic oligonucleotide
tatttcaccgccaactcatgcacctctcagagcca

SEQ ID NO: 121802 - DNA, 36 bp, Artificial Sequence
  Synthetic oligonucleotide
tcccaccgtgcacactgttagttcactgttctatca

SEQ ID NO: 121803 - DNA, 36 bp, Artificial Sequence
  Synthetic oligonucleotide
ccacaccatcatccgccgcccactccatgcccgaga

SEQ ID NO: 121804 - DNA, 36 bp, Artificial Sequence
  Synthetic oligonucleotide
tccacccctattcgattatcatgcctgctccacgga

SEQ ID NO: 121805 - DNA, 37 bp, Artificial Sequence
  Synthetic oligonucleotide
aaatggataggggtaggcggaggggagtatgggcgga

SEQ ID NO: 121806 - DNA, 35 bp, Artificial Sequence
  Synthetic oligonucleotide
gtgggtaggaggaaggggcgacaggggacagacta

SEQ ID NO: 121807 - DNA, 35 bp, Artificial Sequence
  Synthetic oligonucleotide
ttacatcacccgctgccgtacctctacccgccgta

SEQ ID NO: 121808 - DNA, 35 bp, Artificial Sequence
  Synthetic oligonucleotide
gcacactcgctcgtgcacattttctacacccttta

SEQ ID NO: 121809 - DNA, 35 bp, Artificial Sequence
  Synthetic oligonucleotide
tctcacgcctcccgccttatacacgactctctccc

SEQ ID NO: 121810 - DNA, 35 bp, Artificial Sequence
  Synthetic oligonucleotide
gtggtaccccgaccttatcatccctgtttcatgcc

SEQ ID NO: 121811 - DNA, 35 bp, Artificial Sequence
  Synthetic oligonucleotide
atagcaacccgccgccgccagcatgtccccggtcc

SEQ ID NO: 121812 - DNA, 35 bp, Artificial Sequence
  Synthetic oligonucleotide
gacccgcaccacgctacgacctccgcttttcctcg

SEQ ID NO: 121813 - DNA, 35 bp, Artificial Sequence
  Synthetic oligonucleotide
ttgacatacccgttccaactgccaccactcgctcg

SEQ ID NO: 121814 - DNA, 35 bp, Artificial Sequence
  Synthetic oligonucleotide
gcccccccaccaagtcctgttcgtatgccttcctg

SEQ ID NO: 121815 - DNA, 35 bp, Artificial Sequence
  Synthetic oligonucleotide
actcctacaaccatgtgccccttcgtgtccgttct

SEQ ID NO: 121816 - DNA, 35 bp, Artificial Sequence
  Synthetic oligonucleotide
ggggggaaggcggctagggggcgggggagagcatt

SEQ ID NO: 121817 - DNA, 35 bp, Artificial Sequence
  Synthetic oligonucleotide
acccatccccgagttcagctccccttggcttgttt

SEQ ID NO: 121818 - DNA, 35 bp, Artificial Sequence
  Synthetic oligonucleotide
taaccgtggagggtgggtgggtaggttggatatca

SEQ ID NO: 121819 - DNA, 37 bp, Artificial Sequence
  Synthetic oligonucleotide
gaaggtggatggaaggtggggtgaaatgggggacgga

SEQ ID NO: 121820 - DNA, 35 bp, Artificial Sequence
  Synthetic oligonucleotide
attggggtagggaggggtgaacgggagggtaggac

SEQ ID NO: 121821 - DNA, 35 bp, Artificial Sequence
  Synthetic oligonucleotide
tcccatgccctttttttgcgagtcctgtcatgccc

SEQ ID NO: 121822 - DNA, 35 bp, Artificial Sequence
  Synthetic oligonucleotide
accacaggcctttgccgctctggctcctttacttc

SEQ ID NO: 121823 - DNA, 36 bp, Artificial Sequence
  Synthetic oligonucleotide
gacacgcccacgaacgcttcaattacctcgtcatca

SEQ ID NO: 121824 - DNA, 36 bp, Artificial Sequence
  Synthetic oligonucleotide
tatcgcgctgccgatggagggatgggatggggcgga

SEQ ID NO: 121825 - DNA, 35 bp, Artificial Sequence
  Synthetic oligonucleotide
taccaccacattcttcgttggacgctctcctccac

SEQ ID NO: 121826 - DNA, 35 bp, Artificial Sequence
  Synthetic oligonucleotide
ttgttctgcctccatactgtccgttttttagccgc

SEQ ID NO: 121827 - DNA, 35 bp, Artificial Sequence
  Synthetic oligonucleotide
gtggtcccacccctcgctggtattgaaatcatctc

SEQ ID NO: 121828 - DNA, 35 bp, Artificial Sequence
  Synthetic oligonucleotide
atgggcgtggacggggaaggggggtcgtgggttag

SEQ ID NO: 121829 - DNA, 35 bp, Artificial Sequence
  Synthetic oligonucleotide
tccccccccgctagcccgacgatcgatcatcttat

SEQ ID NO: 121830 - DNA, 35 bp, Artificial Sequence
  Synthetic oligonucleotide
tgttgctacaacagcgcgcctatcatctcccacca

SEQ ID NO: 121831 - DNA, 36 bp, Artificial Sequence
  Synthetic oligonucleotide
gagagaggacgttgtggcatgggggggtgaggaaga

SEQ ID NO: 121832 - DNA, 38 bp, Artificial Sequence
  Synthetic oligonucleotide
accgtgcccttgctctcactcccgccctgttgccatga

SEQ ID NO: 121833 - DNA, 37 bp, Artificial Sequence
  Synthetic oligonucleotide
gccaacctctgcgcgtggcatattcctctcaccctga

SEQ ID NO: 121834 - DNA, 35 bp, Artificial Sequence
  Synthetic oligonucleotide
ggatggacgttgtcgtctctcagccctgttccatc

SEQ ID NO: 121835 - DNA, 35 bp, Artificial Sequence
  Synthetic oligonucleotide
gtgaccccacgacaacaacgcaagggctccatttc

SEQ ID NO: 121836 - DNA, 35 bp, Artificial Sequence
  Synthetic oligonucleotide
acgtgacccgcgcgacccatccttcatccgacctg

SEQ ID NO: 121837 - DNA, 35 bp, Artificial Sequence
  Synthetic oligonucleotide
gttgcacgttgtgccattatcgcccctcctctgtg

SEQ ID NO: 121838 - DNA, 35 bp, Artificial Sequence
  Synthetic oligonucleotide
gcacctacactactccccccgccccgtcggtggca

SEQ ID NO: 121839 - DNA, 37 bp, Artificial Sequence
  Synthetic oligonucleotide
gatgacgaagatagagggaacaagggcggggctaaga

SEQ ID NO: 121840 - DNA, 36 bp, Artificial Sequence
  Synthetic oligonucleotide
gtgcccgcccggtatctactcccgtccgacctttta

SEQ ID NO: 121841 - DNA, 35 bp, Artificial Sequence
  Synthetic oligonucleotide
tcctaatgcgctgcagccttgtccctttcttcccc

SEQ ID NO: 121842 - DNA, 35 bp, Artificial Sequence
  Synthetic oligonucleotide
tcccatccattggttacaatgcctaggttctcatc

SEQ ID NO: 121843 - DNA, 35 bp, Artificial Sequence
  Synthetic oligonucleotide
accccactcgcctttatatctagtctcgcagtttc

SEQ ID NO: 121844 - DNA, 36 bp, Artificial Sequence
  Synthetic oligonucleotide
agacacctgcgtgtaccaactgcatccctctcgaca

SEQ ID NO: 121845 - DNA, 37 bp, Artificial Sequence
  Synthetic oligonucleotide
gtgtccccatcctcttacgtcgcgccggttcccctga

SEQ ID NO: 121846 - DNA, 38 bp, Artificial Sequence
  Synthetic oligonucleotide
tgcacccagcagagttcctgccccaccgttttccctga

SEQ ID NO: 121847 - DNA, 35 bp, Artificial Sequence
  Synthetic oligonucleotide
tactatgccgcctttctttgccgtacacatcacac

SEQ ID NO: 121848 - DNA, 35 bp, Artificial Sequence
  Synthetic oligonucleotide
acctactctccacccatgcaacttgacagtcacac

SEQ ID NO: 121849 - DNA, 35 bp, Artificial Sequence
  Synthetic oligonucleotide
gccaaacctgctccgaaagcctgcgcccacccgcc

SEQ ID NO: 121850 - DNA, 35 bp, Artificial Sequence
  Synthetic oligonucleotide
accgccggacactgcccccgcaccacaactggttg

SEQ ID NO: 121851 - DNA, 36 bp, Artificial Sequence
  Synthetic oligonucleotide
ggacacctctcatgtcctaattctaccgcaccccaa

SEQ ID NO: 121852 - DNA, 35 bp, Artificial Sequence
  Synthetic oligonucleotide
tgtggcccccgtttcgctgccatctcatatacaca

SEQ ID NO: 121853 - DNA, 35 bp, Artificial Sequence
  Synthetic oligonucleotide
atacgccctcactggtctttcttcttggtgtacca

SEQ ID NO: 121854 - DNA, 35 bp, Artificial Sequence
  Synthetic oligonucleotide
agccccccaaacgtgatttcgactcctatgttccc

SEQ ID NO: 121855 - DNA, 35 bp, Artificial Sequence
  Synthetic oligonucleotide
ttcgcgccggcctccgctccgttctgctcacccgc

SEQ ID NO: 121856 - DNA, 35 bp, Artificial Sequence
  Synthetic oligonucleotide
ggagccgccggtcgcgtctaccgcctacatctcgc

SEQ ID NO: 121857 - DNA, 35 bp, Artificial Sequence
  Synthetic oligonucleotide
gtgctgctcagcatccgtcgcgtatctttcccttc

SEQ ID NO: 121858 - DNA, 35 bp, Artificial Sequence
  Synthetic oligonucleotide
tccaagctccttcctcgccgtccccgctccggttg

SEQ ID NO: 121859 - DNA, 35 bp, Artificial Sequence
  Synthetic oligonucleotide
acaagcaccgcccccccacccgtgcaccgaatact

SEQ ID NO: 121860 - DNA, 35 bp, Artificial Sequence
  Synthetic oligonucleotide
ttccagcaacacccgtcctcaatgctgattcccct

SEQ ID NO: 121861 - DNA, 35 bp, Artificial Sequence
  Synthetic oligonucleotide
atggtgcactgaccagccacgtcctgccgatctct

SEQ ID NO: 121862 - DNA, 37 bp, Artificial Sequence
  Synthetic oligonucleotide
ggggggagacatgagaggtagatggaaggagtgtgga

SEQ ID NO: 121863 - DNA, 37 bp, Artificial Sequence
  Synthetic oligonucleotide
gaagccgacgtcccatggtaacctgccccttttctga

SEQ ID NO: 121864 - DNA, 35 bp, Artificial Sequence
  Synthetic oligonucleotide
tctccgccccctccccgtcttccccctacgaggtc

SEQ ID NO: 121865 - DNA, 35 bp, Artificial Sequence
  Synthetic oligonucleotide
gcatggcaaccgttcgtgcgccccttacctcatcg

SEQ ID NO: 121866 - DNA, 35 bp, Artificial Sequence
  Synthetic oligonucleotide
gcctgacccgccaaatgcccaccatatagttctcg

SEQ ID NO: 121867 - DNA, 35 bp, Artificial Sequence
  Synthetic oligonucleotide
atccgtccgtatttcccatatgtgcccctcccttg

SEQ ID NO: 121868 - DNA, 35 bp, Artificial Sequence
  Synthetic oligonucleotide
ttcgcacgccttgttcgttttccatcattatccaa

SEQ ID NO: 121869 - DNA, 36 bp, Artificial Sequence
  Synthetic oligonucleotide
gagccgcctgtcgttctgctcttggttccttccaca

SEQ ID NO: 121870 - DNA, 36 bp, Artificial Sequence
  Synthetic oligonucleotide
accaccaacgcgttgattaaacgccacttgtcccca

SEQ ID NO: 121871 - DNA, 34 bp, Artificial Sequence
  Synthetic oligonucleotide
gcaacgagcctttgcaccagtgaccgaccccgca

SEQ ID NO: 121872 - DNA, 36 bp, Artificial Sequence
  Synthetic oligonucleotide
gattccgtaccatcctcctgcgtgctaaacgcctta

SEQ ID NO: 121873 - DNA, 36 bp, Artificial Sequence
  Synthetic oligonucleotide
tcccacctcttgttgtactcctcactgctgagctta

SEQ ID NO: 121874 - DNA, 36 bp, Artificial Sequence
  Synthetic oligonucleotide
gtggggcgccccttcctctgctgatgctcacgttta

SEQ ID NO: 121875 - DNA, 35 bp, Artificial Sequence
  Synthetic oligonucleotide
taaccgtccgttccaggtctcgtctttccaccccc

SEQ ID NO: 121876 - DNA, 35 bp, Artificial Sequence
  Synthetic oligonucleotide
tcccgactcatgacatgatgcctacctttgtgccc

SEQ ID NO: 121877 - DNA, 35 bp, Artificial Sequence
  Synthetic oligonucleotide
gatccgctggcccacaacttctgccatcaatgctc

SEQ ID NO: 121878 - DNA, 35 bp, Artificial Sequence
  Synthetic oligonucleotide
aagtccaacctgctccgtcgctcatgcattctttc

SEQ ID NO: 121879 - DNA, 35 bp, Artificial Sequence
  Synthetic oligonucleotide
acacaccgcctaacatgttcgccgttccgctcttg

SEQ ID NO: 121880 - DNA, 35 bp, Artificial Sequence
  Synthetic oligonucleotide
tcagtgtaggtgacttctcgtttgctgctcccttt

SEQ ID NO: 121881 - DNA, 37 bp, Artificial Sequence
  Synthetic oligonucleotide
atcacctcaatgaccgtttttactccacctgtccaga

SEQ ID NO: 121882 - DNA, 36 bp, Artificial Sequence
  Synthetic oligonucleotide
gcagaggaggtaggaaggggtagtgggtacggtaga

SEQ ID NO: 121883 - DNA, 36 bp, Artificial Sequence
  Synthetic oligonucleotide
accgctgcccccctcgttcccattgtacggccatga

SEQ ID NO: 121884 - DNA, 35 bp, Artificial Sequence
  Synthetic oligonucleotide
tgtctaccacacgtgtacgcgatccttccctaccc

SEQ ID NO: 121885 - DNA, 35 bp, Artificial Sequence
  Synthetic oligonucleotide
tcagccgcccagcatttttgacgatgtcgctcccc

SEQ ID NO: 121886 - DNA, 35 bp, Artificial Sequence
  Synthetic oligonucleotide
acccgtccgaaaccatgctccccttcgctcccgtc

SEQ ID NO: 121887 - DNA, 34 bp, Artificial Sequence
  Synthetic oligonucleotide
tattcagggggggagggtgtgtgagcgaagggcg

SEQ ID NO: 121888 - DNA, 35 bp, Artificial Sequence
  Synthetic oligonucleotide
tacgggatcagggagggcgggaaggccaggctagt

SEQ ID NO: 121889 - DNA, 37 bp, Artificial Sequence
  Synthetic oligonucleotide
gttccgccccctccctgttgactaggccctttcgaga

SEQ ID NO: 121890 - DNA, 37 bp, Artificial Sequence
  Synthetic oligonucleotide
tgtacaccacagatcgattccatcccccctgccgcga

SEQ ID NO: 121891 - DNA, 36 bp, Artificial Sequence
  Synthetic oligonucleotide
aaccgcccatgtcacttgtttctatccctgttgtga

SEQ ID NO: 121892 - DNA, 35 bp, Artificial Sequence
  Synthetic oligonucleotide
tcatggcccgcactttgcctgtgttaccgcttata

SEQ ID NO: 121893 - DNA, 36 bp, Artificial Sequence
  Synthetic oligonucleotide
tcacgcaggtctggtggggtacgggggcggtggcta

SEQ ID NO: 121894 - DNA, 35 bp, Artificial Sequence
  Synthetic oligonucleotide
gggcgaccatcgccgctccctgcaccctgttcacc

SEQ ID NO: 121895 - DNA, 35 bp, Artificial Sequence
  Synthetic oligonucleotide
gtcgttcctccgccgatgatgctacggttcctccc

SEQ ID NO: 121896 - DNA, 35 bp, Artificial Sequence
  Synthetic oligonucleotide
ttggagccagatccccgtctcctcttgctaccgtg

SEQ ID NO: 121897 - DNA, 35 bp, Artificial Sequence
  Synthetic oligonucleotide
actcccccgtgcgttgattatttgccccatgctat

SEQ ID NO: 121898 - DNA, 35 bp, Artificial Sequence
  Synthetic oligonucleotide
ggccgttccatctgcgtcttctgccttcgctctgt

SEQ ID NO: 121899 - DNA, 36 bp, Artificial Sequence
  Synthetic oligonucleotide
gttcgaagcggtaggggggggaggaggggttatcaa

SEQ ID NO: 121900 - DNA, 36 bp, Artificial Sequence
  Synthetic oligonucleotide
tcccaccgctactactggttcgccgcatttttccca

SEQ ID NO: 121901 - DNA, 36 bp, Artificial Sequence
  Synthetic oligonucleotide
tcaccacttcaccctcatgtctcggtcgataaatca

SEQ ID NO: 121902 - DNA, 35 bp, Artificial Sequence
  Synthetic oligonucleotide
tgccaaagtacagaccggcccttcccctttcctca

SEQ ID NO: 121903 - DNA, 35 bp, Artificial Sequence
  Synthetic oligonucleotide
aacgcactcccttcgtcttgcccatgcactgttca

SEQ ID NO: 121904 - DNA, 38 bp, Artificial Sequence
  Synthetic oligonucleotide
tcccgcccccggcacgttttgtcctgcgatacccatga

SEQ ID NO: 121905 - DNA, 37 bp, Artificial Sequence
  Synthetic oligonucleotide
gtagccccgccgacgttatcctctatccccaagctga

SEQ ID NO: 121906 - DNA, 36 bp, Artificial Sequence
  Synthetic oligonucleotide
tcctgcccctctcgaacttaaggtcctgtatctcta

SEQ ID NO: 121907 - DNA, 35 bp, Artificial Sequence
  Synthetic oligonucleotide
gtcaccactcgatgcccctccccgtgcttgcatac

SEQ ID NO: 121908 - DNA, 35 bp, Artificial Sequence
  Synthetic oligonucleotide
accggtatccgcccctgaccgttttgcttttaccc

SEQ ID NO: 121909 - DNA, 35 bp, Artificial Sequence
  Synthetic oligonucleotide
gttcgccatcagcattctagtccgttttgctcgcc

SEQ ID NO: 121910 - DNA, 35 bp, Artificial Sequence
  Synthetic oligonucleotide
tgcccaacatcaatgccacggcacgtttcgtcctc

SEQ ID NO: 121911 - DNA, 34 bp, Artificial Sequence
  Synthetic oligonucleotide
taccaccgacatgactaaagttgctcatcccccg

SEQ ID NO: 121912 - DNA, 35 bp, Artificial Sequence
  Synthetic oligonucleotide
ttcggaaggaggggggacggcaaggggagtggggg

SEQ ID NO: 121913 - DNA, 36 bp, Artificial Sequence
  Synthetic oligonucleotide
ttctgaacctccgacgcgtataccatccgccccaca

SEQ ID NO: 121914 - DNA, 37 bp, Artificial Sequence
  Synthetic oligonucleotide
atgtcaccgccttccgcatttgctaccatcacccgga

SEQ ID NO: 121915 - DNA, 35 bp, Artificial Sequence
  Synthetic oligonucleotide
taagacacacctgttcccattaagtacacgcttcc

SEQ ID NO: 121916 - DNA, 35 bp, Artificial Sequence
  Synthetic oligonucleotide
gagccatctgttgcttcctctcttcacccttaagc

SEQ ID NO: 121917 - DNA, 35 bp, Artificial Sequence
  Synthetic oligonucleotide
aaacgtcacaccgctggtcctacttctttagcctc

SEQ ID NO: 121918 - DNA, 35 bp, Artificial Sequence
  Synthetic oligonucleotide
tccctgcctgacacttttagcatgtacctccgttc

SEQ ID NO: 121919 - DNA, 35 bp, Artificial Sequence
  Synthetic oligonucleotide
gccccagttctgtaccctgccccaccgcccgagag

SEQ ID NO: 121920 - DNA, 35 bp, Artificial Sequence
  Synthetic oligonucleotide
ttgatccgccagttacatttccagtgcctttcccg

SEQ ID NO: 121921 - DNA, 37 bp, Artificial Sequence
  Synthetic oligonucleotide
gacccccccgattataatggcccttgcctacgcccga

SEQ ID NO: 121922 - DNA, 36 bp, Artificial Sequence
  Synthetic oligonucleotide
taggagggaagggtaagttaggactcgggggtggga

SEQ ID NO: 121923 - DNA, 35 bp, Artificial Sequence
  Synthetic oligonucleotide
ttcgcacatgccacttcccttgtctgcacggttac

SEQ ID NO: 121924 - DNA, 35 bp, Artificial Sequence
  Synthetic oligonucleotide
gcgcaactcgctgattgacccgtctacctccctgc

SEQ ID NO: 121925 - DNA, 35 bp, Artificial Sequence
  Synthetic oligonucleotide
gaccctcaccatctcacagccgtcgacccacactc

SEQ ID NO: 121926 - DNA, 35 bp, Artificial Sequence
  Synthetic oligonucleotide
gcacgggcaaaggagagaaggaacggggacgtggt

SEQ ID NO: 121927 - DNA, 35 bp, Artificial Sequence
  Synthetic oligonucleotide
agaatgcggagggagtctcaggggagggagcggtt

SEQ ID NO: 121928 - DNA, 35 bp, Artificial Sequence
  Synthetic oligonucleotide
tgtgtgcgtgagccgatccgtccgtcccccgctaa

SEQ ID NO: 121929 - DNA, 36 bp, Artificial Sequence
  Synthetic oligonucleotide
atcgccgccatcgagcagcccccttcgttactccca

SEQ ID NO: 121930 - DNA, 36 bp, Artificial Sequence
  Synthetic oligonucleotide
ttcctgccacaacgtaatccactctcgccctgtaga

SEQ ID NO: 121931 - DNA, 38 bp, Artificial Sequence
  Synthetic oligonucleotide
gcaccaccacgtctagccgtccttcttcccgcacatga

SEQ ID NO: 121932 - DNA, 37 bp, Artificial Sequence
  Synthetic oligonucleotide
ggggtgaggggtgggcggtggtgcaagcaagggatga

SEQ ID NO: 121933 - DNA, 35 bp, Artificial Sequence
  Synthetic oligonucleotide
aatggctatgcaccggcttacctacccgttccctc

SEQ ID NO: 121934 - DNA, 35 bp, Artificial Sequence
  Synthetic oligonucleotide
ttcgcatacgccacccatggtactctatttttgtc

SEQ ID NO: 121935 - DNA, 35 bp, Artificial Sequence
  Synthetic oligonucleotide
acgcgggttggaggggctaggggtggtcgggccgg

SEQ ID NO: 121936 - DNA, 35 bp, Artificial Sequence
  Synthetic oligonucleotide
tcacgcgtcttgctagtcccgccctcgattgccct

SEQ ID NO: 121937 - DNA, 35 bp, Artificial Sequence
  Synthetic oligonucleotide
ttccccgcccccagattgttctttgtatccatggt

SEQ ID NO: 121938 - DNA, 35 bp, Artificial Sequence
  Synthetic oligonucleotide
agtcccaggtctcggtccgccccggctcttctaaa

SEQ ID NO: 121939 - DNA, 36 bp, Artificial Sequence
  Synthetic oligonucleotide
tagtgcgtccaactcgtcgccggccatgatttacca

SEQ ID NO: 121940 - DNA, 36 bp, Artificial Sequence
  Synthetic oligonucleotide
gcacctatctgctgctcttttcaatcctgcccccca

SEQ ID NO: 121941 - DNA, 36 bp, Artificial Sequence
  Synthetic oligonucleotide
ttgccggcctccaccaccccttaccgctgtcgcgca

SEQ ID NO: 121942 - DNA, 36 bp, Artificial Sequence
  Synthetic oligonucleotide
tgcacccctgattatggccgttcactttgcttctca

SEQ ID NO: 121943 - DNA, 37 bp, Artificial Sequence
  Synthetic oligonucleotide
gatcgacctcacactggtttattagccccttctttga

SEQ ID NO: 121944 - DNA, 36 bp, Artificial Sequence
  Synthetic oligonucleotide
tccgatgccagcgccacgtcttgcttccctccgtta

SEQ ID NO: 121945 - DNA, 35 bp, Artificial Sequence
  Synthetic oligonucleotide
tcccctgcacccgctttttgaacccccccccgggg

SEQ ID NO: 121946 - DNA, 37 bp, Artificial Sequence
  Synthetic oligonucleotide
aatggcaggagggggggtcgaaggcaacggcggaaga

SEQ ID NO: 121947 - DNA, 37 bp, Artificial Sequence
  Synthetic oligonucleotide
agagccgtgggaggtggtacgggggtgggggcatcga

SEQ ID NO: 121948 - DNA, 37 bp, Artificial Sequence
  Synthetic oligonucleotide
tccctcctccgagcccgccctcccacgctatcgcgga

SEQ ID NO: 121949 - DNA, 37 bp, Artificial Sequence
  Synthetic oligonucleotide
gggtggaggggggtgggagcttgggacgcaaggggga

SEQ ID NO: 121950 - DNA, 35 bp, Artificial Sequence
  Synthetic oligonucleotide
accccggcccctgctcacgcgtacgttacacttcc

SEQ ID NO: 121951 - DNA, 35 bp, Artificial Sequence
  Synthetic oligonucleotide
tacgctcaccttaccatcgttaaagcatctttctc

SEQ ID NO: 121952 - DNA, 35 bp, Artificial Sequence
  Synthetic oligonucleotide
agaggagacaacgggggagaacaaacaggagggag

SEQ ID NO: 121953 - DNA, 35 bp, Artificial Sequence
  Synthetic oligonucleotide
ggtgcgcgcttgccctgtgccgttcgaacccgcct

SEQ ID NO: 121954 - DNA, 35 bp, Artificial Sequence
  Synthetic oligonucleotide
atatccctgcctctgctcccgtactccctactagt

SEQ ID NO: 121955 - DNA, 31 bp, Artificial Sequence
  Synthetic oligonucleotide
gttcgccctttcctccgtcaacccccgtggt

SEQ ID NO: 121956 - DNA, 34 bp, Artificial Sequence
  Synthetic oligonucleotide
tcaatgtccgacgttcccgcccccgtaatgctgt

SEQ ID NO: 121957 - DNA, 36 bp, Artificial Sequence
  Synthetic oligonucleotide
caagccacctcgttcgcctatatgcctccacttgca

SEQ ID NO: 121958 - DNA, 36 bp, Artificial Sequence
  Synthetic oligonucleotide
actctacagacaggagggttggaggggagggcggga

SEQ ID NO: 121959 - DNA, 37 bp, Artificial Sequence
  Synthetic oligonucleotide
atgggcccgtgctgacagggagggagcataaagggga

SEQ ID NO: 121960 - DNA, 38 bp, Artificial Sequence
  Synthetic oligonucleotide
gttgtggccaccgcgtttcaagctctacccctccgtga

SEQ ID NO: 121961 - DNA, 35 bp, Artificial Sequence
  Synthetic oligonucleotide
atctgtgtaccctcccgtgtgccgctgcccgtgcc

SEQ ID NO: 121962 - DNA, 35 bp, Artificial Sequence
  Synthetic oligonucleotide
gtgcgctcaatgtcagcctctcgtccatagtttcc

SEQ ID NO: 121963 - DNA, 35 bp, Artificial Sequence
  Synthetic oligonucleotide
acgtagccggtccacaacacgtcgcccctctcctg

SEQ ID NO: 121964 - DNA, 36 bp, Artificial Sequence
  Synthetic oligonucleotide
tgccacctgcgccgcccacgaattcgctacaccgca

SEQ ID NO: 121965 - DNA, 37 bp, Artificial Sequence
  Synthetic oligonucleotide
tcactgcacaccatcttcccactcgaatggcattcga

SEQ ID NO: 121966 - DNA, 36 bp, Artificial Sequence
  Synthetic oligonucleotide
gcatgcaacctcctacccgatccaccgccgcttgga

SEQ ID NO: 121967 - DNA, 35 bp, Artificial Sequence
  Synthetic oligonucleotide
atcccgtccgcctgaaccgtcggggttcctctccc

SEQ ID NO: 121968 - DNA, 35 bp, Artificial Sequence
  Synthetic oligonucleotide
tcacatgctcactacggtaatacgcattccccctc

SEQ ID NO: 121969 - DNA, 35 bp, Artificial Sequence
  Synthetic oligonucleotide
aacagagccacgccccttgtctaaacatccccgtc

SEQ ID NO: 121970 - DNA, 35 bp, Artificial Sequence
  Synthetic oligonucleotide
tcgcacacctcacctgtactcgcgatgccaaccga

SEQ ID NO: 121971 - DNA, 37 bp, Artificial Sequence
  Synthetic oligonucleotide
acgaggtggtgggagggggtactttaggagaagggga

SEQ ID NO: 121972 - DNA, 38 bp, Artificial Sequence
  Synthetic oligonucleotide
atgcacaggagagaacggggaggagagcgacatggtga

SEQ ID NO: 121973 - DNA, 35 bp, Artificial Sequence
  Synthetic oligonucleotide
gcccagccgggtcttttgtttcgcctgccacctta

SEQ ID NO: 121974 - DNA, 35 bp, Artificial Sequence
  Synthetic oligonucleotide
gcatgctatccgcttccgttattgtctgcctccac

SEQ ID NO: 121975 - DNA, 35 bp, Artificial Sequence
  Synthetic oligonucleotide
tcagctcataaatcgtagttgcgccctccccttac

SEQ ID NO: 121976 - DNA, 35 bp, Artificial Sequence
  Synthetic oligonucleotide
ggtcaccatttctgcacgtttacagcctggccgcc

SEQ ID NO: 121977 - DNA, 35 bp, Artificial Sequence
  Synthetic oligonucleotide
tacacgtcgtacgtaacatctgtgccctttctatc

SEQ ID NO: 121978 - DNA, 34 bp, Artificial Sequence
  Synthetic oligonucleotide
tgtagccaccaatgatccccccccccgacctctc

SEQ ID NO: 121979 - DNA, 35 bp, Artificial Sequence
  Synthetic oligonucleotide
gtcagtcgcactgccgtctcacactcttactctcg

SEQ ID NO: 121980 - DNA, 35 bp, Artificial Sequence
  Synthetic oligonucleotide
gtccctgacagccgccctcacctcggtcccattcg

SEQ ID NO: 121981 - DNA, 35 bp, Artificial Sequence
  Synthetic oligonucleotide
gacaactaagggggggaggaggaagaaacgaacgg

SEQ ID NO: 121982 - DNA, 35 bp, Artificial Sequence
  Synthetic oligonucleotide
tcacactagctgactttccaacctcgcccccggtg

SEQ ID NO: 121983 - DNA, 35 bp, Artificial Sequence
  Synthetic oligonucleotide
atcgcccttcccgattcccctactcgttctgcaat

SEQ ID NO: 121984 - DNA, 35 bp, Artificial Sequence
  Synthetic oligonucleotide
taccctcctgcccccgatgaaatgtaaacgtttct

SEQ ID NO: 121985 - DNA, 36 bp, Artificial Sequence
  Synthetic oligonucleotide
atcgacgagcctctcactcgctgttctatccgtgtt

SEQ ID NO: 121986 - DNA, 36 bp, Artificial Sequence
  Synthetic oligonucleotide
gactgaggacaggggagggggacggtgaatttacaa

SEQ ID NO: 121987 - DNA, 36 bp, Artificial Sequence
  Synthetic oligonucleotide
tgccacatacggtacatgtctcatccatcctgctca

SEQ ID NO: 121988 - DNA, 35 bp, Artificial Sequence
  Synthetic oligonucleotide
tccacccacgcactctcgttaactgttgaatctca

SEQ ID NO: 121989 - DNA, 36 bp, Artificial Sequence
  Synthetic oligonucleotide
ttagcgtgcccattttatttatgccttccgtcccga

SEQ ID NO: 121990 - DNA, 38 bp, Artificial Sequence
  Synthetic oligonucleotide
ggacacgtcccctagccgtactttcgttccatctctga

SEQ ID NO: 121991 - DNA, 35 bp, Artificial Sequence
  Synthetic oligonucleotide
atgtcactccctgcccttatattgcaccacgccac

SEQ ID NO: 121992 - DNA, 35 bp, Artificial Sequence
  Synthetic oligonucleotide
tccgctcgccggcggctttccccttcttgtttcgc

SEQ ID NO: 121993 - DNA, 35 bp, Artificial Sequence
  Synthetic oligonucleotide
gtagggggcgggagtaatggcgggaaagagtgggg

SEQ ID NO: 121994 - DNA, 35 bp, Artificial Sequence
  Synthetic oligonucleotide
tacgcgcaggcgtttcccgttgtccaatctgctct

SEQ ID NO: 121995 - DNA, 35 bp, Artificial Sequence
  Synthetic oligonucleotide
gtagccagcgtgccgccgctctgttcatgtcccgt

SEQ ID NO: 121996 - DNA, 36 bp, Artificial Sequence
  Synthetic oligonucleotide
agagggtttagggaaggggagtggctgccgggggaa

SEQ ID NO: 121997 - DNA, 35 bp, Artificial Sequence
  Synthetic oligonucleotide
gcccctcaccaccccgcatactagagacttcaaca

SEQ ID NO: 121998 - DNA, 36 bp, Artificial Sequence
  Synthetic oligonucleotide
gtcagatcctacccttcccctgcgcactgattcaca

SEQ ID NO: 121999 - DNA, 37 bp, Artificial Sequence
  Synthetic oligonucleotide
tcccgtcccccccgaccgcaagtaccaccgccttcga

SEQ ID NO: 122000 - DNA, 37 bp, Artificial Sequence
  Synthetic oligonucleotide
gggtgggcgggaagggcgcaaggaaaggacctattga

SEQ ID NO: 122001 - DNA, 38 bp, Artificial Sequence
  Synthetic oligonucleotide
tccgaccctgcatttcgttactatcccccacagcttga

SEQ ID NO: 122002 - DNA, 36 bp, Artificial Sequence
  Synthetic oligonucleotide
gccactgctccaccttctgctttctcgtgcgtatta

SEQ ID NO: 122003 - DNA, 35 bp, Artificial Sequence
  Synthetic oligonucleotide
gaccctcctgccgcgatccatcacgggtttcctcc

SEQ ID NO: 122004 - DNA, 35 bp, Artificial Sequence
  Synthetic oligonucleotide
agcctgacggtagctatccgcgtactcccccccgc

SEQ ID NO: 122005 - DNA, 35 bp, Artificial Sequence
  Synthetic oligonucleotide
gttgggttaagggggagaagatggaccggtgggag

SEQ ID NO: 122006 - DNA, 35 bp, Artificial Sequence
  Synthetic oligonucleotide
gtgccctctgacccccgcatttcgacctctgagct

SEQ ID NO: 122007 - DNA, 35 bp, Artificial Sequence
  Synthetic oligonucleotide
tcgcgccccacctattattgacatcccctctcgtt

SEQ ID NO: 122008 - DNA, 36 bp, Artificial Sequence
  Synthetic oligonucleotide
ttggtcaacccctcattgcttcccatacctgcccca

SEQ ID NO: 122009 - DNA, 38 bp, Artificial Sequence
  Synthetic oligonucleotide
acacccgccccatgacctacgtaacatctgctttatga

SEQ ID NO: 122010 - DNA, 35 bp, Artificial Sequence
  Synthetic oligonucleotide
gccatgtccggcttcgctattcactcctcacgccc

SEQ ID NO: 122011 - DNA, 29 bp, Artificial Sequence
  Synthetic oligonucleotide
tcacaaggcggcattttcccgtcccttgc

SEQ ID NO: 122012 - DNA, 35 bp, Artificial Sequence
  Synthetic oligonucleotide
attcccccccgaccagttgatccgtccttagcctc

SEQ ID NO: 122013 - DNA, 35 bp, Artificial Sequence
  Synthetic oligonucleotide
tcgtccccctctgtgcctacctatatatgttcctc

SEQ ID NO: 122014 - DNA, 35 bp, Artificial Sequence
  Synthetic oligonucleotide
agtagcacctcctatgccctctgtaccatgtcttc

SEQ ID NO: 122015 - DNA, 36 bp, Artificial Sequence
  Synthetic oligonucleotide
agctccctggccttctctgtacccccgtcttgcaga

SEQ ID NO: 122016 - DNA, 37 bp, Artificial Sequence
  Synthetic oligonucleotide
tgcatctccggcatgactgaaccgcgccctcctccga

SEQ ID NO: 122017 - DNA, 37 bp, Artificial Sequence
  Synthetic oligonucleotide
tagtcacaggtggggcaagaaggggagttggggcgga

SEQ ID NO: 122018 - DNA, 37 bp, Artificial Sequence
  Synthetic oligonucleotide
accactggcggggttgtgttttgttggggagagggga

SEQ ID NO: 122019 - DNA, 37 bp, Artificial Sequence
  Synthetic oligonucleotide
gaaggggagggtcgtgggcagtgaaaaaaagggggga

SEQ ID NO: 122020 - DNA, 38 bp, Artificial Sequence
  Synthetic oligonucleotide
tgtggggcaggagctagccggagcgggggaggggatga

SEQ ID NO: 122021 - DNA, 35 bp, Artificial Sequence
  Synthetic oligonucleotide
atgccacatcttgccagctcccttttctaacgcgc

SEQ ID NO: 122022 - DNA, 35 bp, Artificial Sequence
  Synthetic oligonucleotide
actacacccccctacgcctgttgccttacatatgc

SEQ ID NO: 122023 - DNA, 35 bp, Artificial Sequence
  Synthetic oligonucleotide
taccacgcactctccatcctggctagggcttcctc

SEQ ID NO: 122024 - DNA, 35 bp, Artificial Sequence
  Synthetic oligonucleotide
acccgtacctccgctatagcattgcttcaagcttc

SEQ ID NO: 122025 - DNA, 36 bp, Artificial Sequence
  Synthetic oligonucleotide
tccctccgccctctgtcttcagcacacaactgccaa

SEQ ID NO: 122026 - DNA, 37 bp, Artificial Sequence
  Synthetic oligonucleotide
tgccactccggcgtacatcacagttccatctcttcga

SEQ ID NO: 122027 - DNA, 37 bp, Artificial Sequence
  Synthetic oligonucleotide
aacgagtccacgaggaaagggcgagggagggaaagga

SEQ ID NO: 122028 - DNA, 35 bp, Artificial Sequence
  Synthetic oligonucleotide
gcccaatcgccatagacgggaggggggaggaggga

SEQ ID NO: 122029 - DNA, 38 bp, Artificial Sequence
  Synthetic oligonucleotide
tccgactccccgcatttgttagtgatcccgctccttga

SEQ ID NO: 122030 - DNA, 35 bp, Artificial Sequence
  Synthetic oligonucleotide
gtctccccccgccttgttggtcacgccagtatcta

SEQ ID NO: 122031 - DNA, 35 bp, Artificial Sequence
  Synthetic oligonucleotide
gtccttgtactgcctgcttaattgcccgactttac

SEQ ID NO: 122032 - DNA, 35 bp, Artificial Sequence
  Synthetic oligonucleotide
acacacccccaactgatttaagccgcttataggtc

SEQ ID NO: 122033 - DNA, 35 bp, Artificial Sequence
  Synthetic oligonucleotide
tggaacacctgtctcacgcgcctgcctcatccctg

SEQ ID NO: 122034 - DNA, 35 bp, Artificial Sequence
  Synthetic oligonucleotide
gatagcgttcccctgcccaccactgaacccctgct

SEQ ID NO: 122035 - DNA, 37 bp, Artificial Sequence
  Synthetic oligonucleotide
ttgggacacgagggggtgggggggcgatcgatagcga

SEQ ID NO: 122036 - DNA, 38 bp, Artificial Sequence
  Synthetic oligonucleotide
actagggtagggggggaggggtaatactagaggggtga

SEQ ID NO: 122037 - DNA, 34 bp, Artificial Sequence
  Synthetic oligonucleotide
gttacagccctctttgctccagtcttcacgtaac

SEQ ID NO: 122038 - DNA, 35 bp, Artificial Sequence
  Synthetic oligonucleotide
acacctgctccatcggtcagctgcaatcccccggc

SEQ ID NO: 122039 - DNA, 35 bp, Artificial Sequence
  Synthetic oligonucleotide
gatacactgcccttttggtcttcccacgatctgtg

SEQ ID NO: 122040 - DNA, 35 bp, Artificial Sequence
  Synthetic oligonucleotide
ttgggacatctgaccgggggggacatgtacgggat

SEQ ID NO: 122041 - DNA, 36 bp, Artificial Sequence
  Synthetic oligonucleotide
acgaccgtcgtcgccgccgcttcgattctcatgcca

SEQ ID NO: 122042 - DNA, 37 bp, Artificial Sequence
  Synthetic oligonucleotide
agcggagcccacttccgtctatcctgtcatccatcga

SEQ ID NO: 122043 - DNA, 37 bp, Artificial Sequence
  Synthetic oligonucleotide
gatgagggggggtcgtaggggagaagggggtggatga

SEQ ID NO: 122044 - DNA, 38 bp, Artificial Sequence
  Synthetic oligonucleotide
aacggggaggactcgaggggaggtgggaaagggtatga

SEQ ID NO: 122045 - DNA, 35 bp, Artificial Sequence
  Synthetic oligonucleotide
ttgccggccacttccctctcatcgtacatgcacta

SEQ ID NO: 122046 - DNA, 35 bp, Artificial Sequence
  Synthetic oligonucleotide
gaccccgatatgtacccattagctccgactccgcc

SEQ ID NO: 122047 - DNA, 35 bp, Artificial Sequence
  Synthetic oligonucleotide
tcacgtgaacgcgctgtcgcccctctcccccctcc

SEQ ID NO: 122048 - DNA, 35 bp, Artificial Sequence
  Synthetic oligonucleotide
tccctctccagaaagctgttgctgtttccgcctcc

SEQ ID NO: 122049 - DNA, 35 bp, Artificial Sequence
  Synthetic oligonucleotide
ggaacagtcgccacgtcccccccgtcctcacagca

SEQ ID NO: 122050 - DNA, 36 bp, Artificial Sequence
  Synthetic oligonucleotide
gccgcatcgtactgttacccgtccttgccattttca

SEQ ID NO: 122051 - DNA, 38 bp, Artificial Sequence
  Synthetic oligonucleotide
gttaccgcccgcccttctagcttctgtcctcgtcgtga

SEQ ID NO: 122052 - DNA, 37 bp, Artificial Sequence
  Synthetic oligonucleotide
gtgcccttcctccgccgtcgtatcggccccatattga

SEQ ID NO: 122053 - DNA, 35 bp, Artificial Sequence
  Synthetic oligonucleotide
acccccaggccccgctacacctcgccccatgcgta

SEQ ID NO: 122054 - DNA, 35 bp, Artificial Sequence
  Synthetic oligonucleotide
ttgaacgggacaaaaaggcgtcggggcgggagggc

SEQ ID NO: 122055 - DNA, 36 bp, Artificial Sequence
  Synthetic oligonucleotide
tcaccccacagctgcatcactcgcgcgccgacaccg

SEQ ID NO: 122056 - DNA, 35 bp, Artificial Sequence
  Synthetic oligonucleotide
gtcaagtgggggaggcaagggaggtctagagcgtg

SEQ ID NO: 122057 - DNA, 35 bp, Artificial Sequence
  Synthetic oligonucleotide
tcacgcgtatgtccagcgtgcccactccctactat

SEQ ID NO: 122058 - DNA, 35 bp, Artificial Sequence
  Synthetic oligonucleotide
ccacgccccaggtcgcccccctcgcgtcacccgct

SEQ ID NO: 122059 - DNA, 36 bp, Artificial Sequence
  Synthetic oligonucleotide
actgagagggatggaagcttgggagggtgagggcaa

SEQ ID NO: 122060 - DNA, 35 bp, Artificial Sequence
  Synthetic oligonucleotide
tctgaggagaggggagtgagggaagaatgatggca

SEQ ID NO: 122061 - DNA, 37 bp, Artificial Sequence
  Synthetic oligonucleotide
gacaatgggagggtgcgggggaattggggtgacgcga

SEQ ID NO: 122062 - DNA, 36 bp, Artificial Sequence
  Synthetic oligonucleotide
gccaccctttactgatatgccacccttgttcatcta

SEQ ID NO: 122063 - DNA, 35 bp, Artificial Sequence
  Synthetic oligonucleotide
acactagcaccctgaatatgctcgatctgcccgcc

SEQ ID NO: 122064 - DNA, 35 bp, Artificial Sequence
  Synthetic oligonucleotide
gtgtccgttcgcccttaatatgtcctggtggtctc

SEQ ID NO: 122065 - DNA, 35 bp, Artificial Sequence
  Synthetic oligonucleotide
aagcgcgctgcccctccacgttaattccgcccgtc

SEQ ID NO: 122066 - DNA, 35 bp, Artificial Sequence
  Synthetic oligonucleotide
acactcgcctggcacgcatgtaacactctcgcttc

SEQ ID NO: 122067 - DNA, 34 bp, Artificial Sequence
  Synthetic oligonucleotide
gtacctaccgtgccgactcctctccaatcacttg

SEQ ID NO: 122068 - DNA, 35 bp, Artificial Sequence
  Synthetic oligonucleotide
tgcctccgcgccttttccgttctcccgcaaccgat

SEQ ID NO: 122069 - DNA, 35 bp, Artificial Sequence
  Synthetic oligonucleotide
ttgttcgcccttagacgccttattttgttctccct

SEQ ID NO: 122070 - DNA, 35 bp, Artificial Sequence
  Synthetic oligonucleotide
acatcgtacgttcgctatatacccggccctcttct

SEQ ID NO: 122071 - DNA, 35 bp, Artificial Sequence
  Synthetic oligonucleotide
tgcacgcaattcgcacccccgcaccccctctcgtt

SEQ ID NO: 122072 - DNA, 34 bp, Artificial Sequence
  Synthetic oligonucleotide
gtgatgcccgctaggttgcactactccccctgtt

SEQ ID NO: 122073 - DNA, 35 bp, Artificial Sequence
  Synthetic oligonucleotide
tccagaactgcgatgggcatgggtagggggggaca

SEQ ID NO: 122074 - DNA, 36 bp, Artificial Sequence
  Synthetic oligonucleotide
acgacttgccgcgagagtctttgcccaaccccgcca

SEQ ID NO: 122075 - DNA, 37 bp, Artificial Sequence
  Synthetic oligonucleotide
tacatccgccagtgcgcctgttctacttattccctga

SEQ ID NO: 122076 - DNA, 35 bp, Artificial Sequence
  Synthetic oligonucleotide
acaccgttgctcccatgaccagtcgttcgctttac

SEQ ID NO: 122077 - DNA, 36 bp, Artificial Sequence
  Synthetic oligonucleotide
tcactacccagcagttcccggtctacactctctgcc

SEQ ID NO: 122078 - DNA, 35 bp, Artificial Sequence
  Synthetic oligonucleotide
gtacacaacgaagtgcccttcaccccaccgcccgc

SEQ ID NO: 122079 - DNA, 35 bp, Artificial Sequence
  Synthetic oligonucleotide
gagggtgtggaggcaagggggtgtggagcaggtgg

SEQ ID NO: 122080 - DNA, 35 bp, Artificial Sequence
  Synthetic oligonucleotide
tctcccaccagtaccatgctatgtcacacgccctg

SEQ ID NO: 122081 - DNA, 35 bp, Artificial Sequence
  Synthetic oligonucleotide
gtccgccctcctccatctgttcacacagacaagtg

SEQ ID NO: 122082 - DNA, 37 bp, Artificial Sequence
  Synthetic oligonucleotide
atcaccacagcgtagtttccgcccccacccacaccga

SEQ ID NO: 122083 - DNA, 35 bp, Artificial Sequence
  Synthetic oligonucleotide
acgcactctggagctcccgccgttttggtttcccc

SEQ ID NO: 122084 - DNA, 35 bp, Artificial Sequence
  Synthetic oligonucleotide
agggcatacgctgcccgactttcgacccacacttc

SEQ ID NO: 122085 - DNA, 35 bp, Artificial Sequence
  Synthetic oligonucleotide
ttgacccaccttgattgcgcccctcacagcagttc

SEQ ID NO: 122086 - DNA, 35 bp, Artificial Sequence
  Synthetic oligonucleotide
gaaacggcctcaattactgctactcttccctcccg

SEQ ID NO: 122087 - DNA, 35 bp, Artificial Sequence
  Synthetic oligonucleotide
atgccccctcgcttactgtggttcggttatcttct

SEQ ID NO: 122088 - DNA, 37 bp, Artificial Sequence
  Synthetic oligonucleotide
ggaggagggaggggcgggtgaggaacacaaacttaga

SEQ ID NO: 122089 - DNA, 36 bp, Artificial Sequence
  Synthetic oligonucleotide
tgcgccgcccccccctctgttgctcttggtttttga

SEQ ID NO: 122090 - DNA, 35 bp, Artificial Sequence
  Synthetic oligonucleotide
tagtacccactccgcctcattgcgatatgccctcc

SEQ ID NO: 122091 - DNA, 35 bp, Artificial Sequence
  Synthetic oligonucleotide
gccttctcctgtctgcttatctaggtctgtccctc

SEQ ID NO: 122092 - DNA, 35 bp, Artificial Sequence
  Synthetic oligonucleotide
gtctccccacctccacctgttgcagaacagctcgt

SEQ ID NO: 122093 - DNA, 34 bp, Artificial Sequence
  Synthetic oligonucleotide
gcacatcctggtctagcctctgcacccactcttt

SEQ ID NO: 122094 - DNA, 37 bp, Artificial Sequence
  Synthetic oligonucleotide
acaggcggtcgatgggagggtagggggggcagacgga

SEQ ID NO: 122095 - DNA, 36 bp, Artificial Sequence
  Synthetic oligonucleotide
gaatgcctcctccgccggtcgttaccgttctcatta

SEQ ID NO: 122096 - DNA, 36 bp, Artificial Sequence
  Synthetic oligonucleotide
aacgtcgcaccaactgctttcgcgaacccgccctta

SEQ ID NO: 122097 - DNA, 35 bp, Artificial Sequence
  Synthetic oligonucleotide
gcatgcccatgccctcctcgttgatcacaccggac

SEQ ID NO: 122098 - DNA, 35 bp, Artificial Sequence
  Synthetic oligonucleotide
gcgttgcgcacctcttctgacccatgtcctcgttc

SEQ ID NO: 122099 - DNA, 35 bp, Artificial Sequence
  Synthetic oligonucleotide
tgactgtccggcgacctgttaatctatgccctcct

SEQ ID NO: 122100 - DNA, 34 bp, Artificial Sequence
  Synthetic oligonucleotide
tcgcctccacaacgaccctgcatcccatgttcct

SEQ ID NO: 122101 - DNA, 35 bp, Artificial Sequence
  Synthetic oligonucleotide
tcccggtgaggtcaacgaaccccttgcttactctt

SEQ ID NO: 122102 - DNA, 36 bp, Artificial Sequence
  Synthetic oligonucleotide
accatgttcgctcgctgtatggcactcccgctttca

SEQ ID NO: 122103 - DNA, 35 bp, Artificial Sequence
  Synthetic oligonucleotide
ttgatggtagggggaaggaaggaggcgtaggggga

SEQ ID NO: 122104 - DNA, 38 bp, Artificial Sequence
  Synthetic oligonucleotide
gtagaaggtggggatggagtgggtgaagagcgggttga

SEQ ID NO: 122105 - DNA, 36 bp, Artificial Sequence
  Synthetic oligonucleotide
gacgcatcaccgtctccgtccactaccgatcctgta

SEQ ID NO: 122106 - DNA, 35 bp, Artificial Sequence
  Synthetic oligonucleotide
tccgctcatcagtgcaccctcacgacgctctcgcc

SEQ ID NO: 122107 - DNA, 35 bp, Artificial Sequence
  Synthetic oligonucleotide
tcgagaagggagaaagataggaagagaatggacag

SEQ ID NO: 122108 - DNA, 35 bp, Artificial Sequence
  Synthetic oligonucleotide
ttggtggtggggaaggggcgggcgggctaagcggg

SEQ ID NO: 122109 - DNA, 35 bp, Artificial Sequence
  Synthetic oligonucleotide
ttcatgttgggcggggcgcgtatgtatggtggctt

SEQ ID NO: 122110 - DNA, 36 bp, Artificial Sequence
  Synthetic oligonucleotide
actaggggatgcggagggggtaggacgaggggggaa

SEQ ID NO: 122111 - DNA, 38 bp, Artificial Sequence
  Synthetic oligonucleotide
atcacgtactgctgcgtgtactgcccttccccaactga

SEQ ID NO: 122112 - DNA, 38 bp, Artificial Sequence
  Synthetic oligonucleotide
atctccgctgccccctgtcctggcccgaccgtccgtga

SEQ ID NO: 122113 - DNA, 36 bp, Artificial Sequence
  Synthetic oligonucleotide
tcacctgccccctcttccgcatgcgtggcaccttga

SEQ ID NO: 122114 - DNA, 36 bp, Artificial Sequence
  Synthetic oligonucleotide
acccgtaacctccatagtggtattactcgcccccta

SEQ ID NO: 122115 - DNA, 35 bp, Artificial Sequence
  Synthetic oligonucleotide
gatacgactcgctggtaccatctatgcacttatcc

SEQ ID NO: 122116 - DNA, 35 bp, Artificial Sequence
  Synthetic oligonucleotide
gtttcgcttccgctgccctatgaccctcccccagc

SEQ ID NO: 122117 - DNA, 35 bp, Artificial Sequence
  Synthetic oligonucleotide
agaaccagccccccgcatccgacccatgcctgcgc

SEQ ID NO: 122118 - DNA, 35 bp, Artificial Sequence
  Synthetic oligonucleotide
acaagggagggtgagggatgagaaggtggtaggcg

SEQ ID NO: 122119 - DNA, 35 bp, Artificial Sequence
  Synthetic oligonucleotide
tccatctactctccctgttatgccgtcgctctgct

SEQ ID NO: 122120 - DNA, 35 bp, Artificial Sequence
  Synthetic oligonucleotide
gcatgcgtgttcccctggccttcacccgtacctgt

SEQ ID NO: 122121 - DNA, 35 bp, Artificial Sequence
  Synthetic oligonucleotide
ctactcgccctcacccatctgccgccttgaacctt

SEQ ID NO: 122122 - DNA, 35 bp, Artificial Sequence
  Synthetic oligonucleotide
tctggacccctccttgatctgtcggtcaatccctt

SEQ ID NO: 122123 - DNA, 36 bp, Artificial Sequence
  Synthetic oligonucleotide
gcaaggagccgtccgtttcctccctctatgttctca

SEQ ID NO: 122124 - DNA, 37 bp, Artificial Sequence
  Synthetic oligonucleotide
accccgataccgtcagaccgcctcgattcccctccga

SEQ ID NO: 122125 - DNA, 37 bp, Artificial Sequence
  Synthetic oligonucleotide
tgtggggggggagggaaccaagggtgtgcgagccgga

SEQ ID NO: 122126 - DNA, 35 bp, Artificial Sequence
  Synthetic oligonucleotide
acacacacaccgtttcgaggtcgccgccttatcac

SEQ ID NO: 122127 - DNA, 35 bp, Artificial Sequence
  Synthetic oligonucleotide
agcttcactggctgcccccccgcgctataacatcc

SEQ ID NO: 122128 - DNA, 35 bp, Artificial Sequence
  Synthetic oligonucleotide
gagtccagcgccttaatgccttcattgcgctcctc

SEQ ID NO: 122129 - DNA, 35 bp, Artificial Sequence
  Synthetic oligonucleotide
gatcaccccccatatacgatgtagtactcccgctc

SEQ ID NO: 122130 - DNA, 35 bp, Artificial Sequence
  Synthetic oligonucleotide
tagccgatccatctactccgcatctccgtgcctcg

SEQ ID NO: 122131 - DNA, 35 bp, Artificial Sequence
  Synthetic oligonucleotide
aaacaggtggcggtggggggatcctcggaggacgg

SEQ ID NO: 122132 - DNA, 35 bp, Artificial Sequence
  Synthetic oligonucleotide
aacgtcaccgcaatccctgcccgttccctttagat

SEQ ID NO: 122133 - DNA, 35 bp, Artificial Sequence
  Synthetic oligonucleotide
atccgcccacggacattgactcgtaacccatcact

SEQ ID NO: 122134 - DNA, 35 bp, Artificial Sequence
  Synthetic oligonucleotide
atctcactaagccacgtcagatcgcttcttctcct

SEQ ID NO: 122135 - DNA, 36 bp, Artificial Sequence
  Synthetic oligonucleotide
actggtccgcttcccgccgcgtatcctcctcttcca

SEQ ID NO: 122136 - DNA, 36 bp, Artificial Sequence
  Synthetic oligonucleotide
tgagccgttgtccccttgcgactgacccatctctca

SEQ ID NO: 122137 - DNA, 37 bp, Artificial Sequence
  Synthetic oligonucleotide
acacacgctccatcgtccatcatcttcctcgtcggga

SEQ ID NO: 122138 - DNA, 38 bp, Artificial Sequence
  Synthetic oligonucleotide
acgcacagtccgcccgcgccctcgaaccttccttgtga

SEQ ID NO: 122139 - DNA, 35 bp, Artificial Sequence
  Synthetic oligonucleotide
tgatcgacgcacacggaatataatccgcccccctc

SEQ ID NO: 122140 - DNA, 35 bp, Artificial Sequence
  Synthetic oligonucleotide
gagcatttccccgcgcacacaccgccccttggctc

SEQ ID NO: 122141 - DNA, 35 bp, Artificial Sequence
  Synthetic oligonucleotide
gctgccccatctctacttcgccctcgagtgccgtc

SEQ ID NO: 122142 - DNA, 35 bp, Artificial Sequence
  Synthetic oligonucleotide
accactccatcgctaatttgttctcgctttcggtc

SEQ ID NO: 122143 - DNA, 36 bp, Artificial Sequence
  Synthetic oligonucleotide
ggaaaggggccaggggaaggggtaatggacgggaaa

SEQ ID NO: 122144 - DNA, 36 bp, Artificial Sequence
  Synthetic oligonucleotide
gtgctccccccttgcactttgtacagtgagtttaca

SEQ ID NO: 122145 - DNA, 37 bp, Artificial Sequence
  Synthetic oligonucleotide
agactccgcccgcccatgtctgcaccgtgacgcccta

SEQ ID NO: 122146 - DNA, 36 bp, Artificial Sequence
  Synthetic oligonucleotide
gaggggttctacggggcgggaaatacgaggggccta

SEQ ID NO: 122147 - DNA, 35 bp, Artificial Sequence
  Synthetic oligonucleotide
atgcccccttagcatgtccaagttaacaccttacc

SEQ ID NO: 122148 - DNA, 35 bp, Artificial Sequence
  Synthetic oligonucleotide
gttccaccatttcgctccgcccacagaccgctcgc

SEQ ID NO: 122149 - DNA, 35 bp, Artificial Sequence
  Synthetic oligonucleotide
tccgccaccctggacttctctcgttcatgccgttc

SEQ ID NO: 122150 - DNA, 35 bp, Artificial Sequence
  Synthetic oligonucleotide
gttcccgacgcatgtctccaccacttgcaccccat

SEQ ID NO: 122151 - DNA, 34 bp, Artificial Sequence
  Synthetic oligonucleotide
tacgacgccccggctttctttgccctatccccgt

SEQ ID NO: 122152 - DNA, 35 bp, Artificial Sequence
  Synthetic oligonucleotide
ggacaactgtccgcaatgccttcgcctatccactt

SEQ ID NO: 122153 - DNA, 35 bp, Artificial Sequence
  Synthetic oligonucleotide
agccatcctccattacctgtttggttcactgcctt

SEQ ID NO: 122154 - DNA, 37 bp, Artificial Sequence
  Synthetic oligonucleotide
gtgcttgcccatcggacctccccgtcagtctccagga

SEQ ID NO: 122155 - DNA, 37 bp, Artificial Sequence
  Synthetic oligonucleotide
taggggccgtcgctaggggggggagcgcaatccggga

SEQ ID NO: 122156 - DNA, 37 bp, Artificial Sequence
  Synthetic oligonucleotide
aatgaaggggggaggcgagaggggccgggataactga

SEQ ID NO: 122157 - DNA, 36 bp, Artificial Sequence
  Synthetic oligonucleotide
gccactgcctccgcctggaatctcgttactgactta

SEQ ID NO: 122158 - DNA, 35 bp, Artificial Sequence
  Synthetic oligonucleotide
gcccaccccggcctcatgacgcatttcgccctacc

SEQ ID NO: 122159 - DNA, 35 bp, Artificial Sequence
  Synthetic oligonucleotide
tttgcaggtgtcttcatcgtcgccaccctttcgcc

SEQ ID NO: 122160 - DNA, 35 bp, Artificial Sequence
  Synthetic oligonucleotide
acaggcccgcagtgactacttcgcacgccctatcc

SEQ ID NO: 122161 - DNA, 35 bp, Artificial Sequence
  Synthetic oligonucleotide
ggtatcggtgccatccgtctgttcgttcccgttcc

SEQ ID NO: 122162 - DNA, 35 bp, Artificial Sequence
  Synthetic oligonucleotide
tgttcactcctccgcctgccatgccattcgtttcc

SEQ ID NO: 122163 - DNA, 35 bp, Artificial Sequence
  Synthetic oligonucleotide
gagtcacgctgtgcgtacattttgcccttccgatt

SEQ ID NO: 122164 - DNA, 36 bp, Artificial Sequence
  Synthetic oligonucleotide
gcgggagacgggaggaggttgggaaagcggatggaa

SEQ ID NO: 122165 - DNA, 37 bp, Artificial Sequence
  Synthetic oligonucleotide
tcaccgtcacggggggggcaaaggggtcgagggggga

SEQ ID NO: 122166 - DNA, 37 bp, Artificial Sequence
  Synthetic oligonucleotide
atacgccctgctgcccgcccactctctgcactctgga

SEQ ID NO: 122167 - DNA, 38 bp, Artificial Sequence
  Synthetic oligonucleotide
ggaggagagacaggagtgggttgagggggcagtaatga

SEQ ID NO: 122168 - DNA, 38 bp, Artificial Sequence
  Synthetic oligonucleotide
tcagctcgcatccgagttcatacgcctccgccacctga

SEQ ID NO: 122169 - DNA, 33 bp, Artificial Sequence
  Synthetic oligonucleotide
aaaccagtccggtcgctcaagcccctgtttcac

SEQ ID NO: 122170 - DNA, 35 bp, Artificial Sequence
  Synthetic oligonucleotide
gccaacctcccagcgccccttttgcgccacactac

SEQ ID NO: 122171 - DNA, 35 bp, Artificial Sequence
  Synthetic oligonucleotide
gccgagcttgttccgccggtaatttcctcctcgcc

SEQ ID NO: 122172 - DNA, 36 bp, Artificial Sequence
  Synthetic oligonucleotide
ccacaacgccgttgtccgtacactcttatactccgc

SEQ ID NO: 122173 - DNA, 35 bp, Artificial Sequence
  Synthetic oligonucleotide
aagcccttccacctgtctcgctcctttctcttggg

SEQ ID NO: 122174 - DNA, 35 bp, Artificial Sequence
  Synthetic oligonucleotide
gtaccccccatcttagtcgacctgctcccactgtg

SEQ ID NO: 122175 - DNA, 31 bp, Artificial Sequence
  Synthetic oligonucleotide
ggtacgtgctggccctcggtctactccttct

SEQ ID NO: 122176 - DNA, 36 bp, Artificial Sequence
  Synthetic oligonucleotide
tccgcggatcggcctccttcaagcactgtcaaccca

SEQ ID NO: 122177 - DNA, 35 bp, Artificial Sequence
  Synthetic oligonucleotide
tccgtcgcgcggtgttgtcgccaccttgtcttcac

SEQ ID NO: 122178 - DNA, 35 bp, Artificial Sequence
  Synthetic oligonucleotide
gaccccagcttacaccgcttgaccctccctgtgac

SEQ ID NO: 122179 - DNA, 35 bp, Artificial Sequence
  Synthetic oligonucleotide
tcccgcctgtagctcctgcgctccgcttcctacgc

SEQ ID NO: 122180 - DNA, 36 bp, Artificial Sequence
  Synthetic oligonucleotide
gcagggcgcgaagaaacgggcaacgggaggggggaa

SEQ ID NO: 122181 - DNA, 36 bp, Artificial Sequence
  Synthetic oligonucleotide
tgagcgccatcttttttgtccgtctcgttcacctca

SEQ ID NO: 122182 - DNA, 37 bp, Artificial Sequence
  Synthetic oligonucleotide
gccgcacctcctggtcccaccacctacgctccatcga

SEQ ID NO: 122183 - DNA, 37 bp, Artificial Sequence
  Synthetic oligonucleotide
tcctcccccctcctccgtttcgaaggaaccagtttga

SEQ ID NO: 122184 - DNA, 33 bp, Artificial Sequence
  Synthetic oligonucleotide
gttgtccgcattcttttctccgttctatagtcc

SEQ ID NO: 122185 - DNA, 35 bp, Artificial Sequence
  Synthetic oligonucleotide
gttacacctgccaccgctctgttgctcctgctggc

SEQ ID NO: 122186 - DNA, 35 bp, Artificial Sequence
  Synthetic oligonucleotide
tgtcctcctcagtgcaccttgttcgttccgtagtc

SEQ ID NO: 122187 - DNA, 35 bp, Artificial Sequence
  Synthetic oligonucleotide
tgtccccccccagccaaggcgcacctttccacttc

SEQ ID NO: 122188 - DNA, 35 bp, Artificial Sequence
  Synthetic oligonucleotide
tacgacacacctccgcccacatgtagtgattatcg

SEQ ID NO: 122189 - DNA, 35 bp, Artificial Sequence
  Synthetic oligonucleotide
tagtcagccccggtctcggctattctatccctgct

SEQ ID NO: 122190 - DNA, 35 bp, Artificial Sequence
  Synthetic oligonucleotide
gcccttagcctgccgatcgcctcctccgcaacctt

SEQ ID NO: 122191 - DNA, 35 bp, Artificial Sequence
  Synthetic oligonucleotide
ttgggaaggacataggaggggtcggagggagggtt

SEQ ID NO: 122192 - DNA, 37 bp, Artificial Sequence
  Synthetic oligonucleotide
acagtccgcccacgtgatgaacgcctctaaccctcga

SEQ ID NO: 122193 - DNA, 35 bp, Artificial Sequence
  Synthetic oligonucleotide
atgtgcgccttcgcaattagtatgctcgcccgttc

SEQ ID NO: 122194 - DNA, 35 bp, Artificial Sequence
  Synthetic oligonucleotide
atgccccatcctggtcctcccgtctttttggcaaa

SEQ ID NO: 122195 - DNA, 36 bp, Artificial Sequence
  Synthetic oligonucleotide
ttctccgccacccctcgtatcggccacagccaccga

SEQ ID NO: 122196 - DNA, 36 bp, Artificial Sequence
  Synthetic oligonucleotide
acgacccgggattaacaagaagggacgggagggtga

SEQ ID NO: 122197 - DNA, 35 bp, Artificial Sequence
  Synthetic oligonucleotide
acgcactccccacccggtaatcgtatctgttgcac

SEQ ID NO: 122198 - DNA, 35 bp, Artificial Sequence
  Synthetic oligonucleotide
gagcctcctcctcgctttaccacggtccatgagac

SEQ ID NO: 122199 - DNA, 35 bp, Artificial Sequence
  Synthetic oligonucleotide
tgccgtcactcaattatgccacttgcctgtctccc

SEQ ID NO: 122200 - DNA, 35 bp, Artificial Sequence
  Synthetic oligonucleotide
acacgcggcgctcctgccgggtttccgaccttccc

SEQ ID NO: 122201 - DNA, 35 bp, Artificial Sequence
  Synthetic oligonucleotide
ggagggggggatgtggaaggggatgggcggtcggt

SEQ ID NO: 122202 - DNA, 37 bp, Artificial Sequence
  Synthetic oligonucleotide
ggagggccagatcagggggggagggttcaactctcga

SEQ ID NO: 122203 - DNA, 37 bp, Artificial Sequence
  Synthetic oligonucleotide
gatacaagtgggggggcgtgtgggagaagggagggga

SEQ ID NO: 122204 - DNA, 38 bp, Artificial Sequence
  Synthetic oligonucleotide
gacacgcatcctcctcggttctggtccttcctccctga

SEQ ID NO: 122205 - DNA, 37 bp, Artificial Sequence
  Synthetic oligonucleotide
actcatcccacctgcaatgtaccaacatgacccttga

SEQ ID NO: 122206 - DNA, 36 bp, Artificial Sequence
  Synthetic oligonucleotide
tcatccaccccaattcggtcatcactgccgtgccta

SEQ ID NO: 122207 - DNA, 36 bp, Artificial Sequence
  Synthetic oligonucleotide
tccgagcggtaattgtccgcgcgttccttttgagta

SEQ ID NO: 122208 - DNA, 36 bp, Artificial Sequence
  Synthetic oligonucleotide
ggtggggttgtgggaatgggggggcatgggacggta

SEQ ID NO: 122209 - DNA, 35 bp, Artificial Sequence
  Synthetic oligonucleotide
gcacctcgctccttaatggtctcaactctgccatc

SEQ ID NO: 122210 - DNA, 35 bp, Artificial Sequence
  Synthetic oligonucleotide
atggccccgccctgacatgacttcgtaccccccgg

SEQ ID NO: 122211 - DNA, 35 bp, Artificial Sequence
  Synthetic oligonucleotide
tcgtacgagtccctgtacatccatctcgccgccct

SEQ ID NO: 122212 - DNA, 35 bp, Artificial Sequence
  Synthetic oligonucleotide
actgagcatagggggagggagggatgggttcgagt

SEQ ID NO: 122213 - DNA, 35 bp, Artificial Sequence
  Synthetic oligonucleotide
atcgacctgtccctgcccttacgcacatctcatgt

SEQ ID NO: 122214 - DNA, 35 bp, Artificial Sequence
  Synthetic oligonucleotide
ttaccgcccggtcgtccccctgtttagcccctctt

SEQ ID NO: 122215 - DNA, 36 bp, Artificial Sequence
  Synthetic oligonucleotide
gactacctcctactcgtatctgcagccaatcctcga

SEQ ID NO: 122216 - DNA, 36 bp, Artificial Sequence
  Synthetic oligonucleotide
gccccctccacgatatagtttccgtccctcgagtga

SEQ ID NO: 122217 - DNA, 36 bp, Artificial Sequence
  Synthetic oligonucleotide
gacccctcaccgtgttatctcaccttttttccctta

SEQ ID NO: 122218 - DNA, 35 bp, Artificial Sequence
  Synthetic oligonucleotide
atcgctcccaccgctttgccggatataccaacatc

SEQ ID NO: 122219 - DNA, 35 bp, Artificial Sequence
  Synthetic oligonucleotide
gatggtgcccaacgttgggtatgggggggtagggg

SEQ ID NO: 122220 - DNA, 36 bp, Artificial Sequence
  Synthetic oligonucleotide
taccgcgccaccatatcacgtatcccccgttcccaa

SEQ ID NO: 122221 - DNA, 35 bp, Artificial Sequence
  Synthetic oligonucleotide
gatctatccgtacccagcgcacaacgcacctacca

SEQ ID NO: 122222 - DNA, 36 bp, Artificial Sequence
  Synthetic oligonucleotide
tacccgccctccctgtggcattgcactttgacatca

SEQ ID NO: 122223 - DNA, 37 bp, Artificial Sequence
  Synthetic oligonucleotide
gaagggggcgaaggtgattggcaggaggggtgagaga

SEQ ID NO: 122224 - DNA, 35 bp, Artificial Sequence
  Synthetic oligonucleotide
gaagaactgagggaggcgtaagtaagggtggggga

SEQ ID NO: 122225 - DNA, 37 bp, Artificial Sequence
  Synthetic oligonucleotide
tcccgccctacttctcctctggtccgacagttattga

SEQ ID NO: 122226 - DNA, 35 bp, Artificial Sequence
  Synthetic oligonucleotide
tctctgcctcctggtacttgacccccctactgcta

SEQ ID NO: 122227 - DNA, 36 bp, Artificial Sequence
  Synthetic oligonucleotide
tcccgagaacctctgcctgacaaacacatgctttta

SEQ ID NO: 122228 - DNA, 35 bp, Artificial Sequence
  Synthetic oligonucleotide
ttagccatccgactgtctttcattcgctgcttacc

SEQ ID NO: 122229 - DNA, 35 bp, Artificial Sequence
  Synthetic oligonucleotide
tgtaccgcccgcttacatagactcgtctctcgcgc

SEQ ID NO: 122230 - DNA, 35 bp, Artificial Sequence
  Synthetic oligonucleotide
tagaccctccggcgcctttattgcgattaccttgc

SEQ ID NO: 122231 - DNA, 35 bp, Artificial Sequence
  Synthetic oligonucleotide
gaacaccttcgcttcgtgctttccacagtcctttt

SEQ ID NO: 122232 - DNA, 38 bp, Artificial Sequence
  Synthetic oligonucleotide
tcaaccgcacccgcctggtccctcatcattagccctga

SEQ ID NO: 122233 - DNA, 38 bp, Artificial Sequence
  Synthetic oligonucleotide
gaccaccacccactctcatacgcggacaggaactttga

SEQ ID NO: 122234 - DNA, 36 bp, Artificial Sequence
  Synthetic oligonucleotide
aacacctcgcacatgcgtacgccacttttcattata

SEQ ID NO: 122235 - DNA, 36 bp, Artificial Sequence
  Synthetic oligonucleotide
gccaccactcccgcctctacgcttgttccgcctgta

SEQ ID NO: 122236 - DNA, 36 bp, Artificial Sequence
  Synthetic oligonucleotide
aaccactcctccgtaatgctgcacctgctcctgtta

SEQ ID NO: 122237 - DNA, 35 bp, Artificial Sequence
  Synthetic oligonucleotide
tgtagcacgggtggaagggggtgggtactgattta

SEQ ID NO: 122238 - DNA, 35 bp, Artificial Sequence
  Synthetic oligonucleotide
aatgcaccggtccaatctaatcttacgctcccgcc

SEQ ID NO: 122239 - DNA, 35 bp, Artificial Sequence
  Synthetic oligonucleotide
ggacaaacccgcagacggcccctcttccatagtcc

SEQ ID NO: 122240 - DNA, 34 bp, Artificial Sequence
  Synthetic oligonucleotide
ggacccatcccccctctgttcaccgaacgcgagc

SEQ ID NO: 122241 - DNA, 35 bp, Artificial Sequence
  Synthetic oligonucleotide
tgatcacccgactgcggttccatctctcgacggtc

SEQ ID NO: 122242 - DNA, 35 bp, Artificial Sequence
  Synthetic oligonucleotide
ggtgggagggggggctattggacaagcgcaaggct

SEQ ID NO: 122243 - DNA, 35 bp, Artificial Sequence
  Synthetic oligonucleotide
ttcgcaatgcaccctgccgacgttcccgaccccgt

SEQ ID NO: 122244 - DNA, 35 bp, Artificial Sequence
  Synthetic oligonucleotide
tgtgccccccatttttctacgcagcaagtccccgt

SEQ ID NO: 122245 - DNA, 36 bp, Artificial Sequence
  Synthetic oligonucleotide
gcccacctgtggcccggcctcactctgccattacca

SEQ ID NO: 122246 - DNA, 37 bp, Artificial Sequence
  Synthetic oligonucleotide
gatgtgtgcgggagggtacgggtgggactttcaatga

SEQ ID NO: 122247 - DNA, 38 bp, Artificial Sequence
  Synthetic oligonucleotide
gcccccgccccatccttgtcacagggacctgaacatga

SEQ ID NO: 122248 - DNA, 36 bp, Artificial Sequence
  Synthetic oligonucleotide
tccccgccctgctccaccaaagcaccaactccctga

SEQ ID NO: 122249 - DNA, 35 bp, Artificial Sequence
  Synthetic oligonucleotide
atcccgcccggtccgtggcatgcactttgtcctac

SEQ ID NO: 122250 - DNA, 35 bp, Artificial Sequence
  Synthetic oligonucleotide
tccagctgtgttctgcttagtaattccgttcctcc

SEQ ID NO: 122251 - DNA, 35 bp, Artificial Sequence
  Synthetic oligonucleotide
tccccgtttccgcccatgatcacattcgtccacgc

SEQ ID NO: 122252 - DNA, 35 bp, Artificial Sequence
  Synthetic oligonucleotide
accagagggggaaagggagttggggacggcaaagg

SEQ ID NO: 122253 - DNA, 35 bp, Artificial Sequence
  Synthetic oligonucleotide
gctcaccttccgcattggatttcctcccctccatt

SEQ ID NO: 122254 - DNA, 35 bp, Artificial Sequence
  Synthetic oligonucleotide
gcctccctgatcctgcctgtgttcacatctttcaa

SEQ ID NO: 122255 - DNA, 35 bp, Artificial Sequence
  Synthetic oligonucleotide
ttgcgatgcccgcccaaccgtgacccccgccttca

SEQ ID NO: 122256 - DNA, 36 bp, Artificial Sequence
  Synthetic oligonucleotide
gaaaggagaagatggcggtaggtgatagggggtaga

SEQ ID NO: 122257 - DNA, 36 bp, Artificial Sequence
  Synthetic oligonucleotide
tcgccatcccctccctgtgtgccttcgttcaggcga

SEQ ID NO: 122258 - DNA, 36 bp, Artificial Sequence
  Synthetic oligonucleotide
gcccatcacacgctatatgccaacacctctatatga

SEQ ID NO: 122259 - DNA, 35 bp, Artificial Sequence
  Synthetic oligonucleotide
tatccggtcacgactgctctccataacctgcctcc

SEQ ID NO: 122260 - DNA, 35 bp, Artificial Sequence
  Synthetic oligonucleotide
tgatcccgtaccgcccccgctggacaatgtcccgc

SEQ ID NO: 122261 - DNA, 35 bp, Artificial Sequence
  Synthetic oligonucleotide
gagccgccacatttcccgtacatttccgtccccag

SEQ ID NO: 122262 - DNA, 36 bp, Artificial Sequence
  Synthetic oligonucleotide
attgcctccgcttacgatcgaaccgccctcccgcca

SEQ ID NO: 122263 - DNA, 37 bp, Artificial Sequence
  Synthetic oligonucleotide
gcaataggaggggacggggcaaagtaggcgtgtggga

SEQ ID NO: 122264 - DNA, 35 bp, Artificial Sequence
  Synthetic oligonucleotide
tgcatcctccgtttctctagcgcgtactctgggcc

SEQ ID NO: 122265 - DNA, 35 bp, Artificial Sequence
  Synthetic oligonucleotide
gccctgctgccaattctcgtcgtacctccttcgtc

SEQ ID NO: 122266 - DNA, 35 bp, Artificial Sequence
  Synthetic oligonucleotide
gcccaccttaactgctcccccgaccccatacttcg

SEQ ID NO: 122267 - DNA, 35 bp, Artificial Sequence
  Synthetic oligonucleotide
gttgaaatgggtccgagggagggagggggggtagg

SEQ ID NO: 122268 - DNA, 35 bp, Artificial Sequence
  Synthetic oligonucleotide
gttcccctccgccgatacatggttaccgattcgat

SEQ ID NO: 122269 - DNA, 35 bp, Artificial Sequence
  Synthetic oligonucleotide
ttccgtcccttccccccgttccgcagtgtattaca

SEQ ID NO: 122270 - DNA, 36 bp, Artificial Sequence
  Synthetic oligonucleotide
ggtacgagggggagctaaagggcggagttaagtaga

SEQ ID NO: 122271 - DNA, 35 bp, Artificial Sequence
  Synthetic oligonucleotide
tatcccatccggcctccctaccctctttgggcgcc

SEQ ID NO: 122272 - DNA, 35 bp, Artificial Sequence
  Synthetic oligonucleotide
agagacatgaggggggggacaagaaatggggcgtg

SEQ ID NO: 122273 - DNA, 35 bp, Artificial Sequence
  Synthetic oligonucleotide
gatccccccgcctcaatacctccacttagttcgtg

SEQ ID NO: 122274 - DNA, 35 bp, Artificial Sequence
  Synthetic oligonucleotide
gcggaaccacattatgtcccctcgctttccatttg

SEQ ID NO: 122275 - DNA, 35 bp, Artificial Sequence
  Synthetic oligonucleotide
gccatccagcccccccgccgacactaagcctcaca

SEQ ID NO: 122276 - DNA, 37 bp, Artificial Sequence
  Synthetic oligonucleotide
tgtgcataccttccgcgccccagacgccactccccga

SEQ ID NO: 122277 - DNA, 37 bp, Artificial Sequence
  Synthetic oligonucleotide
gaatgcggggtggggggagatcgggaatctgaacgga

SEQ ID NO: 122278 - DNA, 35 bp, Artificial Sequence
  Synthetic oligonucleotide
taccagcaccctcccgtctctgtcgcctcgctccc

SEQ ID NO: 122279 - DNA, 35 bp, Artificial Sequence
  Synthetic oligonucleotide
agtgtgcacaccgagttaatgccgccctttttccc

SEQ ID NO: 122280 - DNA, 35 bp, Artificial Sequence
  Synthetic oligonucleotide
cccaccgcattctgcattccctgctccttacccaa

SEQ ID NO: 122281 - DNA, 35 bp, Artificial Sequence
  Synthetic oligonucleotide
tccccttcgttccatctgctgccatgtgcctcaca

SEQ ID NO: 122282 - DNA, 36 bp, Artificial Sequence
  Synthetic oligonucleotide
tgcaacctccgctctgctagttatcgttttcgcgca

SEQ ID NO: 122283 - DNA, 35 bp, Artificial Sequence
  Synthetic oligonucleotide
ttatgccctgactctgtaccaccccttgacccccc

SEQ ID NO: 122284 - DNA, 35 bp, Artificial Sequence
  Synthetic oligonucleotide
gtcttcccagccgtgaaatgcccctttctccttgc

SEQ ID NO: 122285 - DNA, 35 bp, Artificial Sequence
  Synthetic oligonucleotide
gccgttccatcggttcaatagactccttcaccatc

SEQ ID NO: 122286 - DNA, 35 bp, Artificial Sequence
  Synthetic oligonucleotide
aagggctggtggaggagaagaaggcaggcgggtag

SEQ ID NO: 122287 - DNA, 34 bp, Artificial Sequence
  Synthetic oligonucleotide
gatgcgatggcccgttccctaccctccagtcccg

SEQ ID NO: 122288 - DNA, 35 bp, Artificial Sequence
  Synthetic oligonucleotide
gccacccctgttctcggacaacccctacttcttcg

SEQ ID NO: 122289 - DNA, 35 bp, Artificial Sequence
  Synthetic oligonucleotide
ggtcgcatgtccgtcccgtcgtgatccgcttccct

SEQ ID NO: 122290 - DNA, 35 bp, Artificial Sequence
  Synthetic oligonucleotide
gcctccccagtagtacgtacccgttaccgtttttt

SEQ ID NO: 122291 - DNA, 35 bp, Artificial Sequence
  Synthetic oligonucleotide
accctgctcgccccccgcacccgtacgatacttca

SEQ ID NO: 122292 - DNA, 35 bp, Artificial Sequence
  Synthetic oligonucleotide
gtgcagagcctgccctcctacgctcgttgtacacc

SEQ ID NO: 122293 - DNA, 35 bp, Artificial Sequence
  Synthetic oligonucleotide
aacgaacgccccgccccaccttccaagaccgctgc

SEQ ID NO: 122294 - DNA, 35 bp, Artificial Sequence
  Synthetic oligonucleotide
gccgcatctcgccacccattcccgccgccaggttc

SEQ ID NO: 122295 - DNA, 35 bp, Artificial Sequence
  Synthetic oligonucleotide
accgcaaccacacgagtctttccgcctgttcctcg

SEQ ID NO: 122296 - DNA, 34 bp, Artificial Sequence
  Synthetic oligonucleotide
tgacgcccgtaccgtacttcacctgcccttacat

SEQ ID NO: 122297 - DNA, 35 bp, Artificial Sequence
  Synthetic oligonucleotide
gtgccaccactagatatccctgttgttcgcccctt

SEQ ID NO: 122298 - DNA, 35 bp, Artificial Sequence
  Synthetic oligonucleotide
tcatcacaccccaatgagcgaaccgaccttctttt

SEQ ID NO: 122299 - DNA, 36 bp, Artificial Sequence
  Synthetic oligonucleotide
gctcacacccgcagcccagcgaggacctgcctcaca

SEQ ID NO: 122300 - DNA, 36 bp, Artificial Sequence
  Synthetic oligonucleotide
tgccacccatgcgttcatgaaccctgttacctccga

SEQ ID NO: 122301 - DNA, 37 bp, Artificial Sequence
  Synthetic oligonucleotide
gccgcgaggccgccgttattacaatatctctctccga

SEQ ID NO: 122302 - DNA, 37 bp, Artificial Sequence
  Synthetic oligonucleotide
gaaaggaagggggagggagattgaggtggagtgagga

SEQ ID NO: 122303 - DNA, 37 bp, Artificial Sequence
  Synthetic oligonucleotide
aatgaagggtacacggtggagctagaagaagggcgga

SEQ ID NO: 122304 - DNA, 37 bp, Artificial Sequence
  Synthetic oligonucleotide
ggggagggaacgagggggagtggttaaacttggggga

SEQ ID NO: 122305 - DNA, 38 bp, Artificial Sequence
  Synthetic oligonucleotide
gcacacgtctcgtttcccactgccccttctctcgctga

SEQ ID NO: 122306 - DNA, 37 bp, Artificial Sequence
  Synthetic oligonucleotide
tactgcatcactctcctggtcctgttctctcctctga

SEQ ID NO: 122307 - DNA, 35 bp, Artificial Sequence
  Synthetic oligonucleotide
aattgctgcccctgcctactgcttcgcttcgccta

SEQ ID NO: 122308 - DNA, 35 bp, Artificial Sequence
  Synthetic oligonucleotide
acatgacctcacccgcttttatgtagccctttgta

SEQ ID NO: 122309 - DNA, 35 bp, Artificial Sequence
  Synthetic oligonucleotide
actccccactctggaataccgacctggttccgctc

SEQ ID NO: 122310 - DNA, 35 bp, Artificial Sequence
  Synthetic oligonucleotide
gttgccttccccgtgaccgctaggttctatttgtc

SEQ ID NO: 122311 - DNA, 35 bp, Artificial Sequence
  Synthetic oligonucleotide
tccgtggttccacatggcatcatgactcgcctttc

SEQ ID NO: 122312 - DNA, 35 bp, Artificial Sequence
  Synthetic oligonucleotide
acatcaccacccctctgctaagttttgcttagtcg

SEQ ID NO: 122313 - DNA, 35 bp, Artificial Sequence
  Synthetic oligonucleotide
ggactatgcccccccctcccgctgcggtgctctct

SEQ ID NO: 122314 - DNA, 35 bp, Artificial Sequence
  Synthetic oligonucleotide
gcaaccgtacccgctcgtctacgtcttccgccgtt

SEQ ID NO: 122315 - DNA, 37 bp, Artificial Sequence
  Synthetic oligonucleotide
aatatgggggagggcaagggagggacgggcaatagca

SEQ ID NO: 122316 - DNA, 37 bp, Artificial Sequence
  Synthetic oligonucleotide
aacactcctccgctttttagtcgcgtccaccctgcga

SEQ ID NO: 122317 - DNA, 35 bp, Artificial Sequence
  Synthetic oligonucleotide
gaaaccccagccccgcccttcatgtaacgcaaacc

SEQ ID NO: 122318 - DNA, 34 bp, Artificial Sequence
  Synthetic oligonucleotide
gtgccagccttccgactttctcagcatgactccc

SEQ ID NO: 122319 - DNA, 35 bp, Artificial Sequence
  Synthetic oligonucleotide
tacctgatccgtggcctatcgccgggcctccctcc

SEQ ID NO: 122320 - DNA, 35 bp, Artificial Sequence
  Synthetic oligonucleotide
tctactgactcggtggtaccgcacacttctcactc

SEQ ID NO: 122321 - DNA, 35 bp, Artificial Sequence
  Synthetic oligonucleotide
gctccgcccctaccatgagttttcgccgtctactc

SEQ ID NO: 122322 - DNA, 36 bp, Artificial Sequence
  Synthetic oligonucleotide
ggacgggggagaagggggggtgggagtagggtgcaa

SEQ ID NO: 122323 - DNA, 35 bp, Artificial Sequence
  Synthetic oligonucleotide
atcagcactcaccccacaccttccgccagctcgca

SEQ ID NO: 122324 - DNA, 36 bp, Artificial Sequence
  Synthetic oligonucleotide
tacaccccgctccgccccctagcccgcctttgtgca

SEQ ID NO: 122325 - DNA, 35 bp, Artificial Sequence
  Synthetic oligonucleotide
ctacatgtcaggcattcctacttttgaccaccacc

SEQ ID NO: 122326 - DNA, 35 bp, Artificial Sequence
  Synthetic oligonucleotide
gttgtcccccatccatgcccccggtcgctgtcctc

SEQ ID NO: 122327 - DNA, 35 bp, Artificial Sequence
  Synthetic oligonucleotide
ttccgaaggatacgtgcagacccacgcttttcctc

SEQ ID NO: 122328 - DNA, 35 bp, Artificial Sequence
  Synthetic oligonucleotide
tgtaacgtgcaactgcccatcatgataccaccccg

SEQ ID NO: 122329 - DNA, 35 bp, Artificial Sequence
  Synthetic oligonucleotide
agcgccttacctgtgctcgtcgtcgctttatctct

SEQ ID NO: 122330 - DNA, 37 bp, Artificial Sequence
  Synthetic oligonucleotide
gacccccccccatgtaatcaccgtctaagctcttaga

SEQ ID NO: 122331 - DNA, 37 bp, Artificial Sequence
  Synthetic oligonucleotide
gtgacaacttcctcctgctgttctttcggggtaccga

SEQ ID NO: 122332 - DNA, 35 bp, Artificial Sequence
  Synthetic oligonucleotide
taacgacgccttatcagtgcatgatttcgcccccc

SEQ ID NO: 122333 - DNA, 35 bp, Artificial Sequence
  Synthetic oligonucleotide
ttgggccgactcacctctcgtatgatatttccatc

SEQ ID NO: 122334 - DNA, 35 bp, Artificial Sequence
  Synthetic oligonucleotide
gtccatgccacggtctacactcctatctctttggg

SEQ ID NO: 122335 - DNA, 36 bp, Artificial Sequence
  Synthetic oligonucleotide
gatccccacgcaccatcgatattcagctgtccccca

SEQ ID NO: 122336 - DNA, 37 bp, Artificial Sequence
  Synthetic oligonucleotide
gaggtggtaagggggtgaggcaaaggggccctggaga

SEQ ID NO: 122337 - DNA, 35 bp, Artificial Sequence
  Synthetic oligonucleotide
taccccgtacgtgctatgatttacggctccccctc

SEQ ID NO: 122338 - DNA, 35 bp, Artificial Sequence
  Synthetic oligonucleotide
tccaccctgagacccgtacacgtccgccccggctc

SEQ ID NO: 122339 - DNA, 35 bp, Artificial Sequence
  Synthetic oligonucleotide
gtcgcaccacctcactcattggaatcaccgatccg

SEQ ID NO: 122340 - DNA, 35 bp, Artificial Sequence
  Synthetic oligonucleotide
gtgcccttccacgctccgtctaatctcctacgggt

SEQ ID NO: 122341 - DNA, 34 bp, Artificial Sequence
  Synthetic oligonucleotide
tccgtcctgccctacgccccagccattcgagttt

SEQ ID NO: 122342 - DNA, 35 bp, Artificial Sequence
  Synthetic oligonucleotide
tgtgtccggctctccttggtttgttcgtcactttt

SEQ ID NO: 122343 - DNA, 36 bp, Artificial Sequence
  Synthetic oligonucleotide
tgtccaccgcggcgccccgtaccatttgcctctacc

SEQ ID NO: 122344 - DNA, 35 bp, Artificial Sequence
  Synthetic oligonucleotide
tcaaacgcgaccggctcactttgacactgcacccc

SEQ ID NO: 122345 - DNA, 35 bp, Artificial Sequence
  Synthetic oligonucleotide
actccatctacgccgccgttccatcacattgagcc

SEQ ID NO: 122346 - DNA, 35 bp, Artificial Sequence
  Synthetic oligonucleotide
aaagccccgcggccgcttccgtccttctcttctgc

SEQ ID NO: 122347 - DNA, 35 bp, Artificial Sequence
  Synthetic oligonucleotide
acgcaactacatccctgccctaagtgttttccctc

SEQ ID NO: 122348 - DNA, 35 bp, Artificial Sequence
  Synthetic oligonucleotide
ttagtccgccctcggtcctctaccacccgcctccg

SEQ ID NO: 122349 - DNA, 35 bp, Artificial Sequence
  Synthetic oligonucleotide
cacacccgcctcccgcgtaatccacgttcctctcg

SEQ ID NO: 122350 - DNA, 34 bp, Artificial Sequence
  Synthetic oligonucleotide
atcaccctgttctcgttgtttggtccgtcttcct

SEQ ID NO: 122351 - DNA, 36 bp, Artificial Sequence
  Synthetic oligonucleotide
tgaaccgggagtccgggtgggagggaactggggaaa

SEQ ID NO: 122352 - DNA, 36 bp, Artificial Sequence
  Synthetic oligonucleotide
gatctgacctcagaaccccgtactcccccctgccca

SEQ ID NO: 122353 - DNA, 36 bp, Artificial Sequence
  Synthetic oligonucleotide
gcgtacgccctcatgcaccacctacccacggttcca

SEQ ID NO: 122354 - DNA, 37 bp, Artificial Sequence
  Synthetic oligonucleotide
accccccgccaagttacttatgaagccctacccacga

SEQ ID NO: 122355 - DNA, 37 bp, Artificial Sequence
  Synthetic oligonucleotide
gaccgccccttcctcccgctccatgtcctcatgggga

SEQ ID NO: 122356 - DNA, 37 bp, Artificial Sequence
  Synthetic oligonucleotide
gcaccccttcctttctcgcccgtctgcttttcctgga

SEQ ID NO: 122357 - DNA, 38 bp, Artificial Sequence
  Synthetic oligonucleotide
tccacccgcactatccgtaactgctatcttctcaatga

SEQ ID NO: 122358 - DNA, 38 bp, Artificial Sequence
  Synthetic oligonucleotide
gacacacacgttgccgttctcacacgacccatccctga

SEQ ID NO: 122359 - DNA, 37 bp, Artificial Sequence
  Synthetic oligonucleotide
attcgccccgagagctccgtgcgccatccattcctga

SEQ ID NO: 122360 - DNA, 35 bp, Artificial Sequence
  Synthetic oligonucleotide
tcccgccgatccctctcccgccatgcagtgcccta

SEQ ID NO: 122361 - DNA, 35 bp, Artificial Sequence
  Synthetic oligonucleotide
atctcgcatctgatgcttaccacgcgcctcactcc

SEQ ID NO: 122362 - DNA, 35 bp, Artificial Sequence
  Synthetic oligonucleotide
acacgccggtacgtctcaagggttcttctttcctg

SEQ ID NO: 122363 - DNA, 35 bp, Artificial Sequence
  Synthetic oligonucleotide
gaggcccaccacctgtacacgttgaacgaccgcct

SEQ ID NO: 122364 - DNA, 33 bp, Artificial Sequence
  Synthetic oligonucleotide
taccacgctatggcccgcccccccgagtccgct

SEQ ID NO: 122365 - DNA, 35 bp, Artificial Sequence
  Synthetic oligonucleotide
aagacgagacgtcgtccgctgcccccttatcgtct

SEQ ID NO: 122366 - DNA, 36 bp, Artificial Sequence
  Synthetic oligonucleotide
cccccgtcccgtttcttgtcttgtcccgctaccaca

SEQ ID NO: 122367 - DNA, 37 bp, Artificial Sequence
  Synthetic oligonucleotide
ggggggttcattttgggaggggcctgtagttagggga

SEQ ID NO: 122368 - DNA, 38 bp, Artificial Sequence
  Synthetic oligonucleotide
acgcggttcaggggagcagggatgaagggctaggggga

SEQ ID NO: 122369 - DNA, 38 bp, Artificial Sequence
  Synthetic oligonucleotide
gcgacggactggcggagaaaggaggggggaaggggtga

SEQ ID NO: 122370 - DNA, 35 bp, Artificial Sequence
  Synthetic oligonucleotide
gtccagactgcctggctcattagtacctccatcac

SEQ ID NO: 122371 - DNA, 35 bp, Artificial Sequence
  Synthetic oligonucleotide
tgtattgaacggtccgcctgacgcccctctcgccc

SEQ ID NO: 122372 - DNA, 35 bp, Artificial Sequence
  Synthetic oligonucleotide
atagccctcttgaccattgccgcctgaccccgtgc

SEQ ID NO: 122373 - DNA, 35 bp, Artificial Sequence
  Synthetic oligonucleotide
gtgtcaacgagtgtcttcgttcctgtccatacctc

SEQ ID NO: 122374 - DNA, 35 bp, Artificial Sequence
  Synthetic oligonucleotide
tactcacgccactcgcggaccccattatttcgttc

SEQ ID NO: 122375 - DNA, 34 bp, Artificial Sequence
  Synthetic oligonucleotide
tccatgcctcacccagcccctctctgcgacagcg

SEQ ID NO: 122376 - DNA, 35 bp, Artificial Sequence
  Synthetic oligonucleotide
gaccgccccccgtgcgctaagccctcattgcttct

SEQ ID NO: 122377 - DNA, 35 bp, Artificial Sequence
  Synthetic oligonucleotide
tctagtgcccaccctcgtatttctttttgttgcca

SEQ ID NO: 122378 - DNA, 36 bp, Artificial Sequence
  Synthetic oligonucleotide
gttcccacccccagctcgctttcattgactaccgca

SEQ ID NO: 122379 - DNA, 36 bp, Artificial Sequence
  Synthetic oligonucleotide
tcccacgccccaattgtcctctttccctgctatgca

SEQ ID NO: 122380 - DNA, 33 bp, Artificial Sequence
  Synthetic oligonucleotide
tcacctcggttcactccggttttatgctcctca

SEQ ID NO: 122381 - DNA, 35 bp, Artificial Sequence
  Synthetic oligonucleotide
tctcatcccacgccgcctcactgctctcctggtta

SEQ ID NO: 122382 - DNA, 35 bp, Artificial Sequence
  Synthetic oligonucleotide
accgacgttcatgccacaccttacagtccctgtgc

SEQ ID NO: 122383 - DNA, 35 bp, Artificial Sequence
  Synthetic oligonucleotide
gagaccgcattgagcctgccattttgccctcgttc

SEQ ID NO: 122384 - DNA, 35 bp, Artificial Sequence
  Synthetic oligonucleotide
gcgcgcctcatctccgcgtgcccgtccttttaccg

SEQ ID NO: 122385 - DNA, 35 bp, Artificial Sequence
  Synthetic oligonucleotide
gccaccttggtcccttttgcttcacctcgacattg

SEQ ID NO: 122386 - DNA, 35 bp, Artificial Sequence
  Synthetic oligonucleotide
tgttctcccgctcgccttcgtactttgtaacctct

SEQ ID NO: 122387 - DNA, 35 bp, Artificial Sequence
  Synthetic oligonucleotide
gcacacgtaagtggcaatgcaccttccccccgatt

SEQ ID NO: 122388 - DNA, 36 bp, Artificial Sequence
  Synthetic oligonucleotide
tcaacgcgtccgctctaaagcctacgccctccgcca

SEQ ID NO: 122389 - DNA, 37 bp, Artificial Sequence
  Synthetic oligonucleotide
ggagagtggggggataaagtggcgggggtaatgcaga

SEQ ID NO: 122390 - DNA, 36 bp, Artificial Sequence
  Synthetic oligonucleotide
tgcacctttggtctgttctatctcgtccagccgcta

SEQ ID NO: 122391 - DNA, 35 bp, Artificial Sequence
  Synthetic oligonucleotide
atgcccctctcgctatacctcgaaactgtcttacc

SEQ ID NO: 122392 - DNA, 35 bp, Artificial Sequence
  Synthetic oligonucleotide
ttcaccgcctactgtgttgctagctacccgccgcc

SEQ ID NO: 122393 - DNA, 35 bp, Artificial Sequence
  Synthetic oligonucleotide
gttatccatcagttatgcgcccaggccatcattcc

SEQ ID NO: 122394 - DNA, 35 bp, Artificial Sequence
  Synthetic oligonucleotide
ataccgcccatccctgcttactagcccgtcctagc

SEQ ID NO: 122395 - DNA, 35 bp, Artificial Sequence
  Synthetic oligonucleotide
tacacccgcccccacagtttcctccttagagtacg

SEQ ID NO: 122396 - DNA, 35 bp, Artificial Sequence
  Synthetic oligonucleotide
tgttgcccactgttcccagcttaggacctcccctg

SEQ ID NO: 122397 - DNA, 35 bp, Artificial Sequence
  Synthetic oligonucleotide
gcctttcgcagagcccatctccccctccgctattg

SEQ ID NO: 122398 - DNA, 35 bp, Artificial Sequence
  Synthetic oligonucleotide
ttagccgccgttcgttatcacccgcgctccccttt

SEQ ID NO: 122399 - DNA, 37 bp, Artificial Sequence
  Synthetic oligonucleotide
acgaagccccccgtccatccgcccgtgcaatcctcga

SEQ ID NO: 122400 - DNA, 35 bp, Artificial Sequence
  Synthetic oligonucleotide
tgaccatacacatgaagtattccctgcaccacgcc

SEQ ID NO: 122401 - DNA, 35 bp, Artificial Sequence
  Synthetic oligonucleotide
gtaaccgtcccacgctccatgcgtctgtaccttcc

SEQ ID NO: 122402 - DNA, 35 bp, Artificial Sequence
  Synthetic oligonucleotide
tacggtcgagtccgagtcctcctttgtacccttcc

SEQ ID NO: 122403 - DNA, 35 bp, Artificial Sequence
  Synthetic oligonucleotide
tgttctggtcattcgctcaacgccgcctcgcccgc

SEQ ID NO: 122404 - DNA, 35 bp, Artificial Sequence
  Synthetic oligonucleotide
gtgcccgccgggcttttcgttacaactcctttggc

SEQ ID NO: 122405 - DNA, 35 bp, Artificial Sequence
  Synthetic oligonucleotide
ttgatcgcgttcagtcgtacgtccctctgctccaa

SEQ ID NO: 122406 - DNA, 33 bp, Artificial Sequence
  Synthetic oligonucleotide
gcctgacctcactttaccatcggacttgctaca

SEQ ID NO: 122407 - DNA, 36 bp, Artificial Sequence
  Synthetic oligonucleotide
tctctatcgcactgtgcctctcttggttctgcccca

SEQ ID NO: 122408 - DNA, 36 bp, Artificial Sequence
  Synthetic oligonucleotide
gatcggagagcaggaacaaggaagggcggggtaaga

SEQ ID NO: 122409 - DNA, 35 bp, Artificial Sequence
  Synthetic oligonucleotide
tccccgcactgagccgcatccattaccgtgcccga

SEQ ID NO: 122410 - DNA, 36 bp, Artificial Sequence
  Synthetic oligonucleotide
ttttacgacggtggaggtggggtaattggcggagga

SEQ ID NO: 122411 - DNA, 37 bp, Artificial Sequence
  Synthetic oligonucleotide
gtccgggaggaaaggtggaaatggtgcaggagcggga

SEQ ID NO: 122412 - DNA, 36 bp, Artificial Sequence
  Synthetic oligonucleotide
atgtccctcgccgcattcctctctccacacgtacta

SEQ ID NO: 122413 - DNA, 36 bp, Artificial Sequence
  Synthetic oligonucleotide
acccccacccgaagtaacctcccccggacagtctta

SEQ ID NO: 122414 - DNA, 35 bp, Artificial Sequence
  Synthetic oligonucleotide
tgtccacagtagctggacattaccctttccccgac

SEQ ID NO: 122415 - DNA, 35 bp, Artificial Sequence
  Synthetic oligonucleotide
tccaggtggtatttagcctgacgcctttccttatc

SEQ ID NO: 122416 - DNA, 33 bp, Artificial Sequence
  Synthetic oligonucleotide
ataccacccgcacttgcctgccttaacgcatag

SEQ ID NO: 122417 - DNA, 36 bp, Artificial Sequence
  Synthetic oligonucleotide
gaaaggggaggaagggatgactggagggcactggga

SEQ ID NO: 122418 - DNA, 36 bp, Artificial Sequence
  Synthetic oligonucleotide
gttgggtgcatgtggtgagggagggggggagtgtta

SEQ ID NO: 122419 - DNA, 35 bp, Artificial Sequence
  Synthetic oligonucleotide
gaccttcgcctggcacagaccgacaacacctgccc

SEQ ID NO: 122420 - DNA, 35 bp, Artificial Sequence
  Synthetic oligonucleotide
gtcgcccatcattagttctcgctcatggtcatccc

SEQ ID NO: 122421 - DNA, 35 bp, Artificial Sequence
  Synthetic oligonucleotide
tcgtaccccctgtcacgtcctgcacctacttacgc

SEQ ID NO: 122422 - DNA, 35 bp, Artificial Sequence
  Synthetic oligonucleotide
gaacgaccccccaccggccctccatccctaacgtg

SEQ ID NO: 122423 - DNA, 35 bp, Artificial Sequence
  Synthetic oligonucleotide
gccggtggggcgcattttgctcagtaacaccctct

SEQ ID NO: 122424 - DNA, 37 bp, Artificial Sequence
  Synthetic oligonucleotide
gacatcgcgatccctcctgcaagcccactgtacccga

SEQ ID NO: 122425 - DNA, 37 bp, Artificial Sequence
  Synthetic oligonucleotide
tgttgtcctcctggagtgccactcaccttcccttcga

SEQ ID NO: 122426 - DNA, 35 bp, Artificial Sequence
  Synthetic oligonucleotide
actcgcgcctggtgccgccgtctaccttactaccc

SEQ ID NO: 122427 - DNA, 29 bp, Artificial Sequence
  Synthetic oligonucleotide
actccgctgcctgagcgcacgcttccccc

SEQ ID NO: 122428 - DNA, 35 bp, Artificial Sequence
  Synthetic oligonucleotide
tagccacctgcagttttcgccccttgattatttcg

SEQ ID NO: 122429 - DNA, 35 bp, Artificial Sequence
  Synthetic oligonucleotide
tgcctgtgcactcgtgttcccccgcccccttcctg

SEQ ID NO: 122430 - DNA, 35 bp, Artificial Sequence
  Synthetic oligonucleotide
acgccccccccgtgccattctgttataattcttgt

SEQ ID NO: 122431 - DNA, 36 bp, Artificial Sequence
  Synthetic oligonucleotide
tgtggccctcatgtaaatttgtcccgcctgcccgca

SEQ ID NO: 122432 - DNA, 37 bp, Artificial Sequence
  Synthetic oligonucleotide
tcccgccttgcctgagtttcccttcaccctgacctga

SEQ ID NO: 122433 - DNA, 35 bp, Artificial Sequence
  Synthetic oligonucleotide
accgctccattcgcacgcctctctcatctccgtga

SEQ ID NO: 122434 - DNA, 38 bp, Artificial Sequence
  Synthetic oligonucleotide
tgggaagggagggggaggagcatgggactgcgaggtga

SEQ ID NO: 122435 - DNA, 35 bp, Artificial Sequence
  Synthetic oligonucleotide
gagtcccgcctgcccgtgcgatccaccaccttgta

SEQ ID NO: 122436 - DNA, 36 bp, Artificial Sequence
  Synthetic oligonucleotide
tctgtgtgtagccccatcccgtccctgtcgacctta

SEQ ID NO: 122437 - DNA, 35 bp, Artificial Sequence
  Synthetic oligonucleotide
tacgagcatgccctcgcctccctgacttagtaaac

SEQ ID NO: 122438 - DNA, 35 bp, Artificial Sequence
  Synthetic oligonucleotide
actcacattcgccccctcgcagcacgtggcactcc

SEQ ID NO: 122439 - DNA, 35 bp, Artificial Sequence
  Synthetic oligonucleotide
agcccaccgccaaaatcgccatagcgccactctcc

SEQ ID NO: 122440 - DNA, 35 bp, Artificial Sequence
  Synthetic oligonucleotide
tccgactacccgctgttcgctcattttggtacctg

SEQ ID NO: 122441 - DNA, 35 bp, Artificial Sequence
  Synthetic oligonucleotide
gaggcccacttgccaccccgactgttaatgttcct

SEQ ID NO: 122442 - DNA, 35 bp, Artificial Sequence
  Synthetic oligonucleotide
ttgtgccttaccgtcgtcgctctatttgctctctt

SEQ ID NO: 122443 - DNA, 35 bp, Artificial Sequence
  Synthetic oligonucleotide
gaccaggtacttgtccttcttgtcgccgaatattt

SEQ ID NO: 122444 - DNA, 37 bp, Artificial Sequence
  Synthetic oligonucleotide
tccagccctcaaggtggttcaccttccgtccccccga

SEQ ID NO: 122445 - DNA, 35 bp, Artificial Sequence
  Synthetic oligonucleotide
ggacatgtaggctccatctgtcccttaacgccatc

SEQ ID NO: 122446 - DNA, 35 bp, Artificial Sequence
  Synthetic oligonucleotide
gtggaaaggaggatgatcgtgggaaggagtaggcg

SEQ ID NO: 122447 - DNA, 35 bp, Artificial Sequence
  Synthetic oligonucleotide
acccccttgccctggtctttgcagcacaccttgct

SEQ ID NO: 122448 - DNA, 35 bp, Artificial Sequence
  Synthetic oligonucleotide
gatcacccgacgtctctgttccctcagtttcatct

SEQ ID NO: 122449 - DNA, 36 bp, Artificial Sequence
  Synthetic oligonucleotide
gaccccctaccgtctgcacctcatggcctgtcttca

SEQ ID NO: 122450 - DNA, 36 bp, Artificial Sequence
  Synthetic oligonucleotide
gggtgcatgaagacgggcgggtaagggagggtttca

SEQ ID NO: 122451 - DNA, 36 bp, Artificial Sequence
  Synthetic oligonucleotide
gtagccctgcctcgttaccgccgtgcttttcaccga

SEQ ID NO: 122452 - DNA, 36 bp, Artificial Sequence
  Synthetic oligonucleotide
tcacccccactgttgcctaaagcctacccacatgta

SEQ ID NO: 122453 - DNA, 35 bp, Artificial Sequence
  Synthetic oligonucleotide
gagtcccgtagccgttttaatctttgtctgcccac

SEQ ID NO: 122454 - DNA, 35 bp, Artificial Sequence
  Synthetic oligonucleotide
tgactacacctgatgcaaacctgccacctatatac

SEQ ID NO: 122455 - DNA, 35 bp, Artificial Sequence
  Synthetic oligonucleotide
actgatctacgccacatttctgtcaccgaacttac

SEQ ID NO: 122456 - DNA, 35 bp, Artificial Sequence
  Synthetic oligonucleotide
ttgacggacaagagggagggggggagttatggccg

SEQ ID NO: 122457 - DNA, 35 bp, Artificial Sequence
  Synthetic oligonucleotide
tacatgcgcctcggtgatctccgccctattctctg

SEQ ID NO: 122458 - DNA, 37 bp, Artificial Sequence
  Synthetic oligonucleotide
ggaacggaccgcggggggcgggagagagggggcacga

SEQ ID NO: 122459 - DNA, 37 bp, Artificial Sequence
  Synthetic oligonucleotide
tactacgatccacctttgtattaatgcctccctccga

SEQ ID NO: 122460 - DNA, 37 bp, Artificial Sequence
  Synthetic oligonucleotide
agtcgccctctgcaccgtaaatgccctccgatctcga

SEQ ID NO: 122461 - DNA, 38 bp, Artificial Sequence
  Synthetic oligonucleotide
tgaggggaggagcgtggagggagaggaaggggtggtga

SEQ ID NO: 122462 - DNA, 37 bp, Artificial Sequence
  Synthetic oligonucleotide
tcacccgcctcctcataggtatcgatcactttcttga

SEQ ID NO: 122463 - DNA, 35 bp, Artificial Sequence
  Synthetic oligonucleotide
gttgccctccgtaacaccgaatgagattcccgccc

SEQ ID NO: 122464 - DNA, 35 bp, Artificial Sequence
  Synthetic oligonucleotide
agtcacgcctacagtcctgaaaagtcgtccttccc

SEQ ID NO: 122465 - DNA, 35 bp, Artificial Sequence
  Synthetic oligonucleotide
gccgacgcacccgtgcacccatccgtaatgcttcc

SEQ ID NO: 122466 - DNA, 34 bp, Artificial Sequence
  Synthetic oligonucleotide
aacccgcccgcatagccatcgaccacgcttccag

SEQ ID NO: 122467 - DNA, 35 bp, Artificial Sequence
  Synthetic oligonucleotide
atactcgtcgcaccgtttttgcatctctccttcgg

SEQ ID NO: 122468 - DNA, 35 bp, Artificial Sequence
  Synthetic oligonucleotide
ggtcaggagggagggtgaggggagatgtagtagat

SEQ ID NO: 122469 - DNA, 36 bp, Artificial Sequence
  Synthetic oligonucleotide
tctagccaccgtccatttatcgtttccggccaccaa

SEQ ID NO: 122470 - DNA, 36 bp, Artificial Sequence
  Synthetic oligonucleotide
atagtaacgacggggaaggcagagggaggggggata

SEQ ID NO: 122471 - DNA, 36 bp, Artificial Sequence
  Synthetic oligonucleotide
tatcatcggccatctgatttagtcccccgccctcta

SEQ ID NO: 122472 - DNA, 36 bp, Artificial Sequence
  Synthetic oligonucleotide
accactaccgcccttctgtccgctaaacgcagtgta

SEQ ID NO: 122473 - DNA, 34 bp, Artificial Sequence
  Synthetic oligonucleotide
ttcgttgcaagtcattcgccacccccctgtcacg

SEQ ID NO: 122474 - DNA, 35 bp, Artificial Sequence
  Synthetic oligonucleotide
gaccacctttccgcaccgcacgtagtgttaccctg

SEQ ID NO: 122475 - DNA, 35 bp, Artificial Sequence
  Synthetic oligonucleotide
tgcgagttgccgccggatatcatccactgttccat

SEQ ID NO: 122476 - DNA, 35 bp, Artificial Sequence
  Synthetic oligonucleotide
aagtgtgcctgttgtcttcttccaccctgcttgct

SEQ ID NO: 122477 - DNA, 35 bp, Artificial Sequence
  Synthetic oligonucleotide
tgcttccatcacgccatcttagtaccgcactctgt

SEQ ID NO: 122478 - DNA, 35 bp, Artificial Sequence
  Synthetic oligonucleotide
accaccgcctcttggccgcacagttcccccacttt

SEQ ID NO: 122479 - DNA, 36 bp, Artificial Sequence
  Synthetic oligonucleotide
aaggtgggagggggggtataggggcgagggtctgca

SEQ ID NO: 122480 - DNA, 36 bp, Artificial Sequence
  Synthetic oligonucleotide
gacacatcctgtttgcctatcctcttcaccttgtca

SEQ ID NO: 122481 - DNA, 37 bp, Artificial Sequence
  Synthetic oligonucleotide
gcatacgcccgactttgctggttctctctccctggga

SEQ ID NO: 122482 - DNA, 36 bp, Artificial Sequence
  Synthetic oligonucleotide
gacccatcccccgctcgcatcccgcgtactaattta

SEQ ID NO: 122483 - DNA, 36 bp, Artificial Sequence
  Synthetic oligonucleotide
tgaccccccaccgtgtccttcctcagcctgttttta

SEQ ID NO: 122484 - DNA, 35 bp, Artificial Sequence
  Synthetic oligonucleotide
acacaccgccccggatttacatgcttccagctacg

SEQ ID NO: 122485 - DNA, 35 bp, Artificial Sequence
  Synthetic oligonucleotide
taccaatgtccgccgctgcacaccccgagcccgtt

SEQ ID NO: 122486 - DNA, 35 bp, Artificial Sequence
  Synthetic oligonucleotide
taacacccaatgatgatgcccctgcccttacttga

SEQ ID NO: 122487 - DNA, 34 bp, Artificial Sequence
  Synthetic oligonucleotide
gacgccccgaccactgtccctctggctgggaccc

SEQ ID NO: 122488 - DNA, 35 bp, Artificial Sequence
  Synthetic oligonucleotide
gcgttcagctcctgcctgtccctacgttcccgtgc

SEQ ID NO: 122489 - DNA, 35 bp, Artificial Sequence
  Synthetic oligonucleotide
tcctctccacgttcccagtcgttgcacatccctca

SEQ ID NO: 122490 - DNA, 37 bp, Artificial Sequence
  Synthetic oligonucleotide
accccgcatgacatgtgactttctgctcctccctcga

SEQ ID NO: 122491 - DNA, 37 bp, Artificial Sequence
  Synthetic oligonucleotide
ccatcgctccgtgcacccctgtccgccctccccctga

SEQ ID NO: 122492 - DNA, 35 bp, Artificial Sequence
  Synthetic oligonucleotide
ccacccccatcctgtttgctgcctctgggattacc

SEQ ID NO: 122493 - DNA, 35 bp, Artificial Sequence
  Synthetic oligonucleotide
agtacaccactcgcatgagttatttcatcgttccc

SEQ ID NO: 122494 - DNA, 35 bp, Artificial Sequence
  Synthetic oligonucleotide
acacccgctttctgcttgtccgcccctggtcaccg

SEQ ID NO: 122495 - DNA, 35 bp, Artificial Sequence
  Synthetic oligonucleotide
ggggacgcacgggtagagagggtggggatagtggg

SEQ ID NO: 122496 - DNA, 37 bp, Artificial Sequence
  Synthetic oligonucleotide
accgtccctcacttcgatgtcacttgccctctgccga

SEQ ID NO: 122497 - DNA, 37 bp, Artificial Sequence
  Synthetic oligonucleotide
acacctccgtagacgtccttcacttccgctcgatcga

SEQ ID NO: 122498 - DNA, 35 bp, Artificial Sequence
  Synthetic oligonucleotide
accacatctgcctctctttgctcacatgggcttac

SEQ ID NO: 122499 - DNA, 35 bp, Artificial Sequence
  Synthetic oligonucleotide
accgtaacatcccgccgcccagccctgctgccatc

SEQ ID NO: 122500 - DNA, 35 bp, Artificial Sequence
  Synthetic oligonucleotide
tccgccccttgtcaacgccggcccccctaatattg

SEQ ID NO: 122501 - DNA, 35 bp, Artificial Sequence
  Synthetic oligonucleotide
tatcgcccttgacactttccgcctctcgagagaca

SEQ ID NO: 122502 - DNA, 36 bp, Artificial Sequence
  Synthetic oligonucleotide
acatcccgtattgctatgcatctgaaaccccgccca

SEQ ID NO: 122503 - DNA, 35 bp, Artificial Sequence
  Synthetic oligonucleotide
gtgtcctcgctccttctgttttcccggtgactcca

SEQ ID NO: 122504 - DNA, 35 bp, Artificial Sequence
  Synthetic oligonucleotide
tctaccaccgtattatgtcttacccacctccctca

SEQ ID NO: 122505 - DNA, 37 bp, Artificial Sequence
  Synthetic oligonucleotide
gttaagccagcattgcatctgcgtcccccctccccga

SEQ ID NO: 122506 - DNA, 37 bp, Artificial Sequence
  Synthetic oligonucleotide
atggaggcggggggggtggcgtggagggaacttccga

SEQ ID NO: 122507 - DNA, 37 bp, Artificial Sequence
  Synthetic oligonucleotide
tcttacctcgccccacatccacggtccttcgttagga

SEQ ID NO: 122508 - DNA, 35 bp, Artificial Sequence
  Synthetic oligonucleotide
ttgcgccgtctgcgccttatcggcctctctctacc

SEQ ID NO: 122509 - DNA, 35 bp, Artificial Sequence
  Synthetic oligonucleotide
gctgtgcccgcccaaagtgcacgctacacctctgc

SEQ ID NO: 122510 - DNA, 35 bp, Artificial Sequence
  Synthetic oligonucleotide
tcgacctgttgtccatcctacccgcccgtttcatc

SEQ ID NO: 122511 - DNA, 35 bp, Artificial Sequence
  Synthetic oligonucleotide
ggacgtacgcgatgccatctgcagtccaccccttc

SEQ ID NO: 122512 - DNA, 35 bp, Artificial Sequence
  Synthetic oligonucleotide
ttcagaggcaccctcccccgtcgccgtagcatttc

SEQ ID NO: 122513 - DNA, 35 bp, Artificial Sequence
  Synthetic oligonucleotide
ttaccgccacacctgtcgcccccatattccacttg

SEQ ID NO: 122514 - DNA, 35 bp, Artificial Sequence
  Synthetic oligonucleotide
gtagccctgttcgtcccactgcccccttgattgat

SEQ ID NO: 122515 - DNA, 35 bp, Artificial Sequence
  Synthetic oligonucleotide
tgcaccctgtccctgcctccagcgaatttttgctt

SEQ ID NO: 122516 - DNA, 37 bp, Artificial Sequence
  Synthetic oligonucleotide
tacctgccggggggggggtaaaatgctggggagggaa

SEQ ID NO: 122517 - DNA, 36 bp, Artificial Sequence
  Synthetic oligonucleotide
tgggacagggtgggagggactaggtatggtgtgtaa

SEQ ID NO: 122518 - DNA, 37 bp, Artificial Sequence
  Synthetic oligonucleotide
tcaacccctgggctaacagtactacaccgcatcccga

SEQ ID NO: 122519 - DNA, 37 bp, Artificial Sequence
  Synthetic oligonucleotide
gcgctcgcactatgattcctccgctgcaccccttcga

SEQ ID NO: 122520 - DNA, 37 bp, Artificial Sequence
  Synthetic oligonucleotide
tgggggagggagtgggaaggtgttgggtccaggagga

SEQ ID NO: 122521 - DNA, 36 bp, Artificial Sequence
  Synthetic oligonucleotide
gaatggggagggactaggagggtcgccggaggaata

SEQ ID NO: 122522 - DNA, 35 bp, Artificial Sequence
  Synthetic oligonucleotide
tcagatccagcacgcggtgcaccttctcctgttac

SEQ ID NO: 122523 - DNA, 35 bp, Artificial Sequence
  Synthetic oligonucleotide
ggaaccgagggggcgaaggggacacggggggatgc

SEQ ID NO: 122524 - DNA, 35 bp, Artificial Sequence
  Synthetic oligonucleotide
tccgcgcgtgcgcccctggtttagtgccgcccctc

SEQ ID NO: 122525 - DNA, 35 bp, Artificial Sequence
  Synthetic oligonucleotide
gcacacgccccatgccaccatcaccatcccgtttg

SEQ ID NO: 122526 - DNA, 35 bp, Artificial Sequence
  Synthetic oligonucleotide
tgccaggtctcatagcgtcttttcctcctcacctt

SEQ ID NO: 122527 - DNA, 35 bp, Artificial Sequence
  Synthetic oligonucleotide
ttgtccgctcccctgctccattacctgactgttaa

SEQ ID NO: 122528 - DNA, 36 bp, Artificial Sequence
  Synthetic oligonucleotide
ttatccccgcgcgcacccccgacttgacctgctcca

SEQ ID NO: 122529 - DNA, 36 bp, Artificial Sequence
  Synthetic oligonucleotide
tagccggatagggaaggagtcgcgggggggggaaga

SEQ ID NO: 122530 - DNA, 36 bp, Artificial Sequence
  Synthetic oligonucleotide
ggggggaggagaaggaaacaagttggactgcacaga

SEQ ID NO: 122531 - DNA, 37 bp, Artificial Sequence
  Synthetic oligonucleotide
gtcgtgcctcccgtaccaccatccctagtcgtttcga

SEQ ID NO: 122532 - DNA, 37 bp, Artificial Sequence
  Synthetic oligonucleotide
gttgtatggaaggggaggggaagggaagggacgtgga

SEQ ID NO: 122533 - DNA, 38 bp, Artificial Sequence
  Synthetic oligonucleotide
gagtggaagaaggggagcgggagggagaccggcaatga

SEQ ID NO: 122534 - DNA, 38 bp, Artificial Sequence
  Synthetic oligonucleotide
tgccagccaacgtttccgcttctccacactactgctga

SEQ ID NO: 122535 - DNA, 38 bp, Artificial Sequence
  Synthetic oligonucleotide
gacgcgataaagtagggagcggggacgggggctagtga

SEQ ID NO: 122536 - DNA, 37 bp, Artificial Sequence
  Synthetic oligonucleotide
gtgggtggggggagcgtttagggcgactcgtgggtga

SEQ ID NO: 122537 - DNA, 35 bp, Artificial Sequence
  Synthetic oligonucleotide
gcaacgcgttgcacagtacacctcggacccccctc

SEQ ID NO: 122538 - DNA, 35 bp, Artificial Sequence
  Synthetic oligonucleotide
gtggtcgcggcccaacgctgattcactaccctgtc

SEQ ID NO: 122539 - DNA, 36 bp, Artificial Sequence
  Synthetic oligonucleotide
gcctagccctcatcttcgcctaccgcactgctccaa

SEQ ID NO: 122540 - DNA, 36 bp, Artificial Sequence
  Synthetic oligonucleotide
gtaccacccactcatgcacctgcttttgccgacgca

SEQ ID NO: 122541 - DNA, 36 bp, Artificial Sequence
  Synthetic oligonucleotide
gtgggttgggatcgaaggggcgcgggaaaggaggga

SEQ ID NO: 122542 - DNA, 38 bp, Artificial Sequence
  Synthetic oligonucleotide
ccactgtcccgcttagtaccatccgcatcaatgattga

SEQ ID NO: 122543 - DNA, 35 bp, Artificial Sequence
  Synthetic oligonucleotide
accacccgcccccgctgtccaacaatgaagtgcac

SEQ ID NO: 122544 - DNA, 35 bp, Artificial Sequence
  Synthetic oligonucleotide
tgacggtaaatcgggaggaggggcgggggaaaaat

SEQ ID NO: 122545 - DNA, 35 bp, Artificial Sequence
  Synthetic oligonucleotide
gccctccacatgcatccaccccccgctgtgttcat

SEQ ID NO: 122546 - DNA, 35 bp, Artificial Sequence
  Synthetic oligonucleotide
acccgttcgagtgtcccacgatgcatcccaccctt

SEQ ID NO: 122547 - DNA, 37 bp, Artificial Sequence
  Synthetic oligonucleotide
gtagaggagtgggtgtcggagggggggaatagataga

SEQ ID NO: 122548 - DNA, 37 bp, Artificial Sequence
  Synthetic oligonucleotide
ttatatcccagctcgtgcagcccgccccgttccccga

SEQ ID NO: 122549 - DNA, 37 bp, Artificial Sequence
  Synthetic oligonucleotide
tgggacatcgcgttacgggtgggcgacgttcacggga

SEQ ID NO: 122550 - DNA, 37 bp, Artificial Sequence
  Synthetic oligonucleotide
gtgctgacgctccattctgttgctctctcttccgtga

SEQ ID NO: 122551 - DNA, 36 bp, Artificial Sequence
  Synthetic oligonucleotide
taagccgccacgttttggcttacctcctctctgcta

SEQ ID NO: 122552 - DNA, 35 bp, Artificial Sequence
  Synthetic oligonucleotide
tacaccaccacttcgcagcgaactgttgttccccc

SEQ ID NO: 122553 - DNA, 35 bp, Artificial Sequence
  Synthetic oligonucleotide
gtgcaggccttcccctccgtggtccagctttcgcc

SEQ ID NO: 122554 - DNA, 35 bp, Artificial Sequence
  Synthetic oligonucleotide
tattccccgacatttcgctctacgactctggctcc

SEQ ID NO: 122555 - DNA, 35 bp, Artificial Sequence
  Synthetic oligonucleotide
gtctcagccacccacggttagaatccagtcccatc

SEQ ID NO: 122556 - DNA, 35 bp, Artificial Sequence
  Synthetic oligonucleotide
tcaagagactaacggggaggggtagacggggtggg

SEQ ID NO: 122557 - DNA, 35 bp, Artificial Sequence
  Synthetic oligonucleotide
accctcccaactcatacgttatgcaccccactctg

SEQ ID NO: 122558 - DNA, 35 bp, Artificial Sequence
  Synthetic oligonucleotide
ggtcgctgcacatttcgtacccgtgcccccatttg

SEQ ID NO: 122559 - DNA, 35 bp, Artificial Sequence
  Synthetic oligonucleotide
gtctacacccttagcgtcaaattcgccgtccgtct

SEQ ID NO: 122560 - DNA, 37 bp, Artificial Sequence
  Synthetic oligonucleotide
gatccgcccctcttatctcggcccctcgagttcacga

SEQ ID NO: 122561 - DNA, 37 bp, Artificial Sequence
  Synthetic oligonucleotide
ttgccagggccctctcatgtcctcgttcccttactga

SEQ ID NO: 122562 - DNA, 35 bp, Artificial Sequence
  Synthetic oligonucleotide
acgatcacgccctggttcagagtcgccgtcgcccc

SEQ ID NO: 122563 - DNA, 35 bp, Artificial Sequence
  Synthetic oligonucleotide
ttaccaaccccggccccacacagcactcctttgct

SEQ ID NO: 122564 - DNA, 35 bp, Artificial Sequence
  Synthetic oligonucleotide
tcgatctgcccatcttgcggagtaaaacaccctct

SEQ ID NO: 122565 - DNA, 36 bp, Artificial Sequence
  Synthetic oligonucleotide
gaacccggggacgtagccaaaggaggggggagagca

SEQ ID NO: 122566 - DNA, 37 bp, Artificial Sequence
  Synthetic oligonucleotide
actggagcctgtctcctcccgtattgcccttcctcga

SEQ ID NO: 122567 - DNA, 37 bp, Artificial Sequence
  Synthetic oligonucleotide
agagagaaggaggagaaaagggcaagattggagagga

SEQ ID NO: 122568 - DNA, 37 bp, Artificial Sequence
  Synthetic oligonucleotide
tgccactccttgtcctatatttttcgctgactgcgga

SEQ ID NO: 122569 - DNA, 37 bp, Artificial Sequence
  Synthetic oligonucleotide
gtcccactccccgccgacttcatacgagtcccatgga

SEQ ID NO: 122570 - DNA, 35 bp, Artificial Sequence
  Synthetic oligonucleotide
atccccgacgcccatccttaagaccgttactaatc

SEQ ID NO: 122571 - DNA, 35 bp, Artificial Sequence
  Synthetic oligonucleotide
ttgcacatcgccaggcccatctcgccttaactgtc

SEQ ID NO: 122572 - DNA, 35 bp, Artificial Sequence
  Synthetic oligonucleotide
gacgacgcaagatctcccgccccactctttagcag

SEQ ID NO: 122573 - DNA, 35 bp, Artificial Sequence
  Synthetic oligonucleotide
gcgtgcgcccaattcccagctgccccgtgttccat

SEQ ID NO: 122574 - DNA, 35 bp, Artificial Sequence
  Synthetic oligonucleotide
ttgagcccctcgtccctctgcccgtttgttgccct

SEQ ID NO: 122575 - DNA, 35 bp, Artificial Sequence
  Synthetic oligonucleotide
acgtcccgccccctgcgactccgacacaggttcct

SEQ ID NO: 122576 - DNA, 35 bp, Artificial Sequence
  Synthetic oligonucleotide
tgacccgcaacccttatcatgcgcctcctccctgt

SEQ ID NO: 122577 - DNA, 36 bp, Artificial Sequence
  Synthetic oligonucleotide
gggggagggacgggataatggtagggcacctgacaa

SEQ ID NO: 122578 - DNA, 33 bp, Artificial Sequence
  Synthetic oligonucleotide
actaccccgccttcgacatcgctctgtccttaa

SEQ ID NO: 122579 - DNA, 36 bp, Artificial Sequence
  Synthetic oligonucleotide
tcccgcgctccttcccggacctgccaccctgagcca

SEQ ID NO: 122580 - DNA, 36 bp, Artificial Sequence
  Synthetic oligonucleotide
acgcgcgctaccaggtttctttgccccttctcgcca

SEQ ID NO: 122581 - DNA, 37 bp, Artificial Sequence
  Synthetic oligonucleotide
ttggggggggtggtgagcgggataggggaacgtaaga

SEQ ID NO: 122582 - DNA, 37 bp, Artificial Sequence
  Synthetic oligonucleotide
gacgccctcatccatggttttcgcattgcctcctcga

SEQ ID NO: 122583 - DNA, 37 bp, Artificial Sequence
  Synthetic oligonucleotide
tgtgtgggggctgtggttgggtggggctccctgggga

SEQ ID NO: 122584 - DNA, 35 bp, Artificial Sequence
  Synthetic oligonucleotide
tcgcgatcgctcccccctctctttctgtggccgta

SEQ ID NO: 122585 - DNA, 35 bp, Artificial Sequence
  Synthetic oligonucleotide
acgcctgtgacctcgactctgcctgctccttcacg

SEQ ID NO: 122586 - DNA, 35 bp, Artificial Sequence
  Synthetic oligonucleotide
ggggaagaacggggggggaattaggcataagcgcg

SEQ ID NO: 122587 - DNA, 35 bp, Artificial Sequence
  Synthetic oligonucleotide
gggaggggcctcgaagtgtcgggggacactggggt

SEQ ID NO: 122588 - DNA, 36 bp, Artificial Sequence
  Synthetic oligonucleotide
gactcccccccgactgacaagaagtgccaccgtaca

SEQ ID NO: 122589 - DNA, 37 bp, Artificial Sequence
  Synthetic oligonucleotide
gacgggaggtatagggggagggcttaagtagagggga

SEQ ID NO: 122590 - DNA, 38 bp, Artificial Sequence
  Synthetic oligonucleotide
gcaccccgcttaatcctgcgcacactggtccatcttga

SEQ ID NO: 122591 - DNA, 36 bp, Artificial Sequence
  Synthetic oligonucleotide
tgtttcccccccattgttgttttatccgctagccta

SEQ ID NO: 122592 - DNA, 34 bp, Artificial Sequence
  Synthetic oligonucleotide
gccttgtgcagcattcttactccttgccgcttta

SEQ ID NO: 122593 - DNA, 35 bp, Artificial Sequence
  Synthetic oligonucleotide
gcccgcccatgcttttgagtttgtccccgcagtcc

SEQ ID NO: 122594 - DNA, 35 bp, Artificial Sequence
  Synthetic oligonucleotide
gttacacgccacctgccactttttcaccctaccgc

SEQ ID NO: 122595 - DNA, 35 bp, Artificial Sequence
  Synthetic oligonucleotide
gccgatcggcaggacaataagtcacctccacccgc

SEQ ID NO: 122596 - DNA, 35 bp, Artificial Sequence
  Synthetic oligonucleotide
gacatgtcccgctccaatcgtactcactttgccgc

SEQ ID NO: 122597 - DNA, 35 bp, Artificial Sequence
  Synthetic oligonucleotide
gaacatcatgtgcgtttggtctgtccccgctccgc

SEQ ID NO: 122598 - DNA, 35 bp, Artificial Sequence
  Synthetic oligonucleotide
tgtgagccaccacgacctctaggacctgcacactc

SEQ ID NO: 122599 - DNA, 35 bp, Artificial Sequence
  Synthetic oligonucleotide
atggcacgacgcgccgagcctgccgtctcccccct

SEQ ID NO: 122600 - DNA, 35 bp, Artificial Sequence
  Synthetic oligonucleotide
gcccgggagtcctttgcttttccgccgacgttcct

SEQ ID NO: 122601 - DNA, 35 bp, Artificial Sequence
  Synthetic oligonucleotide
acgcttccccgctgcggtttccgattcgcacctct

SEQ ID NO: 122602 - DNA, 35 bp, Artificial Sequence
  Synthetic oligonucleotide
actcctgcgccctcttgctcgttgcacctaagtct

SEQ ID NO: 122603 - DNA, 37 bp, Artificial Sequence
  Synthetic oligonucleotide
ttcgcactctcctgtacctttgtagccactccctaga

SEQ ID NO: 122604 - DNA, 37 bp, Artificial Sequence
  Synthetic oligonucleotide
tcctccgctgtccacccgcttgctgatttgccaccga

SEQ ID NO: 122605 - DNA, 37 bp, Artificial Sequence
  Synthetic oligonucleotide
gccaggctgaggggaggagaggggtgggaggcacgga

SEQ ID NO: 122606 - DNA, 38 bp, Artificial Sequence
  Synthetic oligonucleotide
ttgccaggtggagagggaggcgtggggggacggcgtga

SEQ ID NO: 122607 - DNA, 35 bp, Artificial Sequence
  Synthetic oligonucleotide
ttcgaatgcccctgttgctgcccgccctgtttcac

SEQ ID NO: 122608 - DNA, 35 bp, Artificial Sequence
  Synthetic oligonucleotide
accggaaactgcaatggttctgccgccacctgccc

SEQ ID NO: 122609 - DNA, 35 bp, Artificial Sequence
  Synthetic oligonucleotide
gccagatgccacgccacccaattcatcccgctgcc

SEQ ID NO: 122610 - DNA, 35 bp, Artificial Sequence
  Synthetic oligonucleotide
tacatgcgtcgagtcatcccttacggctcttatcc

SEQ ID NO: 122611 - DNA, 35 bp, Artificial Sequence
  Synthetic oligonucleotide
gtacccccgtcccggctagttgtttccgccacttc

SEQ ID NO: 122612 - DNA, 35 bp, Artificial Sequence
  Synthetic oligonucleotide
tgccactgccatttttcacgcttccccccagttcg

SEQ ID NO: 122613 - DNA, 34 bp, Artificial Sequence
  Synthetic oligonucleotide
ttgtgcctcgctttcacctgtttttccctgattg

SEQ ID NO: 122614 - DNA, 35 bp, Artificial Sequence
  Synthetic oligonucleotide
atgggtcccacaagttgcgcatcttcacccttcct

SEQ ID NO: 122615 - DNA, 35 bp, Artificial Sequence
  Synthetic oligonucleotide
gaccgtagcagacggcctcccccgcccccgaacgt

SEQ ID NO: 122616 - DNA, 35 bp, Artificial Sequence
  Synthetic oligonucleotide
acctcccgccgactctctgttcagacccgtggtgt

SEQ ID NO: 122617 - DNA, 36 bp, Artificial Sequence
  Synthetic oligonucleotide
accacaccgccataccgcttctctcggtgacataca

SEQ ID NO: 122618 - DNA, 37 bp, Artificial Sequence
  Synthetic oligonucleotide
cacctcgccctctatcctgtttggccctgtccctcga

SEQ ID NO: 122619 - DNA, 38 bp, Artificial Sequence
  Synthetic oligonucleotide
ttagacccggcacctgctgctttataccttcccgctga

SEQ ID NO: 122620 - DNA, 35 bp, Artificial Sequence
  Synthetic oligonucleotide
gcccttccaacccccgccgctcaatagagacgccg

SEQ ID NO: 122621 - DNA, 35 bp, Artificial Sequence
  Synthetic oligonucleotide
ggggtcgaccgggtgggggctgtagggggaactgg

SEQ ID NO: 122622 - DNA, 36 bp, Artificial Sequence
  Synthetic oligonucleotide
atcccgccaggcttagcccgtacctccaataccttg

SEQ ID NO: 122623 - DNA, 35 bp, Artificial Sequence
  Synthetic oligonucleotide
gtccgccctccccctgcattagtagtctgcctcct

SEQ ID NO: 122624 - DNA, 35 bp, Artificial Sequence
  Synthetic oligonucleotide
taccagtgtgaggtgtccgtctgtcttttcctcct

SEQ ID NO: 122625 - DNA, 36 bp, Artificial Sequence
  Synthetic oligonucleotide
tgatgttcccgctcttctcccccgcctcgtggtcga

SEQ ID NO: 122626 - DNA, 37 bp, Artificial Sequence
  Synthetic oligonucleotide
tagacagagaagggcaagggggtgggcagcagatgga

SEQ ID NO: 122627 - DNA, 38 bp, Artificial Sequence
  Synthetic oligonucleotide
aaccgccctgtcctccgctcctgtcccttatagcgtga

SEQ ID NO: 122628 - DNA, 38 bp, Artificial Sequence
  Synthetic oligonucleotide
actgcgagggagggggggtataggggccgggagggtga

SEQ ID NO: 122629 - DNA, 35 bp, Artificial Sequence
  Synthetic oligonucleotide
accgaccacgctgaccacccgccggagccccatac

SEQ ID NO: 122630 - DNA, 35 bp, Artificial Sequence
  Synthetic oligonucleotide
tcgagcccattgcacgtatccgactatcctgctcc

SEQ ID NO: 122631 - DNA, 35 bp, Artificial Sequence
  Synthetic oligonucleotide
tgatcggtcccctcgtacgccctaggtttcaccgc

SEQ ID NO: 122632 - DNA, 35 bp, Artificial Sequence
  Synthetic oligonucleotide
tctagccttcacttcacatgttccctcccgtcgtc

SEQ ID NO: 122633 - DNA, 35 bp, Artificial Sequence
  Synthetic oligonucleotide
tctgatcgggagggtgacgggtgggcaatgagtgg

SEQ ID NO: 122634 - DNA, 35 bp, Artificial Sequence
  Synthetic oligonucleotide
gtcgcgatgctctgcgttccactgccctattgcca

SEQ ID NO: 122635 - DNA, 35 bp, Artificial Sequence
  Synthetic oligonucleotide
actcatgacatcgcgtatcccccggcatttacccc

SEQ ID NO: 122636 - DNA, 31 bp, Artificial Sequence
  Synthetic oligonucleotide
gatactgtggtccccccgtccctgaccgatt

SEQ ID NO: 122637 - DNA, 36 bp, Artificial Sequence
  Synthetic oligonucleotide
gcctagccttctcgtactcgttggcacacttttcca

SEQ ID NO: 122638 - DNA, 35 bp, Artificial Sequence
  Synthetic oligonucleotide
ttgaggccgcccgccccccacacgtacatctcgca

SEQ ID NO: 122639 - DNA, 37 bp, Artificial Sequence
  Synthetic oligonucleotide
tgtattccgcccgccccttgatttcgaccacccccga

SEQ ID NO: 122640 - DNA, 37 bp, Artificial Sequence
  Synthetic oligonucleotide
tgctacaagcccgttctcctgtcaacacacctcttga

SEQ ID NO: 122641 - DNA, 35 bp, Artificial Sequence
  Synthetic oligonucleotide
agcataggtgagagggggggagggtatctgttccc

SEQ ID NO: 122642 - DNA, 35 bp, Artificial Sequence
  Synthetic oligonucleotide
tttgcgtgcccaccccccgcagtcacagcacctcc

SEQ ID NO: 122643 - DNA, 35 bp, Artificial Sequence
  Synthetic oligonucleotide
gtggtgctcgcccttgcccgtttggaacatctccg

SEQ ID NO: 122644 - DNA, 35 bp, Artificial Sequence
  Synthetic oligonucleotide
gcctgggttccgatccaccgccccattttggccct

SEQ ID NO: 122645 - DNA, 35 bp, Artificial Sequence
  Synthetic oligonucleotide
tcaatctccaccgccgatcgcccttgcttttcaca

SEQ ID NO: 122646 - DNA, 35 bp, Artificial Sequence
  Synthetic oligonucleotide
gtacccttcctgtctataaaactccatccctgtga

SEQ ID NO: 122647 - DNA, 37 bp, Artificial Sequence
  Synthetic oligonucleotide
gactcactcgttggttactcccccttcacttttgtga

SEQ ID NO: 122648 - DNA, 38 bp, Artificial Sequence
  Synthetic oligonucleotide
ggacgccactacattgtctacgtccattcccctcttga

SEQ ID NO: 122649 - DNA, 35 bp, Artificial Sequence
  Synthetic oligonucleotide
ttccacagcctgttgtaggtccccgttcccgcccc

SEQ ID NO: 122650 - DNA, 35 bp, Artificial Sequence
  Synthetic oligonucleotide
acccgcgtggaactccccagccacctgatacctcc

SEQ ID NO: 122651 - DNA, 35 bp, Artificial Sequence
  Synthetic oligonucleotide
cacccacggacacacctcgggtattgccctgttcc

SEQ ID NO: 122652 - DNA, 35 bp, Artificial Sequence
  Synthetic oligonucleotide
gaccccctccgccacatgagcttaatgtgtgcccg

SEQ ID NO: 122653 - DNA, 35 bp, Artificial Sequence
  Synthetic oligonucleotide
gttcccgtgtccccgtctgccccgcgtttctccat

SEQ ID NO: 122654 - DNA, 35 bp, Artificial Sequence
  Synthetic oligonucleotide
atgacgcaccacccgcccccataagttacactcct

SEQ ID NO: 122655 - DNA, 35 bp, Artificial Sequence
  Synthetic oligonucleotide
tccccatacgcgcccactgcgactcttgtttcttt

SEQ ID NO: 122656 - DNA, 36 bp, Artificial Sequence
  Synthetic oligonucleotide
gagccgacaaactgccaccaccaggcctacgctcca

SEQ ID NO: 122657 - DNA, 36 bp, Artificial Sequence
  Synthetic oligonucleotide
gtcgccttcactcggtcagttccccccttcacctca

SEQ ID NO: 122658 - DNA, 36 bp, Artificial Sequence
  Synthetic oligonucleotide
gtgcgcactaccggcgtgtctatctcccgcccttca

SEQ ID NO: 122659 - DNA, 35 bp, Artificial Sequence
  Synthetic oligonucleotide
gccgacaccatacttctgatctttttgtctgttca

SEQ ID NO: 122660 - DNA, 35 bp, Artificial Sequence
  Synthetic oligonucleotide
gacctgtccgaccgaagtgcccccttgtccgccac

SEQ ID NO: 122661 - DNA, 35 bp, Artificial Sequence
  Synthetic oligonucleotide
tccataccaatgtgtgctactctcttcgcctggcc

SEQ ID NO: 122662 - DNA, 35 bp, Artificial Sequence
  Synthetic oligonucleotide
tcacactcccgcgtccaccgaatccaccacgccat

SEQ ID NO: 122663 - DNA, 37 bp, Artificial Sequence
  Synthetic oligonucleotide
tcccactccatctccctgcctctctcagtcatcggga

SEQ ID NO: 122664 - DNA, 37 bp, Artificial Sequence
  Synthetic oligonucleotide
ggggagacggaggtgggttgccgggggaggaatgtga

SEQ ID NO: 122665 - DNA, 35 bp, Artificial Sequence
  Synthetic oligonucleotide
ttacttcccgcctcactcttcggtaccgtgcccac

SEQ ID NO: 122666 - DNA, 35 bp, Artificial Sequence
  Synthetic oligonucleotide
ggtgtgtccgctgatgctcgttctgccaccctacc

SEQ ID NO: 122667 - DNA, 35 bp, Artificial Sequence
  Synthetic oligonucleotide
gggcctaggccacataatatcgttacatcctccgc

SEQ ID NO: 122668 - DNA, 36 bp, Artificial Sequence
  Synthetic oligonucleotide
ttcggacctgtgcctgcctttgccttgtctcttctc

SEQ ID NO: 122669 - DNA, 35 bp, Artificial Sequence
  Synthetic oligonucleotide
ggccgatcagctagtcctttctgtgcctcgccctg

SEQ ID NO: 122670 - DNA, 35 bp, Artificial Sequence
  Synthetic oligonucleotide
tgtggccatccctctgttctaccattcaacggact

SEQ ID NO: 122671 - DNA, 35 bp, Artificial Sequence
  Synthetic oligonucleotide
cccgattcgctccctggtttttgtctcacactcct

SEQ ID NO: 122672 - DNA, 35 bp, Artificial Sequence
  Synthetic oligonucleotide
tccgactccccttcacgattgacctcttgcgatcc

SEQ ID NO: 122673 - DNA, 35 bp, Artificial Sequence
  Synthetic oligonucleotide
gatcaccctgcccccatcttgcgcaacgcccaatc

SEQ ID NO: 122674 - DNA, 35 bp, Artificial Sequence
  Synthetic oligonucleotide
agcatcgctcgtaacctcccccctcttctgtcggg

SEQ ID NO: 122675 - DNA, 35 bp, Artificial Sequence
  Synthetic oligonucleotide
tttgcccccccgcttatgacctcagtattcgtatg

SEQ ID NO: 122676 - DNA, 35 bp, Artificial Sequence
  Synthetic oligonucleotide
accgcacccagtccccctctcgcgcctgttgtttg

SEQ ID NO: 122677 - DNA, 36 bp, Artificial Sequence
  Synthetic oligonucleotide
ttccagccctagttcttaacacatgccgtctcttaa

SEQ ID NO: 122678 - DNA, 35 bp, Artificial Sequence
  Synthetic oligonucleotide
gccatcccgatcctcccttgcttaaacggtttaca

SEQ ID NO: 122679 - DNA, 36 bp, Artificial Sequence
  Synthetic oligonucleotide
aattactcgccccacctgccgtagttgaaaccttca

SEQ ID NO: 122680 - DNA, 36 bp, Artificial Sequence
  Synthetic oligonucleotide
ggtagacggaccggatgcaaagggggcgggggggga

SEQ ID NO: 122681 - DNA, 37 bp, Artificial Sequence
  Synthetic oligonucleotide
agtggagcaaagagggggagggtggaaagggattgga

SEQ ID NO: 122682 - DNA, 35 bp, Artificial Sequence
  Synthetic oligonucleotide
gtctcctgcccccgctttacccaccctggtggtga

SEQ ID NO: 122683 - DNA, 35 bp, Artificial Sequence
  Synthetic oligonucleotide
gcgaagcctcgcatgttccgcctaagtcacgcccc

SEQ ID NO: 122684 - DNA, 35 bp, Artificial Sequence
  Synthetic oligonucleotide
tacccccacagaaggcccttcatgtcacatactcc

SEQ ID NO: 122685 - DNA, 35 bp, Artificial Sequence
  Synthetic oligonucleotide
aacacgcatgtgcgcgcatacactcaccacgttcc

SEQ ID NO: 122686 - DNA, 35 bp, Artificial Sequence
  Synthetic oligonucleotide
acgcccccccctagtagtgtcgcatcccctaggtc

SEQ ID NO: 122687 - DNA, 34 bp, Artificial Sequence
  Synthetic oligonucleotide
gacaccgcccataccgtttcaaccccatggcttc

SEQ ID NO: 122688 - DNA, 35 bp, Artificial Sequence
  Synthetic oligonucleotide
ccacacgctccgcccgttccagctgccttcctccg

SEQ ID NO: 122689 - DNA, 35 bp, Artificial Sequence
  Synthetic oligonucleotide
aaccaggtcccatgctgcagcagcccgcacaccct

SEQ ID NO: 122690 - DNA, 35 bp, Artificial Sequence
  Synthetic oligonucleotide
tgcttcagccaacgctcccctcgcacccgtagcct

SEQ ID NO: 122691 - DNA, 35 bp, Artificial Sequence
  Synthetic oligonucleotide
acatcgcttcgccaccggttcgttactctgcttct

SEQ ID NO: 122692 - DNA, 35 bp, Artificial Sequence
  Synthetic oligonucleotide
gccaccattcgtgggcctaaatgtcctcccctaca

SEQ ID NO: 122693 - DNA, 35 bp, Artificial Sequence
  Synthetic oligonucleotide
tacgcacaccctgcggctctacatcacctgctcca

SEQ ID NO: 122694 - DNA, 35 bp, Artificial Sequence
  Synthetic oligonucleotide
accgcacgccggttatcccctcccctccaagttca

SEQ ID NO: 122695 - DNA, 35 bp, Artificial Sequence
  Synthetic oligonucleotide
acggacgtcaggaaggcgggggtgcggggagggga

SEQ ID NO: 122696 - DNA, 37 bp, Artificial Sequence
  Synthetic oligonucleotide
accgtgccactggtccttacgaactacctctctttga

SEQ ID NO: 122697 - DNA, 35 bp, Artificial Sequence
  Synthetic oligonucleotide
tcccagaccaccgtgctgccacaaaccactctgta

SEQ ID NO: 122698 - DNA, 35 bp, Artificial Sequence
  Synthetic oligonucleotide
agcactagtctgccccgctttttgttacacctatc

SEQ ID NO: 122699 - DNA, 35 bp, Artificial Sequence
  Synthetic oligonucleotide
ttgagtgggcaagggggagggacgtgacggggaag

SEQ ID NO: 122700 - DNA, 35 bp, Artificial Sequence
  Synthetic oligonucleotide
tgtgcaactccccccgctgcttgtacgatatctcg

SEQ ID NO: 122701 - DNA, 32 bp, Artificial Sequence
  Synthetic oligonucleotide
tattcgccccgtttccaccgttgttttattgg

SEQ ID NO: 122702 - DNA, 35 bp, Artificial Sequence
  Synthetic oligonucleotide
acgtacacccagccgaaccaatagtcgcctccact

SEQ ID NO: 122703 - DNA, 35 bp, Artificial Sequence
  Synthetic oligonucleotide
gccggatcagtcctgacctttgaattcctgccctt

SEQ ID NO: 122704 - DNA, 35 bp, Artificial Sequence
  Synthetic oligonucleotide
tcacatcggggggtagggaacgggtgctgagtgga

SEQ ID NO: 122705 - DNA, 34 bp, Artificial Sequence
  Synthetic oligonucleotide
tccacccatgaccgccgccttgttgtcactcata

SEQ ID NO: 122706 - DNA, 35 bp, Artificial Sequence
  Synthetic oligonucleotide
gacacctccgagcgatccaccctcccacttatgac

SEQ ID NO: 122707 - DNA, 35 bp, Artificial Sequence
  Synthetic oligonucleotide
tcgctcacagtccaccgcccccaactggcttgtcc

SEQ ID NO: 122708 - DNA, 35 bp, Artificial Sequence
  Synthetic oligonucleotide
tccgaacacctgggacccctgtaagactcactttc

SEQ ID NO: 122709 - DNA, 35 bp, Artificial Sequence
  Synthetic oligonucleotide
gtcaccaccgagctataatgaactttccccgcgag

SEQ ID NO: 122710 - DNA, 35 bp, Artificial Sequence
  Synthetic oligonucleotide
acaccgtcgctttccttggtcgcccgcatgatctt

SEQ ID NO: 122711 - DNA, 37 bp, Artificial Sequence
  Synthetic oligonucleotide
gggtgcagcccacgacgcctctctccgtttttatcga

SEQ ID NO: 122712 - DNA, 37 bp, Artificial Sequence
  Synthetic oligonucleotide
gtgcacaccgctccatctatacgccattagtcctgga

SEQ ID NO: 122713 - DNA, 35 bp, Artificial Sequence
  Synthetic oligonucleotide
agtcagacccgcttgtaaacacgccctagttccac

SEQ ID NO: 122714 - DNA, 35 bp, Artificial Sequence
  Synthetic oligonucleotide
acgacccccctgttcgctgtttgtgccagtacacc

SEQ ID NO: 122715 - DNA, 35 bp, Artificial Sequence
  Synthetic oligonucleotide
tcaatgccgcgtccgtttttttgatcctccttcgc

SEQ ID NO: 122716 - DNA, 35 bp, Artificial Sequence
  Synthetic oligonucleotide
tgacacgcgcccggtagccgccccttgccatcaat

SEQ ID NO: 122717 - DNA, 35 bp, Artificial Sequence
  Synthetic oligonucleotide
acccgcgacgcagtctttttcatcttggggtcctt

SEQ ID NO: 122718 - DNA, 36 bp, Artificial Sequence
  Synthetic oligonucleotide
acttagccaactgtctcgcgtgcgtttccgcctcca

SEQ ID NO: 122719 - DNA, 37 bp, Artificial Sequence
  Synthetic oligonucleotide
aatgaagggcggggaagagagcgggaggttgtgggga

SEQ ID NO: 122720 - DNA, 35 bp, Artificial Sequence
  Synthetic oligonucleotide
ggtgggttagggctgggagggaagttgaaggggta

SEQ ID NO: 122721 - DNA, 35 bp, Artificial Sequence
  Synthetic oligonucleotide
tgcaccgagtatgtcacctcggtcatgttcctacc

SEQ ID NO: 122722 - DNA, 35 bp, Artificial Sequence
  Synthetic oligonucleotide
gacgccctatgctgcacctccactacctgtagtag

SEQ ID NO: 122723 - DNA, 35 bp, Artificial Sequence
  Synthetic oligonucleotide
gtttgcaccctcaatgcccccctaccgtatttgtg

SEQ ID NO: 122724 - DNA, 35 bp, Artificial Sequence
  Synthetic oligonucleotide
gagtccgccctcttggtctttctatcgctccaatt

SEQ ID NO: 122725 - DNA, 36 bp, Artificial Sequence
  Synthetic oligonucleotide
tgccgccgcagctcctgtttcacccctacccggtaa

SEQ ID NO: 122726 - DNA, 35 bp, Artificial Sequence
  Synthetic oligonucleotide
tcctgccgccattaacatcgaaccggcttcaccca

SEQ ID NO: 122727 - DNA, 36 bp, Artificial Sequence
  Synthetic oligonucleotide
ttcgccttgcctgtgtcagtgtctcacgccccccca

SEQ ID NO: 122728 - DNA, 37 bp, Artificial Sequence
  Synthetic oligonucleotide
acacaccacgttccaatccgtcgaccacaccccttga

SEQ ID NO: 122729 - DNA, 35 bp, Artificial Sequence
  Synthetic oligonucleotide
tagataccgcacatgatccttccattctcgccgac

SEQ ID NO: 122730 - DNA, 35 bp, Artificial Sequence
  Synthetic oligonucleotide
gtctcgccgcccgtaggaattaccccccccgcacc

SEQ ID NO: 122731 - DNA, 35 bp, Artificial Sequence
  Synthetic oligonucleotide
acagtatgccaaacccgtccaccagtccacgtgcc

SEQ ID NO: 122732 - DNA, 35 bp, Artificial Sequence
  Synthetic oligonucleotide
gggacgccaaggcctccacattcaccggttcttcc

SEQ ID NO: 122733 - DNA, 35 bp, Artificial Sequence
  Synthetic oligonucleotide
ttcgcagtgctaccctgctaagctccctcctgtgc

SEQ ID NO: 122734 - DNA, 35 bp, Artificial Sequence
  Synthetic oligonucleotide
atgttccgccagtgccatttaagttccctgccgtc

SEQ ID NO: 122735 - DNA, 35 bp, Artificial Sequence
  Synthetic oligonucleotide
gacgcccctcatttctgtccttcccgccctgtacg

SEQ ID NO: 122736 - DNA, 35 bp, Artificial Sequence
  Synthetic oligonucleotide
gaccatcccgccacttaggataacccttcgccaca

SEQ ID NO: 122737 - DNA, 36 bp, Artificial Sequence
  Synthetic oligonucleotide
atgacggccgtcacgatactctttcctcgttcccca

SEQ ID NO: 122738 - DNA, 36 bp, Artificial Sequence
  Synthetic oligonucleotide
ttggaagtcgccccgcagcgatacccttcacctcca

SEQ ID NO: 122739 - DNA, 36 bp, Artificial Sequence
  Synthetic oligonucleotide
tcacactcctccattctcatcagtctgggcccagca

SEQ ID NO: 122740 - DNA, 37 bp, Artificial Sequence
  Synthetic oligonucleotide
gtagcagggaaagggcgggtggggccggaaagaccga

SEQ ID NO: 122741 - DNA, 37 bp, Artificial Sequence
  Synthetic oligonucleotide
tgaagagggagccatgaagagggggagggggacgtga

SEQ ID NO: 122742 - DNA, 35 bp, Artificial Sequence
  Synthetic oligonucleotide
gccaccccctcatccttacacggtaagacactatc

SEQ ID NO: 122743 - DNA, 35 bp, Artificial Sequence
  Synthetic oligonucleotide
tgcccctcatcgcgacgccccctgctcgatacata

SEQ ID NO: 122744 - DNA, 35 bp, Artificial Sequence
  Synthetic oligonucleotide
gttgcgcccagcactagacctctcgcttcctcccc

SEQ ID NO: 122745 - DNA, 35 bp, Artificial Sequence
  Synthetic oligonucleotide
gtgagctcatgatcaggctccaccacgaccttccc

SEQ ID NO: 122746 - DNA, 34 bp, Artificial Sequence
  Synthetic oligonucleotide
gcaaccccatcatcattcccgcgtgttcaacgcc

SEQ ID NO: 122747 - DNA, 35 bp, Artificial Sequence
  Synthetic oligonucleotide
tgctaacccgccctcgaccgactacgtttaccgcc

SEQ ID NO: 122748 - DNA, 35 bp, Artificial Sequence
  Synthetic oligonucleotide
tcaacgcaatggctcttcaccccctccgtggatcc

SEQ ID NO: 122749 - DNA, 35 bp, Artificial Sequence
  Synthetic oligonucleotide
tccattgtgcgtggcccccgttccatcactgttcc

SEQ ID NO: 122750 - DNA, 35 bp, Artificial Sequence
  Synthetic oligonucleotide
gtgaggccccacagcgccctagcccaaccttgctc

SEQ ID NO: 122751 - DNA, 35 bp, Artificial Sequence
  Synthetic oligonucleotide
gccgctttgtcgcaccctgatcgccctccctcctg

SEQ ID NO: 122752 - DNA, 35 bp, Artificial Sequence
  Synthetic oligonucleotide
atcccacgcggagtgaagtctccccttgttcccat

SEQ ID NO: 122753 - DNA, 35 bp, Artificial Sequence
  Synthetic oligonucleotide
acctcgggccgccgtagccaccgggtccctcccct

SEQ ID NO: 122754 - DNA, 35 bp, Artificial Sequence
  Synthetic oligonucleotide
aagtccatactccgacctgttatgcctctcgccct

SEQ ID NO: 122755 - DNA, 35 bp, Artificial Sequence
  Synthetic oligonucleotide
gtcgcctgccccacggctaatctccagctctcgct

SEQ ID NO: 122756 - DNA, 35 bp, Artificial Sequence
  Synthetic oligonucleotide
tcaccactctgggttacgttcttcgcccgtactct

SEQ ID NO: 122757 - DNA, 35 bp, Artificial Sequence
  Synthetic oligonucleotide
gacaggctcggtgcgtgcccatccttcgttccttt

SEQ ID NO: 122758 - DNA, 35 bp, Artificial Sequence
  Synthetic oligonucleotide
accgctgttacgtcagctctcattctcctgctcca

SEQ ID NO: 122759 - DNA, 38 bp, Artificial Sequence
  Synthetic oligonucleotide
gttgaccccgatgtccgcctgatcaccccgccctatga

SEQ ID NO: 122760 - DNA, 38 bp, Artificial Sequence
  Synthetic oligonucleotide
gaggggacgtaggaggggggcttgggcttaggcggtga

SEQ ID NO: 122761 - DNA, 35 bp, Artificial Sequence
  Synthetic oligonucleotide
tacgctaatcgcccttatctgctacgttcgcttta

SEQ ID NO: 122762 - DNA, 35 bp, Artificial Sequence
  Synthetic oligonucleotide
tgcgagaagtgcctcctgttttccgctcgctccgc

SEQ ID NO: 122763 - DNA, 35 bp, Artificial Sequence
  Synthetic oligonucleotide
acccaccggaccgccccctccactcctatgtctgc

SEQ ID NO: 122764 - DNA, 35 bp, Artificial Sequence
  Synthetic oligonucleotide
gaccatctcggctcagccctgttccttccgtgacg

SEQ ID NO: 122765 - DNA, 35 bp, Artificial Sequence
  Synthetic oligonucleotide
tcccgtccagaaccctcccttacgtcgtcctcccg

SEQ ID NO: 122766 - DNA, 35 bp, Artificial Sequence
  Synthetic oligonucleotide
gcggtgggtgccgttgtcctggtcgttcttttcct

SEQ ID NO: 122767 - DNA, 35 bp, Artificial Sequence
  Synthetic oligonucleotide
tgcacacccgcctgacgactagcacaaatcgccca

SEQ ID NO: 122768 - DNA, 38 bp, Artificial Sequence
  Synthetic oligonucleotide
agggaaggtagacagggggagaaggacagggtatatga

SEQ ID NO: 122769 - DNA, 36 bp, Artificial Sequence
  Synthetic oligonucleotide
ttcgaaccacgttgtagcccactagcccttgcccta

SEQ ID NO: 122770 - DNA, 35 bp, Artificial Sequence
  Synthetic oligonucleotide
aatccgcaccctttgcttgttgctttccctcggtc

SEQ ID NO: 122771 - DNA, 35 bp, Artificial Sequence
  Synthetic oligonucleotide
tatgcctgcctccctgcttttatatgtgctgtgtc

SEQ ID NO: 122772 - DNA, 35 bp, Artificial Sequence
  Synthetic oligonucleotide
tgaggtagcccccctttgttctgtccgtttggtct

SEQ ID NO: 122773 - DNA, 35 bp, Artificial Sequence
  Synthetic oligonucleotide
ggggagaagggagcgccggggaaagttgggggggt

SEQ ID NO: 122774 - DNA, 36 bp, Artificial Sequence
  Synthetic oligonucleotide
gacacctcttcctgtaacgccccaccgcgcccgaca

SEQ ID NO: 122775 - DNA, 36 bp, Artificial Sequence
  Synthetic oligonucleotide
gtctctccgcgctctgttattctcgtcacctgccca

SEQ ID NO: 122776 - DNA, 37 bp, Artificial Sequence
  Synthetic oligonucleotide
atgaactggatggcggggatgaaggagaggcggggga

SEQ ID NO: 122777 - DNA, 38 bp, Artificial Sequence
  Synthetic oligonucleotide
gcgacatgcacgcgcccctctatgtccctcctctgtga

SEQ ID NO: 122778 - DNA, 35 bp, Artificial Sequence
  Synthetic oligonucleotide
tgaccatccatggtgcagtgctgtttcgccccatc

SEQ ID NO: 122779 - DNA, 35 bp, Artificial Sequence
  Synthetic oligonucleotide
acttcgtgccccagcgtattctctctccttcgctc

SEQ ID NO: 122780 - DNA, 35 bp, Artificial Sequence
  Synthetic oligonucleotide
aagcaccgacatccgccctcacaacacgtaccctg

SEQ ID NO: 122781 - DNA, 35 bp, Artificial Sequence
  Synthetic oligonucleotide
acactcatccgccgccgggcctgcgctaataccat

SEQ ID NO: 122782 - DNA, 35 bp, Artificial Sequence
  Synthetic oligonucleotide
gtgggagggaacggaatagcaagggggcaacatat

SEQ ID NO: 122783 - DNA, 35 bp, Artificial Sequence
  Synthetic oligonucleotide
gccacccacttgccgactcatctgatcctttgttt

SEQ ID NO: 122784 - DNA, 36 bp, Artificial Sequence
  Synthetic oligonucleotide
gtgtgcccagcgtgcactaggctatccttctcctca

SEQ ID NO: 122785 - DNA, 35 bp, Artificial Sequence
  Synthetic oligonucleotide
aaagcctcctgcccaagttcccatctctcgcgccc

SEQ ID NO: 122786 - DNA, 35 bp, Artificial Sequence
  Synthetic oligonucleotide
tcctgtggcacactgtctgcttacactttcactcc

SEQ ID NO: 122787 - DNA, 35 bp, Artificial Sequence
  Synthetic oligonucleotide
taactacccggattctgccctgccactagctatgc

SEQ ID NO: 122788 - DNA, 35 bp, Artificial Sequence
  Synthetic oligonucleotide
tgctctccaccgcacataccatcccacaactggtc

SEQ ID NO: 122789 - DNA, 35 bp, Artificial Sequence
  Synthetic oligonucleotide
acgctccacatgtccatccctctgtctgttccttc

SEQ ID NO: 122790 - DNA, 35 bp, Artificial Sequence
  Synthetic oligonucleotide
tgtacccatcttgtccccgtagcagactttctccg

SEQ ID NO: 122791 - DNA, 35 bp, Artificial Sequence
  Synthetic oligonucleotide
gaccacccacagctttcatttgccatcccctaagg

SEQ ID NO: 122792 - DNA, 35 bp, Artificial Sequence
  Synthetic oligonucleotide
gcctctgtccgccggtccttgcctattccgtcctg

SEQ ID NO: 122793 - DNA, 35 bp, Artificial Sequence
  Synthetic oligonucleotide
gcacccccgccttccggtactagtttattacgttt

SEQ ID NO: 122794 - DNA, 35 bp, Artificial Sequence
  Synthetic oligonucleotide
acctcctcccgccacgatgcgctactcttgttcca

SEQ ID NO: 122795 - DNA, 37 bp, Artificial Sequence
  Synthetic oligonucleotide
gcccgccccgaacgtagcaatcaccacctccacgaga

SEQ ID NO: 122796 - DNA, 36 bp, Artificial Sequence
  Synthetic oligonucleotide
tgccaactccgccggcgtctcttcctacctctgcga

SEQ ID NO: 122797 - DNA, 36 bp, Artificial Sequence
  Synthetic oligonucleotide
gtccgggggcagtctgggggaggaagggggacgata

SEQ ID NO: 122798 - DNA, 36 bp, Artificial Sequence
  Synthetic oligonucleotide
acagagccggccacctccgttaaagcgcgcccccta

SEQ ID NO: 122799 - DNA, 35 bp, Artificial Sequence
  Synthetic oligonucleotide
gactgggggatagggggtggggcgtgggattaaac

SEQ ID NO: 122800 - DNA, 35 bp, Artificial Sequence
  Synthetic oligonucleotide
gcccaggtcccggttgttttttttatgccctccac

SEQ ID NO: 122801 - DNA, 35 bp, Artificial Sequence
  Synthetic oligonucleotide
atgttcaccatcatctctttctttggacgttgcac

SEQ ID NO: 122802 - DNA, 31 bp, Artificial Sequence
  Synthetic oligonucleotide
tccacacttagcgccctgtcccattgccccc

SEQ ID NO: 122803 - DNA, 35 bp, Artificial Sequence
  Synthetic oligonucleotide
attgccgcccgcacgtcatcggatcctcgcaagcc

SEQ ID NO: 122804 - DNA, 35 bp, Artificial Sequence
  Synthetic oligonucleotide
gacatctgtgcagctcttccttggcttactccgcc

SEQ ID NO: 122805 - DNA, 35 bp, Artificial Sequence
  Synthetic oligonucleotide
tgagtcgtgcggatgtgcctccgcccatgcccttc

SEQ ID NO: 122806 - DNA, 35 bp, Artificial Sequence
  Synthetic oligonucleotide
acaccatccatccgcgtgtcccgcccacacataat

SEQ ID NO: 122807 - DNA, 35 bp, Artificial Sequence
  Synthetic oligonucleotide
gtaccatcccgactgcacatgagagttctccttct

SEQ ID NO: 122808 - DNA, 35 bp, Artificial Sequence
  Synthetic oligonucleotide
acccacctcttgaccagacagcttaccgacatatt

SEQ ID NO: 122809 - DNA, 34 bp, Artificial Sequence
  Synthetic oligonucleotide
tactgacgcacgccttggttatcatgctcccgtt

SEQ ID NO: 122810 - DNA, 35 bp, Artificial Sequence
  Synthetic oligonucleotide
tacgcactgccagtattgtcttccccatcctgcaa

SEQ ID NO: 122811 - DNA, 37 bp, Artificial Sequence
  Synthetic oligonucleotide
gcccccttgctctgcgcaagcacaaccatttacatga

SEQ ID NO: 122812 - DNA, 35 bp, Artificial Sequence
  Synthetic oligonucleotide
tcgcgcaccgccccatctctccatcacaccgtcta

SEQ ID NO: 122813 - DNA, 35 bp, Artificial Sequence
  Synthetic oligonucleotide
actcaccgtgcatccctgggcttcacataatttcc

SEQ ID NO: 122814 - DNA, 35 bp, Artificial Sequence
  Synthetic oligonucleotide
accgtcaatgcccgccttgttcctactttactcgc

SEQ ID NO: 122815 - DNA, 35 bp, Artificial Sequence
  Synthetic oligonucleotide
gccgtctcttcacctagtccacaatgctgccctgc

SEQ ID NO: 122816 - DNA, 35 bp, Artificial Sequence
  Synthetic oligonucleotide
atgtccccacctgttgctatcccccgatgctgccg

SEQ ID NO: 122817 - DNA, 35 bp, Artificial Sequence
  Synthetic oligonucleotide
atcaatccgcaccatacgacgcttacagagtcttt

SEQ ID NO: 122818 - DNA, 35 bp, Artificial Sequence
  Synthetic oligonucleotide
gctgaagtccgtcctcccgggtcgccccgctcccc

SEQ ID NO: 122819 - DNA, 35 bp, Artificial Sequence
  Synthetic oligonucleotide
ttgtaccacccttcaccgcataactgctcgttgag

SEQ ID NO: 122820 - DNA, 35 bp, Artificial Sequence
  Synthetic oligonucleotide
taccgcaagccccctgctcttctgaaacctctacg

SEQ ID NO: 122821 - DNA, 35 bp, Artificial Sequence
  Synthetic oligonucleotide
aatgcctccacgtcaacaatcgttctcctcgcccg

SEQ ID NO: 122822 - DNA, 35 bp, Artificial Sequence
  Synthetic oligonucleotide
acctgccctccccttcgctcaaaagcacaatcccg

SEQ ID NO: 122823 - DNA, 34 bp, Artificial Sequence
  Synthetic oligonucleotide
tcgacgccatcacccgctttgcccgaccggacat

SEQ ID NO: 122824 - DNA, 35 bp, Artificial Sequence
  Synthetic oligonucleotide
tctccccggtccccacgcgtaatgcaccccgcttt

SEQ ID NO: 122825 - DNA, 35 bp, Artificial Sequence
  Synthetic oligonucleotide
ggagccccttccgcagttccttatacttgtctttt

SEQ ID NO: 122826 - DNA, 35 bp, Artificial Sequence
  Synthetic oligonucleotide
actgggggaaaccagggggggatagggtagtagaa

SEQ ID NO: 122827 - DNA, 35 bp, Artificial Sequence
  Synthetic oligonucleotide
gcaacgcccctactcgatctccattgcgtccccca

SEQ ID NO: 122828 - DNA, 36 bp, Artificial Sequence
  Synthetic oligonucleotide
gacactctccgcagctgtttggccccgctcatctca

SEQ ID NO: 122829 - DNA, 35 bp, Artificial Sequence
  Synthetic oligonucleotide
tcacccctcgtgcctcctgctcccgacccgcgaga

SEQ ID NO: 122830 - DNA, 37 bp, Artificial Sequence
  Synthetic oligonucleotide
gacaatcgtcaccccttgccccgcgccctccatgcga

SEQ ID NO: 122831 - DNA, 37 bp, Artificial Sequence
  Synthetic oligonucleotide
gatgggaaggcacgggatcataggagggctgggggga

SEQ ID NO: 122832 - DNA, 35 bp, Artificial Sequence
  Synthetic oligonucleotide
gatggggggggtagagggacggctagtcttgggga

SEQ ID NO: 122833 - DNA, 38 bp, Artificial Sequence
  Synthetic oligonucleotide
tattggagggtgggaggctggtggaggaggcgggctga

SEQ ID NO: 122834 - DNA, 37 bp, Artificial Sequence
  Synthetic oligonucleotide
gggaggaaggacggggtgaacaggggggcggtattga

SEQ ID NO: 122835 - DNA, 36 bp, Artificial Sequence
  Synthetic oligonucleotide
tccacaccgccccctacgtatcgtaacggacttgta

SEQ ID NO: 122836 - DNA, 35 bp, Artificial Sequence
  Synthetic oligonucleotide
tcccagttcggactcgcccatctgcttataccacc

SEQ ID NO: 122837 - DNA, 35 bp, Artificial Sequence
  Synthetic oligonucleotide
actgcaatctacatcccgccgttctacgtgacctc

SEQ ID NO: 122838 - DNA, 35 bp, Artificial Sequence
  Synthetic oligonucleotide
gatcaggatgtcctactgtttcttgctactctccg

SEQ ID NO: 122839 - DNA, 35 bp, Artificial Sequence
  Synthetic oligonucleotide
tacagcaaagggtgggaggaaagaattggaggggg

SEQ ID NO: 122840 - DNA, 35 bp, Artificial Sequence
  Synthetic oligonucleotide
gccattccgcgtgtccactagcgccgacctctact

SEQ ID NO: 122841 - DNA, 38 bp, Artificial Sequence
  Synthetic oligonucleotide
gctaacggggtcgggtgggcgtaagggaggggaaatga

SEQ ID NO: 122842 - DNA, 38 bp, Artificial Sequence
  Synthetic oligonucleotide
agaccgctgacggtctgggggggtgggagtgggaatga

SEQ ID NO: 122843 - DNA, 37 bp, Artificial Sequence
  Synthetic oligonucleotide
acattcgctcctctctgcccgttccttcccgtagtga

SEQ ID NO: 122844 - DNA, 35 bp, Artificial Sequence
  Synthetic oligonucleotide
tcagtcacatccgtcctatttgtcttgccctcgcc

SEQ ID NO: 122845 - DNA, 35 bp, Artificial Sequence
  Synthetic oligonucleotide
taccgcactcagtctcccgccgcgctgccataggc

SEQ ID NO: 122846 - DNA, 35 bp, Artificial Sequence
  Synthetic oligonucleotide
gtagctgagcctagctggcccttatgttctccctc

SEQ ID NO: 122847 - DNA, 35 bp, Artificial Sequence
  Synthetic oligonucleotide
accccgacgctccacctgtcaactttcgtcatttc

SEQ ID NO: 122848 - DNA, 35 bp, Artificial Sequence
  Synthetic oligonucleotide
gaaactcgtcacatccggcataaatccacccctct

SEQ ID NO: 122849 - DNA, 35 bp, Artificial Sequence
  Synthetic oligonucleotide
acccgacctccgcctccgggatccctacgagcctt

SEQ ID NO: 122850 - DNA, 36 bp, Artificial Sequence
  Synthetic oligonucleotide
tgacaccccatgtaggtaatgcgcccctcttattca

SEQ ID NO: 122851 - DNA, 37 bp, Artificial Sequence
  Synthetic oligonucleotide
gttgggtgggggagggctgggggctcggtaggacgga

SEQ ID NO: 122852 - DNA, 37 bp, Artificial Sequence
  Synthetic oligonucleotide
ttcacccccactgtacccctgcattcccgaatgcgga

SEQ ID NO: 122853 - DNA, 36 bp, Artificial Sequence
  Synthetic oligonucleotide
aaccccacccccgactacgcatacgcgagccattga

SEQ ID NO: 122854 - DNA, 35 bp, Artificial Sequence
  Synthetic oligonucleotide
ggtttgccccacccactgctcatcgtgcctaccac

SEQ ID NO: 122855 - DNA, 35 bp, Artificial Sequence
  Synthetic oligonucleotide
gttccgccggcctttgttgcctcctgctggttatc

SEQ ID NO: 122856 - DNA, 35 bp, Artificial Sequence
  Synthetic oligonucleotide
tcgcccggttctttgttgtccgctcccgatttctc

SEQ ID NO: 122857 - DNA, 35 bp, Artificial Sequence
  Synthetic oligonucleotide
tgccttgcccttaatgtcatcttgtcttaccctgt

SEQ ID NO: 122858 - DNA, 36 bp, Artificial Sequence
  Synthetic oligonucleotide
atccgcccctgcgctcgcccttcgttcctgtgcaaa

SEQ ID NO: 122859 - DNA, 37 bp, Artificial Sequence
  Synthetic oligonucleotide
gatggagatcgggcggggcgggaaacggggaaggcga

SEQ ID NO: 122860 - DNA, 37 bp, Artificial Sequence
  Synthetic oligonucleotide
ttgtgaagggagcagggggaggagagggatcaaatga

SEQ ID NO: 122861 - DNA, 35 bp, Artificial Sequence
  Synthetic oligonucleotide
gccatacctattgtgttgccctgcctccctcggac

SEQ ID NO: 122862 - DNA, 35 bp, Artificial Sequence
  Synthetic oligonucleotide
tccgccctgcacttgcaatgcccttcccagatacc

SEQ ID NO: 122863 - DNA, 35 bp, Artificial Sequence
  Synthetic oligonucleotide
acactgcgccccctgcccttattctggatttggcc

SEQ ID NO: 122864 - DNA, 35 bp, Artificial Sequence
  Synthetic oligonucleotide
tcgcctacatcccggttgtttttagccatcccccg

SEQ ID NO: 122865 - DNA, 35 bp, Artificial Sequence
  Synthetic oligonucleotide
gatgaacaatgagagggtggagagaagttaagagg

SEQ ID NO: 122866 - DNA, 36 bp, Artificial Sequence
  Synthetic oligonucleotide
gccgcccactccttcgtgatatgatctgcgccttca

SEQ ID NO: 122867 - DNA, 37 bp, Artificial Sequence
  Synthetic oligonucleotide
tccaccctcagaaattctacagccctctcacccccga

SEQ ID NO: 122868 - DNA, 37 bp, Artificial Sequence
  Synthetic oligonucleotide
ggagacagattagaaagggaaggatagcggcgggcga

SEQ ID NO: 122869 - DNA, 36 bp, Artificial Sequence
  Synthetic oligonucleotide
atgtcagactccctccccccagccactcacgccgga

SEQ ID NO: 122870 - DNA, 37 bp, Artificial Sequence
  Synthetic oligonucleotide
tccaccattgcccttcgttgtccatcctacctccgga

SEQ ID NO: 122871 - DNA, 36 bp, Artificial Sequence
  Synthetic oligonucleotide
gacacgccctccacctctcttcagttggccattgga

SEQ ID NO: 122872 - DNA, 38 bp, Artificial Sequence
  Synthetic oligonucleotide
atgtaccacaaccccgtacttggacctccctttcgtga

SEQ ID NO: 122873 - DNA, 35 bp, Artificial Sequence
  Synthetic oligonucleotide
gtgtcccgccttcccatccctcgggtgacaaaacc

SEQ ID NO: 122874 - DNA, 35 bp, Artificial Sequence
  Synthetic oligonucleotide
acccaccctccgctccgtaaggattctcccgatcc

SEQ ID NO: 122875 - DNA, 35 bp, Artificial Sequence
  Synthetic oligonucleotide
tctatgcagacccccccaagcgcacccggtactcc

SEQ ID NO: 122876 - DNA, 35 bp, Artificial Sequence
  Synthetic oligonucleotide
tgatgatggcctcagaccgttgtaccgcccgttcc

SEQ ID NO: 122877 - DNA, 34 bp, Artificial Sequence
  Synthetic oligonucleotide
gaggagggaaggaattggcggagggcatggtcat

SEQ ID NO: 122878 - DNA, 35 bp, Artificial Sequence
  Synthetic oligonucleotide
tagtgggtggcggtcatggggcaggctggctggca

SEQ ID NO: 122879 - DNA, 35 bp, Artificial Sequence
  Synthetic oligonucleotide
gtccctccctcctggctacaagtgccgacgctgca

SEQ ID NO: 122880 - DNA, 37 bp, Artificial Sequence
  Synthetic oligonucleotide
tcgaggccaggggggacgattgggagggcgaaggaga

SEQ ID NO: 122881 - DNA, 38 bp, Artificial Sequence
  Synthetic oligonucleotide
tacgcgcctcctttctgcttccacgtgatcccacctga

SEQ ID NO: 122882 - DNA, 35 bp, Artificial Sequence
  Synthetic oligonucleotide
actccgggtcaccatcccgccatgtacaccgttcc

SEQ ID NO: 122883 - DNA, 35 bp, Artificial Sequence
  Synthetic oligonucleotide
gctaccacgccattaggtttgtttcccccgttccg

SEQ ID NO: 122884 - DNA, 35 bp, Artificial Sequence
  Synthetic oligonucleotide
atagcctcgctctcccgccactacgagcccccttg

SEQ ID NO: 122885 - DNA, 35 bp, Artificial Sequence
  Synthetic oligonucleotide
tgaagcccaccgttcttcgcctctttctgcgccta

SEQ ID NO: 122886 - DNA, 35 bp, Artificial Sequence
  Synthetic oligonucleotide
tgtcgctcgctctgtctttcattcgccgcattcta

SEQ ID NO: 122887 - DNA, 35 bp, Artificial Sequence
  Synthetic oligonucleotide
tctccatcccaatgccctctgcccgaccggccgta

SEQ ID NO: 122888 - DNA, 35 bp, Artificial Sequence
  Synthetic oligonucleotide
tcatactctccaatgccgacccatgagtccctccc

SEQ ID NO: 122889 - DNA, 35 bp, Artificial Sequence
  Synthetic oligonucleotide
ggtaccgccctgctcgtgacattattttcatctcc

SEQ ID NO: 122890 - DNA, 33 bp, Artificial Sequence
  Synthetic oligonucleotide
gcctgtctcagtagtgctccgttgtctgtcctc

SEQ ID NO: 122891 - DNA, 35 bp, Artificial Sequence
  Synthetic oligonucleotide
acgtggccatgaagtttcgcgcctcccccactgtc

SEQ ID NO: 122892 - DNA, 35 bp, Artificial Sequence
  Synthetic oligonucleotide
atcactccccggaatgtgcttgtccacctcccaca

SEQ ID NO: 122893 - DNA, 36 bp, Artificial Sequence
  Synthetic oligonucleotide
taccacgcatcaccgtccctccattcccggccgcca

SEQ ID NO: 122894 - DNA, 36 bp, Artificial Sequence
  Synthetic oligonucleotide
aagagagaagaggggtcaagggggggtagcaagaga

SEQ ID NO: 122895 - DNA, 35 bp, Artificial Sequence
  Synthetic oligonucleotide
gcacctgccttactcccatctgacctcctggctga

SEQ ID NO: 122896 - DNA, 38 bp, Artificial Sequence
  Synthetic oligonucleotide
gttgaacccccgcttgctgtgccgggaccctcccttga

SEQ ID NO: 122897 - DNA, 38 bp, Artificial Sequence
  Synthetic oligonucleotide
tcccccgcctccccttcgaacactcgccaatttgttga

SEQ ID NO: 122898 - DNA, 36 bp, Artificial Sequence
  Synthetic oligonucleotide
acacatgcggggagtcgtatatgggtgggcgggata

SEQ ID NO: 122899 - DNA, 35 bp, Artificial Sequence
  Synthetic oligonucleotide
accccacacctcctctgtatccttgccacggaagc

SEQ ID NO: 122900 - DNA, 35 bp, Artificial Sequence
  Synthetic oligonucleotide
tgtagtccagttcgccttcaccagccttactacgc

SEQ ID NO: 122901 - DNA, 35 bp, Artificial Sequence
  Synthetic oligonucleotide
tcaacaccctctagcgtggcccatctacagtaatc

SEQ ID NO: 122902 - DNA, 35 bp, Artificial Sequence
  Synthetic oligonucleotide
gacaccacattgtcctccacttaaagcctcactcg

SEQ ID NO: 122903 - DNA, 36 bp, Artificial Sequence
  Synthetic oligonucleotide
aacacgcgcctctcgtccccctacgtacatccttcg

SEQ ID NO: 122904 - DNA, 35 bp, Artificial Sequence
  Synthetic oligonucleotide
gggagtaggggaggaggtatggacgcagggggcat

SEQ ID NO: 122905 - DNA, 35 bp, Artificial Sequence
  Synthetic oligonucleotide
tctatcgccgaaagttaccctctgtctcacgccgt

SEQ ID NO: 122906 - DNA, 36 bp, Artificial Sequence
  Synthetic oligonucleotide
accaccccacatctataagttcttcacacccctgaa

SEQ ID NO: 122907 - DNA, 36 bp, Artificial Sequence
  Synthetic oligonucleotide
tcaaagtcagcctcactcgctatcccaccttcgcca

SEQ ID NO: 122908 - DNA, 36 bp, Artificial Sequence
  Synthetic oligonucleotide
gtgccgggcgcaccataggtcctcattgcatctcca

SEQ ID NO: 122909 - DNA, 36 bp, Artificial Sequence
  Synthetic oligonucleotide
gacgagtcacctgcccgcccgacgttttatcacgca

SEQ ID NO: 122910 - DNA, 37 bp, Artificial Sequence
  Synthetic oligonucleotide
gggagggtacggagggtaggagggggtacgtgaaaga

SEQ ID NO: 122911 - DNA, 36 bp, Artificial Sequence
  Synthetic oligonucleotide
atcccaaccgcccgaattgccgcttttctcacagga

SEQ ID NO: 122912 - DNA, 38 bp, Artificial Sequence
  Synthetic oligonucleotide
tcacctccatcattggccctgttcccgctacacggtga

SEQ ID NO: 122913 - DNA, 37 bp, Artificial Sequence
  Synthetic oligonucleotide
tagtcatcccgccggttacctgttcctatttccttga

SEQ ID NO: 122914 - DNA, 35 bp, Artificial Sequence
  Synthetic oligonucleotide
tgtatccgcccccaggtttatacgtcaccacccta

SEQ ID NO: 122915 - DNA, 35 bp, Artificial Sequence
  Synthetic oligonucleotide
acgcatgagctcgttccccgtgcccccccgttctc

SEQ ID NO: 122916 - DNA, 36 bp, Artificial Sequence
  Synthetic oligonucleotide
tgtccccaccctctctgtgcgcgagtttgcccctaa

SEQ ID NO: 122917 - DNA, 37 bp, Artificial Sequence
  Synthetic oligonucleotide
gcggaggaggacgggggcaggtgggggaaggacggga

SEQ ID NO: 122918 - DNA, 36 bp, Artificial Sequence
  Synthetic oligonucleotide
atcaggcggggaggaggggaatgggcgaagagggga

SEQ ID NO: 122919 - DNA, 38 bp, Artificial Sequence
  Synthetic oligonucleotide
ttgggtgtatgcggaggttgataagggtgggagggtga

SEQ ID NO: 122920 - DNA, 35 bp, Artificial Sequence
  Synthetic oligonucleotide
attcaccgctcgcttttagatcacgcctcccatta

SEQ ID NO: 122921 - DNA, 32 bp, Artificial Sequence
  Synthetic oligonucleotide
tataccccgccccagttttttgaacccggtta

SEQ ID NO: 122922 - DNA, 35 bp, Artificial Sequence
  Synthetic oligonucleotide
gcatgctgcccgtgcttatcaagtctagctgcccc

SEQ ID NO: 122923 - DNA, 35 bp, Artificial Sequence
  Synthetic oligonucleotide
gccacgttgtaaactgcctgtcctcaatacccgcc

SEQ ID NO: 122924 - DNA, 35 bp, Artificial Sequence
  Synthetic oligonucleotide
tcagccgcattatatcgctgtcctggtcgacttcc

SEQ ID NO: 122925 - DNA, 35 bp, Artificial Sequence
  Synthetic oligonucleotide
tgcggggaggggagggaagggtagcacgactcggc

SEQ ID NO: 122926 - DNA, 35 bp, Artificial Sequence
  Synthetic oligonucleotide
tcgtctcatcacagtccgctaatggcccgccccct

SEQ ID NO: 122927 - DNA, 35 bp, Artificial Sequence
  Synthetic oligonucleotide
gcagtgcacacgcctaaagttaccatgccctctgt

SEQ ID NO: 122928 - DNA, 35 bp, Artificial Sequence
  Synthetic oligonucleotide
gaccatccctctgacacatttgcaccgccacacca

SEQ ID NO: 122929 - DNA, 36 bp, Artificial Sequence
  Synthetic oligonucleotide
attcactcacgccgtactatcccccgacaggtatca

SEQ ID NO: 122930 - DNA, 35 bp, Artificial Sequence
  Synthetic oligonucleotide
tcaccgcgaacatccgtcgcctcaacatgccctca

SEQ ID NO: 122931 - DNA, 36 bp, Artificial Sequence
  Synthetic oligonucleotide
gagggatgaccgagggggctggtgaggcttggggga

SEQ ID NO: 122932 - DNA, 36 bp, Artificial Sequence
  Synthetic oligonucleotide
attctcagcgctcaacccattcgttactgcctccta

SEQ ID NO: 122933 - DNA, 35 bp, Artificial Sequence
  Synthetic oligonucleotide
ttcgatcagacctccgcctctaccattttacgtgc

SEQ ID NO: 122934 - DNA, 35 bp, Artificial Sequence
  Synthetic oligonucleotide
gagggaacatgaaaacagggtatgggcggggaggg

SEQ ID NO: 122935 - DNA, 35 bp, Artificial Sequence
  Synthetic oligonucleotide
gaccaccactctgttctcattacgtaccgtatttt

SEQ ID NO: 122936 - DNA, 35 bp, Artificial Sequence
  Synthetic oligonucleotide
attcccccgtcctgttccaccacctctgcccgcaa

SEQ ID NO: 122937 - DNA, 36 bp, Artificial Sequence
  Synthetic oligonucleotide
tcaccgcatggcatacttcgccacactgtcccgcca

SEQ ID NO: 122938 - DNA, 35 bp, Artificial Sequence
  Synthetic oligonucleotide
tcatcccatcactgtcgatctgcccgttgcctcca

SEQ ID NO: 122939 - DNA, 37 bp, Artificial Sequence
  Synthetic oligonucleotide
tgcgggaggggagggacgggttaaacgcggcaccaga

SEQ ID NO: 122940 - DNA, 36 bp, Artificial Sequence
  Synthetic oligonucleotide
ggggtggtcgcatgccataatatagtgaaagaggga

SEQ ID NO: 122941 - DNA, 36 bp, Artificial Sequence
  Synthetic oligonucleotide
tcccaaccgcccatcctgtaccatacaaactaagta

SEQ ID NO: 122942 - DNA, 35 bp, Artificial Sequence
  Synthetic oligonucleotide
acaccctccataccccttcgccgcacggtacttac

SEQ ID NO: 122943 - DNA, 35 bp, Artificial Sequence
  Synthetic oligonucleotide
tgcaacacccagtcgcgcctctcgtaatcatttcc

SEQ ID NO: 122944 - DNA, 35 bp, Artificial Sequence
  Synthetic oligonucleotide
gacgccgtctattggtacattcaccgcactcccgc

SEQ ID NO: 122945 - DNA, 35 bp, Artificial Sequence
  Synthetic oligonucleotide
ttgcatccctgctcgcacccagttgcccgctctgc

SEQ ID NO: 122946 - DNA, 35 bp, Artificial Sequence
  Synthetic oligonucleotide
ttctcacagcattcgtgctcgattcctggttccct

SEQ ID NO: 122947 - DNA, 35 bp, Artificial Sequence
  Synthetic oligonucleotide
agcacgccacgtatctcctgctgcccaccaaagtt

SEQ ID NO: 122948 - DNA, 35 bp, Artificial Sequence
  Synthetic oligonucleotide
gccaacaggtacgtgccgctcaccaccccccccga

SEQ ID NO: 122949 - DNA, 37 bp, Artificial Sequence
  Synthetic oligonucleotide
ggaacaggaggggaggaagcgattatagggcagccga

SEQ ID NO: 122950 - DNA, 35 bp, Artificial Sequence
  Synthetic oligonucleotide
tatgtcgcagacacgtcactacgcccatctctcga

SEQ ID NO: 122951 - DNA, 37 bp, Artificial Sequence
  Synthetic oligonucleotide
agccacacgcctgcgcatctaatgccttccacttcga

SEQ ID NO: 122952 - DNA, 35 bp, Artificial Sequence
  Synthetic oligonucleotide
gcccatcactgcactgctctttaactcgacttcta

SEQ ID NO: 122953 - DNA, 35 bp, Artificial Sequence
  Synthetic oligonucleotide
tccatcattgcgtcatcccatccacgtcatatcac

SEQ ID NO: 122954 - DNA, 35 bp, Artificial Sequence
  Synthetic oligonucleotide
ttgacaacccggcattgttcccgctttctactccc

SEQ ID NO: 122955 - DNA, 35 bp, Artificial Sequence
  Synthetic oligonucleotide
agctgggcccagacttcacgcgtccttccgtttcc

SEQ ID NO: 122956 - DNA, 35 bp, Artificial Sequence
  Synthetic oligonucleotide
gaggcgctcccggttccttgctctgccacgctcgc

SEQ ID NO: 122957 - DNA, 35 bp, Artificial Sequence
  Synthetic oligonucleotide
gactggcccccctgacgtcgccccctgcacattct

SEQ ID NO: 122958 - DNA, 35 bp, Artificial Sequence
  Synthetic oligonucleotide
gatgaaactgggtggaaagaagtcggagaggggaa

SEQ ID NO: 122959 - DNA, 37 bp, Artificial Sequence
  Synthetic oligonucleotide
atgatggggggggatgggagaatgtagggtgaaagga

SEQ ID NO: 122960 - DNA, 36 bp, Artificial Sequence
  Synthetic oligonucleotide
gcaacgacaggctcgaggggggggatgggaaaggga

SEQ ID NO: 122961 - DNA, 38 bp, Artificial Sequence
  Synthetic oligonucleotide
tccgccccaccgactggcgaacgtacatccctttatga

SEQ ID NO: 122962 - DNA, 35 bp, Artificial Sequence
  Synthetic oligonucleotide
gcacgcccccatattactctgcctgcgacttcacc

SEQ ID NO: 122963 - DNA, 35 bp, Artificial Sequence
  Synthetic oligonucleotide
gacccatcttgccctgttgcatcaccttctcgacc

SEQ ID NO: 122964 - DNA, 35 bp, Artificial Sequence
  Synthetic oligonucleotide
gttgactccgtgcattcccttcactacccagttgc

SEQ ID NO: 122965 - DNA, 35 bp, Artificial Sequence
  Synthetic oligonucleotide
gaccgccaggtgtgcggccgcacttctcattcctc

SEQ ID NO: 122966 - DNA, 35 bp, Artificial Sequence
  Synthetic oligonucleotide
tcctgcaaacgcccacatctgcacaactcgaattc

SEQ ID NO: 122967 - DNA, 35 bp, Artificial Sequence
  Synthetic oligonucleotide
tctcctcacgcctcacggttcctccgacgctctcg

SEQ ID NO: 122968 - DNA, 35 bp, Artificial Sequence
  Synthetic oligonucleotide
tatcccacagcctcttgctcgccttcctcctttcg

SEQ ID NO: 122969 - DNA, 34 bp, Artificial Sequence
  Synthetic oligonucleotide
ttccatgccactcacttctgtctttcgatttcat

SEQ ID NO: 122970 - DNA, 35 bp, Artificial Sequence
  Synthetic oligonucleotide
tacaccacctgtgctactcccagtatacttaccct

SEQ ID NO: 122971 - DNA, 35 bp, Artificial Sequence
  Synthetic oligonucleotide
gaccacctcactttgctccttggcctcgaatgaca

SEQ ID NO: 122972 - DNA, 36 bp, Artificial Sequence
  Synthetic oligonucleotide
gctgacaataggggggggagggaatcgggtggcgga

SEQ ID NO: 122973 - DNA, 35 bp, Artificial Sequence
  Synthetic oligonucleotide
agttcgccagttacctttgctgtccacgtttccac

SEQ ID NO: 122974 - DNA, 35 bp, Artificial Sequence
  Synthetic oligonucleotide
tgcacacccctactatagcctggctacaccgcccc

SEQ ID NO: 122975 - DNA, 35 bp, Artificial Sequence
  Synthetic oligonucleotide
gtagtgctccataagtcattcagtcacccccgccc

SEQ ID NO: 122976 - DNA, 35 bp, Artificial Sequence
  Synthetic oligonucleotide
ttgccggcctccgctcccctcgcgtgcttcacgcc

SEQ ID NO: 122977 - DNA, 35 bp, Artificial Sequence
  Synthetic oligonucleotide
gtgggggggaatgggtgggcgatctacaacgaagc

SEQ ID NO: 122978 - DNA, 35 bp, Artificial Sequence
  Synthetic oligonucleotide
tccgcgtggccattctgcgcagtcataccccctcg

SEQ ID NO: 122979 - DNA, 35 bp, Artificial Sequence
  Synthetic oligonucleotide
gggccctctcatcgtacgcctgctgccctagccca

SEQ ID NO: 122980 - DNA, 36 bp, Artificial Sequence
  Synthetic oligonucleotide
tgggtgcctccgttagtttttcgtgcctcacctcca

SEQ ID NO: 122981 - DNA, 36 bp, Artificial Sequence
  Synthetic oligonucleotide
ttgaccggcctctcctctatgtttcaacaccctcga

SEQ ID NO: 122982 - DNA, 37 bp, Artificial Sequence
  Synthetic oligonucleotide
attccgcgcacgcatgttcacctcgctccacccggga

SEQ ID NO: 122983 - DNA, 36 bp, Artificial Sequence
  Synthetic oligonucleotide
ataccccccgactactcacccgggctgtcccttgga

SEQ ID NO: 122984 - DNA, 35 bp, Artificial Sequence
  Synthetic oligonucleotide
tgatatcgtcgctttgtttcttcctcttcgccgcc

SEQ ID NO: 122985 - DNA, 36 bp, Artificial Sequence
  Synthetic oligonucleotide
acctccgctaccgttgacacattagcccttctttcc

SEQ ID NO: 122986 - DNA, 35 bp, Artificial Sequence
  Synthetic oligonucleotide
gaagccctacgttttccgcgcccgtccctgacgtc

SEQ ID NO: 122987 - DNA, 35 bp, Artificial Sequence
  Synthetic oligonucleotide
gctcccgtcccctccgactatattgccctggatcg

SEQ ID NO: 122988 - DNA, 35 bp, Artificial Sequence
  Synthetic oligonucleotide
gttgcatgcccatcacgtagccctttgctcctcat

SEQ ID NO: 122989 - DNA, 35 bp, Artificial Sequence
  Synthetic oligonucleotide
gttcgccccatatcaatctgctttcaccgggtaca

SEQ ID NO: 122990 - DNA, 37 bp, Artificial Sequence
  Synthetic oligonucleotide
gccgatccttcctagtgtcattttaccccccgttgga

SEQ ID NO: 122991 - DNA, 35 bp, Artificial Sequence
  Synthetic oligonucleotide
tgtgctaactcctgtggttttatcatctcctgccc

SEQ ID NO: 122992 - DNA, 35 bp, Artificial Sequence
  Synthetic oligonucleotide
atgccctctgccagcttagctacgcctccacggtc

SEQ ID NO: 122993 - DNA, 35 bp, Artificial Sequence
  Synthetic oligonucleotide
ggaggagaggaaggcagtaatagcagagaggtgag

SEQ ID NO: 122994 - DNA, 35 bp, Artificial Sequence
  Synthetic oligonucleotide
gccatggtccttcctttcccccgcgctttctgggg

SEQ ID NO: 122995 - DNA, 33 bp, Artificial Sequence
  Synthetic oligonucleotide
ttcccttccccccggccttgtctcattgcacct

SEQ ID NO: 122996 - DNA, 35 bp, Artificial Sequence
  Synthetic oligonucleotide
acgccacctgctttcgtctcaccacgcgctgctct

SEQ ID NO: 122997 - DNA, 36 bp, Artificial Sequence
  Synthetic oligonucleotide
acgtatcacctcaccattcgctatacccgacccaca

SEQ ID NO: 122998 - DNA, 35 bp, Artificial Sequence
  Synthetic oligonucleotide
gccacccctatgacgccccgaccgcgccgccgcca

SEQ ID NO: 122999 - DNA, 36 bp, Artificial Sequence
  Synthetic oligonucleotide
tcacaccgcctgctctcatcaattctgtccctgcca

SEQ ID NO: 123000 - DNA, 35 bp, Artificial Sequence
  Synthetic oligonucleotide
ttacgtccacgctcctgttctcttctgatgaggca

SEQ ID NO: 123001 - DNA, 38 bp, Artificial Sequence
  Synthetic oligonucleotide
gcccacgccacctcaagtatacgcccggcccctcgtga

SEQ ID NO: 123002 - DNA, 38 bp, Artificial Sequence
  Synthetic oligonucleotide
gtcgaacggggagcaaaggaaatagggaagaacggtga

SEQ ID NO: 123003 - DNA, 37 bp, Artificial Sequence
  Synthetic oligonucleotide
atgttccacgcctcattgctcgattccgtactcttga

SEQ ID NO: 123004 - DNA, 35 bp, Artificial Sequence
  Synthetic oligonucleotide
acgcaccccactgtcgctcctacagacccgccgcc

SEQ ID NO: 123005 - DNA, 35 bp, Artificial Sequence
  Synthetic oligonucleotide
tgtccacccatcccattcgagtaagctccctcgcc

SEQ ID NO: 123006 - DNA, 35 bp, Artificial Sequence
  Synthetic oligonucleotide
gcaacgcacatactcacgccactcattccacggag

SEQ ID NO: 123007 - DNA, 35 bp, Artificial Sequence
  Synthetic oligonucleotide
tcccgtattcggccatacgtgtctcttccccttgt

SEQ ID NO: 123008 - DNA, 35 bp, Artificial Sequence
  Synthetic oligonucleotide
tttgcaccacccccccgacgcccgtaatgagataa

SEQ ID NO: 123009 - DNA, 36 bp, Artificial Sequence
  Synthetic oligonucleotide
ggtcgcccctccaactgccccttagactctgtccca

SEQ ID NO: 123010 - DNA, 37 bp, Artificial Sequence
  Synthetic oligonucleotide
gcctacgtctcatgccctccgccatttcacacctcga

SEQ ID NO: 123011 - DNA, 36 bp, Artificial Sequence
  Synthetic oligonucleotide
tgactcccaccctcagaccgacgtctcgcccttcga

SEQ ID NO: 123012 - DNA, 38 bp, Artificial Sequence
  Synthetic oligonucleotide
acacagtggagaataggggcgaggggagggacaaatga

SEQ ID NO: 123013 - DNA, 38 bp, Artificial Sequence
  Synthetic oligonucleotide
ggggatggaaggtgggaagggggcagagatggtggtga

SEQ ID NO: 123014 - DNA, 35 bp, Artificial Sequence
  Synthetic oligonucleotide
tcccacgacggctttgttgggccaacgcttcttcc

SEQ ID NO: 123015 - DNA, 35 bp, Artificial Sequence
  Synthetic oligonucleotide
atgtccctgccagcctggttggcctcacctcactc

SEQ ID NO: 123016 - DNA, 35 bp, Artificial Sequence
  Synthetic oligonucleotide
tccgactccgcttgaaccggtccaaccacatcctc

SEQ ID NO: 123017 - DNA, 35 bp, Artificial Sequence
  Synthetic oligonucleotide
gtgaacactgcagctctcctgatatctcccttacg

SEQ ID NO: 123018 - DNA, 35 bp, Artificial Sequence
  Synthetic oligonucleotide
acctacctccttgtctttcccgagccttctgttgg

SEQ ID NO: 123019 - DNA, 35 bp, Artificial Sequence
  Synthetic oligonucleotide
agacaatccgcctgctcctactttacactcgcgtg

SEQ ID NO: 123020 - DNA, 35 bp, Artificial Sequence
  Synthetic oligonucleotide
acccaccgattacgtttgtccagtaccccccgatt

SEQ ID NO: 123021 - DNA, 37 bp, Artificial Sequence
  Synthetic oligonucleotide
gatgcaaggtggggcaaaggggaagagcagtgagaga

SEQ ID NO: 123022 - DNA, 36 bp, Artificial Sequence
  Synthetic oligonucleotide
ttgctaagcctcctcactgccactccgaaccaccga

SEQ ID NO: 123023 - DNA, 36 bp, Artificial Sequence
  Synthetic oligonucleotide
acacttcgccccgggttcaactcagtcgctccctac

SEQ ID NO: 123024 - DNA, 35 bp, Artificial Sequence
  Synthetic oligonucleotide
tccaacgcattaagcagcggtgtcacttctccccc

SEQ ID NO: 123025 - DNA, 35 bp, Artificial Sequence
  Synthetic oligonucleotide
aagcttggcccagccgcattcaggcctccctgccc

SEQ ID NO: 123026 - DNA, 35 bp, Artificial Sequence; identical to SEQ ID NO: 2989
  Synthetic oligonucleotide

SEQ ID NO: 123027 - DNA, 35 bp, Artificial Sequence
  Synthetic oligonucleotide
atcccctggttactatctgctccatatctccctcg

SEQ ID NO: 123028 - DNA, 35 bp, Artificial Sequence
  Synthetic oligonucleotide
gtaccgccttccagccgtcccaccagtcaatgtcg

SEQ ID NO: 123029 - DNA, 35 bp, Artificial Sequence
  Synthetic oligonucleotide
tactcactccccgccctgcccgtgctaatgaaaat

SEQ ID NO: 123030 - DNA, 35 bp, Artificial Sequence
  Synthetic oligonucleotide
tgacccccgcactgtatctgcgtgaccttttccat

SEQ ID NO: 123031 - DNA, 35 bp, Artificial Sequence
  Synthetic oligonucleotide
acgctatcaacctggcccttgtactaatgtccttt

SEQ ID NO: 123032 - DNA, 37 bp, Artificial Sequence
  Synthetic oligonucleotide
gggggaacgtactaggaagcagggagggacacgcaga

SEQ ID NO: 123033 - DNA, 38 bp, Artificial Sequence
  Synthetic oligonucleotide
tgtcctcctgcgtcccatctctacctccgccaccgtga

SEQ ID NO: 123034 - DNA, 36 bp, Artificial Sequence
  Synthetic oligonucleotide
gactctatcatcccccacatgtgcccgaaccttgta

SEQ ID NO: 123035 - DNA, 35 bp, Artificial Sequence
  Synthetic oligonucleotide
gtgaagggtacgaaactaaagggggggagggatta

SEQ ID NO: 123036 - DNA, 35 bp, Artificial Sequence
  Synthetic oligonucleotide
tcccacgctctgccgcccttcttcgtgccaaaaac

SEQ ID NO: 123037 - DNA, 35 bp, Artificial Sequence
  Synthetic oligonucleotide
tgcaccctccccctcgtatagtaacaattccatac

SEQ ID NO: 123038 - DNA, 35 bp, Artificial Sequence
  Synthetic oligonucleotide
gggcctcccacatcgccctgctgcgctctcgcacc

SEQ ID NO: 123039 - DNA, 35 bp, Artificial Sequence
  Synthetic oligonucleotide
gtactgacgccggttctgtcatattttttccttcg

SEQ ID NO: 123040 - DNA, 35 bp, Artificial Sequence
  Synthetic oligonucleotide
gacagtgccgccccagttgtctctccatccctagg

SEQ ID NO: 123041 - DNA, 35 bp, Artificial Sequence
  Synthetic oligonucleotide
gtccccgtctcccctgtttcgaccgcgcgggccct

SEQ ID NO: 123042 - DNA, 36 bp, Artificial Sequence
  Synthetic oligonucleotide
gtgcccctcagccttcccgcattgttatcaccgcaa

SEQ ID NO: 123043 - DNA, 35 bp, Artificial Sequence
  Synthetic oligonucleotide
acccactccttcgcgcggttccatcactggtccca

SEQ ID NO: 123044 - DNA, 36 bp, Artificial Sequence
  Synthetic oligonucleotide
acgccgtccctgcagcgcacccacgcccctccgaga

SEQ ID NO: 123045 - DNA, 35 bp, Artificial Sequence
  Synthetic oligonucleotide
gatcggtggggaaaggataaaggaaaggaggacga

SEQ ID NO: 123046 - DNA, 34 bp, Artificial Sequence
  Synthetic oligonucleotide
tttccacctcacctcgctgattgtacaatcacgc

SEQ ID NO: 123047 - DNA, 35 bp, Artificial Sequence
  Synthetic oligonucleotide
ttgcctcccattatgtaaactgcccctcttgcatg

SEQ ID NO: 123048 - DNA, 35 bp, Artificial Sequence
  Synthetic oligonucleotide
tccgttcacccgttcggatcccttcgctactctat

SEQ ID NO: 123049 - DNA, 36 bp, Artificial Sequence
  Synthetic oligonucleotide
aaagggaggagacgggggcatagaagagacgtacaa

SEQ ID NO: 123050 - DNA, 36 bp, Artificial Sequence
  Synthetic oligonucleotide
acagtcgtacgcccgctggtcttcccgtttccataa

SEQ ID NO: 123051 - DNA, 36 bp, Artificial Sequence
  Synthetic oligonucleotide
acctcccctacgccaaaactgtcatgcctcacgcca

SEQ ID NO: 123052 - DNA, 36 bp, Artificial Sequence
  Synthetic oligonucleotide
aaacgggggggccggggggtcttcggaggcggtgca

SEQ ID NO: 123053 - DNA, 36 bp, Artificial Sequence
  Synthetic oligonucleotide
gccgacgcctgccttttgactcgcgctctaccatga

SEQ ID NO: 123054 - DNA, 37 bp, Artificial Sequence
  Synthetic oligonucleotide
acgattcgtcacgttgatccccgcctccctctgctga

SEQ ID NO: 123055 - DNA, 35 bp, Artificial Sequence
  Synthetic oligonucleotide
tctctacgccctaatacgtgataaactctccgccc

SEQ ID NO: 123056 - DNA, 35 bp, Artificial Sequence
  Synthetic oligonucleotide
tctgagtcccgattgcacgtcccacaccctcctcc

SEQ ID NO: 123057 - DNA, 35 bp, Artificial Sequence
  Synthetic oligonucleotide
accaacctctgtctacaccgtcctttctatcacgc

SEQ ID NO: 123058 - DNA, 35 bp, Artificial Sequence
  Synthetic oligonucleotide
gggcgggggagggagggtgaagaaatggaaatgtg

SEQ ID NO: 123059 - DNA, 35 bp, Artificial Sequence
  Synthetic oligonucleotide
tatcgccccagacaccagcccgtaccgattacgcc

SEQ ID NO: 123060 - DNA, 35 bp, Artificial Sequence
  Synthetic oligonucleotide
tcagcgagtccccgccttcgttcgcgctcccgtgc

SEQ ID NO: 123061 - DNA, 35 bp, Artificial Sequence
  Synthetic oligonucleotide
gcatgctcagtgaccaaccatctcacgtatcctcg

SEQ ID NO: 123062 - DNA, 35 bp, Artificial Sequence
  Synthetic oligonucleotide
acttgcccctgcctgtttgtctcccgagcccttat

SEQ ID NO: 123063 - DNA, 35 bp, Artificial Sequence
  Synthetic oligonucleotide
tacacgtccagacacccactcgctgaacatcctct

SEQ ID NO: 123064 - DNA, 35 bp, Artificial Sequence
  Synthetic oligonucleotide
tcatcgcgacagctcatcacaccacccctctgtgt

SEQ ID NO: 123065 - DNA, 35 bp, Artificial Sequence
  Synthetic oligonucleotide
tgcaccatacctgttcctcttagttccgtttctaa

SEQ ID NO: 123066 - DNA, 36 bp, Artificial Sequence
  Synthetic oligonucleotide
gccggagctttcgccttgtccttgccttgttccaca

SEQ ID NO: 123067 - DNA, 36 bp, Artificial Sequence
  Synthetic oligonucleotide
tccgacccgccctgccactgcatgcgaagcccgcca

SEQ ID NO: 123068 - DNA, 35 bp, Artificial Sequence
  Synthetic oligonucleotide
gacgcaggacagaatgacaacacctcgccctctca

SEQ ID NO: 123069 - DNA, 37 bp, Artificial Sequence
  Synthetic oligonucleotide
gccaacgtagatccccctatctcgccttgtctcccga

SEQ ID NO: 123070 - DNA, 37 bp, Artificial Sequence
  Synthetic oligonucleotide
acctgacacctgcaccttatgcgtttagcccctatga

SEQ ID NO: 123071 - DNA, 35 bp, Artificial Sequence
  Synthetic oligonucleotide
acttcgcccccactgggatatggtcacatctcacc

SEQ ID NO: 123072 - DNA, 35 bp, Artificial Sequence
  Synthetic oligonucleotide
tttgcagtcctttccttgtatcacaccgccccgcc

SEQ ID NO: 123073 - DNA, 35 bp, Artificial Sequence
  Synthetic oligonucleotide
acagagcgtacgcgccgctgtcccttccctgttcc

SEQ ID NO: 123074 - DNA, 35 bp, Artificial Sequence
  Synthetic oligonucleotide
tcccttgcggagtttcctatcctcgacacgccctc

SEQ ID NO: 123075 - DNA, 36 bp, Artificial Sequence
  Synthetic oligonucleotide
tgctaacgcagaaatttcccgtcttccgcctgcctg

SEQ ID NO: 123076 - DNA, 35 bp, Artificial Sequence
  Synthetic oligonucleotide
gccaggtagggggacggctagagggggggtgcgat

SEQ ID NO: 123077 - DNA, 35 bp, Artificial Sequence
  Synthetic oligonucleotide
tcccctccatcccattcggttttacagtcctctgt

SEQ ID NO: 123078 - DNA, 35 bp, Artificial Sequence
  Synthetic oligonucleotide
tgcatgttgggcggggcgcttatgtatggtggctt

SEQ ID NO: 123079 - DNA, 36 bp, Artificial Sequence
  Synthetic oligonucleotide
ttccccccccgaacatgggtctccgtttctccgcca

SEQ ID NO: 123080 - DNA, 36 bp, Artificial Sequence
  Synthetic oligonucleotide
gcccacctctcaagatcaaacgcgcctactgctcca

SEQ ID NO: 123081 - DNA, 35 bp, Artificial Sequence
  Synthetic oligonucleotide
gttgcaggtcgtttttgcgttccgttccccgttca

SEQ ID NO: 123082 - DNA, 37 bp, Artificial Sequence
  Synthetic oligonucleotide
gcagaccaatccgcggtgtcatcgcccccctttccga

SEQ ID NO: 123083 - DNA, 37 bp, Artificial Sequence
  Synthetic oligonucleotide
ttgtcccctcgacccctcctctagcccgccttcggga

SEQ ID NO: 123084 - DNA, 37 bp, Artificial Sequence
  Synthetic oligonucleotide
tgccattcccccccccgtgcgctttgactagtcctga

SEQ ID NO: 123085 - DNA, 35 bp, Artificial Sequence
  Synthetic oligonucleotide
ttgcgggagagggaaaggggtgggaagactattga

SEQ ID NO: 123086 - DNA, 36 bp, Artificial Sequence
  Synthetic oligonucleotide
gtcccacttcccaactgtaacgcgtgttgcctcgta

SEQ ID NO: 123087 - DNA, 35 bp, Artificial Sequence
  Synthetic oligonucleotide
gtccccctcacatatatcgcattgcattaatgccc

SEQ ID NO: 123088 - DNA, 35 bp, Artificial Sequence
  Synthetic oligonucleotide
aggccccgccgccccttgtaccatccccctgggcc

SEQ ID NO: 123089 - DNA, 35 bp, Artificial Sequence
  Synthetic oligonucleotide
atgaccagtccaagcaccatcctgccttccctacg

SEQ ID NO: 123090 - DNA, 35 bp, Artificial Sequence
  Synthetic oligonucleotide
tctgtcgcccggccgcgagtccttcccagccaccg

SEQ ID NO: 123091 - DNA, 32 bp, Artificial Sequence
  Synthetic oligonucleotide
tctggacccctctactttgctgacctcccgat

SEQ ID NO: 123092 - DNA, 35 bp, Artificial Sequence
  Synthetic oligonucleotide
acctcaaccagtcctatcgcgcccaccccggtatt

SEQ ID NO: 123093 - DNA, 35 bp, Artificial Sequence
  Synthetic oligonucleotide
gatgccctcctgccgttaagcactcgatcgttaca

SEQ ID NO: 123094 - DNA, 35 bp, Artificial Sequence
  Synthetic oligonucleotide
tcccagcccacgccccagaggcccacacgctatca

SEQ ID NO: 123095 - DNA, 36 bp, Artificial Sequence
  Synthetic oligonucleotide
cccaccccccatcgatgcctaaccactgttgcccta

SEQ ID NO: 123096 - DNA, 35 bp, Artificial Sequence
  Synthetic oligonucleotide
agtagtcccagcctccccgcccccgcctccgggac

SEQ ID NO: 123097 - DNA, 35 bp, Artificial Sequence
  Synthetic oligonucleotide
ttgcgcctacactctatgcctcgtacaactccacc

SEQ ID NO: 123098 - DNA, 35 bp, Artificial Sequence
  Synthetic oligonucleotide
gtccccaccgcctaatgtctcacagtccacacatc

SEQ ID NO: 123099 - DNA, 35 bp, Artificial Sequence
  Synthetic oligonucleotide
tcatccgctcatcacgggcgcctttgtcctacctc

SEQ ID NO: 123100 - DNA, 35 bp, Artificial Sequence
  Synthetic oligonucleotide
gctcagaccattcagcccgtccccgtcccggcctc

SEQ ID NO: 123101 - DNA, 35 bp, Artificial Sequence
  Synthetic oligonucleotide
gaccgccctgctttccccacccctgcgggcatctc

SEQ ID NO: 123102 - DNA, 35 bp, Artificial Sequence
  Synthetic oligonucleotide
tgctctcgccagccccgtgcgtcactttcgctttc

SEQ ID NO: 123103 - DNA, 35 bp, Artificial Sequence
  Synthetic oligonucleotide
gcctggactcacctcgcccgcaccgcttccttggt

SEQ ID NO: 123104 - DNA, 35 bp, Artificial Sequence
  Synthetic oligonucleotide
accgcgccctgaccgcgcccgcactatccaccgga

SEQ ID NO: 123105 - DNA, 36 bp, Artificial Sequence
  Synthetic oligonucleotide
ggtcgtagcccgcaaccccccttcctgtcaactgga

SEQ ID NO: 123106 - DNA, 38 bp, Artificial Sequence
  Synthetic oligonucleotide
agcggggagggcgcggggggggcatgagtgggcactga

SEQ ID NO: 123107 - DNA, 35 bp, Artificial Sequence
  Synthetic oligonucleotide
tctcaccaccgggactcgctgtggtctatttcccc

SEQ ID NO: 123108 - DNA, 35 bp, Artificial Sequence
  Synthetic oligonucleotide
tcacgcatgtattgcgcatattttttcaccacgcc

SEQ ID NO: 123109 - DNA, 35 bp, Artificial Sequence
  Synthetic oligonucleotide
tcccgcccctgttgtttcctcacgctcggtcatcc

SEQ ID NO: 123110 - DNA, 35 bp, Artificial Sequence
  Synthetic oligonucleotide
tcaatgtacagcccctcgcttcggtgtcctcccgc

SEQ ID NO: 123111 - DNA, 35 bp, Artificial Sequence
  Synthetic oligonucleotide
atgccttcctgttgaaaacgtgcacaccccctgtc

SEQ ID NO: 123112 - DNA, 35 bp, Artificial Sequence
  Synthetic oligonucleotide
ttcatcacccgcatggtcccagttgtcctccccat

SEQ ID NO: 123113 - DNA, 35 bp, Artificial Sequence
  Synthetic oligonucleotide
tacatgcaactcagacttccgccgacctcgccact

SEQ ID NO: 123114 - DNA, 35 bp, Artificial Sequence
  Synthetic oligonucleotide
gtgaacgtaaaatggggggcagggggagggtcgct

SEQ ID NO: 123115 - DNA, 35 bp, Artificial Sequence
  Synthetic oligonucleotide
gacacccccttaatgtctctaaacccccgtgttct

SEQ ID NO: 123116 - DNA, 35 bp, Artificial Sequence
  Synthetic oligonucleotide
atcgcgggaggtgtgggaggggctgaagttgattt

SEQ ID NO: 123117 - DNA, 35 bp, Artificial Sequence
  Synthetic oligonucleotide
tgacctggtggagggtggaggaggggtggtgtaca

SEQ ID NO: 123118 - DNA, 36 bp, Artificial Sequence
  Synthetic oligonucleotide
tacaaggccagggaggggcgggtggagatataggca

SEQ ID NO: 123119 - DNA, 35 bp, Artificial Sequence
  Synthetic oligonucleotide
ttgccccctgcagcagctcctccctgatctacgta

SEQ ID NO: 123120 - DNA, 35 bp, Artificial Sequence
  Synthetic oligonucleotide
gccggaccctccatgacgcaagttcccccgttacc

SEQ ID NO: 123121 - DNA, 35 bp, Artificial Sequence
  Synthetic oligonucleotide
tgcaccactccacccgctctgcgaattccgtacgc

SEQ ID NO: 123122 - DNA, 35 bp, Artificial Sequence
  Synthetic oligonucleotide
gtccgtgccatctttttttatcgggttcatctcgc

SEQ ID NO: 123123 - DNA, 35 bp, Artificial Sequence
  Synthetic oligonucleotide
acgcacacccgccgtgctcgaatcaattgaacctg

SEQ ID NO: 123124 - DNA, 37 bp, Artificial Sequence
  Synthetic oligonucleotide
gaaggcgctttggagggaggtggggttggtggacgga

SEQ ID NO: 123125 - DNA, 35 bp, Artificial Sequence
  Synthetic oligonucleotide
gccagagctcgctgttccgcccatctctcgtacac

SEQ ID NO: 123126 - DNA, 35 bp, Artificial Sequence
  Synthetic oligonucleotide
gaagaggtgcgggcatggagaagcggggggggtac

SEQ ID NO: 123127 - DNA, 35 bp, Artificial Sequence
  Synthetic oligonucleotide
tagagcggtagctttccctcgtcacaccaggcccc

SEQ ID NO: 123128 - DNA, 35 bp, Artificial Sequence
  Synthetic oligonucleotide
aaccaccaccttcgcactatgttaatcgatcacgc

SEQ ID NO: 123129 - DNA, 35 bp, Artificial Sequence
  Synthetic oligonucleotide
taccccatcaattgctagtacgttcgccacttggc

SEQ ID NO: 123130 - DNA, 35 bp, Artificial Sequence
  Synthetic oligonucleotide
atacctcaggcaccttacgccttcgccccgcctgc

SEQ ID NO: 123131 - DNA, 35 bp, Artificial Sequence
  Synthetic oligonucleotide
taccgcgccattcttcctggccttgattctacctc

SEQ ID NO: 123132 - DNA, 35 bp, Artificial Sequence
  Synthetic oligonucleotide
tccgcctcccgacttaaaccgccgtgcctatgctc

SEQ ID NO: 123133 - DNA, 35 bp, Artificial Sequence
  Synthetic oligonucleotide
gacattgctgatattattctgttgctgcccccttc

SEQ ID NO: 123134 - DNA, 35 bp, Artificial Sequence
  Synthetic oligonucleotide
tgccacgtacccctatggccgccaaaggtacctct

SEQ ID NO: 123135 - DNA, 35 bp, Artificial Sequence
  Synthetic oligonucleotide
accccgcccgtccctctgccgtcagtcgcatgaga

SEQ ID NO: 123136 - DNA, 37 bp, Artificial Sequence
  Synthetic oligonucleotide
gtccatgtggcggagtgcgggtggctagggggaagga

SEQ ID NO: 123137 - DNA, 38 bp, Artificial Sequence
  Synthetic oligonucleotide
acaggtcagtactgggaagggagggggggcgaagctga

SEQ ID NO: 123138 - DNA, 38 bp, Artificial Sequence
  Synthetic oligonucleotide
tgaggagagaggaggtgaaggtggcggggtgggcgtga

SEQ ID NO: 123139 - DNA, 38 bp, Artificial Sequence
  Synthetic oligonucleotide
gatggcgtgtgggtgggtaggcgggggggaggctttga

SEQ ID NO: 123140 - DNA, 36 bp, Artificial Sequence
  Synthetic oligonucleotide
gagggagtgacgggaaggcgagtgtggggaacggta

SEQ ID NO: 123141 - DNA, 35 bp, Artificial Sequence
  Synthetic oligonucleotide
tgttagccgtctgctcgtttaccattcgccttctc

SEQ ID NO: 123142 - DNA, 35 bp, Artificial Sequence
  Synthetic oligonucleotide
tccctcgcccgaaggtccttttccatggtgtacat

SEQ ID NO: 123143 - DNA, 35 bp, Artificial Sequence
  Synthetic oligonucleotide
ttaggccggtcctccctggaatcacagccactcct

SEQ ID NO: 123144 - DNA, 36 bp, Artificial Sequence
  Synthetic oligonucleotide
aacaaacgtgtgcggaaggctgaaagggggcgggga

SEQ ID NO: 123145 - DNA, 35 bp, Artificial Sequence
  Synthetic oligonucleotide
taacagtgcgtagattgcctgttagcccccctccc

SEQ ID NO: 123146 - DNA, 35 bp, Artificial Sequence
  Synthetic oligonucleotide
actggtcagataggccttccacctcctcccccgcc

SEQ ID NO: 123147 - DNA, 35 bp, Artificial Sequence
  Synthetic oligonucleotide
tcccgccccgaagccgaacgttgcctacctcgcgc

SEQ ID NO: 123148 - DNA, 35 bp, Artificial Sequence
  Synthetic oligonucleotide
accaccacacatcgcaactcacaagccccaatcgc

SEQ ID NO: 123149 - DNA, 35 bp, Artificial Sequence
  Synthetic oligonucleotide
tctgcggtccctccagatctcgctgtcccaccgct

SEQ ID NO: 123150 - DNA, 36 bp, Artificial Sequence
  Synthetic oligonucleotide
aagatgcaaagggtgtagtggggggggtgagagaca

SEQ ID NO: 123151 - DNA, 36 bp, Artificial Sequence
  Synthetic oligonucleotide
gacgattcagctatcacctttgtacgccttccccca

SEQ ID NO: 123152 - DNA, 36 bp, Artificial Sequence
  Synthetic oligonucleotide
gtcccccgctaccgtatgccatgcgccacttcccga

SEQ ID NO: 123153 - DNA, 36 bp, Artificial Sequence
  Synthetic oligonucleotide
aaggtggggagggcggacggataaataacggtggta

SEQ ID NO: 123154 - DNA, 35 bp, Artificial Sequence
  Synthetic oligonucleotide
ggtaacagccctccctataagctctgcccacctac

SEQ ID NO: 123155 - DNA, 35 bp, Artificial Sequence
  Synthetic oligonucleotide
gcattgcgcatcatccgaccctccgacattctccg

SEQ ID NO: 123156 - DNA, 35 bp, Artificial Sequence
  Synthetic oligonucleotide
tccgccacctcacctggccaatcccaccttagagg

SEQ ID NO: 123157 - DNA, 35 bp, Artificial Sequence
  Synthetic oligonucleotide
gtgcacccgaccacttccgtccatagtatctactg

SEQ ID NO: 123158 - DNA, 35 bp, Artificial Sequence
  Synthetic oligonucleotide
gacatagtgtgaaggtggaggcgcgggggggtcat

SEQ ID NO: 123159 - DNA, 35 bp, Artificial Sequence
  Synthetic oligonucleotide
gtccccccgcacaggatcctgttatccatcatgct

SEQ ID NO: 123160 - DNA, 37 bp, Artificial Sequence
  Synthetic oligonucleotide
tcaccgcctcttcgtgcactcatcctggacccttaga

SEQ ID NO: 123161 - DNA, 37 bp, Artificial Sequence
  Synthetic oligonucleotide
ttgcacacggaggagggggggctggcggacggctcga

SEQ ID NO: 123162 - DNA, 36 bp, Artificial Sequence
  Synthetic oligonucleotide
accgccttccctcgcatccccttacagatagttcga

SEQ ID NO: 123163 - DNA, 38 bp, Artificial Sequence
  Synthetic oligonucleotide
tctcgcggtcaccagctcctcctacgtgccacccctga

SEQ ID NO: 123164 - DNA, 37 bp, Artificial Sequence
  Synthetic oligonucleotide
tcccgagcctctgcaccgtgttacttcccactcctga

SEQ ID NO: 123165 - DNA, 38 bp, Artificial Sequence
  Synthetic oligonucleotide
gtgggacgggttcgggggggtaacagaaacaattctga

SEQ ID NO: 123166 - DNA, 38 bp, Artificial Sequence
  Synthetic oligonucleotide
ggccatccgccctgcaatacttcgcctgttcccattga

SEQ ID NO: 123167 - DNA, 35 bp, Artificial Sequence
  Synthetic oligonucleotide
tttgagcgtgcaccccggttgttgctttatccccc

SEQ ID NO: 123168 - DNA, 35 bp, Artificial Sequence
  Synthetic oligonucleotide
gagtccatcacgagcgcctgttcgtccgcctgccc

SEQ ID NO: 123169 - DNA, 35 bp, Artificial Sequence
  Synthetic oligonucleotide
gaacagccgcttcacattactggtatcatcctccc

SEQ ID NO: 123170 - DNA, 35 bp, Artificial Sequence
  Synthetic oligonucleotide
tccagtcgcctgactgctgctcctcgccctggtcc

SEQ ID NO: 123171 - DNA, 35 bp, Artificial Sequence
  Synthetic oligonucleotide
acaccgctacctcaccttttcttgccgatgcaagc

SEQ ID NO: 123172 - DNA, 35 bp, Artificial Sequence
  Synthetic oligonucleotide
taagatgtggctccgttgtcccctccggcccatgc

SEQ ID NO: 123173 - DNA, 35 bp, Artificial Sequence
  Synthetic oligonucleotide
gtgcactgtcaataggttcctttctcttgcctttc

SEQ ID NO: 123174 - DNA, 35 bp, Artificial Sequence
  Synthetic oligonucleotide
gcgaacgcctaccatcaccgcggttcccaccccct

SEQ ID NO: 123175 - DNA, 35 bp, Artificial Sequence
  Synthetic oligonucleotide
atctcgccaatccacgggtccctagccgctgctct

SEQ ID NO: 123176 - DNA, 35 bp, Artificial Sequence
  Synthetic oligonucleotide
tgcggaccatccttttcctggcaccttcctccggt

SEQ ID NO: 123177 - DNA, 35 bp, Artificial Sequence
  Synthetic oligonucleotide
acactccacacaatgccatgtcttgctccttcaca

SEQ ID NO: 123178 - DNA, 35 bp, Artificial Sequence
  Synthetic oligonucleotide
tcccgatgggtgagggtggggaaaggatggggaca

SEQ ID NO: 123179 - DNA, 36 bp, Artificial Sequence
  Synthetic oligonucleotide
gtgacacgatcagcctccacctggccagaactccca

SEQ ID NO: 123180 - DNA, 37 bp, Artificial Sequence
  Synthetic oligonucleotide
atgggggcttcgggggggaaggaggacacgggacaga

SEQ ID NO: 123181 - DNA, 36 bp, Artificial Sequence
  Synthetic oligonucleotide
gttgccgacccagccctcccgctattgcgtacgtga

SEQ ID NO: 123182 - DNA, 38 bp, Artificial Sequence
  Synthetic oligonucleotide
tgcattcgcagtcggtgacctccctccaccccccttga

SEQ ID NO: 123183 - DNA, 36 bp, Artificial Sequence
  Synthetic oligonucleotide
gtcgggtgcccctccatgcttatgccccacgcttga

SEQ ID NO: 123184 - DNA, 35 bp, Artificial Sequence
  Synthetic oligonucleotide
tcaacgacgtcttccttagcctcacccggtccacc

SEQ ID NO: 123185 - DNA, 34 bp, Artificial Sequence
  Synthetic oligonucleotide
tactggcctggttccttcttcgtgccactgaccc

SEQ ID NO: 123186 - DNA, 35 bp, Artificial Sequence
  Synthetic oligonucleotide
tccaggccccctcatgtttttcacttgccgtcctc

SEQ ID NO: 123187 - DNA, 30 bp, Artificial Sequence
  Synthetic oligonucleotide
gttgtgtaacggaccgcctgttgccctctc

SEQ ID NO: 123188 - DNA, 35 bp, Artificial Sequence
  Synthetic oligonucleotide
tctactcccccagcgccgttcagttcttttgcccg

SEQ ID NO: 123189 - DNA, 36 bp, Artificial Sequence
  Synthetic oligonucleotide
atccccatccctcaccggcccgtgatccaaggccct

SEQ ID NO: 123190 - DNA, 35 bp, Artificial Sequence
  Synthetic oligonucleotide
gtccctcccactgtttttctgctctctatgagcga

SEQ ID NO: 123191 - DNA, 36 bp, Artificial Sequence
  Synthetic oligonucleotide
gtcttatagcctccgtttcgaacttgcctgccaata

SEQ ID NO: 123192 - DNA, 35 bp, Artificial Sequence
  Synthetic oligonucleotide
acaaagggcgaggggaacggagcaagcaggcgatg

SEQ ID NO: 123193 - DNA, 35 bp, Artificial Sequence
  Synthetic oligonucleotide
tcgaaccacacacctccctgcatgagcttcccgtt

SEQ ID NO: 123194 - DNA, 36 bp, Artificial Sequence
  Synthetic oligonucleotide
gtgcatgccagtactatttgcctttccctcctgcca

SEQ ID NO: 123195 - DNA, 37 bp, Artificial Sequence
  Synthetic oligonucleotide
tagaaccacgatccatgctttgcgcctccactcccga

SEQ ID NO: 123196 - DNA, 37 bp, Artificial Sequence
  Synthetic oligonucleotide
aaccccgccaactctcccgttacccgcgctatcgcga

SEQ ID NO: 123197 - DNA, 38 bp, Artificial Sequence
  Synthetic oligonucleotide
acaccggtgtctattctgtactcttccctgtttcatga

SEQ ID NO: 123198 - DNA, 37 bp, Artificial Sequence
  Synthetic oligonucleotide
tctgacgcgtgaggagggaggggatcaggggggtgta

SEQ ID NO: 123199 - DNA, 35 bp, Artificial Sequence
  Synthetic oligonucleotide
gcaagtgccgatactccttttcagcgctctcatcc

SEQ ID NO: 123200 - DNA, 35 bp, Artificial Sequence
  Synthetic oligonucleotide
tacgcaccccccgcgctgctccttacgttggcatc

SEQ ID NO: 123201 - DNA, 35 bp, Artificial Sequence
  Synthetic oligonucleotide
tcattaccgccccctctgtaagccactaggctatg

SEQ ID NO: 123202 - DNA, 35 bp, Artificial Sequence
  Synthetic oligonucleotide
tcaacacctcactcctcgcaacgcaggcactatca

SEQ ID NO: 123203 - DNA, 35 bp, Artificial Sequence
  Synthetic oligonucleotide
tgccccgccccccctagagccgacaacttgcctca

SEQ ID NO: 123204 - DNA, 38 bp, Artificial Sequence
  Synthetic oligonucleotide
ccatggagagcgggaggaaaggatcccagggtgggtga

SEQ ID NO: 123205 - DNA, 36 bp, Artificial Sequence
  Synthetic oligonucleotide
gcccaccacgctggtgtacctaccgagccgccgcta

SEQ ID NO: 123206 - DNA, 35 bp, Artificial Sequence
  Synthetic oligonucleotide
gacaaccccgttccgtagtgcatcgtactatcacc

SEQ ID NO: 123207 - DNA, 35 bp, Artificial Sequence
  Synthetic oligonucleotide
ggtcactcgcactacctcgtctccatacacgtacc

SEQ ID NO: 123208 - DNA, 35 bp, Artificial Sequence
  Synthetic oligonucleotide
gaacgaggaactggtacaagggcgagaggagaaga

SEQ ID NO: 123209 - DNA, 36 bp, Artificial Sequence
  Synthetic oligonucleotide
accccgtagggcacacctcccatccgtctcctacga

SEQ ID NO: 123210 - DNA, 36 bp, Artificial Sequence
  Synthetic oligonucleotide
tgtggctctcgtgcgttactaccctctctcgctgga

SEQ ID NO: 123211 - DNA, 36 bp, Artificial Sequence
  Synthetic oligonucleotide
gctgtcccccagcccggcccaatctgcccatcttga

SEQ ID NO: 123212 - DNA, 36 bp, Artificial Sequence
  Synthetic oligonucleotide
agcacatgccgtggcatttcgtccctcccgttgtta

SEQ ID NO: 123213 - DNA, 35 bp, Artificial Sequence
  Synthetic oligonucleotide
atccctccgactctagacttggttccgcgaccccc

SEQ ID NO: 123214 - DNA, 35 bp, Artificial Sequence
  Synthetic oligonucleotide
gatccggtccgtgctacaacgcttttatcctgccc

SEQ ID NO: 123215 - DNA, 35 bp, Artificial Sequence
  Synthetic oligonucleotide
tgccacctcgtttctctcgcccgccgagttcctgc

SEQ ID NO: 123216 - DNA, 35 bp, Artificial Sequence
  Synthetic oligonucleotide
tcctaccgccccttccacgatgttccatccgcagg

SEQ ID NO: 123217 - DNA, 35 bp, Artificial Sequence
  Synthetic oligonucleotide
agccttcccgccgccaagccgattggcacactcca

SEQ ID NO: 123218 - DNA, 37 bp, Artificial Sequence
  Synthetic oligonucleotide
ggtggggtggagggagataaggatgaagcgaccacga

SEQ ID NO: 123219 - DNA, 36 bp, Artificial Sequence
  Synthetic oligonucleotide
acacccatcggtcctcactgtccccctcggttacga

SEQ ID NO: 123220 - DNA, 37 bp, Artificial Sequence
  Synthetic oligonucleotide
tcatcttgcagacagattgtctcatcacccccgccga

SEQ ID NO: 123221 - DNA, 37 bp, Artificial Sequence
  Synthetic oligonucleotide
gcacccaggcgctttctgccacttcacttcctgttga

SEQ ID NO: 123222 - DNA, 35 bp, Artificial Sequence
  Synthetic oligonucleotide
tcaccactggtgctaacgggcactctaactttcct

SEQ ID NO: 123223 - DNA, 35 bp, Artificial Sequence
  Synthetic oligonucleotide
ttaccccgctgttggctactctacaccactggtct

SEQ ID NO: 123224 - DNA, 33 bp, Artificial Sequence
  Synthetic oligonucleotide
ggatgtacgccccgctgtctctttcaccataca

SEQ ID NO: 123225 - DNA, 36 bp, Artificial Sequence
  Synthetic oligonucleotide
gatctagcccatgaagtttgcacatcccccgcccca

SEQ ID NO: 123226 - DNA, 36 bp, Artificial Sequence
  Synthetic oligonucleotide
gcccacctctacgcccttacaatctgcgggttccca

SEQ ID NO: 123227 - DNA, 37 bp, Artificial Sequence
  Synthetic oligonucleotide
tcatgggaggggaaggtgggtgagctaagcaggcaga

SEQ ID NO: 123228 - DNA, 36 bp, Artificial Sequence
  Synthetic oligonucleotide
tgaagagggcgggggggtaaacaagcgcacagcgga

SEQ ID NO: 123229 - DNA, 36 bp, Artificial Sequence
  Synthetic oligonucleotide
ggtgtcccctgccgccgactatatatgccttcctga

SEQ ID NO: 123230 - DNA, 35 bp, Artificial Sequence
  Synthetic oligonucleotide
aaacgccccaactcggccttgttatctccacctta

SEQ ID NO: 123231 - DNA, 35 bp, Artificial Sequence
  Synthetic oligonucleotide
tcatcccccttcctccctggcctgcctctgactcc

SEQ ID NO: 123232 - DNA, 35 bp, Artificial Sequence
  Synthetic oligonucleotide
acccctttccgtaggcttgtaactatccaccctgc

SEQ ID NO: 123233 - DNA, 35 bp, Artificial Sequence
  Synthetic oligonucleotide
attctgccgcgtacactctgtccagtcccctctgc

SEQ ID NO: 123234 - DNA, 35 bp, Artificial Sequence
  Synthetic oligonucleotide
ttgcgcaagcaccagccgcctaccttccgttttgc

SEQ ID NO: 123235 - DNA, 35 bp, Artificial Sequence
  Synthetic oligonucleotide
gagtgtccccgcgccctggtagttcccccttgctg

SEQ ID NO: 123236 - DNA, 35 bp, Artificial Sequence
  Synthetic oligonucleotide
tacaccgccgccatacttcccgagtctcttcatgt

SEQ ID NO: 123237 - DNA, 36 bp, Artificial Sequence
  Synthetic oligonucleotide
gtgcttccgggcgggtgagggaagggtagagtggaa

SEQ ID NO: 123238 - DNA, 35 bp, Artificial Sequence
  Synthetic oligonucleotide
tcatcaggcactgccctgcaccaagctcccccgca

SEQ ID NO: 123239 - DNA, 35 bp, Artificial Sequence
  Synthetic oligonucleotide
tctcacaccatgctgttgcctaatactccatctca

SEQ ID NO: 123240 - DNA, 35 bp, Artificial Sequence
  Synthetic oligonucleotide
gtcctagcatcctccccgttcgttcttaattgtac

SEQ ID NO: 123241 - DNA, 35 bp, Artificial Sequence
  Synthetic oligonucleotide
tcgtccactggcgctgttgtcacctcctcaccccc

SEQ ID NO: 123242 - DNA, 34 bp, Artificial Sequence
  Synthetic oligonucleotide
tttgcatacccgccttttctctcgataccgagtc

SEQ ID NO: 123243 - DNA, 35 bp, Artificial Sequence
  Synthetic oligonucleotide
gcgcccgcccccatattgttcccctgtacgtcttc

SEQ ID NO: 123244 - DNA, 35 bp, Artificial Sequence
  Synthetic oligonucleotide
gttcagagtcactccgttttctctcacgcctcccg

SEQ ID NO: 123245 - DNA, 35 bp, Artificial Sequence
  Synthetic oligonucleotide
gcttcatctcactgctctattgtttcaccgttccg

SEQ ID NO: 123246 - DNA, 35 bp, Artificial Sequence
  Synthetic oligonucleotide
agtgggggaggggtggtgaatgaggattcctgggg

SEQ ID NO: 123247 - DNA, 35 bp, Artificial Sequence
  Synthetic oligonucleotide
actgactccaccgccatgtcccaattctgactttg

SEQ ID NO: 123248 - DNA, 35 bp, Artificial Sequence
  Synthetic oligonucleotide
ttctacacccccgcgttgaccgttttctcgtgcct

SEQ ID NO: 123249 - DNA, 36 bp, Artificial Sequence
  Synthetic oligonucleotide
gtaacaagaggggggggagatgagggagtacggaaa

SEQ ID NO: 123250 - DNA, 37 bp, Artificial Sequence
  Synthetic oligonucleotide
atccccgtcctctggttcgccacctcattatccatga

SEQ ID NO: 123251 - DNA, 37 bp, Artificial Sequence
  Synthetic oligonucleotide
acgctcaccagtggtctcactcacatccgctccctga

SEQ ID NO: 123252 - DNA, 37 bp, Artificial Sequence
  Synthetic oligonucleotide
gccgggtgggatcgggggggagagacaggtattgtga

SEQ ID NO: 123253 - DNA, 35 bp, Artificial Sequence
  Synthetic oligonucleotide
gcccaatccgctcaatcccgtccattcctacggta

SEQ ID NO: 123254 - DNA, 35 bp, Artificial Sequence
  Synthetic oligonucleotide
gattcgtccgaaccccccgtcccacagccgtgtcc

SEQ ID NO: 123255 - DNA, 35 bp, Artificial Sequence
  Synthetic oligonucleotide
tgtactatccggcctgtcacaaggtcgctcttcgc

SEQ ID NO: 123256 - DNA, 35 bp, Artificial Sequence
  Synthetic oligonucleotide
tatcacctcgcctgcaggtttcatctcctgtgctc

SEQ ID NO: 123257 - DNA, 35 bp, Artificial Sequence
  Synthetic oligonucleotide
tccatggcccctacacctttctcagtagcccgttc

SEQ ID NO: 123258 - DNA, 35 bp, Artificial Sequence
  Synthetic oligonucleotide
gtctacaccctcgccacccgccgtaacggttgttc

SEQ ID NO: 123259 - DNA, 35 bp, Artificial Sequence
  Synthetic oligonucleotide
acacagacgcttaccgacaccgcccgccctcaacg

SEQ ID NO: 123260 - DNA, 35 bp, Artificial Sequence
  Synthetic oligonucleotide
gagatcgagggggaggaagggaggggaaaacgagg

SEQ ID NO: 123261 - DNA, 35 bp, Artificial Sequence
  Synthetic oligonucleotide
gtgaccgtacggtctccacccccacccctgctgtg

SEQ ID NO: 123262 - DNA, 35 bp, Artificial Sequence
  Synthetic oligonucleotide
atccccgcccatctgcacgtccattacatttgtct

SEQ ID NO: 123263 - DNA, 35 bp, Artificial Sequence
  Synthetic oligonucleotide
ttcacccctgtggttctatggcctcacgctgcctt

SEQ ID NO: 123264 - DNA, 36 bp, Artificial Sequence
  Synthetic oligonucleotide
tgaaacaccttcattcccgacctctgccgccctgca

SEQ ID NO: 123265 - DNA, 37 bp, Artificial Sequence
  Synthetic oligonucleotide
accacgcatcctcgccccagacgaccccacccgcgga

SEQ ID NO: 123266 - DNA, 35 bp, Artificial Sequence
  Synthetic oligonucleotide
tctgtccttcctcactgctgttttattggtcttac

SEQ ID NO: 123267 - DNA, 35 bp, Artificial Sequence
  Synthetic oligonucleotide
gccaccccagtgccttggcccccgaccacgctgcc

SEQ ID NO: 123268 - DNA, 36 bp, Artificial Sequence
  Synthetic oligonucleotide
gctgcatgttcctttgtgtcccctacgtcccgctcc

SEQ ID NO: 123269 - DNA, 35 bp, Artificial Sequence
  Synthetic oligonucleotide
gattctcccgttgccttccgtgccacccaccacgc

SEQ ID NO: 123270 - DNA, 35 bp, Artificial Sequence
  Synthetic oligonucleotide
atggtcacaccatgccaagtgctttcccttcctgc

SEQ ID NO: 123271 - DNA, 35 bp, Artificial Sequence
  Synthetic oligonucleotide
ttaccaccccagccgtgccctagccgattctttgc

SEQ ID NO: 123272 - DNA, 35 bp, Artificial Sequence
  Synthetic oligonucleotide
actccataccgtttgttgcctccccgaacacccct

SEQ ID NO: 123273 - DNA, 35 bp, Artificial Sequence
  Synthetic oligonucleotide
tgccggtccatctggcagaatcacgcccttcctgt

SEQ ID NO: 123274 - DNA, 36 bp, Artificial Sequence
  Synthetic oligonucleotide
agtgccgcagccttgtcaactcacgttccccgcaca

SEQ ID NO: 123275 - DNA, 36 bp, Artificial Sequence
  Synthetic oligonucleotide
tcaacattcgcgcctcacgctgcgttcttctcccca

SEQ ID NO: 123276 - DNA, 36 bp, Artificial Sequence
  Synthetic oligonucleotide
gcatgccggcacctttgttactcgtccttctcatca

SEQ ID NO: 123277 - DNA, 37 bp, Artificial Sequence
  Synthetic oligonucleotide
tccaccgctctgcccataaatcagcgtttccacgcga

SEQ ID NO: 123278 - DNA, 36 bp, Artificial Sequence
  Synthetic oligonucleotide
gagggggaagcaagtggataaaggggggtgagcgga

SEQ ID NO: 123279 - DNA, 37 bp, Artificial Sequence
  Synthetic oligonucleotide
ttgccgacggcataaagggatggggagtgggggggga

SEQ ID NO: 123280 - DNA, 38 bp, Artificial Sequence
  Synthetic oligonucleotide
gacgaacgcctgaccgtgtggttcgctcctccccatga

SEQ ID NO: 123281 - DNA, 35 bp, Artificial Sequence
  Synthetic oligonucleotide
atcgaccgccctcccctgacttgtacccaggtacc

SEQ ID NO: 123282 - DNA, 35 bp, Artificial Sequence
  Synthetic oligonucleotide
acgtccaccacccctgcattacccaagtccttcgc

SEQ ID NO: 123283 - DNA, 35 bp, Artificial Sequence
  Synthetic oligonucleotide
tacccatcaggcgtatctttccgcctccgcttatc

SEQ ID NO: 123284 - DNA, 35 bp, Artificial Sequence
  Synthetic oligonucleotide
gggtggctggggggttttgcggatggcacatcgcg

SEQ ID NO: 123285 - DNA, 35 bp, Artificial Sequence
  Synthetic oligonucleotide
actgctcatccatttgccctctcgtcctccggtgg

SEQ ID NO: 123286 - DNA, 35 bp, Artificial Sequence
  Synthetic oligonucleotide
gatccaccgctattggcctacacgctacgagccat

SEQ ID NO: 123287 - DNA, 35 bp, Artificial Sequence
  Synthetic oligonucleotide
gcactgtccccgtttgtttccctggcaatgttcct

SEQ ID NO: 123288 - DNA, 35 bp, Artificial Sequence
  Synthetic oligonucleotide
tcgacatgtcgggcctcgcatttggttcctcccgt

SEQ ID NO: 123289 - DNA, 35 bp, Artificial Sequence
  Synthetic oligonucleotide
tacattccgccctgcaacacctccacctcaagggt

SEQ ID NO: 123290 - DNA, 35 bp, Artificial Sequence
  Synthetic oligonucleotide
acccccacgcacgatcttttgtgcctcgctttttt

SEQ ID NO: 123291 - DNA, 36 bp, Artificial Sequence
  Synthetic oligonucleotide
tcgaacaagcggtattcgcccccctcacccgctcca

SEQ ID NO: 123292 - DNA, 35 bp, Artificial Sequence
  Synthetic oligonucleotide
gaaggggaggggaggaaggccattttagggggtca

SEQ ID NO: 123293 - DNA, 36 bp, Artificial Sequence
  Synthetic oligonucleotide
tcagccctttatccgccgtgcttcaccgaccctgga

SEQ ID NO: 123294 - DNA, 37 bp, Artificial Sequence
  Synthetic oligonucleotide
tcccccggccccccctcgcgctgtacatgacctctga

SEQ ID NO: 123295 - DNA, 38 bp, Artificial Sequence
  Synthetic oligonucleotide
tgtgacgcacccttgcattttatcctcgccctccgtga

SEQ ID NO: 123296 - DNA, 38 bp, Artificial Sequence
  Synthetic oligonucleotide
aacggatggaggtggtacgaaggggctgggaatggtga

SEQ ID NO: 123297 - DNA, 36 bp, Artificial Sequence
  Synthetic oligonucleotide
acttggcctccggtgcctgtttcttgatcctgccta

SEQ ID NO: 123298 - DNA, 35 bp, Artificial Sequence
  Synthetic oligonucleotide
gtcacgtccttagttttgttcccgcccgcccatta

SEQ ID NO: 123299 - DNA, 35 bp, Artificial Sequence
  Synthetic oligonucleotide
acttccctgcccccatgcccggatcgcctctatgc

SEQ ID NO: 123300 - DNA, 35 bp, Artificial Sequence
  Synthetic oligonucleotide
agttccacactgctgcccctcctcgccgaaacacg

SEQ ID NO: 123301 - DNA, 35 bp, Artificial Sequence
  Synthetic oligonucleotide
ttcagcccggccctctctgtttgaatctaactctg

SEQ ID NO: 123302 - DNA, 35 bp, Artificial Sequence
  Synthetic oligonucleotide
tcgcaaacctctgacgtgtcatcacagcccctcca

SEQ ID NO: 123303 - DNA, 36 bp, Artificial Sequence
  Synthetic oligonucleotide
ttgtaggcgctaacccttgtctatttgtctcctcca

SEQ ID NO: 123304 - DNA, 36 bp, Artificial Sequence
  Synthetic oligonucleotide
attgccctcagcggtacctttccgcctctcgctcca

SEQ ID NO: 123305 - DNA, 35 bp, Artificial Sequence
  Synthetic oligonucleotide
gaggatgaaggggtgggggaggaggccgcgaacga

SEQ ID NO: 123306 - DNA, 35 bp, Artificial Sequence
  Synthetic oligonucleotide
tgtccgtcctccccaggtctcgttctccccgatta

SEQ ID NO: 123307 - DNA, 35 bp, Artificial Sequence
  Synthetic oligonucleotide
taagacctcacccgaccgcaacccgtttaatgtac

SEQ ID NO: 123308 - DNA, 35 bp, Artificial Sequence
  Synthetic oligonucleotide
aaccacactgcctcaatggtgtcatcatgtcctcc

SEQ ID NO: 123309 - DNA, 35 bp, Artificial Sequence
  Synthetic oligonucleotide
ttcatacgtcgcatgttggtctcttttccgtgtcc

SEQ ID NO: 123310 - DNA, 35 bp, Artificial Sequence
  Synthetic oligonucleotide
gttcgacatcttctctctgcgctcctgcttctagc

SEQ ID NO: 123311 - DNA, 35 bp, Artificial Sequence
  Synthetic oligonucleotide
agcccccctcctgtagtgaacttcactgacttctc

SEQ ID NO: 123312 - DNA, 35 bp, Artificial Sequence
  Synthetic oligonucleotide
gccggccgatcctagctgttcacctcgctccattc

SEQ ID NO: 123313 - DNA, 35 bp, Artificial Sequence
  Synthetic oligonucleotide
tcgttcacccccatcagctgtatcctccctgtgcg

SEQ ID NO: 123314 - DNA, 35 bp, Artificial Sequence
  Synthetic oligonucleotide
tttgccgcccctccgaccaaggcctccgacactcg

SEQ ID NO: 123315 - DNA, 35 bp, Artificial Sequence
  Synthetic oligonucleotide
agagacctacccatctgcacccgaacacccgttcg

SEQ ID NO: 123316 - DNA, 35 bp, Artificial Sequence
  Synthetic oligonucleotide
gaatcgggagatatagggtaggtgcgggaatgggg

SEQ ID NO: 123317 - DNA, 35 bp, Artificial Sequence
  Synthetic oligonucleotide
gcaacacccgcacctcttagccctgtcgttcactg

SEQ ID NO: 123318 - DNA, 36 bp, Artificial Sequence
  Synthetic oligonucleotide
gtccacccttttggcgtctaccatcttcgcctcctg

SEQ ID NO: 123319 - DNA, 33 bp, Artificial Sequence
  Synthetic oligonucleotide
gtctaccccgctcgctcacagtcgccgctcgaa

SEQ ID NO: 123320 - DNA, 36 bp, Artificial Sequence
  Synthetic oligonucleotide
tcacgtcgcacttatgctacttcgcccctccaagga

SEQ ID NO: 123321 - DNA, 35 bp, Artificial Sequence
  Synthetic oligonucleotide
tgtcccggtcgctcgctattacgctcttcactgta

SEQ ID NO: 123322 - DNA, 35 bp, Artificial Sequence
  Synthetic oligonucleotide
tgcgccctgtcgccccttgctaatttgcgctttgc

SEQ ID NO: 123323 - DNA, 35 bp, Artificial Sequence
  Synthetic oligonucleotide
gcgtccccccctgaccttttattgcccggatcctg

SEQ ID NO: 123324 - DNA, 35 bp, Artificial Sequence
  Synthetic oligonucleotide
tcagttgcgctaacttgccccgtatccagtcctct

SEQ ID NO: 123325 - DNA, 35 bp, Artificial Sequence
  Synthetic oligonucleotide
gtaggagggacatggagaggggaagcggaaatagt

SEQ ID NO: 123326 - DNA, 35 bp, Artificial Sequence
  Synthetic oligonucleotide
tccaccgcacgttccacccgccccattcctttggt

SEQ ID NO: 123327 - DNA, 35 bp, Artificial Sequence
  Synthetic oligonucleotide
ttgtgacaccttctgctaccctgatcccccctgtt

SEQ ID NO: 123328 - DNA, 36 bp, Artificial Sequence
  Synthetic oligonucleotide
agctcgccgcttgacccctcccactgtatcacttaa

SEQ ID NO: 123329 - DNA, 36 bp, Artificial Sequence
  Synthetic oligonucleotide
gtgggacggggggaacgggagtagagggttgacaca

SEQ ID NO: 123330 - DNA, 30 bp, Artificial Sequence
  Synthetic oligonucleotide
gtgccccctctattgctagatacttccgca

SEQ ID NO: 123331 - DNA, 37 bp, Artificial Sequence
  Synthetic oligonucleotide
atacctcgatctgctgtttccctagcgtgccccccga

SEQ ID NO: 123332 - DNA, 36 bp, Artificial Sequence
  Synthetic oligonucleotide
tcaccccaccctcgattaatcgcccgcatatgcgga

SEQ ID NO: 123333 - DNA, 38 bp, Artificial Sequence
  Synthetic oligonucleotide
agcgtggagggtccagggtgggtggaagggaggggtga

SEQ ID NO: 123334 - DNA, 35 bp, Artificial Sequence
  Synthetic oligonucleotide
gaactgcaggcacccgtccgtctttctgcgttatc

SEQ ID NO: 123335 - DNA, 34 bp, Artificial Sequence
  Synthetic oligonucleotide
acgctgcatcggccgcagagcgcactcccccgtc

SEQ ID NO: 123336 - DNA, 34 bp, Artificial Sequence
  Synthetic oligonucleotide
tcccagtaccagtctctattcccgccttcatgtc

SEQ ID NO: 123337 - DNA, 35 bp, Artificial Sequence
  Synthetic oligonucleotide
gctcgaatagaccaacaagcgtcatgccccttccg

SEQ ID NO: 123338 - DNA, 35 bp, Artificial Sequence
  Synthetic oligonucleotide
gttcgacgtcacccccagcctcaatctgccgccga

SEQ ID NO: 123339 - DNA, 35 bp, Artificial Sequence
  Synthetic oligonucleotide
gtgaaggggtaggaagggaacgacagggccggcga

SEQ ID NO: 123340 - DNA, 35 bp, Artificial Sequence
  Synthetic oligonucleotide
gttaccatagtgctgtttacgccgcccgattaccc

SEQ ID NO: 123341 - DNA, 35 bp, Artificial Sequence
  Synthetic oligonucleotide
actccgccctgtctcgggtctccgggttgctcccc

SEQ ID NO: 123342 - DNA, 35 bp, Artificial Sequence
  Synthetic oligonucleotide
actagccgtcgaatacctgccgacctcccatcgcc

SEQ ID NO: 123343 - DNA, 35 bp, Artificial Sequence
  Synthetic oligonucleotide
gtacgacacaacttcacacgttttatgcctggtcc

SEQ ID NO: 123344 - DNA, 35 bp, Artificial Sequence
  Synthetic oligonucleotide
gcccgcctcacccgctgccaaacagttacggttag

SEQ ID NO: 123345 - DNA, 35 bp, Artificial Sequence
  Synthetic oligonucleotide
tatggccccgtggtcaccgatcttacccccgctcg

SEQ ID NO: 123346 - DNA, 35 bp, Artificial Sequence
  Synthetic oligonucleotide
tgcgtacctgccccctgtttctgtattagttcgtg

SEQ ID NO: 123347 - DNA, 35 bp, Artificial Sequence
  Synthetic oligonucleotide
gtgaggtcggacgacatgacccctcactccaccct

SEQ ID NO: 123348 - DNA, 35 bp, Artificial Sequence
  Synthetic oligonucleotide
aagtcgccggtcagtctactcactcactgctcctt

SEQ ID NO: 123349 - DNA, 35 bp, Artificial Sequence
  Synthetic oligonucleotide
tcaccactcgttcctcattgggtcaccatccattt

SEQ ID NO: 123350 - DNA, 37 bp, Artificial Sequence
  Synthetic oligonucleotide
tgtaggaggggaaagaggacggaaaatcaggggagga

SEQ ID NO: 123351 - DNA, 35 bp, Artificial Sequence
  Synthetic oligonucleotide
ttggagccgtgggtggactggagcgggtgggggga

SEQ ID NO: 123352 - DNA, 38 bp, Artificial Sequence
  Synthetic oligonucleotide
accaccccaccctgtgcttgcgcttaagccaatcctga

SEQ ID NO: 123353 - DNA, 35 bp, Artificial Sequence
  Synthetic oligonucleotide
gagggccgggagtggacgggaaaaggaggggttga

SEQ ID NO: 123354 - DNA, 35 bp, Artificial Sequence
  Synthetic oligonucleotide
ctgctccagcttgccccgcctgagcccttccacta

SEQ ID NO: 123355 - DNA, 35 bp, Artificial Sequence
  Synthetic oligonucleotide
tggaaccgctccactgctcgcttagttccttcgac

SEQ ID NO: 123356 - DNA, 35 bp, Artificial Sequence
  Synthetic oligonucleotide
tacctcttcccgcgccacctctgttaggcccttac

SEQ ID NO: 123357 - DNA, 35 bp, Artificial Sequence
  Synthetic oligonucleotide
gttctcgcctcacgcctacgttttatgcttgttcc

SEQ ID NO: 123358 - DNA, 35 bp, Artificial Sequence
  Synthetic oligonucleotide
tcacgccgtcgcgcgataactgaaccgtgctttcc

SEQ ID NO: 123359 - DNA, 35 bp, Artificial Sequence
  Synthetic oligonucleotide
tcacctacaaaggtcctccacgccttcgccttcgc

SEQ ID NO: 123360 - DNA, 35 bp, Artificial Sequence
  Synthetic oligonucleotide
gcacgtacaaatctgccaccacgggtacgtcctgc

SEQ ID NO: 123361 - DNA, 35 bp, Artificial Sequence
  Synthetic oligonucleotide
gcgctccccccttatcgctgctccctgtccttacg

SEQ ID NO: 123362 - DNA, 35 bp, Artificial Sequence
  Synthetic oligonucleotide
tccccatgtgtccccatccagtctaccgtgtctcg

SEQ ID NO: 123363 - DNA, 35 bp, Artificial Sequence
  Synthetic oligonucleotide
gtcaccgggggagggatgggcggggtaaagcttat

SEQ ID NO: 123364 - DNA, 36 bp, Artificial Sequence
  Synthetic oligonucleotide
agcacctcaccctttgctggacgctgccatacacca

SEQ ID NO: 123365 - DNA, 37 bp, Artificial Sequence
  Synthetic oligonucleotide
gaggggaaggggtgtgagaatttggggagggggacga

SEQ ID NO: 123366 - DNA, 37 bp, Artificial Sequence
  Synthetic oligonucleotide
atctgatgcaggggggggaagggtagagggataggga

SEQ ID NO: 123367 - DNA, 38 bp, Artificial Sequence
  Synthetic oligonucleotide
gggtagggaacggagggaagcggggcctgaggaactga

SEQ ID NO: 123368 - DNA, 38 bp, Artificial Sequence
  Synthetic oligonucleotide
atacctgggatgtgtataaccaccccgccgctccctga

SEQ ID NO: 123369 - DNA, 38 bp, Artificial Sequence
  Synthetic oligonucleotide
atcgcacggaaagagatggggggcaggaggaggggtga

SEQ ID NO: 123370 - DNA, 37 bp, Artificial Sequence
  Synthetic oligonucleotide
acgcatccatcacatcatagtgcctcctctcatttga

SEQ ID NO: 123371 - DNA, 36 bp, Artificial Sequence
  Synthetic oligonucleotide
tcaatggggggaggatcgcaattgggagggtgggta

SEQ ID NO: 123372 - DNA, 36 bp, Artificial Sequence
  Synthetic oligonucleotide
tatcgtcgcacccgtctccccatgtctacgcgtcac

SEQ ID NO: 123373 - DNA, 35 bp, Artificial Sequence
  Synthetic oligonucleotide
gccaacatctagccacgtcctttctgctactctgc

SEQ ID NO: 123374 - DNA, 35 bp, Artificial Sequence
  Synthetic oligonucleotide
aatctcccccaccgccgcccgttttgtcgctcatc

SEQ ID NO: 123375 - DNA, 35 bp, Artificial Sequence
  Synthetic oligonucleotide
gttatcgtggcgccgtatctcttccttccgttggt

SEQ ID NO: 123376 - DNA, 36 bp, Artificial Sequence
  Synthetic oligonucleotide
tccgccctcgccctacgttgatcgccttaatatgca

SEQ ID NO: 123377 - DNA, 36 bp, Artificial Sequence
  Synthetic oligonucleotide
ttaccgcctcccgactatatacccagtttgttcgta

SEQ ID NO: 123378 - DNA, 35 bp, Artificial Sequence
  Synthetic oligonucleotide
ttctgtccagcccgtcgtacgcgcccccggtccac

SEQ ID NO: 123379 - DNA, 35 bp, Artificial Sequence
  Synthetic oligonucleotide
ttcgcaacttacgatacctgttcccgccattccgt

SEQ ID NO: 123380 - DNA, 35 bp, Artificial Sequence
  Synthetic oligonucleotide
gtggcccccgcacgttacatttccactttcccccc

SEQ ID NO: 123381 - DNA, 35 bp, Artificial Sequence
  Synthetic oligonucleotide
tatccgcgctatttccgtccatcctgcgggcttcc

SEQ ID NO: 123382 - DNA, 35 bp, Artificial Sequence
  Synthetic oligonucleotide
agctgtccagccggctatctaatctgaccctttcc

SEQ ID NO: 123383 - DNA, 34 bp, Artificial Sequence
  Synthetic oligonucleotide
gttcaacgctgttccctgtcgccctttcttcgtc

SEQ ID NO: 123384 - DNA, 35 bp, Artificial Sequence
  Synthetic oligonucleotide
agcccatgtcgcaccacctcccctttattaagcgg

SEQ ID NO: 123385 - DNA, 35 bp, Artificial Sequence
  Synthetic oligonucleotide
acgccacgtgaccgccgtactgctctcctccattg

SEQ ID NO: 123386 - DNA, 35 bp, Artificial Sequence
  Synthetic oligonucleotide
acagtgcttcctccgatcgttcgttcacatgcttt

SEQ ID NO: 123387 - DNA, 36 bp, Artificial Sequence
  Synthetic oligonucleotide
acccaccccattgcttgcagcaagaccttacctcca

SEQ ID NO: 123388 - DNA, 37 bp, Artificial Sequence
  Synthetic oligonucleotide
ttgccgatccgtcacactcgatgcccccgtttcccga

SEQ ID NO: 123389 - DNA, 36 bp, Artificial Sequence
  Synthetic oligonucleotide
tgttcccgcccttcatgcacctccacgtcctctcga

SEQ ID NO: 123390 - DNA, 37 bp, Artificial Sequence
  Synthetic oligonucleotide
tatatgaagcgccacgaacccccgccctcgccgtcga

SEQ ID NO: 123391 - DNA, 37 bp, Artificial Sequence
  Synthetic oligonucleotide
acctcggggggagctgggaaattagggggaataggga

SEQ ID NO: 123392 - DNA, 35 bp, Artificial Sequence
  Synthetic oligonucleotide
tccacgcccgtatctttattcacgctcccgcaacc

SEQ ID NO: 123393 - DNA, 35 bp, Artificial Sequence
  Synthetic oligonucleotide
tgccccgctctggcctctctcattgcttttgtacc

SEQ ID NO: 123394 - DNA, 35 bp, Artificial Sequence
  Synthetic oligonucleotide
tcaagagcgcttctcctgtcgtctggtgccccccc

SEQ ID NO: 123395 - DNA, 35 bp, Artificial Sequence
  Synthetic oligonucleotide
gtgccagggttcactgctatcacaaacctcccgcc

SEQ ID NO: 123396 - DNA, 35 bp, Artificial Sequence
  Synthetic oligonucleotide
tcccaactcatgccctcccactttgtctaaatgcc

SEQ ID NO: 123397 - DNA, 35 bp, Artificial Sequence
  Synthetic oligonucleotide
gctccactcgagaacgttcaccgagcatcctttcc

SEQ ID NO: 123398 - DNA, 35 bp, Artificial Sequence
  Synthetic oligonucleotide
tgtctgctgaccctgttctgcccaagctgcccctc

SEQ ID NO: 123399 - DNA, 35 bp, Artificial Sequence
  Synthetic oligonucleotide
atctatacggcacacgacctccctgcacccgtctc

SEQ ID NO: 123400 - DNA, 35 bp, Artificial Sequence
  Synthetic oligonucleotide
tttagcctccgctcctaggacctccccgcacctcg

SEQ ID NO: 123401 - DNA, 35 bp, Artificial Sequence
  Synthetic oligonucleotide
gattgcccctgcctttttctgacctagccccatgg

SEQ ID NO: 123402 - DNA, 36 bp, Artificial Sequence
  Synthetic oligonucleotide
acacgcccgctctacgtacgccctcgtccttcacca

SEQ ID NO: 123403 - DNA, 36 bp, Artificial Sequence
  Synthetic oligonucleotide
ttgcgcctcggccccgcttttggtcagctcttctca

SEQ ID NO: 123404 - DNA, 37 bp, Artificial Sequence
  Synthetic oligonucleotide
gccccatgccccgtacccactgttcatgtttcacgga

SEQ ID NO: 123405 - DNA, 38 bp, Artificial Sequence
  Synthetic oligonucleotide
tgggaccgcccccttgtttccgcctcccgtacacttga

SEQ ID NO: 123406 - DNA, 35 bp, Artificial Sequence
  Synthetic oligonucleotide
actctccgcctctattatgaccctctagttcgacc

SEQ ID NO: 123407 - DNA, 35 bp, Artificial Sequence
  Synthetic oligonucleotide
gtcattggtgactgcgtcctctgccttcgttcccc

SEQ ID NO: 123408 - DNA, 35 bp, Artificial Sequence
  Synthetic oligonucleotide
tagtccagcgcacgcttctatttcactgctttttc

SEQ ID NO: 123409 - DNA, 35 bp, Artificial Sequence
  Synthetic oligonucleotide
gacgccatccgccgcccgtttcaagctaccttcat

SEQ ID NO: 123410 - DNA, 37 bp, Artificial Sequence
  Synthetic oligonucleotide
aattgggggaaggaggtaaggagaaaggggcaacgga

SEQ ID NO: 123411 - DNA, 37 bp, Artificial Sequence
  Synthetic oligonucleotide
atacgaacgagggggacaaggaggaactggccgggga

SEQ ID NO: 123412 - DNA, 35 bp, Artificial Sequence
  Synthetic oligonucleotide
actctcagtcgccacacgcctaaatatgatgtcac

SEQ ID NO: 123413 - DNA, 35 bp, Artificial Sequence
  Synthetic oligonucleotide
ttccaccgcatatatcgagccgcctacttgccgac

SEQ ID NO: 123414 - DNA, 35 bp, Artificial Sequence
  Synthetic oligonucleotide
gttccctctagtcgtatcgatacacctcctcctac

SEQ ID NO: 123415 - DNA, 35 bp, Artificial Sequence
  Synthetic oligonucleotide
ttggagagtgggtggtagggttctggcaccactgg

SEQ ID NO: 123416 - DNA, 35 bp, Artificial Sequence
  Synthetic oligonucleotide
ggaggggccaggaaaggagtagggcagaagcgcat

SEQ ID NO: 123417 - DNA, 36 bp, Artificial Sequence
  Synthetic oligonucleotide
taccctgccccgtacaattagtctgtccccgaatca

SEQ ID NO: 123418 - DNA, 36 bp, Artificial Sequence
  Synthetic oligonucleotide
gccacttccctgctgtgcgctcctcctgccaaacta

SEQ ID NO: 123419 - DNA, 36 bp, Artificial Sequence
  Synthetic oligonucleotide
gaccctccgccaatcaggtcagctctccccctccta

SEQ ID NO: 123420 - DNA, 35 bp, Artificial Sequence
  Synthetic oligonucleotide
tcctcccccctgctagctgcttaacccccggccac

SEQ ID NO: 123421 - DNA, 35 bp, Artificial Sequence
  Synthetic oligonucleotide
tgcgagctccttgcttatccggatccccgtcgtcc

SEQ ID NO: 123422 - DNA, 35 bp, Artificial Sequence
  Synthetic oligonucleotide
aagcgcaacctcgcattcccttctctttgtggctc

SEQ ID NO: 123423 - DNA, 34 bp, Artificial Sequence
  Synthetic oligonucleotide
ttgcccccttcacattgaataccgatcttcttag

SEQ ID NO: 123424 - DNA, 35 bp, Artificial Sequence
  Synthetic oligonucleotide
gtccgtcccgtgcctgcatttgtctactgttctcg

SEQ ID NO: 123425 - DNA, 34 bp, Artificial Sequence
  Synthetic oligonucleotide
gccattctgcccggctgccccctagtcttacctg

SEQ ID NO: 123426 - DNA, 35 bp, Artificial Sequence
  Synthetic oligonucleotide
acacccgatgcgctccatggccctgcacctgctat

SEQ ID NO: 123427 - DNA, 36 bp, Artificial Sequence
  Synthetic oligonucleotide
acctcaccctgcccgatggtaccacacaacttccca

SEQ ID NO: 123428 - DNA, 36 bp, Artificial Sequence
  Synthetic oligonucleotide
tacctcgccgacctgacaatgtcttgttttttccca

SEQ ID NO: 123429 - DNA, 37 bp, Artificial Sequence
  Synthetic oligonucleotide
aaacggtgcatgaagggaaaacaaagggcgggataga

SEQ ID NO: 123430 - DNA, 37 bp, Artificial Sequence
  Synthetic oligonucleotide
ttcattcccacaccctcacatgccgtatctgttccga

SEQ ID NO: 123431 - DNA, 35 bp, Artificial Sequence
  Synthetic oligonucleotide
gagccaccccacctctgcgcactcttcgtatccta

SEQ ID NO: 123432 - DNA, 35 bp, Artificial Sequence
  Synthetic oligonucleotide
accattgccgcgtgttactcccgcccccgcctcac

SEQ ID NO: 123433 - DNA, 35 bp, Artificial Sequence
  Synthetic oligonucleotide
ttccccgacatctgcactccgcagagtacacctcc

SEQ ID NO: 123434 - DNA, 35 bp, Artificial Sequence
  Synthetic oligonucleotide
taggcgagcctctgctctcacgtaacccccgttcc

SEQ ID NO: 123435 - DNA, 35 bp, Artificial Sequence
  Synthetic oligonucleotide
gtcccactctatcccccgagtcttaagacgcactc

SEQ ID NO: 123436 - DNA, 35 bp, Artificial Sequence
  Synthetic oligonucleotide
agcatgacctgcactgctgcacgcccttgcccttc

SEQ ID NO: 123437 - DNA, 35 bp, Artificial Sequence
  Synthetic oligonucleotide
gatcgccgtattaccgtgccactttaccgtactgg

SEQ ID NO: 123438 - DNA, 35 bp, Artificial Sequence
  Synthetic oligonucleotide
tacgccgtagctacatcacgtctagtaccatcttg

SEQ ID NO: 123439 - DNA, 35 bp, Artificial Sequence
  Synthetic oligonucleotide
gatcctccccggccttcctccgtttctgtacctat

SEQ ID NO: 123440 - DNA, 35 bp, Artificial Sequence
  Synthetic oligonucleotide
agacggcgctgcatccctgctgtctttgcttccct

SEQ ID NO: 123441 - DNA, 35 bp, Artificial Sequence
  Synthetic oligonucleotide
gcactcccccgctcttcatccggaccaatgactgt

SEQ ID NO: 123442 - DNA, 37 bp, Artificial Sequence
  Synthetic oligonucleotide
gggagatggggtgagcacgaaggggacaagggggaga

SEQ ID NO: 123443 - DNA, 37 bp, Artificial Sequence
  Synthetic oligonucleotide
gagtgaggtacgaggggcgtgggggggcacacaagga

SEQ ID NO: 123444 - DNA, 36 bp, Artificial Sequence
  Synthetic oligonucleotide
gcaacccccccctgcgagtcccctgcttcctgcgga

SEQ ID NO: 123445 - DNA, 38 bp, Artificial Sequence
  Synthetic oligonucleotide
tccaccactcacatattgtttaccccgtcgctcactga

SEQ ID NO: 123446 - DNA, 36 bp, Artificial Sequence
  Synthetic oligonucleotide
tggattcatcacctctgcctgtttgcctctgtacta

SEQ ID NO: 123447 - DNA, 35 bp, Artificial Sequence
  Synthetic oligonucleotide
actgcccaatcactatttcaaaatggcctcttcac

SEQ ID NO: 123448 - DNA, 35 bp, Artificial Sequence
  Synthetic oligonucleotide
acaacggggagaagggcggggccgataggggggac

SEQ ID NO: 123449 - DNA, 35 bp, Artificial Sequence
  Synthetic oligonucleotide
atgtgttacccatcggttcccagcccctccctacg

SEQ ID NO: 123450 - DNA, 35 bp, Artificial Sequence
  Synthetic oligonucleotide
ggggggagggcgaggcgaggtctagtaggcggcat

SEQ ID NO: 123451 - DNA, 35 bp, Artificial Sequence
  Synthetic oligonucleotide
aacacgccctctgccctcactagaccgcttttaca

SEQ ID NO: 123452 - DNA, 36 bp, Artificial Sequence
  Synthetic oligonucleotide
tgctatcacgcacgtgacattaggttactcccccca

SEQ ID NO: 123453 - DNA, 36 bp, Artificial Sequence
  Synthetic oligonucleotide
gaaaaagggaagggaagatatagcggaacggggaga

SEQ ID NO: 123454 - DNA, 37 bp, Artificial Sequence
  Synthetic oligonucleotide
aaccagcccctagcgttgtcaaaattccatcccccga

SEQ ID NO: 123455 - DNA, 37 bp, Artificial Sequence
  Synthetic oligonucleotide
tcaagtgaatcgatactcacttggggctttaggtgga

SEQ ID NO: 123456 - DNA, 38 bp, Artificial Sequence
  Synthetic oligonucleotide
gtccatgcatccccccctcacgccacagccagacatga

SEQ ID NO: 123457 - DNA, 38 bp, Artificial Sequence
  Synthetic oligonucleotide
tcagcccgggggagggatgggagggtacttaattgtga

SEQ ID NO: 123458 - DNA, 35 bp, Artificial Sequence
  Synthetic oligonucleotide
tccgtaacatcctgcgatcgagtttggcgccctac

SEQ ID NO: 123459 - DNA, 35 bp, Artificial Sequence
  Synthetic oligonucleotide
gccctgttccctaggtcctattacacagtaccttc

SEQ ID NO: 123460 - DNA, 35 bp, Artificial Sequence
  Synthetic oligonucleotide
taaaatgggtcacggggggcaaggggcgaggtggg

SEQ ID NO: 123461 - DNA, 35 bp, Artificial Sequence
  Synthetic oligonucleotide
agcctcccttaccgttctgttccgtgctgtgccct

SEQ ID NO: 123462 - DNA, 37 bp, Artificial Sequence
  Synthetic oligonucleotide
gtagcactgccgctcccgtttaccacccacttggtga

SEQ ID NO: 123463 - DNA, 35 bp, Artificial Sequence
  Synthetic oligonucleotide
accacccattcacccctaagagactgcgcatcacc

SEQ ID NO: 123464 - DNA, 35 bp, Artificial Sequence
  Synthetic oligonucleotide
gtgcttggtcccgcctgatgtactcaccgtccccc

SEQ ID NO: 123465 - DNA, 35 bp, Artificial Sequence
  Synthetic oligonucleotide
aagaccggggtacgagggtgggtgggtggaggccc

SEQ ID NO: 123466 - DNA, 35 bp, Artificial Sequence
  Synthetic oligonucleotide
gtcttaccctactgttgcgcataaccgtacttgcc

SEQ ID NO: 123467 - DNA, 35 bp, Artificial Sequence
  Synthetic oligonucleotide
tactacgcgatcatagcgtagatttctcactttcc

SEQ ID NO: 123468 - DNA, 35 bp, Artificial Sequence
  Synthetic oligonucleotide
acagactgacgcacaccgaacgtgtttcctctctc

SEQ ID NO: 123469 - DNA, 35 bp, Artificial Sequence
  Synthetic oligonucleotide
tcgtgcaccccccctcccgtagtgtcttttgttct

SEQ ID NO: 123470 - DNA, 36 bp, Artificial Sequence
  Synthetic oligonucleotide
tatgcacgcctttctgctaccccgtttccgtttcga

SEQ ID NO: 123471 - DNA, 37 bp, Artificial Sequence
  Synthetic oligonucleotide
ggagaacacgggcagattagggggtgggggaggagga

SEQ ID NO: 123472 - DNA, 37 bp, Artificial Sequence
  Synthetic oligonucleotide
gcacgtgaatgcgggcggaagggtggggcaatttgga

SEQ ID NO: 123473 - DNA, 36 bp, Artificial Sequence
  Synthetic oligonucleotide
aaacgaggtggggaaagccgggagggatggggcata

SEQ ID NO: 123474 - DNA, 35 bp, Artificial Sequence
  Synthetic oligonucleotide
gcgacccagccccatcccaatgtcctgcgccctgc

SEQ ID NO: 123475 - DNA, 35 bp, Artificial Sequence
  Synthetic oligonucleotide
gttcaccatcagtatgccgtccttcctttcagtcg

SEQ ID NO: 123476 - DNA, 35 bp, Artificial Sequence
  Synthetic oligonucleotide
tgtgagagcatatgggtggagtgggagggggttcg

SEQ ID NO: 123477 - DNA, 35 bp, Artificial Sequence
  Synthetic oligonucleotide
accaaccccgacctcctgtaactacgatctgtaat

SEQ ID NO: 123478 - DNA, 35 bp, Artificial Sequence
  Synthetic oligonucleotide
tccacacctgccacagcgcccgtaaacccttccct

SEQ ID NO: 123479 - DNA, 35 bp, Artificial Sequence
  Synthetic oligonucleotide
gaggggtgcggggaatgggagatgggtgatcagct

SEQ ID NO: 123480 - DNA, 35 bp, Artificial Sequence
  Synthetic oligonucleotide
tgatacgccgttgtgccacccttatgtagtcctgt

SEQ ID NO: 123481 - DNA, 34 bp, Artificial Sequence
  Synthetic oligonucleotide
aaccccgcccccctctccagacgcctttgagtgt

SEQ ID NO: 123482 - DNA, 36 bp, Artificial Sequence
  Synthetic oligonucleotide
attctcaccgctcgatgcccacccttagccgcccca

SEQ ID NO: 123483 - DNA, 35 bp, Artificial Sequence
  Synthetic oligonucleotide
gccgccacccgattcgatctctcgctgattttcca

SEQ ID NO: 123484 - DNA, 35 bp, Artificial Sequence
  Synthetic oligonucleotide
attgagcgtaggggggcggggtctaggggggagca

SEQ ID NO: 123485 - DNA, 37 bp, Artificial Sequence
  Synthetic oligonucleotide
gatgccccgctcacatgcatcttatttttcctcccga

SEQ ID NO: 123486 - DNA, 37 bp, Artificial Sequence
  Synthetic oligonucleotide
agaccgtcccagtcgtcttacccatcctaccgcgtga

SEQ ID NO: 123487 - DNA, 38 bp, Artificial Sequence
  Synthetic oligonucleotide
aacaccagacatcgcgatcgtcttatccgcctccttga

SEQ ID NO: 123488 - DNA, 38 bp, Artificial Sequence
  Synthetic oligonucleotide
tgcccaatctggtgctattaactcgccttcccctttga

SEQ ID NO: 123489 - DNA, 35 bp, Artificial Sequence
  Synthetic oligonucleotide
tctgccttcacgttcgccgcctgcataactctcac

SEQ ID NO: 123490 - DNA, 35 bp, Artificial Sequence
  Synthetic oligonucleotide
tgcccaccaagactcctgcttacgtactgaatacc

SEQ ID NO: 123491 - DNA, 35 bp, Artificial Sequence
  Synthetic oligonucleotide
atagccggcccatctccccgacagtctcagccgcc

SEQ ID NO: 123492 - DNA, 35 bp, Artificial Sequence
  Synthetic oligonucleotide
ttcacccgcccctatctgtcacaaccgcgaatctg

SEQ ID NO: 123493 - DNA, 35 bp, Artificial Sequence
  Synthetic oligonucleotide
accacgcccacccagtgagccgccacactcttaaa

SEQ ID NO: 123494 - DNA, 36 bp, Artificial Sequence
  Synthetic oligonucleotide
gtgcgcattgccctgacatagcccgcccccctcgaa

SEQ ID NO: 123495 - DNA, 36 bp, Artificial Sequence
  Synthetic oligonucleotide
tctcaacagcacccgttgcccatcaccttctcctga

SEQ ID NO: 123496 - DNA, 38 bp, Artificial Sequence
  Synthetic oligonucleotide
tgctcccgtgcacctgcgctaatcccggttctctttga

SEQ ID NO: 123497 - DNA, 36 bp, Artificial Sequence
  Synthetic oligonucleotide
tcgagactcccgccatcccttcaatagctgccttta

SEQ ID NO: 123498 - DNA, 35 bp, Artificial Sequence
  Synthetic oligonucleotide
tgtgaaacccccgtgatcgttcgtcgcccgctgcc

SEQ ID NO: 123499 - DNA, 35 bp, Artificial Sequence
  Synthetic oligonucleotide
tcattgcgtcacaccgcgctctttcccgttccgtc

SEQ ID NO: 123500 - DNA, 35 bp, Artificial Sequence
  Synthetic oligonucleotide
ggagaggggtctggccgggggacgtagagggaggg

SEQ ID NO: 123501 - DNA, 35 bp, Artificial Sequence
  Synthetic oligonucleotide
tgcactcatcacaccgggtctacgcttcttgggct

SEQ ID NO: 123502 - DNA, 35 bp, Artificial Sequence
  Synthetic oligonucleotide
ccggggtggggtaagacacgtggggataaaggggt

SEQ ID NO: 123503 - DNA, 36 bp, Artificial Sequence
  Synthetic oligonucleotide
gtgggctagcggtaacgtggggaggagggagggaga

SEQ ID NO: 123504 - DNA, 35 bp, Artificial Sequence
  Synthetic oligonucleotide
gggaggtgaagggaggatggcggagttggagtaga

SEQ ID NO: 123505 - DNA, 37 bp, Artificial Sequence
  Synthetic oligonucleotide
accgcctgtacgtcctcgctccccattccggacccga

SEQ ID NO: 123506 - DNA, 36 bp, Artificial Sequence
  Synthetic oligonucleotide
gccgacacagtgtcttaaacacacgcgccccctcta

SEQ ID NO: 123507 - DNA, 36 bp, Artificial Sequence
  Synthetic oligonucleotide
tccccacatgcgatcgctctcgtttcttcgccctta

SEQ ID NO: 123508 - DNA, 35 bp, Artificial Sequence
  Synthetic oligonucleotide
gcccttcctgacccgcgtttaaagtcacccacacc

SEQ ID NO: 123509 - DNA, 35 bp, Artificial Sequence
  Synthetic oligonucleotide
gacctccctaggattatcagactgtcccttgtccc

SEQ ID NO: 123510 - DNA, 35 bp, Artificial Sequence
  Synthetic oligonucleotide
gacccctccacccgagcattaaacccgccgaaacg

SEQ ID NO: 123511 - DNA, 35 bp, Artificial Sequence
  Synthetic oligonucleotide
gtgaggctcggtgtagatcgatctttccccccctg

SEQ ID NO: 123512 - DNA, 35 bp, Artificial Sequence
  Synthetic oligonucleotide
tgcctagccgcttccctccaccgtgttatccacgt

SEQ ID NO: 123513 - DNA, 35 bp, Artificial Sequence
  Synthetic oligonucleotide
tcacattacgaggagtattatcgtcgccccccctt

SEQ ID NO: 123514 - DNA, 35 bp, Artificial Sequence
  Synthetic oligonucleotide
gcgcactccgtcgggtccgtctctcgtggttggtt

SEQ ID NO: 123515 - DNA, 37 bp, Artificial Sequence
  Synthetic oligonucleotide
gacaagagcactgccactgtagccactcgccccccga

SEQ ID NO: 123516 - DNA, 37 bp, Artificial Sequence
  Synthetic oligonucleotide
attgccaccacacctgttgctaaccctagtctctcga

SEQ ID NO: 123517 - DNA, 35 bp, Artificial Sequence
  Synthetic oligonucleotide
tgcccccccccggcttagcagaaagcttcccttga

SEQ ID NO: 123518 - DNA, 36 bp, Artificial Sequence
  Synthetic oligonucleotide
gagagcggtgggaggtcgggggggagtgggacctta

SEQ ID NO: 123519 - DNA, 35 bp, Artificial Sequence
  Synthetic oligonucleotide
ttccaaccacggatccccccactaaggccgccccc

SEQ ID NO: 123520 - DNA, 35 bp, Artificial Sequence
  Synthetic oligonucleotide
tccgaccttccgtactgctttgcagagtttgctcc

SEQ ID NO: 123521 - DNA, 35 bp, Artificial Sequence
  Synthetic oligonucleotide
gccgcttcagctgaccgctcccccatgtctggttc

SEQ ID NO: 123522 - DNA, 35 bp, Artificial Sequence
  Synthetic oligonucleotide
tctgaccgtcgcctgcccttctaccgctgaccgag

SEQ ID NO: 123523 - DNA, 35 bp, Artificial Sequence
  Synthetic oligonucleotide
ttgcctgccatgccgttcggtccatctacacttct

SEQ ID NO: 123524 - DNA, 35 bp, Artificial Sequence
  Synthetic oligonucleotide
gtccctccagtccccgcgttcctccgccttccgaa

SEQ ID NO: 123525 - DNA, 35 bp, Artificial Sequence
  Synthetic oligonucleotide
tatggacaccccacaccctgctagacacactttaa

SEQ ID NO: 123526 - DNA, 36 bp, Artificial Sequence
  Synthetic oligonucleotide
acacgtgctatacgtcacctcatctcccgcacccga

SEQ ID NO: 123527 - DNA, 37 bp, Artificial Sequence
  Synthetic oligonucleotide
tatgcacagatgtccgatcctccccctcccgagccga

SEQ ID NO: 123528 - DNA, 37 bp, Artificial Sequence
  Synthetic oligonucleotide
gggggacggaggaaatagggacggtaagggggccgga

SEQ ID NO: 123529 - DNA, 38 bp, Artificial Sequence
  Synthetic oligonucleotide
acaccgcaccatctgtagcgcctaacccctcatcgtga

SEQ ID NO: 123530 - DNA, 35 bp, Artificial Sequence
  Synthetic oligonucleotide
gacccggacagcccgcctgtgccctttcccttcta

SEQ ID NO: 123531 - DNA, 35 bp, Artificial Sequence
  Synthetic oligonucleotide
tgtgtcctgccatcgccgtcgcctctctttctcac

SEQ ID NO: 123532 - DNA, 35 bp, Artificial Sequence
  Synthetic oligonucleotide
gccacctccacccgcccccatagtatatttgtacc

SEQ ID NO: 123533 - DNA, 35 bp, Artificial Sequence
  Synthetic oligonucleotide
gagccaccactgccacagccccgtaaaacactgtc

SEQ ID NO: 123534 - DNA, 35 bp, Artificial Sequence
  Synthetic oligonucleotide
gaggatgagccaaggggtaagggcggatggtggag

SEQ ID NO: 123535 - DNA, 35 bp, Artificial Sequence
  Synthetic oligonucleotide
atgaacgccccccccagaccctgactcgccttgtg

SEQ ID NO: 123536 - DNA, 35 bp, Artificial Sequence
  Synthetic oligonucleotide
ttccacgtaggccagttacgccatcacgctctcct

SEQ ID NO: 123537 - DNA, 35 bp, Artificial Sequence
  Synthetic oligonucleotide
agagacgggcgggtcctagggaggggttatggtct

SEQ ID NO: 123538 - DNA, 35 bp, Artificial Sequence
  Synthetic oligonucleotide
tagtcaccaccagcgttttcggacctatcccttct

SEQ ID NO: 123539 - DNA, 35 bp, Artificial Sequence
  Synthetic oligonucleotide
tccctcctcgccgtgttactatcatgggcctgttt

SEQ ID NO: 123540 - DNA, 35 bp, Artificial Sequence
  Synthetic oligonucleotide
ttctaccgccggaaatgtaccgcgccttctctcga

SEQ ID NO: 123541 - DNA, 36 bp, Artificial Sequence
  Synthetic oligonucleotide
gagtcacgtgggggggaatgagatggaatgtgggga

SEQ ID NO: 123542 - DNA, 37 bp, Artificial Sequence
  Synthetic oligonucleotide
tcactgtgcctgccccatcccccacttctcttgtgga

SEQ ID NO: 123543 - DNA, 38 bp, Artificial Sequence
  Synthetic oligonucleotide
tcaacccagctgtcgccctatccctgcaccacccatga

SEQ ID NO: 123544 - DNA, 37 bp, Artificial Sequence
  Synthetic oligonucleotide
atcaccgacatagcgtcatgcacccccgctcccctga

SEQ ID NO: 123545 - DNA, 38 bp, Artificial Sequence
  Synthetic oligonucleotide
actgggtggggggggtaagggtctcatacgcacggtga

SEQ ID NO: 123546 - DNA, 35 bp, Artificial Sequence
  Synthetic oligonucleotide
tgccagtcagtcttaatcctggttattcctcgccc

SEQ ID NO: 123547 - DNA, 35 bp, Artificial Sequence
  Synthetic oligonucleotide
gggaggtggggaattgggggtggaggagcattagc

SEQ ID NO: 123548 - DNA, 35 bp, Artificial Sequence
  Synthetic oligonucleotide
atggggggacacgggggggcatggtggcggactgc

SEQ ID NO: 123549 - DNA, 35 bp, Artificial Sequence
  Synthetic oligonucleotide
tcctactgcaccaccgcggttcgcatagcccactc

SEQ ID NO: 123550 - DNA, 35 bp, Artificial Sequence
  Synthetic oligonucleotide
gaccggtcaccgctccactactagcttgctccctc

SEQ ID NO: 123551 - DNA, 35 bp, Artificial Sequence
  Synthetic oligonucleotide
ttccacaacagaccgtcccggacgctttcttcctc

SEQ ID NO: 123552 - DNA, 35 bp, Artificial Sequence
  Synthetic oligonucleotide
gtaccaccaatgttttaaccgtcgcctgaccgccg

SEQ ID NO: 123553 - DNA, 35 bp, Artificial Sequence
  Synthetic oligonucleotide
ttgtccacctcaactggtttgcttctttcattctg

SEQ ID NO: 123554 - DNA, 35 bp, Artificial Sequence
  Synthetic oligonucleotide
tagcaccatgacacctgcccgcttatccccctgca

SEQ ID NO: 123555 - DNA, 37 bp, Artificial Sequence
  Synthetic oligonucleotide
atgagcggccgtacgaagggggtgggaggggcaacga

SEQ ID NO: 123556 - DNA, 37 bp, Artificial Sequence
  Synthetic oligonucleotide
tgtgccgacgttccatcgtgttcacctgcttcgacga

SEQ ID NO: 123557 - DNA, 37 bp, Artificial Sequence
  Synthetic oligonucleotide
atggagagcgggagggtgggttagcggagcttaatga

SEQ ID NO: 123558 - DNA, 38 bp, Artificial Sequence
  Synthetic oligonucleotide
gtggaggagggcgggggtggagggggcgtaaaacgtga

SEQ ID NO: 123559 - DNA, 35 bp, Artificial Sequence
  Synthetic oligonucleotide
gttcgaccccgccttgttctttcaaccttcagtac

SEQ ID NO: 123560 - DNA, 35 bp, Artificial Sequence
  Synthetic oligonucleotide
aacacctcaccgctccacttgcctgtaaaatgtcc

SEQ ID NO: 123561 - DNA, 35 bp, Artificial Sequence
  Synthetic oligonucleotide
accagtacccgctgcataacatctggactacacgc

SEQ ID NO: 123562 - DNA, 35 bp, Artificial Sequence
  Synthetic oligonucleotide
gagcctgtgtctcccatgcgcctccatcccttatc

SEQ ID NO: 123563 - DNA, 35 bp, Artificial Sequence
  Synthetic oligonucleotide
aaaccgtcactcgggcaaagggagggggggagacg

SEQ ID NO: 123564 - DNA, 35 bp, Artificial Sequence
  Synthetic oligonucleotide
atccctgcgctactgaacttcccgtccccacctcg

SEQ ID NO: 123565 - DNA, 35 bp, Artificial Sequence
  Synthetic oligonucleotide
gccctgtactccactcgccgtccgcgcgccctaat

SEQ ID NO: 123566 - DNA, 36 bp, Artificial Sequence
  Synthetic oligonucleotide
accacgccctgctctcctttgtggtcgttctcatca

SEQ ID NO: 123567 - DNA, 38 bp, Artificial Sequence
  Synthetic oligonucleotide
tgcatccccgagctagcgtaattaatcgccctgcctga

SEQ ID NO: 123568 - DNA, 35 bp, Artificial Sequence
  Synthetic oligonucleotide
actgacatcccgacaggatccgtttctcccctcta

SEQ ID NO: 123569 - DNA, 35 bp, Artificial Sequence
  Synthetic oligonucleotide
aaaggggggaaggtcggggaagtgcgagatgtcag

SEQ ID NO: 123570 - DNA, 35 bp, Artificial Sequence
  Synthetic oligonucleotide
gaaggcccagaccccttgcttacccttgaccctcg

SEQ ID NO: 123571 - DNA, 35 bp, Artificial Sequence
  Synthetic oligonucleotide
agcgatcaactccggcaccaccctttaccatcctg

SEQ ID NO: 123572 - DNA, 35 bp, Artificial Sequence
  Synthetic oligonucleotide
atgcgcccccagctcttttcctgtaatctcgcgct

SEQ ID NO: 123573 - DNA, 36 bp, Artificial Sequence
  Synthetic oligonucleotide
gcgaccgacgccccacttcaccctcgcctgccggaa

SEQ ID NO: 123574 - DNA, 35 bp, Artificial Sequence
  Synthetic oligonucleotide
gagaccccgtcgccgcacccccgcctgtccttcca

SEQ ID NO: 123575 - DNA, 37 bp, Artificial Sequence
  Synthetic oligonucleotide
gtcgcgatgcctacgatgtctcccgccgctcccacga

SEQ ID NO: 123576 - DNA, 37 bp, Artificial Sequence
  Synthetic oligonucleotide
taccgcccgcctctcctttccggtcttgcttgaccga

SEQ ID NO: 123577 - DNA, 37 bp, Artificial Sequence
  Synthetic oligonucleotide
acgccggtgtggagcggggaaaggaacgggatagcga

SEQ ID NO: 123578 - DNA, 36 bp, Artificial Sequence
  Synthetic oligonucleotide
ggtgggaggtgaaggacaggaggcgatgacgaggga

SEQ ID NO: 123579 - DNA, 37 bp, Artificial Sequence
  Synthetic oligonucleotide
tgacataccgccactcggtttccaacatctcccctga

SEQ ID NO: 123580 - DNA, 38 bp, Artificial Sequence
  Synthetic oligonucleotide
accgcgcgggagggatgggtgggaatgcaacgaagtga

SEQ ID NO: 123581 - DNA, 36 bp, Artificial Sequence
  Synthetic oligonucleotide
gcagaaccatcaccatctgcattctagaaccaccta

SEQ ID NO: 123582 - DNA, 35 bp, Artificial Sequence
  Synthetic oligonucleotide
gttgtgggtgcagccttgtatcgcccgtctccacc

SEQ ID NO: 123583 - DNA, 35 bp, Artificial Sequence
  Synthetic oligonucleotide
gcctccacgcaggtgcatcagccgctcgccctacc

SEQ ID NO: 123584 - DNA, 35 bp, Artificial Sequence
  Synthetic oligonucleotide
agcacgcttcggagtaccccgtggtctgcccctcc

SEQ ID NO: 123585 - DNA, 35 bp, Artificial Sequence
  Synthetic oligonucleotide
ttccacctgtcatgctactatcctgccggccaatc

SEQ ID NO: 123586 - DNA, 35 bp, Artificial Sequence
  Synthetic oligonucleotide
gacgcgctatccgctgagccacttcatgattcctc

SEQ ID NO: 123587 - DNA, 30 bp, Artificial Sequence
  Synthetic oligonucleotide
agtccactgcacccccgacccctatactcg

SEQ ID NO: 123588 - DNA, 35 bp, Artificial Sequence
  Synthetic oligonucleotide
tctatggcagtcagttatctccgtccttcaccctg

SEQ ID NO: 123589 - DNA, 35 bp, Artificial Sequence
  Synthetic oligonucleotide
tttgccgacccgttgtccccccatgcccgctattg

SEQ ID NO: 123590 - DNA, 35 bp, Artificial Sequence
  Synthetic oligonucleotide
tctccaccgccacgcctccgttccggaccattcat

SEQ ID NO: 123591 - DNA, 34 bp, Artificial Sequence
  Synthetic oligonucleotide
ttacgtgcgtatgtccttcttgttcgcctgttct

SEQ ID NO: 123592 - DNA, 36 bp, Artificial Sequence
  Synthetic oligonucleotide
accccgcgcccccccgcctacgtcgccgtgagtgca

SEQ ID NO: 123593 - DNA, 37 bp, Artificial Sequence
  Synthetic oligonucleotide
aagccctctgcatagcctgttttgttccgtttcccga

SEQ ID NO: 123594 - DNA, 37 bp, Artificial Sequence
  Synthetic oligonucleotide
ggggtcgggaaggaggagggagtgtgggggtcgcgga

SEQ ID NO: 123595 - DNA, 38 bp, Artificial Sequence
  Synthetic oligonucleotide
tgacacggggttttgatgggggagggatggacgggtga

SEQ ID NO: 123596 - DNA, 35 bp, Artificial Sequence
  Synthetic oligonucleotide
gcgccttcactgtccgtagcccatgtcccccttac

SEQ ID NO: 123597 - DNA, 35 bp, Artificial Sequence
  Synthetic oligonucleotide
tatgcccctcttcatcctgaggtacgaagcacacc

SEQ ID NO: 123598 - DNA, 35 bp, Artificial Sequence
  Synthetic oligonucleotide
tgggtcaccatcacgatgatccgctccatctatcc

SEQ ID NO: 123599 - DNA, 35 bp, Artificial Sequence
  Synthetic oligonucleotide
gcattgcctcgtcctagtctcctgctttctacctc

SEQ ID NO: 123600 - DNA, 35 bp, Artificial Sequence
  Synthetic oligonucleotide
tgccgacccgctcctgacctagctcattgctcctt

SEQ ID NO: 123601 - DNA, 35 bp, Artificial Sequence
  Synthetic oligonucleotide
gtccgatcttgcctgttcttcttgtagcccctctt

SEQ ID NO: 123602 - DNA, 35 bp, Artificial Sequence
  Synthetic oligonucleotide
tactcccggccatgtatggtccccgtttactttca

SEQ ID NO: 123603 - DNA, 37 bp, Artificial Sequence
  Synthetic oligonucleotide
tcacgacagcagtactactacctcccatctatgccga

SEQ ID NO: 123604 - DNA, 36 bp, Artificial Sequence
  Synthetic oligonucleotide
taccgcctcccttcacacacagtgccgttcccgtga

SEQ ID NO: 123605 - DNA, 37 bp, Artificial Sequence
  Synthetic oligonucleotide
gcgataagggaggaggcggggcggtcggtggctgata

SEQ ID NO: 123606 - DNA, 35 bp, Artificial Sequence
  Synthetic oligonucleotide
gtccaccccctcacatgtacgtttttacgctcacc

SEQ ID NO: 123607 - DNA, 35 bp, Artificial Sequence
  Synthetic oligonucleotide
atgcctaccccccatatatacccatgacactcggc

SEQ ID NO: 123608 - DNA, 35 bp, Artificial Sequence
  Synthetic oligonucleotide
ggtcctactgttgccgttcgtttccctgcacctgc

SEQ ID NO: 123609 - DNA, 35 bp, Artificial Sequence
  Synthetic oligonucleotide
tccgacgttatcgacgcgttaccatctcacacctg

SEQ ID NO: 123610 - DNA, 35 bp, Artificial Sequence
  Synthetic oligonucleotide
accatcacaatgttgctcgatctctctttttgcct

SEQ ID NO: 123611 - DNA, 36 bp, Artificial Sequence
  Synthetic oligonucleotide
ggagagggttggagttgggcggtggggcggagagaa

SEQ ID NO: 123612 - DNA, 35 bp, Artificial Sequence
  Synthetic oligonucleotide
accccccccctccgctccagtagttcgcccttgaa

SEQ ID NO: 123613 - DNA, 36 bp, Artificial Sequence
  Synthetic oligonucleotide
gactcacgatggtaatgtttgctctgcccgccgcca

SEQ ID NO: 123614 - DNA, 35 bp, Artificial Sequence
  Synthetic oligonucleotide
acacccccgcctgcaatgcttgcagtttgttttca

SEQ ID NO: 123615 - DNA, 35 bp, Artificial Sequence
  Synthetic oligonucleotide
gcctcatgccaacacatctgtctccgctccctaga

SEQ ID NO: 123616 - DNA, 36 bp, Artificial Sequence
  Synthetic oligonucleotide
gtcccgggcctcctttgtactcacgtctttctccga

SEQ ID NO: 123617 - DNA, 37 bp, Artificial Sequence
  Synthetic oligonucleotide
tccccccgatcccttggtaccccagaccacgcctcga

SEQ ID NO: 123618 - DNA, 35 bp, Artificial Sequence
  Synthetic oligonucleotide
tcaactccctggctatgatcccctcctccaacgga

SEQ ID NO: 123619 - DNA, 37 bp, Artificial Sequence
  Synthetic oligonucleotide
ggagttagagacggggagaaaaggcaggtggagcgga

SEQ ID NO: 123620 - DNA, 35 bp, Artificial Sequence
  Synthetic oligonucleotide
ggaagggaataggggaaatggagagatgggtggga

SEQ ID NO: 123621 - DNA, 37 bp, Artificial Sequence
  Synthetic oligonucleotide
gggggccgctctggcggtggggctaagtggatggtga

SEQ ID NO: 123622 - DNA, 36 bp, Artificial Sequence
  Synthetic oligonucleotide
tccacatgccgtcctccctttgcgtccctcagccta

SEQ ID NO: 123623 - DNA, 35 bp, Artificial Sequence
  Synthetic oligonucleotide
gcgctgcccccttcgcctcagctgttccgctccta

SEQ ID NO: 123624 - DNA, 35 bp, Artificial Sequence
  Synthetic oligonucleotide
tccgacgccttcacacccatgcgggagctcgccac

SEQ ID NO: 123625 - DNA, 35 bp, Artificial Sequence
  Synthetic oligonucleotide
gaccaccacattcttcgttggactctctcctccac

SEQ ID NO: 123626 - DNA, 35 bp, Artificial Sequence
  Synthetic oligonucleotide
tcaaccgccttccttcatctatgcatgtctgctac

SEQ ID NO: 123627 - DNA, 32 bp, Artificial Sequence
  Synthetic oligonucleotide
tcccaagtacccgcagtttatcgctatacctc

SEQ ID NO: 123628 - DNA, 35 bp, Artificial Sequence
  Synthetic oligonucleotide
aattgccccactgcgaagaaacaccctctccacgt

SEQ ID NO: 123629 - DNA, 36 bp, Artificial Sequence
  Synthetic oligonucleotide
gggagggggaggaaggatggggtaattcggggtcaa

SEQ ID NO: 123630 - DNA, 37 bp, Artificial Sequence
  Synthetic oligonucleotide
ggactgggaatatgggcacggggagggagggatctga

SEQ ID NO: 123631 - DNA, 37 bp, Artificial Sequence
  Synthetic oligonucleotide
gaggggacgagagggagtgtggggtgtgggagtttga

SEQ ID NO: 123632 - DNA, 35 bp, Artificial Sequence
  Synthetic oligonucleotide
gcgcccacccctgacttttctgttttactcgttac

SEQ ID NO: 123633 - DNA, 35 bp, Artificial Sequence
  Synthetic oligonucleotide
tttgtatgcctcgctccgtaaaacgcccgccaccc

SEQ ID NO: 123634 - DNA, 35 bp, Artificial Sequence
  Synthetic oligonucleotide
tccttcccgctcactaatacacccagcgcatacgc

SEQ ID NO: 123635 - DNA, 35 bp, Artificial Sequence
  Synthetic oligonucleotide
gccaacatcgccctttgttcgttctggccttccgc

SEQ ID NO: 123636 - DNA, 35 bp, Artificial Sequence
  Synthetic oligonucleotide
tgcccttcgtctgctatttggtcactcccctcccg

SEQ ID NO: 123637 - DNA, 35 bp, Artificial Sequence
  Synthetic oligonucleotide
attccaccccccagtctcgggcctcctcgtttact

SEQ ID NO: 123638 - DNA, 36 bp, Artificial Sequence
  Synthetic oligonucleotide
tcgcaacccccccgctatttgcacgaaacgtttcca

SEQ ID NO: 123639 - DNA, 34 bp, Artificial Sequence
  Synthetic oligonucleotide
ttacgccccagtaacactacccccattgcccgga

SEQ ID NO: 123640 - DNA, 36 bp, Artificial Sequence
  Synthetic oligonucleotide
atcccttaccgcttgcctgtgcaattctgtccccta

SEQ ID NO: 123641 - DNA, 35 bp, Artificial Sequence
  Synthetic oligonucleotide
tcacctctgcacttgccgcaagccccgacgttgac

SEQ ID NO: 123642 - DNA, 35 bp, Artificial Sequence
  Synthetic oligonucleotide
ttgaccggtcaggaactcatgcaaccggctccctc

SEQ ID NO: 123643 - DNA, 35 bp, Artificial Sequence
  Synthetic oligonucleotide
taccatctccggctcgtgaactatacacgatattc

SEQ ID NO: 123644 - DNA, 35 bp, Artificial Sequence
  Synthetic oligonucleotide
tgaagagtaggggtggcattacggcgggtggaggg

SEQ ID NO: 123645 - DNA, 35 bp, Artificial Sequence
  Synthetic oligonucleotide
ggagccggcctcgatactcaccatgttcactctct

SEQ ID NO: 123646 - DNA, 35 bp, Artificial Sequence
  Synthetic oligonucleotide
acgtgccctcaaacacccaccgccgcccgtgggca

SEQ ID NO: 123647 - DNA, 35 bp, Artificial Sequence
  Synthetic oligonucleotide
agagggggggtgaaggaagcagggggtatggcgta

SEQ ID NO: 123648 - DNA, 35 bp, Artificial Sequence
  Synthetic oligonucleotide
tgcccataagtcacctgtaacgtgcctcccccacc

SEQ ID NO: 123649 - DNA, 35 bp, Artificial Sequence
  Synthetic oligonucleotide
gaatgggaaagtagggcaaaaaggagagggtcacc

SEQ ID NO: 123650 - DNA, 35 bp, Artificial Sequence
  Synthetic oligonucleotide
tcgaggccggtttccgctccacgtttgttcccccc

SEQ ID NO: 123651 - DNA, 35 bp, Artificial Sequence
  Synthetic oligonucleotide
gccacaccaatgatgttccatttgcactacctccc

SEQ ID NO: 123652 - DNA, 35 bp, Artificial Sequence
  Synthetic oligonucleotide
gtgcgtgtatgtcctctcttcgtcattccccggcc

SEQ ID NO: 123653 - DNA, 35 bp, Artificial Sequence
  Synthetic oligonucleotide
atggctcccgcctcgtcccgtttggtactccctcc

SEQ ID NO: 123654 - DNA, 35 bp, Artificial Sequence
  Synthetic oligonucleotide
tcaggaccacctctagcatatctttgaccgttcgc

SEQ ID NO: 123655 - DNA, 35 bp, Artificial Sequence
  Synthetic oligonucleotide
aatgccagactgccggttttgtcttcccactggat

SEQ ID NO: 123656 - DNA, 35 bp, Artificial Sequence
  Synthetic oligonucleotide
gagcacgagactaccaccacgccgaccgccccgct

SEQ ID NO: 123657 - DNA, 35 bp, Artificial Sequence
  Synthetic oligonucleotide
tgtctcgtcctagctgtatcccgccccacctcgct

SEQ ID NO: 123658 - DNA, 35 bp, Artificial Sequence
  Synthetic oligonucleotide
atcctccgtgggaacggtctctttcttggccctct

SEQ ID NO: 123659 - DNA, 35 bp, Artificial Sequence
  Synthetic oligonucleotide
ttggatgcgaagggaagggcgggaggaggtgcatt

SEQ ID NO: 123660 - DNA, 36 bp, Artificial Sequence
  Synthetic oligonucleotide
atccgaacgtagcctgcccctccgagcccccacgca

SEQ ID NO: 123661 - DNA, 36 bp, Artificial Sequence
  Synthetic oligonucleotide
acagtcaaactgctccccccggccccatggcctata

SEQ ID NO: 123662 - DNA, 36 bp, Artificial Sequence
  Synthetic oligonucleotide
tcgaccaccatgccatccgagccttgaacccgctta

SEQ ID NO: 123663 - DNA, 35 bp, Artificial Sequence
  Synthetic oligonucleotide
gtgcgctctagccccggtattgttccttcctcgac

SEQ ID NO: 123664 - DNA, 35 bp, Artificial Sequence
  Synthetic oligonucleotide
tgtcgctacaccgttgcctttcgacttttcttacc

SEQ ID NO: 123665 - DNA, 35 bp, Artificial Sequence
  Synthetic oligonucleotide
gacgggagaatggggggaacgtgacggagtcagag

SEQ ID NO: 123666 - DNA, 35 bp, Artificial Sequence
  Synthetic oligonucleotide
accatgtggcatgcgaatacttgtacccttctccg

SEQ ID NO: 123667 - DNA, 35 bp, Artificial Sequence
  Synthetic oligonucleotide
attccgtccccgccgtcatcctgccatgccccaca

SEQ ID NO: 123668 - DNA, 35 bp, Artificial Sequence
  Synthetic oligonucleotide
tccacctatcgcgttcgagcccttgcctcatgcca

SEQ ID NO: 123669 - DNA, 37 bp, Artificial Sequence
  Synthetic oligonucleotide
tagacgagcgggggggaaggggacagggttgcgatga

SEQ ID NO: 123670 - DNA, 38 bp, Artificial Sequence
  Synthetic oligonucleotide
gcctgcgccctactgttgccgcctatgtactatcctga

SEQ ID NO: 123671 - DNA, 34 bp, Artificial Sequence
  Synthetic oligonucleotide
tacaacgcctccagtctatattgccacctctgta

SEQ ID NO: 123672 - DNA, 35 bp, Artificial Sequence
  Synthetic oligonucleotide
ttacgtaacacccgaccgcttctggccttagtgcc

SEQ ID NO: 123673 - DNA, 35 bp, Artificial Sequence
  Synthetic oligonucleotide
tttggtccatcatgcctataacggcctctacatcc

SEQ ID NO: 123674 - DNA, 34 bp, Artificial Sequence
  Synthetic oligonucleotide
ttcgttcgacgcccccttccacactcacaggtcc

SEQ ID NO: 123675 - DNA, 35 bp, Artificial Sequence
  Synthetic oligonucleotide
gttgaacgaggtggagagtaggggttgcggaatgg

SEQ ID NO: 123676 - DNA, 35 bp, Artificial Sequence
  Synthetic oligonucleotide
gaacgggcaagctgtcctcgctctgtttcgccact

SEQ ID NO: 123677 - DNA, 35 bp, Artificial Sequence
  Synthetic oligonucleotide
gtacagtccccgtttcttccgccagtttctagcct

SEQ ID NO: 123678 - DNA, 37 bp, Artificial Sequence
  Synthetic oligonucleotide
acggagggtgggagggtctcaggagtctccggggaga

SEQ ID NO: 123679 - DNA, 37 bp, Artificial Sequence
  Synthetic oligonucleotide
gtacacctctactgttcatatagcgccctctcaccga

SEQ ID NO: 123680 - DNA, 37 bp, Artificial Sequence
  Synthetic oligonucleotide
gacactcattgcgatcccactccgttctgttcaccga

SEQ ID NO: 123681 - DNA, 36 bp, Artificial Sequence
  Synthetic oligonucleotide
gcgtgcctctgaccaaagccacccttgcccacgcta

SEQ ID NO: 123682 - DNA, 35 bp, Artificial Sequence
  Synthetic oligonucleotide
ccattgccccgaaccacatgcctcctcgacgcccc

SEQ ID NO: 123683 - DNA, 35 bp, Artificial Sequence
  Synthetic oligonucleotide
gcacgattcccgccggccttttcactcatgcaacg

SEQ ID NO: 123684 - DNA, 36 bp, Artificial Sequence
  Synthetic oligonucleotide
tcatgtccagcttacgttatccatgctccctgccct

SEQ ID NO: 123685 - DNA, 36 bp, Artificial Sequence
  Synthetic oligonucleotide
gcaacacagacactgcatcctcgttatctgccacca

SEQ ID NO: 123686 - DNA, 37 bp, Artificial Sequence
  Synthetic oligonucleotide
gggcggggtctgctgcatgaaggggtgtctgtgggga

SEQ ID NO: 123687 - DNA, 35 bp, Artificial Sequence
  Synthetic oligonucleotide
ggtaccccccgcccttagcccactgatacaacgcc

SEQ ID NO: 123688 - DNA, 35 bp, Artificial Sequence
  Synthetic oligonucleotide
gtgataacccaggccgttcactttgcctcccgatc

SEQ ID NO: 123689 - DNA, 35 bp, Artificial Sequence
  Synthetic oligonucleotide
atagcgtccgccctgccagcacaaccgtcgtcctc

SEQ ID NO: 123690 - DNA, 35 bp, Artificial Sequence
  Synthetic oligonucleotide
gttgcactgccaggtacgttcccacgcccaccccg

SEQ ID NO: 123691 - DNA, 35 bp, Artificial Sequence
  Synthetic oligonucleotide
ggaccgacccgcctgatgccaccccttcctggtcg

SEQ ID NO: 123692 - DNA, 35 bp, Artificial Sequence
  Synthetic oligonucleotide
acgccttgtaccgcctgcttacaccttgttccaat

SEQ ID NO: 123693 - DNA, 35 bp, Artificial Sequence
  Synthetic oligonucleotide
ttcgtatgccgccccaacctttgttcctccgacct

SEQ ID NO: 123694 - DNA, 35 bp, Artificial Sequence
  Synthetic oligonucleotide
gagggccccacatgccgtccccctttcacctcacc

SEQ ID NO: 123695 - DNA, 35 bp, Artificial Sequence
  Synthetic oligonucleotide
tcttgcgggcccatctgtacatcgctcatccacgc

SEQ ID NO: 123696 - DNA, 35 bp, Artificial Sequence
  Synthetic oligonucleotide
atgacacaacaatacgcaaacgcgcctggccactc

SEQ ID NO: 123697 - DNA, 35 bp, Artificial Sequence
  Synthetic oligonucleotide
gtagagcaaaagggaaggggaggagtgcgcaatcg

SEQ ID NO: 123698 - DNA, 35 bp, Artificial Sequence
  Synthetic oligonucleotide
tcaccatccttatgtcgggtctcccacaccttgtg

SEQ ID NO: 123699 - DNA, 35 bp, Artificial Sequence
  Synthetic oligonucleotide
gagcactcgctacttccgttcctctccgctcccgt

SEQ ID NO: 123700 - DNA, 35 bp, Artificial Sequence
  Synthetic oligonucleotide
gcatccctgtttctgtgcttgtccaccgcttctca

SEQ ID NO: 123701 - DNA, 38 bp, Artificial Sequence
  Synthetic oligonucleotide
aacaacgccctgttgctcgatgcactatcctccgttga

SEQ ID NO: 123702 - DNA, 35 bp, Artificial Sequence
  Synthetic oligonucleotide
gacactgtccgtccctccccagtgcttgttcttac

SEQ ID NO: 123703 - DNA, 35 bp, Artificial Sequence
  Synthetic oligonucleotide
gatgctcatggccacctttcgtcctgctatgcacc

SEQ ID NO: 123704 - DNA, 35 bp, Artificial Sequence
  Synthetic oligonucleotide
atcgaccaattgccggctgctgagcccttccgccc

SEQ ID NO: 123705 - DNA, 35 bp, Artificial Sequence
  Synthetic oligonucleotide
tcgccctccttccctctgtcacccgcacgggctgc

SEQ ID NO: 123706 - DNA, 37 bp, Artificial Sequence
  Synthetic oligonucleotide
agatcggaacaaaatggggtggggcaagggggtagga

SEQ ID NO: 123707 - DNA, 36 bp, Artificial Sequence
  Synthetic oligonucleotide
gggggcagttgctcgggtggggcttcaatgggggta

SEQ ID NO: 123708 - DNA, 35 bp, Artificial Sequence
  Synthetic oligonucleotide
gtgaacgcgcgtggccagctcagtcctgccccccc

SEQ ID NO: 123709 - DNA, 35 bp, Artificial Sequence
  Synthetic oligonucleotide
ttgaccgctttgtgccgtgccctttccttaatccc

SEQ ID NO: 123710 - DNA, 35 bp, Artificial Sequence
  Synthetic oligonucleotide
gtcctgccgccgctatacatactccaactgggtcc

SEQ ID NO: 123711 - DNA, 35 bp, Artificial Sequence
  Synthetic oligonucleotide
tcgacatccccgccttccgtactcgcacgaattgc

SEQ ID NO: 123712 - DNA, 35 bp, Artificial Sequence
  Synthetic oligonucleotide
tgaatctgccctccgtttcccctgtgggtacactc

SEQ ID NO: 123713 - DNA, 35 bp, Artificial Sequence
  Synthetic oligonucleotide
ttaccgctcactgccgactcccgtttccgatcttc

SEQ ID NO: 123714 - DNA, 35 bp, Artificial Sequence
  Synthetic oligonucleotide
tcagattagcctcacttgtagctccaaccctgttc

SEQ ID NO: 123715 - DNA, 35 bp, Artificial Sequence
  Synthetic oligonucleotide
tctggggccccaccacctctatatcgactagaagt

SEQ ID NO: 123716 - DNA, 35 bp, Artificial Sequence
  Synthetic oligonucleotide
agatggggagtgaatggtttggggttgggtggggt

SEQ ID NO: 123717 - DNA, 36 bp, Artificial Sequence
  Synthetic oligonucleotide
gacggaacatgttgggaatggagcggtggaggggga

SEQ ID NO: 123718 - DNA, 38 bp, Artificial Sequence
  Synthetic oligonucleotide
tgcccatgccaatagtcgttttttgcccgccgccctga

SEQ ID NO: 123719 - DNA, 34 bp, Artificial Sequence
  Synthetic oligonucleotide
acctcacgcgcctcctcgggtcccccatgctcta

SEQ ID NO: 123720 - DNA, 35 bp, Artificial Sequence
  Synthetic oligonucleotide
atccaacctctgtcctgcatgaacttctcgaaacc

SEQ ID NO: 123721 - DNA, 35 bp, Artificial Sequence
  Synthetic oligonucleotide
tcgtgcgccctcggtctgtttactcttgcgtgccc

SEQ ID NO: 123722 - DNA, 35 bp, Artificial Sequence
  Synthetic oligonucleotide
acctctgcccgtttgcatatttctcagttcacgcc

SEQ ID NO: 123723 - DNA, 35 bp, Artificial Sequence
  Synthetic oligonucleotide
gtcaccgcaagcgtctctagcatccgccacccgcc

SEQ ID NO: 123724 - DNA, 35 bp, Artificial Sequence
  Synthetic oligonucleotide
tgaccggcacctcttcggtttgtctctcgcctatc

SEQ ID NO: 123725 - DNA, 35 bp, Artificial Sequence
  Synthetic oligonucleotide
tgcagtcacctgctccctcatacgtggcctctctg

SEQ ID NO: 123726 - DNA, 36 bp, Artificial Sequence
  Synthetic oligonucleotide
acctcacgccccccactccgtcatatagcggagcaa

SEQ ID NO: 123727 - DNA, 35 bp, Artificial Sequence
  Synthetic oligonucleotide
ggggagacgcactggggaggaccatgggaagggga

SEQ ID NO: 123728 - DNA, 36 bp, Artificial Sequence
  Synthetic oligonucleotide
gacatccgcattcccgaaccagctcccctaccttga

SEQ ID NO: 123729 - DNA, 37 bp, Artificial Sequence
  Synthetic oligonucleotide
gtctgcctctcgacgtcgccccgagttctttccttga

SEQ ID NO: 123730 - DNA, 38 bp, Artificial Sequence
  Synthetic oligonucleotide
tgtgaccacgctcacacgctattgccttcccactttga

SEQ ID NO: 123731 - DNA, 35 bp, Artificial Sequence
  Synthetic oligonucleotide
taatcgccgctccactgcttggctccctacctcac

SEQ ID NO: 123732 - DNA, 35 bp, Artificial Sequence
  Synthetic oligonucleotide
tcacccgcgccccctgccccgaagttcccgttcac

SEQ ID NO: 123733 - DNA, 35 bp, Artificial Sequence
  Synthetic oligonucleotide
gtatcgctggcccatatcgttctttcccgggtctc

SEQ ID NO: 123734 - DNA, 35 bp, Artificial Sequence
  Synthetic oligonucleotide
aggagggagctatggggagggggcggggcgtgtag

SEQ ID NO: 123735 - DNA, 35 bp, Artificial Sequence
  Synthetic oligonucleotide
gcaacgcaaggatgtaaaccggcctccctatccca

SEQ ID NO: 123736 - DNA, 36 bp, Artificial Sequence
  Synthetic oligonucleotide
gcacgccgcactctggctttagtttatctctgttca

SEQ ID NO: 123737 - DNA, 37 bp, Artificial Sequence
  Synthetic oligonucleotide
taggtccgccccattttgccgcccgtgatttgaccga

SEQ ID NO: 123738 - DNA, 37 bp, Artificial Sequence
  Synthetic oligonucleotide
gaatcaaggagagaagagaggacgggggtggcatgga

SEQ ID NO: 123739 - DNA, 35 bp, Artificial Sequence
  Synthetic oligonucleotide
tcacctcccactagggtagtttgcacatattccac

SEQ ID NO: 123740 - DNA, 35 bp, Artificial Sequence
  Synthetic oligonucleotide
gtgcaccactcactgcccttccaataggactcgac

SEQ ID NO: 123741 - DNA, 35 bp, Artificial Sequence
  Synthetic oligonucleotide
acccatgacaacgccgccggctatttgcactttcc

SEQ ID NO: 123742 - DNA, 35 bp, Artificial Sequence
  Synthetic oligonucleotide
taagccgcttcaatcgcccctctccatccgaccgg

SEQ ID NO: 123743 - DNA, 35 bp, Artificial Sequence
  Synthetic oligonucleotide
atgcccaactgccccgcccgaccttcgaacggtat

SEQ ID NO: 123744 - DNA, 35 bp, Artificial Sequence
  Synthetic oligonucleotide
gtgacgcctacaatctgtgctcgtgcctatacttt

SEQ ID NO: 123745 - DNA, 36 bp, Artificial Sequence
  Synthetic oligonucleotide
atcgaggggatgggggggacggcggtacgggggaaa

SEQ ID NO: 123746 - DNA, 35 bp, Artificial Sequence
  Synthetic oligonucleotide
gatgcaccttccccactgctcctgacgttcaatca

SEQ ID NO: 123747 - DNA, 37 bp, Artificial Sequence
  Synthetic oligonucleotide
ttgtgaatcgcggcgagcgggaaggggggggcgacga

SEQ ID NO: 123748 - DNA, 36 bp, Artificial Sequence
  Synthetic oligonucleotide
tgcgtgttccgttctttttaagctcaccctcctcga

SEQ ID NO: 123749 - DNA, 35 bp, Artificial Sequence
  Synthetic oligonucleotide
acacgccccctcatattttgcctacttacgttcga

SEQ ID NO: 123750 - DNA, 37 bp, Artificial Sequence
  Synthetic oligonucleotide
ggaaaggggaggtaaaggggggtgagacggacccgga

SEQ ID NO: 123751 - DNA, 37 bp, Artificial Sequence
  Synthetic oligonucleotide
gaacgtgcgggccggggagtggtgaggaggaggggga

SEQ ID NO: 123752 - DNA, 38 bp, Artificial Sequence
  Synthetic oligonucleotide
ttggggcaataggggtggggaggaagcgaggggagtga

SEQ ID NO: 123753 - DNA, 38 bp, Artificial Sequence
  Synthetic oligonucleotide
gtaagcccgctcatcctttgaatccctgccccccgtga

SEQ ID NO: 123754 - DNA, 35 bp, Artificial Sequence
  Synthetic oligonucleotide
acacgctcgcctactgcatctgctccaccacatac

SEQ ID NO: 123755 - DNA, 29 bp, Artificial Sequence
  Synthetic oligonucleotide
tgaggatccctgtacacttgccataaacc

SEQ ID NO: 123756 - DNA, 35 bp, Artificial Sequence
  Synthetic oligonucleotide
gtaccctcgcgtccatgccctccccgtccgctgcc

SEQ ID NO: 123757 - DNA, 35 bp, Artificial Sequence
  Synthetic oligonucleotide
tatgcaccccctggaccacctcgaaggccccctcc

SEQ ID NO: 123758 - DNA, 35 bp, Artificial Sequence
  Synthetic oligonucleotide
gcccagttccgccctcttatcccacatgccattgc

SEQ ID NO: 123759 - DNA, 35 bp, Artificial Sequence
  Synthetic oligonucleotide
gagaccggggcgaagtgacgggcgggtagggcatg

SEQ ID NO: 123760 - DNA, 36 bp, Artificial Sequence
  Synthetic oligonucleotide
gcacgccaaatcatatcctctgtcggtcacgcccca

SEQ ID NO: 123761 - DNA, 35 bp, Artificial Sequence
  Synthetic oligonucleotide
gctgcacattacatccgtccctgatccatctgtca

SEQ ID NO: 123762 - DNA, 35 bp, Artificial Sequence
  Synthetic oligonucleotide
gccaaccacatgtaccctagtgctcacgaccttca

SEQ ID NO: 123763 - DNA, 36 bp, Artificial Sequence
  Synthetic oligonucleotide
acgaagggagggcggaatggcaggggcggacaggga

SEQ ID NO: 123764 - DNA, 38 bp, Artificial Sequence
  Synthetic oligonucleotide
aacgaatcgccccatgtttctttctgttcctctcctga

SEQ ID NO: 123765 - DNA, 36 bp, Artificial Sequence
  Synthetic oligonucleotide
tgcaacagaacggggggtaatgcaaagggaggggta

SEQ ID NO: 123766 - DNA, 36 bp, Artificial Sequence
  Synthetic oligonucleotide
gccgcccccgcgtggtctggtccttgcgcccgttta

SEQ ID NO: 123767 - DNA, 34 bp, Artificial Sequence
  Synthetic oligonucleotide
gcttccaccggtcgccttttccgtgccagttcac

SEQ ID NO: 123768 - DNA, 35 bp, Artificial Sequence
  Synthetic oligonucleotide
tgcacgcccgctcttccccatcccaccggctaccc

SEQ ID NO: 123769 - DNA, 35 bp, Artificial Sequence
  Synthetic oligonucleotide
atgatcgccccgccgctaccacccttttagtaagc

SEQ ID NO: 123770 - DNA, 35 bp, Artificial Sequence
  Synthetic oligonucleotide
gtgtccacgggcgaccgtgctaaatcccgcttatc

SEQ ID NO: 123771 - DNA, 35 bp, Artificial Sequence
  Synthetic oligonucleotide
tccagcccgagcacctagtctttggcgttcctctc

SEQ ID NO: 123772 - DNA, 35 bp, Artificial Sequence
  Synthetic oligonucleotide
gccgaatgtgtacggctggtccctttttgtttttc

SEQ ID NO: 123773 - DNA, 36 bp, Artificial Sequence
  Synthetic oligonucleotide
gtgaagctgcccttgattccgccacgtacttgccca

SEQ ID NO: 123774 - DNA, 36 bp, Artificial Sequence
  Synthetic oligonucleotide
gcaacgatcccacatcgtctatcccaccccgactca

SEQ ID NO: 123775 - DNA, 37 bp, Artificial Sequence
  Synthetic oligonucleotide
tcagaaagcgacagactaggaaaggggaggggggaga

SEQ ID NO: 123776 - DNA, 37 bp, Artificial Sequence
  Synthetic oligonucleotide
tcaggaggggtagggggcggggtggttaaaatggaga

SEQ ID NO: 123777 - DNA, 34 bp, Artificial Sequence
  Synthetic oligonucleotide
tgacccacaccttccatgtcgctcgcccccccga

SEQ ID NO: 123778 - DNA, 37 bp, Artificial Sequence
  Synthetic oligonucleotide
ttggcgtagggaggcaaggggctggacgaggggcgga

SEQ ID NO: 123779 - DNA, 37 bp, Artificial Sequence
  Synthetic oligonucleotide
tgtggagtggcggtttccatcctagggcggtggggga

SEQ ID NO: 123780 - DNA, 35 bp, Artificial Sequence
  Synthetic oligonucleotide
ttgaccccatcactgtttgccatatatgccgctag

SEQ ID NO: 123781 - DNA, 35 bp, Artificial Sequence
  Synthetic oligonucleotide
acccctccggctgatcagctcgtccgcccgatccg

SEQ ID NO: 123782 - DNA, 36 bp, Artificial Sequence
  Synthetic oligonucleotide
gcctggccggagcgggagggagggggacgttttccg

SEQ ID NO: 123783 - DNA, 35 bp, Artificial Sequence
  Synthetic oligonucleotide
tccgacgtcgaaccggtctaccatcgccctcttgt

SEQ ID NO: 123784 - DNA, 34 bp, Artificial Sequence
  Synthetic oligonucleotide
ttcgttcctcagccgcaccaccaaccgtatcatt

SEQ ID NO: 123785 - DNA, 35 bp, Artificial Sequence
  Synthetic oligonucleotide
gctcactacctcggaagcgtatgccttcttccctt

SEQ ID NO: 123786 - DNA, 37 bp, Artificial Sequence
  Synthetic oligonucleotide
tccaccgcacattgttttcctgcctactgcccgctga

SEQ ID NO: 123787 - DNA, 36 bp, Artificial Sequence
  Synthetic oligonucleotide
gactagagggggtggtgggaactgaggggtgatgta

SEQ ID NO: 123788 - DNA, 35 bp, Artificial Sequence
  Synthetic oligonucleotide
tcccggacaaacccgccattgctactgttacttac

SEQ ID NO: 123789 - DNA, 35 bp, Artificial Sequence
  Synthetic oligonucleotide
gccaagtgtccggcctcggtcatacgctactaccc

SEQ ID NO: 123790 - DNA, 35 bp, Artificial Sequence
  Synthetic oligonucleotide
ggaactcccgccagctatacattccttcttgcgcc

SEQ ID NO: 123791 - DNA, 35 bp, Artificial Sequence
  Synthetic oligonucleotide
accggagcaccaacccatctcacgccccctgctgc

SEQ ID NO: 123792 - DNA, 35 bp, Artificial Sequence
  Synthetic oligonucleotide
gaagcgatccccagctatgttatctaccctctctg

SEQ ID NO: 123793 - DNA, 35 bp, Artificial Sequence
  Synthetic oligonucleotide
tctggggcccccaccttcgttactcgcctcgctct

SEQ ID NO: 123794 - DNA, 35 bp, Artificial Sequence
  Synthetic oligonucleotide
gaaccgtccgccactatttgcccagctactaccaa

SEQ ID NO: 123795 - DNA, 36 bp, Artificial Sequence
  Synthetic oligonucleotide
tccaccgcattccttatctggtcagccgccactcca

SEQ ID NO: 123796 - DNA, 37 bp, Artificial Sequence
  Synthetic oligonucleotide
aaggacggatacggaccgggggagggcgggaaggaga

SEQ ID NO: 123797 - DNA, 31 bp, Artificial Sequence
  Synthetic oligonucleotide
gacaataggagggaagggagttacgagggga

SEQ ID NO: 123798 - DNA, 35 bp, Artificial Sequence
  Synthetic oligonucleotide
ttgctccaccctgttcccgtcgtcccgccccgtta

SEQ ID NO: 123799 - DNA, 35 bp, Artificial Sequence
  Synthetic oligonucleotide
gcacattagagtgcgtaaactgcccttctctctac

SEQ ID NO: 123800 - DNA, 35 bp, Artificial Sequence
  Synthetic oligonucleotide
gtccctacactccatcacattgtgccccgagcccc

SEQ ID NO: 123801 - DNA, 35 bp, Artificial Sequence
  Synthetic oligonucleotide
gcacaactgccttccggtctctgacgccgagcccc

SEQ ID NO: 123802 - DNA, 35 bp, Artificial Sequence
  Synthetic oligonucleotide
accgccccccgtccctcatgcaatcctagtgctcc

SEQ ID NO: 123803 - DNA, 35 bp, Artificial Sequence
  Synthetic oligonucleotide
acgccccgcatcccactgctgcatgcttctcccgc

SEQ ID NO: 123804 - DNA, 35 bp, Artificial Sequence
  Synthetic oligonucleotide
agaccccactccacgtgtacgtgcccgttgaaatc

SEQ ID NO: 123805 - DNA, 34 bp, Artificial Sequence
  Synthetic oligonucleotide
gccacaccctgcgcccccttgcacatttcttaat

SEQ ID NO: 123806 - DNA, 36 bp, Artificial Sequence
  Synthetic oligonucleotide
atccgtagcccttgttctcgactgttcgatctctct

SEQ ID NO: 123807 - DNA, 35 bp, Artificial Sequence
  Synthetic oligonucleotide
atgaggtgggtggggagggtgctgactccgaggaa

SEQ ID NO: 123808 - DNA, 37 bp, Artificial Sequence
  Synthetic oligonucleotide
acccttgcaccctcccgacttagtccacgtaccccga

SEQ ID NO: 123809 - DNA, 38 bp, Artificial Sequence
  Synthetic oligonucleotide
gatgctgcaactcgccccgtaccccccggccatcctga

SEQ ID NO: 123810 - DNA, 37 bp, Artificial Sequence
  Synthetic oligonucleotide
gatgccccgaacatgaaactcgacctcctccatctga

SEQ ID NO: 123811 - DNA, 35 bp, Artificial Sequence
  Synthetic oligonucleotide
gcactcgacgtcaggcccactgcccccgttcgcta

SEQ ID NO: 123812 - DNA, 35 bp, Artificial Sequence
  Synthetic oligonucleotide
agtcacctctgccccaatcctgccgtcctcgggac

SEQ ID NO: 123813 - DNA, 35 bp, Artificial Sequence
  Synthetic oligonucleotide
tacgctagccacgaccccttgaatatgcttccgtc

SEQ ID NO: 123814 - DNA, 35 bp, Artificial Sequence
  Synthetic oligonucleotide
gagagccactgcccgctccttgtaggccaccattc

SEQ ID NO: 123815 - DNA, 35 bp, Artificial Sequence
  Synthetic oligonucleotide
ggtctcccttcatcgtgcttttggtccgcccgttc

SEQ ID NO: 123816 - DNA, 35 bp, Artificial Sequence
  Synthetic oligonucleotide
tgccctgcaagtcggcccctatcaatgtccttccg

SEQ ID NO: 123817 - DNA, 35 bp, Artificial Sequence
  Synthetic oligonucleotide
tatggctcccttccgaccgcattccatcacactcg

SEQ ID NO: 123818 - DNA, 35 bp, Artificial Sequence
  Synthetic oligonucleotide
acaccgtagtttaacctctcgtccactcccccggg

SEQ ID NO: 123819 - DNA, 35 bp, Artificial Sequence
  Synthetic oligonucleotide
ggactcatccctccgctccgttcccccccgtgggg

SEQ ID NO: 123820 - DNA, 35 bp, Artificial Sequence
  Synthetic oligonucleotide
tgtggcctcacacgcctctgacaacctaccgcact

SEQ ID NO: 123821 - DNA, 37 bp, Artificial Sequence
  Synthetic oligonucleotide
ttggggagtcggagaggggggttggacaaacgggcga

SEQ ID NO: 123822 - DNA, 37 bp, Artificial Sequence
  Synthetic oligonucleotide
acggtcggttctgcgggtgggcggaggggggggcgga

SEQ ID NO: 123823 - DNA, 37 bp, Artificial Sequence
  Synthetic oligonucleotide
aaacgccacagtgtctagtgctcctctctccccctga

SEQ ID NO: 123824 - DNA, 37 bp, Artificial Sequence
  Synthetic oligonucleotide
taccgccccgtcacctaagcaagccctcctctcctga

SEQ ID NO: 123825 - DNA, 36 bp, Artificial Sequence
  Synthetic oligonucleotide
aatcgatcaccccgccacatcttgcccccgtgctta

SEQ ID NO: 123826 - DNA, 35 bp, Artificial Sequence
  Synthetic oligonucleotide
acatcaccgagtgcctcaaccaacagcccgccacc

SEQ ID NO: 123827 - DNA, 35 bp, Artificial Sequence
  Synthetic oligonucleotide
gccccgcctccttcgtcgcaacaacacaagtttcc

SEQ ID NO: 123828 - DNA, 35 bp, Artificial Sequence
  Synthetic oligonucleotide
tgcctatcaggtctccctcggccgtgcccctccgc

SEQ ID NO: 123829 - DNA, 35 bp, Artificial Sequence
  Synthetic oligonucleotide
ttctagccacgcctgctacacgcgccgctcctcgc

SEQ ID NO: 123830 - DNA, 35 bp, Artificial Sequence
  Synthetic oligonucleotide
tgcaacagccgccctgaccggaagcacaacaccct

SEQ ID NO: 123831 - DNA, 35 bp, Artificial Sequence
  Synthetic oligonucleotide
gacaccgcttaggggtcgctatccatgtccccctt

SEQ ID NO: 123832 - DNA, 36 bp, Artificial Sequence
  Synthetic oligonucleotide
tgacaccgtgacccctattgcattagccccgccaca

SEQ ID NO: 123833 - DNA, 36 bp, Artificial Sequence
  Synthetic oligonucleotide
ggtcaacctcctcgccgtccgctcatcatccacgca

SEQ ID NO: 123834 - DNA, 35 bp, Artificial Sequence
  Synthetic oligonucleotide
ggaacacgtcctatggtgcccgcctgccctgttca

SEQ ID NO: 123835 - DNA, 37 bp, Artificial Sequence
  Synthetic oligonucleotide
gtccctgccatccggttttatgcccttcttgtaacga

SEQ ID NO: 123836 - DNA, 37 bp, Artificial Sequence
  Synthetic oligonucleotide
gaaatcgccgcccatgttctgctccgtctcgcttcga

SEQ ID NO: 123837 - DNA, 37 bp, Artificial Sequence
  Synthetic oligonucleotide
gtttgtcgccctcccttattgcctatagtcccttgga

SEQ ID NO: 123838 - DNA, 38 bp, Artificial Sequence
  Synthetic oligonucleotide
ggtcacttcacccccccatcgccacgtcccgcccgtga

SEQ ID NO: 123839 - DNA, 35 bp, Artificial Sequence
  Synthetic oligonucleotide
atcgtgggcggggtgggagggagcgactcataccg

SEQ ID NO: 123840 - DNA, 35 bp, Artificial Sequence
  Synthetic oligonucleotide
gttggctacccagctaccgtattctcgtctcctcg

SEQ ID NO: 123841 - DNA, 35 bp, Artificial Sequence
  Synthetic oligonucleotide
gtcctccgccgcctttcgatcacaaatactgtgct

SEQ ID NO: 123842 - DNA, 35 bp, Artificial Sequence
  Synthetic oligonucleotide
tacccgcccgctgcccatcaactgctcgcatcgtt

SEQ ID NO: 123843 - DNA, 36 bp, Artificial Sequence
  Synthetic oligonucleotide
accagccgccccgcttgccgtatatccacccctcca

SEQ ID NO: 123844 - DNA, 36 bp, Artificial Sequence
  Synthetic oligonucleotide
accgctgccgccctgcaggattccaccaactctcga

SEQ ID NO: 123845 - DNA, 38 bp, Artificial Sequence
  Synthetic oligonucleotide
gtgggggaaagggaggggatcataaactgggagactga

SEQ ID NO: 123846 - DNA, 37 bp, Artificial Sequence
  Synthetic oligonucleotide
atgaggggtagtaggctaggagggggaacaacggtga

SEQ ID NO: 123847 - DNA, 35 bp, Artificial Sequence
  Synthetic oligonucleotide
tcgcctgttgccatgaattgcctgcacctcccgcc

SEQ ID NO: 123848 - DNA, 35 bp, Artificial Sequence
  Synthetic oligonucleotide
taacacgcgccatcctgcatttaccccttactagc

SEQ ID NO: 123849 - DNA, 35 bp, Artificial Sequence
  Synthetic oligonucleotide
acctccgacgcccgctttgactcacgtaagtcttc

SEQ ID NO: 123850 - DNA, 35 bp, Artificial Sequence
  Synthetic oligonucleotide
tccgcgttcctccgtgctccaaccatgtctctttc

SEQ ID NO: 123851 - DNA, 35 bp, Artificial Sequence
  Synthetic oligonucleotide
gagtccccctccagttccttggcccaccagttttc

SEQ ID NO: 123852 - DNA, 35 bp, Artificial Sequence
  Synthetic oligonucleotide
gaaaccctagccccatcccgtaacgaccgccgcct

SEQ ID NO: 123853 - DNA, 35 bp, Artificial Sequence
  Synthetic oligonucleotide
gccatctcgccccgacacatcacttcctgttacgt

SEQ ID NO: 123854 - DNA, 35 bp, Artificial Sequence
  Synthetic oligonucleotide
atcaccggtcggatctcactgcgcctatcaccgtt

SEQ ID NO: 123855 - DNA, 35 bp, Artificial Sequence
  Synthetic oligonucleotide
atgacatcctccttgctgtcggttcctcgtttaca

SEQ ID NO: 123856 - DNA, 36 bp, Artificial Sequence
  Synthetic oligonucleotide
atggggtggaggcgtagggcgggggacggagtgata

SEQ ID NO: 123857 - DNA, 36 bp, Artificial Sequence
  Synthetic oligonucleotide
gccacctgagtgccgatttgcacacctctctctcta

SEQ ID NO: 123858 - DNA, 35 bp, Artificial Sequence
  Synthetic oligonucleotide
actgtccctgcccccctggtgttgtcagccaagcc

SEQ ID NO: 123859 - DNA, 35 bp, Artificial Sequence
  Synthetic oligonucleotide
tctgagtcggatccctttatgcaccatcttcttct

SEQ ID NO: 123860 - DNA, 35 bp, Artificial Sequence
  Synthetic oligonucleotide
tgccttcgctgccgtttaccatgttcatcctcgtt

SEQ ID NO: 123861 - DNA, 36 bp, Artificial Sequence
  Synthetic oligonucleotide
tgcagcctctgccccgcccgacgtctcctgctgaca

SEQ ID NO: 123862 - DNA, 35 bp, Artificial Sequence
  Synthetic oligonucleotide
tcgacagatcggcctatctcgtctggtacccccca

SEQ ID NO: 123863 - DNA, 36 bp, Artificial Sequence
  Synthetic oligonucleotide
gtccttccgccccctcttgcttagtggttttgccca

SEQ ID NO: 123864 - DNA, 36 bp, Artificial Sequence
  Synthetic oligonucleotide
actccatccacaccggcccagactcccatcgttgca

SEQ ID NO: 123865 - DNA, 37 bp, Artificial Sequence
  Synthetic oligonucleotide
tgaaagaaggaaaggggggtggataggggagccgaga

SEQ ID NO: 123866 - DNA, 36 bp, Artificial Sequence
  Synthetic oligonucleotide
taacccggccagtgcacacacgcgtccctgccccga

SEQ ID NO: 123867 - DNA, 37 bp, Artificial Sequence
  Synthetic oligonucleotide
tcaatcaccggccatggacttaagccccctccttcga

SEQ ID NO: 123868 - DNA, 37 bp, Artificial Sequence
  Synthetic oligonucleotide
tatcatagggaagttggggaagtggggtacgagggga

SEQ ID NO: 123869 - DNA, 36 bp, Artificial Sequence
  Synthetic oligonucleotide
tcctgtgcctcgcgtgtgtccctgccgttccgccta

SEQ ID NO: 123870 - DNA, 35 bp, Artificial Sequence
  Synthetic oligonucleotide
tgtgaccacatgcctcccctatccgtacggtgcta

SEQ ID NO: 123871 - DNA, 35 bp, Artificial Sequence
  Synthetic oligonucleotide
acgtgccggtccctgtcaataccaagttctgccgc

SEQ ID NO: 123872 - DNA, 35 bp, Artificial Sequence
  Synthetic oligonucleotide
ttcggtcccagcctcgcgctcctgtccgggccctc

SEQ ID NO: 123873 - DNA, 35 bp, Artificial Sequence
  Synthetic oligonucleotide
acttcccgctgccttcatgccctgctccatacaat

SEQ ID NO: 123874 - DNA, 35 bp, Artificial Sequence
  Synthetic oligonucleotide
accgttgctcttgctccgttagcccctgccaccca

SEQ ID NO: 123875 - DNA, 36 bp, Artificial Sequence
  Synthetic oligonucleotide
aatccacccccgttcccagtttacgtatgcgtgtca

SEQ ID NO: 123876 - DNA, 37 bp, Artificial Sequence
  Synthetic oligonucleotide
gagggtaagtgggaaagataacgggcagggaggggga

SEQ ID NO: 123877 - DNA, 36 bp, Artificial Sequence
  Synthetic oligonucleotide
gccgctccgagttgcttcgcgtcccgccccccctga

SEQ ID NO: 123878 - DNA, 38 bp, Artificial Sequence
  Synthetic oligonucleotide
tgttgccccaccctccgtacacctactgtccgtgttga

SEQ ID NO: 123879 - DNA, 36 bp, Artificial Sequence
  Synthetic oligonucleotide
tgagccggaggcactcgcttacccttccgcccccta

SEQ ID NO: 123880 - DNA, 36 bp, Artificial Sequence
  Synthetic oligonucleotide
tcctcgccccctcgctatcggctcctactgttcgta

SEQ ID NO: 123881 - DNA, 35 bp, Artificial Sequence
  Synthetic oligonucleotide
tccacccccacagatctctctatcggaccttcgac

SEQ ID NO: 123882 - DNA, 35 bp, Artificial Sequence
  Synthetic oligonucleotide
agacaccgggatcgctcttatcttctcgcacctgc

SEQ ID NO: 123883 - DNA, 35 bp, Artificial Sequence
  Synthetic oligonucleotide
gaagtacttccccagcatccccccgctcacgtgcg

SEQ ID NO: 123884 - DNA, 35 bp, Artificial Sequence
  Synthetic oligonucleotide
gtccgacccgttcccttactttggttcaccacctg

SEQ ID NO: 123885 - DNA, 35 bp, Artificial Sequence
  Synthetic oligonucleotide
tcaccctcgcctcaccatcctggcatgctgcctct

SEQ ID NO: 123886 - DNA, 35 bp, Artificial Sequence
  Synthetic oligonucleotide
tccgacccttctcctctgtttgacttgcgtcccgt

SEQ ID NO: 123887 - DNA, 35 bp, Artificial Sequence
  Synthetic oligonucleotide
gcatcccccctggcatgtcccggagttccgccctt

SEQ ID NO: 123888 - DNA, 35 bp, Artificial Sequence
  Synthetic oligonucleotide
gctcagtgccgtggcatgtccgttctctccgtttt

SEQ ID NO: 123889 - DNA, 35 bp, Artificial Sequence
  Synthetic oligonucleotide
gcccccatcaattcgttgtacactgttcacttttt

SEQ ID NO: 123890 - DNA, 36 bp, Artificial Sequence
  Synthetic oligonucleotide
gttgcaccatcgtgtttttcttacccattgccctca

SEQ ID NO: 123891 - DNA, 34 bp, Artificial Sequence
  Synthetic oligonucleotide
taatcctgcgtccctcctccatggtctccgttca

SEQ ID NO: 123892 - DNA, 37 bp, Artificial Sequence
  Synthetic oligonucleotide
cacgccccgttctcgatcgcccactgacattcagtga

SEQ ID NO: 123893 - DNA, 37 bp, Artificial Sequence
  Synthetic oligonucleotide
ttcgctcctcgtgcagttcccgttccatcttgcttga

SEQ ID NO: 123894 - DNA, 35 bp, Artificial Sequence
  Synthetic oligonucleotide
tcgatgttccgctgcgtgcctagcaccctttctac

SEQ ID NO: 123895 - DNA, 35 bp, Artificial Sequence
  Synthetic oligonucleotide
ttactcccgcccatcgccttatataagggtccacc

SEQ ID NO: 123896 - DNA, 35 bp, Artificial Sequence
  Synthetic oligonucleotide
tactaccacgcctcatcggttactgctcgcaatcc

SEQ ID NO: 123897 - DNA, 35 bp, Artificial Sequence
  Synthetic oligonucleotide
tcgctgtcccacctgccccctttggatgacatcgc

SEQ ID NO: 123898 - DNA, 35 bp, Artificial Sequence
  Synthetic oligonucleotide
tgaacgcacatttcacctcccgggcctgttactgc

SEQ ID NO: 123899 - DNA, 35 bp, Artificial Sequence
  Synthetic oligonucleotide
gccctcggtagattcatcctggccactgtcccatc

SEQ ID NO: 123900 - DNA, 26 bp, Artificial Sequence
  Synthetic oligonucleotide
gccccaccaccaccaacgctgacccg

SEQ ID NO: 123901 - DNA, 35 bp, Artificial Sequence
  Synthetic oligonucleotide
tgccggttcatacagcctcccctcgcccgctggtt

SEQ ID NO: 123902 - DNA, 35 bp, Artificial Sequence
  Synthetic oligonucleotide
ggggcactggccccatgatttagctctcacttcca

SEQ ID NO: 123903 - DNA, 37 bp, Artificial Sequence
  Synthetic oligonucleotide
gccttcctcctctgtgtgcaactccctcggattccga

SEQ ID NO: 123904 - DNA, 38 bp, Artificial Sequence
  Synthetic oligonucleotide
accccgctaccaccgttcctccagcccgtgcgccctga

SEQ ID NO: 123905 - DNA, 38 bp, Artificial Sequence
  Synthetic oligonucleotide
gaagagcaccgctttttctgtttatgtcctcctcctga

SEQ ID NO: 123906 - DNA, 38 bp, Artificial Sequence
  Synthetic oligonucleotide
gcgggatcgggcgggtaagggggcaagggatagcgtga

SEQ ID NO: 123907 - DNA, 38 bp, Artificial Sequence
  Synthetic oligonucleotide
accacgccgccccccgttagacccgccttcacagttga

SEQ ID NO: 123908 - DNA, 35 bp, Artificial Sequence
  Synthetic oligonucleotide
aattcgacctcggttcgctgcttttatcgccttcc

SEQ ID NO: 123909 - DNA, 35 bp, Artificial Sequence
  Synthetic oligonucleotide
ttgaccttccaccgtgatatccgactctttcgggc

SEQ ID NO: 123910 - DNA, 35 bp, Artificial Sequence
  Synthetic oligonucleotide
aacacccccggcacggtatctcgattcgcccactc

SEQ ID NO: 123911 - DNA, 35 bp, Artificial Sequence
  Synthetic oligonucleotide
gtttgatccccagaagtttgcccccgtacatcccg

SEQ ID NO: 123912 - DNA, 35 bp, Artificial Sequence
  Synthetic oligonucleotide
gtgccattctcctccctctactcttggattcgtgg

SEQ ID NO: 123913 - DNA, 35 bp, Artificial Sequence
  Synthetic oligonucleotide
accactcagcgctgtcccaccaccacacgttcctg

SEQ ID NO: 123914 - DNA, 36 bp, Artificial Sequence
  Synthetic oligonucleotide
aaaccgccccctctggcttatactcctttgtgacaa

SEQ ID NO: 123915 - DNA, 35 bp, Artificial Sequence
  Synthetic oligonucleotide
tatgtcacctcgtccagatcgtacccctgccgcca

SEQ ID NO: 123916 - DNA, 37 bp, Artificial Sequence
  Synthetic oligonucleotide
gcaccctgcttctagctcgacttccttacttgccgga

SEQ ID NO: 123917 - DNA, 37 bp, Artificial Sequence
  Synthetic oligonucleotide
ttcaccgcccctgttccaactccctgccccagttgga

SEQ ID NO: 123918 - DNA, 37 bp, Artificial Sequence
  Synthetic oligonucleotide
gacccatcaccatctgccgactataccgtctacttga

SEQ ID NO: 123919 - DNA, 36 bp, Artificial Sequence
  Synthetic oligonucleotide
acccgccctgacccctggatcgctccactgttgtta

SEQ ID NO: 123920 - DNA, 35 bp, Artificial Sequence
  Synthetic oligonucleotide
cacgtgctcacatcctccgctctcgttccccgtcc

SEQ ID NO: 123921 - DNA, 35 bp, Artificial Sequence
  Synthetic oligonucleotide
tgttggtcactccccccgttaaccgccttgttcgc

SEQ ID NO: 123922 - DNA, 35 bp, Artificial Sequence
  Synthetic oligonucleotide
gtgttggtcgatacctgtgcgctgctcctcccctc

SEQ ID NO: 123923 - DNA, 35 bp, Artificial Sequence
  Synthetic oligonucleotide
tgcccctaccttgtccgcgcgccctcctaacagtc

SEQ ID NO: 123924 - DNA, 35 bp, Artificial Sequence
  Synthetic oligonucleotide
tcccagtccccccggtattaggccctgttctttat

SEQ ID NO: 123925 - DNA, 35 bp, Artificial Sequence
  Synthetic oligonucleotide
tcaccacactcgcgtcgctccagcccgtccacagt

SEQ ID NO: 123926 - DNA, 36 bp, Artificial Sequence
  Synthetic oligonucleotide
atcgcccttcgcactaattgtcgatacattccatca

SEQ ID NO: 123927 - DNA, 37 bp, Artificial Sequence
  Synthetic oligonucleotide
gggggtgggacgagttgaagggggccgagaacgggga

SEQ ID NO: 123928 - DNA, 35 bp, Artificial Sequence
  Synthetic oligonucleotide
atgactgatcgccctctcgtaccgcaccacttgga

SEQ ID NO: 123929 - DNA, 35 bp, Artificial Sequence
  Synthetic oligonucleotide
tttgcgcctgtcctacgtttcctccgttgcccttc

SEQ ID NO: 123930 - DNA, 35 bp, Artificial Sequence
  Synthetic oligonucleotide
tctgagcgcaatcacctcgtgctttactctcatct

SEQ ID NO: 123931 - DNA, 35 bp, Artificial Sequence
  Synthetic oligonucleotide
actgaacccctagccatgccacccgccagcctttt

SEQ ID NO: 123932 - DNA, 35 bp, Artificial Sequence
  Synthetic oligonucleotide
gtgactccgcacatacaattcgataccctcaccga

SEQ ID NO: 123933 - DNA, 37 bp, Artificial Sequence
  Synthetic oligonucleotide
aaggtggaagggggcggaggaggggctagccagctga

SEQ ID NO: 123934 - DNA, 35 bp, Artificial Sequence
  Synthetic oligonucleotide
tcgccctctcctcacgagctgattttgtccctcta

SEQ ID NO: 123935 - DNA, 35 bp, Artificial Sequence
  Synthetic oligonucleotide
tgccagtcaccatgttcctcttttgcctacttacc

SEQ ID NO: 123936 - DNA, 35 bp, Artificial Sequence
  Synthetic oligonucleotide
tgcgtcatccagcctggtactagttccccatctcc

SEQ ID NO: 123937 - DNA, 35 bp, Artificial Sequence
  Synthetic oligonucleotide
tgcgggacaccatacgtctatttacgcctgctatc

SEQ ID NO: 123938 - DNA, 35 bp, Artificial Sequence
  Synthetic oligonucleotide
gtgctctccgcccctccgtctttgctacttactcg

SEQ ID NO: 123939 - DNA, 35 bp, Artificial Sequence
  Synthetic oligonucleotide
acaagtgcgtgggggaacgggccggatggagtggg

SEQ ID NO: 123940 - DNA, 35 bp, Artificial Sequence
  Synthetic oligonucleotide
atcccctttaccagcgtcacttcacccgccctctg

SEQ ID NO: 123941 - DNA, 35 bp, Artificial Sequence
  Synthetic oligonucleotide
accagccatccccgtttttgctcgccatcccgtat

SEQ ID NO: 123942 - DNA, 36 bp, Artificial Sequence
  Synthetic oligonucleotide
gcagttcaaggggtgggtggcgggtgggcaaggaaa

SEQ ID NO: 123943 - DNA, 35 bp, Artificial Sequence
  Synthetic oligonucleotide
tgcgactccccccgatccgtgcttctggctttaaa

SEQ ID NO: 123944 - DNA, 35 bp, Artificial Sequence
  Synthetic oligonucleotide
tcttccacgtcgagtcttctccccccacgtcctca

SEQ ID NO: 123945 - DNA, 38 bp, Artificial Sequence
  Synthetic oligonucleotide
gaggatgggagaacgggtggcataggcggaggtggtga

SEQ ID NO: 123946 - DNA, 37 bp, Artificial Sequence
  Synthetic oligonucleotide
gtgccccaccatgttatcgcgtgatctcctcatttga

SEQ ID NO: 123947 - DNA, 36 bp, Artificial Sequence
  Synthetic oligonucleotide
tttgttccacccctcagaccgggtcctcatgtccta

SEQ ID NO: 123948 - DNA, 35 bp, Artificial Sequence
  Synthetic oligonucleotide
tcaccccctgttagtattgctactcgcggtaccac

SEQ ID NO: 123949 - DNA, 35 bp, Artificial Sequence
  Synthetic oligonucleotide
tccctgtgccctccatcctgaagttcgcctctgcc

SEQ ID NO: 123950 - DNA, 35 bp, Artificial Sequence
  Synthetic oligonucleotide
tcacacctctcgtagactttgccgatccgaccgtc

SEQ ID NO: 123951 - DNA, 35 bp, Artificial Sequence
  Synthetic oligonucleotide
gccgtccgccgctcgttcctaatctgcttctcaaa

SEQ ID NO: 123952 - DNA, 35 bp, Artificial Sequence
  Synthetic oligonucleotide
gacccgccctaaactgtctatgccgttactcgcaa

SEQ ID NO: 123953 - DNA, 36 bp, Artificial Sequence
  Synthetic oligonucleotide
gcacgggcaatattgggagggcgggagttcggagca

SEQ ID NO: 123954 - DNA, 37 bp, Artificial Sequence
  Synthetic oligonucleotide
gtgcgggggggatggaggatgtccaggggagggacga

SEQ ID NO: 123955 - DNA, 37 bp, Artificial Sequence
  Synthetic oligonucleotide
tacccgggagtggggaaagaagggacggtgagcagga

SEQ ID NO: 123956 - DNA, 37 bp, Artificial Sequence
  Synthetic oligonucleotide
gggacagggggggcagtttaggcgtgaagggggatga

SEQ ID NO: 123957 - DNA, 35 bp, Artificial Sequence
  Synthetic oligonucleotide
aatccccgccaccctgtcattcaagcattctctga

SEQ ID NO: 123958 - DNA, 35 bp, Artificial Sequence
  Synthetic oligonucleotide
atccaggtgcggaagccgcccccttgcctttcccc

SEQ ID NO: 123959 - DNA, 35 bp, Artificial Sequence
  Synthetic oligonucleotide
gcccactcatcaccctgctaggcttgaccttatcc

SEQ ID NO: 123960 - DNA, 35 bp, Artificial Sequence
  Synthetic oligonucleotide
gatccacctgatgagcacgccttttacatcccccg

SEQ ID NO: 123961 - DNA, 35 bp, Artificial Sequence
  Synthetic oligonucleotide
gtacgccccagcctatgaaccaccctgcattgtat

SEQ ID NO: 123962 - DNA, 35 bp, Artificial Sequence
  Synthetic oligonucleotide
acccaccgccattggtcctcggctcaccccggctt

SEQ ID NO: 123963 - DNA, 35 bp, Artificial Sequence
  Synthetic oligonucleotide
ttttcacccgaccaccgccttgcccgcttgctgtt

SEQ ID NO: 123964 - DNA, 36 bp, Artificial Sequence
  Synthetic oligonucleotide
ggtacccaccgcacaccacgcttcgcctttttaaca

SEQ ID NO: 123965 - DNA, 36 bp, Artificial Sequence
  Synthetic oligonucleotide
tgcacacctccctcgattggtcatcggccctactca

SEQ ID NO: 123966 - DNA, 37 bp, Artificial Sequence
  Synthetic oligonucleotide
atgaggccaggaaggggaacactggaggcgggggaga

SEQ ID NO: 123967 - DNA, 37 bp, Artificial Sequence
  Synthetic oligonucleotide
agaaccaaggtaaggggggggaagaaggcgaaataga

SEQ ID NO: 123968 - DNA, 36 bp, Artificial Sequence
  Synthetic oligonucleotide
gtcccgcctcttcgtttacttctcacatctcctaga

SEQ ID NO: 123969 - DNA, 37 bp, Artificial Sequence
  Synthetic oligonucleotide
tgatgtcgtcagcccggccctcgccccgcactcttga

SEQ ID NO: 123970 - DNA, 36 bp, Artificial Sequence
  Synthetic oligonucleotide
acaccctgtcctctgcctgcccatagttgagttcta

SEQ ID NO: 123971 - DNA, 35 bp, Artificial Sequence
  Synthetic oligonucleotide
gcgccatcatgtcgtcttcctatattgccctccgc

SEQ ID NO: 123972 - DNA, 35 bp, Artificial Sequence
  Synthetic oligonucleotide
tatgctgcggcctgtacaatctgctccctcctcct

SEQ ID NO: 123973 - DNA, 35 bp, Artificial Sequence
  Synthetic oligonucleotide
agcctgcacgcccgccatacctccactttcgttgt

SEQ ID NO: 123974 - DNA, 35 bp, Artificial Sequence
  Synthetic oligonucleotide
tcactccccatcgcttggccgagtacgctactttt

SEQ ID NO: 123975 - DNA, 37 bp, Artificial Sequence
  Synthetic oligonucleotide
tgggtggggagatcaaacctagggggtatagtgggga

SEQ ID NO: 123976 - DNA, 38 bp, Artificial Sequence
  Synthetic oligonucleotide
tacgacacactgtgctgtttacttatctccgcccttga

SEQ ID NO: 123977 - DNA, 38 bp, Artificial Sequence
  Synthetic oligonucleotide
cccgacctcacgcctggcgtacctgctccatctcttga

SEQ ID NO: 123978 - DNA, 35 bp, Artificial Sequence
  Synthetic oligonucleotide
gacccccctgcacgtgatttgagcgctccacaccc

SEQ ID NO: 123979 - DNA, 35 bp, Artificial Sequence
  Synthetic oligonucleotide
atgcccctaccgatgtctgtggtagcacgccctcc

SEQ ID NO: 123980 - DNA, 35 bp, Artificial Sequence
  Synthetic oligonucleotide
tcgcccaccatgctaagttctggtcaccctcgttc

SEQ ID NO: 123981 - DNA, 35 bp, Artificial Sequence
  Synthetic oligonucleotide
aaacctgccaattcgtacctgctgacctccctccg

SEQ ID NO: 123982 - DNA, 35 bp, Artificial Sequence
  Synthetic oligonucleotide
tgctgaccaactgcgtgttctcgcggcccctctcg

SEQ ID NO: 123983 - DNA, 35 bp, Artificial Sequence
  Synthetic oligonucleotide
gcaccactcgttccatctcgcaccagggtaaacat

SEQ ID NO: 123984 - DNA, 36 bp, Artificial Sequence
  Synthetic oligonucleotide
agctaacgcctcctgccccacccccccgtatgggaa

SEQ ID NO: 123985 - DNA, 36 bp, Artificial Sequence
  Synthetic oligonucleotide
atccactaccgccccgtatcgtgcatatgcctcgca

SEQ ID NO: 123986 - DNA, 37 bp, Artificial Sequence
  Synthetic oligonucleotide
aagggccaatgcggggagtaaggggtaacggggggga

SEQ ID NO: 123987 - DNA, 37 bp, Artificial Sequence
  Synthetic oligonucleotide
tggagtgggggggtgggtaaaagcgaatcgacaatga

SEQ ID NO: 123988 - DNA, 36 bp, Artificial Sequence
  Synthetic oligonucleotide
acgatcgcctccgctcgacccccacgtgccacctga

SEQ ID NO: 123989 - DNA, 35 bp, Artificial Sequence
  Synthetic oligonucleotide
tcgcgatcctgacgccgctatcacctccgccacac

SEQ ID NO: 123990 - DNA, 35 bp, Artificial Sequence
  Synthetic oligonucleotide
gaacacgccgttgcttaattggttcccctactcgc

SEQ ID NO: 123991 - DNA, 35 bp, Artificial Sequence
  Synthetic oligonucleotide
gattacgcgccttcccgtgttccttccgtttatgc

SEQ ID NO: 123992 - DNA, 35 bp, Artificial Sequence
  Synthetic oligonucleotide
gacacccccactcatatattagtagccgttggctc

SEQ ID NO: 123993 - DNA, 35 bp, Artificial Sequence
  Synthetic oligonucleotide
ctttactgcgctttcctcgacgtgctgccgccttc

SEQ ID NO: 123994 - DNA, 35 bp, Artificial Sequence
  Synthetic oligonucleotide
ttcgccgactcccgggctccaccgttcccttgaag

SEQ ID NO: 123995 - DNA, 35 bp, Artificial Sequence
  Synthetic oligonucleotide
tgcaacctgccccgcttgacacatcgtttctacat

SEQ ID NO: 123996 - DNA, 35 bp, Artificial Sequence
  Synthetic oligonucleotide
tccgcctctcacgaagcaatatcatccctccccct

SEQ ID NO: 123997 - DNA, 35 bp, Artificial Sequence
  Synthetic oligonucleotide
ggtgccacgcccgtctttcgccctgattagtccct

SEQ ID NO: 123998 - DNA, 35 bp, Artificial Sequence
  Synthetic oligonucleotide
acccctgtccctccccttgatatccgcctcgccgt

SEQ ID NO: 123999 - DNA, 35 bp, Artificial Sequence
  Synthetic oligonucleotide
gtctgccttaggtgcggacccttcttccctccctt

SEQ ID NO: 124000 - DNA, 36 bp, Artificial Sequence
  Synthetic oligonucleotide
gatccactcgaccccagcctactccagtgttttaca

SEQ ID NO: 124001 - DNA, 36 bp, Artificial Sequence
  Synthetic oligonucleotide
tgcatcgggatgtccccgtccacccagttccaccca

SEQ ID NO: 124002 - DNA, 36 bp, Artificial Sequence
  Synthetic oligonucleotide
gcaccccgatgcaaatcgtgtcatcttattgcctca

SEQ ID NO: 124003 - DNA, 36 bp, Artificial Sequence
  Synthetic oligonucleotide
ttactcctctgacgcgtgccatccactgacctttca

SEQ ID NO: 124004 - DNA, 37 bp, Artificial Sequence
  Synthetic oligonucleotide
gaacaggggggcgggcgtggaggaaaagcaatgatga

SEQ ID NO: 124005 - DNA, 35 bp, Artificial Sequence
  Synthetic oligonucleotide
gcccccttgccgctctggcccatgcaagcacaccc

SEQ ID NO: 124006 - DNA, 35 bp, Artificial Sequence
  Synthetic oligonucleotide
gctcagccctaagttcaccgtcttcctctagtcgc

SEQ ID NO: 124007 - DNA, 35 bp, Artificial Sequence
  Synthetic oligonucleotide
gtgtcgcggaccatccgttattcccttcgctgttc

SEQ ID NO: 124008 - DNA, 35 bp, Artificial Sequence
  Synthetic oligonucleotide
tgagagagagcggagagggaagtcggaggtgattg

SEQ ID NO: 124009 - DNA, 36 bp, Artificial Sequence
  Synthetic oligonucleotide
gcgccactccactcttacctcgacctgcttccacga

SEQ ID NO: 124010 - DNA, 37 bp, Artificial Sequence
  Synthetic oligonucleotide
acgaacggggagggatagggggggatgcctacgatga

SEQ ID NO: 124011 - DNA, 35 bp, Artificial Sequence
  Synthetic oligonucleotide
tcaacggtgctccgtaaagcactgccgaccctccc

SEQ ID NO: 124012 - DNA, 35 bp, Artificial Sequence
  Synthetic oligonucleotide
atggagccatctgccctctttataaccgttctggc

SEQ ID NO: 124013 - DNA, 35 bp, Artificial Sequence
  Synthetic oligonucleotide
actgaacccgccatttgcagtttccgacgctcctc

SEQ ID NO: 124014 - DNA, 35 bp, Artificial Sequence
  Synthetic oligonucleotide
tgcaccagaaccgcctcccagtctcgctgcacttc

SEQ ID NO: 124015 - DNA, 38 bp, Artificial Sequence
  Synthetic oligonucleotide
ggacgagggggagttgacggaagggggcgtcgtgctga

SEQ ID NO: 124016 - DNA, 37 bp, Artificial Sequence
  Synthetic oligonucleotide
tcactcgcccccatacatagcgcttgtccccccgtga

SEQ ID NO: 124017 - DNA, 38 bp, Artificial Sequence
  Synthetic oligonucleotide
ggggggaggggcagtggagaagaagggcggattattga

SEQ ID NO: 124018 - DNA, 35 bp, Artificial Sequence
  Synthetic oligonucleotide
acactgacactgcctgctatctacacccaatacta

SEQ ID NO: 124019 - DNA, 35 bp, Artificial Sequence
  Synthetic oligonucleotide
gaaccccccacagtgatccagacctcaccggtgcc

SEQ ID NO: 124020 - DNA, 35 bp, Artificial Sequence
  Synthetic oligonucleotide
gaccaccccgtcacggctcctatagtaatgtctcc

SEQ ID NO: 124021 - DNA, 35 bp, Artificial Sequence
  Synthetic oligonucleotide
gttgcgccgacccgacatcggcggcctgtaccatc

SEQ ID NO: 124022 - DNA, 35 bp, Artificial Sequence
  Synthetic oligonucleotide
tccctgtccgcccagtttctttctagtctcgtttc

SEQ ID NO: 124023 - DNA, 35 bp, Artificial Sequence
  Synthetic oligonucleotide
gtccgtcccactgttctgttcttatccccggatcg

SEQ ID NO: 124024 - DNA, 35 bp, Artificial Sequence
  Synthetic oligonucleotide
atattctgcccgcacgctgcccctgttccgtacat

SEQ ID NO: 124025 - DNA, 30 bp, Artificial Sequence
  Synthetic oligonucleotide
tgctcactccactatctgtaaaacgtttct

SEQ ID NO: 124026 - DNA, 35 bp, Artificial Sequence
  Synthetic oligonucleotide
atgccccccacccggatagttttggccacctacgt

SEQ ID NO: 124027 - DNA, 35 bp, Artificial Sequence
  Synthetic oligonucleotide
gaatacgcccgccgctccctgctcttctaccgttt

SEQ ID NO: 124028 - DNA, 36 bp, Artificial Sequence
  Synthetic oligonucleotide
gaccccccccgctcgatcgcattgctttctgaaaca

SEQ ID NO: 124029 - DNA, 36 bp, Artificial Sequence
  Synthetic oligonucleotide
gacacggtaaacgtggtaaccgccgccctttctaca

SEQ ID NO: 124030 - DNA, 36 bp, Artificial Sequence
  Synthetic oligonucleotide
tcatccgcccaaaatgacctggccccatgttttaca

SEQ ID NO: 124031 - DNA, 36 bp, Artificial Sequence
  Synthetic oligonucleotide
actgctcgggcccttgcgttttgacccacgcctcca

SEQ ID NO: 124032 - DNA, 37 bp, Artificial Sequence
  Synthetic oligonucleotide
gatggaggacgggaggttacgggagtaaggcggtaga

SEQ ID NO: 124033 - DNA, 37 bp, Artificial Sequence
  Synthetic oligonucleotide
aacccccgcctcctgcctcgttgtgcacacgcgccga

SEQ ID NO: 124034 - DNA, 36 bp, Artificial Sequence
  Synthetic oligonucleotide
ttcgactcactctcgctgcttatttactacatacta

SEQ ID NO: 124035 - DNA, 36 bp, Artificial Sequence
  Synthetic oligonucleotide
aacccgccaatccccttatcatacgtgtctgttcta

SEQ ID NO: 124036 - DNA, 36 bp, Artificial Sequence
  Synthetic oligonucleotide
gcctcccgtcagtctctcgtctactacaccttgtta

SEQ ID NO: 124037 - DNA, 35 bp, Artificial Sequence
  Synthetic oligonucleotide
atggccaccagcaccaccatgcttctgccctcgcc

SEQ ID NO: 124038 - DNA, 34 bp, Artificial Sequence
  Synthetic oligonucleotide
ttgatccacgtgcttcgcctcccgctcccagtgc

SEQ ID NO: 124039 - DNA, 35 bp, Artificial Sequence
  Synthetic oligonucleotide
tagtcacccgccctgtacaccctaacatcctgtgc

SEQ ID NO: 124040 - DNA, 34 bp, Artificial Sequence
  Synthetic oligonucleotide
atttcgccaccctgtttttatagcccgcatgttc

SEQ ID NO: 124041 - DNA, 35 bp, Artificial Sequence
  Synthetic oligonucleotide
agggggtaggaggggaacttacgtggtgacggggg

SEQ ID NO: 124042 - DNA, 35 bp, Artificial Sequence
  Synthetic oligonucleotide
atcctgccccgcccccatggttgcaacggtgcaat

SEQ ID NO: 124043 - DNA, 36 bp, Artificial Sequence
  Synthetic oligonucleotide
gacccaccactcccagacatcacacgactggcccct

SEQ ID NO: 124044 - DNA, 35 bp, Artificial Sequence
  Synthetic oligonucleotide
atcaccgcttgtactacctccgtctgaccatgcct

SEQ ID NO: 124045 - DNA, 36 bp, Artificial Sequence
  Synthetic oligonucleotide
gtctggaggcacggataggaagggcagggagcgcaa

SEQ ID NO: 124046 - DNA, 36 bp, Artificial Sequence
  Synthetic oligonucleotide
gtcaaccatcgagctaggggaagggcggggaggcaa

SEQ ID NO: 124047 - DNA, 36 bp, Artificial Sequence
  Synthetic oligonucleotide
tgtgcgactactgtcctagtatctgcccccctatca

SEQ ID NO: 124048 - DNA, 38 bp, Artificial Sequence
  Synthetic oligonucleotide
tgcacccccgacctgcccctgccatcttcatggcctga

SEQ ID NO: 124049 - DNA, 36 bp, Artificial Sequence
  Synthetic oligonucleotide
gatcccctcaccatctcgttgttcgaccgcaactta

SEQ ID NO: 124050 - DNA, 35 bp, Artificial Sequence
  Synthetic oligonucleotide
tctcagccgcggactcgctcgccccctcttgttta

SEQ ID NO: 124051 - DNA, 35 bp, Artificial Sequence
  Synthetic oligonucleotide
acgtaagctcagatcgcctttcccccagtccttgc

SEQ ID NO: 124052 - DNA, 35 bp, Artificial Sequence
  Synthetic oligonucleotide
gccctccttcctccgctgttacaaagtctatcgcg

SEQ ID NO: 124053 - DNA, 31 bp, Artificial Sequence
  Synthetic oligonucleotide
tcacgtccatacgttctctgtacatcccctg

SEQ ID NO: 124054 - DNA, 37 bp, Artificial Sequence
  Synthetic oligonucleotide
ggggatgggaagattgaaggggctggcaggggacgga

SEQ ID NO: 124055 - DNA, 37 bp, Artificial Sequence
  Synthetic oligonucleotide
atccaccgacggtggaccctcctttgcccccattgga

SEQ ID NO: 124056 - DNA, 36 bp, Artificial Sequence
  Synthetic oligonucleotide
tcacctcacccatctgcctttgttgcttgttatata

SEQ ID NO: 124057 - DNA, 36 bp, Artificial Sequence
  Synthetic oligonucleotide
acgtatagggaggggggggcataatggggtattgta

SEQ ID NO: 124058 - DNA, 35 bp, Artificial Sequence
  Synthetic oligonucleotide
tgtcacaacgccacatatatcgccggctaccatac

SEQ ID NO: 124059 - DNA, 35 bp, Artificial Sequence
  Synthetic oligonucleotide
cccaccctcgttcgctacggacaacccatgttccc

SEQ ID NO: 124060 - DNA, 35 bp, Artificial Sequence
  Synthetic oligonucleotide
ggtgcgtgtccttgtcactggtcctttcatcttcc

SEQ ID NO: 124061 - DNA, 35 bp, Artificial Sequence
  Synthetic oligonucleotide
ggggggggagcgggtagggagaactttcggcaaag

SEQ ID NO: 124062 - DNA, 35 bp, Artificial Sequence
  Synthetic oligonucleotide
ggaaggagggacggagtacggataaaacgtgcgag

SEQ ID NO: 124063 - DNA, 35 bp, Artificial Sequence
  Synthetic oligonucleotide
gctgtacacctgctgcctcttttatgcttttgccg

SEQ ID NO: 124064 - DNA, 35 bp, Artificial Sequence
  Synthetic oligonucleotide
tggtccctacccttgccccttcgtccccgccaagg

SEQ ID NO: 124065 - DNA, 35 bp, Artificial Sequence
  Synthetic oligonucleotide
actccccactagctgcattccgtcgttccctgttg

SEQ ID NO: 124066 - DNA, 35 bp, Artificial Sequence
  Synthetic oligonucleotide
tgtcaaccgcatgtgagtttcctcgccgtacctat

SEQ ID NO: 124067 - DNA, 34 bp, Artificial Sequence
  Synthetic oligonucleotide
gccccccttcaagtgtccattgaccgcgttacct

SEQ ID NO: 124068 - DNA, 35 bp, Artificial Sequence
  Synthetic oligonucleotide
actgagccaattgggtaaggggggggatgggtagt

SEQ ID NO: 124069 - DNA, 35 bp, Artificial Sequence
  Synthetic oligonucleotide
tcttgatccgcctcactcccgtgttccttggtgtt

SEQ ID NO: 124070 - DNA, 36 bp, Artificial Sequence
  Synthetic oligonucleotide
tcaaagggaaggaggagggtgggcagacacgtttaa

SEQ ID NO: 124071 - DNA, 36 bp, Artificial Sequence
  Synthetic oligonucleotide
gacacctcccttcctcgtcgctggcggtaccgccca

SEQ ID NO: 124072 - DNA, 36 bp, Artificial Sequence
  Synthetic oligonucleotide
gccacccttacttgttggctaccttctccgagacga

SEQ ID NO: 124073 - DNA, 37 bp, Artificial Sequence
  Synthetic oligonucleotide
tacggatggggaagcgggaaaaggggaaagcggccga

SEQ ID NO: 124074 - DNA, 37 bp, Artificial Sequence
  Synthetic oligonucleotide
gaagggacaacaagaaggggccgggacgcagttgcga

SEQ ID NO: 124075 - DNA, 33 bp, Artificial Sequence
  Synthetic oligonucleotide
tgacggtggaggaagaacgggtagcacggagga

SEQ ID NO: 124076 - DNA, 37 bp, Artificial Sequence
  Synthetic oligonucleotide
taagacggggacgggtgatcctgggagcgggggggga

SEQ ID NO: 124077 - DNA, 35 bp, Artificial Sequence
  Synthetic oligonucleotide
aatcagtgatggggagcgggggggaagggtttgga

SEQ ID NO: 124078 - DNA, 37 bp, Artificial Sequence
  Synthetic oligonucleotide
gatagaggcccgggcggggagggacgggatataatga

SEQ ID NO: 124079 - DNA, 33 bp, Artificial Sequence
  Synthetic oligonucleotide
tcatagcctctttccaaccgccggccgtacacc

SEQ ID NO: 124080 - DNA, 35 bp, Artificial Sequence
  Synthetic oligonucleotide
gtcggtgttccatttctgtttcttgtccgtttgcg

SEQ ID NO: 124081 - DNA, 35 bp, Artificial Sequence
  Synthetic oligonucleotide
ttgtgcgccttcccgctgtctgtacctcaggttcg

SEQ ID NO: 124082 - DNA, 35 bp, Artificial Sequence
  Synthetic oligonucleotide
tccgaaccacattgccctccctgcatctaccgttg

SEQ ID NO: 124083 - DNA, 35 bp, Artificial Sequence
  Synthetic oligonucleotide
atcgccaccttctcgttcgtgccttgttccggttt

SEQ ID NO: 124084 - DNA, 36 bp, Artificial Sequence
  Synthetic oligonucleotide
agttacaccggcctcttgattggccccccgccccca

SEQ ID NO: 124085 - DNA, 36 bp, Artificial Sequence
  Synthetic oligonucleotide
tagcccgactcgtttgcaccccttgcccattggcca

SEQ ID NO: 124086 - DNA, 36 bp, Artificial Sequence
  Synthetic oligonucleotide
tcaaccgatccgtcactttcagcttaaccatgtcca

SEQ ID NO: 124087 - DNA, 36 bp, Artificial Sequence
  Synthetic oligonucleotide
gcactgcacgttattccccctcgtctcttctgggca

SEQ ID NO: 124088 - DNA, 36 bp, Artificial Sequence
  Synthetic oligonucleotide
tccccgccccagacataatgagttccccccatccga

SEQ ID NO: 124089 - DNA, 38 bp, Artificial Sequence
  Synthetic oligonucleotide
gtcactgggagggacgggaggagggggagtgctactga

SEQ ID NO: 124090 - DNA, 37 bp, Artificial Sequence
  Synthetic oligonucleotide
gacgcggggcaaagacgaggaggatgaggcgggttga

SEQ ID NO: 124091 - DNA, 38 bp, Artificial Sequence
  Synthetic oligonucleotide
tcctcgccacaatctgccaattgctctcatctctttga

SEQ ID NO: 124092 - DNA, 35 bp, Artificial Sequence
  Synthetic oligonucleotide
tcttgccaccttccgttccctgaggccttatggac

SEQ ID NO: 124093 - DNA, 35 bp, Artificial Sequence
  Synthetic oligonucleotide
gcacgtttgggagggagcgggcagggagggggggc

SEQ ID NO: 124094 - DNA, 34 bp, Artificial Sequence
  Synthetic oligonucleotide
acatgctgcctgcctatcactgtctacaaccgcg

SEQ ID NO: 124095 - DNA, 35 bp, Artificial Sequence
  Synthetic oligonucleotide
accccaactgcgtttcccgctccgtcgcaccctcg

SEQ ID NO: 124096 - DNA, 35 bp, Artificial Sequence
  Synthetic oligonucleotide
gccattccccgccttcttctccccgcttatgaggg

SEQ ID NO: 124097 - DNA, 35 bp, Artificial Sequence
  Synthetic oligonucleotide
gaatgccctgacgtttaaagggggggcgggtaggg

SEQ ID NO: 124098 - DNA, 35 bp, Artificial Sequence
  Synthetic oligonucleotide
ttggacgtatggaagggggagggagggcctgaaat

SEQ ID NO: 124099 - DNA, 35 bp, Artificial Sequence
  Synthetic oligonucleotide
tacgcgacttcggtatcgcctctgctcctttgcct

SEQ ID NO: 124100 - DNA, 35 bp, Artificial Sequence
  Synthetic oligonucleotide
tgtgttcaaccgcgccttccactccccgtgcgagt

SEQ ID NO: 124101 - DNA, 36 bp, Artificial Sequence
  Synthetic oligonucleotide
gccccccacacctggtttagtatcgccccagacgaa

SEQ ID NO: 124102 - DNA, 35 bp, Artificial Sequence
  Synthetic oligonucleotide
ttgatctcattgctgcctaataacgcctccttgca

SEQ ID NO: 124103 - DNA, 36 bp, Artificial Sequence
  Synthetic oligonucleotide
gtggggggccggcaaagggtgcggggggggtaatca

SEQ ID NO: 124104 - DNA, 37 bp, Artificial Sequence
  Synthetic oligonucleotide
gtgggaggggaggagtgaagaagtggggtgcgtggga

SEQ ID NO: 124105 - DNA, 38 bp, Artificial Sequence
  Synthetic oligonucleotide
gacaagagggggcgagaggggtggggaggtatgaatga

SEQ ID NO: 124106 - DNA, 37 bp, Artificial Sequence
  Synthetic oligonucleotide
cccaccctccccattgttttgcgccgtggctcactga

SEQ ID NO: 124107 - DNA, 37 bp, Artificial Sequence
  Synthetic oligonucleotide
gttcaccacccatgctacttcaacaggccaaccttga

SEQ ID NO: 124108 - DNA, 35 bp, Artificial Sequence
  Synthetic oligonucleotide
acacgaatgcgcggctccatcttgtccactcccag

SEQ ID NO: 124109 - DNA, 36 bp, Artificial Sequence
  Synthetic oligonucleotide
gtcccagcccccagccctgtgcttctatcaccacaa

SEQ ID NO: 124110 - DNA, 36 bp, Artificial Sequence
  Synthetic oligonucleotide
tgtcaagcagggcatccccgttccgtccgctcacaa

SEQ ID NO: 124111 - DNA, 36 bp, Artificial Sequence
  Synthetic oligonucleotide
tccccgcccagaccatcccggctgtttctctcccca

SEQ ID NO: 124112 - DNA, 35 bp, Artificial Sequence
  Synthetic oligonucleotide
tatcccgctcacctcctgtacgtctccccatcgca

SEQ ID NO: 124113 - DNA, 37 bp, Artificial Sequence
  Synthetic oligonucleotide
gcactcgccatgggtgagcgccctctctctcttccga

SEQ ID NO: 124114 - DNA, 37 bp, Artificial Sequence
  Synthetic oligonucleotide
caagggggaagggctaagggatgggacggggggcgga

SEQ ID NO: 124115 - DNA, 38 bp, Artificial Sequence
  Synthetic oligonucleotide
gcccctccccgctccaccatataagacgtcccttatga

SEQ ID NO: 124116 - DNA, 35 bp, Artificial Sequence
  Synthetic oligonucleotide
ttacgtcctgcccattcgctttcctgatgccctga

SEQ ID NO: 124117 - DNA, 37 bp, Artificial Sequence
  Synthetic oligonucleotide
agtggtgtcaccgagtatgggggggcggtgagggtga

SEQ ID NO: 124118 - DNA, 35 bp, Artificial Sequence
  Synthetic oligonucleotide
tgcaactggcgcttccggcctttcatctcgctccc

SEQ ID NO: 124119 - DNA, 35 bp, Artificial Sequence
  Synthetic oligonucleotide
gacgcccagtcctaccgctcgatatcaccacttcc

SEQ ID NO: 124120 - DNA, 35 bp, Artificial Sequence
  Synthetic oligonucleotide
tcgcactccattgttttcgagtcttcctctcatcg

SEQ ID NO: 124121 - DNA, 35 bp, Artificial Sequence
  Synthetic oligonucleotide
tcccgctctcactctccgtccccaccgaaatggtg

SEQ ID NO: 124122 - DNA, 36 bp, Artificial Sequence
  Synthetic oligonucleotide
tgccgcctgcccccgactccaatattgctcagctaa

SEQ ID NO: 124123 - DNA, 35 bp, Artificial Sequence
  Synthetic oligonucleotide
tacatctgggcatgggtgggggggagaacacctca

SEQ ID NO: 124124 - DNA, 36 bp, Artificial Sequence
  Synthetic oligonucleotide
aaactcagcccagtgtggtcctcacctccgccttca

SEQ ID NO: 124125 - DNA, 37 bp, Artificial Sequence
  Synthetic oligonucleotide
gagagggcggggggggcatgctgatgcggaaggagga

SEQ ID NO: 124126 - DNA, 38 bp, Artificial Sequence
  Synthetic oligonucleotide
gacactgtccggcgcccataacatgcccacaaccatga

SEQ ID NO: 124127 - DNA, 35 bp, Artificial Sequence
  Synthetic oligonucleotide
gtcccgccgtcgtaccacctccaatgtaatgcacc

SEQ ID NO: 124128 - DNA, 35 bp, Artificial Sequence
  Synthetic oligonucleotide
gctatcgtacagcatcccccggagtcgcacccccc

SEQ ID NO: 124129 - DNA, 35 bp, Artificial Sequence
  Synthetic oligonucleotide
acacccacctcaactatatccaggcccggtacctc

SEQ ID NO: 124130 - DNA, 35 bp, Artificial Sequence
  Synthetic oligonucleotide
tcattctacccccagccacacgctccgacacattc

SEQ ID NO: 124131 - DNA, 35 bp, Artificial Sequence
  Synthetic oligonucleotide
atcagagagctggggggtagggtggcggtggtagg

SEQ ID NO: 124132 - DNA, 35 bp, Artificial Sequence
  Synthetic oligonucleotide
taaggggaagggtggggtgggccattctaacgggg

SEQ ID NO: 124133 - DNA, 34 bp, Artificial Sequence
  Synthetic oligonucleotide
ttccacccaccaagtgttgccgtactttcaactg

SEQ ID NO: 124134 - DNA, 35 bp, Artificial Sequence
  Synthetic oligonucleotide
tgtgccctcgctccttcaatccgttactggaccat

SEQ ID NO: 124135 - DNA, 35 bp, Artificial Sequence
  Synthetic oligonucleotide
tacgttccccagcctcccgtatactccccgcactt

SEQ ID NO: 124136 - DNA, 35 bp, Artificial Sequence
  Synthetic oligonucleotide
acgtgcacgaggggcgggggaagcacggaggaaaa

SEQ ID NO: 124137 - DNA, 38 bp, Artificial Sequence
  Synthetic oligonucleotide
ggggcacaggcgggcggtgggaatcgtgggacggttga

SEQ ID NO: 124138 - DNA, 36 bp, Artificial Sequence
  Synthetic oligonucleotide
accagggggaacaacgggacgggaggggcacacata

SEQ ID NO: 124139 - DNA, 37 bp, Artificial Sequence
  Synthetic oligonucleotide
ttgatcccccccgcacatgtcgcacctaccgacagta

SEQ ID NO: 124140 - DNA, 35 bp, Artificial Sequence
  Synthetic oligonucleotide
tgcccctgcctgccccgatgccaaagtatccaccg

SEQ ID NO: 124141 - DNA, 35 bp, Artificial Sequence
  Synthetic oligonucleotide
atgtcgccccccgcattaatttgatcgttctccat

SEQ ID NO: 124142 - DNA, 34 bp, Artificial Sequence
  Synthetic oligonucleotide
gtcccccctcactgtacccgcgctgctacttaaa

SEQ ID NO: 124143 - DNA, 35 bp, Artificial Sequence
  Synthetic oligonucleotide
agaggggaggcgggatcacggaggggaatgatgaa

SEQ ID NO: 124144 - DNA, 35 bp, Artificial Sequence
  Synthetic oligonucleotide
atccccgcctgagagccgcatgctccaccttccca

SEQ ID NO: 124145 - DNA, 36 bp, Artificial Sequence
  Synthetic oligonucleotide
acgatacgcgcttgccgtttattgttttccttctca

SEQ ID NO: 124146 - DNA, 36 bp, Artificial Sequence
  Synthetic oligonucleotide
gatcaccgccatcgtgctaatacttccttcattcga

SEQ ID NO: 124147 - DNA, 38 bp, Artificial Sequence
  Synthetic oligonucleotide
gtctccatccgggtctttcgctacgtcaccctcgctga

SEQ ID NO: 124148 - DNA, 36 bp, Artificial Sequence
  Synthetic oligonucleotide
actccccctcgccacgacgcacattcccgatattga

SEQ ID NO: 124149 - DNA, 35 bp, Artificial Sequence
  Synthetic oligonucleotide
tctgatccacctcaaggcgtgtgcccctgtaccta

SEQ ID NO: 124150 - DNA, 35 bp, Artificial Sequence
  Synthetic oligonucleotide
atgctcattcgcacccgcccagttcggtctcccac

SEQ ID NO: 124151 - DNA, 35 bp, Artificial Sequence
  Synthetic oligonucleotide
gactcgccctcacttactttgaccggctttgaacc

SEQ ID NO: 124152 - DNA, 35 bp, Artificial Sequence
  Synthetic oligonucleotide
actggctcagagccgtcccgtttgatccgttcccc

SEQ ID NO: 124153 - DNA, 35 bp, Artificial Sequence
  Synthetic oligonucleotide
gacacaccacctgcactacgaagactcttacgccc

SEQ ID NO: 124154 - DNA, 35 bp, Artificial Sequence
  Synthetic oligonucleotide
gtctcccctgtctggttaagctctggttcccgccc

SEQ ID NO: 124155 - DNA, 35 bp, Artificial Sequence
  Synthetic oligonucleotide
atcccgctgagtcaactaccctcgttccgccgtgc

SEQ ID NO: 124156 - DNA, 35 bp, Artificial Sequence
  Synthetic oligonucleotide
tgcccggcacagcctttccgttaaaccgtctcctc

SEQ ID NO: 124157 - DNA, 35 bp, Artificial Sequence
  Synthetic oligonucleotide
gcatcgtgcgcgttactggccatctaccatctctc

SEQ ID NO: 124158 - DNA, 35 bp, Artificial Sequence
  Synthetic oligonucleotide
tcacgtcgtgatgtcacgtcctatctcagcccttc

SEQ ID NO: 124159 - DNA, 35 bp, Artificial Sequence
  Synthetic oligonucleotide
ttgggccaccagacggccacaccttgtcctatctt

SEQ ID NO: 124160 - DNA, 36 bp, Artificial Sequence
  Synthetic oligonucleotide
tgccccttccgctgattgccaactccgcttccctaa

SEQ ID NO: 124161 - DNA, 36 bp, Artificial Sequence
  Synthetic oligonucleotide
agcgggaggggagaatttaaacgtaagggggggcga

SEQ ID NO: 124162 - DNA, 36 bp, Artificial Sequence
  Synthetic oligonucleotide
gcaaggtggtgggggcggaggaaaaacaaataagga

SEQ ID NO: 124163 - DNA, 35 bp, Artificial Sequence
  Synthetic oligonucleotide
ttgggacgggggggcataacttcgggtcaaactga

SEQ ID NO: 124164 - DNA, 37 bp, Artificial Sequence
  Synthetic oligonucleotide
atctcgcgccctcctgcacctctgacttcgatcctga

SEQ ID NO: 124165 - DNA, 35 bp, Artificial Sequence
  Synthetic oligonucleotide
acaccctgtgcccccactcaagccgtttcccttga

SEQ ID NO: 124166 - DNA, 35 bp, Artificial Sequence
  Synthetic oligonucleotide
tctacagctcagcgccctccctccataatgcccta

SEQ ID NO: 124167 - DNA, 35 bp, Artificial Sequence
  Synthetic oligonucleotide
gaatgggtagggctgcgggagggtcgtacaatgcc

SEQ ID NO: 124168 - DNA, 34 bp, Artificial Sequence
  Synthetic oligonucleotide
acatggccccccccgcccaaatctagtaagtgcc

SEQ ID NO: 124169 - DNA, 35 bp, Artificial Sequence
  Synthetic oligonucleotide
acatcccccggatgtggtcagccattttttttatc

SEQ ID NO: 124170 - DNA, 35 bp, Artificial Sequence
  Synthetic oligonucleotide
tctcgcccgccgcccctttcactgatgatgatgtc

SEQ ID NO: 124171 - DNA, 35 bp, Artificial Sequence
  Synthetic oligonucleotide
gcaacaccaccgagtcgttccagccctcttactag

SEQ ID NO: 124172 - DNA, 35 bp, Artificial Sequence
  Synthetic oligonucleotide
tcactgaaccagtgcattacctctcgccttgccat

SEQ ID NO: 124173 - DNA, 35 bp, Artificial Sequence
  Synthetic oligonucleotide
gatcgcccaccgcacaatttatgtcgcctcgccct

SEQ ID NO: 124174 - DNA, 35 bp, Artificial Sequence
  Synthetic oligonucleotide
tcgtgcatccccgcttttgctattcctcgctcgtt

SEQ ID NO: 124175 - DNA, 33 bp, Artificial Sequence
  Synthetic oligonucleotide
ttcctgtgctcccgcctccatcctcgattcgaa

SEQ ID NO: 124176 - DNA, 35 bp, Artificial Sequence
  Synthetic oligonucleotide
acctccccactcctcagacgactcacggaccgaca

SEQ ID NO: 124177 - DNA, 37 bp, Artificial Sequence
  Synthetic oligonucleotide
acgtacccgcctgctacccccctttgtcatcacccga

SEQ ID NO: 124178 - DNA, 37 bp, Artificial Sequence
  Synthetic oligonucleotide
gtaccacccctacatcgcgccatgtgccccttcgtga

SEQ ID NO: 124179 - DNA, 35 bp, Artificial Sequence
  Synthetic oligonucleotide
tagccaagcctcctgcgcctccccataccgcccta

SEQ ID NO: 124180 - DNA, 35 bp, Artificial Sequence
  Synthetic oligonucleotide
ggtccttgcccatggtctctacacttgcctttccc

SEQ ID NO: 124181 - DNA, 34 bp, Artificial Sequence
  Synthetic oligonucleotide
tttcaccccaattgcgatatttccgtcaccttcc

SEQ ID NO: 124182 - DNA, 35 bp, Artificial Sequence
  Synthetic oligonucleotide
tgctcaccctctttcagttgtcatgatctcgcctc

SEQ ID NO: 124183 - DNA, 35 bp, Artificial Sequence
  Synthetic oligonucleotide
tagtgagagacggaaggaaggagcaaacaggaaag

SEQ ID NO: 124184 - DNA, 35 bp, Artificial Sequence
  Synthetic oligonucleotide
gcacagcatatttggggaagggggacggaggatgg

SEQ ID NO: 124185 - DNA, 35 bp, Artificial Sequence
  Synthetic oligonucleotide
ggggaggggatggaaggtagggcacgatgggcagt

SEQ ID NO: 124186 - DNA, 32 bp, Artificial Sequence
  Synthetic oligonucleotide
atcgtaccttgcccccgccgttatccggtaca

SEQ ID NO: 124187 - DNA, 35 bp, Artificial Sequence
  Synthetic oligonucleotide
gcctctccgcacatcgccttggtaacggttaccca

SEQ ID NO: 124188 - DNA, 36 bp, Artificial Sequence
  Synthetic oligonucleotide
gccatcgccctccccgtactgacactcctggttcga

SEQ ID NO: 124189 - DNA, 38 bp, Artificial Sequence
  Synthetic oligonucleotide
gcacccctctacccgcccttcagttcccagtcaactga

SEQ ID NO: 124190 - DNA, 36 bp, Artificial Sequence
  Synthetic oligonucleotide
tctcgccctcgccttgcatccgaatctttgacctta

SEQ ID NO: 124191 - DNA, 34 bp, Artificial Sequence
  Synthetic oligonucleotide
ccgatccgcccctctgcacactggtctcgcctta

SEQ ID NO: 124192 - DNA, 35 bp, Artificial Sequence
  Synthetic oligonucleotide
accacccgccttcatacgcaatgccggctgtttac

SEQ ID NO: 124193 - DNA, 35 bp, Artificial Sequence
  Synthetic oligonucleotide
tcgcacactacctttctgctctgcgttgaaccgcc

SEQ ID NO: 124194 - DNA, 35 bp, Artificial Sequence
  Synthetic oligonucleotide
actcatcactctgcccatgttccgctctgccgtgc

SEQ ID NO: 124195 - DNA, 35 bp, Artificial Sequence
  Synthetic oligonucleotide
gtgtggaaacggggggggaaagaagggtggcgtcg

SEQ ID NO: 124196 - DNA, 35 bp, Artificial Sequence
  Synthetic oligonucleotide
tgaccccccgtcctcatgctccatcccgcgatgct

SEQ ID NO: 124197 - DNA, 35 bp, Artificial Sequence
  Synthetic oligonucleotide
acccctccctccatgtgtcctgcaatagaatcggt

SEQ ID NO: 124198 - DNA, 32 bp, Artificial Sequence
  Synthetic oligonucleotide
atacatccaccttcttacgccgcctgtgagca

SEQ ID NO: 124199 - DNA, 37 bp, Artificial Sequence
  Synthetic oligonucleotide
gccaccctgtgccccgtttttcagatctcctgctgga

SEQ ID NO: 124200 - DNA, 37 bp, Artificial Sequence
  Synthetic oligonucleotide
acctgcgcacctgcgatcatcccacgcctactttgga

SEQ ID NO: 124201 - DNA, 34 bp, Artificial Sequence
  Synthetic oligonucleotide
gacacctcgcaccttccacccagcattccaccta

SEQ ID NO: 124202 - DNA, 34 bp, Artificial Sequence
  Synthetic oligonucleotide
acaccgttagtacgcccctcgctctcccggaacc

SEQ ID NO: 124203 - DNA, 35 bp, Artificial Sequence
  Synthetic oligonucleotide
tcgacaaacccgcagccgttctctacgcaccgccc

SEQ ID NO: 124204 - DNA, 35 bp, Artificial Sequence
  Synthetic oligonucleotide
aaccaaccgctaatggctctccttgcctaccgccc

SEQ ID NO: 124205 - DNA, 35 bp, Artificial Sequence
  Synthetic oligonucleotide
tgccgtcacagccctgcgcagcccgcctcaacgcc

SEQ ID NO: 124206 - DNA, 35 bp, Artificial Sequence
  Synthetic oligonucleotide
gcccctgtccgccaactattaccgtttacacactg

SEQ ID NO: 124207 - DNA, 35 bp, Artificial Sequence
  Synthetic oligonucleotide
aacaacgctcgtgcaggtcgtactttcactttcct

SEQ ID NO: 124208 - DNA, 35 bp, Artificial Sequence
  Synthetic oligonucleotide
taacggaaggaactgggtagggggaaaagggaggt

SEQ ID NO: 124209 - DNA, 35 bp, Artificial Sequence
  Synthetic oligonucleotide
actgcggttcatcgttactaccaccagtttgcctt

SEQ ID NO: 124210 - DNA, 38 bp, Artificial Sequence
  Synthetic oligonucleotide
ggtgatggaggagaggtgaagggtggtctgagacatga

SEQ ID NO: 124211 - DNA, 38 bp, Artificial Sequence
  Synthetic oligonucleotide
tcccatccgccgattgtgcctgtattctccttccgtga

SEQ ID NO: 124212 - DNA, 38 bp, Artificial Sequence
  Synthetic oligonucleotide
tctagggtgggaggggttaaaacggggaggtccggtga

SEQ ID NO: 124213 - DNA, 35 bp, Artificial Sequence
  Synthetic oligonucleotide
acaccacccgtatttctccacgttcctagtgagac

SEQ ID NO: 124214 - DNA, 35 bp, Artificial Sequence
  Synthetic oligonucleotide
tacacgccccgtctcaattgtggaaccgcccttcc

SEQ ID NO: 124215 - DNA, 35 bp, Artificial Sequence
  Synthetic oligonucleotide
gcacccggccctgggatcccaccccaccaatctgc

SEQ ID NO: 124216 - DNA, 35 bp, Artificial Sequence
  Synthetic oligonucleotide
tcgcgccttaacccgcaaacccgcctgctccatcg

SEQ ID NO: 124217 - DNA, 35 bp, Artificial Sequence
  Synthetic oligonucleotide
tgattccaccccccaattaccagcaccgcctctgg

SEQ ID NO: 124218 - DNA, 35 bp, Artificial Sequence
  Synthetic oligonucleotide
gcctcgcatccacctgtttttcttctagctcagct

SEQ ID NO: 124219 - DNA, 36 bp, Artificial Sequence
  Synthetic oligonucleotide
gttgagggaggaggagaagggcagtagtgataggca

SEQ ID NO: 124220 - DNA, 37 bp, Artificial Sequence
  Synthetic oligonucleotide
gtgggtggggtcggggggagggtagcttaaagtagga

SEQ ID NO: 124221 - DNA, 36 bp, Artificial Sequence
  Synthetic oligonucleotide
gatgggacgggagtgtgggcgggtgaacgttaggga

SEQ ID NO: 124222 - DNA, 35 bp, Artificial Sequence
  Synthetic oligonucleotide
ggggaagagaaggggatcaagctttgggcggggga

SEQ ID NO: 124223 - DNA, 38 bp, Artificial Sequence
  Synthetic oligonucleotide
atgccgggtcctcgtcgtaaagtgggagggcggggtga

SEQ ID NO: 124224 - DNA, 35 bp, Artificial Sequence
  Synthetic oligonucleotide
ttggtaacgccctctgttcgggtcgcgcccccttc

SEQ ID NO: 124225 - DNA, 35 bp, Artificial Sequence
  Synthetic oligonucleotide
tgcgctactctgccttattctgtgctcttgttccg

SEQ ID NO: 124226 - DNA, 35 bp, Artificial Sequence
  Synthetic oligonucleotide
ggactccgcacccatgcctttaccctgccgtaggt

SEQ ID NO: 124227 - DNA, 35 bp, Artificial Sequence
  Synthetic oligonucleotide
gagcgagcccacttctgcgcaaccgtaacccctgt

SEQ ID NO: 124228 - DNA, 36 bp, Artificial Sequence
  Synthetic oligonucleotide
accgctgccccttctccattacaatcgcccggtcca

SEQ ID NO: 124229 - DNA, 37 bp, Artificial Sequence
  Synthetic oligonucleotide
agccactcgctctgccttcgttcatcctcagcctcga

SEQ ID NO: 124230 - DNA, 38 bp, Artificial Sequence
  Synthetic oligonucleotide
tgagggcggggtgtcggagtggggacgttcggggctga

SEQ ID NO: 124231 - DNA, 38 bp, Artificial Sequence
  Synthetic oligonucleotide
atgggaccgagacgggatagggtgggcatgggatctga

SEQ ID NO: 124232 - DNA, 37 bp, Artificial Sequence
  Synthetic oligonucleotide
tcctccatcgccgtacttttccagcttacacaagtga

SEQ ID NO: 124233 - DNA, 35 bp, Artificial Sequence
  Synthetic oligonucleotide
gccactgccgaggcgttcgcttccgctctctcccc

SEQ ID NO: 124234 - DNA, 35 bp, Artificial Sequence
  Synthetic oligonucleotide
acgaccttggagccgtgtggcctttccccttcctg

SEQ ID NO: 124235 - DNA, 35 bp, Artificial Sequence
  Synthetic oligonucleotide
gcccccccacgggcctataagcatactcacctcat

SEQ ID NO: 124236 - DNA, 36 bp, Artificial Sequence
  Synthetic oligonucleotide
tccaacgcccagtctgggcattcccgcttttcctaa

SEQ ID NO: 124237 - DNA, 35 bp, Artificial Sequence
  Synthetic oligonucleotide
atgcacccccatcttcctgcgtttcatgacaacca

SEQ ID NO: 124238 - DNA, 35 bp, Artificial Sequence
  Synthetic oligonucleotide
acacacccttccgcccgctcccgttaaggtacgga

SEQ ID NO: 124239 - DNA, 38 bp, Artificial Sequence
  Synthetic oligonucleotide
accccccaccacatgtaacttcactccgctgtccgtga

SEQ ID NO: 124240 - DNA, 35 bp, Artificial Sequence
  Synthetic oligonucleotide
gtcaccgccgatttcccacagtccccttttacccc

SEQ ID NO: 124241 - DNA, 35 bp, Artificial Sequence
  Synthetic oligonucleotide
ttatcgtcgcaggcggatcgctccccccactctcc

SEQ ID NO: 124242 - DNA, 35 bp, Artificial Sequence
  Synthetic oligonucleotide
gtctgcccccggcctctcttccacttgccgcaagc

SEQ ID NO: 124243 - DNA, 35 bp, Artificial Sequence
  Synthetic oligonucleotide
accacctccccgagccgataacttgcatcccaggc

SEQ ID NO: 124244 - DNA, 35 bp, Artificial Sequence
  Synthetic oligonucleotide
tgaggggggtggactggtgggtggtaggaacgtag

SEQ ID NO: 124245 - DNA, 35 bp, Artificial Sequence
  Synthetic oligonucleotide
gcgatacaccctcgcacgttttgcccacagttccg

SEQ ID NO: 124246 - DNA, 35 bp, Artificial Sequence
  Synthetic oligonucleotide
gcagaccctgcgtctgacctgccccatctatgctg

SEQ ID NO: 124247 - DNA, 35 bp, Artificial Sequence
  Synthetic oligonucleotide
gttgaatgtcctgttgctctttcgtgcccattgtt

SEQ ID NO: 124248 - DNA, 35 bp, Artificial Sequence
  Synthetic oligonucleotide
tccgatgctccgtgcacatgttcctgccccgtttt

SEQ ID NO: 124249 - DNA, 37 bp, Artificial Sequence
  Synthetic oligonucleotide
gcaagtcgtaggtcggagggggagggacgggagaaga

SEQ ID NO: 124250 - DNA, 37 bp, Artificial Sequence
  Synthetic oligonucleotide
tccgccgggtgtatcttatttgcgcgcctcctctcga

SEQ ID NO: 124251 - DNA, 37 bp, Artificial Sequence
  Synthetic oligonucleotide
agcaagccagggaaggttatgggcgggggggtttgga

SEQ ID NO: 124252 - DNA, 36 bp, Artificial Sequence
  Synthetic oligonucleotide
acggaagagggagaagggcggggggtgacacaggta

SEQ ID NO: 124253 - DNA, 34 bp, Artificial Sequence
  Synthetic oligonucleotide
gaccaatgaccattgctccttgattacctggttc

SEQ ID NO: 124254 - DNA, 36 bp, Artificial Sequence
  Synthetic oligonucleotide
tgacgccacctcactcctgcgtatcccatttgcgaa

SEQ ID NO: 124255 - DNA, 35 bp, Artificial Sequence
  Synthetic oligonucleotide
tcgcccacctgaattcgctactattgccatcgcca

SEQ ID NO: 124256 - DNA, 35 bp, Artificial Sequence
  Synthetic oligonucleotide
ccccgcccccgctcgatcgcgttagcaccccccga

SEQ ID NO: 124257 - DNA, 37 bp, Artificial Sequence
  Synthetic oligonucleotide
tgcacgtatccactcgccgcacctcccgtcactcgga

SEQ ID NO: 124258 - DNA, 35 bp, Artificial Sequence
  Synthetic oligonucleotide
tgcactcgccgagtcacttgctccatctttctata

SEQ ID NO: 124259 - DNA, 34 bp, Artificial Sequence
  Synthetic oligonucleotide
accattgatcgcccggtacttgctatatgccccc

SEQ ID NO: 124260 - DNA, 35 bp, Artificial Sequence
  Synthetic oligonucleotide
gccaccccccctcgttgtcaagttccgtcgtgccc

SEQ ID NO: 124261 - DNA, 35 bp, Artificial Sequence
  Synthetic oligonucleotide
ggtcccccggccccagtgccttaggcccatttctc

SEQ ID NO: 124262 - DNA, 35 bp, Artificial Sequence
  Synthetic oligonucleotide
tcaatcctccgccatgctagttcgcctcgctcgtc

SEQ ID NO: 124263 - DNA, 35 bp, Artificial Sequence
  Synthetic oligonucleotide
tttccacctcccgatgggcttccccgttacgcact

SEQ ID NO: 124264 - DNA, 35 bp, Artificial Sequence
  Synthetic oligonucleotide
acctcaaccctcccgcataccgacccagttctact

SEQ ID NO: 124265 - DNA, 35 bp, Artificial Sequence
  Synthetic oligonucleotide
gttgtcgacacgccaaagctgctctccgttcccct

SEQ ID NO: 124266 - DNA, 35 bp, Artificial Sequence
  Synthetic oligonucleotide
tagggagggagcaatgtaggagtgcgggtgggggt

SEQ ID NO: 124267 - DNA, 36 bp, Artificial Sequence
  Synthetic oligonucleotide
tgccatgtcagtgttcttcgtgcaatccgtcctcca

SEQ ID NO: 124268 - DNA, 38 bp, Artificial Sequence
  Synthetic oligonucleotide
ttcaccgcccgcccccgacctcgcacccgaaagagtga

SEQ ID NO: 124269 - DNA, 38 bp, Artificial Sequence
  Synthetic oligonucleotide
tatgtgctcagactctgccatttgccctccttacgtga

SEQ ID NO: 124270 - DNA, 38 bp, Artificial Sequence
  Synthetic oligonucleotide
aaccggacacggcctgctctttgcgccacttcccttga

SEQ ID NO: 124271 - DNA, 36 bp, Artificial Sequence
  Synthetic oligonucleotide
tctcgcccctgtctcgcgcgcttacctgacagttga

SEQ ID NO: 124272 - DNA, 32 bp, Artificial Sequence
  Synthetic oligonucleotide
tcgcatgcgcctgctccatcaccctacactac

SEQ ID NO: 124273 - DNA, 35 bp, Artificial Sequence
  Synthetic oligonucleotide
tcgaggttcagcgcccacatattaactcgcctccc

SEQ ID NO: 124274 - DNA, 35 bp, Artificial Sequence
  Synthetic oligonucleotide
cactacgccccgttcctttaatagtcgccttgtcc

SEQ ID NO: 124275 - DNA, 35 bp, Artificial Sequence
  Synthetic oligonucleotide
gcctggccagcccgtccgccctccaccaagttggc

SEQ ID NO: 124276 - DNA, 35 bp, Artificial Sequence
  Synthetic oligonucleotide
gcgccccccaaagtctatgcgtccccttccccatc

SEQ ID NO: 124277 - DNA, 35 bp, Artificial Sequence
  Synthetic oligonucleotide
agactgctagacctgtcgcttccctgtactccctc

SEQ ID NO: 124278 - DNA, 35 bp, Artificial Sequence
  Synthetic oligonucleotide
tgctccatcccaccgtaagtctcccgcgccgcccg

SEQ ID NO: 124279 - DNA, 35 bp, Artificial Sequence
  Synthetic oligonucleotide
atcgggccccacctgaacgtgaatcgctatctcct

SEQ ID NO: 124280 - DNA, 36 bp, Artificial Sequence
  Synthetic oligonucleotide
gccccaccacgtgctcatcgcgcattcttttatgaa

SEQ ID NO: 124281 - DNA, 35 bp, Artificial Sequence
  Synthetic oligonucleotide
aggagacgccgccgagcacctgcagaccaccccca

SEQ ID NO: 124282 - DNA, 37 bp, Artificial Sequence
  Synthetic oligonucleotide
tgagtgctccaccttgccgtatcccaacttctatcga

SEQ ID NO: 124283 - DNA, 38 bp, Artificial Sequence
  Synthetic oligonucleotide
ttgagggagggccggggtagtgggaggaaaacatgtga

SEQ ID NO: 124284 - DNA, 38 bp, Artificial Sequence
  Synthetic oligonucleotide
ggtcccgcaggctattaccctgttccctcccatgttga

SEQ ID NO: 124285 - DNA, 35 bp, Artificial Sequence
  Synthetic oligonucleotide
acatgaggcaaatgggggggaagacgggtcgggtc

SEQ ID NO: 124286 - DNA, 35 bp, Artificial Sequence
  Synthetic oligonucleotide
tgcgtagggggggtgcgagggcaataggggggacg

SEQ ID NO: 124287 - DNA, 35 bp, Artificial Sequence
  Synthetic oligonucleotide
tcatcccgccactacgatcgcgaagtacttccccg

SEQ ID NO: 124288 - DNA, 34 bp, Artificial Sequence
  Synthetic oligonucleotide
gcactatcagatgactcgctctccatcctggcct

SEQ ID NO: 124289 - DNA, 37 bp, Artificial Sequence
  Synthetic oligonucleotide
tgtctcagccctcctggtccgcacgcccatccatcga

SEQ ID NO: 124290 - DNA, 37 bp, Artificial Sequence
  Synthetic oligonucleotide
gtgcaacgtccgcgtttcttttccatccctttgtcga

SEQ ID NO: 124291 - DNA, 37 bp, Artificial Sequence
  Synthetic oligonucleotide
gagtagcggggcggggagggggggtgcgggagaagga

SEQ ID NO: 124292 - DNA, 37 bp, Artificial Sequence
  Synthetic oligonucleotide
acacgctcccatgctgcatcaaccgcctatctactga

SEQ ID NO: 124293 - DNA, 38 bp, Artificial Sequence
  Synthetic oligonucleotide
gtactctgcaacacctgtccctttatgcacactcctga

SEQ ID NO: 124294 - DNA, 35 bp, Artificial Sequence
  Synthetic oligonucleotide
attccctgtgctcccgctgttgatcgatccttacc

SEQ ID NO: 124295 - DNA, 35 bp, Artificial Sequence
  Synthetic oligonucleotide
actcgccatggtatacctagtccccctatcctccc

SEQ ID NO: 124296 - DNA, 35 bp, Artificial Sequence
  Synthetic oligonucleotide
accatgccctgggttttggccctcacccccgctcc

SEQ ID NO: 124297 - DNA, 35 bp, Artificial Sequence
  Synthetic oligonucleotide
acgacccccccgttcccagtctgacggcgatacgc

SEQ ID NO: 124298 - DNA, 35 bp, Artificial Sequence
  Synthetic oligonucleotide
tcactggcgctcctcgatacgccgccgactttatc

SEQ ID NO: 124299 - DNA, 35 bp, Artificial Sequence
  Synthetic oligonucleotide
tacgccccacctactttgccggtgacctctatgct

SEQ ID NO: 124300 - DNA, 36 bp, Artificial Sequence
  Synthetic oligonucleotide
gtacgcaacctcccgatatctatcgttgttctccca

SEQ ID NO: 124301 - DNA, 37 bp, Artificial Sequence
  Synthetic oligonucleotide
actgtcacatattgttctccgtgcctcgcccccccga

SEQ ID NO: 124302 - DNA, 38 bp, Artificial Sequence
  Synthetic oligonucleotide
gcacgcctccgtttctcctgggcccattcactttatga

SEQ ID NO: 124303 - DNA, 38 bp, Artificial Sequence
  Synthetic oligonucleotide
gccactccaccgccacactgggtgctaccctctcttga

SEQ ID NO: 124304 - DNA, 36 bp, Artificial Sequence
  Synthetic oligonucleotide
agtggtaggggaagggggcctaggaagaagggttga

SEQ ID NO: 124305 - DNA, 35 bp, Artificial Sequence
  Synthetic oligonucleotide
gctggccctcatgggtaccgccgtcctccaccacc

SEQ ID NO: 124306 - DNA, 32 bp, Artificial Sequence
  Synthetic oligonucleotide
gtcggtacccccgcatactccaccgattgtcc

SEQ ID NO: 124307 - DNA, 35 bp, Artificial Sequence
  Synthetic oligonucleotide
tattgcgcacccgatcctacctagcactctcacgc

SEQ ID NO: 124308 - DNA, 35 bp, Artificial Sequence
  Synthetic oligonucleotide
ttcatcctcctgaccttggatcaagcactaacctc

SEQ ID NO: 124309 - DNA, 35 bp, Artificial Sequence
  Synthetic oligonucleotide
gcgatctgccgcccgttaacccgccgtttacaact

SEQ ID NO: 124310 - DNA, 35 bp, Artificial Sequence
  Synthetic oligonucleotide
gtccctccgccctcgtagtcataatcgtacgtact

SEQ ID NO: 124311 - DNA, 35 bp, Artificial Sequence
  Synthetic oligonucleotide
tacgcacccggccccccccccgcgcgctgtcccaa

SEQ ID NO: 124312 - DNA, 36 bp, Artificial Sequence
  Synthetic oligonucleotide
atcacccgttgcctgcctccgtatttcctgcttgca

SEQ ID NO: 124313 - DNA, 36 bp, Artificial Sequence
  Synthetic oligonucleotide
gtgaccgcgcagggcaaatgtacctgctcctcctca

SEQ ID NO: 124314 - DNA, 37 bp, Artificial Sequence
  Synthetic oligonucleotide
accaccactctcttctgaaggtacattttcgtgccga

SEQ ID NO: 124315 - DNA, 36 bp, Artificial Sequence
  Synthetic oligonucleotide
gacacagggggatggagtttatggatggggcgggga

SEQ ID NO: 124316 - DNA, 37 bp, Artificial Sequence
  Synthetic oligonucleotide
tgggaggggcaggggtgacggaatagtgagggggtga

SEQ ID NO: 124317 - DNA, 35 bp, Artificial Sequence
  Synthetic oligonucleotide
gtcgcctagccgtacccgtaccaccgtgcaccaac

SEQ ID NO: 124318 - DNA, 35 bp, Artificial Sequence
  Synthetic oligonucleotide
gagtcaccgcccctatcgttctcgctttgttacac

SEQ ID NO: 124319 - DNA, 35 bp, Artificial Sequence
  Synthetic oligonucleotide
taccatcgcatcctctattctcacgcgtgacaccc

SEQ ID NO: 124320 - DNA, 35 bp, Artificial Sequence
  Synthetic oligonucleotide
atgtacgagtccccagcgtccccgtcgtccgcccc

SEQ ID NO: 124321 - DNA, 34 bp, Artificial Sequence
  Synthetic oligonucleotide
tatggtgacatggagtagggggcgggggggtagc

SEQ ID NO: 124322 - DNA, 35 bp, Artificial Sequence
  Synthetic oligonucleotide
gtccctcatcgatcgaattactcccgccctcatgc

SEQ ID NO: 124323 - DNA, 35 bp, Artificial Sequence
  Synthetic oligonucleotide
ttagcccatttgccgttattttaccaccatgctgc

SEQ ID NO: 124324 - DNA, 32 bp, Artificial Sequence
  Synthetic oligonucleotide
tgccgtcatcagcgccgtatttttcatctctc

SEQ ID NO: 124325 - DNA, 35 bp, Artificial Sequence
  Synthetic oligonucleotide
gacagtgcggaactgccactcaccatttcttcttc

SEQ ID NO: 124326 - DNA, 35 bp, Artificial Sequence
  Synthetic oligonucleotide
acatcaccaggtctcattccgtcgccgttttcact

SEQ ID NO: 124327 - DNA, 35 bp, Artificial Sequence
  Synthetic oligonucleotide
tcggaacgcactcgaccgcctgtctgaccactcct

SEQ ID NO: 124328 - DNA, 35 bp, Artificial Sequence
  Synthetic oligonucleotide
tacttgcgcagcaccagcattttcgcctcccctct

SEQ ID NO: 124329 - DNA, 35 bp, Artificial Sequence
  Synthetic oligonucleotide
gacactcaccggttgagctgaaccacacgccctct

SEQ ID NO: 124330 - DNA, 36 bp, Artificial Sequence
  Synthetic oligonucleotide
agggcgggaggggagcctggagataggggacgccca

SEQ ID NO: 124331 - DNA, 38 bp, Artificial Sequence
  Synthetic oligonucleotide
gaggtgccctccctgtacccgacgcctttcatccctga

SEQ ID NO: 124332 - DNA, 37 bp, Artificial Sequence
  Synthetic oligonucleotide
tctccatccccgcgatctgtatgttcaccgcccttga

SEQ ID NO: 124333 - DNA, 35 bp, Artificial Sequence
  Synthetic oligonucleotide
gttgcccttccctgttgttcacttgctatataccc

SEQ ID NO: 124334 - DNA, 36 bp, Artificial Sequence
  Synthetic oligonucleotide
tgcgtcgctcaagccttttcatccccgcctagccgc

SEQ ID NO: 124335 - DNA, 35 bp, Artificial Sequence
  Synthetic oligonucleotide
aatccgcgccgctgccccgaccctgttccacttgc

SEQ ID NO: 124336 - DNA, 35 bp, Artificial Sequence
  Synthetic oligonucleotide
tatgatctgccgcccctgttatggttaacgccatc

SEQ ID NO: 124337 - DNA, 35 bp, Artificial Sequence
  Synthetic oligonucleotide
gacccactcacgcataagtgcttaccctcctcgtg

SEQ ID NO: 124338 - DNA, 35 bp, Artificial Sequence
  Synthetic oligonucleotide
gccccgtaggggacaccctctattcctgacctcct

SEQ ID NO: 124339 - DNA, 35 bp, Artificial Sequence
  Synthetic oligonucleotide
actgacgcggctcatgacttctctgctgttctcct

SEQ ID NO: 124340 - DNA, 35 bp, Artificial Sequence
  Synthetic oligonucleotide
atgtccacccaactgttcactttaggacgtactct

SEQ ID NO: 124341 - DNA, 35 bp, Artificial Sequence
  Synthetic oligonucleotide
accccgtgactcccgtttgctgtccctcatagtct

SEQ ID NO: 124342 - DNA, 35 bp, Artificial Sequence
  Synthetic oligonucleotide
taacccctgttatgcccccgcccgttcgagacggt

SEQ ID NO: 124343 - DNA, 36 bp, Artificial Sequence
  Synthetic oligonucleotide
tgatggaggtgacgggagggcaatagagtggggcaa

SEQ ID NO: 124344 - DNA, 35 bp, Artificial Sequence
  Synthetic oligonucleotide
tgtcgcctacaatgctctcatgcgccctagctcca

SEQ ID NO: 124345 - DNA, 37 bp, Artificial Sequence
  Synthetic oligonucleotide
gcccgggcggggtgtcctaggggcgcttattagggga

SEQ ID NO: 124346 - DNA, 38 bp, Artificial Sequence
  Synthetic oligonucleotide
gccctcctccgcccgacgttcctcttgtctttacatga

SEQ ID NO: 124347 - DNA, 38 bp, Artificial Sequence
  Synthetic oligonucleotide
taggagagggggtggggagtaggaggagcgagcactga

SEQ ID NO: 124348 - DNA, 35 bp, Artificial Sequence
  Synthetic oligonucleotide
gacacggttcttgcccctcggttatcctcgtttac

SEQ ID NO: 124349 - DNA, 35 bp, Artificial Sequence
  Synthetic oligonucleotide
tgctggttgttgcgtctgtatcccgccccatgccc

SEQ ID NO: 124350 - DNA, 35 bp, Artificial Sequence
  Synthetic oligonucleotide
tggtccccgattcagttcttgcaacaccccctcgc

SEQ ID NO: 124351 - DNA, 35 bp, Artificial Sequence
  Synthetic oligonucleotide
accccctcctgctgtttacgacccgtatacccggc

SEQ ID NO: 124352 - DNA, 35 bp, Artificial Sequence
  Synthetic oligonucleotide
tccacggtccattactcgcattcggttactcgctc

SEQ ID NO: 124353 - DNA, 35 bp, Artificial Sequence
  Synthetic oligonucleotide
gccgacgccgtcccgctgtactcatcccccaattc

SEQ ID NO: 124354 - DNA, 35 bp, Artificial Sequence
  Synthetic oligonucleotide
gataacaggggacaaggaagagtggggggcttacg

SEQ ID NO: 124355 - DNA, 35 bp, Artificial Sequence
  Synthetic oligonucleotide
tcatgttccttggttggttccctgttcccgcttcg

SEQ ID NO: 124356 - DNA, 35 bp, Artificial Sequence
  Synthetic oligonucleotide
atccgaccacctcacaaaagtaatcacactgtcct

SEQ ID NO: 124357 - DNA, 36 bp, Artificial Sequence
  Synthetic oligonucleotide
aactaccgcacctgccccgccgatatacccagtcca

SEQ ID NO: 124358 - DNA, 37 bp, Artificial Sequence
  Synthetic oligonucleotide
acgcctccaccgcagcgatgctctcctatccctggga

SEQ ID NO: 124359 - DNA, 37 bp, Artificial Sequence
  Synthetic oligonucleotide
gaaacgcgcaaatgccacgccgccccgtcccttctga

SEQ ID NO: 124360 - DNA, 36 bp, Artificial Sequence
  Synthetic oligonucleotide
gctcctgcctcgaactcctctactgtcacgtttcta

SEQ ID NO: 124361 - DNA, 35 bp, Artificial Sequence
  Synthetic oligonucleotide
ttcatcccatccccgccccgtccttggttcatccc

SEQ ID NO: 124362 - DNA, 35 bp, Artificial Sequence
  Synthetic oligonucleotide
acaaccgaccgccttcagtttctcgtcaacaccgc

SEQ ID NO: 124363 - DNA, 34 bp, Artificial Sequence
  Synthetic oligonucleotide
tcaataccctcaagtgcttgtaccatcccatctc

SEQ ID NO: 124364 - DNA, 35 bp, Artificial Sequence
  Synthetic oligonucleotide
attgcctgtggccgcgtgctcctctcttgtttgtc

SEQ ID NO: 124365 - DNA, 34 bp, Artificial Sequence
  Synthetic oligonucleotide
tctttacgccgcagccccaccgccactcctctcg

SEQ ID NO: 124366 - DNA, 35 bp, Artificial Sequence
  Synthetic oligonucleotide
gatggggggcgagggcgggcgggcttcttcggaat

SEQ ID NO: 124367 - DNA, 35 bp, Artificial Sequence
  Synthetic oligonucleotide
taggctcagccgctattagtccccgccccgtccat

SEQ ID NO: 124368 - DNA, 36 bp, Artificial Sequence
  Synthetic oligonucleotide
agtgcccccccgtgtcctacgctcacaaccatgcca

SEQ ID NO: 124369 - DNA, 37 bp, Artificial Sequence
  Synthetic oligonucleotide
gctgcctccgggtttcttcgttctgccctattaccga

SEQ ID NO: 124370 - DNA, 35 bp, Artificial Sequence
  Synthetic oligonucleotide
accacaaggaacacaaagcaagaggggagggggga

SEQ ID NO: 124371 - DNA, 35 bp, Artificial Sequence
  Synthetic oligonucleotide
ggagtgctacagtatcgtccgtccttgcaaccccc

SEQ ID NO: 124372 - DNA, 35 bp, Artificial Sequence
  Synthetic oligonucleotide
gggtccattgccacctgctgtctcttatctaatcc

SEQ ID NO: 124373 - DNA, 35 bp, Artificial Sequence
  Synthetic oligonucleotide
gtgtacgtcgggcgttcactaccacctatccactg

SEQ ID NO: 124374 - DNA, 35 bp, Artificial Sequence
  Synthetic oligonucleotide
tatgcgccatacgctcagtcttttttgctcccact

SEQ ID NO: 124375 - DNA, 35 bp, Artificial Sequence
  Synthetic oligonucleotide
taggtccaccccagcggcaatttcatcctccccgt

SEQ ID NO: 124376 - DNA, 35 bp, Artificial Sequence
  Synthetic oligonucleotide
tgcacgccccatgcgttttatttacctctcaatca

SEQ ID NO: 124377 - DNA, 38 bp, Artificial Sequence
  Synthetic oligonucleotide
tctccgccccgcctttctaccgccccatggttcccaga

SEQ ID NO: 124378 - DNA, 36 bp, Artificial Sequence
  Synthetic oligonucleotide
ttgactctccgttgccctctcgttccctgttctaga

SEQ ID NO: 124379 - DNA, 35 bp, Artificial Sequence
  Synthetic oligonucleotide
gcctcacacctgctctgcgctttcttagttaccga

SEQ ID NO: 124380 - DNA, 35 bp, Artificial Sequence
  Synthetic oligonucleotide
aatggtagagccgaggaggggtcagaagggcggga

SEQ ID NO: 124381 - DNA, 38 bp, Artificial Sequence
  Synthetic oligonucleotide
gacaccgcccaatgtttcgttcgccgtataccctctga

SEQ ID NO: 124382 - DNA, 36 bp, Artificial Sequence
  Synthetic oligonucleotide
acacgggcgggacgggggaaacgaaaccgggacgta

SEQ ID NO: 124383 - DNA, 35 bp, Artificial Sequence
  Synthetic oligonucleotide
tccgtctctcgcagtacgcatttgcgctttcttcc

SEQ ID NO: 124384 - DNA, 35 bp, Artificial Sequence
  Synthetic oligonucleotide
gcagaccgcccaggccctcttctggctttcttctc

SEQ ID NO: 124385 - DNA, 35 bp, Artificial Sequence
  Synthetic oligonucleotide
gcccgccgcctaaacaccttgtctgagttaccttc

SEQ ID NO: 124386 - DNA, 35 bp, Artificial Sequence
  Synthetic oligonucleotide
gccctcacagttgcccccatcctcagcacatgccg

SEQ ID NO: 124387 - DNA, 35 bp, Artificial Sequence
  Synthetic oligonucleotide
tccctgatcgcgtgtttcggccaacatctcccctg

SEQ ID NO: 124388 - DNA, 35 bp, Artificial Sequence
  Synthetic oligonucleotide
acatcatccctgtcacgttaacccctcattcattg

SEQ ID NO: 124389 - DNA, 35 bp, Artificial Sequence
  Synthetic oligonucleotide
gcccctcctgcttttgccgcctgtcgctttatcct

SEQ ID NO: 124390 - DNA, 35 bp, Artificial Sequence
  Synthetic oligonucleotide
ggtgggaggaggggggtcgggagggttcgtttgaa

SEQ ID NO: 124391 - DNA, 35 bp, Artificial Sequence
  Synthetic oligonucleotide
acgatcacactctgcttcttatatattgcctatca

SEQ ID NO: 124392 - DNA, 37 bp, Artificial Sequence
  Synthetic oligonucleotide
ttgacaccgacaccctcgtctcccccggtccttgaga

SEQ ID NO: 124393 - DNA, 37 bp, Artificial Sequence
  Synthetic oligonucleotide
gcctcgcccttggatgcaatactgcccttctctccga

SEQ ID NO: 124394 - DNA, 38 bp, Artificial Sequence
  Synthetic oligonucleotide
tgtccgccacattactgccctccgctacccgcacgtga

SEQ ID NO: 124395 - DNA, 36 bp, Artificial Sequence
  Synthetic oligonucleotide
tccgcccaccccccgcacttatttgagccgctacta

SEQ ID NO: 124396 - DNA, 35 bp, Artificial Sequence
  Synthetic oligonucleotide
gtcacagatccgctgctccttctctacacaccgta

SEQ ID NO: 124397 - DNA, 35 bp, Artificial Sequence
  Synthetic oligonucleotide
attcaccaccagccctctttgcctcctgcggatac

SEQ ID NO: 124398 - DNA, 35 bp, Artificial Sequence
  Synthetic oligonucleotide
gctgagcccactccctccgtgatgatcactcgccc

SEQ ID NO: 124399 - DNA, 35 bp, Artificial Sequence
  Synthetic oligonucleotide
gtctgacggaactcccatccactctcatatgtgcc

SEQ ID NO: 124400 - DNA, 35 bp, Artificial Sequence
  Synthetic oligonucleotide
ggtcacccgtactcttctatttgcccgacacgcgc

SEQ ID NO: 124401 - DNA, 35 bp, Artificial Sequence
  Synthetic oligonucleotide
gacacctccccctctgtatggtagctactcgtcgc

SEQ ID NO: 124402 - DNA, 35 bp, Artificial Sequence
  Synthetic oligonucleotide
acacccgctgactgctccccggaaccacatcaatc

SEQ ID NO: 124403 - DNA, 35 bp, Artificial Sequence
  Synthetic oligonucleotide
gatcggaaccagtcgccccccttgcgtgatttctc

SEQ ID NO: 124404 - DNA, 35 bp, Artificial Sequence
  Synthetic oligonucleotide
acaatgggaggcggggcggctagcaggggacgggg

SEQ ID NO: 124405 - DNA, 36 bp, Artificial Sequence
  Synthetic oligonucleotide
tgtgctcgcctgttcccttgcccccgttgaatcaca

SEQ ID NO: 124406 - DNA, 35 bp, Artificial Sequence
  Synthetic oligonucleotide
ttcagcctcctgctttttggtaacgctcaccgcca

SEQ ID NO: 124407 - DNA, 38 bp, Artificial Sequence
  Synthetic oligonucleotide
gccgccgcttgcccgtgcgctgacccacccatacatga

SEQ ID NO: 124408 - DNA, 38 bp, Artificial Sequence
  Synthetic oligonucleotide
gacgggtgggtgggggtatgtagtacggttgggcttga

SEQ ID NO: 124409 - DNA, 36 bp, Artificial Sequence
  Synthetic oligonucleotide
gctccctccccagccttccccgtggcttatgcacta

SEQ ID NO: 124410 - DNA, 35 bp, Artificial Sequence
  Synthetic oligonucleotide
tgccccctcctcgccctaggatcattgacgtgcac

SEQ ID NO: 124411 - DNA, 35 bp, Artificial Sequence
  Synthetic oligonucleotide
tagccgccgtacccatacccttatatgacctcctc

SEQ ID NO: 124412 - DNA, 35 bp, Artificial Sequence
  Synthetic oligonucleotide
ttcgcgctcggcccgcgttcgctctactatccctg

SEQ ID NO: 124413 - DNA, 35 bp, Artificial Sequence
  Synthetic oligonucleotide
aacacttggtaccgtgcagtacgaccggcctccat

SEQ ID NO: 124414 - DNA, 35 bp, Artificial Sequence
  Synthetic oligonucleotide
gaacaagcgcccgtcctagcctagttctatcccct

SEQ ID NO: 124415 - DNA, 35 bp, Artificial Sequence
  Synthetic oligonucleotide
tcccgccgcaatccttcttgcttgtactcagccca

SEQ ID NO: 124416 - DNA, 38 bp, Artificial Sequence
  Synthetic oligonucleotide
ggtcaagataggggtgggggggaggaggaccgcggtga

SEQ ID NO: 124417 - DNA, 36 bp, Artificial Sequence
  Synthetic oligonucleotide
ttcatccgccgagtgtcaccactcccgatcccccta

SEQ ID NO: 124418 - DNA, 35 bp, Artificial Sequence
  Synthetic oligonucleotide
agcaccacccgcctgtatcactcgttccgttccgc

SEQ ID NO: 124419 - DNA, 35 bp, Artificial Sequence
  Synthetic oligonucleotide
ttcccccagctggtattctttgccctcccgacccg

SEQ ID NO: 124420 - DNA, 35 bp, Artificial Sequence
  Synthetic oligonucleotide
gcacgcccgagaagagttggatgggacgggggggg

SEQ ID NO: 124421 - DNA, 35 bp, Artificial Sequence
  Synthetic oligonucleotide
gtcccgccgggagtctgtgggtgggcgggtcactt

SEQ ID NO: 124422 - DNA, 35 bp, Artificial Sequence
  Synthetic oligonucleotide
cacacgtgccaccgtcgtctataccgctagccctt

SEQ ID NO: 124423 - DNA, 35 bp, Artificial Sequence
  Synthetic oligonucleotide
ggtatcacgtcgccgccgttttccctctaccgctt

SEQ ID NO: 124424 - DNA, 37 bp, Artificial Sequence
  Synthetic oligonucleotide
tccacgccccctccccttgtgactgccgtttcacaga

SEQ ID NO: 124425 - DNA, 37 bp, Artificial Sequence
  Synthetic oligonucleotide
tgccccgcctatcccatccgccatcgcgcctttacga

SEQ ID NO: 124426 - DNA, 37 bp, Artificial Sequence
  Synthetic oligonucleotide
gttgccctccgtgcccccgtgtgattcgccccgtgga

SEQ ID NO: 124427 - DNA, 35 bp, Artificial Sequence
  Synthetic oligonucleotide
ttcgccccgccggttttcttacaccatctgcttga

SEQ ID NO: 124428 - DNA, 36 bp, Artificial Sequence
  Synthetic oligonucleotide
aagggaaggaccgggggcgggaaggaatggcacgta

SEQ ID NO: 124429 - DNA, 35 bp, Artificial Sequence
  Synthetic oligonucleotide
gagctgacgtgctgccctgcctcttttccctggta

SEQ ID NO: 124430 - DNA, 35 bp, Artificial Sequence
  Synthetic oligonucleotide
tgagggcgcccgcctccccgctcacaccattgtcc

SEQ ID NO: 124431 - DNA, 35 bp, Artificial Sequence
  Synthetic oligonucleotide
gcacgcaacatcacattctatgcctcgccccccgc

SEQ ID NO: 124432 - DNA, 35 bp, Artificial Sequence
  Synthetic oligonucleotide
acgatgtgcacccgtaccgttgccttcccgacccg

SEQ ID NO: 124433 - DNA, 35 bp, Artificial Sequence
  Synthetic oligonucleotide
ttcgccacaccaccattcgcagccacggtttccgg

SEQ ID NO: 124434 - DNA, 35 bp, Artificial Sequence
  Synthetic oligonucleotide
gtgctcgcgcgccggttcgacttcgccccttccca

SEQ ID NO: 124435 - DNA, 36 bp, Artificial Sequence
  Synthetic oligonucleotide
tcgctatcgccaaactgttttgccctttcccgccga

SEQ ID NO: 124436 - DNA, 37 bp, Artificial Sequence
  Synthetic oligonucleotide
acaacccgcctctgctcttaactgataaccctgctga

SEQ ID NO: 124437 - DNA, 35 bp, Artificial Sequence
  Synthetic oligonucleotide
accgtgcgccgctacatatcagttaccacgcctcc

SEQ ID NO: 124438 - DNA, 35 bp, Artificial Sequence
  Synthetic oligonucleotide
attgcctccacccattttacgccccccttggtgtc

SEQ ID NO: 124439 - DNA, 35 bp, Artificial Sequence
  Synthetic oligonucleotide
aaactgcgcacgctgactccaccatgcattcattc

SEQ ID NO: 124440 - DNA, 35 bp, Artificial Sequence
  Synthetic oligonucleotide
gacccttggccacatgctaccggcgctctctgtag

SEQ ID NO: 124441 - DNA, 35 bp, Artificial Sequence
  Synthetic oligonucleotide
tacttcgccgtatcgtaccatctttgggctctgct

SEQ ID NO: 124442 - DNA, 36 bp, Artificial Sequence
  Synthetic oligonucleotide
tcctcccctcacccatcattgccgcctatggacgaa

SEQ ID NO: 124443 - DNA, 34 bp, Artificial Sequence
  Synthetic oligonucleotide
gtcccgacccctgtcccatgaactcgctccggaa

SEQ ID NO: 124444 - DNA, 35 bp, Artificial Sequence
  Synthetic oligonucleotide
tgccccgcctcgccatcaagtttcgaatcgtacca

SEQ ID NO: 124445 - DNA, 35 bp, Artificial Sequence
  Synthetic oligonucleotide
gtgggtggagagggagggggatttaggacgtctca

SEQ ID NO: 124446 - DNA, 37 bp, Artificial Sequence
  Synthetic oligonucleotide
gtgccgtaaggaggggcgaaaggcagggggtgggaga

SEQ ID NO: 124447 - DNA, 36 bp, Artificial Sequence
  Synthetic oligonucleotide
gggagggacgaacaagggatagaggaacatgagcga

SEQ ID NO: 124448 - DNA, 37 bp, Artificial Sequence
  Synthetic oligonucleotide
taaacgacagcacggtagggggggggaggcgaaagga

SEQ ID NO: 124449 - DNA, 38 bp, Artificial Sequence
  Synthetic oligonucleotide
tgaccacctgtccgcgtcatgtaatgctccacctctga

SEQ ID NO: 124450 - DNA, 38 bp, Artificial Sequence
  Synthetic oligonucleotide
gacaagaacggaacgggtagacggggaaggagcggtga

SEQ ID NO: 124451 - DNA, 38 bp, Artificial Sequence
  Synthetic oligonucleotide
atagcgcacgggagggagggtaatgcgccggggattga

SEQ ID NO: 124452 - DNA, 35 bp, Artificial Sequence
  Synthetic oligonucleotide
ttgacgtctttgctatttcgtctgtacccttcctc

SEQ ID NO: 124453 - DNA, 35 bp, Artificial Sequence
  Synthetic oligonucleotide
gtcctccgctcaccttcattgtctcgactccgagt

SEQ ID NO: 124454 - DNA, 36 bp, Artificial Sequence
  Synthetic oligonucleotide
tccgcagaccatgcctgttagcgcctttaccaccca

SEQ ID NO: 124455 - DNA, 37 bp, Artificial Sequence
  Synthetic oligonucleotide
gtccacgtccccttggcccgccccccgcacatacgga

SEQ ID NO: 124456 - DNA, 37 bp, Artificial Sequence
  Synthetic oligonucleotide
gtatgagcaggatggacagggaggggagtggtgggga

SEQ ID NO: 124457 - DNA, 38 bp, Artificial Sequence
  Synthetic oligonucleotide
tgcgaaacgtagcccgtgccgctgccctccttatttga

SEQ ID NO: 124458 - DNA, 36 bp, Artificial Sequence
  Synthetic oligonucleotide
tgtagacgcatctttgccattgtgcctcgctatcta

SEQ ID NO: 124459 - DNA, 35 bp, Artificial Sequence
  Synthetic oligonucleotide
gtgccccctcccatacttccaacagaacggaaccc

SEQ ID NO: 124460 - DNA, 35 bp, Artificial Sequence
  Synthetic oligonucleotide
gttccctccgtgccatgcatttacgcctaatgtcc

SEQ ID NO: 124461 - DNA, 35 bp, Artificial Sequence
  Synthetic oligonucleotide
accatcgtacgcgcatctccgagtgctgtctcctc

SEQ ID NO: 124462 - DNA, 35 bp, Artificial Sequence
  Synthetic oligonucleotide
tagtccctcccccgtacgctagcagccctgcggtc

SEQ ID NO: 124463 - DNA, 35 bp, Artificial Sequence
  Synthetic oligonucleotide
gttattcccgcctgcccgcccttgaccccactccg

SEQ ID NO: 124464 - DNA, 35 bp, Artificial Sequence
  Synthetic oligonucleotide
ggggccacagcccgcacccgctgccatcatcactt

SEQ ID NO: 124465 - DNA, 35 bp, Artificial Sequence
  Synthetic oligonucleotide
gacgcgaagcatatgacgctgcaccaaccaccctt

SEQ ID NO: 124466 - DNA, 35 bp, Artificial Sequence
  Synthetic oligonucleotide
tcaccatgccccttcccggttgccattccaccctt

SEQ ID NO: 124467 - DNA, 36 bp, Artificial Sequence
  Synthetic oligonucleotide
acacatcgcgccttcactgccatcaacactgaccca

SEQ ID NO: 124468 - DNA, 35 bp, Artificial Sequence
  Synthetic oligonucleotide
ttcagcctgccgaccccagcttagtttcatgccca

SEQ ID NO: 124469 - DNA, 35 bp, Artificial Sequence
  Synthetic oligonucleotide
ggagcaactctgcccctctatttcactgttcgcca

SEQ ID NO: 124470 - DNA, 35 bp, Artificial Sequence
  Synthetic oligonucleotide
gtgtaccgcactgtttttatcgtttctcttttcca

SEQ ID NO: 124471 - DNA, 36 bp, Artificial Sequence
  Synthetic oligonucleotide
acaatgacaggagaagggctgggataggggggggca

SEQ ID NO: 124472 - DNA, 36 bp, Artificial Sequence
  Synthetic oligonucleotide
acgtacttgcacaacgtgacctccacctgtttttca

SEQ ID NO: 124473 - DNA, 36 bp, Artificial Sequence
  Synthetic oligonucleotide
tgcgacaccgcccaccttccggtccgccttttacga

SEQ ID NO: 124474 - DNA, 37 bp, Artificial Sequence
  Synthetic oligonucleotide
tgacacccctgctttcggtcaccccctctctttccga

SEQ ID NO: 124475 - DNA, 37 bp, Artificial Sequence
  Synthetic oligonucleotide
atgatggggacaagggagaaggggaaggaaccggcga

SEQ ID NO: 124476 - DNA, 36 bp, Artificial Sequence
  Synthetic oligonucleotide
gcccccatcgccgcacggttttagcccggttttcga

SEQ ID NO: 124477 - DNA, 35 bp, Artificial Sequence
  Synthetic oligonucleotide
aacactggggaggggaggccggcgggacagtagga

SEQ ID NO: 124478 - DNA, 36 bp, Artificial Sequence
  Synthetic oligonucleotide
gacccggaagagaaggtgaggataggaatgcggtga

SEQ ID NO: 124479 - DNA, 35 bp, Artificial Sequence
  Synthetic oligonucleotide
gcgaacactacgcccatgttacccgcttctctccc

SEQ ID NO: 124480 - DNA, 35 bp, Artificial Sequence
  Synthetic oligonucleotide
acccggctcgcctgccagtcttttgatcctcccgc

SEQ ID NO: 124481 - DNA, 35 bp, Artificial Sequence
  Synthetic oligonucleotide
ttaccccccgcacactagcaatcgacttgttcctg

SEQ ID NO: 124482 - DNA, 35 bp, Artificial Sequence
  Synthetic oligonucleotide
ggtgtcgtcgatcctgccatttcgcttgtcctctg

SEQ ID NO: 124483 - DNA, 35 bp, Artificial Sequence
  Synthetic oligonucleotide
tactccctcgcccccccaggtatagcctcataaca

SEQ ID NO: 124484 - DNA, 37 bp, Artificial Sequence
  Synthetic oligonucleotide
gatcaccgagcattgcatagtcgcccgcccctcctga

SEQ ID NO: 124485 - DNA, 37 bp, Artificial Sequence
  Synthetic oligonucleotide
gagtagagaaggtaggagggtgaagtgagggaggtga

SEQ ID NO: 124486 - DNA, 35 bp, Artificial Sequence
  Synthetic oligonucleotide
ggagtgtgggaaagggagggcgacacgggatcata

SEQ ID NO: 124487 - DNA, 36 bp, Artificial Sequence
  Synthetic oligonucleotide
accagcgcattacggtcctcccctcgcccccgggta

SEQ ID NO: 124488 - DNA, 35 bp, Artificial Sequence
  Synthetic oligonucleotide
ttggagctctgattcatgttccccgtctgtctccc

SEQ ID NO: 124489 - DNA, 35 bp, Artificial Sequence
  Synthetic oligonucleotide
gatcggaccgagcctgtaccccgcaattttccgcc

SEQ ID NO: 124490 - DNA, 35 bp, Artificial Sequence
  Synthetic oligonucleotide
tggtcacccgcctttagcaataaccgtacgcttcc

SEQ ID NO: 124491 - DNA, 35 bp, Artificial Sequence
  Synthetic oligonucleotide
gcccgaggcggaggaggggtcctgaggcggagggc

SEQ ID NO: 124492 - DNA, 35 bp, Artificial Sequence
  Synthetic oligonucleotide
atacgccacactgtatggcgcttatctcccgactc

SEQ ID NO: 124493 - DNA, 35 bp, Artificial Sequence
  Synthetic oligonucleotide
attcgccagttgtctgccgtttctccgtctcgccg

SEQ ID NO: 124494 - DNA, 35 bp, Artificial Sequence
  Synthetic oligonucleotide
atagccgtcgccacctcgtgtctctactcctatcg

SEQ ID NO: 124495 - DNA, 35 bp, Artificial Sequence
  Synthetic oligonucleotide
tgatacccgcagccctcacccgttgctttgtcttt

SEQ ID NO: 124496 - DNA, 35 bp, Artificial Sequence
  Synthetic oligonucleotide
gccgtatttcctccgcgtcagtttcctctgctcca

SEQ ID NO: 124497 - DNA, 35 bp, Artificial Sequence
  Synthetic oligonucleotide
acaccactcaccatgcccttgtcgcttataactca

SEQ ID NO: 124498 - DNA, 37 bp, Artificial Sequence
  Synthetic oligonucleotide
gtcgggcgtacgtccttcagttaggggcgggggggga

SEQ ID NO: 124499 - DNA, 38 bp, Artificial Sequence
  Synthetic oligonucleotide
gcaggggggggtaaagggctaaataacgggagacgtga

SEQ ID NO: 124500 - DNA, 37 bp, Artificial Sequence
  Synthetic oligonucleotide
attgcgggtggaggaggaatttgggataggggggtga

SEQ ID NO: 124501 - DNA, 37 bp, Artificial Sequence
  Synthetic oligonucleotide
atccagccctccgcacaagacctagcgccccccttga

SEQ ID NO: 124502 - DNA, 38 bp, Artificial Sequence
  Synthetic oligonucleotide
tgtttccgccccctctgttcgccttgcccagatcttga

SEQ ID NO: 124503 - DNA, 36 bp, Artificial Sequence
  Synthetic oligonucleotide
atgtccaccagtgccccctccgcctcgttcgtttga

SEQ ID NO: 124504 - DNA, 36 bp, Artificial Sequence
  Synthetic oligonucleotide
ttgacatcccctctccggttttgtgtaggtttccta

SEQ ID NO: 124505 - DNA, 35 bp, Artificial Sequence
  Synthetic oligonucleotide
gactcgccgtccccctttgcaacgttcacttcgac

SEQ ID NO: 124506 - DNA, 35 bp, Artificial Sequence
  Synthetic oligonucleotide
aacgacattgtagttttgtcttccctccccccccc

SEQ ID NO: 124507 - DNA, 35 bp, Artificial Sequence
  Synthetic oligonucleotide
ttcatccccggatcttcgttgccacggccatacgc

SEQ ID NO: 124508 - DNA, 35 bp, Artificial Sequence
  Synthetic oligonucleotide
gtgactttgcctactacgcgtgactatctgccatc

SEQ ID NO: 124509 - DNA, 35 bp, Artificial Sequence
  Synthetic oligonucleotide
acagcaggttgccatccttgttcttgttccccgtc

SEQ ID NO: 124510 - DNA, 35 bp, Artificial Sequence
  Synthetic oligonucleotide
taaacccccctcggtgtgctaatgcctactctcat

SEQ ID NO: 124511 - DNA, 35 bp, Artificial Sequence
  Synthetic oligonucleotide
taacaaccgccgtagccacctgtccttttctttgt

SEQ ID NO: 124512 - DNA, 36 bp, Artificial Sequence
  Synthetic oligonucleotide
gctgaggggtctgtgcgaggggagggatggggaaca

SEQ ID NO: 124513 - DNA, 36 bp, Artificial Sequence
  Synthetic oligonucleotide
gtggtcccttgccctttgccttccacggtaagccca

SEQ ID NO: 124514 - DNA, 36 bp, Artificial Sequence
  Synthetic oligonucleotide
ttcacaaccttgccctgtcactatctgccctatgga

SEQ ID NO: 124515 - DNA, 37 bp, Artificial Sequence
  Synthetic oligonucleotide
attccgcaccggcgctccccaatctcctgcctttgga

SEQ ID NO: 124516 - DNA, 37 bp, Artificial Sequence
  Synthetic oligonucleotide
ggaggagacacaggggatggggaggccgttagggtga

SEQ ID NO: 124517 - DNA, 36 bp, Artificial Sequence
  Synthetic oligonucleotide
tgcccggtgagtgggtggggtgttatgggtggaata

SEQ ID NO: 124518 - DNA, 35 bp, Artificial Sequence
  Synthetic oligonucleotide
ggagggtggggggtggaaggagggccgtcgggata

SEQ ID NO: 124519 - DNA, 35 bp, Artificial Sequence
  Synthetic oligonucleotide
ttccccccccaccccgatgtgctgtcccctattta

SEQ ID NO: 124520 - DNA, 25 bp, Artificial Sequence
  Synthetic oligonucleotide
ccccacctcttttcctgccctttgc

SEQ ID NO: 124521 - DNA, 35 bp, Artificial Sequence
  Synthetic oligonucleotide
taggggtgggaggggttgaccgtgcgtagaggggg

SEQ ID NO: 124522 - DNA, 35 bp, Artificial Sequence
  Synthetic oligonucleotide
taccacaccctcatgctgcataatcgcttgcccat

SEQ ID NO: 124523 - DNA, 35 bp, Artificial Sequence
  Synthetic oligonucleotide
tcccgccgccactctgctcagctcacttaccggat

SEQ ID NO: 124524 - DNA, 35 bp, Artificial Sequence
  Synthetic oligonucleotide
gccctaggtgcgccctgtccgttttccaccaattt

SEQ ID NO: 124525 - DNA, 35 bp, Artificial Sequence
  Synthetic oligonucleotide
gtcaccgcctcttcatacagccctgtttttcattt

SEQ ID NO: 124526 - DNA, 35 bp, Artificial Sequence
  Synthetic oligonucleotide
acccacctgttccatcccgaatcccagcccctgaa

SEQ ID NO: 124527 - DNA, 36 bp, Artificial Sequence
  Synthetic oligonucleotide
accaccgcctcatacttaccacaaacccagtccgca

SEQ ID NO: 124528 - DNA, 35 bp, Artificial Sequence
  Synthetic oligonucleotide
tgtagccgagtggggtcggtggggggggaagggca

SEQ ID NO: 124529 - DNA, 35 bp, Artificial Sequence
  Synthetic oligonucleotide
tgggcgggaggccgaggcgggaggaggggctggga

SEQ ID NO: 124530 - DNA, 38 bp, Artificial Sequence
  Synthetic oligonucleotide
gagacagggcggggtgggctgctacaggggcatggtga

SEQ ID NO: 124531 - DNA, 38 bp, Artificial Sequence
  Synthetic oligonucleotide
gcacgggccatacagcagggaagggacggggatggtga

SEQ ID NO: 124532 - DNA, 35 bp, Artificial Sequence
  Synthetic oligonucleotide
ttcgagggcgtgctcgaactccatctttagccatc

SEQ ID NO: 124533 - DNA, 35 bp, Artificial Sequence
  Synthetic oligonucleotide
tgtccactcgctctttatccgggcctatgctcctc

SEQ ID NO: 124534 - DNA, 35 bp, Artificial Sequence
  Synthetic oligonucleotide
acgcggtctggagaggaagacggagggagtgagag

SEQ ID NO: 124535 - DNA, 35 bp, Artificial Sequence
  Synthetic oligonucleotide
tggacaccacccttctgtcctcgggcccactcgcg

SEQ ID NO: 124536 - DNA, 36 bp, Artificial Sequence
  Synthetic oligonucleotide
ggggggggagagtgggagggaacaacttgtcaggga

SEQ ID NO: 124537 - DNA, 37 bp, Artificial Sequence
  Synthetic oligonucleotide
aaagagaggcaatgaaggcgaggggtaaggggggtga

SEQ ID NO: 124538 - DNA, 38 bp, Artificial Sequence
  Synthetic oligonucleotide
gccaacgccttctcctcaacgtgcgccacatctcttga

SEQ ID NO: 124539 - DNA, 36 bp, Artificial Sequence
  Synthetic oligonucleotide
gtctcgcccccaatgttccatcgatttcggttcgta

SEQ ID NO: 124540 - DNA, 35 bp, Artificial Sequence
  Synthetic oligonucleotide
aaagcacaatcggggtggggggcggaggaaatgac

SEQ ID NO: 124541 - DNA, 35 bp, Artificial Sequence
  Synthetic oligonucleotide
ttaggggacagaggggtggagcgcattaggtgggg

SEQ ID NO: 124542 - DNA, 33 bp, Artificial Sequence
  Synthetic oligonucleotide
gccgccacctgtccggtccgctaccttaccctt

SEQ ID NO: 124543 - DNA, 35 bp, Artificial Sequence
  Synthetic oligonucleotide
aaccgagccgccccaacccctgcagccctaacgtt

SEQ ID NO: 124544 - DNA, 36 bp, Artificial Sequence
  Synthetic oligonucleotide
gcacgccacgaccctgtttccgtaagccctcttgaa

SEQ ID NO: 124545 - DNA, 37 bp, Artificial Sequence
  Synthetic oligonucleotide
agctccgcccctcgctgcgtataccctccaaccgcga

SEQ ID NO: 124546 - DNA, 37 bp, Artificial Sequence
  Synthetic oligonucleotide
gctcaccccgctttactagacccccagcccacccgga

SEQ ID NO: 124547 - DNA, 37 bp, Artificial Sequence
  Synthetic oligonucleotide
aggggggcaccctatgttgggcgggctcctagaggga

SEQ ID NO: 124548 - DNA, 38 bp, Artificial Sequence
  Synthetic oligonucleotide
agatccgtcagggagggagaacggagagaggggcgtga

SEQ ID NO: 124549 - DNA, 38 bp, Artificial Sequence
  Synthetic oligonucleotide
tgccaaggaataggagggagagcgagggagcatggtga

SEQ ID NO: 124550 - DNA, 35 bp, Artificial Sequence
  Synthetic oligonucleotide
cccaccccctggtgttttacccggtcctactgccc

SEQ ID NO: 124551 - DNA, 35 bp, Artificial Sequence
  Synthetic oligonucleotide
ttggaacagtgcacaccgctcctcttcgcctcgcc

SEQ ID NO: 124552 - DNA, 36 bp, Artificial Sequence
  Synthetic oligonucleotide
gccacccgtactccccccgtctactccgcttgtatg

SEQ ID NO: 124553 - DNA, 35 bp, Artificial Sequence
  Synthetic oligonucleotide
atccagctgcgattccttcacctacaccctccgtg

SEQ ID NO: 124554 - DNA, 35 bp, Artificial Sequence
  Synthetic oligonucleotide
ttccccacagtccatgcccgcccccatggcgcctt

SEQ ID NO: 124555 - DNA, 36 bp, Artificial Sequence
  Synthetic oligonucleotide
gaccacgggtggtgtgggcagaaaagcgagggggaa

SEQ ID NO: 124556 - DNA, 36 bp, Artificial Sequence
  Synthetic oligonucleotide
aaccgcgccgcactcgctttaacaaccgtaccgcca

SEQ ID NO: 124557 - DNA, 36 bp, Artificial Sequence
  Synthetic oligonucleotide
acctgccgccacggtaaagcctcacgcacgccctca

SEQ ID NO: 124558 - DNA, 36 bp, Artificial Sequence
  Synthetic oligonucleotide
gacaccccgtaattgtactgcgccggcttaccttca

SEQ ID NO: 124559 - DNA, 37 bp, Artificial Sequence
  Synthetic oligonucleotide
gcaaggaggggggcaattagcggttaacagggcggga

SEQ ID NO: 124560 - DNA, 35 bp, Artificial Sequence
  Synthetic oligonucleotide
tcttccgcctgttctgtttccggcatacatcctta

SEQ ID NO: 124561 - DNA, 35 bp, Artificial Sequence
  Synthetic oligonucleotide
gtcgagcgtatccaccgttaagccgcctatccacc

SEQ ID NO: 124562 - DNA, 35 bp, Artificial Sequence
  Synthetic oligonucleotide
tgctcaaccccagccctacaaagacacccccgacc

SEQ ID NO: 124563 - DNA, 35 bp, Artificial Sequence
  Synthetic oligonucleotide
tgtgactacccggccatatcgcaacccatgttccc

SEQ ID NO: 124564 - DNA, 35 bp, Artificial Sequence
  Synthetic oligonucleotide
ttgcggaaccggatcagtcccttacaacacgctcc

SEQ ID NO: 124565 - DNA, 35 bp, Artificial Sequence
  Synthetic oligonucleotide
tcccccgtttgcctcctgtgccacgcggcccttcc

SEQ ID NO: 124566 - DNA, 35 bp, Artificial Sequence
  Synthetic oligonucleotide
actcatccgccccctcacccaggttagggcctctc

SEQ ID NO: 124567 - DNA, 35 bp, Artificial Sequence
  Synthetic oligonucleotide
gccagccttctgcctttgcgctcacctccggcttc

SEQ ID NO: 124568 - DNA, 35 bp, Artificial Sequence
  Synthetic oligonucleotide
tccacgcaggttatctggtacttatgcctttcttc

SEQ ID NO: 124569 - DNA, 35 bp, Artificial Sequence
  Synthetic oligonucleotide
aacccctcatgccagccgtagcgcctttccatcca

SEQ ID NO: 124570 - DNA, 35 bp, Artificial Sequence
  Synthetic oligonucleotide
gtcactcgctgtccctggtatagctcgccctttca

SEQ ID NO: 124571 - DNA, 36 bp, Artificial Sequence
  Synthetic oligonucleotide
tacgcgatcccctgcccgactaacccacagttctta

SEQ ID NO: 124572 - DNA, 35 bp, Artificial Sequence
  Synthetic oligonucleotide
ttccgcccccagcggttacatcctgtttatctaac

SEQ ID NO: 124573 - DNA, 36 bp, Artificial Sequence
  Synthetic oligonucleotide
acaccgtcgtttgcgaccatcctgcctcggtgccac

SEQ ID NO: 124574 - DNA, 35 bp, Artificial Sequence
  Synthetic oligonucleotide
tctacgaaccgggcagactgttacccctgcgctcc

SEQ ID NO: 124575 - DNA, 35 bp, Artificial Sequence
  Synthetic oligonucleotide
atgtgcgaagcctgttcgtcattcaaccgtgctcc

SEQ ID NO: 124576 - DNA, 35 bp, Artificial Sequence
  Synthetic oligonucleotide
tgaccccccttatggttgaagtacccgtggtcctc

SEQ ID NO: 124577 - DNA, 36 bp, Artificial Sequence
  Synthetic oligonucleotide
gaacatggcctgcttggtctaacggtccctccttcg

SEQ ID NO: 124578 - DNA, 35 bp, Artificial Sequence
  Synthetic oligonucleotide
acgccccccgctttccctcagtctccccctctcgg

SEQ ID NO: 124579 - DNA, 30 bp, Artificial Sequence
  Synthetic oligonucleotide
tagtcgtggaccccccccccgtcctgcctt

SEQ ID NO: 124580 - DNA, 36 bp, Artificial Sequence
  Synthetic oligonucleotide
tactcgcccaacccagctattcgtcccactgctcca

SEQ ID NO: 124581 - DNA, 36 bp, Artificial Sequence
  Synthetic oligonucleotide
ttggaccctccaatttatatgacccttctgcttcca

SEQ ID NO: 124582 - DNA, 38 bp, Artificial Sequence
  Synthetic oligonucleotide
gaccgccacttgctcgtacctggccaaccaccttatga

SEQ ID NO: 124583 - DNA, 35 bp, Artificial Sequence
  Synthetic oligonucleotide
accgttgaccggtcgctctgccctgacccctcacc

SEQ ID NO: 124584 - DNA, 35 bp, Artificial Sequence
  Synthetic oligonucleotide
agtgcctggtcgcctcatatctgcccgcaatgccc

SEQ ID NO: 124585 - DNA, 35 bp, Artificial Sequence
  Synthetic oligonucleotide
atcctcacgccgggtagctatctcacggtcatccc

SEQ ID NO: 124586 - DNA, 35 bp, Artificial Sequence
  Synthetic oligonucleotide
gtgccctatccgatgactgttccgtctaccccatc

SEQ ID NO: 124587 - DNA, 36 bp, Artificial Sequence
  Synthetic oligonucleotide
gggaggagggagaaaaggggcgtgagtaacagaaga

SEQ ID NO: 124588 - DNA, 37 bp, Artificial Sequence
  Synthetic oligonucleotide
tcgtaggggcacggggaggggaacaaggtaggacgga

SEQ ID NO: 124589 - DNA, 37 bp, Artificial Sequence
  Synthetic oligonucleotide
tcaagtgtcaaaatggcggagggggcgggcgggatga

SEQ ID NO: 124590 - DNA, 38 bp, Artificial Sequence
  Synthetic oligonucleotide
tagtgcgcccgtttcatccttccgccgtccttgtatga

SEQ ID NO: 124591 - DNA, 35 bp, Artificial Sequence
  Synthetic oligonucleotide
gacccaccctccgtttgctagaaactgatgctctc

SEQ ID NO: 124592 - DNA, 34 bp, Artificial Sequence
  Synthetic oligonucleotide
taagtatgccctctgcttgtcaccaatctcgttc

SEQ ID NO: 124593 - DNA, 35 bp, Artificial Sequence
  Synthetic oligonucleotide
tatgcaatcggtcaagtggcgcacactcccccccg

SEQ ID NO: 124594 - DNA, 36 bp, Artificial Sequence
  Synthetic oligonucleotide
tcaccgtccccctattgcttaatggtacgtcttcca

SEQ ID NO: 124595 - DNA, 37 bp, Artificial Sequence
  Synthetic oligonucleotide
gctccacaggtgatattctgctcccctctctccacga

SEQ ID NO: 124596 - DNA, 37 bp, Artificial Sequence
  Synthetic oligonucleotide
gtgcgcgccctagccgtcacgttccttcattgcccga

SEQ ID NO: 124597 - DNA, 36 bp, Artificial Sequence
  Synthetic oligonucleotide
ttcgtcgcctcgctttcttcgtctgccatccctcga

SEQ ID NO: 124598 - DNA, 37 bp, Artificial Sequence
  Synthetic oligonucleotide
atcacctcacaccccccagccttcctgtaccggagga

SEQ ID NO: 124599 - DNA, 36 bp, Artificial Sequence
  Synthetic oligonucleotide
ggaacaaggacgagggggaggtaggtacgggatgga

SEQ ID NO: 124600 - DNA, 37 bp, Artificial Sequence
  Synthetic oligonucleotide
agggcggggagggggggcaggaccgggagtcgcgtga

SEQ ID NO: 124601 - DNA, 36 bp, Artificial Sequence
  Synthetic oligonucleotide
atccaccactccacacccctgtatatgtcgaactta

SEQ ID NO: 124602 - DNA, 35 bp, Artificial Sequence
  Synthetic oligonucleotide
gagtcacactgcctttgcgtagccacgccttctac

SEQ ID NO: 124603 - DNA, 35 bp, Artificial Sequence
  Synthetic oligonucleotide
ggtcgacccgcgtcatcccgacttccccccatccc

SEQ ID NO: 124604 - DNA, 35 bp, Artificial Sequence
  Synthetic oligonucleotide
tcaccgacatctatcacgcatgccgctatcttgcc

SEQ ID NO: 124605 - DNA, 35 bp, Artificial Sequence
  Synthetic oligonucleotide
tcccgtccggctggtgcccgtgccggttaccctcc

SEQ ID NO: 124606 - DNA, 35 bp, Artificial Sequence
  Synthetic oligonucleotide
agccccaagccagtctcgtctgctcctcttcgctc

SEQ ID NO: 124607 - DNA, 35 bp, Artificial Sequence
  Synthetic oligonucleotide
aggccatccgccttgtgtctccgccttgccccttc

SEQ ID NO: 124608 - DNA, 35 bp, Artificial Sequence
  Synthetic oligonucleotide
gacgccatccccttcccttgtttgatcttgttggt

SEQ ID NO: 124609 - DNA, 36 bp, Artificial Sequence
  Synthetic oligonucleotide
tgttccctccgtactgaacccttgctactacatgca

SEQ ID NO: 124610 - DNA, 36 bp, Artificial Sequence
  Synthetic oligonucleotide
aactccgctgcactgcccctggtaccccgctacgga

SEQ ID NO: 124611 - DNA, 38 bp, Artificial Sequence
  Synthetic oligonucleotide
ggtgccggggcgggggggaagggacctagcgtgcttga

SEQ ID NO: 124612 - DNA, 35 bp, Artificial Sequence
  Synthetic oligonucleotide
gcgtgccttcgcccatgtgcccacacgccacccta

SEQ ID NO: 124613 - DNA, 35 bp, Artificial Sequence
  Synthetic oligonucleotide
tcaacactccaaagttctgtcaagccttctcgtac

SEQ ID NO: 124614 - DNA, 35 bp, Artificial Sequence
  Synthetic oligonucleotide
acctgccattggttaccgcgattcttgttttcccc

SEQ ID NO: 124615 - DNA, 35 bp, Artificial Sequence
  Synthetic oligonucleotide
acgcccccctcgcaacaacttactagagctccatc

SEQ ID NO: 124616 - DNA, 35 bp, Artificial Sequence
  Synthetic oligonucleotide
gtacacgttcggcactcgtatttgcacgttacctc

SEQ ID NO: 124617 - DNA, 35 bp, Artificial Sequence
  Synthetic oligonucleotide
tgcagacctgctctttcgcccgacgcgtcccgctc

SEQ ID NO: 124618 - DNA, 35 bp, Artificial Sequence
  Synthetic oligonucleotide
gagggaggtagggacaaaaggataagtgggtcggg

SEQ ID NO: 124619 - DNA, 35 bp, Artificial Sequence
  Synthetic oligonucleotide
gtagatccgccccccgttttacccgtttcctgtct

SEQ ID NO: 124620 - DNA, 34 bp, Artificial Sequence
  Synthetic oligonucleotide
ttcgccccctccctgcattgttagctttcacctt

SEQ ID NO: 124621 - DNA, 36 bp, Artificial Sequence
  Synthetic oligonucleotide
gatgtgtccgtgccacccctgtgctttgattaccca

SEQ ID NO: 124622 - DNA, 37 bp, Artificial Sequence
  Synthetic oligonucleotide
atgtgccccctccttctgccgccgcctgcttgaacga

SEQ ID NO: 124623 - DNA, 37 bp, Artificial Sequence
  Synthetic oligonucleotide
tgtgcgtgtccaaacgcgctgttcaccccccctctga

SEQ ID NO: 124624 - DNA, 38 bp, Artificial Sequence
  Synthetic oligonucleotide
actcacgtccgccgccccttactacagcatcgctctga

SEQ ID NO: 124625 - DNA, 36 bp, Artificial Sequence
  Synthetic oligonucleotide
acgcgggtggggagggtagtgggggttaggaagtga

SEQ ID NO: 124626 - DNA, 38 bp, Artificial Sequence
  Synthetic oligonucleotide
gtccgctgacctcaccgcctataccatctgcctcgtga

SEQ ID NO: 124627 - DNA, 38 bp, Artificial Sequence
  Synthetic oligonucleotide
agtgcagagcatcacccctcgtttcgcctgtcccttga

SEQ ID NO: 124628 - DNA, 38 bp, Artificial Sequence
  Synthetic oligonucleotide
gccgcaccattcacgtcgttctacgcccacttctttga

SEQ ID NO: 124629 - DNA, 36 bp, Artificial Sequence
  Synthetic oligonucleotide
gtcaacccatatcgcctcagctccccgtcccccgta

SEQ ID NO: 124630 - DNA, 36 bp, Artificial Sequence
  Synthetic oligonucleotide
gagctgccgcccacattttttaccgctccctgctta

SEQ ID NO: 124631 - DNA, 36 bp, Artificial Sequence
  Synthetic oligonucleotide
acgtgccccgaatcgtatcgttccttctcgttctta

SEQ ID NO: 124632 - DNA, 35 bp, Artificial Sequence
  Synthetic oligonucleotide
gactggctcctcgcagcttgattttccttccgttc

SEQ ID NO: 124633 - DNA, 36 bp, Artificial Sequence
  Synthetic oligonucleotide
tcacccgcttgttgcgaacccagactccctcctcca

SEQ ID NO: 124634 - DNA, 36 bp, Artificial Sequence
  Synthetic oligonucleotide
tcacacaccctcacacttgggtggccctgcccctca

SEQ ID NO: 124635 - DNA, 37 bp, Artificial Sequence
  Synthetic oligonucleotide
tttgcgtgccctccgctctagccctgttctcttacga

SEQ ID NO: 124636 - DNA, 37 bp, Artificial Sequence
  Synthetic oligonucleotide
aagggggagggggtggtggcggtggctggcttatcga

SEQ ID NO: 124637 - DNA, 37 bp, Artificial Sequence
  Synthetic oligonucleotide
agggaggagagggaggggtgagactgtgggcgaagga

SEQ ID NO: 124638 - DNA, 37 bp, Artificial Sequence
  Synthetic oligonucleotide
ggaggacggaggggacggtgaccaggatataggggga

SEQ ID NO: 124639 - DNA, 36 bp, Artificial Sequence
  Synthetic oligonucleotide
gtcttgcaacaaaagggagcaaaagggaggggggga

SEQ ID NO: 124640 - DNA, 37 bp, Artificial Sequence
  Synthetic oligonucleotide
gcattgactcgccctcacatctgtcttccaccatgga

SEQ ID NO: 124641 - DNA, 38 bp, Artificial Sequence
  Synthetic oligonucleotide
tgactcgacctgccttgcgtttctccgctcgtccctga

SEQ ID NO: 124642 - DNA, 38 bp, Artificial Sequence
  Synthetic oligonucleotide
gcaccctctcccgttcgttcgccctcacccccgattga

SEQ ID NO: 124643 - DNA, 36 bp, Artificial Sequence
  Synthetic oligonucleotide
tgtgggtggggggggtaggaggggaggacaaggata

SEQ ID NO: 124644 - DNA, 36 bp, Artificial Sequence
  Synthetic oligonucleotide
tgctacccgcctgcacccgaaggtacttccccgtta

SEQ ID NO: 124645 - DNA, 35 bp, Artificial Sequence
  Synthetic oligonucleotide
gacgaagcctcttcctccgtattgttacgctttta

SEQ ID NO: 124646 - DNA, 35 bp, Artificial Sequence
  Synthetic oligonucleotide
gcgttgtccctgttttctcgccgcccgtatcttac

SEQ ID NO: 124647 - DNA, 34 bp, Artificial Sequence
  Synthetic oligonucleotide
aacctctgtacattgacgcgaccgccttgctccc

SEQ ID NO: 124648 - DNA, 35 bp, Artificial Sequence
  Synthetic oligonucleotide
gtgaccaggagcattgcgcccctaagaccacctcc

SEQ ID NO: 124649 - DNA, 36 bp, Artificial Sequence
  Synthetic oligonucleotide
gggaggggggaacatgggtactggtgatggagcagc

SEQ ID NO: 124650 - DNA, 35 bp, Artificial Sequence
  Synthetic oligonucleotide
aggaggaggaggagcggataggggaggggggaatc

SEQ ID NO: 124651 - DNA, 35 bp, Artificial Sequence
  Synthetic oligonucleotide
gaacttgcaggggcgtagggcgggggggcggagag

SEQ ID NO: 124652 - DNA, 36 bp, Artificial Sequence
  Synthetic oligonucleotide
gattgcgctaccagttcgcccgccattgcccctcca

SEQ ID NO: 124653 - DNA, 36 bp, Artificial Sequence
  Synthetic oligonucleotide
tcgcgctgtacccgcccatccgcactcgccttcgca

SEQ ID NO: 124654 - DNA, 37 bp, Artificial Sequence
  Synthetic oligonucleotide
gaccagccccatttcctattagcatctcccggcctga

SEQ ID NO: 124655 - DNA, 36 bp, Artificial Sequence
  Synthetic oligonucleotide
tccacctcgccgccatgaacccctatgcccccctta

SEQ ID NO: 124656 - DNA, 36 bp, Artificial Sequence
  Synthetic oligonucleotide
tacgggcccctccatctatcttgctgtacctcttta

SEQ ID NO: 124657 - DNA, 34 bp, Artificial Sequence
  Synthetic oligonucleotide
ttcgaccacaacttcgggttattctggccacctc

SEQ ID NO: 124658 - DNA, 35 bp, Artificial Sequence
  Synthetic oligonucleotide
acccgggctgccctccgatcttctctctttacttc

SEQ ID NO: 124659 - DNA, 35 bp, Artificial Sequence
  Synthetic oligonucleotide
tgataccgccatcatgccgccgttttctcatcatg

SEQ ID NO: 124660 - DNA, 35 bp, Artificial Sequence
  Synthetic oligonucleotide
agtccgtactggctgtcctccgcttgggtccacct

SEQ ID NO: 124661 - DNA, 36 bp, Artificial Sequence
  Synthetic oligonucleotide
gccatcggcaaagggcgggtgaggagggaagttcaa

SEQ ID NO: 124662 - DNA, 35 bp, Artificial Sequence
  Synthetic oligonucleotide
tccgcccccttcccttgtgcagactagtgcacaga

SEQ ID NO: 124663 - DNA, 37 bp, Artificial Sequence
  Synthetic oligonucleotide
ggtggaacggggaagaggtgctggtggggggagggga

SEQ ID NO: 124664 - DNA, 38 bp, Artificial Sequence
  Synthetic oligonucleotide
gttcagcccatttctgctctcaccaacgccctccgtga

SEQ ID NO: 124665 - DNA, 36 bp, Artificial Sequence
  Synthetic oligonucleotide
gtgtccggtagatgaccatgccctcgttgtccctta

SEQ ID NO: 124666 - DNA, 35 bp, Artificial Sequence
  Synthetic oligonucleotide
gcccacccgcccatattcgttctgctaccatcgac

SEQ ID NO: 124667 - DNA, 35 bp, Artificial Sequence
  Synthetic oligonucleotide
atgtgcctccgccctgttgacgcccaccacttccc

SEQ ID NO: 124668 - DNA, 35 bp, Artificial Sequence
  Synthetic oligonucleotide
aaggcccccgaccctgaatgacgcccttctgttgc

SEQ ID NO: 124669 - DNA, 35 bp, Artificial Sequence
  Synthetic oligonucleotide
gccatccccctcttgttccggtgccctgtttactc

SEQ ID NO: 124670 - DNA, 35 bp, Artificial Sequence
  Synthetic oligonucleotide
acctcctgcaggcctcccatacgttgttctctgtc

SEQ ID NO: 124671 - DNA, 35 bp, Artificial Sequence
  Synthetic oligonucleotide
gaccacctgtgtgaatgtcagccacttgttccttc

SEQ ID NO: 124672 - DNA, 35 bp, Artificial Sequence
  Synthetic oligonucleotide
gcaccactattgcattagtccattcgccctttgag

SEQ ID NO: 124673 - DNA, 35 bp, Artificial Sequence
  Synthetic oligonucleotide
acccaactcggccccaaagccccgcgttttacccg

SEQ ID NO: 124674 - DNA, 34 bp, Artificial Sequence
  Synthetic oligonucleotide
agcaggaagaggtacgggggggaagggggcgttt

SEQ ID NO: 124675 - DNA, 36 bp, Artificial Sequence
  Synthetic oligonucleotide
tccgcgacagcccttccgttacgttgcccgaccaca

SEQ ID NO: 124676 - DNA, 37 bp, Artificial Sequence
  Synthetic oligonucleotide
agcacgaagggagaaaaagggggggaagacgtatgga

SEQ ID NO: 124677 - DNA, 37 bp, Artificial Sequence
  Synthetic oligonucleotide
gccccgttccccccccagttacagtccgctaccgtga

SEQ ID NO: 124678 - DNA, 37 bp, Artificial Sequence
  Synthetic oligonucleotide
gaccagtttcagccgattgcacctccgcccctcttga

SEQ ID NO: 124679 - DNA, 35 bp, Artificial Sequence
  Synthetic oligonucleotide
atccaccacccgtgtccgtattactcctctaacac

SEQ ID NO: 124680 - DNA, 35 bp, Artificial Sequence
  Synthetic oligonucleotide
tcgcaccgcctattctatattatcgccccatcgac

SEQ ID NO: 124681 - DNA, 35 bp, Artificial Sequence
  Synthetic oligonucleotide
taagacacctccatgctcgctgcaccgtgccctgc

SEQ ID NO: 124682 - DNA, 35 bp, Artificial Sequence
  Synthetic oligonucleotide
tgcccccgcccccgccatggcgacttcgtcgctgc

SEQ ID NO: 124683 - DNA, 35 bp, Artificial Sequence
  Synthetic oligonucleotide
tagttgcatcctcataccccttccgccgttccccg

SEQ ID NO: 124684 - DNA, 35 bp, Artificial Sequence
  Synthetic oligonucleotide
tgattgagcccagtatgtttcaactcccccccgcg

SEQ ID NO: 124685 - DNA, 36 bp, Artificial Sequence
  Synthetic oligonucleotide
tggataagggggtgaagggggtgcggggaacagtaa

SEQ ID NO: 124686 - DNA, 36 bp, Artificial Sequence
  Synthetic oligonucleotide
gtcacgccgtatgccctccgtttaccccacccgaca

SEQ ID NO: 124687 - DNA, 36 bp, Artificial Sequence
  Synthetic oligonucleotide
tttgcctgcgtacgtcgccttcatactgcccgtcca

SEQ ID NO: 124688 - DNA, 35 bp, Artificial Sequence
  Synthetic oligonucleotide
gaggggtgggggcatggtggggtgttgaggatgca

SEQ ID NO: 124689 - DNA, 37 bp, Artificial Sequence
  Synthetic oligonucleotide
agcgggtgacaggggagagagggggcggcaacctaga

SEQ ID NO: 124690 - DNA, 37 bp, Artificial Sequence
  Synthetic oligonucleotide
tgagcccaccgcttgtctttacctccgctccgtagga

SEQ ID NO: 124691 - DNA, 37 bp, Artificial Sequence
  Synthetic oligonucleotide
agacaggggggagctaagcagcgggaaccacggggga

SEQ ID NO: 124692 - DNA, 36 bp, Artificial Sequence
  Synthetic oligonucleotide
gtgggtataggggggcgagggtggacaagtggggga

SEQ ID NO: 124693 - DNA, 37 bp, Artificial Sequence
  Synthetic oligonucleotide
acctggcccccgcacaccgtttcccacctctcactga

SEQ ID NO: 124694 - DNA, 37 bp, Artificial Sequence
  Synthetic oligonucleotide
acgatcctcgcccctgacctgtatgtaacttgcctga

SEQ ID NO: 124695 - DNA, 38 bp, Artificial Sequence
  Synthetic oligonucleotide
atgcaccccattccgtttaactagtgccttttccttga

SEQ ID NO: 124696 - DNA, 36 bp, Artificial Sequence
  Synthetic oligonucleotide
aagcggacgcaaagtgtctctcgcgccctccaccta

SEQ ID NO: 124697 - DNA, 35 bp, Artificial Sequence
  Synthetic oligonucleotide
agcctccgtgctggcacgcatacattggcccatcc

SEQ ID NO: 124698 - DNA, 35 bp, Artificial Sequence
  Synthetic oligonucleotide
tcacgacacattttcgtacacgtttgctcttttcc

SEQ ID NO: 124699 - DNA, 35 bp, Artificial Sequence
  Synthetic oligonucleotide
agtccgaaccgacttcctggtaaccttgcccccgc

SEQ ID NO: 124700 - DNA, 35 bp, Artificial Sequence
  Synthetic oligonucleotide
aacccactcgcgccgttggcttatccttctcagtc

SEQ ID NO: 124701 - DNA, 35 bp, Artificial Sequence
  Synthetic oligonucleotide
tcatcggccgttcgagccctgtctttcgcctggtc

SEQ ID NO: 124702 - DNA, 35 bp, Artificial Sequence
  Synthetic oligonucleotide
acactacgccggcaagatcactctacatgccccct

SEQ ID NO: 124703 - DNA, 35 bp, Artificial Sequence
  Synthetic oligonucleotide
atcaccggctctgacaagactgccactcccccctt

SEQ ID NO: 124704 - DNA, 35 bp, Artificial Sequence
  Synthetic oligonucleotide
actccactattgccacatggtacgcctcatgccaa

SEQ ID NO: 124705 - DNA, 35 bp, Artificial Sequence
  Synthetic oligonucleotide
gtttacagcctcacatcctctggcccactttttca

SEQ ID NO: 124706 - DNA, 36 bp, Artificial Sequence
  Synthetic oligonucleotide
tgctgggggggcggggtgagggcgaatcttactaga

SEQ ID NO: 124707 - DNA, 32 bp, Artificial Sequence
  Synthetic oligonucleotide
atctccccgccctccccgtgaatggaatcgga

SEQ ID NO: 124708 - DNA, 35 bp, Artificial Sequence
  Synthetic oligonucleotide
gaatgccgtcagattctcctccctgcctcttttga

SEQ ID NO: 124709 - DNA, 38 bp, Artificial Sequence
  Synthetic oligonucleotide
tacacccccgccctgatctgaacgtcttgctcttttga

SEQ ID NO: 124710 - DNA, 35 bp, Artificial Sequence
  Synthetic oligonucleotide
acaccatcgcattgactctgcggacctttctcgta

SEQ ID NO: 124711 - DNA, 35 bp, Artificial Sequence
  Synthetic oligonucleotide
acgacggtcgctttgagccgctcctttctccgacc

SEQ ID NO: 124712 - DNA, 35 bp, Artificial Sequence
  Synthetic oligonucleotide
acgctctcatcctatgtccccgccgtcccagaccc

SEQ ID NO: 124713 - DNA, 35 bp, Artificial Sequence
  Synthetic oligonucleotide
tagtatcgccacgtatttcgacctcgttccctccc

SEQ ID NO: 124714 - DNA, 35 bp, Artificial Sequence
  Synthetic oligonucleotide
ttctggccccaccctcttgttctagtttacctttg

SEQ ID NO: 124715 - DNA, 35 bp, Artificial Sequence
  Synthetic oligonucleotide
gactcgatgtccgagtctcgtcccccatccctgct

SEQ ID NO: 124716 - DNA, 35 bp, Artificial Sequence
  Synthetic oligonucleotide
tagcgcgtaccgtcctccaaggcccacgaccctct

SEQ ID NO: 124717 - DNA, 35 bp, Artificial Sequence
  Synthetic oligonucleotide
tctcaccgcattgcatacccaaccattctctctgt

SEQ ID NO: 124718 - DNA, 35 bp, Artificial Sequence
  Synthetic oligonucleotide
tcccctccccgacccgctattattgtagtgccgtt

SEQ ID NO: 124719 - DNA, 36 bp, Artificial Sequence
  Synthetic oligonucleotide
gaatcgcctctagggttcgcatactacatcctccca

SEQ ID NO: 124720 - DNA, 37 bp, Artificial Sequence
  Synthetic oligonucleotide
tagccatcatctttgtcactccgtctccctgttccga

SEQ ID NO: 124721 - DNA, 37 bp, Artificial Sequence
  Synthetic oligonucleotide
atggagcttgggcgggggacggagcgggggacggcga

SEQ ID NO: 124722 - DNA, 38 bp, Artificial Sequence
  Synthetic oligonucleotide
gacgaagcacagcattgggagtgggagggtagggatga

SEQ ID NO: 124723 - DNA, 36 bp, Artificial Sequence
  Synthetic oligonucleotide
atccacgcctcgctcttgctaattggaccttgccta

SEQ ID NO: 124724 - DNA, 36 bp, Artificial Sequence
  Synthetic oligonucleotide
gtccgccccttatgtcccggcgtaccccctgttgta

SEQ ID NO: 124725 - DNA, 35 bp, Artificial Sequence
  Synthetic oligonucleotide
tcgaccgtaggttctagttctccccctctgggccc

SEQ ID NO: 124726 - DNA, 35 bp, Artificial Sequence
  Synthetic oligonucleotide
tccacatccgcacttcacagacctcagccccgtcc

SEQ ID NO: 124727 - DNA, 35 bp, Artificial Sequence
  Synthetic oligonucleotide
actttaccgcctcatgcatgacagtcaacctcctc

SEQ ID NO: 124728 - DNA, 35 bp, Artificial Sequence
  Synthetic oligonucleotide
ccacacccctcacctctctttgcgtgttaacgttc

SEQ ID NO: 124729 - DNA, 35 bp, Artificial Sequence
  Synthetic oligonucleotide
acgttcccgaccctgtacattgcaatctgtgcctt

SEQ ID NO: 124730 - DNA, 35 bp, Artificial Sequence
  Synthetic oligonucleotide
gatgcgcccatctctccctattgctcgtcgccgca

SEQ ID NO: 124731 - DNA, 35 bp, Artificial Sequence
  Synthetic oligonucleotide
gagcctccgcccgccccccctgttaacatcccaga

SEQ ID NO: 124732 - DNA, 37 bp, Artificial Sequence
  Synthetic oligonucleotide
tgactcactcccgtgccgctgccgccctccattccga

SEQ ID NO: 124733 - DNA, 37 bp, Artificial Sequence
  Synthetic oligonucleotide
tgccacccccccttgcctatcttaaagtcatcctcga

SEQ ID NO: 124734 - DNA, 38 bp, Artificial Sequence
  Synthetic oligonucleotide
gggtggggaaatggtagcagggaaatatgggagggtga

SEQ ID NO: 124735 - DNA, 36 bp, Artificial Sequence
  Synthetic oligonucleotide
gctgcctgtcgcccggccgtatctgttcctcttcta

SEQ ID NO: 124736 - DNA, 36 bp, Artificial Sequence
  Synthetic oligonucleotide
gccccattcgctctaccggcttcacttagtccctta

SEQ ID NO: 124737 - DNA, 35 bp, Artificial Sequence
  Synthetic oligonucleotide
tcactcccgtgccatccgttctttaggagtgaaac

SEQ ID NO: 124738 - DNA, 35 bp, Artificial Sequence
  Synthetic oligonucleotide
tgcgacgcactgaataggcttgtcacctccacccc

SEQ ID NO: 124739 - DNA, 35 bp, Artificial Sequence
  Synthetic oligonucleotide
tctccgacctccccacgtgatagcaatctaccgcc

SEQ ID NO: 124740 - DNA, 35 bp, Artificial Sequence
  Synthetic oligonucleotide
ggagaagcgcgagcggtcatttcctgtttctttcc

SEQ ID NO: 124741 - DNA, 35 bp, Artificial Sequence
  Synthetic oligonucleotide
gccggcccccgtcacctcgttctatctagtcgtgc

SEQ ID NO: 124742 - DNA, 35 bp, Artificial Sequence
  Synthetic oligonucleotide
tacgaagctaccgccctctctggctgagaagcctc

SEQ ID NO: 124743 - DNA, 35 bp, Artificial Sequence
  Synthetic oligonucleotide
tcgagcgttaccagcctgtttttcgcactcccccg

SEQ ID NO: 124744 - DNA, 35 bp, Artificial Sequence
  Synthetic oligonucleotide
tgatcgctgatgcgcgttaacctcacctcttgtca

SEQ ID NO: 124745 - DNA, 36 bp, Artificial Sequence
  Synthetic oligonucleotide
accccatacgcgcccccttctcgtattacctgttca

SEQ ID NO: 124746 - DNA, 37 bp, Artificial Sequence
  Synthetic oligonucleotide
ttagatgcaggaggagagggaatggtgcgtgggggga

SEQ ID NO: 124747 - DNA, 35 bp, Artificial Sequence
  Synthetic oligonucleotide
ttgcgtgtaggtcctcctgcagctattctctttac

SEQ ID NO: 124748 - DNA, 35 bp, Artificial Sequence
  Synthetic oligonucleotide
tgcgctctgcccttcctcatacggtcacctggccc

SEQ ID NO: 124749 - DNA, 34 bp, Artificial Sequence
  Synthetic oligonucleotide
gtactcatcatctgacgttttacccttgtgtccc

SEQ ID NO: 124750 - DNA, 35 bp, Artificial Sequence
  Synthetic oligonucleotide
acctggccttcaccaccacttctgttatctatgcc

SEQ ID NO: 124751 - DNA, 35 bp, Artificial Sequence
  Synthetic oligonucleotide
gaagaagggaagggcgggacatgagacacggaagg

SEQ ID NO: 124752 - DNA, 35 bp, Artificial Sequence
  Synthetic oligonucleotide
tcaccgccctccataccgcttcacccatctgggct

SEQ ID NO: 124753 - DNA, 36 bp, Artificial Sequence
  Synthetic oligonucleotide
aacagcccattatgctttcagccgctcactacctca

SEQ ID NO: 124754 - DNA, 36 bp, Artificial Sequence
  Synthetic oligonucleotide
tatcccgccctcctgccggattgagcccactcctca

SEQ ID NO: 124755 - DNA, 37 bp, Artificial Sequence
  Synthetic oligonucleotide
tactcgccgccgcacatgctacatcccgtctattcga

SEQ ID NO: 124756 - DNA, 37 bp, Artificial Sequence
  Synthetic oligonucleotide
tgaaccgccctatctggttattcttgtcctggcttga

SEQ ID NO: 124757 - DNA, 35 bp, Artificial Sequence
  Synthetic oligonucleotide
gtatccatccgtctgcccgctctatctcaaggaac

SEQ ID NO: 124758 - DNA, 35 bp, Artificial Sequence
  Synthetic oligonucleotide
atatatcccgccccgcgccgagtccgcccgttccc

SEQ ID NO: 124759 - DNA, 36 bp, Artificial Sequence
  Synthetic oligonucleotide
gcacgccccactgacgttgaattgcacccgtatctc

SEQ ID NO: 124760 - DNA, 35 bp, Artificial Sequence
  Synthetic oligonucleotide
gagagataggacgtaggcaataggaaggtgggagg

SEQ ID NO: 124761 - DNA, 35 bp, Artificial Sequence
  Synthetic oligonucleotide
gacatcccctggacaacgcccctctctgccccgtg

SEQ ID NO: 124762 - DNA, 35 bp, Artificial Sequence
  Synthetic oligonucleotide
gccgacttctgctccctcttggtacatcctttgtg

SEQ ID NO: 124763 - DNA, 35 bp, Artificial Sequence
  Synthetic oligonucleotide
gagaagagggagggacgttgggacaataggggaat

SEQ ID NO: 124764 - DNA, 36 bp, Artificial Sequence
  Synthetic oligonucleotide
tccaccccctgatcacgctctcgtcgccgtttccaa

SEQ ID NO: 124765 - DNA, 35 bp, Artificial Sequence
  Synthetic oligonucleotide
ggaccccccgttcactccgcgacgccccttacgca

SEQ ID NO: 124766 - DNA, 35 bp, Artificial Sequence
  Synthetic oligonucleotide
accaccatacctgtcgaatggtccttgatccctca

SEQ ID NO: 124767 - DNA, 38 bp, Artificial Sequence
  Synthetic oligonucleotide
ggactaagctgtctgacgcccgttccctgccctcctga

SEQ ID NO: 124768 - DNA, 37 bp, Artificial Sequence
  Synthetic oligonucleotide
gcatgggcctgacgtgggcggggagggtacatattga

SEQ ID NO: 124769 - DNA, 36 bp, Artificial Sequence
  Synthetic oligonucleotide
ttgtcactcctcacctgtacataacgcccctgcata

SEQ ID NO: 124770 - DNA, 35 bp, Artificial Sequence
  Synthetic oligonucleotide
acgacggtctcgtggcccggttctctgcccctgcc

SEQ ID NO: 124771 - DNA, 35 bp, Artificial Sequence
  Synthetic oligonucleotide
tgcatcctccactgctgacccacttgaataacttg

SEQ ID NO: 124772 - DNA, 35 bp, Artificial Sequence
  Synthetic oligonucleotide
ttcactcgcggtgactgtccctcgcccttgtcttg

SEQ ID NO: 124773 - DNA, 35 bp, Artificial Sequence
  Synthetic oligonucleotide
tccgttccgcatgttgcctttcttgatactgatat

SEQ ID NO: 124774 - DNA, 36 bp, Artificial Sequence
  Synthetic oligonucleotide
tgtgcgttccacatgccgtaatcctgctcgccccaa

SEQ ID NO: 124775 - DNA, 37 bp, Artificial Sequence
  Synthetic oligonucleotide
tcatcaccccgcccccgcttgcacgcaccactttgga

SEQ ID NO: 124776 - DNA, 35 bp, Artificial Sequence
  Synthetic oligonucleotide
gccactctggtctcttgccgtccacccccgctcta

SEQ ID NO: 124777 - DNA, 35 bp, Artificial Sequence
  Synthetic oligonucleotide
gccggttacattgttgtacttcttccccacgctcc

SEQ ID NO: 124778 - DNA, 35 bp, Artificial Sequence
  Synthetic oligonucleotide
ttgcgcccgtcgttcccccaggtccgtcgccccaa

SEQ ID NO: 124779 - DNA, 36 bp, Artificial Sequence
  Synthetic oligonucleotide
gcgtacgtacctcgctggctgtctctccccattcca

SEQ ID NO: 124780 - DNA, 37 bp, Artificial Sequence
  Synthetic oligonucleotide
acaccctcaccgccctcacaatgtgcacctccttcga

SEQ ID NO: 124781 - DNA, 38 bp, Artificial Sequence
  Synthetic oligonucleotide
gccgacagtctcctgctcatcactgccccatttcctga

SEQ ID NO: 124782 - DNA, 38 bp, Artificial Sequence
  Synthetic oligonucleotide
tctaggcgcgatccatgcctccttcgctgttcccttga

SEQ ID NO: 124783 - DNA, 36 bp, Artificial Sequence
  Synthetic oligonucleotide
gacacctccctcccttttgagccgctaacaggacta

SEQ ID NO: 124784 - DNA, 35 bp, Artificial Sequence
  Synthetic oligonucleotide
tgatacacactacgccgcctgctccctccgcccac

SEQ ID NO: 124785 - DNA, 35 bp, Artificial Sequence
  Synthetic oligonucleotide
tgtttagcccccttccccgtggttattgttcgtac

SEQ ID NO: 124786 - DNA, 35 bp, Artificial Sequence
  Synthetic oligonucleotide
acccacttgaaactgtatgcgtgaaacccctcccc

SEQ ID NO: 124787 - DNA, 35 bp, Artificial Sequence
  Synthetic oligonucleotide
tccacccaccgccatgtacataggaagtcctttcc

SEQ ID NO: 124788 - DNA, 35 bp, Artificial Sequence
  Synthetic oligonucleotide
tgcccacccgccacatacacgttcctcctaaagtc

SEQ ID NO: 124789 - DNA, 35 bp, Artificial Sequence
  Synthetic oligonucleotide
tatcgaccccgcaacacctgaaagctggccctgtc

SEQ ID NO: 124790 - DNA, 35 bp, Artificial Sequence
  Synthetic oligonucleotide
atggccactcctcctgaagttacccctcaccatgg

SEQ ID NO: 124791 - DNA, 34 bp, Artificial Sequence
  Synthetic oligonucleotide
tgcctgtcacagcccttatcgcccttacgctcat

SEQ ID NO: 124792 - DNA, 35 bp, Artificial Sequence
  Synthetic oligonucleotide
acttgtggggtgggagggggaatggaggagacgct

SEQ ID NO: 124793 - DNA, 36 bp, Artificial Sequence
  Synthetic oligonucleotide
tttgcccgcccctaccccccgtcgatatggaggcca

SEQ ID NO: 124794 - DNA, 36 bp, Artificial Sequence
  Synthetic oligonucleotide
acgcctacgccacccctcgttcaacatcgccgtcca

SEQ ID NO: 124795 - DNA, 36 bp, Artificial Sequence
  Synthetic oligonucleotide
agggacgaaggggagtggaatgggggttaaagggca

SEQ ID NO: 124796 - DNA, 32 bp, Artificial Sequence
  Synthetic oligonucleotide
gcttccccccgctcgatttaacacatggctca

SEQ ID NO: 124797 - DNA, 37 bp, Artificial Sequence
  Synthetic oligonucleotide
tgaccatcctcgaccgcctctccgctccttaccgaga

SEQ ID NO: 124798 - DNA, 36 bp, Artificial Sequence
  Synthetic oligonucleotide
tgaggggaggaaggtggaagtagcttgggggtacga

SEQ ID NO: 124799 - DNA, 38 bp, Artificial Sequence
  Synthetic oligonucleotide
gggtcggggaaggagagggggagtcggagcgggaatga

SEQ ID NO: 124800 - DNA, 37 bp, Artificial Sequence
  Synthetic oligonucleotide
agcgcccacaattcgccacaaagcccgccacccatga

SEQ ID NO: 124801 - DNA, 38 bp, Artificial Sequence
  Synthetic oligonucleotide
gacctccgcccatgccaattctacgcctgtccgtatga

SEQ ID NO: 124802 - DNA, 37 bp, Artificial Sequence
  Synthetic oligonucleotide
gagtggcatttcccgttctttgccgtcctgtccctga

SEQ ID NO: 124803 - DNA, 35 bp, Artificial Sequence
  Synthetic oligonucleotide
gagagggtgggagggtactcattgctcctggggac

SEQ ID NO: 124804 - DNA, 35 bp, Artificial Sequence
  Synthetic oligonucleotide
tcagaccagaccatatgctcccctcccgatcaccc

SEQ ID NO: 124805 - DNA, 35 bp, Artificial Sequence
  Synthetic oligonucleotide
agacgcccaatctcgacaccgcttccccccggccc

SEQ ID NO: 124806 - DNA, 35 bp, Artificial Sequence
  Synthetic oligonucleotide
gccgccgcccgctcccgatggcttacaccatcgtc

SEQ ID NO: 124807 - DNA, 35 bp, Artificial Sequence
  Synthetic oligonucleotide
gcctggaccccgcccgctcccgcagacagtgtttc

SEQ ID NO: 124808 - DNA, 35 bp, Artificial Sequence
  Synthetic oligonucleotide
tgtggccccacctccgtaaacgcagcacaccgccg

SEQ ID NO: 124809 - DNA, 35 bp, Artificial Sequence
  Synthetic oligonucleotide
tatccaccgtacctttcgttattgtgttccatctg

SEQ ID NO: 124810 - DNA, 35 bp, Artificial Sequence
  Synthetic oligonucleotide
cgacgccctaacctcagtgcttctttcccgcccct

SEQ ID NO: 124811 - DNA, 35 bp, Artificial Sequence
  Synthetic oligonucleotide
gtcctgccgctcttatcccccgcctgtttcttggt

SEQ ID NO: 124812 - DNA, 35 bp, Artificial Sequence
  Synthetic oligonucleotide
atagggtgggcgggagaagggtctcgagttgctca

SEQ ID NO: 124813 - DNA, 36 bp, Artificial Sequence
  Synthetic oligonucleotide
gacctccaatcatggtttcgaccccctcccatagga

SEQ ID NO: 124814 - DNA, 35 bp, Artificial Sequence
  Synthetic oligonucleotide
tggatctgtcactcgtcgctcgcccccttccgcac

SEQ ID NO: 124815 - DNA, 35 bp, Artificial Sequence
  Synthetic oligonucleotide
ttggtaccccaacctcgtgacttgccttgcccacc

SEQ ID NO: 124816 - DNA, 35 bp, Artificial Sequence
  Synthetic oligonucleotide
tcttgccacgctgcactaccgcattctgtgcctcc

SEQ ID NO: 124817 - DNA, 35 bp, Artificial Sequence
  Synthetic oligonucleotide
acgcagtgcaaactgtacatcgtccgtcccctttc

SEQ ID NO: 124818 - DNA, 35 bp, Artificial Sequence
  Synthetic oligonucleotide
aaagagcggggcgagggcgtggaagatagggtggg

SEQ ID NO: 124819 - DNA, 35 bp, Artificial Sequence
  Synthetic oligonucleotide
ggggtggtgtgggaggggaggtagtctgcgtagtg

SEQ ID NO: 124820 - DNA, 35 bp, Artificial Sequence
  Synthetic oligonucleotide
ggaacgaagtgccgcctccttctctaccccccgaa

SEQ ID NO: 124821 - DNA, 36 bp, Artificial Sequence
  Synthetic oligonucleotide
tctccgccctgctttagtccccgtgccgttatttca

SEQ ID NO: 124822 - DNA, 36 bp, Artificial Sequence
  Synthetic oligonucleotide
taaccgtccacccccccctccgattcacatgtgcta

SEQ ID NO: 124823 - DNA, 35 bp, Artificial Sequence
  Synthetic oligonucleotide
accccacccggcctttccctggctcagggtaaacc

SEQ ID NO: 124824 - DNA, 35 bp, Artificial Sequence
  Synthetic oligonucleotide
gaccacctgtcctaatattgatgacgccccgtccc

SEQ ID NO: 124825 - DNA, 35 bp, Artificial Sequence
  Synthetic oligonucleotide
tccgcgatatcgtacatggcctcctttgcacctcc

SEQ ID NO: 124826 - DNA, 35 bp, Artificial Sequence
  Synthetic oligonucleotide
tccaatgtacagctcccgatcggtccgctttcctc

SEQ ID NO: 124827 - DNA, 35 bp, Artificial Sequence
  Synthetic oligonucleotide
taatgggacggagggaaggataaataggtaggggg

SEQ ID NO: 124828 - DNA, 35 bp, Artificial Sequence
  Synthetic oligonucleotide
tgactcctccactttgcatcctaggccgcacttgg

SEQ ID NO: 124829 - DNA, 35 bp, Artificial Sequence
  Synthetic oligonucleotide
tacttcgcccagtcatcgtccctgccgctatccgt

SEQ ID NO: 124830 - DNA, 34 bp, Artificial Sequence
  Synthetic oligonucleotide
ggtgggggagtgggtgctattgtcacagggcggt

SEQ ID NO: 124831 - DNA, 35 bp, Artificial Sequence
  Synthetic oligonucleotide
taccacgccctctcgactacatccgattcgctgaa

SEQ ID NO: 124832 - DNA, 36 bp, Artificial Sequence
  Synthetic oligonucleotide
gaacttgctgtccgttggccgctctctctcgttcca

SEQ ID NO: 124833 - DNA, 37 bp, Artificial Sequence
  Synthetic oligonucleotide
acaaccggaaatgggtaagcaggggggaggcggtgga

SEQ ID NO: 124834 - DNA, 35 bp, Artificial Sequence
  Synthetic oligonucleotide
accaccgcagtataccccaccgctgttaccgctga

SEQ ID NO: 124835 - DNA, 36 bp, Artificial Sequence
  Synthetic oligonucleotide
gagcaccctccaccgtttacttctccgccgcacata

SEQ ID NO: 124836 - DNA, 36 bp, Artificial Sequence
  Synthetic oligonucleotide
atcccaccgactatttgtcgccttcattcactcccc

SEQ ID NO: 124837 - DNA, 35 bp, Artificial Sequence
  Synthetic oligonucleotide
gagggcggagaggcatggacgggggcggtttcggg

SEQ ID NO: 124838 - DNA, 35 bp, Artificial Sequence
  Synthetic oligonucleotide
tcagagatgccctgttcgccccccccgcctacttg

SEQ ID NO: 124839 - DNA, 35 bp, Artificial Sequence
  Synthetic oligonucleotide
acattccatcattatgcgttaccgtgcccgattct

SEQ ID NO: 124840 - DNA, 36 bp, Artificial Sequence
  Synthetic oligonucleotide
gcgctccatccacggttccaccttccgcccgctgca

SEQ ID NO: 124841 - DNA, 36 bp, Artificial Sequence
  Synthetic oligonucleotide
gcccacgattccgtggtttcataatgtcgcccctca

SEQ ID NO: 124842 - DNA, 37 bp, Artificial Sequence
  Synthetic oligonucleotide
gaacgaggtggagggtatgggtgcaggaaggacaaga

SEQ ID NO: 124843 - DNA, 37 bp, Artificial Sequence
  Synthetic oligonucleotide
gatgggacgcagggagtacggggagaagggggtacga

SEQ ID NO: 124844 - DNA, 36 bp, Artificial Sequence
  Synthetic oligonucleotide
tgagccaccgcttttcaactgcctacctgccaccga

SEQ ID NO: 124845 - DNA, 37 bp, Artificial Sequence
  Synthetic oligonucleotide
tcaacgcctcggacttttcttgttctcctccttcgga

SEQ ID NO: 124846 - DNA, 37 bp, Artificial Sequence
  Synthetic oligonucleotide
gatgcgaggcagtgggaacggaggagaaatgggatga

SEQ ID NO: 124847 - DNA, 37 bp, Artificial Sequence
  Synthetic oligonucleotide
accacctccgccttgacctgttcatcctgtcccttga

SEQ ID NO: 124848 - DNA, 35 bp, Artificial Sequence
  Synthetic oligonucleotide
gaaggggggctcaaaatctggggggggggttcaac

SEQ ID NO: 124849 - DNA, 35 bp, Artificial Sequence
  Synthetic oligonucleotide
tcgcacctgcgagtgttggcttctcctcgtctcac

SEQ ID NO: 124850 - DNA, 35 bp, Artificial Sequence
  Synthetic oligonucleotide
gtcccatgcctccccgtccggcaaggacggtaccc

SEQ ID NO: 124851 - DNA, 35 bp, Artificial Sequence
  Synthetic oligonucleotide
tccgttgagtagcttgcccccccttgtcgtcccgc

SEQ ID NO: 124852 - DNA, 35 bp, Artificial Sequence
  Synthetic oligonucleotide
gtgggggcgggaatgggcgggccagggacagaagg

SEQ ID NO: 124853 - DNA, 35 bp, Artificial Sequence
  Synthetic oligonucleotide
attgtcacgcccagcccgcatgcccgcctttcttg

SEQ ID NO: 124854 - DNA, 35 bp, Artificial Sequence
  Synthetic oligonucleotide
gtaccgcctcagcatactgacccctcttcttctat

SEQ ID NO: 124855 - DNA, 35 bp, Artificial Sequence
  Synthetic oligonucleotide
gacaaggccgggggggatagggacctgcgggttat

SEQ ID NO: 124856 - DNA, 35 bp, Artificial Sequence
  Synthetic oligonucleotide
tcattcccgcccccactcacggagcgtccgaccct

SEQ ID NO: 124857 - DNA, 35 bp, Artificial Sequence
  Synthetic oligonucleotide
gcatacgccgtctcttggtccggcccacccttgct

SEQ ID NO: 124858 - DNA, 37 bp, Artificial Sequence
  Synthetic oligonucleotide
tctaccctccgcttgcacacaccgtcgtctcacgcga

SEQ ID NO: 124859 - DNA, 37 bp, Artificial Sequence
  Synthetic oligonucleotide
ggtgtgggagagacgaaaaaggggggggaggggagga

SEQ ID NO: 124860 - DNA, 35 bp, Artificial Sequence
  Synthetic oligonucleotide
acacccggcctccgatcctcaaattagctccgccc

SEQ ID NO: 124861 - DNA, 35 bp, Artificial Sequence
  Synthetic oligonucleotide
gtacctagcgttctctcgtcgttcttgtctatccc

SEQ ID NO: 124862 - DNA, 35 bp, Artificial Sequence
  Synthetic oligonucleotide
tagcaaccgtcttcgctccatctatgcttctggtc

SEQ ID NO: 124863 - DNA, 35 bp, Artificial Sequence
  Synthetic oligonucleotide
tccatctgcccccagtgtctcagcccccccctttc

SEQ ID NO: 124864 - DNA, 35 bp, Artificial Sequence
  Synthetic oligonucleotide
tgtcaccctctaatatctccgttaacgaccccgcg

SEQ ID NO: 124865 - DNA, 35 bp, Artificial Sequence
  Synthetic oligonucleotide
atcattgtcctcatgctctcgccgtatttaccttg

SEQ ID NO: 124866 - DNA, 35 bp, Artificial Sequence
  Synthetic oligonucleotide
tgccttccgccacattgacgttacatcttatctat

SEQ ID NO: 124867 - DNA, 36 bp, Artificial Sequence
  Synthetic oligonucleotide
gacatagggtcagatctttacttcccccccgctaca

SEQ ID NO: 124868 - DNA, 36 bp, Artificial Sequence
  Synthetic oligonucleotide
accgggcccctcctgtctcttaatgcctttcgttca

SEQ ID NO: 124869 - DNA, 37 bp, Artificial Sequence
  Synthetic oligonucleotide
aggaattgccggaggaggggctgagggaggaggaaga

SEQ ID NO: 124870 - DNA, 37 bp, Artificial Sequence
  Synthetic oligonucleotide
tctcgcctcgctatcctctcaattgacccgcttgcga

SEQ ID NO: 124871 - DNA, 37 bp, Artificial Sequence
  Synthetic oligonucleotide
gaggggtgggaacgggggtggggccaaggatgcatga

SEQ ID NO: 124872 - DNA, 35 bp, Artificial Sequence
  Synthetic oligonucleotide
tcgcatcacccggcatatagccgaagccttccacc

SEQ ID NO: 124873 - DNA, 35 bp, Artificial Sequence
  Synthetic oligonucleotide
actacacccgcctcatagtcaacttcgtttgtacc

SEQ ID NO: 124874 - DNA, 35 bp, Artificial Sequence
  Synthetic oligonucleotide
tcacacgcttctggtctgctccatcaacaaccccc

SEQ ID NO: 124875 - DNA, 35 bp, Artificial Sequence
  Synthetic oligonucleotide
tacgatcaccaccctggcgctatgaacgactgtcc

SEQ ID NO: 124876 - DNA, 35 bp, Artificial Sequence
  Synthetic oligonucleotide
gctgtacatccccccggctgctatcgggccttttc

SEQ ID NO: 124877 - DNA, 35 bp, Artificial Sequence
  Synthetic oligonucleotide
gcaggccccgttgcctcatctctttcctgttcatg

SEQ ID NO: 124878 - DNA, 35 bp, Artificial Sequence
  Synthetic oligonucleotide
acgctccctcactcccctcgtatgtttgttgccat

SEQ ID NO: 124879 - DNA, 35 bp, Artificial Sequence
  Synthetic oligonucleotide
agtcccctcactgctcacaatccctgttcaagcct

SEQ ID NO: 124880 - DNA, 37 bp, Artificial Sequence
  Synthetic oligonucleotide
gtcacccttcccctcacattagtgccctgtttctaga

SEQ ID NO: 124881 - DNA, 37 bp, Artificial Sequence
  Synthetic oligonucleotide
gactcgccatggtactcgttctcctcccttgatctga

SEQ ID NO: 124882 - DNA, 36 bp, Artificial Sequence
  Synthetic oligonucleotide
tgttcgccgcctttcttgcataaacactcgctatta

SEQ ID NO: 124883 - DNA, 35 bp, Artificial Sequence
  Synthetic oligonucleotide
gcccggacccagagagtttaactaccctgctcccc

SEQ ID NO: 124884 - DNA, 35 bp, Artificial Sequence
  Synthetic oligonucleotide
aagtcaacccgactgtctactgccctttagtcccc

SEQ ID NO: 124885 - DNA, 35 bp, Artificial Sequence
  Synthetic oligonucleotide
agcaactcgcccgccgtccatcatcccgtcttaag

SEQ ID NO: 124886 - DNA, 35 bp, Artificial Sequence
  Synthetic oligonucleotide
cacccagtgcctcgaaataccgccattgccttccg

SEQ ID NO: 124887 - DNA, 35 bp, Artificial Sequence
  Synthetic oligonucleotide
attgagcgggcggggtggtacaggtcgtgggaggg

SEQ ID NO: 124888 - DNA, 35 bp, Artificial Sequence
  Synthetic oligonucleotide
gctctccctcgctgtctatgcctaggtgcctccct

SEQ ID NO: 124889 - DNA, 35 bp, Artificial Sequence
  Synthetic oligonucleotide
gactgccgtagcagtactgggaggcgagggcgggt

SEQ ID NO: 124890 - DNA, 35 bp, Artificial Sequence
  Synthetic oligonucleotide
atcatccctcgcctgtttatgacccctcaacacaa

SEQ ID NO: 124891 - DNA, 36 bp, Artificial Sequence
  Synthetic oligonucleotide
ggggttggggaggggaatgcggagggcagccgggca

SEQ ID NO: 124892 - DNA, 38 bp, Artificial Sequence
  Synthetic oligonucleotide
tgatcatccgccctctgtctcgcacgtgccttacgtga

SEQ ID NO: 124893 - DNA, 37 bp, Artificial Sequence
  Synthetic oligonucleotide
ttaggggtacggggggatggctcatgggagggggtga

SEQ ID NO: 124894 - DNA, 36 bp, Artificial Sequence
  Synthetic oligonucleotide
atattcacccgccgccccttgtgccgattgctctta

SEQ ID NO: 124895 - DNA, 35 bp, Artificial Sequence
  Synthetic oligonucleotide
gatgcccctgcccgcctcttctatgactcttccac

SEQ ID NO: 124896 - DNA, 35 bp, Artificial Sequence
  Synthetic oligonucleotide
tcacaacccactatgtcgttgcacccgcccctacc

SEQ ID NO: 124897 - DNA, 35 bp, Artificial Sequence
  Synthetic oligonucleotide
aaccggacgcccccagctcgctacacaactctccc

SEQ ID NO: 124898 - DNA, 35 bp, Artificial Sequence
  Synthetic oligonucleotide
tacctgcacgatccattctggcccagctcactcgc

SEQ ID NO: 124899 - DNA, 35 bp, Artificial Sequence
  Synthetic oligonucleotide
tccatcaaccgctcccgtatctaggccacagcatc

SEQ ID NO: 124900 - DNA, 35 bp, Artificial Sequence
  Synthetic oligonucleotide
gcccgtgctccccttagctttctgtcggtcctgtc

SEQ ID NO: 124901 - DNA, 36 bp, Artificial Sequence
  Synthetic oligonucleotide
agccccccgccctgaatgtcctccttgtaattcgca

SEQ ID NO: 124902 - DNA, 35 bp, Artificial Sequence
  Synthetic oligonucleotide
agacggccggctccccctccccccacggtcctcga

SEQ ID NO: 124903 - DNA, 37 bp, Artificial Sequence
  Synthetic oligonucleotide
gactcgcctccgcctcgctatcccctgttcttctgga

SEQ ID NO: 124904 - DNA, 37 bp, Artificial Sequence
  Synthetic oligonucleotide
gccagcctcaccctcccgtttaacatcctgcacctga

SEQ ID NO: 124905 - DNA, 35 bp, Artificial Sequence
  Synthetic oligonucleotide
tatccccccctccgatatctagggagacacccgta

SEQ ID NO: 124906 - DNA, 34 bp, Artificial Sequence
  Synthetic oligonucleotide
gctccatggcctcacatgctcctacttgccagac

SEQ ID NO: 124907 - DNA, 35 bp, Artificial Sequence
  Synthetic oligonucleotide
gccacctcctctcgagtagtttctcacactttccc

SEQ ID NO: 124908 - DNA, 35 bp, Artificial Sequence
  Synthetic oligonucleotide
accctgccctaccaggctttgtacccttgattgcc

SEQ ID NO: 124909 - DNA, 35 bp, Artificial Sequence
  Synthetic oligonucleotide
gacacccagtgtgcccagcactcaactccatctgc

SEQ ID NO: 124910 - DNA, 35 bp, Artificial Sequence
  Synthetic oligonucleotide
acacaccccctaacatgttcgccgttccgctcttg

SEQ ID NO: 124911 - DNA, 35 bp, Artificial Sequence
  Synthetic oligonucleotide
gcaacggtcttactcgtcgttccctcgtggccctt

SEQ ID NO: 124912 - DNA, 35 bp, Artificial Sequence
  Synthetic oligonucleotide
ttacgggacgggtgggtgtggaaagaggggagaca

SEQ ID NO: 124913 - DNA, 37 bp, Artificial Sequence
  Synthetic oligonucleotide
gatagggggaggggtacgtggcggagacactggcgga

SEQ ID NO: 124914 - DNA, 37 bp, Artificial Sequence
  Synthetic oligonucleotide
taaacgggaaggggggggaagcggagaggaccaatga

SEQ ID NO: 124915 - DNA, 38 bp, Artificial Sequence
  Synthetic oligonucleotide
tcgccaccatatcactggtgttctgcccccctccgtga

SEQ ID NO: 124916 - DNA, 35 bp, Artificial Sequence
  Synthetic oligonucleotide
tgccgttcacgtctactatcccatactccccgtgc

SEQ ID NO: 124917 - DNA, 35 bp, Artificial Sequence
  Synthetic oligonucleotide
acccgccttacccatggattcacgtccaccgttgc

SEQ ID NO: 124918 - DNA, 34 bp, Artificial Sequence
  Synthetic oligonucleotide
aacgaggagggggcccggggagaggatagggtag

SEQ ID NO: 124919 - DNA, 35 bp, Artificial Sequence
  Synthetic oligonucleotide
ttaccgactcgcccaacacctctgcatgccacccg

SEQ ID NO: 124920 - DNA, 35 bp, Artificial Sequence
  Synthetic oligonucleotide
ccaccgtctacgttcgtacagccacaccgcctcct

SEQ ID NO: 124921 - DNA, 35 bp, Artificial Sequence
  Synthetic oligonucleotide
tcattcacatctctgccctcgattctagcctcgct

SEQ ID NO: 124922 - DNA, 34 bp, Artificial Sequence
  Synthetic oligonucleotide
acctccgacatgtgctacgcgctcacacctgctt

SEQ ID NO: 124923 - DNA, 35 bp, Artificial Sequence
  Synthetic oligonucleotide
gcctgcaccattcgtttttccgtgttgctccattt

SEQ ID NO: 124924 - DNA, 35 bp, Artificial Sequence
  Synthetic oligonucleotide
tccgttaggccatctggttgtcccttcttgcccca

SEQ ID NO: 124925 - DNA, 37 bp, Artificial Sequence
  Synthetic oligonucleotide
gcccctcatctgtccttcccccctgtccgaataccga

SEQ ID NO: 124926 - DNA, 36 bp, Artificial Sequence
  Synthetic oligonucleotide
ctgacaaccgtgcactgcctaacgcccttttcccga

SEQ ID NO: 124927 - DNA, 37 bp, Artificial Sequence
  Synthetic oligonucleotide
gatagtaggcagaacggtggcggggaaggcggtagga

SEQ ID NO: 124928 - DNA, 37 bp, Artificial Sequence
  Synthetic oligonucleotide
gcgagggatagtaggagagggctagggagcgatggga

SEQ ID NO: 124929 - DNA, 38 bp, Artificial Sequence
  Synthetic oligonucleotide
tctcgcaccatctggtaacctcccccgccgccttgtga

SEQ ID NO: 124930 - DNA, 35 bp, Artificial Sequence
  Synthetic oligonucleotide
tccggtcggtcgctccatactctagctcgcctcac

SEQ ID NO: 124931 - DNA, 35 bp, Artificial Sequence
  Synthetic oligonucleotide
gttcgttgcccactgtcccttgggttccccttacc

SEQ ID NO: 124932 - DNA, 35 bp, Artificial Sequence
  Synthetic oligonucleotide
gcaacgggccacttgccttctcgcacctttccact

SEQ ID NO: 124933 - DNA, 35 bp, Artificial Sequence
  Synthetic oligonucleotide
gcacacgctgccagactaagcccaatgccgtccct

SEQ ID NO: 124934 - DNA, 36 bp, Artificial Sequence
  Synthetic oligonucleotide
tgctgcacggttctatcccccctgctcttacgggca

SEQ ID NO: 124935 - DNA, 37 bp, Artificial Sequence
  Synthetic oligonucleotide
tgaacggtgcagaagagaggggacggactggagggga

SEQ ID NO: 124936 - DNA, 38 bp, Artificial Sequence
  Synthetic oligonucleotide
acaacgccgtccgaagcgtaccgccgccacacctctga

SEQ ID NO: 124937 - DNA, 38 bp, Artificial Sequence
  Synthetic oligonucleotide
tctccccaccacccgcatcctcggtgtcactcctgtga

SEQ ID NO: 124938 - DNA, 35 bp, Artificial Sequence
  Synthetic oligonucleotide
tcccacggtcgtctgacatcttactccccttccac

SEQ ID NO: 124939 - DNA, 35 bp, Artificial Sequence
  Synthetic oligonucleotide
gcaccgtatcgtcccgccatgcctggagcccttac

SEQ ID NO: 124940 - DNA, 35 bp, Artificial Sequence
  Synthetic oligonucleotide
tgctcccagcccaagggtctcccagtctctccacc

SEQ ID NO: 124941 - DNA, 35 bp, Artificial Sequence
  Synthetic oligonucleotide
acctcatgcaccatcgccttgcgctctcagacccc

SEQ ID NO: 124942 - DNA, 35 bp, Artificial Sequence
  Synthetic oligonucleotide
gccccatcggctgactcttggtgacaccacctccc

SEQ ID NO: 124943 - DNA, 35 bp, Artificial Sequence
  Synthetic oligonucleotide
gaagggtgggtagggaggcgacaagaagaaggacg

SEQ ID NO: 124944 - DNA, 35 bp, Artificial Sequence
  Synthetic oligonucleotide
ttcgcaccaacccgggcgtcatctaagccccccat

SEQ ID NO: 124945 - DNA, 35 bp, Artificial Sequence
  Synthetic oligonucleotide
ttcacgtccacttggtacctgttgtcttctccgat

SEQ ID NO: 124946 - DNA, 35 bp, Artificial Sequence
  Synthetic oligonucleotide
tcaccacgcctcgcacatctccaccaatgtctatt

SEQ ID NO: 124947 - DNA, 35 bp, Artificial Sequence
  Synthetic oligonucleotide
gattgatcgccacatgctcgaactgccatcctaca

SEQ ID NO: 124948 - DNA, 37 bp, Artificial Sequence
  Synthetic oligonucleotide
gagggcgggttgggggtaagggaacatacaggacaga

SEQ ID NO: 124949 - DNA, 35 bp, Artificial Sequence
  Synthetic oligonucleotide
accactcgcactggccactctcgccccactataga

SEQ ID NO: 124950 - DNA, 37 bp, Artificial Sequence
  Synthetic oligonucleotide
tcgacgggccccatctgaacgtaacattcccccccga

SEQ ID NO: 124951 - DNA, 37 bp, Artificial Sequence
  Synthetic oligonucleotide
ggtaggggaccaagtgggtgggggtagagagggcgga

SEQ ID NO: 124952 - DNA, 37 bp, Artificial Sequence
  Synthetic oligonucleotide
tggggagttgcggtttccatcctagggcggtggggga

SEQ ID NO: 124953 - DNA, 38 bp, Artificial Sequence
  Synthetic oligonucleotide
gaggtcgacctgggcgggtatgggggggagcataatga

SEQ ID NO: 124954 - DNA, 35 bp, Artificial Sequence
  Synthetic oligonucleotide
tacctccatcactcagcgcgcatcacacatcagcc

SEQ ID NO: 124955 - DNA, 35 bp, Artificial Sequence
  Synthetic oligonucleotide
gcgcaagacgctcccaaccgctgtcacctagctcc

SEQ ID NO: 124956 - DNA, 35 bp, Artificial Sequence
  Synthetic oligonucleotide
atgatccccaatgtaatgcaaccagtccttcttcc

SEQ ID NO: 124957 - DNA, 35 bp, Artificial Sequence
  Synthetic oligonucleotide
gccggcccccactgtcaatcccaccctccgctgcg

SEQ ID NO: 124958 - DNA, 37 bp, Artificial Sequence
  Synthetic oligonucleotide
ggaggtggtggtgtggacttatggcggtacctgttga

SEQ ID NO: 124959 - DNA, 35 bp, Artificial Sequence
  Synthetic oligonucleotide
gaaccagccgccctggcctccatacccgttgttga

SEQ ID NO: 124960 - DNA, 36 bp, Artificial Sequence
  Synthetic oligonucleotide
ggacgccgtaccgcggttttaacactacccccccta

SEQ ID NO: 124961 - DNA, 35 bp, Artificial Sequence
  Synthetic oligonucleotide
tccccctccccatgtatgatcactcgaaccgccac

SEQ ID NO: 124962 - DNA, 35 bp, Artificial Sequence
  Synthetic oligonucleotide
tgacccccgcctcccaactggtatacatgctttac

SEQ ID NO: 124963 - DNA, 35 bp, Artificial Sequence
  Synthetic oligonucleotide
tcaacgacgagccgccgttgccgtttacgacttcc

SEQ ID NO: 124964 - DNA, 35 bp, Artificial Sequence
  Synthetic oligonucleotide
gcgccgccccatagctatctccatcatgcatccgc

SEQ ID NO: 124965 - DNA, 35 bp, Artificial Sequence
  Synthetic oligonucleotide
ttccaccgcctcgttcctttttgtttgtcatgctc

SEQ ID NO: 124966 - DNA, 35 bp, Artificial Sequence
  Synthetic oligonucleotide
gccgtacgctccaactttctgttcattgcctgttc

SEQ ID NO: 124967 - DNA, 35 bp, Artificial Sequence
  Synthetic oligonucleotide
accgccccttagaacccctgccacgtgccgacccg

SEQ ID NO: 124968 - DNA, 35 bp, Artificial Sequence
  Synthetic oligonucleotide
tactggacgcttcccggttacacgtatgccctctt

SEQ ID NO: 124969 - DNA, 36 bp, Artificial Sequence
  Synthetic oligonucleotide
tggatagggagggggaaagggaggatgttagggcaa

SEQ ID NO: 124970 - DNA, 36 bp, Artificial Sequence
  Synthetic oligonucleotide
gccagtcctttgtcctcatattattgtccggctcca

SEQ ID NO: 124971 - DNA, 35 bp, Artificial Sequence
  Synthetic oligonucleotide
aactcgctcccctcctgtgtatcttactacacgca

SEQ ID NO: 124972 - DNA, 35 bp, Artificial Sequence
  Synthetic oligonucleotide
tctacgggaggggcgtgggaggggtgagtagctca

SEQ ID NO: 124973 - DNA, 25 bp, Artificial Sequence
  Synthetic oligonucleotide
gcctgtactcgccttccctctatga

SEQ ID NO: 124974 - DNA, 37 bp, Artificial Sequence
  Synthetic oligonucleotide
taccggcgaaaaaggcggggggaggaggcgggggtga

SEQ ID NO: 124975 - DNA, 36 bp, Artificial Sequence
  Synthetic oligonucleotide
gattcctccctctcacatgtggccgatccgtgccta

SEQ ID NO: 124976 - DNA, 35 bp, Artificial Sequence
  Synthetic oligonucleotide
aaccttcgccacagtattttttaaccactcgcacc

SEQ ID NO: 124977 - DNA, 35 bp, Artificial Sequence
  Synthetic oligonucleotide
ggtccaggccccagttccgtgatcgtttcctgccc

SEQ ID NO: 124978 - DNA, 35 bp, Artificial Sequence
  Synthetic oligonucleotide
agcagtccgtgcagtctccggccctctacgttccc

SEQ ID NO: 124979 - DNA, 35 bp, Artificial Sequence
  Synthetic oligonucleotide
tctccccgaaaccctctgatcactgtacgttcgcc

SEQ ID NO: 124980 - DNA, 35 bp, Artificial Sequence
  Synthetic oligonucleotide
gttcccgctcctttatgtcaagctacacactactc

SEQ ID NO: 124981 - DNA, 35 bp, Artificial Sequence
  Synthetic oligonucleotide
gcactacgagcgctcatgtcttcccttcttctgtc

SEQ ID NO: 124982 - DNA, 35 bp, Artificial Sequence
  Synthetic oligonucleotide
actccttcctccagccttgcctcacgccgatttgg

SEQ ID NO: 124983 - DNA, 35 bp, Artificial Sequence
  Synthetic oligonucleotide
gtggtgggggtaggggtggagtcaaggcgcaccgt

SEQ ID NO: 124984 - DNA, 36 bp, Artificial Sequence
  Synthetic oligonucleotide
gacgtacgggcgggagggataagattagggagttaa

SEQ ID NO: 124985 - DNA, 35 bp, Artificial Sequence
  Synthetic oligonucleotide
atgcccgctgtccgtcgcttgctctgtcccagtca

SEQ ID NO: 124986 - DNA, 37 bp, Artificial Sequence
  Synthetic oligonucleotide
gggagggaagtggggtggttcgaggaaagggcagaga

SEQ ID NO: 124987 - DNA, 37 bp, Artificial Sequence
  Synthetic oligonucleotide
atgggcaagtatgatgggggtcaggggcgtgtgggga

SEQ ID NO: 124988 - DNA, 38 bp, Artificial Sequence
  Synthetic oligonucleotide
tgtagccgtctattcccgtgcgttccccttcccagtga

SEQ ID NO: 124989 - DNA, 35 bp, Artificial Sequence
  Synthetic oligonucleotide
acactatcctcgtccctgggcccggttacatcccc

SEQ ID NO: 124990 - DNA, 35 bp, Artificial Sequence
  Synthetic oligonucleotide
attcaacgcgagttcctaaaccggcgccccctccc

SEQ ID NO: 124991 - DNA, 35 bp, Artificial Sequence
  Synthetic oligonucleotide
ttcccacccatcacacgcgtaaatagcgccgggcc

SEQ ID NO: 124992 - DNA, 35 bp, Artificial Sequence
  Synthetic oligonucleotide
tttaccgcctgacgttacctgcggactgctcccct

SEQ ID NO: 124993 - DNA, 36 bp, Artificial Sequence
  Synthetic oligonucleotide
gaacctccctgtggtatccattcccgccccatggaa

SEQ ID NO: 124994 - DNA, 37 bp, Artificial Sequence
  Synthetic oligonucleotide
gatgagggacggggtaggagcgagtgcggggaccaga

SEQ ID NO: 124995 - DNA, 37 bp, Artificial Sequence
  Synthetic oligonucleotide
aaaccgggggaggggaggagcgggtggtaggggacga

SEQ ID NO: 124996 - DNA, 37 bp, Artificial Sequence
  Synthetic oligonucleotide
ggttagccatcagtcgtgttcccccccttcctcccga

SEQ ID NO: 124997 - DNA, 37 bp, Artificial Sequence
  Synthetic oligonucleotide
gagggggatgggaccggggcgtgatctagggcgggga

SEQ ID NO: 124998 - DNA, 37 bp, Artificial Sequence
  Synthetic oligonucleotide
atgagtgccgtcagcgcgcccgcccgccctccattga

SEQ ID NO: 124999 - DNA, 36 bp, Artificial Sequence
  Synthetic oligonucleotide
tgcaccccgtaccatttacctcggcgctatgcacta

SEQ ID NO: 125000 - DNA, 35 bp, Artificial Sequence
  Synthetic oligonucleotide
tctggtcgcgctccccggccgcctgctcctactta

SEQ ID NO: 125001 - DNA, 35 bp, Artificial Sequence
  Synthetic oligonucleotide
gccctgcgtcgctccatcagcccccccctagtcac

SEQ ID NO: 125002 - DNA, 35 bp, Artificial Sequence
  Synthetic oligonucleotide
gaagccaacagggggaggaggcgaagaatcatgag

SEQ ID NO: 125003 - DNA, 35 bp, Artificial Sequence
  Synthetic oligonucleotide
aacgcggggaaagtagaggacggaaggtggggggg

SEQ ID NO: 125004 - DNA, 35 bp, Artificial Sequence
  Synthetic oligonucleotide
tccacccaaaagccccgtgcctaccgtgcccacat

SEQ ID NO: 125005 - DNA, 35 bp, Artificial Sequence
  Synthetic oligonucleotide
atccacacaccggtaatttgcactgcttgccccat

SEQ ID NO: 125006 - DNA, 35 bp, Artificial Sequence
  Synthetic oligonucleotide
tcccgtgccgtttatcgatccgccgccattcgctt

SEQ ID NO: 125007 - DNA, 35 bp, Artificial Sequence
  Synthetic oligonucleotide
tcccaccatgccgcccgaccaggttaagttcccca

SEQ ID NO: 125008 - DNA, 36 bp, Artificial Sequence
  Synthetic oligonucleotide
gaccgagctcccgggcccctctctgcgtgtaccgca

SEQ ID NO: 125009 - DNA, 33 bp, Artificial Sequence
  Synthetic oligonucleotide
tcctccgcctcaccatttcctactcgtgcttca

SEQ ID NO: 125010 - DNA, 37 bp, Artificial Sequence
  Synthetic oligonucleotide
gcgggggggacgggcgaatgggggggcactgacgaga

SEQ ID NO: 125011 - DNA, 36 bp, Artificial Sequence
  Synthetic oligonucleotide
gccccgccaatgactactttgtgccccctccataga

SEQ ID NO: 125012 - DNA, 37 bp, Artificial Sequence
  Synthetic oligonucleotide
gcatccgccgtgcaatatgctatcgtttccctgctga

SEQ ID NO: 125013 - DNA, 35 bp, Artificial Sequence
  Synthetic oligonucleotide
ggtgctgccgcttccatctgttacgtgtcctcacc

SEQ ID NO: 125014 - DNA, 35 bp, Artificial Sequence
  Synthetic oligonucleotide
actccgccatggaccgccctgcctgcatgcttacc

SEQ ID NO: 125015 - DNA, 35 bp, Artificial Sequence
  Synthetic oligonucleotide
acaccccttccgctatgagccataccgggcccgcc

SEQ ID NO: 125016 - DNA, 35 bp, Artificial Sequence
  Synthetic oligonucleotide
gagcgtgcccccagactcccacacgatgtaccttc

SEQ ID NO: 125017 - DNA, 35 bp, Artificial Sequence
  Synthetic oligonucleotide
aacggggatgcggacaataggagggtggggaggcg

SEQ ID NO: 125018 - DNA, 35 bp, Artificial Sequence
  Synthetic oligonucleotide
atacatccgacatccccacgctccttcgacccatg

SEQ ID NO: 125019 - DNA, 35 bp, Artificial Sequence
  Synthetic oligonucleotide
gatagggacgaccgtggagcaggaggggcgtattg

SEQ ID NO: 125020 - DNA, 35 bp, Artificial Sequence
  Synthetic oligonucleotide
tcgctccgacctgggacagacgcttcctaccccct

SEQ ID NO: 125021 - DNA, 35 bp, Artificial Sequence
  Synthetic oligonucleotide
gtgcgggtctagtgttaactttcgtacccccccct

SEQ ID NO: 125022 - DNA, 35 bp, Artificial Sequence
  Synthetic oligonucleotide
gattgtgaaagtgggtggaagcaggggcgggtggt

SEQ ID NO: 125023 - DNA, 36 bp, Artificial Sequence
  Synthetic oligonucleotide
gacatcgacctgggcactacctccagctccttcgca

SEQ ID NO: 125024 - DNA, 37 bp, Artificial Sequence
  Synthetic oligonucleotide
gcattgagcaggaggtattatcacgccccccccacga

SEQ ID NO: 125025 - DNA, 37 bp, Artificial Sequence
  Synthetic oligonucleotide
gtgtgtcaggatcggagggggaaggaggggggtcgga

SEQ ID NO: 125026 - DNA, 35 bp, Artificial Sequence
  Synthetic oligonucleotide
gtgtcaactcggcgttgtcgggccttccctccgcc

SEQ ID NO: 125027 - DNA, 35 bp, Artificial Sequence
  Synthetic oligonucleotide
accgttcccgccccaatcacaatgactcctcacgc

SEQ ID NO: 125028 - DNA, 35 bp, Artificial Sequence
  Synthetic oligonucleotide
ttgaccgtatcactatatctgtttcgtgccttatc

SEQ ID NO: 125029 - DNA, 35 bp, Artificial Sequence
  Synthetic oligonucleotide
gttcgtgcccccccccgagtactgtcggaaaactc

SEQ ID NO: 125030 - DNA, 35 bp, Artificial Sequence
  Synthetic oligonucleotide
tgactgtgataggggggaggaggagtttgggaggg

SEQ ID NO: 125031 - DNA, 35 bp, Artificial Sequence
  Synthetic oligonucleotide
gcgttaccgccggcgaccctcctttcccctgccgt

SEQ ID NO: 125032 - DNA, 35 bp, Artificial Sequence
  Synthetic oligonucleotide
aactcccccgctagagtacgtattacacccgtggt

SEQ ID NO: 125033 - DNA, 35 bp, Artificial Sequence
  Synthetic oligonucleotide
gccctcgaccccactagcacgactcacccacctgt

SEQ ID NO: 125034 - DNA, 35 bp, Artificial Sequence
  Synthetic oligonucleotide
tccccactttccctcagcagtacttatctggcctt

SEQ ID NO: 125035 - DNA, 36 bp, Artificial Sequence
  Synthetic oligonucleotide
tcaccaccacgcgtcgcaccgccctctctatgccca

SEQ ID NO: 125036 - DNA, 35 bp, Artificial Sequence
  Synthetic oligonucleotide
ggagcgagcctagtcctgttcgtgcccttcctcca

SEQ ID NO: 125037 - DNA, 35 bp, Artificial Sequence
  Synthetic oligonucleotide
atcgcggacaccactgtcgctttaactttcactca

SEQ ID NO: 125038 - DNA, 35 bp, Artificial Sequence
  Synthetic oligonucleotide
accacagttcgcctctcacttttagggtcctttca

SEQ ID NO: 125039 - DNA, 37 bp, Artificial Sequence
  Synthetic oligonucleotide
gcttggggggaagggggggtgagagtacgagctccga

SEQ ID NO: 125040 - DNA, 36 bp, Artificial Sequence
  Synthetic oligonucleotide
tcactgggtgggcgcatcatagtataaagggcggga

SEQ ID NO: 125041 - DNA, 37 bp, Artificial Sequence
  Synthetic oligonucleotide
gcattgcggaggcgggagggtgcacggggcggatgga

SEQ ID NO: 125042 - DNA, 36 bp, Artificial Sequence
  Synthetic oligonucleotide
tacaaccacccgccgcataacatggcagttcactga

SEQ ID NO: 125043 - DNA, 35 bp, Artificial Sequence
  Synthetic oligonucleotide
acgccattccgtacttgtaacatctacattgccac

SEQ ID NO: 125044 - DNA, 35 bp, Artificial Sequence
  Synthetic oligonucleotide
gtagcacccgccgctccccttaccggcccaggcac

SEQ ID NO: 125045 - DNA, 35 bp, Artificial Sequence
  Synthetic oligonucleotide
ggtccgaccctctcacactgcgctaatacatgtac

SEQ ID NO: 125046 - DNA, 35 bp, Artificial Sequence
  Synthetic oligonucleotide
gaacaccttcgcccagcccgccttgtcgcttggcc

SEQ ID NO: 125047 - DNA, 35 bp, Artificial Sequence
  Synthetic oligonucleotide
gccaacatcattcccgcacctccggaccaacatgc

SEQ ID NO: 125048 - DNA, 28 bp, Artificial Sequence
  Synthetic oligonucleotide
gccacccgtatttttgcgcactattttc

SEQ ID NO: 125049 - DNA, 35 bp, Artificial Sequence
  Synthetic oligonucleotide
gattcccctgctcgcacatcttacgcgtttaaccg

SEQ ID NO: 125050 - DNA, 35 bp, Artificial Sequence
  Synthetic oligonucleotide
gtctcatcatcactcgggcccatcacctgtccctg

SEQ ID NO: 125051 - DNA, 35 bp, Artificial Sequence
  Synthetic oligonucleotide
gggacacctcacgctaatgcgagccacccttactt

SEQ ID NO: 125052 - DNA, 35 bp, Artificial Sequence
  Synthetic oligonucleotide
ttgattgtaggagggctgcaaggagggcgggggaa

SEQ ID NO: 125053 - DNA, 37 bp, Artificial Sequence
  Synthetic oligonucleotide
tgtgacgagtggggaggaaggacatgtgaggagaaga

SEQ ID NO: 125054 - DNA, 36 bp, Artificial Sequence
  Synthetic oligonucleotide
tacccccgccctgccctggtacaaaccctaatacga

SEQ ID NO: 125055 - DNA, 36 bp, Artificial Sequence
  Synthetic oligonucleotide
acgcactatcattgtctcccccacccgcccgcttga

SEQ ID NO: 125056 - DNA, 36 bp, Artificial Sequence
  Synthetic oligonucleotide
gactgggagagcttgggaaaatggggcgtgggggta

SEQ ID NO: 125057 - DNA, 35 bp, Artificial Sequence
  Synthetic oligonucleotide
ttctacccccgattgttcctctggtaatcctttcc

SEQ ID NO: 125058 - DNA, 35 bp, Artificial Sequence
  Synthetic oligonucleotide
tgtcccctcacccgtacatcttgagcctccctgtc

SEQ ID NO: 125059 - DNA, 34 bp, Artificial Sequence
  Synthetic oligonucleotide
tccatccgtccctattagtcaccttgcttggttc

SEQ ID NO: 125060 - DNA, 35 bp, Artificial Sequence
  Synthetic oligonucleotide
gccgaagccgtataccccctgctgctcgttgtttc

SEQ ID NO: 125061 - DNA, 35 bp, Artificial Sequence
  Synthetic oligonucleotide
accatcccatcccttctcgcatcatagacactcgt

SEQ ID NO: 125062 - DNA, 36 bp, Artificial Sequence
  Synthetic oligonucleotide
tgccgcaagccgcccccgtgacaccatgcctgccca

SEQ ID NO: 125063 - DNA, 36 bp, Artificial Sequence
  Synthetic oligonucleotide
aaggtcacctcctatgccgatactactacctgctca

SEQ ID NO: 125064 - DNA, 37 bp, Artificial Sequence
  Synthetic oligonucleotide
gcgtggcacatgagggggagggaggcaagggtgaaga

SEQ ID NO: 125065 - DNA, 37 bp, Artificial Sequence
  Synthetic oligonucleotide
gcttgcccgccgcccgcacatgtcccagtcctaggga

SEQ ID NO: 125066 - DNA, 35 bp, Artificial Sequence
  Synthetic oligonucleotide
atgcgttgctgaccgctgccgtttcacccgatacc

SEQ ID NO: 125067 - DNA, 35 bp, Artificial Sequence
  Synthetic oligonucleotide
tcacagacacctcgctacattcccgcctgttcgcc

SEQ ID NO: 125068 - DNA, 35 bp, Artificial Sequence
  Synthetic oligonucleotide
tcccttgtccagcgcaccccgattcctccgtactc

SEQ ID NO: 125069 - DNA, 35 bp, Artificial Sequence
  Synthetic oligonucleotide
gtgcgtagccctcatcctctctgtctacgattctc

SEQ ID NO: 125070 - DNA, 35 bp, Artificial Sequence
  Synthetic oligonucleotide
ggccccgccccccgccttcgccgtctttgcacttc

SEQ ID NO: 125071 - DNA, 35 bp, Artificial Sequence
  Synthetic oligonucleotide
taacgccacgcgcttctttgcctgtcccatgcccg

SEQ ID NO: 125072 - DNA, 35 bp, Artificial Sequence
  Synthetic oligonucleotide
acctggcgcgatgctctaccccgttaacgctccct

SEQ ID NO: 125073 - DNA, 35 bp, Artificial Sequence
  Synthetic oligonucleotide
acccacacctcaagactgtcgtcgtggcccttgtt

SEQ ID NO: 125074 - DNA, 35 bp, Artificial Sequence
  Synthetic oligonucleotide
aacgctcccccagctctccttctcccggacagtaa

SEQ ID NO: 125075 - DNA, 37 bp, Artificial Sequence
  Synthetic oligonucleotide
gcgaaaaggatgggggagaagggggaggtcctgacga

SEQ ID NO: 125076 - DNA, 37 bp, Artificial Sequence
  Synthetic oligonucleotide
gtgcgctgatggccttacacctgccttcccatcccga

SEQ ID NO: 125077 - DNA, 35 bp, Artificial Sequence
  Synthetic oligonucleotide
gcacccactggcgccttccgtgaaccaccttcata

SEQ ID NO: 125078 - DNA, 36 bp, Artificial Sequence
  Synthetic oligonucleotide
ttgcggggaaggcaaggggggaatggaagaggtcta

SEQ ID NO: 125079 - DNA, 35 bp, Artificial Sequence
  Synthetic oligonucleotide
acgccccgtttcctcgctcccgtcgatacagctcc

SEQ ID NO: 125080 - DNA, 35 bp, Artificial Sequence
  Synthetic oligonucleotide
tcctgcgcgtcgcctccctctcacagccaccgtcc

SEQ ID NO: 125081 - DNA, 35 bp, Artificial Sequence
  Synthetic oligonucleotide
actgaccccttccatgccccccgacgttgtggtcc

SEQ ID NO: 125082 - DNA, 35 bp, Artificial Sequence
  Synthetic oligonucleotide
acctccagcccgcctcattctcgcactaagacctc

SEQ ID NO: 125083 - DNA, 35 bp, Artificial Sequence
  Synthetic oligonucleotide
gccactagcctgtttagtattggccaccttctctc

SEQ ID NO: 125084 - DNA, 35 bp, Artificial Sequence
  Synthetic oligonucleotide
aatgctgtccacctggtctcccctctcttccctcg

SEQ ID NO: 125085 - DNA, 35 bp, Artificial Sequence
  Synthetic oligonucleotide
ttgccaccctcgacgtcgatcaattatttccttcg

SEQ ID NO: 125086 - DNA, 35 bp, Artificial Sequence
  Synthetic oligonucleotide
gtgacgccgtctcccctccctcaccggccttgctg

SEQ ID NO: 125087 - DNA, 35 bp, Artificial Sequence
  Synthetic oligonucleotide
actcgaccgccctccgccgcctcctgcatacgcat

SEQ ID NO: 125088 - DNA, 35 bp, Artificial Sequence
  Synthetic oligonucleotide
agcctcacccatactgtgctgctgttctatctact

SEQ ID NO: 125089 - DNA, 35 bp, Artificial Sequence
  Synthetic oligonucleotide
atctccgcagccgcttctcaccgcttcccctgcgt

SEQ ID NO: 125090 - DNA, 35 bp, Artificial Sequence
  Synthetic oligonucleotide
gctcggaaggttgcctacatatgtccctcgccctt

SEQ ID NO: 125091 - DNA, 32 bp, Artificial Sequence
  Synthetic oligonucleotide
tctccgcccgctacaccatccacgtgttcaaa

SEQ ID NO: 125092 - DNA, 36 bp, Artificial Sequence
  Synthetic oligonucleotide
gaccgccttgccctcatctattcatcccagtgaaca

SEQ ID NO: 125093 - DNA, 36 bp, Artificial Sequence
  Synthetic oligonucleotide
gatacgcatcgcatcatttgtccaccgcccccctca

SEQ ID NO: 125094 - DNA, 35 bp, Artificial Sequence
  Synthetic oligonucleotide
gagccgggtcgacagggggtgggtgggttttaaac

SEQ ID NO: 125095 - DNA, 35 bp, Artificial Sequence
  Synthetic oligonucleotide
agcacccacgccatcccccgcgacggatccctccc

SEQ ID NO: 125096 - DNA, 35 bp, Artificial Sequence
  Synthetic oligonucleotide
acgttacccgcccatcacgttcctggaggccttgc

SEQ ID NO: 125097 - DNA, 35 bp, Artificial Sequence
  Synthetic oligonucleotide
tccgaggcctcccccccgtttcgaaacggtattcg

SEQ ID NO: 125098 - DNA, 35 bp, Artificial Sequence
  Synthetic oligonucleotide
gtagagcacccgtccacattttctggccttctttg

SEQ ID NO: 125099 - DNA, 35 bp, Artificial Sequence
  Synthetic oligonucleotide
tcttcccgcacccagccccttctacactgtagact

SEQ ID NO: 125100 - DNA, 35 bp, Artificial Sequence
  Synthetic oligonucleotide
gatcctctgcccccagaccctggaaggttgaccct

SEQ ID NO: 125101 - DNA, 35 bp, Artificial Sequence
  Synthetic oligonucleotide
tgccccacgctcagagcctctctgcatactgccct

SEQ ID NO: 125102 - DNA, 35 bp, Artificial Sequence
  Synthetic oligonucleotide
tcactcctccgcacccgccctgcctgtttaccagt

SEQ ID NO: 125103 - DNA, 35 bp, Artificial Sequence
  Synthetic oligonucleotide
tcacgagtgtcggaaaggagggatgggtggggagt

SEQ ID NO: 125104 - DNA, 35 bp, Artificial Sequence
  Synthetic oligonucleotide
gttgctaacagcgttgctctgtccttgcctccttt

SEQ ID NO: 125105 - DNA, 37 bp, Artificial Sequence
  Synthetic oligonucleotide
aagccggggggagcataaaggggttcagggggaggga

SEQ ID NO: 125106 - DNA, 35 bp, Artificial Sequence
  Synthetic oligonucleotide
gatggggcggctgggagggtggtgggggtagggga

SEQ ID NO: 125107 - DNA, 38 bp, Artificial Sequence
  Synthetic oligonucleotide
atgtcctcccacacaactggtatcgccacaatcactga

SEQ ID NO: 125108 - DNA, 38 bp, Artificial Sequence
  Synthetic oligonucleotide
tagcgacaccgcctctgctgctttcctccaattcgtga

SEQ ID NO: 125109 - DNA, 35 bp, Artificial Sequence
  Synthetic oligonucleotide
agcgttcccgccgtcgtcttcttcgccctgtaaac

SEQ ID NO: 125110 - DNA, 35 bp, Artificial Sequence
  Synthetic oligonucleotide
accccgcctacatccgctcgaggcgtacatcatcc

SEQ ID NO: 125111 - DNA, 35 bp, Artificial Sequence
  Synthetic oligonucleotide
gctggcacgctgccctcacctagtctcactgcctc

SEQ ID NO: 125112 - DNA, 35 bp, Artificial Sequence
  Synthetic oligonucleotide
tgcccaactgttccttgcgtatcccacgtaccgtc

SEQ ID NO: 125113 - DNA, 35 bp, Artificial Sequence
  Synthetic oligonucleotide
tgcacgacaccgcctcggccaagcctatcaccttc

SEQ ID NO: 125114 - DNA, 35 bp, Artificial Sequence
  Synthetic oligonucleotide
gactacatcgcccgcccccagatctcgttctcacg

SEQ ID NO: 125115 - DNA, 35 bp, Artificial Sequence
  Synthetic oligonucleotide
acccgtccccccgtacaatttgcagttctcgaccg

SEQ ID NO: 125116 - DNA, 36 bp, Artificial Sequence
  Synthetic oligonucleotide
aacgcccccccgttgctgctgtccgcaacctctaca

SEQ ID NO: 125117 - DNA, 36 bp, Artificial Sequence
  Synthetic oligonucleotide
gactccctcaccatcctgcgaatgccttccagctca

SEQ ID NO: 125118 - DNA, 37 bp, Artificial Sequence
  Synthetic oligonucleotide
gccgctcagatatgcctccttcgcgcctcaccttcga

SEQ ID NO: 125119 - DNA, 37 bp, Artificial Sequence
  Synthetic oligonucleotide
gttcccccaggtggtaggggccttgggttgtggtgga

SEQ ID NO: 125120 - DNA, 38 bp, Artificial Sequence
  Synthetic oligonucleotide
gcccgccgcactatctgcatttgacttctttcgggtga

SEQ ID NO: 125121 - DNA, 38 bp, Artificial Sequence
  Synthetic oligonucleotide
tcacccacgttcagcgcttctccacacgccacttttga

SEQ ID NO: 125122 - DNA, 36 bp, Artificial Sequence
  Synthetic oligonucleotide
gatgacacccgtcgccctcgtctacgtcgcccttta

SEQ ID NO: 125123 - DNA, 35 bp, Artificial Sequence
  Synthetic oligonucleotide
tcccgcctcatttctctttcgactgcaagcttgac

SEQ ID NO: 125124 - DNA, 34 bp, Artificial Sequence
  Synthetic oligonucleotide
gtgaccccattcgtacgctttttcgctcctacgc

SEQ ID NO: 125125 - DNA, 35 bp, Artificial Sequence
  Synthetic oligonucleotide
acgacacccgcccgctttactcgatcctgcctatc

SEQ ID NO: 125126 - DNA, 35 bp, Artificial Sequence
  Synthetic oligonucleotide
tgccccgtaccggaactcgattctcctcctgtcct

SEQ ID NO: 125127 - DNA, 35 bp, Artificial Sequence
  Synthetic oligonucleotide
gcccctcctctcgttcgttactatttacggttcct

SEQ ID NO: 125128 - DNA, 35 bp, Artificial Sequence
  Synthetic oligonucleotide
agcccgtcaatcgcgcgccctttcaccttttgcca

SEQ ID NO: 125129 - DNA, 37 bp, Artificial Sequence
  Synthetic oligonucleotide
tgtcacagcctcacactctcgcctgcgcccctatcga

SEQ ID NO: 125130 - DNA, 37 bp, Artificial Sequence
  Synthetic oligonucleotide
tacgggaccgacatttgggtgggcggttatgaaggga

SEQ ID NO: 125131 - DNA, 36 bp, Artificial Sequence
  Synthetic oligonucleotide
tgcgagggggtgggggagcacgacggggttgaggga

SEQ ID NO: 125132 - DNA, 37 bp, Artificial Sequence
  Synthetic oligonucleotide
gtaatccaccgcacatatcgttaccgcctgtccgtga

SEQ ID NO: 125133 - DNA, 35 bp, Artificial Sequence
  Synthetic oligonucleotide
aatgcgtggtgggggaattgcaggtaagggggtga

SEQ ID NO: 125134 - DNA, 36 bp, Artificial Sequence
  Synthetic oligonucleotide
accccctcgttgtctatcctcaggcggacgccgcac

SEQ ID NO: 125135 - DNA, 35 bp, Artificial Sequence
  Synthetic oligonucleotide
tattcaccaccccaccgcgagggcaggccgattac

SEQ ID NO: 125136 - DNA, 35 bp, Artificial Sequence
  Synthetic oligonucleotide
ccagtcacctcccgttgtctgaacctactgtgccc

SEQ ID NO: 125137 - DNA, 35 bp, Artificial Sequence
  Synthetic oligonucleotide
tagaccaatccgccgtcccatccacggtgtgctcc

SEQ ID NO: 125138 - DNA, 35 bp, Artificial Sequence
  Synthetic oligonucleotide
gaaccaagacccagcgatagtcgtcgccgcccctc

SEQ ID NO: 125139 - DNA, 35 bp, Artificial Sequence
  Synthetic oligonucleotide
gcgaccccggtgctcttggtcgaacgtttcttctc

SEQ ID NO: 125140 - DNA, 35 bp, Artificial Sequence
  Synthetic oligonucleotide
gtggcacagcccctgcctacgtttccagtacatcg

SEQ ID NO: 125141 - DNA, 33 bp, Artificial Sequence
  Synthetic oligonucleotide
gtgcgtgaagccgatacgcccgttctacccctg

SEQ ID NO: 125142 - DNA, 35 bp, Artificial Sequence
  Synthetic oligonucleotide
acccccacttctgtgcatgccctaacaactcccct

SEQ ID NO: 125143 - DNA, 34 bp, Artificial Sequence
  Synthetic oligonucleotide
gcttcgtgagctcttcaccgccccgcctttccct

SEQ ID NO: 125144 - DNA, 35 bp, Artificial Sequence
  Synthetic oligonucleotide
acttatgcccccgtactgcaatgcccactactgtt

SEQ ID NO: 125145 - DNA, 35 bp, Artificial Sequence
  Synthetic oligonucleotide
gcactccacctgctcaccattaggctcgtttccaa

SEQ ID NO: 125146 - DNA, 37 bp, Artificial Sequence
  Synthetic oligonucleotide
agtcatgcggaggggcaaggaagcaaggggggcgcga

SEQ ID NO: 125147 - DNA, 38 bp, Artificial Sequence
  Synthetic oligonucleotide
tcaacgggcgcgggtgggggggcaagtaccgtgaatga

SEQ ID NO: 125148 - DNA, 35 bp, Artificial Sequence
  Synthetic oligonucleotide
gcccccctgctacccgtttcagtcctgtcccgaac

SEQ ID NO: 125149 - DNA, 35 bp, Artificial Sequence
  Synthetic oligonucleotide
atgcatgtgtaggactcacctgtctctcgttccac

SEQ ID NO: 125150 - DNA, 35 bp, Artificial Sequence
  Synthetic oligonucleotide
gaacaatgcagtgtcaatttcttcaccgcctgccc

SEQ ID NO: 125151 - DNA, 35 bp, Artificial Sequence
  Synthetic oligonucleotide
taactctccgcaatctgttcaagcgtttcgctccc

SEQ ID NO: 125152 - DNA, 35 bp, Artificial Sequence
  Synthetic oligonucleotide
tcacacttcgacgacccagctgttccttcggtccc

SEQ ID NO: 125153 - DNA, 35 bp, Artificial Sequence
  Synthetic oligonucleotide
accaccatcactccgcgcataactaatgccccgcc

SEQ ID NO: 125154 - DNA, 35 bp, Artificial Sequence
  Synthetic oligonucleotide
acatccccccgcccgtttgtagcctgttatccgcc

SEQ ID NO: 125155 - DNA, 35 bp, Artificial Sequence
  Synthetic oligonucleotide
gacctcgcggtttaccactgcccctcactacatgc

SEQ ID NO: 125156 - DNA, 35 bp, Artificial Sequence
  Synthetic oligonucleotide
taacacagcgggtgggtcggggtggggagttttcg

SEQ ID NO: 125157 - DNA, 35 bp, Artificial Sequence
  Synthetic oligonucleotide
accccgtccaattcccgcgcatacgcgcctcgcct

SEQ ID NO: 125158 - DNA, 35 bp, Artificial Sequence
  Synthetic oligonucleotide
tgaagatcggggtgtggagggcggggtgggagctt

SEQ ID NO: 125159 - DNA, 35 bp, Artificial Sequence
  Synthetic oligonucleotide
acacccacgcccacacatctgagtctttggccgtt

SEQ ID NO: 125160 - DNA, 35 bp, Artificial Sequence
  Synthetic oligonucleotide
gaagcaagagagggcgtaggggggacggaagcgtt

SEQ ID NO: 125161 - DNA, 35 bp, Artificial Sequence
  Synthetic oligonucleotide
attccgcccctccaccgttttacgtgttttacaaa

SEQ ID NO: 125162 - DNA, 36 bp, Artificial Sequence
  Synthetic oligonucleotide
acacgactggtcgggtcggtccctaactcgcctcca

SEQ ID NO: 125163 - DNA, 35 bp, Artificial Sequence
  Synthetic oligonucleotide
tgacggggggaaaggcaaaaagtgggtggggcgca

SEQ ID NO: 125164 - DNA, 37 bp, Artificial Sequence
  Synthetic oligonucleotide
gaagggactggaagggacaggtgggggggagtggaga

SEQ ID NO: 125165 - DNA, 37 bp, Artificial Sequence
  Synthetic oligonucleotide
gcacgaagtgcggcccccctcctggcttgacccacga

SEQ ID NO: 125166 - DNA, 37 bp, Artificial Sequence
  Synthetic oligonucleotide
gtggcctcctcaccatatcgttccctggtcatcacga

SEQ ID NO: 125167 - DNA, 38 bp, Artificial Sequence
  Synthetic oligonucleotide
tcgtgtcacatcctccgctcgtgttgcccttcccgtga

SEQ ID NO: 125168 - DNA, 35 bp, Artificial Sequence
  Synthetic oligonucleotide
gtcatcgcgatgtctgatccccgtcgtctttcacc

SEQ ID NO: 125169 - DNA, 36 bp, Artificial Sequence
  Synthetic oligonucleotide
aatgcccaggcattcgtgtaccatcggatccgcccc

SEQ ID NO: 125170 - DNA, 35 bp, Artificial Sequence
  Synthetic oligonucleotide
aaagccgccacagcccagcaatcttaggtccatcc

SEQ ID NO: 125171 - DNA, 35 bp, Artificial Sequence
  Synthetic oligonucleotide
tcaccaatgttcacaagttgtctcgttttcgttcc

SEQ ID NO: 125172 - DNA, 35 bp, Artificial Sequence
  Synthetic oligonucleotide
tgtgcccctcctgaggctgcccatcacatctaccg

SEQ ID NO: 125173 - DNA, 35 bp, Artificial Sequence
  Synthetic oligonucleotide
atcccgccttggccccattccgacttacgagactg

SEQ ID NO: 125174 - DNA, 35 bp, Artificial Sequence
  Synthetic oligonucleotide
ttacccacccgatcctcagtcgtctactccctctg

SEQ ID NO: 125175 - DNA, 35 bp, Artificial Sequence
  Synthetic oligonucleotide
gccccatcccttgctgtcctcggcctattatctat

SEQ ID NO: 125176 - DNA, 35 bp, Artificial Sequence
  Synthetic oligonucleotide
tcgctcccggccatgccctcgacccctcaatccct

SEQ ID NO: 125177 - DNA, 36 bp, Artificial Sequence
  Synthetic oligonucleotide
tgcaggtgcggttagtggggaaaggggcgggggtaa

SEQ ID NO: 125178 - DNA, 37 bp, Artificial Sequence
  Synthetic oligonucleotide
gatgcgccgcctccccgtccgccccaattctagtcga

SEQ ID NO: 125179 - DNA, 38 bp, Artificial Sequence
  Synthetic oligonucleotide
tgtcgggggaacagggtgggaggggggctcagaagtga

SEQ ID NO: 125180 - DNA, 35 bp, Artificial Sequence
  Synthetic oligonucleotide
tccaacgcctgaccggtctctgctctctcgtttga

SEQ ID NO: 125181 - DNA, 36 bp, Artificial Sequence
  Synthetic oligonucleotide
gcatgcccaaatcgcccccgtcaccatcttctagta

SEQ ID NO: 125182 - DNA, 35 bp, Artificial Sequence
  Synthetic oligonucleotide
gcataccatccgagtctagcctctgcgcccccacc

SEQ ID NO: 125183 - DNA, 35 bp, Artificial Sequence
  Synthetic oligonucleotide
gcttcgatcgcgactcgaattcgtttcttgccccc

SEQ ID NO: 125184 - DNA, 35 bp, Artificial Sequence
  Synthetic oligonucleotide
aacctcgccctgtgtccccgtagccaatttgtcgc

SEQ ID NO: 125185 - DNA, 35 bp, Artificial Sequence
  Synthetic oligonucleotide
aactgcgcaatacctgcttctttgttaccaccgtc

SEQ ID NO: 125186 - DNA, 35 bp, Artificial Sequence
  Synthetic oligonucleotide
attccctccagttccatcatctccgttttagggtc

SEQ ID NO: 125187 - DNA, 35 bp, Artificial Sequence
  Synthetic oligonucleotide
acgcccccgacgattaccctgcccgccggatcttc

SEQ ID NO: 125188 - DNA, 35 bp, Artificial Sequence
  Synthetic oligonucleotide
ggacccccctcatttcagtacgcctacccactacg

SEQ ID NO: 125189 - DNA, 35 bp, Artificial Sequence
  Synthetic oligonucleotide
taaacatgggaggggagggtgaggacaaccgacgg

SEQ ID NO: 125190 - DNA, 35 bp, Artificial Sequence
  Synthetic oligonucleotide
atacgtcgcctatatgtcctgcaccccttatccct

SEQ ID NO: 125191 - DNA, 36 bp, Artificial Sequence
  Synthetic oligonucleotide
ggatacgggggagggacaaggggtgggatggtcaga

SEQ ID NO: 125192 - DNA, 37 bp, Artificial Sequence
  Synthetic oligonucleotide
gcgggggggaaggttggatcgggaggagagctacgga

SEQ ID NO: 125193 - DNA, 37 bp, Artificial Sequence
  Synthetic oligonucleotide
tcagccgaccctgcttgatatgctctcttccatcgga

SEQ ID NO: 125194 - DNA, 37 bp, Artificial Sequence
  Synthetic oligonucleotide
gtccctctgatggcactcgatcgccgctcccccttga

SEQ ID NO: 125195 - DNA, 35 bp, Artificial Sequence
  Synthetic oligonucleotide
tagccctcgcatttttcccaattcagtacctgccc

SEQ ID NO: 125196 - DNA, 35 bp, Artificial Sequence
  Synthetic oligonucleotide
tccggtctctccgttctcgtttctcgccgtttccc

SEQ ID NO: 125197 - DNA, 35 bp, Artificial Sequence
  Synthetic oligonucleotide
acgcacctcgccccaaacatgagaatgcaccatcc

SEQ ID NO: 125198 - DNA, 35 bp, Artificial Sequence
  Synthetic oligonucleotide
atgccaccctgttgtcccactacgatacttcgtgc

SEQ ID NO: 125199 - DNA, 35 bp, Artificial Sequence
  Synthetic oligonucleotide
acccgtccactctccccgcctggaagacacgcttc

SEQ ID NO: 125200 - DNA, 35 bp, Artificial Sequence
  Synthetic oligonucleotide
gaggtgagaaagggaggaaagcgtagggcaagaag

SEQ ID NO: 125201 - DNA, 35 bp, Artificial Sequence
  Synthetic oligonucleotide
atggggaaggggtaaggaaccgtggaaagggatag

SEQ ID NO: 125202 - DNA, 35 bp, Artificial Sequence
  Synthetic oligonucleotide
atggtcggtcggcccggagggaggaggagggatgg

SEQ ID NO: 125203 - DNA, 35 bp, Artificial Sequence
  Synthetic oligonucleotide
tcaccacttgtcgcccgtgttcgcctctatcctaa

SEQ ID NO: 125204 - DNA, 37 bp, Artificial Sequence
  Synthetic oligonucleotide
gacgagggacggccgggggcaggggctggagggagga

SEQ ID NO: 125205 - DNA, 36 bp, Artificial Sequence
  Synthetic oligonucleotide
ggatgtaggggtgggggagtgggtgtaaggggctga

SEQ ID NO: 125206 - DNA, 36 bp, Artificial Sequence
  Synthetic oligonucleotide
tactgcaccgtatttgttctatcattgcctccccta

SEQ ID NO: 125207 - DNA, 35 bp, Artificial Sequence
  Synthetic oligonucleotide
gacgcctcccctgtatccttcgcctgctgtggtta

SEQ ID NO: 125208 - DNA, 35 bp, Artificial Sequence
  Synthetic oligonucleotide
gcccattgcccgtcctgtcgccggccctggttcac

SEQ ID NO: 125209 - DNA, 35 bp, Artificial Sequence
  Synthetic oligonucleotide
gcaccgcagaccgacgacttccttacgctcccacc

SEQ ID NO: 125210 - DNA, 35 bp, Artificial Sequence
  Synthetic oligonucleotide
gacactctacctccagacgtctggaactccgccgc

SEQ ID NO: 125211 - DNA, 35 bp, Artificial Sequence
  Synthetic oligonucleotide
agcgcgtgcatctagtctatcctactgtccttctc

SEQ ID NO: 125212 - DNA, 35 bp, Artificial Sequence
  Synthetic oligonucleotide
gtgtgccctgctctgacgggtaccacttttttttc

SEQ ID NO: 125213 - DNA, 35 bp, Artificial Sequence
  Synthetic oligonucleotide
ttcgctctgcccctcacgttcatgcaattctttcg

SEQ ID NO: 125214 - DNA, 35 bp, Artificial Sequence
  Synthetic oligonucleotide
tcaacaccgcccttgttccagccctcgccttattg

SEQ ID NO: 125215 - DNA, 35 bp, Artificial Sequence
  Synthetic oligonucleotide
gacacctctgactgccttccctagtacctgcccct

SEQ ID NO: 125216 - DNA, 35 bp, Artificial Sequence
  Synthetic oligonucleotide
atgctctcagtactgtcctgcaccaactctcctct

SEQ ID NO: 125217 - DNA, 35 bp, Artificial Sequence
  Synthetic oligonucleotide
cccgatgcccgacgtcgctctgtttgctccccctt

SEQ ID NO: 125218 - DNA, 36 bp, Artificial Sequence
  Synthetic oligonucleotide
tgctccctcagcctcctgccgtcgtttttcacccga

SEQ ID NO: 125219 - DNA, 37 bp, Artificial Sequence
  Synthetic oligonucleotide
tgcaaccccgctacagactcttttgctcctacctcga

SEQ ID NO: 125220 - DNA, 37 bp, Artificial Sequence
  Synthetic oligonucleotide
ggtggggaactgggggggatagaagcagttgcaggga

SEQ ID NO: 125221 - DNA, 37 bp, Artificial Sequence
  Synthetic oligonucleotide
gtgagtgtggggaggttccgtaaagggtggagaggga

SEQ ID NO: 125222 - DNA, 37 bp, Artificial Sequence
  Synthetic oligonucleotide
gagtcccgcctcctcccacccccgcacgtaccttgga

SEQ ID NO: 125223 - DNA, 37 bp, Artificial Sequence
  Synthetic oligonucleotide
tagcacccccatatatctgccgcctgccccatttgga

SEQ ID NO: 125224 - DNA, 35 bp, Artificial Sequence
  Synthetic oligonucleotide
tacccacccacaacgattctgcttaggtcttatcc

SEQ ID NO: 125225 - DNA, 35 bp, Artificial Sequence
  Synthetic oligonucleotide
tcccctgtcgcttcactgtcactgccatactgttc

SEQ ID NO: 125226 - DNA, 35 bp, Artificial Sequence
  Synthetic oligonucleotide
ttgctcctctatcccgcgcattgatacttcctttc

SEQ ID NO: 125227 - DNA, 35 bp, Artificial Sequence
  Synthetic oligonucleotide
gacgcattcagcactgctattgttccctcggtttc

SEQ ID NO: 125228 - DNA, 33 bp, Artificial Sequence
  Synthetic oligonucleotide
atcatggtgaggtagtaaagggtagagtggggg

SEQ ID NO: 125229 - DNA, 35 bp, Artificial Sequence
  Synthetic oligonucleotide
gtggccgatcgctcatgggcccttcccgctcctat

SEQ ID NO: 125230 - DNA, 36 bp, Artificial Sequence
  Synthetic oligonucleotide
aattgaggcgggataaggaggggataggggaagaaa

SEQ ID NO: 125231 - DNA, 32 bp, Artificial Sequence
  Synthetic oligonucleotide
tctccccctcggccaccttttgctcggtttaa

SEQ ID NO: 125232 - DNA, 36 bp, Artificial Sequence
  Synthetic oligonucleotide
gcttacagccccgagccaccatccgcccctccagca

SEQ ID NO: 125233 - DNA, 37 bp, Artificial Sequence
  Synthetic oligonucleotide
ggtcgtggggcgggactatggggtttgagcacgggga

SEQ ID NO: 125234 - DNA, 35 bp, Artificial Sequence
  Synthetic oligonucleotide
aatgcatccggtccgcgcgctattaactcccactc

SEQ ID NO: 125235 - DNA, 35 bp, Artificial Sequence
  Synthetic oligonucleotide
gagggggagggagccgggtggagtagattgttgat

SEQ ID NO: 125236 - DNA, 35 bp, Artificial Sequence
  Synthetic oligonucleotide
tccaccgttttgcgcgagcctgttcttttatcttt

SEQ ID NO: 125237 - DNA, 35 bp, Artificial Sequence
  Synthetic oligonucleotide
agaccaccatctgcacctctccactaagaccggga

SEQ ID NO: 125238 - DNA, 37 bp, Artificial Sequence
  Synthetic oligonucleotide
ggggacaggagggtgatacaagggggaaagggagtga

SEQ ID NO: 125239 - DNA, 38 bp, Artificial Sequence
  Synthetic oligonucleotide
tgccgacacatgtcctgcccctccgcaccgctctttga

SEQ ID NO: 125240 - DNA, 35 bp, Artificial Sequence
  Synthetic oligonucleotide
tgtgagcctccactgctatcatatctggccctgta

SEQ ID NO: 125241 - DNA, 35 bp, Artificial Sequence
  Synthetic oligonucleotide
acccagtcgtaccccgccacggtttgtacaccccc

SEQ ID NO: 125242 - DNA, 35 bp, Artificial Sequence
  Synthetic oligonucleotide
gccctccctgacgaccctgattgtcagcgcccccc

SEQ ID NO: 125243 - DNA, 35 bp, Artificial Sequence
  Synthetic oligonucleotide
tactgtcccgctcttacttggcatggtgctgcccc

SEQ ID NO: 125244 - DNA, 35 bp, Artificial Sequence
  Synthetic oligonucleotide
gccaggttcggtccgctttgctttttgtttcatcc

SEQ ID NO: 125245 - DNA, 35 bp, Artificial Sequence
  Synthetic oligonucleotide
tagcctcccccaatggccaccggactccttccgtc

SEQ ID NO: 125246 - DNA, 37 bp, Artificial Sequence
  Synthetic oligonucleotide
ttggtaggacgggcgaggtggggcaaaccggggaaga

SEQ ID NO: 125247 - DNA, 35 bp, Artificial Sequence
  Synthetic oligonucleotide
taatcctgccctcccttgctcgtaccgaccccgga

SEQ ID NO: 125248 - DNA, 35 bp, Artificial Sequence
  Synthetic oligonucleotide
gcctatgcctcctcatccttcgattgaccacttac

SEQ ID NO: 125249 - DNA, 35 bp, Artificial Sequence
  Synthetic oligonucleotide
actacgcgcccaactgagcatcgaggtcgcccccc

SEQ ID NO: 125250 - DNA, 35 bp, Artificial Sequence
  Synthetic oligonucleotide
tccccgccgcttttgtgctgctccgtcgtagtccc

SEQ ID NO: 125251 - DNA, 34 bp, Artificial Sequence
  Synthetic oligonucleotide
ttacaccggtgcctgccaatcgccccgtccctcc

SEQ ID NO: 125252 - DNA, 35 bp, Artificial Sequence
  Synthetic oligonucleotide
tgctccacctcgcacgctggaatgagcattcttcc

SEQ ID NO: 125253 - DNA, 35 bp, Artificial Sequence
  Synthetic oligonucleotide
accaccctctttgccactataggctatttcctagc

SEQ ID NO: 125254 - DNA, 35 bp, Artificial Sequence
  Synthetic oligonucleotide
gcgcacatcactcaggcccacgtacgcaccccctc

SEQ ID NO: 125255 - DNA, 35 bp, Artificial Sequence
  Synthetic oligonucleotide
caccacccctgttgctaagcccctccgcccggctc

SEQ ID NO: 125256 - DNA, 35 bp, Artificial Sequence
  Synthetic oligonucleotide
tgttcagccggtgagcactgtcttccctcctacct

SEQ ID NO: 125257 - DNA, 35 bp, Artificial Sequence
  Synthetic oligonucleotide
agtatccccctcactgcagatctgccctccttgct

SEQ ID NO: 125258 - DNA, 35 bp, Artificial Sequence
  Synthetic oligonucleotide
atctcgcccactcgttacgcaaggtacttctatct

SEQ ID NO: 125259 - DNA, 35 bp, Artificial Sequence
  Synthetic oligonucleotide
tcaatccgtcgccctgtctcatagttttcactctt

SEQ ID NO: 125260 - DNA, 35 bp, Artificial Sequence
  Synthetic oligonucleotide
gtgtgacgcacgcaccctcaccttgctttccccaa

SEQ ID NO: 125261 - DNA, 37 bp, Artificial Sequence
  Synthetic oligonucleotide
ttgccgaccctcgctgctatagctatatccttctcga

SEQ ID NO: 125262 - DNA, 37 bp, Artificial Sequence
  Synthetic oligonucleotide
gatacaccaccctcgttcccagcgcacccttaaggga

SEQ ID NO: 125263 - DNA, 35 bp, Artificial Sequence
  Synthetic oligonucleotide
atgccccgcctgctctgcacatttacaggtcatac

SEQ ID NO: 125264 - DNA, 35 bp, Artificial Sequence
  Synthetic oligonucleotide
tcaccccgtgaagttgatacccgctccatggcacc

SEQ ID NO: 125265 - DNA, 34 bp, Artificial Sequence
  Synthetic oligonucleotide
gagcggactatcctgctcgatcttctacctcgcc

SEQ ID NO: 125266 - DNA, 35 bp, Artificial Sequence
  Synthetic oligonucleotide
gacccatccggcccaaatgtacgtattccgtcctc

SEQ ID NO: 125267 - DNA, 35 bp, Artificial Sequence
  Synthetic oligonucleotide
tgggacacctcgtatgccgtatcctcgctcttctc

SEQ ID NO: 125268 - DNA, 35 bp, Artificial Sequence
  Synthetic oligonucleotide
gacgggaggggctattacggggacgcactggggtc

SEQ ID NO: 125269 - DNA, 35 bp, Artificial Sequence
  Synthetic oligonucleotide
gccccccgctacccactttgttagatgtgtccacg

SEQ ID NO: 125270 - DNA, 35 bp, Artificial Sequence
  Synthetic oligonucleotide
taccgagcacctcccgcatatcctccgccttatgt

SEQ ID NO: 125271 - DNA, 35 bp, Artificial Sequence
  Synthetic oligonucleotide
gacgtctcctcctctacccagcgtatattgccttt

SEQ ID NO: 125272 - DNA, 35 bp, Artificial Sequence
  Synthetic oligonucleotide
gaacgcctacatgacttgccctggcccctgctttt

SEQ ID NO: 125273 - DNA, 36 bp, Artificial Sequence
  Synthetic oligonucleotide
tccatcattcgccgcccccccgccttcgcagcgaaa

SEQ ID NO: 125274 - DNA, 35 bp, Artificial Sequence
  Synthetic oligonucleotide
atcagcactcctgtgctccacccgttttaccgcca

SEQ ID NO: 125275 - DNA, 36 bp, Artificial Sequence
  Synthetic oligonucleotide
actcgtacaaatggttctcttcctgtcccttcgcca

SEQ ID NO: 125276 - DNA, 36 bp, Artificial Sequence
  Synthetic oligonucleotide
gcagatctccccccgtcgaatagtgttcttccttca

SEQ ID NO: 125277 - DNA, 37 bp, Artificial Sequence
  Synthetic oligonucleotide
gccaccccccggtccttcaacaggcgacatcacacga

SEQ ID NO: 125278 - DNA, 37 bp, Artificial Sequence
  Synthetic oligonucleotide
ggtttgccctcacgttctatcatgcccaccccgctga

SEQ ID NO: 125279 - DNA, 35 bp, Artificial Sequence
  Synthetic oligonucleotide
tgccgcaggcacgttccaccatagcgcagctcccc

SEQ ID NO: 125280 - DNA, 35 bp, Artificial Sequence
  Synthetic oligonucleotide
ggtgggggtggttgttctaccggcggggtggaatc

SEQ ID NO: 125281 - DNA, 33 bp, Artificial Sequence
  Synthetic oligonucleotide
atttcacctgtccacgtatagccgcccccatcg

SEQ ID NO: 125282 - DNA, 36 bp, Artificial Sequence
  Synthetic oligonucleotide
actactgccgcctacaccctccacctgctcccgcaa

SEQ ID NO: 125283 - DNA, 36 bp, Artificial Sequence
  Synthetic oligonucleotide
gcccaagcaacctccgctcccccgcgacagtcgcaa

SEQ ID NO: 125284 - DNA, 36 bp, Artificial Sequence
  Synthetic oligonucleotide
gacacgatgatgtatcccgacgcttgccccccttca

SEQ ID NO: 125285 - DNA, 37 bp, Artificial Sequence
  Synthetic oligonucleotide
tcacccccgtagcgcgctcagtctttccgtccaccga

SEQ ID NO: 125286 - DNA, 37 bp, Artificial Sequence
  Synthetic oligonucleotide
atgcccgtccgccctatagttgcatcacccctttcga

SEQ ID NO: 125287 - DNA, 35 bp, Artificial Sequence
  Synthetic oligonucleotide
gttccacacgccacgcctcctcgtacccttaagga

SEQ ID NO: 125288 - DNA, 37 bp, Artificial Sequence
  Synthetic oligonucleotide
ttgggggcgctggtggatggtcgtgaagggtggtgga

SEQ ID NO: 125289 - DNA, 36 bp, Artificial Sequence
  Synthetic oligonucleotide
aatgggatggtggaagccgcggggggaagggggata

SEQ ID NO: 125290 - DNA, 36 bp, Artificial Sequence
  Synthetic oligonucleotide
tccacccgccatgctttcttttccgtacccaccgta

SEQ ID NO: 125291 - DNA, 35 bp, Artificial Sequence
  Synthetic oligonucleotide
acccccatgccctccacatgctgataatactcgta

SEQ ID NO: 125292 - DNA, 36 bp, Artificial Sequence
  Synthetic oligonucleotide
acctaacccgccgatccgccgcccgtaacttatgta

SEQ ID NO: 125293 - DNA, 35 bp, Artificial Sequence
  Synthetic oligonucleotide
accaccctacatggggccgccgtgacctttccgcc

SEQ ID NO: 125294 - DNA, 35 bp, Artificial Sequence
  Synthetic oligonucleotide
actaacaagccaccaatctgtctcgtacactttcc

SEQ ID NO: 125295 - DNA, 35 bp, Artificial Sequence
  Synthetic oligonucleotide
gactccttctgtaccgatcctgttacttgccacgc

SEQ ID NO: 125296 - DNA, 35 bp, Artificial Sequence
  Synthetic oligonucleotide
gcctccacccacgcctgtatcgacttttctgcctc

SEQ ID NO: 125297 - DNA, 35 bp, Artificial Sequence
  Synthetic oligonucleotide
gcccaccccgtgatgttacttgccccgcaattctc

SEQ ID NO: 125298 - DNA, 35 bp, Artificial Sequence
  Synthetic oligonucleotide
atactccgctcccgccctcacatttggatgcattc

SEQ ID NO: 125299 - DNA, 35 bp, Artificial Sequence
  Synthetic oligonucleotide
gctggggatcgggagagtaggggtaggtgggggcg

SEQ ID NO: 125300 - DNA, 35 bp, Artificial Sequence
  Synthetic oligonucleotide
atgtccgatccctcgtcagctaccccattcaccat

SEQ ID NO: 125301 - DNA, 35 bp, Artificial Sequence
  Synthetic oligonucleotide
tctgtccctactcgcattccaactcaccgcctggt

SEQ ID NO: 125302 - DNA, 37 bp, Artificial Sequence
  Synthetic oligonucleotide
atcgtccagaacgtgtctgcctctgttctccttccga

SEQ ID NO: 125303 - DNA, 37 bp, Artificial Sequence
  Synthetic oligonucleotide
tcccggtgcacacttttacgcccgtccgatccctcga

SEQ ID NO: 125304 - DNA, 37 bp, Artificial Sequence
  Synthetic oligonucleotide
tcgagacggcctctcccgacccccgcccatttgagga

SEQ ID NO: 125305 - DNA, 37 bp, Artificial Sequence
  Synthetic oligonucleotide
tcacgtgggagggtgggtacgtaattgaccatcggga

SEQ ID NO: 125306 - DNA, 36 bp, Artificial Sequence
  Synthetic oligonucleotide
tatcgcccctatctgttcaagcgcttccttttctta

SEQ ID NO: 125307 - DNA, 36 bp, Artificial Sequence
  Synthetic oligonucleotide
gcgccccgctctctcctgctcgcgcatgtcttccac

SEQ ID NO: 125308 - DNA, 35 bp, Artificial Sequence
  Synthetic oligonucleotide
gtgcaaccctaagcctacgctgccagctctcctcc

SEQ ID NO: 125309 - DNA, 35 bp, Artificial Sequence
  Synthetic oligonucleotide
ttctgccccccgtacgctgcttccctatatgctcc

SEQ ID NO: 125310 - DNA, 35 bp, Artificial Sequence
  Synthetic oligonucleotide
tccaaccccattcctccccagccgccgatacatgg

SEQ ID NO: 125311 - DNA, 35 bp, Artificial Sequence
  Synthetic oligonucleotide
tgcctcccgttcgccgtctttactcgttacacttg

SEQ ID NO: 125312 - DNA, 35 bp, Artificial Sequence
  Synthetic oligonucleotide
tcctcccgtgttggctccggtactgtccttccact

SEQ ID NO: 125313 - DNA, 35 bp, Artificial Sequence
  Synthetic oligonucleotide
gatgatgcttccgctgagccctgtacgtactctct

SEQ ID NO: 125314 - DNA, 35 bp, Artificial Sequence
  Synthetic oligonucleotide
tcagcacctaccccccttcatggctgctgttcttt

SEQ ID NO: 125315 - DNA, 37 bp, Artificial Sequence
  Synthetic oligonucleotide
gttagagcggcgggggtatgtagggtgggcaagcaga

SEQ ID NO: 125316 - DNA, 37 bp, Artificial Sequence
  Synthetic oligonucleotide
tcccccgcgccggtttctttgcattgccccccaccga

SEQ ID NO: 125317 - DNA, 36 bp, Artificial Sequence
  Synthetic oligonucleotide
actcgtcctgcccgctacctgtggtacccctttcga

SEQ ID NO: 125318 - DNA, 37 bp, Artificial Sequence
  Synthetic oligonucleotide
gacgctacgcacgagcccacctcgccctccttttcga

SEQ ID NO: 125319 - DNA, 38 bp, Artificial Sequence
  Synthetic oligonucleotide
actggaggtggtggggctggtctaatggtgggttctga

SEQ ID NO: 125320 - DNA, 38 bp, Artificial Sequence
  Synthetic oligonucleotide
ttgccacctctcactcgatatgcctgccggtttcttga

SEQ ID NO: 125321 - DNA, 36 bp, Artificial Sequence
  Synthetic oligonucleotide
gtacaccccgccgcccggttttaactgaactgttga

SEQ ID NO: 125322 - DNA, 35 bp, Artificial Sequence
  Synthetic oligonucleotide
gtacagtgatctggttcctgctatgtcccttcccc

SEQ ID NO: 125323 - DNA, 35 bp, Artificial Sequence
  Synthetic oligonucleotide
gcaagcccacattcctcgaaagatcggaccttccc

SEQ ID NO: 125324 - DNA, 35 bp, Artificial Sequence
  Synthetic oligonucleotide
agacacatctccattcgcgtacggcgtgccttccc

SEQ ID NO: 125325 - DNA, 35 bp, Artificial Sequence
  Synthetic oligonucleotide
tctctttgccacccgtgagtaaccacacctcccgc

SEQ ID NO: 125326 - DNA, 36 bp, Artificial Sequence
  Synthetic oligonucleotide
acaccacaaattcactccatccgtatgctcccatgc

SEQ ID NO: 125327 - DNA, 35 bp, Artificial Sequence
  Synthetic oligonucleotide
gtacgcactctcacccctgtttctgatactcccat

SEQ ID NO: 125328 - DNA, 35 bp, Artificial Sequence
  Synthetic oligonucleotide
taggacgccatccattgccccccaactgtacttca

SEQ ID NO: 125329 - DNA, 37 bp, Artificial Sequence
  Synthetic oligonucleotide
aaacatggtggagggctcaggaggaggttggtaggga

SEQ ID NO: 125330 - DNA, 36 bp, Artificial Sequence
  Synthetic oligonucleotide
gccctcccccgccgttgagtcaaccctccgttgtga

SEQ ID NO: 125331 - DNA, 35 bp, Artificial Sequence
  Synthetic oligonucleotide
gctgcaccacgcctatcattgatctgttcctctta

SEQ ID NO: 125332 - DNA, 35 bp, Artificial Sequence
  Synthetic oligonucleotide
acatcccgcatctctcacagcgaccgcgaccaccc

SEQ ID NO: 125333 - DNA, 35 bp, Artificial Sequence
  Synthetic oligonucleotide
agctcagaagttgcccgccttgttgctgccctgcc

SEQ ID NO: 125334 - DNA, 35 bp, Artificial Sequence
  Synthetic oligonucleotide
tgcccatctcgtccaaaccgagtttacacttcctc

SEQ ID NO: 125335 - DNA, 35 bp, Artificial Sequence
  Synthetic oligonucleotide
ttcgctactaccgcctccgctagccccttcttgtc

SEQ ID NO: 125336 - DNA, 35 bp, Artificial Sequence
  Synthetic oligonucleotide
acctcgtgagagtgttcttcgttccccacctccag

SEQ ID NO: 125337 - DNA, 35 bp, Artificial Sequence
  Synthetic oligonucleotide
gccacctccatgtatgcgacccttttctctgtctg

SEQ ID NO: 125338 - DNA, 35 bp, Artificial Sequence
  Synthetic oligonucleotide
tcaacgaccctcgtttcagcttatttctcccctgt

SEQ ID NO: 125339 - DNA, 35 bp, Artificial Sequence
  Synthetic oligonucleotide
tctgacgccctcgatatctatccgcactccccgtt

SEQ ID NO: 125340 - DNA, 36 bp, Artificial Sequence
  Synthetic oligonucleotide
tccgtcctcccagctgtctcatacaagtcccacaca

SEQ ID NO: 125341 - DNA, 36 bp, Artificial Sequence
  Synthetic oligonucleotide
ttccacgcccctgtctaacgcagtctctcttataca

SEQ ID NO: 125342 - DNA, 35 bp, Artificial Sequence
  Synthetic oligonucleotide
atcgacccacgcgcaggtggttcaccctctctcca

SEQ ID NO: 125343 - DNA, 36 bp, Artificial Sequence
  Synthetic oligonucleotide
gagagagggtgcattgtgggtgggtgggaggaccga

SEQ ID NO: 125344 - DNA, 37 bp, Artificial Sequence
  Synthetic oligonucleotide
gagtggggggactgggaaagaagggtgggaatctgga

SEQ ID NO: 125345 - DNA, 36 bp, Artificial Sequence
  Synthetic oligonucleotide
acgaaccgccagccttacttacccagctcgccctga

SEQ ID NO: 125346 - DNA, 37 bp, Artificial Sequence
  Synthetic oligonucleotide
aaatggaagggcggggcgggcataatggaggggctga

SEQ ID NO: 125347 - DNA, 37 bp, Artificial Sequence
  Synthetic oligonucleotide
atggaaaggagggggggcggacgaggaattggagtga

SEQ ID NO: 125348 - DNA, 35 bp, Artificial Sequence
  Synthetic oligonucleotide
ttgaccgtgccgccctgtaaaacacccacaaccac

SEQ ID NO: 125349 - DNA, 35 bp, Artificial Sequence
  Synthetic oligonucleotide
aggttgctgatagccccttcgatgccgcccttcac

SEQ ID NO: 125350 - DNA, 34 bp, Artificial Sequence
  Synthetic oligonucleotide
gtatccgtcgggtgcactctatgcgccgcccccc

SEQ ID NO: 125351 - DNA, 34 bp, Artificial Sequence
  Synthetic oligonucleotide
gacacctcatatcatttatcaccaccactcgccc

SEQ ID NO: 125352 - DNA, 35 bp, Artificial Sequence
  Synthetic oligonucleotide
tcgtagtagcagccctacccctccccctgttgccc

SEQ ID NO: 125353 - DNA, 35 bp, Artificial Sequence
  Synthetic oligonucleotide
tccctctcactgtatgaagcctgtcgacaccttcc

SEQ ID NO: 125354 - DNA, 35 bp, Artificial Sequence
  Synthetic oligonucleotide
ttaggcatcaatgccgttttcccagcccttgttcc

SEQ ID NO: 125355 - DNA, 35 bp, Artificial Sequence
  Synthetic oligonucleotide
agctcagcccgttcactcgttttagtctcgccctc

SEQ ID NO: 125356 - DNA, 35 bp, Artificial Sequence
  Synthetic oligonucleotide
gcaccgcgtggcactccttgctccttcccggtttc

SEQ ID NO: 125357 - DNA, 35 bp, Artificial Sequence
  Synthetic oligonucleotide
cccgacgtcgcatccttcccctgtctctcctccgg

SEQ ID NO: 125358 - DNA, 35 bp, Artificial Sequence
  Synthetic oligonucleotide
gaacagggccagaataacctcctacccccccgttg

SEQ ID NO: 125359 - DNA, 35 bp, Artificial Sequence
  Synthetic oligonucleotide
tgctgcccggaacttatgccacttactccttctct

SEQ ID NO: 125360 - DNA, 35 bp, Artificial Sequence
  Synthetic oligonucleotide
acatcccagtacgccattatcgcatgcccctgtct

SEQ ID NO: 125361 - DNA, 28 bp, Artificial Sequence
  Synthetic oligonucleotide
ttgtgctaatctcctgctcccttggtaa

SEQ ID NO: 125362 - DNA, 36 bp, Artificial Sequence
  Synthetic oligonucleotide
accacccgttcatgccttggtcttcctgctctttca

SEQ ID NO: 125363 - DNA, 36 bp, Artificial Sequence
  Synthetic oligonucleotide
atcccgctccaaccgccatgtccttcccctcaccga

SEQ ID NO: 125364 - DNA, 37 bp, Artificial Sequence
  Synthetic oligonucleotide
gcagggtggagagggatgaaatggtgcggtgtagcga

SEQ ID NO: 125365 - DNA, 38 bp, Artificial Sequence
  Synthetic oligonucleotide
gtcccactgccgataacgtttccctgcctgctctctga

SEQ ID NO: 125366 - DNA, 38 bp, Artificial Sequence
  Synthetic oligonucleotide
agcgcttggccagccccccgttacgaacccgcccttga

SEQ ID NO: 125367 - DNA, 36 bp, Artificial Sequence
  Synthetic oligonucleotide
gccctctgcctactcccatgtcatcagtattacata

SEQ ID NO: 125368 - DNA, 35 bp, Artificial Sequence
  Synthetic oligonucleotide
accccgtaccgacacgctcgcgttacttcgacccc

SEQ ID NO: 125369 - DNA, 35 bp, Artificial Sequence
  Synthetic oligonucleotide
acatcctcatttggtcactgcctcctcgacactgc

SEQ ID NO: 125370 - DNA, 35 bp, Artificial Sequence
  Synthetic oligonucleotide
tccgccttacctctgtcctaattgtcgatcctctc

SEQ ID NO: 125371 - DNA, 35 bp, Artificial Sequence
  Synthetic oligonucleotide
tcctaccaacgcgccaccggtttactcgggccttc

SEQ ID NO: 125372 - DNA, 35 bp, Artificial Sequence
  Synthetic oligonucleotide
gaaggatggaacggacggctgtaggagcggggtgg

SEQ ID NO: 125373 - DNA, 29 bp, Artificial Sequence
  Synthetic oligonucleotide
acacgtgtattttcgtcccccctgtttgt

SEQ ID NO: 125374 - DNA, 36 bp, Artificial Sequence
  Synthetic oligonucleotide
atccacgggcatggtggaaagggcaaaggtggagca

SEQ ID NO: 125375 - DNA, 36 bp, Artificial Sequence
  Synthetic oligonucleotide
gtcccacccctccactagtcgaggtcctccctccga

SEQ ID NO: 125376 - DNA, 37 bp, Artificial Sequence
  Synthetic oligonucleotide
agcagtggaccgaaggaagtggagagtaaaggaggga

SEQ ID NO: 125377 - DNA, 36 bp, Artificial Sequence
  Synthetic oligonucleotide
gcgagagcacgtcgggaggtcggggggggacgtgga

SEQ ID NO: 125378 - DNA, 37 bp, Artificial Sequence
  Synthetic oligonucleotide
gggagggcgggaaggggtcgtgagagggcagatctga

SEQ ID NO: 125379 - DNA, 37 bp, Artificial Sequence
  Synthetic oligonucleotide
taacgtgcgggaatgaagggggggaaggctggagtga

SEQ ID NO: 125380 - DNA, 35 bp, Artificial Sequence
  Synthetic oligonucleotide
ggtgtgcaacacctgtgctaccttcgccgtatgcc

SEQ ID NO: 125381 - DNA, 35 bp, Artificial Sequence
  Synthetic oligonucleotide
tcgacatccacttcgcccacgcatagcattttgcc

SEQ ID NO: 125382 - DNA, 35 bp, Artificial Sequence
  Synthetic oligonucleotide
aacgctggtgccgccgcattgtcatccacctacgc

SEQ ID NO: 125383 - DNA, 35 bp, Artificial Sequence
  Synthetic oligonucleotide
gtgcgcccacactggtctcttcgccctacataggc

SEQ ID NO: 125384 - DNA, 35 bp, Artificial Sequence
  Synthetic oligonucleotide
aatcaccatccgtccgctctccctggcatcacggc

SEQ ID NO: 125385 - DNA, 35 bp, Artificial Sequence
  Synthetic oligonucleotide
gccccaagttgtcaacatgtcactcagctttcctc

SEQ ID NO: 125386 - DNA, 35 bp, Artificial Sequence
  Synthetic oligonucleotide
tctggtacgccgacgggttctcggtctgctcccct

SEQ ID NO: 125387 - DNA, 35 bp, Artificial Sequence
  Synthetic oligonucleotide
atgccacgcacatcccatgctgtccacttgtcctt

SEQ ID NO: 125388 - DNA, 35 bp, Artificial Sequence
  Synthetic oligonucleotide
agccgaatcgggtagggtgggggggtgttgcccaa

SEQ ID NO: 125389 - DNA, 36 bp, Artificial Sequence
  Synthetic oligonucleotide
attgggaggggagagtgggatcgatggggaacggaa

SEQ ID NO: 125390 - DNA, 36 bp, Artificial Sequence
  Synthetic oligonucleotide
tcaccgctgtcgtccattgttccccgtttggcccca

SEQ ID NO: 125391 - DNA, 36 bp, Artificial Sequence
  Synthetic oligonucleotide
tcaaacgcgctggtccgctttgacacctcgttccca

SEQ ID NO: 125392 - DNA, 36 bp, Artificial Sequence
  Synthetic oligonucleotide
tgtccccggcctcccatgcagatttcggtccgttca

SEQ ID NO: 125393 - DNA, 37 bp, Artificial Sequence
  Synthetic oligonucleotide
gtgcaccctccagctagttttcccccgcctctcggga

SEQ ID NO: 125394 - DNA, 38 bp, Artificial Sequence
  Synthetic oligonucleotide
gaagcccacctgtatactcccatctccccttggcttga

SEQ ID NO: 125395 - DNA, 36 bp, Artificial Sequence
  Synthetic oligonucleotide
gagcatcgccgccgctctcgccaccgcctaacacta

SEQ ID NO: 125396 - DNA, 36 bp, Artificial Sequence
  Synthetic oligonucleotide
gctgcctcgcccatgcccaagctcgacttctctcta

SEQ ID NO: 125397 - DNA, 35 bp, Artificial Sequence
  Synthetic oligonucleotide
gtctgccgcattgtacggcccgcacccccttccgc

SEQ ID NO: 125398 - DNA, 35 bp, Artificial Sequence
  Synthetic oligonucleotide
agacacctgtagatatctccacgcacaccccgccg

SEQ ID NO: 125399 - DNA, 34 bp, Artificial Sequence
  Synthetic oligonucleotide
atcatcctgccgcccgcgacgacttcaccacgcg

SEQ ID NO: 125400 - DNA, 35 bp, Artificial Sequence
  Synthetic oligonucleotide
aagtaaacggggaggcggaggaaagggtggacggg

SEQ ID NO: 125401 - DNA, 35 bp, Artificial Sequence
  Synthetic oligonucleotide
tccactgctccaagtaatcaccgctgttcgccctt

SEQ ID NO: 125402 - DNA, 37 bp, Artificial Sequence
  Synthetic oligonucleotide
gacaacctggctgtttactttcgttaccgtgctccga

SEQ ID NO: 125403 - DNA, 35 bp, Artificial Sequence
  Synthetic oligonucleotide
tgctcagtcgcctcctcgcctttgtcccggtccac

SEQ ID NO: 125404 - DNA, 35 bp, Artificial Sequence
  Synthetic oligonucleotide
tgcctccgaacccagccgtacttcacctcaacacc

SEQ ID NO: 125405 - DNA, 35 bp, Artificial Sequence
  Synthetic oligonucleotide
gctgagcgctgtactaccctgttttttatgtcacc

SEQ ID NO: 125406 - DNA, 35 bp, Artificial Sequence
  Synthetic oligonucleotide
atgcttcccgggcctcgcacctcgctcttgcatgc

SEQ ID NO: 125407 - DNA, 35 bp, Artificial Sequence
  Synthetic oligonucleotide
agcctacgcccgccaactgtctcgacacattcttc

SEQ ID NO: 125408 - DNA, 35 bp, Artificial Sequence
  Synthetic oligonucleotide
gcacccagaataaacccgcctggccccactttgct

SEQ ID NO: 125409 - DNA, 35 bp, Artificial Sequence
  Synthetic oligonucleotide
gacatccggagagggtgggtgggttcggtaggatt

SEQ ID NO: 125410 - DNA, 35 bp, Artificial Sequence
  Synthetic oligonucleotide
tccagccaggcctagctcctccgccctctttcctt

SEQ ID NO: 125411 - DNA, 36 bp, Artificial Sequence
  Synthetic oligonucleotide
atgcgtgccacttattccccagctcttctctgctaa

SEQ ID NO: 125412 - DNA, 36 bp, Artificial Sequence
  Synthetic oligonucleotide
atgtcctgcccccagaaaccatgccaacgccttaca

SEQ ID NO: 125413 - DNA, 37 bp, Artificial Sequence
  Synthetic oligonucleotide
gggaaagagtgggagggccgggaagggcggtgaacga

SEQ ID NO: 125414 - DNA, 37 bp, Artificial Sequence
  Synthetic oligonucleotide
gagtgggggaatggggacgagttacaatggggcggga

SEQ ID NO: 125415 - DNA, 35 bp, Artificial Sequence
  Synthetic oligonucleotide
tgacccgcacaccagccactctccccacagcctga

SEQ ID NO: 125416 - DNA, 35 bp, Artificial Sequence
  Synthetic oligonucleotide
actgacaccttccacagcccattcctcctgtttga

SEQ ID NO: 125417 - DNA, 36 bp, Artificial Sequence
  Synthetic oligonucleotide
acccatgcacaaactgccgaggaccgccctatccta

SEQ ID NO: 125418 - DNA, 36 bp, Artificial Sequence
  Synthetic oligonucleotide
tagtggggggagggagctatggaagggggcctcgta

SEQ ID NO: 125419 - DNA, 35 bp, Artificial Sequence
  Synthetic oligonucleotide
gcccgcccccatgctttgtcattgcaagctctaac

SEQ ID NO: 125420 - DNA, 35 bp, Artificial Sequence
  Synthetic oligonucleotide
gccgtcgccccctagtgtccacacgcgtttctcac

SEQ ID NO: 125421 - DNA, 35 bp, Artificial Sequence
  Synthetic oligonucleotide
agtaatcgccgccgtgaacccatcgcactcactcc

SEQ ID NO: 125422 - DNA, 36 bp, Artificial Sequence
  Synthetic oligonucleotide
tgagcgcgcccatttatgtactagtccgccccacca

SEQ ID NO: 125423 - DNA, 35 bp, Artificial Sequence
  Synthetic oligonucleotide
gccccgctcctccctgtccgcccgacacacgtcca

SEQ ID NO: 125424 - DNA, 37 bp, Artificial Sequence
  Synthetic oligonucleotide
gggaggggcgggacggccggggaatcaagggagaaga

SEQ ID NO: 125425 - DNA, 37 bp, Artificial Sequence
  Synthetic oligonucleotide
gcaggtggggtgagggggtaggggatcggaagtcaga

SEQ ID NO: 125426 - DNA, 36 bp, Artificial Sequence
  Synthetic oligonucleotide
acccctacttgcccgcttccgaccctcgccgtgcga

SEQ ID NO: 125427 - DNA, 36 bp, Artificial Sequence
  Synthetic oligonucleotide
agtgaggtaagcaaaaaaaagcggggggactacgga

SEQ ID NO: 125428 - DNA, 37 bp, Artificial Sequence
  Synthetic oligonucleotide
taccacacctccccgcgtgctatgggactagcactga

SEQ ID NO: 125429 - DNA, 37 bp, Artificial Sequence
  Synthetic oligonucleotide
gtcaccagttcgtccgtcgcccgccgcccccgcttga

SEQ ID NO: 125430 - DNA, 35 bp, Artificial Sequence
  Synthetic oligonucleotide
tcttcgcaccctccgccctgacaccgcgattttga

SEQ ID NO: 125431 - DNA, 37 bp, Artificial Sequence
  Synthetic oligonucleotide
agagggtgggagggaagggaggcggtactgtctatta

SEQ ID NO: 125432 - DNA, 35 bp, Artificial Sequence
  Synthetic oligonucleotide
tccacatcagccgctgcattattgccaatgccacc

SEQ ID NO: 125433 - DNA, 35 bp, Artificial Sequence
  Synthetic oligonucleotide
tgacaccgcctactggacaccgcgcccctcgttcc

SEQ ID NO: 125434 - DNA, 35 bp, Artificial Sequence
  Synthetic oligonucleotide
agccaaccaccagacacgcacctcctactgacctc

SEQ ID NO: 125435 - DNA, 35 bp, Artificial Sequence
  Synthetic oligonucleotide
tgcatcccgtaggcattagcgcttgacctatcctc

SEQ ID NO: 125436 - DNA, 35 bp, Artificial Sequence
  Synthetic oligonucleotide
gttacgtacaccgatgtctgcattttacgcctctc

SEQ ID NO: 125437 - DNA, 35 bp, Artificial Sequence
  Synthetic oligonucleotide
tctgcgggagggactccctatcacaccttcattcg

SEQ ID NO: 125438 - DNA, 35 bp, Artificial Sequence
  Synthetic oligonucleotide
agtgagagagagggaaggatgagaataggtgatgg

SEQ ID NO: 125439 - DNA, 35 bp, Artificial Sequence
  Synthetic oligonucleotide
ttcgctccatctactgtctacccccacgtcacagt

SEQ ID NO: 125440 - DNA, 37 bp, Artificial Sequence
  Synthetic oligonucleotide
gtagacgggaaaggcatggtgggcgggggatcgcaga

SEQ ID NO: 125441 - DNA, 37 bp, Artificial Sequence
  Synthetic oligonucleotide
acgaccctgccttccgcatcgcccactacccgttcga

SEQ ID NO: 125442 - DNA, 38 bp, Artificial Sequence
  Synthetic oligonucleotide
ggggggtgaggaggggggatggagtagaggttggctga

SEQ ID NO: 125443 - DNA, 38 bp, Artificial Sequence
  Synthetic oligonucleotide
gaccgggaggggttgcatgggggcatttctaggggtga

SEQ ID NO: 125444 - DNA, 34 bp, Artificial Sequence
  Synthetic oligonucleotide
aacagaccttaccgccacaactgtctttgccacc

SEQ ID NO: 125445 - DNA, 35 bp, Artificial Sequence
  Synthetic oligonucleotide
atcgatccaccccctcccatgcctcaactgagacc

SEQ ID NO: 125446 - DNA, 35 bp, Artificial Sequence
  Synthetic oligonucleotide
gacccgtcctctgcttccgtcccttttcccatcag

SEQ ID NO: 125447 - DNA, 35 bp, Artificial Sequence
  Synthetic oligonucleotide
gatcgggattcggccactcactgcctgcgccctct

SEQ ID NO: 125448 - DNA, 35 bp, Artificial Sequence
  Synthetic oligonucleotide
accaatcccgcccccctggtaagttcacattggaa

SEQ ID NO: 125449 - DNA, 36 bp, Artificial Sequence
  Synthetic oligonucleotide
tacgacccgccacccgttttgcctagtgcgcgccca

SEQ ID NO: 125450 - DNA, 36 bp, Artificial Sequence
  Synthetic oligonucleotide
tacactcctcgtccacctgccttatccacgctccca

SEQ ID NO: 125451 - DNA, 37 bp, Artificial Sequence
  Synthetic oligonucleotide
tccgagcgcaccataactctctgctccctcacgccga

SEQ ID NO: 125452 - DNA, 37 bp, Artificial Sequence
  Synthetic oligonucleotide
ttggggcgggggttattttggggcaccgaattgggga

SEQ ID NO: 125453 - DNA, 35 bp, Artificial Sequence
  Synthetic oligonucleotide
tctcactcccgccatgctctcttttaacgaacata

SEQ ID NO: 125454 - DNA, 35 bp, Artificial Sequence
  Synthetic oligonucleotide
gccagatctagactgaacgccccccccgacctccc

SEQ ID NO: 125455 - DNA, 35 bp, Artificial Sequence
  Synthetic oligonucleotide
tccagtcggcgcacccacgttactctatctgctcc

SEQ ID NO: 125456 - DNA, 35 bp, Artificial Sequence
  Synthetic oligonucleotide
attcgcacccgaccgacaccttctctcgcatggtc

SEQ ID NO: 125457 - DNA, 35 bp, Artificial Sequence
  Synthetic oligonucleotide
tactccccttgcctgcttattcgtttgacgcgttc

SEQ ID NO: 125458 - DNA, 35 bp, Artificial Sequence
  Synthetic oligonucleotide
ttgtaccccctctgttctttgccatcttagtttgg

SEQ ID NO: 125459 - DNA, 35 bp, Artificial Sequence
  Synthetic oligonucleotide
ggacgcggggggcggacggacgaggcaagggggat

SEQ ID NO: 125460 - DNA, 36 bp, Artificial Sequence
  Synthetic oligonucleotide
gggaacgtgagcaagaggagatggggtgtggggaga

SEQ ID NO: 125461 - DNA, 37 bp, Artificial Sequence
  Synthetic oligonucleotide
ggaatggcaggaggggggggaagcaggggtgatagga

SEQ ID NO: 125462 - DNA, 35 bp, Artificial Sequence
  Synthetic oligonucleotide
gaggtggaggtggggcgaacataaggtggtttgga

SEQ ID NO: 125463 - DNA, 36 bp, Artificial Sequence
  Synthetic oligonucleotide
ttcgtcccgccactatctgcttaaccacttacggta

SEQ ID NO: 125464 - DNA, 35 bp, Artificial Sequence
  Synthetic oligonucleotide
gtgcccctcacacctcaatatgatttcactcctta

SEQ ID NO: 125465 - DNA, 35 bp, Artificial Sequence
  Synthetic oligonucleotide
gcacaggtcgtccgtttctacctgtagctctatcc

SEQ ID NO: 125466 - DNA, 35 bp, Artificial Sequence
  Synthetic oligonucleotide
acagccactgagcgacgttcataccttcactttcc

SEQ ID NO: 125467 - DNA, 35 bp, Artificial Sequence
  Synthetic oligonucleotide
acatcaactgcctctcccgtgacgcatacccgttc

SEQ ID NO: 125468 - DNA, 35 bp, Artificial Sequence
  Synthetic oligonucleotide
gctgtacgccaatttttcactccaccccttcacag

SEQ ID NO: 125469 - DNA, 35 bp, Artificial Sequence
  Synthetic oligonucleotide
gcattgcccggctccacctctaacctcacgcctag

SEQ ID NO: 125470 - DNA, 36 bp, Artificial Sequence
  Synthetic oligonucleotide
tcacccccgtaggttcttgcctccgtccgccgccca

SEQ ID NO: 125471 - DNA, 37 bp, Artificial Sequence
  Synthetic oligonucleotide
gagggaggggttgtaatgttcggggataacatgggga

SEQ ID NO: 125472 - DNA, 37 bp, Artificial Sequence
  Synthetic oligonucleotide
tccccacactgttctgcatactgcctcgtctccatga

SEQ ID NO: 125473 - DNA, 35 bp, Artificial Sequence
  Synthetic oligonucleotide
tcgtatgcccccaccatcctgcccactgcacttga

SEQ ID NO: 125474 - DNA, 37 bp, Artificial Sequence
  Synthetic oligonucleotide
gaaccgtcgccctgcctatagctctcacattgcttga

SEQ ID NO: 125475 - DNA, 38 bp, Artificial Sequence
  Synthetic oligonucleotide
aactgactccgcccgcccatatggaaccgccttcttga

SEQ ID NO: 125476 - DNA, 30 bp, Artificial Sequence
  Synthetic oligonucleotide
tacccccgacgctggattctcttctacgcc

SEQ ID NO: 125477 - DNA, 35 bp, Artificial Sequence
  Synthetic oligonucleotide
aaaaacggggggatgggctggagaagggccgccgt

SEQ ID NO: 125478 - DNA, 35 bp, Artificial Sequence
  Synthetic oligonucleotide
ttccacgacgccacccgcccagtcgtctcttcctt

SEQ ID NO: 125479 - DNA, 36 bp, Artificial Sequence
  Synthetic oligonucleotide
gttcctctgtcctcctgtcgtctcagttcccaccca

SEQ ID NO: 125480 - DNA, 36 bp, Artificial Sequence
  Synthetic oligonucleotide
gtgcgacctccccactgtcatccgctatttgtgcca

SEQ ID NO: 125481 - DNA, 37 bp, Artificial Sequence
  Synthetic oligonucleotide
gcattctacccgccgcgcaccactaccctctccgaga

SEQ ID NO: 125482 - DNA, 37 bp, Artificial Sequence
  Synthetic oligonucleotide
gatcgctgcccttattatttgtcgctctcgtccctga

SEQ ID NO: 125483 - DNA, 38 bp, Artificial Sequence
  Synthetic oligonucleotide
tgacccgctttttcgtgcccatgctcgaggccccttga

SEQ ID NO: 125484 - DNA, 35 bp, Artificial Sequence
  Synthetic oligonucleotide
taggtgagcctcaccgacgtttgcctacctccgcc

SEQ ID NO: 125485 - DNA, 35 bp, Artificial Sequence
  Synthetic oligonucleotide
atcgcccctctgtacgcactgatgtcagtacctcc

SEQ ID NO: 125486 - DNA, 35 bp, Artificial Sequence
  Synthetic oligonucleotide
gatatcatcggtcctgtgagccgaccccccgcctc

SEQ ID NO: 125487 - DNA, 35 bp, Artificial Sequence
  Synthetic oligonucleotide
gcctgatccatccagtcggtttgacacacctgctc

SEQ ID NO: 125488 - DNA, 35 bp, Artificial Sequence
  Synthetic oligonucleotide
atggtgagtgggcgggggtggtgctagaaataaag

SEQ ID NO: 125489 - DNA, 35 bp, Artificial Sequence
  Synthetic oligonucleotide
tcgaatgagtggtgggagcatgggggctgacgggg

SEQ ID NO: 125490 - DNA, 35 bp, Artificial Sequence
  Synthetic oligonucleotide
tcaacaccactgtctcggtaggtatcccacgccct

SEQ ID NO: 125491 - DNA, 35 bp, Artificial Sequence
  Synthetic oligonucleotide
gatcacacttcctggtcctactacagactacgtgt

SEQ ID NO: 125492 - DNA, 36 bp, Artificial Sequence
  Synthetic oligonucleotide
gtccccacaggtgcccgtgcccagcgtaccgcccca

SEQ ID NO: 125493 - DNA, 35 bp, Artificial Sequence
  Synthetic oligonucleotide
tgtgtatactgctccacgttgtccctctcgcgcca

SEQ ID NO: 125494 - DNA, 36 bp, Artificial Sequence
  Synthetic oligonucleotide
tcagcgcgcgatatgctcttgctccccgtacttcca

SEQ ID NO: 125495 - DNA, 37 bp, Artificial Sequence
  Synthetic oligonucleotide
acgtcccccaccatgcccgtccttttgctcccgacga

SEQ ID NO: 125496 - DNA, 36 bp, Artificial Sequence
  Synthetic oligonucleotide
ttgatcgccccttcgttctactaacccgtcctccga

SEQ ID NO: 125497 - DNA, 37 bp, Artificial Sequence
  Synthetic oligonucleotide
caccggagaggatgggaaggtggagggaggtgaagga

SEQ ID NO: 125498 - DNA, 35 bp, Artificial Sequence
  Synthetic oligonucleotide
tacccccgccccgacctccctacgggtcctgagga

SEQ ID NO: 125499 - DNA, 36 bp, Artificial Sequence
  Synthetic oligonucleotide
tgctggggacaaggtgagtgaggggcacggggggga

SEQ ID NO: 125500 - DNA, 38 bp, Artificial Sequence
  Synthetic oligonucleotide
ttgccccgccgcccttgcccacataccacccttagtga

SEQ ID NO: 125501 - DNA, 35 bp, Artificial Sequence
  Synthetic oligonucleotide
accacactctgccctaatcggacgcctgagcttga

SEQ ID NO: 125502 - DNA, 38 bp, Artificial Sequence
  Synthetic oligonucleotide
taccatgcgtttcctgcatgtattacccctcttgttga

SEQ ID NO: 125503 - DNA, 35 bp, Artificial Sequence
  Synthetic oligonucleotide
gcccctgtcgtagtctctgcctcccgagtagtccc

SEQ ID NO: 125504 - DNA, 35 bp, Artificial Sequence
  Synthetic oligonucleotide
ccacgcccccctgacgctctcataatgttcaggcc

SEQ ID NO: 125505 - DNA, 35 bp, Artificial Sequence
  Synthetic oligonucleotide
gttccatcaacggcccccaggcatcagtcatgctc

SEQ ID NO: 125506 - DNA, 35 bp, Artificial Sequence
  Synthetic oligonucleotide
gtagcccctctccatgtttctactgtttcgctctc

SEQ ID NO: 125507 - DNA, 35 bp, Artificial Sequence
  Synthetic oligonucleotide
gacaccaccgggcgacgcagcacatccatcagccg

SEQ ID NO: 125508 - DNA, 35 bp, Artificial Sequence
  Synthetic oligonucleotide
gttccacatgtcaagccccaccctctttctcagcg

SEQ ID NO: 125509 - DNA, 35 bp, Artificial Sequence
  Synthetic oligonucleotide
acatcctgcccccttcttccaccgcgacatggctt

SEQ ID NO: 125510 - DNA, 36 bp, Artificial Sequence
  Synthetic oligonucleotide
ttcaccgtgtgttgcgcgccccttagcctcccctaa

SEQ ID NO: 125511 - DNA, 36 bp, Artificial Sequence
  Synthetic oligonucleotide
gatcccgcccctagaattgccctcgtacaacataca

SEQ ID NO: 125512 - DNA, 37 bp, Artificial Sequence
  Synthetic oligonucleotide
tcaccggcctcagattcatctcccctgcctggcccga

SEQ ID NO: 125513 - DNA, 36 bp, Artificial Sequence
  Synthetic oligonucleotide
gtgttacgccagccaacctccccttgcctcgctcga

SEQ ID NO: 125514 - DNA, 37 bp, Artificial Sequence
  Synthetic oligonucleotide
gtgggcggggagggtggaaccgaagggggtgattgga

SEQ ID NO: 125515 - DNA, 36 bp, Artificial Sequence
  Synthetic oligonucleotide
atcccaccgccatacaagcagtcacatcccgcctga

SEQ ID NO: 125516 - DNA, 35 bp, Artificial Sequence
  Synthetic oligonucleotide
atgctccacctactgcccgcattttgtgccatcta

SEQ ID NO: 125517 - DNA, 35 bp, Artificial Sequence
  Synthetic oligonucleotide
acatccaccagcacggactgccctcacaccgcccc

SEQ ID NO: 125518 - DNA, 35 bp, Artificial Sequence
  Synthetic oligonucleotide
tcagactcaccacctgcttttaacatgcccgtcgc

SEQ ID NO: 125519 - DNA, 35 bp, Artificial Sequence
  Synthetic oligonucleotide
tcatgcacctacacctgttcacactcttgctaatc

SEQ ID NO: 125520 - DNA, 35 bp, Artificial Sequence
  Synthetic oligonucleotide
acagttcgtctcccgctgtagcctctagtaccatc

SEQ ID NO: 125521 - DNA, 35 bp, Artificial Sequence
  Synthetic oligonucleotide
ttcccacctctctgtcatttcgcagtcaatctatc

SEQ ID NO: 125522 - DNA, 29 bp, Artificial Sequence
  Synthetic oligonucleotide
tagttccgcctcacaggcctccttcactc

SEQ ID NO: 125523 - DNA, 28 bp, Artificial Sequence
  Synthetic oligonucleotide
tctgtagcccctccccagggagtacctc

SEQ ID NO: 125524 - DNA, 35 bp, Artificial Sequence
  Synthetic oligonucleotide
ggaccctccccccaacgcgtcaattaacgcccctc

SEQ ID NO: 125525 - DNA, 35 bp, Artificial Sequence
  Synthetic oligonucleotide
gccctcgttcgtgttgatttccttccgtcccttcg

SEQ ID NO: 125526 - DNA, 35 bp, Artificial Sequence
  Synthetic oligonucleotide
tgctcccccgctgtggcccgttttttctttcctat

SEQ ID NO: 125527 - DNA, 35 bp, Artificial Sequence
  Synthetic oligonucleotide
accgttgtgcctttctcgtgctgttcgcttccact

SEQ ID NO: 125528 - DNA, 35 bp, Artificial Sequence
  Synthetic oligonucleotide
tgcgatcgatcaccatctcgctcgtgaccaacctt

SEQ ID NO: 125529 - DNA, 36 bp, Artificial Sequence
  Synthetic oligonucleotide
tgaaacgcgcaaatattagccgcccctcgcccctaa

SEQ ID NO: 125530 - DNA, 37 bp, Artificial Sequence
  Synthetic oligonucleotide
gtgacgggggggcgggttgaccaattgttgacaggga

SEQ ID NO: 125531 - DNA, 37 bp, Artificial Sequence
  Synthetic oligonucleotide
gagatgggagcaatgggggggcggacgcagggtggga

SEQ ID NO: 125532 - DNA, 37 bp, Artificial Sequence
  Synthetic oligonucleotide
gaggtaccgcgcattgctcttcatcgcactcccctga

SEQ ID NO: 125533 - DNA, 36 bp, Artificial Sequence
  Synthetic oligonucleotide
atccccgccacaccacgtccctttagggcgacacta

SEQ ID NO: 125534 - DNA, 35 bp, Artificial Sequence
  Synthetic oligonucleotide
gtaaggtgtaggtggggtcggggggggtcggcgta

SEQ ID NO: 125535 - DNA, 35 bp, Artificial Sequence
  Synthetic oligonucleotide
tccctcgatcagctcccacaccgccatcttcgccc

SEQ ID NO: 125536 - DNA, 35 bp, Artificial Sequence
  Synthetic oligonucleotide
atgtcagcagtcctcgtcctctttcgaagccctcc

SEQ ID NO: 125537 - DNA, 35 bp, Artificial Sequence
  Synthetic oligonucleotide
acatcaccatttgaccgtcccactgtaccctgtcc

SEQ ID NO: 125538 - DNA, 35 bp, Artificial Sequence
  Synthetic oligonucleotide
acaccctgcccctcgatgccgtcgtcccactcttc

SEQ ID NO: 125539 - DNA, 37 bp, Artificial Sequence
  Synthetic oligonucleotide
tcactgtcgccacatcatcccactcctcttccggtga

SEQ ID NO: 125540 - DNA, 38 bp, Artificial Sequence
  Synthetic oligonucleotide
ttcagtccgcgtgtttctgccctttttcccgttggtga

SEQ ID NO: 125541 - DNA, 36 bp, Artificial Sequence
  Synthetic oligonucleotide
ttactgcctcagggatcgcctcccaccgccgcttga

SEQ ID NO: 125542 - DNA, 36 bp, Artificial Sequence
  Synthetic oligonucleotide
tgccagtgcccgtctgccacctcgttcttcattcta

SEQ ID NO: 125543 - DNA, 35 bp, Artificial Sequence
  Synthetic oligonucleotide
gcatctccacccatgccgtgcgtctttcgctaccc

SEQ ID NO: 125544 - DNA, 35 bp, Artificial Sequence
  Synthetic oligonucleotide
gtaccatccgccgacgctccgagtaacggcccgcc

SEQ ID NO: 125545 - DNA, 35 bp, Artificial Sequence
  Synthetic oligonucleotide
atacgaacgtatgtcgctatcacactacacctctc

SEQ ID NO: 125546 - DNA, 35 bp, Artificial Sequence
  Synthetic oligonucleotide
actctctcgcgccccactacaatgacccccgcttg

SEQ ID NO: 125547 - DNA, 35 bp, Artificial Sequence
  Synthetic oligonucleotide
acacaccacctaacatgttcgacgttccgctcttg

SEQ ID NO: 125548 - DNA, 35 bp, Artificial Sequence
  Synthetic oligonucleotide
attccgtccaatcgttccaagttctttcgtgttct

SEQ ID NO: 125549 - DNA, 35 bp, Artificial Sequence
  Synthetic oligonucleotide
gcatcggtcgctgtctgcacgcccctgcacctttt

SEQ ID NO: 125550 - DNA, 35 bp, Artificial Sequence
  Synthetic oligonucleotide
tcactcctccagcgcgctctcatggccgccgtttt

SEQ ID NO: 125551 - DNA, 36 bp, Artificial Sequence
  Synthetic oligonucleotide
ttgaccctctcctgaaatgctataaagctaccccca

SEQ ID NO: 125552 - DNA, 36 bp, Artificial Sequence
  Synthetic oligonucleotide
tcccgctccaccttgcctcttcggttgtattgttca

SEQ ID NO: 125553 - DNA, 37 bp, Artificial Sequence
  Synthetic oligonucleotide
accacaagtccctacgtgcttataccctgccccctga

SEQ ID NO: 125554 - DNA, 35 bp, Artificial Sequence
  Synthetic oligonucleotide
gtgtgtcacacgcttctctcaaggccctccctgta

SEQ ID NO: 125555 - DNA, 35 bp, Artificial Sequence
  Synthetic oligonucleotide
ggaagccatcgttcgtcgcgccgcttgattccacc

SEQ ID NO: 125556 - DNA, 35 bp, Artificial Sequence
  Synthetic oligonucleotide
ttgacactcgcagactcgagttattattgcctccc

SEQ ID NO: 125557 - DNA, 35 bp, Artificial Sequence
  Synthetic oligonucleotide
gtacctcgccctatgtcctatcgacctttgcttcc

SEQ ID NO: 125558 - DNA, 35 bp, Artificial Sequence
  Synthetic oligonucleotide
tttgcgcccccggtgtctttccgcttccacaacgc

SEQ ID NO: 125559 - DNA, 35 bp, Artificial Sequence
  Synthetic oligonucleotide
atacaccctcagacggtccatctctcatcgcccgc

SEQ ID NO: 125560 - DNA, 35 bp, Artificial Sequence
  Synthetic oligonucleotide
tcacacatcattcacgtttacttgcttgggccttc

SEQ ID NO: 125561 - DNA, 35 bp, Artificial Sequence
  Synthetic oligonucleotide
tcacctcggacgttgggctcttacactctacacct

SEQ ID NO: 125562 - DNA, 35 bp, Artificial Sequence
  Synthetic oligonucleotide
aactcgcacgctgccattctccccgtacctttggt

SEQ ID NO: 125563 - DNA, 36 bp, Artificial Sequence
  Synthetic oligonucleotide
agggtgggcgggtatctgtgggctattacaactcaa

SEQ ID NO: 125564 - DNA, 36 bp, Artificial Sequence
  Synthetic oligonucleotide
gaaagcacatccgtccctccgccagactgctattaa

SEQ ID NO: 125565 - DNA, 36 bp, Artificial Sequence
  Synthetic oligonucleotide
tcactccctgccgatatgcgctttgggccacttcca

SEQ ID NO: 125566 - DNA, 36 bp, Artificial Sequence
  Synthetic oligonucleotide
gccaggccgggaggagaggggcgtgaaggggctgga

SEQ ID NO: 125567 - DNA, 38 bp, Artificial Sequence
  Synthetic oligonucleotide
gatcgcggaggggtgaagggcgggggctggcaatctga

SEQ ID NO: 125568 - DNA, 35 bp, Artificial Sequence
  Synthetic oligonucleotide
tcaaagcgcagtatcaaccttccatcacgcactac

SEQ ID NO: 125569 - DNA, 35 bp, Artificial Sequence
  Synthetic oligonucleotide
gttcactaccgctgttctcttcgtcgactcgcttg

SEQ ID NO: 125570 - DNA, 35 bp, Artificial Sequence
  Synthetic oligonucleotide
acctgccttgcatcatccatgtcatcacacttcgt

SEQ ID NO: 125571 - DNA, 35 bp, Artificial Sequence
  Synthetic oligonucleotide
gttggaaccgacgtgtgggtgaggagagggtgggt

SEQ ID NO: 125572 - DNA, 36 bp, Artificial Sequence
  Synthetic oligonucleotide
gatcgcagatcccccgtccactgacgccgccctaca

SEQ ID NO: 125573 - DNA, 37 bp, Artificial Sequence
  Synthetic oligonucleotide
agccactccacattgtctccgctttaccctcttacga

SEQ ID NO: 125574 - DNA, 37 bp, Artificial Sequence
  Synthetic oligonucleotide
tcctggggcgggagggtagggagttgaaccatgccga

SEQ ID NO: 125575 - DNA, 37 bp, Artificial Sequence
  Synthetic oligonucleotide
gcctccctatgcctagttgctctgttcgcctctccga

SEQ ID NO: 125576 - DNA, 37 bp, Artificial Sequence
  Synthetic oligonucleotide
tcaccacatccggatctcgcagaacccttcccttgga

SEQ ID NO: 125577 - DNA, 38 bp, Artificial Sequence
  Synthetic oligonucleotide
gttgcatcatccgcccccgcgtgcccttccctatatga

SEQ ID NO: 125578 - DNA, 34 bp, Artificial Sequence
  Synthetic oligonucleotide
ggccacccgccccccgacttcaactgtccgctga

SEQ ID NO: 125579 - DNA, 38 bp, Artificial Sequence
  Synthetic oligonucleotide
acacacatcgacccgttgccgcctgaccaccttcttga

SEQ ID NO: 125580 - DNA, 38 bp, Artificial Sequence
  Synthetic oligonucleotide
ggaccggggcaaaggggaacggaaaggaggaaatttga

SEQ ID NO: 125581 - DNA, 36 bp, Artificial Sequence
  Synthetic oligonucleotide
tcatcccacgccaatccgtaaacacaccccaacgta

SEQ ID NO: 125582 - DNA, 35 bp, Artificial Sequence
  Synthetic oligonucleotide
tacacctccaccggagagggggcggggagggttgc

SEQ ID NO: 125583 - DNA, 35 bp, Artificial Sequence
  Synthetic oligonucleotide
aaccgcacgtcattctcgccatttcatacgccgtc

SEQ ID NO: 125584 - DNA, 35 bp, Artificial Sequence
  Synthetic oligonucleotide
tagccatacgcgcacaacgttggcctttacacttc

SEQ ID NO: 125585 - DNA, 35 bp, Artificial Sequence
  Synthetic oligonucleotide
ggtggatacagaggggctaagggcgggaaagtcag

SEQ ID NO: 125586 - DNA, 35 bp, Artificial Sequence
  Synthetic oligonucleotide
aacattcgccactaagaccacctcgccgccccctg

SEQ ID NO: 125587 - DNA, 34 bp, Artificial Sequence
  Synthetic oligonucleotide
gctccgccctatcgcctacccaccaagtaacact

SEQ ID NO: 125588 - DNA, 35 bp, Artificial Sequence
  Synthetic oligonucleotide
actcgtgactatcccagcctggtatctttccacct

SEQ ID NO: 125589 - DNA, 35 bp, Artificial Sequence
  Synthetic oligonucleotide
gctccgacgccggtcgttctactcttggcctatct

SEQ ID NO: 125590 - DNA, 35 bp, Artificial Sequence
  Synthetic oligonucleotide
ccgacactgccaccgagttaggccaccccccccca

SEQ ID NO: 125591 - DNA, 36 bp, Artificial Sequence
  Synthetic oligonucleotide
gccactcacctgccccacccgcgttccattctgtca

SEQ ID NO: 125592 - DNA, 37 bp, Artificial Sequence
  Synthetic oligonucleotide
ggacccctatcgctcccctccgcccaggcgtttacga

SEQ ID NO: 125593 - DNA, 35 bp, Artificial Sequence
  Synthetic oligonucleotide
tacaccatcctgcatttcctgtactctagtagtga

SEQ ID NO: 125594 - DNA, 38 bp, Artificial Sequence
  Synthetic oligonucleotide
tgctgcccccctagtcccgggcccctcacctttggtga

SEQ ID NO: 125595 - DNA, 36 bp, Artificial Sequence
  Synthetic oligonucleotide
tgtttactgcccccagcttgctattccattccttga

SEQ ID NO: 125596 - DNA, 35 bp, Artificial Sequence
  Synthetic oligonucleotide
tgcacatccaggcaccccattaagccccgtacgcc

SEQ ID NO: 125597 - DNA, 35 bp, Artificial Sequence
  Synthetic oligonucleotide
aaagcatacagtctgatcaccgcccctctctgctc

SEQ ID NO: 125598 - DNA, 35 bp, Artificial Sequence
  Synthetic oligonucleotide
tccgatccacactggttgcatttcgcctacctttc

SEQ ID NO: 125599 - DNA, 35 bp, Artificial Sequence
  Synthetic oligonucleotide
gacccagtctcgcccctctgtttcagttttccggt

SEQ ID NO: 125600 - DNA, 35 bp, Artificial Sequence
  Synthetic oligonucleotide
tgcgcctctgtgtccgtccgttgctcttttcttgt

SEQ ID NO: 125601 - DNA, 35 bp, Artificial Sequence
  Synthetic oligonucleotide
tgcaccgccctgctccatcgggtctgtcttaccaa

SEQ ID NO: 125602 - DNA, 37 bp, Artificial Sequence
  Synthetic oligonucleotide
gcaggtcgatcgaatcctcccccgtcctccatgtcga

SEQ ID NO: 125603 - DNA, 38 bp, Artificial Sequence
  Synthetic oligonucleotide
tagcacgaatgctctgcacctccccccgccactagtga

SEQ ID NO: 125604 - DNA, 38 bp, Artificial Sequence
  Synthetic oligonucleotide
ttgcgcccctgttacgtttcaatcgctccgccccttga

SEQ ID NO: 125605 - DNA, 36 bp, Artificial Sequence
  Synthetic oligonucleotide
ttcaccatccccccgtatcgcgtcgccatacacgta

SEQ ID NO: 125606 - DNA, 35 bp, Artificial Sequence
  Synthetic oligonucleotide
gtgcgccggtcccgccctcctccgccttgtaagcc

SEQ ID NO: 125607 - DNA, 35 bp, Artificial Sequence
  Synthetic oligonucleotide
gcgcaattgtcctgcttgctacgggcctctacctt

SEQ ID NO: 125608 - DNA, 35 bp, Artificial Sequence
  Synthetic oligonucleotide
atccccgagctcagcctcgcgtacttccttttctt

SEQ ID NO: 125609 - DNA, 35 bp, Artificial Sequence
  Synthetic oligonucleotide
acacccgctcaagttgcctgtctcttccgttcgaa

SEQ ID NO: 125610 - DNA, 36 bp, Artificial Sequence
  Synthetic oligonucleotide
attccgatctgtgcgttgtcgccccgttgtccccca

SEQ ID NO: 125611 - DNA, 36 bp, Artificial Sequence
  Synthetic oligonucleotide
ttcgcacccagcgcttgccaccgccccccacggcca

SEQ ID NO: 125612 - DNA, 37 bp, Artificial Sequence
  Synthetic oligonucleotide
gtgccgccctgtatgccatgtccccattcctcgccga

SEQ ID NO: 125613 - DNA, 37 bp, Artificial Sequence
  Synthetic oligonucleotide
gtagtacggggtggggaagggaactaaccggatagga

SEQ ID NO: 125614 - DNA, 37 bp, Artificial Sequence
  Synthetic oligonucleotide
tgatcctcctgccatatcgcatttagcttcctacgga

SEQ ID NO: 125615 - DNA, 36 bp, Artificial Sequence
  Synthetic oligonucleotide
aagtccaggtggggtggggtgggaaggtaaatggga

SEQ ID NO: 125616 - DNA, 38 bp, Artificial Sequence
  Synthetic oligonucleotide
tgcctgccgcctcttgctaccccgacccactgcggtga

SEQ ID NO: 125617 - DNA, 35 bp, Artificial Sequence
  Synthetic oligonucleotide
gctccaccccctgttgtacgtcctttcaccgtggc

SEQ ID NO: 125618 - DNA, 34 bp, Artificial Sequence
  Synthetic oligonucleotide
gaccctccgctcagcccttctcaaagaccaactc

SEQ ID NO: 125619 - DNA, 35 bp, Artificial Sequence
  Synthetic oligonucleotide
tccccgctccctctatcaacatgctcgcaccttcg

SEQ ID NO: 125620 - DNA, 36 bp, Artificial Sequence
  Synthetic oligonucleotide
tctcgccccgttccaaccatgcgtcccacttttaca

SEQ ID NO: 125621 - DNA, 35 bp, Artificial Sequence
  Synthetic oligonucleotide
actcggtcccactgttcatccgtattgttcaccca

SEQ ID NO: 125622 - DNA, 35 bp, Artificial Sequence
  Synthetic oligonucleotide
tgttacccctacagcctgcctcattaggaccttca

SEQ ID NO: 125623 - DNA, 37 bp, Artificial Sequence
  Synthetic oligonucleotide
gatggggggagtgctatggggggaaggacgttcctga

SEQ ID NO: 125624 - DNA, 38 bp, Artificial Sequence
  Synthetic oligonucleotide
agttggaggggtaggggaaggaggcggacaaaaagtga

SEQ ID NO: 125625 - DNA, 36 bp, Artificial Sequence
  Synthetic oligonucleotide
tgcaccccccgtatcatcttgtgctttaccacggta

SEQ ID NO: 125626 - DNA, 35 bp, Artificial Sequence
  Synthetic oligonucleotide
ttacgatccgctcccgaatttcaatgttgcacctc

SEQ ID NO: 125627 - DNA, 35 bp, Artificial Sequence
  Synthetic oligonucleotide
gcccttcccgcctcagcccgcaccataacatctag

SEQ ID NO: 125628 - DNA, 35 bp, Artificial Sequence
  Synthetic oligonucleotide
tacgccctccggtcaatagccctactcactttccg

SEQ ID NO: 125629 - DNA, 35 bp, Artificial Sequence
  Synthetic oligonucleotide
atcgtggggtgggcagggtgggggctttgagctgg

SEQ ID NO: 125630 - DNA, 35 bp, Artificial Sequence
  Synthetic oligonucleotide
gttcacccccggacctacgcccagctctagccctt

SEQ ID NO: 125631 - DNA, 35 bp, Artificial Sequence
  Synthetic oligonucleotide
tcatccccccgggttgtctgtgcccccatatcctt

SEQ ID NO: 125632 - DNA, 36 bp, Artificial Sequence
  Synthetic oligonucleotide
aagggtggcgcggggaggcaagggggggcgttgtaa

SEQ ID NO: 125633 - DNA, 35 bp, Artificial Sequence
  Synthetic oligonucleotide
gaccccatccccgatttgcttagcatcccctatga

SEQ ID NO: 125634 - DNA, 38 bp, Artificial Sequence
  Synthetic oligonucleotide
ttcgccccatcgcccacctctgctacatcagtctatga

SEQ ID NO: 125635 - DNA, 35 bp, Artificial Sequence
  Synthetic oligonucleotide
gatgggtgaagggtagtaggtggagctattggtga

SEQ ID NO: 125636 - DNA, 38 bp, Artificial Sequence
  Synthetic oligonucleotide
tacgcacacggtcacctctctccggtccctccctgtga

SEQ ID NO: 125637 - DNA, 36 bp, Artificial Sequence
  Synthetic oligonucleotide
gtcccgcacgccctctgttcaagcctattattgcta

SEQ ID NO: 125638 - DNA, 36 bp, Artificial Sequence
  Synthetic oligonucleotide
gagggacagataggatagggcaacagggggcgtcta

SEQ ID NO: 125639 - DNA, 35 bp, Artificial Sequence
  Synthetic oligonucleotide
gtgccactccgccaggtcgtctgcattactctacc

SEQ ID NO: 125640 - DNA, 35 bp, Artificial Sequence
  Synthetic oligonucleotide
gctacgcctccgcctagatcgaccgcctatgtccc

SEQ ID NO: 125641 - DNA, 35 bp, Artificial Sequence
  Synthetic oligonucleotide
tacgccctcgccaccatgtaatcccccgtgcgtag

SEQ ID NO: 125642 - DNA, 35 bp, Artificial Sequence
  Synthetic oligonucleotide
cccagccccagacgcatgtctacttcttccgaacg

SEQ ID NO: 125643 - DNA, 35 bp, Artificial Sequence
  Synthetic oligonucleotide
tgagtgcctcgccgtgatcaatcgctccacctcgt

SEQ ID NO: 125644 - DNA, 36 bp, Artificial Sequence
  Synthetic oligonucleotide
tacccgcatacctctgcttccttacttggtgcacca

SEQ ID NO: 125645 - DNA, 38 bp, Artificial Sequence
  Synthetic oligonucleotide
tgcaaaacgggcggagggcggacacggagtgggggtga

SEQ ID NO: 125646 - DNA, 35 bp, Artificial Sequence
  Synthetic oligonucleotide
tgctaccatcacaccgctgtttttgtctggaatac

SEQ ID NO: 125647 - DNA, 35 bp, Artificial Sequence
  Synthetic oligonucleotide
tcccgtctctctcagccctgccttgcactgtctac

SEQ ID NO: 125648 - DNA, 35 bp, Artificial Sequence
  Synthetic oligonucleotide
acccccaccgcaccatgtctgcacttcgcgccacc

SEQ ID NO: 125649 - DNA, 35 bp, Artificial Sequence
  Synthetic oligonucleotide
gactccccgttgtcccgtgtcgtttcctgctcgcc

SEQ ID NO: 125650 - DNA, 35 bp, Artificial Sequence
  Synthetic oligonucleotide
tccccaccatgatggtgcgtgtcctccatttctcg

SEQ ID NO: 125651 - DNA, 35 bp, Artificial Sequence
  Synthetic oligonucleotide
tgtcatcccttccgttgatttctcgttccgctttg

SEQ ID NO: 125652 - DNA, 36 bp, Artificial Sequence
  Synthetic oligonucleotide
gagtgtaggggtgggggaatgtgacgggtggcaaaa

SEQ ID NO: 125653 - DNA, 33 bp, Artificial Sequence
  Synthetic oligonucleotide
gccccctcccgtgccgttagccttgttgccgca

SEQ ID NO: 125654 - DNA, 36 bp, Artificial Sequence
  Synthetic oligonucleotide
gcttgcagagggaatgcgggtggagggggggggtca

SEQ ID NO: 125655 - DNA, 37 bp, Artificial Sequence
  Synthetic oligonucleotide
gttgtagagggcgggggggttcgggctgaacaggaga

SEQ ID NO: 125656 - DNA, 35 bp, Artificial Sequence
  Synthetic oligonucleotide
accggtccacggtcctggtcttatttgcgcactcc

SEQ ID NO: 125657 - DNA, 35 bp, Artificial Sequence
  Synthetic oligonucleotide
ttcacccgccactctcttatgtagggatccgttcc

SEQ ID NO: 125658 - DNA, 35 bp, Artificial Sequence
  Synthetic oligonucleotide
gtcagagctttgtgctgtccgttctttcgccccgc

SEQ ID NO: 125659 - DNA, 35 bp, Artificial Sequence
  Synthetic oligonucleotide
tgaactcttcacgcagtgcgagccttcacctcctc

SEQ ID NO: 125660 - DNA, 35 bp, Artificial Sequence
  Synthetic oligonucleotide
gtgccctcccgtgagcagtaccaatgcatcctttc

SEQ ID NO: 125661 - DNA, 37 bp, Artificial Sequence
  Synthetic oligonucleotide
gaggaacgggaaaagggcaaagggaaagtgcgaaaga

SEQ ID NO: 125662 - DNA, 38 bp, Artificial Sequence
  Synthetic oligonucleotide
ggacaggggaaaaggggggtggttgaagtgggctctga

SEQ ID NO: 125663 - DNA, 35 bp, Artificial Sequence
  Synthetic oligonucleotide
tgtccacccgccatgacatcttaggtgtctcttac

SEQ ID NO: 125664 - DNA, 35 bp, Artificial Sequence
  Synthetic oligonucleotide
tcccatcacttgtcctccgcacgcggtttcttgcc

SEQ ID NO: 125665 - DNA, 35 bp, Artificial Sequence
  Synthetic oligonucleotide
atgttcccaccgcacaatcgccctgggatacttcc

SEQ ID NO: 125666 - DNA, 35 bp, Artificial Sequence
  Synthetic oligonucleotide
gtaccgctccatcccctcctatagctttgcgacgc

SEQ ID NO: 125667 - DNA, 35 bp, Artificial Sequence
  Synthetic oligonucleotide
acatccatccccgtttagggatgctctataccatc

SEQ ID NO: 125668 - DNA, 35 bp, Artificial Sequence
  Synthetic oligonucleotide
tccgttacccagccgaaccaccattgttacccgtc

SEQ ID NO: 125669 - DNA, 35 bp, Artificial Sequence
  Synthetic oligonucleotide
accccatgtctttgcaccatactttctcgcccatg

SEQ ID NO: 125670 - DNA, 35 bp, Artificial Sequence
  Synthetic oligonucleotide
gttgctgcgcctctgcccttttggtccgcttcctg

SEQ ID NO: 125671 - DNA, 35 bp, Artificial Sequence
  Synthetic oligonucleotide
ggtgcaacctcccgtttctcatgtctttatctcct

SEQ ID NO: 125672 - DNA, 35 bp, Artificial Sequence
  Synthetic oligonucleotide
atgcgctacatgtcctgttcgtcacgtctcttctt

SEQ ID NO: 125673 - DNA, 32 bp, Artificial Sequence
  Synthetic oligonucleotide
acctgcgcactacgcttcttctgctctgccaa

SEQ ID NO: 125674 - DNA, 34 bp, Artificial Sequence
  Synthetic oligonucleotide
tgcacagccacaccccccgcctttcgattcttca

SEQ ID NO: 125675 - DNA, 36 bp, Artificial Sequence
  Synthetic oligonucleotide
gaagccaagtgaaggggtaggagggccggaacagga

SEQ ID NO: 125676 - DNA, 38 bp, Artificial Sequence
  Synthetic oligonucleotide
tggggggggaggtaggaagaagggactggagtgaatga

SEQ ID NO: 125677 - DNA, 35 bp, Artificial Sequence
  Synthetic oligonucleotide
gccacgctaccttgttcgtcctttatcacgttcta

SEQ ID NO: 125678 - DNA, 35 bp, Artificial Sequence
  Synthetic oligonucleotide
accatcacgcttattatatgtcttcgttctcacac

SEQ ID NO: 125679 - DNA, 35 bp, Artificial Sequence
  Synthetic oligonucleotide
agcccacgcacatatctaacgccacgctcgcccac

SEQ ID NO: 125680 - DNA, 35 bp, Artificial Sequence
  Synthetic oligonucleotide
acagtcgcgccattcgtaactatccgtcgtctcac

SEQ ID NO: 125681 - DNA, 35 bp, Artificial Sequence
  Synthetic oligonucleotide
gagcccatcgcaggctctttaccatcgcgcccccc

SEQ ID NO: 125682 - DNA, 35 bp, Artificial Sequence
  Synthetic oligonucleotide
gacgtcctctcagtacttatttctactcgcccgcc

SEQ ID NO: 125683 - DNA, 35 bp, Artificial Sequence
  Synthetic oligonucleotide
ttgccgggtctcccatctggcagttcgctccctcc

SEQ ID NO: 125684 - DNA, 35 bp, Artificial Sequence
  Synthetic oligonucleotide
gagccactatgcttctctatgctttcacgttcctc

SEQ ID NO: 125685 - DNA, 34 bp, Artificial Sequence
  Synthetic oligonucleotide
gctcagccagccgatgtacgacctcccccttgtc

SEQ ID NO: 125686 - DNA, 35 bp, Artificial Sequence
  Synthetic oligonucleotide
aacgccgcattagttgcgcgcttctatgctttcct

SEQ ID NO: 125687 - DNA, 36 bp, Artificial Sequence
  Synthetic oligonucleotide
ggggcctcggggtggtcaaagttacgtggaggggaa

SEQ ID NO: 125688 - DNA, 36 bp, Artificial Sequence
  Synthetic oligonucleotide
tccgcccctcctagctacgtgtctgtaaaacctgca

SEQ ID NO: 125689 - DNA, 37 bp, Artificial Sequence
  Synthetic oligonucleotide
ttatccaccgtccggtcaccgtatctatgcccctcga

SEQ ID NO: 125690 - DNA, 37 bp, Artificial Sequence
  Synthetic oligonucleotide
accgccgggaggagggcgggggtgacgggggagtgga

SEQ ID NO: 125691 - DNA, 37 bp, Artificial Sequence
  Synthetic oligonucleotide
gccgccaggcgccctagttttaccccgttttccatga

SEQ ID NO: 125692 - DNA, 38 bp, Artificial Sequence
  Synthetic oligonucleotide
aaggggggaggttgcaggagcggggagggagaatatga

SEQ ID NO: 125693 - DNA, 35 bp, Artificial Sequence
  Synthetic oligonucleotide
tattgctcccgtcccctcttatcggcgtttttccc

SEQ ID NO: 125694 - DNA, 35 bp, Artificial Sequence
  Synthetic oligonucleotide
ttcactgccctgcataacgtccactgtctacctcc

SEQ ID NO: 125695 - DNA, 35 bp, Artificial Sequence
  Synthetic oligonucleotide
gccaagggatcgggggggtgggttgcaactatttg

SEQ ID NO: 125696 - DNA, 35 bp, Artificial Sequence
  Synthetic oligonucleotide
gtctcccgctcaattgttcgctccggccgtatcct

SEQ ID NO: 125697 - DNA, 35 bp, Artificial Sequence
  Synthetic oligonucleotide
tgcacctctgactcttccctgcctgcatcattcgt

SEQ ID NO: 125698 - DNA, 34 bp, Artificial Sequence
  Synthetic oligonucleotide
ttgctgccaccgatccaccctgtcgacgcaccaa

SEQ ID NO: 125699 - DNA, 35 bp, Artificial Sequence
  Synthetic oligonucleotide
gtgctaccctccccaccgtgctttgttacatccca

SEQ ID NO: 125700 - DNA, 36 bp, Artificial Sequence
  Synthetic oligonucleotide
tgcgcatgcaacatcggggtaagggtgggggggcca

SEQ ID NO: 125701 - DNA, 36 bp, Artificial Sequence
  Synthetic oligonucleotide
gtgcccagcaccccccgctgtgccaccgctccctca

SEQ ID NO: 125702 - DNA, 36 bp, Artificial Sequence
  Synthetic oligonucleotide
atccaccgcccctactcggcaaacagtcgactgcga

SEQ ID NO: 125703 - DNA, 37 bp, Artificial Sequence
  Synthetic oligonucleotide
gtgcgccgaaagcgggtgggacaacagggggggtcga

SEQ ID NO: 125704 - DNA, 37 bp, Artificial Sequence
  Synthetic oligonucleotide
tgggggtagggaggcggggaatgaggaggtaactgga

SEQ ID NO: 125705 - DNA, 38 bp, Artificial Sequence
  Synthetic oligonucleotide
gtggccctccctgttatctagctgctcctatgccatga

SEQ ID NO: 125706 - DNA, 37 bp, Artificial Sequence
  Synthetic oligonucleotide
tcatacacccgcagatgtcgtctccccgcgcacctga

SEQ ID NO: 125707 - DNA, 34 bp, Artificial Sequence
  Synthetic oligonucleotide
ttctacgttgccgccgtacttcgcctcctatacc

SEQ ID NO: 125708 - DNA, 35 bp, Artificial Sequence
  Synthetic oligonucleotide
tgatcccctcgcgctccttcctgggcctaactctc

SEQ ID NO: 125709 - DNA, 35 bp, Artificial Sequence
  Synthetic oligonucleotide
tgccccgccctttatcatgatgttcctgctccttc

SEQ ID NO: 125710 - DNA, 38 bp, Artificial Sequence
  Synthetic oligonucleotide
gacccccccctcacgacacagacagttactctcgatga

SEQ ID NO: 125711 - DNA, 37 bp, Artificial Sequence
  Synthetic oligonucleotide
tcgcacacgcctgttcctgcatcctcgtccccgctga

SEQ ID NO: 125712 - DNA, 38 bp, Artificial Sequence
  Synthetic oligonucleotide
tgcgcacgattgcccttcctccacgctccactctgtga

SEQ ID NO: 125713 - DNA, 33 bp, Artificial Sequence
  Synthetic oligonucleotide
gcctctccacctcggtgtgcgctactgtctacc

SEQ ID NO: 125714 - DNA, 35 bp, Artificial Sequence
  Synthetic oligonucleotide
tagccataccttctgctcgtttcccggcttgaccc

SEQ ID NO: 125715 - DNA, 35 bp, Artificial Sequence
  Synthetic oligonucleotide
gtcgcaatgcttatccccgtatcacgtccgttgcc

SEQ ID NO: 125716 - DNA, 35 bp, Artificial Sequence
  Synthetic oligonucleotide
tactgcccctcgcttgcacttgtggcgccttcttc

SEQ ID NO: 125717 - DNA, 34 bp, Artificial Sequence
  Synthetic oligonucleotide
ggacacccaatgctatcgggtacaactcttcttc

SEQ ID NO: 125718 - DNA, 35 bp, Artificial Sequence
  Synthetic oligonucleotide
ggttacatctgccgtattccgtcgccatctcgttc

SEQ ID NO: 125719 - DNA, 35 bp, Artificial Sequence
  Synthetic oligonucleotide
tgcctcgacaccctaccccccaccgcagctcaacg

SEQ ID NO: 125720 - DNA, 35 bp, Artificial Sequence
  Synthetic oligonucleotide
tactcactgcaccctggttatcgtgtctgtcctgt

SEQ ID NO: 125721 - DNA, 36 bp, Artificial Sequence
  Synthetic oligonucleotide
gcaccacacatgattcggccaggttccttctccaca

SEQ ID NO: 125722 - DNA, 36 bp, Artificial Sequence
  Synthetic oligonucleotide
gtcaccccatggcttacagacaccacgattctacca

SEQ ID NO: 125723 - DNA, 36 bp, Artificial Sequence
  Synthetic oligonucleotide
tgcacgttcactcctgcccctgtataaccttcccca

SEQ ID NO: 125724 - DNA, 36 bp, Artificial Sequence
  Synthetic oligonucleotide
accgtacatcacttgctaatttgtcttgccttctca

SEQ ID NO: 125725 - DNA, 36 bp, Artificial Sequence
  Synthetic oligonucleotide
gacacactgatcgtcatcgacttgccccactaccga

SEQ ID NO: 125726 - DNA, 37 bp, Artificial Sequence
  Synthetic oligonucleotide
accccacacccacgcccgtgacattattatgttccga

SEQ ID NO: 125727 - DNA, 37 bp, Artificial Sequence
  Synthetic oligonucleotide
gcgtcacgtagatcattatcgctgccatccctctcga

SEQ ID NO: 125728 - DNA, 36 bp, Artificial Sequence
  Synthetic oligonucleotide
tactcagcccccgcctcatacctcagcctcaccgga

SEQ ID NO: 125729 - DNA, 37 bp, Artificial Sequence
  Synthetic oligonucleotide
gactcgcccactcgtactcctcgcgccccttgactga

SEQ ID NO: 125730 - DNA, 35 bp, Artificial Sequence
  Synthetic oligonucleotide
gtcctccgcacacagtatatctgttgttccccacc

SEQ ID NO: 125731 - DNA, 35 bp, Artificial Sequence
  Synthetic oligonucleotide
ttcgacatactccacctcgtgtaaacatcgccacc

SEQ ID NO: 125732 - DNA, 35 bp, Artificial Sequence
  Synthetic oligonucleotide
acgagtccgcttagccgccctgttaccgtaatccc

SEQ ID NO: 125733 - DNA, 35 bp, Artificial Sequence
  Synthetic oligonucleotide
acgcgcccctcttgccatggccccgactcctcggc

SEQ ID NO: 125734 - DNA, 35 bp, Artificial Sequence
  Synthetic oligonucleotide
gagaaaggggggggaaggaggtgtaggggtacatc

SEQ ID NO: 125735 - DNA, 35 bp, Artificial Sequence
  Synthetic oligonucleotide
gctacgcccctcgtattgttcgtttcttggcgctc

SEQ ID NO: 125736 - DNA, 35 bp, Artificial Sequence
  Synthetic oligonucleotide
gatcatggtcctgacgtcgatgcgccctccctccg

SEQ ID NO: 125737 - DNA, 35 bp, Artificial Sequence
  Synthetic oligonucleotide
tccatcccggccatccctccgcgttcaagtcctcg

SEQ ID NO: 125738 - DNA, 35 bp, Artificial Sequence
  Synthetic oligonucleotide
tttccgcccactgtttcctaggtcgtacccattcg

SEQ ID NO: 125739 - DNA, 35 bp, Artificial Sequence
  Synthetic oligonucleotide
atccctccccgtcccgttcttgcatgtccgcggct

SEQ ID NO: 125740 - DNA, 35 bp, Artificial Sequence
  Synthetic oligonucleotide
gccccgccataagtacggcctttccccaatttcca

SEQ ID NO: 125741 - DNA, 35 bp, Artificial Sequence
  Synthetic oligonucleotide
gtatcctgtccgcacctcttcacgctccgccacga

SEQ ID NO: 125742 - DNA, 37 bp, Artificial Sequence
  Synthetic oligonucleotide
gccgctgcccatttcgatacacgtgccttctacccga

SEQ ID NO: 125743 - DNA, 37 bp, Artificial Sequence
  Synthetic oligonucleotide
gttgggggtgacggaaatgatagaatggcggggagga

SEQ ID NO: 125744 - DNA, 37 bp, Artificial Sequence
  Synthetic oligonucleotide
tgtgcgcccttgtattcgtcttgctctaccccccgga

SEQ ID NO: 125745 - DNA, 37 bp, Artificial Sequence
  Synthetic oligonucleotide
gcaaacactagggggaaggagggggcggttactggga

SEQ ID NO: 125746 - DNA, 36 bp, Artificial Sequence
  Synthetic oligonucleotide
aaacgggaggggacgaaggttgggcggggtttatga

SEQ ID NO: 125747 - DNA, 37 bp, Artificial Sequence
  Synthetic oligonucleotide
actacccccagccaccccatctgtctcaccgacgtga

SEQ ID NO: 125748 - DNA, 38 bp, Artificial Sequence
  Synthetic oligonucleotide
gttaggtagggaaggaggtaagggtaggaatagggtga

SEQ ID NO: 125749 - DNA, 35 bp, Artificial Sequence
  Synthetic oligonucleotide
tccatcataccatgccttggtctcccacgttgccc

SEQ ID NO: 125750 - DNA, 35 bp, Artificial Sequence
  Synthetic oligonucleotide
ggagcagtctgccagcgtccccatcccctcccggc

SEQ ID NO: 125751 - DNA, 35 bp, Artificial Sequence
  Synthetic oligonucleotide
atgcattcatccatgcccgtccacatcccagcatc

SEQ ID NO: 125752 - DNA, 35 bp, Artificial Sequence
  Synthetic oligonucleotide
gcaaccaccagccatcgtccccatttctttaggtc

SEQ ID NO: 125753 - DNA, 36 bp, Artificial Sequence
  Synthetic oligonucleotide
tactgcgcccgctcttcacctctaccatgctgaacg

SEQ ID NO: 125754 - DNA, 35 bp, Artificial Sequence
  Synthetic oligonucleotide
ataaacacccactatggcatacagttactcctccg

SEQ ID NO: 125755 - DNA, 35 bp, Artificial Sequence
  Synthetic oligonucleotide
gccaaccaccccgggtatcgcgcttcttaacgcct

SEQ ID NO: 125756 - DNA, 35 bp, Artificial Sequence
  Synthetic oligonucleotide
aaccaccccccctgccctggtctgttgggacatct

SEQ ID NO: 125757 - DNA, 35 bp, Artificial Sequence
  Synthetic oligonucleotide
gggccgggtgggacgggaggggcttagtgcgatct

SEQ ID NO: 125758 - DNA, 36 bp, Artificial Sequence
  Synthetic oligonucleotide
tacgaggggggtaggaacggggacgtaggtaagaga

SEQ ID NO: 125759 - DNA, 37 bp, Artificial Sequence
  Synthetic oligonucleotide
atgtcaacccctcactgtcccctgagctcgtttccga

SEQ ID NO: 125760 - DNA, 37 bp, Artificial Sequence
  Synthetic oligonucleotide
acgaaccacccctcgtactgtaattcccctttcggga

SEQ ID NO: 125761 - DNA, 38 bp, Artificial Sequence
  Synthetic oligonucleotide
gttccccgcccccgcttgttaccgcaacactctagtga

SEQ ID NO: 125762 - DNA, 35 bp, Artificial Sequence
  Synthetic oligonucleotide
gtccgacaccccgattagctattccccctgtcacc

SEQ ID NO: 125763 - DNA, 35 bp, Artificial Sequence
  Synthetic oligonucleotide
gcacgttctgacctgctcagattcccccctttgcc

SEQ ID NO: 125764 - DNA, 35 bp, Artificial Sequence
  Synthetic oligonucleotide
gagagtgcgtcacacattttttactgcctgcccgc

SEQ ID NO: 125765 - DNA, 35 bp, Artificial Sequence
  Synthetic oligonucleotide
aatcatctctgcctctgcttcaccaggttcgcctc

SEQ ID NO: 125766 - DNA, 35 bp, Artificial Sequence
  Synthetic oligonucleotide
acccccgtacatttgatgccgctcctctgcctttc

SEQ ID NO: 125767 - DNA, 35 bp, Artificial Sequence
  Synthetic oligonucleotide
tcaccgcgtgataccgcctaccccctttgtgtccg

SEQ ID NO: 125768 - DNA, 35 bp, Artificial Sequence
  Synthetic oligonucleotide
actccacacctcaccacccctgcctccaaaccggg

SEQ ID NO: 125769 - DNA, 35 bp, Artificial Sequence
  Synthetic oligonucleotide
tctgatagccctcctgttaccgtgcgttcgcccat

SEQ ID NO: 125770 - DNA, 35 bp, Artificial Sequence
  Synthetic oligonucleotide
ggattgcatcactgccctcgaccaccgaccccact

SEQ ID NO: 125771 - DNA, 35 bp, Artificial Sequence
  Synthetic oligonucleotide
gatcgccttcctcgcatgctgttcatgcacttact

SEQ ID NO: 125772 - DNA, 32 bp, Artificial Sequence
  Synthetic oligonucleotide
caccacgcagacctatctgtttccgtgcccct

SEQ ID NO: 125773 - DNA, 35 bp, Artificial Sequence
  Synthetic oligonucleotide
gttggaacctccgcaccttcaggatctcgctccct

SEQ ID NO: 125774 - DNA, 35 bp, Artificial Sequence
  Synthetic oligonucleotide
gctgctgaacctgcataccgttgaccccgtggcct

SEQ ID NO: 125775 - DNA, 35 bp, Artificial Sequence
  Synthetic oligonucleotide
tatactacacctcatgatctgctctgcgcacctct

SEQ ID NO: 125776 - DNA, 35 bp, Artificial Sequence
  Synthetic oligonucleotide
ttcgtacgcccctacaagctgcatggtactcttct

SEQ ID NO: 125777 - DNA, 36 bp, Artificial Sequence
  Synthetic oligonucleotide
taccaccatgccagctccgtgccgctccttccgtaa

SEQ ID NO: 125778 - DNA, 37 bp, Artificial Sequence
  Synthetic oligonucleotide
gagggcccaggtggagggggaaagcgtgggactggga

SEQ ID NO: 125779 - DNA, 38 bp, Artificial Sequence
  Synthetic oligonucleotide
tgaccacgtgtatttcgcgccgccgacccccgccctga

SEQ ID NO: 125780 - DNA, 38 bp, Artificial Sequence
  Synthetic oligonucleotide
atgggggggagtagtacggcaatatgagggtggggtga

SEQ ID NO: 125781 - DNA, 32 bp, Artificial Sequence
  Synthetic oligonucleotide
accccatccgcctgaggccttcccccgccgta

SEQ ID NO: 125782 - DNA, 35 bp, Artificial Sequence
  Synthetic oligonucleotide
gtgcccttcctgacgccttactccgaatctgctac

SEQ ID NO: 125783 - DNA, 35 bp, Artificial Sequence
  Synthetic oligonucleotide
tgacccacgaccatgtccccttttgccaataccgc

SEQ ID NO: 125784 - DNA, 35 bp, Artificial Sequence
  Synthetic oligonucleotide
gacgcccctcatttctgtcctgcccgccctgtact

SEQ ID NO: 125785 - DNA, 35 bp, Artificial Sequence
  Synthetic oligonucleotide
tagtcagtccctcgtggtcccatccctctctccaa

SEQ ID NO: 125786 - DNA, 36 bp, Artificial Sequence
  Synthetic oligonucleotide
taagacgcgccagtctcgtcccaccccgccctgcaa

SEQ ID NO: 125787 - DNA, 35 bp, Artificial Sequence
  Synthetic oligonucleotide
atgtgggctcacccgtgcgattttgctttccccca

SEQ ID NO: 125788 - DNA, 29 bp, Artificial Sequence
  Synthetic oligonucleotide
ttgcgccctcaccctgtctcccttactca

SEQ ID NO: 125789 - DNA, 36 bp, Artificial Sequence
  Synthetic oligonucleotide
gttgcgctgacgaccgcttttcccccgttttgctta

SEQ ID NO: 125790 - DNA, 35 bp, Artificial Sequence
  Synthetic oligonucleotide
tgaggggtgcggtcctggagtggggtgggtgggac

SEQ ID NO: 125791 - DNA, 35 bp, Artificial Sequence
  Synthetic oligonucleotide
tcgagagctcatgcgtcaagccccattgccgtccc

SEQ ID NO: 125792 - DNA, 35 bp, Artificial Sequence
  Synthetic oligonucleotide
accccaccggtcctcaattgttacactacttagcc

SEQ ID NO: 125793 - DNA, 35 bp, Artificial Sequence
  Synthetic oligonucleotide
tacgccgacgccgggctgatgtcttttctcccgcc

SEQ ID NO: 125794 - DNA, 35 bp, Artificial Sequence
  Synthetic oligonucleotide
gcaccgacaatcccttcatagtggctcacgctctc

SEQ ID NO: 125795 - DNA, 36 bp, Artificial Sequence
  Synthetic oligonucleotide
agaactcgccgctgtttcttcatgttccttgcccga

SEQ ID NO: 125796 - DNA, 37 bp, Artificial Sequence
  Synthetic oligonucleotide
acgtgagtgggagggcggacggaggcaaagaaggcga

SEQ ID NO: 125797 - DNA, 38 bp, Artificial Sequence
  Synthetic oligonucleotide
gtcacccagcgccccttgagcttatcctcccaccgtga

SEQ ID NO: 125798 - DNA, 38 bp, Artificial Sequence
  Synthetic oligonucleotide
tcccaaccctcacttgacattggtgtccctttccgtga

SEQ ID NO: 125799 - DNA, 35 bp, Artificial Sequence
  Synthetic oligonucleotide
tcaccctcgtgtctcccccccgcaatgtgcttccg

SEQ ID NO: 125800 - DNA, 35 bp, Artificial Sequence
  Synthetic oligonucleotide
gtgcgggagggtgggtgttgggcctacggtcttgg

SEQ ID NO: 125801 - DNA, 35 bp, Artificial Sequence
  Synthetic oligonucleotide
tagacgcgctccccggcctctagttgttcctcatg

SEQ ID NO: 125802 - DNA, 35 bp, Artificial Sequence
  Synthetic oligonucleotide
tgttaggatccgctctgtccccccccatggttact

SEQ ID NO: 125803 - DNA, 35 bp, Artificial Sequence
  Synthetic oligonucleotide
gtgcctcccccaaccgtgtctcaattgttcggcct

SEQ ID NO: 125804 - DNA, 35 bp, Artificial Sequence
  Synthetic oligonucleotide
gatgccaccgccacttcgtcccttcgtatcttggt

SEQ ID NO: 125805 - DNA, 36 bp, Artificial Sequence
  Synthetic oligonucleotide
gcaggggggcgggtagggagtcgggaaaagctggaa

SEQ ID NO: 125806 - DNA, 35 bp, Artificial Sequence
  Synthetic oligonucleotide
tcctcctgctccaccttctgtatattccacgcgca

SEQ ID NO: 125807 - DNA, 36 bp, Artificial Sequence
  Synthetic oligonucleotide
gatccctgcacctacctgagcattgcctgttactca

SEQ ID NO: 125808 - DNA, 36 bp, Artificial Sequence
  Synthetic oligonucleotide
ttggtcactacatcgggtcctcgttcctccatttca

SEQ ID NO: 125809 - DNA, 38 bp, Artificial Sequence
  Synthetic oligonucleotide
tgtacctcccttcctgcctccaaagcggacagctttga

SEQ ID NO: 125810 - DNA, 36 bp, Artificial Sequence
  Synthetic oligonucleotide
acattacgccctctctgtctccgtgcccgtggaata

SEQ ID NO: 125811 - DNA, 36 bp, Artificial Sequence
  Synthetic oligonucleotide
acgaacctctgcttgcccgcttttgacacatcacta

SEQ ID NO: 125812 - DNA, 36 bp, Artificial Sequence
  Synthetic oligonucleotide
acttcgggccagaaccctgttcgcgtgacacaccta

SEQ ID NO: 125813 - DNA, 38 bp, Artificial Sequence
  Synthetic oligonucleotide
tcacgacggccgtcagaccagtgcccctgtcccctgta

SEQ ID NO: 125814 - DNA, 35 bp, Artificial Sequence
  Synthetic oligonucleotide
gtcgcctcatcttacttaccgtctcgtctcaccgc

SEQ ID NO: 125815 - DNA, 34 bp, Artificial Sequence
  Synthetic oligonucleotide
ggaccgcgacacgaccttatactcccgtccaatc

SEQ ID NO: 125816 - DNA, 35 bp, Artificial Sequence
  Synthetic oligonucleotide
gggggagcgagggtgggcgggtttggccttgcgcg

SEQ ID NO: 125817 - DNA, 35 bp, Artificial Sequence
  Synthetic oligonucleotide
agaagagggtgggtagaaagggagggaccgatgcg

SEQ ID NO: 125818 - DNA, 35 bp, Artificial Sequence
  Synthetic oligonucleotide
gtggtgatgaggggccggagggagaaacgggaggg

SEQ ID NO: 125819 - DNA, 35 bp, Artificial Sequence
  Synthetic oligonucleotide
tgactccccgatttaagtacccgctctctctaatg

SEQ ID NO: 125820 - DNA, 35 bp, Artificial Sequence
  Synthetic oligonucleotide
gccgcaccttcgtccacccgcagttgttgccatct

SEQ ID NO: 125821 - DNA, 35 bp, Artificial Sequence
  Synthetic oligonucleotide
tccgacgcaagccgctggcccactgaccctctatt

SEQ ID NO: 125822 - DNA, 36 bp, Artificial Sequence
  Synthetic oligonucleotide
tttgccatcatcttgcttgtttcttctgcgatccca

SEQ ID NO: 125823 - DNA, 36 bp, Artificial Sequence
  Synthetic oligonucleotide
actcctgccccgcccaatacccggagtgatttctca

SEQ ID NO: 125824 - DNA, 38 bp, Artificial Sequence
  Synthetic oligonucleotide
gatgagcccgcaactgtccctgacctcccctcgcttga

SEQ ID NO: 125825 - DNA, 38 bp, Artificial Sequence
  Synthetic oligonucleotide
aaccgacacctgccccatccgataagccggccctttga

SEQ ID NO: 125826 - DNA, 34 bp, Artificial Sequence
  Synthetic oligonucleotide
tacgggggggtagggtgggtaggcttctcagcac

SEQ ID NO: 125827 - DNA, 35 bp, Artificial Sequence
  Synthetic oligonucleotide
tttcgcggccacatcgcccacctgcccgtccgcac

SEQ ID NO: 125828 - DNA, 35 bp, Artificial Sequence
  Synthetic oligonucleotide
tccccaatcagccgatgacccggatgttccccccc

SEQ ID NO: 125829 - DNA, 35 bp, Artificial Sequence
  Synthetic oligonucleotide
gccgcatgcgcccgcccacgtcggttatcgttccc

SEQ ID NO: 125830 - DNA, 35 bp, Artificial Sequence
  Synthetic oligonucleotide
tactacccatcggattgacccagcgctgccccgcc

SEQ ID NO: 125831 - DNA, 35 bp, Artificial Sequence
  Synthetic oligonucleotide
atacatccacggatgcttttcgttactactttgcc

SEQ ID NO: 125832 - DNA, 35 bp, Artificial Sequence
  Synthetic oligonucleotide
atccaaccaacccgctccgaggtagttattacctc

SEQ ID NO: 125833 - DNA, 35 bp, Artificial Sequence
  Synthetic oligonucleotide
tcccactgcacaccgctatgggccttttccctccg

SEQ ID NO: 125834 - DNA, 35 bp, Artificial Sequence
  Synthetic oligonucleotide
gcctccatcacgttttacaccgctaccgatcatcg

SEQ ID NO: 125835 - DNA, 36 bp, Artificial Sequence
  Synthetic oligonucleotide
tccccaactcctgcccctttggttgagcccgaaact

SEQ ID NO: 125836 - DNA, 35 bp, Artificial Sequence
  Synthetic oligonucleotide
tgacatggtccacgatcccctgtcttctgcctgtt

SEQ ID NO: 125837 - DNA, 35 bp, Artificial Sequence
  Synthetic oligonucleotide
gacccgcgcaccgggtttcctctcattcgctccaa

SEQ ID NO: 125838 - DNA, 35 bp, Artificial Sequence
  Synthetic oligonucleotide
tgttgccccccgctacggcccccctgtctccccga

SEQ ID NO: 125839 - DNA, 37 bp, Artificial Sequence
  Synthetic oligonucleotide
tcacgtcgtggggagggcagaggggcgggaactagga

SEQ ID NO: 125840 - DNA, 38 bp, Artificial Sequence
  Synthetic oligonucleotide
tcaacaggcctccgctgtaccacctgaccgccccgtga

SEQ ID NO: 125841 - DNA, 36 bp, Artificial Sequence
  Synthetic oligonucleotide
gtacggtgggggggtgggaaagaagtgggacaagta

SEQ ID NO: 125842 - DNA, 36 bp, Artificial Sequence
  Synthetic oligonucleotide
gaccgtaggggggaggataaagggtgcggagctgta

SEQ ID NO: 125843 - DNA, 35 bp, Artificial Sequence
  Synthetic oligonucleotide
agcgcacggtaggagggggggtggaaggcgtgtac

SEQ ID NO: 125844 - DNA, 35 bp, Artificial Sequence
  Synthetic oligonucleotide
tgttgggtgggaccaaccgttaagggcggggaacc

SEQ ID NO: 125845 - DNA, 35 bp, Artificial Sequence
  Synthetic oligonucleotide
tatgtcccatgcgtgctctcaccagaccctgcccc

SEQ ID NO: 125846 - DNA, 35 bp, Artificial Sequence
  Synthetic oligonucleotide
gttgcaacgccctgtgcttgtccacggtcctttcc

SEQ ID NO: 125847 - DNA, 35 bp, Artificial Sequence
  Synthetic oligonucleotide
agcccacagccaggccacgttaccccccagtttcc

SEQ ID NO: 125848 - DNA, 35 bp, Artificial Sequence
  Synthetic oligonucleotide
accgtcctccctcactcatgccctgaagccttatc

SEQ ID NO: 125849 - DNA, 35 bp, Artificial Sequence
  Synthetic oligonucleotide
acccgccccccctcagtagtacccggtctcttggg

SEQ ID NO: 125850 - DNA, 35 bp, Artificial Sequence
  Synthetic oligonucleotide
ggagccctccaagtcctcggccaccacctcccttg

SEQ ID NO: 125851 - DNA, 35 bp, Artificial Sequence
  Synthetic oligonucleotide
gcccccagacgtctcatattgccaccggtacccct

SEQ ID NO: 125852 - DNA, 36 bp, Artificial Sequence
  Synthetic oligonucleotide
tgtgcttggcggtacggaggggaggaggtgggagaa

SEQ ID NO: 125853 - DNA, 36 bp, Artificial Sequence
  Synthetic oligonucleotide
tatgaagaggggtgagtgtcgaaagggagggaggaa

SEQ ID NO: 125854 - DNA, 37 bp, Artificial Sequence
  Synthetic oligonucleotide
ttccgctgccccgctctctcgctccccgtcctgatga

SEQ ID NO: 125855 - DNA, 36 bp, Artificial Sequence
  Synthetic oligonucleotide
tcaagaccccagccgtcccgtcctctgctcccctga

SEQ ID NO: 125856 - DNA, 35 bp, Artificial Sequence
  Synthetic oligonucleotide
tcctcctacccagttgtgcggccactaccaccgcc

SEQ ID NO: 125857 - DNA, 35 bp, Artificial Sequence
  Synthetic oligonucleotide
aacgcacccgcctctttcctttagctgctatctag

SEQ ID NO: 125858 - DNA, 35 bp, Artificial Sequence
  Synthetic oligonucleotide
tgcaacccaatacttgctagctgcccttcctaccg

SEQ ID NO: 125859 - DNA, 35 bp, Artificial Sequence
  Synthetic oligonucleotide
tgtatatcccgctccattctttgctggccaccatg

SEQ ID NO: 125860 - DNA, 35 bp, Artificial Sequence
  Synthetic oligonucleotide
agcacccgctcaaacctctttttctgtcgaccctg

SEQ ID NO: 125861 - DNA, 35 bp, Artificial Sequence
  Synthetic oligonucleotide
ccacccgccacccgaatttgcaccattcccgcctg

SEQ ID NO: 125862 - DNA, 35 bp, Artificial Sequence
  Synthetic oligonucleotide
tccgggccctacgctgcgcactccactcgtcccct

SEQ ID NO: 125863 - DNA, 35 bp, Artificial Sequence
  Synthetic oligonucleotide
tactcgcgttaccatggcatactccgtcgctcgct

SEQ ID NO: 125864 - DNA, 36 bp, Artificial Sequence
  Synthetic oligonucleotide
tacccctgctcccaatgcgcctaccaggctacccaa

SEQ ID NO: 125865 - DNA, 37 bp, Artificial Sequence
  Synthetic oligonucleotide
attgggaggaagggtgggaggaacggaggggtagaga

SEQ ID NO: 125866 - DNA, 37 bp, Artificial Sequence
  Synthetic oligonucleotide
taggtcgggtgggagggagtggagggcttcatgacga

SEQ ID NO: 125867 - DNA, 34 bp, Artificial Sequence
  Synthetic oligonucleotide
ttccacatcccctgacgctactgaccgataccga

SEQ ID NO: 125868 - DNA, 37 bp, Artificial Sequence
  Synthetic oligonucleotide
agtccgccctaagttgcctcccgttacctgccatcga

SEQ ID NO: 125869 - DNA, 36 bp, Artificial Sequence
  Synthetic oligonucleotide
tcgatgccgtcacccttgtttccaccccttcagtga

SEQ ID NO: 125870 - DNA, 36 bp, Artificial Sequence
  Synthetic oligonucleotide
tcccccgcgcgctcgttcgctcttgccacctagtga

SEQ ID NO: 125871 - DNA, 35 bp, Artificial Sequence
  Synthetic oligonucleotide
acgcacacccggagcacaccggagcccccatcccc

SEQ ID NO: 125872 - DNA, 35 bp, Artificial Sequence
  Synthetic oligonucleotide
gccggttacatcctcactcgccgctgatactgtcc

SEQ ID NO: 125873 - DNA, 36 bp, Artificial Sequence
  Synthetic oligonucleotide
gcacccgccgcgcagcttctctccctccagcttggc

SEQ ID NO: 125874 - DNA, 27 bp, Artificial Sequence
  Synthetic oligonucleotide
tcagggtccagcctcactgccgccatc

SEQ ID NO: 125875 - DNA, 35 bp, Artificial Sequence
  Synthetic oligonucleotide
acccaccgggcatgcttgtgctgaccgccatactc

SEQ ID NO: 125876 - DNA, 35 bp, Artificial Sequence
  Synthetic oligonucleotide
aacgatgcgacccatccatttgctaactcctcgtc

SEQ ID NO: 125877 - DNA, 35 bp, Artificial Sequence
  Synthetic oligonucleotide
tcaaatgagcaggggttcgggcacggaggggaggg

SEQ ID NO: 125878 - DNA, 35 bp, Artificial Sequence
  Synthetic oligonucleotide
tccgaccgggagttgccctatcacccctacccttg

SEQ ID NO: 125879 - DNA, 35 bp, Artificial Sequence
  Synthetic oligonucleotide
acgcaccaaactcgcattggccctttgaacaccct

SEQ ID NO: 125880 - DNA, 35 bp, Artificial Sequence
  Synthetic oligonucleotide
gcccatccacgggtggctacccttcgttgtaccct

SEQ ID NO: 125881 - DNA, 35 bp, Artificial Sequence
  Synthetic oligonucleotide
aatgccgccccacaaggatatatcccgtcctgctt

SEQ ID NO: 125882 - DNA, 34 bp, Artificial Sequence
  Synthetic oligonucleotide
ggtaaggctcgagggggggtgcggggggaataga

SEQ ID NO: 125883 - DNA, 37 bp, Artificial Sequence
  Synthetic oligonucleotide
taccccgccgacgctttatacgccacccaacgctgga

SEQ ID NO: 125884 - DNA, 37 bp, Artificial Sequence
  Synthetic oligonucleotide
tacgcattcccttcgccttgacatccaccgtccctga

SEQ ID NO: 125885 - DNA, 36 bp, Artificial Sequence
  Synthetic oligonucleotide
gtcgacatccgtccccaccgcccttctctgtcgtga

SEQ ID NO: 125886 - DNA, 38 bp, Artificial Sequence
  Synthetic oligonucleotide
gagggagaggagagctggggataggggagcgagtgtga

SEQ ID NO: 125887 - DNA, 35 bp, Artificial Sequence
  Synthetic oligonucleotide
gtgccctctttaccatagttactgtcattccttgc

SEQ ID NO: 125888 - DNA, 35 bp, Artificial Sequence
  Synthetic oligonucleotide
gcccccactcgtcgtacccgcataaaacccagccg

SEQ ID NO: 125889 - DNA, 35 bp, Artificial Sequence
  Synthetic oligonucleotide
gtcacgcctcccatctagctcacgcagccgtatcg

SEQ ID NO: 125890 - DNA, 35 bp, Artificial Sequence
  Synthetic oligonucleotide
tgcacccgttcgcacgctttgatctcggttctact

SEQ ID NO: 125891 - DNA, 29 bp, Artificial Sequence
  Synthetic oligonucleotide
tgcaccccgccacttttccaagttcccct

SEQ ID NO: 125892 - DNA, 35 bp, Artificial Sequence
  Synthetic oligonucleotide
atcaaccccgccaaggagcctcccttcccaatgct

SEQ ID NO: 125893 - DNA, 36 bp, Artificial Sequence
  Synthetic oligonucleotide
gcacatagtgccccgcccgctcccctcccgcagtca

SEQ ID NO: 125894 - DNA, 35 bp, Artificial Sequence
  Synthetic oligonucleotide
actgcccccaccacctccgcctgttttcacgccta

SEQ ID NO: 125895 - DNA, 35 bp, Artificial Sequence
  Synthetic oligonucleotide
tacgaacgtaccgcgcaggcatcctctcctctcta

SEQ ID NO: 125896 - DNA, 36 bp, Artificial Sequence
  Synthetic oligonucleotide
gaacgtcaggtcatcccccagtgatccccctgccac

SEQ ID NO: 125897 - DNA, 35 bp, Artificial Sequence
  Synthetic oligonucleotide
gcgccccccatggcgctaatacccgtttacactac

SEQ ID NO: 125898 - DNA, 35 bp, Artificial Sequence
  Synthetic oligonucleotide
tccgcacgcatcgaagtgcactgtccgaccttacc

SEQ ID NO: 125899 - DNA, 35 bp, Artificial Sequence
  Synthetic oligonucleotide
gagatgcacctgaccgtttgttcttattttttctg

SEQ ID NO: 125900 - DNA, 35 bp, Artificial Sequence
  Synthetic oligonucleotide
atcacctcacatggttttgtctttcattgcccaat

SEQ ID NO: 125901 - DNA, 35 bp, Artificial Sequence
  Synthetic oligonucleotide
aagtggggggggcggggtaccggcacggcggaact

SEQ ID NO: 125902 - DNA, 35 bp, Artificial Sequence
  Synthetic oligonucleotide
tctgcctccgactcagcagcctacctcacaactct

SEQ ID NO: 125903 - DNA, 36 bp, Artificial Sequence
  Synthetic oligonucleotide
gacatgccgcagctcattgcccccacgccccatcaa

SEQ ID NO: 125904 - DNA, 38 bp, Artificial Sequence
  Synthetic oligonucleotide
gggggaggggttggggtggacggtcttacattcattga

SEQ ID NO: 125905 - DNA, 35 bp, Artificial Sequence
  Synthetic oligonucleotide
ttggggggggggcgggtagcacgagttggggccac

SEQ ID NO: 125906 - DNA, 35 bp, Artificial Sequence
  Synthetic oligonucleotide
tccatctctgcccacgctcgtgctatccagttacc

SEQ ID NO: 125907 - DNA, 35 bp, Artificial Sequence
  Synthetic oligonucleotide
gatgccgatacccgccgcccgagtacttccactgc

SEQ ID NO: 125908 - DNA, 35 bp, Artificial Sequence
  Synthetic oligonucleotide
ttcgggggaggggggggacgcagaaacgcaagcag

SEQ ID NO: 125909 - DNA, 35 bp, Artificial Sequence
  Synthetic oligonucleotide
gtcaaggctaggggagggcactgtaggtggggggg

SEQ ID NO: 125910 - DNA, 35 bp, Artificial Sequence
  Synthetic oligonucleotide
tccgcttggttcctctgggtctcgcatctccctct

SEQ ID NO: 125911 - DNA, 35 bp, Artificial Sequence
  Synthetic oligonucleotide
acacgggggtgaggactggaggaaggacgggcagt

SEQ ID NO: 125912 - DNA, 35 bp, Artificial Sequence
  Synthetic oligonucleotide
tccttccggccccttccactccgctgcatggcttt

SEQ ID NO: 125913 - DNA, 35 bp, Artificial Sequence
  Synthetic oligonucleotide
gaggagtgaggagggctacatggacacgggtgaaa

SEQ ID NO: 125914 - DNA, 35 bp, Artificial Sequence
  Synthetic oligonucleotide
atccgcgagcctctcacgttcccccccggcctcaa

SEQ ID NO: 125915 - DNA, 37 bp, Artificial Sequence
  Synthetic oligonucleotide
gcaccatcctgcctgtctcgcttgccctcgttgggga

SEQ ID NO: 125916 - DNA, 35 bp, Artificial Sequence
  Synthetic oligonucleotide
tctccccccaatcagtccgcctgctgtccaggccc

SEQ ID NO: 125917 - DNA, 35 bp, Artificial Sequence
  Synthetic oligonucleotide
gaaggagccggtttgtttgccgcctgtccctgccc

SEQ ID NO: 125918 - DNA, 35 bp, Artificial Sequence
  Synthetic oligonucleotide
gtatcagacgcctacttcgttaacacgtgcctccc

SEQ ID NO: 125919 - DNA, 35 bp, Artificial Sequence
  Synthetic oligonucleotide
gcgtgagggcgggagggacacaagggttacggtgc

SEQ ID NO: 125920 - DNA, 35 bp, Artificial Sequence
  Synthetic oligonucleotide
gctgtgcccttccgcccgctcgcgctaatcctccg

SEQ ID NO: 125921 - DNA, 35 bp, Artificial Sequence
  Synthetic oligonucleotide
gatcgtccacccgcccagccaccggttacagctcg

SEQ ID NO: 125922 - DNA, 35 bp, Artificial Sequence
  Synthetic oligonucleotide
tcgcatcgccgcaatccgtagtgtcactctctcct

SEQ ID NO: 125923 - DNA, 35 bp, Artificial Sequence
  Synthetic oligonucleotide
gacacgcacttgttatatcagttttccctccttct

SEQ ID NO: 125924 - DNA, 35 bp, Artificial Sequence
  Synthetic oligonucleotide
atgtagggggggcaaagggagcacgggccagtggt

SEQ ID NO: 125925 - DNA, 35 bp, Artificial Sequence
  Synthetic oligonucleotide
atgcgaccgccaatgcccagtttccgtcttcttgt

SEQ ID NO: 125926 - DNA, 36 bp, Artificial Sequence
  Synthetic oligonucleotide
tgacaaccgctcccacccggcgtctattcgaacgaa

SEQ ID NO: 125927 - DNA, 36 bp, Artificial Sequence
  Synthetic oligonucleotide
gctcgcatgcactccgacgcttacctccccctgcca

SEQ ID NO: 125928 - DNA, 36 bp, Artificial Sequence
  Synthetic oligonucleotide
gacgcgtggcctctgtcttatcccccgcattgcgca

SEQ ID NO: 125929 - DNA, 37 bp, Artificial Sequence
  Synthetic oligonucleotide
agtggggcaggagggcggcgaaagcggaggtggtcga

SEQ ID NO: 125930 - DNA, 37 bp, Artificial Sequence
  Synthetic oligonucleotide
ggtgagaggggtacagggggtgcgtgattggggagga

SEQ ID NO: 125931 - DNA, 36 bp, Artificial Sequence
  Synthetic oligonucleotide
atcatagagcagcaggaggagggaaatggggtggta

SEQ ID NO: 125932 - DNA, 35 bp, Artificial Sequence
  Synthetic oligonucleotide
gataacgtcccgcgttccaccctcctcggttttgc

SEQ ID NO: 125933 - DNA, 35 bp, Artificial Sequence
  Synthetic oligonucleotide
gatctaccccccggtctccatcgcgatgtatgtcg

SEQ ID NO: 125934 - DNA, 35 bp, Artificial Sequence
  Synthetic oligonucleotide
tcttgtccaccctcacacggttctcagcccttcgg

SEQ ID NO: 125935 - DNA, 35 bp, Artificial Sequence
  Synthetic oligonucleotide
tctggtcacgcgcatcctcatcctgtttttgtctg

SEQ ID NO: 125936 - DNA, 35 bp, Artificial Sequence
  Synthetic oligonucleotide
gtccaccctgacctgtatcaccccgccggtcccat

SEQ ID NO: 125937 - DNA, 34 bp, Artificial Sequence
  Synthetic oligonucleotide
tcgaacacctcgtcggttcatgccaccaccacgt

SEQ ID NO: 125938 - DNA, 37 bp, Artificial Sequence
  Synthetic oligonucleotide
ttcgggacaatgggggaagggcgggtggcgtaaggga

SEQ ID NO: 125939 - DNA, 36 bp, Artificial Sequence
  Synthetic oligonucleotide
gtcatttccggcccttgttacgccccgccccttgga

SEQ ID NO: 125940 - DNA, 36 bp, Artificial Sequence
  Synthetic oligonucleotide
tcccgccccctcctgctcatcggactaactcatata

SEQ ID NO: 125941 - DNA, 36 bp, Artificial Sequence
  Synthetic oligonucleotide
cccgcgcacacgctggtttccccggcccccttgcta

SEQ ID NO: 125942 - DNA, 35 bp, Artificial Sequence
  Synthetic oligonucleotide
ttgacctccaccacgatccgtccattcagcttagc

SEQ ID NO: 125943 - DNA, 35 bp, Artificial Sequence
  Synthetic oligonucleotide
tctagtccgctcccctgcccttggacactggtatc

SEQ ID NO: 125944 - DNA, 35 bp, Artificial Sequence
  Synthetic oligonucleotide
accgtacaacgccgcttccgacccatagctccctc

SEQ ID NO: 125945 - DNA, 35 bp, Artificial Sequence
  Synthetic oligonucleotide
tacccagtcccaacctccccgcactcttgccttgg

SEQ ID NO: 125946 - DNA, 35 bp, Artificial Sequence
  Synthetic oligonucleotide
gtctggtccgttccccagtcacaggtcctgttcct

SEQ ID NO: 125947 - DNA, 35 bp, Artificial Sequence
  Synthetic oligonucleotide
gcccccgccacgggtttccggtcacccttattgct

SEQ ID NO: 125948 - DNA, 35 bp, Artificial Sequence
  Synthetic oligonucleotide
tgcatgttgggaggggcgcgtatgtatggtggctt

SEQ ID NO: 125949 - DNA, 36 bp, Artificial Sequence
  Synthetic oligonucleotide
gtcacgcatccactcgccttcgtgccattataccca

SEQ ID NO: 125950 - DNA, 36 bp, Artificial Sequence
  Synthetic oligonucleotide
atcccacccgctgacctgtctctccagttacttcca

SEQ ID NO: 125951 - DNA, 36 bp, Artificial Sequence
  Synthetic oligonucleotide
gtgcgccctctatatctatgttaccgtgccccatca

SEQ ID NO: 125952 - DNA, 36 bp, Artificial Sequence
  Synthetic oligonucleotide
gtcccgaccgtcactatatctctatcgtccatttca

SEQ ID NO: 125953 - DNA, 37 bp, Artificial Sequence
  Synthetic oligonucleotide
gcatgggcgggggatgcgggcgggatgtacttccaga

SEQ ID NO: 125954 - DNA, 34 bp, Artificial Sequence
  Synthetic oligonucleotide
gcctcggtctgatgactttgcacccttcccccga

SEQ ID NO: 125955 - DNA, 35 bp, Artificial Sequence
  Synthetic oligonucleotide
ggggacggtcatggaacggtggcgggtgggttgga

SEQ ID NO: 125956 - DNA, 38 bp, Artificial Sequence
  Synthetic oligonucleotide
tcgcgggtcgttgttagcccctgccgcaccttccatga

SEQ ID NO: 125957 - DNA, 35 bp, Artificial Sequence
  Synthetic oligonucleotide
taagggaagggcggggggtgcgggtcgtatgaacc

SEQ ID NO: 125958 - DNA, 35 bp, Artificial Sequence
  Synthetic oligonucleotide
tttgccacccccattcctaagcgtatttttaccgc

SEQ ID NO: 125959 - DNA, 35 bp, Artificial Sequence
  Synthetic oligonucleotide
tacttcccagttgtcctttgcatgctgctcccgtc

SEQ ID NO: 125960 - DNA, 35 bp, Artificial Sequence
  Synthetic oligonucleotide
accttgtgcaccgcatgctccaccttcttctggtc

SEQ ID NO: 125961 - DNA, 36 bp, Artificial Sequence
  Synthetic oligonucleotide
tcatcctccgactgtccgctgctatcttccgcttcg

SEQ ID NO: 125962 - DNA, 35 bp, Artificial Sequence
  Synthetic oligonucleotide
gaccccgccccttccgtcccgcttggttgttcatg

SEQ ID NO: 125963 - DNA, 35 bp, Artificial Sequence
  Synthetic oligonucleotide
gactcgttgttctgttattgctccccatcccatct

SEQ ID NO: 125964 - DNA, 35 bp, Artificial Sequence
  Synthetic oligonucleotide
atctgctacgatgcggcacaacttgcatctcctct

SEQ ID NO: 125965 - DNA, 35 bp, Artificial Sequence
  Synthetic oligonucleotide
tccatccgcactgcatgagcccacccatcaccatt

SEQ ID NO: 125966 - DNA, 36 bp, Artificial Sequence
  Synthetic oligonucleotide
gaaccaccacgcatgtgcacgctccgctcctttaaa

SEQ ID NO: 125967 - DNA, 36 bp, Artificial Sequence
  Synthetic oligonucleotide
gaagggaggggaaggaacgcaatagccgagggtgaa

SEQ ID NO: 125968 - DNA, 35 bp, Artificial Sequence
  Synthetic oligonucleotide
tgagtcagttcgcgcctcctgtctccccttatgca

SEQ ID NO: 125969 - DNA, 37 bp, Artificial Sequence
  Synthetic oligonucleotide
gccctgcgccgaccgcggatcctcactgctctaccga

SEQ ID NO: 125970 - DNA, 36 bp, Artificial Sequence
  Synthetic oligonucleotide
tcgacgcctcgcgcctcccgttaaagccgctcccta

SEQ ID NO: 125971 - DNA, 35 bp, Artificial Sequence
  Synthetic oligonucleotide
aggaacgtcgctgcctttcacgcctcccctcgcgc

SEQ ID NO: 125972 - DNA, 35 bp, Artificial Sequence
  Synthetic oligonucleotide
tccactccgtcccacctataggcttcccgccaggc

SEQ ID NO: 125973 - DNA, 35 bp, Artificial Sequence
  Synthetic oligonucleotide
tgttgccacccggtctgagcgagtcttccatcctc

SEQ ID NO: 125974 - DNA, 35 bp, Artificial Sequence
  Synthetic oligonucleotide
tcaatcgatgtcgtgccgctgtagcattacctcct

SEQ ID NO: 125975 - DNA, 35 bp, Artificial Sequence
  Synthetic oligonucleotide
taataccaccgggagcgcctcccccgccctgtcct

SEQ ID NO: 125976 - DNA, 35 bp, Artificial Sequence
  Synthetic oligonucleotide
gacacgccacagctagtgccggtgtcgttccttct

SEQ ID NO: 125977 - DNA, 35 bp, Artificial Sequence
  Synthetic oligonucleotide
tctagcgaccgctcgtttccctacctcacctttct

SEQ ID NO: 125978 - DNA, 35 bp, Artificial Sequence
  Synthetic oligonucleotide
gcaacagcgcgccgtatcgctccatccttacttgt

SEQ ID NO: 125979 - DNA, 35 bp, Artificial Sequence
  Synthetic oligonucleotide
tctctcgccctcgatattcctcgaccgcacacttt

SEQ ID NO: 125980 - DNA, 36 bp, Artificial Sequence
  Synthetic oligonucleotide
gcatgtcgcatttcgtgattctcccctgccttgtaa

SEQ ID NO: 125981 - DNA, 34 bp, Artificial Sequence
  Synthetic oligonucleotide
gtccacgcctcctacataatttcgctcccttgca

SEQ ID NO: 125982 - DNA, 37 bp, Artificial Sequence
  Synthetic oligonucleotide
tggacgggggaaggacatgggaagaatcggaaagaga

SEQ ID NO: 125983 - DNA, 35 bp, Artificial Sequence
  Synthetic oligonucleotide
agaaccggtggcggtggggggggaggaagttggga

SEQ ID NO: 125984 - DNA, 37 bp, Artificial Sequence
  Synthetic oligonucleotide
gttacgtccaaacgcttcccgtacactcccctcgtga

SEQ ID NO: 125985 - DNA, 36 bp, Artificial Sequence
  Synthetic oligonucleotide
tgactctccgctgtactacttacgcagcccccttga

SEQ ID NO: 125986 - DNA, 37 bp, Artificial Sequence
  Synthetic oligonucleotide
gacgtggctcctgcacatcgtatcatactctccttga

SEQ ID NO: 125987 - DNA, 38 bp, Artificial Sequence
  Synthetic oligonucleotide
agtgggaggggaacggagaggaatgatagtgcggttga

SEQ ID NO: 125988 - DNA, 35 bp, Artificial Sequence
  Synthetic oligonucleotide
atcccgtgccctcacatttctctttacgagcactc

SEQ ID NO: 125989 - DNA, 32 bp, Artificial Sequence
  Synthetic oligonucleotide
agagcctaccatcacttccgacacaccctccg

SEQ ID NO: 125990 - DNA, 35 bp, Artificial Sequence
  Synthetic oligonucleotide
gattcgtctgccattgtacccgtccccgcttcgct

SEQ ID NO: 125991 - DNA, 35 bp, Artificial Sequence
  Synthetic oligonucleotide
aagcgcgagcaggtgatcatccgttccgcccctgt

SEQ ID NO: 125992 - DNA, 36 bp, Artificial Sequence
  Synthetic oligonucleotide
ttcaccatccgattatgtcttttagcatccctctaa

SEQ ID NO: 125993 - DNA, 35 bp, Artificial Sequence
  Synthetic oligonucleotide
ggtgtgagacgagggatggagtgggaatggcgtaa

SEQ ID NO: 125994 - DNA, 37 bp, Artificial Sequence
  Synthetic oligonucleotide
atggagtcgaggggaacggaaaaaggacggaggagga

SEQ ID NO: 125995 - DNA, 38 bp, Artificial Sequence
  Synthetic oligonucleotide
gcaggaaggagaaggaggagctaggggtgacaatgtga

SEQ ID NO: 125996 - DNA, 37 bp, Artificial Sequence
  Synthetic oligonucleotide
gcccgcactccatgccccgccggttctcattccttga

SEQ ID NO: 125997 - DNA, 35 bp, Artificial Sequence
  Synthetic oligonucleotide
tacaggtggggagggagggagagttgttgcgggta

SEQ ID NO: 125998 - DNA, 35 bp, Artificial Sequence
  Synthetic oligonucleotide
tgtcgcaatcctcgactcaccttgccgcctgttac

SEQ ID NO: 125999 - DNA, 35 bp, Artificial Sequence
  Synthetic oligonucleotide
gctccaatcgcacctgtttcacacgttacacaatc

SEQ ID NO: 126000 - DNA, 35 bp, Artificial Sequence
  Synthetic oligonucleotide
accccgccgtaaacgatctcactagtcacattctc

SEQ ID NO: 126001 - DNA, 35 bp, Artificial Sequence
  Synthetic oligonucleotide
tccagcccactcgccccatccgcccagctaaccag

SEQ ID NO: 126002 - DNA, 35 bp, Artificial Sequence
  Synthetic oligonucleotide
gaccacccaccactaagccttttggaacagcttcg

SEQ ID NO: 126003 - DNA, 35 bp, Artificial Sequence
  Synthetic oligonucleotide
gtgtgagggacgtgggggaaggtagcggttacggg

SEQ ID NO: 126004 - DNA, 35 bp, Artificial Sequence
  Synthetic oligonucleotide
ggagaggggttaagggggaactataagcgaggggg

SEQ ID NO: 126005 - DNA, 35 bp, Artificial Sequence
  Synthetic oligonucleotide
taccgatggacgaggagaggtggtgaggggaagtg

SEQ ID NO: 126006 - DNA, 35 bp, Artificial Sequence
  Synthetic oligonucleotide
atcgacgctgtcggcccctactcgtcctgcatact

SEQ ID NO: 126007 - DNA, 35 bp, Artificial Sequence
  Synthetic oligonucleotide
agttgtgcctgcctctctctgtcaccgccaccatt

SEQ ID NO: 126008 - DNA, 36 bp, Artificial Sequence
  Synthetic oligonucleotide
gcactccctcaccgccccgcccccagcttggttcca

SEQ ID NO: 126009 - DNA, 36 bp, Artificial Sequence
  Synthetic oligonucleotide
acgcacactcccctccttgttttgtgcaatttttca

SEQ ID NO: 126010 - DNA, 38 bp, Artificial Sequence
  Synthetic oligonucleotide
atggccacatccatgcattgtccttcgacccaccctga

SEQ ID NO: 126011 - DNA, 38 bp, Artificial Sequence
  Synthetic oligonucleotide
ggaatggcctctttgcgtctcacacactccctcgctga

SEQ ID NO: 126012 - DNA, 35 bp, Artificial Sequence
  Synthetic oligonucleotide
gtagcacgagcacatctatcgcgccattcctgtac

SEQ ID NO: 126013 - DNA, 35 bp, Artificial Sequence
  Synthetic oligonucleotide
tttccgcaactcaggttcccgctcatgcccgccgc

SEQ ID NO: 126014 - DNA, 35 bp, Artificial Sequence
  Synthetic oligonucleotide
agttacgccccacacactcgacctgctttcacatc

SEQ ID NO: 126015 - DNA, 35 bp, Artificial Sequence
  Synthetic oligonucleotide
gcaacatccacccggctgtgcttatccatgtcact

SEQ ID NO: 126016 - DNA, 35 bp, Artificial Sequence
  Synthetic oligonucleotide
atgacctccctgacttgctttgatctgaattttct

SEQ ID NO: 126017 - DNA, 36 bp, Artificial Sequence
  Synthetic oligonucleotide
atcagtgggacgccctccgcctcctcaaacacccca

SEQ ID NO: 126018 - DNA, 35 bp, Artificial Sequence
  Synthetic oligonucleotide
tgccgcactccagccacattagcacctcatcgcca

SEQ ID NO: 126019 - DNA, 36 bp, Artificial Sequence
  Synthetic oligonucleotide
tcacaacgcccgccgctttagtatcctgtccacgca

SEQ ID NO: 126020 - DNA, 36 bp, Artificial Sequence
  Synthetic oligonucleotide
gttccctgcctcgccatcgtgtcacattcccgcgca

SEQ ID NO: 126021 - DNA, 37 bp, Artificial Sequence
  Synthetic oligonucleotide
gtcgcgtgagggggagaacggagaagagagggaacga

SEQ ID NO: 126022 - DNA, 36 bp, Artificial Sequence
  Synthetic oligonucleotide
ggcaatccgggaaggttggtggggttagggatggga

SEQ ID NO: 126023 - DNA, 38 bp, Artificial Sequence
  Synthetic oligonucleotide
ggagagggtggtaggaggggaccggggcgggggaatga

SEQ ID NO: 126024 - DNA, 38 bp, Artificial Sequence
  Synthetic oligonucleotide
gttgcccgccagtcagtagatccgcccttccgtcatga

SEQ ID NO: 126025 - DNA, 38 bp, Artificial Sequence
  Synthetic oligonucleotide
ggtggagacgggaaggcagggggactaggatagggtga

SEQ ID NO: 126026 - DNA, 35 bp, Artificial Sequence
  Synthetic oligonucleotide
atccgtgtgcctatccgtttgctttttcgttctcc

SEQ ID NO: 126027 - DNA, 35 bp, Artificial Sequence
  Synthetic oligonucleotide
gcctgtgtccgttgccccgtaatcctttctgtctc

SEQ ID NO: 126028 - DNA, 35 bp, Artificial Sequence
  Synthetic oligonucleotide
gggatagccggtaggggggaggaggggggtcgccg

SEQ ID NO: 126029 - DNA, 35 bp, Artificial Sequence
  Synthetic oligonucleotide
aaccgcccctattccctcaagtgcctacgaatccg

SEQ ID NO: 126030 - DNA, 35 bp, Artificial Sequence
  Synthetic oligonucleotide
tgcccctcgccgctggttttgatcgccccccgctg

SEQ ID NO: 126031 - DNA, 36 bp, Artificial Sequence
  Synthetic oligonucleotide
accttgtaccgtcccatttgactcatcgaccctact

SEQ ID NO: 126032 - DNA, 35 bp, Artificial Sequence
  Synthetic oligonucleotide
gtcatcccatcacgcgcaataaagccttggcacct

SEQ ID NO: 126033 - DNA, 35 bp, Artificial Sequence
  Synthetic oligonucleotide
ttagcccctctctactcgactgcctccctccggct

SEQ ID NO: 126034 - DNA, 35 bp, Artificial Sequence
  Synthetic oligonucleotide
actgctggccctcaggtctcactctgtcccgctct

SEQ ID NO: 126035 - DNA, 35 bp, Artificial Sequence
  Synthetic oligonucleotide
gcaacgccgctgagatctattactgccacctctct

SEQ ID NO: 126036 - DNA, 36 bp, Artificial Sequence
  Synthetic oligonucleotide
tgtggcggctccatcgccttgttgccctcgtcctca

SEQ ID NO: 126037 - DNA, 37 bp, Artificial Sequence
  Synthetic oligonucleotide
tgacagacctcctgcgcatcatactctcttccgacga

SEQ ID NO: 126038 - DNA, 37 bp, Artificial Sequence
  Synthetic oligonucleotide
gcctaccgtgccaccccgcccaagcctctcgcttcga

SEQ ID NO: 126039 - DNA, 38 bp, Artificial Sequence
  Synthetic oligonucleotide
tacgaaggagggggcaagggggtagaaaagcagggtga

SEQ ID NO: 126040 - DNA, 35 bp, Artificial Sequence
  Synthetic oligonucleotide
tcacgagggacgtaccgagccatatcctcttccac

SEQ ID NO: 126041 - DNA, 35 bp, Artificial Sequence
  Synthetic oligonucleotide
atgcggcgcctgtcccatctttgcgcggtgccccc

SEQ ID NO: 126042 - DNA, 35 bp, Artificial Sequence
  Synthetic oligonucleotide
gattaccgaccgtccagccgtaccgctcgccccgc

SEQ ID NO: 126043 - DNA, 35 bp, Artificial Sequence
  Synthetic oligonucleotide
gacagttcatctgtcatttaacaccctggcctttc

SEQ ID NO: 126044 - DNA, 35 bp, Artificial Sequence
  Synthetic oligonucleotide
gtccacacggtcctgttatcatccatcacttacat

SEQ ID NO: 126045 - DNA, 35 bp, Artificial Sequence
  Synthetic oligonucleotide
tttgtctcgccccatcgtttcggccatcccataaa

SEQ ID NO: 126046 - DNA, 36 bp, Artificial Sequence
  Synthetic oligonucleotide
gtacactcccctcaatgatgccgccccacgagtcca

SEQ ID NO: 126047 - DNA, 37 bp, Artificial Sequence
  Synthetic oligonucleotide
gcccattcccctgtgtccccctccgccacaccatgga

SEQ ID NO: 126048 - DNA, 36 bp, Artificial Sequence
  Synthetic oligonucleotide
gcacctcgctccgtgaccgcattctgtaacatccta

SEQ ID NO: 126049 - DNA, 35 bp, Artificial Sequence
  Synthetic oligonucleotide
tgctccaccggcgtaccgttcttgacctaccctta

SEQ ID NO: 126050 - DNA, 36 bp, Artificial Sequence
  Synthetic oligonucleotide
tcgatccccgcaccttacggtacttacaccaggtta

SEQ ID NO: 126051 - DNA, 35 bp, Artificial Sequence
  Synthetic oligonucleotide
aaaccaggcgcctcgctgtcccttattcatagccc

SEQ ID NO: 126052 - DNA, 35 bp, Artificial Sequence
  Synthetic oligonucleotide
gatgcgcgagtgtcctagcctgcccccttacgccc

SEQ ID NO: 126053 - DNA, 35 bp, Artificial Sequence
  Synthetic oligonucleotide
gggtcccgcccgacccctttttacacccagtactc

SEQ ID NO: 126054 - DNA, 35 bp, Artificial Sequence
  Synthetic oligonucleotide
acaccagtcctccacgaaatatcgttatgctcctc

SEQ ID NO: 126055 - DNA, 35 bp, Artificial Sequence
  Synthetic oligonucleotide
ttgcgcccaaacgacgccaccttttcccttcgaag

SEQ ID NO: 126056 - DNA, 35 bp, Artificial Sequence
  Synthetic oligonucleotide
gctaacccgccccttatgtcctgatgacttgccct

SEQ ID NO: 126057 - DNA, 36 bp, Artificial Sequence
  Synthetic oligonucleotide
acaacagggcggagcgtgggatagggaacaatgtaa

SEQ ID NO: 126058 - DNA, 35 bp, Artificial Sequence
  Synthetic oligonucleotide
tacacctcagacccaccgaccgctcacttcctcca

SEQ ID NO: 126059 - DNA, 37 bp, Artificial Sequence
  Synthetic oligonucleotide
gtagggtagggtgggaggggatagagcttggaataga

SEQ ID NO: 126060 - DNA, 37 bp, Artificial Sequence
  Synthetic oligonucleotide
gcccaccctcacactctcctagggattgctccctaga

SEQ ID NO: 126061 - DNA, 37 bp, Artificial Sequence
  Synthetic oligonucleotide
gggacgccgcacctggtacaccccttctacgcttcga

SEQ ID NO: 126062 - DNA, 38 bp, Artificial Sequence
  Synthetic oligonucleotide
ggtcgccgtgaggtcccctgataatcctgcccttttga

SEQ ID NO: 126063 - DNA, 35 bp, Artificial Sequence
  Synthetic oligonucleotide
gtgttccgcctacgcttccatgcctcagttccaac

SEQ ID NO: 126064 - DNA, 35 bp, Artificial Sequence
  Synthetic oligonucleotide
acgataaccaccctgtacttgatgctttgctacac

SEQ ID NO: 126065 - DNA, 35 bp, Artificial Sequence
  Synthetic oligonucleotide
gtgcacatcctccattcatcgctcgaccgtggtac

SEQ ID NO: 126066 - DNA, 35 bp, Artificial Sequence
  Synthetic oligonucleotide
accactcaccccctcgtttatcgtgtcgcggtacc

SEQ ID NO: 126067 - DNA, 35 bp, Artificial Sequence
  Synthetic oligonucleotide
ggatgaccccaccccccactgcgcgctggcccccc

SEQ ID NO: 126068 - DNA, 35 bp, Artificial Sequence
  Synthetic oligonucleotide
gttcgcatacagcctcacgaccaattggctccccc

SEQ ID NO: 126069 - DNA, 35 bp, Artificial Sequence
  Synthetic oligonucleotide
tgcattgatcttcgcccggacccctgcaccgctcc

SEQ ID NO: 126070 - DNA, 35 bp, Artificial Sequence
  Synthetic oligonucleotide
atttccgccccgtgagcgctcgctttatctgttcc

SEQ ID NO: 126071 - DNA, 35 bp, Artificial Sequence
  Synthetic oligonucleotide
agacccttgcgcatgttcctgttcttgcctctatc

SEQ ID NO: 126072 - DNA, 35 bp, Artificial Sequence
  Synthetic oligonucleotide
atccccacgcagttcatggtcttaccgccccaccg

SEQ ID NO: 126073 - DNA, 35 bp, Artificial Sequence
  Synthetic oligonucleotide
tctgaggcgattcagcctcactcgtgacccccccg

SEQ ID NO: 126074 - DNA, 35 bp, Artificial Sequence
  Synthetic oligonucleotide
acattccgccttcacgaggttcctataatcctccg

SEQ ID NO: 126075 - DNA, 35 bp, Artificial Sequence
  Synthetic oligonucleotide
tcgcgcgcccattctttgtgctccttccctacctg

SEQ ID NO: 126076 - DNA, 35 bp, Artificial Sequence
  Synthetic oligonucleotide
ggacagtgcaagtgaataacccccccgtgtcccct

SEQ ID NO: 126077 - DNA, 35 bp, Artificial Sequence
  Synthetic oligonucleotide
gtggagccatactcgcactgtactgtcaccgccct

SEQ ID NO: 126078 - DNA, 35 bp, Artificial Sequence
  Synthetic oligonucleotide
gctccgccatctcccacacgcctaccgtccacgct

SEQ ID NO: 126079 - DNA, 35 bp, Artificial Sequence
  Synthetic oligonucleotide
taacggaggcggaggggctggctataggtgggagt

SEQ ID NO: 126080 - DNA, 34 bp, Artificial Sequence
  Synthetic oligonucleotide
tccttacacctcaccttgtgcccccattgtagtt

SEQ ID NO: 126081 - DNA, 35 bp, Artificial Sequence
  Synthetic oligonucleotide
gccctcgcctccctttggtcacgccttctttagaa

SEQ ID NO: 126082 - DNA, 35 bp, Artificial Sequence
  Synthetic oligonucleotide
acgcacgcccgtcctagctgatcctctttccacca

SEQ ID NO: 126083 - DNA, 37 bp, Artificial Sequence
  Synthetic oligonucleotide
accccacacattgggtcatccctgtttcttcccacga

SEQ ID NO: 126084 - DNA, 35 bp, Artificial Sequence
  Synthetic oligonucleotide
tcacactcgccgccacgtaaacatccggtacacta

SEQ ID NO: 126085 - DNA, 35 bp, Artificial Sequence
  Synthetic oligonucleotide
aggatcatcccccgcctgtaatctcgttcgccacg

SEQ ID NO: 126086 - DNA, 35 bp, Artificial Sequence
  Synthetic oligonucleotide
acacccgacctttcgctgaattatgatcaacctat

SEQ ID NO: 126087 - DNA, 36 bp, Artificial Sequence
  Synthetic oligonucleotide
gaaatgacgggatagggtgggaggagtaacgggtaa

SEQ ID NO: 126088 - DNA, 36 bp, Artificial Sequence
  Synthetic oligonucleotide
acatccgcctccacatgggtatttacctctcctcga

SEQ ID NO: 126089 - DNA, 37 bp, Artificial Sequence
  Synthetic oligonucleotide
gagagaacgaaatgggtggagcagggagcgcgtctga

SEQ ID NO: 126090 - DNA, 36 bp, Artificial Sequence
  Synthetic oligonucleotide
aacaacgctccaccaacggcacctcgcctatttgta

SEQ ID NO: 126091 - DNA, 35 bp, Artificial Sequence
  Synthetic oligonucleotide
gcaacctgctcccacttggctcttgatacgttacc

SEQ ID NO: 126092 - DNA, 35 bp, Artificial Sequence
  Synthetic oligonucleotide
aaccccaccgcctaggtctccccctaacacggggc

SEQ ID NO: 126093 - DNA, 35 bp, Artificial Sequence
  Synthetic oligonucleotide
attcgtgcccgcacttgcctcccccggtatggttc

SEQ ID NO: 126094 - DNA, 35 bp, Artificial Sequence
  Synthetic oligonucleotide
gccctttgtctacccccgtatcgcccccccgctgg

SEQ ID NO: 126095 - DNA, 35 bp, Artificial Sequence
  Synthetic oligonucleotide
gacaatctgcacatctgtcctcccaactgattcct

SEQ ID NO: 126096 - DNA, 35 bp, Artificial Sequence
  Synthetic oligonucleotide
gcgctctccgcgtcgacgtttctccactgcccctt

SEQ ID NO: 126097 - DNA, 35 bp, Artificial Sequence
  Synthetic oligonucleotide
ttacggggccgaacggaggagagggggatgagcca

SEQ ID NO: 126098 - DNA, 37 bp, Artificial Sequence
  Synthetic oligonucleotide
cagttgaccccgccatccgctccatgcgctaccccga

SEQ ID NO: 126099 - DNA, 37 bp, Artificial Sequence
  Synthetic oligonucleotide
agaccccaccacacgtacctacctcgcgttcccccga

SEQ ID NO: 126100 - DNA, 37 bp, Artificial Sequence
  Synthetic oligonucleotide
ggggaccaggtgggggtggcccctacatcggtgggga

SEQ ID NO: 126101 - DNA, 38 bp, Artificial Sequence
  Synthetic oligonucleotide
tcttgggggtgggcgggcacaggaggggatgtccttga

SEQ ID NO: 126102 - DNA, 35 bp, Artificial Sequence
  Synthetic oligonucleotide
acccctccatgcctcgagttgtgcatcgcaccacc

SEQ ID NO: 126103 - DNA, 34 bp, Artificial Sequence
  Synthetic oligonucleotide
tgccttggtcagatactcactgtcctcgttcgcc

SEQ ID NO: 126104 - DNA, 35 bp, Artificial Sequence
  Synthetic oligonucleotide
tcctgcggccccttgaacgtctttttgctcgctgc

SEQ ID NO: 126105 - DNA, 35 bp, Artificial Sequence
  Synthetic oligonucleotide
tcgttctgccgcactcgcctgccatccctgaaatc

SEQ ID NO: 126106 - DNA, 35 bp, Artificial Sequence
  Synthetic oligonucleotide
gagctgcccccgtgccccgctgagccttctaagtc

SEQ ID NO: 126107 - DNA, 35 bp, Artificial Sequence
  Synthetic oligonucleotide
gacgctcgctacacgttccttcttgccacccagtc

SEQ ID NO: 126108 - DNA, 35 bp, Artificial Sequence
  Synthetic oligonucleotide
gtattctcccgcccatacgcgccacttcctccgtc

SEQ ID NO: 126109 - DNA, 35 bp, Artificial Sequence
  Synthetic oligonucleotide
acctccctcccctcatagtcgtaacgtacccactg

SEQ ID NO: 126110 - DNA, 35 bp, Artificial Sequence
  Synthetic oligonucleotide
gacgggccagaaagcgtttgcaaccgtccttccct

SEQ ID NO: 126111 - DNA, 35 bp, Artificial Sequence
  Synthetic oligonucleotide
gcataacgcccgctacaccttccctacacgtgcct

SEQ ID NO: 126112 - DNA, 35 bp, Artificial Sequence
  Synthetic oligonucleotide
accccccccccggcatctgcccttggcccgccgct

SEQ ID NO: 126113 - DNA, 35 bp, Artificial Sequence
  Synthetic oligonucleotide
gcacaggctggtcctggctcactttacacctctct

SEQ ID NO: 126114 - DNA, 36 bp, Artificial Sequence
  Synthetic oligonucleotide
gagcatccgccctacttagcttcactgttcgtccca

SEQ ID NO: 126115 - DNA, 37 bp, Artificial Sequence
  Synthetic oligonucleotide
gttcctggcggggttgtttggggtgtcgctctgggga

SEQ ID NO: 126116 - DNA, 38 bp, Artificial Sequence
  Synthetic oligonucleotide
gaggaggggtggcgggggaaacagagaggcacgtgtga

SEQ ID NO: 126117 - DNA, 36 bp, Artificial Sequence
  Synthetic oligonucleotide
acacggggcgggggattgagttgtcgggtggggtta

SEQ ID NO: 126118 - DNA, 35 bp, Artificial Sequence
  Synthetic oligonucleotide
agtccccaccatcacttcagcgtgcctgcattcac

SEQ ID NO: 126119 - DNA, 35 bp, Artificial Sequence
  Synthetic oligonucleotide
gacacaacaggtactgatcacccaccccccgcgac

SEQ ID NO: 126120 - DNA, 35 bp, Artificial Sequence
  Synthetic oligonucleotide
tgcaaactgcctacgcaaactacaccgggctcccc

SEQ ID NO: 126121 - DNA, 35 bp, Artificial Sequence
  Synthetic oligonucleotide
tacagcccgctatccgttacagacgcccactatcc

SEQ ID NO: 126122 - DNA, 35 bp, Artificial Sequence
  Synthetic oligonucleotide
tttcgagcacctggcacatccaaccgccgtcccgc

SEQ ID NO: 126123 - DNA, 35 bp, Artificial Sequence
  Synthetic oligonucleotide
tccaccacttctgggcgttaccctttagggcttgc

SEQ ID NO: 126124 - DNA, 35 bp, Artificial Sequence
  Synthetic oligonucleotide
tgcccctagaatgcgctaacacacacactaccatc

SEQ ID NO: 126125 - DNA, 36 bp, Artificial Sequence
  Synthetic oligonucleotide
ggagcacatctgcgttcctgtctgcaacctggcctc

SEQ ID NO: 126126 - DNA, 35 bp, Artificial Sequence
  Synthetic oligonucleotide
gccactgcccactcgctaccctcttctcccagacg

SEQ ID NO: 126127 - DNA, 35 bp, Artificial Sequence
  Synthetic oligonucleotide
acacgccctctttaaacgccacgtccgtacccgcg

SEQ ID NO: 126128 - DNA, 35 bp, Artificial Sequence
  Synthetic oligonucleotide
acctcagtcccgccgttcctagtaatccaacttcg

SEQ ID NO: 126129 - DNA, 35 bp, Artificial Sequence
  Synthetic oligonucleotide
gccccctgacgttctatcacttgtccccagcatgg

SEQ ID NO: 126130 - DNA, 35 bp, Artificial Sequence
  Synthetic oligonucleotide
gatcccccgccatttggcatcgagccttcttccct

SEQ ID NO: 126131 - DNA, 35 bp, Artificial Sequence
  Synthetic oligonucleotide
atgctcccccgtgccccctttccacttgtgacggt

SEQ ID NO: 126132 - DNA, 35 bp, Artificial Sequence
  Synthetic oligonucleotide
agacacgctcaatctcctcctccgcctgtcgcgaa

SEQ ID NO: 126133 - DNA, 36 bp, Artificial Sequence
  Synthetic oligonucleotide
gattgggtgggtaggagggcatgggcgattatggca

SEQ ID NO: 126134 - DNA, 35 bp, Artificial Sequence
  Synthetic oligonucleotide
gatcgaccgtccctccgcccctcctgctagctaga

SEQ ID NO: 126135 - DNA, 38 bp, Artificial Sequence
  Synthetic oligonucleotide
gtcgccgccccaacattatcgccccgcacaccacgtga

SEQ ID NO: 126136 - DNA, 38 bp, Artificial Sequence
  Synthetic oligonucleotide
gcacgccgcatccaattaggcccctcgtccacacttga

SEQ ID NO: 126137 - DNA, 35 bp, Artificial Sequence
  Synthetic oligonucleotide
tcctgtctcccatacccggtccttcttcccgcgta

SEQ ID NO: 126138 - DNA, 36 bp, Artificial Sequence
  Synthetic oligonucleotide
tggaggattggcggggaggggggcggacaagttgta

SEQ ID NO: 126139 - DNA, 35 bp, Artificial Sequence
  Synthetic oligonucleotide
aatgccacccgcctgcccttatcataacgctacac

SEQ ID NO: 126140 - DNA, 35 bp, Artificial Sequence
  Synthetic oligonucleotide
gccacgacgaaagtgcggctccttggtctcttcac

SEQ ID NO: 126141 - DNA, 35 bp, Artificial Sequence
  Synthetic oligonucleotide
atgctgaccgttgcctggttttcgcgcttcccacc

SEQ ID NO: 126142 - DNA, 35 bp, Artificial Sequence
  Synthetic oligonucleotide
tcagcaagcagcctattggtccctgtacatccgcc

SEQ ID NO: 126143 - DNA, 31 bp, Artificial Sequence
  Synthetic oligonucleotide
gtgcgcctagccaggcaccttgaacccttcc

SEQ ID NO: 126144 - DNA, 35 bp, Artificial Sequence
  Synthetic oligonucleotide
ccacaccatccgctttaaccacatcctcgccatgc

SEQ ID NO: 126145 - DNA, 32 bp, Artificial Sequence
  Synthetic oligonucleotide
tccccgaactaccaaatgtctatgacccgtgc

SEQ ID NO: 126146 - DNA, 35 bp, Artificial Sequence
  Synthetic oligonucleotide
acaccacccctagcaactgggtctctctcccgtgc

SEQ ID NO: 126147 - DNA, 35 bp, Artificial Sequence
  Synthetic oligonucleotide
tgttccgattccttggtctgcctcatgtctccatc

SEQ ID NO: 126148 - DNA, 35 bp, Artificial Sequence
  Synthetic oligonucleotide
gagtgccacgctgtgttcgccccctgttgctagtc

SEQ ID NO: 126149 - DNA, 35 bp, Artificial Sequence
  Synthetic oligonucleotide
gagcaaacgacggggggaacggatcacggggaggg

SEQ ID NO: 126150 - DNA, 35 bp, Artificial Sequence
  Synthetic oligonucleotide
gcacgactccctaaccggcctgtgacctgtaccat

SEQ ID NO: 126151 - DNA, 35 bp, Artificial Sequence
  Synthetic oligonucleotide
gccacagccatccgcgcacctcttgtctcatacct

SEQ ID NO: 126152 - DNA, 36 bp, Artificial Sequence
  Synthetic oligonucleotide
acttccgtcgcgatgctgttaactcccgccgccaca

SEQ ID NO: 126153 - DNA, 37 bp, Artificial Sequence
  Synthetic oligonucleotide
tgaacggggcgatacccactgcttagggcgggtggga

SEQ ID NO: 126154 - DNA, 36 bp, Artificial Sequence
  Synthetic oligonucleotide
gcgcccgctgcccagcccctgcacatctcctgttga

SEQ ID NO: 126155 - DNA, 35 bp, Artificial Sequence
  Synthetic oligonucleotide
tgtcaacgcgcccggctacctattctctcgtcccc

SEQ ID NO: 126156 - DNA, 35 bp, Artificial Sequence
  Synthetic oligonucleotide
gtgcgtgctgaccacgcggcttcccatttgccctc

SEQ ID NO: 126157 - DNA, 35 bp, Artificial Sequence
  Synthetic oligonucleotide
gccttcctcccactgtagtaactagctccttgccg

SEQ ID NO: 126158 - DNA, 35 bp, Artificial Sequence
  Synthetic oligonucleotide
gtgtgcctcattgaaccatccctctttacccacgt

SEQ ID NO: 126159 - DNA, 35 bp, Artificial Sequence
  Synthetic oligonucleotide
agacccccagccatatctaaacgcgcacctcctgt

SEQ ID NO: 126160 - DNA, 35 bp, Artificial Sequence
  Synthetic oligonucleotide
tccacaagcaggtcgccacccggtccacccacatt

SEQ ID NO: 126161 - DNA, 35 bp, Artificial Sequence
  Synthetic oligonucleotide
gaagggtgggagggccgatagggcaaattgacatt

SEQ ID NO: 126162 - DNA, 35 bp, Artificial Sequence
  Synthetic oligonucleotide
acctggtcggggcccccgatagctccttcgccctt

SEQ ID NO: 126163 - DNA, 35 bp, Artificial Sequence
  Synthetic oligonucleotide
tactgcgtgcacaccgtctgcgccccgtaccattt

SEQ ID NO: 126164 - DNA, 35 bp, Artificial Sequence
  Synthetic oligonucleotide
agtttgccgcctgccctctacgatcattattacca

SEQ ID NO: 126165 - DNA, 36 bp, Artificial Sequence
  Synthetic oligonucleotide
gagggggttttgctgggtgggcggggggagaactca

SEQ ID NO: 126166 - DNA, 37 bp, Artificial Sequence
  Synthetic oligonucleotide
acattgccactcgcatcctgtatcgttccgcctccga

SEQ ID NO: 126167 - DNA, 37 bp, Artificial Sequence
  Synthetic oligonucleotide
attgcaactgtgggaggagggggggatggcgggagga

SEQ ID NO: 126168 - DNA, 38 bp, Artificial Sequence
  Synthetic oligonucleotide
gcccactcctttcgtgtctgcaccacattccctgctga

SEQ ID NO: 126169 - DNA, 35 bp, Artificial Sequence
  Synthetic oligonucleotide
tccgccccgacatggcaacttgatcgcaaacctcc

SEQ ID NO: 126170 - DNA, 35 bp, Artificial Sequence
  Synthetic oligonucleotide
gggaggtgaggacggagggtgcgggggagtgtagc

SEQ ID NO: 126171 - DNA, 35 bp, Artificial Sequence
  Synthetic oligonucleotide
tagacctgtccggcgagtccgcactgcctcccctc

SEQ ID NO: 126172 - DNA, 35 bp, Artificial Sequence
  Synthetic oligonucleotide
tgccacccaccgctctctcattttaaatgccgctc

SEQ ID NO: 126173 - DNA, 35 bp, Artificial Sequence
  Synthetic oligonucleotide
agattacgccactgcttgatactttcccgttcccg

SEQ ID NO: 126174 - DNA, 35 bp, Artificial Sequence
  Synthetic oligonucleotide
gggggaggaccagggggtgagaaaaggcgagatgg

SEQ ID NO: 126175 - DNA, 35 bp, Artificial Sequence
  Synthetic oligonucleotide
gttaccaccgcgtattgcttatgaaccacccatct

SEQ ID NO: 126176 - DNA, 35 bp, Artificial Sequence
  Synthetic oligonucleotide
gctctggcccggcgcacgcttcgcctccgctccca

SEQ ID NO: 126177 - DNA, 35 bp, Artificial Sequence
  Synthetic oligonucleotide
taccagtaccatctgcacgaacaacgcttttctca

SEQ ID NO: 126178 - DNA, 37 bp, Artificial Sequence
  Synthetic oligonucleotide
acccacctccctcattgtagtcgctctcgtatcgcga

SEQ ID NO: 126179 - DNA, 35 bp, Artificial Sequence
  Synthetic oligonucleotide
accgccctcccgcttatcgtgctgtccaggatgga

SEQ ID NO: 126180 - DNA, 38 bp, Artificial Sequence
  Synthetic oligonucleotide
gagcgacgatcgtgaccatccgcccgcccctttcatga

SEQ ID NO: 126181 - DNA, 35 bp, Artificial Sequence
  Synthetic oligonucleotide
gggccgacctcatgcgcactgttgccctaccatcc

SEQ ID NO: 126182 - DNA, 35 bp, Artificial Sequence
  Synthetic oligonucleotide
gagtccgccttctgcccccgtgccaggttatgtcc

SEQ ID NO: 126183 - DNA, 34 bp, Artificial Sequence
  Synthetic oligonucleotide
tccctcctcgttcctttatggagccttatgttcc

SEQ ID NO: 126184 - DNA, 35 bp, Artificial Sequence
  Synthetic oligonucleotide
aacctcgccacacacgttgtatcctttcatcaatc

SEQ ID NO: 126185 - DNA, 35 bp, Artificial Sequence
  Synthetic oligonucleotide
gcacaccacctatccttccagccatcttgccaccg

SEQ ID NO: 126186 - DNA, 35 bp, Artificial Sequence
  Synthetic oligonucleotide
tgcactcgtccgaatcacatccttctcctggcccg

SEQ ID NO: 126187 - DNA, 35 bp, Artificial Sequence
  Synthetic oligonucleotide
acccagttctgcaccacccccgtacgcttagagcg

SEQ ID NO: 126188 - DNA, 35 bp, Artificial Sequence
  Synthetic oligonucleotide
aaagaccatcgcgcagtttggtcacgctcccctct

SEQ ID NO: 126189 - DNA, 35 bp, Artificial Sequence
  Synthetic oligonucleotide
acatccaccccgtccgcccgtatgtgtccacacgt

SEQ ID NO: 126190 - DNA, 35 bp, Artificial Sequence
  Synthetic oligonucleotide
ttcaccaccgcccccagccgtcgcatgtcattgga

SEQ ID NO: 126191 - DNA, 38 bp, Artificial Sequence
  Synthetic oligonucleotide
ctcccaggtcggtgttctgcagcccccgccctccctga

SEQ ID NO: 126192 - DNA, 35 bp, Artificial Sequence
  Synthetic oligonucleotide
aacccctccccgccgtacatgtcatcaaaaggtga

SEQ ID NO: 126193 - DNA, 35 bp, Artificial Sequence
  Synthetic oligonucleotide
gactacttaccatggcccgccgcacaacctttgcc

SEQ ID NO: 126194 - DNA, 35 bp, Artificial Sequence
  Synthetic oligonucleotide
gccgaccgcacggttatcacccgttatactcttcc

SEQ ID NO: 126195 - DNA, 35 bp, Artificial Sequence
  Synthetic oligonucleotide
gtcagtccactcaagtccgggccgcctccatcttc

SEQ ID NO: 126196 - DNA, 35 bp, Artificial Sequence
  Synthetic oligonucleotide
tgttctgccctcctgtctctacgctttacacgccg

SEQ ID NO: 126197 - DNA, 35 bp, Artificial Sequence
  Synthetic oligonucleotide
atcttccgtccgcccccgaatttcgtccgccggcg

SEQ ID NO: 126198 - DNA, 35 bp, Artificial Sequence
  Synthetic oligonucleotide
accactccgttcggacaacttacactgtgccctcg

SEQ ID NO: 126199 - DNA, 35 bp, Artificial Sequence
  Synthetic oligonucleotide
agcgcatgcctcacatcccagcccgttcttcgtat

SEQ ID NO: 126200 - DNA, 35 bp, Artificial Sequence
  Synthetic oligonucleotide
taaccgggcaggggagggcggggttcatggatagt

SEQ ID NO: 126201 - DNA, 35 bp, Artificial Sequence
  Synthetic oligonucleotide
gacttcacccttccgacctccgatacgagtcactt

SEQ ID NO: 126202 - DNA, 35 bp, Artificial Sequence
  Synthetic oligonucleotide
gcctggacacgcaccttcgcctccattgcgccctt

SEQ ID NO: 126203 - DNA, 35 bp, Artificial Sequence
  Synthetic oligonucleotide
acctggcgctcgcacattcgccgtcaacacctcca

SEQ ID NO: 126204 - DNA, 37 bp, Artificial Sequence
  Synthetic oligonucleotide
gggggggcgaagataggaagaggggatttgggtcaga

SEQ ID NO: 126205 - DNA, 37 bp, Artificial Sequence
  Synthetic oligonucleotide
actcgccaactgccctatccgatagtccccctgccga

SEQ ID NO: 126206 - DNA, 37 bp, Artificial Sequence
  Synthetic oligonucleotide
gtgggggagatcgaagggggagaggtcgggacgagga

SEQ ID NO: 126207 - DNA, 37 bp, Artificial Sequence
  Synthetic oligonucleotide
gtgacaagacgggggcggaagagaccggtggagtgga

SEQ ID NO: 126208 - DNA, 37 bp, Artificial Sequence
  Synthetic oligonucleotide
gtggtgccacactcggttgattcgcctgccttcttga

SEQ ID NO: 126209 - DNA, 35 bp, Artificial Sequence
  Synthetic oligonucleotide
ttgatacactgcaccatccatgtccgcacctacac

SEQ ID NO: 126210 - DNA, 35 bp, Artificial Sequence
  Synthetic oligonucleotide
ttgctcgttcgtctgtcctgcacgcacacccaccc

SEQ ID NO: 126211 - DNA, 35 bp, Artificial Sequence
  Synthetic oligonucleotide
atgcacacttcgccatctggtcatcctcctgatcc

SEQ ID NO: 126212 - DNA, 35 bp, Artificial Sequence
  Synthetic oligonucleotide
tctgtgccaccacctgccttgaacggggtatttcc

SEQ ID NO: 126213 - DNA, 35 bp, Artificial Sequence
  Synthetic oligonucleotide
gcaaggctccgtcacggtccgcttcgttccctccg

SEQ ID NO: 126214 - DNA, 35 bp, Artificial Sequence
  Synthetic oligonucleotide
tagggaggaagggagaggggatgggggacgttttg

SEQ ID NO: 126215 - DNA, 35 bp, Artificial Sequence
  Synthetic oligonucleotide
aggaaggagggggcacaaggggataagggtgggat

SEQ ID NO: 126216 - DNA, 35 bp, Artificial Sequence
  Synthetic oligonucleotide
acacgcgcatcaccgtgatccactgtggcccacct

SEQ ID NO: 126217 - DNA, 35 bp, Artificial Sequence
  Synthetic oligonucleotide
gtcgtaggcccattgggattatcgttccacctcct

SEQ ID NO: 126218 - DNA, 35 bp, Artificial Sequence
  Synthetic oligonucleotide
tctcccgccaacacgtgctccgcacagcctcgctt

SEQ ID NO: 126219 - DNA, 35 bp, Artificial Sequence
  Synthetic oligonucleotide
gtttcccctgccctgctgccactcttaccatggtt

SEQ ID NO: 126220 - DNA, 35 bp, Artificial Sequence
  Synthetic oligonucleotide
attgctgccgacccccagcccgtctttccctgcca

SEQ ID NO: 126221 - DNA, 36 bp, Artificial Sequence
  Synthetic oligonucleotide
tccacccccacactcatgtaaattgaagttttgcca

SEQ ID NO: 126222 - DNA, 35 bp, Artificial Sequence
  Synthetic oligonucleotide
actgccggtcaccccccctagcttcacctcgggca

SEQ ID NO: 126223 - DNA, 35 bp, Artificial Sequence
  Synthetic oligonucleotide
tgctccgcctcctgaaccgcatatcttttccacga

SEQ ID NO: 126224 - DNA, 37 bp, Artificial Sequence
  Synthetic oligonucleotide
gcccacccctcgaactcgtcagaataccccgtcccga

SEQ ID NO: 126225 - DNA, 37 bp, Artificial Sequence
  Synthetic oligonucleotide
acccccgacatcatgagatgcgtcatccgccttccga

SEQ ID NO: 126226 - DNA, 38 bp, Artificial Sequence
  Synthetic oligonucleotide
tcgcgtcccccgtcctgaattccgccgtacccgcctga

SEQ ID NO: 126227 - DNA, 34 bp, Artificial Sequence
  Synthetic oligonucleotide
accagccccgctcctcgatagaaccggctacacc

SEQ ID NO: 126228 - DNA, 35 bp, Artificial Sequence
  Synthetic oligonucleotide
gcgcctcctcctggtttaactcacgatcccctggc

SEQ ID NO: 126229 - DNA, 35 bp, Artificial Sequence
  Synthetic oligonucleotide
gcaccatccctgattctttcggacccccacagtgc

SEQ ID NO: 126230 - DNA, 35 bp, Artificial Sequence
  Synthetic oligonucleotide
acaaccaccagctctatcctgccgtcgcccctcat

SEQ ID NO: 126231 - DNA, 36 bp, Artificial Sequence
  Synthetic oligonucleotide
acacatggtgagggttggtgcgcgggtggggtggaa

SEQ ID NO: 126232 - DNA, 36 bp, Artificial Sequence
  Synthetic oligonucleotide
tttcgcccgccctgtcgtcgtaccatccacgtataa

SEQ ID NO: 126233 - DNA, 35 bp, Artificial Sequence
  Synthetic oligonucleotide
tgacaggcgcccccagcttttccgccgccgttaca

SEQ ID NO: 126234 - DNA, 35 bp, Artificial Sequence
  Synthetic oligonucleotide
agtgccatcgagtccttctcgcttatcccgcctca

SEQ ID NO: 126235 - DNA, 35 bp, Artificial Sequence
  Synthetic oligonucleotide
ggtccatcccccgccttaattcctgcctgtccgga

SEQ ID NO: 126236 - DNA, 36 bp, Artificial Sequence
  Synthetic oligonucleotide
gtgggccggggtaggggggcgggtcgagatagggga

SEQ ID NO: 126237 - DNA, 38 bp, Artificial Sequence
  Synthetic oligonucleotide
tagaacagggaggagagggagggcaattgccgaggtga

SEQ ID NO: 126238 - DNA, 35 bp, Artificial Sequence
  Synthetic oligonucleotide
gcgccatagccgtgtcctgcccattttcgccacac

SEQ ID NO: 126239 - DNA, 26 bp, Artificial Sequence
  Synthetic oligonucleotide
tacttgtccggccgaacccacttacc

SEQ ID NO: 126240 - DNA, 35 bp, Artificial Sequence
  Synthetic oligonucleotide
ggaagcgcattccgctgtcgtcccctcacccaccc

SEQ ID NO: 126241 - DNA, 35 bp, Artificial Sequence
  Synthetic oligonucleotide
tatgcacggactctacgccatctaccccccgttcg

SEQ ID NO: 126242 - DNA, 35 bp, Artificial Sequence
  Synthetic oligonucleotide
tcctgccgccgttgtctgtcgccgtgccataattg

SEQ ID NO: 126243 - DNA, 34 bp, Artificial Sequence
  Synthetic oligonucleotide
tcttgcccactccgacgttttttaattgatccat

SEQ ID NO: 126244 - DNA, 35 bp, Artificial Sequence
  Synthetic oligonucleotide
tccgaagccccccatgttgctccggtcctgtttct

SEQ ID NO: 126245 - DNA, 35 bp, Artificial Sequence
  Synthetic oligonucleotide
aacaagaggaaggggagcgaaaagaggaagaataa

SEQ ID NO: 126246 - DNA, 35 bp, Artificial Sequence
  Synthetic oligonucleotide
atggtgcacgccccactccctctcactgttcctaa

SEQ ID NO: 126247 - DNA, 37 bp, Artificial Sequence
  Synthetic oligonucleotide
tcgcatccccgactgccccctccggtaacccgcccga

SEQ ID NO: 126248 - DNA, 37 bp, Artificial Sequence
  Synthetic oligonucleotide
gcctgcaccaccgcactcttctccgcgctcccatgga

SEQ ID NO: 126249 - DNA, 36 bp, Artificial Sequence
  Synthetic oligonucleotide
aagcgcacgcccacttgatgcttctcctccccgtta

SEQ ID NO: 126250 - DNA, 33 bp, Artificial Sequence
  Synthetic oligonucleotide
gtacgctcggtcgcatccaatcacctctcgtta

SEQ ID NO: 126251 - DNA, 35 bp, Artificial Sequence
  Synthetic oligonucleotide
agccgcccatcgtattcttagcgttcctcccagac

SEQ ID NO: 126252 - DNA, 35 bp, Artificial Sequence
  Synthetic oligonucleotide
acacccgggttagtatcccatcgctcccatggccc

SEQ ID NO: 126253 - DNA, 35 bp, Artificial Sequence
  Synthetic oligonucleotide
gcggacatctcgccccttgttgactagtcctgccc

SEQ ID NO: 126254 - DNA, 35 bp, Artificial Sequence
  Synthetic oligonucleotide
tgcgcttcctgccgctcctggtcgatctacttgcc

SEQ ID NO: 126255 - DNA, 35 bp, Artificial Sequence
  Synthetic oligonucleotide
ttcccacgatcacgagtcgtcgctacttgctctcc

SEQ ID NO: 126256 - DNA, 35 bp, Artificial Sequence
  Synthetic oligonucleotide
gcgctaccccatcgtacttgtcactggccggcctc

SEQ ID NO: 126257 - DNA, 35 bp, Artificial Sequence
  Synthetic oligonucleotide
tccacctccgatccccttatatcgctgtctccgct

SEQ ID NO: 126258 - DNA, 36 bp, Artificial Sequence
  Synthetic oligonucleotide
gcccccacatcccggctgtacgtatgtcccccctca

SEQ ID NO: 126259 - DNA, 36 bp, Artificial Sequence
  Synthetic oligonucleotide
tctgcccagtagttcgcccccatttgccgctgttca

SEQ ID NO: 126260 - DNA, 37 bp, Artificial Sequence
  Synthetic oligonucleotide
gccccacgccctgcaacgaatctacgcgccccctaga

SEQ ID NO: 126261 - DNA, 36 bp, Artificial Sequence
  Synthetic oligonucleotide
gactcatcccaccgcttctatcgttcgccctctgga

SEQ ID NO: 126262 - DNA, 36 bp, Artificial Sequence
  Synthetic oligonucleotide
gataggacgaacgggcagggtggggaagatagatga

SEQ ID NO: 126263 - DNA, 36 bp, Artificial Sequence
  Synthetic oligonucleotide
actttccgcccatacttgttgttttgaccctgctga

SEQ ID NO: 126264 - DNA, 36 bp, Artificial Sequence
  Synthetic oligonucleotide
agttccccttcccgtgtttacgccgcccagttgcta

SEQ ID NO: 126265 - DNA, 35 bp, Artificial Sequence
  Synthetic oligonucleotide
gctcgccctgtctcgcgtcttcggaccccctgtac

SEQ ID NO: 126266 - DNA, 35 bp, Artificial Sequence
  Synthetic oligonucleotide
gttgacttcacccgtcttagacgcttgttaccacc

SEQ ID NO: 126267 - DNA, 35 bp, Artificial Sequence
  Synthetic oligonucleotide
actccaccaccgctttaccttgccgtgccgctacg

SEQ ID NO: 126268 - DNA, 35 bp, Artificial Sequence
  Synthetic oligonucleotide
tccactcgatttatgtcttgccccacctctgcgcg

SEQ ID NO: 126269 - DNA, 35 bp, Artificial Sequence
  Synthetic oligonucleotide
attgtggcccacacagctgctggttccttctccat

SEQ ID NO: 126270 - DNA, 36 bp, Artificial Sequence
  Synthetic oligonucleotide
taggccagggggatgggggaggcggagagggctgaa

SEQ ID NO: 126271 - DNA, 34 bp, Artificial Sequence
  Synthetic oligonucleotide
tcccgccccgccccgcaggttaaagtgttgcaca

SEQ ID NO: 126272 - DNA, 36 bp, Artificial Sequence
  Synthetic oligonucleotide
tccgccgtaacatctaaagcagcctactcaatttca

SEQ ID NO: 126273 - DNA, 37 bp, Artificial Sequence
  Synthetic oligonucleotide
tggataggggaattggggcaggggacggcggagggga

SEQ ID NO: 126274 - DNA, 38 bp, Artificial Sequence
  Synthetic oligonucleotide
tcacaggtcgccgcctcacaccaccgatccgtacctga

SEQ ID NO: 126275 - DNA, 38 bp, Artificial Sequence
  Synthetic oligonucleotide
acaatccacccgccgattgatcgttcgcccttccttga

SEQ ID NO: 126276 - DNA, 35 bp, Artificial Sequence
  Synthetic oligonucleotide
gacctgcgcacgagctcttttctagtttcccgcac

SEQ ID NO: 126277 - DNA, 35 bp, Artificial Sequence
  Synthetic oligonucleotide
gtcccccgcccttgatatcttggccggtctgttcc

SEQ ID NO: 126278 - DNA, 35 bp, Artificial Sequence
  Synthetic oligonucleotide
tgtgtggccccatctctgctttgagcccaatctgc

SEQ ID NO: 126279 - DNA, 35 bp, Artificial Sequence
  Synthetic oligonucleotide
gcttcacacccactcacatcggccccttcttctgc

SEQ ID NO: 126280 - DNA, 35 bp, Artificial Sequence
  Synthetic oligonucleotide
tccgccactgtacccgctgtctttcccccgctgtc

SEQ ID NO: 126281 - DNA, 35 bp, Artificial Sequence
  Synthetic oligonucleotide
gcgacacgcgggagagagaggaggggtgagggtat

SEQ ID NO: 126282 - DNA, 35 bp, Artificial Sequence
  Synthetic oligonucleotide
tgacccccctatgcgataaccggccacaaaccgct

SEQ ID NO: 126283 - DNA, 35 bp, Artificial Sequence
  Synthetic oligonucleotide
tccaccgtttctgttcagctgctgccccaatcgct

SEQ ID NO: 126284 - DNA, 33 bp, Artificial Sequence
  Synthetic oligonucleotide
gacgtaggccggaggggggggggtcgtgggaaa

SEQ ID NO: 126285 - DNA, 36 bp, Artificial Sequence
  Synthetic oligonucleotide
tccccacctgtgcctcgtccctgctgtcgcattaaa

SEQ ID NO: 126286 - DNA, 36 bp, Artificial Sequence
  Synthetic oligonucleotide
gagaggtacgggaagaagcgtggtagggggtggtaa

SEQ ID NO: 126287 - DNA, 36 bp, Artificial Sequence
  Synthetic oligonucleotide
tcttacgcccccaaacgtgcacacgggtaccccaca

SEQ ID NO: 126288 - DNA, 35 bp, Artificial Sequence
  Synthetic oligonucleotide
gtccccacacagatcggcctctaattctccgccca

SEQ ID NO: 126289 - DNA, 36 bp, Artificial Sequence
  Synthetic oligonucleotide
tgtgacgtccttccgtctgtactcgctttgccccga

SEQ ID NO: 126290 - DNA, 36 bp, Artificial Sequence
  Synthetic oligonucleotide
gtcccttgttcgatccaccccccgcccgtacgtcga

SEQ ID NO: 126291 - DNA, 38 bp, Artificial Sequence
  Synthetic oligonucleotide
agcgccccctattactggccttccacacccacgcgtga

SEQ ID NO: 126292 - DNA, 36 bp, Artificial Sequence
  Synthetic oligonucleotide
gttacccacgccttgtcatctctgagtcccctgcta

SEQ ID NO: 126293 - DNA, 35 bp, Artificial Sequence
  Synthetic oligonucleotide
gtacccccacaactcgccttttaggagcctacctc

SEQ ID NO: 126294 - DNA, 35 bp, Artificial Sequence
  Synthetic oligonucleotide
agtagagcaatggggttggagggagtggatgggag

SEQ ID NO: 126295 - DNA, 35 bp, Artificial Sequence
  Synthetic oligonucleotide
gtacgtcagcccagcattcttcctcctctgatcat

SEQ ID NO: 126296 - DNA, 35 bp, Artificial Sequence
  Synthetic oligonucleotide
aggaccagcccccgattgatccatcgccgcaacct

SEQ ID NO: 126297 - DNA, 35 bp, Artificial Sequence
  Synthetic oligonucleotide
tatggtggagttgagggtggtagggtggtgggatt

SEQ ID NO: 126298 - DNA, 36 bp, Artificial Sequence
  Synthetic oligonucleotide
taccctcccccgtttgtattttgtctactgattcca

SEQ ID NO: 126299 - DNA, 35 bp, Artificial Sequence
  Synthetic oligonucleotide
tatattgcatgggaggatggagggggggaggggca

SEQ ID NO: 126300 - DNA, 35 bp, Artificial Sequence
  Synthetic oligonucleotide
agaccccacgcgtcgcgattgcccctccctgccga

SEQ ID NO: 126301 - DNA, 37 bp, Artificial Sequence
  Synthetic oligonucleotide
tcagacgcagtcttccttcaaccccgctccctttgga

SEQ ID NO: 126302 - DNA, 37 bp, Artificial Sequence
  Synthetic oligonucleotide
acaacggtcgaccactcctgttacgttctccctgtga

SEQ ID NO: 126303 - DNA, 38 bp, Artificial Sequence
  Synthetic oligonucleotide
tcgacctccatccttctcgttacatcaccggtcattga

SEQ ID NO: 126304 - DNA, 36 bp, Artificial Sequence
  Synthetic oligonucleotide
atgtcgccctatcggttactgcgcactccatcccta

SEQ ID NO: 126305 - DNA, 35 bp, Artificial Sequence
  Synthetic oligonucleotide
tccaccctgtgggagtacgctctgcttccgccccc

SEQ ID NO: 126306 - DNA, 35 bp, Artificial Sequence
  Synthetic oligonucleotide
acatcgacctgcccgcctcaccgaacgtatccgcc

SEQ ID NO: 126307 - DNA, 35 bp, Artificial Sequence
  Synthetic oligonucleotide
gccatccttcacctatattatcacgaggacccatc

SEQ ID NO: 126308 - DNA, 35 bp, Artificial Sequence
  Synthetic oligonucleotide
gcactgcccgctcccatgtcgttgcgccccttatc

SEQ ID NO: 126309 - DNA, 35 bp, Artificial Sequence
  Synthetic oligonucleotide
gtcaagcacgacgccaccagtctctgtacccactc

SEQ ID NO: 126310 - DNA, 35 bp, Artificial Sequence
  Synthetic oligonucleotide
tcaacttcagcgccctcgttgctaccgccatactc

SEQ ID NO: 126311 - DNA, 35 bp, Artificial Sequence
  Synthetic oligonucleotide
ggcggtggggggggcggggacggcggaactatgtc

SEQ ID NO: 126312 - DNA, 36 bp, Artificial Sequence
  Synthetic oligonucleotide
tcatcccaccgaccaatgcgtactgatccacccaca

SEQ ID NO: 126313 - DNA, 37 bp, Artificial Sequence
  Synthetic oligonucleotide
gaagggggggggcataatgaacgagtgcgcgccaaga

SEQ ID NO: 126314 - DNA, 35 bp, Artificial Sequence
  Synthetic oligonucleotide
atgcgcctccacgagccctcctgatctctcccaga

SEQ ID NO: 126315 - DNA, 38 bp, Artificial Sequence
  Synthetic oligonucleotide
atgtgtgccgccacttattcgttctatgccactcttga

SEQ ID NO: 126316 - DNA, 35 bp, Artificial Sequence
  Synthetic oligonucleotide
gggagggggatagggtggggtagaaagctgaaggc

SEQ ID NO: 126317 - DNA, 35 bp, Artificial Sequence
  Synthetic oligonucleotide
gacggtccaccctccgtgccttttacttttaatgc

SEQ ID NO: 126318 - DNA, 35 bp, Artificial Sequence
  Synthetic oligonucleotide
tgaggggaaggactaggaacggagaggggtttgag

SEQ ID NO: 126319 - DNA, 35 bp, Artificial Sequence
  Synthetic oligonucleotide
gttacagtcgggaatgtagcgagggtgggggggcg

SEQ ID NO: 126320 - DNA, 35 bp, Artificial Sequence
  Synthetic oligonucleotide
gccgccccttctatcaccccagatgagcttacctg

SEQ ID NO: 126321 - DNA, 35 bp, Artificial Sequence
  Synthetic oligonucleotide
atgcgccacgggcaacatccgtaatgctactccct

SEQ ID NO: 126322 - DNA, 35 bp, Artificial Sequence
  Synthetic oligonucleotide
ttgacttgcaacggcatataagtcacgctccttct

SEQ ID NO: 126323 - DNA, 35 bp, Artificial Sequence
  Synthetic oligonucleotide
tccgcaacctgtctccgtacagcataccacccatt

SEQ ID NO: 126324 - DNA, 35 bp, Artificial Sequence
  Synthetic oligonucleotide
tctgccacctgatcgccccattgtctgaatcgctt

SEQ ID NO: 126325 - DNA, 35 bp, Artificial Sequence
  Synthetic oligonucleotide
gcacgccggcgcatcttgctttaactttcgctctt

SEQ ID NO: 126326 - DNA, 36 bp, Artificial Sequence
  Synthetic oligonucleotide
gccctgcccctgtaccgctccattttttacagtgaa

SEQ ID NO: 126327 - DNA, 36 bp, Artificial Sequence
  Synthetic oligonucleotide
tcacaagcgaggaagtgcccactccatgccccccga

SEQ ID NO: 126328 - DNA, 37 bp, Artificial Sequence
  Synthetic oligonucleotide
aaaaggggggcggaggaggtaagggaggtatctagga

SEQ ID NO: 126329 - DNA, 37 bp, Artificial Sequence
  Synthetic oligonucleotide
tcaggtgagccagtggagacgcggtgggggggtggga

SEQ ID NO: 126330 - DNA, 38 bp, Artificial Sequence
  Synthetic oligonucleotide
ttgccccgccgacttttggccgccatccaccaacgtga

SEQ ID NO: 126331 - DNA, 35 bp, Artificial Sequence
  Synthetic oligonucleotide
gcccgagccttcccgtttattttgccaacctgtta

SEQ ID NO: 126332 - DNA, 35 bp, Artificial Sequence
  Synthetic oligonucleotide
tgtgaccgtgcagcctttaaacaaagttccgctcc

SEQ ID NO: 126333 - DNA, 35 bp, Artificial Sequence
  Synthetic oligonucleotide
aacgttggaacgggttggtgggtagggtgggattg

SEQ ID NO: 126334 - DNA, 35 bp, Artificial Sequence
  Synthetic oligonucleotide
tcacaccctcgccagctatcagcgacttctcacat

SEQ ID NO: 126335 - DNA, 35 bp, Artificial Sequence
  Synthetic oligonucleotide
tgcaacccctccgcttatcctgacgttctaggtct

SEQ ID NO: 126336 - DNA, 36 bp, Artificial Sequence
  Synthetic oligonucleotide
tacaccgccctatcacctgccagattagtccttcga

SEQ ID NO: 126337 - DNA, 37 bp, Artificial Sequence
  Synthetic oligonucleotide
gagggtaaggggcaaggaggttgggggagttcgatga

SEQ ID NO: 126338 - DNA, 37 bp, Artificial Sequence
  Synthetic oligonucleotide
tgccgggcacggggacgaagggtgggtggggggctga

SEQ ID NO: 126339 - DNA, 38 bp, Artificial Sequence
  Synthetic oligonucleotide
tgcaccacacgtacactgttccgatcctccctctgtga

SEQ ID NO: 126340 - DNA, 35 bp, Artificial Sequence
  Synthetic oligonucleotide
tgtccgaagccctgtcttgctcaatcgctcccacc

SEQ ID NO: 126341 - DNA, 35 bp, Artificial Sequence
  Synthetic oligonucleotide
ggattcccccgctgtttctctcgttacctgacccc

SEQ ID NO: 126342 - DNA, 35 bp, Artificial Sequence
  Synthetic oligonucleotide
aacgtggctacacattcttagctggttacccttcc

SEQ ID NO: 126343 - DNA, 34 bp, Artificial Sequence
  Synthetic oligonucleotide
gtgtcgtctccttgcccctgtctgttcctacact

SEQ ID NO: 126344 - DNA, 35 bp, Artificial Sequence
  Synthetic oligonucleotide
caaccgccccacagatgttgccaattccgtatcct

SEQ ID NO: 126345 - DNA, 35 bp, Artificial Sequence
  Synthetic oligonucleotide
tcgccgaaggacctgcgccctatcttacccccgct

SEQ ID NO: 126346 - DNA, 35 bp, Artificial Sequence
  Synthetic oligonucleotide
agtcggggggagaatggagcggaagggggatgagt

SEQ ID NO: 126347 - DNA, 35 bp, Artificial Sequence
  Synthetic oligonucleotide
acgtgtagcaacctgctgtttcgccccacgtcctt

SEQ ID NO: 126348 - DNA, 36 bp, Artificial Sequence
  Synthetic oligonucleotide
agatccccccgctatcccctgtattctggcctgtaa

SEQ ID NO: 126349 - DNA, 36 bp, Artificial Sequence
  Synthetic oligonucleotide
tcacgggacagggggggtcgggtgcgatacatgcga

SEQ ID NO: 126350 - DNA, 36 bp, Artificial Sequence
  Synthetic oligonucleotide
agttaaggagcaagtgagggtgggagggcgatcgta

SEQ ID NO: 126351 - DNA, 35 bp, Artificial Sequence
  Synthetic oligonucleotide
gcgatccgcccagttttttgcactctctttcgcac

SEQ ID NO: 126352 - DNA, 35 bp, Artificial Sequence
  Synthetic oligonucleotide
gtggtcccttcagcatctctcttaggccttgattc

SEQ ID NO: 126353 - DNA, 36 bp, Artificial Sequence
  Synthetic oligonucleotide
gtacacgcccgacgctccccttcatcgttgacgaaa

SEQ ID NO: 126354 - DNA, 36 bp, Artificial Sequence
  Synthetic oligonucleotide
tacgacgcctcccactcagttatattgcgctaccaa

SEQ ID NO: 126355 - DNA, 36 bp, Artificial Sequence
  Synthetic oligonucleotide
agaggcgaggagagaagggagaaggggcgtgcggca

SEQ ID NO: 126356 - DNA, 37 bp, Artificial Sequence
  Synthetic oligonucleotide
tgaacgtcacaccaacctcgccgccttcattcgacga

SEQ ID NO: 126357 - DNA, 37 bp, Artificial Sequence
  Synthetic oligonucleotide
gagctggccgtcacatctcccaccccaccactcagga

SEQ ID NO: 126358 - DNA, 37 bp, Artificial Sequence
  Synthetic oligonucleotide
gataggaggaggcggggaagggcagattaaggcggga

SEQ ID NO: 126359 - DNA, 38 bp, Artificial Sequence
  Synthetic oligonucleotide
gccgaccccggcggattatcaatgttgcctccccttga

SEQ ID NO: 126360 - DNA, 35 bp, Artificial Sequence
  Synthetic oligonucleotide
gtcgccccaccggccctctgtcttcccctgcttga

SEQ ID NO: 126361 - DNA, 35 bp, Artificial Sequence
  Synthetic oligonucleotide
tattcgcagcccctggccctcccgttgtactatac

SEQ ID NO: 126362 - DNA, 35 bp, Artificial Sequence
  Synthetic oligonucleotide
gctgaggacggagggaatagagggaatcggacgag

SEQ ID NO: 126363 - DNA, 35 bp, Artificial Sequence
  Synthetic oligonucleotide
ttgtccgttccatgcacgctctcgtttcctccgcg

SEQ ID NO: 126364 - DNA, 35 bp, Artificial Sequence
  Synthetic oligonucleotide
actcccgcctcatcaccgaatttacacagttcatg

SEQ ID NO: 126365 - DNA, 35 bp, Artificial Sequence
  Synthetic oligonucleotide
tctatccgccactgtacgcttctctccagcctact

SEQ ID NO: 126366 - DNA, 35 bp, Artificial Sequence
  Synthetic oligonucleotide
gcgatggggaggtggagtttgcgggggcgagtgaa

SEQ ID NO: 126367 - DNA, 37 bp, Artificial Sequence
  Synthetic oligonucleotide
ttgggcccacattgtcgtctttctcctctccatctga

SEQ ID NO: 126368 - DNA, 36 bp, Artificial Sequence
  Synthetic oligonucleotide
aacgtcctcgaccgcccctgattccctggcctgcta

SEQ ID NO: 126369 - DNA, 36 bp, Artificial Sequence
  Synthetic oligonucleotide
gagggagtggtgggaggggagaaaaccggcgcttta

SEQ ID NO: 126370 - DNA, 35 bp, Artificial Sequence
  Synthetic oligonucleotide
atcgcagaaaaacgcttgggccttcccctcccatc

SEQ ID NO: 126371 - DNA, 35 bp, Artificial Sequence
  Synthetic oligonucleotide
tcagagtctccgtcacacatccctgcctgatcctc

SEQ ID NO: 126372 - DNA, 35 bp, Artificial Sequence
  Synthetic oligonucleotide
gctcaccaaatgtcacctgtcccgacccacttgcg

SEQ ID NO: 126373 - DNA, 35 bp, Artificial Sequence
  Synthetic oligonucleotide
tgattggtcgggggtgggatgggtggcggttttcg

SEQ ID NO: 126374 - DNA, 35 bp, Artificial Sequence
  Synthetic oligonucleotide
tatgcagagtacctgcccgccgccaacttgacatt

SEQ ID NO: 126375 - DNA, 36 bp, Artificial Sequence
  Synthetic oligonucleotide
tacctgccggggtggggtaaaatgctggggagggaa

SEQ ID NO: 126376 - DNA, 36 bp, Artificial Sequence
  Synthetic oligonucleotide
tgcacccctcgcaacctatagccacatggactctca

SEQ ID NO: 126377 - DNA, 37 bp, Artificial Sequence
  Synthetic oligonucleotide
tgataccagggtgcggagggggggcgggtcagttcga

SEQ ID NO: 126378 - DNA, 38 bp, Artificial Sequence
  Synthetic oligonucleotide
gatgtccgggttggggagaaggagggggagaccaatga

SEQ ID NO: 126379 - DNA, 35 bp, Artificial Sequence
  Synthetic oligonucleotide
atgtcgccccatcatttcgctagccctttgcctta

SEQ ID NO: 126380 - DNA, 35 bp, Artificial Sequence
  Synthetic oligonucleotide
gagcgtgacatcagtcccctttatacttggccctt

SEQ ID NO: 126381 - DNA, 35 bp, Artificial Sequence
  Synthetic oligonucleotide
tgtgccatcctggccccccctttatcgccccacga

SEQ ID NO: 126382 - DNA, 35 bp, Artificial Sequence
  Synthetic oligonucleotide
actgggaccaggtaggggctcaggagggacgggga

SEQ ID NO: 126383 - DNA, 38 bp, Artificial Sequence
  Synthetic oligonucleotide
accccttcgcccctgacattaagctcgacctgctctga

SEQ ID NO: 126384 - DNA, 38 bp, Artificial Sequence
  Synthetic oligonucleotide
tccgcccccacgcctcgtgccatcgataaaccttctga

SEQ ID NO: 126385 - DNA, 35 bp, Artificial Sequence
  Synthetic oligonucleotide
tcgacccccccatgcctttgaacacaactatttta

SEQ ID NO: 126386 - DNA, 35 bp, Artificial Sequence
  Synthetic oligonucleotide
tccccacccccatgcattaatgatatacccgcacc

SEQ ID NO: 126387 - DNA, 35 bp, Artificial Sequence
  Synthetic oligonucleotide
tacgcccctcttgtcgctctccgtagacaggaccc

SEQ ID NO: 126388 - DNA, 35 bp, Artificial Sequence
  Synthetic oligonucleotide
acgcacgtcaataccccccgtcgttggttttcccc

SEQ ID NO: 126389 - DNA, 35 bp, Artificial Sequence
  Synthetic oligonucleotide
tccacgtccatacccgcatacgcaccgaacggccc

SEQ ID NO: 126390 - DNA, 35 bp, Artificial Sequence
  Synthetic oligonucleotide
acagatgcctcatccgagtactgttcgagcctccc

SEQ ID NO: 126391 - DNA, 35 bp, Artificial Sequence
  Synthetic oligonucleotide
tcgccaacgacgctcactggaatgcccaccccgcc

SEQ ID NO: 126392 - DNA, 35 bp, Artificial Sequence
  Synthetic oligonucleotide
tgttcaccccctggcgctccatgtattgcccatcc

SEQ ID NO: 126393 - DNA, 35 bp, Artificial Sequence
  Synthetic oligonucleotide
tccgcacccgcaatcaatcctccgatctgcctagc

SEQ ID NO: 126394 - DNA, 35 bp, Artificial Sequence
  Synthetic oligonucleotide
gtcaccacggttttaccttgaactgctcttgcctc

SEQ ID NO: 126395 - DNA, 35 bp, Artificial Sequence
  Synthetic oligonucleotide
tgggccttactgctggtttccgtgtcaccatcctc

SEQ ID NO: 126396 - DNA, 35 bp, Artificial Sequence
  Synthetic oligonucleotide
ttccctgtcctgtgcattgtctaccttacctcacg

SEQ ID NO: 126397 - DNA, 35 bp, Artificial Sequence
  Synthetic oligonucleotide
gcagaatctcaccgccctttgcactgctccccctg

SEQ ID NO: 126398 - DNA, 35 bp, Artificial Sequence
  Synthetic oligonucleotide
gccaaccatgaccggtttacttcgccctcccgttg

SEQ ID NO: 126399 - DNA, 35 bp, Artificial Sequence
  Synthetic oligonucleotide
tccacgccaatgtgcgtctacccaccatcgcccat

SEQ ID NO: 126400 - DNA, 37 bp, Artificial Sequence
  Synthetic oligonucleotide
agcacggtggaggtaggtaggcgggggtaaagtaaga

SEQ ID NO: 126401 - DNA, 37 bp, Artificial Sequence
  Synthetic oligonucleotide
atggtggtggagcaatacggggcacggaaggaggcga

SEQ ID NO: 126402 - DNA, 35 bp, Artificial Sequence
  Synthetic oligonucleotide
atgggtgctacccctccacttcggccgtcccgtcc

SEQ ID NO: 126403 - DNA, 35 bp, Artificial Sequence
  Synthetic oligonucleotide
gtttccacgcgtgtcaccagcgcccctcgttcttc

SEQ ID NO: 126404 - DNA, 35 bp, Artificial Sequence
  Synthetic oligonucleotide
acccttccccactaggctgttaaaattcgcccacg

SEQ ID NO: 126405 - DNA, 35 bp, Artificial Sequence
  Synthetic oligonucleotide
tgccccccgctactgctacctattcgccacgagcg

SEQ ID NO: 126406 - DNA, 35 bp, Artificial Sequence
  Synthetic oligonucleotide
gccgatcatcgcacattcccatcgcctacgcttgg

SEQ ID NO: 126407 - DNA, 35 bp, Artificial Sequence
  Synthetic oligonucleotide
ggagtggtggggtatcggggtggttgcaaaggctg

SEQ ID NO: 126408 - DNA, 35 bp, Artificial Sequence
  Synthetic oligonucleotide
gcctccctgcccttcttaaatatcagcagacctct

SEQ ID NO: 126409 - DNA, 35 bp, Artificial Sequence
  Synthetic oligonucleotide
agccggagggcgggggagttaggcagggggccggt

SEQ ID NO: 126410 - DNA, 38 bp, Artificial Sequence
  Synthetic oligonucleotide
gtattgggaagggagggcaataagggaaggaacagtga

SEQ ID NO: 126411 - DNA, 38 bp, Artificial Sequence
  Synthetic oligonucleotide
gtagagagggcggggagtagtgaagcgggtgagggtga

SEQ ID NO: 126412 - DNA, 36 bp, Artificial Sequence
  Synthetic oligonucleotide
accgatcgttccgtcaagctcccttccctggccgta

SEQ ID NO: 126413 - DNA, 36 bp, Artificial Sequence
  Synthetic oligonucleotide
cagtatggaggtggggggggttcggatatggtggta

SEQ ID NO: 126414 - DNA, 35 bp, Artificial Sequence
  Synthetic oligonucleotide
gcccgagccatcgaactgttcctgcctgggttcac

SEQ ID NO: 126415 - DNA, 35 bp, Artificial Sequence
  Synthetic oligonucleotide
tctcactgaaccgtacctgttatctgctcacaccc

SEQ ID NO: 126416 - DNA, 35 bp, Artificial Sequence
  Synthetic oligonucleotide
tccctcgctacccacgattatcatttagccttccc

SEQ ID NO: 126417 - DNA, 34 bp, Artificial Sequence
  Synthetic oligonucleotide
gaactcccaccccggctggcctgatcgccttgcc

SEQ ID NO: 126418 - DNA, 35 bp, Artificial Sequence
  Synthetic oligonucleotide
ttggatcgcgccaatcctattttctacactgccgc

SEQ ID NO: 126419 - DNA, 35 bp, Artificial Sequence
  Synthetic oligonucleotide
gacgtccccccgacgaccccccagctcgttcctgc

SEQ ID NO: 126420 - DNA, 35 bp, Artificial Sequence
  Synthetic oligonucleotide
agctcctcatcccaattttgtcacgctccctttgc

SEQ ID NO: 126421 - DNA, 35 bp, Artificial Sequence
  Synthetic oligonucleotide
gctcgcgaagcattgctttccttatctccactccg

SEQ ID NO: 126422 - DNA, 35 bp, Artificial Sequence
  Synthetic oligonucleotide
acgcccaggtcgccactcctctcatgtctatggct

SEQ ID NO: 126423 - DNA, 35 bp, Artificial Sequence
  Synthetic oligonucleotide
tcgacgcgcctggctgatccttactccctcctcgt

SEQ ID NO: 126424 - DNA, 35 bp, Artificial Sequence
  Synthetic oligonucleotide
acattgacccgaccgacctgcgccatgctctcttt

SEQ ID NO: 126425 - DNA, 36 bp, Artificial Sequence
  Synthetic oligonucleotide
atgccccacccgcctaagattaggtactcggcccca

SEQ ID NO: 126426 - DNA, 36 bp, Artificial Sequence
  Synthetic oligonucleotide
gatcggggaggtgtgggtgggacaaaggaagggaga

SEQ ID NO: 126427 - DNA, 37 bp, Artificial Sequence
  Synthetic oligonucleotide
gaaggagcacggaccggtgggggatcggtaggaggga

SEQ ID NO: 126428 - DNA, 38 bp, Artificial Sequence
  Synthetic oligonucleotide
accagtgtgccacgttcccctgcttaaatcccagctga

SEQ ID NO: 126429 - DNA, 38 bp, Artificial Sequence
  Synthetic oligonucleotide
gtccccccctctttggtaccgaaccctcaagtctttga

SEQ ID NO: 126430 - DNA, 36 bp, Artificial Sequence
  Synthetic oligonucleotide
gatactcagcctgacgcgcgaccgccactcctccta

SEQ ID NO: 126431 - DNA, 35 bp, Artificial Sequence
  Synthetic oligonucleotide
gcatcgcgccacgcattcctttttctgttatcgcc

SEQ ID NO: 126432 - DNA, 35 bp, Artificial Sequence
  Synthetic oligonucleotide
tcactgccctcacagtccgccgtgccctgattcgc

SEQ ID NO: 126433 - DNA, 35 bp, Artificial Sequence
  Synthetic oligonucleotide
accgctgactctgaaatacgctccaccccccgttc

SEQ ID NO: 126434 - DNA, 35 bp, Artificial Sequence
  Synthetic oligonucleotide
gatgatgggttcgggggtggtgggtagatagtttg

SEQ ID NO: 126435 - DNA, 35 bp, Artificial Sequence
  Synthetic oligonucleotide
gctcgcatcgatattgtcgtcacaccatcctcttt

SEQ ID NO: 126436 - DNA, 36 bp, Artificial Sequence
  Synthetic oligonucleotide
gccccgtgccgcttgctttcttaccttcgtccgcca

SEQ ID NO: 126437 - DNA, 36 bp, Artificial Sequence
  Synthetic oligonucleotide
gacgcactcccgacgtcgcgcaaaccatccctgtca

SEQ ID NO: 126438 - DNA, 36 bp, Artificial Sequence
  Synthetic oligonucleotide
aacctgcacccgactcgccctctgccatttttgaga

SEQ ID NO: 126439 - DNA, 37 bp, Artificial Sequence
  Synthetic oligonucleotide
acctgacaacctcccgatcgccatttcgctacattga

SEQ ID NO: 126440 - DNA, 37 bp, Artificial Sequence
  Synthetic oligonucleotide
ttcccgccccccatgcgctcccggtgatcaaacttga

SEQ ID NO: 126441 - DNA, 36 bp, Artificial Sequence
  Synthetic oligonucleotide
ttctccgttccatgtcccctacacgtgcctccttga

SEQ ID NO: 126442 - DNA, 36 bp, Artificial Sequence
  Synthetic oligonucleotide
gcatagagtcgtcgtccgcgcgcttcacctctccac

SEQ ID NO: 126443 - DNA, 35 bp, Artificial Sequence
  Synthetic oligonucleotide
acacctccatcgatgcacagtacgtatcccgttcc

SEQ ID NO: 126444 - DNA, 35 bp, Artificial Sequence
  Synthetic oligonucleotide
accgccccctccgcaactgtcgctatactcgtttc

SEQ ID NO: 126445 - DNA, 35 bp, Artificial Sequence
  Synthetic oligonucleotide
gagagcgctgccccccgtctcctgccccacttggg

SEQ ID NO: 126446 - DNA, 35 bp, Artificial Sequence
  Synthetic oligonucleotide
actcccaccttcctccacgtatccaagggctctat

SEQ ID NO: 126447 - DNA, 35 bp, Artificial Sequence
  Synthetic oligonucleotide
actacatcacaccggtttcccagacctcgctctca

SEQ ID NO: 126448 - DNA, 35 bp, Artificial Sequence
  Synthetic oligonucleotide
ttcctccatcccatgcgttttcaccttcgcctaga

SEQ ID NO: 126449 - DNA, 38 bp, Artificial Sequence
  Synthetic oligonucleotide
attgcgtagaccgtgcccgccatcatcccctcctgtga

SEQ ID NO: 126450 - DNA, 36 bp, Artificial Sequence
  Synthetic oligonucleotide
accgtggcctcatagttttgtttcgccccccattga

SEQ ID NO: 126451 - DNA, 36 bp, Artificial Sequence
  Synthetic oligonucleotide
aacaccgcccactctttttatttgtgctttgtccta

SEQ ID NO: 126452 - DNA, 35 bp, Artificial Sequence
  Synthetic oligonucleotide
tgtctcgaccacagtagtcgtcaccgccttaccac

SEQ ID NO: 126453 - DNA, 35 bp, Artificial Sequence
  Synthetic oligonucleotide
taccccacccgacccggatgtacttccggtagtcc

SEQ ID NO: 126454 - DNA, 35 bp, Artificial Sequence
  Synthetic oligonucleotide
gccccttacagagtactattttgcttgtgccttcc

SEQ ID NO: 126455 - DNA, 35 bp, Artificial Sequence
  Synthetic oligonucleotide
gcatgcacgcttgtaacgctcccgactctctgtgc

SEQ ID NO: 126456 - DNA, 35 bp, Artificial Sequence
  Synthetic oligonucleotide
gtcactcgccgccgctgtacgccgcttccttttgc

SEQ ID NO: 126457 - DNA, 35 bp, Artificial Sequence
  Synthetic oligonucleotide
gctctagcccattgcccacgttgtctgtctcactc

SEQ ID NO: 126458 - DNA, 34 bp, Artificial Sequence
  Synthetic oligonucleotide
tcacgtcgccgtccgtttctcactctatatggtc

SEQ ID NO: 126459 - DNA, 33 bp, Artificial Sequence
  Synthetic oligonucleotide
gttgcgaagatgacagggggggggcgatgaggg

SEQ ID NO: 126460 - DNA, 35 bp, Artificial Sequence
  Synthetic oligonucleotide
gccaccctgctgttatgtttctgcttcccttcctg

SEQ ID NO: 126461 - DNA, 35 bp, Artificial Sequence
  Synthetic oligonucleotide
acgctacctgctctgcgctccaccttctgctattt

SEQ ID NO: 126462 - DNA, 35 bp, Artificial Sequence
  Synthetic oligonucleotide
aggttgggagggggtggtggcaggtggaggaaaaa

SEQ ID NO: 126463 - DNA, 37 bp, Artificial Sequence
  Synthetic oligonucleotide
atcgaccctccgcccccgccccgctgactgttacaga

SEQ ID NO: 126464 - DNA, 35 bp, Artificial Sequence
  Synthetic oligonucleotide
atccgcgcaacctctaccccttccgtattccggcc

SEQ ID NO: 126465 - DNA, 35 bp, Artificial Sequence
  Synthetic oligonucleotide
gcctgcccaggtccccgttatacccagccgctgcc

SEQ ID NO: 126466 - DNA, 35 bp, Artificial Sequence
  Synthetic oligonucleotide
gatcccctcagatgccttcgccaccgttccaccgc

SEQ ID NO: 126467 - DNA, 35 bp, Artificial Sequence
  Synthetic oligonucleotide
gtactcccttgcgtcgtcatcgctataccacctgc

SEQ ID NO: 126468 - DNA, 36 bp, Artificial Sequence
  Synthetic oligonucleotide
gatgcgcgcccagtcctaagccccctcacccttgca

SEQ ID NO: 126469 - DNA, 38 bp, Artificial Sequence
  Synthetic oligonucleotide
taagggaggtgaacagggaaatggaggggggccggtga

SEQ ID NO: 126470 - DNA, 35 bp, Artificial Sequence
  Synthetic oligonucleotide
tagtccccatgtcaccttccgttggctgtatcacc

SEQ ID NO: 126471 - DNA, 35 bp, Artificial Sequence
  Synthetic oligonucleotide
attgcctgctgttcgacatctgttaaccgccatcc

SEQ ID NO: 126472 - DNA, 35 bp, Artificial Sequence
  Synthetic oligonucleotide
gacgtctggcctgcccattgcgacctcttacttcc

SEQ ID NO: 126473 - DNA, 35 bp, Artificial Sequence
  Synthetic oligonucleotide
acgccccccaccggtcatacgacatccacccacag

SEQ ID NO: 126474 - DNA, 35 bp, Artificial Sequence
  Synthetic oligonucleotide
gtgaccacttctgctctggcgctccttctcctcca

SEQ ID NO: 126475 - DNA, 35 bp, Artificial Sequence
  Synthetic oligonucleotide
ggttgcccgtccgcctaccgccactcgttccttca

SEQ ID NO: 126476 - DNA, 37 bp, Artificial Sequence
  Synthetic oligonucleotide
aagtgcccgagagggaaaacgagggggaagggcaaga

SEQ ID NO: 126477 - DNA, 37 bp, Artificial Sequence
  Synthetic oligonucleotide
gttcgccgcccaccccttactgccccagtatgcccga

SEQ ID NO: 126478 - DNA, 36 bp, Artificial Sequence
  Synthetic oligonucleotide
tagggagggggggcagtggactagggaacatgagga

SEQ ID NO: 126479 - DNA, 35 bp, Artificial Sequence
  Synthetic oligonucleotide
tgttgactggtcagtctgcctcacacgttcgcccc

SEQ ID NO: 126480 - DNA, 35 bp, Artificial Sequence
  Synthetic oligonucleotide
cacagcacatctcaatctgtcacccgtatccagcc

SEQ ID NO: 126481 - DNA, 35 bp, Artificial Sequence
  Synthetic oligonucleotide
gctcctccgatcgctaccatagtcctccattgctc

SEQ ID NO: 126482 - DNA, 35 bp, Artificial Sequence
  Synthetic oligonucleotide
tggaatccccccctcttgtgctctgtcccgccgtc

SEQ ID NO: 126483 - DNA, 35 bp, Artificial Sequence
  Synthetic oligonucleotide
atcagccgtcattccttttggcgcgtacctctttc

SEQ ID NO: 126484 - DNA, 35 bp, Artificial Sequence
  Synthetic oligonucleotide
gtgggaaggaagtaaggagtgggggtcaaagggcg

SEQ ID NO: 126485 - DNA, 35 bp, Artificial Sequence
  Synthetic oligonucleotide
aacattgtgcgctgctccaccctgcttatcgatcg

SEQ ID NO: 126486 - DNA, 31 bp, Artificial Sequence
  Synthetic oligonucleotide
tctccccacgcccgaccgttccttactattg

SEQ ID NO: 126487 - DNA, 35 bp, Artificial Sequence
  Synthetic oligonucleotide
tcccccaaccgcctcacctccaaaccatgacggaa

SEQ ID NO: 126488 - DNA, 36 bp, Artificial Sequence
  Synthetic oligonucleotide
tgggcaagagggggcatagggcgcagggggagggaa

SEQ ID NO: 126489 - DNA, 36 bp, Artificial Sequence
  Synthetic oligonucleotide
gatgccatctctccgtattcctctgcgcaaagccca

SEQ ID NO: 126490 - DNA, 36 bp, Artificial Sequence
  Synthetic oligonucleotide
gacgcccgagaggcaaggtcagctcccttcgctcca

SEQ ID NO: 126491 - DNA, 37 bp, Artificial Sequence
  Synthetic oligonucleotide
tcagatcagcctgtccttactaccgccttccccacga

SEQ ID NO: 126492 - DNA, 35 bp, Artificial Sequence
  Synthetic oligonucleotide
gctcgggttgggagggacgggtacacagacaatga

SEQ ID NO: 126493 - DNA, 38 bp, Artificial Sequence
  Synthetic oligonucleotide
aaagacaggagagggtgggagggtagatcctgcggtga

SEQ ID NO: 126494 - DNA, 35 bp, Artificial Sequence
  Synthetic oligonucleotide
tgcactctcctttgacgtggtcatgccgttccacc

SEQ ID NO: 126495 - DNA, 35 bp, Artificial Sequence
  Synthetic oligonucleotide
actcggagccttctgccctctatcaggactccccc

SEQ ID NO: 126496 - DNA, 35 bp, Artificial Sequence
  Synthetic oligonucleotide
acgccctcctcgtcgatatttcgatgaccctccgc

SEQ ID NO: 126497 - DNA, 35 bp, Artificial Sequence
  Synthetic oligonucleotide
agccaccctcttccactcccgaactcagcttgggc

SEQ ID NO: 126498 - DNA, 35 bp, Artificial Sequence
  Synthetic oligonucleotide
gagtgttgcctcatgtagctgctctcccttacctc

SEQ ID NO: 126499 - DNA, 30 bp, Artificial Sequence
  Synthetic oligonucleotide
ttgcccaccactcagccctggtttacgttc

SEQ ID NO: 126500 - DNA, 35 bp, Artificial Sequence
  Synthetic oligonucleotide
tgcatcccggcgccttcagttctcacccgttaccg

SEQ ID NO: 126501 - DNA, 35 bp, Artificial Sequence
  Synthetic oligonucleotide
tacgaccgccacaagtcccttttgtttcccttgcg

SEQ ID NO: 126502 - DNA, 35 bp, Artificial Sequence
  Synthetic oligonucleotide
gaagcgcctacatccgttgtcaacagcctcgccct

SEQ ID NO: 126503 - DNA, 35 bp, Artificial Sequence
  Synthetic oligonucleotide
tgtgtcttcagccttccactagcccggcccttgct

SEQ ID NO: 126504 - DNA, 35 bp, Artificial Sequence
  Synthetic oligonucleotide
aagtccactccgcccagaacctgataatgccccaa

SEQ ID NO: 126505 - DNA, 35 bp, Artificial Sequence
  Synthetic oligonucleotide
acgtgaacccctctgtgcaccatcaatgaccacca

SEQ ID NO: 126506 - DNA, 37 bp, Artificial Sequence
  Synthetic oligonucleotide
gggtgagcaagacggaaacggggaggggcgaacagga

SEQ ID NO: 126507 - DNA, 37 bp, Artificial Sequence
  Synthetic oligonucleotide
gactgcatcgacggggggctggggacggaagaaggga

SEQ ID NO: 126508 - DNA, 36 bp, Artificial Sequence
  Synthetic oligonucleotide
tgtcttatgggcgggaatgtcgtgtatgggtgggga

SEQ ID NO: 126509 - DNA, 37 bp, Artificial Sequence
  Synthetic oligonucleotide
gcccctcccctttgtgtccccgtctcccctttcatga

SEQ ID NO: 126510 - DNA, 38 bp, Artificial Sequence
  Synthetic oligonucleotide
tcctcaccccgccgcccgaaccattgtaacagttttga

SEQ ID NO: 126511 - DNA, 35 bp, Artificial Sequence
  Synthetic oligonucleotide
ttctcagcgtggagcccccgacatccgcccgttcc

SEQ ID NO: 126512 - DNA, 35 bp, Artificial Sequence
  Synthetic oligonucleotide
actgcaagcgttccgtctacgctccaccgtgcctc

SEQ ID NO: 126513 - DNA, 35 bp, Artificial Sequence
  Synthetic oligonucleotide
ggaggagggaaagtttttgaggggacgggggtatg

SEQ ID NO: 126514 - DNA, 36 bp, Artificial Sequence
  Synthetic oligonucleotide
ggttcactcctgcatgttttttcgccgcccgatcca

SEQ ID NO: 126515 - DNA, 36 bp, Artificial Sequence
  Synthetic oligonucleotide
aatccccacgctcccccttgtttactatgcctggca

SEQ ID NO: 126516 - DNA, 35 bp, Artificial Sequence
  Synthetic oligonucleotide
tcaatgcccacactgatcctccgagtcaccgctca

SEQ ID NO: 126517 - DNA, 34 bp, Artificial Sequence
  Synthetic oligonucleotide
gagaggaaggaaagaacggtggcgtgagggcaga

SEQ ID NO: 126518 - DNA, 37 bp, Artificial Sequence
  Synthetic oligonucleotide
aatggccgaaaggtggagggtgcaggggggggctaga

SEQ ID NO: 126519 - DNA, 35 bp, Artificial Sequence
  Synthetic oligonucleotide
tacacccggtcactgaacttcctccacccacggga

SEQ ID NO: 126520 - DNA, 36 bp, Artificial Sequence
  Synthetic oligonucleotide
tgccataggctccatgctgccctcttcacttaccta

SEQ ID NO: 126521 - DNA, 35 bp, Artificial Sequence
  Synthetic oligonucleotide
aattcaccgcccacccccccgagagtctctgtacc

SEQ ID NO: 126522 - DNA, 31 bp, Artificial Sequence
  Synthetic oligonucleotide
acgattccacactgcatataggtccaccccc

SEQ ID NO: 126523 - DNA, 35 bp, Artificial Sequence
  Synthetic oligonucleotide
tcactcgtccgcagagtttggctcatctccctgcc

SEQ ID NO: 126524 - DNA, 36 bp, Artificial Sequence
  Synthetic oligonucleotide
aatgggaggggtggggtgtacaggattgggggcgtc

SEQ ID NO: 126525 - DNA, 35 bp, Artificial Sequence
  Synthetic oligonucleotide
tccccagcctgttggtattcccgccgttactccct

SEQ ID NO: 126526 - DNA, 35 bp, Artificial Sequence
  Synthetic oligonucleotide
tactccttgccccggccctctgtgattcctcatct

SEQ ID NO: 126527 - DNA, 35 bp, Artificial Sequence
  Synthetic oligonucleotide
accccaacctacagggcctgtacgccccccccgtt

SEQ ID NO: 126528 - DNA, 35 bp, Artificial Sequence
  Synthetic oligonucleotide
gccccactgcccatgcatcgccatatcgcacacca

SEQ ID NO: 126529 - DNA, 35 bp, Artificial Sequence
  Synthetic oligonucleotide
attgccgcgcctcgacgctcttcagcacttcccca

SEQ ID NO: 126530 - DNA, 35 bp, Artificial Sequence
  Synthetic oligonucleotide
ttactcgacccatgctttcctttaggcacctttca

SEQ ID NO: 126531 - DNA, 37 bp, Artificial Sequence
  Synthetic oligonucleotide
gcgcctgtcactcgtttcttctgttgtccctccccga

SEQ ID NO: 126532 - DNA, 37 bp, Artificial Sequence
  Synthetic oligonucleotide
gtacccgcgggggggatagggacgggtaggacgagga

SEQ ID NO: 126533 - DNA, 37 bp, Artificial Sequence
  Synthetic oligonucleotide
tagcccgcgcgatctccgctgttactcccgccttgga

SEQ ID NO: 126534 - DNA, 35 bp, Artificial Sequence
  Synthetic oligonucleotide
gatccccctgccgaccttggtcttggtcacactta

SEQ ID NO: 126535 - DNA, 35 bp, Artificial Sequence
  Synthetic oligonucleotide
accggtctgccacctgcctctcgcgacgctgctta

SEQ ID NO: 126536 - DNA, 36 bp, Artificial Sequence
  Synthetic oligonucleotide
actgcgtctctccgctcaccctgttcttgcactctc

SEQ ID NO: 126537 - DNA, 35 bp, Artificial Sequence
  Synthetic oligonucleotide
aaggccacccgtcataccggccccgccctgctctc

SEQ ID NO: 126538 - DNA, 35 bp, Artificial Sequence
  Synthetic oligonucleotide
gtgcccttcatttcgttctacctgagtgtcctttc

SEQ ID NO: 126539 - DNA, 35 bp, Artificial Sequence
  Synthetic oligonucleotide
tcgacccgcccacttgcacacgttcctgagctcat

SEQ ID NO: 126540 - DNA, 35 bp, Artificial Sequence
  Synthetic oligonucleotide
tcacaacccacatcgtacttagctaccaaactact

SEQ ID NO: 126541 - DNA, 35 bp, Artificial Sequence
  Synthetic oligonucleotide
gctggttacacgtttgctttcgatccctctgccct

SEQ ID NO: 126542 - DNA, 35 bp, Artificial Sequence
  Synthetic oligonucleotide
gcaccgttacacccttcgtctttgctcccgcgtgt

SEQ ID NO: 126543 - DNA, 36 bp, Artificial Sequence
  Synthetic oligonucleotide
agggggaggggtgggggggaaaataggctggataaa

SEQ ID NO: 126544 - DNA, 36 bp, Artificial Sequence
  Synthetic oligonucleotide
gtctacctcgccatgttctcgttcgcacatctataa

SEQ ID NO: 126545 - DNA, 35 bp, Artificial Sequence
  Synthetic oligonucleotide
ttctccctcctgcccatagtgttgtggctcacaca

SEQ ID NO: 126546 - DNA, 35 bp, Artificial Sequence
  Synthetic oligonucleotide
gcatccgccattgccttcccggcccccgataatca

SEQ ID NO: 126547 - DNA, 37 bp, Artificial Sequence
  Synthetic oligonucleotide
acctacctcagggtggcctatacctcctgctcgccga

SEQ ID NO: 126548 - DNA, 35 bp, Artificial Sequence
  Synthetic oligonucleotide
tcctcaccggatcccaggtcaccatgctctctgcc

SEQ ID NO: 126549 - DNA, 35 bp, Artificial Sequence
  Synthetic oligonucleotide
gtcaaactcggccactcgtaaacgcacacccttcc

SEQ ID NO: 126550 - DNA, 35 bp, Artificial Sequence
  Synthetic oligonucleotide
tgtgacgccaccaggtttacgacacaatccccctc

SEQ ID NO: 126551 - DNA, 35 bp, Artificial Sequence
  Synthetic oligonucleotide
tttccaccgctcgaatttgcacgtattcccttgtc

SEQ ID NO: 126552 - DNA, 35 bp, Artificial Sequence
  Synthetic oligonucleotide
tctgatgccctcgaccccatgccactacgcgaacg

SEQ ID NO: 126553 - DNA, 35 bp, Artificial Sequence
  Synthetic oligonucleotide
tacttgccgccaataacttttgccctcggaccccg

SEQ ID NO: 126554 - DNA, 35 bp, Artificial Sequence
  Synthetic oligonucleotide
gtggtggggatgggggcgggagaaccatgaggcat

SEQ ID NO: 126555 - DNA, 35 bp, Artificial Sequence
  Synthetic oligonucleotide
tgcatgccccttatataacgcccttccctgtgcat

SEQ ID NO: 126556 - DNA, 35 bp, Artificial Sequence
  Synthetic oligonucleotide
acccatcctccgcccttaaggctgcccgtagccca

SEQ ID NO: 126557 - DNA, 36 bp, Artificial Sequence
  Synthetic oligonucleotide
ggaacacggacggccctgtttcttcatccatgccca

SEQ ID NO: 126558 - DNA, 35 bp, Artificial Sequence
  Synthetic oligonucleotide
gcgccgcacattattattggttccacgttccatca

SEQ ID NO: 126559 - DNA, 36 bp, Artificial Sequence
  Synthetic oligonucleotide
gtacaagaggaggggggtgggcaggactaggttaga

SEQ ID NO: 126560 - DNA, 38 bp, Artificial Sequence
  Synthetic oligonucleotide
gtcgcacctccacggtttcttccatgttcatgccctga

SEQ ID NO: 126561 - DNA, 38 bp, Artificial Sequence
  Synthetic oligonucleotide
tctccaacgcactatccctgtcaccttccctcgcttga

SEQ ID NO: 126562 - DNA, 36 bp, Artificial Sequence
  Synthetic oligonucleotide
tcacccgcccttccgtgtttcacgctggcttcttga

SEQ ID NO: 126563 - DNA, 36 bp, Artificial Sequence
  Synthetic oligonucleotide
gccgccccccccgtgatacatcgtacatcgcctcta

SEQ ID NO: 126564 - DNA, 36 bp, Artificial Sequence
  Synthetic oligonucleotide
gacgccgtatggcatcccccactgtcctgctacgta

SEQ ID NO: 126565 - DNA, 35 bp, Artificial Sequence
  Synthetic oligonucleotide
atccccgtaccttgggctttcgcgcccccggcccc

SEQ ID NO: 126566 - DNA, 35 bp, Artificial Sequence
  Synthetic oligonucleotide
gtccccgcctgttgggaacccacttgtactagccc

SEQ ID NO: 126567 - DNA, 36 bp, Artificial Sequence
  Synthetic oligonucleotide
tcattgccgcccccgtacacgcgctgtttcaagctc

SEQ ID NO: 126568 - DNA, 35 bp, Artificial Sequence
  Synthetic oligonucleotide
gggtggcggtggggttttgcggatggcacatcgcg

SEQ ID NO: 126569 - DNA, 35 bp, Artificial Sequence
  Synthetic oligonucleotide
gtcgtcccccgttgttgcttctcttggttacatca

SEQ ID NO: 126570 - DNA, 36 bp, Artificial Sequence
  Synthetic oligonucleotide
tctgaggtggagggcaaggaaggggcagagacgtca

SEQ ID NO: 126571 - DNA, 37 bp, Artificial Sequence
  Synthetic oligonucleotide
gacacccgctcgaaatatctgcaacgccttcctccga

SEQ ID NO: 126572 - DNA, 38 bp, Artificial Sequence
  Synthetic oligonucleotide
agaccggtgaggagggtgggaagggaaagaaaaactga

SEQ ID NO: 126573 - DNA, 36 bp, Artificial Sequence
  Synthetic oligonucleotide
ccacggtccgcctcgacgcgttttctgcctcaccta

SEQ ID NO: 126574 - DNA, 35 bp, Artificial Sequence
  Synthetic oligonucleotide
gcgcaatgtttcgtccgcctctctcgcccgccgcc

SEQ ID NO: 126575 - DNA, 35 bp, Artificial Sequence
  Synthetic oligonucleotide
acgccgctgagtaacgcgcacctggccctcattcc

SEQ ID NO: 126576 - DNA, 35 bp, Artificial Sequence
  Synthetic oligonucleotide
gacctgagcaccgccgcactcgccgaacatattcc

SEQ ID NO: 126577 - DNA, 35 bp, Artificial Sequence
  Synthetic oligonucleotide
gggtgcaacttcccaccattgttcccgtcgttcgc

SEQ ID NO: 126578 - DNA, 35 bp, Artificial Sequence
  Synthetic oligonucleotide
gccgaagccatttctgctccccccttgccggtttc

SEQ ID NO: 126579 - DNA, 35 bp, Artificial Sequence
  Synthetic oligonucleotide
taccgccgttcccaatctcacctgtccacgttccg

SEQ ID NO: 126580 - DNA, 35 bp, Artificial Sequence
  Synthetic oligonucleotide
actccgtccggcgcatcttttcggccctctatttg

SEQ ID NO: 126581 - DNA, 35 bp, Artificial Sequence
  Synthetic oligonucleotide
atgcccctcgctctgttaatccggtccactgatat

SEQ ID NO: 126582 - DNA, 36 bp, Artificial Sequence
  Synthetic oligonucleotide
acaccaccccaccctaagcctgtattatcggtcaca

SEQ ID NO: 126583 - DNA, 36 bp, Artificial Sequence
  Synthetic oligonucleotide
agaccgcaaaggttgggtgggggtggaggaatgcga

SEQ ID NO: 126584 - DNA, 37 bp, Artificial Sequence
  Synthetic oligonucleotide
gattggggaaggggggttaaggaaagggagttgatga

SEQ ID NO: 126585 - DNA, 38 bp, Artificial Sequence
  Synthetic oligonucleotide
atgcccccgttgcatatctatcagccccagtcttctga

SEQ ID NO: 126586 - DNA, 35 bp, Artificial Sequence
  Synthetic oligonucleotide
ttatgccacccgtacccctgcgtttacgtaccgcc

SEQ ID NO: 126587 - DNA, 35 bp, Artificial Sequence
  Synthetic oligonucleotide
atcccgccgggcccatcgaactcattagatcactc

SEQ ID NO: 126588 - DNA, 35 bp, Artificial Sequence
  Synthetic oligonucleotide
ttctcccgccgtcacttcccgctcatgctcggctc

SEQ ID NO: 126589 - DNA, 35 bp, Artificial Sequence
  Synthetic oligonucleotide
gtagccgcacctgctctatccgactcttaaacatg

SEQ ID NO: 126590 - DNA, 35 bp, Artificial Sequence
  Synthetic oligonucleotide
acctgggggacgggggaaggggtaatggtaagtct

SEQ ID NO: 126591 - DNA, 35 bp, Artificial Sequence
  Synthetic oligonucleotide
ttgaggggaaggagcgggggggacgttaccggtgt

SEQ ID NO: 126592 - DNA, 36 bp, Artificial Sequence
  Synthetic oligonucleotide
gtgggtggggcggggagggtacgggtcagaccggga

SEQ ID NO: 126593 - DNA, 38 bp, Artificial Sequence
  Synthetic oligonucleotide
tcctcccaacaccgccattgtcccacgccctgtactga

SEQ ID NO: 126594 - DNA, 37 bp, Artificial Sequence
  Synthetic oligonucleotide
tctcgccgccacaagccacgacccactccctctgtga

SEQ ID NO: 126595 - DNA, 36 bp, Artificial Sequence
  Synthetic oligonucleotide
gatggaggtgaggcggaggataggggccatttgtga

SEQ ID NO: 126596 - DNA, 35 bp, Artificial Sequence
  Synthetic oligonucleotide
tagacgctccgaagtccttgcgatgccttctcacc

SEQ ID NO: 126597 - DNA, 35 bp, Artificial Sequence
  Synthetic oligonucleotide
gctagccccgtaaagtgtctagcactccccctccc

SEQ ID NO: 126598 - DNA, 35 bp, Artificial Sequence
  Synthetic oligonucleotide
tgctatccccctctgctgttttttcttgcgcctcc

SEQ ID NO: 126599 - DNA, 35 bp, Artificial Sequence
  Synthetic oligonucleotide
atccccgcgttacagaccgtcctggcctcttactc

SEQ ID NO: 126600 - DNA, 35 bp, Artificial Sequence
  Synthetic oligonucleotide
actcgtccccgcactttccaccgttcaggccctag

SEQ ID NO: 126601 - DNA, 35 bp, Artificial Sequence
  Synthetic oligonucleotide
gaagagtgataccagggagggtgggacatggggcg

SEQ ID NO: 126602 - DNA, 35 bp, Artificial Sequence
  Synthetic oligonucleotide
tgatacggtgggtagtggggtgggaaagggcgagg

SEQ ID NO: 126603 - DNA, 35 bp, Artificial Sequence
  Synthetic oligonucleotide
tacgagctactatccaccccgccacatgttgccct

SEQ ID NO: 126604 - DNA, 35 bp, Artificial Sequence
  Synthetic oligonucleotide
gttcaggctcccccttctcctttgtaaccgttgct

SEQ ID NO: 126605 - DNA, 35 bp, Artificial Sequence
  Synthetic oligonucleotide
gacatccctcgtcacgccctcctttgtacaccctt

SEQ ID NO: 126606 - DNA, 36 bp, Artificial Sequence
  Synthetic oligonucleotide
gaacccggacagcctgtgatcctcaacatcgcctca

SEQ ID NO: 126607 - DNA, 35 bp, Artificial Sequence
  Synthetic oligonucleotide
gacagtggcggtgagtaggggtggtgggtagggga

SEQ ID NO: 126608 - DNA, 35 bp, Artificial Sequence
  Synthetic oligonucleotide
aatgccccctcgaacttcatcttgttgcccctgga

SEQ ID NO: 126609 - DNA, 38 bp, Artificial Sequence
  Synthetic oligonucleotide
aacctacgccttcccactgcctgtatcacctccggtga

SEQ ID NO: 126610 - DNA, 35 bp, Artificial Sequence
  Synthetic oligonucleotide
ttagcgccgagttcctgccgcacttgatccattac

SEQ ID NO: 126611 - DNA, 35 bp, Artificial Sequence
  Synthetic oligonucleotide
ttccgctcatcctgcgcacgttactacgttttacc

SEQ ID NO: 126612 - DNA, 35 bp, Artificial Sequence
  Synthetic oligonucleotide
gcccaaccaccatgacaaatccctactgtgtgccc

SEQ ID NO: 126613 - DNA, 35 bp, Artificial Sequence
  Synthetic oligonucleotide
accgtgaaggtcgttgcgttacgtctttgttcctc

SEQ ID NO: 126614 - DNA, 35 bp, Artificial Sequence
  Synthetic oligonucleotide
tgcacacaccacggttgctcacctcgcctccgctc

SEQ ID NO: 126615 - DNA, 35 bp, Artificial Sequence
  Synthetic oligonucleotide
tgccaattccgccccgccatgcgtgcatctgtctc

SEQ ID NO: 126616 - DNA, 35 bp, Artificial Sequence
  Synthetic oligonucleotide
tgtgtcagtccgctctttattccatggttcccttc

SEQ ID NO: 126617 - DNA, 34 bp, Artificial Sequence
  Synthetic oligonucleotide
taccaaagtgtccagctgctgctccaccacgttc

SEQ ID NO: 126618 - DNA, 35 bp, Artificial Sequence
  Synthetic oligonucleotide
gtcacacgattacttgccaaacccgcccgccctcg

SEQ ID NO: 126619 - DNA, 35 bp, Artificial Sequence
  Synthetic oligonucleotide
atcccccactgatggacctagttgccgttcgccct

SEQ ID NO: 126620 - DNA, 35 bp, Artificial Sequence
  Synthetic oligonucleotide
ggggtgggcgggtgcggtaggagcgggttttcttt

SEQ ID NO: 126621 - DNA, 37 bp, Artificial Sequence
  Synthetic oligonucleotide
ttgtagacgggcgggagagggagggctgtaagcagga

SEQ ID NO: 126622 - DNA, 34 bp, Artificial Sequence
  Synthetic oligonucleotide
gacactccgccctcatatctgaccctcgcttgga

SEQ ID NO: 126623 - DNA, 38 bp, Artificial Sequence
  Synthetic oligonucleotide
atggcggagggttgtccggggtggttggcctgacctga

SEQ ID NO: 126624 - DNA, 37 bp, Artificial Sequence
  Synthetic oligonucleotide
atcagcatacgccgccccccgcatattgccttcctga

SEQ ID NO: 126625 - DNA, 35 bp, Artificial Sequence
  Synthetic oligonucleotide
aacccacctacattgtgatcttcctcctcggttac

SEQ ID NO: 126626 - DNA, 35 bp, Artificial Sequence
  Synthetic oligonucleotide
tccatatccatctggtgttgaaccgtttcgcctcc

SEQ ID NO: 126627 - DNA, 35 bp, Artificial Sequence
  Synthetic oligonucleotide
gtgtcgccatacgtgcaactgatctgtgctcctcc

SEQ ID NO: 126628 - DNA, 35 bp, Artificial Sequence
  Synthetic oligonucleotide
gtggggccatcactaaaagccgaccgctctcctcc

SEQ ID NO: 126629 - DNA, 35 bp, Artificial Sequence
  Synthetic oligonucleotide
actctcccgccacttgcccgccgatgatcatgtcc

SEQ ID NO: 126630 - DNA, 35 bp, Artificial Sequence
  Synthetic oligonucleotide
acacacttgcccctccacatggttcgaagtccatc

SEQ ID NO: 126631 - DNA, 35 bp, Artificial Sequence
  Synthetic oligonucleotide
atcgcgccccccgtatccttcattcctcggttatc

SEQ ID NO: 126632 - DNA, 35 bp, Artificial Sequence
  Synthetic oligonucleotide
tgatcgctggccgctccacccatgcctcatgtctc

SEQ ID NO: 126633 - DNA, 35 bp, Artificial Sequence
  Synthetic oligonucleotide
gggacggaagggggaattggaagcagttggagcag

SEQ ID NO: 126634 - DNA, 35 bp, Artificial Sequence
  Synthetic oligonucleotide
gaatccccgtcccgtcctgccagcatacctcctag

SEQ ID NO: 126635 - DNA, 35 bp, Artificial Sequence
  Synthetic oligonucleotide
acaatggccactttatgtcacgacctcccccttgg

SEQ ID NO: 126636 - DNA, 35 bp, Artificial Sequence
  Synthetic oligonucleotide
gccactaccatctgctgttgacactactcccttgg

SEQ ID NO: 126637 - DNA, 35 bp, Artificial Sequence
  Synthetic oligonucleotide
gcgacgacttcggctcgtatcctccccattcttgg

SEQ ID NO: 126638 - DNA, 35 bp, Artificial Sequence
  Synthetic oligonucleotide
ttggccgttagctgccgtggtcgtttccccccttg

SEQ ID NO: 126639 - DNA, 35 bp, Artificial Sequence
  Synthetic oligonucleotide
acccccctactacttgcatgacaggcctccgcact

SEQ ID NO: 126640 - DNA, 35 bp, Artificial Sequence
  Synthetic oligonucleotide
tcagccgtccagaactctgctctatctaccattct

SEQ ID NO: 126641 - DNA, 37 bp, Artificial Sequence
  Synthetic oligonucleotide
gccctccgcacatgacttacttctcgcactttgccga

SEQ ID NO: 126642 - DNA, 35 bp, Artificial Sequence
  Synthetic oligonucleotide
tctatccgctgcagcctcccgcggcccctcgagta

SEQ ID NO: 126643 - DNA, 36 bp, Artificial Sequence
  Synthetic oligonucleotide
ttgtgcacacacctgacttcttgccgcctgtcctta

SEQ ID NO: 126644 - DNA, 35 bp, Artificial Sequence
  Synthetic oligonucleotide
actgacccgcagaaagcctgtctgctccattcacc

SEQ ID NO: 126645 - DNA, 35 bp, Artificial Sequence
  Synthetic oligonucleotide
tgcctcaccgccttatgcctaaccttctggaaccc

SEQ ID NO: 126646 - DNA, 35 bp, Artificial Sequence
  Synthetic oligonucleotide
aaccacccgcgcacctcgatccctgcttcgtagcc

SEQ ID NO: 126647 - DNA, 35 bp, Artificial Sequence
  Synthetic oligonucleotide
acattcaatcaccctccgatgtcaggtccacctcc

SEQ ID NO: 126648 - DNA, 35 bp, Artificial Sequence
  Synthetic oligonucleotide
tgcgaccacactacgctgtaccattgcttcacctc

SEQ ID NO: 126649 - DNA, 35 bp, Artificial Sequence
  Synthetic oligonucleotide
gtaccgtcgctcgtcttttttccgcccatgtccag

SEQ ID NO: 126650 - DNA, 35 bp, Artificial Sequence
  Synthetic oligonucleotide
gcaccactcatcggtctacacaccgcctccactat

SEQ ID NO: 126651 - DNA, 36 bp, Artificial Sequence
  Synthetic oligonucleotide
gcatatgcgtggagggagggagaatgggaatgggaa

SEQ ID NO: 126652 - DNA, 36 bp, Artificial Sequence
  Synthetic oligonucleotide
atgacaacttcgccgcaccgccgaccccgctttcca

SEQ ID NO: 126653 - DNA, 36 bp, Artificial Sequence
  Synthetic oligonucleotide
gagcaggctcaatttccgccctcgtcttccttcgca

SEQ ID NO: 126654 - DNA, 37 bp, Artificial Sequence
  Synthetic oligonucleotide
tccacccccccgccatttcgttgcgattgttccacga

SEQ ID NO: 126655 - DNA, 36 bp, Artificial Sequence
  Synthetic oligonucleotide
gacgggcgggaaaggagcagggggcaagcaaaggga

SEQ ID NO: 126656 - DNA, 38 bp, Artificial Sequence
  Synthetic oligonucleotide
atggaggggacggaggggagatggggtagcctcggtga

SEQ ID NO: 126657 - DNA, 35 bp, Artificial Sequence
  Synthetic oligonucleotide
tgtcgcagccacaccttcccggaatatgtcgcctc

SEQ ID NO: 126658 - DNA, 35 bp, Artificial Sequence
  Synthetic oligonucleotide
tgtgccccagtcgaacccgcacccctcactgcttc

SEQ ID NO: 126659 - DNA, 35 bp, Artificial Sequence
  Synthetic oligonucleotide
gttaacccccgctatcacatgccgctagggctttc

SEQ ID NO: 126660 - DNA, 35 bp, Artificial Sequence
  Synthetic oligonucleotide
gttcatccgcctcctatccgtagtttagacgttgt

SEQ ID NO: 126661 - DNA, 37 bp, Artificial Sequence
  Synthetic oligonucleotide
gggaggggggtgtaggtggaacaaaaagcaaggacga

SEQ ID NO: 126662 - DNA, 36 bp, Artificial Sequence
  Synthetic oligonucleotide
attccgagcacgccctgttgccgactcacactctta

SEQ ID NO: 126663 - DNA, 35 bp, Artificial Sequence
  Synthetic oligonucleotide
gcccccatcggagaagacccgcatacacactcgcc

SEQ ID NO: 126664 - DNA, 35 bp, Artificial Sequence
  Synthetic oligonucleotide
gcatccatccgccagctatatcgaatactacccgc

SEQ ID NO: 126665 - DNA, 35 bp, Artificial Sequence
  Synthetic oligonucleotide
attgcatggccgccgccccctttgccctggatatg

SEQ ID NO: 126666 - DNA, 35 bp, Artificial Sequence
  Synthetic oligonucleotide
tgtacgtcccttgccatacgccgccgtacgtccct

SEQ ID NO: 126667 - DNA, 35 bp, Artificial Sequence
  Synthetic oligonucleotide
gaccccactagcatgcattgctgccaccatctggt

SEQ ID NO: 126668 - DNA, 35 bp, Artificial Sequence
  Synthetic oligonucleotide
tgaaccggtctagccgcgacctacccgtccctctt

SEQ ID NO: 126669 - DNA, 35 bp, Artificial Sequence
  Synthetic oligonucleotide
ttgcacccagcctagccgttttcgcctccatttaa

SEQ ID NO: 126670 - DNA, 35 bp, Artificial Sequence
  Synthetic oligonucleotide
tcgcatacggccctcgctactctctcacgccgcca

SEQ ID NO: 126671 - DNA, 36 bp, Artificial Sequence
  Synthetic oligonucleotide
tagacacccactcgtttcatccgtgacatcctctca

SEQ ID NO: 126672 - DNA, 36 bp, Artificial Sequence
  Synthetic oligonucleotide
accatcccatagttactgtgcctgccccgcccttca

SEQ ID NO: 126673 - DNA, 37 bp, Artificial Sequence
  Synthetic oligonucleotide
accactccgcctggtgtactctcttcgtactagccga

SEQ ID NO: 126674 - DNA, 37 bp, Artificial Sequence
  Synthetic oligonucleotide
acaccccggcactactgccctgacgctataccttcga

SEQ ID NO: 126675 - DNA, 37 bp, Artificial Sequence
  Synthetic oligonucleotide
accacgccgctggctacgtctgtccacgctccttcga

SEQ ID NO: 126676 - DNA, 37 bp, Artificial Sequence
  Synthetic oligonucleotide
gcccaaagaagggcggagtgggagggtggaggatgga

SEQ ID NO: 126677 - DNA, 36 bp, Artificial Sequence
  Synthetic oligonucleotide
aactaggcggtgaaacatggaggggtggaggcggta

SEQ ID NO: 126678 - DNA, 35 bp, Artificial Sequence
  Synthetic oligonucleotide
gcactggtcacacctgcacatcgcctatctctgac

SEQ ID NO: 126679 - DNA, 35 bp, Artificial Sequence
  Synthetic oligonucleotide
accagtacacctcactgttcttcattgccaccacc

SEQ ID NO: 126680 - DNA, 35 bp, Artificial Sequence
  Synthetic oligonucleotide
ttgaccgccatccttcgtaagacctcgccggatcc

SEQ ID NO: 126681 - DNA, 35 bp, Artificial Sequence
  Synthetic oligonucleotide
gcccatcttgatccctgcttgtgagccctcttccg

SEQ ID NO: 126682 - DNA, 35 bp, Artificial Sequence
  Synthetic oligonucleotide
tcgcctccacccggcaatccctcgccctatcggcg

SEQ ID NO: 126683 - DNA, 35 bp, Artificial Sequence
  Synthetic oligonucleotide
gctgaccgccatgcaccaccctcgtagagctctcg

SEQ ID NO: 126684 - DNA, 35 bp, Artificial Sequence
  Synthetic oligonucleotide
gggaggtgagggggggagcgagcgcgagcaacatg

SEQ ID NO: 126685 - DNA, 35 bp, Artificial Sequence
  Synthetic oligonucleotide
atgccccgccctccacaacggtgttctgctcgact

SEQ ID NO: 126686 - DNA, 35 bp, Artificial Sequence
  Synthetic oligonucleotide
gtggtgcgcgcccgtacctattagtccccttacct

SEQ ID NO: 126687 - DNA, 35 bp, Artificial Sequence
  Synthetic oligonucleotide
gcacactgcagcaacacatcacgccccggtccttt

SEQ ID NO: 126688 - DNA, 35 bp, Artificial Sequence
  Synthetic oligonucleotide
aactccgacctcactggacgcccttgacgcctcca

SEQ ID NO: 126689 - DNA, 36 bp, Artificial Sequence
  Synthetic oligonucleotide
gcctcgcctccacctcatgacgcactaaatgccgca

SEQ ID NO: 126690 - DNA, 36 bp, Artificial Sequence
  Synthetic oligonucleotide
tcgaaagcctcacacattcacactctcttctgccga

SEQ ID NO: 126691 - DNA, 35 bp, Artificial Sequence
  Synthetic oligonucleotide
ggaaagggggaaaagggagaatatcgggtcgggga

SEQ ID NO: 126692 - DNA, 35 bp, Artificial Sequence
  Synthetic oligonucleotide
ttcccaccaggtcacctcgcctcctacgcccggta

SEQ ID NO: 126693 - DNA, 35 bp, Artificial Sequence
  Synthetic oligonucleotide
tccccaccctactgagcgtgcgctatccatcctta

SEQ ID NO: 126694 - DNA, 35 bp, Artificial Sequence
  Synthetic oligonucleotide
gtcccccactggatctattaagcacctacctgtcc

SEQ ID NO: 126695 - DNA, 35 bp, Artificial Sequence
  Synthetic oligonucleotide
accgctgccgtactattctgctctcattttcctgc

SEQ ID NO: 126696 - DNA, 35 bp, Artificial Sequence
  Synthetic oligonucleotide
ttgcatccatcgctgcggtgcccgatcctcaactc

SEQ ID NO: 126697 - DNA, 35 bp, Artificial Sequence
  Synthetic oligonucleotide
gatgtcaccacaccatcgctcctatagtttgcccg

SEQ ID NO: 126698 - DNA, 35 bp, Artificial Sequence
  Synthetic oligonucleotide
tcccctcagccggcatccctctttgcttcacttca

SEQ ID NO: 126699 - DNA, 36 bp, Artificial Sequence
  Synthetic oligonucleotide
gtccgactgtcctcaggttattgtccccgcccccga

SEQ ID NO: 126700 - DNA, 37 bp, Artificial Sequence
  Synthetic oligonucleotide
tgcgggggtgagtcacgggtggggttcctgcagggga

SEQ ID NO: 126701 - DNA, 35 bp, Artificial Sequence
  Synthetic oligonucleotide
gtactacccggtcatctgtcctcctcctgtctgga

SEQ ID NO: 126702 - DNA, 32 bp, Artificial Sequence
  Synthetic oligonucleotide
tctgtgctcgctatcccacctctaccatctta

SEQ ID NO: 126703 - DNA, 36 bp, Artificial Sequence
  Synthetic oligonucleotide
gtgccccaggcgtcgtcgtccattgcccccttctta

SEQ ID NO: 126704 - DNA, 35 bp, Artificial Sequence
  Synthetic oligonucleotide
tcccgttcacctcaccaacgcgtaaccctgctacc

SEQ ID NO: 126705 - DNA, 35 bp, Artificial Sequence
  Synthetic oligonucleotide
gtcctcgacgcctttgctctcttacgggctacccc

SEQ ID NO: 126706 - DNA, 35 bp, Artificial Sequence
  Synthetic oligonucleotide
gccgtggtatatgccccccgcccgctcatctgccc

SEQ ID NO: 126707 - DNA, 35 bp, Artificial Sequence
  Synthetic oligonucleotide
tcactgggccggtacagcaccgtcatcttgcctcc

SEQ ID NO: 126708 - DNA, 35 bp, Artificial Sequence
  Synthetic oligonucleotide
cctaccatccgtccttgcctgcgctcccgttctcc

SEQ ID NO: 126709 - DNA, 35 bp, Artificial Sequence
  Synthetic oligonucleotide
acgcccctgcaccccttgacccgaggatcccttcc

SEQ ID NO: 126710 - DNA, 35 bp, Artificial Sequence
  Synthetic oligonucleotide
gtcgcctctgcccgcctacacctcggtcaaacccg

SEQ ID NO: 126711 - DNA, 35 bp, Artificial Sequence
  Synthetic oligonucleotide
gtagtcgccagctgtccttcccccgttccgattcg

SEQ ID NO: 126712 - DNA, 35 bp, Artificial Sequence
  Synthetic oligonucleotide
gccacccccacttccgatgcatgtaagccttctct

SEQ ID NO: 126713 - DNA, 35 bp, Artificial Sequence
  Synthetic oligonucleotide
tacgccctcaccatcgagctaactccagtcaactt

SEQ ID NO: 126714 - DNA, 36 bp, Artificial Sequence
  Synthetic oligonucleotide
attcaacccacccgctgtaacttgtcctgtttcgca

SEQ ID NO: 126715 - DNA, 35 bp, Artificial Sequence
  Synthetic oligonucleotide
tcctgatcacccgcctatctttctccgtagaaaga

SEQ ID NO: 126716 - DNA, 37 bp, Artificial Sequence
  Synthetic oligonucleotide
gagcgccgggcgggagcggagggcacaaaccgatgga

SEQ ID NO: 126717 - DNA, 35 bp, Artificial Sequence
  Synthetic oligonucleotide
gtgggcctccttctccgtactagtgcatttctcta

SEQ ID NO: 126718 - DNA, 35 bp, Artificial Sequence
  Synthetic oligonucleotide
ccgaccaccccgtcctgccgtttctatttggtcta

SEQ ID NO: 126719 - DNA, 35 bp, Artificial Sequence
  Synthetic oligonucleotide
gttacaccctccgaaatgaatcgccgggccatgac

SEQ ID NO: 126720 - DNA, 35 bp, Artificial Sequence
  Synthetic oligonucleotide
gtacccctcagacttagcccgatctgacgccaccc

SEQ ID NO: 126721 - DNA, 35 bp, Artificial Sequence
  Synthetic oligonucleotide
tgacccgttcgctccatcggtactgatatccaccc

SEQ ID NO: 126722 - DNA, 35 bp, Artificial Sequence
  Synthetic oligonucleotide
tgatgcctcgcctctgcctccccgtccgctatccc

SEQ ID NO: 126723 - DNA, 35 bp, Artificial Sequence
  Synthetic oligonucleotide
tagcccggcgctcttggccatccgaccgctccgcc

SEQ ID NO: 126724 - DNA, 35 bp, Artificial Sequence
  Synthetic oligonucleotide
gtctgccgcccgactccccgtatccaagttggtcc

SEQ ID NO: 126725 - DNA, 35 bp, Artificial Sequence
  Synthetic oligonucleotide
tgcccgtcgcccttcccacggtatgcccccctgtc

SEQ ID NO: 126726 - DNA, 30 bp, Artificial Sequence
  Synthetic oligonucleotide
gctctcctgcccggctcgactcttttcttc

SEQ ID NO: 126727 - DNA, 35 bp, Artificial Sequence
  Synthetic oligonucleotide
gcgcacttcctcgcgttatctccgcttgtctcccg

SEQ ID NO: 126728 - DNA, 35 bp, Artificial Sequence
  Synthetic oligonucleotide
aagcgccgcactcggtaagcttctgtcccccgccg

SEQ ID NO: 126729 - DNA, 35 bp, Artificial Sequence
  Synthetic oligonucleotide
tgtggccccacctatctccgagaacgtacccctgg

SEQ ID NO: 126730 - DNA, 35 bp, Artificial Sequence
  Synthetic oligonucleotide
acaccacccactcctgaatgtgcctcctccgaact

SEQ ID NO: 126731 - DNA, 35 bp, Artificial Sequence
  Synthetic oligonucleotide
gttacccaacatcgaccctggccttgcccaccgct

SEQ ID NO: 126732 - DNA, 35 bp, Artificial Sequence
  Synthetic oligonucleotide
atgatgcaggcctccagcacggactaactctctct

SEQ ID NO: 126733 - DNA, 35 bp, Artificial Sequence
  Synthetic oligonucleotide
tccgccacctggtcgtatcatgcaccttctcgcaa

SEQ ID NO: 126734 - DNA, 37 bp, Artificial Sequence
  Synthetic oligonucleotide
agaccccgtacgccctgttcatttatctcgcccatga

SEQ ID NO: 126735 - DNA, 36 bp, Artificial Sequence
  Synthetic oligonucleotide
gcctgccattactgtaacctcacctagcccccctga

SEQ ID NO: 126736 - DNA, 35 bp, Artificial Sequence
  Synthetic oligonucleotide
tccagcacctcttctgtcattactagcttacatcc

SEQ ID NO: 126737 - DNA, 35 bp, Artificial Sequence
  Synthetic oligonucleotide
aacgtcaggcctcatcgtcttgttacacgcctatc

SEQ ID NO: 126738 - DNA, 33 bp, Artificial Sequence
  Synthetic oligonucleotide
tgctgccctggtctcgtaaccctgcctcctgtc

SEQ ID NO: 126739 - DNA, 35 bp, Artificial Sequence
  Synthetic oligonucleotide
acgatcacatctccgttcatattgctggtcctgtc

SEQ ID NO: 126740 - DNA, 35 bp, Artificial Sequence
  Synthetic oligonucleotide
gtcagacacgcctccccgtccaccgactcaccccg

SEQ ID NO: 126741 - DNA, 35 bp, Artificial Sequence
  Synthetic oligonucleotide
gccacacgaccgcaatgactgtccccccaactccg

SEQ ID NO: 126742 - DNA, 35 bp, Artificial Sequence
  Synthetic oligonucleotide
tgcccatggctcccgcgcacatcctacattcctcg

SEQ ID NO: 126743 - DNA, 35 bp, Artificial Sequence
  Synthetic oligonucleotide
acgactacatcttgcccttactcgtttgcccttcg

SEQ ID NO: 126744 - DNA, 35 bp, Artificial Sequence
  Synthetic oligonucleotide
acgccccactgttggtacgattttcagttatctct

SEQ ID NO: 126745 - DNA, 36 bp, Artificial Sequence
  Synthetic oligonucleotide
gatggccccacccttttccgtgttctcttgtttgca

SEQ ID NO: 126746 - DNA, 37 bp, Artificial Sequence
  Synthetic oligonucleotide
gtggtagggcgatggggacgggggggagggttttaga

SEQ ID NO: 126747 - DNA, 38 bp, Artificial Sequence
  Synthetic oligonucleotide
acgatctccgcccttctcctgtcctgtgcctttgctga

SEQ ID NO: 126748 - DNA, 35 bp, Artificial Sequence
  Synthetic oligonucleotide
tttggcatactcacacttgtcccgtcggtcttccc

SEQ ID NO: 126749 - DNA, 35 bp, Artificial Sequence
  Synthetic oligonucleotide
aagagaggggggaggtgtgggcaaaagatagagcc

SEQ ID NO: 126750 - DNA, 35 bp, Artificial Sequence
  Synthetic oligonucleotide
gtcacccatcatatctcgttcttgaagctatctcg

SEQ ID NO: 126751 - DNA, 35 bp, Artificial Sequence
  Synthetic oligonucleotide
acccctcgccgctcaaggtaccctctttgtccctg

SEQ ID NO: 126752 - DNA, 35 bp, Artificial Sequence
  Synthetic oligonucleotide
ttatgacacacggggggggaaagggcgggacattt

SEQ ID NO: 126753 - DNA, 36 bp, Artificial Sequence
  Synthetic oligonucleotide
gtcagcacgccccctccgacgttacctactgctgca

SEQ ID NO: 126754 - DNA, 36 bp, Artificial Sequence
  Synthetic oligonucleotide
gtgtgccccgtatgacgcccgccctattgtttgtca

SEQ ID NO: 126755 - DNA, 37 bp, Artificial Sequence
  Synthetic oligonucleotide
ttagcccccgtgcccctttgtaaactgaccaccacga

SEQ ID NO: 126756 - DNA, 35 bp, Artificial Sequence
  Synthetic oligonucleotide
tcacgatgtacgcccttgtcttttattcgtctcac

SEQ ID NO: 126757 - DNA, 35 bp, Artificial Sequence
  Synthetic oligonucleotide
tgtacctcgccccttgtcgttgaccaacttttgac

SEQ ID NO: 126758 - DNA, 35 bp, Artificial Sequence
  Synthetic oligonucleotide
tgtccttgcccgactctccaaagccacgtaatacc

SEQ ID NO: 126759 - DNA, 35 bp, Artificial Sequence
  Synthetic oligonucleotide
atcccccccgtccattgtgccccggtagggttacc

SEQ ID NO: 126760 - DNA, 35 bp, Artificial Sequence
  Synthetic oligonucleotide
gcgcccctcgcacctaatccgtggttaaatctccc

SEQ ID NO: 126761 - DNA, 35 bp, Artificial Sequence
  Synthetic oligonucleotide
ggttcgctcatcgccccttgcatttcctcgccgtg

SEQ ID NO: 126762 - DNA, 35 bp, Artificial Sequence
  Synthetic oligonucleotide
ttcgtctaacggcacatgacatcctgccgctccct

SEQ ID NO: 126763 - DNA, 36 bp, Artificial Sequence
  Synthetic oligonucleotide
gatgtccgccgcctagctcgtttcttttcccacgga

SEQ ID NO: 126764 - DNA, 37 bp, Artificial Sequence
  Synthetic oligonucleotide
gcccccccacacatacttcccatgagacaacgggtga

SEQ ID NO: 126765 - DNA, 38 bp, Artificial Sequence
  Synthetic oligonucleotide
tctgtgaccgcccgaccttatttgtacctctcacttga

SEQ ID NO: 126766 - DNA, 38 bp, Artificial Sequence
  Synthetic oligonucleotide
gtccgtgcccctgctgagcactagaataccctctttga

SEQ ID NO: 126767 - DNA, 38 bp, Artificial Sequence
  Synthetic oligonucleotide
aaccgccccatcgtgcgtcgacccctcgcccgttttga

SEQ ID NO: 126768 - DNA, 35 bp, Artificial Sequence
  Synthetic oligonucleotide
gaacatcaacaacctctgtcgtcgccaccgccccc

SEQ ID NO: 126769 - DNA, 35 bp, Artificial Sequence
  Synthetic oligonucleotide
actccatcccgcccaagttcttgacctcgcactcc

SEQ ID NO: 126770 - DNA, 35 bp, Artificial Sequence
  Synthetic oligonucleotide
tccagccacaccgtcgctagttccttcttccgccg

SEQ ID NO: 126771 - DNA, 35 bp, Artificial Sequence
  Synthetic oligonucleotide
ttcccaccgcactaatgtttccgtcgcccttttcg

SEQ ID NO: 126772 - DNA, 35 bp, Artificial Sequence
  Synthetic oligonucleotide
tgacattcctcaagcctacccgctacccctcctgg

SEQ ID NO: 126773 - DNA, 36 bp, Artificial Sequence
  Synthetic oligonucleotide
atgagagtgaggtggagggcgaataaagggatgaaa

SEQ ID NO: 126774 - DNA, 36 bp, Artificial Sequence
  Synthetic oligonucleotide
taagcaatgggggggtagggaagggacctttgtaca

SEQ ID NO: 126775 - DNA, 37 bp, Artificial Sequence
  Synthetic oligonucleotide
tgcttgggtgggtgaggggaggggtgcgccatgcaga

SEQ ID NO: 126776 - DNA, 37 bp, Artificial Sequence
  Synthetic oligonucleotide
ggatgtgcgttggatggggatagggggggcggtcgga

SEQ ID NO: 126777 - DNA, 37 bp, Artificial Sequence
  Synthetic oligonucleotide
tccccgtcgccctatgcactccaatacgccatcctga

SEQ ID NO: 126778 - DNA, 38 bp, Artificial Sequence
  Synthetic oligonucleotide
gccgtctcggctccatttctgtattattgcccttctga

SEQ ID NO: 126779 - DNA, 37 bp, Artificial Sequence
  Synthetic oligonucleotide
tgagggcgggtgggactgtagagggatagtacagtga

SEQ ID NO: 126780 - DNA, 36 bp, Artificial Sequence
  Synthetic oligonucleotide
gtaaggcggagggggatagcggggaaaggattggta

SEQ ID NO: 126781 - DNA, 36 bp, Artificial Sequence
  Synthetic oligonucleotide
gagtatacgagagggggtcgggggggcgcggtgtta

SEQ ID NO: 126782 - DNA, 35 bp, Artificial Sequence
  Synthetic oligonucleotide
gtagcccccgacccctgcttttcgatctgacccgc

SEQ ID NO: 126783 - DNA, 35 bp, Artificial Sequence
  Synthetic oligonucleotide
ttacccccattcatccgtagtacgctgccccctgc

SEQ ID NO: 126784 - DNA, 35 bp, Artificial Sequence
  Synthetic oligonucleotide
gaggatacggccgcagatatcaggggggagggggg

SEQ ID NO: 126785 - DNA, 35 bp, Artificial Sequence
  Synthetic oligonucleotide
acgagctacctccccccggtcgctaccgttcacct

SEQ ID NO: 126786 - DNA, 35 bp, Artificial Sequence
  Synthetic oligonucleotide
gtcctcgccacttacatcacctgcaccggtccggt

SEQ ID NO: 126787 - DNA, 35 bp, Artificial Sequence
  Synthetic oligonucleotide
tagcgtcgtgctcgctctctgtccctcgttcctgt

SEQ ID NO: 126788 - DNA, 35 bp, Artificial Sequence
  Synthetic oligonucleotide
taaagcacgtcaatcgccatttacctccgaccctt

SEQ ID NO: 126789 - DNA, 35 bp, Artificial Sequence
  Synthetic oligonucleotide
atctgctgccacttgatgctgccccaccgtcctca

SEQ ID NO: 126790 - DNA, 36 bp, Artificial Sequence
  Synthetic oligonucleotide
tccgccggtaccactgagtgccttcgccatctttca

SEQ ID NO: 126791 - DNA, 37 bp, Artificial Sequence
  Synthetic oligonucleotide
acacccgctaaaggaaggggtggaaggggatgggaga

SEQ ID NO: 126792 - DNA, 37 bp, Artificial Sequence
  Synthetic oligonucleotide
tgaccgtgcctatgccacccggtgctcgttcccccga

SEQ ID NO: 126793 - DNA, 35 bp, Artificial Sequence
  Synthetic oligonucleotide
tagtacgccacgcgccccactgagccctgtctgcc

SEQ ID NO: 126794 - DNA, 35 bp, Artificial Sequence
  Synthetic oligonucleotide
tgccgacacggccctcattacggtcatcattctcc

SEQ ID NO: 126795 - DNA, 35 bp, Artificial Sequence
  Synthetic oligonucleotide
gtagcgcgcctcccattcttttaactcgtccgtgc

SEQ ID NO: 126796 - DNA, 35 bp, Artificial Sequence
  Synthetic oligonucleotide
tgctcagcccatcccaccgtgctccaatttacatc

SEQ ID NO: 126797 - DNA, 35 bp, Artificial Sequence
  Synthetic oligonucleotide
gccgacagatccccgctctccgccctactaacctc

SEQ ID NO: 126798 - DNA, 35 bp, Artificial Sequence
  Synthetic oligonucleotide
gccgttccgctttcccctgtcgcactatccgcctc

SEQ ID NO: 126799 - DNA, 35 bp, Artificial Sequence
  Synthetic oligonucleotide
aaccgactggtcacgtccttggctccattcctctg

SEQ ID NO: 126800 - DNA, 35 bp, Artificial Sequence
  Synthetic oligonucleotide
accagttcgccgcccctccataattgtgccgccat

SEQ ID NO: 126801 - DNA, 35 bp, Artificial Sequence
  Synthetic oligonucleotide
gtccgccgaagggtcaaccggccccccgcccctgt

SEQ ID NO: 126802 - DNA, 35 bp, Artificial Sequence
  Synthetic oligonucleotide
atgcgagggggggagtggagggtattgtgttggtt

SEQ ID NO: 126803 - DNA, 35 bp, Artificial Sequence
  Synthetic oligonucleotide
atagaggggagggaggcgggagcaatccacaggaa

SEQ ID NO: 126804 - DNA, 36 bp, Artificial Sequence
  Synthetic oligonucleotide
tgtccccctgcccagtatcgatccatttcttacgga

SEQ ID NO: 126805 - DNA, 37 bp, Artificial Sequence
  Synthetic oligonucleotide
aagagggggagatgcactgaggggagtgaaggaggga

SEQ ID NO: 126806 - DNA, 37 bp, Artificial Sequence
  Synthetic oligonucleotide
atgccaggggaggggggggcagaatcaagagtcggga

SEQ ID NO: 126807 - DNA, 38 bp, Artificial Sequence
  Synthetic oligonucleotide
ttgccagccagcatccgtacatcgccccctccaactga

SEQ ID NO: 126808 - DNA, 38 bp, Artificial Sequence
  Synthetic oligonucleotide
ggaggccaccgacatttcggtatttgttccatccctga

SEQ ID NO: 126809 - DNA, 38 bp, Artificial Sequence
  Synthetic oligonucleotide
ttatgcccgccatcattgtaacctgcctcctactctga

SEQ ID NO: 126810 - DNA, 35 bp, Artificial Sequence
  Synthetic oligonucleotide
tgaggtccattgtgccccgccatgatcatcccccc

SEQ ID NO: 126811 - DNA, 35 bp, Artificial Sequence
  Synthetic oligonucleotide
tccggaggatgtacggtgcctcccctttttgcccc

SEQ ID NO: 126812 - DNA, 35 bp, Artificial Sequence
  Synthetic oligonucleotide
acagtccgacgcatcccgcctgctttaaagcctcc

SEQ ID NO: 126813 - DNA, 35 bp, Artificial Sequence
  Synthetic oligonucleotide
tcgtgcccggagagctacgcccttgcccgttactc

SEQ ID NO: 126814 - DNA, 35 bp, Artificial Sequence
  Synthetic oligonucleotide
gtacctgtagctgtccattgcccttgctacctctc

SEQ ID NO: 126815 - DNA, 35 bp, Artificial Sequence
  Synthetic oligonucleotide
gttggccagcctttccagcgttcccacacccagtc

SEQ ID NO: 126816 - DNA, 35 bp, Artificial Sequence
  Synthetic oligonucleotide
tgtccatcgcccccaccacctcgttaactcgagcg

SEQ ID NO: 126817 - DNA, 35 bp, Artificial Sequence
  Synthetic oligonucleotide
actgacgtcaagccattgccccgctttctcattcg

SEQ ID NO: 126818 - DNA, 35 bp, Artificial Sequence
  Synthetic oligonucleotide
gcactccgcccacacgaatcaatcgtcgctctcct

SEQ ID NO: 126819 - DNA, 35 bp, Artificial Sequence
  Synthetic oligonucleotide
ttacccagcccggcgcgttaactgccattcttcca

SEQ ID NO: 126820 - DNA, 35 bp, Artificial Sequence
  Synthetic oligonucleotide
gccctcaccatcaacacttcgctcgtgctgttcca

SEQ ID NO: 126821 - DNA, 36 bp, Artificial Sequence
  Synthetic oligonucleotide
tagacgtaccgacaggacggcccttgttccccctca

SEQ ID NO: 126822 - DNA, 35 bp, Artificial Sequence
  Synthetic oligonucleotide
tgatgtcgccagacactcctgcacgccccctttca

SEQ ID NO: 126823 - DNA, 37 bp, Artificial Sequence
  Synthetic oligonucleotide
gaggacggacggaagggagggacgtgaacaggttgga

SEQ ID NO: 126824 - DNA, 35 bp, Artificial Sequence
  Synthetic oligonucleotide
gccacctctccatcctgcctcttagcgccttccta

SEQ ID NO: 126825 - DNA, 36 bp, Artificial Sequence
  Synthetic oligonucleotide
atgaccccagatgacttgctcgttccctgtctgtta

SEQ ID NO: 126826 - DNA, 35 bp, Artificial Sequence
  Synthetic oligonucleotide
gggggctggttgaacagggagggaggggtttacac

SEQ ID NO: 126827 - DNA, 35 bp, Artificial Sequence
  Synthetic oligonucleotide
acgttacgtacgccactcaccaccgacgcccggac

SEQ ID NO: 126828 - DNA, 35 bp, Artificial Sequence
  Synthetic oligonucleotide
gctgtggcgcttaccggttatctccatttgtttcc

SEQ ID NO: 126829 - DNA, 35 bp, Artificial Sequence
  Synthetic oligonucleotide
acaacacccgccatccgtgctcatcactcacacgc

SEQ ID NO: 126830 - DNA, 35 bp, Artificial Sequence
  Synthetic oligonucleotide
gagaaacgtccggatctgcttcgttcgtcacccgc

SEQ ID NO: 126831 - DNA, 35 bp, Artificial Sequence
  Synthetic oligonucleotide
gccgtcgtgacaatctgtcatcccttttccccttc

SEQ ID NO: 126832 - DNA, 35 bp, Artificial Sequence
  Synthetic oligonucleotide
gatccatcacccacactctgttagcctttagcttc

SEQ ID NO: 126833 - DNA, 35 bp, Artificial Sequence
  Synthetic oligonucleotide
agtcacccgacgccagactcttcgcctcgcccttg

SEQ ID NO: 126834 - DNA, 35 bp, Artificial Sequence
  Synthetic oligonucleotide
gtcactctggcgttcccttctgacccttccacgct

SEQ ID NO: 126835 - DNA, 35 bp, Artificial Sequence
  Synthetic oligonucleotide
tacacccagcgagatcactgtccgcccatccctct

SEQ ID NO: 126836 - DNA, 35 bp, Artificial Sequence
  Synthetic oligonucleotide
tactgtcaacgttgcctctgttctatgtcctgtct

SEQ ID NO: 126837 - DNA, 36 bp, Artificial Sequence
  Synthetic oligonucleotide
agtggagggagcaatatggggggagtgagtagcgaa

SEQ ID NO: 126838 - DNA, 36 bp, Artificial Sequence
  Synthetic oligonucleotide
gcaagtttaggcgggaggtggggaagggaggggtaa

SEQ ID NO: 126839 - DNA, 36 bp, Artificial Sequence
  Synthetic oligonucleotide
gagcgcccagctccatctcctgcctttggactccca

SEQ ID NO: 126840 - DNA, 35 bp, Artificial Sequence
  Synthetic oligonucleotide
attgggagaagggggagaggtagaagaacgggaga

SEQ ID NO: 126841 - DNA, 37 bp, Artificial Sequence
  Synthetic oligonucleotide
tcctggactgggcgggtgggttctaaagtcggggaga

SEQ ID NO: 126842 - DNA, 38 bp, Artificial Sequence
  Synthetic oligonucleotide
actaagccggggtgggaggcggggaacactaagactga

SEQ ID NO: 126843 - DNA, 35 bp, Artificial Sequence
  Synthetic oligonucleotide
ggatggagcgggtgaagggttgggggtgggtctga

SEQ ID NO: 126844 - DNA, 35 bp, Artificial Sequence
  Synthetic oligonucleotide
tccgatcggccgtgatcaatgtcacctgtctcccc

SEQ ID NO: 126845 - DNA, 35 bp, Artificial Sequence
  Synthetic oligonucleotide
tgtatacccgtcgcttgcctgtactgtaccccatc

SEQ ID NO: 126846 - DNA, 35 bp, Artificial Sequence
  Synthetic oligonucleotide
gacgcctcactgatttactaaatgcattgcctctc

SEQ ID NO: 126847 - DNA, 35 bp, Artificial Sequence
  Synthetic oligonucleotide
gatgccgtcacgtacactacctttcacccatcgtc

SEQ ID NO: 126848 - DNA, 35 bp, Artificial Sequence
  Synthetic oligonucleotide
tcaccgcccatattacctccgccgcctcaacggtc

SEQ ID NO: 126849 - DNA, 35 bp, Artificial Sequence
  Synthetic oligonucleotide
tagaccccggagcgcatttgttgctttcttgttct

SEQ ID NO: 126850 - DNA, 35 bp, Artificial Sequence
  Synthetic oligonucleotide
tacatgcccatctgcctttgtttccaacctaacca

SEQ ID NO: 126851 - DNA, 35 bp, Artificial Sequence
  Synthetic oligonucleotide
gactcacccagccgcccattaatatctgcccagca

SEQ ID NO: 126852 - DNA, 36 bp, Artificial Sequence
  Synthetic oligonucleotide
gacccgccttaggaattcggtcgcccctcttcatca

SEQ ID NO: 126853 - DNA, 37 bp, Artificial Sequence
  Synthetic oligonucleotide
tgctacgtcaacttgccatcacgcgttcctccttaga

SEQ ID NO: 126854 - DNA, 36 bp, Artificial Sequence
  Synthetic oligonucleotide
gcatgcacagtagtatcctgtcccgccccctatcga

SEQ ID NO: 126855 - DNA, 31 bp, Artificial Sequence
  Synthetic oligonucleotide
tcatacacgccgccccaccgcttctcttcga

SEQ ID NO: 126856 - DNA, 36 bp, Artificial Sequence
  Synthetic oligonucleotide
gtggggaggagatggagggtggcctggcagaaggga

SEQ ID NO: 126857 - DNA, 37 bp, Artificial Sequence
  Synthetic oligonucleotide
ttgacacacgtggatcggggcaatagggcgggaggga

SEQ ID NO: 126858 - DNA, 35 bp, Artificial Sequence
  Synthetic oligonucleotide
tccacgtggaactgcacaacccgaccctcttagta

SEQ ID NO: 126859 - DNA, 35 bp, Artificial Sequence
  Synthetic oligonucleotide
tgtgggtcgtcgccgcttgtctcatcattccctta

SEQ ID NO: 126860 - DNA, 35 bp, Artificial Sequence
  Synthetic oligonucleotide
gatgggaagtcataggggcggagggtggggtgtta

SEQ ID NO: 126861 - DNA, 35 bp, Artificial Sequence
  Synthetic oligonucleotide
aaccccgcctatccgtcactctcgtcattcatacc

SEQ ID NO: 126862 - DNA, 35 bp, Artificial Sequence
  Synthetic oligonucleotide
gcccccccttcgtacctttgctccaccgggttacc

SEQ ID NO: 126863 - DNA, 35 bp, Artificial Sequence
  Synthetic oligonucleotide
tccccggtgttgatgctcacgcctgctcctgtccc

SEQ ID NO: 126864 - DNA, 35 bp, Artificial Sequence
  Synthetic oligonucleotide
ttacgcgggtgggggcatgggtggggtggtgcggc

SEQ ID NO: 126865 - DNA, 35 bp, Artificial Sequence
  Synthetic oligonucleotide
gagcacggcacactagccacgacgtcactaccatc

SEQ ID NO: 126866 - DNA, 35 bp, Artificial Sequence
  Synthetic oligonucleotide
acaccgcacatcttgaactcaatcacgggccccat

SEQ ID NO: 126867 - DNA, 35 bp, Artificial Sequence
  Synthetic oligonucleotide
agcgctgactcagccgccaccttctcctgccccgt

SEQ ID NO: 126868 - DNA, 36 bp, Artificial Sequence
  Synthetic oligonucleotide
ggacgctgcaatttgggtagggtgggagggtactaa

SEQ ID NO: 126869 - DNA, 35 bp, Artificial Sequence
  Synthetic oligonucleotide
gccgatcttccgcccgccataccgctaccagacga

SEQ ID NO: 126870 - DNA, 37 bp, Artificial Sequence
  Synthetic oligonucleotide
gccttctgcatcactgttctactcccccgcccgccga

SEQ ID NO: 126871 - DNA, 37 bp, Artificial Sequence
  Synthetic oligonucleotide
gagggagggagcggggcctcgcgtggtggggaaggga

SEQ ID NO: 126872 - DNA, 37 bp, Artificial Sequence
  Synthetic oligonucleotide
tatgtgtggaagggggctaaggggaggaggacgggga

SEQ ID NO: 126873 - DNA, 36 bp, Artificial Sequence
  Synthetic oligonucleotide
gatcccccactcctgttcgtatttgccccccccata

SEQ ID NO: 126874 - DNA, 35 bp, Artificial Sequence
  Synthetic oligonucleotide
gcatgcctccagtttcatccagtccgttactacac

SEQ ID NO: 126875 - DNA, 35 bp, Artificial Sequence
  Synthetic oligonucleotide
gagaccctcctcctatgttcccgtggcctcactac

SEQ ID NO: 126876 - DNA, 35 bp, Artificial Sequence
  Synthetic oligonucleotide
ggaccctacccgcctgtcttagcattttagcctac

SEQ ID NO: 126877 - DNA, 35 bp, Artificial Sequence
  Synthetic oligonucleotide
tctacaccatctcgccttgagtgaccttatcgtac

SEQ ID NO: 126878 - DNA, 35 bp, Artificial Sequence
  Synthetic oligonucleotide
acgcgcctcaccctgtgccgttttgctatggctcc

SEQ ID NO: 126879 - DNA, 35 bp, Artificial Sequence
  Synthetic oligonucleotide
tggggaggggaggtcgggggcgcggaggaaggtgc

SEQ ID NO: 126880 - DNA, 35 bp, Artificial Sequence
  Synthetic oligonucleotide
acgaccacatctctatgctgcctgcactccccatc

SEQ ID NO: 126881 - DNA, 35 bp, Artificial Sequence
  Synthetic oligonucleotide
tgtacccgccccctgtatgcccttcgcaacttatc

SEQ ID NO: 126882 - DNA, 35 bp, Artificial Sequence
  Synthetic oligonucleotide
acgccccgccctcctcagcatggaccgttttaccg

SEQ ID NO: 126883 - DNA, 35 bp, Artificial Sequence
  Synthetic oligonucleotide
gcaccccgcctccttgtttcgccccgcttcgcgcg

SEQ ID NO: 126884 - DNA, 35 bp, Artificial Sequence
  Synthetic oligonucleotide
ttctaaacgacgtccgcacgcatccccagccctct

SEQ ID NO: 126885 - DNA, 36 bp, Artificial Sequence
  Synthetic oligonucleotide
aatcacgcggggggtaaacgggtagggggggcgaca

SEQ ID NO: 126886 - DNA, 36 bp, Artificial Sequence
  Synthetic oligonucleotide
accgacaaacccccctgattatactaggccacacca

SEQ ID NO: 126887 - DNA, 36 bp, Artificial Sequence
  Synthetic oligonucleotide
tccgattaccgccgggccctcgatgcttcgcctcca

SEQ ID NO: 126888 - DNA, 35 bp, Artificial Sequence
  Synthetic oligonucleotide
gcctcctcacctctgcaggacagcaccccccttca

SEQ ID NO: 126889 - DNA, 36 bp, Artificial Sequence
  Synthetic oligonucleotide
actcccccgctgattcgaacttcgcacctgccttca

SEQ ID NO: 126890 - DNA, 36 bp, Artificial Sequence
  Synthetic oligonucleotide
tgccccccccgcctaattccctgagcccggttcgga

SEQ ID NO: 126891 - DNA, 37 bp, Artificial Sequence
  Synthetic oligonucleotide
gggaatagcacatagggggaaggagtggggagaggga

SEQ ID NO: 126892 - DNA, 37 bp, Artificial Sequence
  Synthetic oligonucleotide
gacgggaaactccaccttcgtcccttcactctactga

SEQ ID NO: 126893 - DNA, 38 bp, Artificial Sequence
  Synthetic oligonucleotide
atcgtacaatgcccagacgcgcctccacctcaccctga

SEQ ID NO: 126894 - DNA, 35 bp, Artificial Sequence
  Synthetic oligonucleotide
tctacaccgcccgacctgtcgatgcacaacttcta

SEQ ID NO: 126895 - DNA, 36 bp, Artificial Sequence
  Synthetic oligonucleotide
gagtgtggggcgggtagtagtagacggggggcatta

SEQ ID NO: 126896 - DNA, 35 bp, Artificial Sequence
  Synthetic oligonucleotide
gccatacccgttattcaatcgccccctcttcgcgc

SEQ ID NO: 126897 - DNA, 35 bp, Artificial Sequence
  Synthetic oligonucleotide
gtcaccttgcatcggtaccgctttcgtccaccctc

SEQ ID NO: 126898 - DNA, 35 bp, Artificial Sequence
  Synthetic oligonucleotide
agccaatccgctgactctatctgctaggtcctttc

SEQ ID NO: 126899 - DNA, 35 bp, Artificial Sequence
  Synthetic oligonucleotide
tcctgccacccccctgccatacgtcccggccacag

SEQ ID NO: 126900 - DNA, 35 bp, Artificial Sequence
  Synthetic oligonucleotide
aatacgccaccgcctcattgcaatacatcctctag

SEQ ID NO: 126901 - DNA, 35 bp, Artificial Sequence
  Synthetic oligonucleotide
accacccgccagatattgccaccctgtcaaccgcg

SEQ ID NO: 126902 - DNA, 35 bp, Artificial Sequence
  Synthetic oligonucleotide
acatgccggctggtaactttcccctggatccctct

SEQ ID NO: 126903 - DNA, 35 bp, Artificial Sequence
  Synthetic oligonucleotide
aatcgcctccgcctaactgtttgccgtttttccaa

SEQ ID NO: 126904 - DNA, 36 bp, Artificial Sequence
  Synthetic oligonucleotide
gaccccctcacatggccactttcacccgcgagtaca

SEQ ID NO: 126905 - DNA, 35 bp, Artificial Sequence
  Synthetic oligonucleotide
taccccgcatcgcatcctgcgccccctatatacca

SEQ ID NO: 126906 - DNA, 36 bp, Artificial Sequence
  Synthetic oligonucleotide
gccctccccccctgatgtcttccgtacgtcgcccca

SEQ ID NO: 126907 - DNA, 36 bp, Artificial Sequence
  Synthetic oligonucleotide
atcaccactgccctgttagcaactgaaacttttcca

SEQ ID NO: 126908 - DNA, 36 bp, Artificial Sequence
  Synthetic oligonucleotide
tccgcaccccgtgctctggggaacacaccctcctca

SEQ ID NO: 126909 - DNA, 36 bp, Artificial Sequence
  Synthetic oligonucleotide
atcgcggcccgcgcagccgccacacctcccctgtca

SEQ ID NO: 126910 - DNA, 38 bp, Artificial Sequence
  Synthetic oligonucleotide
gtacccgcccctgtgccgctcaaaacttgccttactga

SEQ ID NO: 126911 - DNA, 35 bp, Artificial Sequence
  Synthetic oligonucleotide
tagacttcgcccctccaatctgttgctgccttcac

SEQ ID NO: 126912 - DNA, 35 bp, Artificial Sequence
  Synthetic oligonucleotide
tcatcatgacgccctgtacacccgcatctgactcc

SEQ ID NO: 126913 - DNA, 35 bp, Artificial Sequence
  Synthetic oligonucleotide
gtggaatggaaaaaccggagcagaggagtgaggag

SEQ ID NO: 126914 - DNA, 35 bp, Artificial Sequence
  Synthetic oligonucleotide
atcccgtcgccctctccttaggcctgcattttgag

SEQ ID NO: 126915 - DNA, 35 bp, Artificial Sequence
  Synthetic oligonucleotide
gccccgcccgttccgctgcactgtttaatttttcg

SEQ ID NO: 126916 - DNA, 35 bp, Artificial Sequence
  Synthetic oligonucleotide
acgcccccccttgatgagcttcctatcgcactcgg

SEQ ID NO: 126917 - DNA, 35 bp, Artificial Sequence
  Synthetic oligonucleotide
gcccgcgcacctacccacgcccagtcgctcccagt

SEQ ID NO: 126918 - DNA, 36 bp, Artificial Sequence
  Synthetic oligonucleotide
tctgttcgctccggtgcgcactataattcctcgtaa

SEQ ID NO: 126919 - DNA, 36 bp, Artificial Sequence
  Synthetic oligonucleotide
taccaactgccgccactttatcatcacagccgcgca

SEQ ID NO: 126920 - DNA, 37 bp, Artificial Sequence
  Synthetic oligonucleotide
gtgccgtagcaactagaccaggggggaaggaggggga

SEQ ID NO: 126921 - DNA, 37 bp, Artificial Sequence
  Synthetic oligonucleotide
gtctgcctcagcctcccccgggacccatcacagctga

SEQ ID NO: 126922 - DNA, 36 bp, Artificial Sequence
  Synthetic oligonucleotide
tgcctccccatcaaattggactatctgccgtaccta

SEQ ID NO: 126923 - DNA, 35 bp, Artificial Sequence
  Synthetic oligonucleotide
agttcgcccccaccgcggtgtccccagttacccgc

SEQ ID NO: 126924 - DNA, 35 bp, Artificial Sequence
  Synthetic oligonucleotide
tgacgccccccacttacccccgccgtgactttagg

SEQ ID NO: 126925 - DNA, 35 bp, Artificial Sequence
  Synthetic oligonucleotide
tcctacctaccgccctctttgcttgcccctactgg

SEQ ID NO: 126926 - DNA, 35 bp, Artificial Sequence
  Synthetic oligonucleotide
tgccctcccgttgttattctgtcacccacgccctg

SEQ ID NO: 126927 - DNA, 35 bp, Artificial Sequence
  Synthetic oligonucleotide
agccttgctacgacatttctttccatctgctcttg

SEQ ID NO: 126928 - DNA, 35 bp, Artificial Sequence
  Synthetic oligonucleotide
atgcccctctctgccctttgccatgcccgcccact

SEQ ID NO: 126929 - DNA, 35 bp, Artificial Sequence
  Synthetic oligonucleotide
ggtcgggaacggagcaagacgggggggcgggggtt

SEQ ID NO: 126930 - DNA, 35 bp, Artificial Sequence
  Synthetic oligonucleotide
gggagggaggttcggtaaagggcgggagggttttt

SEQ ID NO: 126931 - DNA, 35 bp, Artificial Sequence
  Synthetic oligonucleotide
tcacgcgctgctggtatcacctctctgtctctcaa

SEQ ID NO: 126932 - DNA, 36 bp, Artificial Sequence
  Synthetic oligonucleotide
atcatccccccctgcgacctgcaatccctgtaagga

SEQ ID NO: 126933 - DNA, 37 bp, Artificial Sequence
  Synthetic oligonucleotide
aaagtggggacaatgggggaagggaacgagtgtagga

SEQ ID NO: 126934 - DNA, 37 bp, Artificial Sequence
  Synthetic oligonucleotide
agagtgagagggtgagtagggcgggggtatacacgga

SEQ ID NO: 126935 - DNA, 37 bp, Artificial Sequence
  Synthetic oligonucleotide
gagggggggtaggggaagttctgacgtcgaaccggga

SEQ ID NO: 126936 - DNA, 36 bp, Artificial Sequence
  Synthetic oligonucleotide
gacaggagtcggccaacgagggagggcaaaggggga

SEQ ID NO: 126937 - DNA, 36 bp, Artificial Sequence
  Synthetic oligonucleotide
gaacgacgtggcaggggaggggaagaatttagatga

SEQ ID NO: 126938 - DNA, 34 bp, Artificial Sequence
  Synthetic oligonucleotide
gagcctgtgcttgccgtatccacctccccgttta

SEQ ID NO: 126939 - DNA, 35 bp, Artificial Sequence
  Synthetic oligonucleotide
agtcacctaaccgccaatctctgccccgtccatgc

SEQ ID NO: 126940 - DNA, 35 bp, Artificial Sequence
  Synthetic oligonucleotide
gatacatccgatagccttccgtcccttccgtgcct

SEQ ID NO: 126941 - DNA, 29 bp, Artificial Sequence
  Synthetic oligonucleotide
ttgctccctcaccctgtcgcccttactca

SEQ ID NO: 126942 - DNA, 37 bp, Artificial Sequence
  Synthetic oligonucleotide
tactgggtgggggtaataagttcaggagtgggcggga

SEQ ID NO: 126943 - DNA, 35 bp, Artificial Sequence
  Synthetic oligonucleotide
tgcgttgcagggtgcctccgcccgtccttcaccta

SEQ ID NO: 126944 - DNA, 36 bp, Artificial Sequence
  Synthetic oligonucleotide
tccacctctcttcacgccctcggatccgtaatgcta

SEQ ID NO: 126945 - DNA, 35 bp, Artificial Sequence
  Synthetic oligonucleotide
tgacgggtgggcatcgggggggtctgctgacaacc

SEQ ID NO: 126946 - DNA, 35 bp, Artificial Sequence
  Synthetic oligonucleotide
tgtacagaccgccccctgtttccggtgaaaccatc

SEQ ID NO: 126947 - DNA, 35 bp, Artificial Sequence
  Synthetic oligonucleotide
aatcactcctgcacatgtagtccttcgaaccgatc

SEQ ID NO: 126948 - DNA, 35 bp, Artificial Sequence
  Synthetic oligonucleotide
ttcgagtgcgggggcggggtgctcaggaggtggtt

SEQ ID NO: 126949 - DNA, 34 bp, Artificial Sequence
  Synthetic oligonucleotide
gacccgtcgtattattttttgtccgccgccatca

SEQ ID NO: 126950 - DNA, 36 bp, Artificial Sequence
  Synthetic oligonucleotide
tctccctgccgcctatttgttccgtcccccacccga

SEQ ID NO: 126951 - DNA, 36 bp, Artificial Sequence
  Synthetic oligonucleotide
tgcggcgtgggcgggcggggaataggatcaaacgga

SEQ ID NO: 126952 - DNA, 37 bp, Artificial Sequence
  Synthetic oligonucleotide
tagggggacggagacaaagatgggcggatggaacgga

SEQ ID NO: 126953 - DNA, 35 bp, Artificial Sequence
  Synthetic oligonucleotide
gcacgccggactgttgggcccgtccgcctccctgc

SEQ ID NO: 126954 - DNA, 35 bp, Artificial Sequence
  Synthetic oligonucleotide
gccccaagacgttatttcagatccgccgttccttc

SEQ ID NO: 126955 - DNA, 35 bp, Artificial Sequence
  Synthetic oligonucleotide
tcctccactctggcctccaaccttcctgtccgtag

SEQ ID NO: 126956 - DNA, 35 bp, Artificial Sequence
  Synthetic oligonucleotide
gggtgacggggggtagctgggttgggtggagcggg

SEQ ID NO: 126957 - DNA, 35 bp, Artificial Sequence
  Synthetic oligonucleotide
taatccgcatcccaccttgtatcgctcctccgcat

SEQ ID NO: 126958 - DNA, 35 bp, Artificial Sequence
  Synthetic oligonucleotide
gtcataccgccgcccttgactgctctttcgcctct

SEQ ID NO: 126959 - DNA, 36 bp, Artificial Sequence
  Synthetic oligonucleotide
tacccgcctccagctttatcctacaacccgtgcaca

SEQ ID NO: 126960 - DNA, 35 bp, Artificial Sequence
  Synthetic oligonucleotide
aagacaacccgcattcgggtgggtattgggaggga

SEQ ID NO: 126961 - DNA, 37 bp, Artificial Sequence
  Synthetic oligonucleotide
ttggggcgagcagtttgggggggctgttgttgaggga

SEQ ID NO: 126962 - DNA, 38 bp, Artificial Sequence
  Synthetic oligonucleotide
tagaatgcggccgtgtgcggtggaggagggggaggtga

SEQ ID NO: 126963 - DNA, 35 bp, Artificial Sequence
  Synthetic oligonucleotide
ttacaacgccatcgtatggtgttcacgcctccacc

SEQ ID NO: 126964 - DNA, 35 bp, Artificial Sequence
  Synthetic oligonucleotide
tacacgtcttggacctccggctgccgccctacgcc

SEQ ID NO: 126965 - DNA, 35 bp, Artificial Sequence
  Synthetic oligonucleotide
tacccgactgcaatgtttcgtgcctctgtttcgcc

SEQ ID NO: 126966 - DNA, 35 bp, Artificial Sequence
  Synthetic oligonucleotide
attcgccaccgcgaccaccttttctggttctctgc

SEQ ID NO: 126967 - DNA, 35 bp, Artificial Sequence
  Synthetic oligonucleotide
gacagtccttcagccgcggcctgtcttcaccactc

SEQ ID NO: 126968 - DNA, 35 bp, Artificial Sequence
  Synthetic oligonucleotide
gtgggctgcaggggagtagggtgggctgggtaggg

SEQ ID NO: 126969 - DNA, 34 bp, Artificial Sequence
  Synthetic oligonucleotide
accccgggcctgatttacatactaccaccctctg

SEQ ID NO: 126970 - DNA, 35 bp, Artificial Sequence
  Synthetic oligonucleotide
tccgcatcctccttgtttaggcggttacacttcct

SEQ ID NO: 126971 - DNA, 35 bp, Artificial Sequence
  Synthetic oligonucleotide
tcacgccccctatgggttccattaggccccaccca

SEQ ID NO: 126972 - DNA, 34 bp, Artificial Sequence
  Synthetic oligonucleotide
gccggtaccattagcctcacatctctcccgttca

SEQ ID NO: 126973 - DNA, 37 bp, Artificial Sequence
  Synthetic oligonucleotide
tatgggcgaaaaggggggaggggacagttcggagaga

SEQ ID NO: 126974 - DNA, 36 bp, Artificial Sequence
  Synthetic oligonucleotide
ggggggccgaagaagggccggtggaagggcaaggga

SEQ ID NO: 126975 - DNA, 36 bp, Artificial Sequence
  Synthetic oligonucleotide
tggacgtgcaatgggattgggggcgggagggcttga

SEQ ID NO: 126976 - DNA, 36 bp, Artificial Sequence
  Synthetic oligonucleotide
ggacctgcccctcgattctagtgccttcccgaaata

SEQ ID NO: 126977 - DNA, 35 bp, Artificial Sequence
  Synthetic oligonucleotide
ggggcactcccctctgtcgtatcgcccaccgcccc

SEQ ID NO: 126978 - DNA, 35 bp, Artificial Sequence
  Synthetic oligonucleotide
gccaccaccgtgctccctactcctcgcgcttagag

SEQ ID NO: 126979 - DNA, 35 bp, Artificial Sequence
  Synthetic oligonucleotide
aaaggccaatcgccgccctccctgttaccatgttg

SEQ ID NO: 126980 - DNA, 35 bp, Artificial Sequence
  Synthetic oligonucleotide
tagccctcccctcgcgaactcaaccgcttcccggt

SEQ ID NO: 126981 - DNA, 36 bp, Artificial Sequence
  Synthetic oligonucleotide
acgcccctgtcgccttgctgatcttgataacaccca

SEQ ID NO: 126982 - DNA, 37 bp, Artificial Sequence
  Synthetic oligonucleotide
agtgcctcacacagtatccccccgccttagccgccga

SEQ ID NO: 126983 - DNA, 35 bp, Artificial Sequence
  Synthetic oligonucleotide
agcacgacaaggacgcaggacgagggcgggaggga

SEQ ID NO: 126984 - DNA, 37 bp, Artificial Sequence
  Synthetic oligonucleotide
aatggggggaaagggaccgatgggggcggatagggga

SEQ ID NO: 126985 - DNA, 34 bp, Artificial Sequence
  Synthetic oligonucleotide
atgccccagctgcccgcccacgccattaattgga

SEQ ID NO: 126986 - DNA, 35 bp, Artificial Sequence
  Synthetic oligonucleotide
tcgtgccacacttgctcctaacgttgtctctccac

SEQ ID NO: 126987 - DNA, 35 bp, Artificial Sequence
  Synthetic oligonucleotide
aacgagcatctcagccggccttagttctcccctac

SEQ ID NO: 126988 - DNA, 35 bp, Artificial Sequence
  Synthetic oligonucleotide
tactacctcaggccggctctccatactcccagccc

SEQ ID NO: 126989 - DNA, 35 bp, Artificial Sequence
  Synthetic oligonucleotide
tccccacgcctttgtcatcatcaggaggggtgctc

SEQ ID NO: 126990 - DNA, 35 bp, Artificial Sequence
  Synthetic oligonucleotide
gcgctgccccatggaagctatattactcccccctg

SEQ ID NO: 126991 - DNA, 35 bp, Artificial Sequence
  Synthetic oligonucleotide
ttgaaccgcccccctccctgagtacccagatcgct

SEQ ID NO: 126992 - DNA, 35 bp, Artificial Sequence
  Synthetic oligonucleotide
ttccggtcgtcctccgctgccatcttaagaccggt

SEQ ID NO: 126993 - DNA, 35 bp, Artificial Sequence
  Synthetic oligonucleotide
tccaccacctcagggtttgccgttagccccactgt

SEQ ID NO: 126994 - DNA, 35 bp, Artificial Sequence
  Synthetic oligonucleotide
gccccctctctcaccagcccggcggttctcccgtt

SEQ ID NO: 126995 - DNA, 35 bp, Artificial Sequence
  Synthetic oligonucleotide
ttcgcacacgtcatttgaccttcgctcccccttaa

SEQ ID NO: 126996 - DNA, 35 bp, Artificial Sequence
  Synthetic oligonucleotide
agcctcagcacagttcttcctccgacttcattgca

SEQ ID NO: 126997 - DNA, 37 bp, Artificial Sequence
  Synthetic oligonucleotide
tcagaggggggaaatagcaagggggcaagatagagga

SEQ ID NO: 126998 - DNA, 37 bp, Artificial Sequence
  Synthetic oligonucleotide
aagggcatggggagcacgggataagctggggcgggga

SEQ ID NO: 126999 - DNA, 38 bp, Artificial Sequence
  Synthetic oligonucleotide
tggaccgacatgtttacgcccccctgcttctccactga

SEQ ID NO: 127000 - DNA, 37 bp, Artificial Sequence
  Synthetic oligonucleotide
gctcctgagccctgaacttgtactcccacacctctga

SEQ ID NO: 127001 - DNA, 37 bp, Artificial Sequence
  Synthetic oligonucleotide
acccgtccccccaccgcactgtaccatcccattgtga

SEQ ID NO: 127002 - DNA, 35 bp, Artificial Sequence
  Synthetic oligonucleotide
gccgccgcaacccgttccctacccggccgttttac

SEQ ID NO: 127003 - DNA, 35 bp, Artificial Sequence
  Synthetic oligonucleotide
tcgattcctccgaacggaacgccccatgcctagcc

SEQ ID NO: 127004 - DNA, 35 bp, Artificial Sequence
  Synthetic oligonucleotide
gcccctccgccggtattattgcttcgtgttacatc

SEQ ID NO: 127005 - DNA, 35 bp, Artificial Sequence
  Synthetic oligonucleotide
gttccaaccgcctacgtcgtcccggcgcccccttc

SEQ ID NO: 127006 - DNA, 35 bp, Artificial Sequence
  Synthetic oligonucleotide
atgtggaaggggggagggaggtaagaagcgtaggg

SEQ ID NO: 127007 - DNA, 35 bp, Artificial Sequence
  Synthetic oligonucleotide
gactgcctcctccgccatacgcatccttacgcaat

SEQ ID NO: 127008 - DNA, 35 bp, Artificial Sequence
  Synthetic oligonucleotide
tccgacgcttagccctatagtgctgcaccctctct

SEQ ID NO: 127009 - DNA, 30 bp, Artificial Sequence
  Synthetic oligonucleotide
gtgtggtaggggtgggtggaattatgcagt

SEQ ID NO: 127010 - DNA, 35 bp, Artificial Sequence
  Synthetic oligonucleotide
agtaactccgccccatttatttcgagcctatctgt

SEQ ID NO: 127011 - DNA, 36 bp, Artificial Sequence
  Synthetic oligonucleotide
gttgccccactgttggttctctcagcttaccgctaa

SEQ ID NO: 127012 - DNA, 36 bp, Artificial Sequence
  Synthetic oligonucleotide
gagcccacccgcctggggatgttctatccgcctaca

SEQ ID NO: 127013 - DNA, 36 bp, Artificial Sequence
  Synthetic oligonucleotide
gttgcccgccatctcaccctgatccacctgaatgca

SEQ ID NO: 127014 - DNA, 37 bp, Artificial Sequence
  Synthetic oligonucleotide
gtacgatgtggggggggagtaatggagtgagggtaga

SEQ ID NO: 127015 - DNA, 37 bp, Artificial Sequence
  Synthetic oligonucleotide
tgcagggggcgtatttggggcgagtaccgggcgggga

SEQ ID NO: 127016 - DNA, 36 bp, Artificial Sequence
  Synthetic oligonucleotide
atccagccacacatgtcatcgcgccatcctgcttta

SEQ ID NO: 127017 - DNA, 35 bp, Artificial Sequence
  Synthetic oligonucleotide
gagcaaacgttcctgctgccaactgtctcctcatc

SEQ ID NO: 127018 - DNA, 35 bp, Artificial Sequence
  Synthetic oligonucleotide
tacgcacgtcacattaggcccatctagtactcgtc

SEQ ID NO: 127019 - DNA, 35 bp, Artificial Sequence
  Synthetic oligonucleotide
tacaaccctctcgaccctgccttatcgtccgctag

SEQ ID NO: 127020 - DNA, 35 bp, Artificial Sequence
  Synthetic oligonucleotide
tgatgccccaatggtctccccactccagcctcccg

SEQ ID NO: 127021 - DNA, 35 bp, Artificial Sequence
  Synthetic oligonucleotide
tgctccacacccagccaacctacaagaccaccgtg

SEQ ID NO: 127022 - DNA, 35 bp, Artificial Sequence
  Synthetic oligonucleotide
gaccccgaagttgggtacgaagggtgggtggggtg

SEQ ID NO: 127023 - DNA, 35 bp, Artificial Sequence
  Synthetic oligonucleotide
gctggctcgggtgggagggtagtagggttgccttg

SEQ ID NO: 127024 - DNA, 35 bp, Artificial Sequence
  Synthetic oligonucleotide
gcacccgccctcgtcgccctatgttgggcccaact

SEQ ID NO: 127025 - DNA, 35 bp, Artificial Sequence
  Synthetic oligonucleotide
tgcatcgggctagggggggagggcaagcgcaatct

SEQ ID NO: 127026 - DNA, 36 bp, Artificial Sequence
  Synthetic oligonucleotide
tgagataaccgttcctgcccttatagcactttacca

SEQ ID NO: 127027 - DNA, 37 bp, Artificial Sequence
  Synthetic oligonucleotide
tacgatggggggaatggtgttggggacgggggacaga

SEQ ID NO: 127028 - DNA, 36 bp, Artificial Sequence
  Synthetic oligonucleotide
tgtaccactgtcctccatcgccgccctctgttatga

SEQ ID NO: 127029 - DNA, 37 bp, Artificial Sequence
  Synthetic oligonucleotide
gatccccatccgcctgcccctgtattgtcgtctctga

SEQ ID NO: 127030 - DNA, 37 bp, Artificial Sequence
  Synthetic oligonucleotide
gacacaacacaccgccgcacatctacacagtcattga

SEQ ID NO: 127031 - DNA, 35 bp, Artificial Sequence
  Synthetic oligonucleotide
tcccccaccctctaccctttgctgagccccagtta

SEQ ID NO: 127032 - DNA, 35 bp, Artificial Sequence
  Synthetic oligonucleotide
gaccacccccagtcctgcaatgatctccattttac

SEQ ID NO: 127033 - DNA, 35 bp, Artificial Sequence
  Synthetic oligonucleotide
gttgacactcctccagttattcttaggtcgctacc

SEQ ID NO: 127034 - DNA, 35 bp, Artificial Sequence
  Synthetic oligonucleotide
actcgacctgttgtgcctcgccctaatgctccgcc

SEQ ID NO: 127035 - DNA, 35 bp, Artificial Sequence
  Synthetic oligonucleotide
gcgtatatgccgcctgtctgctcgagcccacttcc

SEQ ID NO: 127036 - DNA, 35 bp, Artificial Sequence
  Synthetic oligonucleotide
tgaccctacatttttgcctgggctcccccgtttcc

SEQ ID NO: 127037 - DNA, 35 bp, Artificial Sequence
  Synthetic oligonucleotide
tgcccggtgtagttggttgtcactccgcccgcctc

SEQ ID NO: 127038 - DNA, 35 bp, Artificial Sequence
  Synthetic oligonucleotide
ttcccaacaacatgtccctccggcggtcctccccg

SEQ ID NO: 127039 - DNA, 35 bp, Artificial Sequence
  Synthetic oligonucleotide
gccctcccccgagcgtcgacttttcttcctattcg

SEQ ID NO: 127040 - DNA, 35 bp, Artificial Sequence
  Synthetic oligonucleotide
acactagctgcttcgttcgccccccgccgcccgct

SEQ ID NO: 127041 - DNA, 35 bp, Artificial Sequence
  Synthetic oligonucleotide
tctaccgccgcctgtaatcatgcctccgtaatgct

SEQ ID NO: 127042 - DNA, 35 bp, Artificial Sequence
  Synthetic oligonucleotide
gtgccccccgcccactccatcactgcccgttgaca

SEQ ID NO: 127043 - DNA, 36 bp, Artificial Sequence
  Synthetic oligonucleotide
ttgagccccaaccatctgcgccaccgtactgctgca

SEQ ID NO: 127044 - DNA, 36 bp, Artificial Sequence
  Synthetic oligonucleotide
ttggacccgtgagttgtccgccgccgcttgccttca

SEQ ID NO: 127045 - DNA, 35 bp, Artificial Sequence
  Synthetic oligonucleotide
agcccgcccgctccaccctgttaattgctccacga

SEQ ID NO: 127046 - DNA, 37 bp, Artificial Sequence
  Synthetic oligonucleotide
gtccccccgcgctccaccgtacctgcccctcttctga

SEQ ID NO: 127047 - DNA, 37 bp, Artificial Sequence
  Synthetic oligonucleotide
gtatagcgcactttctatcaacgccgcacacccttga

SEQ ID NO: 127048 - DNA, 36 bp, Artificial Sequence
  Synthetic oligonucleotide
tagttcccccatattgtgcctaaccatacgctccta

SEQ ID NO: 127049 - DNA, 36 bp, Artificial Sequence
  Synthetic oligonucleotide
tacccccctccgcgattatgaatctgttctcttgta

SEQ ID NO: 127050 - DNA, 35 bp, Artificial Sequence
  Synthetic oligonucleotide
gagccgatcaggctcgttatttcccgcctacatcc

SEQ ID NO: 127051 - DNA, 35 bp, Artificial Sequence
  Synthetic oligonucleotide
agcccgttcccgcccactctcgtgtcattgccagc

SEQ ID NO: 127052 - DNA, 35 bp, Artificial Sequence
  Synthetic oligonucleotide
accctcgccctcttatttgccattcggcggtttgc

SEQ ID NO: 127053 - DNA, 35 bp, Artificial Sequence
  Synthetic oligonucleotide
tgcccctagccgtacgaacttcttactcctgcccg

SEQ ID NO: 127054 - DNA, 35 bp, Artificial Sequence
  Synthetic oligonucleotide
ggtaggctgaggcggacgggggggtgggcgttctg

SEQ ID NO: 127055 - DNA, 31 bp, Artificial Sequence
  Synthetic oligonucleotide
tgcacccccattcgtgtacctccctagcgct

SEQ ID NO: 127056 - DNA, 35 bp, Artificial Sequence
  Synthetic oligonucleotide
gtccacacaacccgctacctgttcaactgttccgt

SEQ ID NO: 127057 - DNA, 35 bp, Artificial Sequence
  Synthetic oligonucleotide
aacgacacctcctatctgctcaaccgggtcttggt

SEQ ID NO: 127058 - DNA, 34 bp, Artificial Sequence
  Synthetic oligonucleotide
atcccccccacggacccgttctttcgacccgaga

SEQ ID NO: 127059 - DNA, 37 bp, Artificial Sequence
  Synthetic oligonucleotide
gtccgccctcgcctggcccacacttctttcatgacga

SEQ ID NO: 127060 - DNA, 37 bp, Artificial Sequence
  Synthetic oligonucleotide
actgtaccgacgggtgggggatgagcggtggggcgga

SEQ ID NO: 127061 - DNA, 36 bp, Artificial Sequence
  Synthetic oligonucleotide
taccccccagtgcgttttcgcgtgccaccttcgata

SEQ ID NO: 127062 - DNA, 36 bp, Artificial Sequence
  Synthetic oligonucleotide
ggaggaggggggcgggaagctaaggggcataggata

SEQ ID NO: 127063 - DNA, 35 bp, Artificial Sequence
  Synthetic oligonucleotide
acacgactgtcgcgcgctggatttcgctctgtccc

SEQ ID NO: 127064 - DNA, 35 bp, Artificial Sequence
  Synthetic oligonucleotide
gttcacatcacgaagtactccgcattcacatagcc

SEQ ID NO: 127065 - DNA, 35 bp, Artificial Sequence
  Synthetic oligonucleotide
gaccactccgggactatccgttttgctgttcttcc

SEQ ID NO: 127066 - DNA, 35 bp, Artificial Sequence
  Synthetic oligonucleotide
tcgcccatgcccaccacacatcgttacgaaacatc

SEQ ID NO: 127067 - DNA, 35 bp, Artificial Sequence
  Synthetic oligonucleotide
acgccacacgaccccacgcacgctttccactggtc

SEQ ID NO: 127068 - DNA, 35 bp, Artificial Sequence
  Synthetic oligonucleotide
aatgcctgccccaccggaacaccgccccgtttttc

SEQ ID NO: 127069 - DNA, 35 bp, Artificial Sequence
  Synthetic oligonucleotide
acccgccttgcccgtgagtccatttttgcctttag

SEQ ID NO: 127070 - DNA, 35 bp, Artificial Sequence
  Synthetic oligonucleotide
tgctatcgcccccctatgtcagcttccttttcccg

SEQ ID NO: 127071 - DNA, 35 bp, Artificial Sequence
  Synthetic oligonucleotide
acgaaggggagagcgcggaggacagggtgtgcggg

SEQ ID NO: 127072 - DNA, 35 bp, Artificial Sequence
  Synthetic oligonucleotide
tcacatgtccccctgctcgtgccttccacttggat

SEQ ID NO: 127073 - DNA, 35 bp, Artificial Sequence
  Synthetic oligonucleotide
gccgccgtatcgtttttctgttcccacttgtcact

SEQ ID NO: 127074 - DNA, 35 bp, Artificial Sequence
  Synthetic oligonucleotide
gcattcccctcagtccgccactcaggtcctccgct

SEQ ID NO: 127075 - DNA, 36 bp, Artificial Sequence
  Synthetic oligonucleotide
acgtagcccgttgcgccccgacccccctgtgtccaa

SEQ ID NO: 127076 - DNA, 36 bp, Artificial Sequence
  Synthetic oligonucleotide
tgtaagcccggttatgaatcgctcgctgcctctcca

SEQ ID NO: 127077 - DNA, 34 bp, Artificial Sequence
  Synthetic oligonucleotide
ttagcaccgcctcaactgaccttcgctcctcgca

SEQ ID NO: 127078 - DNA, 38 bp, Artificial Sequence
  Synthetic oligonucleotide
agagaggggggggaaggagaagggtcggttagtgatga

SEQ ID NO: 127079 - DNA, 37 bp, Artificial Sequence
  Synthetic oligonucleotide
accagcatcacgctactgttccttcccttctgtctga

SEQ ID NO: 127080 - DNA, 36 bp, Artificial Sequence
  Synthetic oligonucleotide
tcacgcttgcaccatcttatgtctctgcccgccgta

SEQ ID NO: 127081 - DNA, 36 bp, Artificial Sequence
  Synthetic oligonucleotide
accgacggtgcgcacccgtccattccaccgacctta

SEQ ID NO: 127082 - DNA, 34 bp, Artificial Sequence
  Synthetic oligonucleotide
gcgggggggatagggtgggggtcgaaaatggtta

SEQ ID NO: 127083 - DNA, 35 bp, Artificial Sequence
  Synthetic oligonucleotide
cacaaccgcatgtttcacgtactccctctgccgac

SEQ ID NO: 127084 - DNA, 35 bp, Artificial Sequence
  Synthetic oligonucleotide
aatagcacgcacgggaaagggattaagggagggac

SEQ ID NO: 127085 - DNA, 35 bp, Artificial Sequence
  Synthetic oligonucleotide
acccataccctgatccatgtccctcgccgcacacc

SEQ ID NO: 127086 - DNA, 34 bp, Artificial Sequence
  Synthetic oligonucleotide
gatccactcttgccttgccgctttacgcccgacc

SEQ ID NO: 127087 - DNA, 35 bp, Artificial Sequence
  Synthetic oligonucleotide
tgatacgcccccgctgaatccttagctcgacttgc

SEQ ID NO: 127088 - DNA, 35 bp, Artificial Sequence
  Synthetic oligonucleotide
attgcgcaaatccgctggcataataatctccgctc

SEQ ID NO: 127089 - DNA, 34 bp, Artificial Sequence
  Synthetic oligonucleotide
tacgaccaccgccttgtggttcgctcccttgttc

SEQ ID NO: 127090 - DNA, 35 bp, Artificial Sequence
  Synthetic oligonucleotide
aacattcgcccacccgatgcactccttcccgcact

SEQ ID NO: 127091 - DNA, 35 bp, Artificial Sequence
  Synthetic oligonucleotide
gtgtcccccccgtgcctgtcttagataacaatcct

SEQ ID NO: 127092 - DNA, 35 bp, Artificial Sequence
  Synthetic oligonucleotide
gtctcccgctcccaccccatgcctccgttcctggt

SEQ ID NO: 127093 - DNA, 35 bp, Artificial Sequence
  Synthetic oligonucleotide
acgcgggagggaaggggggatggggttcgcgcaaa

SEQ ID NO: 127094 - DNA, 36 bp, Artificial Sequence
  Synthetic oligonucleotide
actcaccctcatgcatcacgtcgtaccaccggtcca

SEQ ID NO: 127095 - DNA, 37 bp, Artificial Sequence
  Synthetic oligonucleotide
tagacgaccgcagtgccccgtttcaccctgttgccga

SEQ ID NO: 127096 - DNA, 37 bp, Artificial Sequence
  Synthetic oligonucleotide
tgcactgtcacactagtccactcgccctgctctccga

SEQ ID NO: 127097 - DNA, 37 bp, Artificial Sequence
  Synthetic oligonucleotide
aactgggggcacatggtgacaaactatcgggagggga

SEQ ID NO: 127098 - DNA, 37 bp, Artificial Sequence
  Synthetic oligonucleotide
ttgatggggggtagactaaggacggggagtacgggga

SEQ ID NO: 127099 - DNA, 38 bp, Artificial Sequence
  Synthetic oligonucleotide
tcacggtctgttctgccgccgccgtttgtaccaactga

SEQ ID NO: 127100 - DNA, 37 bp, Artificial Sequence
  Synthetic oligonucleotide
ggaccacaaccgatccgcctagtgccatacttattga

SEQ ID NO: 127101 - DNA, 37 bp, Artificial Sequence
  Synthetic oligonucleotide
tcactccgaccacaactgcctatgctctttcccttga

SEQ ID NO: 127102 - DNA, 35 bp, Artificial Sequence
  Synthetic oligonucleotide
atgcacctttcccgcctcggcccgcccgtcccaac

SEQ ID NO: 127103 - DNA, 35 bp, Artificial Sequence
  Synthetic oligonucleotide
gactgcatgccacgtcactctgtccttccgttccc

SEQ ID NO: 127104 - DNA, 35 bp, Artificial Sequence
  Synthetic oligonucleotide
tcgaggccttcagctctcgttcatctctccctttc

SEQ ID NO: 127105 - DNA, 35 bp, Artificial Sequence
  Synthetic oligonucleotide
gccgacaccgttccccaggggctcctcctctttcg

SEQ ID NO: 127106 - DNA, 35 bp, Artificial Sequence
  Synthetic oligonucleotide
tttgacgagggactatgggggggaggggtggtagg

SEQ ID NO: 127107 - DNA, 35 bp, Artificial Sequence
  Synthetic oligonucleotide
gagacacacggcaggggagggggtccggggaagtg

SEQ ID NO: 127108 - DNA, 35 bp, Artificial Sequence
  Synthetic oligonucleotide
agcccgccccatccagcttccgttgtttgcaccat

SEQ ID NO: 127109 - DNA, 33 bp, Artificial Sequence
  Synthetic oligonucleotide
gcgccgccacgggttctagcttccttcccctgt

SEQ ID NO: 127110 - DNA, 37 bp, Artificial Sequence
  Synthetic oligonucleotide
tcctgccctcccacctatgtctacctcgttttccaga

SEQ ID NO: 127111 - DNA, 35 bp, Artificial Sequence
  Synthetic oligonucleotide
gagaaaggaagggaggtgaaggtgggctcttgaga

SEQ ID NO: 127112 - DNA, 36 bp, Artificial Sequence
  Synthetic oligonucleotide
tcgattcccgcccgctgctctgccctgcccacccga

SEQ ID NO: 127113 - DNA, 37 bp, Artificial Sequence
  Synthetic oligonucleotide
gatggaacaatggtaggtggtaggtagggattgagga

SEQ ID NO: 127114 - DNA, 35 bp, Artificial Sequence
  Synthetic oligonucleotide
gacgggcgggccggaaagtagtcaaaggggaggga

SEQ ID NO: 127115 - DNA, 38 bp, Artificial Sequence
  Synthetic oligonucleotide
acccctgccacacttgtcgtgactccccctccatatga

SEQ ID NO: 127116 - DNA, 37 bp, Artificial Sequence
  Synthetic oligonucleotide
acgaagtgtggtggtcgggggaggccgggacgggtga

SEQ ID NO: 127117 - DNA, 35 bp, Artificial Sequence
  Synthetic oligonucleotide
tctggccacaacattgctggtacgtacttttcacc

SEQ ID NO: 127118 - DNA, 35 bp, Artificial Sequence
  Synthetic oligonucleotide
gcccatcatcctacgctgttacgggattccttgcc

SEQ ID NO: 127119 - DNA, 35 bp, Artificial Sequence
  Synthetic oligonucleotide
accaccgtatgtttggccttttgcgttcctctcgc

SEQ ID NO: 127120 - DNA, 35 bp, Artificial Sequence
  Synthetic oligonucleotide
gcgtggtcctatctgtctgcccttttataccgtgc

SEQ ID NO: 127121 - DNA, 35 bp, Artificial Sequence
  Synthetic oligonucleotide
tcctcggtcctgcaccctctgccctgtttgtgctt

SEQ ID NO: 127122 - DNA, 35 bp, Artificial Sequence
  Synthetic oligonucleotide
accccctctgtgttcttcattgtcggtccctccaa

SEQ ID NO: 127123 - DNA, 36 bp, Artificial Sequence
  Synthetic oligonucleotide
gagttatgggggaggtggaaaagggtggggctcgaa

SEQ ID NO: 127124 - DNA, 35 bp, Artificial Sequence
  Synthetic oligonucleotide
ttggaggcaggggacggggataggtggacacaaca

SEQ ID NO: 127125 - DNA, 35 bp, Artificial Sequence
  Synthetic oligonucleotide
ttgtgcaccatcctcatctagtcctcctgcggaca

SEQ ID NO: 127126 - DNA, 35 bp, Artificial Sequence
  Synthetic oligonucleotide
ttccgggagccacctgctaaccatcctccgtgcca

SEQ ID NO: 127127 - DNA, 36 bp, Artificial Sequence
  Synthetic oligonucleotide
tcgtaattgtggagggtagggagggaggggaatgca

SEQ ID NO: 127128 - DNA, 36 bp, Artificial Sequence
  Synthetic oligonucleotide
gccacgacaccccgaccatgcgtctccatctagtca

SEQ ID NO: 127129 - DNA, 35 bp, Artificial Sequence
  Synthetic oligonucleotide
ggtacctgccctcttgccccgccgtctcaggacga

SEQ ID NO: 127130 - DNA, 37 bp, Artificial Sequence
  Synthetic oligonucleotide
tcgcccccgctatattcctccgacgctccttcatcga

SEQ ID NO: 127131 - DNA, 37 bp, Artificial Sequence
  Synthetic oligonucleotide
attcgggtgggctgttgggagggtggaggggggcgga

SEQ ID NO: 127132 - DNA, 37 bp, Artificial Sequence
  Synthetic oligonucleotide
attcgatgcctccgatacgctaaatgcccctccctga

SEQ ID NO: 127133 - DNA, 35 bp, Artificial Sequence
  Synthetic oligonucleotide
gactctcccggagtcgtataccccttcctatacac

SEQ ID NO: 127134 - DNA, 35 bp, Artificial Sequence
  Synthetic oligonucleotide
tcgccacttgctctttgttgcgcatcatctttcac

SEQ ID NO: 127135 - DNA, 35 bp, Artificial Sequence
  Synthetic oligonucleotide
attccgcctcacctgtgcagtgtttgcttagcctc

SEQ ID NO: 127136 - DNA, 35 bp, Artificial Sequence
  Synthetic oligonucleotide
tacgccgtcaaaacctgcagggtccgcctcccccg

SEQ ID NO: 127137 - DNA, 35 bp, Artificial Sequence
  Synthetic oligonucleotide
tcccctgaccgctatatactgcatactccctcccg

SEQ ID NO: 127138 - DNA, 31 bp, Artificial Sequence
  Synthetic oligonucleotide
gtggcccccacgcttgcccccacctacccgg

SEQ ID NO: 127139 - DNA, 37 bp, Artificial Sequence
  Synthetic oligonucleotide
gacagtaacagggggacggcgaggggagagggtaaga

SEQ ID NO: 127140 - DNA, 37 bp, Artificial Sequence
  Synthetic oligonucleotide
taaacgtggggggaggagcagggcgcatatacgggga

SEQ ID NO: 127141 - DNA, 37 bp, Artificial Sequence
  Synthetic oligonucleotide
agacgaacgctcgggtgggagggagctgggtcaatga

SEQ ID NO: 127142 - DNA, 35 bp, Artificial Sequence
  Synthetic oligonucleotide
actgagctccgtgccgatctctgttctgtccttta

SEQ ID NO: 127143 - DNA, 35 bp, Artificial Sequence
  Synthetic oligonucleotide
gaaccacccgggccacatacagtcccttccatgac

SEQ ID NO: 127144 - DNA, 35 bp, Artificial Sequence
  Synthetic oligonucleotide
gtcaggcccagctcgccccgtatgcctcgtttgcc

SEQ ID NO: 127145 - DNA, 35 bp, Artificial Sequence
  Synthetic oligonucleotide
tctgccagatgtacctccccctccctctgctaccg

SEQ ID NO: 127146 - DNA, 35 bp, Artificial Sequence
  Synthetic oligonucleotide
ggtaaggaacaagaatgggatgcagggagggtggg

SEQ ID NO: 127147 - DNA, 36 bp, Artificial Sequence
  Synthetic oligonucleotide
gtgcggggggggtagttgaagtagatggaaggcaaa

SEQ ID NO: 127148 - DNA, 31 bp, Artificial Sequence
  Synthetic oligonucleotide
gcataccccgttccgccttgcgctagcacca

SEQ ID NO: 127149 - DNA, 35 bp, Artificial Sequence
  Synthetic oligonucleotide
gtacgatcatcgcaccattgccttactaagcccca

SEQ ID NO: 127150 - DNA, 36 bp, Artificial Sequence
  Synthetic oligonucleotide
tgcgcccgcccatattgctcatgcggtcccattcca

SEQ ID NO: 127151 - DNA, 35 bp, Artificial Sequence
  Synthetic oligonucleotide
gtgcccgcccccattgtcgtgattccacgcgcgca

SEQ ID NO: 127152 - DNA, 36 bp, Artificial Sequence
  Synthetic oligonucleotide
ttgaggggcggggggtggagggggcgcacggagtca

SEQ ID NO: 127153 - DNA, 37 bp, Artificial Sequence
  Synthetic oligonucleotide
gtccgccatctcaccatgctcccctattccgtgcaga

SEQ ID NO: 127154 - DNA, 35 bp, Artificial Sequence
  Synthetic oligonucleotide
ggagtcagcaccacgcgaccctcctcaccggcctc

SEQ ID NO: 127155 - DNA, 35 bp, Artificial Sequence
  Synthetic oligonucleotide
gacacccgcgtcttggtccgcttcgattcgcttct

SEQ ID NO: 127156 - DNA, 36 bp, Artificial Sequence
  Synthetic oligonucleotide
tacaccctcctggtcccaaccatctgtactacgtaa

SEQ ID NO: 127157 - DNA, 37 bp, Artificial Sequence
  Synthetic oligonucleotide
tcccaccccctcgtcctcttctactgtcatggcacga

SEQ ID NO: 127158 - DNA, 38 bp, Artificial Sequence
  Synthetic oligonucleotide
tgatgctccgtcctgctccttagcgtgattccttctga

SEQ ID NO: 127159 - DNA, 36 bp, Artificial Sequence
  Synthetic oligonucleotide
tggaacctcctaccttctgcagacccgcctcggcta

SEQ ID NO: 127160 - DNA, 36 bp, Artificial Sequence
  Synthetic oligonucleotide
ttgctactgcatccggccgccgccctgttcacctta

SEQ ID NO: 127161 - DNA, 35 bp, Artificial Sequence
  Synthetic oligonucleotide
gacactcacgcatcccacttatctgtaccgatccc

SEQ ID NO: 127162 - DNA, 35 bp, Artificial Sequence
  Synthetic oligonucleotide
tgcaccctctcctgtagattctcgcgcagcctatc

SEQ ID NO: 127163 - DNA, 35 bp, Artificial Sequence
  Synthetic oligonucleotide
ttgtgtctccgccattgtctttctcttgttccccg

SEQ ID NO: 127164 - DNA, 35 bp, Artificial Sequence
  Synthetic oligonucleotide
gtcatccctcacttcatacagatcttggcctcgct

SEQ ID NO: 127165 - DNA, 35 bp, Artificial Sequence
  Synthetic oligonucleotide
acctcccccttgtacgcccgcccgaccatctgagt

SEQ ID NO: 127166 - DNA, 35 bp, Artificial Sequence
  Synthetic oligonucleotide
gacaccagtgcctatttcttcacgatcacaccctt

SEQ ID NO: 127167 - DNA, 36 bp, Artificial Sequence
  Synthetic oligonucleotide
tcataccacccgtctaatttgcccccggtacccgaa

SEQ ID NO: 127168 - DNA, 36 bp, Artificial Sequence
  Synthetic oligonucleotide
agccgccgcacgtttcttctcgctatatgtcttaca

SEQ ID NO: 127169 - DNA, 37 bp, Artificial Sequence
  Synthetic oligonucleotide
tccacacccgcccacaatgtgcgataaccgcacaaga

SEQ ID NO: 127170 - DNA, 37 bp, Artificial Sequence
  Synthetic oligonucleotide
tagtcacccgcttccttgaatacaccgctctccacga

SEQ ID NO: 127171 - DNA, 36 bp, Artificial Sequence
  Synthetic oligonucleotide
gcccccgtaccgacccctcgcccttccctgcgcgga

SEQ ID NO: 127172 - DNA, 37 bp, Artificial Sequence
  Synthetic oligonucleotide
acggactgggatcggaggggcattgaggggggaggga

SEQ ID NO: 127173 - DNA, 35 bp, Artificial Sequence
  Synthetic oligonucleotide
accatggcccctctagctttctgcgtgtcatccta

SEQ ID NO: 127174 - DNA, 35 bp, Artificial Sequence
  Synthetic oligonucleotide
taccttccctgtgtcgtagcatatacatcatcctc

SEQ ID NO: 127175 - DNA, 35 bp, Artificial Sequence
  Synthetic oligonucleotide
acccggagggagggccatgaagcacgaaggggggt

SEQ ID NO: 127176 - DNA, 35 bp, Artificial Sequence
  Synthetic oligonucleotide
tccaacccggccccccccagctctcgatcgctatt

SEQ ID NO: 127177 - DNA, 36 bp, Artificial Sequence
  Synthetic oligonucleotide
tgatccgccctcaatcgctgccgtttggcctcccga

SEQ ID NO: 127178 - DNA, 37 bp, Artificial Sequence
  Synthetic oligonucleotide
gattaccagagggagggggagtgtgatgggaggggga

SEQ ID NO: 127179 - DNA, 38 bp, Artificial Sequence
  Synthetic oligonucleotide
aagttgtgaacggacggggaagggcaaaaagggcgtga

SEQ ID NO: 127180 - DNA, 35 bp, Artificial Sequence
  Synthetic oligonucleotide
gtagtcgtgaggaaagggaggggaggccgaggtga

SEQ ID NO: 127181 - DNA, 35 bp, Artificial Sequence
  Synthetic oligonucleotide
tccccctccccatgtatgatcacgcgaacctccac

SEQ ID NO: 127182 - DNA, 35 bp, Artificial Sequence
  Synthetic oligonucleotide
tccaacgtcccaccgatacattttgcgacgccccc

SEQ ID NO: 127183 - DNA, 35 bp, Artificial Sequence
  Synthetic oligonucleotide
gccatttcctgagtgacaccagtgcctcatcttcc

SEQ ID NO: 127184 - DNA, 35 bp, Artificial Sequence
  Synthetic oligonucleotide
tagtgccctactgtcccgtttaactgttcttttcc

SEQ ID NO: 127185 - DNA, 35 bp, Artificial Sequence
  Synthetic oligonucleotide
tatgacaccgccaagcttccctgaccccatttggc

SEQ ID NO: 127186 - DNA, 35 bp, Artificial Sequence
  Synthetic oligonucleotide
gaatcgctcccggcgtccataccattccttgtcct

SEQ ID NO: 127187 - DNA, 35 bp, Artificial Sequence
  Synthetic oligonucleotide
agttgcccccgcagtttcatcgctaccttaatgct

SEQ ID NO: 127188 - DNA, 35 bp, Artificial Sequence
  Synthetic oligonucleotide
aactgtcgtccagagtttccgtccatttgtcctct

SEQ ID NO: 127189 - DNA, 35 bp, Artificial Sequence
  Synthetic oligonucleotide
gactccccctccaccgtcgaatcgcaccagttatt

SEQ ID NO: 127190 - DNA, 36 bp, Artificial Sequence
  Synthetic oligonucleotide
gatggagagaggggtagggcggggtacgtgtgaaga

SEQ ID NO: 127191 - DNA, 37 bp, Artificial Sequence
  Synthetic oligonucleotide
agacgaggaagtcggggtggggagtcgagaggtcaga

SEQ ID NO: 127192 - DNA, 35 bp, Artificial Sequence
  Synthetic oligonucleotide
gaaaggtgggaggtggttggtcgtggtggaggcga

SEQ ID NO: 127193 - DNA, 36 bp, Artificial Sequence
  Synthetic oligonucleotide
atgtatcgggacgggtgggaggggaccgtgttggga

SEQ ID NO: 127194 - DNA, 37 bp, Artificial Sequence
  Synthetic oligonucleotide
tccatctcacctcccaccgagccacgtcttctctgga

SEQ ID NO: 127195 - DNA, 38 bp, Artificial Sequence
  Synthetic oligonucleotide
ggtgggtgttagcagggaaggagcgggggttggaatga

SEQ ID NO: 127196 - DNA, 38 bp, Artificial Sequence
  Synthetic oligonucleotide
gtaccccccccgaccctgtacaaatcatcacagagtga

SEQ ID NO: 127197 - DNA, 38 bp, Artificial Sequence
  Synthetic oligonucleotide
atgggaacgggggggggagcaaggatccagcggtttga

SEQ ID NO: 127198 - DNA, 35 bp, Artificial Sequence
  Synthetic oligonucleotide
tgcaccccagcttccaatcccactttggccgtccc

SEQ ID NO: 127199 - DNA, 35 bp, Artificial Sequence
  Synthetic oligonucleotide
tgtggggggggaggggagacgacaggcatagggcc

SEQ ID NO: 127200 - DNA, 35 bp, Artificial Sequence
  Synthetic oligonucleotide
tctggactgccctctcctgtccaactattaggtcc

SEQ ID NO: 127201 - DNA, 35 bp, Artificial Sequence
  Synthetic oligonucleotide
tgcccctgccacaccttgccttgactaaccgccgc

SEQ ID NO: 127202 - DNA, 35 bp, Artificial Sequence
  Synthetic oligonucleotide
gcatcgtcctctcttcccacccgttcgcctgctgc

SEQ ID NO: 127203 - DNA, 35 bp, Artificial Sequence
  Synthetic oligonucleotide
gtgatcaggtgaaagtcccactccctgcgttgctc

SEQ ID NO: 127204 - DNA, 30 bp, Artificial Sequence
  Synthetic oligonucleotide
tctacgacggttcccacaccccctgcccct

SEQ ID NO: 127205 - DNA, 35 bp, Artificial Sequence
  Synthetic oligonucleotide
tgacaccgcaccaccccaatcttgcgtctttgcct

SEQ ID NO: 127206 - DNA, 35 bp, Artificial Sequence
  Synthetic oligonucleotide
atggaacaccctcactttgcgaatctcattgtcct

SEQ ID NO: 127207 - DNA, 35 bp, Artificial Sequence
  Synthetic oligonucleotide
ggggggtgggtacgggcgggaaatacatacccggt

SEQ ID NO: 127208 - DNA, 35 bp, Artificial Sequence
  Synthetic oligonucleotide
tcttgcctccgccattcctacgttcccatttggtt

SEQ ID NO: 127209 - DNA, 34 bp, Artificial Sequence
  Synthetic oligonucleotide
gcattcaccatttgctactcgcggtcttacacaa

SEQ ID NO: 127210 - DNA, 36 bp, Artificial Sequence
  Synthetic oligonucleotide
gctggccctagctgcctccctattccacgttgtcca

SEQ ID NO: 127211 - DNA, 36 bp, Artificial Sequence
  Synthetic oligonucleotide
atgtgccgctgcccccttcgaacgattaccgtctca

SEQ ID NO: 127212 - DNA, 37 bp, Artificial Sequence
  Synthetic oligonucleotide
agcactatccacgcagctgcctcttacgccccgtaga

SEQ ID NO: 127213 - DNA, 37 bp, Artificial Sequence
  Synthetic oligonucleotide
acatccgaagcactgggaataggacggggggagggga

SEQ ID NO: 127214 - DNA, 37 bp, Artificial Sequence
  Synthetic oligonucleotide
gtcactgggggcgataacaatagggcgggcatgggga

SEQ ID NO: 127215 - DNA, 36 bp, Artificial Sequence
  Synthetic oligonucleotide
taccgcccgcaacacccgccgcagcctgtatacata

SEQ ID NO: 127216 - DNA, 36 bp, Artificial Sequence
  Synthetic oligonucleotide
atccgacgccgctccaatttacccgggtcccgttta

SEQ ID NO: 127217 - DNA, 35 bp, Artificial Sequence
  Synthetic oligonucleotide
atgccagtccgctccgtcctcctggttgcctttta

SEQ ID NO: 127218 - DNA, 35 bp, Artificial Sequence
  Synthetic oligonucleotide
gccgccccgcgcccaacgtatctatcatcgtgttc

SEQ ID NO: 127219 - DNA, 35 bp, Artificial Sequence
  Synthetic oligonucleotide
gcccacctcgttgactatcacagtgcctttcatgg

SEQ ID NO: 127220 - DNA, 35 bp, Artificial Sequence
  Synthetic oligonucleotide
tcactccgtaacgtggttccgggctactcctctct

SEQ ID NO: 127221 - DNA, 35 bp, Artificial Sequence
  Synthetic oligonucleotide
ggagaaggcacgggggagcgaagaaaaaaaggggt

SEQ ID NO: 127222 - DNA, 36 bp, Artificial Sequence
  Synthetic oligonucleotide
tctccgctccgcccccttgcgactcgccctcgttca

SEQ ID NO: 127223 - DNA, 37 bp, Artificial Sequence
  Synthetic oligonucleotide
gtgccccgtgcctccctcgtaccctgactcttgacga

SEQ ID NO: 127224 - DNA, 37 bp, Artificial Sequence
  Synthetic oligonucleotide
acaccacctgcccgttccaatccagtcccaaggatga

SEQ ID NO: 127225 - DNA, 38 bp, Artificial Sequence
  Synthetic oligonucleotide
ggaggtggagggggagtaagtggaaagatgggtgatga

SEQ ID NO: 127226 - DNA, 35 bp, Artificial Sequence
  Synthetic oligonucleotide
gcgccccctccacgcctactcgcattttgccctga

SEQ ID NO: 127227 - DNA, 38 bp, Artificial Sequence
  Synthetic oligonucleotide
gtcgccacccgacccccgcattagaccctacctgctga

SEQ ID NO: 127228 - DNA, 38 bp, Artificial Sequence
  Synthetic oligonucleotide
tgatgtggggggagtgggcgaggggttgagcagtgtga

SEQ ID NO: 127229 - DNA, 36 bp, Artificial Sequence
  Synthetic oligonucleotide
tgtccgaccccccccgtgctacggccagcatattta

SEQ ID NO: 127230 - DNA, 35 bp, Artificial Sequence
  Synthetic oligonucleotide
gtacccgccggtctattactgacccattttccgac

SEQ ID NO: 127231 - DNA, 35 bp, Artificial Sequence
  Synthetic oligonucleotide
gcctccgcacatatatctaagcaccgtgggcctcc

SEQ ID NO: 127232 - DNA, 33 bp, Artificial Sequence
  Synthetic oligonucleotide
tagccagtggggagcgagtggggaggtggtcat

SEQ ID NO: 127233 - DNA, 35 bp, Artificial Sequence
  Synthetic oligonucleotide
gttaccccgtcatccccatactgctccgctgcgca

SEQ ID NO: 127234 - DNA, 37 bp, Artificial Sequence
  Synthetic oligonucleotide
tttggggggggagggaaggggtacaaaaattaaggga

SEQ ID NO: 127235 - DNA, 38 bp, Artificial Sequence
  Synthetic oligonucleotide
accgccactccaccacatgcccaggcattaacacctga

SEQ ID NO: 127236 - DNA, 36 bp, Artificial Sequence
  Synthetic oligonucleotide
aaagatgtgtaagcccccgccggccccaccacccta

SEQ ID NO: 127237 - DNA, 35 bp, Artificial Sequence
  Synthetic oligonucleotide
accatgccccgacccccccgattcgccccggtcta

SEQ ID NO: 127238 - DNA, 36 bp, Artificial Sequence
  Synthetic oligonucleotide
accgcaccgctctatctgccatcacccatgtctgta

SEQ ID NO: 127239 - DNA, 35 bp, Artificial Sequence
  Synthetic oligonucleotide
gttcatgcccccatgtctctcttattaccccgtta

SEQ ID NO: 127240 - DNA, 35 bp, Artificial Sequence
  Synthetic oligonucleotide
acccacctgtgttgactatcattgctactccctgc

SEQ ID NO: 127241 - DNA, 35 bp, Artificial Sequence
  Synthetic oligonucleotide
gacaacgctccgtctttgttacttgtctccatatc

SEQ ID NO: 127242 - DNA, 35 bp, Artificial Sequence
  Synthetic oligonucleotide
gccacttcgcctgaatcgtaactcgcttttccgtc

SEQ ID NO: 127243 - DNA, 35 bp, Artificial Sequence
  Synthetic oligonucleotide
gccacccctactgtatggctccaacaccagccctg

SEQ ID NO: 127244 - DNA, 35 bp, Artificial Sequence
  Synthetic oligonucleotide
aacttctgccgccatcgggtctagccttctgccct

SEQ ID NO: 127245 - DNA, 35 bp, Artificial Sequence
  Synthetic oligonucleotide
gccccagcacttcagtaaccatcgccctagtccct

SEQ ID NO: 127246 - DNA, 35 bp, Artificial Sequence
  Synthetic oligonucleotide
aattgccccgccgctttctcgcacccggtcgagct

SEQ ID NO: 127247 - DNA, 36 bp, Artificial Sequence
  Synthetic oligonucleotide
tcaccgccaaaatgattcgcctcctgccacccatga

SEQ ID NO: 127248 - DNA, 38 bp, Artificial Sequence
  Synthetic oligonucleotide
aactacgggcaggccaaaacggtagggagggagggtga

SEQ ID NO: 127249 - DNA, 33 bp, Artificial Sequence
  Synthetic oligonucleotide
acccatcatgtgccacgaccccagccttaccta

SEQ ID NO: 127250 - DNA, 35 bp, Artificial Sequence
  Synthetic oligonucleotide
ggatgacccctgccgtagctatacgcctcttgctc

SEQ ID NO: 127251 - DNA, 35 bp, Artificial Sequence
  Synthetic oligonucleotide
acctccccactcacctttgccccctgtgttgtgtc

SEQ ID NO: 127252 - DNA, 35 bp, Artificial Sequence
  Synthetic oligonucleotide
tgaccccatcacctgttgttttcggctcaccttat

SEQ ID NO: 127253 - DNA, 35 bp, Artificial Sequence
  Synthetic oligonucleotide
gcccctactccctggttgattcgtccgcttgccct

SEQ ID NO: 127254 - DNA, 35 bp, Artificial Sequence
  Synthetic oligonucleotide
gacgacgtaatccttgtcaagcctaccgccatcct

SEQ ID NO: 127255 - DNA, 35 bp, Artificial Sequence
  Synthetic oligonucleotide
atagaccatccccctggtgcctacgaccgtttctt

SEQ ID NO: 127256 - DNA, 36 bp, Artificial Sequence
  Synthetic oligonucleotide
gaaacgcaccatcctgttctcctgtcgttatctaaa

SEQ ID NO: 127257 - DNA, 36 bp, Artificial Sequence
  Synthetic oligonucleotide
aacccatcgccctgcccacatctactactagtggaa

SEQ ID NO: 127258 - DNA, 36 bp, Artificial Sequence
  Synthetic oligonucleotide
ttgaccacgcccatcgctacactatgtccaccccca

SEQ ID NO: 127259 - DNA, 36 bp, Artificial Sequence
  Synthetic oligonucleotide
acgctcactacgacgctatattgccttgctttctca

SEQ ID NO: 127260 - DNA, 35 bp, Artificial Sequence
  Synthetic oligonucleotide
tcatgacgccacttttgaacgccacactccattca

SEQ ID NO: 127261 - DNA, 37 bp, Artificial Sequence
  Synthetic oligonucleotide
gtttacccggcacttgtttcgctccgtctcccatcga

SEQ ID NO: 127262 - DNA, 37 bp, Artificial Sequence
  Synthetic oligonucleotide
tccccatgtcttctattcgataagccgcgccccctga

SEQ ID NO: 127263 - DNA, 36 bp, Artificial Sequence
  Synthetic oligonucleotide
ttgctggctccacttgcctacccgacccacagccta

SEQ ID NO: 127264 - DNA, 36 bp, Artificial Sequence
  Synthetic oligonucleotide
gccacgcccacttgttcacacaccctcatcccctta

SEQ ID NO: 127265 - DNA, 35 bp, Artificial Sequence
  Synthetic oligonucleotide
tgcacccttcctgcctctcgggtccgtaattggcc

SEQ ID NO: 127266 - DNA, 35 bp, Artificial Sequence
  Synthetic oligonucleotide
gaagaccccgtacatcgatatctcgccaccctcgc

SEQ ID NO: 127267 - DNA, 35 bp, Artificial Sequence
  Synthetic oligonucleotide
acctcctcgcgcccccttattgtcggaatatcctc

SEQ ID NO: 127268 - DNA, 35 bp, Artificial Sequence
  Synthetic oligonucleotide
ggtgtgggaaagggtgggtgggattagaatgtgag

SEQ ID NO: 127269 - DNA, 35 bp, Artificial Sequence
  Synthetic oligonucleotide
ttcacgtcaaccttcatctgccccccttggttacg

SEQ ID NO: 127270 - DNA, 35 bp, Artificial Sequence
  Synthetic oligonucleotide
gtcgcccccgcgctgggctctattttcatgttact

SEQ ID NO: 127271 - DNA, 35 bp, Artificial Sequence
  Synthetic oligonucleotide
tgttgcctggccgccattttttccaccgttactct

SEQ ID NO: 127272 - DNA, 35 bp, Artificial Sequence
  Synthetic oligonucleotide
ttcaaccactgacctcagccggactgttcctccca

SEQ ID NO: 127273 - DNA, 36 bp, Artificial Sequence
  Synthetic oligonucleotide
tcaccacccctgttcagcaccgtcctgctgctgcca

SEQ ID NO: 127274 - DNA, 36 bp, Artificial Sequence
  Synthetic oligonucleotide
cagccgcttactcgctctattcatgacttgctgcca

SEQ ID NO: 127275 - DNA, 36 bp, Artificial Sequence
  Synthetic oligonucleotide
tatgcatcgccgctacgggttcttcgccttcctcca

SEQ ID NO: 127276 - DNA, 34 bp, Artificial Sequence
  Synthetic oligonucleotide
gcccgtcgatttttccgctcctgatccctctgca

SEQ ID NO: 127277 - DNA, 36 bp, Artificial Sequence
  Synthetic oligonucleotide
gcatggggggatagaatgaaggggaggagaagaaga

SEQ ID NO: 127278 - DNA, 37 bp, Artificial Sequence
  Synthetic oligonucleotide
gagggagtgggtgggaaaatagggtgagactgcgcga

SEQ ID NO: 127279 - DNA, 36 bp, Artificial Sequence
  Synthetic oligonucleotide
tagccagacccctctttgcccagttcccttgattga

SEQ ID NO: 127280 - DNA, 36 bp, Artificial Sequence
  Synthetic oligonucleotide
acatgtcaggtcccataccgttcacctcgccgccta

SEQ ID NO: 127281 - DNA, 35 bp, Artificial Sequence
  Synthetic oligonucleotide
ttgttgtccgcctcttcatcgttctgctccctgtc

SEQ ID NO: 127282 - DNA, 35 bp, Artificial Sequence
  Synthetic oligonucleotide
tggtacacgcattagctccttcatatcggcctttc

SEQ ID NO: 127283 - DNA, 35 bp, Artificial Sequence
  Synthetic oligonucleotide
gatcgccccctgccccgacatacccccgttgcctg

SEQ ID NO: 127284 - DNA, 35 bp, Artificial Sequence
  Synthetic oligonucleotide
ttacgctaacagactccgcgcatgcccccgttcct

SEQ ID NO: 127285 - DNA, 36 bp, Artificial Sequence
  Synthetic oligonucleotide
acctgccccagccgctttcaacttagcaatccctca

SEQ ID NO: 127286 - DNA, 37 bp, Artificial Sequence
  Synthetic oligonucleotide
acagaacgggtggggcggaaaacaggctggaggagga

SEQ ID NO: 127287 - DNA, 37 bp, Artificial Sequence
  Synthetic oligonucleotide
ggtgaggtcgggggtcgcgggagcaacaggaggggga

SEQ ID NO: 127288 - DNA, 38 bp, Artificial Sequence
  Synthetic oligonucleotide
agacgggggggggaggtggaactcgggagacggtgtga

SEQ ID NO: 127289 - DNA, 35 bp, Artificial Sequence
  Synthetic oligonucleotide
accatccactgagcttctccagaccattcccagta

SEQ ID NO: 127290 - DNA, 35 bp, Artificial Sequence
  Synthetic oligonucleotide
tcagacgcactcaccatattatttgctccgctgac

SEQ ID NO: 127291 - DNA, 35 bp, Artificial Sequence
  Synthetic oligonucleotide
gaccaaccgaacccggcgccatcctggtacccacc

SEQ ID NO: 127292 - DNA, 35 bp, Artificial Sequence
  Synthetic oligonucleotide
atgctcacctctccgggctgtatcgaaccctacgc

SEQ ID NO: 127293 - DNA, 34 bp, Artificial Sequence
  Synthetic oligonucleotide
tgacccccccccccatatgtattccaccagctgc

SEQ ID NO: 127294 - DNA, 35 bp, Artificial Sequence
  Synthetic oligonucleotide
gcctcattcgcgcctgccgctggactgctcccatc

SEQ ID NO: 127295 - DNA, 35 bp, Artificial Sequence
  Synthetic oligonucleotide
gtacgaagctctcctgccccagtacaacacacctc

SEQ ID NO: 127296 - DNA, 35 bp, Artificial Sequence
  Synthetic oligonucleotide
gcgaacgtacattgtcgcccccagattcaacgctc

SEQ ID NO: 127297 - DNA, 35 bp, Artificial Sequence
  Synthetic oligonucleotide
tcgcccatcaagcgtgttactttcgccagcccttc

SEQ ID NO: 127298 - DNA, 35 bp, Artificial Sequence
  Synthetic oligonucleotide
tccgccctcccctcgatgagactcactgccctttc

SEQ ID NO: 127299 - DNA, 35 bp, Artificial Sequence
  Synthetic oligonucleotide
tccccggaagccggtcagtgcccccaatatatccg

SEQ ID NO: 127300 - DNA, 35 bp, Artificial Sequence
  Synthetic oligonucleotide
catgacgagatatcctacccgcttaacctcttccg

SEQ ID NO: 127301 - DNA, 35 bp, Artificial Sequence
  Synthetic oligonucleotide
acccaccccggccaaaccgactgtctcaccttcgt

SEQ ID NO: 127302 - DNA, 35 bp, Artificial Sequence
  Synthetic oligonucleotide
tgaccgcccccccgtaattagtggcctctccttgt

SEQ ID NO: 127303 - DNA, 35 bp, Artificial Sequence
  Synthetic oligonucleotide
gccggttaggcgccctctgtctctgccttccaaaa

SEQ ID NO: 127304 - DNA, 36 bp, Artificial Sequence
  Synthetic oligonucleotide
atagcgcggtacctgctgcctttatcctcgttcaaa

SEQ ID NO: 127305 - DNA, 35 bp, Artificial Sequence
  Synthetic oligonucleotide
tcaaaagggaggtaaaaggagggggagaccggcaa

SEQ ID NO: 127306 - DNA, 37 bp, Artificial Sequence
  Synthetic oligonucleotide
tgcatccagccgcaccccgcaaccctacatgttccga

SEQ ID NO: 127307 - DNA, 38 bp, Artificial Sequence
  Synthetic oligonucleotide
atcgacaggcgcccgcccccttgtactagccaccatga

SEQ ID NO: 127308 - DNA, 38 bp, Artificial Sequence
  Synthetic oligonucleotide
acccgcctccactgcttcgcactcagtcataggcatga

SEQ ID NO: 127309 - DNA, 36 bp, Artificial Sequence
  Synthetic oligonucleotide
gtctgctccaccggtaccactgcgtttcctatcgta

SEQ ID NO: 127310 - DNA, 36 bp, Artificial Sequence
  Synthetic oligonucleotide
agcacatgccgtggcattgcttccctcccgttgtta

SEQ ID NO: 127311 - DNA, 34 bp, Artificial Sequence
  Synthetic oligonucleotide
tatgccgatcgcccggcctagctcttacacccgc

SEQ ID NO: 127312 - DNA, 35 bp, Artificial Sequence
  Synthetic oligonucleotide
tcaatcccgcccgtccctttgctccagtcaattgc

SEQ ID NO: 127313 - DNA, 35 bp, Artificial Sequence
  Synthetic oligonucleotide
gtcgcaccaccactccctgtattgccgcttaggtc

SEQ ID NO: 127314 - DNA, 35 bp, Artificial Sequence
  Synthetic oligonucleotide
atcaccgaacaaattttgaatctgccccgaccttc

SEQ ID NO: 127315 - DNA, 35 bp, Artificial Sequence
  Synthetic oligonucleotide
tcacacttcaccaatctagctcacgacctcggttc

SEQ ID NO: 127316 - DNA, 35 bp, Artificial Sequence
  Synthetic oligonucleotide
tggagcccccattcaataagccgccgctcactcct

SEQ ID NO: 127317 - DNA, 35 bp, Artificial Sequence
  Synthetic oligonucleotide
acccatgcgctagtcctccccacggtcgcccttct

SEQ ID NO: 127318 - DNA, 36 bp, Artificial Sequence
  Synthetic oligonucleotide
gtccccctgcctatgtactatcacttcattcatcca

SEQ ID NO: 127319 - DNA, 35 bp, Artificial Sequence
  Synthetic oligonucleotide
tgaccaccctcgaccccgcgccacctggttccgca

SEQ ID NO: 127320 - DNA, 36 bp, Artificial Sequence
  Synthetic oligonucleotide
gccacccgccactgaactccttgaccgttatgggca

SEQ ID NO: 127321 - DNA, 37 bp, Artificial Sequence
  Synthetic oligonucleotide
ggtagagggtgggcagaggggggggagcaccgcgaga

SEQ ID NO: 127322 - DNA, 38 bp, Artificial Sequence
  Synthetic oligonucleotide
tcgctcactcacattgtgcttgcccttcctccctatga

SEQ ID NO: 127323 - DNA, 36 bp, Artificial Sequence
  Synthetic oligonucleotide
gaccactccgtagttcccagggccctgccttccgta

SEQ ID NO: 127324 - DNA, 36 bp, Artificial Sequence
  Synthetic oligonucleotide
ttagcgggtacaggcaagtagggataacggggggag

SEQ ID NO: 127325 - DNA, 35 bp, Artificial Sequence
  Synthetic oligonucleotide
tcactgtcctcccccatctgtacgcacaattcgcg

SEQ ID NO: 127326 - DNA, 35 bp, Artificial Sequence
  Synthetic oligonucleotide
acaaggaagggcaaaagggggttgggcggggctgg

SEQ ID NO: 127327 - DNA, 35 bp, Artificial Sequence
  Synthetic oligonucleotide
tcgcaagggcctcatctccattattcacattgcca

SEQ ID NO: 127328 - DNA, 36 bp, Artificial Sequence
  Synthetic oligonucleotide
gtcaccatcaccggcggtcaacatactccccctcca

SEQ ID NO: 127329 - DNA, 37 bp, Artificial Sequence
  Synthetic oligonucleotide
atgccaacacctgacactgggtaagggatggggggga

SEQ ID NO: 127330 - DNA, 38 bp, Artificial Sequence
  Synthetic oligonucleotide
tgccgccgcccctctgttactctcacgccccgcggtga

SEQ ID NO: 127331 - DNA, 37 bp, Artificial Sequence
  Synthetic oligonucleotide
gctgagcgccgcctgccatggcccacccgctttttga

SEQ ID NO: 127332 - DNA, 36 bp, Artificial Sequence
  Synthetic oligonucleotide
taccccacgccgcatcccgttctagtcctgacgcta

SEQ ID NO: 127333 - DNA, 35 bp, Artificial Sequence
  Synthetic oligonucleotide
tcactgtcgttgcggtagtcctgcaccactccccc

SEQ ID NO: 127334 - DNA, 35 bp, Artificial Sequence
  Synthetic oligonucleotide
gatcccgtagtgtagcccttcgcccccctgtgagc

SEQ ID NO: 127335 - DNA, 35 bp, Artificial Sequence
  Synthetic oligonucleotide
tctggggcggggaacagggggggaggcgccgaggc

SEQ ID NO: 127336 - DNA, 35 bp, Artificial Sequence
  Synthetic oligonucleotide
acctcggacacgccattgacctacccgacccactc

SEQ ID NO: 127337 - DNA, 35 bp, Artificial Sequence
  Synthetic oligonucleotide
acgtgctcaatgtagcacttcgcccgcaccccctc

SEQ ID NO: 127338 - DNA, 35 bp, Artificial Sequence
  Synthetic oligonucleotide
tgtgtgagccatcccgtgtcttcgtactcccctat

SEQ ID NO: 127339 - DNA, 35 bp, Artificial Sequence
  Synthetic oligonucleotide
acgacgcccccgtgcgtgcgcaataacctctcact

SEQ ID NO: 127340 - DNA, 35 bp, Artificial Sequence
  Synthetic oligonucleotide
gatgcctgttccgacccgttcattccgttgtcatt

SEQ ID NO: 127341 - DNA, 36 bp, Artificial Sequence
  Synthetic oligonucleotide
aaccgccaccccatgcttcccactagtaacccgcaa

SEQ ID NO: 127342 - DNA, 36 bp, Artificial Sequence
  Synthetic oligonucleotide
attgacgacagggacagggggggagatggggtctaa

SEQ ID NO: 127343 - DNA, 37 bp, Artificial Sequence
  Synthetic oligonucleotide
acagggggacgggtgaggcggtaaaaggtgggacgga

SEQ ID NO: 127344 - DNA, 36 bp, Artificial Sequence
  Synthetic oligonucleotide
tatgggcggggatggggtgtcagactaacctgggga

SEQ ID NO: 127345 - DNA, 37 bp, Artificial Sequence
  Synthetic oligonucleotide
tgcatcctccacgtcctccgctctgtcactctattga

SEQ ID NO: 127346 - DNA, 35 bp, Artificial Sequence
  Synthetic oligonucleotide
cccacgcctccgtttggtctatttatccgttcacc

SEQ ID NO: 127347 - DNA, 35 bp, Artificial Sequence
  Synthetic oligonucleotide
gcgccctaggctaagcctccgtctgtccccctgcc

SEQ ID NO: 127348 - DNA, 35 bp, Artificial Sequence
  Synthetic oligonucleotide
gtgaagctccagtaatctacactcctggtccctcc

SEQ ID NO: 127349 - DNA, 35 bp, Artificial Sequence
  Synthetic oligonucleotide
tgcttcccgaactatatacctgcccttgctcgcgc

SEQ ID NO: 127350 - DNA, 35 bp, Artificial Sequence
  Synthetic oligonucleotide
tcgctccccctatcctgtgttcctatgtcctgggc

SEQ ID NO: 127351 - DNA, 35 bp, Artificial Sequence
  Synthetic oligonucleotide
ataggccgcccctatgccgccgtcttttcttcgtc

SEQ ID NO: 127352 - DNA, 35 bp, Artificial Sequence
  Synthetic oligonucleotide
ggggcgggagggggttaaaggtgtcgggggcccag

SEQ ID NO: 127353 - DNA, 35 bp, Artificial Sequence
  Synthetic oligonucleotide
tcccacacccatatgttcctgatccttgtccgacg

SEQ ID NO: 127354 - DNA, 35 bp, Artificial Sequence
  Synthetic oligonucleotide
tcgcgccgtatcattcacaccatcgcccgctttgt

SEQ ID NO: 127355 - DNA, 35 bp, Artificial Sequence
  Synthetic oligonucleotide
ttcgccgctgctccgcccttaatatctgtccgttt

SEQ ID NO: 127356 - DNA, 37 bp, Artificial Sequence
  Synthetic oligonucleotide
ggacggaggaaacaaaaagggaaggacgaagggagaa

SEQ ID NO: 127357 - DNA, 35 bp, Artificial Sequence
  Synthetic oligonucleotide
atacaccgcgcccctggtgcattttcccgacccca

SEQ ID NO: 127358 - DNA, 36 bp, Artificial Sequence
  Synthetic oligonucleotide
aatggtgcagaaggacaggataaggagggagcgaga

SEQ ID NO: 127359 - DNA, 36 bp, Artificial Sequence
  Synthetic oligonucleotide
gaaaagacaggaatggagacggggagtaagggacga

SEQ ID NO: 127360 - DNA, 37 bp, Artificial Sequence
  Synthetic oligonucleotide
taccaccgccattatctttacgccttgtcacgcggga

SEQ ID NO: 127361 - DNA, 38 bp, Artificial Sequence
  Synthetic oligonucleotide
taggggaggggtggaggggatggagttcgattaagtga

SEQ ID NO: 127362 - DNA, 38 bp, Artificial Sequence
  Synthetic oligonucleotide
ggaaccggtgaaaagggggggtaagggtagggtggtga

SEQ ID NO: 127363 - DNA, 37 bp, Artificial Sequence
  Synthetic oligonucleotide
taccccgcccttgctccatcagtcacaccgagattga

SEQ ID NO: 127364 - DNA, 38 bp, Artificial Sequence
  Synthetic oligonucleotide
tgccgctccccagttcgtaccaggcctccctcccttga

SEQ ID NO: 127365 - DNA, 35 bp, Artificial Sequence
  Synthetic oligonucleotide
ataccacagcacccgcgcccatggcctacttccgc

SEQ ID NO: 127366 - DNA, 35 bp, Artificial Sequence
  Synthetic oligonucleotide
ggaaaatggaggggagtacttagataacgtgtagg

SEQ ID NO: 127367 - DNA, 35 bp, Artificial Sequence
  Synthetic oligonucleotide
atgtttgtgacgggaggggaggggaggggagacgg

SEQ ID NO: 127368 - DNA, 35 bp, Artificial Sequence
  Synthetic oligonucleotide
acatcataacgccctgttcgcgaatcatttgccct

SEQ ID NO: 127369 - DNA, 36 bp, Artificial Sequence
  Synthetic oligonucleotide
aggggagggggggaggatatatcggatggaggataa

SEQ ID NO: 127370 - DNA, 36 bp, Artificial Sequence
  Synthetic oligonucleotide
ggactgaccctgaccccgttttaagctcccgctcga

SEQ ID NO: 127371 - DNA, 37 bp, Artificial Sequence
  Synthetic oligonucleotide
tacgtgtagcgtgactaaaccgccgcccactaactga

SEQ ID NO: 127372 - DNA, 38 bp, Artificial Sequence
  Synthetic oligonucleotide
gcgatccaccgccccattttagcttgtccttacgctga

SEQ ID NO: 127373 - DNA, 37 bp, Artificial Sequence
  Synthetic oligonucleotide
tcgctagccgcgtgcgaagcaccccaacctctcttga

SEQ ID NO: 127374 - DNA, 36 bp, Artificial Sequence
  Synthetic oligonucleotide
gccccgctccatatctgccccatctgtccatgctta

SEQ ID NO: 127375 - DNA, 35 bp, Artificial Sequence
  Synthetic oligonucleotide
tgccagtaacaaatcctgcctcagtcacgcctccc

SEQ ID NO: 127376 - DNA, 35 bp, Artificial Sequence
  Synthetic oligonucleotide
aacgcgcgcaggttctactcgtatgcccgccgtcc

SEQ ID NO: 127377 - DNA, 35 bp, Artificial Sequence
  Synthetic oligonucleotide
actcatactggcaccctgcttcactccgttcctgc

SEQ ID NO: 127378 - DNA, 35 bp, Artificial Sequence
  Synthetic oligonucleotide
ttcagccgccgcccctgaacttccgcaccctaatc

SEQ ID NO: 127379 - DNA, 35 bp, Artificial Sequence
  Synthetic oligonucleotide
tcacgcccgcacagacctttccctggtggtacctc

SEQ ID NO: 127380 - DNA, 28 bp, Artificial Sequence
  Synthetic oligonucleotide
tccgcctcccttggatcaatcaccgctc

SEQ ID NO: 127381 - DNA, 35 bp, Artificial Sequence
  Synthetic oligonucleotide
tgtgccgagtccctatctgctgaccgccgttcttc

SEQ ID NO: 127382 - DNA, 35 bp, Artificial Sequence
  Synthetic oligonucleotide
gtacccaccaccgccattttttcgtgctctcgccg

SEQ ID NO: 127383 - DNA, 35 bp, Artificial Sequence
  Synthetic oligonucleotide
tgtgggggatggtggatggggtgtctgaaggtggg

SEQ ID NO: 127384 - DNA, 35 bp, Artificial Sequence
  Synthetic oligonucleotide
gtctcgctgcctgccatatattctcgcttctcaat

SEQ ID NO: 127385 - DNA, 35 bp, Artificial Sequence
  Synthetic oligonucleotide
tcagagaggggcggggcggggccatgggacaagat

SEQ ID NO: 127386 - DNA, 34 bp, Artificial Sequence
  Synthetic oligonucleotide
gtccattgtctgctacgacctgcaccccttacct

SEQ ID NO: 127387 - DNA, 35 bp, Artificial Sequence
  Synthetic oligonucleotide
gtgccctgcctacgtactgttctgctacattcgct

SEQ ID NO: 127388 - DNA, 35 bp, Artificial Sequence
  Synthetic oligonucleotide
tgttacggtctccgcctccgtgtcttccatactct

SEQ ID NO: 127389 - DNA, 35 bp, Artificial Sequence
  Synthetic oligonucleotide
atttatgcgcgcagtatcctcttcgtccccgctgt

SEQ ID NO: 127390 - DNA, 35 bp, Artificial Sequence
  Synthetic oligonucleotide
aaggtggtgcaggggaatggaggaggagcgctatt

SEQ ID NO: 127391 - DNA, 34 bp, Artificial Sequence
  Synthetic oligonucleotide
gaccccgcccccgccaccctgaggttgatagctt

SEQ ID NO: 127392 - DNA, 36 bp, Artificial Sequence
  Synthetic oligonucleotide
actgacggcggaagggagggccgggctcggggggaa

SEQ ID NO: 127393 - DNA, 36 bp, Artificial Sequence
  Synthetic oligonucleotide
taacacccctgcgcactatgtagctcgccttcacca

SEQ ID NO: 127394 - DNA, 36 bp, Artificial Sequence
  Synthetic oligonucleotide
tgccatgccctctactgatacccgccctatgcgcca

SEQ ID NO: 127395 - DNA, 35 bp, Artificial Sequence
  Synthetic oligonucleotide
gacctgcccgtacattactagttgccgttctatca

SEQ ID NO: 127396 - DNA, 36 bp, Artificial Sequence
  Synthetic oligonucleotide
gatgaccacgcgtatgccgggctctagtgcctctca

SEQ ID NO: 127397 - DNA, 35 bp, Artificial Sequence
  Synthetic oligonucleotide
gatcatggcacatgtaattggtcttcactttctca

SEQ ID NO: 127398 - DNA, 35 bp, Artificial Sequence
  Synthetic oligonucleotide
gatgcgtgtcctcagtcgttccctattatccgtca

SEQ ID NO: 127399 - DNA, 38 bp, Artificial Sequence
  Synthetic oligonucleotide
tcccgtgacgccattcgtgattcctgcaccctacctga

SEQ ID NO: 127400 - DNA, 35 bp, Artificial Sequence
  Synthetic oligonucleotide
tccgcctttcggttcatttcgtatctgctcaccac

SEQ ID NO: 127401 - DNA, 35 bp, Artificial Sequence
  Synthetic oligonucleotide
tctaagcctccgtcatctcataacatcgctcgccc

SEQ ID NO: 127402 - DNA, 35 bp, Artificial Sequence
  Synthetic oligonucleotide
ttcaccgccttcctcccgagtccaattaaccagcc

SEQ ID NO: 127403 - DNA, 35 bp, Artificial Sequence
  Synthetic oligonucleotide
gcgagccgtgatctccccggttgttacttgcctcc

SEQ ID NO: 127404 - DNA, 35 bp, Artificial Sequence
  Synthetic oligonucleotide
cccacatcaccgccgctttcgtatcagccgttcgc

SEQ ID NO: 127405 - DNA, 31 bp, Artificial Sequence
  Synthetic oligonucleotide
gtttcatccactctagttttccgtgctctgc

SEQ ID NO: 127406 - DNA, 35 bp, Artificial Sequence
  Synthetic oligonucleotide
ggcctacgccgcccatgttcccactccctaacctg

SEQ ID NO: 127407 - DNA, 35 bp, Artificial Sequence
  Synthetic oligonucleotide
tccctgccactcgccgttcaatctggcatacgcct

SEQ ID NO: 127408 - DNA, 35 bp, Artificial Sequence
  Synthetic oligonucleotide
gtccaatgatcgcctgccccacatcccgctacgct

SEQ ID NO: 127409 - DNA, 35 bp, Artificial Sequence
  Synthetic oligonucleotide
tgtggaccggcctccattttgtctttcgtgcggtt

SEQ ID NO: 127410 - DNA, 36 bp, Artificial Sequence
  Synthetic oligonucleotide
aaaccccaccctcatacgttctgtctgtcttcgcca

SEQ ID NO: 127411 - DNA, 37 bp, Artificial Sequence
  Synthetic oligonucleotide
acggaccgtagctccatcgtttctgtctttccctcga

SEQ ID NO: 127412 - DNA, 37 bp, Artificial Sequence
  Synthetic oligonucleotide
accacctacgatgagctatcattagcctccccttcga

SEQ ID NO: 127413 - DNA, 38 bp, Artificial Sequence
  Synthetic oligonucleotide
acagtctgcccctagcccttcaccgtgccgtttactga

SEQ ID NO: 127414 - DNA, 35 bp, Artificial Sequence
  Synthetic oligonucleotide
actcacggcggttccggttctgctgcttcttccac

SEQ ID NO: 127415 - DNA, 35 bp, Artificial Sequence
  Synthetic oligonucleotide
tcgcataatcgctacctgtccacccctcagatcac

SEQ ID NO: 127416 - DNA, 35 bp, Artificial Sequence
  Synthetic oligonucleotide
gcaaggttaccaccgccgacacctgtactctgccc

SEQ ID NO: 127417 - DNA, 35 bp, Artificial Sequence
  Synthetic oligonucleotide
tgatgcccgcccccccgctctctcaattcgccgcc

SEQ ID NO: 127418 - DNA, 35 bp, Artificial Sequence
  Synthetic oligonucleotide
ttccgcttacgaccgaaggacccacgcccctcgcc

SEQ ID NO: 127419 - DNA, 35 bp, Artificial Sequence
  Synthetic oligonucleotide
gcatatccgtcgattatgcttagcctcacctgtcc

SEQ ID NO: 127420 - DNA, 35 bp, Artificial Sequence
  Synthetic oligonucleotide
tgcgtcacgctcttgccgcctttcacggtaccatc

SEQ ID NO: 127421 - DNA, 34 bp, Artificial Sequence
  Synthetic oligonucleotide
accaccgttgtcctggtttttatccttccccacg

SEQ ID NO: 127422 - DNA, 35 bp, Artificial Sequence
  Synthetic oligonucleotide
gcaggggtggggggttcgggcaaggcatggggtcg

SEQ ID NO: 127423 - DNA, 35 bp, Artificial Sequence
  Synthetic oligonucleotide
gatccggccgactttgatctacctctcgctcccct

SEQ ID NO: 127424 - DNA, 35 bp, Artificial Sequence
  Synthetic oligonucleotide
aacgtctgtgtcacacctcccttgcctaatgccct

SEQ ID NO: 127425 - DNA, 35 bp, Artificial Sequence
  Synthetic oligonucleotide
atacaccgcgatttgcttcctctccggtgctccct

SEQ ID NO: 127426 - DNA, 35 bp, Artificial Sequence
  Synthetic oligonucleotide
gcatcaaacgtcgcgcttattaccgtactcctgct

SEQ ID NO: 127427 - DNA, 35 bp, Artificial Sequence
  Synthetic oligonucleotide
tccgactccgcccatcatgatccatccagctttct

SEQ ID NO: 127428 - DNA, 35 bp, Artificial Sequence
  Synthetic oligonucleotide
gtctgtgtccgggtctatgtcttcctgtccgtcgt

SEQ ID NO: 127429 - DNA, 35 bp, Artificial Sequence
  Synthetic oligonucleotide
tacggattgggaaggggtgttgggggagggcactt

SEQ ID NO: 127430 - DNA, 36 bp, Artificial Sequence
  Synthetic oligonucleotide
gctggggtggtaaggggaggtgcagggcgtggagaa

SEQ ID NO: 127431 - DNA, 36 bp, Artificial Sequence
  Synthetic oligonucleotide
acctaccgactggtgcgccctatcctccgctggcca

SEQ ID NO: 127432 - DNA, 35 bp, Artificial Sequence
  Synthetic oligonucleotide
gatggcactcccccgggccgcactattccagttca

SEQ ID NO: 127433 - DNA, 36 bp, Artificial Sequence
  Synthetic oligonucleotide
ggagggtggaggggagttgggtccaggtgaaggaga

SEQ ID NO: 127434 - DNA, 37 bp, Artificial Sequence
  Synthetic oligonucleotide
gacgacacgggacgggggatatcggggcgggtcggga

SEQ ID NO: 127435 - DNA, 35 bp, Artificial Sequence
  Synthetic oligonucleotide
gattacctcccgacgtttgcctccccgttctggga

SEQ ID NO: 127436 - DNA, 38 bp, Artificial Sequence
  Synthetic oligonucleotide
tgtggccccacccgtaggacgcactctctctttgctga

SEQ ID NO: 127437 - DNA, 38 bp, Artificial Sequence
  Synthetic oligonucleotide
atgcggggggagggggtttgtggacgggttcggagtga

SEQ ID NO: 127438 - DNA, 37 bp, Artificial Sequence
  Synthetic oligonucleotide
gcgccttaccgccctgtcctttcgctgaccgcattga

SEQ ID NO: 127439 - DNA, 35 bp, Artificial Sequence
  Synthetic oligonucleotide
tgagggagacctccccgcagtctttgcaccaccta

SEQ ID NO: 127440 - DNA, 36 bp, Artificial Sequence
  Synthetic oligonucleotide
agagccccatccgtacctcgttccctcttgtgccta

SEQ ID NO: 127441 - DNA, 36 bp, Artificial Sequence
  Synthetic oligonucleotide
tcacaccctctgtcgtaaacctatccattcaacgta

SEQ ID NO: 127442 - DNA, 35 bp, Artificial Sequence
  Synthetic oligonucleotide
ggtatcggtagccctgtttctatcctgtcctttac

SEQ ID NO: 127443 - DNA, 35 bp, Artificial Sequence
  Synthetic oligonucleotide
gaagcacggtcccgtttctagcccttactgcaccc

SEQ ID NO: 127444 - DNA, 35 bp, Artificial Sequence
  Synthetic oligonucleotide
acgtatgtccccctcgttgcatatgcactcttcgc

SEQ ID NO: 127445 - DNA, 35 bp, Artificial Sequence
  Synthetic oligonucleotide
acgcggagaggcggggagaaatggggaagtccggg

SEQ ID NO: 127446 - DNA, 35 bp, Artificial Sequence
  Synthetic oligonucleotide
agtgcaagcccctcgccccttcgcgcccacccctg

SEQ ID NO: 127447 - DNA, 33 bp, Artificial Sequence
  Synthetic oligonucleotide
attgagggcaggggtgggaaaggggtcctctct

SEQ ID NO: 127448 - DNA, 36 bp, Artificial Sequence
  Synthetic oligonucleotide
tgtgaagtcagccgattcttttatcccccccgccca

SEQ ID NO: 127449 - DNA, 37 bp, Artificial Sequence
  Synthetic oligonucleotide
accgaagaagctggggaaggaacggggggtgaagcga

SEQ ID NO: 127450 - DNA, 38 bp, Artificial Sequence
  Synthetic oligonucleotide
tcaccccctgagatcttttatactggccccctcactga

SEQ ID NO: 127451 - DNA, 36 bp, Artificial Sequence
  Synthetic oligonucleotide
agtagggggaggggaggggaacgcgctaatgggcta

SEQ ID NO: 127452 - DNA, 35 bp, Artificial Sequence
  Synthetic oligonucleotide
tcgaacgaaccagtatctcgctaactctcgccccc

SEQ ID NO: 127453 - DNA, 35 bp, Artificial Sequence
  Synthetic oligonucleotide
tcccgtcgccaaggccgtccgttaaacccatctcc

SEQ ID NO: 127454 - DNA, 35 bp, Artificial Sequence
  Synthetic oligonucleotide
accccgacgctgaacacttgccctccggtccactc

SEQ ID NO: 127455 - DNA, 35 bp, Artificial Sequence
  Synthetic oligonucleotide
agtgcaaactccccatcgtctatttccgctctgtc

SEQ ID NO: 127456 - DNA, 35 bp, Artificial Sequence
  Synthetic oligonucleotide
gagttaaccctccgtcatcagcggcttccccccgt

SEQ ID NO: 127457 - DNA, 35 bp, Artificial Sequence
  Synthetic oligonucleotide
gtcctatcgccgatccggtgttcatcgcttccatt

SEQ ID NO: 127458 - DNA, 35 bp, Artificial Sequence
  Synthetic oligonucleotide
atgctggcaccgtgttcgctatgtttcggcccctt

SEQ ID NO: 127459 - DNA, 36 bp, Artificial Sequence
  Synthetic oligonucleotide
ttgcccgcccgttaccgccctgttctgtcgctgtca

SEQ ID NO: 127460 - DNA, 37 bp, Artificial Sequence
  Synthetic oligonucleotide
agggtggggcataatcgtgggggtgctttcggggaga

SEQ ID NO: 127461 - DNA, 37 bp, Artificial Sequence
  Synthetic oligonucleotide
tcccatcacctgcatgacttcgtcacatctccctcga

SEQ ID NO: 127462 - DNA, 37 bp, Artificial Sequence
  Synthetic oligonucleotide
aacgacgagggggggagaattctggagtctgatagga

SEQ ID NO: 127463 - DNA, 37 bp, Artificial Sequence
  Synthetic oligonucleotide
aatgggcggtggtctaatcgttagggagggcggggga

SEQ ID NO: 127464 - DNA, 37 bp, Artificial Sequence
  Synthetic oligonucleotide
gtgggaaagtcgggggagggcggacgggcgaagctga

SEQ ID NO: 127465 - DNA, 38 bp, Artificial Sequence
  Synthetic oligonucleotide
tccatccggtcgcctgccacattatgccatccttctga

SEQ ID NO: 127466 - DNA, 35 bp, Artificial Sequence
  Synthetic oligonucleotide
acttgccagggcgggaggggagatggtatggggta

SEQ ID NO: 127467 - DNA, 35 bp, Artificial Sequence
  Synthetic oligonucleotide
gcaacgccgccgcccattgtctcccgagtattgac

SEQ ID NO: 127468 - DNA, 35 bp, Artificial Sequence
  Synthetic oligonucleotide
taggaggccacaatccctgctcctgtttatcaccc

SEQ ID NO: 127469 - DNA, 35 bp, Artificial Sequence
  Synthetic oligonucleotide
gcccgatcccgaccctttgtcaatacgctttggcc

SEQ ID NO: 127470 - DNA, 35 bp, Artificial Sequence
  Synthetic oligonucleotide
ttacccccgttcagactgcaccccgtaccaaccgc

SEQ ID NO: 127471 - DNA, 35 bp, Artificial Sequence
  Synthetic oligonucleotide
tgacccgagttcggataacctgacccccctgccgc

SEQ ID NO: 127472 - DNA, 35 bp, Artificial Sequence
  Synthetic oligonucleotide
gcacacgggggggagtggggaaatggggcgactgc

SEQ ID NO: 127473 - DNA, 35 bp, Artificial Sequence
  Synthetic oligonucleotide
attcgcccggcctcgaaacatttaattcgccctgc

SEQ ID NO: 127474 - DNA, 35 bp, Artificial Sequence
  Synthetic oligonucleotide
gtgtgccgtcccagctcgctccccacattggaatc

SEQ ID NO: 127475 - DNA, 35 bp, Artificial Sequence
  Synthetic oligonucleotide
aaagtacggaaccaaggcgggtgggggggaacatg

SEQ ID NO: 127476 - DNA, 35 bp, Artificial Sequence
  Synthetic oligonucleotide
atgacgtcagtgttgctccatgtttcgtctcgcct

SEQ ID NO: 127477 - DNA, 35 bp, Artificial Sequence
  Synthetic oligonucleotide
atacgtctgtctgccggtgctcactcctcctccgt

SEQ ID NO: 127478 - DNA, 35 bp, Artificial Sequence
  Synthetic oligonucleotide
tcagctcccgccacgcatttgccttctcttgactt

SEQ ID NO: 127479 - DNA, 34 bp, Artificial Sequence
  Synthetic oligonucleotide
gaggtggtggggaggccagaacaaggaggcggaa

SEQ ID NO: 127480 - DNA, 36 bp, Artificial Sequence
  Synthetic oligonucleotide
gtggtgacggagtgtacgggaagggggaggcgggaa

SEQ ID NO: 127481 - DNA, 36 bp, Artificial Sequence
  Synthetic oligonucleotide
tcatacttgccagcgttcgtccacccccctaagcca

SEQ ID NO: 127482 - DNA, 36 bp, Artificial Sequence
  Synthetic oligonucleotide
gtgatccgccattgtgacaaatgtttcccgcctcca

SEQ ID NO: 127483 - DNA, 36 bp, Artificial Sequence
  Synthetic oligonucleotide
acacctcacatggcgcattattcctctcaatcttca

SEQ ID NO: 127484 - DNA, 37 bp, Artificial Sequence
  Synthetic oligonucleotide
taggagagtcaacaaactgggcgggaagggaaaggga

SEQ ID NO: 127485 - DNA, 37 bp, Artificial Sequence
  Synthetic oligonucleotide
ttggggatgatctcgttgggagggagcatgtagggga

SEQ ID NO: 127486 - DNA, 37 bp, Artificial Sequence
  Synthetic oligonucleotide
tgccatcccccccctcggccgtcaccctagacggtga

SEQ ID NO: 127487 - DNA, 35 bp, Artificial Sequence
  Synthetic oligonucleotide
tgcggagccgcttgcgccactacactccttggccc

SEQ ID NO: 127488 - DNA, 35 bp, Artificial Sequence
  Synthetic oligonucleotide
gtgcttaccactactgtccgccgccctggtttcgc

SEQ ID NO: 127489 - DNA, 35 bp, Artificial Sequence
  Synthetic oligonucleotide
tcacttcgactctgtccgcccgccttggctacatc

SEQ ID NO: 127490 - DNA, 35 bp, Artificial Sequence
  Synthetic oligonucleotide
gtgccatttccatcgttttagtcgctgctcccatc

SEQ ID NO: 127491 - DNA, 35 bp, Artificial Sequence
  Synthetic oligonucleotide
tgctcactgtttgttcacgtatctccctgcctatc

SEQ ID NO: 127492 - DNA, 35 bp, Artificial Sequence
  Synthetic oligonucleotide
ttcaccggacccggttgacgctggaccttctcctc

SEQ ID NO: 127493 - DNA, 35 bp, Artificial Sequence
  Synthetic oligonucleotide
tccacaagcctgtgcggtgccctaggtctctcttc

SEQ ID NO: 127494 - DNA, 35 bp, Artificial Sequence
  Synthetic oligonucleotide
gaaccacccgacggtcactctcccgatgctattcg

SEQ ID NO: 127495 - DNA, 35 bp, Artificial Sequence
  Synthetic oligonucleotide
actggacggaattataggtaggtggaggagagggg

SEQ ID NO: 127496 - DNA, 36 bp, Artificial Sequence
  Synthetic oligonucleotide
tcgaaatccgggggtggggcacaggaggggggacga

SEQ ID NO: 127497 - DNA, 37 bp, Artificial Sequence
  Synthetic oligonucleotide
atagggtcacggtaggggagagaggggcagggcgcga

SEQ ID NO: 127498 - DNA, 37 bp, Artificial Sequence
  Synthetic oligonucleotide
gcccctcctcgggccccacagactcccaccttgttga

SEQ ID NO: 127499 - DNA, 35 bp, Artificial Sequence
  Synthetic oligonucleotide
agcaccacccgtagcttagtttccccggtacctcc

SEQ ID NO: 127500 - DNA, 35 bp, Artificial Sequence
  Synthetic oligonucleotide
tccgcctaccgagcactcggccttttacatcctgc

SEQ ID NO: 127501 - DNA, 35 bp, Artificial Sequence
  Synthetic oligonucleotide
tcctgtcagccgagtatggccccctcccttatgtc

SEQ ID NO: 127502 - DNA, 35 bp, Artificial Sequence
  Synthetic oligonucleotide
tccttcacacatgctcgtggtctcgtgctcctttc

SEQ ID NO: 127503 - DNA, 35 bp, Artificial Sequence
  Synthetic oligonucleotide
gcccgacgaaccttctcctgcctccttatctgacg

SEQ ID NO: 127504 - DNA, 35 bp, Artificial Sequence
  Synthetic oligonucleotide
gtttcgctcctgtccccgccgtttgttttaacccg

SEQ ID NO: 127505 - DNA, 35 bp, Artificial Sequence
  Synthetic oligonucleotide
tcgcaaggtcatctgctcagcccccacccacttcg

SEQ ID NO: 127506 - DNA, 35 bp, Artificial Sequence
  Synthetic oligonucleotide
gagccgaccctgcatcattcctcttctccaactgg

SEQ ID NO: 127507 - DNA, 35 bp, Artificial Sequence
  Synthetic oligonucleotide
atagtctcgcctcccgtaaggtccattctcctgtt

SEQ ID NO: 127508 - DNA, 36 bp, Artificial Sequence
  Synthetic oligonucleotide
actccaccctgtttactactgtagccacttgaccaa

SEQ ID NO: 127509 - DNA, 35 bp, Artificial Sequence
  Synthetic oligonucleotide
accatccatcccgatggtatgtttctcttcttcaa

SEQ ID NO: 127510 - DNA, 36 bp, Artificial Sequence
  Synthetic oligonucleotide
acgacctccctctctgtagacttgaccgctcttaca

SEQ ID NO: 127511 - DNA, 36 bp, Artificial Sequence
  Synthetic oligonucleotide
aagcccccgcccgtttaacccgctgcctcttcaaga

SEQ ID NO: 127512 - DNA, 37 bp, Artificial Sequence
  Synthetic oligonucleotide
aaggacgggggggagcgcaaaaaaactggggtcagga

SEQ ID NO: 127513 - DNA, 37 bp, Artificial Sequence
  Synthetic oligonucleotide
tctcgtaccacactgtagttctccaccttccaccgga

SEQ ID NO: 127514 - DNA, 38 bp, Artificial Sequence
  Synthetic oligonucleotide
gacggtgtccgcctgctgcctttccgactctattctga

SEQ ID NO: 127515 - DNA, 38 bp, Artificial Sequence
  Synthetic oligonucleotide
agaaggggcaaagggcaggagggcggtaaatcgggtga

SEQ ID NO: 127516 - DNA, 36 bp, Artificial Sequence
  Synthetic oligonucleotide
gcgcaagcccactcttatcctgcctctcactcttga

SEQ ID NO: 127517 - DNA, 35 bp, Artificial Sequence
  Synthetic oligonucleotide
ttgctcacctgtcttcactcgccgtttgcaccgta

SEQ ID NO: 127518 - DNA, 36 bp, Artificial Sequence
  Synthetic oligonucleotide
actggaagcaaaggcgcgggcaaggggggaggcgta

SEQ ID NO: 127519 - DNA, 34 bp, Artificial Sequence
  Synthetic oligonucleotide
tcgatccaacccctgcgtgcccccatgactttta

SEQ ID NO: 127520 - DNA, 35 bp, Artificial Sequence
  Synthetic oligonucleotide
tgcccccgcctcgaatgggtccttcgatttctccc

SEQ ID NO: 127521 - DNA, 35 bp, Artificial Sequence
  Synthetic oligonucleotide
taacccccagccatccgctataccacggtctcttc

SEQ ID NO: 127522 - DNA, 35 bp, Artificial Sequence
  Synthetic oligonucleotide
tccctgggcggggtgagggaggagggtaatggttg

SEQ ID NO: 127523 - DNA, 35 bp, Artificial Sequence
  Synthetic oligonucleotide
tgcccatgcgatcatcgccgatccacccgctacct

SEQ ID NO: 127524 - DNA, 35 bp, Artificial Sequence
  Synthetic oligonucleotide
tgaacctgtcacagcctgacgttactactgcctct

SEQ ID NO: 127525 - DNA, 35 bp, Artificial Sequence
  Synthetic oligonucleotide
gcacaaacctaacatgtgctgtatgccctgccctt

SEQ ID NO: 127526 - DNA, 35 bp, Artificial Sequence
  Synthetic oligonucleotide
agcccgaccgccatgccccctacatttgttgcaca

SEQ ID NO: 127527 - DNA, 37 bp, Artificial Sequence
  Synthetic oligonucleotide
agccaccctcccttgcgcgcatagtcgtcccagccga

SEQ ID NO: 127528 - DNA, 37 bp, Artificial Sequence
  Synthetic oligonucleotide
gactagaggagggcgagggggcagacgagggcatcga

SEQ ID NO: 127529 - DNA, 37 bp, Artificial Sequence
  Synthetic oligonucleotide
ctcatgggggcgggaggagtatggtagtctcagggga

SEQ ID NO: 127530 - DNA, 38 bp, Artificial Sequence
  Synthetic oligonucleotide
gctgggggagagaaactgggagggacgtggtggagtga

SEQ ID NO: 127531 - DNA, 38 bp, Artificial Sequence
  Synthetic oligonucleotide
gcactcctcccgctgtgtgtccccatccgcacccgtga

SEQ ID NO: 127532 - DNA, 38 bp, Artificial Sequence
  Synthetic oligonucleotide
aagggggggaaggggcggtatatcctgaggggaggtga

SEQ ID NO: 127533 - DNA, 37 bp, Artificial Sequence
  Synthetic oligonucleotide
tgagtggggaaagtggtggaaactaagggagtggtga

SEQ ID NO: 127534 - DNA, 37 bp, Artificial Sequence
  Synthetic oligonucleotide
tgtcatcccacgtggcctaaagccgccgcccccttga

SEQ ID NO: 127535 - DNA, 36 bp, Artificial Sequence
  Synthetic oligonucleotide
ttcaccccgtccgtcattcatccctcccagattgta

SEQ ID NO: 127536 - DNA, 36 bp, Artificial Sequence
  Synthetic oligonucleotide
atgcggcgacacccttctatagtatcgtcccttgcc

SEQ ID NO: 127537 - DNA, 35 bp, Artificial Sequence
  Synthetic oligonucleotide
tcactgtccttgccccggcttcactcgctcgatcc

SEQ ID NO: 127538 - DNA, 35 bp, Artificial Sequence
  Synthetic oligonucleotide
tctaacatctaccgtctggtcgcgcccaccttcgc

SEQ ID NO: 127539 - DNA, 35 bp, Artificial Sequence
  Synthetic oligonucleotide
gcgtcacgttagcggtcctttccatcgtcactctc

SEQ ID NO: 127540 - DNA, 35 bp, Artificial Sequence
  Synthetic oligonucleotide
acgttcccctcagccctgaattcggttaacacttc

SEQ ID NO: 127541 - DNA, 35 bp, Artificial Sequence
  Synthetic oligonucleotide
tttcgctcccgagcggattgtccctctctaccttc

SEQ ID NO: 127542 - DNA, 35 bp, Artificial Sequence
  Synthetic oligonucleotide
acggacccctccccatgtaccggctttatgctttc

SEQ ID NO: 127543 - DNA, 35 bp, Artificial Sequence
  Synthetic oligonucleotide
tcctcccccgccttctgactccctttcgaagtttg

SEQ ID NO: 127544 - DNA, 35 bp, Artificial Sequence
  Synthetic oligonucleotide
tcaacactcgtcaccgcttacttggcccagtttct

SEQ ID NO: 127545 - DNA, 35 bp, Artificial Sequence
  Synthetic oligonucleotide
tcgtcccaccatcgttcatgcacgcaacacccttt

SEQ ID NO: 127546 - DNA, 35 bp, Artificial Sequence
  Synthetic oligonucleotide
gagtcgtgggaagaggggggagcggtgagtacgaa

SEQ ID NO: 127547 - DNA, 36 bp, Artificial Sequence
  Synthetic oligonucleotide
tctgtcacgcctggatatgcccacctgcccctatca

SEQ ID NO: 127548 - DNA, 37 bp, Artificial Sequence
  Synthetic oligonucleotide
atacgccgggtggagaagaagggatcgggggagatga

SEQ ID NO: 127549 - DNA, 38 bp, Artificial Sequence
  Synthetic oligonucleotide
tgcatacccgctctgaattacctcccgccttccgctga

SEQ ID NO: 127550 - DNA, 38 bp, Artificial Sequence
  Synthetic oligonucleotide
gaccctccgtccttaatcccccgccactctccgtgtga

SEQ ID NO: 127551 - DNA, 38 bp, Artificial Sequence
  Synthetic oligonucleotide
gtgcgagtccttctgtttccatcctgcttctcttgtga

SEQ ID NO: 127552 - DNA, 35 bp, Artificial Sequence
  Synthetic oligonucleotide
tatcacctcctgagtctcgaaacctcggtcatcac

SEQ ID NO: 127553 - DNA, 35 bp, Artificial Sequence
  Synthetic oligonucleotide
tgatccatgaattggcctattatcactgtcccgcc

SEQ ID NO: 127554 - DNA, 35 bp, Artificial Sequence
  Synthetic oligonucleotide
tcacgtccctttgtcgtccttacctatagtcatcc

SEQ ID NO: 127555 - DNA, 35 bp, Artificial Sequence
  Synthetic oligonucleotide
gcccgcctcttatctgcccgcaccagactacaagc

SEQ ID NO: 127556 - DNA, 35 bp, Artificial Sequence
  Synthetic oligonucleotide
gccgcatcccccgacccctctctgagcgataccgc

SEQ ID NO: 127557 - DNA, 35 bp, Artificial Sequence
  Synthetic oligonucleotide
tcagtctatcgcctccgtacgttcgcacgttcctc

SEQ ID NO: 127558 - DNA, 35 bp, Artificial Sequence
  Synthetic oligonucleotide
gtgctcgccgcatggggcccctgcctcctttcctc

SEQ ID NO: 127559 - DNA, 35 bp, Artificial Sequence
  Synthetic oligonucleotide
gtgggggggtggagtgtgtggtggttgggttggcg

SEQ ID NO: 127560 - DNA, 35 bp, Artificial Sequence
  Synthetic oligonucleotide
tatcgtcccatcctggtccctccacctactaggtg

SEQ ID NO: 127561 - DNA, 35 bp, Artificial Sequence
  Synthetic oligonucleotide
tacgaccggccactcggtcgccctagaacttcctt

SEQ ID NO: 127562 - DNA, 36 bp, Artificial Sequence
  Synthetic oligonucleotide
tgagtcgtacctgctcctacccgtgccaatccacca

SEQ ID NO: 127563 - DNA, 37 bp, Artificial Sequence
  Synthetic oligonucleotide
gagtgagacgaaacgcggtgcagggggggcgggacga

SEQ ID NO: 127564 - DNA, 37 bp, Artificial Sequence
  Synthetic oligonucleotide
gtccccccgccgcctgtagggtccaggacccctttga

SEQ ID NO: 127565 - DNA, 36 bp, Artificial Sequence
  Synthetic oligonucleotide
tacagagcgcatcttggcatcatgtcaccgccccta

SEQ ID NO: 127566 - DNA, 36 bp, Artificial Sequence
  Synthetic oligonucleotide
tgccttccgcattctgttactaccttctgctggcta

SEQ ID NO: 127567 - DNA, 36 bp, Artificial Sequence
  Synthetic oligonucleotide
accgcccccgctctgtatgagcatcacccgtttcta

SEQ ID NO: 127568 - DNA, 36 bp, Artificial Sequence
  Synthetic oligonucleotide
aatcgcgcaatgagccgcgcattacactttccctta

SEQ ID NO: 127569 - DNA, 35 bp, Artificial Sequence
  Synthetic oligonucleotide
ttaactatcccgccgctgcctgctcaccttccagc

SEQ ID NO: 127570 - DNA, 36 bp, Artificial Sequence
  Synthetic oligonucleotide
tcgctagcacttttcgttagtcctgccatcattcgc

SEQ ID NO: 127571 - DNA, 35 bp, Artificial Sequence
  Synthetic oligonucleotide
agtcccatctgcatcgaatattccacctatccggc

SEQ ID NO: 127572 - DNA, 35 bp, Artificial Sequence
  Synthetic oligonucleotide
tgtgagacgttcttgccattgcttttccatcctgc

SEQ ID NO: 127573 - DNA, 35 bp, Artificial Sequence
  Synthetic oligonucleotide
atcgaccgtaccactggtgaagtcctgaccccctc

SEQ ID NO: 127574 - DNA, 35 bp, Artificial Sequence
  Synthetic oligonucleotide
gaataggcgtcattgtttggtaccatcccccgctc

SEQ ID NO: 127575 - DNA, 35 bp, Artificial Sequence
  Synthetic oligonucleotide
ccaacgcgccaatgatcttgcaccatcgcccgctc

SEQ ID NO: 127576 - DNA, 35 bp, Artificial Sequence
  Synthetic oligonucleotide
atgcgcgctagtccgcgatagtttgcctctctttc

SEQ ID NO: 127577 - DNA, 35 bp, Artificial Sequence
  Synthetic oligonucleotide
gaccacctgtggttccttattgtcccgcccccgag

SEQ ID NO: 127578 - DNA, 35 bp, Artificial Sequence
  Synthetic oligonucleotide
atgcaacgcacctcccatgctgtccacttgtcctt

SEQ ID NO: 127579 - DNA, 36 bp, Artificial Sequence
  Synthetic oligonucleotide
accctccaacactcagcgtatactccccctgttaca

SEQ ID NO: 127580 - DNA, 35 bp, Artificial Sequence
  Synthetic oligonucleotide
ttccgctcaccgaccaaatcgtagttcctgtctca

SEQ ID NO: 127581 - DNA, 35 bp, Artificial Sequence
  Synthetic oligonucleotide
gtcaccatcgatgcccaattacctgattttcgtca

SEQ ID NO: 127582 - DNA, 37 bp, Artificial Sequence
  Synthetic oligonucleotide
aatggaggggggagggagcagtaaaaggaaatcgaga

SEQ ID NO: 127583 - DNA, 35 bp, Artificial Sequence
  Synthetic oligonucleotide
agtgacgggtggggataggggctacggaatgggga

SEQ ID NO: 127584 - DNA, 38 bp, Artificial Sequence
  Synthetic oligonucleotide
acagtccccgccgaccccgcaccgacgcagttccttga

SEQ ID NO: 127585 - DNA, 38 bp, Artificial Sequence
  Synthetic oligonucleotide
aagccccatcccatccccctcacagtcaatcctgttga

SEQ ID NO: 127586 - DNA, 35 bp, Artificial Sequence
  Synthetic oligonucleotide
acactcctcgatcgtccaccagcgcaccccaggcc

SEQ ID NO: 127587 - DNA, 35 bp, Artificial Sequence
  Synthetic oligonucleotide
gtcaggctcggccgtgaacaacaccccccccttcc

SEQ ID NO: 127588 - DNA, 35 bp, Artificial Sequence
  Synthetic oligonucleotide
ttggaagacgttcccacttgctgcctggtaccttc

SEQ ID NO: 127589 - DNA, 35 bp, Artificial Sequence
  Synthetic oligonucleotide
attgaggaagtaggggggagagagaagggcctccg

SEQ ID NO: 127590 - DNA, 35 bp, Artificial Sequence
  Synthetic oligonucleotide
tacatctccattggctcgcagagcaccgccttccg

SEQ ID NO: 127591 - DNA, 35 bp, Artificial Sequence
  Synthetic oligonucleotide
acatcgacgctgataaattgctcgcgctccctcct

SEQ ID NO: 127592 - DNA, 36 bp, Artificial Sequence
  Synthetic oligonucleotide
tggagtgagcgaagtggggggtggcggtgagggaaa

SEQ ID NO: 127593 - DNA, 37 bp, Artificial Sequence
  Synthetic oligonucleotide
accgtgccttcctccattgcaacatccagcctttaga

SEQ ID NO: 127594 - DNA, 36 bp, Artificial Sequence
  Synthetic oligonucleotide
atccccgcatccatacctttgtacacgtccttgcga

SEQ ID NO: 127595 - DNA, 37 bp, Artificial Sequence
  Synthetic oligonucleotide
ggaactacacgagggggtaggaacggaggggggagga

SEQ ID NO: 127596 - DNA, 36 bp, Artificial Sequence
  Synthetic oligonucleotide
tgtgtgccccaccccatccattagctgtccagcgga

SEQ ID NO: 127597 - DNA, 37 bp, Artificial Sequence
  Synthetic oligonucleotide
tgaaggcagtaagggaatagtggagcggggggaggga

SEQ ID NO: 127598 - DNA, 37 bp, Artificial Sequence
  Synthetic oligonucleotide
ggtatgagcaggagggtatgggattaagcggggggga

SEQ ID NO: 127599 - DNA, 37 bp, Artificial Sequence
  Synthetic oligonucleotide
atccgggcgggcgggcgagggtcacaatagatctgga

SEQ ID NO: 127600 - DNA, 38 bp, Artificial Sequence
  Synthetic oligonucleotide
atgttccctgcccccagccgttgctttctacaccctga

SEQ ID NO: 127601 - DNA, 35 bp, Artificial Sequence
  Synthetic oligonucleotide
gtcactcccctgtcctgctacatagtattctctac

SEQ ID NO: 127602 - DNA, 35 bp, Artificial Sequence
  Synthetic oligonucleotide
aactcgcgcaggattctcacttgttacacgccacc

SEQ ID NO: 127603 - DNA, 35 bp, Artificial Sequence
  Synthetic oligonucleotide
gccatcatcccttggtaagtctctctcgtcgctcc

SEQ ID NO: 127604 - DNA, 35 bp, Artificial Sequence
  Synthetic oligonucleotide
tccaccccgaacgtgacacactctcgcgaatttcc

SEQ ID NO: 127605 - DNA, 35 bp, Artificial Sequence
  Synthetic oligonucleotide
gttcgccctccacacactacatccgccatacctgc

SEQ ID NO: 127606 - DNA, 35 bp, Artificial Sequence
  Synthetic oligonucleotide
gatagcgctgtctatcattgctactccccatttgc

SEQ ID NO: 127607 - DNA, 35 bp, Artificial Sequence
  Synthetic oligonucleotide
tgccccttgagttgtcgcgtaccatcttctacctc

SEQ ID NO: 127608 - DNA, 35 bp, Artificial Sequence
  Synthetic oligonucleotide
tccgtaactccagactggcctgattccccactttc

SEQ ID NO: 127609 - DNA, 35 bp, Artificial Sequence
  Synthetic oligonucleotide
tgcctcacccagagcgatttacctcacatcacccg

SEQ ID NO: 127610 - DNA, 35 bp, Artificial Sequence
  Synthetic oligonucleotide
gatgctactaacgggggggattgagccagggaggg

SEQ ID NO: 127611 - DNA, 35 bp, Artificial Sequence
  Synthetic oligonucleotide
gagccctgcaactgtacctgcgtcactccccctgg

SEQ ID NO: 127612 - DNA, 35 bp, Artificial Sequence
  Synthetic oligonucleotide
tgttgggatagggagggccaaaggggggaaggtat

SEQ ID NO: 127613 - DNA, 35 bp, Artificial Sequence
  Synthetic oligonucleotide
accccccaccttcgaccgccctgatcagacgatct

SEQ ID NO: 127614 - DNA, 36 bp, Artificial Sequence
  Synthetic oligonucleotide
aacatcccgccgatcgcgactcgtcccttaccacca

SEQ ID NO: 127615 - DNA, 36 bp, Artificial Sequence
  Synthetic oligonucleotide
gttgcctttgacgtttcttttgcccccccggaccca

SEQ ID NO: 127616 - DNA, 37 bp, Artificial Sequence
  Synthetic oligonucleotide
agccccgcatcggcacgagttgaacctacccccacga

SEQ ID NO: 127617 - DNA, 35 bp, Artificial Sequence
  Synthetic oligonucleotide
gtcatctgccatttgttctatcccccttctgcgga

SEQ ID NO: 127618 - DNA, 37 bp, Artificial Sequence
  Synthetic oligonucleotide
gccacaaccgggggggagtaagacagggaattgggga

SEQ ID NO: 127619 - DNA, 37 bp, Artificial Sequence
  Synthetic oligonucleotide
gagtccctccgatgactatctcatactctctcttgga

SEQ ID NO: 127620 - DNA, 38 bp, Artificial Sequence
  Synthetic oligonucleotide
tcctacaaccgccatgacctttattactgcctccatga

SEQ ID NO: 127621 - DNA, 35 bp, Artificial Sequence
  Synthetic oligonucleotide
tccccgcctatatgtcctctgacaacaccctccta

SEQ ID NO: 127622 - DNA, 37 bp, Artificial Sequence
  Synthetic oligonucleotide
tggggagtggcggtttccatcctagggcggtggggta

SEQ ID NO: 127623 - DNA, 35 bp, Artificial Sequence
  Synthetic oligonucleotide
gaccccccggttattggtaacttcccaggcttgac

SEQ ID NO: 127624 - DNA, 35 bp, Artificial Sequence
  Synthetic oligonucleotide
tcgttgcatgcgtgctccatcgtgcccatcctgcc

SEQ ID NO: 127625 - DNA, 35 bp, Artificial Sequence
  Synthetic oligonucleotide
atggacctagccccagtttgctaaacaccccgtcc

SEQ ID NO: 127626 - DNA, 35 bp, Artificial Sequence
  Synthetic oligonucleotide
atcccatcgctacgtgcccgtaaccccctcttcat

SEQ ID NO: 127627 - DNA, 35 bp, Artificial Sequence
  Synthetic oligonucleotide
tgacgctgtccccactcgtccgttaactcctgcct

SEQ ID NO: 127628 - DNA, 35 bp, Artificial Sequence
  Synthetic oligonucleotide
tctggcccagccttctatgactacactcctctttt

SEQ ID NO: 127629 - DNA, 35 bp, Artificial Sequence
  Synthetic oligonucleotide
gatgggagggtggggcctcgttggggttgcagcca

SEQ ID NO: 127630 - DNA, 37 bp, Artificial Sequence
  Synthetic oligonucleotide
tccttagcctccctcccccatgtctcgtaagccacga

SEQ ID NO: 127631 - DNA, 37 bp, Artificial Sequence
  Synthetic oligonucleotide
gccgcgcacgcagcaccgccccaactacacactccga

SEQ ID NO: 127632 - DNA, 36 bp, Artificial Sequence
  Synthetic oligonucleotide
gctacactcgtccctgccacttcccccagtcctcga

SEQ ID NO: 127633 - DNA, 38 bp, Artificial Sequence
  Synthetic oligonucleotide
tagtagcaggaatggggaaaggggggggatggggatga

SEQ ID NO: 127634 - DNA, 38 bp, Artificial Sequence
  Synthetic oligonucleotide
gccgccctcagaagcggccacccctgccccccctgtga

SEQ ID NO: 127635 - DNA, 36 bp, Artificial Sequence
  Synthetic oligonucleotide
acgcccccgctgaactcgacaacgcacctaccttta

SEQ ID NO: 127636 - DNA, 35 bp, Artificial Sequence
  Synthetic oligonucleotide
gtcgctccggttcgttctttttccttctggtcacc

SEQ ID NO: 127637 - DNA, 35 bp, Artificial Sequence
  Synthetic oligonucleotide
gcgacacacagctgtcattctacccttgctggccc

SEQ ID NO: 127638 - DNA, 35 bp, Artificial Sequence
  Synthetic oligonucleotide
gcaacgttggcccctctctgcggtctgactcgtcc

SEQ ID NO: 127639 - DNA, 35 bp, Artificial Sequence
  Synthetic oligonucleotide
atcgggagtgcctgagttgcgccccctctctcatc

SEQ ID NO: 127640 - DNA, 35 bp, Artificial Sequence
  Synthetic oligonucleotide
gtgatgaacggagggtgggttaacggatgaaggcg

SEQ ID NO: 127641 - DNA, 35 bp, Artificial Sequence
  Synthetic oligonucleotide
tcccgtccttagttgcttgcttggccgcccgttcg

SEQ ID NO: 127642 - DNA, 36 bp, Artificial Sequence
  Synthetic oligonucleotide
tcccttcacctatgcgtgtcctactcccccggttaa

SEQ ID NO: 127643 - DNA, 35 bp, Artificial Sequence
  Synthetic oligonucleotide
tcacttcacatgttcacgccgctctctttgccaca

SEQ ID NO: 127644 - DNA, 37 bp, Artificial Sequence
  Synthetic oligonucleotide
aatgtcgcgctgtccttctctacctccgcttcgggga

SEQ ID NO: 127645 - DNA, 35 bp, Artificial Sequence
  Synthetic oligonucleotide
gacgcgtcgccccgcccgtcttgctatttctcgta

SEQ ID NO: 127646 - DNA, 35 bp, Artificial Sequence
  Synthetic oligonucleotide
agtacctccatccatctgcaccattagtcctgcac

SEQ ID NO: 127647 - DNA, 35 bp, Artificial Sequence
  Synthetic oligonucleotide
tgccgcccctgttccctgaacgctccgctacacgc

SEQ ID NO: 127648 - DNA, 35 bp, Artificial Sequence
  Synthetic oligonucleotide
tgacccccgtccaggcccctccatgccctcttatc

SEQ ID NO: 127649 - DNA, 35 bp, Artificial Sequence
  Synthetic oligonucleotide
ttcaattgcccacatctgatactgctacctgtctc

SEQ ID NO: 127650 - DNA, 35 bp, Artificial Sequence
  Synthetic oligonucleotide
gcgtcgctcctgtcgtccccaagctcccgccgttc

SEQ ID NO: 127651 - DNA, 35 bp, Artificial Sequence
  Synthetic oligonucleotide
gtactccggcctgactgccccttcacgttcacctg

SEQ ID NO: 127652 - DNA, 35 bp, Artificial Sequence
  Synthetic oligonucleotide
gtgccacggttgtaccccgtccttcacttttcctg

SEQ ID NO: 127653 - DNA, 35 bp, Artificial Sequence
  Synthetic oligonucleotide
aacgtccatgccattgtccccgcattactcacact

SEQ ID NO: 127654 - DNA, 35 bp, Artificial Sequence
  Synthetic oligonucleotide
aacatcaccgccggccgcccgagccaaatttgcct

SEQ ID NO: 127655 - DNA, 35 bp, Artificial Sequence
  Synthetic oligonucleotide
ttggcccaacgtcgcatgcaatcgcccttcatcct

SEQ ID NO: 127656 - DNA, 35 bp, Artificial Sequence
  Synthetic oligonucleotide
tccacggccacctgcttaactcatcccttcgtgtt

SEQ ID NO: 127657 - DNA, 37 bp, Artificial Sequence
  Synthetic oligonucleotide
tgcgcctagcgcgatcccagcactccctcccgcccga

SEQ ID NO: 127658 - DNA, 36 bp, Artificial Sequence
  Synthetic oligonucleotide
gcactaccacaatgtttaccgcccttcccactgtta

SEQ ID NO: 127659 - DNA, 35 bp, Artificial Sequence
  Synthetic oligonucleotide
tctgccgtcagccggccatctgcaacctgaaccac

SEQ ID NO: 127660 - DNA, 35 bp, Artificial Sequence
  Synthetic oligonucleotide
gccaccgcactacgccttagtcccgattccgccgc

SEQ ID NO: 127661 - DNA, 35 bp, Artificial Sequence
  Synthetic oligonucleotide
gagataggggaaataagtcaggtggggcggggggc

SEQ ID NO: 127662 - DNA, 35 bp, Artificial Sequence
  Synthetic oligonucleotide
tgtgcgcagatcgctctgccctcccgatccgcctc

SEQ ID NO: 127663 - DNA, 35 bp, Artificial Sequence
  Synthetic oligonucleotide
actcccgatcgcaccacctccaccctccataggcg

SEQ ID NO: 127664 - DNA, 35 bp, Artificial Sequence
  Synthetic oligonucleotide
gtgccatcgcattcatcgcggtcgccccctatcct

SEQ ID NO: 127665 - DNA, 35 bp, Artificial Sequence
  Synthetic oligonucleotide
tatctgccgcctgtccttgtttccttatccactgt

SEQ ID NO: 127666 - DNA, 36 bp, Artificial Sequence
  Synthetic oligonucleotide
actgagcggtgaaagggggaaagggggtcatggcaa

SEQ ID NO: 127667 - DNA, 35 bp, Artificial Sequence
  Synthetic oligonucleotide
gtctcccccgcacccatttcctgtacctgtttaca

SEQ ID NO: 127668 - DNA, 35 bp, Artificial Sequence
  Synthetic oligonucleotide
tctcgtccctcactcgttcgcacttgccatgccca

SEQ ID NO: 127669 - DNA, 36 bp, Artificial Sequence
  Synthetic oligonucleotide
attgcgccattataacctatccccgtacgttcgcca

SEQ ID NO: 127670 - DNA, 35 bp, Artificial Sequence
  Synthetic oligonucleotide
acccgcctccggtgtagtcgatctttacccgtcca

SEQ ID NO: 127671 - DNA, 36 bp, Artificial Sequence
  Synthetic oligonucleotide
tccgctcccacgcatcgcttttcactgatctttgca

SEQ ID NO: 127672 - DNA, 37 bp, Artificial Sequence
  Synthetic oligonucleotide
tcacgcgtacatgtctacacccgtcctcccggtccga

SEQ ID NO: 127673 - DNA, 36 bp, Artificial Sequence
  Synthetic oligonucleotide
tgaacgcccataacctcgtacctgagcccacctcga

SEQ ID NO: 127674 - DNA, 35 bp, Artificial Sequence
  Synthetic oligonucleotide
gcccatcgcgacgcccgttacctcccggctttcga

SEQ ID NO: 127675 - DNA, 37 bp, Artificial Sequence
  Synthetic oligonucleotide
tctgtgggagggggtagggggtatttattcgtgggga

SEQ ID NO: 127676 - DNA, 37 bp, Artificial Sequence
  Synthetic oligonucleotide
gggggggtgggggccagggaggataggcggaaactga

SEQ ID NO: 127677 - DNA, 37 bp, Artificial Sequence
  Synthetic oligonucleotide
gacgcccctcataacgtacacctgccttgatcattga

SEQ ID NO: 127678 - DNA, 38 bp, Artificial Sequence
  Synthetic oligonucleotide
gagcacggtcgccctctcttccgccgcctatccgttga

SEQ ID NO: 127679 - DNA, 36 bp, Artificial Sequence
  Synthetic oligonucleotide
ggagcccctgctccgggtatctcgttctcttcacta

SEQ ID NO: 127680 - DNA, 35 bp, Artificial Sequence
  Synthetic oligonucleotide
gccgagcggatccgcctgttcgtcgtctataccta

SEQ ID NO: 127681 - DNA, 36 bp, Artificial Sequence
  Synthetic oligonucleotide
gactgaccgacctgtccaattttgccccgttcttta

SEQ ID NO: 127682 - DNA, 35 bp, Artificial Sequence
  Synthetic oligonucleotide
tccacccctccgccgccgtttgtaccaaggaaaac

SEQ ID NO: 127683 - DNA, 34 bp, Artificial Sequence
  Synthetic oligonucleotide
gtccgcattggcgctgttcactcctcttctcgac

SEQ ID NO: 127684 - DNA, 35 bp, Artificial Sequence
  Synthetic oligonucleotide
accgcgtgccggatatctcgcacctctgccccccc

SEQ ID NO: 127685 - DNA, 35 bp, Artificial Sequence
  Synthetic oligonucleotide
gagtgagcccatccgggattttgaccacgccttcc

SEQ ID NO: 127686 - DNA, 35 bp, Artificial Sequence
  Synthetic oligonucleotide
gatcacgctagttctgtccctctgccgttttacgc

SEQ ID NO: 127687 - DNA, 35 bp, Artificial Sequence
  Synthetic oligonucleotide
tagatccacgtccctgctctttcccaccgcgaatc

SEQ ID NO: 127688 - DNA, 35 bp, Artificial Sequence
  Synthetic oligonucleotide
gaccccgcccatttaatagctacgtaagccccgtc

SEQ ID NO: 127689 - DNA, 35 bp, Artificial Sequence
  Synthetic oligonucleotide
tcatacgatgttggtctcttcttcccagtcctgtc

SEQ ID NO: 127690 - DNA, 35 bp, Artificial Sequence
  Synthetic oligonucleotide
tcccccaccatcgttacgagcctcctgccactgag

SEQ ID NO: 127691 - DNA, 35 bp, Artificial Sequence
  Synthetic oligonucleotide
ttcccatgcgacgatgtcctgtctgttccctgttg

SEQ ID NO: 127692 - DNA, 35 bp, Artificial Sequence
  Synthetic oligonucleotide
aactgcccccgctactccaacttcccgtcaagggt

SEQ ID NO: 127693 - DNA, 35 bp, Artificial Sequence
  Synthetic oligonucleotide
gtcatcagcctccagtaggccttcactgctccctt

SEQ ID NO: 127694 - DNA, 35 bp, Artificial Sequence
  Synthetic oligonucleotide
tgtcctgccttcctccgtttacaccgcctcgccaa

SEQ ID NO: 127695 - DNA, 36 bp, Artificial Sequence
  Synthetic oligonucleotide
agcgcccgcctaggcatgtcccttccccctacccca

SEQ ID NO: 127696 - DNA, 35 bp, Artificial Sequence
  Synthetic oligonucleotide
acatctcctccgtcgactcgccccgcccctctaga

SEQ ID NO: 127697 - DNA, 38 bp, Artificial Sequence
  Synthetic oligonucleotide
acaggatgtgtggggaggagtgaggggaggcggagtga

SEQ ID NO: 127698 - DNA, 36 bp, Artificial Sequence
  Synthetic oligonucleotide
tacatggtggaaatgggcggggagggaacctagtga

SEQ ID NO: 127699 - DNA, 35 bp, Artificial Sequence
  Synthetic oligonucleotide
tcatcttgcatcctgttcggccctgtttgccccta

SEQ ID NO: 127700 - DNA, 35 bp, Artificial Sequence
  Synthetic oligonucleotide
atgttgaccccgcctttgtacttctagtctcacac

SEQ ID NO: 127701 - DNA, 35 bp, Artificial Sequence
  Synthetic oligonucleotide
gtgttacactggtgacgtgagtccggcccttcccc

SEQ ID NO: 127702 - DNA, 35 bp, Artificial Sequence
  Synthetic oligonucleotide
acgcacgtactaccccgcgttctgtgcttatgccc

SEQ ID NO: 127703 - DNA, 35 bp, Artificial Sequence
  Synthetic oligonucleotide
gagccacctcaagccgctctaatccccacgacgcc

SEQ ID NO: 127704 - DNA, 35 bp, Artificial Sequence
  Synthetic oligonucleotide
gttcagccatcctatcatacgttcaatccaccggc

SEQ ID NO: 127705 - DNA, 35 bp, Artificial Sequence
  Synthetic oligonucleotide
actcagccacgttcctctgagcttcaagcatcctc

SEQ ID NO: 127706 - DNA, 35 bp, Artificial Sequence
  Synthetic oligonucleotide
atgaccgctcgctgtccattattcatcctcttttg

SEQ ID NO: 127707 - DNA, 34 bp, Artificial Sequence
  Synthetic oligonucleotide
tccacgccgcatcgccctgtgagcccttctattt

SEQ ID NO: 127708 - DNA, 35 bp, Artificial Sequence
  Synthetic oligonucleotide
gtgacctccaccccatctccccgccccgcgtgtaa

SEQ ID NO: 127709 - DNA, 36 bp, Artificial Sequence
  Synthetic oligonucleotide
tgagtctcacccgcgctgttttctcccccgttggca

SEQ ID NO: 127710 - DNA, 37 bp, Artificial Sequence
  Synthetic oligonucleotide
agcgaggagacgggggtagggcgggcgtgtagtggga

SEQ ID NO: 127711 - DNA, 37 bp, Artificial Sequence
  Synthetic oligonucleotide
gccctcgtacacgcttctttatccacatcccccgtga

SEQ ID NO: 127712 - DNA, 38 bp, Artificial Sequence
  Synthetic oligonucleotide
ttgcctgcgctagtccgtgtcatcgttccacctcttga

SEQ ID NO: 127713 - DNA, 36 bp, Artificial Sequence
  Synthetic oligonucleotide
accagccacccccgaccgttttatccaatgctgcta

SEQ ID NO: 127714 - DNA, 35 bp, Artificial Sequence
  Synthetic oligonucleotide
gcatcagcacggcgctcacctattacgtctcccac

SEQ ID NO: 127715 - DNA, 35 bp, Artificial Sequence
  Synthetic oligonucleotide
gtcaacacgcttgcctcttcttgtaatcactccac

SEQ ID NO: 127716 - DNA, 35 bp, Artificial Sequence
  Synthetic oligonucleotide
gttggcgttactccccgccttggaccacgatctac

SEQ ID NO: 127717 - DNA, 35 bp, Artificial Sequence
  Synthetic oligonucleotide
tgccgcaccgccgggcgtatctgcgctcgcctccc

SEQ ID NO: 127718 - DNA, 35 bp, Artificial Sequence
  Synthetic oligonucleotide
tccccgttgaacgttcttgggtccacccgcttgcc

SEQ ID NO: 127719 - DNA, 35 bp, Artificial Sequence
  Synthetic oligonucleotide
aaccgccgggcatacgtgagcctccctccagccgc

SEQ ID NO: 127720 - DNA, 35 bp, Artificial Sequence
  Synthetic oligonucleotide
gtgccgctaccaccatgtcgccgtgccgaccctgc

SEQ ID NO: 127721 - DNA, 35 bp, Artificial Sequence
  Synthetic oligonucleotide
gcctcactgaccgcccaccgttgctgcgcctactc

SEQ ID NO: 127722 - DNA, 35 bp, Artificial Sequence
  Synthetic oligonucleotide
gcactgcccataattgactgcgcccctgtttcact

SEQ ID NO: 127723 - DNA, 35 bp, Artificial Sequence
  Synthetic oligonucleotide
gacgcctctttgctcgcgtggctcccaactcacct

SEQ ID NO: 127724 - DNA, 36 bp, Artificial Sequence
  Synthetic oligonucleotide
gcgcacgtacggcctcgttctaccttacactgtctt

SEQ ID NO: 127725 - DNA, 34 bp, Artificial Sequence
  Synthetic oligonucleotide
gtcgccccatctcgatcgctactacccccaccaa

SEQ ID NO: 127726 - DNA, 36 bp, Artificial Sequence
  Synthetic oligonucleotide
gcgcacccatcgccccatccagtttcgttctggcca

SEQ ID NO: 127727 - DNA, 36 bp, Artificial Sequence
  Synthetic oligonucleotide
gcggtccacctctcgttgccctttctttgcttagca

SEQ ID NO: 127728 - DNA, 35 bp, Artificial Sequence
  Synthetic oligonucleotide
tattccgcgccacccacttatggccacatttttca

SEQ ID NO: 127729 - DNA, 37 bp, Artificial Sequence
  Synthetic oligonucleotide
acgacccattccgttgttgtcgcccttccctctgaga

SEQ ID NO: 127730 - DNA, 36 bp, Artificial Sequence
  Synthetic oligonucleotide
atccccgcctctccgttgttcgttgcattgcctaga

SEQ ID NO: 127731 - DNA, 37 bp, Artificial Sequence
  Synthetic oligonucleotide
gacacctcgtgctgatccgtactccgcacctctccga

SEQ ID NO: 127732 - DNA, 37 bp, Artificial Sequence
  Synthetic oligonucleotide
tgatcaagcctacacctgtctcttttggccccttcga

SEQ ID NO: 127733 - DNA, 38 bp, Artificial Sequence
  Synthetic oligonucleotide
agacagaaaaggcgggaagggcggggtagtaggactga

SEQ ID NO: 127734 - DNA, 37 bp, Artificial Sequence
  Synthetic oligonucleotide
ggtcagaggtgggcggtggggtgatgggacggggtga

SEQ ID NO: 127735 - DNA, 37 bp, Artificial Sequence
  Synthetic oligonucleotide
ggaggtggtggggtggacttatggaggtacctgttga

SEQ ID NO: 127736 - DNA, 35 bp, Artificial Sequence
  Synthetic oligonucleotide
atggccctcgccaatgcaagcatcctcatcccccc

SEQ ID NO: 127737 - DNA, 35 bp, Artificial Sequence
  Synthetic oligonucleotide
ttgcgtgctcccatgtttcgtgccttcgttcgtcc

SEQ ID NO: 127738 - DNA, 35 bp, Artificial Sequence
  Synthetic oligonucleotide
ttgacaccggagatccatcttcctacactctttgc

SEQ ID NO: 127739 - DNA, 35 bp, Artificial Sequence
  Synthetic oligonucleotide
gctcaccgccgggatttcctgctaacattttcctc

SEQ ID NO: 127740 - DNA, 35 bp, Artificial Sequence
  Synthetic oligonucleotide
tccacacctcatgctgcccaccgatccgttctgat

SEQ ID NO: 127741 - DNA, 35 bp, Artificial Sequence
  Synthetic oligonucleotide
ggtccgctcctgcttgctacttccttgttttccgt

SEQ ID NO: 127742 - DNA, 35 bp, Artificial Sequence
  Synthetic oligonucleotide
tgtgacgggaggaggagggtgagtggacgctgtgt

SEQ ID NO: 127743 - DNA, 36 bp, Artificial Sequence
  Synthetic oligonucleotide
gacggccccggacgggtgggaagggagggactcaaa

SEQ ID NO: 127744 - DNA, 34 bp, Artificial Sequence
  Synthetic oligonucleotide
gccgttcccccgcccaattgttgatcgtacataa

SEQ ID NO: 127745 - DNA, 36 bp, Artificial Sequence
  Synthetic oligonucleotide
gtacgccgcccctcctttgcattaggaacgatcgca

SEQ ID NO: 127746 - DNA, 37 bp, Artificial Sequence
  Synthetic oligonucleotide
gtgctactgcatcacctcccgcccgccccccgccaga

SEQ ID NO: 127747 - DNA, 37 bp, Artificial Sequence
  Synthetic oligonucleotide
gagcccgaagagggaggggaggcaggaaagcgagcga

SEQ ID NO: 127748 - DNA, 37 bp, Artificial Sequence
  Synthetic oligonucleotide
tctgcgcccacctccttgtcttaccgaccatccgcga

SEQ ID NO: 127749 - DNA, 36 bp, Artificial Sequence
  Synthetic oligonucleotide
tctaccacccgcgctgacataacaacccccctcgga

SEQ ID NO: 127750 - DNA, 36 bp, Artificial Sequence
  Synthetic oligonucleotide
tgtcatccccttcccacgcccgtgctatttgcctga

SEQ ID NO: 127751 - DNA, 37 bp, Artificial Sequence
  Synthetic oligonucleotide
tcacggtcacatgcaacactccaccttctacatgtga

SEQ ID NO: 127752 - DNA, 36 bp, Artificial Sequence
  Synthetic oligonucleotide
atcgcgccccccgtcattgccctcccaacgtgcata

SEQ ID NO: 127753 - DNA, 35 bp, Artificial Sequence
  Synthetic oligonucleotide
tttgcctcctgttacgcaccgatcgtttccgctta

SEQ ID NO: 127754 - DNA, 35 bp, Artificial Sequence
  Synthetic oligonucleotide
gccactcatactctctgcatgtctcgcgtactacc

SEQ ID NO: 127755 - DNA, 35 bp, Artificial Sequence
  Synthetic oligonucleotide
agccaaagtccgatccgtccacattttccggcccc

SEQ ID NO: 127756 - DNA, 35 bp, Artificial Sequence
  Synthetic oligonucleotide
gtccccacagacgtgctcccttacggttatttgcc

SEQ ID NO: 127757 - DNA, 35 bp, Artificial Sequence
  Synthetic oligonucleotide
ggaaagggagggagttgtagggatgagtgggttgc

SEQ ID NO: 127758 - DNA, 35 bp, Artificial Sequence
  Synthetic oligonucleotide
gtacgcccgctgttctggttttctactaccctttc

SEQ ID NO: 127759 - DNA, 35 bp, Artificial Sequence
  Synthetic oligonucleotide
gtcagtgccttcccttctgttacaacttgcccgtt

SEQ ID NO: 127760 - DNA, 36 bp, Artificial Sequence
  Synthetic oligonucleotide
gaatgcggcacttcgctcgttcccttgttgcttaca

SEQ ID NO: 127761 - DNA, 37 bp, Artificial Sequence
  Synthetic oligonucleotide
gagggggggagagtgtcgaacggagtgggcggccaga

SEQ ID NO: 127762 - DNA, 37 bp, Artificial Sequence
  Synthetic oligonucleotide
acccgccctctgacgcctgctgtactggctttgccga

SEQ ID NO: 127763 - DNA, 37 bp, Artificial Sequence
  Synthetic oligonucleotide
accccccccgctatatcttgttgttactgatctccga

SEQ ID NO: 127764 - DNA, 37 bp, Artificial Sequence
  Synthetic oligonucleotide
tgtatgccgccccctctcgctcgcctctgttttagga

SEQ ID NO: 127765 - DNA, 34 bp, Artificial Sequence
  Synthetic oligonucleotide
tccctccctcgccaagctgcccctgtcacgcata

SEQ ID NO: 127766 - DNA, 36 bp, Artificial Sequence
  Synthetic oligonucleotide
gaaagggggaggagggttagaggtgaggcggggata

SEQ ID NO: 127767 - DNA, 35 bp, Artificial Sequence
  Synthetic oligonucleotide
ggggtgggtggggatagggccaggacaacctcaac

SEQ ID NO: 127768 - DNA, 35 bp, Artificial Sequence
  Synthetic oligonucleotide
tgccctccggctcccagaatttgctcgatccgtcc

SEQ ID NO: 127769 - DNA, 36 bp, Artificial Sequence
  Synthetic oligonucleotide
tccgccctccatcccccggtcaccccacagggacaa

SEQ ID NO: 127770 - DNA, 35 bp, Artificial Sequence
  Synthetic oligonucleotide
tttgtatcccgcccctgtggcttgccctgctctca

SEQ ID NO: 127771 - DNA, 36 bp, Artificial Sequence
  Synthetic oligonucleotide
tcaacacctccgttacgttaatgtttcatcacctga

SEQ ID NO: 127772 - DNA, 35 bp, Artificial Sequence
  Synthetic oligonucleotide
gtcgcgctactcttcccacccttttgttggcagcc

SEQ ID NO: 127773 - DNA, 35 bp, Artificial Sequence
  Synthetic oligonucleotide
gacattccacagccttgcaattattacccaccgcc

SEQ ID NO: 127774 - DNA, 35 bp, Artificial Sequence
  Synthetic oligonucleotide
gaccgcacctacgcccgacacggctcactcccgcc

SEQ ID NO: 127775 - DNA, 35 bp, Artificial Sequence
  Synthetic oligonucleotide
ttgcccccaatactcgtatttacaccggaacctcc

SEQ ID NO: 127776 - DNA, 35 bp, Artificial Sequence
  Synthetic oligonucleotide
attccatcccgttggctttgatcgtaccttgctcc

SEQ ID NO: 127777 - DNA, 35 bp, Artificial Sequence
  Synthetic oligonucleotide
tacgccctctagataacccgtctctccctccgggc

SEQ ID NO: 127778 - DNA, 35 bp, Artificial Sequence
  Synthetic oligonucleotide
gtcgcctcgtacgcgctttcccctgtacttttttc

SEQ ID NO: 127779 - DNA, 35 bp, Artificial Sequence
  Synthetic oligonucleotide
tgaaggcgccctatatccatcgcccccgccctgag

SEQ ID NO: 127780 - DNA, 35 bp, Artificial Sequence
  Synthetic oligonucleotide
ttgccatccggtgcacccttactgcttgtctcccg

SEQ ID NO: 127781 - DNA, 35 bp, Artificial Sequence
  Synthetic oligonucleotide
tctcccgccgcttgcattatcccggccccttagtg

SEQ ID NO: 127782 - DNA, 36 bp, Artificial Sequence
  Synthetic oligonucleotide
tacctcccccctcagtcgcgaccacgggacagggat

SEQ ID NO: 127783 - DNA, 35 bp, Artificial Sequence
  Synthetic oligonucleotide
agaacaccgcccgctgttactcgtccctgttaatt

SEQ ID NO: 127784 - DNA, 36 bp, Artificial Sequence
  Synthetic oligonucleotide
ttgcacctcaatcctacataggctcctactctcgca

SEQ ID NO: 127785 - DNA, 37 bp, Artificial Sequence
  Synthetic oligonucleotide
gcaaagagggaatgggttgggagggccagctcgaaga

SEQ ID NO: 127786 - DNA, 37 bp, Artificial Sequence
  Synthetic oligonucleotide
tccaccccacgcgtcgtatcccatccgaatcccacga

SEQ ID NO: 127787 - DNA, 37 bp, Artificial Sequence
  Synthetic oligonucleotide
agagcgaggggcaaggtggggggaagtggggtcatga

SEQ ID NO: 127788 - DNA, 35 bp, Artificial Sequence
  Synthetic oligonucleotide
atcccgcctcaaccgtttttgccctcgtaagctta

SEQ ID NO: 127789 - DNA, 35 bp, Artificial Sequence
  Synthetic oligonucleotide
gcacctatctccgccaccgccctgtctcaattgac

SEQ ID NO: 127790 - DNA, 35 bp, Artificial Sequence
  Synthetic oligonucleotide
gacacgtcctctctaaaaaccggaatcgcccgccc

SEQ ID NO: 127791 - DNA, 35 bp, Artificial Sequence
  Synthetic oligonucleotide
ggtatccccgctccgcctccgtccctatggctgcc

SEQ ID NO: 127792 - DNA, 34 bp, Artificial Sequence
  Synthetic oligonucleotide
aacatgtcctggaatggtcactgccccttctgcc

SEQ ID NO: 127793 - DNA, 35 bp, Artificial Sequence
  Synthetic oligonucleotide
cgagctggtcactgcacaacgtcaggctcacctcc

SEQ ID NO: 127794 - DNA, 35 bp, Artificial Sequence
  Synthetic oligonucleotide
accacgcctcgtttgtccacctcatctgtgaagcg

SEQ ID NO: 127795 - DNA, 35 bp, Artificial Sequence
  Synthetic oligonucleotide
gccacttctgacgcttccgacggttccatcattcg

SEQ ID NO: 127796 - DNA, 35 bp, Artificial Sequence
  Synthetic oligonucleotide
tctctccacaccatcctccagcatagccatcacat

SEQ ID NO: 127797 - DNA, 35 bp, Artificial Sequence
  Synthetic oligonucleotide
atgccggaagcccacccgcacacttcgccgtaact

SEQ ID NO: 127798 - DNA, 35 bp, Artificial Sequence
  Synthetic oligonucleotide
gatctcgcccctgccctccgccgcttccttgaggt

SEQ ID NO: 127799 - DNA, 35 bp, Artificial Sequence
  Synthetic oligonucleotide
gacccaacgctgttcttctattcactgtccgacca

SEQ ID NO: 127800 - DNA, 35 bp, Artificial Sequence
  Synthetic oligonucleotide
acccacgctcccctatgctgaccacctggtgctca

SEQ ID NO: 127801 - DNA, 36 bp, Artificial Sequence
  Synthetic oligonucleotide
tcaccaccctccccggataactttagtcgtttttca

SEQ ID NO: 127802 - DNA, 37 bp, Artificial Sequence
  Synthetic oligonucleotide
gacgccacctgccatccgtagtccgcccacgaaccga

SEQ ID NO: 127803 - DNA, 38 bp, Artificial Sequence
  Synthetic oligonucleotide
ggagagggtgagaagaggaggagaactggcgccgatga

SEQ ID NO: 127804 - DNA, 38 bp, Artificial Sequence
  Synthetic oligonucleotide
ggggcggggacagctggggttcaagttacagggggtga

SEQ ID NO: 127805 - DNA, 36 bp, Artificial Sequence
  Synthetic oligonucleotide
accgtcccgaccacgtctcagccctcgttttacata

SEQ ID NO: 127806 - DNA, 36 bp, Artificial Sequence
  Synthetic oligonucleotide
gccaccctgtatgcagtccccgccccaattacgcta

SEQ ID NO: 127807 - DNA, 36 bp, Artificial Sequence
  Synthetic oligonucleotide
tacgccaccacctgttgcctctgaaactcacacgta

SEQ ID NO: 127808 - DNA, 35 bp, Artificial Sequence
  Synthetic oligonucleotide
ttagcacctgctgcatttttccatcgccttctgac

SEQ ID NO: 127809 - DNA, 35 bp, Artificial Sequence
  Synthetic oligonucleotide
gcgtgctacctgaaggcgcgcacctccttgctccc

SEQ ID NO: 127810 - DNA, 35 bp, Artificial Sequence
  Synthetic oligonucleotide
actctcgacatctattgctttcctggttcctatcc

SEQ ID NO: 127811 - DNA, 35 bp, Artificial Sequence
  Synthetic oligonucleotide
gatgattgccatctcgtatttcctgcactggctcc

SEQ ID NO: 127812 - DNA, 35 bp, Artificial Sequence
  Synthetic oligonucleotide
tccggggcgacatctttcgtccatctctcgtgtcc

SEQ ID NO: 127813 - DNA, 35 bp, Artificial Sequence
  Synthetic oligonucleotide
gtgttttcccccgctgtttttagtttaacgcctgc

SEQ ID NO: 127814 - DNA, 35 bp, Artificial Sequence
  Synthetic oligonucleotide
gcgtgcctcccatgccgctcctacactattcactc

SEQ ID NO: 127815 - DNA, 35 bp, Artificial Sequence
  Synthetic oligonucleotide
gccacatcgcctataggttttccttctactcctcg

SEQ ID NO: 127816 - DNA, 35 bp, Artificial Sequence
  Synthetic oligonucleotide
tcgctctaccgctgctgctatttcggccctccgtg

SEQ ID NO: 127817 - DNA, 35 bp, Artificial Sequence
  Synthetic oligonucleotide
atggggaggaagggtggtgttgtaccgtggtggtg

SEQ ID NO: 127818 - DNA, 35 bp, Artificial Sequence
  Synthetic oligonucleotide
tatccacagcgcatgtgacgccgtttcaccccttt

SEQ ID NO: 127819 - DNA, 37 bp, Artificial Sequence
  Synthetic oligonucleotide
gcacccgccccaacgctacaccggataccgatcccga

SEQ ID NO: 127820 - DNA, 37 bp, Artificial Sequence
  Synthetic oligonucleotide
aagagaacgggagacggaaaatcgggtggaggcagga

SEQ ID NO: 127821 - DNA, 36 bp, Artificial Sequence
  Synthetic oligonucleotide
tcccccaccgccctactgcctacaggtctctcgtga

SEQ ID NO: 127822 - DNA, 38 bp, Artificial Sequence
  Synthetic oligonucleotide
acaacactcccgccgcgaggtgcccccttacattgtga

SEQ ID NO: 127823 - DNA, 35 bp, Artificial Sequence
  Synthetic oligonucleotide
tcccgaccgcattccgactattcggcctctcttga

SEQ ID NO: 127824 - DNA, 35 bp, Artificial Sequence
  Synthetic oligonucleotide
gcctccccgtcctgatcccttggtttccttcttga

SEQ ID NO: 127825 - DNA, 35 bp, Artificial Sequence
  Synthetic oligonucleotide
gttgacagaatgggagatgggtgtgggagggtgta

SEQ ID NO: 127826 - DNA, 35 bp, Artificial Sequence
  Synthetic oligonucleotide
ttaatcgtgtgtctgctgcctcgcctccaccttta

SEQ ID NO: 127827 - DNA, 35 bp, Artificial Sequence
  Synthetic oligonucleotide
agaccaacgtagtccgaccagttcgcccacccgcc

SEQ ID NO: 127828 - DNA, 33 bp, Artificial Sequence
  Synthetic oligonucleotide
tccgtacaccatggtctcctcatttcgacctcc

SEQ ID NO: 127829 - DNA, 35 bp, Artificial Sequence
  Synthetic oligonucleotide
tgcaacctgtcctgtccaactacttcttccccatc

SEQ ID NO: 127830 - DNA, 35 bp, Artificial Sequence
  Synthetic oligonucleotide
gacttccctcgcacggtggtattggttccgttttc

SEQ ID NO: 127831 - DNA, 35 bp, Artificial Sequence
  Synthetic oligonucleotide
gtggagagaagcgtgggggggggaaagggctgccg

SEQ ID NO: 127832 - DNA, 35 bp, Artificial Sequence
  Synthetic oligonucleotide
gaaagtacgtaggggttgaaggagtggggaagtgg

SEQ ID NO: 127833 - DNA, 36 bp, Artificial Sequence
  Synthetic oligonucleotide
tgaccacagtgtccgcccgtccgccgcctacttcaa

SEQ ID NO: 127834 - DNA, 36 bp, Artificial Sequence
  Synthetic oligonucleotide
gactcacgccccccggttccgtcgtcctcttttgaa

SEQ ID NO: 127835 - DNA, 36 bp, Artificial Sequence
  Synthetic oligonucleotide
gatcaccctcctctattacttgtacacggtaccaca

SEQ ID NO: 127836 - DNA, 36 bp, Artificial Sequence
  Synthetic oligonucleotide
gacgcctccaccttgcctgactgccaaatacgctca

SEQ ID NO: 127837 - DNA, 36 bp, Artificial Sequence
  Synthetic oligonucleotide
gacgggaattaggggaacgaagggagggttgaagga

SEQ ID NO: 127838 - DNA, 37 bp, Artificial Sequence
  Synthetic oligonucleotide
gaaggggtggggaagtgggctagggcaattggtgtga

SEQ ID NO: 127839 - DNA, 36 bp, Artificial Sequence
  Synthetic oligonucleotide
gatgggggggggaggaggcgagtagcacaggcgata

SEQ ID NO: 127840 - DNA, 36 bp, Artificial Sequence
  Synthetic oligonucleotide
tgcatttcacccgtcgttttagcccgtccccgcgta

SEQ ID NO: 127841 - DNA, 35 bp, Artificial Sequence
  Synthetic oligonucleotide
tgagggaaagtggaaggaggtggaggacgaaggta

SEQ ID NO: 127842 - DNA, 31 bp, Artificial Sequence
  Synthetic oligonucleotide
gtccacccgcccgagacttccggccatctta

SEQ ID NO: 127843 - DNA, 35 bp, Artificial Sequence
  Synthetic oligonucleotide
tcctcgccacgccccttgattcttcctatccggac

SEQ ID NO: 127844 - DNA, 35 bp, Artificial Sequence
  Synthetic oligonucleotide
tgccctccgccttttcgactaccggaacatgcacc

SEQ ID NO: 127845 - DNA, 35 bp, Artificial Sequence
  Synthetic oligonucleotide
gtactccaccccatccactgacgcgatacgaacgc

SEQ ID NO: 127846 - DNA, 35 bp, Artificial Sequence
  Synthetic oligonucleotide
tacctcgcctatgtctaccttctacaacgccctgc

SEQ ID NO: 127847 - DNA, 35 bp, Artificial Sequence
  Synthetic oligonucleotide
ggacgaccgtcggtcagcccggcctctcttccatc

SEQ ID NO: 127848 - DNA, 35 bp, Artificial Sequence
  Synthetic oligonucleotide
tcgcctcatacaattctatccggtcgaccttgctc

SEQ ID NO: 127849 - DNA, 35 bp, Artificial Sequence
  Synthetic oligonucleotide
aagccacataaccgtgccccccgaccgcacccccg

SEQ ID NO: 127850 - DNA, 35 bp, Artificial Sequence
  Synthetic oligonucleotide
tccaacctctgagtatctctctagttcatcccccg

SEQ ID NO: 127851 - DNA, 35 bp, Artificial Sequence
  Synthetic oligonucleotide
tcctcccagccgaacgccccatctttcatagccgg

SEQ ID NO: 127852 - DNA, 35 bp, Artificial Sequence
  Synthetic oligonucleotide
gcaccggtctgagcttatagtctccgcctcccctg

SEQ ID NO: 127853 - DNA, 35 bp, Artificial Sequence
  Synthetic oligonucleotide
aagcctccccagcccgcttcacagacaaatccgtg

SEQ ID NO: 127854 - DNA, 35 bp, Artificial Sequence
  Synthetic oligonucleotide
gacgccccctacctgctcacggcgctccactccat

SEQ ID NO: 127855 - DNA, 35 bp, Artificial Sequence
  Synthetic oligonucleotide
tccatacgcctcttggattttctgacgcccgccct

SEQ ID NO: 127856 - DNA, 35 bp, Artificial Sequence
  Synthetic oligonucleotide
tgacaccccctggtgtctcactatgctcacatcct

SEQ ID NO: 127857 - DNA, 35 bp, Artificial Sequence
  Synthetic oligonucleotide
actatgcgcagctatcccaagccaccccacttcgt

SEQ ID NO: 127858 - DNA, 35 bp, Artificial Sequence
  Synthetic oligonucleotide
agccccttgctgttctccgatcctgcctccccgtt

SEQ ID NO: 127859 - DNA, 33 bp, Artificial Sequence
  Synthetic oligonucleotide
ttgcacactcgactctgaacctcccgccgcgga

SEQ ID NO: 127860 - DNA, 38 bp, Artificial Sequence
  Synthetic oligonucleotide
ttagcctgcccctgcttgtccacctggttcctacatga

SEQ ID NO: 127861 - DNA, 38 bp, Artificial Sequence
  Synthetic oligonucleotide
gttgaactctgctcccgtaccctgctccactctagtga

SEQ ID NO: 127862 - DNA, 38 bp, Artificial Sequence
  Synthetic oligonucleotide
aagctgccgcgggagaggtgggagtgggtggggtgtga

SEQ ID NO: 127863 - DNA, 35 bp, Artificial Sequence
  Synthetic oligonucleotide
gagtgcgcctcggtacaacatcccccgctccacta

SEQ ID NO: 127864 - DNA, 35 bp, Artificial Sequence
  Synthetic oligonucleotide
aggagtgccccctgttcggccttccttgcttcccc

SEQ ID NO: 127865 - DNA, 35 bp, Artificial Sequence
  Synthetic oligonucleotide
gcgtgtggcgcagatttcccctggctcgcacttcc

SEQ ID NO: 127866 - DNA, 35 bp, Artificial Sequence
  Synthetic oligonucleotide
ataccggtcggtcccgttgtcatcaccgcccactc

SEQ ID NO: 127867 - DNA, 35 bp, Artificial Sequence
  Synthetic oligonucleotide
atgacccgttcgacctctcttattccatgcacccg

SEQ ID NO: 127868 - DNA, 35 bp, Artificial Sequence
  Synthetic oligonucleotide
tataagcgcaatcgccatccccccccgcctagtcg

SEQ ID NO: 127869 - DNA, 35 bp, Artificial Sequence
  Synthetic oligonucleotide
tacgcggccggctctctattatctgcttcctccgg

SEQ ID NO: 127870 - DNA, 35 bp, Artificial Sequence
  Synthetic oligonucleotide
agtcagagcggcaattagtttacctcgccccctct

SEQ ID NO: 127871 - DNA, 35 bp, Artificial Sequence
  Synthetic oligonucleotide
gagacgtaaggaaaggcggaggacggggatcgagt

SEQ ID NO: 127872 - DNA, 35 bp, Artificial Sequence
  Synthetic oligonucleotide
tccagccccatggcctagttccgccagtactgctt

SEQ ID NO: 127873 - DNA, 37 bp, Artificial Sequence
  Synthetic oligonucleotide
gtggtgacggggtgggagagaggtacaagtggggcga

SEQ ID NO: 127874 - DNA, 37 bp, Artificial Sequence
  Synthetic oligonucleotide
gcccacccgcccttctgaatgtcttctccacaatcga

SEQ ID NO: 127875 - DNA, 37 bp, Artificial Sequence
  Synthetic oligonucleotide
gtggagggggcaggggaggtctggcagcatcgtggga

SEQ ID NO: 127876 - DNA, 37 bp, Artificial Sequence
  Synthetic oligonucleotide
tctgtaccctcctatccctgtctacggacctcaatga

SEQ ID NO: 127877 - DNA, 38 bp, Artificial Sequence
  Synthetic oligonucleotide
gagagcaaagcgacgaaagggtggaggtgggtgaatga

SEQ ID NO: 127878 - DNA, 38 bp, Artificial Sequence
  Synthetic oligonucleotide
gcccatcctccgccctagccccgtacattcacgagtga

SEQ ID NO: 127879 - DNA, 38 bp, Artificial Sequence
  Synthetic oligonucleotide
gtcccacctcgctcgttaatccatgcacaccctcgtga

SEQ ID NO: 127880 - DNA, 35 bp, Artificial Sequence
  Synthetic oligonucleotide
tcccgctccggtttcacatgtctttacccgcccta

SEQ ID NO: 127881 - DNA, 36 bp, Artificial Sequence
  Synthetic oligonucleotide
accatcaccgtcactccgccgtctcgccgtcaggta

SEQ ID NO: 127882 - DNA, 35 bp, Artificial Sequence
  Synthetic oligonucleotide
acacggtcggcccaggcgcaacatccacccccccc

SEQ ID NO: 127883 - DNA, 35 bp, Artificial Sequence
  Synthetic oligonucleotide
acgcaccccactgtcgcgcctacagacccgcctcc

SEQ ID NO: 127884 - DNA, 35 bp, Artificial Sequence
  Synthetic oligonucleotide
acgaccgatttgacgcttaatgtcccaccttgtcc

SEQ ID NO: 127885 - DNA, 35 bp, Artificial Sequence
  Synthetic oligonucleotide
acatgccaggttgtacggccgtccttctcttctgc

SEQ ID NO: 127886 - DNA, 35 bp, Artificial Sequence
  Synthetic oligonucleotide
agcccagtgcagcaaggttctacctatcgttcctc

SEQ ID NO: 127887 - DNA, 35 bp, Artificial Sequence
  Synthetic oligonucleotide
tgaaagtgtaactgcccccgccccatctgctgacg

SEQ ID NO: 127888 - DNA, 35 bp, Artificial Sequence
  Synthetic oligonucleotide
tccccacgcccttggagcccctgacatctaccgcg

SEQ ID NO: 127889 - DNA, 35 bp, Artificial Sequence
  Synthetic oligonucleotide
ggagaagggtgcggtacggcaaggaggggcaggcg

SEQ ID NO: 127890 - DNA, 35 bp, Artificial Sequence
  Synthetic oligonucleotide
acatcaaccgcagttagtcgtacctatcgcccact

SEQ ID NO: 127891 - DNA, 36 bp, Artificial Sequence
  Synthetic oligonucleotide
tccatgccccgcccgttgatattgcctcctcgtaaa

SEQ ID NO: 127892 - DNA, 37 bp, Artificial Sequence
  Synthetic oligonucleotide
gtagggaaaggtgggggaaggtgaccgagggcaacga

SEQ ID NO: 127893 - DNA, 37 bp, Artificial Sequence
  Synthetic oligonucleotide
ttgtgcgtaggaggggaaaggcgggaaggagcatgga

SEQ ID NO: 127894 - DNA, 37 bp, Artificial Sequence
  Synthetic oligonucleotide
ggggtggtggagggggacaattcgcgggtagacatga

SEQ ID NO: 127895 - DNA, 38 bp, Artificial Sequence
  Synthetic oligonucleotide
ttggacgctgccagaggtctcaacatctccctccctga

SEQ ID NO: 127896 - DNA, 35 bp, Artificial Sequence
  Synthetic oligonucleotide
gcctgtcaaactctgccgctccgtctacgccgcac

SEQ ID NO: 127897 - DNA, 35 bp, Artificial Sequence
  Synthetic oligonucleotide
atgccccccagacacttcttggaccgccaatagcc

SEQ ID NO: 127898 - DNA, 35 bp, Artificial Sequence
  Synthetic oligonucleotide
atcatagcgatccgtcctcccaacacccttctgcc

SEQ ID NO: 127899 - DNA, 35 bp, Artificial Sequence
  Synthetic oligonucleotide
agtgcctccgcaccgacttgcttgtctgctcctcc

SEQ ID NO: 127900 - DNA, 35 bp, Artificial Sequence
  Synthetic oligonucleotide
tcctgcctattaatccctccactctcgcccatagc

SEQ ID NO: 127901 - DNA, 35 bp, Artificial Sequence
  Synthetic oligonucleotide
ttctcccacacgcctcccattgcctctttcgactc

SEQ ID NO: 127902 - DNA, 35 bp, Artificial Sequence
  Synthetic oligonucleotide
tccatcccgtccgcacttagtattagcccctgttc

SEQ ID NO: 127903 - DNA, 35 bp, Artificial Sequence
  Synthetic oligonucleotide
tgataacctccacgggacttgcactgcccactccg

SEQ ID NO: 127904 - DNA, 35 bp, Artificial Sequence
  Synthetic oligonucleotide
agaggggggagttaatgacggaatggaccagggcg

SEQ ID NO: 127905 - DNA, 35 bp, Artificial Sequence
  Synthetic oligonucleotide
taccccgtcagtagaccctccgatgcattcaccct

SEQ ID NO: 127906 - DNA, 35 bp, Artificial Sequence
  Synthetic oligonucleotide
gaggcccttgccctccgcgccgtatctttgttcct

SEQ ID NO: 127907 - DNA, 35 bp, Artificial Sequence
  Synthetic oligonucleotide
gttacctcagggcctacttgccaccttgctacgct

SEQ ID NO: 127908 - DNA, 36 bp, Artificial Sequence
  Synthetic oligonucleotide
tacttcaccatcgcgcacccgacctgttaacgccca

SEQ ID NO: 127909 - DNA, 36 bp, Artificial Sequence
  Synthetic oligonucleotide
gttttgccctcactcgatacaccgtcctgccctaga

SEQ ID NO: 127910 - DNA, 38 bp, Artificial Sequence
  Synthetic oligonucleotide
gcagtgcgcatctgctcttgttgccctcctacccatga

SEQ ID NO: 127911 - DNA, 36 bp, Artificial Sequence
  Synthetic oligonucleotide
tgccgctacctgccgtgacgtaccaccctattctga

SEQ ID NO: 127912 - DNA, 37 bp, Artificial Sequence
  Synthetic oligonucleotide
agagaggggagggggcgtgcggaggctttcaaggtga

SEQ ID NO: 127913 - DNA, 38 bp, Artificial Sequence
  Synthetic oligonucleotide
tgcacggccagtctacactcgtcgccgccataccttga

SEQ ID NO: 127914 - DNA, 35 bp, Artificial Sequence
  Synthetic oligonucleotide
actcccaacctggatggttcttccgtcgaccctta

SEQ ID NO: 127915 - DNA, 35 bp, Artificial Sequence
  Synthetic oligonucleotide
ttacgctccccggcagtttagtacttcacctccac

SEQ ID NO: 127916 - DNA, 35 bp, Artificial Sequence
  Synthetic oligonucleotide
gtactcgcccacaataatcagcccacgccgcgccc

SEQ ID NO: 127917 - DNA, 35 bp, Artificial Sequence
  Synthetic oligonucleotide
acccgcggctatcagtactttcgcacccttgtccc

SEQ ID NO: 127918 - DNA, 35 bp, Artificial Sequence
  Synthetic oligonucleotide
atcacagtccgcgtgcatccggcccacacccgttc

SEQ ID NO: 127919 - DNA, 35 bp, Artificial Sequence
  Synthetic oligonucleotide
gttccctcccgtattgcccctgccccaccaacagg

SEQ ID NO: 127920 - DNA, 36 bp, Artificial Sequence
  Synthetic oligonucleotide
gcctgtcgctcgcccacccctgtgtctcttatactg

SEQ ID NO: 127921 - DNA, 35 bp, Artificial Sequence
  Synthetic oligonucleotide
tacccgactgatcacactgtctcccttcgttcctt

SEQ ID NO: 127922 - DNA, 35 bp, Artificial Sequence
  Synthetic oligonucleotide
tccggggtgtccgcctgccttactgcccatcattt

SEQ ID NO: 127923 - DNA, 35 bp, Artificial Sequence
  Synthetic oligonucleotide
gggggagggggtgaggcgggtcaaacgggcggaaa

SEQ ID NO: 127924 - DNA, 36 bp, Artificial Sequence
  Synthetic oligonucleotide
acaggagggggggcaatcgggactaatgcagggtaa

SEQ ID NO: 127925 - DNA, 36 bp, Artificial Sequence
  Synthetic oligonucleotide
accacccccttcgctcacaccaggcctacatggaca

SEQ ID NO: 127926 - DNA, 36 bp, Artificial Sequence
  Synthetic oligonucleotide
gcctcatcccctcggcatgttcttgcatgaccacca

SEQ ID NO: 127927 - DNA, 35 bp, Artificial Sequence
  Synthetic oligonucleotide
accatgtcctgcctttctgtacactcgctagagca

SEQ ID NO: 127928 - DNA, 36 bp, Artificial Sequence
  Synthetic oligonucleotide
agcacccgccgctcactacgctgccactttttttca

SEQ ID NO: 127929 - DNA, 36 bp, Artificial Sequence
  Synthetic oligonucleotide
gtcaacctccctccttttctgcgagcccgcctacga

SEQ ID NO: 127930 - DNA, 37 bp, Artificial Sequence
  Synthetic oligonucleotide
tgtcaccgcatggtttgtgcgatcttcttccctccga

SEQ ID NO: 127931 - DNA, 38 bp, Artificial Sequence
  Synthetic oligonucleotide
tgatggcggaggtgggggtgcaatggcggtttggctga

SEQ ID NO: 127932 - DNA, 36 bp, Artificial Sequence
  Synthetic oligonucleotide
gtccgttcgctccacgctttattacacacatgccta

SEQ ID NO: 127933 - DNA, 35 bp, Artificial Sequence
  Synthetic oligonucleotide
gaccagtcatcgtgtcgctcgcccccatcgttacc

SEQ ID NO: 127934 - DNA, 35 bp, Artificial Sequence
  Synthetic oligonucleotide
gctgaatccgactctcgctcctgtatgcctgcccc

SEQ ID NO: 127935 - DNA, 35 bp, Artificial Sequence
  Synthetic oligonucleotide
acgtgtcacccaatcgtactcaataccggctcccc

SEQ ID NO: 127936 - DNA, 35 bp, Artificial Sequence
  Synthetic oligonucleotide
tgtgtgagccgtcaagtccttccccgcccttgccc

SEQ ID NO: 127937 - DNA, 35 bp, Artificial Sequence
  Synthetic oligonucleotide
gcgctccaccgaggtctgtcaccgttgctccatgc

SEQ ID NO: 127938 - DNA, 35 bp, Artificial Sequence
  Synthetic oligonucleotide
tcgctgtacagcccgtcgctgcccctaaatcctgc

SEQ ID NO: 127939 - DNA, 27 bp, Artificial Sequence
  Synthetic oligonucleotide
gatgcccccgccctcccatggaaggtc

SEQ ID NO: 127940 - DNA, 35 bp, Artificial Sequence
  Synthetic oligonucleotide
ggtgggaggaagtgtaactgcgggggggaggaagg

SEQ ID NO: 127941 - DNA, 35 bp, Artificial Sequence
  Synthetic oligonucleotide
gcattccccatccgatgcgttccgccaacacccat

SEQ ID NO: 127942 - DNA, 35 bp, Artificial Sequence
  Synthetic oligonucleotide
tgaccaggcccccatctacgttcaccagcatacct

SEQ ID NO: 127943 - DNA, 34 bp, Artificial Sequence
  Synthetic oligonucleotide
tcactactccctggttatgttctctctcgaccct

SEQ ID NO: 127944 - DNA, 35 bp, Artificial Sequence
  Synthetic oligonucleotide
attgccgctgtcgccgcccagcccaactcgcctct

SEQ ID NO: 127945 - DNA, 35 bp, Artificial Sequence
  Synthetic oligonucleotide
atagtcactgctcctctgttcgcgtacacttactt

SEQ ID NO: 127946 - DNA, 36 bp, Artificial Sequence
  Synthetic oligonucleotide
gatagcgcccagagtgacatcaccccatctgctcca

SEQ ID NO: 127947 - DNA, 32 bp, Artificial Sequence
  Synthetic oligonucleotide
aacgcgcctccctccactgaaccgcagccgca

SEQ ID NO: 127948 - DNA, 37 bp, Artificial Sequence
  Synthetic oligonucleotide
accgccaccctgctgcaacagtctctcactccatcga

SEQ ID NO: 127949 - DNA, 38 bp, Artificial Sequence
  Synthetic oligonucleotide
aacaagaggagggaacgggggcatgatggagcaggtga

SEQ ID NO: 127950 - DNA, 35 bp, Artificial Sequence
  Synthetic oligonucleotide
tacacccctcgtaccgaccggaccatgtctttatc

SEQ ID NO: 127951 - DNA, 35 bp, Artificial Sequence
  Synthetic oligonucleotide
tttccgccccccgccgcccatcttgcatagagaag

SEQ ID NO: 127952 - DNA, 35 bp, Artificial Sequence
  Synthetic oligonucleotide
tccgcccatcgcgcgcctctcttttagcctactgg

SEQ ID NO: 127953 - DNA, 35 bp, Artificial Sequence
  Synthetic oligonucleotide
gacgctacgccttaagtggaatcacaccccccctg

SEQ ID NO: 127954 - DNA, 35 bp, Artificial Sequence
  Synthetic oligonucleotide
agtcccccacagacgtgcccgctgttccccatctg

SEQ ID NO: 127955 - DNA, 35 bp, Artificial Sequence
  Synthetic oligonucleotide
gccgtccctcctcgcgcgatatgctcatacacact

SEQ ID NO: 127956 - DNA, 35 bp, Artificial Sequence
  Synthetic oligonucleotide
gtggggcgaagttaggggagggcgggtctcttaaa

SEQ ID NO: 127957 - DNA, 36 bp, Artificial Sequence
  Synthetic oligonucleotide
gttaggaggaggtaggggtggctggtggaatgtgca

SEQ ID NO: 127958 - DNA, 35 bp, Artificial Sequence
  Synthetic oligonucleotide
agccgaccccagccctcccactggactagttctca

SEQ ID NO: 127959 - DNA, 38 bp, Artificial Sequence
  Synthetic oligonucleotide
acttacgcccccttggtatatcgttctcctgtccctga

SEQ ID NO: 127960 - DNA, 38 bp, Artificial Sequence
  Synthetic oligonucleotide
gtacccccccgtgttgcttcaacggacgcctttcctga

SEQ ID NO: 127961 - DNA, 35 bp, Artificial Sequence
  Synthetic oligonucleotide
ttcacacactatgctccctgaactctgtccttgta

SEQ ID NO: 127962 - DNA, 35 bp, Artificial Sequence
  Synthetic oligonucleotide
tcccttcagatggtgccctcttgtacctgctgtcc

SEQ ID NO: 127963 - DNA, 36 bp, Artificial Sequence
  Synthetic oligonucleotide
tgcccctccgccagggttgacaccttctgcctttgc

SEQ ID NO: 127964 - DNA, 35 bp, Artificial Sequence
  Synthetic oligonucleotide
gacctccgccagcaccgttagttccactgtttctc

SEQ ID NO: 127965 - DNA, 35 bp, Artificial Sequence
  Synthetic oligonucleotide
ggaatgggtgggccgggggaattgggggtattgag

SEQ ID NO: 127966 - DNA, 35 bp, Artificial Sequence
  Synthetic oligonucleotide
aaaggaggggtggtagtcggtgaatagtggtggcg

SEQ ID NO: 127967 - DNA, 35 bp, Artificial Sequence
  Synthetic oligonucleotide
tagggaactgttggggaacaaggggagtggggggg

SEQ ID NO: 127968 - DNA, 35 bp, Artificial Sequence
  Synthetic oligonucleotide
attgtctccgctatcatcctggtcccctgtgcact

SEQ ID NO: 127969 - DNA, 36 bp, Artificial Sequence
  Synthetic oligonucleotide
agattcggcccaactgctattcctctgcttctcaaa

SEQ ID NO: 127970 - DNA, 35 bp, Artificial Sequence
  Synthetic oligonucleotide
tgtagggtggggggtaagggtagtgaaaccggcaa

SEQ ID NO: 127971 - DNA, 36 bp, Artificial Sequence
  Synthetic oligonucleotide
gactctcgcactgttttggcttcatcctcctcgcca

SEQ ID NO: 127972 - DNA, 35 bp, Artificial Sequence
  Synthetic oligonucleotide
gcagagtcacgcgtgcgcctccctcgcctatctca

SEQ ID NO: 127973 - DNA, 37 bp, Artificial Sequence
  Synthetic oligonucleotide
actcgatgccccgccgatgttggccccttccacccga

SEQ ID NO: 127974 - DNA, 37 bp, Artificial Sequence
  Synthetic oligonucleotide
tatcagggagagagcggggggagagggcggctcggga

SEQ ID NO: 127975 - DNA, 38 bp, Artificial Sequence
  Synthetic oligonucleotide
gccctcacggcgggggtgggatgcggaggttggcctga

SEQ ID NO: 127976 - DNA, 38 bp, Artificial Sequence
  Synthetic oligonucleotide
tccgctacgacattccgttccctcactgcctcgtttga

SEQ ID NO: 127977 - DNA, 35 bp, Artificial Sequence
  Synthetic oligonucleotide
tgccgccggtttgcgcctcgccgttcctctccaac

SEQ ID NO: 127978 - DNA, 35 bp, Artificial Sequence
  Synthetic oligonucleotide
taccgtgccaacctcccaatgtatcgccgtttatc

SEQ ID NO: 127979 - DNA, 35 bp, Artificial Sequence
  Synthetic oligonucleotide
tgctcaccccgcgcccgactagttcgcttccgttc

SEQ ID NO: 127980 - DNA, 35 bp, Artificial Sequence
  Synthetic oligonucleotide
ttcccacaatgccccccgtagccacctaggccacg

SEQ ID NO: 127981 - DNA, 35 bp, Artificial Sequence
  Synthetic oligonucleotide
tgatgccctctatgttttttgtcaacgttccgcct

SEQ ID NO: 127982 - DNA, 35 bp, Artificial Sequence
  Synthetic oligonucleotide
gacatgcacgaccacttgccgtccgccatctttct

SEQ ID NO: 127983 - DNA, 35 bp, Artificial Sequence
  Synthetic oligonucleotide
tgtcgccactccatctgctttatgtttccgtttct

SEQ ID NO: 127984 - DNA, 35 bp, Artificial Sequence
  Synthetic oligonucleotide
gtacgggtgggggggagttggcgggatgcgactgt

SEQ ID NO: 127985 - DNA, 35 bp, Artificial Sequence
  Synthetic oligonucleotide
tcgcttaccctcctgcttatacgatcgtacctttt

SEQ ID NO: 127986 - DNA, 36 bp, Artificial Sequence
  Synthetic oligonucleotide
ttcacccgaccccgatgcgttccatcaatccatcaa

SEQ ID NO: 127987 - DNA, 37 bp, Artificial Sequence
  Synthetic oligonucleotide
gtaggggggcgagagaagggtcggcacaacggggaga

SEQ ID NO: 127988 - DNA, 37 bp, Artificial Sequence
  Synthetic oligonucleotide
gacatgtatgacggggtggtgggaggtgagggctaga

SEQ ID NO: 127989 - DNA, 37 bp, Artificial Sequence
  Synthetic oligonucleotide
ttcgccgagtccctgatttttacctgccccccttcga

SEQ ID NO: 127990 - DNA, 37 bp, Artificial Sequence
  Synthetic oligonucleotide
tcacaccccctccagagattctcgacgccttcttgga

SEQ ID NO: 127991 - DNA, 35 bp, Artificial Sequence
  Synthetic oligonucleotide
tactacccgagttgcgtaccgtacctcccccgtac

SEQ ID NO: 127992 - DNA, 35 bp, Artificial Sequence
  Synthetic oligonucleotide
accactcggccatgctgcaacagtccaccgtaccc

SEQ ID NO: 127993 - DNA, 35 bp, Artificial Sequence
  Synthetic oligonucleotide
ttccaagccgcaccatgtgctcggctctccatccc

SEQ ID NO: 127994 - DNA, 35 bp, Artificial Sequence
  Synthetic oligonucleotide
tactcccgacgttggctgcccttgtttcaccggcc

SEQ ID NO: 127995 - DNA, 35 bp, Artificial Sequence
  Synthetic oligonucleotide
gcccgccctcgttgaaggtaaatgtctcgccgtcc

SEQ ID NO: 127996 - DNA, 35 bp, Artificial Sequence
  Synthetic oligonucleotide
gaaagtagggtggggaagaagtaaggtggaagagc

SEQ ID NO: 127997 - DNA, 35 bp, Artificial Sequence
  Synthetic oligonucleotide
gtgcttagaccgaggggagagggagggcgggtctc

SEQ ID NO: 127998 - DNA, 35 bp, Artificial Sequence
  Synthetic oligonucleotide
gacctacgccggtgccctcctgtatgcttttggtc

SEQ ID NO: 127999 - DNA, 35 bp, Artificial Sequence
  Synthetic oligonucleotide
tacgcacctccgcctctccgctgactccttggaag

SEQ ID NO: 128000 - DNA, 35 bp, Artificial Sequence
  Synthetic oligonucleotide
gtcgcccccctgcgcagaccgaaactctcttgccg

SEQ ID NO: 128001 - DNA, 35 bp, Artificial Sequence
  Synthetic oligonucleotide
gcctgggcccgtccttcctcgtgcttcccctttgt

SEQ ID NO: 128002 - DNA, 35 bp, Artificial Sequence
  Synthetic oligonucleotide
ttccccccgctcatcggtcctatacgcgctttaca

SEQ ID NO: 128003 - DNA, 36 bp, Artificial Sequence
  Synthetic oligonucleotide
actcgcctgcctccccacacgccaatgcggtttgca

SEQ ID NO: 128004 - DNA, 35 bp, Artificial Sequence
  Synthetic oligonucleotide
ggaccgccgtgaaccacctgcccttccgttacgta

SEQ ID NO: 128005 - DNA, 35 bp, Artificial Sequence
  Synthetic oligonucleotide
acgccgtgcatacctctgcgggcccctttcgccac

SEQ ID NO: 128006 - DNA, 35 bp, Artificial Sequence
  Synthetic oligonucleotide
atgcactctatgcccgcttctcttttcgattagcc

SEQ ID NO: 128007 - DNA, 35 bp, Artificial Sequence
  Synthetic oligonucleotide
tgcacgtaacagaactgcccttcatttcacttgcc

SEQ ID NO: 128008 - DNA, 35 bp, Artificial Sequence
  Synthetic oligonucleotide
acttacgtctgacgcatactgtccgctcttttgcc

SEQ ID NO: 128009 - DNA, 35 bp, Artificial Sequence
  Synthetic oligonucleotide
gtgcatgttgctatccgtgctgtgcacctccttcc

SEQ ID NO: 128010 - DNA, 35 bp, Artificial Sequence
  Synthetic oligonucleotide
ttgcccccctccatgtccgtctgttcacatctttc

SEQ ID NO: 128011 - DNA, 35 bp, Artificial Sequence
  Synthetic oligonucleotide
tgccatgtataccgccccagtccgttcccctagcg

SEQ ID NO: 128012 - DNA, 35 bp, Artificial Sequence
  Synthetic oligonucleotide
tccacccctcgttgcatacctcctgcctcacctcg

SEQ ID NO: 128013 - DNA, 35 bp, Artificial Sequence
  Synthetic oligonucleotide
gttgcatctcgctcgtacccatcctccttcggtat

SEQ ID NO: 128014 - DNA, 35 bp, Artificial Sequence
  Synthetic oligonucleotide
gctaacgccccgccttatcgttacatcgcccaact

SEQ ID NO: 128015 - DNA, 35 bp, Artificial Sequence
  Synthetic oligonucleotide
gacatgagccagctcctaatttcggcctactctct

SEQ ID NO: 128016 - DNA, 35 bp, Artificial Sequence
  Synthetic oligonucleotide
gtaccccgcccgttcggacacccttatccctcagt

SEQ ID NO: 128017 - DNA, 36 bp, Artificial Sequence
  Synthetic oligonucleotide
gtgctgcctcccgcggctattccctgtccctgacaa

SEQ ID NO: 128018 - DNA, 36 bp, Artificial Sequence
  Synthetic oligonucleotide
tgcaagcctacgaattgcctcccgttacgccaccca

SEQ ID NO: 128019 - DNA, 35 bp, Artificial Sequence
  Synthetic oligonucleotide
tcacaccccctgttttcttcgctgacccttggcca

SEQ ID NO: 128020 - DNA, 36 bp, Artificial Sequence
  Synthetic oligonucleotide
gtctgcctacacactttgctccccctgcggtacgca

SEQ ID NO: 128021 - DNA, 36 bp, Artificial Sequence
  Synthetic oligonucleotide
tgcctccgtcggtcttcatttacctcgcaccctcga

SEQ ID NO: 128022 - DNA, 36 bp, Artificial Sequence
  Synthetic oligonucleotide
gagggaaggcggaggggagaagaagtaggtacagga

SEQ ID NO: 128023 - DNA, 37 bp, Artificial Sequence
  Synthetic oligonucleotide
ttcaacgcacccgacggtacccgccgccccttcctga

SEQ ID NO: 128024 - DNA, 36 bp, Artificial Sequence
  Synthetic oligonucleotide
tcgtaaccccgccgctccttttacgcccctgcgtga

SEQ ID NO: 128025 - DNA, 36 bp, Artificial Sequence
  Synthetic oligonucleotide
tctgactccgacccgctccactcaccagtcgcacta

SEQ ID NO: 128026 - DNA, 36 bp, Artificial Sequence
  Synthetic oligonucleotide
tcctgcctccttcgcataaactaactcacatccgta

SEQ ID NO: 128027 - DNA, 35 bp, Artificial Sequence
  Synthetic oligonucleotide
gtcgacaaccaggtacctccatcgtccttctccac

SEQ ID NO: 128028 - DNA, 35 bp, Artificial Sequence
  Synthetic oligonucleotide
tgtgattgacagcgggctacctccatccgctcccc

SEQ ID NO: 128029 - DNA, 35 bp, Artificial Sequence
  Synthetic oligonucleotide
gtcccccgtcattctctactgtccgctgcctgacg

SEQ ID NO: 128030 - DNA, 35 bp, Artificial Sequence
  Synthetic oligonucleotide
gacaagggcaaagagggaggggagaagcgcccgtg

SEQ ID NO: 128031 - DNA, 34 bp, Artificial Sequence
  Synthetic oligonucleotide
ggggtcgcggggggggtaaggggaggaatgacat

SEQ ID NO: 128032 - DNA, 35 bp, Artificial Sequence
  Synthetic oligonucleotide
taaccccgctcttgtatccgtcttgttctccctgt

SEQ ID NO: 128033 - DNA, 36 bp, Artificial Sequence
  Synthetic oligonucleotide
tcacctcttgtccctcgcccccgagcacgtttacca

SEQ ID NO: 128034 - DNA, 36 bp, Artificial Sequence
  Synthetic oligonucleotide
gcgaagcgacatgcgtcctttttgcgtccccatcca

SEQ ID NO: 128035 - DNA, 37 bp, Artificial Sequence
  Synthetic oligonucleotide
gaaccgcgccctgccttttctcgttcgacgctcccga

SEQ ID NO: 128036 - DNA, 37 bp, Artificial Sequence
  Synthetic oligonucleotide
aacgatcgcccacatgacttcttcttctgacttccga

SEQ ID NO: 128037 - DNA, 38 bp, Artificial Sequence
  Synthetic oligonucleotide
tgatcgtccggtccgattacgccgcccatccctactga

SEQ ID NO: 128038 - DNA, 37 bp, Artificial Sequence
  Synthetic oligonucleotide
aatgcctcacttctcctggcctgtctagctttcctga

SEQ ID NO: 128039 - DNA, 38 bp, Artificial Sequence
  Synthetic oligonucleotide
agcacgcccctgtttcccagccccacaacttgttctga

SEQ ID NO: 128040 - DNA, 36 bp, Artificial Sequence
  Synthetic oligonucleotide
ggtgccgaccggctctacaccatacactccccgtga

SEQ ID NO: 128041 - DNA, 36 bp, Artificial Sequence
  Synthetic oligonucleotide
tctcctcctccacccgatcctttgagcagtttacta

SEQ ID NO: 128042 - DNA, 35 bp, Artificial Sequence
  Synthetic oligonucleotide
accgacaacttctctgctatctgtcctacctttta

SEQ ID NO: 128043 - DNA, 35 bp, Artificial Sequence
  Synthetic oligonucleotide
cacgtcaactcctgactccgtgtcgttcgccttcc

SEQ ID NO: 128044 - DNA, 35 bp, Artificial Sequence
  Synthetic oligonucleotide
tcactcccgaggtcgtataggtacctccccccatc

SEQ ID NO: 128045 - DNA, 35 bp, Artificial Sequence
  Synthetic oligonucleotide
accccgtcgtgttacgtccagttctcccgtccatc

SEQ ID NO: 128046 - DNA, 35 bp, Artificial Sequence
  Synthetic oligonucleotide
aactacgccctctccgtataactccgtgggtcctc

SEQ ID NO: 128047 - DNA, 35 bp, Artificial Sequence
  Synthetic oligonucleotide
gccacatccggacctgaactcgccacttttgtgtc

SEQ ID NO: 128048 - DNA, 35 bp, Artificial Sequence
  Synthetic oligonucleotide
tggtcgaggctctggggaacaggggaggggggagg

SEQ ID NO: 128049 - DNA, 35 bp, Artificial Sequence
  Synthetic oligonucleotide
agcacagagacggtaggataaggggggaaggatgg

SEQ ID NO: 128050 - DNA, 35 bp, Artificial Sequence
  Synthetic oligonucleotide
gccgctcgccctgtccccggtcccgacgtgtccat

SEQ ID NO: 128051 - DNA, 35 bp, Artificial Sequence
  Synthetic oligonucleotide
aatcgaccaccgtcctgcccgtccctctcgactat

SEQ ID NO: 128052 - DNA, 35 bp, Artificial Sequence
  Synthetic oligonucleotide
ttcatcctcggtcgccaacaccaccgtttcacgct

SEQ ID NO: 128053 - DNA, 36 bp, Artificial Sequence
  Synthetic oligonucleotide
tacttcctccgctcccgcctgctcatgcattgctca

SEQ ID NO: 128054 - DNA, 37 bp, Artificial Sequence
  Synthetic oligonucleotide
atccctccgccacccgtgaatacagccttaaccgcga

SEQ ID NO: 128055 - DNA, 37 bp, Artificial Sequence
  Synthetic oligonucleotide
acagacagccgaggggaacggtggggggaggaacgga

SEQ ID NO: 128056 - DNA, 36 bp, Artificial Sequence
  Synthetic oligonucleotide
tgagtaggtccgttcgccccataactcccactccta

SEQ ID NO: 128057 - DNA, 35 bp, Artificial Sequence
  Synthetic oligonucleotide
gcctacccctcctgctgttcaaacgccagttcccc

SEQ ID NO: 128058 - DNA, 35 bp, Artificial Sequence
  Synthetic oligonucleotide
gtgtgccttacgccgtcctgcctcccatgtcttat

SEQ ID NO: 128059 - DNA, 35 bp, Artificial Sequence
  Synthetic oligonucleotide
gaaatcggcccccctgacttgctattgatctccct

SEQ ID NO: 128060 - DNA, 35 bp, Artificial Sequence
  Synthetic oligonucleotide
ctagccaccgccggccttcgtttgtcaccgcctct

SEQ ID NO: 128061 - DNA, 35 bp, Artificial Sequence
  Synthetic oligonucleotide
gtcactcctcggacgtccaccttgtactgcacttt

SEQ ID NO: 128062 - DNA, 36 bp, Artificial Sequence
  Synthetic oligonucleotide
aacctgccgggggggggtaaaatgctggggagggaa

SEQ ID NO: 128063 - DNA, 36 bp, Artificial Sequence
  Synthetic oligonucleotide
tccggacagtacctccgccctccgtatcatcccgga

SEQ ID NO: 128064 - DNA, 35 bp, Artificial Sequence
  Synthetic oligonucleotide
gactttgtccggtggcgtatgttcagcccccccta

SEQ ID NO: 128065 - DNA, 35 bp, Artificial Sequence
  Synthetic oligonucleotide
aacgcctccctctgccatttcccacgcttagacac

SEQ ID NO: 128066 - DNA, 35 bp, Artificial Sequence
  Synthetic oligonucleotide
gtacccccccaaatgtagaccaccgtcccggccac

SEQ ID NO: 128067 - DNA, 35 bp, Artificial Sequence
  Synthetic oligonucleotide
atgtcccaccgttaatccctgccgtgtggattgac

SEQ ID NO: 128068 - DNA, 35 bp, Artificial Sequence
  Synthetic oligonucleotide
tcacacacgcgtacgtccactcaagccgatctgcc

SEQ ID NO: 128069 - DNA, 35 bp, Artificial Sequence
  Synthetic oligonucleotide
agaagcgcaccgcctgcgttatgcccgccattgcc

SEQ ID NO: 128070 - DNA, 35 bp, Artificial Sequence
  Synthetic oligonucleotide
ccccccgactcgacctgccatgcacacgctaatcc

SEQ ID NO: 128071 - DNA, 35 bp, Artificial Sequence
  Synthetic oligonucleotide
attcccccatccttgttgctgagcccgttattcgc

SEQ ID NO: 128072 - DNA, 35 bp, Artificial Sequence
  Synthetic oligonucleotide
tgatgccactccctgtccttaggtccgcctcttgc

SEQ ID NO: 128073 - DNA, 35 bp, Artificial Sequence
  Synthetic oligonucleotide
tcaaccgttcctgccatcctatcagtgccccggtc

SEQ ID NO: 128074 - DNA, 35 bp, Artificial Sequence
  Synthetic oligonucleotide
gccatcctcccgctgtggttgtttcaccgatatgg

SEQ ID NO: 128075 - DNA, 35 bp, Artificial Sequence
  Synthetic oligonucleotide
gatcgcccccggttcttgtgcccttaaagcacact

SEQ ID NO: 128076 - DNA, 35 bp, Artificial Sequence
  Synthetic oligonucleotide
acctgcaccaattgcgtcttagtcaagctcctcct

SEQ ID NO: 128077 - DNA, 35 bp, Artificial Sequence
  Synthetic oligonucleotide
tgcaccgccctgcacccacgttgccctctcgcagt

SEQ ID NO: 128078 - DNA, 35 bp, Artificial Sequence
  Synthetic oligonucleotide
agccgcatctctgctacagagctcccttccgccca

SEQ ID NO: 128079 - DNA, 38 bp, Artificial Sequence
  Synthetic oligonucleotide
tgcacccccttgtgctaggctccacttccattgcatga

SEQ ID NO: 128080 - DNA, 37 bp, Artificial Sequence
  Synthetic oligonucleotide
tcgccacccttccactgaccgcaccacagtcttatga

SEQ ID NO: 128081 - DNA, 38 bp, Artificial Sequence
  Synthetic oligonucleotide
tgtgcccgaccgctactaggcgcgcttctaccccctga

SEQ ID NO: 128082 - DNA, 37 bp, Artificial Sequence
  Synthetic oligonucleotide
tgcaccgccggggttgtcgccgcccctcttatattga

SEQ ID NO: 128083 - DNA, 35 bp, Artificial Sequence
  Synthetic oligonucleotide
gccacatccctatcctgtcttttgtggaccaccta

SEQ ID NO: 128084 - DNA, 35 bp, Artificial Sequence
  Synthetic oligonucleotide
gttgcatggcacgtttctatcctagtctctcgcta

SEQ ID NO: 128085 - DNA, 36 bp, Artificial Sequence
  Synthetic oligonucleotide
gcctaccctccgccccgtattataatcctgatgtta

SEQ ID NO: 128086 - DNA, 35 bp, Artificial Sequence
  Synthetic oligonucleotide
tccatccccactttcctccggcattgttatgtacc

SEQ ID NO: 128087 - DNA, 35 bp, Artificial Sequence
  Synthetic oligonucleotide
tagtccaccttcgcacgatacctgactgctcgccc

SEQ ID NO: 128088 - DNA, 35 bp, Artificial Sequence
  Synthetic oligonucleotide
atcgtcattcgcttctgggtcccctcaccgctatc

SEQ ID NO: 128089 - DNA, 35 bp, Artificial Sequence
  Synthetic oligonucleotide
gtggtgagggcgggggggttataagttagccatcg

SEQ ID NO: 128090 - DNA, 35 bp, Artificial Sequence
  Synthetic oligonucleotide
gagaagagagacagatatagagggcggaaaaacgg

SEQ ID NO: 128091 - DNA, 35 bp, Artificial Sequence
  Synthetic oligonucleotide
gtcgcccacatggtcgcaaacgcttggccttctct

SEQ ID NO: 128092 - DNA, 35 bp, Artificial Sequence
  Synthetic oligonucleotide
tgcatcgcaataccccccgtccgcacttgcagtct

SEQ ID NO: 128093 - DNA, 35 bp, Artificial Sequence
  Synthetic oligonucleotide
ttcccactgttacatcttgtcgagcgacgcccctt

SEQ ID NO: 128094 - DNA, 36 bp, Artificial Sequence
  Synthetic oligonucleotide
ttaccccgccctgtccccgaacgacttttgacgcaa

SEQ ID NO: 128095 - DNA, 36 bp, Artificial Sequence
  Synthetic oligonucleotide
tcgcattgcccgcccacgtatgcaacaaccatccca

SEQ ID NO: 128096 - DNA, 37 bp, Artificial Sequence
  Synthetic oligonucleotide
gcccccgcccatccgcacccccttgcactgcacgaga

SEQ ID NO: 128097 - DNA, 37 bp, Artificial Sequence
  Synthetic oligonucleotide
gccaccgcaactaataccacccattcccatgtggaga

SEQ ID NO: 128098 - DNA, 37 bp, Artificial Sequence
  Synthetic oligonucleotide
gcatagcaccgttctcctgctgttcccatatcatcga

SEQ ID NO: 128099 - DNA, 38 bp, Artificial Sequence
  Synthetic oligonucleotide
gagagaggggtgggtgggcgtggcagggagattgatga

SEQ ID NO: 128100 - DNA, 38 bp, Artificial Sequence
  Synthetic oligonucleotide
acgcgtgggagtcgggagggggggtggcggtgcgctga

SEQ ID NO: 128101 - DNA, 36 bp, Artificial Sequence
  Synthetic oligonucleotide
gagctcgctcgtggccccgttcctgttctcccacta

SEQ ID NO: 128102 - DNA, 35 bp, Artificial Sequence
  Synthetic oligonucleotide
ggtggccgccccactatgaatttgttccatgccac

SEQ ID NO: 128103 - DNA, 35 bp, Artificial Sequence
  Synthetic oligonucleotide
tcccgcccaatgtctcccatctcaactggttgcac

SEQ ID NO: 128104 - DNA, 35 bp, Artificial Sequence
  Synthetic oligonucleotide
tccacctagtattggtccctgttcccgaccgtgcc

SEQ ID NO: 128105 - DNA, 35 bp, Artificial Sequence
  Synthetic oligonucleotide
gcactttaccgtcataccacctcgccatgttgtcc

SEQ ID NO: 128106 - DNA, 35 bp, Artificial Sequence
  Synthetic oligonucleotide
gactccacactcgtgtccagtttttccccttgtgc

SEQ ID NO: 128107 - DNA, 35 bp, Artificial Sequence
  Synthetic oligonucleotide
gcatccacctcgggactgaccacgcctgttttttc

SEQ ID NO: 128108 - DNA, 35 bp, Artificial Sequence
  Synthetic oligonucleotide
ttgtctacccctcgatgcctatttcaccctgcagg

SEQ ID NO: 128109 - DNA, 35 bp, Artificial Sequence
  Synthetic oligonucleotide
accagtggcttgtcaaacggtccttctctttcctg

SEQ ID NO: 128110 - DNA, 35 bp, Artificial Sequence
  Synthetic oligonucleotide
ggtagttcggtgggagggaggcgggtgggctggat

SEQ ID NO: 128111 - DNA, 35 bp, Artificial Sequence
  Synthetic oligonucleotide
gtcgtacccctgcctgctccacttgcaacccgcct

SEQ ID NO: 128112 - DNA, 35 bp, Artificial Sequence
  Synthetic oligonucleotide
gtcatccctcgcgccttccttgctccttcgtctgt

SEQ ID NO: 128113 - DNA, 35 bp, Artificial Sequence
  Synthetic oligonucleotide
tctatccgcgttgttccgcgcctcatgactacctt

SEQ ID NO: 128114 - DNA, 36 bp, Artificial Sequence
  Synthetic oligonucleotide
gccacacaccgattcctatctgagccttaggcccca

SEQ ID NO: 128115 - DNA, 35 bp, Artificial Sequence
  Synthetic oligonucleotide
aacatccccattgtttgcaccgatcctttcttcga

SEQ ID NO: 128116 - DNA, 37 bp, Artificial Sequence
  Synthetic oligonucleotide
aatggcggagggcgggagggttccaggggtgacagga

SEQ ID NO: 128117 - DNA, 38 bp, Artificial Sequence
  Synthetic oligonucleotide
gtggaagaacagacaagggataggacggggggggatga

SEQ ID NO: 128118 - DNA, 38 bp, Artificial Sequence
  Synthetic oligonucleotide
tctgcgcacacccatgctttcaccccgtcgctctctga

SEQ ID NO: 128119 - DNA, 37 bp, Artificial Sequence
  Synthetic oligonucleotide
tgagtgctcacttgccggttatgccatccccttctga

SEQ ID NO: 128120 - DNA, 38 bp, Artificial Sequence
  Synthetic oligonucleotide
tgaacggagagtgggtgcggtgggtttgactcctgtga

SEQ ID NO: 128121 - DNA, 37 bp, Artificial Sequence
  Synthetic oligonucleotide
accattcgcccacgggtgaccttaccaccatccttga

SEQ ID NO: 128122 - DNA, 37 bp, Artificial Sequence
  Synthetic oligonucleotide
tggacatgctccgcgccggtacgcccttcacctttga

SEQ ID NO: 128123 - DNA, 36 bp, Artificial Sequence
  Synthetic oligonucleotide
accccaccgccttatctgtcccacgcttttcacata

SEQ ID NO: 128124 - DNA, 35 bp, Artificial Sequence
  Synthetic oligonucleotide
atgacggtcgcctcactcgcctcttcttgctgatc

SEQ ID NO: 128125 - DNA, 35 bp, Artificial Sequence
  Synthetic oligonucleotide
tcaagcctcttctgttctttacgtcgcactccctc

SEQ ID NO: 128126 - DNA, 35 bp, Artificial Sequence
  Synthetic oligonucleotide
ttcgcctcctgccaccttgtcaagtccttacggtc

SEQ ID NO: 128127 - DNA, 35 bp, Artificial Sequence
  Synthetic oligonucleotide
gatccgcctccctgtacacaactttccttcgggtg

SEQ ID NO: 128128 - DNA, 35 bp, Artificial Sequence
  Synthetic oligonucleotide
gtatgcccaccgtgctgcatgagtccccgcaccat

SEQ ID NO: 128129 - DNA, 35 bp, Artificial Sequence
  Synthetic oligonucleotide
acatctccgcccccctaattgcgactgagcccgtt

SEQ ID NO: 128130 - DNA, 35 bp, Artificial Sequence
  Synthetic oligonucleotide
gtcactcctgtcatacggtagtaaccataccacca

SEQ ID NO: 128131 - DNA, 35 bp, Artificial Sequence
  Synthetic oligonucleotide
tcactaccgccctacctctgctccctgtgcctgca

SEQ ID NO: 128132 - DNA, 36 bp, Artificial Sequence
  Synthetic oligonucleotide
actccacgtaccactgcactattccaacggtcttca

SEQ ID NO: 128133 - DNA, 37 bp, Artificial Sequence
  Synthetic oligonucleotide
tacccctgtcatcagcttgccaccctgcaccccccga

SEQ ID NO: 128134 - DNA, 37 bp, Artificial Sequence
  Synthetic oligonucleotide
gattagcggagggggtgaggcttcaagggaggaggga

SEQ ID NO: 128135 - DNA, 38 bp, Artificial Sequence
  Synthetic oligonucleotide
acgcgagtgccgcctcaatctgccagctttccccgtga

SEQ ID NO: 128136 - DNA, 38 bp, Artificial Sequence
  Synthetic oligonucleotide
tccgtaccctcgtccctcctgctcacagtctatattga

SEQ ID NO: 128137 - DNA, 38 bp, Artificial Sequence
  Synthetic oligonucleotide
cacctcccccccacatgccctctgacggtcacgcttga

SEQ ID NO: 128138 - DNA, 36 bp, Artificial Sequence
  Synthetic oligonucleotide
ttgacactccgactgcatttggcccatcacacgcta

SEQ ID NO: 128139 - DNA, 36 bp, Artificial Sequence
  Synthetic oligonucleotide
tagtggggggggtgaggtggggctaccggaaattta

SEQ ID NO: 128140 - DNA, 35 bp, Artificial Sequence
  Synthetic oligonucleotide
actgcacatcgatcggcctatacaaattctgcccc

SEQ ID NO: 128141 - DNA, 35 bp, Artificial Sequence
  Synthetic oligonucleotide
gctgcacacactccgcattttgttggcgtttcccc

SEQ ID NO: 128142 - DNA, 35 bp, Artificial Sequence
  Synthetic oligonucleotide
ttagcccccccgacacttatgcatgggcctcctcc

SEQ ID NO: 128143 - DNA, 35 bp, Artificial Sequence
  Synthetic oligonucleotide
tcctcaactgtcatgcagtggtttgtcctgtcctc

SEQ ID NO: 128144 - DNA, 35 bp, Artificial Sequence
  Synthetic oligonucleotide
aagatcaccctctgcactctacctaccgtcctacg

SEQ ID NO: 128145 - DNA, 33 bp, Artificial Sequence
  Synthetic oligonucleotide
acacgtggggggggggcagggatacggtttatg

SEQ ID NO: 128146 - DNA, 35 bp, Artificial Sequence
  Synthetic oligonucleotide
gcctccgtccgtcgacccctcatccctataccggt

SEQ ID NO: 128147 - DNA, 35 bp, Artificial Sequence
  Synthetic oligonucleotide
tccccccacctcgatggctttttgtaaacccaatt

SEQ ID NO: 128148 - DNA, 34 bp, Artificial Sequence
  Synthetic oligonucleotide
tagggcttgctgctgtagtaccacccgctccctt

SEQ ID NO: 128149 - DNA, 35 bp, Artificial Sequence
  Synthetic oligonucleotide
ttagcaccgacccatggcgactgcaccttccccaa

SEQ ID NO: 128150 - DNA, 35 bp, Artificial Sequence
  Synthetic oligonucleotide
atcacaccaatgcttattcaatctgccgcccacca

SEQ ID NO: 128151 - DNA, 37 bp, Artificial Sequence
  Synthetic oligonucleotide
actgacacaccactgccgccccggactcatcttccga

SEQ ID NO: 128152 - DNA, 38 bp, Artificial Sequence
  Synthetic oligonucleotide
gtaaagcacggagagagggggagagtggggtgaagtga

SEQ ID NO: 128153 - DNA, 35 bp, Artificial Sequence
  Synthetic oligonucleotide
acaccccttgccctctgactcggtgtcatggaccc

SEQ ID NO: 128154 - DNA, 35 bp, Artificial Sequence
  Synthetic oligonucleotide
accgcgaaaccgtcacggacttcctcacatcgccc

SEQ ID NO: 128155 - DNA, 35 bp, Artificial Sequence
  Synthetic oligonucleotide
atgcgtgcctcttgtcttaccatgtacgtttcgcc

SEQ ID NO: 128156 - DNA, 35 bp, Artificial Sequence
  Synthetic oligonucleotide
tcaaatcaccccggctgttaatcagttgcccttcc

SEQ ID NO: 128157 - DNA, 35 bp, Artificial Sequence
  Synthetic oligonucleotide
acatgtccctaagcctcccgtttgcctcccgtcgc

SEQ ID NO: 128158 - DNA, 35 bp, Artificial Sequence
  Synthetic oligonucleotide
tacctgcgcaccactcgctcctctcgattcgctag

SEQ ID NO: 128159 - DNA, 34 bp, Artificial Sequence
  Synthetic oligonucleotide
gtgcgtgggggggggattagggccgggatagtag

SEQ ID NO: 128160 - DNA, 35 bp, Artificial Sequence
  Synthetic oligonucleotide
tgcgcccctgacctctgcccatcctacgagaaacg

SEQ ID NO: 128161 - DNA, 35 bp, Artificial Sequence
  Synthetic oligonucleotide
gtcgcaatacaatctgttacacgtacctccctgtg

SEQ ID NO: 128162 - DNA, 35 bp, Artificial Sequence
  Synthetic oligonucleotide
aaaacacgccgtcctcaggcatccacgctcttcct

SEQ ID NO: 128163 - DNA, 35 bp, Artificial Sequence
  Synthetic oligonucleotide
tgtctccaccccgaccccgctgatgctttaccgct

SEQ ID NO: 128164 - DNA, 35 bp, Artificial Sequence
  Synthetic oligonucleotide
aactgtgccgtgtccctgtcccttgaacgctctct

SEQ ID NO: 128165 - DNA, 35 bp, Artificial Sequence
  Synthetic oligonucleotide
tacgcacgcagtgtcagccactccccctagcgtct

SEQ ID NO: 128166 - DNA, 34 bp, Artificial Sequence
  Synthetic oligonucleotide
gtgtaggccaggggaaggagggggatataggtgt

SEQ ID NO: 128167 - DNA, 36 bp, Artificial Sequence
  Synthetic oligonucleotide
acatagtccctgcttcctattgcccgtccctttcca

SEQ ID NO: 128168 - DNA, 37 bp, Artificial Sequence
  Synthetic oligonucleotide
gtccacctgtccgttcccttctcgcccgttcaaaaga

SEQ ID NO: 128169 - DNA, 37 bp, Artificial Sequence
  Synthetic oligonucleotide
tgaaaggatatggtggggtaaggggtggatggatcga

SEQ ID NO: 128170 - DNA, 37 bp, Artificial Sequence
  Synthetic oligonucleotide
agacaggccacaatggcgttcttctcactctcccgga

SEQ ID NO: 128171 - DNA, 35 bp, Artificial Sequence
  Synthetic oligonucleotide
accacgactccctatgcctttcctccagcctccac

SEQ ID NO: 128172 - DNA, 35 bp, Artificial Sequence
  Synthetic oligonucleotide
acacaccctgtcatcagcacaccagcccgcccgcc

SEQ ID NO: 128173 - DNA, 35 bp, Artificial Sequence
  Synthetic oligonucleotide
tccgccccttagtcccatcatgcggtacagttttc

SEQ ID NO: 128174 - DNA, 35 bp, Artificial Sequence
  Synthetic oligonucleotide
actccgcccgccaccgtcctgaagcctgttttgtt

SEQ ID NO: 128175 - DNA, 35 bp, Artificial Sequence
  Synthetic oligonucleotide
acaccacctcattactagtctcccttacagctcca

SEQ ID NO: 128176 - DNA, 37 bp, Artificial Sequence
  Synthetic oligonucleotide
ggtccaccggtcactggtttcggcccatctcccatga

SEQ ID NO: 128177 - DNA, 36 bp, Artificial Sequence
  Synthetic oligonucleotide
acaccaccctccaccatcggaacaggttatctgtga

SEQ ID NO: 128178 - DNA, 36 bp, Artificial Sequence
  Synthetic oligonucleotide
gacacccacccctcctgagcgtatctagatcagcta

SEQ ID NO: 128179 - DNA, 36 bp, Artificial Sequence
  Synthetic oligonucleotide
tccctacgcctccttgattctggcatttagccatta

SEQ ID NO: 128180 - DNA, 36 bp, Artificial Sequence
  Synthetic oligonucleotide
tacgtactcccaccgtccattgctcggcacccctta

SEQ ID NO: 128181 - DNA, 35 bp, Artificial Sequence
  Synthetic oligonucleotide
ttcgagcacgggcccttcttttacgaccgcactcc

SEQ ID NO: 128182 - DNA, 35 bp, Artificial Sequence
  Synthetic oligonucleotide
acttgtcgccgttaacggtcgtggtccccctttcc

SEQ ID NO: 128183 - DNA, 34 bp, Artificial Sequence
  Synthetic oligonucleotide
gaagctctcgtccgttccgccttttgcccactgc

SEQ ID NO: 128184 - DNA, 35 bp, Artificial Sequence
  Synthetic oligonucleotide
gacaggttacgtgcgctactctgccccattcctgc

SEQ ID NO: 128185 - DNA, 35 bp, Artificial Sequence
  Synthetic oligonucleotide
tccagcactttagcaccttcgcctgcctcttgatc

SEQ ID NO: 128186 - DNA, 35 bp, Artificial Sequence
  Synthetic oligonucleotide
acgtgtgcccgtccctctcgctttgctatgcattc

SEQ ID NO: 128187 - DNA, 35 bp, Artificial Sequence
  Synthetic oligonucleotide
gcatccctcccggttctttaggccttactggtact

SEQ ID NO: 128188 - DNA, 35 bp, Artificial Sequence
  Synthetic oligonucleotide
gaagaaatgccggaggggggaaaaggggggttact

SEQ ID NO: 128189 - DNA, 35 bp, Artificial Sequence
  Synthetic oligonucleotide
accatagccccgctgctgctcactccgttcgtcct

SEQ ID NO: 128190 - DNA, 36 bp, Artificial Sequence
  Synthetic oligonucleotide
gtgcgacctggacagcgtgttatgtccccccgccaa

SEQ ID NO: 128191 - DNA, 34 bp, Artificial Sequence
  Synthetic oligonucleotide
gcattgctcactgtcctcccccgggtttgttgca

SEQ ID NO: 128192 - DNA, 36 bp, Artificial Sequence
  Synthetic oligonucleotide
accctccaccactgtactgttagcctttttccacga

SEQ ID NO: 128193 - DNA, 35 bp, Artificial Sequence
  Synthetic oligonucleotide
gcccattcactgctacgaccggttttcaagccccc

SEQ ID NO: 128194 - DNA, 35 bp, Artificial Sequence
  Synthetic oligonucleotide
ggtaccagccactgccgtgccgtaactattccgcc

SEQ ID NO: 128195 - DNA, 35 bp, Artificial Sequence
  Synthetic oligonucleotide
atagctgggccttagcgttcatcaacacctcccgc

SEQ ID NO: 128196 - DNA, 35 bp, Artificial Sequence
  Synthetic oligonucleotide
ataggccccctgtgctcgcttgcctcgttaccatc

SEQ ID NO: 128197 - DNA, 35 bp, Artificial Sequence
  Synthetic oligonucleotide
gtacctccgccgtgagtctacgtcccatttttttg

SEQ ID NO: 128198 - DNA, 35 bp, Artificial Sequence
  Synthetic oligonucleotide
gtcgcacccgttattgcctatagccgctcctccat

SEQ ID NO: 128199 - DNA, 35 bp, Artificial Sequence
  Synthetic oligonucleotide
ataccccactccgcccttgttttagatcatgaggt

SEQ ID NO: 128200 - DNA, 35 bp, Artificial Sequence
  Synthetic oligonucleotide
gtactcggcccattcttgtttcgcgttccaccctt

SEQ ID NO: 128201 - DNA, 35 bp, Artificial Sequence
  Synthetic oligonucleotide
gtgatgtccctctgcttatatgcgcattccttttt

SEQ ID NO: 128202 - DNA, 36 bp, Artificial Sequence
  Synthetic oligonucleotide
tccccggcatccctacgctggccgagcccttcccca

SEQ ID NO: 128203 - DNA, 35 bp, Artificial Sequence
  Synthetic oligonucleotide
gagtcaagccattagttgctcttctgcccttttca

SEQ ID NO: 128204 - DNA, 37 bp, Artificial Sequence
  Synthetic oligonucleotide
tccgggggagggcatggggagggcgggagaaatcaga

SEQ ID NO: 128205 - DNA, 36 bp, Artificial Sequence
  Synthetic oligonucleotide
tatgccctccgactcttcccctggagccttgttaga

SEQ ID NO: 128206 - DNA, 37 bp, Artificial Sequence
  Synthetic oligonucleotide
gacctccgtccgccttgttagtgtccccacgtcccga

SEQ ID NO: 128207 - DNA, 37 bp, Artificial Sequence
  Synthetic oligonucleotide
tccacccctcgctaatcggttttttctgctccacgga

SEQ ID NO: 128208 - DNA, 38 bp, Artificial Sequence
  Synthetic oligonucleotide
accacggcacatacttcctgcaccgcccaccacgctga

SEQ ID NO: 128209 - DNA, 37 bp, Artificial Sequence
  Synthetic oligonucleotide
acttcccacccacatcaagcacgtccgcttagcgtga

SEQ ID NO: 128210 - DNA, 38 bp, Artificial Sequence
  Synthetic oligonucleotide
gcggggaaggcagggcggggcataggatggacgggtga

SEQ ID NO: 128211 - DNA, 35 bp, Artificial Sequence
  Synthetic oligonucleotide
tactccgcccgctgaaacatgccacccttacggta

SEQ ID NO: 128212 - DNA, 35 bp, Artificial Sequence
  Synthetic oligonucleotide
gtgccatcgcacgtccgccactcctgccacactta

SEQ ID NO: 128213 - DNA, 35 bp, Artificial Sequence
  Synthetic oligonucleotide
gctacagacctcaccatgctacctaccgaccttta

SEQ ID NO: 128214 - DNA, 35 bp, Artificial Sequence
  Synthetic oligonucleotide
gcccacggcagtatcacaacgcgcgctgttccatc

SEQ ID NO: 128215 - DNA, 35 bp, Artificial Sequence
  Synthetic oligonucleotide
tatgggacgggcggagggacaatgaagagctagtg

SEQ ID NO: 128216 - DNA, 35 bp, Artificial Sequence
  Synthetic oligonucleotide
atctcggtccccccctgtaaccttgccagttgcct

SEQ ID NO: 128217 - DNA, 35 bp, Artificial Sequence
  Synthetic oligonucleotide
tcatgtccgacgccgttacgtattcatctttcctt

SEQ ID NO: 128218 - DNA, 35 bp, Artificial Sequence
  Synthetic oligonucleotide
ttaccagtgtgtcgctcgtctgccccatccccgtt

SEQ ID NO: 128219 - DNA, 33 bp, Artificial Sequence
  Synthetic oligonucleotide
gtcatccgcggaataccgcccctgcacttctca

SEQ ID NO: 128220 - DNA, 36 bp, Artificial Sequence
  Synthetic oligonucleotide
tagggacaccccgcagccgccttccatctttcgtca

SEQ ID NO: 128221 - DNA, 37 bp, Artificial Sequence
  Synthetic oligonucleotide
actcctccaccgctgcctttcgatccacttcagacga

SEQ ID NO: 128222 - DNA, 35 bp, Artificial Sequence
  Synthetic oligonucleotide
gacaccttctgccttttgtgggcgcttatccccga

SEQ ID NO: 128223 - DNA, 37 bp, Artificial Sequence
  Synthetic oligonucleotide
tccatcccgttgagtaccctgacccgcgactccccga

SEQ ID NO: 128224 - DNA, 38 bp, Artificial Sequence
  Synthetic oligonucleotide
aacgctcgctccatccgcacctgacccgctcctattga

SEQ ID NO: 128225 - DNA, 35 bp, Artificial Sequence
  Synthetic oligonucleotide
ttgcctcacacggccgccaattaccccgccctgta

SEQ ID NO: 128226 - DNA, 35 bp, Artificial Sequence
  Synthetic oligonucleotide
tagtacccgtcctgcctgtccccatccgttttgcc

SEQ ID NO: 128227 - DNA, 35 bp, Artificial Sequence
  Synthetic oligonucleotide
tgcgcgcccacgcactgattcacaccctcgtctgc

SEQ ID NO: 128228 - DNA, 35 bp, Artificial Sequence
  Synthetic oligonucleotide
gtcacccacatcgattgcgattacaactatccatc

SEQ ID NO: 128229 - DNA, 35 bp, Artificial Sequence
  Synthetic oligonucleotide
ggtccgcccatactggttcgttatctctggtcttc

SEQ ID NO: 128230 - DNA, 35 bp, Artificial Sequence
  Synthetic oligonucleotide
tcgtgatgtcacgggaatggggggctgggtggagg

SEQ ID NO: 128231 - DNA, 35 bp, Artificial Sequence
  Synthetic oligonucleotide
ttgatagagggtgggggggcggagattacaatggg

SEQ ID NO: 128232 - DNA, 35 bp, Artificial Sequence
  Synthetic oligonucleotide
accactgctcgctcgccgctttttcctatactctg

SEQ ID NO: 128233 - DNA, 35 bp, Artificial Sequence
  Synthetic oligonucleotide
ttgcgccgcagaactgttcgcacagtctctcccct

SEQ ID NO: 128234 - DNA, 36 bp, Artificial Sequence
  Synthetic oligonucleotide
tacgtggtgggcgggtacggggacggaatgatggaa

SEQ ID NO: 128235 - DNA, 36 bp, Artificial Sequence
  Synthetic oligonucleotide
tcgcggccctgacccctgcgccttcttccacgctca

SEQ ID NO: 128236 - DNA, 37 bp, Artificial Sequence
  Synthetic oligonucleotide
gagaaggggggggtggcgtggagcagtgactgtcaga

SEQ ID NO: 128237 - DNA, 37 bp, Artificial Sequence
  Synthetic oligonucleotide
aagagaaggcgaggcaacgagaggacggggagggcga

SEQ ID NO: 128238 - DNA, 37 bp, Artificial Sequence
  Synthetic oligonucleotide
tgacgacaccgcccacccgttcctgccatacccggga

SEQ ID NO: 128239 - DNA, 35 bp, Artificial Sequence
  Synthetic oligonucleotide
gaggggtgggagggatctatagcctagcatgggga

SEQ ID NO: 128240 - DNA, 38 bp, Artificial Sequence
  Synthetic oligonucleotide
acattccgcccctttcgtggaacacttcccccccgtga

SEQ ID NO: 128241 - DNA, 38 bp, Artificial Sequence
  Synthetic oligonucleotide
gtgtgcgcttgtgcctgtccctccctctttccgcgtga

SEQ ID NO: 128242 - DNA, 37 bp, Artificial Sequence
  Synthetic oligonucleotide
tcccttcccacgccgtacccagtctcgctctgtgtga

SEQ ID NO: 128243 - DNA, 38 bp, Artificial Sequence
  Synthetic oligonucleotide
gaccggtccccctgctcctcgactgccctatactttga

SEQ ID NO: 128244 - DNA, 35 bp, Artificial Sequence
  Synthetic oligonucleotide
tcaccgcccgcctccacctgaatactgctaacccc

SEQ ID NO: 128245 - DNA, 35 bp, Artificial Sequence
  Synthetic oligonucleotide
gtggggtggggggtcacacacgggggttatcgccc

SEQ ID NO: 128246 - DNA, 35 bp, Artificial Sequence
  Synthetic oligonucleotide
acacactccgtgctccatcgccccctaggttatcc

SEQ ID NO: 128247 - DNA, 35 bp, Artificial Sequence
  Synthetic oligonucleotide
ggactcccactgctactacgcagccacccatctcc

SEQ ID NO: 128248 - DNA, 34 bp, Artificial Sequence
  Synthetic oligonucleotide
ggagcacctacactgctagtgatatccttgcctc

SEQ ID NO: 128249 - DNA, 35 bp, Artificial Sequence
  Synthetic oligonucleotide
gccgatgtcattttccacacccccgctccgccgcg

SEQ ID NO: 128250 - DNA, 35 bp, Artificial Sequence
  Synthetic oligonucleotide
gccatgtgccttattgtttttgtttcctaccttcg

SEQ ID NO: 128251 - DNA, 35 bp, Artificial Sequence
  Synthetic oligonucleotide
acgctcctctgaccctttgcccaccgtgcctagtg

SEQ ID NO: 128252 - DNA, 35 bp, Artificial Sequence
  Synthetic oligonucleotide
gcatcgccatcatcgcagcgagccattcccgccat

SEQ ID NO: 128253 - DNA, 35 bp, Artificial Sequence
  Synthetic oligonucleotide
tccccctcggtcgggtgggcttgtagggtggggat

SEQ ID NO: 128254 - DNA, 35 bp, Artificial Sequence
  Synthetic oligonucleotide
tcacctcttacgtcacttcgcatagaacctcccct

SEQ ID NO: 128255 - DNA, 35 bp, Artificial Sequence
  Synthetic oligonucleotide
agccgtgcgcaggtttctaggtccatgtctcccgt

SEQ ID NO: 128256 - DNA, 35 bp, Artificial Sequence
  Synthetic oligonucleotide
tccgtgctgtctgccttttgtttctccgctttggt

SEQ ID NO: 128257 - DNA, 35 bp, Artificial Sequence
  Synthetic oligonucleotide
agtcgcgcatagcctatttgcctccatcacactgt

SEQ ID NO: 128258 - DNA, 35 bp, Artificial Sequence
  Synthetic oligonucleotide
atgacactcccagccatcccatacggagccccgca

SEQ ID NO: 128259 - DNA, 38 bp, Artificial Sequence
  Synthetic oligonucleotide
ggtacgggcagagggaaagcaaggaagggggagtgtga

SEQ ID NO: 128260 - DNA, 35 bp, Artificial Sequence
  Synthetic oligonucleotide
gccacctctgcctggccccgtgctcgggtatgccc

SEQ ID NO: 128261 - DNA, 35 bp, Artificial Sequence
  Synthetic oligonucleotide
ttcgtccggccccgtccttccatcgctctttgccc

SEQ ID NO: 128262 - DNA, 35 bp, Artificial Sequence
  Synthetic oligonucleotide
acatcgcggcccacccttgacccggtccacttacg

SEQ ID NO: 128263 - DNA, 35 bp, Artificial Sequence
  Synthetic oligonucleotide
tccccgcccgcctcaatccgcccaatctttcggcg

SEQ ID NO: 128264 - DNA, 35 bp, Artificial Sequence
  Synthetic oligonucleotide
tagacatcacaggtcgctcgatccaccttttcctg

SEQ ID NO: 128265 - DNA, 35 bp, Artificial Sequence
  Synthetic oligonucleotide
gccccaccacgctctatggcggtctccgctcccgt

SEQ ID NO: 128266 - DNA, 32 bp, Artificial Sequence
  Synthetic oligonucleotide
accccgccatcaattgcactgcaccgtgaaca

SEQ ID NO: 128267 - DNA, 36 bp, Artificial Sequence
  Synthetic oligonucleotide
tcgcccacgcccttctgatccgtcatcttagctaca

SEQ ID NO: 128268 - DNA, 36 bp, Artificial Sequence
  Synthetic oligonucleotide
tgacgcccagccattagccttcccgtacactttaca

SEQ ID NO: 128269 - DNA, 35 bp, Artificial Sequence
  Synthetic oligonucleotide
tccctcaccatcaacacttcgcgcgtgctgttcca

SEQ ID NO: 128270 - DNA, 36 bp, Artificial Sequence
  Synthetic oligonucleotide
tcacactccgctcgttgtatctagtcccactgctca

SEQ ID NO: 128271 - DNA, 36 bp, Artificial Sequence
  Synthetic oligonucleotide
gtagacaggggagaacgggtacggaggggcctcaga

SEQ ID NO: 128272 - DNA, 36 bp, Artificial Sequence
  Synthetic oligonucleotide
tagcggagtggggaagcaagcggggcgggggtgaga

SEQ ID NO: 128273 - DNA, 37 bp, Artificial Sequence
  Synthetic oligonucleotide
gacgagggccgggtgagggcgggtagagtcgcaatga

SEQ ID NO: 128274 - DNA, 37 bp, Artificial Sequence
  Synthetic oligonucleotide
tgagccccgcccattatcgttattaacttgctcctga

SEQ ID NO: 128275 - DNA, 38 bp, Artificial Sequence
  Synthetic oligonucleotide
ggggtcagaggggggtgtagatggggcggggaatctga

SEQ ID NO: 128276 - DNA, 35 bp, Artificial Sequence
  Synthetic oligonucleotide
tctatcaccgctccccgacctccgcacgtaccaac

SEQ ID NO: 128277 - DNA, 35 bp, Artificial Sequence
  Synthetic oligonucleotide
atgctatggcgcgggccggcttccactgttccccc

SEQ ID NO: 128278 - DNA, 35 bp, Artificial Sequence
  Synthetic oligonucleotide
gcatacacagcccacgcccgttttctgtcctagcc

SEQ ID NO: 128279 - DNA, 35 bp, Artificial Sequence
  Synthetic oligonucleotide
tagtcccgccggtgcgtcatccggccttttaatcc

SEQ ID NO: 128280 - DNA, 35 bp, Artificial Sequence
  Synthetic oligonucleotide
ttccaccctccacagagttccgtacgaagtatctc

SEQ ID NO: 128281 - DNA, 35 bp, Artificial Sequence
  Synthetic oligonucleotide
ttgccccgcccacggttcgttatgccccgtttctc

SEQ ID NO: 128282 - DNA, 35 bp, Artificial Sequence
  Synthetic oligonucleotide
aacctgtttgccacgcctgtcccccgccacttgtc

SEQ ID NO: 128283 - DNA, 35 bp, Artificial Sequence
  Synthetic oligonucleotide
tctccccgcccgaacgggttcctcatgaacatttc

SEQ ID NO: 128284 - DNA, 35 bp, Artificial Sequence
  Synthetic oligonucleotide
aatgaagccaccccagctctgttccttcaactttc

SEQ ID NO: 128285 - DNA, 35 bp, Artificial Sequence
  Synthetic oligonucleotide
tattacgcccatcgtgaactagcacctcccctaag

SEQ ID NO: 128286 - DNA, 35 bp, Artificial Sequence
  Synthetic oligonucleotide
gacctgccgcccacacttttacccgatctacaccg

SEQ ID NO: 128287 - DNA, 35 bp, Artificial Sequence
  Synthetic oligonucleotide
gcgcaaccccgcccagctacgctacgacccaccgg

SEQ ID NO: 128288 - DNA, 35 bp, Artificial Sequence
  Synthetic oligonucleotide
tcagcccctgcccttctcagtccgacccatgatat

SEQ ID NO: 128289 - DNA, 35 bp, Artificial Sequence
  Synthetic oligonucleotide
tctgaccaatgcctgtgcttctccacgttacactt

SEQ ID NO: 128290 - DNA, 36 bp, Artificial Sequence
  Synthetic oligonucleotide
taccccttgtcccgctccagccacattcgacccgaa

SEQ ID NO: 128291 - DNA, 36 bp, Artificial Sequence
  Synthetic oligonucleotide
tacggggggaagggggccaaaaggacagtacgggaa

SEQ ID NO: 128292 - DNA, 36 bp, Artificial Sequence
  Synthetic oligonucleotide
tgctaggtactggtcgtctccccgtcactcttccca

SEQ ID NO: 128293 - DNA, 35 bp, Artificial Sequence
  Synthetic oligonucleotide
gtgcgcccctcacggctaatactgacctggatcca

SEQ ID NO: 128294 - DNA, 37 bp, Artificial Sequence
  Synthetic oligonucleotide
agaggagagggggggggtgtatgcgtaagacggcgga

SEQ ID NO: 128295 - DNA, 35 bp, Artificial Sequence
  Synthetic oligonucleotide
gggcggggtccttggggtatcgctccttaggggga

SEQ ID NO: 128296 - DNA, 37 bp, Artificial Sequence
  Synthetic oligonucleotide
acaccgtgccccatccgcatttacgtttgcccctgga

SEQ ID NO: 128297 - DNA, 38 bp, Artificial Sequence
  Synthetic oligonucleotide
gtcactcccaacgggtctatgaactccacccccgctga

SEQ ID NO: 128298 - DNA, 35 bp, Artificial Sequence
  Synthetic oligonucleotide
tgctcctgcccgttaatatgccccaacacctctga

SEQ ID NO: 128299 - DNA, 37 bp, Artificial Sequence
  Synthetic oligonucleotide
tcacgtcgcccgctcctgtttataccattctcgttga

SEQ ID NO: 128300 - DNA, 35 bp, Artificial Sequence
  Synthetic oligonucleotide
gacacggtatgtgaccggccccccccatccgcacc

SEQ ID NO: 128301 - DNA, 36 bp, Artificial Sequence
  Synthetic oligonucleotide
gtgtccgcccgtaatgcgcctccctcaccgaaatcc

SEQ ID NO: 128302 - DNA, 35 bp, Artificial Sequence
  Synthetic oligonucleotide
atcgtactcactgtctgccgtagtacctaccttcc

SEQ ID NO: 128303 - DNA, 35 bp, Artificial Sequence
  Synthetic oligonucleotide
tcatccccgcggttctggacccggcttcgccccgc

SEQ ID NO: 128304 - DNA, 35 bp, Artificial Sequence
  Synthetic oligonucleotide
tccatccgcgtctattaggcttctcgtcgtccatc

SEQ ID NO: 128305 - DNA, 35 bp, Artificial Sequence
  Synthetic oligonucleotide
tcccgaaccgcctccccggtccaacagagatactc

SEQ ID NO: 128306 - DNA, 35 bp, Artificial Sequence
  Synthetic oligonucleotide
agcatggtgcctgtttgccgatccctcacgtattc

SEQ ID NO: 128307 - DNA, 35 bp, Artificial Sequence
  Synthetic oligonucleotide
tgccccactggctcactcctcttcttaccgcctgg

SEQ ID NO: 128308 - DNA, 35 bp, Artificial Sequence
  Synthetic oligonucleotide
gcccaccgcccccatctgcttttcgattgactctg

SEQ ID NO: 128309 - DNA, 35 bp, Artificial Sequence
  Synthetic oligonucleotide
aagtccaccctccatgctttaagaaacttagtgat

SEQ ID NO: 128310 - DNA, 35 bp, Artificial Sequence
  Synthetic oligonucleotide
tgctctgcctccgccggtactgcatttattactct

SEQ ID NO: 128311 - DNA, 35 bp, Artificial Sequence
  Synthetic oligonucleotide
atcctcgcgcgctgtccccggcactttgtcccctt

SEQ ID NO: 128312 - DNA, 25 bp, Artificial Sequence
  Synthetic oligonucleotide
gtaaccccgctaccattgaacccca

SEQ ID NO: 128313 - DNA, 36 bp, Artificial Sequence
  Synthetic oligonucleotide
tctggtcgccctcttaattcctccaggtctgttcca

SEQ ID NO: 128314 - DNA, 37 bp, Artificial Sequence
  Synthetic oligonucleotide
aaccgccaccatcgcgcgtcaccctcttcttaccaga

SEQ ID NO: 128315 - DNA, 37 bp, Artificial Sequence
  Synthetic oligonucleotide
ggaacgggaggggaacaggggttattgtgtatgggga

SEQ ID NO: 128316 - DNA, 37 bp, Artificial Sequence
  Synthetic oligonucleotide
tgaccgactggattgacacctcccgccgcttccctga

SEQ ID NO: 128317 - DNA, 36 bp, Artificial Sequence
  Synthetic oligonucleotide
tgacgacaggaggggagctgagcgaggggggggtga

SEQ ID NO: 128318 - DNA, 36 bp, Artificial Sequence
  Synthetic oligonucleotide
ggatggaccagcgagggaaaggggagtaggggaata

SEQ ID NO: 128319 - DNA, 35 bp, Artificial Sequence
  Synthetic oligonucleotide
tcacgcacccgtctttggctgcttttcctttgcta

SEQ ID NO: 128320 - DNA, 35 bp, Artificial Sequence
  Synthetic oligonucleotide
acgccctacccccctcccgacgcgtggcccatgta

SEQ ID NO: 128321 - DNA, 35 bp, Artificial Sequence
  Synthetic oligonucleotide
actgagcttgcatctggcccgcctttccactgccc

SEQ ID NO: 128322 - DNA, 36 bp, Artificial Sequence
  Synthetic oligonucleotide
tccgccagatgggactcttccctgttcatagctccc

SEQ ID NO: 128323 - DNA, 35 bp, Artificial Sequence
  Synthetic oligonucleotide
accgcgctcttctgcgtgtcctcaccctatttgcc

SEQ ID NO: 128324 - DNA, 35 bp, Artificial Sequence
  Synthetic oligonucleotide
tagcacccctacgcgcgtaaaaccctgccctgtcc

SEQ ID NO: 128325 - DNA, 35 bp, Artificial Sequence
  Synthetic oligonucleotide
taatgcctcgttgtgcgccgccccatctatacttc

SEQ ID NO: 128326 - DNA, 35 bp, Artificial Sequence
  Synthetic oligonucleotide
aacgcagtatcgatccgcattagtccctcttgttc

SEQ ID NO: 128327 - DNA, 35 bp, Artificial Sequence
  Synthetic oligonucleotide
gcattgcatatgcgcaacttcaagctccaccttcg

SEQ ID NO: 128328 - DNA, 35 bp, Artificial Sequence
  Synthetic oligonucleotide
tgcccagatgggcgttcctgtccgattaccccctg

SEQ ID NO: 128329 - DNA, 35 bp, Artificial Sequence
  Synthetic oligonucleotide
tacgccgggggggagggatgacaggggttagacat

SEQ ID NO: 128330 - DNA, 35 bp, Artificial Sequence
  Synthetic oligonucleotide
tctcatcgcagccgatccgcgacctttatgcccat

SEQ ID NO: 128331 - DNA, 35 bp, Artificial Sequence
  Synthetic oligonucleotide
accacccaccccaagcgtttgcgtccgcttggcct

SEQ ID NO: 128332 - DNA, 35 bp, Artificial Sequence
  Synthetic oligonucleotide
atcgcgtgttgtctgttccttccttccggccctct

SEQ ID NO: 128333 - DNA, 34 bp, Artificial Sequence
  Synthetic oligonucleotide
tgtcaagccccttacacctactcactgtccttgt

SEQ ID NO: 128334 - DNA, 36 bp, Artificial Sequence
  Synthetic oligonucleotide
attgcaagcccgctagccccctccgcccactgcaca

SEQ ID NO: 128335 - DNA, 37 bp, Artificial Sequence
  Synthetic oligonucleotide
gagagggacgggaagaggggctaagtggaatgcgaga

SEQ ID NO: 128336 - DNA, 36 bp, Artificial Sequence
  Synthetic oligonucleotide
atcaacccacatctcgccctgtcctctcaatctgga

SEQ ID NO: 128337 - DNA, 38 bp, Artificial Sequence
  Synthetic oligonucleotide
atcacctcgcttctctcatctgcctgctccctgactga

SEQ ID NO: 128338 - DNA, 38 bp, Artificial Sequence
  Synthetic oligonucleotide
ttccagccacacacctgctaccgctctccaagccttga

SEQ ID NO: 128339 - DNA, 36 bp, Artificial Sequence
  Synthetic oligonucleotide
tccccccggaggaccgttatcttccctgccctggta

SEQ ID NO: 128340 - DNA, 35 bp, Artificial Sequence
  Synthetic oligonucleotide
ttacagctccaacatgctctcatcccctttggccc

SEQ ID NO: 128341 - DNA, 35 bp, Artificial Sequence
  Synthetic oligonucleotide
tgacgaagcgacttaagtctgtctgtcccgcctcc

SEQ ID NO: 128342 - DNA, 35 bp, Artificial Sequence
  Synthetic oligonucleotide
acaggtgctccactgccatcgcctcgtacccatgc

SEQ ID NO: 128343 - DNA, 35 bp, Artificial Sequence
  Synthetic oligonucleotide
gcatgcctctttcctgtcctagtcccgtaatctcg

SEQ ID NO: 128344 - DNA, 35 bp, Artificial Sequence
  Synthetic oligonucleotide
tgtgccccccaccgtgacggttcatacgcctcttg

SEQ ID NO: 128345 - DNA, 35 bp, Artificial Sequence
  Synthetic oligonucleotide
taggtcccctccgcctggcaagaagcccataccat

SEQ ID NO: 128346 - DNA, 35 bp, Artificial Sequence
  Synthetic oligonucleotide
gtgtagtcaggagggggggaggcgggaattcgttt

SEQ ID NO: 128347 - DNA, 36 bp, Artificial Sequence
  Synthetic oligonucleotide
tcccctatgcccccacatgtatcacaccacctgcaa

SEQ ID NO: 128348 - DNA, 36 bp, Artificial Sequence
  Synthetic oligonucleotide
tgaccaccgcccctacggtgccattccactctcaca

SEQ ID NO: 128349 - DNA, 36 bp, Artificial Sequence
  Synthetic oligonucleotide
accgccccctgcgttagtgcactgcccttgcttaca

SEQ ID NO: 128350 - DNA, 36 bp, Artificial Sequence
  Synthetic oligonucleotide
tactacacctcgtttggaccgacacactgtgcccca

SEQ ID NO: 128351 - DNA, 35 bp, Artificial Sequence
  Synthetic oligonucleotide
tgtagtgcagtcatccaccctgccgtatcctcgca

SEQ ID NO: 128352 - DNA, 37 bp, Artificial Sequence
  Synthetic oligonucleotide
gtaatcctcccacctgtgttctgctccacctctggga

SEQ ID NO: 128353 - DNA, 37 bp, Artificial Sequence
  Synthetic oligonucleotide
ccccggccctctgctgccatcactaatttcgctatga

SEQ ID NO: 128354 - DNA, 38 bp, Artificial Sequence
  Synthetic oligonucleotide
gcctcgccacatgccgcctccaccgttcaacgctttga

SEQ ID NO: 128355 - DNA, 35 bp, Artificial Sequence
  Synthetic oligonucleotide
ttgacagccgacccgacgttccgtttccgcctaac

SEQ ID NO: 128356 - DNA, 35 bp, Artificial Sequence
  Synthetic oligonucleotide
atgtgccctcccacgtgcccgcgcttggctttcac

SEQ ID NO: 128357 - DNA, 35 bp, Artificial Sequence
  Synthetic oligonucleotide
tgccagaagtcggtccgttcctccgttatttcacc

SEQ ID NO: 128358 - DNA, 30 bp, Artificial Sequence
  Synthetic oligonucleotide
aacaccgaccgaccccggccctgctccgcc

SEQ ID NO: 128359 - DNA, 35 bp, Artificial Sequence
  Synthetic oligonucleotide
gacgccgttcgatctccccccaaaggcccgtgttc

SEQ ID NO: 128360 - DNA, 35 bp, Artificial Sequence
  Synthetic oligonucleotide
tggtcgtccattctgccatagtttccacctccgcg

SEQ ID NO: 128361 - DNA, 35 bp, Artificial Sequence
  Synthetic oligonucleotide
tttgtacccgtccgcttctgctacttcccttatgg

SEQ ID NO: 128362 - DNA, 35 bp, Artificial Sequence
  Synthetic oligonucleotide
gaaagcccgctgtccagtcctgctgcccatattct

SEQ ID NO: 128363 - DNA, 35 bp, Artificial Sequence
  Synthetic oligonucleotide
acgcccggctctctgcctgctactgctagttcctt

SEQ ID NO: 128364 - DNA, 35 bp, Artificial Sequence
  Synthetic oligonucleotide
tgttcaccgctcgtccgccgcttattgcttcgcca

SEQ ID NO: 128365 - DNA, 37 bp, Artificial Sequence
  Synthetic oligonucleotide
attggtccgcctcccactgaacctgttgcacctccga

SEQ ID NO: 128366 - DNA, 35 bp, Artificial Sequence
  Synthetic oligonucleotide
gaaaatggtgggccggggggtgagggataagtgac

SEQ ID NO: 128367 - DNA, 35 bp, Artificial Sequence
  Synthetic oligonucleotide
gtccctgtcccgcttggctatacttccgcttatac

SEQ ID NO: 128368 - DNA, 35 bp, Artificial Sequence
  Synthetic oligonucleotide
gttgggtgggacgggcacaaaattagggttatacc

SEQ ID NO: 128369 - DNA, 35 bp, Artificial Sequence
  Synthetic oligonucleotide
tggggtcgccactccccacggttttttgtctcgcc

SEQ ID NO: 128370 - DNA, 35 bp, Artificial Sequence
  Synthetic oligonucleotide
tgttccacccccctagcagcatggtgcctgtgctc

SEQ ID NO: 128371 - DNA, 35 bp, Artificial Sequence
  Synthetic oligonucleotide
taaccacggcatggcgtctaccgatcacctctccg

SEQ ID NO: 128372 - DNA, 35 bp, Artificial Sequence
  Synthetic oligonucleotide
gatgagggtgatggtgtgtgggtgggccaaagggg

SEQ ID NO: 128373 - DNA, 35 bp, Artificial Sequence
  Synthetic oligonucleotide
agacaaccccgttccctgcccgagatacctccatg

SEQ ID NO: 128374 - DNA, 35 bp, Artificial Sequence
  Synthetic oligonucleotide
tccctccaagccgacgcgtgcgtgctcctgcccct

SEQ ID NO: 128375 - DNA, 35 bp, Artificial Sequence
  Synthetic oligonucleotide
gcgctccactgtaactaccatctccccgcggtgct

SEQ ID NO: 128376 - DNA, 35 bp, Artificial Sequence
  Synthetic oligonucleotide
tgtaaccttgccgcccgcctttcacttagagatct

SEQ ID NO: 128377 - DNA, 35 bp, Artificial Sequence
  Synthetic oligonucleotide
ttgagcgctgccgtttggtcttttcctggttttct

SEQ ID NO: 128378 - DNA, 35 bp, Artificial Sequence
  Synthetic oligonucleotide
tatccgccgcccccatacacatgtgctgtgcgttt

SEQ ID NO: 128379 - DNA, 36 bp, Artificial Sequence
  Synthetic oligonucleotide
accctcgccagtatctgttcatctaccgctatccca

SEQ ID NO: 128380 - DNA, 37 bp, Artificial Sequence
  Synthetic oligonucleotide
taggacgagggagggaggggtacgtctggtcagggga

SEQ ID NO: 128381 - DNA, 38 bp, Artificial Sequence
  Synthetic oligonucleotide
acccgccatccatcactttaccccgccctcgacggtga

SEQ ID NO: 128382 - DNA, 37 bp, Artificial Sequence
  Synthetic oligonucleotide
gagggcgggggacctggtggggcgggggtgactgtga

SEQ ID NO: 128383 - DNA, 35 bp, Artificial Sequence
  Synthetic oligonucleotide
acattcaccgctcgccatggtttcgtgcgaactac

SEQ ID NO: 128384 - DNA, 35 bp, Artificial Sequence
  Synthetic oligonucleotide
tcaaagctcataatatccgtaagccgccctgtccc

SEQ ID NO: 128385 - DNA, 35 bp, Artificial Sequence
  Synthetic oligonucleotide
actaccatcatgatatctgcgcctcgattttcatc

SEQ ID NO: 128386 - DNA, 35 bp, Artificial Sequence
  Synthetic oligonucleotide
gtgtcggggcccgccctgcttgaattgtacccttc

SEQ ID NO: 128387 - DNA, 35 bp, Artificial Sequence
  Synthetic oligonucleotide
acacatggtgccgggctcttcgtccctcctccttc

SEQ ID NO: 128388 - DNA, 35 bp, Artificial Sequence
  Synthetic oligonucleotide
tcccacctctccactgatatgtccgggcttaaaat

SEQ ID NO: 128389 - DNA, 36 bp, Artificial Sequence
  Synthetic oligonucleotide
ttgccgtaggttgcgtctttcttctgccgtttctat

SEQ ID NO: 128390 - DNA, 35 bp, Artificial Sequence
  Synthetic oligonucleotide
tcaccccgccctgggaatactgaaaaattgcccct

SEQ ID NO: 128391 - DNA, 36 bp, Artificial Sequence
  Synthetic oligonucleotide
gtcacgcgctatgtatgttctgcctccttcccatca

SEQ ID NO: 128392 - DNA, 37 bp, Artificial Sequence
  Synthetic oligonucleotide
gtccaatccgccacataggtgctctccgtctcttcga

SEQ ID NO: 128393 - DNA, 37 bp, Artificial Sequence
  Synthetic oligonucleotide
gatggcaccccgccgatctcatcctttcatccctgga

SEQ ID NO: 128394 - DNA, 37 bp, Artificial Sequence
  Synthetic oligonucleotide
gaggagggtgggcggggaaggatcaattaactaatga

SEQ ID NO: 128395 - DNA, 38 bp, Artificial Sequence
  Synthetic oligonucleotide
atttcggcaatgtgtaccttcccccgtcccgctcctga

SEQ ID NO: 128396 - DNA, 36 bp, Artificial Sequence
  Synthetic oligonucleotide
gcgccccccagctcctccgctcccgtggtgattcta

SEQ ID NO: 128397 - DNA, 36 bp, Artificial Sequence
  Synthetic oligonucleotide
tgtggtccatctgccgcgttaacacaatcctctgta

SEQ ID NO: 128398 - DNA, 35 bp, Artificial Sequence
  Synthetic oligonucleotide
acctccgcctcattctaagtcactttccgcgccac

SEQ ID NO: 128399 - DNA, 35 bp, Artificial Sequence
  Synthetic oligonucleotide
tccacgcctctcgattggcccgcctatatgtccac

SEQ ID NO: 128400 - DNA, 35 bp, Artificial Sequence
  Synthetic oligonucleotide
atgccccccccatccgattgtccggactatacccc

SEQ ID NO: 128401 - DNA, 35 bp, Artificial Sequence
  Synthetic oligonucleotide
actccacaccctcattacacttctacagggacgcc

SEQ ID NO: 128402 - DNA, 35 bp, Artificial Sequence
  Synthetic oligonucleotide
gttcgcccccgtttagtcggctgacccgtccctcc

SEQ ID NO: 128403 - DNA, 35 bp, Artificial Sequence
  Synthetic oligonucleotide
gtggccctgcccggtttatgccccccaatgcactc

SEQ ID NO: 128404 - DNA, 35 bp, Artificial Sequence
  Synthetic oligonucleotide
gccactctctagttgttcttttctgggtttccctc

SEQ ID NO: 128405 - DNA, 35 bp, Artificial Sequence
  Synthetic oligonucleotide
accctaaccctctgttctgattgcgcgctttcctc

SEQ ID NO: 128406 - DNA, 35 bp, Artificial Sequence
  Synthetic oligonucleotide
tccccctagccccataatcactgttgaccgctctc

SEQ ID NO: 128407 - DNA, 35 bp, Artificial Sequence
  Synthetic oligonucleotide
ttagcgcctccgccttgagcttccctccacagttc

SEQ ID NO: 128408 - DNA, 35 bp, Artificial Sequence
  Synthetic oligonucleotide
tctggccccctcccattagcttaacggtgacaccg

SEQ ID NO: 128409 - DNA, 35 bp, Artificial Sequence
  Synthetic oligonucleotide
tcgtgaaatcctgcctgctttaagctcctgctccg

SEQ ID NO: 128410 - DNA, 36 bp, Artificial Sequence
  Synthetic oligonucleotide
tgcgctctcaatatctctctatgccacttgcccgca

SEQ ID NO: 128411 - DNA, 35 bp, Artificial Sequence
  Synthetic oligonucleotide
gtactgctgcccggtacattgcattccacttttca

SEQ ID NO: 128412 - DNA, 37 bp, Artificial Sequence
  Synthetic oligonucleotide
tgccccgcccagttctccaccgtcatccaaagcacga

SEQ ID NO: 128413 - DNA, 37 bp, Artificial Sequence
  Synthetic oligonucleotide
agccactccatctccacaccgcctaccgccctgccga

SEQ ID NO: 128414 - DNA, 37 bp, Artificial Sequence
  Synthetic oligonucleotide
taaaagtggcgaaggtaggggggagggcgtggaggga

SEQ ID NO: 128415 - DNA, 37 bp, Artificial Sequence
  Synthetic oligonucleotide
tccacccctcatttccgactagtacagtccgtgggga

SEQ ID NO: 128416 - DNA, 34 bp, Artificial Sequence
  Synthetic oligonucleotide
accccccccagcgatggcaccatctcgacctcac

SEQ ID NO: 128417 - DNA, 35 bp, Artificial Sequence
  Synthetic oligonucleotide
gctgcgcccgctatcttacttatgcgtcacccccc

SEQ ID NO: 128418 - DNA, 35 bp, Artificial Sequence
  Synthetic oligonucleotide
accccccgccacgactcctccgtcaaggctctgcc

SEQ ID NO: 128419 - DNA, 35 bp, Artificial Sequence
  Synthetic oligonucleotide
tacattcacccccagagccgtgcgtttccactatc

SEQ ID NO: 128420 - DNA, 35 bp, Artificial Sequence
  Synthetic oligonucleotide
gccacacctctttgcatcgtttaggacacctcttc

SEQ ID NO: 128421 - DNA, 35 bp, Artificial Sequence
  Synthetic oligonucleotide
atgatgctagcccgactcctcccgcacgccgcccg

SEQ ID NO: 128422 - DNA, 35 bp, Artificial Sequence
  Synthetic oligonucleotide
tcgaaggaggaggtggggggtctagggaaagcggg

SEQ ID NO: 128423 - DNA, 35 bp, Artificial Sequence
  Synthetic oligonucleotide
aggaaccacgccgcctttcacgtcccttcgacctg

SEQ ID NO: 128424 - DNA, 35 bp, Artificial Sequence
  Synthetic oligonucleotide
gagaccccctgccccagactaaggccccatgaatt

SEQ ID NO: 128425 - DNA, 35 bp, Artificial Sequence
  Synthetic oligonucleotide
gatagccccctcacagcgtgctgcactttagcctt

SEQ ID NO: 128426 - DNA, 35 bp, Artificial Sequence
  Synthetic oligonucleotide
atgaccgcgtaccgtcacatatttgccacccgctt

SEQ ID NO: 128427 - DNA, 37 bp, Artificial Sequence
  Synthetic oligonucleotide
accaccctcactcgtacctcctgtcctggtctttaga

SEQ ID NO: 128428 - DNA, 35 bp, Artificial Sequence
  Synthetic oligonucleotide
gtagggggagcccgggtgggagagggcaaaaacga

SEQ ID NO: 128429 - DNA, 37 bp, Artificial Sequence
  Synthetic oligonucleotide
gaccccaccctcctattgcattccagtcacggttcga

SEQ ID NO: 128430 - DNA, 37 bp, Artificial Sequence
  Synthetic oligonucleotide
gttgaaggtgcgggggggccaaaagggcagcaaggga

SEQ ID NO: 128431 - DNA, 37 bp, Artificial Sequence
  Synthetic oligonucleotide
tgagggcgggtagggggaggactgatacgcaggggga

SEQ ID NO: 128432 - DNA, 35 bp, Artificial Sequence
  Synthetic oligonucleotide
agtacagtgccgtattggctgtcatccccgttccc

SEQ ID NO: 128433 - DNA, 27 bp, Artificial Sequence
  Synthetic oligonucleotide
gttcatccgttatctcccacccaggcc

SEQ ID NO: 128434 - DNA, 35 bp, Artificial Sequence
  Synthetic oligonucleotide
tctcactacccgctttctctcgtggactggtctcc

SEQ ID NO: 128435 - DNA, 35 bp, Artificial Sequence
  Synthetic oligonucleotide
atacaaccgactcacgagcgctcgcctaccaccgc

SEQ ID NO: 128436 - DNA, 35 bp, Artificial Sequence
  Synthetic oligonucleotide
tacccgcccttccgacagcgatagctcacggtctc

SEQ ID NO: 128437 - DNA, 35 bp, Artificial Sequence
  Synthetic oligonucleotide
gaggagaagtagggggttagaagaggaatggtgtg

SEQ ID NO: 128438 - DNA, 35 bp, Artificial Sequence
  Synthetic oligonucleotide
gactctgcccccgtccccgagcactgctacgcact

SEQ ID NO: 128439 - DNA, 35 bp, Artificial Sequence
  Synthetic oligonucleotide
aagcacctcaccccgcacgttggccatgcttagct

SEQ ID NO: 128440 - DNA, 35 bp, Artificial Sequence
  Synthetic oligonucleotide
tagacctccgctgccacgatactaccctgcttgaa

SEQ ID NO: 128441 - DNA, 37 bp, Artificial Sequence
  Synthetic oligonucleotide
gtgctgtgggtggggggggagaattgcagtcgggaga

SEQ ID NO: 128442 - DNA, 37 bp, Artificial Sequence
  Synthetic oligonucleotide
acaagcaacgccctgccccccgacctactcgcctaga

SEQ ID NO: 128443 - DNA, 37 bp, Artificial Sequence
  Synthetic oligonucleotide
tgtgctggggtacgcaaggggggatagaaggggtgga

SEQ ID NO: 128444 - DNA, 37 bp, Artificial Sequence
  Synthetic oligonucleotide
gatcacctcactgaacttctgagcccccctcctttga

SEQ ID NO: 128445 - DNA, 36 bp, Artificial Sequence
  Synthetic oligonucleotide
ttcgccgaccaacgctttcccactgaggcaccccta

SEQ ID NO: 128446 - DNA, 35 bp, Artificial Sequence
  Synthetic oligonucleotide
ttgccagggtgggtatgggaagggagcgaggtgac

SEQ ID NO: 128447 - DNA, 35 bp, Artificial Sequence
  Synthetic oligonucleotide
gtccgagcgcacattgcactgcatttcaccgaacc

SEQ ID NO: 128448 - DNA, 35 bp, Artificial Sequence
  Synthetic oligonucleotide
gcgggtgggagtggtgggggggggtcggggttgcc

SEQ ID NO: 128449 - DNA, 35 bp, Artificial Sequence
  Synthetic oligonucleotide
atcccacctcgttagcctggctatagtcaccttcc

SEQ ID NO: 128450 - DNA, 35 bp, Artificial Sequence
  Synthetic oligonucleotide
gtggcgtgtactggtcatatctctccggcgcttcc

SEQ ID NO: 128451 - DNA, 35 bp, Artificial Sequence
  Synthetic oligonucleotide
gttcagccggtacgacccgccgcactcattctttc

SEQ ID NO: 128452 - DNA, 35 bp, Artificial Sequence
  Synthetic oligonucleotide
tgtgcccgctccacccgtttcacctgttcgatcag

SEQ ID NO: 128453 - DNA, 35 bp, Artificial Sequence
  Synthetic oligonucleotide
ggtggggaagcagaggaacatggggggggaagtcg

SEQ ID NO: 128454 - DNA, 35 bp, Artificial Sequence
  Synthetic oligonucleotide
tcatcacgcctcgactccgatctcgcctggttcct

SEQ ID NO: 128455 - DNA, 35 bp, Artificial Sequence
  Synthetic oligonucleotide
gctggagcccacgagcacggtccctcctgtcctct

SEQ ID NO: 128456 - DNA, 35 bp, Artificial Sequence
  Synthetic oligonucleotide
gagtatgcccgcgcctctgaccgttctatcgctct

SEQ ID NO: 128457 - DNA, 35 bp, Artificial Sequence
  Synthetic oligonucleotide
cagtacaccgccccgcaccgtcctgcttccccgtt

SEQ ID NO: 128458 - DNA, 36 bp, Artificial Sequence
  Synthetic oligonucleotide
gtgggaagggggggagcacaagaattggcatgggaa

SEQ ID NO: 128459 - DNA, 34 bp, Artificial Sequence
  Synthetic oligonucleotide
gtgctcccaagaggtccgacccactgctctcaca

SEQ ID NO: 128460 - DNA, 35 bp, Artificial Sequence
  Synthetic oligonucleotide
gccgtcccactcttaaccgctgctcgccttcgcca

SEQ ID NO: 128461 - DNA, 36 bp, Artificial Sequence
  Synthetic oligonucleotide
gggggagggcggggtcgtacagcgcggggacataga

SEQ ID NO: 128462 - DNA, 29 bp, Artificial Sequence
  Synthetic oligonucleotide
aatccctgtccacgccatgtctttctcga

SEQ ID NO: 128463 - DNA, 38 bp, Artificial Sequence
  Synthetic oligonucleotide
acatgtacgtagatgggggggggacaaggcgggtgtga

SEQ ID NO: 128464 - DNA, 38 bp, Artificial Sequence
  Synthetic oligonucleotide
agggagggagggaggggcatgggatactggttctttga

SEQ ID NO: 128465 - DNA, 35 bp, Artificial Sequence
  Synthetic oligonucleotide
ttgcacaccggcccgcactcgttcgtccactcaac

SEQ ID NO: 128466 - DNA, 35 bp, Artificial Sequence
  Synthetic oligonucleotide
ttccatcgcgccccaggcctgtactttccgttaac

SEQ ID NO: 128467 - DNA, 35 bp, Artificial Sequence
  Synthetic oligonucleotide
tcccgccctcaattggttttaaattctggcaccac

SEQ ID NO: 128468 - DNA, 28 bp, Artificial Sequence
  Synthetic oligonucleotide
aacgccccacaaggcctccctaacccac

SEQ ID NO: 128469 - DNA, 35 bp, Artificial Sequence
  Synthetic oligonucleotide
acctccccctgggctagtttacttgactgttcacc

SEQ ID NO: 128470 - DNA, 35 bp, Artificial Sequence
  Synthetic oligonucleotide
tctcgctcacactcccataccgtggggtcctcccc

SEQ ID NO: 128471 - DNA, 35 bp, Artificial Sequence
  Synthetic oligonucleotide
tgccactttccgcgcctcaccctttcaccgctagg

SEQ ID NO: 128472 - DNA, 35 bp, Artificial Sequence
  Synthetic oligonucleotide
gcgattcgccaccgattgtgaaactccgcccttct

SEQ ID NO: 128473 - DNA, 36 bp, Artificial Sequence
  Synthetic oligonucleotide
gacaggagcggggtggaaaaaaagaaaaagtcagaa

SEQ ID NO: 128474 - DNA, 35 bp, Artificial Sequence
  Synthetic oligonucleotide
gcgatgggtggggtcgggtgggaccttgcaaaaca

SEQ ID NO: 128475 - DNA, 37 bp, Artificial Sequence
  Synthetic oligonucleotide
aagacgggactgttgtaggggacttgagggagggaga

SEQ ID NO: 128476 - DNA, 35 bp, Artificial Sequence
  Synthetic oligonucleotide
tccttgccgactacagcccgccagctctcaaacga

SEQ ID NO: 128477 - DNA, 37 bp, Artificial Sequence
  Synthetic oligonucleotide
gattcctcgccccacactctcattcgacagtccagga

SEQ ID NO: 128478 - DNA, 36 bp, Artificial Sequence
  Synthetic oligonucleotide
agagccccccggaaccgcccgacccctcccattgga

SEQ ID NO: 128479 - DNA, 37 bp, Artificial Sequence
  Synthetic oligonucleotide
tgcctgaccacctctgtgtccacattccacctcctga

SEQ ID NO: 128480 - DNA, 36 bp, Artificial Sequence
  Synthetic oligonucleotide
agacgggctcctgccgacacattccaccctgcctta

SEQ ID NO: 128481 - DNA, 35 bp, Artificial Sequence
  Synthetic oligonucleotide
tgtacgtcacgcaccagccatgtccggcatttccc

SEQ ID NO: 128482 - DNA, 35 bp, Artificial Sequence
  Synthetic oligonucleotide
ccattctgcccctttgtcgccccgcaccggttctc

SEQ ID NO: 128483 - DNA, 35 bp, Artificial Sequence
  Synthetic oligonucleotide
gctgtccagcacctggcatactctccctgcatttc

SEQ ID NO: 128484 - DNA, 35 bp, Artificial Sequence
  Synthetic oligonucleotide
ggaaggacgccgccatctatacaaccatccatctg

SEQ ID NO: 128485 - DNA, 35 bp, Artificial Sequence
  Synthetic oligonucleotide
tccatcccccaacatttatgacgctggccttccct

SEQ ID NO: 128486 - DNA, 35 bp, Artificial Sequence
  Synthetic oligonucleotide
ttgtctcccctcccattcagcttacgtacaggcct

SEQ ID NO: 128487 - DNA, 35 bp, Artificial Sequence
  Synthetic oligonucleotide
ttctgcacacactgctgtaccgttacgtaccacaa

SEQ ID NO: 128488 - DNA, 36 bp, Artificial Sequence
  Synthetic oligonucleotide
tgctcccatcgtgtgtcttctcacctcgtcgcccaa

SEQ ID NO: 128489 - DNA, 36 bp, Artificial Sequence
  Synthetic oligonucleotide
tgtgtcgccctagttttcattcgttgcctttcacca

SEQ ID NO: 128490 - DNA, 37 bp, Artificial Sequence
  Synthetic oligonucleotide
taggggtcgcaaaggggggagggagggatgaagggga

SEQ ID NO: 128491 - DNA, 38 bp, Artificial Sequence
  Synthetic oligonucleotide
gacacgtcgaacagatgggatcgggaagggggggttga

SEQ ID NO: 128492 - DNA, 36 bp, Artificial Sequence
  Synthetic oligonucleotide
atcgcaccctcctatgccaacaaccacatcgcgcta

SEQ ID NO: 128493 - DNA, 35 bp, Artificial Sequence
  Synthetic oligonucleotide
tttcatccgccctttatgtacgtgcctacctcaac

SEQ ID NO: 128494 - DNA, 35 bp, Artificial Sequence
  Synthetic oligonucleotide
gacctctccgccttaattgtaatgtccagatcccc

SEQ ID NO: 128495 - DNA, 35 bp, Artificial Sequence
  Synthetic oligonucleotide
tcgcgccccccacacctcctcaatgccggtttcgc

SEQ ID NO: 128496 - DNA, 35 bp, Artificial Sequence
  Synthetic oligonucleotide
gcaccgccaacatccccccctactcgttaggctgc

SEQ ID NO: 128497 - DNA, 35 bp, Artificial Sequence
  Synthetic oligonucleotide
acaagccggaggaaggaggaacgggggccaaggtc

SEQ ID NO: 128498 - DNA, 35 bp, Artificial Sequence
  Synthetic oligonucleotide
accccatcaagctgttcccactgttcacgccattc

SEQ ID NO: 128499 - DNA, 35 bp, Artificial Sequence
  Synthetic oligonucleotide
acgtgcgcatctctgctggtctcaattctaccttc

SEQ ID NO: 128500 - DNA, 35 bp, Artificial Sequence
  Synthetic oligonucleotide
ttccagccctctatgctcgactaactcatgccctg

SEQ ID NO: 128501 - DNA, 35 bp, Artificial Sequence
  Synthetic oligonucleotide
tccgccgtagacgcgctccccctttcgtacttaat

SEQ ID NO: 128502 - DNA, 35 bp, Artificial Sequence
  Synthetic oligonucleotide
acccctcaacctgccgacttcctgtaaccgcctgt

SEQ ID NO: 128503 - DNA, 35 bp, Artificial Sequence
  Synthetic oligonucleotide
tctctgccgcaccattcaccaacgcccttcacgtt

SEQ ID NO: 128504 - DNA, 35 bp, Artificial Sequence
  Synthetic oligonucleotide
acgaccacaccctccgactctgcattattgtattt

SEQ ID NO: 128505 - DNA, 35 bp, Artificial Sequence
  Synthetic oligonucleotide
gatccgtctccagttttccgttgtttgccatgttt

SEQ ID NO: 128506 - DNA, 36 bp, Artificial Sequence
  Synthetic oligonucleotide
actcgcccccggcctctttggtttcactctctttaa

SEQ ID NO: 128507 - DNA, 35 bp, Artificial Sequence
  Synthetic oligonucleotide
tacatcatcagcgcaaatcgcttctcttgtagtca

SEQ ID NO: 128508 - DNA, 37 bp, Artificial Sequence
  Synthetic oligonucleotide
ggtgcccccctgcattcttactcgccacctcacagga

SEQ ID NO: 128509 - DNA, 37 bp, Artificial Sequence
  Synthetic oligonucleotide
gacaccgccgtgccgcccttagttccttccttccgga

SEQ ID NO: 128510 - DNA, 36 bp, Artificial Sequence
  Synthetic oligonucleotide
tgtcactgcccttcgtttgcttctgttctcgcctga

SEQ ID NO: 128511 - DNA, 38 bp, Artificial Sequence
  Synthetic oligonucleotide
gcccgcatctccatctggtttctgtcttaccgccttga

SEQ ID NO: 128512 - DNA, 36 bp, Artificial Sequence
  Synthetic oligonucleotide
acatgggagggtgactggatgtgggcgggggggcta

SEQ ID NO: 128513 - DNA, 35 bp, Artificial Sequence
  Synthetic oligonucleotide
atcccgcccgactgctgcttagtttcccgattcta

SEQ ID NO: 128514 - DNA, 36 bp, Artificial Sequence
  Synthetic oligonucleotide
actgcaccttccatcagcctgtccctttagctgtta

SEQ ID NO: 128515 - DNA, 35 bp, Artificial Sequence
  Synthetic oligonucleotide
atgggagaggctgggagggaagcggtggtcggacc

SEQ ID NO: 128516 - DNA, 35 bp, Artificial Sequence
  Synthetic oligonucleotide
agcctaatgccatccgccccgtgtcgaaccccgcc

SEQ ID NO: 128517 - DNA, 35 bp, Artificial Sequence
  Synthetic oligonucleotide
tcccgacgcccttatatgctgaacaccgatcgcgc

SEQ ID NO: 128518 - DNA, 35 bp, Artificial Sequence
  Synthetic oligonucleotide
gatgggcgggtatgcgataagggagggcaatttgc

SEQ ID NO: 128519 - DNA, 35 bp, Artificial Sequence
  Synthetic oligonucleotide
acgatcacttgtcttacgctcccgacccgttcatc

SEQ ID NO: 128520 - DNA, 35 bp, Artificial Sequence
  Synthetic oligonucleotide
gttgtacccccgccccgtatttgccttgagggatc

SEQ ID NO: 128521 - DNA, 35 bp, Artificial Sequence
  Synthetic oligonucleotide
aagcactctgctcgccgccctggtacctccccgtc

SEQ ID NO: 128522 - DNA, 35 bp, Artificial Sequence
  Synthetic oligonucleotide
taccgcctgccacacatcttccatacgcccctccg

SEQ ID NO: 128523 - DNA, 35 bp, Artificial Sequence
  Synthetic oligonucleotide
gcaatcgcgtacattcggccttatgtccctgcctg

SEQ ID NO: 128524 - DNA, 35 bp, Artificial Sequence
  Synthetic oligonucleotide
ttcaccctgtctgttgtccgcccgttcgttcacgt

SEQ ID NO: 128525 - DNA, 35 bp, Artificial Sequence
  Synthetic oligonucleotide
acctacagacgcccatgccgctatgtctacccctt

SEQ ID NO: 128526 - DNA, 35 bp, Artificial Sequence
  Synthetic oligonucleotide
tacactgtacctgccgtggttcagccccatcccaa

SEQ ID NO: 128527 - DNA, 36 bp, Artificial Sequence
  Synthetic oligonucleotide
tgtgtacgttaagccatcgccgcctgatccccgcca

SEQ ID NO: 128528 - DNA, 36 bp, Artificial Sequence
  Synthetic oligonucleotide
gtcatgagggaaattactgggacggggggaaaggca

SEQ ID NO: 128529 - DNA, 35 bp, Artificial Sequence
  Synthetic oligonucleotide
tgctgccctctgtggccttccgaccattccttgca

SEQ ID NO: 128530 - DNA, 36 bp, Artificial Sequence
  Synthetic oligonucleotide
aaccctccccgtccgacgtactaccgatcactatca

SEQ ID NO: 128531 - DNA, 36 bp, Artificial Sequence
  Synthetic oligonucleotide
tccccatctcgagccttctaaggaccacccatttca

SEQ ID NO: 128532 - DNA, 37 bp, Artificial Sequence
  Synthetic oligonucleotide
ttcgtccctcgcctttcaactgtgccttccccaccga

SEQ ID NO: 128533 - DNA, 36 bp, Artificial Sequence
  Synthetic oligonucleotide
gcacaccgtcccccactgcgacccgttccatctcga

SEQ ID NO: 128534 - DNA, 37 bp, Artificial Sequence
  Synthetic oligonucleotide
gacaatgggaagaaagggaaggggcaaacttggtgga

SEQ ID NO: 128535 - DNA, 38 bp, Artificial Sequence
  Synthetic oligonucleotide
ggggtgtaagtggtgggggacgagggcggagagagtga

SEQ ID NO: 128536 - DNA, 38 bp, Artificial Sequence
  Synthetic oligonucleotide
gctccaacgtcggcccttactgctcctttctcgcgtga

SEQ ID NO: 128537 - DNA, 38 bp, Artificial Sequence
  Synthetic oligonucleotide
acagccccgccttctgcttctctgcaatccccaattga

SEQ ID NO: 128538 - DNA, 37 bp, Artificial Sequence
  Synthetic oligonucleotide
aaccatgcctgccccgttttatccttcgtcatcttga

SEQ ID NO: 128539 - DNA, 36 bp, Artificial Sequence
  Synthetic oligonucleotide
tcacctcccccccagccactacgttttagtgtcgta

SEQ ID NO: 128540 - DNA, 35 bp, Artificial Sequence
  Synthetic oligonucleotide
gtattccgtcgccctcccccttgcccggtttcgac

SEQ ID NO: 128541 - DNA, 35 bp, Artificial Sequence
  Synthetic oligonucleotide
actaagcagctgccccccgcccgatacgtctagcc

SEQ ID NO: 128542 - DNA, 35 bp, Artificial Sequence
  Synthetic oligonucleotide
gtcacccggaacgatgttagctcctcctccgatcc

SEQ ID NO: 128543 - DNA, 35 bp, Artificial Sequence
  Synthetic oligonucleotide
gaccacgacactggtttctctctgcttaatcccgc

SEQ ID NO: 128544 - DNA, 35 bp, Artificial Sequence
  Synthetic oligonucleotide
acctcgacatgcccggcgtgcctgcccttacactc

SEQ ID NO: 128545 - DNA, 35 bp, Artificial Sequence
  Synthetic oligonucleotide
gtagcctctcgccgttccgtacgttttgctctctc

SEQ ID NO: 128546 - DNA, 35 bp, Artificial Sequence
  Synthetic oligonucleotide
gatggccggagaggtggtgggggaaggaagtcgag

SEQ ID NO: 128547 - DNA, 35 bp, Artificial Sequence
  Synthetic oligonucleotide
tcagatcagggcggagggctatcagaaagggaggg

SEQ ID NO: 128548 - DNA, 36 bp, Artificial Sequence
  Synthetic oligonucleotide
tccccaccaattagtaacatccagcgtatctataca

SEQ ID NO: 128549 - DNA, 36 bp, Artificial Sequence
  Synthetic oligonucleotide
gtcaccccgctagccctctctctctctcacagggca

SEQ ID NO: 128550 - DNA, 35 bp, Artificial Sequence
  Synthetic oligonucleotide
accccaaccagctcctatatgcccatgccgtctca

SEQ ID NO: 128551 - DNA, 36 bp, Artificial Sequence
  Synthetic oligonucleotide
gtccgtccgccctatcatttgtctgtttttacgtca

SEQ ID NO: 128552 - DNA, 35 bp, Artificial Sequence
  Synthetic oligonucleotide
tggtcaagggaggaggagggatcacacaagaaaga

SEQ ID NO: 128553 - DNA, 37 bp, Artificial Sequence
  Synthetic oligonucleotide
tatgcgagctgcctccgcctaccttccaccgttccga

SEQ ID NO: 128554 - DNA, 37 bp, Artificial Sequence
  Synthetic oligonucleotide
agagggaaagtcggaagggggagggcacagggtatga

SEQ ID NO: 128555 - DNA, 37 bp, Artificial Sequence
  Synthetic oligonucleotide
gcgctccatcactcttgcttctcgtgccccatgttga

SEQ ID NO: 128556 - DNA, 34 bp, Artificial Sequence
  Synthetic oligonucleotide
accgtggccgcccttgtcgaccgaacccgctacc

SEQ ID NO: 128557 - DNA, 35 bp, Artificial Sequence
  Synthetic oligonucleotide
gtcgccgatgcataattctacctccccactgcgcc

SEQ ID NO: 128558 - DNA, 35 bp, Artificial Sequence
  Synthetic oligonucleotide
tcgccaccctcacaactctccgagccacgggatcc

SEQ ID NO: 128559 - DNA, 36 bp, Artificial Sequence
  Synthetic oligonucleotide
accgcccctatcccagtgtttgtccgcccctttcaa

SEQ ID NO: 128560 - DNA, 36 bp, Artificial Sequence
  Synthetic oligonucleotide
atttcccccgccaccatgcgtcttactcaagcatca

SEQ ID NO: 128561 - DNA, 37 bp, Artificial Sequence
  Synthetic oligonucleotide
gtggttcccgcgccttgtttcctgctccactcttaga

SEQ ID NO: 128562 - DNA, 38 bp, Artificial Sequence
  Synthetic oligonucleotide
tcacgcctcacatttttaacctgtttcaccacccgtga

SEQ ID NO: 128563 - DNA, 36 bp, Artificial Sequence
  Synthetic oligonucleotide
ggagcacaccgccacatgccacttctcttagctgta

SEQ ID NO: 128564 - DNA, 36 bp, Artificial Sequence
  Synthetic oligonucleotide
tccgtacatcacaagttggttattcccgctccctta

SEQ ID NO: 128565 - DNA, 35 bp, Artificial Sequence
  Synthetic oligonucleotide
ggactccggcatacggtgctcctccttgccttcac

SEQ ID NO: 128566 - DNA, 35 bp, Artificial Sequence
  Synthetic oligonucleotide
ggatgcgcacccgcaccttcccccccggctattac

SEQ ID NO: 128567 - DNA, 35 bp, Artificial Sequence
  Synthetic oligonucleotide
tccatcatctaagcctattcgtccgccgtacgccc

SEQ ID NO: 128568 - DNA, 35 bp, Artificial Sequence
  Synthetic oligonucleotide
tgtaacaccctgttcgtatcgcatggcccccgccc

SEQ ID NO: 128569 - DNA, 35 bp, Artificial Sequence
  Synthetic oligonucleotide
gttgcacgtctcaatcctccgttccctcaggtgcc

SEQ ID NO: 128570 - DNA, 35 bp, Artificial Sequence
  Synthetic oligonucleotide
aactacgcaccggtggttctatacaccctcgcctc

SEQ ID NO: 128571 - DNA, 36 bp, Artificial Sequence
  Synthetic oligonucleotide
tttcgacccggcccctcaccacgcatcgtttcaaca

SEQ ID NO: 128572 - DNA, 36 bp, Artificial Sequence
  Synthetic oligonucleotide
gtgcacttcggtatccttatgcgcatctctcctcca

SEQ ID NO: 128573 - DNA, 36 bp, Artificial Sequence
  Synthetic oligonucleotide
acgaccccctttgtcgatgtttttgcccctcttcca

SEQ ID NO: 128574 - DNA, 37 bp, Artificial Sequence
  Synthetic oligonucleotide
tctgctccacccggtccctgccctcccaagagtacga

SEQ ID NO: 128575 - DNA, 37 bp, Artificial Sequence
  Synthetic oligonucleotide
agagggggaatccgaactaaggaggagggtggaggga

SEQ ID NO: 128576 - DNA, 37 bp, Artificial Sequence
  Synthetic oligonucleotide
agccgccccgcaccgttgccctattctattccctgga

SEQ ID NO: 128577 - DNA, 37 bp, Artificial Sequence
  Synthetic oligonucleotide
tctcccccccgaactccttttagttgcagtccaatga

SEQ ID NO: 128578 - DNA, 38 bp, Artificial Sequence
  Synthetic oligonucleotide
tgcaccccaggacttatgcccccgccacctgccactga

SEQ ID NO: 128579 - DNA, 38 bp, Artificial Sequence
  Synthetic oligonucleotide
tagtcccccctctgtccaccgttgcagtcatcccgtga

SEQ ID NO: 128580 - DNA, 38 bp, Artificial Sequence
  Synthetic oligonucleotide
ttgcgcacagctgcttacctgcttgcctccctgcttga

SEQ ID NO: 128581 - DNA, 37 bp, Artificial Sequence
  Synthetic oligonucleotide
gctcgcacccacatttcgtctcccgcgccgttcttga

SEQ ID NO: 128582 - DNA, 35 bp, Artificial Sequence
  Synthetic oligonucleotide
gttcctcctcaccgtgcaatcaggatatccaccac

SEQ ID NO: 128583 - DNA, 35 bp, Artificial Sequence
  Synthetic oligonucleotide
acaaccactcgtgtggtgccccccctcatgtttac

SEQ ID NO: 128584 - DNA, 35 bp, Artificial Sequence
  Synthetic oligonucleotide
tcaccctccgtggtcatgtatcctggacctttccc

SEQ ID NO: 128585 - DNA, 35 bp, Artificial Sequence
  Synthetic oligonucleotide
taaccagctgccacactttcatgctctccgacgcc

SEQ ID NO: 128586 - DNA, 35 bp, Artificial Sequence
  Synthetic oligonucleotide
gtcgtcccgttaccatccgatctttcctggtgtcc

SEQ ID NO: 128587 - DNA, 35 bp, Artificial Sequence
  Synthetic oligonucleotide
aaacccgccgctgctacctcctagtcgcgtccctc

SEQ ID NO: 128588 - DNA, 35 bp, Artificial Sequence
  Synthetic oligonucleotide
tccgtgcccctataatgtgttgcgtttctatcctg

SEQ ID NO: 128589 - DNA, 35 bp, Artificial Sequence
  Synthetic oligonucleotide
ttctacctcgctgttcactgtactgcaccctgcct

SEQ ID NO: 128590 - DNA, 35 bp, Artificial Sequence
  Synthetic oligonucleotide
tagagaccatcgctgcatttaccagacttccctct

SEQ ID NO: 128591 - DNA, 35 bp, Artificial Sequence
  Synthetic oligonucleotide
atgggagtgagtgcggaaggggtaagggatagagt

SEQ ID NO: 128592 - DNA, 35 bp, Artificial Sequence
  Synthetic oligonucleotide
tacttcacccagcctgtcgccttcatccatccggt

SEQ ID NO: 128593 - DNA, 36 bp, Artificial Sequence
  Synthetic oligonucleotide
tcagggggggtccggggcgggaatggagagatagaa

SEQ ID NO: 128594 - DNA, 36 bp, Artificial Sequence
  Synthetic oligonucleotide
acccgtgtcccagccgccctgctctcacgtttgaca

SEQ ID NO: 128595 - DNA, 36 bp, Artificial Sequence
  Synthetic oligonucleotide
tccatccctctgcagatcccgttttagtcataccca

SEQ ID NO: 128596 - DNA, 36 bp, Artificial Sequence
  Synthetic oligonucleotide
tgaacacccgtacccaatccacttcgccgtccccga

SEQ ID NO: 128597 - DNA, 36 bp, Artificial Sequence
  Synthetic oligonucleotide
gcctcggcacatcctgcaagcctgttcttccatcga

SEQ ID NO: 128598 - DNA, 37 bp, Artificial Sequence
  Synthetic oligonucleotide
atgcccaagccgatctgctccccacgtccgccttcga

SEQ ID NO: 128599 - DNA, 38 bp, Artificial Sequence
  Synthetic oligonucleotide
tgaccagggggtgggtgaagaaacggagtataagatga

SEQ ID NO: 128600 - DNA, 37 bp, Artificial Sequence
  Synthetic oligonucleotide
gttgtcctgccccagcattttctttgtcatctcctga

SEQ ID NO: 128601 - DNA, 38 bp, Artificial Sequence
  Synthetic oligonucleotide
gccccccgctgtacgccgcttgttcccactctggttga

SEQ ID NO: 128602 - DNA, 34 bp, Artificial Sequence
  Synthetic oligonucleotide
accgcaatctgtctcttcatgtccctgctccgta

SEQ ID NO: 128603 - DNA, 35 bp, Artificial Sequence
  Synthetic oligonucleotide
acttgagcccacctgtgccctaaactgccgtgccc

SEQ ID NO: 128604 - DNA, 35 bp, Artificial Sequence
  Synthetic oligonucleotide
gactgttcgccgccccgtaaaatagtttgttatcc

SEQ ID NO: 128605 - DNA, 35 bp, Artificial Sequence
  Synthetic oligonucleotide
gatgcatcgcaatccgtatattggtcccgtcctcc

SEQ ID NO: 128606 - DNA, 35 bp, Artificial Sequence
  Synthetic oligonucleotide
gctgcactgtctagttatagccactttcgccttcc

SEQ ID NO: 128607 - DNA, 35 bp, Artificial Sequence
  Synthetic oligonucleotide
gctttgtgtccgtccctattcccgccacaccctgc

SEQ ID NO: 128608 - DNA, 35 bp, Artificial Sequence
  Synthetic oligonucleotide
tgaccaaccgcgaggtcatcgatacgctccacatc

SEQ ID NO: 128609 - DNA, 35 bp, Artificial Sequence
  Synthetic oligonucleotide
taatgcgacccatcgttttttgccctatcaccgtc

SEQ ID NO: 128610 - DNA, 35 bp, Artificial Sequence
  Synthetic oligonucleotide
tgcgcccgttcgccctcggaccatcttctccattg

SEQ ID NO: 128611 - DNA, 35 bp, Artificial Sequence
  Synthetic oligonucleotide
agcccggcctgacgggttacgttccccgtgccact

SEQ ID NO: 128612 - DNA, 36 bp, Artificial Sequence
  Synthetic oligonucleotide
tgagtgggggggatgagggaaaaagggcatggaaaa

SEQ ID NO: 128613 - DNA, 35 bp, Artificial Sequence
  Synthetic oligonucleotide
ttgttgcccggaaaacagcgtgactttctcctcca

SEQ ID NO: 128614 - DNA, 36 bp, Artificial Sequence
  Synthetic oligonucleotide
ccaacccatccgccgccacttatgcattgcagtcca

SEQ ID NO: 128615 - DNA, 36 bp, Artificial Sequence
  Synthetic oligonucleotide
gtacccgcccttatgtattccgtgaattcgccctca

SEQ ID NO: 128616 - DNA, 36 bp, Artificial Sequence
  Synthetic oligonucleotide
gtggccagcccgatgtcagcccgcctcctccctcga

SEQ ID NO: 128617 - DNA, 38 bp, Artificial Sequence
  Synthetic oligonucleotide
gttgccagaacaacacgggtggtgagggggggccatga

SEQ ID NO: 128618 - DNA, 38 bp, Artificial Sequence
  Synthetic oligonucleotide
aacctctgcccaagccttccataagacccttcccctga

SEQ ID NO: 128619 - DNA, 38 bp, Artificial Sequence
  Synthetic oligonucleotide
gggacatcaagaaggggcgggggggcggagtgctgtga

SEQ ID NO: 128620 - DNA, 36 bp, Artificial Sequence
  Synthetic oligonucleotide
acatcaacggcagatcgtcatacactcgccgccata

SEQ ID NO: 128621 - DNA, 35 bp, Artificial Sequence
  Synthetic oligonucleotide
agccgctctccgcctatatgtacacatccttcacc

SEQ ID NO: 128622 - DNA, 35 bp, Artificial Sequence
  Synthetic oligonucleotide
aacgctcaactgctctccatttgccagcctgaccc

SEQ ID NO: 128623 - DNA, 35 bp, Artificial Sequence
  Synthetic oligonucleotide
tccagaccgagccccgcctggcatatagcaccccc

SEQ ID NO: 128624 - DNA, 34 bp, Artificial Sequence
  Synthetic oligonucleotide
accgcagaaaacatgtactatcgctctggccccc

SEQ ID NO: 128625 - DNA, 35 bp, Artificial Sequence
  Synthetic oligonucleotide
tgtgtatgcatgtgtcatcctgccgtaccgttccc

SEQ ID NO: 128626 - DNA, 35 bp, Artificial Sequence
  Synthetic oligonucleotide
tcacaccgccgttgcctgttactcccgctccagcc

SEQ ID NO: 128627 - DNA, 35 bp, Artificial Sequence
  Synthetic oligonucleotide
taccccgcctaggtttaaccaacggccccttctcc

SEQ ID NO: 128628 - DNA, 35 bp, Artificial Sequence
  Synthetic oligonucleotide
tgccgtgcccacctcatatccgcttgtgaccactc

SEQ ID NO: 128629 - DNA, 35 bp, Artificial Sequence
  Synthetic oligonucleotide
gatggccatgcacctgaacttagccgccgttactc

SEQ ID NO: 128630 - DNA, 34 bp, Artificial Sequence
  Synthetic oligonucleotide
gccggtggtatctgtctcttaggcaccttctttc

SEQ ID NO: 128631 - DNA, 35 bp, Artificial Sequence
  Synthetic oligonucleotide
atcgccctagcctcttctgtcaccacgaatctacg

SEQ ID NO: 128632 - DNA, 35 bp, Artificial Sequence
  Synthetic oligonucleotide
tctacccttacgccccatgccacggccttgacccg

SEQ ID NO: 128633 - DNA, 35 bp, Artificial Sequence
  Synthetic oligonucleotide
accgccatttccggcccctccgttagacactcccg

SEQ ID NO: 128634 - DNA, 35 bp, Artificial Sequence
  Synthetic oligonucleotide
aggaccccctctcctagtttagtgtcttctctccg

SEQ ID NO: 128635 - DNA, 35 bp, Artificial Sequence
  Synthetic oligonucleotide
tgtcattccgcttcctccgctcccgaccctcgcgg

SEQ ID NO: 128636 - DNA, 35 bp, Artificial Sequence
  Synthetic oligonucleotide
tacacgtcagccgtaatcaccgtctctagcgctct

SEQ ID NO: 128637 - DNA, 35 bp, Artificial Sequence
  Synthetic oligonucleotide
tccatgcacctgccctgtagggtgcccctctttct

SEQ ID NO: 128638 - DNA, 36 bp, Artificial Sequence
  Synthetic oligonucleotide
gttcgaccccccctgtccatcagttagctggttaca

SEQ ID NO: 128639 - DNA, 36 bp, Artificial Sequence
  Synthetic oligonucleotide
gatacctcccgtgcatttttccgcgtcactcctgca

SEQ ID NO: 128640 - DNA, 37 bp, Artificial Sequence
  Synthetic oligonucleotide
tcaaggggaaggtgagggggacgcgcgctaagggtga

SEQ ID NO: 128641 - DNA, 35 bp, Artificial Sequence
  Synthetic oligonucleotide
ttaatcccgccgttgctacttaatgcgccttttac

SEQ ID NO: 128642 - DNA, 35 bp, Artificial Sequence
  Synthetic oligonucleotide
atgcatgtcaattgcgctgccccccccttccttcc

SEQ ID NO: 128643 - DNA, 35 bp, Artificial Sequence
  Synthetic oligonucleotide
gccaactagaagcgcatgcatttcgtcgccctctc

SEQ ID NO: 128644 - DNA, 35 bp, Artificial Sequence
  Synthetic oligonucleotide
gtcacctctcactgctttgaaatgtgctgccattc

SEQ ID NO: 128645 - DNA, 35 bp, Artificial Sequence
  Synthetic oligonucleotide
ttccaccgcctgacgccttcgttttgcataccgtg

SEQ ID NO: 128646 - DNA, 35 bp, Artificial Sequence
  Synthetic oligonucleotide
gtgcccatccacgtttatcatcgtcacgtccttct

SEQ ID NO: 128647 - DNA, 34 bp, Artificial Sequence
  Synthetic oligonucleotide
tcgccaccactaactgtctactcatataccctgt

SEQ ID NO: 128648 - DNA, 35 bp, Artificial Sequence
  Synthetic oligonucleotide
atccagagctcgcctcctgttagggcctgttcctt

SEQ ID NO: 128649 - DNA, 35 bp, Artificial Sequence
  Synthetic oligonucleotide
gacatcgggcgggggcgggcatgaggggttgtaga

SEQ ID NO: 128650 - DNA, 36 bp, Artificial Sequence
  Synthetic oligonucleotide
agacagtaggacaatttggcaaggggggcgggcgga

SEQ ID NO: 128651 - DNA, 37 bp, Artificial Sequence
  Synthetic oligonucleotide
ggagaggagggcctcggggaaaagggggagatcggga

SEQ ID NO: 128652 - DNA, 38 bp, Artificial Sequence
  Synthetic oligonucleotide
agagggagacagggagtgggggggttaaagcgggatga

SEQ ID NO: 128653 - DNA, 37 bp, Artificial Sequence
  Synthetic oligonucleotide
aaggtggacgggagggggtagggcatgaagacactga

SEQ ID NO: 128654 - DNA, 38 bp, Artificial Sequence
  Synthetic oligonucleotide
tccaccccgctcgcttgtgcagatatctccactcttga

SEQ ID NO: 128655 - DNA, 35 bp, Artificial Sequence
  Synthetic oligonucleotide
gtcgcaccagcctagcacacccccccctgtcaata

SEQ ID NO: 128656 - DNA, 36 bp, Artificial Sequence
  Synthetic oligonucleotide
accgctcgcccttcgcggttgcccctccacgcctta

SEQ ID NO: 128657 - DNA, 35 bp, Artificial Sequence
  Synthetic oligonucleotide
tccatcctcagccaggtacacccgtgcgtttccac

SEQ ID NO: 128658 - DNA, 35 bp, Artificial Sequence
  Synthetic oligonucleotide
gctggccccctttgttttacgtttcgttatcgccc

SEQ ID NO: 128659 - DNA, 35 bp, Artificial Sequence
  Synthetic oligonucleotide
tctgttctcgccctgccgttacaaataccggttcc

SEQ ID NO: 128660 - DNA, 35 bp, Artificial Sequence
  Synthetic oligonucleotide
gtacacgctagatcttccgcgatcacacccctctc

SEQ ID NO: 128661 - DNA, 35 bp, Artificial Sequence
  Synthetic oligonucleotide
ttccatcagcgccgcgccattccgatttcctgttc

SEQ ID NO: 128662 - DNA, 35 bp, Artificial Sequence
  Synthetic oligonucleotide
agggcggggcgggcgggttcgggaatgcaacttag

SEQ ID NO: 128663 - DNA, 35 bp, Artificial Sequence
  Synthetic oligonucleotide
gaagacatgggaagggtgggtgccgcttgggcccg

SEQ ID NO: 128664 - DNA, 35 bp, Artificial Sequence
  Synthetic oligonucleotide
gcactgctgccttctcacgccttggtaagctccat

SEQ ID NO: 128665 - DNA, 35 bp, Artificial Sequence
  Synthetic oligonucleotide
tgctgcctccgcccgtgcctctgtagagcctttct

SEQ ID NO: 128666 - DNA, 35 bp, Artificial Sequence
  Synthetic oligonucleotide
gcaccacatgacgtcttctgccctagtcccttcaa

SEQ ID NO: 128667 - DNA, 35 bp, Artificial Sequence
  Synthetic oligonucleotide
ggatccccgctcgaacccccccgccgtgtcgcaca

SEQ ID NO: 128668 - DNA, 36 bp, Artificial Sequence
  Synthetic oligonucleotide
tcactaccctatcttccgcgtgccactagttggaca

SEQ ID NO: 128669 - DNA, 35 bp, Artificial Sequence
  Synthetic oligonucleotide
tactcccgccctgtaccgcgttcatcccgggttca

SEQ ID NO: 128670 - DNA, 37 bp, Artificial Sequence
  Synthetic oligonucleotide
tgcaagggtacggagagcgggagagcgagaggtgaga

SEQ ID NO: 128671 - DNA, 38 bp, Artificial Sequence
  Synthetic oligonucleotide
gctgggcggggaggggcaagcagggaggggaccgatga

SEQ ID NO: 128672 - DNA, 38 bp, Artificial Sequence
  Synthetic oligonucleotide
tgcactcctccgcccgcgccccatcggtacactactga

SEQ ID NO: 128673 - DNA, 38 bp, Artificial Sequence
  Synthetic oligonucleotide
ttacgccgcccacccacctacattgtgacagttcctga

SEQ ID NO: 128674 - DNA, 35 bp, Artificial Sequence
  Synthetic oligonucleotide
tccgcatgtgcgttgtcttttggcctcccgttata

SEQ ID NO: 128675 - DNA, 36 bp, Artificial Sequence
  Synthetic oligonucleotide
gcacaccatctgacttagcattatcacatcaccgta

SEQ ID NO: 128676 - DNA, 35 bp, Artificial Sequence
  Synthetic oligonucleotide
atgccccatccggccacccctggatcaccccatta

SEQ ID NO: 128677 - DNA, 35 bp, Artificial Sequence
  Synthetic oligonucleotide
acatgcgcgaactctatatcccgtagccccgcccc

SEQ ID NO: 128678 - DNA, 35 bp, Artificial Sequence
  Synthetic oligonucleotide
accgtgccccagccacacctgccttattgagtccc

SEQ ID NO: 128679 - DNA, 35 bp, Artificial Sequence
  Synthetic oligonucleotide
tttgcagggaggggagggtaggggagccatctagc

SEQ ID NO: 128680 - DNA, 36 bp, Artificial Sequence
  Synthetic oligonucleotide
gagcactaccgtgtccgtcctccgcactgtcccttc

SEQ ID NO: 128681 - DNA, 35 bp, Artificial Sequence
  Synthetic oligonucleotide
tacgctctcactggtcctccgctctactatgatcg

SEQ ID NO: 128682 - DNA, 35 bp, Artificial Sequence
  Synthetic oligonucleotide
gctcgagccctggtgatcgctatcctgtccttttt

SEQ ID NO: 128683 - DNA, 35 bp, Artificial Sequence
  Synthetic oligonucleotide
tccaccctccgcaccgactctctgacggggtccca

SEQ ID NO: 128684 - DNA, 36 bp, Artificial Sequence
  Synthetic oligonucleotide
gcccagagttcaggctccctccccttgccgcacgca

SEQ ID NO: 128685 - DNA, 36 bp, Artificial Sequence
  Synthetic oligonucleotide
gctgggcgcgattgcacccgtcgaccttccctttca

SEQ ID NO: 128686 - DNA, 36 bp, Artificial Sequence
  Synthetic oligonucleotide
gcaagccggggtggcaaacggtggaagggggctgga

SEQ ID NO: 128687 - DNA, 35 bp, Artificial Sequence
  Synthetic oligonucleotide
atgcgctcacactctaccctctcgttcttgcttga

SEQ ID NO: 128688 - DNA, 35 bp, Artificial Sequence
  Synthetic oligonucleotide
aatgccccttcgctctgttagccgctcggtaaccc

SEQ ID NO: 128689 - DNA, 35 bp, Artificial Sequence
  Synthetic oligonucleotide
gacgactcactatacttttatccacgcattctcgc

SEQ ID NO: 128690 - DNA, 36 bp, Artificial Sequence
  Synthetic oligonucleotide
tgtagctatacgcgcccctgtcctgtcctcttcgtc

SEQ ID NO: 128691 - DNA, 35 bp, Artificial Sequence
  Synthetic oligonucleotide
atgctaacagccgcacccgttgtcattttcttccg

SEQ ID NO: 128692 - DNA, 35 bp, Artificial Sequence
  Synthetic oligonucleotide
aaattcagatgggacccgccgccctgccccactcg

SEQ ID NO: 128693 - DNA, 35 bp, Artificial Sequence
  Synthetic oligonucleotide
aacccctgcccatcgctgctgttgatcaagcccct

SEQ ID NO: 128694 - DNA, 35 bp, Artificial Sequence
  Synthetic oligonucleotide
acatccgactgtcgctccttccgttccagtaattt

SEQ ID NO: 128695 - DNA, 35 bp, Artificial Sequence
  Synthetic oligonucleotide
tccgaccccgacacctgcctcacttgccagtcgca

SEQ ID NO: 128696 - DNA, 36 bp, Artificial Sequence
  Synthetic oligonucleotide
agcacacacctggcgttttaattccgtcgttcctca

SEQ ID NO: 128697 - DNA, 37 bp, Artificial Sequence
  Synthetic oligonucleotide
gcgccgccaccgcgtaactcggtctcctctctctcga

SEQ ID NO: 128698 - DNA, 37 bp, Artificial Sequence
  Synthetic oligonucleotide
taggtgggacgtggagggcggggaagacgatacgtga

SEQ ID NO: 128699 - DNA, 38 bp, Artificial Sequence
  Synthetic oligonucleotide
aaaccgtacgatcacgtcatcttgcaccccctccgtga

SEQ ID NO: 128700 - DNA, 37 bp, Artificial Sequence
  Synthetic oligonucleotide
tgatgcgccccgttttcaccaccctgtccaaacttga

SEQ ID NO: 128701 - DNA, 35 bp, Artificial Sequence
  Synthetic oligonucleotide
gtcacaccatttctgccgccgactgcccgacgcta

SEQ ID NO: 128702 - DNA, 35 bp, Artificial Sequence
  Synthetic oligonucleotide
tccccccgcccgcccctatacttggtgtctggcta

SEQ ID NO: 128703 - DNA, 35 bp, Artificial Sequence
  Synthetic oligonucleotide
gcataatcggtggaggaggggaatggatgggggac

SEQ ID NO: 128704 - DNA, 35 bp, Artificial Sequence
  Synthetic oligonucleotide
gaggcccccgctcgtttgcgttacacacgcccgcc

SEQ ID NO: 128705 - DNA, 35 bp, Artificial Sequence
  Synthetic oligonucleotide
tccgcgttgatgctccctccccgcgttgttgccgc

SEQ ID NO: 128706 - DNA, 35 bp, Artificial Sequence
  Synthetic oligonucleotide
tgcccctgcccatgtacgtgccgctgttccttcgc

SEQ ID NO: 128707 - DNA, 32 bp, Artificial Sequence
  Synthetic oligonucleotide
acccgactattcccctacccagccacttaggc

SEQ ID NO: 128708 - DNA, 35 bp, Artificial Sequence
  Synthetic oligonucleotide
atgccttgatccgcctgatctcttccaccttatgc

SEQ ID NO: 128709 - DNA, 35 bp, Artificial Sequence
  Synthetic oligonucleotide
tgcgagtccactacctggtctatgtcttaccgctc

SEQ ID NO: 128710 - DNA, 35 bp, Artificial Sequence
  Synthetic oligonucleotide
agggctcacacagcatccatccacgtcccgccccg

SEQ ID NO: 128711 - DNA, 35 bp, Artificial Sequence
  Synthetic oligonucleotide
gcacaccggacctgttaatccgtacccttttcctg

SEQ ID NO: 128712 - DNA, 35 bp, Artificial Sequence
  Synthetic oligonucleotide
gcgctcgccccccatctgcagccctgattcttctg

SEQ ID NO: 128713 - DNA, 35 bp, Artificial Sequence
  Synthetic oligonucleotide
gtacccaccttcgaccctccagcgtccttccgttt

SEQ ID NO: 128714 - DNA, 36 bp, Artificial Sequence
  Synthetic oligonucleotide
gattagggcggggggtggaagggagcacttggtaca

SEQ ID NO: 128715 - DNA, 35 bp, Artificial Sequence
  Synthetic oligonucleotide
tcccgctgccccctgccgtgcaactatgccatcca

SEQ ID NO: 128716 - DNA, 37 bp, Artificial Sequence
  Synthetic oligonucleotide
gcgccattcgcacctgttcattcgaccctattccaga

SEQ ID NO: 128717 - DNA, 37 bp, Artificial Sequence
  Synthetic oligonucleotide
ttatcgcagggggaccagggaagggagggaacggaga

SEQ ID NO: 128718 - DNA, 37 bp, Artificial Sequence
  Synthetic oligonucleotide
agagacggggatgacgggtggggcggttcgagtagga

SEQ ID NO: 128719 - DNA, 36 bp, Artificial Sequence
  Synthetic oligonucleotide
gtcacgacagggacggggagcggaatagggcgcgga

SEQ ID NO: 128720 - DNA, 37 bp, Artificial Sequence
  Synthetic oligonucleotide
ggtgggcgggggggcagtggtcggttacataggggga

SEQ ID NO: 128721 - DNA, 37 bp, Artificial Sequence
  Synthetic oligonucleotide
ggacacgctcctcctgccttcacttcatcatctggga

SEQ ID NO: 128722 - DNA, 38 bp, Artificial Sequence
  Synthetic oligonucleotide
acacgccaacgctactgctcaagctcatcctaccatga

SEQ ID NO: 128723 - DNA, 35 bp, Artificial Sequence
  Synthetic oligonucleotide
ttgcatagccccggattcacctctacctgccctga

SEQ ID NO: 128724 - DNA, 36 bp, Artificial Sequence
  Synthetic oligonucleotide
actccccgccttgttttatgtcattgccatctctga

SEQ ID NO: 128725 - DNA, 38 bp, Artificial Sequence
  Synthetic oligonucleotide
gtccccccccgccagtttagctgcttcaccttcagtga

SEQ ID NO: 128726 - DNA, 35 bp, Artificial Sequence
  Synthetic oligonucleotide
tggacaccccccggcctcttaccagctgacccaac

SEQ ID NO: 128727 - DNA, 35 bp, Artificial Sequence
  Synthetic oligonucleotide
ataccccatcatgtacgagcccatgcacattccgc

SEQ ID NO: 128728 - DNA, 35 bp, Artificial Sequence
  Synthetic oligonucleotide
gtgccacggaagggtctaactgcttttctcccctc

SEQ ID NO: 128729 - DNA, 35 bp, Artificial Sequence
  Synthetic oligonucleotide
actagcagtcgatcatccccgtctttaacatcctc

SEQ ID NO: 128730 - DNA, 35 bp, Artificial Sequence
  Synthetic oligonucleotide
gacgcccaggctcccttttcctgccggatcacccg

SEQ ID NO: 128731 - DNA, 35 bp, Artificial Sequence
  Synthetic oligonucleotide
gcgttgccccacttgtaacatttgctcccgcttcg

SEQ ID NO: 128732 - DNA, 35 bp, Artificial Sequence
  Synthetic oligonucleotide
acacatccccgcaacagcgctttcactgtccacct

SEQ ID NO: 128733 - DNA, 36 bp, Artificial Sequence
  Synthetic oligonucleotide
gtgatgccccattgtagctacgccagcttttctcca

SEQ ID NO: 128734 - DNA, 37 bp, Artificial Sequence
  Synthetic oligonucleotide
ggacacgaagggcaggacgggggaggtcggcgtgaga

SEQ ID NO: 128735 - DNA, 36 bp, Artificial Sequence
  Synthetic oligonucleotide
gggggggagtaggaaagaggggaagaagaatcagga

SEQ ID NO: 128736 - DNA, 37 bp, Artificial Sequence
  Synthetic oligonucleotide
agggcggggcgagtcattaggggttatctcatgggga

SEQ ID NO: 128737 - DNA, 37 bp, Artificial Sequence
  Synthetic oligonucleotide
aaggaggtgggggggaacgaagacccgaggcggtgga

SEQ ID NO: 128738 - DNA, 37 bp, Artificial Sequence
  Synthetic oligonucleotide
agtggaggggaacggggtaagtgcggacggagaatga

SEQ ID NO: 128739 - DNA, 38 bp, Artificial Sequence
  Synthetic oligonucleotide
accgcctcatctccgttaagtgtctcccatccttctga

SEQ ID NO: 128740 - DNA, 38 bp, Artificial Sequence
  Synthetic oligonucleotide
ggtgccccgcttgctactgtccctctcctacaccgtga

SEQ ID NO: 128741 - DNA, 38 bp, Artificial Sequence
  Synthetic oligonucleotide
acccccgacgacttccgccttcgcccatcacctggtga

SEQ ID NO: 128742 - DNA, 37 bp, Artificial Sequence
  Synthetic oligonucleotide
gtccagaccacatcaactgcctcccctatctctttga

SEQ ID NO: 128743 - DNA, 35 bp, Artificial Sequence
  Synthetic oligonucleotide
gtctacgcactgactcctgcactataccgcgcacc

SEQ ID NO: 128744 - DNA, 29 bp, Artificial Sequence
  Synthetic oligonucleotide
gcagtcagatctagttccgcccctttacc

SEQ ID NO: 128745 - DNA, 35 bp, Artificial Sequence
  Synthetic oligonucleotide
tccaccgtttcagccatccgtatcactttaacatc

SEQ ID NO: 128746 - DNA, 35 bp, Artificial Sequence
  Synthetic oligonucleotide
tccggccaccacaccattgcccccacatacacgtc

SEQ ID NO: 128747 - DNA, 35 bp, Artificial Sequence
  Synthetic oligonucleotide
tgtccctccgctgccccttgttaccgccgccgttc

SEQ ID NO: 128748 - DNA, 35 bp, Artificial Sequence
  Synthetic oligonucleotide
gcccaggacgggggaggacggggaaatagtcaggg

SEQ ID NO: 128749 - DNA, 35 bp, Artificial Sequence
  Synthetic oligonucleotide
gcacctcccgcagacgttttcgccacaacatttat

SEQ ID NO: 128750 - DNA, 35 bp, Artificial Sequence
  Synthetic oligonucleotide
taacctgcgcctgtgcctctacgtccgccccgatt

SEQ ID NO: 128751 - DNA, 36 bp, Artificial Sequence
  Synthetic oligonucleotide
atcacccgtcttgccacccgccgctttgtgaaacaa

SEQ ID NO: 128752 - DNA, 36 bp, Artificial Sequence
  Synthetic oligonucleotide
tccctcaccaccccccgatccctatgtgccttggaa

SEQ ID NO: 128753 - DNA, 35 bp, Artificial Sequence
  Synthetic oligonucleotide
acgcgaggtctgcccctttacccgcccgcttacca

SEQ ID NO: 128754 - DNA, 35 bp, Artificial Sequence
  Synthetic oligonucleotide
actagctgggccatagtggccgcaccatctcccca

SEQ ID NO: 128755 - DNA, 36 bp, Artificial Sequence
  Synthetic oligonucleotide
gacccacccctgattagccgccaatcttccggccca

SEQ ID NO: 128756 - DNA, 37 bp, Artificial Sequence
  Synthetic oligonucleotide
gactcgcaatgtggggctggacggggtaagggaggga

SEQ ID NO: 128757 - DNA, 38 bp, Artificial Sequence
  Synthetic oligonucleotide
accccctccaccctcgtcacgcgtgctcctccgcctga

SEQ ID NO: 128758 - DNA, 36 bp, Artificial Sequence
  Synthetic oligonucleotide
ttgtacccgccccacgttgttttatctcccgaaata

SEQ ID NO: 128759 - DNA, 36 bp, Artificial Sequence
  Synthetic oligonucleotide
ttgccccgacgtccctccgcactatgccagcttata

SEQ ID NO: 128760 - DNA, 36 bp, Artificial Sequence
  Synthetic oligonucleotide
acgcacccggagccgccctaaccatacctccttgta

SEQ ID NO: 128761 - DNA, 35 bp, Artificial Sequence
  Synthetic oligonucleotide
ccgaccccccccagtttgctggcacccggccttac

SEQ ID NO: 128762 - DNA, 35 bp, Artificial Sequence
  Synthetic oligonucleotide
gacccctcgagtagccgcctcttcccccaccggcc

SEQ ID NO: 128763 - DNA, 35 bp, Artificial Sequence
  Synthetic oligonucleotide
tggtgggtcgcccgccctctctacccttccttggc

SEQ ID NO: 128764 - DNA, 35 bp, Artificial Sequence
  Synthetic oligonucleotide
atccaatcggcctgttgcctcacccatgcctaatc

SEQ ID NO: 128765 - DNA, 35 bp, Artificial Sequence
  Synthetic oligonucleotide
attccccgatacgccttctgccttctatagccatg

SEQ ID NO: 128766 - DNA, 35 bp, Artificial Sequence
  Synthetic oligonucleotide
tgcggtccttgctcctcctgtctgtttttccaact

SEQ ID NO: 128767 - DNA, 35 bp, Artificial Sequence
  Synthetic oligonucleotide
tgcggcctggtctcgcacgttctccctccgccgtt

SEQ ID NO: 128768 - DNA, 35 bp, Artificial Sequence
  Synthetic oligonucleotide
tcacgcgcttcacccgtcgcgccgttttctcattt

SEQ ID NO: 128769 - DNA, 36 bp, Artificial Sequence
  Synthetic oligonucleotide
gacaggaaggtcgggaaacgggggcaaacatggtaa

SEQ ID NO: 128770 - DNA, 36 bp, Artificial Sequence
  Synthetic oligonucleotide
tcattgcaccagtgtgaccgttccacttgccctcca

SEQ ID NO: 128771 - DNA, 35 bp, Artificial Sequence
  Synthetic oligonucleotide
gcaccgccccgtctctaaaccgctccacagtggca

SEQ ID NO: 128772 - DNA, 36 bp, Artificial Sequence
  Synthetic oligonucleotide
ttccacctgcgtcggtccattatgatctgcccctca

SEQ ID NO: 128773 - DNA, 36 bp, Artificial Sequence
  Synthetic oligonucleotide
accgacacgtgctcaccctccctctccagtcgctca

SEQ ID NO: 128774 - DNA, 37 bp, Artificial Sequence
  Synthetic oligonucleotide
taaccctccgctgagttggtacttttcccttcaccga

SEQ ID NO: 128775 - DNA, 36 bp, Artificial Sequence
  Synthetic oligonucleotide
tgaacgccacgacgttctgtcttccccctgcctcga

SEQ ID NO: 128776 - DNA, 36 bp, Artificial Sequence
  Synthetic oligonucleotide
agcgggtgggagtgggagggtacaggtgttggcgga

SEQ ID NO: 128777 - DNA, 37 bp, Artificial Sequence
  Synthetic oligonucleotide
gaaaccagaagtgcgggtgggtagggagagagaggga

SEQ ID NO: 128778 - DNA, 36 bp, Artificial Sequence
  Synthetic oligonucleotide
gtagggtggggggggacttagagccacgcgtaggga

SEQ ID NO: 128779 - DNA, 37 bp, Artificial Sequence
  Synthetic oligonucleotide
gacagggaacggggggagtggggcgtggacttgggga

SEQ ID NO: 128780 - DNA, 37 bp, Artificial Sequence
  Synthetic oligonucleotide
tacgacattgcaactgggggggtggggcgtgggtgga

SEQ ID NO: 128781 - DNA, 36 bp, Artificial Sequence
  Synthetic oligonucleotide
acgcgcaacaagggggggggcgagggaaaggagtga

SEQ ID NO: 128782 - DNA, 38 bp, Artificial Sequence
  Synthetic oligonucleotide
tggtcatggggggggtgggtgacggcggatgggcgtga

SEQ ID NO: 128783 - DNA, 37 bp, Artificial Sequence
  Synthetic oligonucleotide
tatgagggggtgacatagagggaggcgggtagggtga

SEQ ID NO: 128784 - DNA, 36 bp, Artificial Sequence
  Synthetic oligonucleotide
tacgcgcggtcacgtttccctcgtctcacctggcta

SEQ ID NO: 128785 - DNA, 35 bp, Artificial Sequence
  Synthetic oligonucleotide
gattgccccccggctgacgaatattcgtcgacccc

SEQ ID NO: 128786 - DNA, 35 bp, Artificial Sequence
  Synthetic oligonucleotide
gtaccacccccaaattcctataaaggaggctcgcc

SEQ ID NO: 128787 - DNA, 35 bp, Artificial Sequence
  Synthetic oligonucleotide
gacaccctgtactcggtccttgcatgactggctcg

SEQ ID NO: 128788 - DNA, 35 bp, Artificial Sequence
  Synthetic oligonucleotide
ggggagggccactgggtggatgaaggctgggaggg

SEQ ID NO: 128789 - DNA, 35 bp, Artificial Sequence
  Synthetic oligonucleotide
tccaaccgaagcttgctgtcttcatcccttgcact

SEQ ID NO: 128790 - DNA, 35 bp, Artificial Sequence
  Synthetic oligonucleotide
gttgatgggccagagtgggatgggcgggggtttct

SEQ ID NO: 128791 - DNA, 35 bp, Artificial Sequence
  Synthetic oligonucleotide
gtccgtagcctttgcatccacacgctgtccccgtt

SEQ ID NO: 128792 - DNA, 36 bp, Artificial Sequence
  Synthetic oligonucleotide
gcgagcatacgcctcctcctctccgtctgttcctaa

SEQ ID NO: 128793 - DNA, 35 bp, Artificial Sequence
  Synthetic oligonucleotide
tgactgagaagccggggaggtagcagggagtagca

SEQ ID NO: 128794 - DNA, 36 bp, Artificial Sequence
  Synthetic oligonucleotide
tgcctgcgcctcattggccatctactgctctcatca

SEQ ID NO: 128795 - DNA, 36 bp, Artificial Sequence
  Synthetic oligonucleotide
ggaaggggtacggggcggggtatgaggcatgtcaga

SEQ ID NO: 128796 - DNA, 36 bp, Artificial Sequence
  Synthetic oligonucleotide
acctgggtccgcgcacggggggggagggaaagacga

SEQ ID NO: 128797 - DNA, 37 bp, Artificial Sequence
  Synthetic oligonucleotide
taagccccggacgtctatccgtcactcgaccccccga

SEQ ID NO: 128798 - DNA, 35 bp, Artificial Sequence
  Synthetic oligonucleotide
gatggagacggggaaaggggactatatagcaggga

SEQ ID NO: 128799 - DNA, 36 bp, Artificial Sequence
  Synthetic oligonucleotide
gtggggttcggtatcagggggaggtgctagtgggga

SEQ ID NO: 128800 - DNA, 36 bp, Artificial Sequence
  Synthetic oligonucleotide
gacgtgcccatatggtttcatcccggtccacaccta

SEQ ID NO: 128801 - DNA, 35 bp, Artificial Sequence
  Synthetic oligonucleotide
tccgagcaaagctcaatcccttcccctaggccccc

SEQ ID NO: 128802 - DNA, 35 bp, Artificial Sequence
  Synthetic oligonucleotide
gcctctgcccgacgcgatccctcccgcggtgcccc

SEQ ID NO: 128803 - DNA, 35 bp, Artificial Sequence
  Synthetic oligonucleotide
tgtaacgcatctgacaccttttgccccgctgtgcc

SEQ ID NO: 128804 - DNA, 35 bp, Artificial Sequence
  Synthetic oligonucleotide
aactgtatccgcctatcctcgccacgccccggtcc

SEQ ID NO: 128805 - DNA, 35 bp, Artificial Sequence
  Synthetic oligonucleotide
gacaactgcctaacgtatttgacacctcctccctc

SEQ ID NO: 128806 - DNA, 35 bp, Artificial Sequence
  Synthetic oligonucleotide
tagtgccaacgcgctctcccctgctatcgcttccg

SEQ ID NO: 128807 - DNA, 35 bp, Artificial Sequence
  Synthetic oligonucleotide
tgtggccacccccctgttctcgtatcatgtttact

SEQ ID NO: 128808 - DNA, 35 bp, Artificial Sequence
  Synthetic oligonucleotide
tacctgctggtcatctccgtcgcccaccgcctggt

SEQ ID NO: 128809 - DNA, 35 bp, Artificial Sequence
  Synthetic oligonucleotide
tcattccacgctcctggttagcacttctcttcgtt

SEQ ID NO: 128810 - DNA, 35 bp, Artificial Sequence
  Synthetic oligonucleotide
tcaccacctacaatccgtatacccactcggctttt

SEQ ID NO: 128811 - DNA, 35 bp, Artificial Sequence
  Synthetic oligonucleotide
gccactctatgccctccgacgccacagttcgagaa

SEQ ID NO: 128812 - DNA, 36 bp, Artificial Sequence
  Synthetic oligonucleotide
ttcgcaccctgcctgatcacgcccttaaagcccgaa

SEQ ID NO: 128813 - DNA, 36 bp, Artificial Sequence
  Synthetic oligonucleotide
agttcaaccctcaaccgatgccacgcctgtcctaca

SEQ ID NO: 128814 - DNA, 37 bp, Artificial Sequence
  Synthetic oligonucleotide
ttgtcagggtgggaggggcacgggagaggcaagaaga

SEQ ID NO: 128815 - DNA, 37 bp, Artificial Sequence
  Synthetic oligonucleotide
acagggagagattcgggggggatgaggtgcgggaaga

SEQ ID NO: 128816 - DNA, 37 bp, Artificial Sequence
  Synthetic oligonucleotide
tgagtggggggacaggaggcgtggaggagctggacga

SEQ ID NO: 128817 - DNA, 35 bp, Artificial Sequence
  Synthetic oligonucleotide
atacctcacgcccggacctgcacttgaacgatcga

SEQ ID NO: 128818 - DNA, 37 bp, Artificial Sequence
  Synthetic oligonucleotide
agaagcagagaggggaaggtgatggacgggggccgga

SEQ ID NO: 128819 - DNA, 38 bp, Artificial Sequence
  Synthetic oligonucleotide
gacacgctggccccagtattgtccacccactctcctga

SEQ ID NO: 128820 - DNA, 38 bp, Artificial Sequence
  Synthetic oligonucleotide
gttgccctcctgctggcgtatcctactgcctcctgtga

SEQ ID NO: 128821 - DNA, 35 bp, Artificial Sequence
  Synthetic oligonucleotide
ggaccgcacacccggcactgaccgccacactcgta

SEQ ID NO: 128822 - DNA, 35 bp, Artificial Sequence
  Synthetic oligonucleotide
tttagccctccgcagcctatcattacaccgcctta

SEQ ID NO: 128823 - DNA, 35 bp, Artificial Sequence
  Synthetic oligonucleotide
agctacatcagcgcgcatacggtcgcacacccacc

SEQ ID NO: 128824 - DNA, 35 bp, Artificial Sequence
  Synthetic oligonucleotide
tacgtccagcctggttctcgcacatatctctgccc

SEQ ID NO: 128825 - DNA, 35 bp, Artificial Sequence
  Synthetic oligonucleotide
ttgtgtgcccggcgcctctctttccgctgatccgc

SEQ ID NO: 128826 - DNA, 35 bp, Artificial Sequence
  Synthetic oligonucleotide
tgcccacgctcagccatacactgtcctgtttattc

SEQ ID NO: 128827 - DNA, 35 bp, Artificial Sequence
  Synthetic oligonucleotide
tacctcttcgaactgctctttgacccgggtccctt

SEQ ID NO: 128828 - DNA, 35 bp, Artificial Sequence
  Synthetic oligonucleotide
gtgccacccactcccgcctcttgacaacgcctgtt

SEQ ID NO: 128829 - DNA, 37 bp, Artificial Sequence
  Synthetic oligonucleotide
ttgctggtccccatttgctcagcacactcctcgccga

SEQ ID NO: 128830 - DNA, 37 bp, Artificial Sequence
  Synthetic oligonucleotide
ggtggtggggtgagtcggggatggagggatgccggga

SEQ ID NO: 128831 - DNA, 37 bp, Artificial Sequence
  Synthetic oligonucleotide
gccagaccctcagccccccgttcccgtttttcatgga

SEQ ID NO: 128832 - DNA, 38 bp, Artificial Sequence
  Synthetic oligonucleotide
aatctggcggacggtgggggcggtataacggagggtga

SEQ ID NO: 128833 - DNA, 35 bp, Artificial Sequence
  Synthetic oligonucleotide
gtgcccctgcccttcctactgctcgctgtggcccc

SEQ ID NO: 128834 - DNA, 35 bp, Artificial Sequence
  Synthetic oligonucleotide
acgccccaccccattcttactggtcccacgccgcc

SEQ ID NO: 128835 - DNA, 35 bp, Artificial Sequence
  Synthetic oligonucleotide
tttcgcgcgcgctcacctcacccccccatgcggcc

SEQ ID NO: 128836 - DNA, 35 bp, Artificial Sequence
  Synthetic oligonucleotide
tggggcaccgcgcatgtttccctgtcacatccact

SEQ ID NO: 128837 - DNA, 35 bp, Artificial Sequence
  Synthetic oligonucleotide
gacaccggtctgccttttcgccgtttctgaccatt

SEQ ID NO: 128838 - DNA, 35 bp, Artificial Sequence
  Synthetic oligonucleotide
ggtagatacaaagggaggggagtgcggtgtggaaa

SEQ ID NO: 128839 - DNA, 35 bp, Artificial Sequence
  Synthetic oligonucleotide
ttatcctgcccacgacttccgcagtcttgttccca

SEQ ID NO: 128840 - DNA, 35 bp, Artificial Sequence
  Synthetic oligonucleotide
tgaccttcccggccacctcaccccgcggacctcca

SEQ ID NO: 128841 - DNA, 36 bp, Artificial Sequence
  Synthetic oligonucleotide
tcacgcccctaccacttgtatttcttgtgctttcca

SEQ ID NO: 128842 - DNA, 35 bp, Artificial Sequence
  Synthetic oligonucleotide
accaccaccgagtaacatcagtcccacgtttcgca

SEQ ID NO: 128843 - DNA, 36 bp, Artificial Sequence
  Synthetic oligonucleotide
tccgctgtacgtcccgatcccccccgtactctcaga

SEQ ID NO: 128844 - DNA, 37 bp, Artificial Sequence
  Synthetic oligonucleotide
acgtgccccctggccctgatctcgctcgttgccccga

SEQ ID NO: 128845 - DNA, 37 bp, Artificial Sequence
  Synthetic oligonucleotide
gccagtgggatgacgggggaggggagtggcaaatgga

SEQ ID NO: 128846 - DNA, 36 bp, Artificial Sequence
  Synthetic oligonucleotide
tcctcgcccactgatatacctgttccttagctttga

SEQ ID NO: 128847 - DNA, 35 bp, Artificial Sequence
  Synthetic oligonucleotide
gactgcgagctgcttctccctgtatccgccctgcc

SEQ ID NO: 128848 - DNA, 35 bp, Artificial Sequence
  Synthetic oligonucleotide
aagccaacgcgagactttcgttatctgccccgctc

SEQ ID NO: 128849 - DNA, 35 bp, Artificial Sequence
  Synthetic oligonucleotide
gtacacgttccaatcgtttcattgttttacctttc

SEQ ID NO: 128850 - DNA, 35 bp, Artificial Sequence
  Synthetic oligonucleotide
gttgcaatcctttctgcctcttagtgaccccgacg

SEQ ID NO: 128851 - DNA, 35 bp, Artificial Sequence
  Synthetic oligonucleotide
gtgccaactcgtgcatgttctttttcttccgcgcg

SEQ ID NO: 128852 - DNA, 35 bp, Artificial Sequence
  Synthetic oligonucleotide
gactcacgtccgacctcaacaccatccgttccact

SEQ ID NO: 128853 - DNA, 35 bp, Artificial Sequence
  Synthetic oligonucleotide
tgacacgctcgatccgccttggcccgctcccttct

SEQ ID NO: 128854 - DNA, 35 bp, Artificial Sequence
  Synthetic oligonucleotide
gccacgcaaccgctatactccccacagtcaaccgt

SEQ ID NO: 128855 - DNA, 36 bp, Artificial Sequence
  Synthetic oligonucleotide
gagacgcttgcctcccaccctcgccgttcctgcgaa

SEQ ID NO: 128856 - DNA, 36 bp, Artificial Sequence
  Synthetic oligonucleotide
gatggggtggaatgggggggaaacgctaatagggaa

SEQ ID NO: 128857 - DNA, 35 bp, Artificial Sequence
  Synthetic oligonucleotide
taccccccgatcgtatcactcggactctcgcccca

SEQ ID NO: 128858 - DNA, 37 bp, Artificial Sequence
  Synthetic oligonucleotide
tccgccccgaccctgcgccaattagctgcaccttgga

SEQ ID NO: 128859 - DNA, 36 bp, Artificial Sequence
  Synthetic oligonucleotide
gatgagagaggggagaaggcgggacggggtatttga

SEQ ID NO: 128860 - DNA, 35 bp, Artificial Sequence
  Synthetic oligonucleotide
gacgataggaggtcggggtaaggattgtgaaggta

SEQ ID NO: 128861 - DNA, 34 bp, Artificial Sequence
  Synthetic oligonucleotide
atccctccccgtcgcctttcagcgtagtactacc

SEQ ID NO: 128862 - DNA, 35 bp, Artificial Sequence
  Synthetic oligonucleotide
tctgggggtggaggcacggggaagatggatgggtc

SEQ ID NO: 128863 - DNA, 35 bp, Artificial Sequence
  Synthetic oligonucleotide
gttggtcgcgtagtgtgtcctctcgtgtccttcct

SEQ ID NO: 128864 - DNA, 35 bp, Artificial Sequence
  Synthetic oligonucleotide
gaagacgccaattgccactccacctttctccttct

SEQ ID NO: 128865 - DNA, 35 bp, Artificial Sequence
  Synthetic oligonucleotide
tacgggagggaggggtacgtaacagcgatacgggt

SEQ ID NO: 128866 - DNA, 35 bp, Artificial Sequence
  Synthetic oligonucleotide
aacgcgccgtccgcatttcggttcttcacctggtt

SEQ ID NO: 128867 - DNA, 36 bp, Artificial Sequence
  Synthetic oligonucleotide
aagctggtgcgggagggagaaggcgggtgtggcaaa

SEQ ID NO: 128868 - DNA, 34 bp, Artificial Sequence
  Synthetic oligonucleotide
agtggagcagttgggagggcgcgggtagggttaa

SEQ ID NO: 128869 - DNA, 36 bp, Artificial Sequence
  Synthetic oligonucleotide
tgccatcaagccctcccgcccggttgtcgacccaca

SEQ ID NO: 128870 - DNA, 36 bp, Artificial Sequence
  Synthetic oligonucleotide
tacaccccccccccgacgatccattgctggagacca

SEQ ID NO: 128871 - DNA, 35 bp, Artificial Sequence
  Synthetic oligonucleotide
accccaccccgcatgtcgacaactgcgcattgcca

SEQ ID NO: 128872 - DNA, 36 bp, Artificial Sequence
  Synthetic oligonucleotide
gaggggggacaggggggttaaggaaggagttaggca

SEQ ID NO: 128873 - DNA, 37 bp, Artificial Sequence
  Synthetic oligonucleotide
ttggtcgccgccacttatgacccccctctatccgaga

SEQ ID NO: 128874 - DNA, 37 bp, Artificial Sequence
  Synthetic oligonucleotide
gatcaccatctggattacacctgcccttctctcggga

SEQ ID NO: 128875 - DNA, 35 bp, Artificial Sequence
  Synthetic oligonucleotide
tttcgacgggagggaaaaagggtggaagaggggga

SEQ ID NO: 128876 - DNA, 37 bp, Artificial Sequence
  Synthetic oligonucleotide
gaccaccgtccgactccactccggaccacacctatga

SEQ ID NO: 128877 - DNA, 38 bp, Artificial Sequence
  Synthetic oligonucleotide
gttcaccccgcagacttacgaccctgccaccccgctga

SEQ ID NO: 128878 - DNA, 37 bp, Artificial Sequence
  Synthetic oligonucleotide
tactcccgccgactctgctattcgcctccgttgctga

SEQ ID NO: 128879 - DNA, 36 bp, Artificial Sequence
  Synthetic oligonucleotide
gattcacagcccggatccgatctccccccgccgtga

SEQ ID NO: 128880 - DNA, 34 bp, Artificial Sequence
  Synthetic oligonucleotide
ttgtatcccgccatttcacccacagtctcgccta

SEQ ID NO: 128881 - DNA, 36 bp, Artificial Sequence
  Synthetic oligonucleotide
acccaccgtccgcagttactcagttcattcctccta

SEQ ID NO: 128882 - DNA, 35 bp, Artificial Sequence
  Synthetic oligonucleotide
acaaccccccaccccgcctctgaccagtatgctac

SEQ ID NO: 128883 - DNA, 35 bp, Artificial Sequence
  Synthetic oligonucleotide
taagcccactctccatgtcgtgcctagtatcctcc

SEQ ID NO: 128884 - DNA, 35 bp, Artificial Sequence
  Synthetic oligonucleotide
tctgcgccccgcagacccgacccacgaatccacgc

SEQ ID NO: 128885 - DNA, 35 bp, Artificial Sequence
  Synthetic oligonucleotide
gtcagatcccctacttataccacgctccggactgc

SEQ ID NO: 128886 - DNA, 35 bp, Artificial Sequence
  Synthetic oligonucleotide
actcgaagccaccgctcgcccttttttcagacatc

SEQ ID NO: 128887 - DNA, 35 bp, Artificial Sequence
  Synthetic oligonucleotide
ttaccagtgcacggttgcattgcttctccccactc

SEQ ID NO: 128888 - DNA, 35 bp, Artificial Sequence
  Synthetic oligonucleotide
gcacagacgctgccagcgtgttctttctttctccg

SEQ ID NO: 128889 - DNA, 35 bp, Artificial Sequence
  Synthetic oligonucleotide
aacaagggccgtctgtcgctttacttgtcccttct

SEQ ID NO: 128890 - DNA, 35 bp, Artificial Sequence
  Synthetic oligonucleotide
gaaggagggtggggggggtggtccctatgagtggt

SEQ ID NO: 128891 - DNA, 35 bp, Artificial Sequence
  Synthetic oligonucleotide
acccgctcatcctcatgtccatatcctttcgccaa

SEQ ID NO: 128892 - DNA, 37 bp, Artificial Sequence
  Synthetic oligonucleotide
gctggggaaggcggagggtggtgggggagttactcga

SEQ ID NO: 128893 - DNA, 38 bp, Artificial Sequence
  Synthetic oligonucleotide
tgagggcggagggagggtggtggatttggacggtatga

SEQ ID NO: 128894 - DNA, 38 bp, Artificial Sequence
  Synthetic oligonucleotide
gctccatccctagaatactttaagcacattgcccctga

SEQ ID NO: 128895 - DNA, 36 bp, Artificial Sequence
  Synthetic oligonucleotide
atcaccttcaagccccccacccagtcccgcgagtga

SEQ ID NO: 128896 - DNA, 38 bp, Artificial Sequence
  Synthetic oligonucleotide
tacacccgtttgcctgtattcccctccgaagaccgtga

SEQ ID NO: 128897 - DNA, 38 bp, Artificial Sequence
  Synthetic oligonucleotide
gagaccaggaaagggagtgaaagcacgggggtaggtga

SEQ ID NO: 128898 - DNA, 36 bp, Artificial Sequence
  Synthetic oligonucleotide
atgcgccctgatctgccccactaccttcgtactcta

SEQ ID NO: 128899 - DNA, 36 bp, Artificial Sequence
  Synthetic oligonucleotide
gatggctacgtgctgtccccgctgtcctccgtttta

SEQ ID NO: 128900 - DNA, 35 bp, Artificial Sequence
  Synthetic oligonucleotide
tgggggggcgggggggtagcacgagttggggccac

SEQ ID NO: 128901 - DNA, 35 bp, Artificial Sequence
  Synthetic oligonucleotide
tgaagcccacacgttcccgacccagcaccacgtcc

SEQ ID NO: 128902 - DNA, 35 bp, Artificial Sequence
  Synthetic oligonucleotide
acacaccacctaacatgttcgccgttcagctcttg

SEQ ID NO: 128903 - DNA, 35 bp, Artificial Sequence
  Synthetic oligonucleotide
tgcccttccgctgcggtcttcaacccccgcaccct

SEQ ID NO: 128904 - DNA, 35 bp, Artificial Sequence
  Synthetic oligonucleotide
ggacgcgcccgtcacttctgccattcccctgtgct

SEQ ID NO: 128905 - DNA, 34 bp, Artificial Sequence
  Synthetic oligonucleotide
gcctgccccgactgccctcacgctacgccttgct

SEQ ID NO: 128906 - DNA, 35 bp, Artificial Sequence
  Synthetic oligonucleotide
tcccgctaccctctgcatcccgtgttatcaacggt

SEQ ID NO: 128907 - DNA, 34 bp, Artificial Sequence
  Synthetic oligonucleotide
gtgatgttgccctgttccccttctcagttactgt

SEQ ID NO: 128908 - DNA, 35 bp, Artificial Sequence
  Synthetic oligonucleotide
tatgccgtaaacggaaggaggtagggaagggaaca

SEQ ID NO: 128909 - DNA, 36 bp, Artificial Sequence
  Synthetic oligonucleotide
tcacacatcagcgtgttcgttcgccatctgccccca

SEQ ID NO: 128910 - DNA, 36 bp, Artificial Sequence
  Synthetic oligonucleotide
acataacagcgatccactcgtcctgcatccagccca

SEQ ID NO: 128911 - DNA, 36 bp, Artificial Sequence
  Synthetic oligonucleotide
gtgccgcctagccatccttgttcgtcttacgtgcca

SEQ ID NO: 128912 - DNA, 35 bp, Artificial Sequence
  Synthetic oligonucleotide
gctgcaagccgccgtctttatcattagctccttca

SEQ ID NO: 128913 - DNA, 37 bp, Artificial Sequence
  Synthetic oligonucleotide
atccacccccattgttcttgtgtttctgccctttcga

SEQ ID NO: 128914 - DNA, 37 bp, Artificial Sequence
  Synthetic oligonucleotide
tgtgcaccccgttcgtcgtttcgccaccttcttagga

SEQ ID NO: 128915 - DNA, 36 bp, Artificial Sequence
  Synthetic oligonucleotide
tcattggtgcaccgtgatcgcccctctcttcctgga

SEQ ID NO: 128916 - DNA, 35 bp, Artificial Sequence
  Synthetic oligonucleotide
tagtagtcggggaggtacggggggagagggactga

SEQ ID NO: 128917 - DNA, 36 bp, Artificial Sequence
  Synthetic oligonucleotide
atcccccgccgccaaactcatgtcgactgaccggta

SEQ ID NO: 128918 - DNA, 35 bp, Artificial Sequence
  Synthetic oligonucleotide
gaacacaccccccgtccggctccttatagttcgcc

SEQ ID NO: 128919 - DNA, 35 bp, Artificial Sequence
  Synthetic oligonucleotide
agccatgtggctgcccgaccgctagccctccttcc

SEQ ID NO: 128920 - DNA, 35 bp, Artificial Sequence
  Synthetic oligonucleotide
gtactcgcgttacttgagtttccatccgtccttcc

SEQ ID NO: 128921 - DNA, 35 bp, Artificial Sequence
  Synthetic oligonucleotide
accctgccctctttctgctctacatcagaccaagc

SEQ ID NO: 128922 - DNA, 35 bp, Artificial Sequence
  Synthetic oligonucleotide
gttggccgccccgccacgtactactatgatacctc

SEQ ID NO: 128923 - DNA, 35 bp, Artificial Sequence
  Synthetic oligonucleotide
cccccgtgggacgcctaacgaccccgctgtctttc

SEQ ID NO: 128924 - DNA, 35 bp, Artificial Sequence
  Synthetic oligonucleotide
gtaggccacgcctgcgcaaatgccatctatccccg

SEQ ID NO: 128925 - DNA, 35 bp, Artificial Sequence
  Synthetic oligonucleotide
tcacacgccctgctgctaactttactcgcctttcg

SEQ ID NO: 128926 - DNA, 35 bp, Artificial Sequence
  Synthetic oligonucleotide
ttcgtgcccaactattgcgtcccctccattggctg

SEQ ID NO: 128927 - DNA, 35 bp, Artificial Sequence
  Synthetic oligonucleotide
ttacggacgccccccgtgccttgttccttgcatat

SEQ ID NO: 128928 - DNA, 35 bp, Artificial Sequence
  Synthetic oligonucleotide
tgagtacgcctgtatccgtactgaacctttcctct

SEQ ID NO: 128929 - DNA, 35 bp, Artificial Sequence
  Synthetic oligonucleotide
atgaagggagaagggtaagtggggcgtagtcgggt

SEQ ID NO: 128930 - DNA, 35 bp, Artificial Sequence
  Synthetic oligonucleotide
tacgacgctaagggggggcgtaagggaggggacaa

SEQ ID NO: 128931 - DNA, 37 bp, Artificial Sequence
  Synthetic oligonucleotide
tgtgccctccgattgcatttgatcccacctgtataga

SEQ ID NO: 128932 - DNA, 35 bp, Artificial Sequence
  Synthetic oligonucleotide
gagggaacggtggggtggtggtacttgcaggtaga

SEQ ID NO: 128933 - DNA, 35 bp, Artificial Sequence
  Synthetic oligonucleotide
tccctacgtcactcaacttggcccccgttttccga

SEQ ID NO: 128934 - DNA, 37 bp, Artificial Sequence
  Synthetic oligonucleotide
gtggagaggacgggcacacgggggcattcgggaggga

SEQ ID NO: 128935 - DNA, 37 bp, Artificial Sequence
  Synthetic oligonucleotide
tcctcggtccatatttccgcccagtactacaccttga

SEQ ID NO: 128936 - DNA, 35 bp, Artificial Sequence
  Synthetic oligonucleotide
acacctcccccgcctttgattggacgtcatcgaac

SEQ ID NO: 128937 - DNA, 35 bp, Artificial Sequence
  Synthetic oligonucleotide
accatcgcattgacaatatcagcacctattaccac

SEQ ID NO: 128938 - DNA, 35 bp, Artificial Sequence
  Synthetic oligonucleotide
atgcgcctccaaccgtgagtcattccccctgcgac

SEQ ID NO: 128939 - DNA, 35 bp, Artificial Sequence
  Synthetic oligonucleotide
accaatcgccgccccggtcatatcgctcctcgccc

SEQ ID NO: 128940 - DNA, 35 bp, Artificial Sequence
  Synthetic oligonucleotide
tacacccagcgctcccagtcccgtcacgacctccc

SEQ ID NO: 128941 - DNA, 35 bp, Artificial Sequence
  Synthetic oligonucleotide
atggtctgccttccgctttacgttatatctgtcct

SEQ ID NO: 128942 - DNA, 36 bp, Artificial Sequence
  Synthetic oligonucleotide
accgcccaatcccctgcctgcttgtcgttgaactca

SEQ ID NO: 128943 - DNA, 36 bp, Artificial Sequence
  Synthetic oligonucleotide
tgaaccatcgctccactgattctgctcctactttca

SEQ ID NO: 128944 - DNA, 37 bp, Artificial Sequence
  Synthetic oligonucleotide
acaatatccgcctgcttgaaaccgagcccccctccga

SEQ ID NO: 128945 - DNA, 37 bp, Artificial Sequence
  Synthetic oligonucleotide
gtgccggcggaggagggaggagcggatggggatgtga

SEQ ID NO: 128946 - DNA, 37 bp, Artificial Sequence
  Synthetic oligonucleotide
gttccgccacccccacattgctacttcagtttcttga

SEQ ID NO: 128947 - DNA, 35 bp, Artificial Sequence
  Synthetic oligonucleotide
tcagctgccagccgctgaccccacctacctacgta

SEQ ID NO: 128948 - DNA, 35 bp, Artificial Sequence
  Synthetic oligonucleotide
tatgccgcaccatctcctttaacgggcccgcctac

SEQ ID NO: 128949 - DNA, 34 bp, Artificial Sequence
  Synthetic oligonucleotide
actcagccccgccatatttccctgtgcattcgcc

SEQ ID NO: 128950 - DNA, 35 bp, Artificial Sequence
  Synthetic oligonucleotide
tagcctgccgaagctccggcctccagacccttgcc

SEQ ID NO: 128951 - DNA, 35 bp, Artificial Sequence
  Synthetic oligonucleotide
acccctcgttccgtggcgtcatagttacgccctcc

SEQ ID NO: 128952 - DNA, 35 bp, Artificial Sequence
  Synthetic oligonucleotide
ttggtagacgtcgccatgcactgacccctcgttcc

SEQ ID NO: 128953 - DNA, 35 bp, Artificial Sequence
  Synthetic oligonucleotide
tatcaaacgccctgttctcgtatccatctttagcg

SEQ ID NO: 128954 - DNA, 35 bp, Artificial Sequence
  Synthetic oligonucleotide
gtcgtcccgcggtcataatatgctcccaccccctg

SEQ ID NO: 128955 - DNA, 35 bp, Artificial Sequence
  Synthetic oligonucleotide
gcatcgcaccgctccgttacggactctaccccttg

SEQ ID NO: 128956 - DNA, 36 bp, Artificial Sequence
  Synthetic oligonucleotide
ggtggagcgggaatagtcgggagggcacggggtcaa

SEQ ID NO: 128957 - DNA, 37 bp, Artificial Sequence
  Synthetic oligonucleotide
atcaagggagtgggggaggtaataaggggtagggaga

SEQ ID NO: 128958 - DNA, 37 bp, Artificial Sequence
  Synthetic oligonucleotide
tacgggtgggagaggcggggggctagacggataacga

SEQ ID NO: 128959 - DNA, 37 bp, Artificial Sequence
  Synthetic oligonucleotide
aataccgccggcggcgggggggttatggaaggaagga

SEQ ID NO: 128960 - DNA, 38 bp, Artificial Sequence
  Synthetic oligonucleotide
tactgaccaccgcaatgtatctcccgcctgtccgctga

SEQ ID NO: 128961 - DNA, 38 bp, Artificial Sequence
  Synthetic oligonucleotide
tcacgccgcacctgcatcatgtactgccggccccttga

SEQ ID NO: 128962 - DNA, 38 bp, Artificial Sequence
  Synthetic oligonucleotide
ggacaccccctgactccgtgctcaaaccgctatcttga

SEQ ID NO: 128963 - DNA, 36 bp, Artificial Sequence
  Synthetic oligonucleotide
tcccccccgtgacctgggccatttcatcctgcctta

SEQ ID NO: 128964 - DNA, 35 bp, Artificial Sequence
  Synthetic oligonucleotide
gagctgaccacctttcttatcgcgcttggttcacc

SEQ ID NO: 128965 - DNA, 35 bp, Artificial Sequence
  Synthetic oligonucleotide
gccaggtccctattaccatataatgccgcacctcc

SEQ ID NO: 128966 - DNA, 35 bp, Artificial Sequence
  Synthetic oligonucleotide
gtgcaaaccgtatgcttcgacggcctctactcatc

SEQ ID NO: 128967 - DNA, 33 bp, Artificial Sequence
  Synthetic oligonucleotide
ttatgtccgccgccactcccgcttcgcacaacg

SEQ ID NO: 128968 - DNA, 35 bp, Artificial Sequence
  Synthetic oligonucleotide
gccccgtccacagctctgccttagggtgccccccg

SEQ ID NO: 128969 - DNA, 35 bp, Artificial Sequence
  Synthetic oligonucleotide
tcaccccccgctctgttcctgttactactgtgccg

SEQ ID NO: 128970 - DNA, 35 bp, Artificial Sequence
  Synthetic oligonucleotide
acgtcgccccttcgcctttcccgcacgaccaccat

SEQ ID NO: 128971 - DNA, 35 bp, Artificial Sequence
  Synthetic oligonucleotide
acctccgtcggtcgtttactccccccatgttccat

SEQ ID NO: 128972 - DNA, 35 bp, Artificial Sequence
  Synthetic oligonucleotide
ggtggtcaccagcccccatacactgccatccgttt

SEQ ID NO: 128973 - DNA, 36 bp, Artificial Sequence
  Synthetic oligonucleotide
gcacctcccggctccttacatgcgatttgctcccaa

SEQ ID NO: 128974 - DNA, 33 bp, Artificial Sequence
  Synthetic oligonucleotide
gccccccccgcgctttgatcatattcacctaca

SEQ ID NO: 128975 - DNA, 37 bp, Artificial Sequence
  Synthetic oligonucleotide
gggaggtgtcgcggggctgaggggcgtgggcggggga

SEQ ID NO: 128976 - DNA, 38 bp, Artificial Sequence
  Synthetic oligonucleotide
acagaggagggaggggtgttttgcaacggagggactga

SEQ ID NO: 128977 - DNA, 37 bp, Artificial Sequence
  Synthetic oligonucleotide
gcccatgggcgtcactgcctgtttcccttcgccttga

SEQ ID NO: 128978 - DNA, 35 bp, Artificial Sequence
  Synthetic oligonucleotide
agcgacatcaatgacgcgacctccttcctcctgac

SEQ ID NO: 128979 - DNA, 35 bp, Artificial Sequence
  Synthetic oligonucleotide
ttcctcacccgccgtgccatggtaacgcccctgcc

SEQ ID NO: 128980 - DNA, 35 bp, Artificial Sequence
  Synthetic oligonucleotide
gtgaaaccccccgggcccctcactgtgaccaacgc

SEQ ID NO: 128981 - DNA, 35 bp, Artificial Sequence
  Synthetic oligonucleotide
atagtgcgccccgctcccggatcaccctctccatc

SEQ ID NO: 128982 - DNA, 35 bp, Artificial Sequence
  Synthetic oligonucleotide
acgcctgttcactcctccgttaagttatccccctg

SEQ ID NO: 128983 - DNA, 35 bp, Artificial Sequence
  Synthetic oligonucleotide
gtgcgccaactcttgttatgcgctgttatcccttg

SEQ ID NO: 128984 - DNA, 35 bp, Artificial Sequence
  Synthetic oligonucleotide
gtctaccctccctgtgtttgctgcttccaccgagt

SEQ ID NO: 128985 - DNA, 35 bp, Artificial Sequence
  Synthetic oligonucleotide
gccacacctgccgcatactctttgtcccatcctgt

SEQ ID NO: 128986 - DNA, 35 bp, Artificial Sequence
  Synthetic oligonucleotide
tgaacgcagacctcaacgcacccgcctttccacca

SEQ ID NO: 128987 - DNA, 36 bp, Artificial Sequence
  Synthetic oligonucleotide
gccttccgccggctttcttcatatcctgcattgcca

SEQ ID NO: 128988 - DNA, 36 bp, Artificial Sequence
  Synthetic oligonucleotide
gatgatgatcccgccgcccatacccttggatgtcca

SEQ ID NO: 128989 - DNA, 37 bp, Artificial Sequence
  Synthetic oligonucleotide
gacacgccgcctccgttgacttttgtgcgtataccga

SEQ ID NO: 128990 - DNA, 37 bp, Artificial Sequence
  Synthetic oligonucleotide
tcagtgcatgatggacttccctacctctcgtttccga

SEQ ID NO: 128991 - DNA, 37 bp, Artificial Sequence
  Synthetic oligonucleotide
gatggagaggaacgggtgaacaaaggccggggcgcga

SEQ ID NO: 128992 - DNA, 37 bp, Artificial Sequence
  Synthetic oligonucleotide
tcccaccctcccacagcttaaacggtcattcccggga

SEQ ID NO: 128993 - DNA, 35 bp, Artificial Sequence
  Synthetic oligonucleotide
tgatacccgcccccgttcttggctcgccgcactta

SEQ ID NO: 128994 - DNA, 35 bp, Artificial Sequence
  Synthetic oligonucleotide
acccgcccccccggttattctctttcacgcgaacc

SEQ ID NO: 128995 - DNA, 35 bp, Artificial Sequence
  Synthetic oligonucleotide
gagtgtgtgcttcgttggttttctcgtcccgcccc

SEQ ID NO: 128996 - DNA, 36 bp, Artificial Sequence
  Synthetic oligonucleotide
ttcgccgtctgaccttctgccgtccccttatttgcc

SEQ ID NO: 128997 - DNA, 35 bp, Artificial Sequence
  Synthetic oligonucleotide
ttccgtcgtccaccacccgcggtcactgcccccgc

SEQ ID NO: 128998 - DNA, 35 bp, Artificial Sequence
  Synthetic oligonucleotide
tccacctatgccccatggccgccccagtacctggc

SEQ ID NO: 128999 - DNA, 35 bp, Artificial Sequence
  Synthetic oligonucleotide
gactccggtcacgtccccccgtagtttgccacccg

SEQ ID NO: 129000 - DNA, 35 bp, Artificial Sequence
  Synthetic oligonucleotide
gtaacacctgtccatcaatctcgccacctagttcg

SEQ ID NO: 129001 - DNA, 35 bp, Artificial Sequence
  Synthetic oligonucleotide
gcatagacgggtggatgtgggggtggggtggttcg

SEQ ID NO: 129002 - DNA, 35 bp, Artificial Sequence
  Synthetic oligonucleotide
ggccgattcgaggcgtcaggttttcgatcctcctg

SEQ ID NO: 129003 - DNA, 35 bp, Artificial Sequence
  Synthetic oligonucleotide
tccctgtccctgagccatgcgtccttgtcccccct

SEQ ID NO: 129004 - DNA, 35 bp, Artificial Sequence
  Synthetic oligonucleotide
tacgccccctctcagtcccccattgacatgttcgt
